United States Patent 12,624,385 (RIBOREGULATORS AND METHODS OF USE THEREOF) - sequence listing, part 2

SEQ ID NO: 15641 - DNA, 103 bp, Artificial Sequence
  Synthetic Polynucleotide
taatacgactcactatagggtaaatctacttaacaattgcactacatagaaacagaggagatctatgatgtgcaattgtaacctggcggcagcgcaaaagatg

SEQ ID NO: 15642 - DNA, 103 bp, Artificial Sequence
  Synthetic Polynucleotide
taatacgactcactatagggctttctaaatctacttaacaattgcactacaacagaggagagtagtgatgttgttaagtaacctggcggcagcgcaaaagatg

SEQ ID NO: 15643 - DNA, 103 bp, Artificial Sequence
  Synthetic Polynucleotide
taatacgactcactatagggtagccctttctaaatctacttaacaattgcaacagaggagagcaattatgaagtagattaacctggcggcagcgcaaaagatg

SEQ ID NO: 15644 - DNA, 103 bp, Artificial Sequence
  Synthetic Polynucleotide
taatacgactcactataggggagttccagggcttctcagtcctcttcaagaacagaggagacttgaaatggactgagaaaacctggcggcagcgcaaaagatg

SEQ ID NO: 15645 - DNA, 103 bp, Artificial Sequence
  Synthetic Polynucleotide
taatacgactcactataggggcctatagccctttctaaatctacttaacaaacagaggagatgttaaatggatttagaaaacctggcggcagcgcaaaagatg

SEQ ID NO: 15646 - DNA, 103 bp, Artificial Sequence
  Synthetic Polynucleotide
taatacgactcactatagggaacaggcctatagccctttctaaatctactaacagaggagaagtagaatgagaaagggcaacctggcggcagcgcaaaagatg

SEQ ID NO: 15647 - DNA, 103 bp, Artificial Sequence
  Synthetic Polynucleotide
taatacgactcactataggggagaaaacaggcctatagccctttctaaataacagaggagaatttagatggggctatagaacctggcggcagcgcaaaagatg

SEQ ID NO: 15648 - DNA, 103 bp, Artificial Sequence
  Synthetic Polynucleotide
taatacgactcactataggggggaagagaaaacaggcctatagccctttcaacagaggagagaaaggatgataggcctgaacctggcggcagcgcaaaagatg

SEQ ID NO: 15649 - DNA, 103 bp, Artificial Sequence
  Synthetic Polynucleotide
taatacgactcactatagggggggggggaagagaaaacaggcctatagccaacagaggagaggctatatgcctgttttcaacctggcggcagcgcaaaagatg

SEQ ID NO: 15650 - DNA, 103 bp, Artificial Sequence
  Synthetic Polynucleotide
taatacgactcactatagggtaaccggggggggaagagaaaacaggcctaaacagaggagataggccatgtttctcttcaacctggcggcagcgcaaaagatg

SEQ ID NO: 15651 - DNA, 103 bp, Artificial Sequence
  Synthetic Polynucleotide
taatacgactcactatagggggagataaccggggggggaagagaaaacagaacagaggagactgtttatgcttccccccaacctggcggcagcgcaaaagatg

SEQ ID NO: 15652 - DNA, 103 bp, Artificial Sequence
  Synthetic Polynucleotide
taatacgactcactatagggctgttggagataaccggggggggaagagaaaacagaggagattctctatgccccccggtaacctggcggcagcgcaaaagatg

SEQ ID NO: 15653 - DNA, 103 bp, Artificial Sequence
  Synthetic Polynucleotide
taatacgactcactatagggtggatctgttggagataaccggggggggaaaacagaggagattccccatgcggttatctaacctggcggcagcgcaaaagatg

SEQ ID NO: 15654 - DNA, 103 bp, Artificial Sequence
  Synthetic Polynucleotide
taatacgactcactatagggggatatggatctgttggagataaccgggggaacagaggagacccccgatgatctccaacaacctggcggcagcgcaaaagatg

SEQ ID NO: 15655 - DNA, 103 bp, Artificial Sequence
  Synthetic Polynucleotide
taatacgactcactatagggcagccgagttccagggcttctcagtcctctaacagaggagaagaggaatgagaagccctaacctggcggcagcgcaaaagatg

SEQ ID NO: 15656 - DNA, 103 bp, Artificial Sequence
  Synthetic Polynucleotide
taatacgactcactatagggcttgtggatatggatctgttggagataaccaacagaggagaggttatatgcaacagatcaacctggcggcagcgcaaaagatg

SEQ ID NO: 15657 - DNA, 103 bp, Artificial Sequence
  Synthetic Polynucleotide
taatacgactcactatagggcggtccttgtggatatggatctgttggagaaacagaggagatctccaatggatccatataacctggcggcagcgcaaaagatg

SEQ ID NO: 15658 - DNA, 103 bp, Artificial Sequence
  Synthetic Polynucleotide
taatacgactcactataggggtccccggtccttgtggatatggatctgttaacagaggagaaacagaatgatatccacaaacctggcggcagcgcaaaagatg

SEQ ID NO: 15659 - DNA, 103 bp, Artificial Sequence
  Synthetic Polynucleotide
taatacgactcactatagggtggctgtccccggtccttgtggatatggataacagaggagaatccatatgcacaaggacaacctggcggcagcgcaaaagatg

SEQ ID NO: 15660 - DNA, 103 bp, Artificial Sequence
  Synthetic Polynucleotide
taatacgactcactatagggttggctggctgtccccggtccttgtggataaacagaggagatatccaatgggaccggggaacctggcggcagcgcaaaagatg

SEQ ID NO: 15661 - DNA, 103 bp, Artificial Sequence
  Synthetic Polynucleotide
taatacgactcactatagggcttcgttggctggctgtccccggtccttgtaacagaggagaacaaggatgggggacagcaacctggcggcagcgcaaaagatg

SEQ ID NO: 15662 - DNA, 103 bp, Artificial Sequence
  Synthetic Polynucleotide
taatacgactcactatagggtgttccttcgttggctggctgtccccggtcaacagaggagagaccggatgcagccagccaacctggcggcagcgcaaaagatg

SEQ ID NO: 15663 - DNA, 103 bp, Artificial Sequence
  Synthetic Polynucleotide
taatacgactcactatagggtcttctgttccttcgttggctggctgtcccaacagaggagagggacaatgagccaacgaaacctggcggcagcgcaaaagatg

SEQ ID NO: 15664 - DNA, 103 bp, Artificial Sequence
  Synthetic Polynucleotide
taatacgactcactatagggcgtcttcttctgttccttcgttggctggctaacagaggagaagccagatgacgaaggaaaacctggcggcagcgcaaaagatg

SEQ ID NO: 15665 - DNA, 103 bp, Artificial Sequence
  Synthetic Polynucleotide
taatacgactcactatagggtccgacgtcttcttctgttccttcgttggcaacagaggagagccaacatgggaacagaaaacctggcggcagcgcaaaagatg

SEQ ID NO: 15666 - DNA, 103 bp, Artificial Sequence
  Synthetic Polynucleotide
taatacgactcactatagggtcactcagccgagttccagggcttctcagtaacagaggagaactgagatgccctggaacaacctggcggcagcgcaaaagatg

SEQ ID NO: 15667 - DNA, 103 bp, Artificial Sequence
  Synthetic Polynucleotide
taatacgactcactatagggtcgcctccgacgtcttcttctgttccttcgaacagaggagacgaaggatgagaagaagaaacctggcggcagcgcaaaagatg

SEQ ID NO: 15668 - DNA, 103 bp, Artificial Sequence
  Synthetic Polynucleotide
taatacgactcactatagggcactgtcgcctccgacgtcttcttctgttcaacagaggagagaacagatgaagacgtcgaacctggcggcagcgcaaaagatg

SEQ ID NO: 15669 - DNA, 103 bp, Artificial Sequence
  Synthetic Polynucleotide
taatacgactcactataggggtaaccactgtcgcctccgacgtcttcttcaacagaggagagaagaaatggtcggaggcaacctggcggcagcgcaaaagatg

SEQ ID NO: 15670 - DNA, 103 bp, Artificial Sequence
  Synthetic Polynucleotide
taatacgactcactatagggaagtcgtaaccactgtcgcctccgacgtctaacagaggagaagacgtatgaggcgacagaacctggcggcagcgcaaaagatg

SEQ ID NO: 15671 - DNA, 103 bp, Artificial Sequence
  Synthetic Polynucleotide
taatacgactcactataggggccacaagtcgtaaccactgtcgcctccgaaacagaggagatcggagatgacagtggttaacctggcggcagcgcaaaagatg

SEQ ID NO: 15672 - DNA, 103 bp, Artificial Sequence
  Synthetic Polynucleotide
taatacgactcactatagggccaaggccacaagtcgtaaccactgtcgccaacagaggagaggcgacatgggttacgacaacctggcggcagcgcaaaagatg

SEQ ID NO: 15673 - DNA, 103 bp, Artificial Sequence
  Synthetic Polynucleotide
taatacgactcactatagggattggccaaggccacaagtcgtaaccactgaacagaggagacagtggatgcgacttgtgaacctggcggcagcgcaaaagatg

SEQ ID NO: 15674 - DNA, 103 bp, Artificial Sequence
  Synthetic Polynucleotide
taatacgactcactatagggagtttattggccaaggccacaagtcgtaacaacagaggagagttacgatgtgtggccttaacctggcggcagcgcaaaagatg

SEQ ID NO: 15675 - DNA, 103 bp, Artificial Sequence
  Synthetic Polynucleotide
taatacgactcactatagggcacatagtttattggccaaggccacaagtcaacagaggagagacttgatgccttggccaaacctggcggcagcgcaaaagatg

SEQ ID NO: 15676 - DNA, 103 bp, Artificial Sequence
  Synthetic Polynucleotide
taatacgactcactatagggaactgcacatagtttattggccaaggccacaacagaggagagtggccatggccaataaaaacctggcggcagcgcaaaagatg

SEQ ID NO: 15677 - DNA, 103 bp, Artificial Sequence
  Synthetic Polynucleotide
taatacgactcactatagggtgccttcactcagccgagttccagggcttcaacagaggagagaagccatggaactcggcaacctggcggcagcgcaaaagatg

SEQ ID NO: 15678 - DNA, 103 bp, Artificial Sequence
  Synthetic Polynucleotide
taatacgactcactatagggtcaggaactgcacatagtttattggccaagaacagaggagacttggcatgtaaactatgaacctggcggcagcgcaaaagatg

SEQ ID NO: 15679 - DNA, 103 bp, Artificial Sequence
  Synthetic Polynucleotide
taatacgactcactataggggtggatcaggaactgcacatagtttattggaacagaggagaccaataatgtatgtgcagaacctggcggcagcgcaaaagatg

SEQ ID NO: 15680 - DNA, 103 bp, Artificial Sequence
  Synthetic Polynucleotide
taatacgactcactatagggagtaggtggatcaggaactgcacatagtttaacagaggagaaaactaatggcagttcctaacctggcggcagcgcaaaagatg

SEQ ID NO: 15681 - DNA, 103 bp, Artificial Sequence
  Synthetic Polynucleotide
taatacgactcactataggggagtcagtaggtggatcaggaactgcacataacagaggagaatgtgcatgtcctgatccaacctggcggcagcgcaaaagatg

SEQ ID NO: 15682 - DNA, 103 bp, Artificial Sequence
  Synthetic Polynucleotide
taatacgactcactataggggaggcgagtcagtaggtggatcaggaactgaacagaggagacagttcatgatccacctaaacctggcggcagcgcaaaagatg

SEQ ID NO: 15683 - DNA, 103 bp, Artificial Sequence
  Synthetic Polynucleotide
taatacgactcactatagggatcaagaggcgagtcagtaggtggatcaggaacagaggagacctgatatgcctactgacaacctggcggcagcgcaaaagatg

SEQ ID NO: 15684 - DNA, 103 bp, Artificial Sequence
  Synthetic Polynucleotide
taatacgactcactataggggcccgatcaagaggcgagtcagtaggtggaaacagaggagatccaccatgtgactcgccaacctggcggcagcgcaaaagatg

SEQ ID NO: 15685 - DNA, 103 bp, Artificial Sequence
  Synthetic Polynucleotide
taatacgactcactataggggtatagcccgatcaagaggcgagtcagtagaacagaggagactactgatgcgcctcttgaacctggcggcagcgcaaaagatg

SEQ ID NO: 15686 - DNA, 103 bp, Artificial Sequence
  Synthetic Polynucleotide
taatacgactcactatagggatgttgtatagcccgatcaagaggcgagtcaacagaggagagactcgatgcttgatcggaacctggcggcagcgcaaaagatg

SEQ ID NO: 15687 - DNA, 103 bp, Artificial Sequence
  Synthetic Polynucleotide
taatacgactcactatagggtgcagatgttgtatagcccgatcaagaggcaacagaggagagcctctatgtcgggctataacctggcggcagcgcaaaagatg

SEQ ID NO: 15688 - DNA, 103 bp, Artificial Sequence
  Synthetic Polynucleotide
taatacgactcactatagggtaccttactcctggcccatgagtataattcaacagaggagagaattaatgtcatgggccaacctggcggcagcgcaaaagatg

SEQ ID NO: 15689 - DNA, 103 bp, Artificial Sequence
  Synthetic Polynucleotide
taatacgactcactatagggcttactgccttcactcagccgagttccaggaacagaggagacctggaatgcggctgagtaacctggcggcagcgcaaaagatg

SEQ ID NO: 15690 - DNA, 103 bp, Artificial Sequence
  Synthetic Polynucleotide
taatacgactcactataggggtctctgcagatgttgtatagcccgatcaaaacagaggagattgatcatgctatacaacaacctggcggcagcgcaaaagatg

SEQ ID NO: 15691 - DNA, 103 bp, Artificial Sequence
  Synthetic Polynucleotide
taatacgactcactatagggagtaagtctctgcagatgttgtatagcccgaacagaggagacgggctatgcaacatctgaacctggcggcagcgcaaaagatg

SEQ ID NO: 15692 - DNA, 103 bp, Artificial Sequence
  Synthetic Polynucleotide
taatacgactcactatagggtggatagtaagtctctgcagatgttgtataaacagaggagatatacaatgtctgcagagaacctggcggcagcgcaaaagatg

SEQ ID NO: 15693 - DNA, 103 bp, Artificial Sequence
  Synthetic Polynucleotide
taatacgactcactataggggttcttggatagtaagtctctgcagatgttaacagaggagaaacatcatgagagacttaaacctggcggcagcgcaaaagatg

SEQ ID NO: 15694 - DNA, 103 bp, Artificial Sequence
  Synthetic Polynucleotide
taatacgactcactatagggggggagttcttggatagtaagtctctgcagaacagaggagactgcagatgcttactatcaacctggcggcagcgcaaaagatg

SEQ ID NO: 15695 - DNA, 103 bp, Artificial Sequence
  Synthetic Polynucleotide
taatacgactcactataggggggtcggggagttcttggatagtaagtctcaacagaggagagagactatgtatccaagaaacctggcggcagcgcaaaagatg

SEQ ID NO: 15696 - DNA, 103 bp, Artificial Sequence
  Synthetic Polynucleotide
taatacgactcactatagggtcggcgggtcggggagttcttggatagtaaaacagaggagattactaatgaagaactccaacctggcggcagcgcaaaagatg

SEQ ID NO: 15697 - DNA, 103 bp, Artificial Sequence
  Synthetic Polynucleotide
taatacgactcactatagggatcagtcggcgggtcggggagttcttggataacagaggagaatccaaatgctccccgacaacctggcggcagcgcaaaagatg

SEQ ID NO: 15698 - DNA, 103 bp, Artificial Sequence
  Synthetic Polynucleotide
taatacgactcactataggggggagatcagtcggcgggtcggggagttctaacagaggagaagaactatgcgacccgccaacctggcggcagcgcaaaagatg

SEQ ID NO: 15699 - DNA, 103 bp, Artificial Sequence
  Synthetic Polynucleotide
taatacgactcactatagggactctgggagatcagtcggcgggtcggggaaacagaggagatccccgatgcgccgactgaacctggcggcagcgcaaaagatg

SEQ ID NO: 15700 - DNA, 103 bp, Artificial Sequence
  Synthetic Polynucleotide
taatacgactcactatagggccgcccttactgccttcactcagccgagttaacagaggagaaactcgatggagtgaaggaacctggcggcagcgcaaaagatg

SEQ ID NO: 15701 - DNA, 103 bp, Artificial Sequence
  Synthetic Polynucleotide
taatacgactcactataggggttagactctgggagatcagtcggcgggtcaacagaggagagacccgatgactgatctcaacctggcggcagcgcaaaagatg

SEQ ID NO: 15702 - DNA, 103 bp, Artificial Sequence
  Synthetic Polynucleotide
taatacgactcactatagggttgctgttagactctgggagatcagtcggcaacagaggagagccgacatgtctcccagaaacctggcggcagcgcaaaagatg

SEQ ID NO: 15703 - DNA, 103 bp, Artificial Sequence
  Synthetic Polynucleotide
taatacgactcactatagggcctgattgctgttagactctgggagatcagaacagaggagactgatcatgcagagtctaaacctggcggcagcgcaaaagatg

SEQ ID NO: 15704 - DNA, 103 bp, Artificial Sequence
  Synthetic Polynucleotide
taatacgactcactatagggcagtccctgattgctgttagactctgggagaacagaggagactcccaatgtctaacagcaacctggcggcagcgcaaaagatg

SEQ ID NO: 15705 - DNA, 103 bp, Artificial Sequence
  Synthetic Polynucleotide
taatacgactcactatagggtcagccagtccctgattgctgttagactctaacagaggagaagagtcatgcagcaatcaaacctggcggcagcgcaaaagatg

SEQ ID NO: 15706 - DNA, 103 bp, Artificial Sequence
  Synthetic Polynucleotide
taatacgactcactatagggaagtctcagccagtccctgattgctgttagaacagaggagactaacaatgatcagggacaacctggcggcagcgcaaaagatg

SEQ ID NO: 15707 - DNA, 103 bp, Artificial Sequence
  Synthetic Polynucleotide
taatacgactcactataggggccttaagtctcagccagtccctgattgctaacagaggagaagcaatatgggactggctaacctggcggcagcgcaaaagatg

SEQ ID NO: 15708 - DNA, 103 bp, Artificial Sequence
  Synthetic Polynucleotide
taatacgactcactataggggggccgccttaagtctcagccagtccctgaaacagaggagatcagggatgggctgagacaacctggcggcagcgcaaaagatg

SEQ ID NO: 15709 - DNA, 103 bp, Artificial Sequence
  Synthetic Polynucleotide
taatacgactcactatagggcagttgggccgccttaagtctcagccagtcaacagaggagagactggatgagacttaagaacctggcggcagcgcaaaagatg

SEQ ID NO: 15710 - DNA, 103 bp, Artificial Sequence
  Synthetic Polynucleotide
taatacgactcactatagggtattgcagttgggccgccttaagtctcagcaacagaggagagctgagatgtaaggcggcaacctggcggcagcgcaaaagatg

SEQ ID NO: 15711 - DNA, 103 bp, Artificial Sequence
  Synthetic Polynucleotide
taatacgactcactatagggtcctgccgcccttactgccttcactcagccaacagaggagaggctgaatgaaggcagtaaacctggcggcagcgcaaaagatg

SEQ ID NO: 15712 - DNA, 103 bp, Artificial Sequence
  Synthetic Polynucleotide
taatacgactcactatagggacccatattgcagttgggccgccttaagtcaacagaggagagacttaatgcggcccaacaacctggcggcagcgcaaaagatg

SEQ ID NO: 15713 - DNA, 103 bp, Artificial Sequence
  Synthetic Polynucleotide
taatacgactcactatagggctcgcacccatattgcagttgggccgccttaacagaggagaaaggcgatgcaactgcaaaacctggcggcagcgcaaaagatg

SEQ ID NO: 15714 - DNA, 103 bp, Artificial Sequence
  Synthetic Polynucleotide
taatacgactcactatagggatccactcgcacccatattgcagttgggccaacagaggagaggcccaatggcaatatggaacctggcggcagcgcaaaagatg

SEQ ID NO: 15715 - DNA, 103 bp, Artificial Sequence
  Synthetic Polynucleotide
taatacgactcactatagggcttggatccactcgcacccatattgcagttaacagaggagaaactgcatgatgggtgcgaacctggcggcagcgcaaaagatg

SEQ ID NO: 15716 - DNA, 103 bp, Artificial Sequence
  Synthetic Polynucleotide
taatacgactcactatagggagcttcttggatccactcgcacccatattgaacagaggagacaatatatgtgcgagtggaacctggcggcagcgcaaaagatg

SEQ ID NO: 15717 - DNA, 103 bp, Artificial Sequence
  Synthetic Polynucleotide
taatacgactcactatagggtggaaagcttcttggatccactcgcacccaaacagaggagatgggtgatggtggatccaaacctggcggcagcgcaaaagatg

SEQ ID NO: 15718 - DNA, 103 bp, Artificial Sequence
  Synthetic Polynucleotide
taatacgactcactatagggatgcttggaaagcttcttggatccactcgcaacagaggagagcgagtatgtccaagaagaacctggcggcagcgcaaaagatg

SEQ ID NO: 15719 - DNA, 103 bp, Artificial Sequence
  Synthetic Polynucleotide
taatacgactcactatagggcgcgaatgcttggaaagcttcttggatccaaacagaggagatggatcatggaagctttcaacctggcggcagcgcaaaagatg

SEQ ID NO: 15720 - DNA, 103 bp, Artificial Sequence
  Synthetic Polynucleotide
taatacgactcactataggggtcctcgcgaatgcttggaaagcttcttggaacagaggagaccaagaatgtttccaagcaacctggcggcagcgcaaaagatg

SEQ ID NO: 15721 - DNA, 103 bp, Artificial Sequence
  Synthetic Polynucleotide
taatacgactcactatagggtcgtagtcctcgcgaatgcttggaaagcttaacagaggagaaagcttatgaagcattcgaacctggcggcagcgcaaaagatg

SEQ ID NO: 15722 - DNA, 103 bp, Artificial Sequence
  Synthetic Polynucleotide
taatacgactcactatagggtttgttcctgccgcccttactgccttcactaacagaggagaagtgaaatgagtaagggcaacctggcggcagcgcaaaagatg

SEQ ID NO: 15723 - DNA, 103 bp, Artificial Sequence
  Synthetic Polynucleotide
taatacgactcactatagggctctctcgtagtcctcgcgaatgcttggaaaacagaggagattccaaatgttcgcgaggaacctggcggcagcgcaaaagatg

SEQ ID NO: 15724 - DNA, 103 bp, Artificial Sequence
  Synthetic Polynucleotide
taatacgactcactatagggagagtctctctcgtagtcctcgcgaatgctaacagaggagaagcattatggaggactacaacctggcggcagcgcaaaagatg

SEQ ID NO: 15725 - DNA, 103 bp, Artificial Sequence
  Synthetic Polynucleotide
taatacgactcactatagggccgcaagagtctctctcgtagtcctcgcgaaacagaggagatcgcgaatgctacgagagaacctggcggcagcgcaaaagatg

SEQ ID NO: 15726 - DNA, 103 bp, Artificial Sequence
  Synthetic Polynucleotide
taatacgactcactatagggcgcgcccgcaagagtctctctcgtagtcctaacagaggagaaggactatgagagagactaacctggcggcagcgcaaaagatg

SEQ ID NO: 15727 - DNA, 103 bp, Artificial Sequence
  Synthetic Polynucleotide
taatacgactcactatagggccccacgcgcccgcaagagtctctctcgtaaacagaggagatacgagatggactcttgcaacctggcggcagcgcaaaagatg

SEQ ID NO: 15728 - DNA, 103 bp, Artificial Sequence
  Synthetic Polynucleotide
taatacgactcactatagggaccatccccacgcgcccgcaagagtctctcaacagaggagagagagaatgttgcgggcgaacctggcggcagcgcaaaagatg

SEQ ID NO: 15729 - DNA, 103 bp, Artificial Sequence
  Synthetic Polynucleotide
taatacgactcactatagggccataaccatccccacgcgcccgcaagagtaacagaggagaactcttatgggcgcgtggaacctggcggcagcgcaaaagatg

SEQ ID NO: 15730 - DNA, 103 bp, Artificial Sequence
  Synthetic Polynucleotide
taatacgactcactataggggcttcccataaccatccccacgcgcccgcaaacagaggagatgcgggatggtggggatgaacctggcggcagcgcaaaagatg

SEQ ID NO: 15731 - DNA, 103 bp, Artificial Sequence
  Synthetic Polynucleotide
taatacgactcactataggggcgctgcttcccataaccatccccacgcgcaacagaggagagcgcgtatggatggttataacctggcggcagcgcaaaagatg

SEQ ID NO: 15732 - DNA, 103 bp, Artificial Sequence
  Synthetic Polynucleotide
taatacgactcactataggggcgtcgcgctgcttcccataaccatccccaaacagaggagatggggaatgttatgggaaaacctggcggcagcgcaaaagatg

SEQ ID NO: 15733 - DNA, 103 bp, Artificial Sequence
  Synthetic Polynucleotide
taatacgactcactatagggcgtggtttgttcctgccgcccttactgcctaacagaggagaaggcagatggggcggcagaacctggcggcagcgcaaaagatg

SEQ ID NO: 15734 - DNA, 103 bp, Artificial Sequence
  Synthetic Polynucleotide
taatacgactcactatagggccgatgcgtcgcgctgcttcccataaccataacagaggagaatggttatgggaagcagcaacctggcggcagcgcaaaagatg

SEQ ID NO: 15735 - DNA, 103 bp, Artificial Sequence
  Synthetic Polynucleotide
taatacgactcactatagggccctcccgatgcgtcgcgctgcttcccataaacagaggagatatgggatgcagcgcgacaacctggcggcagcgcaaaagatg

SEQ ID NO: 15736 - DNA, 103 bp, Artificial Sequence
  Synthetic Polynucleotide
taatacgactcactatagggtattcccctcccgatgcgtcgcgctgcttcaacagaggagagaagcaatgcgacgcatcaacctggcggcagcgcaaaagatg

SEQ ID NO: 15737 - DNA, 103 bp, Artificial Sequence
  Synthetic Polynucleotide
taatacgactcactataggggcgagtattcccctcccgatgcgtcgcgctaacagaggagaagcgcgatgcatcgggagaacctggcggcagcgcaaaagatg

SEQ ID NO: 15738 - DNA, 103 bp, Artificial Sequence
  Synthetic Polynucleotide
taatacgactcactataggggaactgcgagtattcccctcccgatgcgtcaacagaggagagacgcaatgggaggggaaaacctggcggcagcgcaaaagatg

SEQ ID NO: 15739 - DNA, 103 bp, Artificial Sequence
  Synthetic Polynucleotide
taatacgactcactatagggtcttggaactgcgagtattcccctcccgataacagaggagaatcgggatgggaatactcaacctggcggcagcgcaaaagatg

SEQ ID NO: 15740 - DNA, 103 bp, Artificial Sequence
  Synthetic Polynucleotide
taatacgactcactatagggattcttcttggaactgcgagtattcccctcaacagaggagagaggggatgactcgcagtaacctggcggcagcgcaaaagatg

SEQ ID NO: 15741 - DNA, 103 bp, Artificial Sequence
  Synthetic Polynucleotide
taatacgactcactataggggcctgattcttcttggaactgcgagtattcaacagaggagagaatacatgcagttccaaaacctggcggcagcgcaaaagatg

SEQ ID NO: 15742 - DNA, 103 bp, Artificial Sequence
  Synthetic Polynucleotide
taatacgactcactatagggtccctgcctgattcttcttggaactgcgagaacagaggagactcgcaatgccaagaagaaacctggcggcagcgcaaaagatg

SEQ ID NO: 15743 - DNA, 103 bp, Artificial Sequence
  Synthetic Polynucleotide
taatacgactcactatagggtctgctccctgcctgattcttcttggaactaacagaggagaagttccatgaagaatcagaacctggcggcagcgcaaaagatg

SEQ ID NO: 15744 - DNA, 103 bp, Artificial Sequence
  Synthetic Polynucleotide
taatacgactcactatagggtccgtcgtggtttgttcctgccgcccttacaacagaggagagtaaggatggcaggaacaaacctggcggcagcgcaaaagatg

SEQ ID NO: 15745 - DNA, 103 bp, Artificial Sequence
  Synthetic Polynucleotide
taatacgactcactatagggcgagttctgctccctgcctgattcttcttgaacagaggagacaagaaatgtcaggcaggaacctggcggcagcgcaaaagatg

SEQ ID NO: 15746 - DNA, 103 bp, Artificial Sequence
  Synthetic Polynucleotide
taatacgactcactataggggagggcgagttctgctccctgcctgattctaacagaggagaagaatcatgcagggagcaaacctggcggcagcgcaaaagatg

SEQ ID NO: 15747 - DNA, 103 bp, Artificial Sequence
  Synthetic Polynucleotide
taatacgactcactatagggcacaggagggcgagttctgctccctgcctgaacagaggagacaggcaatgagcagaactaacctggcggcagcgcaaaagatg

SEQ ID NO: 15748 - DNA, 103 bp, Artificial Sequence
  Synthetic Polynucleotide
taatacgactcactatagggtccctcacaggagggcgagttctgctccctaacagaggagaagggagatgaactcgcccaacctggcggcagcgcaaaagatg

SEQ ID NO: 15749 - DNA, 103 bp, Artificial Sequence
  Synthetic Polynucleotide
taatacgactcactatagggtgctgtccctcacaggagggcgagttctgcaacagaggagagcagaaatggccctcctgaacctggcggcagcgcaaaagatg

SEQ ID NO: 15750 - DNA, 103 bp, Artificial Sequence
  Synthetic Polynucleotide
taatacgactcactataggggatactgctgtccctcacaggagggcgagtaacagaggagaactcgcatgcctgtgaggaacctggcggcagcgcaaaagatg

SEQ ID NO: 15751 - DNA, 103 bp, Artificial Sequence
  Synthetic Polynucleotide
taatacgactcactatagggctgctgatactgctgtccctcacaggagggaacagaggagaccctccatggagggacagaacctggcggcagcgcaaaagatg

SEQ ID NO: 15752 - DNA, 103 bp, Artificial Sequence
  Synthetic Polynucleotide
taatacgactcactatagggtctccctgctgatactgctgtccctcacagaacagaggagactgtgaatgacagcagtaaacctggcggcagcgcaaaagatg

SEQ ID NO: 15753 - DNA, 103 bp, Artificial Sequence
  Synthetic Polynucleotide
taatacgactcactatagggtgtactctccctgctgatactgctgtccctaacagaggagaagggacatgagtatcagcaacctggcggcagcgcaaaagatg

SEQ ID NO: 15754 - DNA, 103 bp, Artificial Sequence
  Synthetic Polynucleotide
taatacgactcactataggggttcatgtactctccctgctgatactgctgaacagaggagacagcagatgcagcagggaaacctggcggcagcgcaaaagatg

SEQ ID NO: 15755 - DNA, 103 bp, Artificial Sequence
  Synthetic Polynucleotide
taatacgactcactatagggagcactccgtcgtggtttgttcctgccgccaacagaggagaggcggcatgaacaaaccaaacctggcggcagcgcaaaagatg

SEQ ID NO: 15756 - DNA, 103 bp, Artificial Sequence
  Synthetic Polynucleotide
taatacgactcactataggggggctgttcatgtactctccctgctgatacaacagaggagagtatcaatggggagagtaaacctggcggcagcgcaaaagatg

SEQ ID NO: 15757 - DNA, 103 bp, Artificial Sequence
  Synthetic Polynucleotide
taatacgactcactatagggtccatgggctgttcatgtactctccctgctaacagaggagaagcaggatgagtacatgaaacctggcggcagcgcaaaagatg

SEQ ID NO: 15758 - DNA, 103 bp, Artificial Sequence
  Synthetic Polynucleotide
taatacgactcactataggggtttctccatgggctgttcatgtactctccaacagaggagaggagagatgatgaacagcaacctggcggcagcgcaaaagatg

SEQ ID NO: 15759 - DNA, 103 bp, Artificial Sequence
  Synthetic Polynucleotide
taatacgactcactataggggctgggtttctccatgggctgttcatgtacaacagaggagagtacatatgcagcccatgaacctggcggcagcgcaaaagatg

SEQ ID NO: 15760 - DNA, 103 bp, Artificial Sequence
  Synthetic Polynucleotide
taatacgactcactatagggctgttgctgggtttctccatgggctgttcaaacagaggagatgaacaatgcatggagaaaacctggcggcagcgcaaaagatg

SEQ ID NO: 15761 - DNA, 103 bp, Artificial Sequence
  Synthetic Polynucleotide
taatacgactcactatagggtctttctgttgctgggtttctccatgggctaacagaggagaagcccaatgagaaacccaaacctggcggcagcgcaaaagatg

SEQ ID NO: 15762 - DNA, 103 bp, Artificial Sequence
  Synthetic Polynucleotide
taatacgactcactatagggttctgtctttctgttgctgggtttctccataacagaggagaatggagatgcccagcaacaacctggcggcagcgcaaaagatg

SEQ ID NO: 15763 - DNA, 103 bp, Artificial Sequence
  Synthetic Polynucleotide
taatacgactcactatagggaatctttctgtctttctgttgctgggtttcaacagaggagagaaaccatgcaacagaaaaacctggcggcagcgcaaaagatg

SEQ ID NO: 15764 - DNA, 103 bp, Artificial Sequence
  Synthetic Polynucleotide
taatacgactcactatagggatacaaatctttctgtctttctgttgctggaacagaggagaccagcaatggaaagacagaacctggcggcagcgcaaaagatg

SEQ ID NO: 15765 - DNA, 103 bp, Artificial Sequence
  Synthetic Polynucleotide
taatacgactcactatagggtgcctatacaaatctttctgtctttctgttaacagaggagaaacagaatgacagaaagaaacctggcggcagcgcaaaagatg

SEQ ID NO: 15766 - DNA, 103 bp, Artificial Sequence
  Synthetic Polynucleotide
taatacgactcactatagggctaggagcactccgtcgtggtttgttcctgaacagaggagacaggaaatgaccacgacgaacctggcggcagcgcaaaagatg

SEQ ID NO: 15767 - DNA, 103 bp, Artificial Sequence
  Synthetic Polynucleotide
taatacgactcactatagggtttgctgcctatacaaatctttctgtctttaacagaggagaaaagacatgaagatttgtaacctggcggcagcgcaaaagatg

SEQ ID NO: 15768 - DNA, 103 bp, Artificial Sequence
  Synthetic Polynucleotide
taatacgactcactatagggcatattttgctgcctatacaaatctttctgaacagaggagacagaaaatgttgtataggaacctggcggcagcgcaaaagatg

SEQ ID NO: 15769 - DNA, 103 bp, Artificial Sequence
  Synthetic Polynucleotide
taatacgactcactatagggtcatccatattttgctgcctatacaaatctaacagaggagaagatttatgtaggcagcaaacctggcggcagcgcaaaagatg

SEQ ID NO: 15770 - DNA, 103 bp, Artificial Sequence
  Synthetic Polynucleotide
taatacgactcactatagggctacatcatccatattttgctgcctatacaaacagaggagatgtataatgagcaaaataaacctggcggcagcgcaaaagatg

SEQ ID NO: 15771 - DNA, 103 bp, Artificial Sequence
  Synthetic Polynucleotide
taatacgactcactatagggagaatctacatcatccatattttgctgcctaacagaggagaaggcagatgaatatggataacctggcggcagcgcaaaagatg

SEQ ID NO: 15772 - DNA, 103 bp, Artificial Sequence
  Synthetic Polynucleotide
taatacgactcactatagggtcatcagaatctacatcatccatattttgcaacagaggagagcaaaaatgggatgatgtaacctggcggcagcgcaaaagatg

SEQ ID NO: 15773 - DNA, 103 bp, Artificial Sequence
  Synthetic Polynucleotide
taatacgactcactatagggcatcatcatcagaatctacatcatccatataacagaggagaatatggatgatgtagattaacctggcggcagcgcaaaagatg

SEQ ID NO: 15774 - DNA, 103 bp, Artificial Sequence
  Synthetic Polynucleotide
taatacgactcactatagggtaggtcatcatcatcagaatctacatcatcaacagaggagagatgatatggattctgataacctggcggcagcgcaaaagatg

SEQ ID NO: 15775 - DNA, 103 bp, Artificial Sequence
  Synthetic Polynucleotide
taatacgactcactatagggcctattaggtcatcatcatcagaatctacaaacagaggagatgtagaatgtgatgatgaaacctggcggcagcgcaaaagatg

SEQ ID NO: 15776 - DNA, 103 bp, Artificial Sequence
  Synthetic Polynucleotide
taatacgactcactataggggaactcctattaggtcatcatcatcagaataacagaggagaattctgatgatgatgaccaacctggcggcagcgcaaaagatg

SEQ ID NO: 15777 - DNA, 103 bp, Artificial Sequence
  Synthetic Polynucleotide
taatacgactcactatagggcctttctaggagcactccgtcgtggtttgtaacagaggagaacaaacatggacggagtgaacctggcggcagcgcaaaagatg

SEQ ID NO: 15778 - DNA, 103 bp, Artificial Sequence
  Synthetic Polynucleotide
taatacgactcactatagggaacaggaactcctattaggtcatcatcatcaacagaggagagatgatatggacctaataaacctggcggcagcgcaaaagatg

SEQ ID NO: 15779 - DNA, 103 bp, Artificial Sequence
  Synthetic Polynucleotide
taatacgactcactatagggggtgtaacaggaactcctattaggtcatcaaacagaggagatgatgaatgaataggagtaacctggcggcagcgcaaaagatg

SEQ ID NO: 15780 - DNA, 103 bp, Artificial Sequence
  Synthetic Polynucleotide
taatacgactcactatagggctcttggtgtaacaggaactcctattaggtaacagaggagaacctaaatggagttcctgaacctggcggcagcgcaaaagatg

SEQ ID NO: 15781 - DNA, 103 bp, Artificial Sequence
  Synthetic Polynucleotide
taatacgactcactatagggtggtactcttggtgtaacaggaactcctataacagaggagaataggaatgcctgttacaaacctggcggcagcgcaaaagatg

SEQ ID NO: 15782 - DNA, 103 bp, Artificial Sequence
  Synthetic Polynucleotide
taatacgactcactatagggctccgtggtactcttggtgtaacaggaactaacagaggagaagttccatgtacaccaagaacctggcggcagcgcaaaagatg

SEQ ID NO: 15783 - DNA, 103 bp, Artificial Sequence
  Synthetic Polynucleotide
taatacgactcactatagggtttctctccgtggtactcttggtgtaacagaacagaggagactgttaatgcaagagtacaacctggcggcagcgcaaaagatg

SEQ ID NO: 15784 - DNA, 103 bp, Artificial Sequence
  Synthetic Polynucleotide
taatacgactcactatagggggtcatttctctccgtggtactcttggtgtaacagaggagaacaccaatggtaccacggaacctggcggcagcgcaaaagatg

SEQ ID NO: 15785 - DNA, 103 bp, Artificial Sequence
  Synthetic Polynucleotide
taatacgactcactatagggttataggtcatttctctccgtggtactcttaacagaggagaaagagtatgacggagagaaacctggcggcagcgcaaaagatg

SEQ ID NO: 15786 - DNA, 103 bp, Artificial Sequence
  Synthetic Polynucleotide
taatacgactcactatagggccaatttataggtcatttctctccgtggtaaacagaggagataccacatggagaaatgaaacctggcggcagcgcaaaagatg

SEQ ID NO: 15787 - DNA, 103 bp, Artificial Sequence
  Synthetic Polynucleotide
taatacgactcactatagggtattgccaatttataggtcatttctctccgaacagaggagacggagaatgatgacctataacctggcggcagcgcaaaagatg

SEQ ID NO: 15788 - DNA, 103 bp, Artificial Sequence
  Synthetic Polynucleotide
taatacgactcactatagggccgcgcctttctaggagcactccgtcgtggaacagaggagaccacgaatgagtgctcctaacctggcggcagcgcaaaagatg

SEQ ID NO: 15789 - DNA, 103 bp, Artificial Sequence
  Synthetic Polynucleotide
taatacgactcactatagggatatctattgccaatttataggtcatttctaacagaggagaagaaatatgctataaattaacctggcggcagcgcaaaagatg

SEQ ID NO: 15790 - DNA, 103 bp, Artificial Sequence
  Synthetic Polynucleotide
taatacgactcactataggggtgacatatctattgccaatttataggtcaaacagaggagatgacctatgaattggcaaaacctggcggcagcgcaaaagatg

SEQ ID NO: 15791 - DNA, 103 bp, Artificial Sequence
  Synthetic Polynucleotide
taatacgactcactatagggaaaatgtgacatatctattgccaatttataaacagaggagatataaaatggcaatagataacctggcggcagcgcaaaagatg

SEQ ID NO: 15792 - DNA, 103 bp, Artificial Sequence
  Synthetic Polynucleotide
taatacgactcactatagggtttataaaatgtgacatatctattgccaataacagaggagaattggcatgagatatgtcaacctggcggcagcgcaaaagatg

SEQ ID NO: 15793 - DNA, 103 bp, Artificial Sequence
  Synthetic Polynucleotide
taatacgactcactatagggtttcttttataaaatgtgacatatctattgaacagaggagacaatagatgtgtcacattaacctggcggcagcgcaaaagatg

SEQ ID NO: 15794 - DNA, 103 bp, Artificial Sequence
  Synthetic Polynucleotide
taatacgactcactatagggccctttttcttttataaaatgtgacatatcaacagaggagagatatgatgcattttataaacctggcggcagcgcaaaagatg

SEQ ID NO: 15795 - DNA, 103 bp, Artificial Sequence
  Synthetic Polynucleotide
taatacgactcactatagggagtccccctttttcttttataaaatgtgacaacagaggagagtcacaatgtataaaagaaacctggcggcagcgcaaaagatg

SEQ ID NO: 15796 - DNA, 103 bp, Artificial Sequence
  Synthetic Polynucleotide
taatacgactcactatagggcttgcagtccccctttttcttttataaaataacagaggagaattttaatgaagaaaaagaacctggcggcagcgcaaaagatg

SEQ ID NO: 15797 - DNA, 103 bp, Artificial Sequence
  Synthetic Polynucleotide
taatacgactcactatagggcatcccttgcagtccccctttttcttttataacagaggagaataaaaatgaaagggggaaacctggcggcagcgcaaaagatg

SEQ ID NO: 15798 - DNA, 103 bp, Artificial Sequence
  Synthetic Polynucleotide
taatacgactcactatagggtaaaacatcccttgcagtccccctttttctaacagaggagaagaaaaatggggactgcaaacctggcggcagcgcaaaagatg

SEQ ID NO: 15799 - DNA, 103 bp, Artificial Sequence
  Synthetic Polynucleotide
taatacgactcactatagggttgggtaccttactcctggcccatgagtataacagaggagaatactcatgggccaggagaacctggcggcagcgcaaaagatg

SEQ ID NO: 15800 - DNA, 103 bp, Artificial Sequence
  Synthetic Polynucleotide
taatacgactcactatagggtcggcccgcgcctttctaggagcactccgtaacagaggagaacggagatgtcctagaaaaacctggcggcagcgcaaaagatg

SEQ ID NO: 15801 - DNA, 103 bp, Artificial Sequence
  Synthetic Polynucleotide
taatacgactcactatagggtactgtaaaacatcccttgcagtcccccttaacagaggagaaaggggatgtgcaagggaaacctggcggcagcgcaaaagatg

SEQ ID NO: 15802 - DNA, 103 bp, Artificial Sequence
  Synthetic Polynucleotide
taatacgactcactatagggcctcctactgtaaaacatcccttgcagtccaacagaggagaggactgatggggatgtttaacctggcggcagcgcaaaagatg

SEQ ID NO: 15803 - DNA, 103 bp, Artificial Sequence
  Synthetic Polynucleotide
taatacgactcactatagggtgtctcctcctactgtaaaacatcccttgcaacagaggagagcaaggatggttttacagaacctggcggcagcgcaaaagatg

SEQ ID NO: 15804 - DNA, 103 bp, Artificial Sequence
  Synthetic Polynucleotide
taatacgactcactatagggttctatgtctcctcctactgtaaaacatccaacagaggagaggatgtatgacagtaggaaacctggcggcagcgcaaaagatg

SEQ ID NO: 15805 - DNA, 103 bp, Artificial Sequence
  Synthetic Polynucleotide
taatacgactcactatagggtaggattctatgtctcctcctactgtaaaaaacagaggagattttacatgaggaggagaaacctggcggcagcgcaaaagatg

SEQ ID NO: 15806 - DNA, 103 bp, Artificial Sequence
  Synthetic Polynucleotide
taatacgactcactatagggatgtctaggattctatgtctcctcctactgaacagaggagacagtagatggagacatagaacctggcggcagcgcaaaagatg

SEQ ID NO: 15807 - DNA, 103 bp, Artificial Sequence
  Synthetic Polynucleotide
taatacgactcactatagggggtatatgtctaggattctatgtctcctccaacagaggagaggaggaatgatagaatccaacctggcggcagcgcaaaagatg

SEQ ID NO: 15808 - DNA, 103 bp, Artificial Sequence
  Synthetic Polynucleotide
taatacgactcactatagggttctaggtatatgtctaggattctatgtctaacagaggagaagacatatgatcctagacaacctggcggcagcgcaaaagatg

SEQ ID NO: 15809 - DNA, 103 bp, Artificial Sequence
  Synthetic Polynucleotide
taatacgactcactatagggtctttttctaggtatatgtctaggattctaaacagaggagatagaatatgagacatataaacctggcggcagcgcaaaagatg

SEQ ID NO: 15810 - DNA, 103 bp, Artificial Sequence
  Synthetic Polynucleotide
taatacgactcactatagggcttcctctttttctaggtatatgtctaggaaacagaggagatcctagatgtatacctagaacctggcggcagcgcaaaagatg

SEQ ID NO: 15811 - DNA, 103 bp, Artificial Sequence
  Synthetic Polynucleotide
taatacgactcactataggggtacctcggcccgcgcctttctaggagcacaacagaggagagtgctcatggaaaggcgcaacctggcggcagcgcaaaagatg

SEQ ID NO: 15812 - DNA, 103 bp, Artificial Sequence
  Synthetic Polynucleotide
taatacgactcactatagggtatcccttcctctttttctaggtatatgtcaacagaggagagacataatgctagaaaaaaacctggcggcagcgcaaaagatg

SEQ ID NO: 15813 - DNA, 103 bp, Artificial Sequence
  Synthetic Polynucleotide
taatacgactcactatagggggtattatcccttcctctttttctaggtataacagaggagaatacctatgaaaagaggaaacctggcggcagcgcaaaagatg

SEQ ID NO: 15814 - DNA, 103 bp, Artificial Sequence
  Synthetic Polynucleotide
taatacgactcactatagggaatctggtattatcccttcctctttttctaaacagaggagatagaaaatgaggaagggaaacctggcggcagcgcaaaagatg

SEQ ID NO: 15815 - DNA, 103 bp, Artificial Sequence
  Synthetic Polynucleotide
taatacgactcactatagggctgccaatctggtattatcccttcctctttaacagaggagaaaagagatggggataataaacctggcggcagcgcaaaagatg

SEQ ID NO: 15816 - DNA, 103 bp, Artificial Sequence
  Synthetic Polynucleotide
taatacgactcactatagggtaattctgccaatctggtattatcccttccaacagaggagaggaaggatgaataccagaaacctggcggcagcgcaaaagatg

SEQ ID NO: 15817 - DNA, 103 bp, Artificial Sequence
  Synthetic Polynucleotide
taatacgactcactataggggagtataattctgccaatctggtattatccaacagaggagaggataaatgcagattggcaacctggcggcagcgcaaaagatg

SEQ ID NO: 15818 - DNA, 103 bp, Artificial Sequence
  Synthetic Polynucleotide
taatacgactcactatagggcccatgagtataattctgccaatctggtataacagaggagaataccaatgtggcagaataacctggcggcagcgcaaaagatg

SEQ ID NO: 15819 - DNA, 103 bp, Artificial Sequence
  Synthetic Polynucleotide
taatacgactcactatagggcctggcccatgagtataattctgccaatctaacagaggagaagattgatggaattatacaacctggcggcagcgcaaaagatg

SEQ ID NO: 15820 - DNA, 103 bp, Artificial Sequence
  Synthetic Polynucleotide
taatacgactcactatagggttactcctggcccatgagtataattctgccaacagaggagaggcagaatgatactcatgaacctggcggcagcgcaaaagatg

SEQ ID NO: 15821 - DNA, 103 bp, Artificial Sequence
  Synthetic Polynucleotide
taatacgactcactataggggtaccttactcctggcccatgagtataattaacagaggagaaattatatgcatgggccaaacctggcggcagcgcaaaagatg

SEQ ID NO: 15822 - DNA, 103 bp, Artificial Sequence
  Synthetic Polynucleotide
taatacgactcactatagggctttggtacctcggcccgcgcctttctaggaacagaggagacctagaatggcgcgggccaacctggcggcagcgcaaaagatg

SEQ ID NO: 15823 - DNA, 103 bp, Artificial Sequence
  Synthetic Polynucleotide
taatacgactcactatagggattgggtaccttactcctggcccatgagtaaacagaggagatactcaatggccaggagtaacctggcggcagcgcaaaagatg

SEQ ID NO: 15824 - DNA, 103 bp, Artificial Sequence
  Synthetic Polynucleotide
taatacgactcactatagggagtacattgggtaccttactcctggcccataacagaggagaatgggcatggagtaaggtaacctggcggcagcgcaaaagatg

SEQ ID NO: 15825 - DNA, 103 bp, Artificial Sequence
  Synthetic Polynucleotide
taatacgactcactatagggcccgaagtacattgggtaccttactcctggaacagaggagaccaggaatgaggtacccaaacctggcggcagcgcaaaagatg

SEQ ID NO: 15826 - DNA, 103 bp, Artificial Sequence
  Synthetic Polynucleotide
taatacgactcactatagggagccacccgaagtacattgggtaccttactaacagaggagaagtaagatgcccaatgtaaacctggcggcagcgcaaaagatg

SEQ ID NO: 15827 - DNA, 103 bp, Artificial Sequence
  Synthetic Polynucleotide
taatacgactcactatagggtccacagccacccgaagtacattgggtaccaacagaggagaggtaccatgtgtacttcgaacctggcggcagcgcaaaagatg

SEQ ID NO: 15828 - DNA, 103 bp, Artificial Sequence
  Synthetic Polynucleotide
taatacgactcactatagggtagcttccacagccacccgaagtacattggaacagaggagaccaatgatgttcgggtggaacctggcggcagcgcaaaagatg

SEQ ID NO: 15829 - DNA, 103 bp, Artificial Sequence
  Synthetic Polynucleotide
taatacgactcactataggggatactagcttccacagccacccgaagtacaacagaggagagtacttatggtggctgtgaacctggcggcagcgcaaaagatg

SEQ ID NO: 15830 - DNA, 103 bp, Artificial Sequence
  Synthetic Polynucleotide
taatacgactcactatagggctactgatactagcttccacagccacccgaaacagaggagatcgggtatgtgtggaagcaacctggcggcagcgcaaaagatg

SEQ ID NO: 15831 - DNA, 103 bp, Artificial Sequence
  Synthetic Polynucleotide
taatacgactcactataggggagttctactgatactagcttccacagccaaacagaggagatggctgatgaagctagtaaacctggcggcagcgcaaaagatg

SEQ ID NO: 15832 - DNA, 103 bp, Artificial Sequence
  Synthetic Polynucleotide
taatacgactcactatagggtgtgagagttctactgatactagcttccacaacagaggagagtggaaatgagtatcagtaacctggcggcagcgcaaaagatg

SEQ ID NO: 15833 - DNA, 103 bp, Artificial Sequence
  Synthetic Polynucleotide
taatacgactcactataggggccgcctttggtacctcggcccgcgcctttaacagaggagaaaaggcatgggccgaggtaacctggcggcagcgcaaaagatg

SEQ ID NO: 15834 - DNA, 103 bp, Artificial Sequence
  Synthetic Polynucleotide
taatacgactcactatagggcctcttgtgagagttctactgatactagctaacagaggagaagctagatgcagtagaacaacctggcggcagcgcaaaagatg

SEQ ID NO: 15835 - DNA, 103 bp, Artificial Sequence
  Synthetic Polynucleotide
taatacgactcactatagggctctgcctcttgtgagagttctactgatacaacagaggagagtatcaatggaactctcaaacctggcggcagcgcaaaagatg

SEQ ID NO: 15836 - DNA, 103 bp, Artificial Sequence
  Synthetic Polynucleotide
taatacgactcactatagggtcttcctctgcctcttgtgagagttctactaacagaggagaagtagaatgctcacaagaaacctggcggcagcgcaaaagatg

SEQ ID NO: 15837 - DNA, 103 bp, Artificial Sequence
  Synthetic Polynucleotide
taatacgactcactatagggcctcatcttcctctgcctcttgtgagagttaacagaggagaaactctatgaagaggcagaacctggcggcagcgcaaaagatg

SEQ ID NO: 15838 - DNA, 103 bp, Artificial Sequence
  Synthetic Polynucleotide
taatacgactcactataggggttggcctcatcttcctctgcctcttgtgaaacagaggagatcacaaatggcagaggaaaacctggcggcagcgcaaaagatg

SEQ ID NO: 15839 - DNA, 103 bp, Artificial Sequence
  Synthetic Polynucleotide
taatacgactcactatagggaagcagttggcctcatcttcctctgcctctaacagaggagaagaggcatgggaagatgaaacctggcggcagcgcaaaagatg

SEQ ID NO: 15840 - DNA, 103 bp, Artificial Sequence
  Synthetic Polynucleotide
taatacgactcactataggggtactaagcagttggcctcatcttcctctgaacagaggagacagaggatgatgaggccaaacctggcggcagcgcaaaagatg

SEQ ID NO: 15841 - DNA, 103 bp, Artificial Sequence
  Synthetic Polynucleotide
taatacgactcactatagggtgggtgtactaagcagttggcctcatcttcaacagaggagagaagatatggccaactgcaacctggcggcagcgcaaaagatg

SEQ ID NO: 15842 - DNA, 103 bp, Artificial Sequence
  Synthetic Polynucleotide
taatacgactcactatagggtgtgctgggtgtactaagcagttggcctcaaacagaggagatgaggcatgctgcttagtaacctggcggcagcgcaaaagatg

SEQ ID NO: 15843 - DNA, 103 bp, Artificial Sequence
  Synthetic Polynucleotide
taatacgactcactatagggttgtttgtgctgggtgtactaagcagttggaacagaggagaccaactatgtagtacaccaacctggcggcagcgcaaaagatg

SEQ ID NO: 15844 - DNA, 103 bp, Artificial Sequence
  Synthetic Polynucleotide
taatacgactcactatagggcacacgccgcctttggtacctcggcccgcgaacagaggagacgcgggatgaggtaccaaaacctggcggcagcgcaaaagatg

SEQ ID NO: 15845 - DNA, 103 bp, Artificial Sequence
  Synthetic Polynucleotide
taatacgactcactatagggtctgcttgtttgtgctgggtgtactaagcaaacagaggagatgcttaatgcacccagcaaacctggcggcagcgcaaaagatg

SEQ ID NO: 15846 - DNA, 103 bp, Artificial Sequence
  Synthetic Polynucleotide
taatacgactcactatagggtcatgtctgcttgtttgtgctgggtgtactaacagaggagaagtacaatgagcacaaacaacctggcggcagcgcaaaagatg

SEQ ID NO: 15847 - DNA, 103 bp, Artificial Sequence
  Synthetic Polynucleotide
taatacgactcactatagggcatcatcatgtctgcttgtttgtgctgggtaacagaggagaacccagatgaaacaagcaaacctggcggcagcgcaaaagatg

SEQ ID NO: 15848 - DNA, 103 bp, Artificial Sequence
  Synthetic Polynucleotide
taatacgactcactatagggatgctcatcatcatgtctgcttgtttgtgcaacagaggagagcacaaatgagcagacataacctggcggcagcgcaaaagatg

SEQ ID NO: 15849 - DNA, 103 bp, Artificial Sequence
  Synthetic Polynucleotide
taatacgactcactatagggtccccatgctcatcatcatgtctgcttgttaacagaggagaaacaagatgacatgatgaaacctggcggcagcgcaaaagatg

SEQ ID NO: 15850 - DNA, 103 bp, Artificial Sequence
  Synthetic Polynucleotide
taatacgactcactatagggatgtctccccatgctcatcatcatgtctgcaacagaggagagcagacatgatgatgagcaacctggcggcagcgcaaaagatg

SEQ ID NO: 15851 - DNA, 103 bp, Artificial Sequence
  Synthetic Polynucleotide
taatacgactcactatagggcactaatgtctccccatgctcatcatcatgaacagaggagacatgatatggagcatgggaacctggcggcagcgcaaaagatg

SEQ ID NO: 15852 - DNA, 103 bp, Artificial Sequence
  Synthetic Polynucleotide
taatacgactcactatagggtgccacactaatgtctccccatgctcatcaaacagaggagatgatgaatgtggggagacaacctggcggcagcgcaaaagatg

SEQ ID NO: 15853 - DNA, 103 bp, Artificial Sequence
  Synthetic Polynucleotide
taatacgactcactatagggcaaactgccacactaatgtctccccatgctaacagaggagaagcatgatgagacattagaacctggcggcagcgcaaaagatg

SEQ ID NO: 15854 - DNA, 103 bp, Artificial Sequence
  Synthetic Polynucleotide
taatacgactcactatagggggagtcaaactgccacactaatgtctccccaacagaggagaggggagatgttagtgtggaacctggcggcagcgcaaaagatg

SEQ ID NO: 15855 - DNA, 103 bp, Artificial Sequence
  Synthetic Polynucleotide
taatacgactcactatagggcgctccacacgccgcctttggtacctcggcaacagaggagagccgagatgccaaaggcgaacctggcggcagcgcaaaagatg

SEQ ID NO: 15856 - DNA, 103 bp, Artificial Sequence
  Synthetic Polynucleotide
taatacgactcactatagggagcatggagtcaaactgccacactaatgtcaacagaggagagacattatggtggcagttaacctggcggcagcgcaaaagatg

SEQ ID NO: 15857 - DNA, 103 bp, Artificial Sequence
  Synthetic Polynucleotide
taatacgactcactatagggaggccagcatggagtcaaactgccacactaaacagaggagatagtgtatgagtttgactaacctggcggcagcgcaaaagatg

SEQ ID NO: 15858 - DNA, 103 bp, Artificial Sequence
  Synthetic Polynucleotide
taatacgactcactataggggttataggccagcatggagtcaaactgccaaacagaggagatggcagatggactccatgaacctggcggcagcgcaaaagatg

SEQ ID NO: 15859 - DNA, 103 bp, Artificial Sequence
  Synthetic Polynucleotide
taatacgactcactatagggttgtagttataggccagcatggagtcaaacaacagaggagagtttgaatgcatgctggcaacctggcggcagcgcaaaagatg

SEQ ID NO: 15860 - DNA, 103 bp, Artificial Sequence
  Synthetic Polynucleotide
taatacgactcactatagggaggccttgtagttataggccagcatggagtaacagaggagaactccaatgtggcctataaacctggcggcagcgcaaaagatg

SEQ ID NO: 15861 - DNA, 103 bp, Artificial Sequence
  Synthetic Polynucleotide
taatacgactcactatagggagtgaaggccttgtagttataggccagcataacagaggagaatgctgatgtataactacaacctggcggcagcgcaaaagatg

SEQ ID NO: 15862 - DNA, 103 bp, Artificial Sequence
  Synthetic Polynucleotide
taatacgactcactatagggtacagagtgaaggccttgtagttataggccaacagaggagaggcctaatgctacaaggcaacctggcggcagcgcaaaagatg

SEQ ID NO: 15863 - DNA, 103 bp, Artificial Sequence
  Synthetic Polynucleotide
taatacgactcactatagggctgggtacagagtgaaggccttgtagttataacagaggagaataactatgaggccttcaaacctggcggcagcgcaaaagatg

SEQ ID NO: 15864 - DNA, 103 bp, Artificial Sequence
  Synthetic Polynucleotide
taatacgactcactatagggctcttctgggtacagagtgaaggccttgtaaacagaggagatacaagatgttcactctgaacctggcggcagcgcaaaagatg

SEQ ID NO: 15865 - DNA, 103 bp, Artificial Sequence
  Synthetic Polynucleotide
taatacgactcactatagggccaaactcttctgggtacagagtgaaggccaacagaggagaggccttatgtctgtacccaacctggcggcagcgcaaaagatg

SEQ ID NO: 15866 - DNA, 103 bp, Artificial Sequence
  Synthetic Polynucleotide
taatacgactcactatagggactcccgctccacacgccgcctttggtaccaacagaggagaggtaccatgggcggcgtgaacctggcggcagcgcaaaagatg

SEQ ID NO: 15867 - DNA, 103 bp, Artificial Sequence
  Synthetic Polynucleotide
taatacgactcactatagggtgtgcccaaactcttctgggtacagagtgaaacagaggagatcactcatgacccagaagaacctggcggcagcgcaaaagatg

SEQ ID NO: 15868 - DNA, 103 bp, Artificial Sequence
  Synthetic Polynucleotide
taatacgactcactatagggtgacttgtgcccaaactcttctgggtacagaacagaggagactgtacatggaagagtttaacctggcggcagcgcaaaagatg

SEQ ID NO: 15869 - DNA, 103 bp, Artificial Sequence
  Synthetic Polynucleotide
taatacgactcactatagggaatcctgacttgtgcccaaactcttctgggaacagaggagacccagaatggtttgggcaaacctggcggcagcgcaaaagatg

SEQ ID NO: 15870 - DNA, 103 bp, Artificial Sequence
  Synthetic Polynucleotide
taatacgactcactatagggctggcaatcctgacttgtgcccaaactcttaacagaggagaaagagtatgggcacaagtaacctggcggcagcgcaaaagatg

SEQ ID NO: 15871 - DNA, 103 bp, Artificial Sequence
  Synthetic Polynucleotide
taatacgactcactatagggtttctctggcaatcctgacttgtgcccaaaaacagaggagatttgggatgaagtcaggaaacctggcggcagcgcaaaagatg

SEQ ID NO: 15872 - DNA, 103 bp, Artificial Sequence
  Synthetic Polynucleotide
taatacgactcactatagggcattctttctctggcaatcctgacttgtgcaacagaggagagcacaaatgaggattgccaacctggcggcagcgcaaaagatg

SEQ ID NO: 15873 - DNA, 103 bp, Artificial Sequence
  Synthetic Polynucleotide
taatacgactcactatagggccttccattctttctctggcaatcctgactaacagaggagaagtcagatgtgccagagaaacctggcggcagcgcaaaagatg

SEQ ID NO: 15874 - DNA, 103 bp, Artificial Sequence
  Synthetic Polynucleotide
taatacgactcactatagggttttgccttccattctttctctggcaatccaacagaggagaggattgatggagaaagaaaacctggcggcagcgcaaaagatg

SEQ ID NO: 15875 - DNA, 103 bp, Artificial Sequence
  Synthetic Polynucleotide
taatacgactcactatagggttcagttttgccttccattctttctctggcaacagaggagagccagaatgagaatggaaaacctggcggcagcgcaaaagatg

SEQ ID NO: 15876 - DNA, 103 bp, Artificial Sequence
  Synthetic Polynucleotide
taatacgactcactatagggttgctttcagttttgccttccattctttctaacagaggagaagaaagatgggaaggcaaaacctggcggcagcgcaaaagatg

SEQ ID NO: 15877 - DNA, 103 bp, Artificial Sequence
  Synthetic Polynucleotide
taatacgactcactatagggctttcactcccgctccacacgccgcctttgaacagaggagacaaaggatgcgtgtggagaacctggcggcagcgcaaaagatg

SEQ ID NO: 15878 - DNA, 103 bp, Artificial Sequence
  Synthetic Polynucleotide
taatacgactcactatagggccctcttgctttcagttttgccttccattcaacagaggagagaatggatggcaaaactgaacctggcggcagcgcaaaagatg

SEQ ID NO: 15879 - DNA, 103 bp, Artificial Sequence
  Synthetic Polynucleotide
taatacgactcactatagggggtatccctcttgctttcagttttgccttcaacagaggagagaaggcatgactgaaagcaacctggcggcagcgcaaaagatg

SEQ ID NO: 15880 - DNA, 103 bp, Artificial Sequence
  Synthetic Polynucleotide
taatacgactcactatagggtatatggtatccctcttgctttcagttttgaacagaggagacaaaacatgaagcaagagaacctggcggcagcgcaaaagatg

SEQ ID NO: 15881 - DNA, 103 bp, Artificial Sequence
  Synthetic Polynucleotide
taatacgactcactatagggttcactatatggtatccctcttgctttcagaacagaggagactgaaaatgagagggataaacctggcggcagcgcaaaagatg

SEQ ID NO: 15882 - DNA, 103 bp, Artificial Sequence
  Synthetic Polynucleotide
taatacgactcactatagggtgttattcactatatggtatccctcttgctaacagaggagaagcaagatggataccataaacctggcggcagcgcaaaagatg

SEQ ID NO: 15883 - DNA, 103 bp, Artificial Sequence
  Synthetic Polynucleotide
taatacgactcactataggggttcctgttattcactatatggtatccctcaacagaggagagagggaatgcatatagtgaacctggcggcagcgcaaaagatg

SEQ ID NO: 15884 - DNA, 103 bp, Artificial Sequence
  Synthetic Polynucleotide
taatacgactcactatagggtggttgttcctgttattcactatatggtataacagaggagaataccaatgagtgaataaaacctggcggcagcgcaaaagatg

SEQ ID NO: 15885 - DNA, 103 bp, Artificial Sequence
  Synthetic Polynucleotide
taatacgactcactatagggaagtatggttgttcctgttattcactatataacagaggagaatatagatgataacaggaaacctggcggcagcgcaaaagatg

SEQ ID NO: 15886 - DNA, 103 bp, Artificial Sequence
  Synthetic Polynucleotide
taatacgactcactatagggtgaccaagtatggttgttcctgttattcacaacagaggagagtgaatatgaggaacaacaacctggcggcagcgcaaaagatg

SEQ ID NO: 15887 - DNA, 103 bp, Artificial Sequence
  Synthetic Polynucleotide
taatacgactcactatagggtgccttgaccaagtatggttgttcctgttaaacagaggagataacagatgcaaccatacaacctggcggcagcgcaaaagatg

SEQ ID NO: 15888 - DNA, 103 bp, Artificial Sequence
  Synthetic Polynucleotide
taatacgactcactatagggggcctctttcactcccgctccacacgccgcaacagaggagagcggcgatgggagcgggaaacctggcggcagcgcaaaagatg

SEQ ID NO: 15889 - DNA, 103 bp, Artificial Sequence
  Synthetic Polynucleotide
taatacgactcactatagggcttcctgccttgaccaagtatggttgttccaacagaggagaggaacaatgatacttggtaacctggcggcagcgcaaaagatg

SEQ ID NO: 15890 - DNA, 103 bp, Artificial Sequence
  Synthetic Polynucleotide
taatacgactcactatagggagctacttcctgccttgaccaagtatggttaacagaggagaaaccatatgtggtcaaggaacctggcggcagcgcaaaagatg

SEQ ID NO: 15891 - DNA, 103 bp, Artificial Sequence
  Synthetic Polynucleotide
taatacgactcactatagggttagtagctacttcctgccttgaccaagtaaacagaggagatacttgatgaaggcaggaaacctggcggcagcgcaaaagatg

SEQ ID NO: 15892 - DNA, 103 bp, Artificial Sequence
  Synthetic Polynucleotide
taatacgactcactataggggtttcttagtagctacttcctgccttgaccaacagaggagaggtcaaatgaggaagtagaacctggcggcagcgcaaaagatg

SEQ ID NO: 15893 - DNA, 103 bp, Artificial Sequence
  Synthetic Polynucleotide
taatacgactcactatagggcagctgtttcttagtagctacttcctgcctaacagaggagaaggcagatggtagctactaacctggcggcagcgcaaaagatg

SEQ ID NO: 15894 - DNA, 103 bp, Artificial Sequence
  Synthetic Polynucleotide
taatacgactcactatagggagcctcagctgtttcttagtagctacttccaacagaggagaggaagtatgtactaagaaaacctggcggcagcgcaaaagatg

SEQ ID NO: 15895 - DNA, 103 bp, Artificial Sequence
  Synthetic Polynucleotide
taatacgactcactatagggcctgcagcctcagctgtttcttagtagctaaacagaggagatagctaatgagaaacagcaacctggcggcagcgcaaaagatg

SEQ ID NO: 15896 - DNA, 103 bp, Artificial Sequence
  Synthetic Polynucleotide
taatacgactcactatagggaagtccctgcagcctcagctgtttcttagtaacagaggagaactaagatgcagctgaggaacctggcggcagcgcaaaagatg

SEQ ID NO: 15897 - DNA, 103 bp, Artificial Sequence
  Synthetic Polynucleotide
taatacgactcactatagggctggaaagtccctgcagcctcagctgtttcaacagaggagagaaacaatggaggctgcaaacctggcggcagcgcaaaagatg

SEQ ID NO: 15898 - DNA, 103 bp, Artificial Sequence
  Synthetic Polynucleotide
taatacgactcactatagggcccttctggaaagtccctgcagcctcagctaacagaggagaagctgaatgtgcagggacaacctggcggcagcgcaaaagatg

SEQ ID NO: 15899 - DNA, 103 bp, Artificial Sequence
  Synthetic Polynucleotide
taatacgactcactatagggccggaggcctctttcactcccgctccacacaacagaggagagtgtggatggggagtgaaaacctggcggcagcgcaaaagatg

SEQ ID NO: 15900 - DNA, 103 bp, Artificial Sequence
  Synthetic Polynucleotide
taatacgactcactatagggacagccccttctggaaagtccctgcagcctaacagaggagaaggctgatgggactttccaacctggcggcagcgcaaaagatg

SEQ ID NO: 15901 - DNA, 103 bp, Artificial Sequence
  Synthetic Polynucleotide
taatacgactcactatagggtggttacagccccttctggaaagtccctgcaacagaggagagcagggatgttccagaagaacctggcggcagcgcaaaagatg

SEQ ID NO: 15902 - DNA, 103 bp, Artificial Sequence
  Synthetic Polynucleotide
taatacgactcactatagggtcccttggttacagccccttctggaaagtcaacagaggagagactttatggaaggggctaacctggcggcagcgcaaaagatg

SEQ ID NO: 15903 - DNA, 103 bp, Artificial Sequence
  Synthetic Polynucleotide
taatacgactcactataggggtccctcccttggttacagccccttctggaaacagaggagatccagaatgggctgtaacaacctggcggcagcgcaaaagatg

SEQ ID NO: 15904 - DNA, 103 bp, Artificial Sequence
  Synthetic Polynucleotide
taatacgactcactatagggcccatgtccctcccttggttacagccccttaacagaggagaaaggggatgtaaccaaggaacctggcggcagcgcaaaagatg

SEQ ID NO: 15905 - DNA, 103 bp, Artificial Sequence
  Synthetic Polynucleotide
taatacgactcactatagggctcctcccatgtccctcccttggttacagcaacagaggagagctgtaatgaagggagggaacctggcggcagcgcaaaagatg

SEQ ID NO: 15906 - DNA, 103 bp, Artificial Sequence
  Synthetic Polynucleotide
taatacgactcactatagggaccagctcctcccatgtccctcccttggttaacagaggagaaaccaaatgagggacatgaacctggcggcagcgcaaaagatg

SEQ ID NO: 15907 - DNA, 103 bp, Artificial Sequence
  Synthetic Polynucleotide
taatacgactcactatagggtccccaccagctcctcccatgtccctccctaacagaggagaagggagatgcatgggaggaacctggcggcagcgcaaaagatg

SEQ ID NO: 15908 - DNA, 103 bp, Artificial Sequence
  Synthetic Polynucleotide
taatacgactcactatagggggcgttccccaccagctcctcccatgtcccaacagaggagagggacaatggaggagctgaacctggcggcagcgcaaaagatg

SEQ ID NO: 15909 - DNA, 103 bp, Artificial Sequence
  Synthetic Polynucleotide
taatacgactcactatagggatgagggcgttccccaccagctcctcccataacagaggagaatgggaatggctggtgggaacctggcggcagcgcaaaagatg

SEQ ID NO: 15910 - DNA, 103 bp, Artificial Sequence
  Synthetic Polynucleotide
taatacgactcactatagggtctatgtctcctcctactgtaaaacatcccaacagaggagagggatgatgtacagtaggaacctggcggcagcgcaaaagatg

SEQ ID NO: 15911 - DNA, 103 bp, Artificial Sequence
  Synthetic Polynucleotide
taatacgactcactataggggtacattgggtaccttactcctggcccatgaacagaggagacatgggatgggagtaaggaacctggcggcagcgcaaaagatg

SEQ ID NO: 15912 - DNA, 103 bp, Artificial Sequence
  Synthetic Polynucleotide
taatacgactcactatagggttcacccggaggcctctttcactcccgctcaacagaggagagagcggatgtgaaagaggaacctggcggcagcgcaaaagatg

SEQ ID NO: 15913 - DNA, 103 bp, Artificial Sequence
  Synthetic Polynucleotide
taatacgactcactatagggtaagtatgagggcgttccccaccagctcctaacagaggagaaggagcatgtggggaacgaacctggcggcagcgcaaaagatg

SEQ ID NO: 15914 - DNA, 103 bp, Artificial Sequence
  Synthetic Polynucleotide
taatacgactcactatagggtacagtaagtatgagggcgttccccaccagaacagaggagactggtgatgaacgccctcaacctggcggcagcgcaaaagatg

SEQ ID NO: 15915 - DNA, 103 bp, Artificial Sequence
  Synthetic Polynucleotide
taatacgactcactatagggatttatacagtaagtatgagggcgttccccaacagaggagaggggaaatgcctcatactaacctggcggcagcgcaaaagatg

SEQ ID NO: 15916 - DNA, 103 bp, Artificial Sequence
  Synthetic Polynucleotide
taatacgactcactatagggggtacatttatacagtaagtatgagggcgtaacagaggagaacgcccatgtacttactgaacctggcggcagcgcaaaagatg

SEQ ID NO: 15917 - DNA, 103 bp, Artificial Sequence
  Synthetic Polynucleotide
taatacgactcactatagggaagcgggtacatttatacagtaagtatgagaacagaggagactcataatgactgtataaaacctggcggcagcgcaaaagatg

SEQ ID NO: 15918 - DNA, 103 bp, Artificial Sequence
  Synthetic Polynucleotide
taatacgactcactataggggcaagaagcgggtacatttatacagtaagtaacagaggagaacttacatgataaatgtaaacctggcggcagcgcaaaagatg

SEQ ID NO: 15919 - DNA, 103 bp, Artificial Sequence
  Synthetic Polynucleotide
taatacgactcactatagggacaatgcaagaagcgggtacatttatacagaacagaggagactgtatatgtgtacccgcaacctggcggcagcgcaaaagatg

SEQ ID NO: 15920 - DNA, 103 bp, Artificial Sequence
  Synthetic Polynucleotide
taatacgactcactatagggtgaatacaatgcaagaagcgggtacatttaaacagaggagataaatgatgccgcttcttaacctggcggcagcgcaaaagatg

SEQ ID NO: 15921 - DNA, 103 bp, Artificial Sequence
  Synthetic Polynucleotide
taatacgactcactataggggcgactgaatacaatgcaagaagcgggtacaacagaggagagtacccatgtcttgcattaacctggcggcagcgcaaaagatg

SEQ ID NO: 15922 - DNA, 103 bp, Artificial Sequence
  Synthetic Polynucleotide
taatacgactcactataggggcagagcgactgaatacaatgcaagaagcgaacagaggagacgcttcatgcattgtattaacctggcggcagcgcaaaagatg

SEQ ID NO: 15923 - DNA, 103 bp, Artificial Sequence
  Synthetic Polynucleotide
taatacgactcactatagggttaccttcacccggaggcctctttcactccaacagaggagaggagtgatggaggcctccaacctggcggcagcgcaaaagatg

SEQ ID NO: 15924 - DNA, 103 bp, Artificial Sequence
  Synthetic Polynucleotide
taatacgactcactatagggtctccgcagagcgactgaatacaatgcaagaacagaggagacttgcaatgtattcagtcaacctggcggcagcgcaaaagatg

SEQ ID NO: 15925 - DNA, 103 bp, Artificial Sequence
  Synthetic Polynucleotide
taatacgactcactatagggcagcctctccgcagagcgactgaatacaataacagaggagaattgtaatgagtcgctctaacctggcggcagcgcaaaagatg

SEQ ID NO: 15926 - DNA, 103 bp, Artificial Sequence
  Synthetic Polynucleotide
taatacgactcactatagggtctgccagcctctccgcagagcgactgaataacagaggagaattcagatgctctgcggaaacctggcggcagcgcaaaagatg

SEQ ID NO: 15927 - DNA, 103 bp, Artificial Sequence
  Synthetic Polynucleotide
taatacgactcactatagggctcgatctgccagcctctccgcagagcgacaacagaggagagtcgctatgcggagaggcaacctggcggcagcgcaaaagatg

SEQ ID NO: 15928 - DNA, 103 bp, Artificial Sequence
  Synthetic Polynucleotide
taatacgactcactatagggcagggctcgatctgccagcctctccgcagaaacagaggagatctgcgatgaggctggcaaacctggcggcagcgcaaaagatg

SEQ ID NO: 15929 - DNA, 103 bp, Artificial Sequence
  Synthetic Polynucleotide
taatacgactcactatagggcctctcagggctcgatctgccagcctctccaacagaggagaggagagatgggcagatcgaacctggcggcagcgcaaaagatg

SEQ ID NO: 15930 - DNA, 103 bp, Artificial Sequence
  Synthetic Polynucleotide
taatacgactcactataggggagaacctctcagggctcgatctgccagccaacagaggagaggctggatgatcgagcccaacctggcggcagcgcaaaagatg

SEQ ID NO: 15931 - DNA, 103 bp, Artificial Sequence
  Synthetic Polynucleotide
taatacgactcactatagggctggagagaacctctcagggctcgatctgcaacagaggagagcagatatggccctgagaaacctggcggcagcgcaaaagatg

SEQ ID NO: 15932 - DNA, 103 bp, Artificial Sequence
  Synthetic Polynucleotide
taatacgactcactatagggtagtgctggagagaacctctcagggctcgaaacagaggagatcgagcatggagaggttcaacctggcggcagcgcaaaagatg

SEQ ID NO: 15933 - DNA, 103 bp, Artificial Sequence
  Synthetic Polynucleotide
taatacgactcactatagggcctgctagtgctggagagaacctctcagggaacagaggagaccctgaatggttctctccaacctggcggcagcgcaaaagatg

SEQ ID NO: 15934 - DNA, 103 bp, Artificial Sequence
  Synthetic Polynucleotide
taatacgactcactatagggggtacttaccttcacccggaggcctctttcaacagaggagagaaagaatgctccgggtgaacctggcggcagcgcaaaagatg

SEQ ID NO: 15935 - DNA, 103 bp, Artificial Sequence
  Synthetic Polynucleotide
taatacgactcactatagggctctacctgctagtgctggagagaacctctaacagaggagaagaggtatgctccagcacaacctggcggcagcgcaaaagatg

SEQ ID NO: 15936 - DNA, 103 bp, Artificial Sequence
  Synthetic Polynucleotide
taatacgactcactatagggccaggctctacctgctagtgctggagagaaaacagaggagattctctatggcactagcaaacctggcggcagcgcaaaagatg

SEQ ID NO: 15937 - DNA, 103 bp, Artificial Sequence
  Synthetic Polynucleotide
taatacgactcactatagggaacacccaggctctacctgctagtgctggaaacagaggagatccagcatgagcaggtagaacctggcggcagcgcaaaagatg

SEQ ID NO: 15938 - DNA, 103 bp, Artificial Sequence
  Synthetic Polynucleotide
taatacgactcactatagggcagggaacacccaggctctacctgctagtgaacagaggagacactagatggtagagcctaacctggcggcagcgcaaaagatg

SEQ ID NO: 15939 - DNA, 103 bp, Artificial Sequence
  Synthetic Polynucleotide
taatacgactcactatagggtccagcagggaacacccaggctctacctgcaacagaggagagcaggtatggcctgggtgaacctggcggcagcgcaaaagatg

SEQ ID NO: 15940 - DNA, 103 bp, Artificial Sequence
  Synthetic Polynucleotide
taatacgactcactataggggagagtccagcagggaacacccaggctctaaacagaggagatagagcatgggtgttcccaacctggcggcagcgcaaaagatg

SEQ ID NO: 15941 - DNA, 103 bp, Artificial Sequence
  Synthetic Polynucleotide
taatacgactcactatagggctggtgagagtccagcagggaacacccaggaacagaggagacctgggatgtccctgctgaacctggcggcagcgcaaaagatg

SEQ ID NO: 15942 - DNA, 103 bp, Artificial Sequence
  Synthetic Polynucleotide
taatacgactcactatagggaagtactggtgagagtccagcagggaacacaacagaggagagtgttcatggctggactcaacctggcggcagcgcaaaagatg

SEQ ID NO: 15943 - DNA, 103 bp, Artificial Sequence
  Synthetic Polynucleotide
taatacgactcactatagggcggccaagtactggtgagagtccagcagggaacagaggagaccctgcatgactctcaccaacctggcggcagcgcaaaagatg

SEQ ID NO: 15944 - DNA, 103 bp, Artificial Sequence
  Synthetic Polynucleotide
taatacgactcactatagggagtaccggccaagtactggtgagagtccagaacagaggagactggacatgcaccagtacaacctggcggcagcgcaaaagatg

SEQ ID NO: 15945 - DNA, 103 bp, Artificial Sequence
  Synthetic Polynucleotide
taatacgactcactataggggtgtaggtacttaccttcacccggaggcctaacagaggagaaggcctatgggtgaaggtaacctggcggcagcgcaaaagatg

SEQ ID NO: 15946 - DNA, 103 bp, Artificial Sequence
  Synthetic Polynucleotide
taatacgactcactatagggtgcccagtaccggccaagtactggtgagagaacagaggagactctcaatggtacttggcaacctggcggcagcgcaaaagatg

SEQ ID NO: 15947 - DNA, 103 bp, Artificial Sequence
  Synthetic Polynucleotide
taatacgactcactatagggccgtctgcccagtaccggccaagtactggtaacagaggagaaccagtatgtggccggtaaacctggcggcagcgcaaaagatg

SEQ ID NO: 15948 - DNA, 103 bp, Artificial Sequence
  Synthetic Polynucleotide
taatacgactcactatagggtggagccgtctgcccagtaccggccaagtaaacagaggagatacttgatgggtactgggaacctggcggcagcgcaaaagatg

SEQ ID NO: 15949 - DNA, 103 bp, Artificial Sequence
  Synthetic Polynucleotide
taatacgactcactatagggaagcgtggagccgtctgcccagtaccggccaacagaggagaggccggatgtgggcagacaacctggcggcagcgcaaaagatg

SEQ ID NO: 15950 - DNA, 103 bp, Artificial Sequence
  Synthetic Polynucleotide
taatacgactcactatagggcaagcaagcgtggagccgtctgcccagtacaacagaggagagtactgatgagacggctcaacctggcggcagcgcaaaagatg

SEQ ID NO: 15951 - DNA, 103 bp, Artificial Sequence
  Synthetic Polynucleotide
taatacgactcactatagggttaagcaagcaagcgtggagccgtctgcccaacagaggagagggcagatggctccacgcaacctggcggcagcgcaaaagatg

SEQ ID NO: 15952 - DNA, 103 bp, Artificial Sequence
  Synthetic Polynucleotide
taatacgactcactatagggggtctttaagcaagcaagcgtggagccgtcaacagaggagagacggcatgacgcttgctaacctggcggcagcgcaaaagatg

SEQ ID NO: 15953 - DNA, 103 bp, Artificial Sequence
  Synthetic Polynucleotide
taatacgactcactataggggaagaggtctttaagcaagcaagcgtggagaacagaggagactccacatgtgcttgcttaacctggcggcagcgcaaaagatg

SEQ ID NO: 15954 - DNA, 103 bp, Artificial Sequence
  Synthetic Polynucleotide
taatacgactcactatagggttattgaagaggtctttaagcaagcaagcgaacagaggagacgcttgatggcttaaagaaacctggcggcagcgcaaaagatg

SEQ ID NO: 15955 - DNA, 103 bp, Artificial Sequence
  Synthetic Polynucleotide
taatacgactcactatagggcagctttattgaagaggtctttaagcaagcaacagaggagagcttgcatgaagacctctaacctggcggcagcgcaaaagatg

SEQ ID NO: 15956 - DNA, 103 bp, Artificial Sequence
  Synthetic Polynucleotide
taatacgactcactatagggttttggtgtaggtacttaccttcacccggaaacagaggagatccgggatgaggtaagtaaacctggcggcagcgcaaaagatg

SEQ ID NO: 15957 - DNA, 103 bp, Artificial Sequence
  Synthetic Polynucleotide
taatacgactcactatagggactggcagctttattgaagaggtctttaagaacagaggagacttaaaatgctcttcaataacctggcggcagcgcaaaagatg

SEQ ID NO: 15958 - DNA, 103 bp, Artificial Sequence
  Synthetic Polynucleotide
taatacgactcactatagggttctaactggcagctttattgaagaggtctaacagaggagaagacctatgcaataaagcaacctggcggcagcgcaaaagatg

SEQ ID NO: 15959 - DNA, 103 bp, Artificial Sequence
  Synthetic Polynucleotide
taatacgactcactatagggcttgcttctaactggcagctttattgaagaaacagaggagatcttcaatgaagctgccaaacctggcggcagcgcaaaagatg

SEQ ID NO: 15960 - DNA, 103 bp, Artificial Sequence
  Synthetic Polynucleotide
taatacgactcactatagggcttaacttgcttctaactggcagctttattaacagaggagaaataaaatggccagttagaacctggcggcagcgcaaaagatg

SEQ ID NO: 15961 - DNA, 103 bp, Artificial Sequence
  Synthetic Polynucleotide
taatacgactcactatagggacacacttaacttgcttctaactggcagctaacagaggagaagctgcatgttagaagcaaacctggcggcagcgcaaaagatg

SEQ ID NO: 15962 - DNA, 103 bp, Artificial Sequence
  Synthetic Polynucleotide
taatacgactcactatagggggaacacacacttaacttgcttctaactggaacagaggagaccagttatgagcaagttaaacctggcggcagcgcaaaagatg

SEQ ID NO: 15963 - DNA, 103 bp, Artificial Sequence
  Synthetic Polynucleotide
taatacgactcactatagggagatgggaacacacacttaacttgcttctaaacagaggagatagaagatggttaagtgtaacctggcggcagcgcaaaagatg

SEQ ID NO: 15964 - DNA, 103 bp, Artificial Sequence
  Synthetic Polynucleotide
taatacgactcactatagggaggagagatgggaacacacacttaacttgcaacagaggagagcaagtatggtgtgtgttaacctggcggcagcgcaaaagatg

SEQ ID NO: 15965 - DNA, 103 bp, Artificial Sequence
  Synthetic Polynucleotide
taatacgactcactatagggcgactaggagagatgggaacacacacttaaaacagaggagattaagtatgtgttcccataacctggcggcagcgcaaaagatg

SEQ ID NO: 15966 - DNA, 103 bp, Artificial Sequence
  Synthetic Polynucleotide
taatacgactcactatagggggcggcgactaggagagatgggaacacacaaacagaggagatgtgtgatgccatctctcaacctggcggcagcgcaaaagatg

SEQ ID NO: 15967 - DNA, 103 bp, Artificial Sequence
  Synthetic Polynucleotide
taatacgactcactatagggacagtttttggtgtaggtacttaccttcacaacagaggagagtgaagatgagtacctacaacctggcggcagcgcaaaagatg

SEQ ID NO: 15968 - DNA, 103 bp, Artificial Sequence
  Synthetic Polynucleotide
taatacgactcactataggggaccaggcggcgactaggagagatgggaacaacagaggagagttcccatgtctcctagtaacctggcggcagcgcaaaagatg

SEQ ID NO: 15969 - DNA, 103 bp, Artificial Sequence
  Synthetic Polynucleotide
taatacgactcactatagggcgaatgaccaggcggcgactaggagagatgaacagaggagacatctcatgtagtcgccgaacctggcggcagcgcaaaagatg

SEQ ID NO: 15970 - DNA, 103 bp, Artificial Sequence
  Synthetic Polynucleotide
taatacgactcactatagggaacaccgaatgaccaggcggcgactaggagaacagaggagactcctaatggccgcctggaacctggcggcagcgcaaaagatg

SEQ ID NO: 15971 - DNA, 103 bp, Artificial Sequence
  Synthetic Polynucleotide
taatacgactcactatagggagatgaacaccgaatgaccaggcggcgactaacagaggagaagtcgcatgctggtcattaacctggcggcagcgcaaaagatg

SEQ ID NO: 15972 - DNA, 103 bp, Artificial Sequence
  Synthetic Polynucleotide
taatacgactcactatagggtactcagatgaacaccgaatgaccaggcggaacagaggagaccgcctatgcattcggtgaacctggcggcagcgcaaaagatg

SEQ ID NO: 15973 - DNA, 103 bp, Artificial Sequence
  Synthetic Polynucleotide
taatacgactcactatagggcttgttactcagatgaacaccgaatgaccaaacagaggagatggtcaatgggtgttcataacctggcggcagcgcaaaagatg

SEQ ID NO: 15974 - DNA, 103 bp, Artificial Sequence
  Synthetic Polynucleotide
taatacgactcactatagggagggtcttgttactcagatgaacaccgaataacagaggagaattcggatgtcatctgagaacctggcggcagcgcaaaagatg

SEQ ID NO: 15975 - DNA, 103 bp, Artificial Sequence
  Synthetic Polynucleotide
taatacgactcactatagggagaccagggtcttgttactcagatgaacacaacagaggagagtgttcatgtgagtaacaaacctggcggcagcgcaaaagatg

SEQ ID NO: 15976 - DNA, 103 bp, Artificial Sequence
  Synthetic Polynucleotide
taatacgactcactatagggctaacagaccagggtcttgttactcagatgaacagaggagacatctgatgaacaagaccaacctggcggcagcgcaaaagatg

SEQ ID NO: 15977 - DNA, 103 bp, Artificial Sequence
  Synthetic Polynucleotide
taatacgactcactataggggggtcctaacagaccagggtcttgttactcaacagaggagagagtaaatggaccctggtaacctggcggcagcgcaaaagatg

SEQ ID NO: 15978 - DNA, 103 bp, Artificial Sequence
  Synthetic Polynucleotide
taatacgactcactatagggtggctacagtttttggtgtaggtacttaccaacagaggagaggtaagatgctacaccaaaacctggcggcagcgcaaaagatg

SEQ ID NO: 15979 - DNA, 103 bp, Artificial Sequence
  Synthetic Polynucleotide
taatacgactcactataggggagaagggtcctaacagaccagggtcttgtaacagaggagaacaagaatgtggtctgttaacctggcggcagcgcaaaagatg

SEQ ID NO: 15980 - DNA, 103 bp, Artificial Sequence
  Synthetic Polynucleotide
taatacgactcactatagggaaagcgagaagggtcctaacagaccagggtaacagaggagaaccctgatgtgttaggacaacctggcggcagcgcaaaagatg

SEQ ID NO: 15981 - DNA, 103 bp, Artificial Sequence
  Synthetic Polynucleotide
taatacgactcactatagggttcccaaagcgagaagggtcctaacagaccaacagaggagaggtctgatgggacccttcaacctggcggcagcgcaaaagatg

SEQ ID NO: 15982 - DNA, 103 bp, Artificial Sequence
  Synthetic Polynucleotide
taatacgactcactatagggttggattcccaaagcgagaagggtcctaacaacagaggagagttaggatgcttctcgctaacctggcggcagcgcaaaagatg

SEQ ID NO: 15983 - DNA, 103 bp, Artificial Sequence
  Synthetic Polynucleotide
taatacgactcactatagggctgccttggattcccaaagcgagaagggtcaacagaggagagaccctatgcgctttgggaacctggcggcagcgcaaaagatg

SEQ ID NO: 15984 - DNA, 103 bp, Artificial Sequence
  Synthetic Polynucleotide
taatacgactcactatagggttttcctgccttggattcccaaagcgagaaaacagaggagattctcgatgtgggaatccaacctggcggcagcgcaaaagatg

SEQ ID NO: 15985 - DNA, 103 bp, Artificial Sequence
  Synthetic Polynucleotide
taatacgactcactatagggagggattttcctgccttggattcccaaagcaacagaggagagctttgatgatccaaggcaacctggcggcagcgcaaaagatg

SEQ ID NO: 15986 - DNA, 103 bp, Artificial Sequence
  Synthetic Polynucleotide
taatacgactcactatagggttttctggctacagtttttggtgtaggtacaacagaggagagtacctatgccaaaaactaacctggcggcagcgcaaaagatg

SEQ ID NO: 15987 - DNA, 103 bp, Artificial Sequence
  Synthetic Polynucleotide
taatacgactcactatagggaagccttttctggctacagtttttggtgtaaacagaggagatacaccatgaactgtagcaacctggcggcagcgcaaaagatg

SEQ ID NO: 15988 - DNA, 103 bp, Artificial Sequence
  Synthetic Polynucleotide
taatacgactcactatagggataacaagccttttctggctacagtttttgaacagaggagacaaaaaatgtagccagaaaacctggcggcagcgcaaaagatg

SEQ ID NO: 15989 - DNA, 103 bp, Artificial Sequence
  Synthetic Polynucleotide
taatacgactcactatagggccgaagtacattgggtaccttactcctggcaacagaggagagccaggatgaaggtacccaacctggcggcagcgcaaaagatg

SEQ ID NO: 15990 - DNA, 103 bp, Artificial Sequence
  Synthetic Polynucleotide
taatacgactcactataggggtaggataacaagccttttctggctacagtaacagaggagaactgtaatgagaaaaggcaacctggcggcagcgcaaaagatg

SEQ ID NO: 15991 - DNA, 103 bp, Artificial Sequence
  Synthetic Polynucleotide
taatacgactcactatagggtaaaggtaggataacaagccttttctggctaacagaggagaagccagatgaggcttgttaacctggcggcagcgcaaaagatg

SEQ ID NO: 15992 - DNA, 103 bp, Artificial Sequence
  Synthetic Polynucleotide
taatacgactcactatagggctgtctaaaggtaggataacaagccttttcaacagaggagagaaaagatgtgttatcctaacctggcggcagcgcaaaagatg

SEQ ID NO: 15993 - DNA, 103 bp, Artificial Sequence
  Synthetic Polynucleotide
taatacgactcactatagggtctacctgtctaaaggtaggataacaagccaacagaggagaggcttgatgtcctaccttaacctggcggcagcgcaaaagatg

SEQ ID NO: 15994 - DNA, 103 bp, Artificial Sequence
  Synthetic Polynucleotide
taatacgactcactatagggaatcttctacctgtctaaaggtaggataacaacagaggagagttatcatgcctttagacaacctggcggcagcgcaaaagatg

SEQ ID NO: 15995 - DNA, 103 bp, Artificial Sequence
  Synthetic Polynucleotide
taatacgactcactatagggcccacaatcttctacctgtctaaaggtaggaacagaggagacctaccatgagacaggtaaacctggcggcagcgcaaaagatg

SEQ ID NO: 15996 - DNA, 103 bp, Artificial Sequence
  Synthetic Polynucleotide
taatacgactcactatagggcatctcccacaatcttctacctgtctaaagaacagaggagactttagatgggtagaagaaacctggcggcagcgcaaaagatg

SEQ ID NO: 15997 - DNA, 103 bp, Artificial Sequence
  Synthetic Polynucleotide
taatacgactcactataggggcgcccatctcccacaatcttctacctgtcaacagaggagagacaggatgaagattgtgaacctggcggcagcgcaaaagatg

SEQ ID NO: 15998 - DNA, 103 bp, Artificial Sequence
  Synthetic Polynucleotide
taatacgactcactatagggttctcgcgcccatctcccacaatcttctacaacagaggagagtagaaatgtgtgggagaaacctggcggcagcgcaaaagatg

SEQ ID NO: 15999 - DNA, 103 bp, Artificial Sequence
  Synthetic Polynucleotide
taatacgactcactatagggggagtttctcgcgcccatctcccacaatctaacagaggagaagattgatggagatgggcaacctggcggcagcgcaaaagatg

SEQ ID NO: 16000 - DNA, 103 bp, Artificial Sequence
  Synthetic Polynucleotide
taatacgactcactataggggccacccgaagtacattgggtaccttactcaacagaggagagagtaaatgacccaatgtaacctggcggcagcgcaaaagatg

SEQ ID NO: 16001 - DNA, 103 bp, Artificial Sequence
  Synthetic Polynucleotide
taatacgactcactatagggaagacggagtttctcgcgcccatctcccacaacagaggagagtgggaatggggcgcgagaacctggcggcagcgcaaaagatg

SEQ ID NO: 16002 - DNA, 103 bp, Artificial Sequence
  Synthetic Polynucleotide
taatacgactcactatagggctctcaagacggagtttctcgcgcccatctaacagaggagaagatggatgcgagaaactaacctggcggcagcgcaaaagatg

SEQ ID NO: 16003 - DNA, 103 bp, Artificial Sequence
  Synthetic Polynucleotide
taatacgactcactatagggtttccctctcaagacggagtttctcgcgccaacagaggagaggcgcgatgaactccgtcaacctggcggcagcgcaaaagatg

SEQ ID NO: 16004 - DNA, 103 bp, Artificial Sequence
  Synthetic Polynucleotide
taatacgactcactataggggcttttttccctctcaagacggagtttctcaacagaggagagagaaaatgcgtcttgagaacctggcggcagcgcaaaagatg

SEQ ID NO: 16005 - DNA, 103 bp, Artificial Sequence
  Synthetic Polynucleotide
taatacgactcactatagggcgtctgcttttttccctctcaagacggagtaacagaggagaactccgatgtgagagggaaacctggcggcagcgcaaaagatg

SEQ ID NO: 16006 - DNA, 103 bp, Artificial Sequence
  Synthetic Polynucleotide
taatacgactcactatagggtaattcgtctgcttttttccctctcaagacaacagaggagagtcttgatggggaaaaaaaacctggcggcagcgcaaaagatg

SEQ ID NO: 16007 - DNA, 103 bp, Artificial Sequence
  Synthetic Polynucleotide
taatacgactcactatagggttttctaattcgtctgcttttttccctctcaacagaggagagagaggatgaaaagcagaaacctggcggcagcgcaaaagatg

SEQ ID NO: 16008 - DNA, 103 bp, Artificial Sequence
  Synthetic Polynucleotide
taatacgactcactatagggtaactttttctaattcgtctgcttttttccaacagaggagaggaaaaatgcagacgaataacctggcggcagcgcaaaagatg

SEQ ID NO: 16009 - DNA, 103 bp, Artificial Sequence
  Synthetic Polynucleotide
taatacgactcactatagggtaacctaactttttctaattcgtctgctttaacagaggagaaaagcaatggaattagaaaacctggcggcagcgcaaaagatg

SEQ ID NO: 16010 - DNA, 103 bp, Artificial Sequence
  Synthetic Polynucleotide
taatacgactcactatagggggccgtaacctaactttttctaattcgtctaacagaggagaagacgaatgagaaaaagtaacctggcggcagcgcaaaagatg

SEQ ID NO: 16011 - DNA, 103 bp, Artificial Sequence
  Synthetic Polynucleotide
taatacgactcactatagggccacagccacccgaagtacattgggtacctaacagaggagaaggtacatgatgtacttcaacctggcggcagcgcaaaagatg

SEQ ID NO: 16012 - DNA, 103 bp, Artificial Sequence
  Synthetic Polynucleotide
taatacgactcactatagggcgccgggccgtaacctaactttttctaattaacagaggagaaattagatgaagttaggtaacctggcggcagcgcaaaagatg

SEQ ID NO: 16013 - DNA, 103 bp, Artificial Sequence
  Synthetic Polynucleotide
taatacgactcactatagggctttccgccgggccgtaacctaactttttcaacagaggagagaaaaaatgaggttacggaacctggcggcagcgcaaaagatg

SEQ ID NO: 16014 - DNA, 103 bp, Artificial Sequence
  Synthetic Polynucleotide
taatacgactcactatagggtttttctttccgccgggccgtaacctaactaacagaggagaagttagatgacggcccggaacctggcggcagcgcaaaagatg

SEQ ID NO: 16015 - DNA, 103 bp, Artificial Sequence
  Synthetic Polynucleotide
taatacgactcactatagggtgtactttttctttccgccgggccgtaaccaacagaggagaggttacatgccggcggaaaacctggcggcagcgcaaaagatg

SEQ ID NO: 16016 - DNA, 103 bp, Artificial Sequence
  Synthetic Polynucleotide
taatacgactcactatagggtaacctgtactttttctttccgccgggccgaacagaggagacggcccatgggaaagaaaaacctggcggcagcgcaaaagatg

SEQ ID NO: 16017 - DNA, 103 bp, Artificial Sequence
  Synthetic Polynucleotide
taatacgactcactatagggtgttttaacctgtactttttctttccgccgaacagaggagacggcggatggaaaaagtaaacctggcggcagcgcaaaagatg

SEQ ID NO: 16018 - DNA, 103 bp, Artificial Sequence
  Synthetic Polynucleotide
taatacgactcactatagggcaatatgttttaacctgtactttttctttcaacagaggagagaaagaatgagtacaggtaacctggcggcagcgcaaaagatg

SEQ ID NO: 16019 - DNA, 103 bp, Artificial Sequence
  Synthetic Polynucleotide
taatacgactcactatagggccacacaatatgttttaacctgtactttttaacagaggagaaaaaagatgaggttaaaaaacctggcggcagcgcaaaagatg

SEQ ID NO: 16020 - DNA, 103 bp, Artificial Sequence
  Synthetic Polynucleotide
taatacgactcactataggggctgcccacacaatatgttttaacctgtacaacagaggagagtacagatgaaaacatataacctggcggcagcgcaaaagatg

SEQ ID NO: 16021 - DNA, 103 bp, Artificial Sequence
  Synthetic Polynucleotide
taatacgactcactatagggcattcgctgcccacacaatatgttttaaccaacagaggagaggttaaatgatattgtgtaacctggcggcagcgcaaaagatg

SEQ ID NO: 16022 - DNA, 103 bp, Artificial Sequence
  Synthetic Polynucleotide
taatacgactcactatagggagcttccacagccacccgaagtacattgggaacagaggagacccaatatgcttcgggtgaacctggcggcagcgcaaaagatg

SEQ ID NO: 16023 - DNA, 103 bp, Artificial Sequence
  Synthetic Polynucleotide
taatacgactcactatagggcaattcattcgctgcccacacaatatgtttaacagaggagaaaacatatggtgtgggcaaacctggcggcagcgcaaaagatg

SEQ ID NO: 16024 - DNA, 103 bp, Artificial Sequence
  Synthetic Polynucleotide
taatacgactcactatagggttatccaattcattcgctgcccacacaataaacagaggagatattgtatgggcagcgaaaacctggcggcagcgcaaaagatg

SEQ ID NO: 16025 - DNA, 103 bp, Artificial Sequence
  Synthetic Polynucleotide
taatacgactcactatagggcgaatttatccaattcattcgctgcccacaaacagaggagatgtgggatgcgaatgaataacctggcggcagcgcaaaagatg

SEQ ID NO: 16026 - DNA, 103 bp, Artificial Sequence
  Synthetic Polynucleotide
taatacgactcactatagggcaatccgaatttatccaattcattcgctgcaacagaggagagcagcgatggaattggataacctggcggcagcgcaaaagatg

SEQ ID NO: 16027 - DNA, 103 bp, Artificial Sequence
  Synthetic Polynucleotide
taatacgactcactatagggtctgccaatccgaatttatccaattcattcaacagaggagagaatgaatgggataaattaacctggcggcagcgcaaaagatg

SEQ ID NO: 16028 - DNA, 103 bp, Artificial Sequence
  Synthetic Polynucleotide
taatacgactcactatagggggctctctgccaatccgaatttatccaattaacagaggagaaattggatgaattcggataacctggcggcagcgcaaaagatg

SEQ ID NO: 16029 - DNA, 103 bp, Artificial Sequence
  Synthetic Polynucleotide
taatacgactcactatagggcaacaggctctctgccaatccgaatttatcaacagaggagagataaaatgggattggcaaacctggcggcagcgcaaaagatg

SEQ ID NO: 16030 - DNA, 103 bp, Artificial Sequence
  Synthetic Polynucleotide
taatacgactcactataggggactccaacaggctctctgccaatccgaataacagaggagaattcggatgggcagagagaacctggcggcagcgcaaaagatg

SEQ ID NO: 16031 - DNA, 103 bp, Artificial Sequence
  Synthetic Polynucleotide
taatacgactcactatagggcttttgactccaacaggctctctgccaatcaacagaggagagattggatgagagcctgtaacctggcggcagcgcaaaagatg

SEQ ID NO: 16032 - DNA, 103 bp, Artificial Sequence
  Synthetic Polynucleotide
taatacgactcactatagggaccttcttttgactccaacaggctctctgcaacagaggagagcagagatgctgttggagaacctggcggcagcgcaaaagatg

SEQ ID NO: 16033 - DNA, 103 bp, Artificial Sequence
  Synthetic Polynucleotide
taatacgactcactatagggatactagcttccacagccacccgaagtacaaacagaggagatgtactatgggtggctgtaacctggcggcagcgcaaaagatg

SEQ ID NO: 16034 - DNA, 103 bp, Artificial Sequence
  Synthetic Polynucleotide
taatacgactcactatagggtggcaaccttcttttgactccaacaggctcaacagaggagagagcctatgggagtcaaaaacctggcggcagcgcaaaagatg

SEQ ID NO: 16035 - DNA, 103 bp, Artificial Sequence
  Synthetic Polynucleotide
taatacgactcactatagggtcttttggcaaccttcttttgactccaacaaacagaggagatgttggatgcaaaagaagaacctggcggcagcgcaaaagatg

SEQ ID NO: 16036 - DNA, 103 bp, Artificial Sequence
  Synthetic Polynucleotide
taatacgactcactataggggagaatcttttggcaaccttcttttgactcaacagaggagagagtcaatggaaggttgcaacctggcggcagcgcaaaagatg

SEQ ID NO: 16037 - DNA, 103 bp, Artificial Sequence
  Synthetic Polynucleotide
taatacgactcactatagggactctgagaatcttttggcaaccttcttttaacagaggagaaaaagaatgttgccaaaaaacctggcggcagcgcaaaagatg

SEQ ID NO: 16038 - DNA, 103 bp, Artificial Sequence
  Synthetic Polynucleotide
taatacgactcactatagggctaaaactctgagaatcttttggcaaccttaacagaggagaaaggttatgaaaagattcaacctggcggcagcgcaaaagatg

SEQ ID NO: 16039 - DNA, 103 bp, Artificial Sequence
  Synthetic Polynucleotide
taatacgactcactatagggtggatctaaaactctgagaatcttttggcaaacagaggagatgccaaatgattctcagaaacctggcggcagcgcaaaagatg

SEQ ID NO: 16040 - DNA, 103 bp, Artificial Sequence
  Synthetic Polynucleotide
taatacgactcactatagggactaatggatctaaaactctgagaatctttaacagaggagaaaagatatgcagagttttaacctggcggcagcgcaaaagatg

SEQ ID NO: 16041 - DNA, 103 bp, Artificial Sequence
  Synthetic Polynucleotide
taatacgactcactatagggttggtactaatggatctaaaactctgagaaaacagaggagattctcaatgttttagatcaacctggcggcagcgcaaaagatg

SEQ ID NO: 16042 - DNA, 103 bp, Artificial Sequence
  Synthetic Polynucleotide
taatacgactcactatagggccctgttggtactaatggatctaaaactctaacagaggagaagagttatggatccattaaacctggcggcagcgcaaaagatg

SEQ ID NO: 16043 - DNA, 103 bp, Artificial Sequence
  Synthetic Polynucleotide
taatacgactcactatagggtctgaccctgttggtactaatggatctaaaaacagaggagatttagaatgattagtaccaacctggcggcagcgcaaaagatg

SEQ ID NO: 16044 - DNA, 103 bp, Artificial Sequence
  Synthetic Polynucleotide
taatacgactcactatagggtactgatactagcttccacagccacccgaaaacagaggagattcgggatgctgtggaagaacctggcggcagcgcaaaagatg

SEQ ID NO: 16045 - DNA, 103 bp, Artificial Sequence
  Synthetic Polynucleotide
taatacgactcactatagggaattttctgaccctgttggtactaatggataacagaggagaatccatatgtaccaacagaacctggcggcagcgcaaaagatg

SEQ ID NO: 16046 - DNA, 103 bp, Artificial Sequence
  Synthetic Polynucleotide
taatacgactcactatagggttttaaattttctgaccctgttggtactaaaacagaggagattagtaatgacagggtcaaacctggcggcagcgcaaaagatg

SEQ ID NO: 16047 - DNA, 103 bp, Artificial Sequence
  Synthetic Polynucleotide
taatacgactcactatagggaggctttttaaattttctgaccctgttggtaacagaggagaaccaacatggtcagaaaaaacctggcggcagcgcaaaagatg

SEQ ID NO: 16048 - DNA, 103 bp, Artificial Sequence
  Synthetic Polynucleotide
taatacgactcactatagggtaaaaaggctttttaaattttctgaccctgaacagaggagacagggtatgaaaatttaaaacctggcggcagcgcaaaagatg

SEQ ID NO: 16049 - DNA, 103 bp, Artificial Sequence
  Synthetic Polynucleotide
taatacgactcactatagggggtattaaaaaggctttttaaattttctgaaacagaggagatcagaaatgttaaaaagcaacctggcggcagcgcaaaagatg

SEQ ID NO: 16050 - DNA, 103 bp, Artificial Sequence
  Synthetic Polynucleotide
taatacgactcactatagggcagacggtattaaaaaggctttttaaatttaacagaggagaaaatttatgaagccttttaacctggcggcagcgcaaaagatg

SEQ ID NO: 16051 - DNA, 103 bp, Artificial Sequence
  Synthetic Polynucleotide
taatacgactcactatagggtgacgcagacggtattaaaaaggctttttaaacagaggagataaaaaatgtttttaataaacctggcggcagcgcaaaagatg

SEQ ID NO: 16052 - DNA, 103 bp, Artificial Sequence
  Synthetic Polynucleotide
taatacgactcactatagggccaaatgacgcagacggtattaaaaaggctaacagaggagaagccttatgaataccgtcaacctggcggcagcgcaaaagatg

SEQ ID NO: 16053 - DNA, 103 bp, Artificial Sequence
  Synthetic Polynucleotide
taatacgactcactatagggaagcaccaaatgacgcagacggtattaaaaaacagaggagattttaaatgcgtctgcgtaacctggcggcagcgcaaaagatg

SEQ ID NO: 16054 - DNA, 103 bp, Artificial Sequence
  Synthetic Polynucleotide
taatacgactcactatagggcgtgcaagcaccaaatgacgcagacggtataacagaggagaataccgatggcgtcatttaacctggcggcagcgcaaaagatg

SEQ ID NO: 16055 - DNA, 103 bp, Artificial Sequence
  Synthetic Polynucleotide
taatacgactcactatagggagttctactgatactagcttccacagccacaacagaggagagtggctatggaagctagtaacctggcggcagcgcaaaagatg

SEQ ID NO: 16056 - DNA, 103 bp, Artificial Sequence
  Synthetic Polynucleotide
taatacgactcactatagggttctgcgtgcaagcaccaaatgacgcagacaacagaggagagtctgcatgatttggtgcaacctggcggcagcgcaaaagatg

SEQ ID NO: 16057 - DNA, 103 bp, Artificial Sequence
  Synthetic Polynucleotide
taatacgactcactatagggttctcttctgcgtgcaagcaccaaatgacgaacagaggagacgtcatatggtgcttgcaaacctggcggcagcgcaaaagatg

SEQ ID NO: 16058 - DNA, 103 bp, Artificial Sequence
  Synthetic Polynucleotide
taatacgactcactatagggtcactttctcttctgcgtgcaagcaccaaaaacagaggagatttggtatgtgcacgcagaacctggcggcagcgcaaaagatg

SEQ ID NO: 16059 - DNA, 103 bp, Artificial Sequence
  Synthetic Polynucleotide
taatacgactcactatagggatctttcactttctcttctgcgtgcaagcaaacagaggagatgcttgatggcagaagagaacctggcggcagcgcaaaagatg

SEQ ID NO: 16060 - DNA, 103 bp, Artificial Sequence
  Synthetic Polynucleotide
taatacgactcactatagggtcagtatctttcactttctcttctgcgtgcaacagaggagagcacgcatgagagaaagtaacctggcggcagcgcaaaagatg

SEQ ID NO: 16061 - DNA, 103 bp, Artificial Sequence
  Synthetic Polynucleotide
taatacgactcactatagggcttcctcagtatctttcactttctcttctgaacagaggagacagaagatgaagtgaaagaacctggcggcagcgcaaaagatg

SEQ ID NO: 16062 - DNA, 103 bp, Artificial Sequence
  Synthetic Polynucleotide
taatacgactcactatagggctttgcttcctcagtatctttcactttctcaacagaggagagagaaaatgaaagatactaacctggcggcagcgcaaaagatg

SEQ ID NO: 16063 - DNA, 103 bp, Artificial Sequence
  Synthetic Polynucleotide
taatacgactcactatagggagtttctttgcttcctcagtatctttcactaacagaggagaagtgaaatgtactgaggaaacctggcggcagcgcaaaagatg

SEQ ID NO: 16064 - DNA, 103 bp, Artificial Sequence
  Synthetic Polynucleotide
taatacgactcactataggggtgctagtttctttgcttcctcagtatcttaacagaggagaaagataatgaggaagcaaaacctggcggcagcgcaaaagatg

SEQ ID NO: 16065 - DNA, 103 bp, Artificial Sequence
  Synthetic Polynucleotide
taatacgactcactatagggtctctgtgctagtttctttgcttcctcagtaacagaggagaactgagatggcaaagaaaaacctggcggcagcgcaaaagatg

SEQ ID NO: 16066 - DNA, 103 bp, Artificial Sequence
  Synthetic Polynucleotide
taatacgactcactataggggtgagagttctactgatactagcttccacaaacagaggagatgtggaatgtagtatcagaacctggcggcagcgcaaaagatg

SEQ ID NO: 16067 - DNA, 103 bp, Artificial Sequence
  Synthetic Polynucleotide
taatacgactcactatagggagatgtctctgtgctagtttctttgcttccaacagaggagaggaagcatggaaactagcaacctggcggcagcgcaaaagatg

SEQ ID NO: 16068 - DNA, 103 bp, Artificial Sequence
  Synthetic Polynucleotide
taatacgactcactatagggccactagatgtctctgtgctagtttctttgaacagaggagacaaagaatgtagcacagaaacctggcggcagcgcaaaagatg

SEQ ID NO: 16069 - DNA, 103 bp, Artificial Sequence
  Synthetic Polynucleotide
taatacgactcactatagggttctgccactagatgtctctgtgctagtttaacagaggagaaaactaatgcagagacataacctggcggcagcgcaaaagatg

SEQ ID NO: 16070 - DNA, 103 bp, Artificial Sequence
  Synthetic Polynucleotide
taatacgactcactatagggccagtttctgccactagatgtctctgtgctaacagaggagaagcacaatgacatctagtaacctggcggcagcgcaaaagatg

SEQ ID NO: 16071 - DNA, 103 bp, Artificial Sequence
  Synthetic Polynucleotide
taatacgactcactatagggcagttccagtttctgccactagatgtctctaacagaggagaagagacatgtagtggcagaacctggcggcagcgcaaaagatg

SEQ ID NO: 16072 - DNA, 103 bp, Artificial Sequence
  Synthetic Polynucleotide
taatacgactcactatagggctctgcagttccagtttctgccactagatgaacagaggagacatctaatggcagaaactaacctggcggcagcgcaaaagatg

SEQ ID NO: 16073 - DNA, 103 bp, Artificial Sequence
  Synthetic Polynucleotide
taatacgactcactatagggattttctctgcagttccagtttctgccactaacagaggagaagtggcatgaactggaacaacctggcggcagcgcaaaagatg

SEQ ID NO: 16074 - DNA, 103 bp, Artificial Sequence
  Synthetic Polynucleotide
taatacgactcactatagggttggcattttctctgcagttccagtttctgaacagaggagacagaaaatggaactgcagaacctggcggcagcgcaaaagatg

SEQ ID NO: 16075 - DNA, 103 bp, Artificial Sequence
  Synthetic Polynucleotide
taatacgactcactatagggtgtatttggcattttctctgcagttccagtaacagaggagaactggaatggcagagaaaaacctggcggcagcgcaaaagatg

SEQ ID NO: 16076 - DNA, 103 bp, Artificial Sequence
  Synthetic Polynucleotide
taatacgactcactatagggctacttgtatttggcattttctctgcagttaacagaggagaaactgcatggaaaatgccaacctggcggcagcgcaaaagatg

SEQ ID NO: 16077 - DNA, 103 bp, Artificial Sequence
  Synthetic Polynucleotide
taatacgactcactatagggctcttgtgagagttctactgatactagcttaacagaggagaaagctaatgtcagtagaaaacctggcggcagcgcaaaagatg

SEQ ID NO: 16078 - DNA, 103 bp, Artificial Sequence
  Synthetic Polynucleotide
taatacgactcactatagggttggtctacttgtatttggcattttctctgaacagaggagacagagaatgtgccaaataaacctggcggcagcgcaaaagatg

SEQ ID NO: 16079 - DNA, 103 bp, Artificial Sequence
  Synthetic Polynucleotide
taatacgactcactatagggtgctgttggtctacttgtatttggcattttaacagaggagaaaaatgatgaatacaagtaacctggcggcagcgcaaaagatg

SEQ ID NO: 16080 - DNA, 103 bp, Artificial Sequence
  Synthetic Polynucleotide
taatacgactcactatagggggtggtgctgttggtctacttgtatttggcaacagaggagagccaaaatgaagtagaccaacctggcggcagcgcaaaagatg

SEQ ID NO: 16081 - DNA, 103 bp, Artificial Sequence
  Synthetic Polynucleotide
taatacgactcactatagggcactaggtggtgctgttggtctacttgtataacagaggagaatacaaatggaccaacagaacctggcggcagcgcaaaagatg

SEQ ID NO: 16082 - DNA, 103 bp, Artificial Sequence
  Synthetic Polynucleotide
taatacgactcactatagggtttcccactaggtggtgctgttggtctactaacagaggagaagtagaatgacagcaccaaacctggcggcagcgcaaaagatg

SEQ ID NO: 16083 - DNA, 103 bp, Artificial Sequence
  Synthetic Polynucleotide
taatacgactcactatagggcctcttttcccactaggtggtgctgttggtaacagaggagaaccaacatgaccacctagaacctggcggcagcgcaaaagatg

SEQ ID NO: 16084 - DNA, 103 bp, Artificial Sequence
  Synthetic Polynucleotide
taatacgactcactatagggagtttcctcttttcccactaggtggtgctgaacagaggagacagcacatgctagtgggaaacctggcggcagcgcaaaagatg

SEQ ID NO: 16085 - DNA, 103 bp, Artificial Sequence
  Synthetic Polynucleotide
taatacgactcactatagggggggtagtttcctcttttcccactaggtggaacagaggagaccacctatggggaaaagaaacctggcggcagcgcaaaagatg

SEQ ID NO: 16086 - DNA, 103 bp, Artificial Sequence
  Synthetic Polynucleotide
taatacgactcactatagggtgcacggggtagtttcctcttttcccactaaacagaggagatagtggatgaagaggaaaaacctggcggcagcgcaaaagatg

SEQ ID NO: 16087 - DNA, 103 bp, Artificial Sequence
  Synthetic Polynucleotide
taatacgactcactatagggcttgttgcacggggtagtttcctcttttccaacagaggagaggaaaaatggaaactaccaacctggcggcagcgcaaaagatg

SEQ ID NO: 16088 - DNA, 103 bp, Artificial Sequence
  Synthetic Polynucleotide
taatacgactcactatagggaggattctatgtctcctcctactgtaaaacaacagaggagagttttaatgtaggaggagaacctggcggcagcgcaaaagatg

SEQ ID NO: 16089 - DNA, 103 bp, Artificial Sequence
  Synthetic Polynucleotide
taatacgactcactatagggtctgcctcttgtgagagttctactgatactaacagaggagaagtatcatgagaactctcaacctggcggcagcgcaaaagatg

SEQ ID NO: 16090 - DNA, 103 bp, Artificial Sequence
  Synthetic Polynucleotide
taatacgactcactatagggacccgcttgttgcacggggtagtttcctctaacagaggagaagaggaatgtaccccgtgaacctggcggcagcgcaaaagatg

SEQ ID NO: 16091 - DNA, 103 bp, Artificial Sequence
  Synthetic Polynucleotide
taatacgactcactatagggttgccacccgcttgttgcacggggtagtttaacagaggagaaaactaatgcgtgcaacaaacctggcggcagcgcaaaagatg

SEQ ID NO: 16092 - DNA, 103 bp, Artificial Sequence
  Synthetic Polynucleotide
taatacgactcactatagggcatagttgccacccgcttgttgcacggggtaacagaggagaaccccgatgaacaagcggaacctggcggcagcgcaaaagatg

SEQ ID NO: 16093 - DNA, 103 bp, Artificial Sequence
  Synthetic Polynucleotide
taatacgactcactatagggatggacatagttgccacccgcttgttgcacaacagaggagagtgcaaatggcgggtggcaacctggcggcagcgcaaaagatg

SEQ ID NO: 16094 - DNA, 103 bp, Artificial Sequence
  Synthetic Polynucleotide
taatacgactcactatagggggcacatggacatagttgccacccgcttgtaacagaggagaacaagcatgtggcaactaaacctggcggcagcgcaaaagatg

SEQ ID NO: 16095 - DNA, 103 bp, Artificial Sequence
  Synthetic Polynucleotide
taatacgactcactatagggtcagtggcacatggacatagttgccacccgaacagaggagacgggtgatgactatgtccaacctggcggcagcgcaaaagatg

SEQ ID NO: 16096 - DNA, 103 bp, Artificial Sequence
  Synthetic Polynucleotide
taatacgactcactatagggggggctcagtggcacatggacatagttgccaacagaggagaggcaacatggtccatgtgaacctggcggcagcgcaaaagatg

SEQ ID NO: 16097 - DNA, 103 bp, Artificial Sequence
  Synthetic Polynucleotide
taatacgactcactataggggttcgggggctcagtggcacatggacatagaacagaggagactatgtatgtgtgccactaacctggcggcagcgcaaaagatg

SEQ ID NO: 16098 - DNA, 103 bp, Artificial Sequence
  Synthetic Polynucleotide
taatacgactcactatagggttagagttcgggggctcagtggcacatggaaacagaggagatccatgatgcactgagccaacctggcggcagcgcaaaagatg

SEQ ID NO: 16099 - DNA, 103 bp, Artificial Sequence
  Synthetic Polynucleotide
taatacgactcactatagggtgcatttagagttcgggggctcagtggcacaacagaggagagtgccaatgagcccccgaaacctggcggcagcgcaaaagatg

SEQ ID NO: 16100 - DNA, 103 bp, Artificial Sequence
  Synthetic Polynucleotide
taatacgactcactatagggcttcctctgcctcttgtgagagttctactgaacagaggagacagtagatgtctcacaagaacctggcggcagcgcaaaagatg

SEQ ID NO: 16101 - DNA, 103 bp, Artificial Sequence
  Synthetic Polynucleotide
taatacgactcactatagggacccatgcatttagagttcgggggctcagtaacagaggagaactgagatgccgaactctaacctggcggcagcgcaaaagatg

SEQ ID NO: 16102 - DNA, 103 bp, Artificial Sequence
  Synthetic Polynucleotide
taatacgactcactatagggattttacccatgcatttagagttcgggggcaacagaggagagcccccatgctctaaatgaacctggcggcagcgcaaaagatg

SEQ ID NO: 16103 - DNA, 103 bp, Artificial Sequence
  Synthetic Polynucleotide
taatacgactcactatagggcactaattttacccatgcatttagagttcgaacagaggagacgaactatgaatgcatggaacctggcggcagcgcaaaagatg

SEQ ID NO: 16104 - DNA, 103 bp, Artificial Sequence
  Synthetic Polynucleotide
taatacgactcactatagggtcctccactaattttacccatgcatttagaaacagaggagatctaaaatgatgggtaaaaacctggcggcagcgcaaaagatg

SEQ ID NO: 16105 - DNA, 103 bp, Artificial Sequence
  Synthetic Polynucleotide
taatacgactcactatagggtcttttcctccactaattttacccatgcataacagaggagaatgcatatgtaaaattagaacctggcggcagcgcaaaagatg

SEQ ID NO: 16106 - DNA, 103 bp, Artificial Sequence
  Synthetic Polynucleotide
taatacgactcactataggggaacttcttttcctccactaattttacccaaacagaggagatgggtaatgttagtggagaacctggcggcagcgcaaaagatg

SEQ ID NO: 16107 - DNA, 103 bp, Artificial Sequence
  Synthetic Polynucleotide
taatacgactcactataggggccccgaacttcttttcctccactaattttaacagaggagaaaaattatgggaggaaaaaacctggcggcagcgcaaaagatg

SEQ ID NO: 16108 - DNA, 103 bp, Artificial Sequence
  Synthetic Polynucleotide
taatacgactcactatagggcttctgccccgaacttcttttcctccactaaacagaggagatagtggatgaaaagaagtaacctggcggcagcgcaaaagatg

SEQ ID NO: 16109 - DNA, 103 bp, Artificial Sequence
  Synthetic Polynucleotide
taatacgactcactatagggcactacttctgccccgaacttcttttcctcaacagaggagagaggaaatgaagttcgggaacctggcggcagcgcaaaagatg

SEQ ID NO: 16110 - DNA, 103 bp, Artificial Sequence
  Synthetic Polynucleotide
taatacgactcactatagggcctggcactacttctgccccgaacttctttaacagaggagaaaagaaatgcggggcagaaacctggcggcagcgcaaaagatg

SEQ ID NO: 16111 - DNA, 103 bp, Artificial Sequence
  Synthetic Polynucleotide
taatacgactcactatagggctcatcttcctctgcctcttgtgagagttcaacagaggagagaactcatgcaagaggcaaacctggcggcagcgcaaaagatg

SEQ ID NO: 16112 - DNA, 103 bp, Artificial Sequence
  Synthetic Polynucleotide
taatacgactcactataggggaaatcctggcactacttctgccccgaactaacagaggagaagttcgatgcagaagtagaacctggcggcagcgcaaaagatg

SEQ ID NO: 16113 - DNA, 103 bp, Artificial Sequence
  Synthetic Polynucleotide
taatacgactcactatagggtgcctgaaatcctggcactacttctgccccaacagaggagaggggcaatggtagtgccaaacctggcggcagcgcaaaagatg

SEQ ID NO: 16114 - DNA, 103 bp, Artificial Sequence
  Synthetic Polynucleotide
taatacgactcactataggggagagtgcctgaaatcctggcactacttctaacagaggagaagaagtatggccaggattaacctggcggcagcgcaaaagatg

SEQ ID NO: 16115 - DNA, 103 bp, Artificial Sequence
  Synthetic Polynucleotide
taatacgactcactatagggcttctgagagtgcctgaaatcctggcactaaacagaggagatagtgcatggatttcaggaacctggcggcagcgcaaaagatg

SEQ ID NO: 16116 - DNA, 103 bp, Artificial Sequence
  Synthetic Polynucleotide
taatacgactcactataggggcagccttctgagagtgcctgaaatcctggaacagaggagaccaggaatgcaggcactcaacctggcggcagcgcaaaagatg

SEQ ID NO: 16117 - DNA, 103 bp, Artificial Sequence
  Synthetic Polynucleotide
taatacgactcactatagggggcgtgcagccttctgagagtgcctgaaataacagaggagaatttcaatgactctcagaaacctggcggcagcgcaaaagatg

SEQ ID NO: 16118 - DNA, 103 bp, Artificial Sequence
  Synthetic Polynucleotide
taatacgactcactatagggcatagggcgtgcagccttctgagagtgcctaacagaggagaaggcacatgcagaaggctaacctggcggcagcgcaaaagatg

SEQ ID NO: 16119 - DNA, 103 bp, Artificial Sequence
  Synthetic Polynucleotide
taatacgactcactatagggaatatcatagggcgtgcagccttctgagagaacagaggagactctcaatgggctgcacgaacctggcggcagcgcaaaagatg

SEQ ID NO: 16120 - DNA, 103 bp, Artificial Sequence
  Synthetic Polynucleotide
taatacgactcactatagggtgattaatatcatagggcgtgcagccttctaacagaggagaagaaggatgcacgccctaaacctggcggcagcgcaaaagatg

SEQ ID NO: 16121 - DNA, 103 bp, Artificial Sequence
  Synthetic Polynucleotide
taatacgactcactataggggcatttgattaatatcatagggcgtgcagcaacagaggagagctgcaatgcctatgataaacctggcggcagcgcaaaagatg

SEQ ID NO: 16122 - DNA, 103 bp, Artificial Sequence
  Synthetic Polynucleotide
taatacgactcactatagggttggcctcatcttcctctgcctcttgtgagaacagaggagactcacaatgggcagaggaaacctggcggcagcgcaaaagatg

SEQ ID NO: 16123 - DNA, 103 bp, Artificial Sequence
  Synthetic Polynucleotide
taatacgactcactatagggattaagcatttgattaatatcatagggcgtaacagaggagaacgcccatggatattaataacctggcggcagcgcaaaagatg

SEQ ID NO: 16124 - DNA, 103 bp, Artificial Sequence
  Synthetic Polynucleotide
taatacgactcactatagggacacaattaagcatttgattaatatcatagaacagaggagactatgaatgtaatcaaataacctggcggcagcgcaaaagatg

SEQ ID NO: 16125 - DNA, 103 bp, Artificial Sequence
  Synthetic Polynucleotide
taatacgactcactatagggcgcccacacaattaagcatttgattaatataacagaggagaatattaatgaaatgcttaaacctggcggcagcgcaaaagatg

SEQ ID NO: 16126 - DNA, 103 bp, Artificial Sequence
  Synthetic Polynucleotide
taatacgactcactataggggtgatcgcccacacaattaagcatttgattaacagaggagaaatcaaatgcttaattgtaacctggcggcagcgcaaaagatg

SEQ ID NO: 16127 - DNA, 103 bp, Artificial Sequence
  Synthetic Polynucleotide
taatacgactcactataggggcttggtgatcgcccacacaattaagcattaacagaggagaaatgctatgttgtgtgggaacctggcggcagcgcaaaagatg

SEQ ID NO: 16128 - DNA, 103 bp, Artificial Sequence
  Synthetic Polynucleotide
taatacgactcactatagggtagctgcttggtgatcgcccacacaattaaaacagaggagattaattatgtgggcgatcaacctggcggcagcgcaaaagatg

SEQ ID NO: 16129 - DNA, 103 bp, Artificial Sequence
  Synthetic Polynucleotide
taatacgactcactatagggttgcatagctgcttggtgatcgcccacacaaacagaggagatgtgtgatggatcaccaaaacctggcggcagcgcaaaagatg

SEQ ID NO: 16130 - DNA, 103 bp, Artificial Sequence
  Synthetic Polynucleotide
taatacgactcactatagggattatttgcatagctgcttggtgatcgcccaacagaggagagggcgaatgccaagcagcaacctggcggcagcgcaaaagatg

SEQ ID NO: 16131 - DNA, 103 bp, Artificial Sequence
  Synthetic Polynucleotide
taatacgactcactatagggctctgattatttgcatagctgcttggtgataacagaggagaatcaccatgcagctatgcaacctggcggcagcgcaaaagatg

SEQ ID NO: 16132 - DNA, 103 bp, Artificial Sequence
  Synthetic Polynucleotide
taatacgactcactatagggaatctctctgattatttgcatagctgcttgaacagaggagacaagcaatgatgcaaataaacctggcggcagcgcaaaagatg

SEQ ID NO: 16133 - DNA, 103 bp, Artificial Sequence
  Synthetic Polynucleotide
taatacgactcactatagggagcagttggcctcatcttcctctgcctcttaacagaggagaaagaggatgaggaagatgaacctggcggcagcgcaaaagatg

SEQ ID NO: 16134 - DNA, 103 bp, Artificial Sequence
  Synthetic Polynucleotide
taatacgactcactatagggttaataatctctctgattatttgcatagctaacagaggagaagctatatgaataatcagaacctggcggcagcgcaaaagatg

SEQ ID NO: 16135 - DNA, 103 bp, Artificial Sequence
  Synthetic Polynucleotide
taatacgactcactatagggcttcattaataatctctctgattatttgcaaacagaggagatgcaaaatgtcagagagaaacctggcggcagcgcaaaagatg

SEQ ID NO: 16136 - DNA, 103 bp, Artificial Sequence
  Synthetic Polynucleotide
taatacgactcactatagggtgcttcttcattaataatctctctgattataacagaggagaataatcatggagattattaacctggcggcagcgcaaaagatg

SEQ ID NO: 16137 - DNA, 103 bp, Artificial Sequence
  Synthetic Polynucleotide
taatacgactcactatagggtctgctgcttcttcattaataatctctctgaacagaggagacagagaatgtattaatgaaacctggcggcagcgcaaaagatg

SEQ ID NO: 16138 - DNA, 103 bp, Artificial Sequence
  Synthetic Polynucleotide
taatacgactcactatagggcccagtctgctgcttcttcattaataatctaacagaggagaagattaatgatgaagaagaacctggcggcagcgcaaaagatg

SEQ ID NO: 16139 - DNA, 103 bp, Artificial Sequence
  Synthetic Polynucleotide
taatacgactcactatagggcgaatcccagtctgctgcttcttcattaataacagaggagaattaatatggaagcagcaaacctggcggcagcgcaaaagatg

SEQ ID NO: 16140 - DNA, 103 bp, Artificial Sequence
  Synthetic Polynucleotide
taatacgactcactatagggtgctgcgaatcccagtctgctgcttcttcaaacagaggagatgaagaatgagcagactgaacctggcggcagcgcaaaagatg

SEQ ID NO: 16141 - DNA, 103 bp, Artificial Sequence
  Synthetic Polynucleotide
taatacgactcactatagggttgggtgctgcgaatcccagtctgctgcttaacagaggagaaagcagatgactgggattaacctggcggcagcgcaaaagatg

SEQ ID NO: 16142 - DNA, 103 bp, Artificial Sequence
  Synthetic Polynucleotide
taatacgactcactatagggtggtattgggtgctgcgaatcccagtctgcaacagaggagagcagacatggattcgcagaacctggcggcagcgcaaaagatg

SEQ ID NO: 16143 - DNA, 103 bp, Artificial Sequence
  Synthetic Polynucleotide
taatacgactcactataggggggcctggtattgggtgctgcgaatcccagaacagaggagactgggaatggcagcacccaacctggcggcagcgcaaaagatg

SEQ ID NO: 16144 - DNA, 103 bp, Artificial Sequence
  Synthetic Polynucleotide
taatacgactcactatagggtactaagcagttggcctcatcttcctctgcaacagaggagagcagagatggatgaggccaacctggcggcagcgcaaaagatg

SEQ ID NO: 16145 - DNA, 103 bp, Artificial Sequence
  Synthetic Polynucleotide
taatacgactcactataggggtaaggggcctggtattgggtgctgcgaataacagaggagaattcgcatgacccaatacaacctggcggcagcgcaaaagatg

SEQ ID NO: 16146 - DNA, 103 bp, Artificial Sequence
  Synthetic Polynucleotide
taatacgactcactatagggtgctggtaaggggcctggtattgggtgctgaacagaggagacagcacatgataccaggcaacctggcggcagcgcaaaagatg

SEQ ID NO: 16147 - DNA, 103 bp, Artificial Sequence
  Synthetic Polynucleotide
taatacgactcactatagggtgtcctgctggtaaggggcctggtattgggaacagaggagacccaatatgaggccccttaacctggcggcagcgcaaaagatg

SEQ ID NO: 16148 - DNA, 103 bp, Artificial Sequence
  Synthetic Polynucleotide
taatacgactcactatagggtgagctgtcctgctggtaaggggcctggtaaacagaggagataccagatgccttaccagaacctggcggcagcgcaaaagatg

SEQ ID NO: 16149 - DNA, 103 bp, Artificial Sequence
  Synthetic Polynucleotide
taatacgactcactataggggtctctgagctgtcctgctggtaaggggccaacagaggagaggccccatgccagcaggaaacctggcggcagcgcaaaagatg

SEQ ID NO: 16150 - DNA, 103 bp, Artificial Sequence
  Synthetic Polynucleotide
taatacgactcactatagggcttgggtctctgagctgtcctgctggtaagaacagaggagacttaccatgaggacagctaacctggcggcagcgcaaaagatg

SEQ ID NO: 16151 - DNA, 103 bp, Artificial Sequence
  Synthetic Polynucleotide
taatacgactcactatagggaccctcttgggtctctgagctgtcctgctgaacagaggagacagcagatgagctcagagaacctggcggcagcgcaaaagatg

SEQ ID NO: 16152 - DNA, 103 bp, Artificial Sequence
  Synthetic Polynucleotide
taatacgactcactataggggtcagaccctcttgggtctctgagctgtccaacagaggagaggacagatgagagacccaaacctggcggcagcgcaaaagatg

SEQ ID NO: 16153 - DNA, 103 bp, Artificial Sequence
  Synthetic Polynucleotide
taatacgactcactataggggctatgtcagaccctcttgggtctctgagcaacagaggagagctcagatgcccaagaggaacctggcggcagcgcaaaagatg

SEQ ID NO: 16154 - DNA, 103 bp, Artificial Sequence
  Synthetic Polynucleotide
taatacgactcactatagggttcctgctatgtcagaccctcttgggtctcaacagaggagagagaccatggagggtctgaacctggcggcagcgcaaaagatg

SEQ ID NO: 16155 - DNA, 103 bp, Artificial Sequence
  Synthetic Polynucleotide
taatacgactcactataggggggtgtactaagcagttggcctcatcttccaacagaggagaggaagaatgggccaactgaacctggcggcagcgcaaaagatg

SEQ ID NO: 16156 - DNA, 103 bp, Artificial Sequence
  Synthetic Polynucleotide
taatacgactcactatagggtgttgttcctgctatgtcagaccctcttggaacagaggagaccaagaatgtctgacataaacctggcggcagcgcaaaagatg

SEQ ID NO: 16157 - DNA, 103 bp, Artificial Sequence
  Synthetic Polynucleotide
taatacgactcactataggggtgcttgttgttcctgctatgtcagaccctaacagaggagaagggtcatgcatagcaggaacctggcggcagcgcaaaagatg

SEQ ID NO: 16158 - DNA, 103 bp, Artificial Sequence
  Synthetic Polynucleotide
taatacgactcactatagggctactgtgcttgttgttcctgctatgtcagaacagaggagactgacaatgcaggaacaaaacctggcggcagcgcaaaagatg

SEQ ID NO: 16159 - DNA, 103 bp, Artificial Sequence
  Synthetic Polynucleotide
taatacgactcactatagggttcatctactgtgcttgttgttcctgctataacagaggagaatagcaatgacaacaagcaacctggcggcagcgcaaaagatg

SEQ ID NO: 16160 - DNA, 103 bp, Artificial Sequence
  Synthetic Polynucleotide
taatacgactcactatagggatctgttcatctactgtgcttgttgttcctaacagaggagaaggaacatgaagcacagtaacctggcggcagcgcaaaagatg

SEQ ID NO: 16161 - DNA, 103 bp, Artificial Sequence
  Synthetic Polynucleotide
taatacgactcactatagggactggatctgttcatctactgtgcttgttgaacagaggagacaacaaatgcagtagatgaacctggcggcagcgcaaaagatg

SEQ ID NO: 16162 - DNA, 103 bp, Artificial Sequence
  Synthetic Polynucleotide
taatacgactcactatagggcatccactggatctgttcatctactgtgctaacagaggagaagcacaatggatgaacagaacctggcggcagcgcaaaagatg

SEQ ID NO: 16163 - DNA, 103 bp, Artificial Sequence
  Synthetic Polynucleotide
taatacgactcactatagggctatacatccactggatctgttcatctactaacagaggagaagtagaatgacagatccaaacctggcggcagcgcaaaagatg

SEQ ID NO: 16164 - DNA, 103 bp, Artificial Sequence
  Synthetic Polynucleotide
taatacgactcactataggggtggcctatacatccactggatctgttcataacagaggagaatgaacatgtccagtggaaacctggcggcagcgcaaaagatg

SEQ ID NO: 16165 - DNA, 103 bp, Artificial Sequence
  Synthetic Polynucleotide
taatacgactcactatagggattttgtggcctatacatccactggatctgaacagaggagacagatcatgtggatgtataacctggcggcagcgcaaaagatg

SEQ ID NO: 16166 - DNA, 103 bp, Artificial Sequence
  Synthetic Polynucleotide
taatacgactcactataggggtgctgggtgtactaagcagttggcctcataacagaggagaatgaggatgactgcttagaacctggcggcagcgcaaaagatg

SEQ ID NO: 16167 - DNA, 103 bp, Artificial Sequence
  Synthetic Polynucleotide
taatacgactcactatagggacgggattttgtggcctatacatccactggaacagaggagaccagtgatggtataggccaacctggcggcagcgcaaaagatg

SEQ ID NO: 16168 - DNA, 103 bp, Artificial Sequence
  Synthetic Polynucleotide
taatacgactcactatagggccggtacgggattttgtggcctatacatccaacagaggagaggatgtatgggccacaaaaacctggcggcagcgcaaaagatg

SEQ ID NO: 16169 - DNA, 103 bp, Artificial Sequence
  Synthetic Polynucleotide
taatacgactcactatagggccctaccggtacgggattttgtggcctataaacagaggagatataggatgcaaaatcccaacctggcggcagcgcaaaagatg

SEQ ID NO: 16170 - DNA, 103 bp, Artificial Sequence
  Synthetic Polynucleotide
taatacgactcactatagggatgttccctaccggtacgggattttgtggcaacagaggagagccacaatgtcccgtaccaacctggcggcagcgcaaaagatg

SEQ ID NO: 16171 - DNA, 103 bp, Artificial Sequence
  Synthetic Polynucleotide
taatacgactcactatagggtgtagatgttccctaccggtacgggattttaacagaggagaaaaatcatgtaccggtagaacctggcggcagcgcaaaagatg

SEQ ID NO: 16172 - DNA, 103 bp, Artificial Sequence
  Synthetic Polynucleotide
taatacgactcactatagggtcttctgtagatgttccctaccggtacgggaacagaggagacccgtaatggtagggaacaacctggcggcagcgcaaaagatg

SEQ ID NO: 16173 - DNA, 103 bp, Artificial Sequence
  Synthetic Polynucleotide
taatacgactcactatagggatccatcttctgtagatgttccctaccggtaacagaggagaaccggtatggaacatctaaacctggcggcagcgcaaaagatg

SEQ ID NO: 16174 - DNA, 103 bp, Artificial Sequence
  Synthetic Polynucleotide
taatacgactcactatagggtttggatccatcttctgtagatgttccctaaacagaggagatagggaatgtctacagaaaacctggcggcagcgcaaaagatg

SEQ ID NO: 16175 - DNA, 103 bp, Artificial Sequence
  Synthetic Polynucleotide
taatacgactcactatagggccctatttggatccatcttctgtagatgttaacagaggagaaacatcatgagaagatggaacctggcggcagcgcaaaagatg

SEQ ID NO: 16176 - DNA, 103 bp, Artificial Sequence
  Synthetic Polynucleotide
taatacgactcactatagggtgcagccctatttggatccatcttctgtagaacagaggagactacagatgatggatccaaacctggcggcagcgcaaaagatg

SEQ ID NO: 16177 - DNA, 103 bp, Artificial Sequence
  Synthetic Polynucleotide
taatacgactcactatagggtgtttgtgctgggtgtactaagcagttggcaacagaggagagccaacatgttagtacacaacctggcggcagcgcaaaagatg

SEQ ID NO: 16178 - DNA, 103 bp, Artificial Sequence
  Synthetic Polynucleotide
taatacgactcactatagggacttttgcagccctatttggatccatcttcaacagaggagagaagatatgtccaaatagaacctggcggcagcgcaaaagatg

SEQ ID NO: 16179 - DNA, 103 bp, Artificial Sequence
  Synthetic Polynucleotide
taatacgactcactataggggacacacttttgcagccctatttggatccaaacagaggagatggatcatgatagggctgaacctggcggcagcgcaaaagatg

SEQ ID NO: 16180 - DNA, 103 bp, Artificial Sequence
  Synthetic Polynucleotide
taatacgactcactatagggtttctgacacacttttgcagccctatttggaacagaggagaccaaatatggctgcaaaaaacctggcggcagcgcaaaagatg

SEQ ID NO: 16181 - DNA, 103 bp, Artificial Sequence
  Synthetic Polynucleotide
taatacgactcactatagggtgtactttctgacacacttttgcagccctaaacagaggagatagggcatgaaaagtgtgaacctggcggcagcgcaaaagatg

SEQ ID NO: 16182 - DNA, 103 bp, Artificial Sequence
  Synthetic Polynucleotide
taatacgactcactatagggtgggttgtactttctgacacacttttgcagaacagaggagactgcaaatgtgtgtcagaaacctggcggcagcgcaaaagatg

SEQ ID NO: 16183 - DNA, 103 bp, Artificial Sequence
  Synthetic Polynucleotide
taatacgactcactatagggttagttgggttgtactttctgacacactttaacagaggagaaaagtgatgcagaaagtaaacctggcggcagcgcaaaagatg

SEQ ID NO: 16184 - DNA, 103 bp, Artificial Sequence
  Synthetic Polynucleotide
taatacgactcactatagggagatgttagttgggttgtactttctgacacaacagaggagagtgtcaatgagtacaaccaacctggcggcagcgcaaaagatg

SEQ ID NO: 16185 - DNA, 103 bp, Artificial Sequence
  Synthetic Polynucleotide
taatacgactcactataggggtctaagatgttagttgggttgtactttctaacagaggagaagaaagatgaacccaactaacctggcggcagcgcaaaagatg

SEQ ID NO: 16186 - DNA, 103 bp, Artificial Sequence
  Synthetic Polynucleotide
taatacgactcactatagggtttatgtctaagatgttagttgggttgtacaacagaggagagtacaaatgaactaacataacctggcggcagcgcaaaagatg

SEQ ID NO: 16187 - DNA, 103 bp, Artificial Sequence
  Synthetic Polynucleotide
taatacgactcactatagggcctgttttatgtctaagatgttagttgggtaacagaggagaacccaaatgacatcttagaacctggcggcagcgcaaaagatg

SEQ ID NO: 16188 - DNA, 103 bp, Artificial Sequence
  Synthetic Polynucleotide
taatacgactcactatagggctgcttgtttgtgctgggtgtactaagcagaacagaggagactgcttatgacacccagcaacctggcggcagcgcaaaagatg

SEQ ID NO: 16189 - DNA, 103 bp, Artificial Sequence
  Synthetic Polynucleotide
taatacgactcactatagggtggtccctgttttatgtctaagatgttagtaacagaggagaactaacatgttagacataaacctggcggcagcgcaaaagatg

SEQ ID NO: 16190 - DNA, 103 bp, Artificial Sequence
  Synthetic Polynucleotide
taatacgactcactatagggtcttttggtccctgttttatgtctaagatgaacagaggagacatcttatgcataaaacaaacctggcggcagcgcaaaagatg

SEQ ID NO: 16191 - DNA, 103 bp, Artificial Sequence
  Synthetic Polynucleotide
taatacgactcactatagggacggttcttttggtccctgttttatgtctaaacagaggagatagacaatgaacagggacaacctggcggcagcgcaaaagatg

SEQ ID NO: 16192 - DNA, 103 bp, Artificial Sequence
  Synthetic Polynucleotide
taatacgactcactatagggttggaacggttcttttggtccctgttttataacagaggagaataaaaatgggaccaaaaaacctggcggcagcgcaaaagatg

SEQ ID NO: 16193 - DNA, 103 bp, Artificial Sequence
  Synthetic Polynucleotide
taatacgactcactatagggtagctttggaacggttcttttggtccctgtaacagaggagaacagggatgaaaagaaccaacctggcggcagcgcaaaagatg

SEQ ID NO: 16194 - DNA, 103 bp, Artificial Sequence
  Synthetic Polynucleotide
taatacgactcactatagggctacatagctttggaacggttcttttggtcaacagaggagagaccaaatgaaccgttccaacctggcggcagcgcaaaagatg

SEQ ID NO: 16195 - DNA, 103 bp, Artificial Sequence
  Synthetic Polynucleotide
taatacgactcactatagggcctgtctacatagctttggaacggttctttaacagaggagaaaagaaatgttccaaagcaacctggcggcagcgcaaaagatg

SEQ ID NO: 16196 - DNA, 103 bp, Artificial Sequence
  Synthetic Polynucleotide
taatacgactcactatagggtagaacctgtctacatagctttggaacggtaacagaggagaaccgttatgaagctatgtaacctggcggcagcgcaaaagatg

SEQ ID NO: 16197 - DNA, 103 bp, Artificial Sequence
  Synthetic Polynucleotide
taatacgactcactatagggttttgtagaacctgtctacatagctttggaaacagaggagatccaaaatgatgtagacaaacctggcggcagcgcaaaagatg

SEQ ID NO: 16198 - DNA, 103 bp, Artificial Sequence
  Synthetic Polynucleotide
taatacgactcactatagggcaagcttttgtagaacctgtctacatagctaacagaggagaagctatatggacaggttcaacctggcggcagcgcaaaagatg

SEQ ID NO: 16199 - DNA, 103 bp, Artificial Sequence
  Synthetic Polynucleotide
taatacgactcactatagggtgtctaggattctatgtctcctcctactgtaacagaggagaacagtaatgggagacataaacctggcggcagcgcaaaagatg

SEQ ID NO: 16200 - DNA, 103 bp, Artificial Sequence
  Synthetic Polynucleotide
taatacgactcactatagggcatgtctgcttgtttgtgctgggtgtactaaacagaggagatagtacatgcagcacaaaaacctggcggcagcgcaaaagatg

SEQ ID NO: 16201 - DNA, 103 bp, Artificial Sequence
  Synthetic Polynucleotide
taatacgactcactataggggccctcaagcttttgtagaacctgtctacaaacagaggagatgtagaatggttctacaaaacctggcggcagcgcaaaagatg

SEQ ID NO: 16202 - DNA, 103 bp, Artificial Sequence
  Synthetic Polynucleotide
taatacgactcactataggggttctgccctcaagcttttgtagaacctgtaacagaggagaacaggtatgacaaaagctaacctggcggcagcgcaaaagatg

SEQ ID NO: 16203 - DNA, 103 bp, Artificial Sequence
  Synthetic Polynucleotide
taatacgactcactatagggtgtttgttctgccctcaagcttttgtagaaaacagaggagattctacatgagcttgaggaacctggcggcagcgcaaaagatg

SEQ ID NO: 16204 - DNA, 103 bp, Artificial Sequence
  Synthetic Polynucleotide
taatacgactcactataggggggtctgtttgttctgccctcaagcttttgaacagaggagacaaaagatggagggcagaaacctggcggcagcgcaaaagatg

SEQ ID NO: 16205 - DNA, 103 bp, Artificial Sequence
  Synthetic Polynucleotide
taatacgactcactatagggctgctgggtctgtttgttctgccctcaagcaacagaggagagcttgaatgcagaacaaaaacctggcggcagcgcaaaagatg

SEQ ID NO: 16206 - DNA, 103 bp, Artificial Sequence
  Synthetic Polynucleotide
taatacgactcactatagggttttactgctgggtctgtttgttctgccctaacagaggagaagggcaatgcaaacagacaacctggcggcagcgcaaaagatg

SEQ ID NO: 16207 - DNA, 103 bp, Artificial Sequence
  Synthetic Polynucleotide
taatacgactcactatagggcaattttttactgctgggtctgtttgttctaacagaggagaagaacaatgagacccagcaacctggcggcagcgcaaaagatg

SEQ ID NO: 16208 - DNA, 103 bp, Artificial Sequence
  Synthetic Polynucleotide
taatacgactcactatagggtcatccaattttttactgctgggtctgtttaacagaggagaaaacagatgcagcagtaaaacctggcggcagcgcaaaagatg

SEQ ID NO: 16209 - DNA, 103 bp, Artificial Sequence
  Synthetic Polynucleotide
taatacgactcactatagggttgggtcatccaattttttactgctgggtcaacagaggagagacccaatggtaaaaaataacctggcggcagcgcaaaagatg

SEQ ID NO: 16210 - DNA, 103 bp, Artificial Sequence
  Synthetic Polynucleotide
taatacgactcactatagggagcgtttgggtcatccaattttttactgctaacagaggagaagcagtatgaaattggataacctggcggcagcgcaaaagatg

SEQ ID NO: 16211 - DNA, 103 bp, Artificial Sequence
  Synthetic Polynucleotide
taatacgactcactatagggatcatcatgtctgcttgtttgtgctgggtgaacagaggagacacccaatgcaaacaagcaacctggcggcagcgcaaaagatg

SEQ ID NO: 16212 - DNA, 103 bp, Artificial Sequence
  Synthetic Polynucleotide
taatacgactcactatagggttagcagcgtttgggtcatccaattttttaaacagaggagataaaaaatgggatgacccaacctggcggcagcgcaaaagatg

SEQ ID NO: 16213 - DNA, 103 bp, Artificial Sequence
  Synthetic Polynucleotide
taatacgactcactatagggctgtattagcagcgtttgggtcatccaattaacagaggagaaattggatgacccaaacgaacctggcggcagcgcaaaagatg

SEQ ID NO: 16214 - DNA, 103 bp, Artificial Sequence
  Synthetic Polynucleotide
taatacgactcactataggggcattctgtattagcagcgtttgggtcatcaacagaggagagatgacatgaacgctgctaacctggcggcagcgcaaaagatg

SEQ ID NO: 16215 - DNA, 103 bp, Artificial Sequence
  Synthetic Polynucleotide
taatacgactcactatagggggttggcattctgtattagcagcgtttgggaacagaggagacccaaaatgtgctaatacaacctggcggcagcgcaaaagatg

SEQ ID NO: 16216 - DNA, 103 bp, Artificial Sequence
  Synthetic Polynucleotide
taatacgactcactataggggtctgggttggcattctgtattagcagcgtaacagaggagaacgctgatgatacagaataacctggcggcagcgcaaaagatg

SEQ ID NO: 16217 - DNA, 103 bp, Artificial Sequence
  Synthetic Polynucleotide
taatacgactcactatagggttgcagtctgggttggcattctgtattagcaacagaggagagctaatatggaatgccaaaacctggcggcagcgcaaaagatg

SEQ ID NO: 16218 - DNA, 103 bp, Artificial Sequence
  Synthetic Polynucleotide
taatacgactcactatagggctaacttgcagtctgggttggcattctgtaaacagaggagatacagaatgccaacccagaacctggcggcagcgcaaaagatg

SEQ ID NO: 16219 - DNA, 103 bp, Artificial Sequence
  Synthetic Polynucleotide
taatacgactcactatagggtagtactaacttgcagtctgggttggcattaacagaggagaaatgccatgccagactgcaacctggcggcagcgcaaaagatg

SEQ ID NO: 16220 - DNA, 103 bp, Artificial Sequence
  Synthetic Polynucleotide
taatacgactcactatagggccttttagtactaacttgcagtctgggttgaacagaggagacaacccatgctgcaagttaacctggcggcagcgcaaaagatg

SEQ ID NO: 16221 - DNA, 103 bp, Artificial Sequence
  Synthetic Polynucleotide
taatacgactcactatagggccagtccttttagtactaacttgcagtctgaacagaggagacagactatgagttagtacaacctggcggcagcgcaaaagatg

SEQ ID NO: 16222 - DNA, 103 bp, Artificial Sequence
  Synthetic Polynucleotide
taatacgactcactatagggtgctcatcatcatgtctgcttgtttgtgctaacagaggagaagcacaatgaagcagacaaacctggcggcagcgcaaaagatg

SEQ ID NO: 16223 - DNA, 103 bp, Artificial Sequence
  Synthetic Polynucleotide
taatacgactcactatagggcatccccagtccttttagtactaacttgcaaacagaggagatgcaagatggtactaaaaaacctggcggcagcgcaaaagatg

SEQ ID NO: 16224 - DNA, 103 bp, Artificial Sequence
  Synthetic Polynucleotide
taatacgactcactatagggggattcatccccagtccttttagtactaacaacagaggagagttagtatgaaaaggactaacctggcggcagcgcaaaagatg

SEQ ID NO: 16225 - DNA, 103 bp, Artificial Sequence
  Synthetic Polynucleotide
taatacgactcactataggggggtgggattcatccccagtccttttagtaaacagaggagatactaaatggactggggaaacctggcggcagcgcaaaagatg

SEQ ID NO: 16226 - DNA, 103 bp, Artificial Sequence
  Synthetic Polynucleotide
taatacgactcactatagggttctagggtgggattcatccccagtcctttaacagaggagaaaaggaatggggatgaataacctggcggcagcgcaaaagatg

SEQ ID NO: 16227 - DNA, 103 bp, Artificial Sequence
  Synthetic Polynucleotide
taatacgactcactatagggatctcttctagggtgggattcatccccagtaacagaggagaactgggatggaatcccacaacctggcggcagcgcaaaagatg

SEQ ID NO: 16228 - DNA, 103 bp, Artificial Sequence
  Synthetic Polynucleotide
taatacgactcactatagggttagcatctcttctagggtgggattcatccaacagaggagaggatgaatgccaccctagaacctggcggcagcgcaaaagatg

SEQ ID NO: 16229 - DNA, 103 bp, Artificial Sequence
  Synthetic Polynucleotide
taatacgactcactatagggggcggttagcatctcttctagggtgggattaacagaggagaaatcccatgctagaagagaacctggcggcagcgcaaaagatg

SEQ ID NO: 16230 - DNA, 103 bp, Artificial Sequence
  Synthetic Polynucleotide
taatacgactcactatagggtggcaggcggttagcatctcttctagggtgaacagaggagacaccctatgagagatgctaacctggcggcagcgcaaaagatg

SEQ ID NO: 16231 - DNA, 103 bp, Artificial Sequence
  Synthetic Polynucleotide
taatacgactcactatagggccccctggcaggcggttagcatctcttctaaacagaggagatagaagatgtgctaaccgaacctggcggcagcgcaaaagatg

SEQ ID NO: 16232 - DNA, 103 bp, Artificial Sequence
  Synthetic Polynucleotide
taatacgactcactataggggcctaccccctggcaggcggttagcatctcaacagaggagagagatgatgaccgcctgcaacctggcggcagcgcaaaagatg

SEQ ID NO: 16233 - DNA, 103 bp, Artificial Sequence
  Synthetic Polynucleotide
taatacgactcactatagggccccatgctcatcatcatgtctgcttgtttaacagaggagaaaacaaatggacatgatgaacctggcggcagcgcaaaagatg

SEQ ID NO: 16234 - DNA, 103 bp, Artificial Sequence
  Synthetic Polynucleotide
taatacgactcactatagggggtccgcctaccccctggcaggcggttagcaacagaggagagctaacatgctgccagggaacctggcggcagcgcaaaagatg

SEQ ID NO: 16235 - DNA, 103 bp, Artificial Sequence
  Synthetic Polynucleotide
taatacgactcactatagggggcctggtccgcctaccccctggcaggcggaacagaggagaccgcctatgagggggtagaacctggcggcagcgcaaaagatg

SEQ ID NO: 16236 - DNA, 103 bp, Artificial Sequence
  Synthetic Polynucleotide
taatacgactcactatagggtttctggcctggtccgcctaccccctggcaaacagaggagatgccagatggtaggcggaaacctggcggcagcgcaaaagatg

SEQ ID NO: 16237 - DNA, 103 bp, Artificial Sequence
  Synthetic Polynucleotide
taatacgactcactatagggctggctttctggcctggtccgcctacccccaacagaggagagggggtatgcggaccaggaacctggcggcagcgcaaaagatg

SEQ ID NO: 16238 - DNA, 103 bp, Artificial Sequence
  Synthetic Polynucleotide
taatacgactcactatagggttagcctggctttctggcctggtccgcctaaacagaggagataggcgatgcaggccagaaacctggcggcagcgcaaaagatg

SEQ ID NO: 16239 - DNA, 103 bp, Artificial Sequence
  Synthetic Polynucleotide
taatacgactcactatagggagccattagcctggctttctggcctggtccaacagaggagaggaccaatgcagaaagccaacctggcggcagcgcaaaagatg

SEQ ID NO: 16240 - DNA, 103 bp, Artificial Sequence
  Synthetic Polynucleotide
taatacgactcactataggggcttcagccattagcctggctttctggcctaacagaggagaaggccaatgagccaggctaacctggcggcagcgcaaaagatg

SEQ ID NO: 16241 - DNA, 103 bp, Artificial Sequence
  Synthetic Polynucleotide
taatacgactcactatagggttagggcttcagccattagcctggctttctaacagaggagaagaaagatgggctaatggaacctggcggcagcgcaaaagatg

SEQ ID NO: 16242 - DNA, 103 bp, Artificial Sequence
  Synthetic Polynucleotide
taatacgactcactatagggctcttttagggcttcagccattagcctggcaacagaggagagccaggatgatggctgaaaacctggcggcagcgcaaaagatg

SEQ ID NO: 16243 - DNA, 103 bp, Artificial Sequence
  Synthetic Polynucleotide
taatacgactcactatagggatagcctcttttagggcttcagccattagcaacagaggagagctaatatgtgaagccctaacctggcggcagcgcaaaagatg

SEQ ID NO: 16244 - DNA, 103 bp, Artificial Sequence
  Synthetic Polynucleotide
taatacgactcactatagggtgtctccccatgctcatcatcatgtctgctaacagaggagaagcagaatggatgatgagaacctggcggcagcgcaaaagatg

SEQ ID NO: 16245 - DNA, 103 bp, Artificial Sequence
  Synthetic Polynucleotide
taatacgactcactataggggtcccatagcctcttttagggcttcagccaaacagaggagatggctgatgccctaaaagaacctggcggcagcgcaaaagatg

SEQ ID NO: 16246 - DNA, 103 bp, Artificial Sequence
  Synthetic Polynucleotide
taatacgactcactataggggcttggtcccatagcctcttttagggcttcaacagaggagagaagccatgaaagaggctaacctggcggcagcgcaaaagatg

SEQ ID NO: 16247 - DNA, 103 bp, Artificial Sequence
  Synthetic Polynucleotide
taatacgactcactatagggatagggcttggtcccatagcctcttttaggaacagaggagacctaaaatgggctatgggaacctggcggcagcgcaaaagatg

SEQ ID NO: 16248 - DNA, 103 bp, Artificial Sequence
  Synthetic Polynucleotide
taatacgactcactatagggatgggatagggcttggtcccatagcctcttaacagaggagaaagaggatgtgggaccaaaacctggcggcagcgcaaaagatg

SEQ ID NO: 16249 - DNA, 103 bp, Artificial Sequence
  Synthetic Polynucleotide
taatacgactcactatagggtgcaaatgggatagggcttggtcccatagcaacagaggagagctatgatgccaagccctaacctggcggcagcgcaaaagatg

SEQ ID NO: 16250 - DNA, 103 bp, Artificial Sequence
  Synthetic Polynucleotide
taatacgactcactataggggctgctgcaaatgggatagggcttggtcccaacagaggagagggaccatgccctatcccaacctggcggcagcgcaaaagatg

SEQ ID NO: 16251 - DNA, 103 bp, Artificial Sequence
  Synthetic Polynucleotide
taatacgactcactataggggttgggctgctgcaaatgggatagggcttgaacagaggagacaagccatgtcccatttgaacctggcggcagcgcaaaagatg

SEQ ID NO: 16252 - DNA, 103 bp, Artificial Sequence
  Synthetic Polynucleotide
taatacgactcactatagggtctttgttgggctgctgcaaatgggataggaacagaggagacctatcatgtttgcagcaaacctggcggcagcgcaaaagatg

SEQ ID NO: 16253 - DNA, 103 bp, Artificial Sequence
  Synthetic Polynucleotide
taatacgactcactataggggcctttctttgttgggctgctgcaaatgggaacagaggagacccattatgagcagcccaaacctggcggcagcgcaaaagatg

SEQ ID NO: 16254 - DNA, 103 bp, Artificial Sequence
  Synthetic Polynucleotide
taatacgactcactatagggtaattgcctttctttgttgggctgctgcaaaacagaggagattgcagatgcccaacaaaaacctggcggcagcgcaaaagatg

SEQ ID NO: 16255 - DNA, 103 bp, Artificial Sequence
  Synthetic Polynucleotide
taatacgactcactatagggactaatgtctccccatgctcatcatcatgtaacagaggagaacatgaatgtgagcatggaacctggcggcagcgcaaaagatg

SEQ ID NO: 16256 - DNA, 103 bp, Artificial Sequence
  Synthetic Polynucleotide
taatacgactcactatagggatacctaattgcctttctttgttgggctgcaacagaggagagcagccatgcaaagaaagaacctggcggcagcgcaaaagatg

SEQ ID NO: 16257 - DNA, 103 bp, Artificial Sequence
  Synthetic Polynucleotide
taatacgactcactatagggttccaatacctaattgcctttctttgttggaacagaggagaccaacaatgaaaggcaataacctggcggcagcgcaaaagatg

SEQ ID NO: 16258 - DNA, 103 bp, Artificial Sequence
  Synthetic Polynucleotide
taatacgactcactatagggcacagttccaatacctaattgcctttctttaacagaggagaaaagaaatgcaattaggtaacctggcggcagcgcaaaagatg

SEQ ID NO: 16259 - DNA, 103 bp, Artificial Sequence
  Synthetic Polynucleotide
taatacgactcactatagggctttccacagttccaatacctaattgccttaacagaggagaaaggcaatgaggtattggaacctggcggcagcgcaaaagatg

SEQ ID NO: 16260 - DNA, 103 bp, Artificial Sequence
  Synthetic Polynucleotide
taatacgactcactatagggccctcctttccacagttccaatacctaattaacagaggagaaattagatgttggaactgaacctggcggcagcgcaaaagatg

SEQ ID NO: 16261 - DNA, 103 bp, Artificial Sequence
  Synthetic Polynucleotide
taatacgactcactatagggagtgtccctcctttccacagttccaataccaacagaggagaggtattatgactgtggaaaacctggcggcagcgcaaaagatg

SEQ ID NO: 16262 - DNA, 103 bp, Artificial Sequence
  Synthetic Polynucleotide
taatacgactcactatagggtgccgagtgtccctcctttccacagttccaaacagaggagatggaacatgggaaaggagaacctggcggcagcgcaaaagatg

SEQ ID NO: 16263 - DNA, 103 bp, Artificial Sequence
  Synthetic Polynucleotide
taatacgactcactatagggtgtcttgccgagtgtccctcctttccacagaacagaggagactgtggatgggagggacaaacctggcggcagcgcaaaagatg

SEQ ID NO: 16264 - DNA, 103 bp, Artificial Sequence
  Synthetic Polynucleotide
taatacgactcactatagggggcactgtcttgccgagtgtccctcctttcaacagaggagagaaaggatggacactcggaacctggcggcagcgcaaaagatg

SEQ ID NO: 16265 - DNA, 103 bp, Artificial Sequence
  Synthetic Polynucleotide
taatacgactcactatagggtgctcggcactgtcttgccgagtgtccctcaacagaggagagagggaatgtcggcaagaaacctggcggcagcgcaaaagatg

SEQ ID NO: 16266 - DNA, 103 bp, Artificial Sequence
  Synthetic Polynucleotide
taatacgactcactataggggccacactaatgtctccccatgctcatcataacagaggagaatgatgatgatggggagaaacctggcggcagcgcaaaagatg

SEQ ID NO: 16267 - DNA, 103 bp, Artificial Sequence
  Synthetic Polynucleotide
taatacgactcactatagggctaggtgctcggcactgtcttgccgagtgtaacagaggagaacactcatgaagacagtgaacctggcggcagcgcaaaagatg

SEQ ID NO: 16268 - DNA, 103 bp, Artificial Sequence
  Synthetic Polynucleotide
taatacgactcactataggggtcttctaggtgctcggcactgtcttgccgaacagaggagacggcaaatgagtgccgagaacctggcggcagcgcaaaagatg

SEQ ID NO: 16269 - DNA, 103 bp, Artificial Sequence
  Synthetic Polynucleotide
taatacgactcactataggggccctgtcttctaggtgctcggcactgtctaacagaggagaagacagatgcgagcacctaacctggcggcagcgcaaaagatg

SEQ ID NO: 16270 - DNA, 103 bp, Artificial Sequence
  Synthetic Polynucleotide
taatacgactcactatagggcagcagccctgtcttctaggtgctcggcacaacagaggagagtgccgatgacctagaagaacctggcggcagcgcaaaagatg

SEQ ID NO: 16271 - DNA, 103 bp, Artificial Sequence
  Synthetic Polynucleotide
taatacgactcactatagggacttccagcagccctgtcttctaggtgctcaacagaggagagagcacatggaagacaggaacctggcggcagcgcaaaagatg

SEQ ID NO: 16272 - DNA, 103 bp, Artificial Sequence
  Synthetic Polynucleotide
taatacgactcactataggggccacacttccagcagccctgtcttctaggaacagaggagacctagaatgcagggctgcaacctggcggcagcgcaaaagatg

SEQ ID NO: 16273 - DNA, 103 bp, Artificial Sequence
  Synthetic Polynucleotide
taatacgactcactatagggggcttgccacacttccagcagccctgtcttaacagaggagaaagacaatgctgctggaaaacctggcggcagcgcaaaagatg

SEQ ID NO: 16274 - DNA, 103 bp, Artificial Sequence
  Synthetic Polynucleotide
taatacgactcactataggggtcctggcttgccacacttccagcagccctaacagaggagaagggctatgggaagtgtgaacctggcggcagcgcaaaagatg

SEQ ID NO: 16275 - DNA, 103 bp, Artificial Sequence
  Synthetic Polynucleotide
taatacgactcactataggggatgtgtcctggcttgccacacttccagcaaacagaggagatgctggatgtgtggcaagaacctggcggcagcgcaaaagatg

SEQ ID NO: 16276 - DNA, 103 bp, Artificial Sequence
  Synthetic Polynucleotide
taatacgactcactataggggccatgatgtgtcctggcttgccacacttcaacagaggagagaagtgatgcaagccaggaacctggcggcagcgcaaaagatg

SEQ ID NO: 16277 - DNA, 103 bp, Artificial Sequence
  Synthetic Polynucleotide
taatacgactcactatagggaaactgccacactaatgtctccccatgctcaacagaggagagagcatatggagacattaaacctggcggcagcgcaaaagatg

SEQ ID NO: 16278 - DNA, 103 bp, Artificial Sequence
  Synthetic Polynucleotide
taatacgactcactatagggagtttgccatgatgtgtcctggcttgccacaacagaggagagtggcaatgcaggacacaaacctggcggcagcgcaaaagatg

SEQ ID NO: 16279 - DNA, 103 bp, Artificial Sequence
  Synthetic Polynucleotide
taatacgactcactatagggcgggcagtttgccatgatgtgtcctggcttaacagaggagaaagccaatgcacatcatgaacctggcggcagcgcaaaagatg

SEQ ID NO: 16280 - DNA, 103 bp, Artificial Sequence
  Synthetic Polynucleotide
taatacgactcactatagggctttccgggcagtttgccatgatgtgtcctaacagaggagaaggacaatgcatggcaaaaacctggcggcagcgcaaaagatg

SEQ ID NO: 16281 - DNA, 103 bp, Artificial Sequence
  Synthetic Polynucleotide
taatacgactcactatagggcctgtctttccgggcagtttgccatgatgtaacagaggagaacatcaatgcaaactgccaacctggcggcagcgcaaaagatg

SEQ ID NO: 16282 - DNA, 103 bp, Artificial Sequence
  Synthetic Polynucleotide
taatacgactcactatagggacctgcctgtctttccgggcagtttgccataacagaggagaatggcaatgtgcccggaaaacctggcggcagcgcaaaagatg

SEQ ID NO: 16283 - DNA, 103 bp, Artificial Sequence
  Synthetic Polynucleotide
taatacgactcactatagggaaaaaacctgcctgtctttccgggcagtttaacagaggagaaaactgatgggaaagacaaacctggcggcagcgcaaaagatg

SEQ ID NO: 16284 - DNA, 103 bp, Artificial Sequence
  Synthetic Polynucleotide
taatacgactcactatagggaccctaaaaaacctgcctgtctttccgggcaacagaggagagcccggatggacaggcagaacctggcggcagcgcaaaagatg

SEQ ID NO: 16285 - DNA, 103 bp, Artificial Sequence
  Synthetic Polynucleotide
taatacgactcactataggggcccaaccctaaaaaacctgcctgtctttcaacagaggagagaaagaatggcaggttttaacctggcggcagcgcaaaagatg

SEQ ID NO: 16286 - DNA, 103 bp, Artificial Sequence
  Synthetic Polynucleotide
taatacgactcactatagggcgtgggcccaaccctaaaaaacctgcctgtaacagaggagaacaggcatgttttttaggaacctggcggcagcgcaaaagatg

SEQ ID NO: 16287 - DNA, 103 bp, Artificial Sequence
  Synthetic Polynucleotide
taatacgactcactatagggttccccgtgggcccaaccctaaaaaacctgaacagaggagacaggttatgtagggttggaacctggcggcagcgcaaaagatg

SEQ ID NO: 16288 - DNA, 103 bp, Artificial Sequence
  Synthetic Polynucleotide
taatacgactcactataggggagtcaaactgccacactaatgtctccccaaacagaggagatggggaatgattagtgtgaacctggcggcagcgcaaaagatg

SEQ ID NO: 16289 - DNA, 103 bp, Artificial Sequence
  Synthetic Polynucleotide
taatacgactcactatagggcttctttccccgtgggcccaaccctaaaaaaacagaggagatttttaatgttgggcccaaacctggcggcagcgcaaaagatg

SEQ ID NO: 16290 - DNA, 103 bp, Artificial Sequence
  Synthetic Polynucleotide
taatacgactcactatagggcgaggcttctttccccgtgggcccaaccctaacagaggagaagggttatgcccacggggaacctggcggcagcgcaaaagatg

SEQ ID NO: 16291 - DNA, 103 bp, Artificial Sequence
  Synthetic Polynucleotide
taatacgactcactatagggagttgcgaggcttctttccccgtgggcccaaacagaggagatgggccatgggggaaagaaacctggcggcagcgcaaaagatg

SEQ ID NO: 16292 - DNA, 103 bp, Artificial Sequence
  Synthetic Polynucleotide
taatacgactcactatagggggggaagttgcgaggcttctttccccgtggaacagaggagaccacggatgaagaagcctaacctggcggcagcgcaaaagatg

SEQ ID NO: 16293 - DNA, 103 bp, Artificial Sequence
  Synthetic Polynucleotide
taatacgactcactataggggtcacggggaagttgcgaggcttctttcccaacagaggagagggaaaatggcctcgcaaaacctggcggcagcgcaaaagatg

SEQ ID NO: 16294 - DNA, 103 bp, Artificial Sequence
  Synthetic Polynucleotide
taatacgactcactatagggcttgggtcacggggaagttgcgaggcttctaacagaggagaagaagcatggcaacttccaacctggcggcagcgcaaaagatg

SEQ ID NO: 16295 - DNA, 103 bp, Artificial Sequence
  Synthetic Polynucleotide
taatacgactcactatagggaggggcttgggtcacggggaagttgcgaggaacagaggagacctcgcatgttccccgtgaacctggcggcagcgcaaaagatg

SEQ ID NO: 16296 - DNA, 103 bp, Artificial Sequence
  Synthetic Polynucleotide
taatacgactcactatagggccctgaggggcttgggtcacggggaagttgaacagaggagacaacttatgcgtgacccaaacctggcggcagcgcaaaagatg

SEQ ID NO: 16297 - DNA, 103 bp, Artificial Sequence
  Synthetic Polynucleotide
taatacgactcactatagggtcagcccctgaggggcttgggtcacggggaaacagaggagatccccgatgcccaagcccaacctggcggcagcgcaaaagatg

SEQ ID NO: 16298 - DNA, 103 bp, Artificial Sequence
  Synthetic Polynucleotide
taatacgactcactatagggtggtatcagcccctgaggggcttgggtcacaacagaggagagtgaccatggcccctcagaacctggcggcagcgcaaaagatg

SEQ ID NO: 16299 - DNA, 103 bp, Artificial Sequence
  Synthetic Polynucleotide
taatacgactcactataggggcatggagtcaaactgccacactaatgtctaacagaggagaagacatatgtgtggcagtaacctggcggcagcgcaaaagatg

SEQ ID NO: 16300 - DNA, 103 bp, Artificial Sequence
  Synthetic Polynucleotide
taatacgactcactataggggctgttggtatcagcccctgaggggcttggaacagaggagaccaagcatgtcaggggctaacctggcggcagcgcaaaagatg

SEQ ID NO: 16301 - DNA, 103 bp, Artificial Sequence
  Synthetic Polynucleotide
taatacgactcactataggggaggtgctgttggtatcagcccctgaggggaacagaggagacccctcatgggctgatacaacctggcggcagcgcaaaagatg

SEQ ID NO: 16302 - DNA, 103 bp, Artificial Sequence
  Synthetic Polynucleotide
taatacgactcactatagggtgccggaggtgctgttggtatcagcccctgaacagaggagacaggggatgataccaacaaacctggcggcagcgcaaaagatg

SEQ ID NO: 16303 - DNA, 103 bp, Artificial Sequence
  Synthetic Polynucleotide
taatacgactcactatagggggatctgccggaggtgctgttggtatcagcaacagaggagagctgatatgaacagcaccaacctggcggcagcgcaaaagatg

SEQ ID NO: 16304 - DNA, 103 bp, Artificial Sequence
  Synthetic Polynucleotide
taatacgactcactatagggctgctggatctgccggaggtgctgttggtaaacagaggagataccaaatgcacctccggaacctggcggcagcgcaaaagatg

SEQ ID NO: 16305 - DNA, 103 bp, Artificial Sequence
  Synthetic Polynucleotide
taatacgactcactatagggttccgctgctggatctgccggaggtgctgtaacagaggagaacagcaatgccggcagataacctggcggcagcgcaaaagatg

SEQ ID NO: 16306 - DNA, 103 bp, Artificial Sequence
  Synthetic Polynucleotide
taatacgactcactatagggaacagttccgctgctggatctgccggaggtaacagaggagaacctccatgagatccagcaacctggcggcagcgcaaaagatg

SEQ ID NO: 16307 - DNA, 103 bp, Artificial Sequence
  Synthetic Polynucleotide
taatacgactcactatagggtctccaacagttccgctgctggatctgccgaacagaggagacggcagatgcagcagcggaacctggcggcagcgcaaaagatg

SEQ ID NO: 16308 - DNA, 103 bp, Artificial Sequence
  Synthetic Polynucleotide
taatacgactcactatagggatatctctccaacagttccgctgctggatcaacagaggagagatccaatggcggaactgaacctggcggcagcgcaaaagatg

SEQ ID NO: 16309 - DNA, 103 bp, Artificial Sequence
  Synthetic Polynucleotide
taatacgactcactatagggtgcatatatctctccaacagttccgctgctaacagaggagaagcagcatgactgttggaaacctggcggcagcgcaaaagatg

SEQ ID NO: 16310 - DNA, 103 bp, Artificial Sequence
  Synthetic Polynucleotide
taatacgactcactataggggtatatgtctaggattctatgtctcctcctaacagaggagaaggaggatgcatagaatcaacctggcggcagcgcaaaagatg

SEQ ID NO: 16311 - DNA, 103 bp, Artificial Sequence
  Synthetic Polynucleotide
taatacgactcactatagggggccagcatggagtcaaactgccacactaaaacagaggagattagtgatgcagtttgacaacctggcggcagcgcaaaagatg

SEQ ID NO: 16312 - DNA, 103 bp, Artificial Sequence
  Synthetic Polynucleotide
taatacgactcactatagggcttgctgcatatatctctccaacagttccgaacagaggagacggaacatgtggagagataacctggcggcagcgcaaaagatg

SEQ ID NO: 16313 - DNA, 103 bp, Artificial Sequence
  Synthetic Polynucleotide
taatacgactcactatagggtctcccttgctgcatatatctctccaacagaacagaggagactgttgatgagatatatgaacctggcggcagcgcaaaagatg

SEQ ID NO: 16314 - DNA, 103 bp, Artificial Sequence
  Synthetic Polynucleotide
taatacgactcactatagggtgctttctcccttgctgcatatatctctccaacagaggagaggagagatgtatgcagcaaacctggcggcagcgcaaaagatg

SEQ ID NO: 16315 - DNA, 103 bp, Artificial Sequence
  Synthetic Polynucleotide
taatacgactcactatagggccctctgctttctcccttgctgcatatatcaacagaggagagatataatgagcaagggaaacctggcggcagcgcaaaagatg

SEQ ID NO: 16316 - DNA, 103 bp, Artificial Sequence
  Synthetic Polynucleotide
taatacgactcactatagggctgctccctctgctttctcccttgctgcataacagaggagaatgcagatggggagaaagaacctggcggcagcgcaaaagatg

SEQ ID NO: 16317 - DNA, 103 bp, Artificial Sequence
  Synthetic Polynucleotide
taatacgactcactatagggtccctctgctccctctgctttctcccttgcaacagaggagagcaaggatgaaagcagagaacctggcggcagcgcaaaagatg

SEQ ID NO: 16318 - DNA, 103 bp, Artificial Sequence
  Synthetic Polynucleotide
taatacgactcactataggggtctctccctctgctccctctgctttctccaacagaggagaggagaaatgagagggagcaacctggcggcagcgcaaaagatg

SEQ ID NO: 16319 - DNA, 103 bp, Artificial Sequence
  Synthetic Polynucleotide
taatacgactcactataggggtatggtctctccctctgctccctctgcttaacagaggagaaagcagatggagcagaggaacctggcggcagcgcaaaagatg

SEQ ID NO: 16320 - DNA, 103 bp, Artificial Sequence
  Synthetic Polynucleotide
taatacgactcactatagggtctttgtatggtctctccctctgctccctcaacagaggagagagggaatggagggagagaacctggcggcagcgcaaaagatg

SEQ ID NO: 16321 - DNA, 103 bp, Artificial Sequence
  Synthetic Polynucleotide
taatacgactcactatagggtcacctctttgtatggtctctccctctgctaacagaggagaagcagaatgagagaccataacctggcggcagcgcaaaagatg

SEQ ID NO: 16322 - DNA, 103 bp, Artificial Sequence
  Synthetic Polynucleotide
taatacgactcactatagggttataggccagcatggagtcaaactgccacaacagaggagagtggcaatgtgactccataacctggcggcagcgcaaaagatg

SEQ ID NO: 16323 - DNA, 103 bp, Artificial Sequence
  Synthetic Polynucleotide
taatacgactcactatagggctccgtcacctctttgtatggtctctccctaacagaggagaagggagatgccatacaaaaacctggcggcagcgcaaaagatg

SEQ ID NO: 16324 - DNA, 103 bp, Artificial Sequence
  Synthetic Polynucleotide
taatacgactcactatagggaagtcctccgtcacctctttgtatggtctcaacagaggagagagaccatgcaaagaggtaacctggcggcagcgcaaaagatg

SEQ ID NO: 16325 - DNA, 103 bp, Artificial Sequence
  Synthetic Polynucleotide
taatacgactcactataggggcagcaagtcctccgtcacctctttgtatgaacagaggagacatacaatgaggtgacggaacctggcggcagcgcaaaagatg

SEQ ID NO: 16326 - DNA, 103 bp, Artificial Sequence
  Synthetic Polynucleotide
taatacgactcactataggggaggtgcagcaagtcctccgtcacctctttaacagaggagaaaagagatgacggaggacaacctggcggcagcgcaaaagatg

SEQ ID NO: 16327 - DNA, 103 bp, Artificial Sequence
  Synthetic Polynucleotide
taatacgactcactatagggtgctcgaggtgcagcaagtcctccgtcaccaacagaggagaggtgacatgggacttgctaacctggcggcagcgcaaaagatg

SEQ ID NO: 16328 - DNA, 103 bp, Artificial Sequence
  Synthetic Polynucleotide
taatacgactcactatagggctctctgctcgaggtgcagcaagtcctccgaacagaggagacggaggatgtgctgcaccaacctggcggcagcgcaaaagatg

SEQ ID NO: 16329 - DNA, 103 bp, Artificial Sequence
  Synthetic Polynucleotide
taatacgactcactatagggtgtctctctctgctcgaggtgcagcaagtcaacagaggagagacttgatgcacctcgagaacctggcggcagcgcaaaagatg

SEQ ID NO: 16330 - DNA, 103 bp, Artificial Sequence
  Synthetic Polynucleotide
taatacgactcactatagggtgaggtgtctctctctgctcgaggtgcagcaacagaggagagctgcaatgcgagcagagaacctggcggcagcgcaaaagatg

SEQ ID NO: 16331 - DNA, 103 bp, Artificial Sequence
  Synthetic Polynucleotide
taatacgactcactatagggctctgtgaggtgtctctctctgctcgaggtaacagaggagaacctcgatgagagagagaaacctggcggcagcgcaaaagatg

SEQ ID NO: 16332 - DNA, 103 bp, Artificial Sequence
  Synthetic Polynucleotide
taatacgactcactatagggctcctctctgtgaggtgtctctctctgctcaacagaggagagagcagatggagacacctaacctggcggcagcgcaaaagatg

SEQ ID NO: 16333 - DNA, 103 bp, Artificial Sequence
  Synthetic Polynucleotide
taatacgactcactatagggtgtagttataggccagcatggagtcaaactaacagaggagaagtttgatgccatgctggaacctggcggcagcgcaaaagatg

SEQ ID NO: 16334 - DNA, 103 bp, Artificial Sequence
  Synthetic Polynucleotide
taatacgactcactatagggtctgtctcctctctgtgaggtgtctctctcaacagaggagagagagaatgacctcacagaacctggcggcagcgcaaaagatg

SEQ ID NO: 16335 - DNA, 103 bp, Artificial Sequence
  Synthetic Polynucleotide
taatacgactcactatagggagtcctctgtctcctctctgtgaggtgtctaacagaggagaagacacatgacagagaggaacctggcggcagcgcaaaagatg

SEQ ID NO: 16336 - DNA, 103 bp, Artificial Sequence
  Synthetic Polynucleotide
taatacgactcactatagggcagcaagtcctctgtctcctctctgtgaggaacagaggagacctcacatggaggagacaaacctggcggcagcgcaaaagatg

SEQ ID NO: 16337 - DNA, 103 bp, Artificial Sequence
  Synthetic Polynucleotide
taatacgactcactatagggaggtgcagcaagtcctctgtctcctctctgaacagaggagacagagaatggacagaggaaacctggcggcagcgcaaaagatg

SEQ ID NO: 16338 - DNA, 103 bp, Artificial Sequence
  Synthetic Polynucleotide
taatacgactcactatagggaattgaggtgcagcaagtcctctgtctcctaacagaggagaaggagaatgaggacttgcaacctggcggcagcgcaaaagatg

SEQ ID NO: 16339 - DNA, 103 bp, Artificial Sequence
  Synthetic Polynucleotide
taatacgactcactataggggagagaattgaggtgcagcaagtcctctgtaacagaggagaacagagatgttgctgcacaacctggcggcagcgcaaaagatg

SEQ ID NO: 16340 - DNA, 103 bp, Artificial Sequence
  Synthetic Polynucleotide
taatacgactcactatagggccaaagagagaattgaggtgcagcaagtccaacagaggagaggacttatggcacctcaaaacctggcggcagcgcaaaagatg

SEQ ID NO: 16341 - DNA, 103 bp, Artificial Sequence
  Synthetic Polynucleotide
taatacgactcactatagggcttttccaaagagagaattgaggtgcagcaaacagaggagatgctgcatgtcaattctcaacctggcggcagcgcaaaagatg

SEQ ID NO: 16342 - DNA, 103 bp, Artificial Sequence
  Synthetic Polynucleotide
taatacgactcactatagggctggtcttttccaaagagagaattgaggtgaacagaggagacacctcatgtctctctttaacctggcggcagcgcaaaagatg

SEQ ID NO: 16343 - DNA, 103 bp, Artificial Sequence
  Synthetic Polynucleotide
taatacgactcactataggggactactggtcttttccaaagagagaattgaacagaggagacaattcatgctttggaaaaacctggcggcagcgcaaaagatg

SEQ ID NO: 16344 - DNA, 103 bp, Artificial Sequence
  Synthetic Polynucleotide
taatacgactcactatagggggccttgtagttataggccagcatggagtcaacagaggagagactccatgctggcctataacctggcggcagcgcaaaagatg

SEQ ID NO: 16345 - DNA, 103 bp, Artificial Sequence
  Synthetic Polynucleotide
taatacgactcactataggggctgtgactactggtcttttccaaagagagaacagaggagactctctatggaaaagaccaacctggcggcagcgcaaaagatg

SEQ ID NO: 16346 - DNA, 103 bp, Artificial Sequence
  Synthetic Polynucleotide
taatacgactcactatagggtgtacgctgtgactactggtcttttccaaaaacagaggagatttggaatggaccagtagaacctggcggcagcgcaaaagatg

SEQ ID NO: 16347 - DNA, 103 bp, Artificial Sequence
  Synthetic Polynucleotide
taatacgactcactatagggctcgatgtacgctgtgactactggtcttttaacagaggagaaaaagaatggtagtcacaaacctggcggcagcgcaaaagatg

SEQ ID NO: 16348 - DNA, 103 bp, Artificial Sequence
  Synthetic Polynucleotide
taatacgactcactatagggtgatcctcgatgtacgctgtgactactggtaacagaggagaaccagtatgcacagcgtaaacctggcggcagcgcaaaagatg

SEQ ID NO: 16349 - DNA, 103 bp, Artificial Sequence
  Synthetic Polynucleotide
taatacgactcactatagggccggctgatcctcgatgtacgctgtgactaaacagaggagatagtcaatgcgtacatcgaacctggcggcagcgcaaaagatg

SEQ ID NO: 16350 - DNA, 103 bp, Artificial Sequence
  Synthetic Polynucleotide
taatacgactcactatagggttctaccggctgatcctcgatgtacgctgtaacagaggagaacagcgatgatcgaggataacctggcggcagcgcaaaagatg

SEQ ID NO: 16351 - DNA, 103 bp, Artificial Sequence
  Synthetic Polynucleotide
taatacgactcactatagggaagacttctaccggctgatcctcgatgtacaacagaggagagtacatatgggatcagccaacctggcggcagcgcaaaagatg

SEQ ID NO: 16352 - DNA, 103 bp, Artificial Sequence
  Synthetic Polynucleotide
taatacgactcactatagggctagtaagacttctaccggctgatcctcgaaacagaggagatcgaggatgagccggtagaacctggcggcagcgcaaaagatg

SEQ ID NO: 16353 - DNA, 103 bp, Artificial Sequence
  Synthetic Polynucleotide
taatacgactcactatagggtgtgtctagtaagacttctaccggctgatcaacagaggagagatcagatggtagaagtcaacctggcggcagcgcaaaagatg

SEQ ID NO: 16354 - DNA, 103 bp, Artificial Sequence
  Synthetic Polynucleotide
taatacgactcactataggggcccctgtgtctagtaagacttctaccggcaacagaggagagccggtatgagtcttactaacctggcggcagcgcaaaagatg

SEQ ID NO: 16355 - DNA, 103 bp, Artificial Sequence
  Synthetic Polynucleotide
taatacgactcactataggggtgaaggccttgtagttataggccagcatgaacagaggagacatgctatgctataactaaacctggcggcagcgcaaaagatg

SEQ ID NO: 16356 - DNA, 103 bp, Artificial Sequence
  Synthetic Polynucleotide
taatacgactcactatagggcatcagcccctgtgtctagtaagacttctaaacagaggagatagaagatgtactagacaaacctggcggcagcgcaaaagatg

SEQ ID NO: 16357 - DNA, 103 bp, Artificial Sequence
  Synthetic Polynucleotide
taatacgactcactatagggtgagtcatcagcccctgtgtctagtaagacaacagaggagagtcttaatggacacagggaacctggcggcagcgcaaaagatg

SEQ ID NO: 16358 - DNA, 103 bp, Artificial Sequence
  Synthetic Polynucleotide
taatacgactcactatagggactattgagtcatcagcccctgtgtctagtaacagaggagaactagaatgaggggctgaaacctggcggcagcgcaaaagatg

SEQ ID NO: 16359 - DNA, 103 bp, Artificial Sequence
  Synthetic Polynucleotide
taatacgactcactatagggctgctactattgagtcatcagcccctgtgtaacagaggagaacacagatgctgatgactaacctggcggcagcgcaaaagatg

SEQ ID NO: 16360 - DNA, 103 bp, Artificial Sequence
  Synthetic Polynucleotide
taatacgactcactatagggtattcctgctactattgagtcatcagccccaacagaggagaggggctatggactcaataaacctggcggcagcgcaaaagatg

SEQ ID NO: 16361 - DNA, 103 bp, Artificial Sequence
  Synthetic Polynucleotide
taatacgactcactatagggaattctattcctgctactattgagtcatcaaacagaggagatgatgaatgaatagtagcaacctggcggcagcgcaaaagatg

SEQ ID NO: 16362 - DNA, 103 bp, Artificial Sequence
  Synthetic Polynucleotide
taatacgactcactatagggcccctaattctattcctgctactattgagtaacagaggagaactcaaatgtagcaggaaaacctggcggcagcgcaaaagatg

SEQ ID NO: 16363 - DNA, 103 bp, Artificial Sequence
  Synthetic Polynucleotide
taatacgactcactatagggattgtcccctaattctattcctgctactataacagaggagaatagtaatgggaatagaaaacctggcggcagcgcaaaagatg

SEQ ID NO: 16364 - DNA, 103 bp, Artificial Sequence
  Synthetic Polynucleotide
taatacgactcactataggggtgtaattgtcccctaattctattcctgctaacagaggagaagcaggatgagaattaggaacctggcggcagcgcaaaagatg

SEQ ID NO: 16365 - DNA, 103 bp, Artificial Sequence
  Synthetic Polynucleotide
taatacgactcactatagggttggagtgtaattgtcccctaattctattcaacagaggagagaatagatgtaggggacaaacctggcggcagcgcaaaagatg

SEQ ID NO: 16366 - DNA, 103 bp, Artificial Sequence
  Synthetic Polynucleotide
taatacgactcactatagggacagagtgaaggccttgtagttataggccaaacagaggagatggcctatgactacaaggaacctggcggcagcgcaaaagatg

SEQ ID NO: 16367 - DNA, 103 bp, Artificial Sequence
  Synthetic Polynucleotide
taatacgactcactatagggtatttttggagtgtaattgtcccctaattcaacagaggagagaattaatggacaattacaacctggcggcagcgcaaaagatg

SEQ ID NO: 16368 - DNA, 103 bp, Artificial Sequence
  Synthetic Polynucleotide
taatacgactcactatagggcctactatttttggagtgtaattgtcccctaacagaggagaaggggaatgttacactccaacctggcggcagcgcaaaagatg

SEQ ID NO: 16369 - DNA, 103 bp, Artificial Sequence
  Synthetic Polynucleotide
taatacgactcactatagggttccccctactatttttggagtgtaattgtaacagaggagaacaattatgctccaaaaaaacctggcggcagcgcaaaagatg

SEQ ID NO: 16370 - DNA, 103 bp, Artificial Sequence
  Synthetic Polynucleotide
taatacgactcactatagggccctattccccctactatttttggagtgtaaacagaggagatacactatgaaaatagtaaacctggcggcagcgcaaaagatg

SEQ ID NO: 16371 - DNA, 103 bp, Artificial Sequence
  Synthetic Polynucleotide
taatacgactcactatagggaatccccctattccccctactatttttggaaacagaggagatccaaaatgagtagggggaacctggcggcagcgcaaaagatg

SEQ ID NO: 16372 - DNA, 103 bp, Artificial Sequence
  Synthetic Polynucleotide
taatacgactcactatagggttataaatccccctattccccctactatttaacagaggagaaaatagatgggggaatagaacctggcggcagcgcaaaagatg

SEQ ID NO: 16373 - DNA, 103 bp, Artificial Sequence
  Synthetic Polynucleotide
taatacgactcactatagggggtgtttataaatccccctattccccctacaacagaggagagtagggatgatagggggaaacctggcggcagcgcaaaagatg

SEQ ID NO: 16374 - DNA, 103 bp, Artificial Sequence
  Synthetic Polynucleotide
taatacgactcactatagggtctttggtgtttataaatccccctattcccaacagaggagagggaatatggggatttataacctggcggcagcgcaaaagatg

SEQ ID NO: 16375 - DNA, 103 bp, Artificial Sequence
  Synthetic Polynucleotide
taatacgactcactatagggtgtattctttggtgtttataaatccccctaaacagaggagataggggatgttataaacaaacctggcggcagcgcaaaagatg

SEQ ID NO: 16376 - DNA, 103 bp, Artificial Sequence
  Synthetic Polynucleotide
taatacgactcactatagggatttttgtattctttggtgtttataaatccaacagaggagaggatttatgaacaccaaaaacctggcggcagcgcaaaagatg

SEQ ID NO: 16377 - DNA, 103 bp, Artificial Sequence
  Synthetic Polynucleotide
taatacgactcactatagggtgggtacagagtgaaggccttgtagttataaacagaggagatataacatgaaggccttcaacctggcggcagcgcaaaagatg

SEQ ID NO: 16378 - DNA, 103 bp, Artificial Sequence
  Synthetic Polynucleotide
taatacgactcactatagggtctacatttttgtattctttggtgtttataaacagaggagatataaaatgcaaagaataaacctggcggcagcgcaaaagatg

SEQ ID NO: 16379 - DNA, 103 bp, Artificial Sequence
  Synthetic Polynucleotide
taatacgactcactatagggttatttctacatttttgtattctttggtgtaacagaggagaacaccaatgaatacaaaaaacctggcggcagcgcaaaagatg

SEQ ID NO: 16380 - DNA, 103 bp, Artificial Sequence
  Synthetic Polynucleotide
taatacgactcactatagggtacttttatttctacatttttgtattctttaacagaggagaaaagaaatgaaaaatgtaaacctggcggcagcgcaaaagatg

SEQ ID NO: 16381 - DNA, 103 bp, Artificial Sequence
  Synthetic Polynucleotide
taatacgactcactatagggtttagtacttttatttctacatttttgtataacagaggagaatacaaatgtgtagaaataacctggcggcagcgcaaaagatg

SEQ ID NO: 16382 - DNA, 103 bp, Artificial Sequence
  Synthetic Polynucleotide
taatacgactcactatagggttttatttagtacttttatttctacattttaacagaggagaaaaatgatgaaataaaagaacctggcggcagcgcaaaagatg

SEQ ID NO: 16383 - DNA, 103 bp, Artificial Sequence
  Synthetic Polynucleotide
taatacgactcactatagggtactcttttatttagtacttttatttctacaacagaggagagtagaaatgaaagtactaaacctggcggcagcgcaaaagatg

SEQ ID NO: 16384 - DNA, 103 bp, Artificial Sequence
  Synthetic Polynucleotide
taatacgactcactataggggctcttactcttttatttagtacttttattaacagaggagaaataaaatgactaaataaaacctggcggcagcgcaaaagatg

SEQ ID NO: 16385 - DNA, 103 bp, Artificial Sequence
  Synthetic Polynucleotide
taatacgactcactatagggtggtggctcttactcttttatttagtacttaacagaggagaaagtacatgataaaagagaacctggcggcagcgcaaaagatg

SEQ ID NO: 16386 - DNA, 103 bp, Artificial Sequence
  Synthetic Polynucleotide
taatacgactcactatagggcattatggtggctcttactcttttatttagaacagaggagactaaatatgagagtaagaaacctggcggcagcgcaaaagatg

SEQ ID NO: 16387 - DNA, 103 bp, Artificial Sequence
  Synthetic Polynucleotide
taatacgactcactatagggcctgtcattatggtggctcttactcttttaaacagaggagataaaagatgaagagccacaacctggcggcagcgcaaaagatg

SEQ ID NO: 16388 - DNA, 103 bp, Artificial Sequence
  Synthetic Polynucleotide
taatacgactcactatagggtcttctgggtacagagtgaaggccttgtagaacagaggagactacaaatgcttcactctaacctggcggcagcgcaaaagatg

SEQ ID NO: 16389 - DNA, 103 bp, Artificial Sequence
  Synthetic Polynucleotide
taatacgactcactatagggtatctcctgtcattatggtggctcttactcaacagaggagagagtaaatgccaccataaaacctggcggcagcgcaaaagatg

SEQ ID NO: 16390 - DNA, 103 bp, Artificial Sequence
  Synthetic Polynucleotide
taatacgactcactatagggtggggtatctcctgtcattatggtggctctaacagaggagaagagccatgataatgacaaacctggcggcagcgcaaaagatg

SEQ ID NO: 16391 - DNA, 103 bp, Artificial Sequence
  Synthetic Polynucleotide
taatacgactcactatagggttgattggggtatctcctgtcattatggtgaacagaggagacaccatatggacaggagaaacctggcggcagcgcaaaagatg

SEQ ID NO: 16392 - DNA, 103 bp, Artificial Sequence
  Synthetic Polynucleotide
taatacgactcactatagggagatgttgattggggtatctcctgtcattaaacagaggagataatgaatggagatacccaacctggcggcagcgcaaaagatg

SEQ ID NO: 16393 - DNA, 103 bp, Artificial Sequence
  Synthetic Polynucleotide
taatacgactcactataggggccaaagatgttgattggggtatctcctgtaacagaggagaacaggaatgaccccaatcaacctggcggcagcgcaaaagatg

SEQ ID NO: 16394 - DNA, 103 bp, Artificial Sequence
  Synthetic Polynucleotide
taatacgactcactatagggtttctgccaaagatgttgattggggtatctaacagaggagaagatacatgaatcaacataacctggcggcagcgcaaaagatg

SEQ ID NO: 16395 - DNA, 103 bp, Artificial Sequence
  Synthetic Polynucleotide
taatacgactcactataggggaatatttctgccaaagatgttgattggggaacagaggagaccccaaatgacatctttgaacctggcggcagcgcaaaagatg

SEQ ID NO: 16396 - DNA, 103 bp, Artificial Sequence
  Synthetic Polynucleotide
taatacgactcactatagggtgtcagaatatttctgccaaagatgttgataacagaggagaatcaacatgtttggcagaaacctggcggcagcgcaaaagatg

SEQ ID NO: 16397 - DNA, 103 bp, Artificial Sequence
  Synthetic Polynucleotide
taatacgactcactatagggaaggctgtcagaatatttctgccaaagatgaacagaggagacatcttatgcagaaatataacctggcggcagcgcaaaagatg

SEQ ID NO: 16398 - DNA, 103 bp, Artificial Sequence
  Synthetic Polynucleotide
taatacgactcactatagggtgcctaaggctgtcagaatatttctgccaaaacagaggagattggcaatgatattctgaaacctggcggcagcgcaaaagatg

SEQ ID NO: 16399 - DNA, 103 bp, Artificial Sequence
  Synthetic Polynucleotide
taatacgactcactatagggcaaactcttctgggtacagagtgaaggcctaacagaggagaaggcctatgctctgtaccaacctggcggcagcgcaaaagatg

SEQ ID NO: 16400 - DNA, 103 bp, Artificial Sequence
  Synthetic Polynucleotide
taatacgactcactatagggtgacatgcctaaggctgtcagaatatttctaacagaggagaagaaatatgctgacagccaacctggcggcagcgcaaaagatg

SEQ ID NO: 16401 - DNA, 103 bp, Artificial Sequence
  Synthetic Polynucleotide
taatacgactcactatagggtttaatgacatgcctaaggctgtcagaataaacagaggagatattctatgagccttaggaacctggcggcagcgcaaaagatg

SEQ ID NO: 16402 - DNA, 103 bp, Artificial Sequence
  Synthetic Polynucleotide
taatacgactcactataggggtaaatttaatgacatgcctaaggctgtcaaacagaggagatgacagatgtaggcatgtaacctggcggcagcgcaaaagatg

SEQ ID NO: 16403 - DNA, 103 bp, Artificial Sequence
  Synthetic Polynucleotide
taatacgactcactatagggaactggtaaatttaatgacatgcctaaggcaacagaggagagccttaatgatgtcattaaacctggcggcagcgcaaaagatg

SEQ ID NO: 16404 - DNA, 103 bp, Artificial Sequence
  Synthetic Polynucleotide
taatacgactcactatagggttggcaactggtaaatttaatgacatgcctaacagaggagaaggcatatgattaaatttaacctggcggcagcgcaaaagatg

SEQ ID NO: 16405 - DNA, 103 bp, Artificial Sequence
  Synthetic Polynucleotide
taatacgactcactatagggctatcttggcaactggtaaatttaatgacaaacagaggagatgtcatatgatttaccagaacctggcggcagcgcaaaagatg

SEQ ID NO: 16406 - DNA, 103 bp, Artificial Sequence
  Synthetic Polynucleotide
taatacgactcactatagggtggctctatcttggcaactggtaaatttaaaacagaggagattaaatatgccagttgccaacctggcggcagcgcaaaagatg

SEQ ID NO: 16407 - DNA, 103 bp, Artificial Sequence
  Synthetic Polynucleotide
taatacgactcactatagggtttattggctctatcttggcaactggtaaaaacagaggagatttaccatgtgccaagataacctggcggcagcgcaaaagatg

SEQ ID NO: 16408 - DNA, 103 bp, Artificial Sequence
  Synthetic Polynucleotide
taatacgactcactatagggttacttttattggctctatcttggcaactgaacagaggagacagttgatgagatagagcaacctggcggcagcgcaaaagatg

SEQ ID NO: 16409 - DNA, 103 bp, Artificial Sequence
  Synthetic Polynucleotide
taatacgactcactatagggcaatgttacttttattggctctatcttggcaacagaggagagccaagatggagccaataaacctggcggcagcgcaaaagatg

SEQ ID NO: 16410 - DNA, 103 bp, Artificial Sequence
  Synthetic Polynucleotide
taatacgactcactataggggtgcccaaactcttctgggtacagagtgaaaacagaggagattcactatgtacccagaaaacctggcggcagcgcaaaagatg

SEQ ID NO: 16411 - DNA, 103 bp, Artificial Sequence
  Synthetic Polynucleotide
taatacgactcactatagggggcttcaatgttacttttattggctctatcaacagaggagagatagaatgaataaaagtaacctggcggcagcgcaaaagatg

SEQ ID NO: 16412 - DNA, 103 bp, Artificial Sequence
  Synthetic Polynucleotide
taatacgactcactatagggtccctggcttcaatgttacttttattggctaacagaggagaagccaaatgaagtaacataacctggcggcagcgcaaaagatg

SEQ ID NO: 16413 - DNA, 103 bp, Artificial Sequence
  Synthetic Polynucleotide
taatacgactcactatagggatctttccctggcttcaatgttacttttataacagaggagaataaaaatgacattgaagaacctggcggcagcgcaaaagatg

SEQ ID NO: 16414 - DNA, 103 bp, Artificial Sequence
  Synthetic Polynucleotide
taatacgactcactatagggggtccatctttccctggcttcaatgttactaacagaggagaagtaacatggaagccaggaacctggcggcagcgcaaaagatg

SEQ ID NO: 16415 - DNA, 103 bp, Artificial Sequence
  Synthetic Polynucleotide
taatacgactcactataggggccttggtccatctttccctggcttcaatgaacagaggagacattgaatgcagggaaagaacctggcggcagcgcaaaagatg

SEQ ID NO: 16416 - DNA, 103 bp, Artificial Sequence
  Synthetic Polynucleotide
taatacgactcactatagggtttcagccttggtccatctttccctggcttaacagaggagaaagccaatgaaagatggaaacctggcggcagcgcaaaagatg

SEQ ID NO: 16417 - DNA, 103 bp, Artificial Sequence
  Synthetic Polynucleotide
taatacgactcactatagggcattgtttcagccttggtccatctttccctaacagaggagaagggaaatgtggaccaagaacctggcggcagcgcaaaagatg

SEQ ID NO: 16418 - DNA, 103 bp, Artificial Sequence
  Synthetic Polynucleotide
taatacgactcactatagggggggccattgtttcagccttggtccatcttaacagaggagaaagatgatgcaaggctgaaacctggcggcagcgcaaaagatg

SEQ ID NO: 16419 - DNA, 103 bp, Artificial Sequence
  Synthetic Polynucleotide
taatacgactcactatagggtgttaggggccattgtttcagccttggtccaacagaggagaggaccaatgctgaaacaaaacctggcggcagcgcaaaagatg

SEQ ID NO: 16420 - DNA, 103 bp, Artificial Sequence
  Synthetic Polynucleotide
taatacgactcactatagggtcttttgttaggggccattgtttcagccttaacagaggagaaaggctatgacaatggccaacctggcggcagcgcaaaagatg

SEQ ID NO: 16421 - DNA, 103 bp, Artificial Sequence
  Synthetic Polynucleotide
taatacgactcactatagggtctaggtatatgtctaggattctatgtctcaacagaggagagagacaatgaatcctagaaacctggcggcagcgcaaaagatg

SEQ ID NO: 16422 - DNA, 103 bp, Artificial Sequence
  Synthetic Polynucleotide
taatacgactcactataggggacttgtgcccaaactcttctgggtacagaaacagaggagatctgtaatgagaagagttaacctggcggcagcgcaaaagatg

SEQ ID NO: 16423 - DNA, 103 bp, Artificial Sequence
  Synthetic Polynucleotide
taatacgactcactatagggttttctcttttgttaggggccattgtttcaaacagaggagatgaaacatgggcccctaaaacctggcggcagcgcaaaagatg

SEQ ID NO: 16424 - DNA, 103 bp, Artificial Sequence
  Synthetic Polynucleotide
taatacgactcactatagggttctattttctcttttgttaggggccattgaacagaggagacaatggatgctaacaaaaaacctggcggcagcgcaaaagatg

SEQ ID NO: 16425 - DNA, 103 bp, Artificial Sequence
  Synthetic Polynucleotide
taatacgactcactatagggagtgcttctattttctcttttgttaggggcaacagaggagagcccctatgaaaagagaaaacctggcggcagcgcaaaagatg

SEQ ID NO: 16426 - DNA, 103 bp, Artificial Sequence
  Synthetic Polynucleotide
taatacgactcactatagggcttttagtgcttctattttctcttttgttaaacagaggagataacaaatgagaaaatagaacctggcggcagcgcaaaagatg

SEQ ID NO: 16427 - DNA, 103 bp, Artificial Sequence
  Synthetic Polynucleotide
taatacgactcactataggggatctcttttagtgcttctattttctctttaacagaggagaaaagagatgatagaagcaaacctggcggcagcgcaaaagatg

SEQ ID NO: 16428 - DNA, 103 bp, Artificial Sequence
  Synthetic Polynucleotide
taatacgactcactatagggtcacagatctcttttagtgcttctattttcaacagaggagagaaaatatgagcactaaaaacctggcggcagcgcaaaagatg

SEQ ID NO: 16429 - DNA, 103 bp, Artificial Sequence
  Synthetic Polynucleotide
taatacgactcactatagggttttttcacagatctcttttagtgcttctaaacagaggagatagaagatgtaaaagagaaacctggcggcagcgcaaaagatg

SEQ ID NO: 16430 - DNA, 103 bp, Artificial Sequence
  Synthetic Polynucleotide
taatacgactcactatagggttccattttttcacagatctcttttagtgcaacagaggagagcactaatggagatctgtaacctggcggcagcgcaaaagatg

SEQ ID NO: 16431 - DNA, 103 bp, Artificial Sequence
  Synthetic Polynucleotide
taatacgactcactatagggtctttttccattttttcacagatctcttttaacagaggagaaaaagaatgctgtgaaaaaacctggcggcagcgcaaaagatg

SEQ ID NO: 16432 - DNA, 103 bp, Artificial Sequence
  Synthetic Polynucleotide
taatacgactcactatagggggccctctttttccattttttcacagatctaacagaggagaagatctatgaaaaaatggaacctggcggcagcgcaaaagatg

SEQ ID NO: 16433 - DNA, 103 bp, Artificial Sequence
  Synthetic Polynucleotide
taatacgactcactatagggatcctgacttgtgcccaaactcttctgggtaacagaggagaacccagatgagtttgggcaacctggcggcagcgcaaaagatg

SEQ ID NO: 16434 - DNA, 103 bp, Artificial Sequence
  Synthetic Polynucleotide
taatacgactcactatagggtagctggccctctttttccattttttcacaaacagaggagatgtgaaatgatggaaaaaaacctggcggcagcgcaaaagatg

SEQ ID NO: 16435 - DNA, 103 bp, Artificial Sequence
  Synthetic Polynucleotide
taatacgactcactatagggtcttctagctggccctctttttccatttttaacagaggagaaaaaatatgaaaagagggaacctggcggcagcgcaaaagatg

SEQ ID NO: 16436 - DNA, 103 bp, Artificial Sequence
  Synthetic Polynucleotide
taatacgactcactataggggtgcctcttctagctggccctctttttccaaacagaggagatggaaaatgagggccagcaacctggcggcagcgcaaaagatg

SEQ ID NO: 16437 - DNA, 103 bp, Artificial Sequence
  Synthetic Polynucleotide
taatacgactcactatagggtggaggtgcctcttctagctggccctctttaacagaggagaaaagagatgcagctagaaaacctggcggcagcgcaaaagatg

SEQ ID NO: 16438 - DNA, 103 bp, Artificial Sequence
  Synthetic Polynucleotide
taatacgactcactatagggttagttggaggtgcctcttctagctggcccaacagaggagagggccaatgagaagaggcaacctggcggcagcgcaaaagatg

SEQ ID NO: 16439 - DNA, 103 bp, Artificial Sequence
  Synthetic Polynucleotide
taatacgactcactatagggaaggattagttggaggtgcctcttctagctaacagaggagaagctagatgaggcacctcaacctggcggcagcgcaaaagatg

SEQ ID NO: 16440 - DNA, 103 bp, Artificial Sequence
  Synthetic Polynucleotide
taatacgactcactatagggattataaggattagttggaggtgcctcttcaacagaggagagaagagatgcctccaactaacctggcggcagcgcaaaagatg

SEQ ID NO: 16441 - DNA, 103 bp, Artificial Sequence
  Synthetic Polynucleotide
taatacgactcactatagggggggtattataaggattagttggaggtgccaacagaggagaggcaccatgaactaatccaacctggcggcagcgcaaaagatg

SEQ ID NO: 16442 - DNA, 103 bp, Artificial Sequence
  Synthetic Polynucleotide
taatacgactcactatagggatgtgggggtattataaggattagttggagaacagaggagactccaaatgatccttataaacctggcggcagcgcaaaagatg

SEQ ID NO: 16443 - DNA, 103 bp, Artificial Sequence
  Synthetic Polynucleotide
taatacgactcactatagggtgcaaatgtgggggtattataaggattagtaacagaggagaactaatatgtataataccaacctggcggcagcgcaaaagatg

SEQ ID NO: 16444 - DNA, 103 bp, Artificial Sequence
  Synthetic Polynucleotide
taatacgactcactatagggtggcaatcctgacttgtgcccaaactcttcaacagaggagagaagagatggggcacaagaacctggcggcagcgcaaaagatg

SEQ ID NO: 16445 - DNA, 103 bp, Artificial Sequence
  Synthetic Polynucleotide
taatacgactcactatagggttaattgcaaatgtgggggtattataaggaaacagaggagatccttaatgtacccccacaacctggcggcagcgcaaaagatg

SEQ ID NO: 16446 - DNA, 103 bp, Artificial Sequence
  Synthetic Polynucleotide
taatacgactcactatagggttttcttaattgcaaatgtgggggtattataacagaggagaataataatgccacatttgaacctggcggcagcgcaaaagatg

SEQ ID NO: 16447 - DNA, 103 bp, Artificial Sequence
  Synthetic Polynucleotide
taatacgactcactataggggtcctttttcttaattgcaaatgtgggggtaacagaggagaacccccatgtttgcaattaacctggcggcagcgcaaaagatg

SEQ ID NO: 16448 - DNA, 103 bp, Artificial Sequence
  Synthetic Polynucleotide
taatacgactcactatagggttcttgtcctttttcttaattgcaaatgtgaacagaggagacacattatgaattaagaaaacctggcggcagcgcaaaagatg

SEQ ID NO: 16449 - DNA, 103 bp, Artificial Sequence
  Synthetic Polynucleotide
taatacgactcactatagggatttgttcttgtcctttttcttaattgcaaaacagaggagattgcaaatgagaaaaaggaacctggcggcagcgcaaaagatg

SEQ ID NO: 16450 - DNA, 103 bp, Artificial Sequence
  Synthetic Polynucleotide
taatacgactcactatagggcctccatttgttcttgtcctttttcttaataacagaggagaattaagatgaaggacaagaacctggcggcagcgcaaaagatg

SEQ ID NO: 16451 - DNA, 103 bp, Artificial Sequence
  Synthetic Polynucleotide
taatacgactcactatagggagcatcctccatttgttcttgtcctttttcaacagaggagagaaaaaatgcaagaacaaaacctggcggcagcgcaaaagatg

SEQ ID NO: 16452 - DNA, 103 bp, Artificial Sequence
  Synthetic Polynucleotide
taatacgactcactatagggctatcagcatcctccatttgttcttgtcctaacagaggagaaggacaatgacaaatggaaacctggcggcagcgcaaaagatg

SEQ ID NO: 16453 - DNA, 103 bp, Artificial Sequence
  Synthetic Polynucleotide
taatacgactcactatagggaaaatctatcagcatcctccatttgttcttaacagaggagaaagaacatgtggaggatgaacctggcggcagcgcaaaagatg

SEQ ID NO: 16454 - DNA, 103 bp, Artificial Sequence
  Synthetic Polynucleotide
taatacgactcactatagggtctctaaaatctatcagcatcctccatttgaacagaggagacaaatgatggatgctgataacctggcggcagcgcaaaagatg

SEQ ID NO: 16455 - DNA, 103 bp, Artificial Sequence
  Synthetic Polynucleotide
taatacgactcactatagggttctctggcaatcctgacttgtgcccaaacaacagaggagagtttggatgcaagtcaggaacctggcggcagcgcaaaagatg

SEQ ID NO: 16456 - DNA, 103 bp, Artificial Sequence
  Synthetic Polynucleotide
taatacgactcactatagggttagttctctaaaatctatcagcatcctccaacagaggagaggaggaatgtgatagattaacctggcggcagcgcaaaagatg

SEQ ID NO: 16457 - DNA, 103 bp, Artificial Sequence
  Synthetic Polynucleotide
taatacgactcactatagggcttatttagttctctaaaatctatcagcataacagaggagaatgctgatggattttagaaacctggcggcagcgcaaaagatg

SEQ ID NO: 16458 - DNA, 103 bp, Artificial Sequence
  Synthetic Polynucleotide
taatacgactcactataggggtcaccttatttagttctctaaaatctatcaacagaggagagatagaatgtagagaactaacctggcggcagcgcaaaagatg

SEQ ID NO: 16459 - DNA, 103 bp, Artificial Sequence
  Synthetic Polynucleotide
taatacgactcactatagggcttgagtcaccttatttagttctctaaaataacagaggagaattttaatgaactaaataaacctggcggcagcgcaaaagatg

SEQ ID NO: 16460 - DNA, 103 bp, Artificial Sequence
  Synthetic Polynucleotide
taatacgactcactataggggaaatcttgagtcaccttatttagttctctaacagaggagaagagaaatgaataaggtgaacctggcggcagcgcaaaagatg

SEQ ID NO: 16461 - DNA, 103 bp, Artificial Sequence
  Synthetic Polynucleotide
taatacgactcactatagggtctgtgaaatcttgagtcaccttatttagtaacagaggagaactaaaatgggtgactcaaacctggcggcagcgcaaaagatg

SEQ ID NO: 16462 - DNA, 103 bp, Artificial Sequence
  Synthetic Polynucleotide
taatacgactcactataggggaatttctgtgaaatcttgagtcaccttataacagaggagaataaggatgctcaagattaacctggcggcagcgcaaaagatg

SEQ ID NO: 16463 - DNA, 103 bp, Artificial Sequence
  Synthetic Polynucleotide
taatacgactcactatagggtagctgaatttctgtgaaatcttgagtcacaacagaggagagtgactatggatttcacaaacctggcggcagcgcaaaagatg

SEQ ID NO: 16464 - DNA, 103 bp, Artificial Sequence
  Synthetic Polynucleotide
taatacgactcactatagggattcctagctgaatttctgtgaaatcttgaaacagaggagatcaagaatgcacagaaataacctggcggcagcgcaaaagatg

SEQ ID NO: 16465 - DNA, 103 bp, Artificial Sequence
  Synthetic Polynucleotide
taatacgactcactataggggtggaattcctagctgaatttctgtgaaataacagaggagaatttcaatgaaattcagcaacctggcggcagcgcaaaagatg

SEQ ID NO: 16466 - DNA, 103 bp, Artificial Sequence
  Synthetic Polynucleotide
taatacgactcactatagggattctttctctggcaatcctgacttgtgccaacagaggagaggcacaatgcaggattgcaacctggcggcagcgcaaaagatg

SEQ ID NO: 16467 - DNA, 103 bp, Artificial Sequence
  Synthetic Polynucleotide
taatacgactcactatagggcgggtgtggaattcctagctgaatttctgtaacagaggagaacagaaatgcagctaggaaacctggcggcagcgcaaaagatg

SEQ ID NO: 16468 - DNA, 103 bp, Artificial Sequence
  Synthetic Polynucleotide
taatacgactcactatagggcctgccgggtgtggaattcctagctgaattaacagaggagaaattcaatgaggaattccaacctggcggcagcgcaaaagatg

SEQ ID NO: 16469 - DNA, 103 bp, Artificial Sequence
  Synthetic Polynucleotide
taatacgactcactatagggctagtcctgccgggtgtggaattcctagctaacagaggagaagctagatgttccacaccaacctggcggcagcgcaaaagatg

SEQ ID NO: 16470 - DNA, 103 bp, Artificial Sequence
  Synthetic Polynucleotide
taatacgactcactatagggtttggctagtcctgccgggtgtggaattccaacagaggagaggaattatgcacccggcaaacctggcggcagcgcaaaagatg

SEQ ID NO: 16471 - DNA, 103 bp, Artificial Sequence
  Synthetic Polynucleotide
taatacgactcactatagggttctttttggctagtcctgccgggtgtggaaacagaggagatccacaatgggcaggactaacctggcggcagcgcaaaagatg

SEQ ID NO: 16472 - DNA, 103 bp, Artificial Sequence
  Synthetic Polynucleotide
taatacgactcactatagggtccttttctttttggctagtcctgccgggtaacagaggagaacccggatggactagccaaacctggcggcagcgcaaaagatg

SEQ ID NO: 16473 - DNA, 103 bp, Artificial Sequence
  Synthetic Polynucleotide
taatacgactcactatagggagagatccttttctttttggctagtcctgcaacagaggagagcaggaatggccaaaaagaacctggcggcagcgcaaaagatg

SEQ ID NO: 16474 - DNA, 103 bp, Artificial Sequence
  Synthetic Polynucleotide
taatacgactcactatagggaatatagagatccttttctttttggctagtaacagaggagaactagcatgaaagaaaagaacctggcggcagcgcaaaagatg

SEQ ID NO: 16475 - DNA, 103 bp, Artificial Sequence
  Synthetic Polynucleotide
taatacgactcactatagggcatctaatatagagatccttttctttttggaacagaggagaccaaaaatgaaaggatctaacctggcggcagcgcaaaagatg

SEQ ID NO: 16476 - DNA, 103 bp, Artificial Sequence
  Synthetic Polynucleotide
taatacgactcactatagggccctacatctaatatagagatccttttcttaacagaggagaaagaaaatgatctctataaacctggcggcagcgcaaaagatg

SEQ ID NO: 16477 - DNA, 103 bp, Artificial Sequence
  Synthetic Polynucleotide
taatacgactcactatagggcttccattctttctctggcaatcctgacttaacagaggagaaagtcaatgttgccagagaacctggcggcagcgcaaaagatg

SEQ ID NO: 16478 - DNA, 103 bp, Artificial Sequence
  Synthetic Polynucleotide
taatacgactcactataggggcatcccctacatctaatatagagatccttaacagaggagaaaggatatgtatattagaaacctggcggcagcgcaaaagatg

SEQ ID NO: 16479 - DNA, 103 bp, Artificial Sequence
  Synthetic Polynucleotide
taatacgactcactatagggaataggcatcccctacatctaatatagagaaacagaggagatctctaatgtagatgtagaacctggcggcagcgcaaaagatg

SEQ ID NO: 16480 - DNA, 103 bp, Artificial Sequence
  Synthetic Polynucleotide
taatacgactcactatagggggaaaaataggcatcccctacatctaatataacagaggagaatattaatggtaggggataacctggcggcagcgcaaaagatg

SEQ ID NO: 16481 - DNA, 103 bp, Artificial Sequence
  Synthetic Polynucleotide
taatacgactcactatagggggtatggaaaaataggcatcccctacatctaacagaggagaagatgtatgggatgcctaaacctggcggcagcgcaaaagatg

SEQ ID NO: 16482 - DNA, 103 bp, Artificial Sequence
  Synthetic Polynucleotide
taatacgactcactataggggtagtggtatggaaaaataggcatcccctaaacagaggagataggggatgcctatttttaacctggcggcagcgcaaaagatg

SEQ ID NO: 16483 - DNA, 103 bp, Artificial Sequence
  Synthetic Polynucleotide
taatacgactcactatagggttcatgtagtggtatggaaaaataggcatcaacagaggagagatgccatgttttccataaacctggcggcagcgcaaaagatg

SEQ ID NO: 16484 - DNA, 103 bp, Artificial Sequence
  Synthetic Polynucleotide
taatacgactcactatagggaaatcttcatgtagtggtatggaaaaatagaacagaggagactatttatgcataccactaacctggcggcagcgcaaaagatg

SEQ ID NO: 16485 - DNA, 103 bp, Artificial Sequence
  Synthetic Polynucleotide
taatacgactcactataggggcctaaaatcttcatgtagtggtatggaaaaacagaggagatttccaatgcactacatgaacctggcggcagcgcaaaagatg

SEQ ID NO: 16486 - DNA, 103 bp, Artificial Sequence
  Synthetic Polynucleotide
taatacgactcactatagggatactgcctaaaatcttcatgtagtggtataacagaggagaataccaatgcatgaagataacctggcggcagcgcaaaagatg

SEQ ID NO: 16487 - DNA, 103 bp, Artificial Sequence
  Synthetic Polynucleotide
taatacgactcactataggggcagtatactgcctaaaatcttcatgtagtaacagaggagaactacaatgagattttagaacctggcggcagcgcaaaagatg

SEQ ID NO: 16488 - DNA, 103 bp, Artificial Sequence
  Synthetic Polynucleotide
taatacgactcactatagggtttgccttccattctttctctggcaatcctaacagaggagaaggattatgagagaaagaaacctggcggcagcgcaaaagatg

SEQ ID NO: 16489 - DNA, 103 bp, Artificial Sequence
  Synthetic Polynucleotide
taatacgactcactatagggtaaatgcagtatactgcctaaaatcttcataacagaggagaatgaagatgttaggcagtaacctggcggcagcgcaaaagatg

SEQ ID NO: 16490 - DNA, 103 bp, Artificial Sequence
  Synthetic Polynucleotide
taatacgactcactatagggtagggtaaatgcagtatactgcctaaaatcaacagaggagagattttatgcagtatactaacctggcggcagcgcaaaagatg

SEQ ID NO: 16491 - DNA, 103 bp, Artificial Sequence
  Synthetic Polynucleotide
taatacgactcactataggggctggtagggtaaatgcagtatactgcctaaacagaggagataggcaatgtactgcattaacctggcggcagcgcaaaagatg

SEQ ID NO: 16492 - DNA, 103 bp, Artificial Sequence
  Synthetic Polynucleotide
taatacgactcactatagggttactgctggtagggtaaatgcagtatactaacagaggagaagtataatgcatttacccaacctggcggcagcgcaaaagatg

SEQ ID NO: 16493 - DNA, 103 bp, Artificial Sequence
  Synthetic Polynucleotide
taatacgactcactatagggattgtttactgctggtagggtaaatgcagtaacagaggagaactgcaatgaccctaccaaacctggcggcagcgcaaaagatg

SEQ ID NO: 16494 - DNA, 103 bp, Artificial Sequence
  Synthetic Polynucleotide
taatacgactcactatagggtccatattgtttactgctggtagggtaaataacagaggagaatttacatgaccagcagtaacctggcggcagcgcaaaagatg

SEQ ID NO: 16495 - DNA, 103 bp, Artificial Sequence
  Synthetic Polynucleotide
taatacgactcactatagggctggttccatattgtttactgctggtagggaacagaggagaccctacatgcagtaaacaaacctggcggcagcgcaaaagatg

SEQ ID NO: 16496 - DNA, 103 bp, Artificial Sequence
  Synthetic Polynucleotide
taatacgactcactatagggttttcctggttccatattgtttactgctggaacagaggagaccagcaatgaacaatatgaacctggcggcagcgcaaaagatg

SEQ ID NO: 16497 - DNA, 103 bp, Artificial Sequence
  Synthetic Polynucleotide
taatacgactcactatagggtatctttttcctggttccatattgtttactaacagaggagaagtaaaatgtatggaaccaacctggcggcagcgcaaaagatg

SEQ ID NO: 16498 - DNA, 103 bp, Artificial Sequence
  Synthetic Polynucleotide
taatacgactcactatagggatatatatctttttcctggttccatattgtaacagaggagaacaataatgaaccaggaaaacctggcggcagcgcaaaagatg

SEQ ID NO: 16499 - DNA, 103 bp, Artificial Sequence
  Synthetic Polynucleotide
taatacgactcactatagggtcagttttgccttccattctttctctggcaaacagaggagatgccagatgaagaatggaaacctggcggcagcgcaaaagatg

SEQ ID NO: 16500 - DNA, 103 bp, Artificial Sequence
  Synthetic Polynucleotide
taatacgactcactatagggtttatatatatatctttttcctggttccataacagaggagaatggaaatgggaaaaagaaacctggcggcagcgcaaaagatg

SEQ ID NO: 16501 - DNA, 103 bp, Artificial Sequence
  Synthetic Polynucleotide
taatacgactcactatagggaagactttatatatatatctttttcctggtaacagaggagaaccaggatgaagatatataacctggcggcagcgcaaaagatg

SEQ ID NO: 16502 - DNA, 103 bp, Artificial Sequence
  Synthetic Polynucleotide
taatacgactcactataggggtggcaagactttatatatatatctttttcaacagaggagagaaaaaatgatatatataaacctggcggcagcgcaaaagatg

SEQ ID NO: 16503 - DNA, 103 bp, Artificial Sequence
  Synthetic Polynucleotide
taatacgactcactatagggtccttgtggcaagactttatatatatatctaacagaggagaagatatatgtataaagtcaacctggcggcagcgcaaaagatg

SEQ ID NO: 16504 - DNA, 103 bp, Artificial Sequence
  Synthetic Polynucleotide
taatacgactcactatagggttccatccttgtggcaagactttatatataaacagaggagatatataatgagtcttgccaacctggcggcagcgcaaaagatg

SEQ ID NO: 16505 - DNA, 103 bp, Artificial Sequence
  Synthetic Polynucleotide
taatacgactcactatagggatcccttccatccttgtggcaagactttataacagaggagaataaagatgtgccacaagaacctggcggcagcgcaaaagatg

SEQ ID NO: 16506 - DNA, 103 bp, Artificial Sequence
  Synthetic Polynucleotide
taatacgactcactatagggtggtgatcccttccatccttgtggcaagacaacagaggagagtcttgatgcaaggatggaacctggcggcagcgcaaaagatg

SEQ ID NO: 16507 - DNA, 103 bp, Artificial Sequence
  Synthetic Polynucleotide
taatacgactcactatagggattgctggtgatcccttccatccttgtggcaacagaggagagccacaatgatggaagggaacctggcggcagcgcaaaagatg

SEQ ID NO: 16508 - DNA, 103 bp, Artificial Sequence
  Synthetic Polynucleotide
taatacgactcactataggggaaaaattgctggtgatcccttccatccttaacagaggagaaaggatatgagggatcacaacctggcggcagcgcaaaagatg

SEQ ID NO: 16509 - DNA, 103 bp, Artificial Sequence
  Synthetic Polynucleotide
taatacgactcactataggggtattgaaaaattgctggtgatcccttccaaacagaggagatggaagatgtcaccagcaaacctggcggcagcgcaaaagatg

SEQ ID NO: 16510 - DNA, 103 bp, Artificial Sequence
  Synthetic Polynucleotide
taatacgactcactatagggtgctttcagttttgccttccattctttctcaacagaggagagagaaaatgtggaaggcaaacctggcggcagcgcaaaagatg

SEQ ID NO: 16511 - DNA, 103 bp, Artificial Sequence
  Synthetic Polynucleotide
taatacgactcactatagggattgtgtattgaaaaattgctggtgatcccaacagaggagagggatcatgagcaattttaacctggcggcagcgcaaaagatg

SEQ ID NO: 16512 - DNA, 103 bp, Artificial Sequence
  Synthetic Polynucleotide
taatacgactcactataggggcctcattgtgtattgaaaaattgctggtgaacagaggagacaccagatgtttttcaataacctggcggcagcgcaaaagatg

SEQ ID NO: 16513 - DNA, 103 bp, Artificial Sequence
  Synthetic Polynucleotide
taatacgactcactataggggacttgcctcattgtgtattgaaaaattgcaacagaggagagcaattatgcaatacacaaacctggcggcagcgcaaaagatg

SEQ ID NO: 16514 - DNA, 103 bp, Artificial Sequence
  Synthetic Polynucleotide
taatacgactcactatagggtctaagacttgcctcattgtgtattgaaaaaacagaggagattttcaatgcacaatgagaacctggcggcagcgcaaaagatg

SEQ ID NO: 16515 - DNA, 103 bp, Artificial Sequence
  Synthetic Polynucleotide
taatacgactcactatagggaaggttctaagacttgcctcattgtgtattaacagaggagaaatacaatgtgaggcaagaacctggcggcagcgcaaaagatg

SEQ ID NO: 16516 - DNA, 103 bp, Artificial Sequence
  Synthetic Polynucleotide
taatacgactcactatagggtctgaaaggttctaagacttgcctcattgtaacagaggagaacaatgatgcaagtcttaaacctggcggcagcgcaaaagatg

SEQ ID NO: 16517 - DNA, 103 bp, Artificial Sequence
  Synthetic Polynucleotide
taatacgactcactataggggcttttctgaaaggttctaagacttgcctcaacagaggagagaggcaatgcttagaaccaacctggcggcagcgcaaaagatg

SEQ ID NO: 16518 - DNA, 103 bp, Artificial Sequence
  Synthetic Polynucleotide
taatacgactcactatagggggtttgcttttctgaaaggttctaagacttaacagaggagaaagtctatgaacctttcaaacctggcggcagcgcaaaagatg

SEQ ID NO: 16519 - DNA, 103 bp, Artificial Sequence
  Synthetic Polynucleotide
taatacgactcactatagggatctgggtttgcttttctgaaaggttctaaaacagaggagattagaaatgttcagaaaaaacctggcggcagcgcaaaagatg

SEQ ID NO: 16520 - DNA, 103 bp, Artificial Sequence
  Synthetic Polynucleotide
taatacgactcactatagggatgacatctgggtttgcttttctgaaaggtaacagaggagaacctttatgaaaagcaaaaacctggcggcagcgcaaaagatg

SEQ ID NO: 16521 - DNA, 103 bp, Artificial Sequence
  Synthetic Polynucleotide
taatacgactcactatagggcctcttgctttcagttttgccttccattctaacagaggagaagaatgatgggcaaaactaacctggcggcagcgcaaaagatg

SEQ ID NO: 16522 - DNA, 103 bp, Artificial Sequence
  Synthetic Polynucleotide
taatacgactcactatagggtgagaatgacatctgggtttgcttttctgaaacagaggagatcagaaatgcaaacccagaacctggcggcagcgcaaaagatg

SEQ ID NO: 16523 - DNA, 103 bp, Artificial Sequence
  Synthetic Polynucleotide
taatacgactcactatagggctggatgagaatgacatctgggtttgctttaacagaggagaaaagcaatgccagatgtcaacctggcggcagcgcaaaagatg

SEQ ID NO: 16524 - DNA, 103 bp, Artificial Sequence
  Synthetic Polynucleotide
taatacgactcactatagggatgtactggatgagaatgacatctgggtttaacagaggagaaaacccatgtgtcattctaacctggcggcagcgcaaaagatg

SEQ ID NO: 16525 - DNA, 103 bp, Artificial Sequence
  Synthetic Polynucleotide
taatacgactcactatagggcatccatgtactggatgagaatgacatctgaacagaggagacagatgatgttctcatccaacctggcggcagcgcaaaagatg

SEQ ID NO: 16526 - DNA, 103 bp, Artificial Sequence
  Synthetic Polynucleotide
taatacgactcactataggggatatcatccatgtactggatgagaatgacaacagaggagagtcattatgatccagtacaacctggcggcagcgcaaaagatg

SEQ ID NO: 16527 - DNA, 103 bp, Artificial Sequence
  Synthetic Polynucleotide
taatacgactcactatagggattaagatatcatccatgtactggatgagaaacagaggagatctcatatggtacatggaaacctggcggcagcgcaaaagatg

SEQ ID NO: 16528 - DNA, 103 bp, Artificial Sequence
  Synthetic Polynucleotide
taatacgactcactatagggtagctattaagatatcatccatgtactggaaacagaggagatccagtatgtggatgataaacctggcggcagcgcaaaagatg

SEQ ID NO: 16529 - DNA, 103 bp, Artificial Sequence
  Synthetic Polynucleotide
taatacgactcactataggggtcactagctattaagatatcatccatgtaaacagaggagatacatgatggatatcttaaacctggcggcagcgcaaaagatg

SEQ ID NO: 16530 - DNA, 103 bp, Artificial Sequence
  Synthetic Polynucleotide
taatacgactcactataggggtcctgtcactagctattaagatatcatccaacagaggagaggatgaatgcttaatagcaacctggcggcagcgcaaaagatg

SEQ ID NO: 16531 - DNA, 103 bp, Artificial Sequence
  Synthetic Polynucleotide
taatacgactcactatagggaacctgtcctgtcactagctattaagatataacagaggagaatatctatgtagctagtgaacctggcggcagcgcaaaagatg

SEQ ID NO: 16532 - DNA, 103 bp, Artificial Sequence
  Synthetic Polynucleotide
taatacgactcactatagggctttttctaggtatatgtctaggattctataacagaggagaatagaaatgtagacatataacctggcggcagcgcaaaagatg

SEQ ID NO: 16533 - DNA, 103 bp, Artificial Sequence
  Synthetic Polynucleotide
taatacgactcactataggggtatccctcttgctttcagttttgccttccaacagaggagaggaaggatgaactgaaagaacctggcggcagcgcaaaagatg

SEQ ID NO: 16534 - DNA, 103 bp, Artificial Sequence
  Synthetic Polynucleotide
taatacgactcactatagggctctaaacctgtcctgtcactagctattaaaacagaggagattaataatgagtgacaggaacctggcggcagcgcaaaagatg

SEQ ID NO: 16535 - DNA, 103 bp, Artificial Sequence
  Synthetic Polynucleotide
taatacgactcactatagggtcatgctctaaacctgtcctgtcactagctaacagaggagaagctagatgcaggacaggaacctggcggcagcgcaaaagatg

SEQ ID NO: 16536 - DNA, 103 bp, Artificial Sequence
  Synthetic Polynucleotide
taatacgactcactatagggctttgtcatgctctaaacctgtcctgtcacaacagaggagagtgacaatgcaggtttagaacctggcggcagcgcaaaagatg

SEQ ID NO: 16537 - DNA, 103 bp, Artificial Sequence
  Synthetic Polynucleotide
taatacgactcactataggggaccactttgtcatgctctaaacctgtcctaacagaggagaaggacaatgttagagcataacctggcggcagcgcaaaagatg

SEQ ID NO: 16538 - DNA, 103 bp, Artificial Sequence
  Synthetic Polynucleotide
taatacgactcactatagggtgcaggaccactttgtcatgctctaaacctaacagaggagaaggtttatggcatgacaaaacctggcggcagcgcaaaagatg

SEQ ID NO: 16539 - DNA, 103 bp, Artificial Sequence
  Synthetic Polynucleotide
taatacgactcactatagggttagctgcaggaccactttgtcatgctctaaacagaggagatagagcatgacaaagtggaacctggcggcagcgcaaaagatg

SEQ ID NO: 16540 - DNA, 103 bp, Artificial Sequence
  Synthetic Polynucleotide
taatacgactcactatagggttcttttagctgcaggaccactttgtcatgaacagaggagacatgacatggtggtcctgaacctggcggcagcgcaaaagatg

SEQ ID NO: 16541 - DNA, 103 bp, Artificial Sequence
  Synthetic Polynucleotide
taatacgactcactatagggagaagttcttttagctgcaggaccactttgaacagaggagacaaagtatgcctgcagctaacctggcggcagcgcaaaagatg

SEQ ID NO: 16542 - DNA, 103 bp, Artificial Sequence
  Synthetic Polynucleotide
taatacgactcactatagggcatttagaagttcttttagctgcaggaccaaacagaggagatggtccatgagctaaaagaacctggcggcagcgcaaaagatg

SEQ ID NO: 16543 - DNA, 103 bp, Artificial Sequence
  Synthetic Polynucleotide
taatacgactcactatagggtaggccatttagaagttcttttagctgcagaacagaggagactgcagatgaaagaacttaacctggcggcagcgcaaaagatg

SEQ ID NO: 16544 - DNA, 103 bp, Artificial Sequence
  Synthetic Polynucleotide
taatacgactcactatagggatatggtatccctcttgctttcagttttgcaacagaggagagcaaaaatgaaagcaagaaacctggcggcagcgcaaaagatg

SEQ ID NO: 16545 - DNA, 103 bp, Artificial Sequence
  Synthetic Polynucleotide
taatacgactcactatagggaaccctaggccatttagaagttcttttagcaacagaggagagctaaaatgacttctaaaaacctggcggcagcgcaaaagatg

SEQ ID NO: 16546 - DNA, 103 bp, Artificial Sequence
  Synthetic Polynucleotide
taatacgactcactatagggtagaaaaccctaggccatttagaagttcttaacagaggagaaagaacatgtaaatggccaacctggcggcagcgcaaaagatg

SEQ ID NO: 16547 - DNA, 103 bp, Artificial Sequence
  Synthetic Polynucleotide
taatacgactcactatagggtggagtagaaaaccctaggccatttagaagaacagaggagacttctaatgggcctagggaacctggcggcagcgcaaaagatg

SEQ ID NO: 16548 - DNA, 103 bp, Artificial Sequence
  Synthetic Polynucleotide
taatacgactcactatagggtcatctggagtagaaaaccctaggccatttaacagaggagaaaatggatgagggttttcaacctggcggcagcgcaaaagatg

SEQ ID NO: 16549 - DNA, 103 bp, Artificial Sequence
  Synthetic Polynucleotide
taatacgactcactatagggacttctcatctggagtagaaaaccctaggcaacagaggagagcctagatgtttctactcaacctggcggcagcgcaaaagatg

SEQ ID NO: 16550 - DNA, 103 bp, Artificial Sequence
  Synthetic Polynucleotide
taatacgactcactatagggttggaacttctcatctggagtagaaaacccaacagaggagagggtttatgactccagataacctggcggcagcgcaaaagatg

SEQ ID NO: 16551 - DNA, 103 bp, Artificial Sequence
  Synthetic Polynucleotide
taatacgactcactatagggtctttttggaacttctcatctggagtagaaaacagaggagattctacatgagatgagaaaacctggcggcagcgcaaaagatg

SEQ ID NO: 16552 - DNA, 103 bp, Artificial Sequence
  Synthetic Polynucleotide
taatacgactcactataggggagggtctttttggaacttctcatctggagaacagaggagactccagatgagaagttccaacctggcggcagcgcaaaagatg

SEQ ID NO: 16553 - DNA, 103 bp, Artificial Sequence
  Synthetic Polynucleotide
taatacgactcactatagggaaatggagggtctttttggaacttctcatcaacagaggagagatgagatgttccaaaaaaacctggcggcagcgcaaaagatg

SEQ ID NO: 16554 - DNA, 103 bp, Artificial Sequence
  Synthetic Polynucleotide
taatacgactcactatagggcattgaaatggagggtctttttggaacttcaacagaggagagaagttatgaaaagacccaacctggcggcagcgcaaaagatg

SEQ ID NO: 16555 - DNA, 103 bp, Artificial Sequence
  Synthetic Polynucleotide
taatacgactcactatagggtcactatatggtatccctcttgctttcagtaacagaggagaactgaaatgaagagggataacctggcggcagcgcaaaagatg

SEQ ID NO: 16556 - DNA, 103 bp, Artificial Sequence
  Synthetic Polynucleotide
taatacgactcactatagggccatccattgaaatggagggtctttttggaaacagaggagatccaaaatgaccctccataacctggcggcagcgcaaaagatg

SEQ ID NO: 16557 - DNA, 103 bp, Artificial Sequence
  Synthetic Polynucleotide
taatacgactcactatagggacagcccatccattgaaatggagggtctttaacagaggagaaaagacatgccatttcaaaacctggcggcagcgcaaaagatg

SEQ ID NO: 16558 - DNA, 103 bp, Artificial Sequence
  Synthetic Polynucleotide
taatacgactcactatagggagttcacagcccatccattgaaatggagggaacagaggagaccctccatgtcaatggataacctggcggcagcgcaaaagatg

SEQ ID NO: 16559 - DNA, 103 bp, Artificial Sequence
  Synthetic Polynucleotide
taatacgactcactataggggccatagttcacagcccatccattgaaatgaacagaggagacatttcatgggatgggctaacctggcggcagcgcaaaagatg

SEQ ID NO: 16560 - DNA, 103 bp, Artificial Sequence
  Synthetic Polynucleotide
taatacgactcactatagggagttggccatagttcacagcccatccattgaacagaggagacaatggatgggctgtgaaaacctggcggcagcgcaaaagatg

SEQ ID NO: 16561 - DNA, 103 bp, Artificial Sequence
  Synthetic Polynucleotide
taatacgactcactatagggcatttagttggccatagttcacagcccatcaacagaggagagatgggatgtgaactatgaacctggcggcagcgcaaaagatg

SEQ ID NO: 16562 - DNA, 103 bp, Artificial Sequence
  Synthetic Polynucleotide
taatacgactcactataggggcttccatttagttggccatagttcacagcaacagaggagagctgtgatgtatggccaaaacctggcggcagcgcaaaagatg

SEQ ID NO: 16563 - DNA, 103 bp, Artificial Sequence
  Synthetic Polynucleotide
taatacgactcactatagggctgcagcttccatttagttggccatagttcaacagaggagagaactaatgccaactaaaaacctggcggcagcgcaaaagatg

SEQ ID NO: 16564 - DNA, 103 bp, Artificial Sequence
  Synthetic Polynucleotide
taatacgactcactatagggagtttctgcagcttccatttagttggccataacagaggagaatggccatgtaaatggaaaacctggcggcagcgcaaaagatg

SEQ ID NO: 16565 - DNA, 103 bp, Artificial Sequence
  Synthetic Polynucleotide
taatacgactcactataggggttgtagtttctgcagcttccatttagttgaacagaggagacaactaatgggaagctgcaacctggcggcagcgcaaaagatg

SEQ ID NO: 16566 - DNA, 103 bp, Artificial Sequence
  Synthetic Polynucleotide
taatacgactcactataggggttattcactatatggtatccctcttgcttaacagaggagaaagcaaatgggataccataacctggcggcagcgcaaaagatg

SEQ ID NO: 16567 - DNA, 103 bp, Artificial Sequence
  Synthetic Polynucleotide
taatacgactcactataggggggcagttgtagtttctgcagcttccatttaacagaggagaaaatggatgctgcagaaaaacctggcggcagcgcaaaagatg

SEQ ID NO: 16568 - DNA, 103 bp, Artificial Sequence
  Synthetic Polynucleotide
taatacgactcactatagggttctggggcagttgtagtttctgcagcttcaacagaggagagaagctatggaaactacaaacctggcggcagcgcaaaagatg

SEQ ID NO: 16569 - DNA, 103 bp, Artificial Sequence
  Synthetic Polynucleotide
taatacgactcactatagggtgtctttctggggcagttgtagtttctgcaaacagaggagatgcagaatgtacaactgcaacctggcggcagcgcaaaagatg

SEQ ID NO: 16570 - DNA, 103 bp, Artificial Sequence
  Synthetic Polynucleotide
taatacgactcactatagggccatatgtctttctggggcagttgtagtttaacagaggagaaaactaatgctgccccagaacctggcggcagcgcaaaagatg

SEQ ID NO: 16571 - DNA, 103 bp, Artificial Sequence
  Synthetic Polynucleotide
taatacgactcactatagggactgtccatatgtctttctggggcagttgtaacagaggagaacaactatgccagaaagaaacctggcggcagcgcaaaagatg

SEQ ID NO: 16572 - DNA, 103 bp, Artificial Sequence
  Synthetic Polynucleotide
taatacgactcactatagggcattgactgtccatatgtctttctggggcaaacagaggagatgccccatgaagacatataacctggcggcagcgcaaaagatg

SEQ ID NO: 16573 - DNA, 103 bp, Artificial Sequence
  Synthetic Polynucleotide
taatacgactcactataggggatgtcattgactgtccatatgtctttctgaacagaggagacagaaaatgatatggacaaacctggcggcagcgcaaaagatg

SEQ ID NO: 16574 - DNA, 103 bp, Artificial Sequence
  Synthetic Polynucleotide
taatacgactcactatagggttttggatgtcattgactgtccatatgtctaacagaggagaagacatatggacagtcaaaacctggcggcagcgcaaaagatg

SEQ ID NO: 16575 - DNA, 103 bp, Artificial Sequence
  Synthetic Polynucleotide
taatacgactcactatagggctagcttttggatgtcattgactgtccataaacagaggagatatggaatgtcaatgacaaacctggcggcagcgcaaaagatg

SEQ ID NO: 16576 - DNA, 103 bp, Artificial Sequence
  Synthetic Polynucleotide
taatacgactcactatagggtcccactagcttttggatgtcattgactgtaacagaggagaacagtcatggacatccaaaacctggcggcagcgcaaaagatg

SEQ ID NO: 16577 - DNA, 103 bp, Artificial Sequence
  Synthetic Polynucleotide
taatacgactcactatagggttcctgttattcactatatggtatccctctaacagaggagaagagggatgccatatagtaacctggcggcagcgcaaaagatg

SEQ ID NO: 16578 - DNA, 103 bp, Artificial Sequence
  Synthetic Polynucleotide
taatacgactcactatagggaagactcccactagcttttggatgtcattgaacagaggagacaatgaatgccaaaagctaacctggcggcagcgcaaaagatg

SEQ ID NO: 16579 - DNA, 103 bp, Artificial Sequence
  Synthetic Polynucleotide
taatacgactcactatagggaatttaagactcccactagcttttggatgtaacagaggagaacatccatgagctagtggaacctggcggcagcgcaaaagatg

SEQ ID NO: 16580 - DNA, 103 bp, Artificial Sequence
  Synthetic Polynucleotide
taatacgactcactatagggcgcccaatttaagactcccactagcttttgaacagaggagacaaaagatggtgggagtcaacctggcggcagcgcaaaagatg

SEQ ID NO: 16581 - DNA, 103 bp, Artificial Sequence
  Synthetic Polynucleotide
taatacgactcactatagggtgtgccgcccaatttaagactcccactagcaacagaggagagctagtatgagtcttaaaaacctggcggcagcgcaaaagatg

SEQ ID NO: 16582 - DNA, 103 bp, Artificial Sequence
  Synthetic Polynucleotide
taatacgactcactatagggagatttgtgccgcccaatttaagactcccaaacagaggagatgggagatgtaaattgggaacctggcggcagcgcaaaagatg

SEQ ID NO: 16583 - DNA, 103 bp, Artificial Sequence
  Synthetic Polynucleotide
taatacgactcactatagggtgaatagatttgtgccgcccaatttaagacaacagaggagagtcttaatgtgggcggcaaacctggcggcagcgcaaaagatg

SEQ ID NO: 16584 - DNA, 103 bp, Artificial Sequence
  Synthetic Polynucleotide
taatacgactcactatagggattcctgaatagatttgtgccgcccaatttaacagaggagaaaattgatgggcacaaataacctggcggcagcgcaaaagatg

SEQ ID NO: 16585 - DNA, 103 bp, Artificial Sequence
  Synthetic Polynucleotide
taatacgactcactatagggtttttattcctgaatagatttgtgccgcccaacagaggagagggcggatgaaatctattaacctggcggcagcgcaaaagatg

SEQ ID NO: 16586 - DNA, 103 bp, Artificial Sequence
  Synthetic Polynucleotide
taatacgactcactatagggtttggtttttattcctgaatagatttgtgcaacagaggagagcacaaatgtattcaggaaacctggcggcagcgcaaaagatg

SEQ ID NO: 16587 - DNA, 103 bp, Artificial Sequence
  Synthetic Polynucleotide
taatacgactcactatagggaagtgtttggtttttattcctgaatagattaacagaggagaaatctaatgaggaataaaaacctggcggcagcgcaaaagatg

SEQ ID NO: 16588 - DNA, 103 bp, Artificial Sequence
  Synthetic Polynucleotide
taatacgactcactatagggggttgttcctgttattcactatatggtatcaacagaggagagataccatgtagtgaataaacctggcggcagcgcaaaagatg

SEQ ID NO: 16589 - DNA, 103 bp, Artificial Sequence
  Synthetic Polynucleotide
taatacgactcactatagggtacataagtgtttggtttttattcctgaataacagaggagaattcagatgtaaaaaccaaacctggcggcagcgcaaaagatg

SEQ ID NO: 16590 - DNA, 103 bp, Artificial Sequence
  Synthetic Polynucleotide
taatacgactcactatagggtagtctacataagtgtttggtttttattccaacagaggagaggaataatgaccaaacacaacctggcggcagcgcaaaagatg

SEQ ID NO: 16591 - DNA, 103 bp, Artificial Sequence
  Synthetic Polynucleotide
taatacgactcactatagggctaattagtctacataagtgtttggtttttaacagaggagaaaaaacatgacacttatgaacctggcggcagcgcaaaagatg

SEQ ID NO: 16592 - DNA, 103 bp, Artificial Sequence
  Synthetic Polynucleotide
taatacgactcactatagggttcctctaattagtctacataagtgtttggaacagaggagaccaaacatgtatgtagacaacctggcggcagcgcaaaagatg

SEQ ID NO: 16593 - DNA, 103 bp, Artificial Sequence
  Synthetic Polynucleotide
taatacgactcactatagggcatttttcctctaattagtctacataagtgaacagaggagacacttaatgagactaattaacctggcggcagcgcaaaagatg

SEQ ID NO: 16594 - DNA, 103 bp, Artificial Sequence
  Synthetic Polynucleotide
taatacgactcactatagggagtgtcatttttcctctaattagtctacataacagaggagaatgtagatgaattagaggaacctggcggcagcgcaaaagatg

SEQ ID NO: 16595 - DNA, 103 bp, Artificial Sequence
  Synthetic Polynucleotide
taatacgactcactatagggctgtgagtgtcatttttcctctaattagtcaacagaggagagactaaatggaggaaaaaaacctggcggcagcgcaaaagatg

SEQ ID NO: 16596 - DNA, 103 bp, Artificial Sequence
  Synthetic Polynucleotide
taatacgactcactatagggttcttctgtgagtgtcatttttcctctaataacagaggagaattagaatgaaaatgacaaacctggcggcagcgcaaaagatg

SEQ ID NO: 16597 - DNA, 103 bp, Artificial Sequence
  Synthetic Polynucleotide
taatacgactcactatagggtgcacttcttctgtgagtgtcatttttcctaacagaggagaaggaaaatggacactcacaacctggcggcagcgcaaaagatg

SEQ ID NO: 16598 - DNA, 103 bp, Artificial Sequence
  Synthetic Polynucleotide
taatacgactcactatagggtccactgcacttcttctgtgagtgtcatttaacagaggagaaaatgaatgtcacagaagaacctggcggcagcgcaaaagatg

SEQ ID NO: 16599 - DNA, 103 bp, Artificial Sequence
  Synthetic Polynucleotide
taatacgactcactatagggagtatggttgttcctgttattcactatatgaacagaggagacatataatgaataacaggaacctggcggcagcgcaaaagatg

SEQ ID NO: 16600 - DNA, 103 bp, Artificial Sequence
  Synthetic Polynucleotide
taatacgactcactatagggttctgtccactgcacttcttctgtgagtgtaacagaggagaacactcatggaagaagtgaacctggcggcagcgcaaaagatg

SEQ ID NO: 16601 - DNA, 103 bp, Artificial Sequence
  Synthetic Polynucleotide
taatacgactcactataggggctagttctgtccactgcacttcttctgtgaacagaggagacacagaatgagtgcagtgaacctggcggcagcgcaaaagatg

SEQ ID NO: 16602 - DNA, 103 bp, Artificial Sequence
  Synthetic Polynucleotide
taatacgactcactatagggcttctgctagttctgtccactgcacttcttaacagaggagaaagaagatgagtggacagaacctggcggcagcgcaaaagatg

SEQ ID NO: 16603 - DNA, 103 bp, Artificial Sequence
  Synthetic Polynucleotide
taatacgactcactatagggctctgcttctgctagttctgtccactgcacaacagaggagagtgcagatgacagaactaaacctggcggcagcgcaaaagatg

SEQ ID NO: 16604 - DNA, 103 bp, Artificial Sequence
  Synthetic Polynucleotide
taatacgactcactatagggtctagctctgcttctgctagttctgtccacaacagaggagagtggacatgactagcagaaacctggcggcagcgcaaaagatg

SEQ ID NO: 16605 - DNA, 103 bp, Artificial Sequence
  Synthetic Polynucleotide
taatacgactcactatagggtttcttctagctctgcttctgctagttctgaacagaggagacagaacatgcagaagcagaacctggcggcagcgcaaaagatg

SEQ ID NO: 16606 - DNA, 103 bp, Artificial Sequence
  Synthetic Polynucleotide
taatacgactcactatagggtttgttttcttctagctctgcttctgctagaacagaggagactagcaatggcagagctaaacctggcggcagcgcaaaagatg

SEQ ID NO: 16607 - DNA, 103 bp, Artificial Sequence
  Synthetic Polynucleotide
taatacgactcactatagggataattttgttttcttctagctctgcttctaacagaggagaagaagcatggctagaagaaacctggcggcagcgcaaaagatg

SEQ ID NO: 16608 - DNA, 103 bp, Artificial Sequence
  Synthetic Polynucleotide
taatacgactcactatagggtcaagataattttgttttcttctagctctgaacagaggagacagagcatgaagaaaacaaacctggcggcagcgcaaaagatg

SEQ ID NO: 16609 - DNA, 103 bp, Artificial Sequence
  Synthetic Polynucleotide
taatacgactcactatagggctggctcaagataattttgttttcttctagaacagaggagactagaaatgaacaaaattaacctggcggcagcgcaaaagatg

SEQ ID NO: 16610 - DNA, 103 bp, Artificial Sequence
  Synthetic Polynucleotide
taatacgactcactataggggaccaagtatggttgttcctgttattcactaacagaggagaagtgaaatgcaggaacaaaacctggcggcagcgcaaaagatg

SEQ ID NO: 16611 - DNA, 103 bp, Artificial Sequence
  Synthetic Polynucleotide
taatacgactcactatagggtgttcctggctcaagataattttgttttctaacagaggagaagaaaaatgaattatcttaacctggcggcagcgcaaaagatg

SEQ ID NO: 16612 - DNA, 103 bp, Artificial Sequence
  Synthetic Polynucleotide
taatacgactcactatagggcttcttgttcctggctcaagataattttgtaacagaggagaacaaaaatgtcttgagccaacctggcggcagcgcaaaagatg

SEQ ID NO: 16613 - DNA, 103 bp, Artificial Sequence
  Synthetic Polynucleotide
taatacgactcactatagggatatccttcttgttcctggctcaagataataacagaggagaattatcatgagccaggaaaacctggcggcagcgcaaaagatg

SEQ ID NO: 16614 - DNA, 103 bp, Artificial Sequence
  Synthetic Polynucleotide
taatacgactcactatagggtaataatatccttcttgttcctggctcaagaacagaggagacttgagatgggaacaagaaacctggcggcagcgcaaaagatg

SEQ ID NO: 16615 - DNA, 103 bp, Artificial Sequence
  Synthetic Polynucleotide
taatacgactcactatagggcttggtaataatatccttcttgttcctggcaacagaggagagccaggatgaagaaggataacctggcggcagcgcaaaagatg

SEQ ID NO: 16616 - DNA, 103 bp, Artificial Sequence
  Synthetic Polynucleotide
taatacgactcactatagggttcttcttggtaataatatccttcttgttcaacagaggagagaacaaatgggatattataacctggcggcagcgcaaaagatg

SEQ ID NO: 16617 - DNA, 103 bp, Artificial Sequence
  Synthetic Polynucleotide
taatacgactcactatagggtctttttcttcttggtaataatatccttctaacagaggagaagaaggatgttattaccaaacctggcggcagcgcaaaagatg

SEQ ID NO: 16618 - DNA, 103 bp, Artificial Sequence
  Synthetic Polynucleotide
taatacgactcactatagggctaattctttttcttcttggtaataatatcaacagaggagagatattatgaccaagaagaacctggcggcagcgcaaaagatg

SEQ ID NO: 16619 - DNA, 103 bp, Artificial Sequence
  Synthetic Polynucleotide
taatacgactcactatagggtgcctctaattctttttcttcttggtaataaacagaggagatattacatggaagaaaaaaacctggcggcagcgcaaaagatg

SEQ ID NO: 16620 - DNA, 103 bp, Artificial Sequence
  Synthetic Polynucleotide
taatacgactcactatagggattgttgcctctaattctttttcttcttggaacagaggagaccaagaatgaaaagaattaacctggcggcagcgcaaaagatg

SEQ ID NO: 16621 - DNA, 103 bp, Artificial Sequence
  Synthetic Polynucleotide
taatacgactcactataggggccttgaccaagtatggttgttcctgttataacagaggagaataacaatgacaaccataaacctggcggcagcgcaaaagatg

SEQ ID NO: 16622 - DNA, 103 bp, Artificial Sequence
  Synthetic Polynucleotide
taatacgactcactatagggtttggattgttgcctctaattctttttcttaacagaggagaaagaaaatgaattagaggaacctggcggcagcgcaaaagatg

SEQ ID NO: 16623 - DNA, 103 bp, Artificial Sequence
  Synthetic Polynucleotide
taatacgactcactataggggcttttttggattgttgcctctaattctttaacagaggagaaaagaaatggaggcaacaaacctggcggcagcgcaaaagatg

SEQ ID NO: 16624 - DNA, 103 bp, Artificial Sequence
  Synthetic Polynucleotide
taatacgactcactatagggccttggcttttttggattgttgcctctaataacagaggagaattagaatgaacaatccaaacctggcggcagcgcaaaagatg

SEQ ID NO: 16625 - DNA, 103 bp, Artificial Sequence
  Synthetic Polynucleotide
taatacgactcactataggggatgtccttggcttttttggattgttgcctaacagaggagaaggcaaatgtccaaaaaaaacctggcggcagcgcaaaagatg

SEQ ID NO: 16626 - DNA, 103 bp, Artificial Sequence
  Synthetic Polynucleotide
taatacgactcactatagggccattgatgtccttggcttttttggattgtaacagaggagaacaatcatgaaaagccaaaacctggcggcagcgcaaaagatg

SEQ ID NO: 16627 - DNA, 103 bp, Artificial Sequence
  Synthetic Polynucleotide
taatacgactcactatagggtatgtccattgatgtccttggcttttttggaacagaggagaccaaaaatgccaaggacaaacctggcggcagcgcaaaagatg

SEQ ID NO: 16628 - DNA, 103 bp, Artificial Sequence
  Synthetic Polynucleotide
taatacgactcactatagggttttgtatgtccattgatgtccttggctttaacagaggagaaaagccatggacatcaataacctggcggcagcgcaaaagatg

SEQ ID NO: 16629 - DNA, 103 bp, Artificial Sequence
  Synthetic Polynucleotide
taatacgactcactataggggtgtattttgtatgtccattgatgtccttgaacagaggagacaaggaatgcaatggacaaacctggcggcagcgcaaaagatg

SEQ ID NO: 16630 - DNA, 103 bp, Artificial Sequence
  Synthetic Polynucleotide
taatacgactcactatagggtcctggtgtattttgtatgtccattgatgtaacagaggagaacatcaatggacatacaaaacctggcggcagcgcaaaagatg

SEQ ID NO: 16631 - DNA, 103 bp, Artificial Sequence
  Synthetic Polynucleotide
taatacgactcactatagggtctcttcctggtgtattttgtatgtccattaacagaggagaaatggaatgacaaaatacaacctggcggcagcgcaaaagatg

SEQ ID NO: 16632 - DNA, 103 bp, Artificial Sequence
  Synthetic Polynucleotide
taatacgactcactatagggttcctgccttgaccaagtatggttgttcctaacagaggagaaggaacatgcatacttggaacctggcggcagcgcaaaagatg

SEQ ID NO: 16633 - DNA, 103 bp, Artificial Sequence
  Synthetic Polynucleotide
taatacgactcactataggggattttctcttcctggtgtattttgtatgtaacagaggagaacatacatgatacaccagaacctggcggcagcgcaaaagatg

SEQ ID NO: 16634 - DNA, 103 bp, Artificial Sequence
  Synthetic Polynucleotide
taatacgactcactatagggtttaggattttctcttcctggtgtattttgaacagaggagacaaaatatgccaggaagaaacctggcggcagcgcaaaagatg

SEQ ID NO: 16635 - DNA, 103 bp, Artificial Sequence
  Synthetic Polynucleotide
taatacgactcactatagggctacttttaggattttctcttcctggtgtaaacagaggagatacaccatgaagagaaaaaacctggcggcagcgcaaaagatg

SEQ ID NO: 16636 - DNA, 103 bp, Artificial Sequence
  Synthetic Polynucleotide
taatacgactcactatagggctttcctacttttaggattttctcttcctgaacagaggagacaggaaatgaaaatcctaaacctggcggcagcgcaaaagatg

SEQ ID NO: 16637 - DNA, 103 bp, Artificial Sequence
  Synthetic Polynucleotide
taatacgactcactataggggcatactttcctacttttaggattttctctaacagaggagaagagaaatgcctaaaagtaacctggcggcagcgcaaaagatg

SEQ ID NO: 16638 - DNA, 103 bp, Artificial Sequence
  Synthetic Polynucleotide
taatacgactcactatagggtctttgcatactttcctacttttaggatttaacagaggagaaaatccatgaagtaggaaaacctggcggcagcgcaaaagatg

SEQ ID NO: 16639 - DNA, 103 bp, Artificial Sequence
  Synthetic Polynucleotide
taatacgactcactatagggttttatctttgcatactttcctacttttagaacagaggagactaaaaatgggaaagtataacctggcggcagcgcaaaagatg

SEQ ID NO: 16640 - DNA, 103 bp, Artificial Sequence
  Synthetic Polynucleotide
taatacgactcactataggggtattttttatctttgcatactttcctactaacagaggagaagtaggatggtatgcaaaaacctggcggcagcgcaaaagatg

SEQ ID NO: 16641 - DNA, 103 bp, Artificial Sequence
  Synthetic Polynucleotide
taatacgactcactatagggtatgggtattttttatctttgcatactttcaacagaggagagaaagtatgcaaagataaaacctggcggcagcgcaaaagatg

SEQ ID NO: 16642 - DNA, 103 bp, Artificial Sequence
  Synthetic Polynucleotide
taatacgactcactatagggattggtatgggtattttttatctttgcataaacagaggagatatgcaatgataaaaaataacctggcggcagcgcaaaagatg

SEQ ID NO: 16643 - DNA, 103 bp, Artificial Sequence
  Synthetic Polynucleotide
taatacgactcactatagggttcctctttttctaggtatatgtctaggataacagaggagaatcctaatgatatacctaaacctggcggcagcgcaaaagatg

SEQ ID NO: 16644 - DNA, 103 bp, Artificial Sequence
  Synthetic Polynucleotide
taatacgactcactataggggctacttcctgccttgaccaagtatggttgaacagaggagacaaccaatgttggtcaagaacctggcggcagcgcaaaagatg

SEQ ID NO: 16645 - DNA, 103 bp, Artificial Sequence
  Synthetic Polynucleotide
taatacgactcactatagggaccccattggtatgggtattttttatctttaacagaggagaaaagatatgaaatacccaaacctggcggcagcgcaaaagatg

SEQ ID NO: 16646 - DNA, 103 bp, Artificial Sequence
  Synthetic Polynucleotide
taatacgactcactatagggatctgaccccattggtatgggtattttttaaacagaggagataaaaaatgcccataccaaacctggcggcagcgcaaaagatg

SEQ ID NO: 16647 - DNA, 103 bp, Artificial Sequence
  Synthetic Polynucleotide
taatacgactcactatagggtagtaatctgaccccattggtatgggtattaacagaggagaaataccatgaccaatgggaacctggcggcagcgcaaaagatg

SEQ ID NO: 16648 - DNA, 103 bp, Artificial Sequence
  Synthetic Polynucleotide
taatacgactcactatagggtgtgctagtaatctgaccccattggtatggaacagaggagaccatacatgtggggtcagaacctggcggcagcgcaaaagatg

SEQ ID NO: 16649 - DNA, 103 bp, Artificial Sequence
  Synthetic Polynucleotide
taatacgactcactatagggctacctgtgctagtaatctgaccccattggaacagaggagaccaatgatgtcagattacaacctggcggcagcgcaaaagatg

SEQ ID NO: 16650 - DNA, 103 bp, Artificial Sequence
  Synthetic Polynucleotide
taatacgactcactatagggctgaactacctgtgctagtaatctgaccccaacagaggagaggggtcatgttactagcaaacctggcggcagcgcaaaagatg

SEQ ID NO: 16651 - DNA, 103 bp, Artificial Sequence
  Synthetic Polynucleotide
taatacgactcactatagggattttctgaactacctgtgctagtaatctgaacagaggagacagattatgagcacaggtaacctggcggcagcgcaaaagatg

SEQ ID NO: 16652 - DNA, 103 bp, Artificial Sequence
  Synthetic Polynucleotide
taatacgactcactatagggttcctattttctgaactacctgtgctagtaaacagaggagatactagatgaggtagttcaacctggcggcagcgcaaaagatg

SEQ ID NO: 16653 - DNA, 103 bp, Artificial Sequence
  Synthetic Polynucleotide
taatacgactcactatagggctcttttcctattttctgaactacctgtgcaacagaggagagcacagatggttcagaaaaacctggcggcagcgcaaaagatg

SEQ ID NO: 16654 - DNA, 103 bp, Artificial Sequence
  Synthetic Polynucleotide
taatacgactcactatagggagtgcctcttttcctattttctgaactaccaacagaggagaggtagtatggaaaataggaacctggcggcagcgcaaaagatg

SEQ ID NO: 16655 - DNA, 103 bp, Artificial Sequence
  Synthetic Polynucleotide
taatacgactcactatagggtagtagctacttcctgccttgaccaagtataacagaggagaatacttatgcaaggcaggaacctggcggcagcgcaaaagatg

SEQ ID NO: 16656 - DNA, 103 bp, Artificial Sequence
  Synthetic Polynucleotide
taatacgactcactatagggtgactagtgcctcttttcctattttctgaaaacagaggagattcagaatgtaggaaaagaacctggcggcagcgcaaaagatg

SEQ ID NO: 16657 - DNA, 103 bp, Artificial Sequence
  Synthetic Polynucleotide
taatacgactcactatagggccaaatgactagtgcctcttttcctattttaacagaggagaaaaataatgaaagaggcaaacctggcggcagcgcaaaagatg

SEQ ID NO: 16658 - DNA, 103 bp, Artificial Sequence
  Synthetic Polynucleotide
taatacgactcactatagggcgtccccaaatgactagtgcctcttttcctaacagaggagaaggaaaatgggcactagtaacctggcggcagcgcaaaagatg

SEQ ID NO: 16659 - DNA, 103 bp, Artificial Sequence
  Synthetic Polynucleotide
taatacgactcactataggggtatccgtccccaaatgactagtgcctcttaacagaggagaaagaggatgtagtcatttaacctggcggcagcgcaaaagatg

SEQ ID NO: 16660 - DNA, 103 bp, Artificial Sequence
  Synthetic Polynucleotide
taatacgactcactatagggttttggtatccgtccccaaatgactagtgcaacagaggagagcactaatgatttggggaaacctggcggcagcgcaaaagatg

SEQ ID NO: 16661 - DNA, 103 bp, Artificial Sequence
  Synthetic Polynucleotide
taatacgactcactatagggtgaaattttggtatccgtccccaaatgactaacagaggagaagtcatatggggacggataacctggcggcagcgcaaaagatg

SEQ ID NO: 16662 - DNA, 103 bp, Artificial Sequence
  Synthetic Polynucleotide
taatacgactcactataggggcaggtgaaattttggtatccgtccccaaaaacagaggagatttgggatgggataccaaaacctggcggcagcgcaaaagatg

SEQ ID NO: 16663 - DNA, 103 bp, Artificial Sequence
  Synthetic Polynucleotide
taatacgactcactatagggcactggcaggtgaaattttggtatccgtccaacagaggagaggacggatgccaaaatttaacctggcggcagcgcaaaagatg

SEQ ID NO: 16664 - DNA, 103 bp, Artificial Sequence
  Synthetic Polynucleotide
taatacgactcactatagggctctccactggcaggtgaaattttggtatcaacagaggagagataccatgatttcacctaacctggcggcagcgcaaaagatg

SEQ ID NO: 16665 - DNA, 103 bp, Artificial Sequence
  Synthetic Polynucleotide
taatacgactcactatagggtctctctctccactggcaggtgaaattttgaacagaggagacaaaatatgacctgccagaacctggcggcagcgcaaaagatg

SEQ ID NO: 16666 - DNA, 103 bp, Artificial Sequence
  Synthetic Polynucleotide
taatacgactcactatagggtttcttagtagctacttcctgccttgaccaaacagaggagatggtcaatgcaggaagtaaacctggcggcagcgcaaaagatg

SEQ ID NO: 16667 - DNA, 103 bp, Artificial Sequence
  Synthetic Polynucleotide
taatacgactcactatagggccaggtctctctctccactggcaggtgaaaaacagaggagatttcacatgccagtggagaacctggcggcagcgcaaaagatg

SEQ ID NO: 16668 - DNA, 103 bp, Artificial Sequence
  Synthetic Polynucleotide
taatacgactcactatagggtgctcccaggtctctctctccactggcaggaacagaggagacctgccatgggagagagaaacctggcggcagcgcaaaagatg

SEQ ID NO: 16669 - DNA, 103 bp, Artificial Sequence
  Synthetic Polynucleotide
taatacgactcactatagggaccactgctcccaggtctctctctccactgaacagaggagacagtggatggagagacctaacctggcggcagcgcaaaagatg

SEQ ID NO: 16670 - DNA, 103 bp, Artificial Sequence
  Synthetic Polynucleotide
taatacgactcactatagggatcccaccactgctcccaggtctctctctcaacagaggagagagagaatgacctgggagaacctggcggcagcgcaaaagatg

SEQ ID NO: 16671 - DNA, 103 bp, Artificial Sequence
  Synthetic Polynucleotide
taatacgactcactatagggtagttatcccaccactgctcccaggtctctaacagaggagaagagacatgggagcagtgaacctggcggcagcgcaaaagatg

SEQ ID NO: 16672 - DNA, 103 bp, Artificial Sequence
  Synthetic Polynucleotide
taatacgactcactataggggccagtagttatcccaccactgctcccaggaacagaggagacctgggatgagtggtgggaacctggcggcagcgcaaaagatg

SEQ ID NO: 16673 - DNA, 103 bp, Artificial Sequence
  Synthetic Polynucleotide
taatacgactcactatagggcacttgccagtagttatcccaccactgctcaacagaggagagagcagatgtgggataacaacctggcggcagcgcaaaagatg

SEQ ID NO: 16674 - DNA, 103 bp, Artificial Sequence
  Synthetic Polynucleotide
taatacgactcactatagggcatgtcacttgccagtagttatcccaccacaacagaggagagtggtgatgtaactactgaacctggcggcagcgcaaaagatg

SEQ ID NO: 16675 - DNA, 103 bp, Artificial Sequence
  Synthetic Polynucleotide
taatacgactcactatagggggatccatgtcacttgccagtagttatcccaacagaggagagggataatgactggcaagaacctggcggcagcgcaaaagatg

SEQ ID NO: 16676 - DNA, 103 bp, Artificial Sequence
  Synthetic Polynucleotide
taatacgactcactatagggctctgggatccatgtcacttgccagtagttaacagaggagaaactacatgcaagtgacaaacctggcggcagcgcaaaagatg

SEQ ID NO: 16677 - DNA, 103 bp, Artificial Sequence
  Synthetic Polynucleotide
taatacgactcactatagggagctgtttcttagtagctacttcctgccttaacagaggagaaaggcaatgagtagctacaacctggcggcagcgcaaaagatg

SEQ ID NO: 16678 - DNA, 103 bp, Artificial Sequence
  Synthetic Polynucleotide
taatacgactcactatagggtcccactctgggatccatgtcacttgccagaacagaggagactggcaatggacatggataacctggcggcagcgcaaaagatg

SEQ ID NO: 16679 - DNA, 103 bp, Artificial Sequence
  Synthetic Polynucleotide
taatacgactcactatagggcaaagtcccactctgggatccatgtcacttaacagaggagaaagtgaatgggatcccagaacctggcggcagcgcaaaagatg

SEQ ID NO: 16680 - DNA, 103 bp, Artificial Sequence
  Synthetic Polynucleotide
taatacgactcactatagggagatacaaagtcccactctgggatccatgtaacagaggagaacatggatgccagagtggaacctggcggcagcgcaaaagatg

SEQ ID NO: 16681 - DNA, 103 bp, Artificial Sequence
  Synthetic Polynucleotide
taatacgactcactatagggggggtagatacaaagtcccactctgggatcaacagaggagagatcccatggtgggacttaacctggcggcagcgcaaaagatg

SEQ ID NO: 16682 - DNA, 103 bp, Artificial Sequence
  Synthetic Polynucleotide
taatacgactcactataggggtggtggggtagatacaaagtcccactctgaacagaggagacagagtatgactttgtataacctggcggcagcgcaaaagatg

SEQ ID NO: 16683 - DNA, 103 bp, Artificial Sequence
  Synthetic Polynucleotide
taatacgactcactataggggaccagtggtggggtagatacaaagtcccaaacagaggagatgggacatggtatctaccaacctggcggcagcgcaaaagatg

SEQ ID NO: 16684 - DNA, 103 bp, Artificial Sequence
  Synthetic Polynucleotide
taatacgactcactatagggaacctgaccagtggtggggtagatacaaagaacagaggagactttgtatgtaccccaccaacctggcggcagcgcaaaagatg

SEQ ID NO: 16685 - DNA, 103 bp, Artificial Sequence
  Synthetic Polynucleotide
taatacgactcactatagggatgttaacctgaccagtggtggggtagataaacagaggagatatctaatgcaccactggaacctggcggcagcgcaaaagatg

SEQ ID NO: 16686 - DNA, 103 bp, Artificial Sequence
  Synthetic Polynucleotide
taatacgactcactataggggttaaatgttaacctgaccagtggtggggtaacagaggagaaccccaatgctggtcaggaacctggcggcagcgcaaaagatg

SEQ ID NO: 16687 - DNA, 103 bp, Artificial Sequence
  Synthetic Polynucleotide
taatacgactcactatagggactaggttaaatgttaacctgaccagtggtaacagaggagaaccactatgcaggttaacaacctggcggcagcgcaaaagatg

SEQ ID NO: 16688 - DNA, 103 bp, Artificial Sequence
  Synthetic Polynucleotide
taatacgactcactataggggcctcagctgtttcttagtagctacttcctaacagaggagaaggaagatgctactaagaaacctggcggcagcgcaaaagatg

SEQ ID NO: 16689 - DNA, 103 bp, Artificial Sequence
  Synthetic Polynucleotide
taatacgactcactatagggctcctactaggttaaatgttaacctgaccaaacagaggagatggtcaatgtaacatttaaacctggcggcagcgcaaaagatg

SEQ ID NO: 16690 - DNA, 103 bp, Artificial Sequence
  Synthetic Polynucleotide
taatacgactcactatagggaggatctcctactaggttaaatgttaacctaacagaggagaaggttaatgtttaacctaaacctggcggcagcgcaaaagatg

SEQ ID NO: 16691 - DNA, 103 bp, Artificial Sequence
  Synthetic Polynucleotide
taatacgactcactatagggggtataggatctcctactaggttaaatgttaacagaggagaaacattatgcctagtaggaacctggcggcagcgcaaaagatg

SEQ ID NO: 16692 - DNA, 103 bp, Artificial Sequence
  Synthetic Polynucleotide
taatacgactcactatagggcgcctggtataggatctcctactaggttaaaacagaggagattaaccatgtaggagatcaacctggcggcagcgcaaaagatg

SEQ ID NO: 16693 - DNA, 103 bp, Artificial Sequence
  Synthetic Polynucleotide
taatacgactcactatagggctctgcgcctggtataggatctcctactagaacagaggagactagtaatggatcctataaacctggcggcagcgcaaaagatg

SEQ ID NO: 16694 - DNA, 103 bp, Artificial Sequence
  Synthetic Polynucleotide
taatacgactcactatagggaaggtctctgcgcctggtataggatctcctaacagaggagaaggagaatgtataccaggaacctggcggcagcgcaaaagatg

SEQ ID NO: 16695 - DNA, 103 bp, Artificial Sequence
  Synthetic Polynucleotide
taatacgactcactatagggtgtagaaggtctctgcgcctggtataggataacagaggagaatcctaatgcaggcgcagaacctggcggcagcgcaaaagatg

SEQ ID NO: 16696 - DNA, 103 bp, Artificial Sequence
  Synthetic Polynucleotide
taatacgactcactatagggatctgtgtagaaggtctctgcgcctggtataacagaggagaataccaatggcagagaccaacctggcggcagcgcaaaagatg

SEQ ID NO: 16697 - DNA, 103 bp, Artificial Sequence
  Synthetic Polynucleotide
taatacgactcactataggggatccatctgtgtagaaggtctctgcgcctaacagaggagaaggcgcatggaccttctaaacctggcggcagcgcaaaagatg

SEQ ID NO: 16698 - DNA, 103 bp, Artificial Sequence
  Synthetic Polynucleotide
taatacgactcactatagggtgcatgatccatctgtgtagaaggtctctgaacagaggagacagagaatgtctacacagaacctggcggcagcgcaaaagatg

SEQ ID NO: 16699 - DNA, 103 bp, Artificial Sequence
  Synthetic Polynucleotide
taatacgactcactatagggctgcagcctcagctgtttcttagtagctacaacagaggagagtagctatgaagaaacagaacctggcggcagcgcaaaagatg

SEQ ID NO: 16700 - DNA, 103 bp, Artificial Sequence
  Synthetic Polynucleotide
taatacgactcactatagggtctattgcatgatccatctgtgtagaaggtaacagaggagaaccttcatgacagatggaaacctggcggcagcgcaaaagatg

SEQ ID NO: 16701 - DNA, 103 bp, Artificial Sequence
  Synthetic Polynucleotide
taatacgactcactataggggactgtctattgcatgatccatctgtgtagaacagaggagactacacatgtggatcatgaacctggcggcagcgcaaaagatg

SEQ ID NO: 16702 - DNA, 103 bp, Artificial Sequence
  Synthetic Polynucleotide
taatacgactcactatagggcttttgactgtctattgcatgatccatctgaacagaggagacagatgatgcatgcaataaacctggcggcagcgcaaaagatg

SEQ ID NO: 16703 - DNA, 103 bp, Artificial Sequence
  Synthetic Polynucleotide
taatacgactcactatagggtccctcttttgactgtctattgcatgatccaacagaggagaggatcaatgaatagacagaacctggcggcagcgcaaaagatg

SEQ ID NO: 16704 - DNA, 103 bp, Artificial Sequence
  Synthetic Polynucleotide
taatacgactcactataggggcttttccctcttttgactgtctattgcataacagaggagaatgcaaatgacagtcaaaaacctggcggcagcgcaaaagatg

SEQ ID NO: 16705 - DNA, 103 bp, Artificial Sequence
  Synthetic Polynucleotide
taatacgactcactatagggatcctgcttttccctcttttgactgtctataacagaggagaatagacatgcaaaagaggaacctggcggcagcgcaaaagatg

SEQ ID NO: 16706 - DNA, 103 bp, Artificial Sequence
  Synthetic Polynucleotide
taatacgactcactatagggtacatatcctgcttttccctcttttgactgaacagaggagacagtcaatggagggaaaaaacctggcggcagcgcaaaagatg

SEQ ID NO: 16707 - DNA, 103 bp, Artificial Sequence
  Synthetic Polynucleotide
taatacgactcactatagggtctgttacatatcctgcttttccctcttttaacagaggagaaaaagaatgaaaagcaggaacctggcggcagcgcaaaagatg

SEQ ID NO: 16708 - DNA, 103 bp, Artificial Sequence
  Synthetic Polynucleotide
taatacgactcactatagggctctatctgttacatatcctgcttttccctaacagaggagaagggaaatgcaggatatgaacctggcggcagcgcaaaagatg

SEQ ID NO: 16709 - DNA, 103 bp, Artificial Sequence
  Synthetic Polynucleotide
taatacgactcactatagggttttcctctatctgttacatatcctgctttaacagaggagaaaagcaatgtatgtaacaaacctggcggcagcgcaaaagatg

SEQ ID NO: 16710 - DNA, 103 bp, Artificial Sequence
  Synthetic Polynucleotide
taatacgactcactatagggagtccctgcagcctcagctgtttcttagtaaacagaggagatactaaatgacagctgagaacctggcggcagcgcaaaagatg

SEQ ID NO: 16711 - DNA, 103 bp, Artificial Sequence
  Synthetic Polynucleotide
taatacgactcactatagggttgtcttttcctctatctgttacatatcctaacagaggagaaggataatgaacagatagaacctggcggcagcgcaaaagatg

SEQ ID NO: 16712 - DNA, 103 bp, Artificial Sequence
  Synthetic Polynucleotide
taatacgactcactatagggttactttgtcttttcctctatctgttacataacagaggagaatgtaaatgatagaggaaaacctggcggcagcgcaaaagatg

SEQ ID NO: 16713 - DNA, 103 bp, Artificial Sequence
  Synthetic Polynucleotide
taatacgactcactatagggtacttttactttgtcttttcctctatctgtaacagaggagaacagatatgggaaaagacaacctggcggcagcgcaaaagatg

SEQ ID NO: 16714 - DNA, 103 bp, Artificial Sequence
  Synthetic Polynucleotide
taatacgactcactatagggtctaatacttttactttgtcttttcctctaaacagaggagatagaggatgagacaaagtaacctggcggcagcgcaaaagatg

SEQ ID NO: 16715 - DNA, 103 bp, Artificial Sequence
  Synthetic Polynucleotide
taatacgactcactatagggtttgttctaatacttttactttgtcttttcaacagaggagagaaaagatgaagtaaaagaacctggcggcagcgcaaaagatg

SEQ ID NO: 16716 - DNA, 103 bp, Artificial Sequence
  Synthetic Polynucleotide
taatacgactcactatagggggtagtttgttctaatacttttactttgtcaacagaggagagacaaaatgaaagtattaaacctggcggcagcgcaaaagatg

SEQ ID NO: 16717 - DNA, 103 bp, Artificial Sequence
  Synthetic Polynucleotide
taatacgactcactatagggtgattggtagtttgttctaatacttttactaacagaggagaagtaaaatgattagaacaaacctggcggcagcgcaaaagatg

SEQ ID NO: 16718 - DNA, 103 bp, Artificial Sequence
  Synthetic Polynucleotide
taatacgactcactatagggcctgctgattggtagtttgttctaatacttaacagaggagaaagtatatgaacaaactaaacctggcggcagcgcaaaagatg

SEQ ID NO: 16719 - DNA, 103 bp, Artificial Sequence
  Synthetic Polynucleotide
taatacgactcactatagggttctgcctgctgattggtagtttgttctaaaacagaggagattagaaatgactaccaataacctggcggcagcgcaaaagatg

SEQ ID NO: 16720 - DNA, 103 bp, Artificial Sequence
  Synthetic Polynucleotide
taatacgactcactatagggtctaattctgcctgctgattggtagtttgtaacagaggagaacaaacatgcaatcagcaaacctggcggcagcgcaaaagatg

SEQ ID NO: 16721 - DNA, 103 bp, Artificial Sequence
  Synthetic Polynucleotide
taatacgactcactatagggtggaaagtccctgcagcctcagctgtttctaacagaggagaagaaacatgtgaggctgcaacctggcggcagcgcaaaagatg

SEQ ID NO: 16722 - DNA, 103 bp, Artificial Sequence
  Synthetic Polynucleotide
taatacgactcactatagggagacttctaattctgcctgctgattggtagaacagaggagactaccaatgagcaggcagaacctggcggcagcgcaaaagatg

SEQ ID NO: 16723 - DNA, 103 bp, Artificial Sequence
  Synthetic Polynucleotide
taatacgactcactatagggccgaaagacttctaattctgcctgctgattaacagaggagaaatcagatggcagaattaaacctggcggcagcgcaaaagatg

SEQ ID NO: 16724 - DNA, 103 bp, Artificial Sequence
  Synthetic Polynucleotide
taatacgactcactataggggccatccgaaagacttctaattctgcctgcaacagaggagagcaggcatgattagaagtaacctggcggcagcgcaaaagatg

SEQ ID NO: 16725 - DNA, 103 bp, Artificial Sequence
  Synthetic Polynucleotide
taatacgactcactatagggccagtgccatccgaaagacttctaattctgaacagaggagacagaatatgaagtctttcaacctggcggcagcgcaaaagatg

SEQ ID NO: 16726 - DNA, 103 bp, Artificial Sequence
  Synthetic Polynucleotide
taatacgactcactataggggtctgccagtgccatccgaaagacttctaaaacagaggagattagaaatgtttcggatgaacctggcggcagcgcaaaagatg

SEQ ID NO: 16727 - DNA, 103 bp, Artificial Sequence
  Synthetic Polynucleotide
taatacgactcactatagggcctgagtctgccagtgccatccgaaagactaacagaggagaagtcttatggatggcactaacctggcggcagcgcaaaagatg

SEQ ID NO: 16728 - DNA, 103 bp, Artificial Sequence
  Synthetic Polynucleotide
taatacgactcactatagggttgggcctgagtctgccagtgccatccgaaaacagaggagattcggaatgcactggcagaacctggcggcagcgcaaaagatg

SEQ ID NO: 16729 - DNA, 103 bp, Artificial Sequence
  Synthetic Polynucleotide
taatacgactcactatagggaacctttgggcctgagtctgccagtgccataacagaggagaatggcaatggcagactcaaacctggcggcagcgcaaaagatg

SEQ ID NO: 16730 - DNA, 103 bp, Artificial Sequence
  Synthetic Polynucleotide
taatacgactcactatagggatattaacctttgggcctgagtctgccagtaacagaggagaactggcatgctcaggcccaacctggcggcagcgcaaaagatg

SEQ ID NO: 16731 - DNA, 103 bp, Artificial Sequence
  Synthetic Polynucleotide
taatacgactcactatagggctatgatattaacctttgggcctgagtctgaacagaggagacagactatggcccaaaggaacctggcggcagcgcaaaagatg

SEQ ID NO: 16732 - DNA, 103 bp, Artificial Sequence
  Synthetic Polynucleotide
taatacgactcactatagggccttctggaaagtccctgcagcctcagctgaacagaggagacagctgatgctgcagggaaacctggcggcagcgcaaaagatg

SEQ ID NO: 16733 - DNA, 103 bp, Artificial Sequence
  Synthetic Polynucleotide
taatacgactcactatagggatctactatgatattaacctttgggcctgaaacagaggagatcaggcatgaaggttaataacctggcggcagcgcaaaagatg

SEQ ID NO: 16734 - DNA, 103 bp, Artificial Sequence
  Synthetic Polynucleotide
taatacgactcactatagggtgtgaatctactatgatattaacctttgggaacagaggagacccaaaatgtaatatcataacctggcggcagcgcaaaagatg

SEQ ID NO: 16735 - DNA, 103 bp, Artificial Sequence
  Synthetic Polynucleotide
taatacgactcactatagggcatactgtgaatctactatgatattaacctaacagaggagaaggttaatgtcatagtagaacctggcggcagcgcaaaagatg

SEQ ID NO: 16736 - DNA, 103 bp, Artificial Sequence
  Synthetic Polynucleotide
taatacgactcactatagggcattacatactgtgaatctactatgatattaacagaggagaaatatcatggtagattcaaacctggcggcagcgcaaaagatg

SEQ ID NO: 16737 - DNA, 103 bp, Artificial Sequence
  Synthetic Polynucleotide
taatacgactcactatagggatccccattacatactgtgaatctactatgaacagaggagacatagtatgttcacagtaaacctggcggcagcgcaaaagatg

SEQ ID NO: 16738 - DNA, 103 bp, Artificial Sequence
  Synthetic Polynucleotide
taatacgactcactatagggctactatccccattacatactgtgaatctaaacagaggagatagattatgagtatgtaaaacctggcggcagcgcaaaagatg

SEQ ID NO: 16739 - DNA, 103 bp, Artificial Sequence
  Synthetic Polynucleotide
taatacgactcactataggggcctgctactatccccattacatactgtgaaacagaggagatcacagatggtaatggggaacctggcggcagcgcaaaagatg

SEQ ID NO: 16740 - DNA, 103 bp, Artificial Sequence
  Synthetic Polynucleotide
taatacgactcactatagggggctggcctgctactatccccattacatacaacagaggagagtatgtatgggggatagtaacctggcggcagcgcaaaagatg

SEQ ID NO: 16741 - DNA, 103 bp, Artificial Sequence
  Synthetic Polynucleotide
taatacgactcactatagggctgttggctggcctgctactatccccattaaacagaggagataatggatgtagtagcagaacctggcggcagcgcaaaagatg

SEQ ID NO: 16742 - DNA, 103 bp, Artificial Sequence
  Synthetic Polynucleotide
taatacgactcactatagggtgactctgttggctggcctgctactatcccaacagaggagagggataatggcaggccagaacctggcggcagcgcaaaagatg

SEQ ID NO: 16743 - DNA, 103 bp, Artificial Sequence
  Synthetic Polynucleotide
taatacgactcactatagggcagccccttctggaaagtccctgcagcctcaacagaggagagaggctatggggactttcaacctggcggcagcgcaaaagatg

SEQ ID NO: 16744 - DNA, 103 bp, Artificial Sequence
  Synthetic Polynucleotide
taatacgactcactatagggttttctgactctgttggctggcctgctactaacagaggagaagtagcatgccagccaacaacctggcggcagcgcaaaagatg

SEQ ID NO: 16745 - DNA, 103 bp, Artificial Sequence
  Synthetic Polynucleotide
taatacgactcactatagggttctattttctgactctgttggctggcctgaacagaggagacaggccatgcaacagagtaacctggcggcagcgcaaaagatg

SEQ ID NO: 16746 - DNA, 103 bp, Artificial Sequence
  Synthetic Polynucleotide
taatacgactcactatagggcactattctattttctgactctgttggctgaacagaggagacagccaatggagtcagaaaacctggcggcagcgcaaaagatg

SEQ ID NO: 16747 - DNA, 103 bp, Artificial Sequence
  Synthetic Polynucleotide
taatacgactcactatagggtggttcactattctattttctgactctgttaacagaggagaaacagaatgagaaaatagaacctggcggcagcgcaaaagatg

SEQ ID NO: 16748 - DNA, 103 bp, Artificial Sequence
  Synthetic Polynucleotide
taatacgactcactatagggtgatctggttcactattctattttctgactaacagaggagaagtcagatgatagaatagaacctggcggcagcgcaaaagatg

SEQ ID NO: 16749 - DNA, 103 bp, Artificial Sequence
  Synthetic Polynucleotide
taatacgactcactatagggttctatgatctggttcactattctattttcaacagaggagagaaaatatgatagtgaacaacctggcggcagcgcaaaagatg

SEQ ID NO: 16750 - DNA, 103 bp, Artificial Sequence
  Synthetic Polynucleotide
taatacgactcactatagggatttcttctatgatctggttcactattctaaacagaggagatagaatatggaaccagataacctggcggcagcgcaaaagatg

SEQ ID NO: 16751 - DNA, 103 bp, Artificial Sequence
  Synthetic Polynucleotide
taatacgactcactatagggttatcatttcttctatgatctggttcactaaacagaggagatagtgaatgagatcatagaacctggcggcagcgcaaaagatg

SEQ ID NO: 16752 - DNA, 103 bp, Artificial Sequence
  Synthetic Polynucleotide
taatacgactcactatagggcttctttatcatttcttctatgatctggttaacagaggagaaaccagatgatagaagaaaacctggcggcagcgcaaaagatg

SEQ ID NO: 16753 - DNA, 103 bp, Artificial Sequence
  Synthetic Polynucleotide
taatacgactcactataggggcttccttctttatcatttcttctatgatcaacagaggagagatcatatgagaaatgataacctggcggcagcgcaaaagatg

SEQ ID NO: 16754 - DNA, 103 bp, Artificial Sequence
  Synthetic Polynucleotide
taatacgactcactatagggatcccttcctctttttctaggtatatgtctaacagaggagaagacatatgcctagaaaaaacctggcggcagcgcaaaagatg

SEQ ID NO: 16755 - DNA, 103 bp, Artificial Sequence
  Synthetic Polynucleotide
taatacgactcactatagggggttacagccccttctggaaagtccctgcaaacagaggagatgcaggatgtttccagaaaacctggcggcagcgcaaaagatg

SEQ ID NO: 16756 - DNA, 103 bp, Artificial Sequence
  Synthetic Polynucleotide
taatacgactcactatagggagactgcttccttctttatcatttcttctaaacagaggagatagaagatgtgataaagaaacctggcggcagcgcaaaagatg

SEQ ID NO: 16757 - DNA, 103 bp, Artificial Sequence
  Synthetic Polynucleotide
taatacgactcactatagggaacatagactgcttccttctttatcatttcaacagaggagagaaatgatgaagaaggaaaacctggcggcagcgcaaaagatg

SEQ ID NO: 16758 - DNA, 103 bp, Artificial Sequence
  Synthetic Polynucleotide
taatacgactcactatagggcatgcaacatagactgcttccttctttatcaacagaggagagataaaatgggaagcagtaacctggcggcagcgcaaaagatg

SEQ ID NO: 16759 - DNA, 103 bp, Artificial Sequence
  Synthetic Polynucleotide
taatacgactcactatagggggacccatgcaacatagactgcttccttctaacagaggagaagaaggatgcagtctatgaacctggcggcagcgcaaaagatg

SEQ ID NO: 16760 - DNA, 103 bp, Artificial Sequence
  Synthetic Polynucleotide
taatacgactcactatagggggctgggacccatgcaacatagactgcttcaacagaggagagaagcaatgtatgttgcaaacctggcggcagcgcaaaagatg

SEQ ID NO: 16761 - DNA, 103 bp, Artificial Sequence
  Synthetic Polynucleotide
taatacgactcactatagggttatgggctgggacccatgcaacatagactaacagaggagaagtctaatgtgcatgggtaacctggcggcagcgcaaaagatg

SEQ ID NO: 16762 - DNA, 103 bp, Artificial Sequence
  Synthetic Polynucleotide
taatacgactcactatagggtgcctttatgggctgggacccatgcaacataacagaggagaatgttgatggggtcccagaacctggcggcagcgcaaaagatg

SEQ ID NO: 16763 - DNA, 103 bp, Artificial Sequence
  Synthetic Polynucleotide
taatacgactcactatagggtcctatgcctttatgggctgggacccatgcaacagaggagagcatggatgccagcccataacctggcggcagcgcaaaagatg

SEQ ID NO: 16764 - DNA, 103 bp, Artificial Sequence
  Synthetic Polynucleotide
taatacgactcactatagggtttcctcctatgcctttatgggctgggaccaacagaggagaggtcccatgccataaaggaacctggcggcagcgcaaaagatg

SEQ ID NO: 16765 - DNA, 103 bp, Artificial Sequence
  Synthetic Polynucleotide
taatacgactcactatagggcctggtttcctcctatgcctttatgggctgaacagaggagacagcccatgaaggcatagaacctggcggcagcgcaaaagatg

SEQ ID NO: 16766 - DNA, 103 bp, Artificial Sequence
  Synthetic Polynucleotide
taatacgactcactatagggcccttggttacagccccttctggaaagtccaacagaggagaggacttatgagaaggggcaacctggcggcagcgcaaaagatg

SEQ ID NO: 16767 - DNA, 103 bp, Artificial Sequence
  Synthetic Polynucleotide
taatacgactcactatagggtacttcctggtttcctcctatgcctttatgaacagaggagacataaaatgataggaggaaacctggcggcagcgcaaaagatg

SEQ ID NO: 16768 - DNA, 103 bp, Artificial Sequence
  Synthetic Polynucleotide
taatacgactcactatagggtggtctacttcctggtttcctcctatgcctaacagaggagaaggcatatgaggaaaccaaacctggcggcagcgcaaaagatg

SEQ ID NO: 16769 - DNA, 103 bp, Artificial Sequence
  Synthetic Polynucleotide
taatacgactcactatagggctaaatggtctacttcctggtttcctcctaaacagaggagataggagatgaccaggaagaacctggcggcagcgcaaaagatg

SEQ ID NO: 16770 - DNA, 103 bp, Artificial Sequence
  Synthetic Polynucleotide
taatacgactcactatagggacttactaaatggtctacttcctggtttccaacagaggagaggaaacatggaagtagacaacctggcggcagcgcaaaagatg

SEQ ID NO: 16771 - DNA, 103 bp, Artificial Sequence
  Synthetic Polynucleotide
taatacgactcactatagggccttgacttactaaatggtctacttcctggaacagaggagaccaggaatgagaccatttaacctggcggcagcgcaaaagatg

SEQ ID NO: 16772 - DNA, 103 bp, Artificial Sequence
  Synthetic Polynucleotide
taatacgactcactatagggtgatgccttgacttactaaatggtctacttaacagaggagaaagtagatgatttagtaaaacctggcggcagcgcaaaagatg

SEQ ID NO: 16773 - DNA, 103 bp, Artificial Sequence
  Synthetic Polynucleotide
taatacgactcactatagggttgtctgatgccttgacttactaaatggtcaacagaggagagaccatatggtaagtcaaaacctggcggcagcgcaaaagatg

SEQ ID NO: 16774 - DNA, 103 bp, Artificial Sequence
  Synthetic Polynucleotide
taatacgactcactatagggaatacttgtctgatgccttgacttactaaaaacagaggagatttagtatgtcaaggcataacctggcggcagcgcaaaagatg

SEQ ID NO: 16775 - DNA, 103 bp, Artificial Sequence
  Synthetic Polynucleotide
taatacgactcactatagggggaataatacttgtctgatgccttgacttaaacagaggagataagtcatggcatcagacaacctggcggcagcgcaaaagatg

SEQ ID NO: 16776 - DNA, 103 bp, Artificial Sequence
  Synthetic Polynucleotide
taatacgactcactatagggttccaggaataatacttgtctgatgccttgaacagaggagacaaggcatgagacaagtaaacctggcggcagcgcaaaagatg

SEQ ID NO: 16777 - DNA, 103 bp, Artificial Sequence
  Synthetic Polynucleotide
taatacgactcactatagggtccctcccttggttacagccccttctggaaaacagaggagattccagatggggctgtaaaacctggcggcagcgcaaaagatg

SEQ ID NO: 16778 - DNA, 103 bp, Artificial Sequence
  Synthetic Polynucleotide
taatacgactcactatagggatcttttccaggaataatacttgtctgatgaacagaggagacatcagatgagtattattaacctggcggcagcgcaaaagatg

SEQ ID NO: 16779 - DNA, 103 bp, Artificial Sequence
  Synthetic Polynucleotide
taatacgactcactataggggctctatcttttccaggaataatacttgtcaacagaggagagacaagatgtattcctggaacctggcggcagcgcaaaagatg

SEQ ID NO: 16780 - DNA, 103 bp, Artificial Sequence
  Synthetic Polynucleotide
taatacgactcactatagggagcgggctctatcttttccaggaataatacaacagaggagagtattaatgctggaaaagaacctggcggcagcgcaaaagatg

SEQ ID NO: 16781 - DNA, 103 bp, Artificial Sequence
  Synthetic Polynucleotide
taatacgactcactatagggtcttgagcgggctctatcttttccaggaataacagaggagaattcctatgaaagatagaaacctggcggcagcgcaaaagatg

SEQ ID NO: 16782 - DNA, 103 bp, Artificial Sequence
  Synthetic Polynucleotide
taatacgactcactataggggttcctcttgagcgggctctatcttttccaaacagaggagatggaaaatgtagagcccgaacctggcggcagcgcaaaagatg

SEQ ID NO: 16783 - DNA, 103 bp, Artificial Sequence
  Synthetic Polynucleotide
taatacgactcactatagggttcatgttcctcttgagcgggctctatcttaacagaggagaaagataatgcccgctcaaaacctggcggcagcgcaaaagatg

SEQ ID NO: 16784 - DNA, 103 bp, Artificial Sequence
  Synthetic Polynucleotide
taatacgactcactatagggtatttttcatgttcctcttgagcgggctctaacagaggagaagagccatgtcaagaggaaacctggcggcagcgcaaaagatg

SEQ ID NO: 16785 - DNA, 103 bp, Artificial Sequence
  Synthetic Polynucleotide
taatacgactcactatagggtatgatatttttcatgttcctcttgagcggaacagaggagaccgctcatgaggaacatgaacctggcggcagcgcaaaagatg

SEQ ID NO: 16786 - DNA, 103 bp, Artificial Sequence
  Synthetic Polynucleotide
taatacgactcactatagggaatgctatgatatttttcatgttcctcttgaacagaggagacaagagatgcatgaaaaaaacctggcggcagcgcaaaagatg

SEQ ID NO: 16787 - DNA, 103 bp, Artificial Sequence
  Synthetic Polynucleotide
taatacgactcactatagggtttataatgctatgatatttttcatgttccaacagaggagaggaacaatgaaaatatcaaacctggcggcagcgcaaaagatg

SEQ ID NO: 16788 - DNA, 103 bp, Artificial Sequence
  Synthetic Polynucleotide
taatacgactcactatagggccatgtccctcccttggttacagccccttcaacagaggagagaagggatggtaaccaagaacctggcggcagcgcaaaagatg

SEQ ID NO: 16789 - DNA, 103 bp, Artificial Sequence
  Synthetic Polynucleotide
taatacgactcactataggggttcttttataatgctatgatatttttcataacagaggagaatgaaaatgatcatagcaaacctggcggcagcgcaaaagatg

SEQ ID NO: 16790 - DNA, 103 bp, Artificial Sequence
  Synthetic Polynucleotide
taatacgactcactatagggggttagttcttttataatgctatgatatttaacagaggagaaaatatatgagcattataaacctggcggcagcgcaaaagatg

SEQ ID NO: 16791 - DNA, 103 bp, Artificial Sequence
  Synthetic Polynucleotide
taatacgactcactatagggttatgggttagttcttttataatgctatgaaacagaggagatcatagatgtataaaagaaacctggcggcagcgcaaaagatg

SEQ ID NO: 16792 - DNA, 103 bp, Artificial Sequence
  Synthetic Polynucleotide
taatacgactcactatagggcaaatttatgggttagttcttttataatgcaacagaggagagcattaatgaagaactaaaacctggcggcagcgcaaaagatg

SEQ ID NO: 16793 - DNA, 103 bp, Artificial Sequence
  Synthetic Polynucleotide
taatacgactcactatagggtattccaaatttatgggttagttcttttataacagaggagaataaaaatgctaacccataacctggcggcagcgcaaaagatg

SEQ ID NO: 16794 - DNA, 103 bp, Artificial Sequence
  Synthetic Polynucleotide
taatacgactcactatagggaggggtattccaaatttatgggttagttctaacagaggagaagaactatgccataaattaacctggcggcagcgcaaaagatg

SEQ ID NO: 16795 - DNA, 103 bp, Artificial Sequence
  Synthetic Polynucleotide
taatacgactcactatagggctagaaggggtattccaaatttatgggttaaacagaggagataacccatgaatttggaaaacctggcggcagcgcaaaagatg

SEQ ID NO: 16796 - DNA, 103 bp, Artificial Sequence
  Synthetic Polynucleotide
taatacgactcactatagggtgctactagaaggggtattccaaatttatgaacagaggagacataaaatgggaatacccaacctggcggcagcgcaaaagatg

SEQ ID NO: 16797 - DNA, 103 bp, Artificial Sequence
  Synthetic Polynucleotide
taatacgactcactatagggtgtcttgctactagaaggggtattccaaataacagaggagaatttggatgaccccttctaacctggcggcagcgcaaaagatg

SEQ ID NO: 16798 - DNA, 103 bp, Artificial Sequence
  Synthetic Polynucleotide
taatacgactcactatagggctatctgtcttgctactagaaggggtattcaacagaggagagaatacatgttctagtagaacctggcggcagcgcaaaagatg

SEQ ID NO: 16799 - DNA, 103 bp, Artificial Sequence
  Synthetic Polynucleotide
taatacgactcactatagggtcctcccatgtccctcccttggttacagccaacagaggagaggctgtatgcaagggaggaacctggcggcagcgcaaaagatg

SEQ ID NO: 16800 - DNA, 103 bp, Artificial Sequence
  Synthetic Polynucleotide
taatacgactcactataggggtttactatctgtcttgctactagaaggggaacagaggagaccccttatggtagcaagaaacctggcggcagcgcaaaagatg

SEQ ID NO: 16801 - DNA, 103 bp, Artificial Sequence
  Synthetic Polynucleotide
taatacgactcactatagggcatgagtttactatctgtcttgctactagaaacagaggagatctagtatgaagacagataacctggcggcagcgcaaaagatg

SEQ ID NO: 16802 - DNA, 103 bp, Artificial Sequence
  Synthetic Polynucleotide
taatacgactcactataggggggcacatgagtttactatctgtcttgctaaacagaggagatagcaaatgagatagtaaaacctggcggcagcgcaaaagatg

SEQ ID NO: 16803 - DNA, 103 bp, Artificial Sequence
  Synthetic Polynucleotide
taatacgactcactataggggcattgggcacatgagtttactatctgtctaacagaggagaagacagatggtaaactcaaacctggcggcagcgcaaaagatg

SEQ ID NO: 16804 - DNA, 103 bp, Artificial Sequence
  Synthetic Polynucleotide
taatacgactcactatagggtgttggcattgggcacatgagtttactatcaacagaggagagatagtatgctcatgtgcaacctggcggcagcgcaaaagatg

SEQ ID NO: 16805 - DNA, 103 bp, Artificial Sequence
  Synthetic Polynucleotide
taatacgactcactatagggctttctgttggcattgggcacatgagtttaaacagaggagataaactatggtgcccaataacctggcggcagcgcaaaagatg

SEQ ID NO: 16806 - DNA, 103 bp, Artificial Sequence
  Synthetic Polynucleotide
taatacgactcactatagggttctcctttctgttggcattgggcacatgaaacagaggagatcatgtatgcaatgccaaaacctggcggcagcgcaaaagatg

SEQ ID NO: 16807 - DNA, 103 bp, Artificial Sequence
  Synthetic Polynucleotide
taatacgactcactatagggatggcttctcctttctgttggcattgggcaaacagaggagatgcccaatgccaacagaaaacctggcggcagcgcaaaagatg

SEQ ID NO: 16808 - DNA, 103 bp, Artificial Sequence
  Synthetic Polynucleotide
taatacgactcactatagggcatgtatggcttctcctttctgttggcattaacagaggagaaatgccatgagaaaggagaacctggcggcagcgcaaaagatg

SEQ ID NO: 16809 - DNA, 103 bp, Artificial Sequence
  Synthetic Polynucleotide
taatacgactcactatagggttgcccatgtatggcttctcctttctgttgaacagaggagacaacagatgggagaagccaacctggcggcagcgcaaaagatg

SEQ ID NO: 16810 - DNA, 103 bp, Artificial Sequence
  Synthetic Polynucleotide
taatacgactcactatagggccagctcctcccatgtccctcccttggttaaacagaggagataaccaatggagggacataacctggcggcagcgcaaaagatg

SEQ ID NO: 16811 - DNA, 103 bp, Artificial Sequence
  Synthetic Polynucleotide
taatacgactcactatagggtttacttgcccatgtatggcttctcctttcaacagaggagagaaaggatgagccatacaaacctggcggcagcgcaaaagatg

SEQ ID NO: 16812 - DNA, 103 bp, Artificial Sequence
  Synthetic Polynucleotide
taatacgactcactatagggctgcatttacttgcccatgtatggcttctcaacagaggagagagaagatgtacatgggcaacctggcggcagcgcaaaagatg

SEQ ID NO: 16813 - DNA, 103 bp, Artificial Sequence
  Synthetic Polynucleotide
taatacgactcactatagggtatttctgcatttacttgcccatgtatggcaacagaggagagccataatggggcaagtaaacctggcggcagcgcaaaagatg

SEQ ID NO: 16814 - DNA, 103 bp, Artificial Sequence
  Synthetic Polynucleotide
taatacgactcactatagggacgcctatttctgcatttacttgcccatgtaacagaggagaacatggatgagtaaatgcaacctggcggcagcgcaaaagatg

SEQ ID NO: 16815 - DNA, 103 bp, Artificial Sequence
  Synthetic Polynucleotide
taatacgactcactataggggccaaacgcctatttctgcatttacttgccaacagaggagaggcaagatgatgcagaaaaacctggcggcagcgcaaaagatg

SEQ ID NO: 16816 - DNA, 103 bp, Artificial Sequence
  Synthetic Polynucleotide
taatacgactcactatagggcatttgccaaacgcctatttctgcatttacaacagaggagagtaaatatggaaataggcaacctggcggcagcgcaaaagatg

SEQ ID NO: 16817 - DNA, 103 bp, Artificial Sequence
  Synthetic Polynucleotide
taatacgactcactatagggtagtccatttgccaaacgcctatttctgcaaacagaggagatgcagaatgaggcgtttgaacctggcggcagcgcaaaagatg

SEQ ID NO: 16818 - DNA, 103 bp, Artificial Sequence
  Synthetic Polynucleotide
taatacgactcactataggggtgtgtagtccatttgccaaacgcctatttaacagaggagaaaatagatgtttggcaaaaacctggcggcagcgcaaaagatg

SEQ ID NO: 16819 - DNA, 103 bp, Artificial Sequence
  Synthetic Polynucleotide
taatacgactcactatagggtaagtgtgtgtagtccatttgccaaacgccaacagaggagaggcgttatgcaaatggacaacctggcggcagcgcaaaagatg

SEQ ID NO: 16820 - DNA, 103 bp, Artificial Sequence
  Synthetic Polynucleotide
taatacgactcactatagggccttctaagtgtgtgtagtccatttgccaaaacagaggagattggcaatgggactacacaacctggcggcagcgcaaaagatg

SEQ ID NO: 16821 - DNA, 103 bp, Artificial Sequence
  Synthetic Polynucleotide
taatacgactcactatagggccccaccagctcctcccatgtccctcccttaacagaggagaaagggaatgacatgggagaacctggcggcagcgcaaaagatg

SEQ ID NO: 16822 - DNA, 103 bp, Artificial Sequence
  Synthetic Polynucleotide
taatacgactcactatagggtttttccttctaagtgtgtgtagtccatttaacagaggagaaaatggatgacacacactaacctggcggcagcgcaaaagatg

SEQ ID NO: 16823 - DNA, 103 bp, Artificial Sequence
  Synthetic Polynucleotide
taatacgactcactatagggaatgatttttccttctaagtgtgtgtagtcaacagaggagagactacatgcacttagaaaacctggcggcagcgcaaaagatg

SEQ ID NO: 16824 - DNA, 103 bp, Artificial Sequence
  Synthetic Polynucleotide
taatacgactcactatagggactataatgatttttccttctaagtgtgtgaacagaggagacacacaatgagaaggaaaaacctggcggcagcgcaaaagatg

SEQ ID NO: 16825 - DNA, 103 bp, Artificial Sequence
  Synthetic Polynucleotide
taatacgactcactatagggctgctactataatgatttttccttctaagtaacagaggagaacttagatggaaaaatcaaacctggcggcagcgcaaaagatg

SEQ ID NO: 16826 - DNA, 103 bp, Artificial Sequence
  Synthetic Polynucleotide
taatacgactcactatagggatgtactgctactataatgatttttccttcaacagaggagagaaggaatgatcattataaacctggcggcagcgcaaaagatg

SEQ ID NO: 16827 - DNA, 103 bp, Artificial Sequence
  Synthetic Polynucleotide
taatacgactcactataggggcaacatgtactgctactataatgatttttaacagaggagaaaaaatatgtatagtagcaacctggcggcagcgcaaaagatg

SEQ ID NO: 16828 - DNA, 103 bp, Artificial Sequence
  Synthetic Polynucleotide
taatacgactcactatagggcacttgcaacatgtactgctactataatgaaacagaggagatcattaatgtagcagtacaacctggcggcagcgcaaaagatg

SEQ ID NO: 16829 - DNA, 103 bp, Artificial Sequence
  Synthetic Polynucleotide
taatacgactcactataggggaatccacttgcaacatgtactgctactataacagaggagaatagtaatggtacatgttaacctggcggcagcgcaaaagatg

SEQ ID NO: 16830 - DNA, 103 bp, Artificial Sequence
  Synthetic Polynucleotide
taatacgactcactatagggtctatgaatccacttgcaacatgtactgctaacagaggagaagcagtatgtgttgcaagaacctggcggcagcgcaaaagatg

SEQ ID NO: 16831 - DNA, 103 bp, Artificial Sequence
  Synthetic Polynucleotide
taatacgactcactatagggctgcttctatgaatccacttgcaacatgtaaacagaggagatacatgatgcaagtggataacctggcggcagcgcaaaagatg

SEQ ID NO: 16832 - DNA, 103 bp, Artificial Sequence
  Synthetic Polynucleotide
taatacgactcactataggggcgttccccaccagctcctcccatgtccctaacagaggagaagggacatgggaggagctaacctggcggcagcgcaaaagatg

SEQ ID NO: 16833 - DNA, 103 bp, Artificial Sequence
  Synthetic Polynucleotide
taatacgactcactataggggacttctgcttctatgaatccacttgcaacaacagaggagagttgcaatgggattcataaacctggcggcagcgcaaaagatg

SEQ ID NO: 16834 - DNA, 103 bp, Artificial Sequence
  Synthetic Polynucleotide
taatacgactcactataggggggatgacttctgcttctatgaatccacttaacagaggagaaagtggatgcatagaagcaacctggcggcagcgcaaaagatg

SEQ ID NO: 16835 - DNA, 103 bp, Artificial Sequence
  Synthetic Polynucleotide
taatacgactcactatagggcctgtgggatgacttctgcttctatgaatcaacagaggagagattcaatgaagcagaagaacctggcggcagcgcaaaagatg

SEQ ID NO: 16836 - DNA, 103 bp, Artificial Sequence
  Synthetic Polynucleotide
taatacgactcactatagggtgattcctgtgggatgacttctgcttctataacagaggagaatagaaatggaagtcatcaacctggcggcagcgcaaaagatg

SEQ ID NO: 16837 - DNA, 103 bp, Artificial Sequence
  Synthetic Polynucleotide
taatacgactcactatagggcttcctgattcctgtgggatgacttctgctaacagaggagaagcagaatgcatcccacaaacctggcggcagcgcaaaagatg

SEQ ID NO: 16838 - DNA, 103 bp, Artificial Sequence
  Synthetic Polynucleotide
taatacgactcactatagggtctgccttcctgattcctgtgggatgacttaacagaggagaaagtcaatgcacaggaataacctggcggcagcgcaaaagatg

SEQ ID NO: 16839 - DNA, 103 bp, Artificial Sequence
  Synthetic Polynucleotide
taatacgactcactatagggtgctgtctgccttcctgattcctgtgggataacagaggagaatcccaatggaatcaggaaacctggcggcagcgcaaaagatg

SEQ ID NO: 16840 - DNA, 103 bp, Artificial Sequence
  Synthetic Polynucleotide
taatacgactcactatagggaagagtgctgtctgccttcctgattcctgtaacagaggagaacaggaatgaggaaggcaaacctggcggcagcgcaaaagatg

SEQ ID NO: 16841 - DNA, 103 bp, Artificial Sequence
  Synthetic Polynucleotide
taatacgactcactatagggataggaagagtgctgtctgccttcctgattaacagaggagaaatcagatgggcagacagaacctggcggcagcgcaaaagatg

SEQ ID NO: 16842 - DNA, 103 bp, Artificial Sequence
  Synthetic Polynucleotide
taatacgactcactatagggttttaataggaagagtgctgtctgccttccaacagaggagaggaaggatgacagcactcaacctggcggcagcgcaaaagatg

SEQ ID NO: 16843 - DNA, 103 bp, Artificial Sequence
  Synthetic Polynucleotide
taatacgactcactatagggtgagggcgttccccaccagctcctcccatgaacagaggagacatgggatgagctggtggaacctggcggcagcgcaaaagatg

SEQ ID NO: 16844 - DNA, 103 bp, Artificial Sequence
  Synthetic Polynucleotide
taatacgactcactataggggccagttttaataggaagagtgctgtctgcaacagaggagagcagacatgactcttcctaacctggcggcagcgcaaaagatg

SEQ ID NO: 16845 - DNA, 103 bp, Artificial Sequence
  Synthetic Polynucleotide
taatacgactcactatagggtactggccagttttaataggaagagtgctgaacagaggagacagcacatgtcctattaaaacctggcggcagcgcaaaagatg

SEQ ID NO: 16846 - DNA, 103 bp, Artificial Sequence
  Synthetic Polynucleotide
taatacgactcactatagggccacctactggccagttttaataggaagagaacagaggagactcttcatgttaaaactgaacctggcggcagcgcaaaagatg

SEQ ID NO: 16847 - DNA, 103 bp, Artificial Sequence
  Synthetic Polynucleotide
taatacgactcactatagggattggccacctactggccagttttaataggaacagaggagacctattatgactggccagaacctggcggcagcgcaaaagatg

SEQ ID NO: 16848 - DNA, 103 bp, Artificial Sequence
  Synthetic Polynucleotide
taatacgactcactataggggcgttattggccacctactggccagttttaaacagaggagataaaacatgccagtaggtaacctggcggcagcgcaaaagatg

SEQ ID NO: 16849 - DNA, 103 bp, Artificial Sequence
  Synthetic Polynucleotide
taatacgactcactatagggcaagtgcgttattggccacctactggccagaacagaggagactggccatgaggtggccaaacctggcggcagcgcaaaagatg

SEQ ID NO: 16850 - DNA, 103 bp, Artificial Sequence
  Synthetic Polynucleotide
taatacgactcactataggggtgtgcaagtgcgttattggccacctactgaacagaggagacagtagatggccaataacaacctggcggcagcgcaaaagatg

SEQ ID NO: 16851 - DNA, 103 bp, Artificial Sequence
  Synthetic Polynucleotide
taatacgactcactatagggtgtctgtgtgcaagtgcgttattggccaccaacagaggagaggtggcatgtaacgcactaacctggcggcagcgcaaaagatg

SEQ ID NO: 16852 - DNA, 103 bp, Artificial Sequence
  Synthetic Polynucleotide
taatacgactcactataggggccattgtctgtgtgcaagtgcgttattggaacagaggagaccaataatgcacttgcacaacctggcggcagcgcaaaagatg

SEQ ID NO: 16853 - DNA, 103 bp, Artificial Sequence
  Synthetic Polynucleotide
taatacgactcactatagggttggggccattgtctgtgtgcaagtgcgttaacagaggagaaacgcaatggcacacagaaacctggcggcagcgcaaaagatg

SEQ ID NO: 16854 - DNA, 103 bp, Artificial Sequence
  Synthetic Polynucleotide
taatacgactcactatagggaagtatgagggcgttccccaccagctcctcaacagaggagagaggagatggtggggaacaacctggcggcagcgcaaaagatg

SEQ ID NO: 16855 - DNA, 103 bp, Artificial Sequence
  Synthetic Polynucleotide
taatacgactcactatagggtgaagttggggccattgtctgtgtgcaagtaacagaggagaacttgcatgcagacaatgaacctggcggcagcgcaaaagatg

SEQ ID NO: 16856 - DNA, 103 bp, Artificial Sequence
  Synthetic Polynucleotide
taatacgactcactatagggtgaagtgaagttggggccattgtctgtgtgaacagaggagacacacaatgaatggccccaacctggcggcagcgcaaaagatg

SEQ ID NO: 16857 - DNA, 103 bp, Artificial Sequence
  Synthetic Polynucleotide
taatacgactcactatagggtcctgtgaagtgaagttggggccattgtctaacagaggagaagacaaatgccccaacttaacctggcggcagcgcaaaagatg

SEQ ID NO: 16858 - DNA, 103 bp, Artificial Sequence
  Synthetic Polynucleotide
taatacgactcactatagggtcacttcctgtgaagtgaagttggggccataacagaggagaatggccatgacttcacttaacctggcggcagcgcaaaagatg

SEQ ID NO: 16859 - DNA, 103 bp, Artificial Sequence
  Synthetic Polynucleotide
taatacgactcactatagggcatcttcacttcctgtgaagtgaagttgggaacagaggagacccaacatgacttcacagaacctggcggcagcgcaaaagatg

SEQ ID NO: 16860 - DNA, 103 bp, Artificial Sequence
  Synthetic Polynucleotide
taatacgactcactataggggccaccatcttcacttcctgtgaagtgaagaacagaggagacttcacatgacaggaagtaacctggcggcagcgcaaaagatg

SEQ ID NO: 16861 - DNA, 103 bp, Artificial Sequence
  Synthetic Polynucleotide
taatacgactcactatagggaccatgccaccatcttcacttcctgtgaagaacagaggagacttcacatgaagtgaagaaacctggcggcagcgcaaaagatg

SEQ ID NO: 16862 - DNA, 103 bp, Artificial Sequence
  Synthetic Polynucleotide
taatacgactcactatagggtacccaccatgccaccatcttcacttcctgaacagaggagacaggaaatgaagatggtgaacctggcggcagcgcaaaagatg

SEQ ID NO: 16863 - DNA, 103 bp, Artificial Sequence
  Synthetic Polynucleotide
taatacgactcactatagggatacctacccaccatgccaccatcttcactaacagaggagaagtgaaatgggtggcatgaacctggcggcagcgcaaaagatg

SEQ ID NO: 16864 - DNA, 103 bp, Artificial Sequence
  Synthetic Polynucleotide
taatacgactcactataggggttctatacctacccaccatgccaccatctaacagaggagaagatggatgcatggtgggaacctggcggcagcgcaaaagatg

SEQ ID NO: 16865 - DNA, 103 bp, Artificial Sequence
  Synthetic Polynucleotide
taatacgactcactatagggaccggcggcgaccggcggcatctgatttggaacagaggagaccaaatatgatgccgccgaacctggcggcagcgcaaaagatg

SEQ ID NO: 16866 - DNA, 103 bp, Artificial Sequence
  Synthetic Polynucleotide
taatacgactcactatagggggaaatgacgtaattgtccgccatcttgtaaacagaggagatacaagatggcggacaataacctggcggcagcgcaaaagatg

SEQ ID NO: 16867 - DNA, 103 bp, Artificial Sequence
  Synthetic Polynucleotide
taatacgactcactatagggagctgcggcagtgctgtgctatatatactgaacagaggagacagtatatgtagcacagcaacctggcggcagcgcaaaagatg

SEQ ID NO: 16868 - DNA, 103 bp, Artificial Sequence
  Synthetic Polynucleotide
taatacgactcactataggggtggtactggtgggcgtttagttacgcatcaacagaggagagatgcgatgctaaacgccaacctggcggcagcgcaaaagatg

SEQ ID NO: 16869 - DNA, 103 bp, Artificial Sequence
  Synthetic Polynucleotide
taatacgactcactatagggtctgggtggtactggtgggcgtttagttacaacagaggagagtaactatgcgcccaccaaacctggcggcagcgcaaaagatg

SEQ ID NO: 16870 - DNA, 103 bp, Artificial Sequence
  Synthetic Polynucleotide
taatacgactcactatagggtacagtctgggtggtactggtgggcgtttaaacagaggagataaacgatgaccagtaccaacctggcggcagcgcaaaagatg

SEQ ID NO: 16871 - DNA, 103 bp, Artificial Sequence
  Synthetic Polynucleotide
taatacgactcactataggggcaggtacagtctgggtggtactggtgggcaacagaggagagcccacatgtaccacccaaacctggcggcagcgcaaaagatg

SEQ ID NO: 16872 - DNA, 103 bp, Artificial Sequence
  Synthetic Polynucleotide
taatacgactcactatagggagggggcaggtacagtctgggtggtactggaacagaggagaccagtaatgcccagactgaacctggcggcagcgcaaaagatg

SEQ ID NO: 16873 - DNA, 103 bp, Artificial Sequence
  Synthetic Polynucleotide
taatacgactcactatagggataggagggggcaggtacagtctgggtggtaacagaggagaaccaccatgactgtacctaacctggcggcagcgcaaaagatg

SEQ ID NO: 16874 - DNA, 103 bp, Artificial Sequence
  Synthetic Polynucleotide
taatacgactcactatagggtaggtataggagggggcaggtacagtctggaacagaggagaccagacatgacctgccccaacctggcggcagcgcaaaagatg

SEQ ID NO: 16875 - DNA, 103 bp, Artificial Sequence
  Synthetic Polynucleotide
taatacgactcactatagggtcttataggtataggagggggcaggtacagaacagaggagactgtacatgccccctcctaacctggcggcagcgcaaaagatg

SEQ ID NO: 16876 - DNA, 103 bp, Artificial Sequence
  Synthetic Polynucleotide
taatacgactcactatagggggctgtcttataggtataggagggggcaggaacagaggagacctgccatgtcctataccaacctggcggcagcgcaaaagatg

SEQ ID NO: 16877 - DNA, 103 bp, Artificial Sequence
  Synthetic Polynucleotide
taatacgactcactatagggtgttaggctgtcttataggtataggaggggaacagaggagacccctcatgtacctataaaacctggcggcagcgcaaaagatg

SEQ ID NO: 16878 - DNA, 103 bp, Artificial Sequence
  Synthetic Polynucleotide
taatacgactcactataggggaaagagctgcggcagtgctgtgctatataaacagaggagatatataatgcagcactgcaacctggcggcagcgcaaaagatg

SEQ ID NO: 16879 - DNA, 103 bp, Artificial Sequence
  Synthetic Polynucleotide
taatacgactcactatagggttttgtgttaggctgtcttataggtataggaacagaggagacctataatgataagacagaacctggcggcagcgcaaaagatg

SEQ ID NO: 16880 - DNA, 103 bp, Artificial Sequence
  Synthetic Polynucleotide
taatacgactcactatagggatatcttttgtgttaggctgtcttataggtaacagaggagaacctatatgacagcctaaaacctggcggcagcgcaaaagatg

SEQ ID NO: 16881 - DNA, 103 bp, Artificial Sequence
  Synthetic Polynucleotide
taatacgactcactatagggtgtctatatcttttgtgttaggctgtcttaaacagaggagataagacatgctaacacaaaacctggcggcagcgcaaaagatg

SEQ ID NO: 16882 - DNA, 103 bp, Artificial Sequence
  Synthetic Polynucleotide
taatacgactcactatagggtacattgtctatatcttttgtgttaggctgaacagaggagacagcctatgacaaaagataacctggcggcagcgcaaaagatg

SEQ ID NO: 16883 - DNA, 103 bp, Artificial Sequence
  Synthetic Polynucleotide
taatacgactcactatagggaattctacattgtctatatcttttgtgttaaacagaggagataacacatgagatatagaaacctggcggcagcgcaaaagatg

SEQ ID NO: 16884 - DNA, 103 bp, Artificial Sequence
  Synthetic Polynucleotide
taatacgactcactatagggacttaaattctacattgtctatatcttttgaacagaggagacaaaagatgtagacaatgaacctggcggcagcgcaaaagatg

SEQ ID NO: 16885 - DNA, 103 bp, Artificial Sequence
  Synthetic Polynucleotide
taatacgactcactatagggtaaatacttaaattctacattgtctatatcaacagaggagagatataatgaatgtagaaaacctggcggcagcgcaaaagatg

SEQ ID NO: 16886 - DNA, 103 bp, Artificial Sequence
  Synthetic Polynucleotide
taatacgactcactatagggctggttaaatacttaaattctacattgtctaacagaggagaagacaaatgagaatttaaaacctggcggcagcgcaaaagatg

SEQ ID NO: 16887 - DNA, 103 bp, Artificial Sequence
  Synthetic Polynucleotide
taatacgactcactatagggcatatctggttaaatacttaaattctacataacagaggagaatgtagatgttaagtattaacctggcggcagcgcaaaagatg

SEQ ID NO: 16888 - DNA, 103 bp, Artificial Sequence
  Synthetic Polynucleotide
taatacgactcactatagggttgttcatatctggttaaatacttaaattcaacagaggagagaatttatgtatttaaccaacctggcggcagcgcaaaagatg

SEQ ID NO: 16889 - DNA, 103 bp, Artificial Sequence
  Synthetic Polynucleotide
taatacgactcactatagggagaaagaaagagctgcggcagtgctgtgctaacagaggagaagcacaatgctgccgcagaacctggcggcagcgcaaaagatg

SEQ ID NO: 16890 - DNA, 103 bp, Artificial Sequence
  Synthetic Polynucleotide
taatacgactcactatagggacatgttgttcatatctggttaaatacttaaacagaggagataagtaatgaaccagataaacctggcggcagcgcaaaagatg

SEQ ID NO: 16891 - DNA, 103 bp, Artificial Sequence
  Synthetic Polynucleotide
taatacgactcactatagggtaataacatgttgttcatatctggttaaataacagaggagaatttaaatggatatgaacaacctggcggcagcgcaaaagatg

SEQ ID NO: 16892 - DNA, 103 bp, Artificial Sequence
  Synthetic Polynucleotide
taatacgactcactatagggcattctaataacatgttgttcatatctggtaacagaggagaaccagaatggaacaacataacctggcggcagcgcaaaagatg

SEQ ID NO: 16893 - DNA, 103 bp, Artificial Sequence
  Synthetic Polynucleotide
taatacgactcactatagggcttaacattctaataacatgttgttcatataacagaggagaatatgaatgacatgttataacctggcggcagcgcaaaagatg

SEQ ID NO: 16894 - DNA, 103 bp, Artificial Sequence
  Synthetic Polynucleotide
taatacgactcactatagggacaatcttaacattctaataacatgttgttaacagaggagaaacaacatgttattagaaaacctggcggcagcgcaaaagatg

SEQ ID NO: 16895 - DNA, 103 bp, Artificial Sequence
  Synthetic Polynucleotide
taatacgactcactatagggattacacaatcttaacattctaataacatgaacagaggagacatgttatgagaatgttaaacctggcggcagcgcaaaagatg

SEQ ID NO: 16896 - DNA, 103 bp, Artificial Sequence
  Synthetic Polynucleotide
taatacgactcactatagggtacatattacacaatcttaacattctaataaacagaggagatattagatggttaagattaacctggcggcagcgcaaaagatg

SEQ ID NO: 16897 - DNA, 103 bp, Artificial Sequence
  Synthetic Polynucleotide
taatacgactcactatagggtttgatacatattacacaatcttaacattcaacagaggagagaatgtatggattgtgtaaacctggcggcagcgcaaaagatg

SEQ ID NO: 16898 - DNA, 103 bp, Artificial Sequence
  Synthetic Polynucleotide
taatacgactcactatagggtaaattttgatacatattacacaatcttaaaacagaggagattaagaatgtgtaatatgaacctggcggcagcgcaaaagatg

SEQ ID NO: 16899 - DNA, 103 bp, Artificial Sequence
  Synthetic Polynucleotide
taatacgactcactatagggttttctaaattttgatacatattacacaataacagaggagaattgtgatgtatgtatcaaacctggcggcagcgcaaaagatg

SEQ ID NO: 16900 - DNA, 103 bp, Artificial Sequence
  Synthetic Polynucleotide
taatacgactcactatagggagcccagaaagaaagagctgcggcagtgctaacagaggagaagcactatggcagctcttaacctggcggcagcgcaaaagatg

SEQ ID NO: 16901 - DNA, 103 bp, Artificial Sequence
  Synthetic Polynucleotide
taatacgactcactatagggtttatttttctaaattttgatacatattacaacagaggagagtaataatgatcaaaattaacctggcggcagcgcaaaagatg

SEQ ID NO: 16902 - DNA, 103 bp, Artificial Sequence
  Synthetic Polynucleotide
taatacgactcactatagggaaacgtttatttttctaaattttgatacataacagaggagaatgtatatgaatttagaaaacctggcggcagcgcaaaagatg

SEQ ID NO: 16903 - DNA, 103 bp, Artificial Sequence
  Synthetic Polynucleotide
taatacgactcactatagggacaacaaacgtttatttttctaaattttgaaacagaggagatcaaaaatgagaaaaataaacctggcggcagcgcaaaagatg

SEQ ID NO: 16904 - DNA, 103 bp, Artificial Sequence
  Synthetic Polynucleotide
taatacgactcactatagggtaaccacaacaaacgtttatttttctaaataacagaggagaatttagatgaataaacgtaacctggcggcagcgcaaaagatg

SEQ ID NO: 16905 - DNA, 103 bp, Artificial Sequence
  Synthetic Polynucleotide
taatacgactcactatagggttttttaaccacaacaaacgtttatttttcaacagaggagagaaaaaatgacgtttgttaacctggcggcagcgcaaaagatg

SEQ ID NO: 16906 - DNA, 103 bp, Artificial Sequence
  Synthetic Polynucleotide
taatacgactcactatagggcataattttttaaccacaacaaacgtttataacagaggagaataaacatgtgttgtggtaacctggcggcagcgcaaaagatg

SEQ ID NO: 16907 - DNA, 103 bp, Artificial Sequence
  Synthetic Polynucleotide
taatacgactcactatagggaacaacataattttttaaccacaacaaacgaacagaggagacgtttgatgtggttaaaaaacctggcggcagcgcaaaagatg

SEQ ID NO: 16908 - DNA, 103 bp, Artificial Sequence
  Synthetic Polynucleotide
taatacgactcactatagggagcgcaacaacataattttttaaccacaacaacagaggagagttgtgatgaaaaaattaaacctggcggcagcgcaaaagatg

SEQ ID NO: 16909 - DNA, 103 bp, Artificial Sequence
  Synthetic Polynucleotide
taatacgactcactatagggtttaaagcgcaacaacataattttttaaccaacagaggagaggttaaatgattatgttgaacctggcggcagcgcaaaagatg

SEQ ID NO: 16910 - DNA, 103 bp, Artificial Sequence
  Synthetic Polynucleotide
taatacgactcactatagggaaatttttaaagcgcaacaacataatttttaacagaggagaaaaaatatggttgttgcgaacctggcggcagcgcaaaagatg

SEQ ID NO: 16911 - DNA, 103 bp, Artificial Sequence
  Synthetic Polynucleotide
taatacgactcactatagggaaagcagcccagaaagaaagagctgcggcaaacagaggagatgccgcatgtctttctttaacctggcggcagcgcaaaagatg

SEQ ID NO: 16912 - DNA, 103 bp, Artificial Sequence
  Synthetic Polynucleotide
taatacgactcactatagggcttttaaatttttaaagcgcaacaacataaaacagaggagattatgtatgtgcgctttaaacctggcggcagcgcaaaagatg

SEQ ID NO: 16913 - DNA, 103 bp, Artificial Sequence
  Synthetic Polynucleotide
taatacgactcactataggggtcttcttttaaatttttaaagcgcaacaaaacagaggagattgttgatgtttaaaaataacctggcggcagcgcaaaagatg

SEQ ID NO: 16914 - DNA, 103 bp, Artificial Sequence
  Synthetic Polynucleotide
taatacgactcactatagggttggtgtcttcttttaaatttttaaagcgcaacagaggagagcgcttatgaaatttaaaaacctggcggcagcgcaaaagatg

SEQ ID NO: 16915 - DNA, 103 bp, Artificial Sequence
  Synthetic Polynucleotide
taatacgactcactatagggctgatttggtgtcttcttttaaatttttaaaacagaggagattaaaaatgtaaaagaagaacctggcggcagcgcaaaagatg

SEQ ID NO: 16916 - DNA, 103 bp, Artificial Sequence
  Synthetic Polynucleotide
taatacgactcactatagggggcatctgatttggtgtcttcttttaaattaacagaggagaaatttaatggaagacaccaacctggcggcagcgcaaaagatg

SEQ ID NO: 16917 - DNA, 103 bp, Artificial Sequence
  Synthetic Polynucleotide
taatacgactcactatagggccggcggcatctgatttggtgtcttcttttaacagaggagaaaaagaatgcaccaaatcaacctggcggcagcgcaaaagatg

SEQ ID NO: 16918 - DNA, 103 bp, Artificial Sequence
  Synthetic Polynucleotide
taatacgactcactatagggggcgaccggcggcatctgatttggtgtcttaacagaggagaaagacaatgaatcagatgaacctggcggcagcgcaaaagatg

SEQ ID NO: 16919 - DNA, 103 bp, Artificial Sequence
  Synthetic Polynucleotide
taatacgactcactatagggccggcggcgaccggcggcatctgatttggtaacagaggagaaccaaaatggatgccgccaacctggcggcagcgcaaaagatg

SEQ ID NO: 16920 - DNA, 103 bp, Artificial Sequence
  Synthetic Polynucleotide
taatacgactcactataggggcctaccggcggcgaccggcggcatctgataacagaggagaatcagaatgcgccggtcgaacctggcggcagcgcaaaagatg

SEQ ID NO: 16921 - DNA, 103 bp, Artificial Sequence
  Synthetic Polynucleotide
taatacgactcactataggggtcccgcctaccggcggcgaccggcggcataacagaggagaatgccgatggtcgccgccaacctggcggcagcgcaaaagatg

SEQ ID NO: 16922 - DNA, 103 bp, Artificial Sequence
  Synthetic Polynucleotide
taatacgactcactatagggaggaaaaagcagcccagaaagaaagagctgaacagaggagacagctcatgctttctgggaacctggcggcagcgcaaaagatg

SEQ ID NO: 16923 - DNA, 103 bp, Artificial Sequence
  Synthetic Polynucleotide
taatacgactcactatagggcggaagtcccgcctaccggcggcgaccggcaacagaggagagccggtatgcgccggtagaacctggcggcagcgcaaaagatg

SEQ ID NO: 16924 - DNA, 103 bp, Artificial Sequence
  Synthetic Polynucleotide
taatacgactcactatagggtgtaccggaagtcccgcctaccggcggcgaaacagaggagatcgccgatggtaggcgggaacctggcggcagcgcaaaagatg

SEQ ID NO: 16925 - DNA, 103 bp, Artificial Sequence
  Synthetic Polynucleotide
taatacgactcactatagggcatcttgtaccggaagtcccgcctaccggcaacagaggagagccggtatgcgggacttcaacctggcggcagcgcaaaagatg

SEQ ID NO: 16926 - DNA, 103 bp, Artificial Sequence
  Synthetic Polynucleotide
taatacgactcactatagggtccgccatcttgtaccggaagtcccgcctaaacagaggagataggcgatgcttccggtaaacctggcggcagcgcaaaagatg

SEQ ID NO: 16927 - DNA, 103 bp, Artificial Sequence
  Synthetic Polynucleotide
taatacgactcactatagggaattgtccgccatcttgtaccggaagtcccaacagaggagagggactatgggtacaagaaacctggcggcagcgcaaaagatg

SEQ ID NO: 16928 - DNA, 103 bp, Artificial Sequence
  Synthetic Polynucleotide
taatacgactcactataggggacgtaattgtccgccatcttgtaccggaaaacagaggagattccggatgaagatggcgaacctggcggcagcgcaaaagatg

SEQ ID NO: 16929 - DNA, 103 bp, Artificial Sequence
  Synthetic Polynucleotide
taatacgactcactataggggaaatgacgtaattgtccgccatcttgtacaacagaggagagtacaaatgggcggacaaaacctggcggcagcgcaaaagatg

SEQ ID NO: 16930 - DNA, 103 bp, Artificial Sequence
  Synthetic Polynucleotide
taatacgactcactatagggcacaggaaatgacgtaattgtccgccatctaacagaggagaagatggatgacaattacgaacctggcggcagcgcaaaagatg

SEQ ID NO: 16931 - DNA, 103 bp, Artificial Sequence
  Synthetic Polynucleotide
taatacgactcactataggggacgtcacaggaaatgacgtaattgtccgcaacagaggagagcggacatgtacgtcattaacctggcggcagcgcaaaagatg

SEQ ID NO: 16932 - DNA, 103 bp, Artificial Sequence
  Synthetic Polynucleotide
taatacgactcactataggggaaatgacgtcacaggaaatgacgtaattgaacagaggagacaattaatgcatttcctgaacctggcggcagcgcaaaagatg

SEQ ID NO: 16933 - DNA, 103 bp, Artificial Sequence
  Synthetic Polynucleotide
taatacgactcactatagggagtccaggaaaaagcagcccagaaagaaagaacagaggagactttctatgtgggctgctaacctggcggcagcgcaaaagatg

SEQ ID NO: 16934 - DNA, 103 bp, Artificial Sequence
  Synthetic Polynucleotide
taatacgactcactatagggcacaggaaatgacgtcacaggaaatgacgtaacagaggagaacgtcaatgcctgtgacgaacctggcggcagcgcaaaagatg

SEQ ID NO: 16935 - DNA, 103 bp, Artificial Sequence
  Synthetic Polynucleotide
taatacgactcactataggggacgtcacaggaaatgacgtcacaggaaataacagaggagaatttccatggacgtcattaacctggcggcagcgcaaaagatg

SEQ ID NO: 16936 - DNA, 103 bp, Artificial Sequence
  Synthetic Polynucleotide
taatacgactcactataggggaagtgacgtcacaggaaatgacgtcacagaacagaggagactgtgaatgcatttcctgaacctggcggcagcgcaaaagatg

SEQ ID NO: 16937 - DNA, 103 bp, Artificial Sequence
  Synthetic Polynucleotide
taatacgactcactatagggcaccggaagtgacgtcacaggaaatgacgtaacagaggagaacgtcaatgcctgtgacgaacctggcggcagcgcaaaagatg

SEQ ID NO: 16938 - DNA, 103 bp, Artificial Sequence
  Synthetic Polynucleotide
taatacgactcactatagggccgcccaccggaagtgacgtcacaggaaataacagaggagaatttccatggacgtcactaacctggcggcagcgcaaaagatg

SEQ ID NO: 16939 - DNA, 103 bp, Artificial Sequence
  Synthetic Polynucleotide
taatacgactcactatagggaagttccgcccaccggaagtgacgtcacagaacagaggagactgtgaatgcacttccggaacctggcggcagcgcaaaagatg

SEQ ID NO: 16940 - DNA, 103 bp, Artificial Sequence
  Synthetic Polynucleotide
taatacgactcactatagggtccggaagttccgcccaccggaagtgacgtaacagaggagaacgtcaatgccggtgggcaacctggcggcagcgcaaaagatg

SEQ ID NO: 16941 - DNA, 103 bp, Artificial Sequence
  Synthetic Polynucleotide
taatacgactcactatagggctaattccggaagttccgcccaccggaagtaacagaggagaacttccatggggcggaacaacctggcggcagcgcaaaagatg

SEQ ID NO: 16942 - DNA, 103 bp, Artificial Sequence
  Synthetic Polynucleotide
taatacgactcactatagggcaaccctaattccggaagttccgcccaccgaacagaggagacggtggatggaacttccgaacctggcggcagcgcaaaagatg

SEQ ID NO: 16943 - DNA, 103 bp, Artificial Sequence
  Synthetic Polynucleotide
taatacgactcactatagggagagccaaccctaattccggaagttccgccaacagaggagaggcggaatgtccggaattaacctggcggcagcgcaaaagatg

SEQ ID NO: 16944 - DNA, 103 bp, Artificial Sequence
  Synthetic Polynucleotide
taatacgactcactatagggaagaaagtccaggaaaaagcagcccagaaaaacagaggagatttctgatgtgctttttcaacctggcggcagcgcaaaagatg

SEQ ID NO: 16945 - DNA, 103 bp, Artificial Sequence
  Synthetic Polynucleotide
taatacgactcactatagggggcccagagccaaccctaattccggaagttaacagaggagaaacttcatgaattagggtaacctggcggcagcgcaaaagatg

SEQ ID NO: 16946 - DNA, 103 bp, Artificial Sequence
  Synthetic Polynucleotide
taatacgactcactataggggcgctggcccagagccaaccctaattccggaacagaggagaccggaaatggggttggctaacctggcggcagcgcaaaagatg

SEQ ID NO: 16947 - DNA, 103 bp, Artificial Sequence
  Synthetic Polynucleotide
taatacgactcactatagggcccaagcgctggcccagagccaaccctaataacagaggagaattaggatgggctctgggaacctggcggcagcgcaaaagatg

SEQ ID NO: 16948 - DNA, 103 bp, Artificial Sequence
  Synthetic Polynucleotide
taatacgactcactatagggtcaaccccaagcgctggcccagagccaaccaacagaggagaggttggatgtgggccagcaacctggcggcagcgcaaaagatg

SEQ ID NO: 16949 - DNA, 103 bp, Artificial Sequence
  Synthetic Polynucleotide
taatacgactcactataggggcacgtcaaccccaagcgctggcccagagcaacagaggagagctctgatgcagcgcttgaacctggcggcagcgcaaaagatg

SEQ ID NO: 16950 - DNA, 103 bp, Artificial Sequence
  Synthetic Polynucleotide
taatacgactcactatagggtagtggcacgtcaaccccaagcgctggcccaacagaggagagggccaatgcttggggttaacctggcggcagcgcaaaagatg

SEQ ID NO: 16951 - DNA, 103 bp, Artificial Sequence
  Synthetic Polynucleotide
taatacgactcactataggggatcttagtggcacgtcaaccccaagcgctaacagaggagaagcgctatgggttgacgtaacctggcggcagcgcaaaagatg

SEQ ID NO: 16952 - DNA, 103 bp, Artificial Sequence
  Synthetic Polynucleotide
taatacgactcactatagggcgcttgatcttagtggcacgtcaaccccaaaacagaggagattggggatgacgtgccacaacctggcggcagcgcaaaagatg

SEQ ID NO: 16953 - DNA, 103 bp, Artificial Sequence
  Synthetic Polynucleotide
taatacgactcactatagggcgcgccgcttgatcttagtggcacgtcaacaacagaggagagttgacatgccactaagaaacctggcggcagcgcaaaagatg

SEQ ID NO: 16954 - DNA, 103 bp, Artificial Sequence
  Synthetic Polynucleotide
taatacgactcactatagggagcggcgcgccgcttgatcttagtggcacgaacagaggagacgtgccatgaagatcaagaacctggcggcagcgcaaaagatg

SEQ ID NO: 16955 - DNA, 103 bp, Artificial Sequence
  Synthetic Polynucleotide
taatacgactcactatagggacagcaagaaagtccaggaaaaagcagcccaacagaggagagggctgatgtttcctggaaacctggcggcagcgcaaaagatg

SEQ ID NO: 16956 - DNA, 103 bp, Artificial Sequence
  Synthetic Polynucleotide
taatacgactcactatagggagacaagcggcgcgccgcttgatcttagtgaacagaggagacactaaatgcaagcggcgaacctggcggcagcgcaaaagatg

SEQ ID NO: 16957 - DNA, 103 bp, Artificial Sequence
  Synthetic Polynucleotide
taatacgactcactatagggcactaagacaagcggcgcgccgcttgatctaacagaggagaagatcaatgggcgcgccgaacctggcggcagcgcaaaagatg

SEQ ID NO: 16958 - DNA, 103 bp, Artificial Sequence
  Synthetic Polynucleotide
taatacgactcactatagggcttgacactaagacaagcggcgcgccgcttaacagaggagaaagcggatggccgcttgtaacctggcggcagcgcaaaagatg

SEQ ID NO: 16959 - DNA, 103 bp, Artificial Sequence
  Synthetic Polynucleotide
taatacgactcactataggggttgccttgacactaagacaagcggcgcgcaacagaggagagcgcgcatgttgtcttagaacctggcggcagcgcaaaagatg

SEQ ID NO: 16960 - DNA, 103 bp, Artificial Sequence
  Synthetic Polynucleotide
taatacgactcactatagggttggggttgccttgacactaagacaagcggaacagaggagaccgcttatgttagtgtcaaacctggcggcagcgcaaaagatg

SEQ ID NO: 16961 - DNA, 103 bp, Artificial Sequence
  Synthetic Polynucleotide
taatacgactcactatagggcttgcttggggttgccttgacactaagacaaacagaggagatgtcttatggtcaaggcaaacctggcggcagcgcaaaagatg

SEQ ID NO: 16962 - DNA, 103 bp, Artificial Sequence
  Synthetic Polynucleotide
taatacgactcactataggggccagcttgcttggggttgccttgacactaaacagaggagatagtgtatgggcaaccccaacctggcggcagcgcaaaagatg

SEQ ID NO: 16963 - DNA, 103 bp, Artificial Sequence
  Synthetic Polynucleotide
taatacgactcactatagggtctgggccagcttgcttggggttgccttgaaacagaggagatcaaggatgccccaagcaaacctggcggcagcgcaaaagatg

SEQ ID NO: 16964 - DNA, 103 bp, Artificial Sequence
  Synthetic Polynucleotide
taatacgactcactatagggttggctctgggccagcttgcttggggttgcaacagaggagagcaaccatgagcaagctgaacctggcggcagcgcaaaagatg

SEQ ID NO: 16965 - DNA, 103 bp, Artificial Sequence
  Synthetic Polynucleotide
taatacgactcactatagggtagggttggctctgggccagcttgcttgggaacagaggagacccaagatggctggcccaaacctggcggcagcgcaaaagatg

SEQ ID NO: 16966 - DNA, 103 bp, Artificial Sequence
  Synthetic Polynucleotide
taatacgactcactatagggaaaaaacagcaagaaagtccaggaaaaagcaacagaggagagcttttatgtggactttcaacctggcggcagcgcaaaagatg

SEQ ID NO: 16967 - DNA, 103 bp, Artificial Sequence
  Synthetic Polynucleotide
taatacgactcactatagggggaattagggttggctctgggccagcttgcaacagaggagagcaagcatgcccagagccaacctggcggcagcgcaaaagatg

SEQ ID NO: 16968 - DNA, 103 bp, Artificial Sequence
  Synthetic Polynucleotide
taatacgactcactatagggcttccggaattagggttggctctgggccagaacagaggagactggccatgagccaacccaacctggcggcagcgcaaaagatg

SEQ ID NO: 16969 - DNA, 103 bp, Artificial Sequence
  Synthetic Polynucleotide
taatacgactcactatagggcgggacttccggaattagggttggctctggaacagaggagaccagagatgaccctaattaacctggcggcagcgcaaaagatg

SEQ ID NO: 16970 - DNA, 103 bp, Artificial Sequence
  Synthetic Polynucleotide
taatacgactcactataggggtgggcgggacttccggaattagggttggcaacagaggagagccaacatgaattccggaaacctggcggcagcgcaaaagatg

SEQ ID NO: 16971 - DNA, 103 bp, Artificial Sequence
  Synthetic Polynucleotide
taatacgactcactatagggttccggtgggcgggacttccggaattagggaacagaggagaccctaaatgcggaagtccaacctggcggcagcgcaaaagatg

SEQ ID NO: 16972 - DNA, 103 bp, Artificial Sequence
  Synthetic Polynucleotide
taatacgactcactataggggtcacttccggtgggcgggacttccggaataacagaggagaattccgatggtcccgcccaacctggcggcagcgcaaaagatg

SEQ ID NO: 16973 - DNA, 103 bp, Artificial Sequence
  Synthetic Polynucleotide
taatacgactcactataggggtgacgtcacttccggtgggcgggacttccaacagaggagaggaagtatggcccaccggaacctggcggcagcgcaaaagatg

SEQ ID NO: 16974 - DNA, 103 bp, Artificial Sequence
  Synthetic Polynucleotide
taatacgactcactatagggttcctgtgacgtcacttccggtgggcgggaaacagaggagatcccgcatgccggaagtgaacctggcggcagcgcaaaagatg

SEQ ID NO: 16975 - DNA, 103 bp, Artificial Sequence
  Synthetic Polynucleotide
taatacgactcactataggggtcatttcctgtgacgtcacttccggtgggaacagaggagacccaccatgagtgacgtcaacctggcggcagcgcaaaagatg

SEQ ID NO: 16976 - DNA, 103 bp, Artificial Sequence
  Synthetic Polynucleotide
taatacgactcactataggggtgacgtcatttcctgtgacgtcacttccgaacagaggagacggaagatgcgtcacaggaacctggcggcagcgcaaaagatg

SEQ ID NO: 16977 - DNA, 103 bp, Artificial Sequence
  Synthetic Polynucleotide
taatacgactcactatagggtcacaggaaatgacgtaattgtccgccatcaacagaggagagatggcatgcaattacgtaacctggcggcagcgcaaaagatg

SEQ ID NO: 16978 - DNA, 103 bp, Artificial Sequence
  Synthetic Polynucleotide
taatacgactcactatagggctcacaaaaaacagcaagaaagtccaggaaaacagaggagattcctgatgtttcttgctaacctggcggcagcgcaaaagatg

SEQ ID NO: 16979 - DNA, 103 bp, Artificial Sequence
  Synthetic Polynucleotide
taatacgactcactatagggttcctgtgacgtcatttcctgtgacgtcacaacagaggagagtgacgatgcaggaaatgaacctggcggcagcgcaaaagatg

SEQ ID NO: 16980 - DNA, 103 bp, Artificial Sequence
  Synthetic Polynucleotide
taatacgactcactataggggtcatttcctgtgacgtcatttcctgtgacaacagaggagagtcacaatgaatgacgtcaacctggcggcagcgcaaaagatg

SEQ ID NO: 16981 - DNA, 103 bp, Artificial Sequence
  Synthetic Polynucleotide
taatacgactcactatagggattacgtcatttcctgtgacgtcatttcctaacagaggagaaggaaaatgcgtcacaggaacctggcggcagcgcaaaagatg

SEQ ID NO: 16982 - DNA, 103 bp, Artificial Sequence
  Synthetic Polynucleotide
taatacgactcactatagggggacaattacgtcatttcctgtgacgtcataacagaggagaatgacgatgcaggaaatgaacctggcggcagcgcaaaagatg

SEQ ID NO: 16983 - DNA, 103 bp, Artificial Sequence
  Synthetic Polynucleotide
taatacgactcactatagggatggcggacaattacgtcatttcctgtgacaacagaggagagtcacaatgaatgacgtaaacctggcggcagcgcaaaagatg

SEQ ID NO: 16984 - DNA, 103 bp, Artificial Sequence
  Synthetic Polynucleotide
taatacgactcactatagggacaagatggcggacaattacgtcatttcctaacagaggagaaggaaaatgcgtaattgtaacctggcggcagcgcaaaagatg

SEQ ID NO: 16985 - DNA, 103 bp, Artificial Sequence
  Synthetic Polynucleotide
taatacgactcactatagggccggtacaagatggcggacaattacgtcataacagaggagaatgacgatgttgtccgccaacctggcggcagcgcaaaagatg

SEQ ID NO: 16986 - DNA, 103 bp, Artificial Sequence
  Synthetic Polynucleotide
taatacgactcactataggggacttccggtacaagatggcggacaattacaacagaggagagtaattatgcgccatcttaacctggcggcagcgcaaaagatg

SEQ ID NO: 16987 - DNA, 103 bp, Artificial Sequence
  Synthetic Polynucleotide
taatacgactcactatagggggcgggacttccggtacaagatggcggacaaacagaggagatgtccgatgtcttgtaccaacctggcggcagcgcaaaagatg

SEQ ID NO: 16988 - DNA, 103 bp, Artificial Sequence
  Synthetic Polynucleotide
taatacgactcactatagggcggtaggcgggacttccggtacaagatggcaacagaggagagccatcatgtaccggaagaacctggcggcagcgcaaaagatg

SEQ ID NO: 16989 - DNA, 103 bp, Artificial Sequence
  Synthetic Polynucleotide
taatacgactcactataggggttagctcacaaaaaacagcaagaaagtccaacagaggagaggacttatgtgctgttttaacctggcggcagcgcaaaagatg

SEQ ID NO: 16990 - DNA, 103 bp, Artificial Sequence
  Synthetic Polynucleotide
taatacgactcactataggggccgccggtaggcgggacttccggtacaagaacagaggagacttgtaatggaagtcccgaacctggcggcagcgcaaaagatg

SEQ ID NO: 16991 - DNA, 103 bp, Artificial Sequence
  Synthetic Polynucleotide
taatacgactcactatagggcggtcgccgccggtaggcgggacttccggtaacagaggagaaccggaatgcccgcctacaacctggcggcagcgcaaaagatg

SEQ ID NO: 16992 - DNA, 103 bp, Artificial Sequence
  Synthetic Polynucleotide
taatacgactcactataggggccgccggtcgccgccggtaggcgggacttaacagaggagaaagtccatgctaccggcgaacctggcggcagcgcaaaagatg

SEQ ID NO: 16993 - DNA, 103 bp, Artificial Sequence
  Synthetic Polynucleotide
taatacgactcactatagggcagatgccgccggtcgccgccggtaggcggaacagaggagaccgcctatgggcggcgacaacctggcggcagcgcaaaagatg

SEQ ID NO: 16994 - DNA, 103 bp, Artificial Sequence
  Synthetic Polynucleotide
taatacgactcactatagggcaaatcagatgccgccggtcgccgccggtaaacagaggagataccggatgcgaccggcgaacctggcggcagcgcaaaagatg

SEQ ID NO: 16995 - DNA, 103 bp, Artificial Sequence
  Synthetic Polynucleotide
taatacgactcactatagggtgttagttagctcacaaaaaacagcaagaaaacagaggagattcttgatgttttttgtgaacctggcggcagcgcaaaagatg

SEQ ID NO: 16996 - DNA, 103 bp, Artificial Sequence
  Synthetic Polynucleotide
taatacgactcactatagggatacctgttagttagctcacaaaaaacagcaacagaggagagctgttatgtgtgagctaaacctggcggcagcgcaaaagatg

SEQ ID NO: 16997 - DNA, 103 bp, Artificial Sequence
  Synthetic Polynucleotide
taatacgactcactatagggtataaatacctgttagttagctcacaaaaaaacagaggagatttttgatggctaactaaaacctggcggcagcgcaaaagatg

SEQ ID NO: 16998 - DNA, 103 bp, Artificial Sequence
  Synthetic Polynucleotide
taatacgactcactatagggagtagtataaatacctgttagttagctcacaacagaggagagtgagcatgctaacaggtaacctggcggcagcgcaaaagatg

SEQ ID NO: 16999 - DNA, 103 bp, Artificial Sequence
  Synthetic Polynucleotide
taatacgactcactatagggtaacaagtagtataaatacctgttagttagaacagaggagactaactatgaggtatttaaacctggcggcagcgcaaaagatg

SEQ ID NO: 17000 - DNA, 103 bp, Artificial Sequence
  Synthetic Polynucleotide
taatacgactcactatagggtatattaacaagtagtataaatacctgttaaacagaggagataacagatgtttatactaaacctggcggcagcgcaaaagatg

SEQ ID NO: 17001 - DNA, 103 bp, Artificial Sequence
  Synthetic Polynucleotide
taatacgactcactataggggttagtatattaacaagtagtataaataccaacagaggagaggtattatgactacttgtaacctggcggcagcgcaaaagatg

SEQ ID NO: 17002 - DNA, 103 bp, Artificial Sequence
  Synthetic Polynucleotide
taatacgactcactatagggtccatgttagtatattaacaagtagtataaaacagaggagattatacatgttgttaataaacctggcggcagcgcaaaagatg

SEQ ID NO: 17003 - DNA, 103 bp, Artificial Sequence
  Synthetic Polynucleotide
taatacgactcactatagggtgacgtcacaggaaatgacgtaattgtccgaacagaggagacggacaatgacgtcatttaacctggcggcagcgcaaaagatg

SEQ ID NO: 17004 - DNA, 103 bp, Artificial Sequence
  Synthetic Polynucleotide
taatacgactcactatagggatagctccatgttagtatattaacaagtagaacagaggagactacttatgaatatactaaacctggcggcagcgcaaaagatg

SEQ ID NO: 17005 - DNA, 103 bp, Artificial Sequence
  Synthetic Polynucleotide
taatacgactcactatagggtctaaatagctccatgttagtatattaacaaacagaggagatgttaaatgactaacatgaacctggcggcagcgcaaaagatg

SEQ ID NO: 17006 - DNA, 103 bp, Artificial Sequence
  Synthetic Polynucleotide
taatacgactcactatagggacccctctaaatagctccatgttagtatataacagaggagaatatacatgcatggagctaacctggcggcagcgcaaaagatg

SEQ ID NO: 17007 - DNA, 103 bp, Artificial Sequence
  Synthetic Polynucleotide
taatacgactcactataggggaagcacccctctaaatagctccatgttagaacagaggagactaacaatgagctatttaaacctggcggcagcgcaaaagatg

SEQ ID NO: 17008 - DNA, 103 bp, Artificial Sequence
  Synthetic Polynucleotide
taatacgactcactatagggaacttgaagcacccctctaaatagctccataacagaggagaatggagatgtttagagggaacctggcggcagcgcaaaagatg

SEQ ID NO: 17009 - DNA, 103 bp, Artificial Sequence
  Synthetic Polynucleotide
taatacgactcactataggggaagaaacttgaagcacccctctaaatagcaacagaggagagctattatgaggggtgctaacctggcggcagcgcaaaagatg

SEQ ID NO: 17010 - DNA, 103 bp, Artificial Sequence
  Synthetic Polynucleotide
taatacgactcactatagggcattagaagaaacttgaagcacccctctaaaacagaggagattagagatgtgcttcaagaacctggcggcagcgcaaaagatg

SEQ ID NO: 17011 - DNA, 103 bp, Artificial Sequence
  Synthetic Polynucleotide
taatacgactcactatagggcagaacattagaagaaacttgaagcaccccaacagaggagaggggtgatgcaagtttctaacctggcggcagcgcaaaagatg

SEQ ID NO: 17012 - DNA, 103 bp, Artificial Sequence
  Synthetic Polynucleotide
taatacgactcactatagggcagtccagaacattagaagaaacttgaagcaacagaggagagcttcaatgttcttctaaaacctggcggcagcgcaaaagatg

SEQ ID NO: 17013 - DNA, 103 bp, Artificial Sequence
  Synthetic Polynucleotide
taatacgactcactatagggtagcacagtccagaacattagaagaaacttaacagaggagaaagtttatgctaatgttcaacctggcggcagcgcaaaagatg

SEQ ID NO: 17014 - DNA, 103 bp, Artificial Sequence
  Synthetic Polynucleotide
taatacgactcactatagggggaaatgacgtcacaggaaatgacgtaattaacagaggagaaattacatgatttcctgtaacctggcggcagcgcaaaagatg

SEQ ID NO: 17015 - DNA, 103 bp, Artificial Sequence
  Synthetic Polynucleotide
taatacgactcactatagggatcgttagcacagtccagaacattagaagaaacagaggagatcttctatggttctggacaacctggcggcagcgcaaaagatg

SEQ ID NO: 17016 - DNA, 103 bp, Artificial Sequence
  Synthetic Polynucleotide
taatacgactcactatagggcagttatcgttagcacagtccagaacattaaacagaggagataatgtatgggactgtgcaacctggcggcagcgcaaaagatg

SEQ ID NO: 17017 - DNA, 103 bp, Artificial Sequence
  Synthetic Polynucleotide
taatacgactcactatagggaccaccagttatcgttagcacagtccagaaaacagaggagattctggatggtgctaacgaacctggcggcagcgcaaaagatg

SEQ ID NO: 17018 - DNA, 103 bp, Artificial Sequence
  Synthetic Polynucleotide
taatacgactcactatagggagagcaccaccagttatcgttagcacagtcaacagaggagagactgtatgaacgataacaacctggcggcagcgcaaaagatg

SEQ ID NO: 17019 - DNA, 103 bp, Artificial Sequence
  Synthetic Polynucleotide
taatacgactcactatagggagtaaagagcaccaccagttatcgttagcaaacagaggagatgctaaatgtaactggtgaacctggcggcagcgcaaaagatg

SEQ ID NO: 17020 - DNA, 103 bp, Artificial Sequence
  Synthetic Polynucleotide
taatacgactcactatagggaatctagtaaagagcaccaccagttatcgtaacagaggagaacgataatgggtggtgctaacctggcggcagcgcaaaagatg

SEQ ID NO: 17021 - DNA, 103 bp, Artificial Sequence
  Synthetic Polynucleotide
taatacgactcactataggggtctaaatctagtaaagagcaccaccagttaacagaggagaaactggatgtgctctttaaacctggcggcagcgcaaaagatg

SEQ ID NO: 17022 - DNA, 103 bp, Artificial Sequence
  Synthetic Polynucleotide
taatacgactcactataggggaagtgtctaaatctagtaaagagcaccacaacagaggagagtggtgatgtttactagaaacctggcggcagcgcaaaagatg

SEQ ID NO: 17023 - DNA, 103 bp, Artificial Sequence
  Synthetic Polynucleotide
taatacgactcactatagggagtcagaagtgtctaaatctagtaaagagcaacagaggagagctcttatgtagatttagaacctggcggcagcgcaaaagatg

SEQ ID NO: 17024 - DNA, 103 bp, Artificial Sequence
  Synthetic Polynucleotide
taatacgactcactatagggttcccagtcagaagtgtctaaatctagtaaaacagaggagattactaatgttagacactaacctggcggcagcgcaaaagatg

SEQ ID NO: 17025 - DNA, 103 bp, Artificial Sequence
  Synthetic Polynucleotide
taatacgactcactatagggtcacaggaaatgacgtcacaggaaatgacgaacagaggagacgtcatatgctgtgacgtaacctggcggcagcgcaaaagatg

SEQ ID NO: 17026 - DNA, 103 bp, Artificial Sequence
  Synthetic Polynucleotide
taatacgactcactatagggagtggttcccagtcagaagtgtctaaatctaacagaggagaagatttatgcacttctgaaacctggcggcagcgcaaaagatg

SEQ ID NO: 17027 - DNA, 103 bp, Artificial Sequence
  Synthetic Polynucleotide
taatacgactcactataggggagttagtggttcccagtcagaagtgtctaaacagaggagatagacaatgctgactgggaacctggcggcagcgcaaaagatg

SEQ ID NO: 17028 - DNA, 103 bp, Artificial Sequence
  Synthetic Polynucleotide
taatacgactcactatagggagtatgagttagtggttcccagtcagaagtaacagaggagaacttctatgtgggaaccaaacctggcggcagcgcaaaagatg

SEQ ID NO: 17029 - DNA, 103 bp, Artificial Sequence
  Synthetic Polynucleotide
taatacgactcactatagggctgttagtatgagttagtggttcccagtcaaacagaggagatgactgatgaccactaacaacctggcggcagcgcaaaagatg

SEQ ID NO: 17030 - DNA, 103 bp, Artificial Sequence
  Synthetic Polynucleotide
taatacgactcactatagggttagtctgttagtatgagttagtggttcccaacagaggagagggaacatgtaactcataaacctggcggcagcgcaaaagatg

SEQ ID NO: 17031 - DNA, 103 bp, Artificial Sequence
  Synthetic Polynucleotide
taatacgactcactatagggtgccattagtctgttagtatgagttagtggaacagaggagaccactaatgcatactaacaacctggcggcagcgcaaaagatg

SEQ ID NO: 17032 - DNA, 103 bp, Artificial Sequence
  Synthetic Polynucleotide
taatacgactcactatagggtatattgccattagtctgttagtatgagttaacagaggagaaactcaatgtaacagactaacctggcggcagcgcaaaagatg

SEQ ID NO: 17033 - DNA, 103 bp, Artificial Sequence
  Synthetic Polynucleotide
taatacgactcactatagggttaagtatattgccattagtctgttagtataacagaggagaatactaatggactaatggaacctggcggcagcgcaaaagatg

SEQ ID NO: 17034 - DNA, 103 bp, Artificial Sequence
  Synthetic Polynucleotide
taatacgactcactatagggactgcttaagtatattgccattagtctgttaacagaggagaaacagaatgatggcaataaacctggcggcagcgcaaaagatg

SEQ ID NO: 17035 - DNA, 103 bp, Artificial Sequence
  Synthetic Polynucleotide
taatacgactcactataggggccacactgcttaagtatattgccattagtaacagaggagaactaatatgaatatacttaacctggcggcagcgcaaaagatg

SEQ ID NO: 17036 - DNA, 103 bp, Artificial Sequence
  Synthetic Polynucleotide
taatacgactcactatagggtgacgtcacaggaaatgacgtcacaggaaaaacagaggagatttcctatgacgtcatttaacctggcggcagcgcaaaagatg

SEQ ID NO: 17037 - DNA, 103 bp, Artificial Sequence
  Synthetic Polynucleotide
taatacgactcactatagggtagaagccacactgcttaagtatattgccaaacagaggagatggcaaatgacttaagcaaacctggcggcagcgcaaaagatg

SEQ ID NO: 17038 - DNA, 103 bp, Artificial Sequence
  Synthetic Polynucleotide
taatacgactcactatagggaagcttagaagccacactgcttaagtatataacagaggagaatatacatgagcagtgtgaacctggcggcagcgcaaaagatg

SEQ ID NO: 17039 - DNA, 103 bp, Artificial Sequence
  Synthetic Polynucleotide
taatacgactcactatagggaggtcaagcttagaagccacactgcttaagaacagaggagacttaagatgtgtggcttcaacctggcggcagcgcaaaagatg

SEQ ID NO: 17040 - DNA, 103 bp, Artificial Sequence
  Synthetic Polynucleotide
taatacgactcactatagggcggtaaggtcaagcttagaagccacactgcaacagaggagagcagtgatgcttctaagcaacctggcggcagcgcaaaagatg

SEQ ID NO: 17041 - DNA, 103 bp, Artificial Sequence
  Synthetic Polynucleotide
taatacgactcactatagggccccccggtaaggtcaagcttagaagccacaacagaggagagtggctatgaagcttgacaacctggcggcagcgcaaaagatg

SEQ ID NO: 17042 - DNA, 103 bp, Artificial Sequence
  Synthetic Polynucleotide
taatacgactcactatagggagtggccccccggtaaggtcaagcttagaaaacagaggagattctaaatgtgaccttacaacctggcggcagcgcaaaagatg

SEQ ID NO: 17043 - DNA, 103 bp, Artificial Sequence
  Synthetic Polynucleotide
taatacgactcactatagggctgctagtggccccccggtaaggtcaagctaacagaggagaagcttgatgttaccggggaacctggcggcagcgcaaaagatg

SEQ ID NO: 17044 - DNA, 103 bp, Artificial Sequence
  Synthetic Polynucleotide
taatacgactcactataggggcaccctgctagtggccccccggtaaggtcaacagaggagagaccttatgggggggccaaacctggcggcagcgcaaaagatg

SEQ ID NO: 17045 - DNA, 103 bp, Artificial Sequence
  Synthetic Polynucleotide
taatacgactcactatagggtacaagcaccctgctagtggccccccggtaaacagaggagataccggatggccactagcaacctggcggcagcgcaaaagatg

SEQ ID NO: 17046 - DNA, 103 bp, Artificial Sequence
  Synthetic Polynucleotide
taatacgactcactatagggaaaagtacaagcaccctgctagtggcccccaacagaggagagggggcatgtagcagggtaacctggcggcagcgcaaaagatg

SEQ ID NO: 17047 - DNA, 103 bp, Artificial Sequence
  Synthetic Polynucleotide
taatacgactcactatagggggaagtgacgtcacaggaaatgacgtcacaaacagaggagatgtgacatgatttcctgtaacctggcggcagcgcaaaagatg

SEQ ID NO: 17048 - DNA, 103 bp, Artificial Sequence
  Synthetic Polynucleotide
taatacgactcactatagggttgaaaaaagtacaagcaccctgctagtggaacagaggagaccactaatggggtgcttgaacctggcggcagcgcaaaagatg

SEQ ID NO: 17049 - DNA, 103 bp, Artificial Sequence
  Synthetic Polynucleotide
taatacgactcactatagggtctgcttgaaaaaagtacaagcaccctgctaacagaggagaagcaggatgcttgtacttaacctggcggcagcgcaaaagatg

SEQ ID NO: 17050 - DNA, 103 bp, Artificial Sequence
  Synthetic Polynucleotide
taatacgactcactatagggtacattctgcttgaaaaaagtacaagcaccaacagaggagaggtgctatgacttttttcaacctggcggcagcgcaaaagatg

SEQ ID NO: 17051 - DNA, 103 bp, Artificial Sequence
  Synthetic Polynucleotide
taatacgactcactatagggtttgttacattctgcttgaaaaaagtacaaaacagaggagattgtacatgtttcaagcaaacctggcggcagcgcaaaagatg

SEQ ID NO: 17052 - DNA, 103 bp, Artificial Sequence
  Synthetic Polynucleotide
taatacgactcactatagggtcaaatttgttacattctgcttgaaaaaagaacagaggagactttttatgagcagaatgaacctggcggcagcgcaaaagatg

SEQ ID NO: 17053 - DNA, 103 bp, Artificial Sequence
  Synthetic Polynucleotide
taatacgactcactatagggcttcttcaaatttgttacattctgcttgaaaacagaggagattcaagatgaatgtaacaaacctggcggcagcgcaaaagatg

SEQ ID NO: 17054 - DNA, 103 bp, Artificial Sequence
  Synthetic Polynucleotide
taatacgactcactatagggatagccttcttcaaatttgttacattctgcaacagaggagagcagaaatgaacaaatttaacctggcggcagcgcaaaagatg

SEQ ID NO: 17055 - DNA, 103 bp, Artificial Sequence
  Synthetic Polynucleotide
taatacgactcactatagggatatgatagccttcttcaaatttgttacataacagaggagaatgtaaatgatttgaagaaacctggcggcagcgcaaaagatg

SEQ ID NO: 17056 - DNA, 103 bp, Artificial Sequence
  Synthetic Polynucleotide
taatacgactcactatagggcatgaatatgatagccttcttcaaatttgtaacagaggagaacaaatatgaagaaggctaacctggcggcagcgcaaaagatg

SEQ ID NO: 17057 - DNA, 103 bp, Artificial Sequence
  Synthetic Polynucleotide
taatacgactcactatagggaaccacatgaatatgatagccttcttcaaaaacagaggagatttgaaatgggctatcataacctggcggcagcgcaaaagatg

SEQ ID NO: 17058 - DNA, 103 bp, Artificial Sequence
  Synthetic Polynucleotide
taatacgactcactatagggccaccggaagtgacgtcacaggaaatgacgaacagaggagacgtcatatgctgtgacgtaacctggcggcagcgcaaaagatg

SEQ ID NO: 17059 - DNA, 103 bp, Artificial Sequence
  Synthetic Polynucleotide
taatacgactcactatagggccaataaccacatgaatatgatagccttctaacagaggagaagaaggatgtcatattcaaacctggcggcagcgcaaaagatg

SEQ ID NO: 17060 - DNA, 103 bp, Artificial Sequence
  Synthetic Polynucleotide
taatacgactcactataggggccccccaataaccacatgaatatgatagcaacagaggagagctatcatgttcatgtggaacctggcggcagcgcaaaagatg

SEQ ID NO: 17061 - DNA, 103 bp, Artificial Sequence
  Synthetic Polynucleotide
taatacgactcactatagggccctggccccccaataaccacatgaatatgaacagaggagacatattatggtggttattaacctggcggcagcgcaaaagatg

SEQ ID NO: 17062 - DNA, 103 bp, Artificial Sequence
  Synthetic Polynucleotide
taatacgactcactatagggtttaaccctggccccccaataaccacatgaaacagaggagatcatgtatgtattgggggaacctggcggcagcgcaaaagatg

SEQ ID NO: 17063 - DNA, 103 bp, Artificial Sequence
  Synthetic Polynucleotide
taatacgactcactatagggtggggtttaaccctggccccccaataaccaaacagaggagatggttaatggggggccagaacctggcggcagcgcaaaagatg

SEQ ID NO: 17064 - DNA, 103 bp, Artificial Sequence
  Synthetic Polynucleotide
taatacgactcactataggggtttctggggtttaaccctggccccccaataacagaggagaattgggatgccagggttaaacctggcggcagcgcaaaagatg

SEQ ID NO: 17065 - DNA, 103 bp, Artificial Sequence
  Synthetic Polynucleotide
taatacgactcactataggggtgaggtttctggggtttaaccctggccccaacagaggagaggggccatggttaaacccaacctggcggcagcgcaaaagatg

SEQ ID NO: 17066 - DNA, 103 bp, Artificial Sequence
  Synthetic Polynucleotide
taatacgactcactatagggacactgtgaggtttctggggtttaaccctgaacagaggagacagggtatgaccccagaaaacctggcggcagcgcaaaagatg

SEQ ID NO: 17067 - DNA, 103 bp, Artificial Sequence
  Synthetic Polynucleotide
taatacgactcactatagggtacacacactgtgaggtttctggggtttaaaacagaggagattaaacatgagaaacctcaacctggcggcagcgcaaaagatg

SEQ ID NO: 17068 - DNA, 103 bp, Artificial Sequence
  Synthetic Polynucleotide
taatacgactcactatagggccctctacacacactgtgaggtttctggggaacagaggagaccccagatgcctcacagtaacctggcggcagcgcaaaagatg

SEQ ID NO: 17069 - DNA, 103 bp, Artificial Sequence
  Synthetic Polynucleotide
taatacgactcactatagggcccgcccaccggaagtgacgtcacaggaaaaacagaggagatttcctatgacgtcacttaacctggcggcagcgcaaaagatg

SEQ ID NO: 17070 - DNA, 103 bp, Artificial Sequence
  Synthetic Polynucleotide
taatacgactcactatagggataacccctctacacacactgtgaggtttcaacagaggagagaaaccatgcagtgtgtgaacctggcggcagcgcaaaagatg

SEQ ID NO: 17071 - DNA, 103 bp, Artificial Sequence
  Synthetic Polynucleotide
taatacgactcactatagggattaaataacccctctacacacactgtgagaacagaggagactcacaatgtgtgtagagaacctggcggcagcgcaaaagatg

SEQ ID NO: 17072 - DNA, 103 bp, Artificial Sequence
  Synthetic Polynucleotide
taatacgactcactatagggacattattaaataacccctctacacacactaacagaggagaagtgtgatgagaggggttaacctggcggcagcgcaaaagatg

SEQ ID NO: 17073 - DNA, 103 bp, Artificial Sequence
  Synthetic Polynucleotide
taatacgactcactatagggaaagtacattattaaataacccctctacacaacagaggagagtgtagatgggttatttaaacctggcggcagcgcaaaagatg

SEQ ID NO: 17074 - DNA, 103 bp, Artificial Sequence
  Synthetic Polynucleotide
taatacgactcactataggggtgataaagtacattattaaataacccctcaacagaggagagaggggatgtttaataataacctggcggcagcgcaaaagatg

SEQ ID NO: 17075 - DNA, 103 bp, Artificial Sequence
  Synthetic Polynucleotide
taatacgactcactatagggacaaagtgataaagtacattattaaataacaacagaggagagttattatgtaatgtactaacctggcggcagcgcaaaagatg

SEQ ID NO: 17076 - DNA, 103 bp, Artificial Sequence
  Synthetic Polynucleotide
taatacgactcactatagggcagttacaaagtgataaagtacattattaaaacagaggagattaataatgtactttatcaacctggcggcagcgcaaaagatg

SEQ ID NO: 17077 - DNA, 103 bp, Artificial Sequence
  Synthetic Polynucleotide
taatacgactcactatagggattttcagttacaaagtgataaagtacattaacagaggagaaatgtaatgtatcactttaacctggcggcagcgcaaaagatg

SEQ ID NO: 17078 - DNA, 103 bp, Artificial Sequence
  Synthetic Polynucleotide
taatacgactcactatagggttcacattttcagttacaaagtgataaagtaacagaggagaactttaatgctttgtaacaacctggcggcagcgcaaaagatg

SEQ ID NO: 17079 - DNA, 103 bp, Artificial Sequence
  Synthetic Polynucleotide
taatacgactcactatagggttagcttcacattttcagttacaaagtgataacagaggagaatcactatgtaactgaaaaacctggcggcagcgcaaaagatg

SEQ ID NO: 17080 - DNA, 103 bp, Artificial Sequence
  Synthetic Polynucleotide
taatacgactcactataggggaagtcccgcccaccggaagtgacgtcacaaacagaggagatgtgacatgacttccggtaacctggcggcagcgcaaaagatg

SEQ ID NO: 17081 - DNA, 103 bp, Artificial Sequence
  Synthetic Polynucleotide
taatacgactcactatagggaaattttagcttcacattttcagttacaaaaacagaggagatttgtaatggaaaatgtgaacctggcggcagcgcaaaagatg

SEQ ID NO: 17082 - DNA, 103 bp, Artificial Sequence
  Synthetic Polynucleotide
taatacgactcactatagggggcaaaaattttagcttcacattttcagttaacagaggagaaactgaatgtgtgaagctaacctggcggcagcgcaaaagatg

SEQ ID NO: 17083 - DNA, 103 bp, Artificial Sequence
  Synthetic Polynucleotide
taatacgactcactatagggttcctggcaaaaattttagcttcacattttaacagaggagaaaaatgatgagctaaaataacctggcggcagcgcaaaagatg

SEQ ID NO: 17084 - DNA, 103 bp, Artificial Sequence
  Synthetic Polynucleotide
taatacgactcactatagggagtcattcctggcaaaaattttagcttcacaacagaggagagtgaagatgaaatttttgaacctggcggcagcgcaaaagatg

SEQ ID NO: 17085 - DNA, 103 bp, Artificial Sequence
  Synthetic Polynucleotide
taatacgactcactatagggtttgtagtcattcctggcaaaaattttagcaacagaggagagctaaaatgtttgccaggaacctggcggcagcgcaaaagatg

SEQ ID NO: 17086 - DNA, 103 bp, Artificial Sequence
  Synthetic Polynucleotide
taatacgactcactatagggtgccttttgtagtcattcctggcaaaaattaacagaggagaaattttatgcaggaatgaaacctggcggcagcgcaaaagatg

SEQ ID NO: 17087 - DNA, 103 bp, Artificial Sequence
  Synthetic Polynucleotide
taatacgactcactataggggtatttgccttttgtagtcattcctggcaaaacagaggagattgccaatgatgactacaaacctggcggcagcgcaaaagatg

SEQ ID NO: 17088 - DNA, 103 bp, Artificial Sequence
  Synthetic Polynucleotide
taatacgactcactatagggctaaagtatttgccttttgtagtcattcctaacagaggagaaggaatatgtacaaaaggaacctggcggcagcgcaaaagatg

SEQ ID NO: 17089 - DNA, 103 bp, Artificial Sequence
  Synthetic Polynucleotide
taatacgactcactatagggcatctctaaagtatttgccttttgtagtcaaacagaggagatgactaatgaaggcaaataacctggcggcagcgcaaaagatg

SEQ ID NO: 17090 - DNA, 103 bp, Artificial Sequence
  Synthetic Polynucleotide
taatacgactcactatagggctctccatctctaaagtatttgccttttgtaacagaggagaacaaaaatgaaatactttaacctggcggcagcgcaaaagatg

SEQ ID NO: 17091 - DNA, 103 bp, Artificial Sequence
  Synthetic Polynucleotide
taatacgactcactatagggcgcctaccggcggcgaccggcggcatctgaaacagaggagatcagatatggccggtcgcaacctggcggcagcgcaaaagatg

SEQ ID NO: 17092 - DNA, 103 bp, Artificial Sequence
  Synthetic Polynucleotide
taatacgactcactatagggttccggaagtcccgcccaccggaagtgacgaacagaggagacgtcacatgcggtgggcgaacctggcggcagcgcaaaagatg

SEQ ID NO: 17093 - DNA, 103 bp, Artificial Sequence
  Synthetic Polynucleotide
taatacgactcactatagggaactgctctccatctctaaagtatttgcctaacagaggagaaggcaaatgctttagagaaacctggcggcagcgcaaaagatg

SEQ ID NO: 17094 - DNA, 103 bp, Artificial Sequence
  Synthetic Polynucleotide
taatacgactcactatagggctataaactgctctccatctctaaagtattaacagaggagaaatactatggagatggagaacctggcggcagcgcaaaagatg

SEQ ID NO: 17095 - DNA, 103 bp, Artificial Sequence
  Synthetic Polynucleotide
taatacgactcactataggggttttctataaactgctctccatctctaaaaacagaggagatttagaatgggagagcagaacctggcggcagcgcaaaagatg

SEQ ID NO: 17096 - DNA, 103 bp, Artificial Sequence
  Synthetic Polynucleotide
taatacgactcactatagggaaatagttttctataaactgctctccatctaacagaggagaagatggatggcagtttataacctggcggcagcgcaaaagatg

SEQ ID NO: 17097 - DNA, 103 bp, Artificial Sequence
  Synthetic Polynucleotide
taatacgactcactatagggtcattaaatagttttctataaactgctctcaacagaggagagagagcatgttatagaaaaacctggcggcagcgcaaaagatg

SEQ ID NO: 17098 - DNA, 103 bp, Artificial Sequence
  Synthetic Polynucleotide
taatacgactcactatagggttttttcattaaatagttttctataaactgaacagaggagacagtttatggaaaactataacctggcggcagcgcaaaagatg

SEQ ID NO: 17099 - DNA, 103 bp, Artificial Sequence
  Synthetic Polynucleotide
taatacgactcactatagggggtatttttttcattaaatagttttctataaacagaggagatatagaatgctatttaataacctggcggcagcgcaaaagatg

SEQ ID NO: 17100 - DNA, 103 bp, Artificial Sequence
  Synthetic Polynucleotide
taatacgactcactatagggttaaaggtatttttttcattaaatagttttaacagaggagaaaaactatgtaatgaaaaaacctggcggcagcgcaaaagatg

SEQ ID NO: 17101 - DNA, 103 bp, Artificial Sequence
  Synthetic Polynucleotide
taatacgactcactatagggaacatttaaaggtatttttttcattaaataaacagaggagatatttaatgaaaaaaataaacctggcggcagcgcaaaagatg

SEQ ID NO: 17102 - DNA, 103 bp, Artificial Sequence
  Synthetic Polynucleotide
taatacgactcactatagggcatacaacatttaaaggtatttttttcattaacagaggagaaatgaaatgaatacctttaacctggcggcagcgcaaaagatg

SEQ ID NO: 17103 - DNA, 103 bp, Artificial Sequence
  Synthetic Polynucleotide
taatacgactcactatagggcctaattccggaagtcccgcccaccggaagaacagaggagacttccgatgggcgggactaacctggcggcagcgcaaaagatg

SEQ ID NO: 17104 - DNA, 103 bp, Artificial Sequence
  Synthetic Polynucleotide
taatacgactcactatagggcacaccatacaacatttaaaggtattttttaacagaggagaaaaaaaatgctttaaatgaacctggcggcagcgcaaaagatg

SEQ ID NO: 17105 - DNA, 103 bp, Artificial Sequence
  Synthetic Polynucleotide
taatacgactcactatagggagtaacacaccatacaacatttaaaggtataacagaggagaatacctatgaatgttgtaaacctggcggcagcgcaaaagatg

SEQ ID NO: 17106 - DNA, 103 bp, Artificial Sequence
  Synthetic Polynucleotide
taatacgactcactatagggatattagtaacacaccatacaacatttaaaaacagaggagatttaaaatgtgtatggtgaacctggcggcagcgcaaaagatg

SEQ ID NO: 17107 - DNA, 103 bp, Artificial Sequence
  Synthetic Polynucleotide
taatacgactcactatagggcatcaatattagtaacacaccatacaacataacagaggagaatgttgatgggtgtgttaaacctggcggcagcgcaaaagatg

SEQ ID NO: 17108 - DNA, 103 bp, Artificial Sequence
  Synthetic Polynucleotide
taatacgactcactatagggatatccatcaatattagtaacacaccatacaacagaggagagtatggatggttactaataacctggcggcagcgcaaaagatg

SEQ ID NO: 17109 - DNA, 103 bp, Artificial Sequence
  Synthetic Polynucleotide
taatacgactcactatagggtctatatatccatcaatattagtaacacacaacagaggagagtgtgtatgtaatattgaaacctggcggcagcgcaaaagatg

SEQ ID NO: 17110 - DNA, 103 bp, Artificial Sequence
  Synthetic Polynucleotide
taatacgactcactatagggaggtatctatatatccatcaatattagtaaaacagaggagattactaatgttgatggataacctggcggcagcgcaaaagatg

SEQ ID NO: 17111 - DNA, 103 bp, Artificial Sequence
  Synthetic Polynucleotide
taatacgactcactatagggaatacaggtatctatatatccatcaatattaacagaggagaaatattatgggatatataaacctggcggcagcgcaaaagatg

SEQ ID NO: 17112 - DNA, 103 bp, Artificial Sequence
  Synthetic Polynucleotide
taatacgactcactataggggcagaaatacaggtatctatatatccatcaaacagaggagatgatggatgtatagatacaacctggcggcagcgcaaaagatg

SEQ ID NO: 17113 - DNA, 103 bp, Artificial Sequence
  Synthetic Polynucleotide
taatacgactcactatagggaagtagcagaaatacaggtatctatatatcaacagaggagagatataatgatacctgtaaacctggcggcagcgcaaaagatg

SEQ ID NO: 17114 - DNA, 103 bp, Artificial Sequence
  Synthetic Polynucleotide
taatacgactcactatagggccaaccctaattccggaagtcccgcccaccaacagaggagaggtgggatggacttccggaacctggcggcagcgcaaaagatg

SEQ ID NO: 17115 - DNA, 103 bp, Artificial Sequence
  Synthetic Polynucleotide
taatacgactcactatagggtctaaaagtagcagaaatacaggtatctataacagaggagaatagatatgtgtatttctaacctggcggcagcgcaaaagatg

SEQ ID NO: 17116 - DNA, 103 bp, Artificial Sequence
  Synthetic Polynucleotide
taatacgactcactatagggccccttctaaaagtagcagaaatacaggtaaacagaggagatacctgatgttctgctacaacctggcggcagcgcaaaagatg

SEQ ID NO: 17117 - DNA, 103 bp, Artificial Sequence
  Synthetic Polynucleotide
taatacgactcactatagggaagctccccttctaaaagtagcagaaatacaacagaggagagtatttatgctacttttaaacctggcggcagcgcaaaagatg

SEQ ID NO: 17118 - DNA, 103 bp, Artificial Sequence
  Synthetic Polynucleotide
taatacgactcactatagggatggcaagctccccttctaaaagtagcagaaacagaggagatctgctatgtttagaaggaacctggcggcagcgcaaaagatg

SEQ ID NO: 17119 - DNA, 103 bp, Artificial Sequence
  Synthetic Polynucleotide
taatacgactcactatagggttggcatggcaagctccccttctaaaagtaaacagaggagatactttatgaaggggagcaacctggcggcagcgcaaaagatg

SEQ ID NO: 17120 - DNA, 103 bp, Artificial Sequence
  Synthetic Polynucleotide
taatacgactcactataggggtttcttggcatggcaagctccccttctaaaacagaggagattagaaatggagcttgccaacctggcggcagcgcaaaagatg

SEQ ID NO: 17121 - DNA, 103 bp, Artificial Sequence
  Synthetic Polynucleotide
taatacgactcactataggggcggggtttcttggcatggcaagctcccctaacagaggagaaggggaatgtgccatgccaacctggcggcagcgcaaaagatg

SEQ ID NO: 17122 - DNA, 103 bp, Artificial Sequence
  Synthetic Polynucleotide
taatacgactcactataggggtaatgcggggtttcttggcatggcaagctaacagaggagaagcttgatgtgccaagaaaacctggcggcagcgcaaaagatg

SEQ ID NO: 17123 - DNA, 103 bp, Artificial Sequence
  Synthetic Polynucleotide
taatacgactcactatagggctgtggtaatgcggggtttcttggcatggcaacagaggagagccatgatgagaaaccccaacctggcggcagcgcaaaagatg

SEQ ID NO: 17124 - DNA, 103 bp, Artificial Sequence
  Synthetic Polynucleotide
taatacgactcactatagggtatggctgtggtaatgcggggtttcttggcaacagaggagagccaagatgccccgcattaacctggcggcagcgcaaaagatg

SEQ ID NO: 17125 - DNA, 103 bp, Artificial Sequence
  Synthetic Polynucleotide
taatacgactcactatagggcagagccaaccctaattccggaagtcccgcaacagaggagagcgggaatgccggaattaaacctggcggcagcgcaaaagatg

SEQ ID NO: 17126 - DNA, 103 bp, Artificial Sequence
  Synthetic Polynucleotide
taatacgactcactatagggtcatttatggctgtggtaatgcggggtttcaacagaggagagaaaccatgcattaccacaacctggcggcagcgcaaaagatg

SEQ ID NO: 17127 - DNA, 103 bp, Artificial Sequence
  Synthetic Polynucleotide
taatacgactcactatagggtagtatcatttatggctgtggtaatgcgggaacagaggagacccgcaatgccacagccaaacctggcggcagcgcaaaagatg

SEQ ID NO: 17128 - DNA, 103 bp, Artificial Sequence
  Synthetic Polynucleotide
taatacgactcactataggggctactagtatcatttatggctgtggtaataacagaggagaattaccatggccataaataacctggcggcagcgcaaaagatg

SEQ ID NO: 17129 - DNA, 103 bp, Artificial Sequence
  Synthetic Polynucleotide
taatacgactcactataggggcatcgctactagtatcatttatggctgtgaacagaggagacacagcatgaaatgatacaacctggcggcagcgcaaaagatg

SEQ ID NO: 17130 - DNA, 103 bp, Artificial Sequence
  Synthetic Polynucleotide
taatacgactcactatagggccccagcatcgctactagtatcatttatggaacagaggagaccataaatgatactagtaaacctggcggcagcgcaaaagatg

SEQ ID NO: 17131 - DNA, 103 bp, Artificial Sequence
  Synthetic Polynucleotide
taatacgactcactatagggagactccccagcatcgctactagtatcattaacagaggagaaatgatatgagtagcgataacctggcggcagcgcaaaagatg

SEQ ID NO: 17132 - DNA, 103 bp, Artificial Sequence
  Synthetic Polynucleotide
taatacgactcactatagggccgctagactccccagcatcgctactagtaaacagaggagatactagatgcgatgctggaacctggcggcagcgcaaaagatg

SEQ ID NO: 17133 - DNA, 103 bp, Artificial Sequence
  Synthetic Polynucleotide
taatacgactcactatagggctgtgccgctagactccccagcatcgctacaacagaggagagtagcgatgctggggagtaacctggcggcagcgcaaaagatg

SEQ ID NO: 17134 - DNA, 103 bp, Artificial Sequence
  Synthetic Polynucleotide
taatacgactcactatagggtgcccctgtgccgctagactccccagcatcaacagaggagagatgctatggagtctagcaacctggcggcagcgcaaaagatg

SEQ ID NO: 17135 - DNA, 103 bp, Artificial Sequence
  Synthetic Polynucleotide
taatacgactcactatagggacctctgcccctgtgccgctagactccccaaacagaggagatggggaatgtagcggcacaacctggcggcagcgcaaaagatg

SEQ ID NO: 17136 - DNA, 103 bp, Artificial Sequence
  Synthetic Polynucleotide
taatacgactcactatagggtggcccagagccaaccctaattccggaagtaacagaggagaacttccatgattagggttaacctggcggcagcgcaaaagatg

SEQ ID NO: 17137 - DNA, 103 bp, Artificial Sequence
  Synthetic Polynucleotide
taatacgactcactataggggcacaacctctgcccctgtgccgctagactaacagaggagaagtctaatggcacaggggaacctggcggcagcgcaaaagatg

SEQ ID NO: 17138 - DNA, 103 bp, Artificial Sequence
  Synthetic Polynucleotide
taatacgactcactatagggaaatggcacaacctctgcccctgtgccgctaacagaggagaagcggcatgggggcagagaacctggcggcagcgcaaaagatg

SEQ ID NO: 17139 - DNA, 103 bp, Artificial Sequence
  Synthetic Polynucleotide
taatacgactcactatagggccattaaatggcacaacctctgcccctgtgaacagaggagacacaggatgagaggttgtaacctggcggcagcgcaaaagatg

SEQ ID NO: 17140 - DNA, 103 bp, Artificial Sequence
  Synthetic Polynucleotide
taatacgactcactatagggccttcccattaaatggcacaacctctgcccaacagaggagagggcagatgttgtgccataacctggcggcagcgcaaaagatg

SEQ ID NO: 17141 - DNA, 103 bp, Artificial Sequence
  Synthetic Polynucleotide
taatacgactcactatagggagttcccttcccattaaatggcacaacctcaacagaggagagaggttatgccatttaataacctggcggcagcgcaaaagatg

SEQ ID NO: 17142 - DNA, 103 bp, Artificial Sequence
  Synthetic Polynucleotide
taatacgactcactataggggccttagttcccttcccattaaatggcacaaacagaggagatgtgccatgtaatgggaaaacctggcggcagcgcaaaagatg

SEQ ID NO: 17143 - DNA, 103 bp, Artificial Sequence
  Synthetic Polynucleotide
taatacgactcactatagggtgctagccttagttcccttcccattaaatgaacagaggagacatttaatgggaagggaaaacctggcggcagcgcaaaagatg

SEQ ID NO: 17144 - DNA, 103 bp, Artificial Sequence
  Synthetic Polynucleotide
taatacgactcactatagggctttatgctagccttagttcccttcccattaacagaggagaaatgggatgggaactaagaacctggcggcagcgcaaaagatg

SEQ ID NO: 17145 - DNA, 103 bp, Artificial Sequence
  Synthetic Polynucleotide
taatacgactcactatagggtgaaactttatgctagccttagttcccttcaacagaggagagaagggatgtaaggctagaacctggcggcagcgcaaaagatg

SEQ ID NO: 17146 - DNA, 103 bp, Artificial Sequence
  Synthetic Polynucleotide
taatacgactcactatagggtagtttgaaactttatgctagccttagttcaacagaggagagaactaatgctagcataaaacctggcggcagcgcaaaagatg

SEQ ID NO: 17147 - DNA, 103 bp, Artificial Sequence
  Synthetic Polynucleotide
taatacgactcactatagggcaagctggcccagagccaaccctaattccgaacagaggagacggaatatgggttggctcaacctggcggcagcgcaaaagatg

SEQ ID NO: 17148 - DNA, 103 bp, Artificial Sequence
  Synthetic Polynucleotide
taatacgactcactatagggtaccatagtttgaaactttatgctagccttaacagaggagaaaggctatgataaagtttaacctggcggcagcgcaaaagatg

SEQ ID NO: 17149 - DNA, 103 bp, Artificial Sequence
  Synthetic Polynucleotide
taatacgactcactatagggcagtttaccatagtttgaaactttatgctaaacagaggagatagcatatggtttcaaacaacctggcggcagcgcaaaagatg

SEQ ID NO: 17150 - DNA, 103 bp, Artificial Sequence
  Synthetic Polynucleotide
taatacgactcactatagggacaaccagtttaccatagtttgaaactttaaacagaggagataaagtatgaaactatggaacctggcggcagcgcaaaagatg

SEQ ID NO: 17151 - DNA, 103 bp, Artificial Sequence
  Synthetic Polynucleotide
taatacgactcactatagggttcacacaaccagtttaccatagtttgaaaaacagaggagatttcaaatgatggtaaacaacctggcggcagcgcaaaagatg

SEQ ID NO: 17152 - DNA, 103 bp, Artificial Sequence
  Synthetic Polynucleotide
taatacgactcactatagggctgttttcacacaaccagtttaccatagttaacagaggagaaactatatgaaactggttaacctggcggcagcgcaaaagatg

SEQ ID NO: 17153 - DNA, 103 bp, Artificial Sequence
  Synthetic Polynucleotide
taatacgactcactatagggacactctgttttcacacaaccagtttaccaaacagaggagatggtaaatgggttgtgtgaacctggcggcagcgcaaaagatg

SEQ ID NO: 17154 - DNA, 103 bp, Artificial Sequence
  Synthetic Polynucleotide
taatacgactcactatagggtgtaaacactctgttttcacacaaccagttaacagaggagaaactggatgtgtgaaaacaacctggcggcagcgcaaaagatg

SEQ ID NO: 17155 - DNA, 103 bp, Artificial Sequence
  Synthetic Polynucleotide
taatacgactcactatagggtcctctgtaaacactctgttttcacacaacaacagaggagagttgtgatgaaacagagtaacctggcggcagcgcaaaagatg

SEQ ID NO: 17156 - DNA, 103 bp, Artificial Sequence
  Synthetic Polynucleotide
taatacgactcactatagggacttatcctctgtaaacactctgttttcacaacagaggagagtgaaaatggagtgtttaaacctggcggcagcgcaaaagatg

SEQ ID NO: 17157 - DNA, 103 bp, Artificial Sequence
  Synthetic Polynucleotide
taatacgactcactatagggtttccacttatcctctgtaaacactctgttaacagaggagaaacagaatgtttacagagaacctggcggcagcgcaaaagatg

SEQ ID NO: 17158 - DNA, 103 bp, Artificial Sequence
  Synthetic Polynucleotide
taatacgactcactatagggccaagcaagctggcccagagccaaccctaaaacagaggagattagggatggctctgggcaacctggcggcagcgcaaaagatg

SEQ ID NO: 17159 - DNA, 103 bp, Artificial Sequence
  Synthetic Polynucleotide
taatacgactcactatagggactagtttccacttatcctctgtaaacactaacagaggagaagtgttatgagaggataaaacctggcggcagcgcaaaagatg

SEQ ID NO: 17160 - DNA, 103 bp, Artificial Sequence
  Synthetic Polynucleotide
taatacgactcactatagggagtcaactagtttccacttatcctctgtaaaacagaggagattacagatgataagtggaaacctggcggcagcgcaaaagatg

SEQ ID NO: 17161 - DNA, 103 bp, Artificial Sequence
  Synthetic Polynucleotide
taatacgactcactataggggttaaagtcaactagtttccacttatcctcaacagaggagagaggatatgtggaaactaaacctggcggcagcgcaaaagatg

SEQ ID NO: 17162 - DNA, 103 bp, Artificial Sequence
  Synthetic Polynucleotide
taatacgactcactatagggtactggttaaagtcaactagtttccacttaaacagaggagataagtgatgactagttgaaacctggcggcagcgcaaaagatg

SEQ ID NO: 17163 - DNA, 103 bp, Artificial Sequence
  Synthetic Polynucleotide
taatacgactcactatagggaagtgtactggttaaagtcaactagtttccaacagaggagaggaaacatgttgactttaaacctggcggcagcgcaaaagatg

SEQ ID NO: 17164 - DNA, 103 bp, Artificial Sequence
  Synthetic Polynucleotide
taatacgactcactatagggtagtaaagtgtactggttaaagtcaactagaacagaggagactagttatgtttaaccagaacctggcggcagcgcaaaagatg

SEQ ID NO: 17165 - DNA, 103 bp, Artificial Sequence
  Synthetic Polynucleotide
taatacgactcactatagggctgcttagtaaagtgtactggttaaagtcaaacagaggagatgacttatgccagtacacaacctggcggcagcgcaaaagatg

SEQ ID NO: 17166 - DNA, 103 bp, Artificial Sequence
  Synthetic Polynucleotide
taatacgactcactataggggactactgcttagtaaagtgtactggttaaaacagaggagattaaccatgacactttacaacctggcggcagcgcaaaagatg

SEQ ID NO: 17167 - DNA, 103 bp, Artificial Sequence
  Synthetic Polynucleotide
taatacgactcactatagggactgtgactactgcttagtaaagtgtactgaacagaggagacagtacatgttactaagcaacctggcggcagcgcaaaagatg

SEQ ID NO: 17168 - DNA, 103 bp, Artificial Sequence
  Synthetic Polynucleotide
taatacgactcactatagggcttccactgtgactactgcttagtaaagtgaacagaggagacactttatgaagcagtagaacctggcggcagcgcaaaagatg

SEQ ID NO: 17169 - DNA, 103 bp, Artificial Sequence
  Synthetic Polynucleotide
taatacgactcactatagggcaaccccaagcaagctggcccagagccaacaacagaggagagttggcatggggccagctaacctggcggcagcgcaaaagatg

SEQ ID NO: 17170 - DNA, 103 bp, Artificial Sequence
  Synthetic Polynucleotide
taatacgactcactataggggaaaacttccactgtgactactgcttagtaaacagaggagatactaaatggtagtcacaaacctggcggcagcgcaaaagatg

SEQ ID NO: 17171 - DNA, 103 bp, Artificial Sequence
  Synthetic Polynucleotide
taatacgactcactatagggaatttgaaaacttccactgtgactactgctaacagaggagaagcagtatgcacagtggaaacctggcggcagcgcaaaagatg

SEQ ID NO: 17172 - DNA, 103 bp, Artificial Sequence
  Synthetic Polynucleotide
taatacgactcactatagggctttgaatttgaaaacttccactgtgactaaacagaggagatagtcaatgtggaagtttaacctggcggcagcgcaaaagatg

SEQ ID NO: 17173 - DNA, 103 bp, Artificial Sequence
  Synthetic Polynucleotide
taatacgactcactataggggtgcactttgaatttgaaaacttccactgtaacagaggagaacagtgatggttttcaaaaacctggcggcagcgcaaaagatg

SEQ ID NO: 17174 - DNA, 103 bp, Artificial Sequence
  Synthetic Polynucleotide
taatacgactcactatagggttttagtgcactttgaatttgaaaacttccaacagaggagaggaagtatgcaaattcaaaacctggcggcagcgcaaaagatg

SEQ ID NO: 17175 - DNA, 103 bp, Artificial Sequence
  Synthetic Polynucleotide
taatacgactcactataggggctagttttagtgcactttgaatttgaaaaaacagaggagattttcaatgtcaaagtgcaacctggcggcagcgcaaaagatg

SEQ ID NO: 17176 - DNA, 103 bp, Artificial Sequence
  Synthetic Polynucleotide
taatacgactcactatagggaaattgctagttttagtgcactttgaatttaacagaggagaaaattcatggtgcactaaaacctggcggcagcgcaaaagatg

SEQ ID NO: 17177 - DNA, 103 bp, Artificial Sequence
  Synthetic Polynucleotide
taatacgactcactatagggtttataaattgctagttttagtgcactttgaacagaggagacaaagtatgctaaaactaaacctggcggcagcgcaaaagatg

SEQ ID NO: 17178 - DNA, 103 bp, Artificial Sequence
  Synthetic Polynucleotide
taatacgactcactataggggttgctttataaattgctagttttagtgcaaacagaggagatgcactatgactagcaataacctggcggcagcgcaaaagatg

SEQ ID NO: 17179 - DNA, 103 bp, Artificial Sequence
  Synthetic Polynucleotide
taatacgactcactatagggaattagttgctttataaattgctagttttaaacagaggagataaaacatgcaatttataaacctggcggcagcgcaaaagatg

SEQ ID NO: 17180 - DNA, 103 bp, Artificial Sequence
  Synthetic Polynucleotide
taatacgactcactatagggcaaggcaaccccaagcaagctggcccagagaacagaggagactctggatgagcttgcttaacctggcggcagcgcaaaagatg

SEQ ID NO: 17181 - DNA, 103 bp, Artificial Sequence
  Synthetic Polynucleotide
taatacgactcactatagggcactaaattagttgctttataaattgctagaacagaggagactagcaatgtataaagcaaacctggcggcagcgcaaaagatg

SEQ ID NO: 17182 - DNA, 103 bp, Artificial Sequence
  Synthetic Polynucleotide
taatacgactcactataggggtaggcactaaattagttgctttataaattaacagaggagaaatttaatgagcaactaaaacctggcggcagcgcaaaagatg

SEQ ID NO: 17183 - DNA, 103 bp, Artificial Sequence
  Synthetic Polynucleotide
taatacgactcactatagggtgctagtaggcactaaattagttgctttataacagaggagaataaagatgctaatttagaacctggcggcagcgcaaaagatg

SEQ ID NO: 17184 - DNA, 103 bp, Artificial Sequence
  Synthetic Polynucleotide
taatacgactcactatagggaaatgtgctagtaggcactaaattagttgcaacagaggagagcaactatgttagtgcctaacctggcggcagcgcaaaagatg

SEQ ID NO: 17185 - DNA, 103 bp, Artificial Sequence
  Synthetic Polynucleotide
taatacgactcactatagggaataaaaatgtgctagtaggcactaaattaaacagaggagataatttatggcctactagaacctggcggcagcgcaaaagatg

SEQ ID NO: 17186 - DNA, 103 bp, Artificial Sequence
  Synthetic Polynucleotide
taatacgactcactatagggtatgcaataaaaatgtgctagtaggcactaaacagaggagatagtgcatgctagcacataacctggcggcagcgcaaaagatg

SEQ ID NO: 17187 - DNA, 103 bp, Artificial Sequence
  Synthetic Polynucleotide
taatacgactcactataggggtctgtatgcaataaaaatgtgctagtaggaacagaggagacctactatgacatttttaaacctggcggcagcgcaaaagatg

SEQ ID NO: 17188 - DNA, 103 bp, Artificial Sequence
  Synthetic Polynucleotide
taatacgactcactatagggtcaaagtctgtatgcaataaaaatgtgctaaacagaggagatagcacatgtttattgcaaacctggcggcagcgcaaaagatg

SEQ ID NO: 17189 - DNA, 103 bp, Artificial Sequence
  Synthetic Polynucleotide
taatacgactcactatagggcctgctcaaagtctgtatgcaataaaaatgaacagaggagacattttatgtgcatacagaacctggcggcagcgcaaaagatg

SEQ ID NO: 17190 - DNA, 103 bp, Artificial Sequence
  Synthetic Polynucleotide
taatacgactcactatagggcataacctgctcaaagtctgtatgcaataaaacagaggagattattgatgacagactttaacctggcggcagcgcaaaagatg

SEQ ID NO: 17191 - DNA, 103 bp, Artificial Sequence
  Synthetic Polynucleotide
taatacgactcactatagggagtgtcaaggcaaccccaagcaagctggccaacagaggagaggccagatggcttggggtaacctggcggcagcgcaaaagatg

SEQ ID NO: 17192 - DNA, 103 bp, Artificial Sequence
  Synthetic Polynucleotide
taatacgactcactatagggatacacataacctgctcaaagtctgtatgcaacagaggagagcatacatgctttgagcaaacctggcggcagcgcaaaagatg

SEQ ID NO: 17193 - DNA, 103 bp, Artificial Sequence
  Synthetic Polynucleotide
taatacgactcactatagggctttaatacacataacctgctcaaagtctgaacagaggagacagactatgagcaggttaaacctggcggcagcgcaaaagatg

SEQ ID NO: 17194 - DNA, 103 bp, Artificial Sequence
  Synthetic Polynucleotide
taatacgactcactatagggattgtctttaatacacataacctgctcaaaaacagaggagatttgagatggttatgtgtaacctggcggcagcgcaaaagatg

SEQ ID NO: 17195 - DNA, 103 bp, Artificial Sequence
  Synthetic Polynucleotide
taatacgactcactatagggattttattgtctttaatacacataacctgcaacagaggagagcaggtatggtgtattaaaacctggcggcagcgcaaaagatg

SEQ ID NO: 17196 - DNA, 103 bp, Artificial Sequence
  Synthetic Polynucleotide
taatacgactcactatagggtaacaattttattgtctttaatacacataaaacagaggagattatgtatgttaaagacaaacctggcggcagcgcaaaagatg

SEQ ID NO: 17197 - DNA, 103 bp, Artificial Sequence
  Synthetic Polynucleotide
taatacgactcactatagggcaatttaacaattttattgtctttaatacaaacagaggagatgtattatggacaataaaaacctggcggcagcgcaaaagatg

SEQ ID NO: 17198 - DNA, 103 bp, Artificial Sequence
  Synthetic Polynucleotide
taatacgactcactatagggagtaacaatttaacaattttattgtctttaaacagaggagataaagaatgtaaaattgtaacctggcggcagcgcaaaagatg

SEQ ID NO: 17199 - DNA, 103 bp, Artificial Sequence
  Synthetic Polynucleotide
taatacgactcactataggggacaaagtaacaatttaacaattttattgtaacagaggagaacaataatgttgttaaataacctggcggcagcgcaaaagatg

SEQ ID NO: 17200 - DNA, 103 bp, Artificial Sequence
  Synthetic Polynucleotide
taatacgactcactataggggttttgacaaagtaacaatttaacaattttaacagaggagaaaaattatgaaattgttaaacctggcggcagcgcaaaagatg

SEQ ID NO: 17201 - DNA, 103 bp, Artificial Sequence
  Synthetic Polynucleotide
taatacgactcactatagggtcatagttttgacaaagtaacaatttaacaaacagaggagatgttaaatggttactttgaacctggcggcagcgcaaaagatg

SEQ ID NO: 17202 - DNA, 103 bp, Artificial Sequence
  Synthetic Polynucleotide
taatacgactcactatagggagtcccgcctaccggcggcgaccggcggcaaacagaggagatgccgcatgtcgccgccgaacctggcggcagcgcaaaagatg

SEQ ID NO: 17203 - DNA, 103 bp, Artificial Sequence
  Synthetic Polynucleotide
taatacgactcactataggggtcttagtgtcaaggcaaccccaagcaagcaacagaggagagcttgcatggggttgcctaacctggcggcagcgcaaaagatg

SEQ ID NO: 17204 - DNA, 103 bp, Artificial Sequence
  Synthetic Polynucleotide
taatacgactcactataggggggggtcatagttttgacaaagtaacaattaacagaggagaaattgtatgtttgtcaaaaacctggcggcagcgcaaaagatg

SEQ ID NO: 17205 - DNA, 103 bp, Artificial Sequence
  Synthetic Polynucleotide
taatacgactcactatagggcaatagggggtcatagttttgacaaagtaaaacagaggagattacttatgcaaaactataacctggcggcagcgcaaaagatg

SEQ ID NO: 17206 - DNA, 103 bp, Artificial Sequence
  Synthetic Polynucleotide
taatacgactcactatagggcccaccaatagggggtcatagttttgacaaaacagaggagattgtcaatgctatgacccaacctggcggcagcgcaaaagatg

SEQ ID NO: 17207 - DNA, 103 bp, Artificial Sequence
  Synthetic Polynucleotide
taatacgactcactataggggctgccccaccaatagggggtcatagttttaacagaggagaaaaactatgaccccctataacctggcggcagcgcaaaagatg

SEQ ID NO: 17208 - DNA, 103 bp, Artificial Sequence
  Synthetic Polynucleotide
taatacgactcactatagggcacatgctgccccaccaatagggggtcataaacagaggagatatgacatgctattggtgaacctggcggcagcgcaaaagatg

SEQ ID NO: 17209 - DNA, 103 bp, Artificial Sequence
  Synthetic Polynucleotide
taatacgactcactatagggtttaacacatgctgccccaccaatagggggaacagaggagaccccctatgggtggggcaaacctggcggcagcgcaaaagatg

SEQ ID NO: 17210 - DNA, 103 bp, Artificial Sequence
  Synthetic Polynucleotide
taatacgactcactatagggtccactttaacacatgctgccccaccaataaacagaggagatattggatgggcagcatgaacctggcggcagcgcaaaagatg

SEQ ID NO: 17211 - DNA, 103 bp, Artificial Sequence
  Synthetic Polynucleotide
taatacgactcactatagggatcaatccactttaacacatgctgccccacaacagaggagagtggggatgcatgtgttaaacctggcggcagcgcaaaagatg

SEQ ID NO: 17212 - DNA, 103 bp, Artificial Sequence
  Synthetic Polynucleotide
taatacgactcactatagggtttttatcaatccactttaacacatgctgcaacagaggagagcagcaatggttaaagtgaacctggcggcagcgcaaaagatg

SEQ ID NO: 17213 - DNA, 103 bp, Artificial Sequence
  Synthetic Polynucleotide
taatacgactcactatagggcacattttttatcaatccactttaacacataacagaggagaatgtgtatgagtggattgaacctggcggcagcgcaaaagatg

SEQ ID NO: 17214 - DNA, 103 bp, Artificial Sequence
  Synthetic Polynucleotide
taatacgactcactatagggcgcttgtcttagtgtcaaggcaaccccaagaacagaggagacttgggatggccttgacaaacctggcggcagcgcaaaagatg

SEQ ID NO: 17215 - DNA, 103 bp, Artificial Sequence
  Synthetic Polynucleotide
taatacgactcactatagggcttgccacattttttatcaatccactttaaaacagaggagattaaagatgattgataaaaacctggcggcagcgcaaaagatg

SEQ ID NO: 17216 - DNA, 103 bp, Artificial Sequence
  Synthetic Polynucleotide
taatacgactcactatagggtttttcttgccacattttttatcaatccacaacagaggagagtggatatgtaaaaaatgaacctggcggcagcgcaaaagatg

SEQ ID NO: 17217 - DNA, 103 bp, Artificial Sequence
  Synthetic Polynucleotide
taatacgactcactataggggtgtatttttcttgccacattttttatcaaaacagaggagattgataatgaatgtggcaaacctggcggcagcgcaaaagatg

SEQ ID NO: 17218 - DNA, 103 bp, Artificial Sequence
  Synthetic Polynucleotide
taatacgactcactatagggccacagtgtatttttcttgccacattttttaacagaggagaaaaaaaatgggcaagaaaaacctggcggcagcgcaaaagatg

SEQ ID NO: 17219 - DNA, 103 bp, Artificial Sequence
  Synthetic Polynucleotide
taatacgactcactatagggtaaaaccacagtgtatttttcttgccacataacagaggagaatgtggatggaaaaatacaacctggcggcagcgcaaaagatg

SEQ ID NO: 17220 - DNA, 103 bp, Artificial Sequence
  Synthetic Polynucleotide
taatacgactcactataggggcccataaaaccacagtgtatttttcttgcaacagaggagagcaagaatgatacactgtaacctggcggcagcgcaaaagatg

SEQ ID NO: 17221 - DNA, 103 bp, Artificial Sequence
  Synthetic Polynucleotide
taatacgactcactatagggtggcggcccataaaaccacagtgtatttttaacagaggagaaaaaatatgctgtggtttaacctggcggcagcgcaaaagatg

SEQ ID NO: 17222 - DNA, 103 bp, Artificial Sequence
  Synthetic Polynucleotide
taatacgactcactataggggtacttggcggcccataaaaccacagtgtaaacagaggagatacactatggttttatggaacctggcggcagcgcaaaagatg

SEQ ID NO: 17223 - DNA, 103 bp, Artificial Sequence
  Synthetic Polynucleotide
taatacgactcactatagggttcctgtacttggcggcccataaaaccacaaacagaggagatgtggtatgatgggccgcaacctggcggcagcgcaaaagatg

SEQ ID NO: 17224 - DNA, 103 bp, Artificial Sequence
  Synthetic Polynucleotide
taatacgactcactatagggtgtttttcctgtacttggcggcccataaaaaacagaggagattttatatgccgccaagtaacctggcggcagcgcaaaagatg

SEQ ID NO: 17225 - DNA, 103 bp, Artificial Sequence
  Synthetic Polynucleotide
taatacgactcactatagggcgcgccgcttgtcttagtgtcaaggcaaccaacagaggagaggttgcatggacactaagaacctggcggcagcgcaaaagatg

SEQ ID NO: 17226 - DNA, 103 bp, Artificial Sequence
  Synthetic Polynucleotide
taatacgactcactatagggaagtttgtttttcctgtacttggcggcccaaacagaggagatgggccatgaagtacaggaacctggcggcagcgcaaaagatg

SEQ ID NO: 17227 - DNA, 103 bp, Artificial Sequence
  Synthetic Polynucleotide
taatacgactcactatagggttgccaagtttgtttttcctgtacttggcgaacagaggagacgccaaatgcaggaaaaaaacctggcggcagcgcaaaagatg

SEQ ID NO: 17228 - DNA, 103 bp, Artificial Sequence
  Synthetic Polynucleotide
taatacgactcactatagggggccattgccaagtttgtttttcctgtactaacagaggagaagtacaatgaaaacaaacaacctggcggcagcgcaaaagatg

SEQ ID NO: 17229 - DNA, 103 bp, Artificial Sequence
  Synthetic Polynucleotide
taatacgactcactataggggcaatggccattgccaagtttgtttttcctaacagaggagaaggaaaatgaaacttggcaacctggcggcagcgcaaaagatg

SEQ ID NO: 17230 - DNA, 103 bp, Artificial Sequence
  Synthetic Polynucleotide
taatacgactcactatagggttttagcaatggccattgccaagtttgtttaacagaggagaaaacaaatgtggcaatggaacctggcggcagcgcaaaagatg

SEQ ID NO: 17231 - DNA, 103 bp, Artificial Sequence
  Synthetic Polynucleotide
taatacgactcactatagggaacacttttagcaatggccattgccaagttaacagaggagaaacttgatgatggccattaacctggcggcagcgcaaaagatg

SEQ ID NO: 17232 - DNA, 103 bp, Artificial Sequence
  Synthetic Polynucleotide
taatacgactcactatagggactggaacacttttagcaatggccattgccaacagaggagaggcaatatgcattgctaaaacctggcggcagcgcaaaagatg

SEQ ID NO: 17233 - DNA, 103 bp, Artificial Sequence
  Synthetic Polynucleotide
taatacgactcactatagggcatatactggaacacttttagcaatggccaaacagaggagatggccaatgctaaaagtgaacctggcggcagcgcaaaagatg

SEQ ID NO: 17234 - DNA, 103 bp, Artificial Sequence
  Synthetic Polynucleotide
taatacgactcactatagggcatgccatatactggaacacttttagcaataacagaggagaattgctatgagtgttccaaacctggcggcagcgcaaaagatg

SEQ ID NO: 17235 - DNA, 103 bp, Artificial Sequence
  Synthetic Polynucleotide
taatacgactcactatagggttaaccatgccatatactggaacacttttaaacagaggagataaaagatgtccagtataaacctggcggcagcgcaaaagatg

SEQ ID NO: 17236 - DNA, 103 bp, Artificial Sequence
  Synthetic Polynucleotide
taatacgactcactatagggagcggcgcgccgcttgtcttagtgtcaaggaacagaggagaccttgaatgtaagacaagaacctggcggcagcgcaaaagatg

SEQ ID NO: 17237 - DNA, 103 bp, Artificial Sequence
  Synthetic Polynucleotide
taatacgactcactatagggtccagttaaccatgccatatactggaacacaacagaggagagtgttcatgtatatggcaaacctggcggcagcgcaaaagatg

SEQ ID NO: 17238 - DNA, 103 bp, Artificial Sequence
  Synthetic Polynucleotide
taatacgactcactatagggattattccagttaaccatgccatatactggaacagaggagaccagtaatgggcatggttaacctggcggcagcgcaaaagatg

SEQ ID NO: 17239 - DNA, 103 bp, Artificial Sequence
  Synthetic Polynucleotide
taatacgactcactatagggttttcattattccagttaaccatgccatataacagaggagaatatggatgggttaactgaacctggcggcagcgcaaaagatg

SEQ ID NO: 17240 - DNA, 103 bp, Artificial Sequence
  Synthetic Polynucleotide
taatacgactcactataggggaaagttttcattattccagttaaccatgcaacagaggagagcatggatgactggaataaacctggcggcagcgcaaaagatg

SEQ ID NO: 17241 - DNA, 103 bp, Artificial Sequence
  Synthetic Polynucleotide
taatacgactcactatagggaaatggaaagttttcattattccagttaacaacagaggagagttaacatgaataatgaaaacctggcggcagcgcaaaagatg

SEQ ID NO: 17242 - DNA, 103 bp, Artificial Sequence
  Synthetic Polynucleotide
taatacgactcactatagggtcattaaatggaaagttttcattattccagaacagaggagactggaaatgtgaaaacttaacctggcggcagcgcaaaagatg

SEQ ID NO: 17243 - DNA, 103 bp, Artificial Sequence
  Synthetic Polynucleotide
taatacgactcactatagggctacatcattaaatggaaagttttcattataacagaggagaataatgatgactttccataacctggcggcagcgcaaaagatg

SEQ ID NO: 17244 - DNA, 103 bp, Artificial Sequence
  Synthetic Polynucleotide
taatacgactcactatagggtcctgctacatcattaaatggaaagttttcaacagaggagagaaaacatgccatttaataacctggcggcagcgcaaaagatg

SEQ ID NO: 17245 - DNA, 103 bp, Artificial Sequence
  Synthetic Polynucleotide
taatacgactcactatagggctttttcctgctacatcattaaatggaaagaacagaggagactttccatgtaatgatgtaacctggcggcagcgcaaaagatg

SEQ ID NO: 17246 - DNA, 103 bp, Artificial Sequence
  Synthetic Polynucleotide
taatacgactcactatagggccaagctttttcctgctacatcattaaatgaacagaggagacatttaatgatgtagcagaacctggcggcagcgcaaaagatg

SEQ ID NO: 17247 - DNA, 103 bp, Artificial Sequence
  Synthetic Polynucleotide
taatacgactcactataggggatcaagcggcgcgccgcttgtcttagtgtaacagaggagaacactaatgcaagcggcgaacctggcggcagcgcaaaagatg

SEQ ID NO: 17248 - DNA, 103 bp, Artificial Sequence
  Synthetic Polynucleotide
taatacgactcactataggggaccaccaagctttttcctgctacatcattaacagaggagaaatgatatggcaggaaaaaacctggcggcagcgcaaaagatg

SEQ ID NO: 17249 - DNA, 103 bp, Artificial Sequence
  Synthetic Polynucleotide
taatacgactcactatagggtcccagaccaccaagctttttcctgctacaaacagaggagatgtagcatgaaaaagcttaacctggcggcagcgcaaaagatg

SEQ ID NO: 17250 - DNA, 103 bp, Artificial Sequence
  Synthetic Polynucleotide
taatacgactcactatagggcttcatcccagaccaccaagctttttcctgaacagaggagacaggaaatggcttggtggaacctggcggcagcgcaaaagatg

SEQ ID NO: 17251 - DNA, 103 bp, Artificial Sequence
  Synthetic Polynucleotide
taatacgactcactatagggaataccttcatcccagaccaccaagcttttaacagaggagaaaaagcatggtggtctggaacctggcggcagcgcaaaagatg

SEQ ID NO: 17252 - DNA, 103 bp, Artificial Sequence
  Synthetic Polynucleotide
taatacgactcactatagggttaataataccttcatcccagaccaccaagaacagaggagacttggtatgctgggatgaaacctggcggcagcgcaaaagatg

SEQ ID NO: 17253 - DNA, 103 bp, Artificial Sequence
  Synthetic Polynucleotide
taatacgactcactatagggtagacttaataataccttcatcccagaccaaacagaggagatggtctatgatgaaggtaaacctggcggcagcgcaaaagatg

SEQ ID NO: 17254 - DNA, 103 bp, Artificial Sequence
  Synthetic Polynucleotide
taatacgactcactatagggaattgtagacttaataataccttcatcccaaacagaggagatgggatatgggtattattaacctggcggcagcgcaaaagatg

SEQ ID NO: 17255 - DNA, 103 bp, Artificial Sequence
  Synthetic Polynucleotide
taatacgactcactatagggtctacaattgtagacttaataataccttcaaacagaggagatgaaggatgtattaagtcaacctggcggcagcgcaaaagatg

SEQ ID NO: 17256 - DNA, 103 bp, Artificial Sequence
  Synthetic Polynucleotide
taatacgactcactatagggcagcttctacaattgtagacttaataatacaacagaggagagtattaatgagtctacaaaacctggcggcagcgcaaaagatg

SEQ ID NO: 17257 - DNA, 103 bp, Artificial Sequence
  Synthetic Polynucleotide
taatacgactcactatagggttttgcagcttctacaattgtagacttaataacagaggagaattaagatgacaattgtaaacctggcggcagcgcaaaagatg

SEQ ID NO: 17258 - DNA, 103 bp, Artificial Sequence
  Synthetic Polynucleotide
taatacgactcactatagggactaagatcaagcggcgcgccgcttgtcttaacagaggagaaagacaatgggcgcgccgaacctggcggcagcgcaaaagatg

SEQ ID NO: 17259 - DNA, 103 bp, Artificial Sequence
  Synthetic Polynucleotide
taatacgactcactatagggatggcttttgcagcttctacaattgtagacaacagaggagagtctacatgtgtagaagcaacctggcggcagcgcaaaagatg

SEQ ID NO: 17260 - DNA, 103 bp, Artificial Sequence
  Synthetic Polynucleotide
taatacgactcactatagggctaaaatggcttttgcagcttctacaattgaacagaggagacaattgatgaagctgcaaaacctggcggcagcgcaaaagatg

SEQ ID NO: 17261 - DNA, 103 bp, Artificial Sequence
  Synthetic Polynucleotide
taatacgactcactatagggcccgcctaaaatggcttttgcagcttctacaacagaggagagtagaaatggcaaaagccaacctggcggcagcgcaaaagatg

SEQ ID NO: 17262 - DNA, 103 bp, Artificial Sequence
  Synthetic Polynucleotide
taatacgactcactatagggggttgcccgcctaaaatggcttttgcagctaacagaggagaagctgcatgagccattttaacctggcggcagcgcaaaagatg

SEQ ID NO: 17263 - DNA, 103 bp, Artificial Sequence
  Synthetic Polynucleotide
taatacgactcactatagggtggtgggttgcccgcctaaaatggcttttgaacagaggagacaaaagatgttttaggcgaacctggcggcagcgcaaaagatg

SEQ ID NO: 17264 - DNA, 103 bp, Artificial Sequence
  Synthetic Polynucleotide
taatacgactcactatagggtaccctggtgggttgcccgcctaaaatggcaacagaggagagccattatgggcgggcaaaacctggcggcagcgcaaaagatg

SEQ ID NO: 17265 - DNA, 103 bp, Artificial Sequence
  Synthetic Polynucleotide
taatacgactcactatagggtgatctaccctggtgggttgcccgcctaaaaacagaggagatttaggatggcaacccacaacctggcggcagcgcaaaagatg

SEQ ID NO: 17266 - DNA, 103 bp, Artificial Sequence
  Synthetic Polynucleotide
taatacgactcactatagggttttttgatctaccctggtgggttgcccgcaacagaggagagcgggcatgccaccagggaacctggcggcagcgcaaaagatg

SEQ ID NO: 17267 - DNA, 103 bp, Artificial Sequence
  Synthetic Polynucleotide
taatacgactcactatagggacgcattttttgatctaccctggtgggttgaacagaggagacaacccatgagggtagataacctggcggcagcgcaaaagatg

SEQ ID NO: 17268 - DNA, 103 bp, Artificial Sequence
  Synthetic Polynucleotide
taatacgactcactatagggcttccacgcattttttgatctaccctggtgaacagaggagacaccagatgagatcaaaaaacctggcggcagcgcaaaagatg

SEQ ID NO: 17269 - DNA, 103 bp, Artificial Sequence
  Synthetic Polynucleotide
taatacgactcactataggggtgccactaagatcaagcggcgcgccgcttaacagaggagaaagcggatggccgcttgaaacctggcggcagcgcaaaagatg

SEQ ID NO: 17270 - DNA, 103 bp, Artificial Sequence
  Synthetic Polynucleotide
taatacgactcactatagggctacacttccacgcattttttgatctacccaacagaggagagggtagatgaaaaaatgcaacctggcggcagcgcaaaagatg

SEQ ID NO: 17271 - DNA, 103 bp, Artificial Sequence
  Synthetic Polynucleotide
taatacgactcactatagggcacagctacacttccacgcattttttgatcaacagaggagagatcaaatgatgcgtggaaacctggcggcagcgcaaaagatg

SEQ ID NO: 17272 - DNA, 103 bp, Artificial Sequence
  Synthetic Polynucleotide
taatacgactcactatagggccaggcacagctacacttccacgcatttttaacagaggagaaaaaatatgtggaagtgtaacctggcggcagcgcaaaagatg

SEQ ID NO: 17273 - DNA, 103 bp, Artificial Sequence
  Synthetic Polynucleotide
taatacgactcactataggggtactccaggcacagctacacttccacgcaaacagaggagatgcgtgatggtgtagctgaacctggcggcagcgcaaaagatg

SEQ ID NO: 17274 - DNA, 103 bp, Artificial Sequence
  Synthetic Polynucleotide
taatacgactcactatagggcacaggtactccaggcacagctacacttccaacagaggagaggaagtatggctgtgcctaacctggcggcagcgcaaaagatg

SEQ ID NO: 17275 - DNA, 103 bp, Artificial Sequence
  Synthetic Polynucleotide
taatacgactcactatagggataaccacaggtactccaggcacagctacaaacagaggagatgtagcatggcctggagtaacctggcggcagcgcaaaagatg

SEQ ID NO: 17276 - DNA, 103 bp, Artificial Sequence
  Synthetic Polynucleotide
taatacgactcactatagggtggttataaccacaggtactccaggcacagaacagaggagactgtgcatggagtacctgaacctggcggcagcgcaaaagatg

SEQ ID NO: 17277 - DNA, 103 bp, Artificial Sequence
  Synthetic Polynucleotide
taatacgactcactatagggattgctggttataaccacaggtactccaggaacagaggagacctggaatgcctgtggttaacctggcggcagcgcaaaagatg

SEQ ID NO: 17278 - DNA, 103 bp, Artificial Sequence
  Synthetic Polynucleotide
taatacgactcactatagggtcaccattgctggttataaccacaggtactaacagaggagaagtaccatgggttataacaacctggcggcagcgcaaaagatg

SEQ ID NO: 17279 - DNA, 103 bp, Artificial Sequence
  Synthetic Polynucleotide
taatacgactcactatagggtaatgtcaccattgctggttataaccacagaacagaggagactgtggatgtaaccagcaaacctggcggcagcgcaaaagatg

SEQ ID NO: 17280 - DNA, 103 bp, Artificial Sequence
  Synthetic Polynucleotide
taatacgactcactatagggttgacgtgccactaagatcaagcggcgcgcaacagaggagagcgcgcatgttgatcttaaacctggcggcagcgcaaaagatg

SEQ ID NO: 17281 - DNA, 103 bp, Artificial Sequence
  Synthetic Polynucleotide
taatacgactcactatagggaaaagtaatgtcaccattgctggttataacaacagaggagagttataatgagcaatggtaacctggcggcagcgcaaaagatg

SEQ ID NO: 17282 - DNA, 103 bp, Artificial Sequence
  Synthetic Polynucleotide
taatacgactcactatagggacaacaaaagtaatgtcaccattgctggttaacagaggagaaaccagatgtggtgacataacctggcggcagcgcaaaagatg

SEQ ID NO: 17283 - DNA, 103 bp, Artificial Sequence
  Synthetic Polynucleotide
taatacgactcactatagggcgcttacaacaaaagtaatgtcaccattgcaacagaggagagcaatgatgacattacttaacctggcggcagcgcaaaagatg

SEQ ID NO: 17284 - DNA, 103 bp, Artificial Sequence
  Synthetic Polynucleotide
taatacgactcactataggggttcccgcttacaacaaaagtaatgtcaccaacagaggagaggtgacatgacttttgttaacctggcggcagcgcaaaagatg

SEQ ID NO: 17285 - DNA, 103 bp, Artificial Sequence
  Synthetic Polynucleotide
taatacgactcactataggggtagtgttcccgcttacaacaaaagtaatgaacagaggagacattacatgtgttgtaagaacctggcggcagcgcaaaagatg

SEQ ID NO: 17286 - DNA, 103 bp, Artificial Sequence
  Synthetic Polynucleotide
taatacgactcactatagggttgttgtagtgttcccgcttacaacaaaagaacagaggagacttttgatgtaagcgggaaacctggcggcagcgcaaaagatg

SEQ ID NO: 17287 - DNA, 103 bp, Artificial Sequence
  Synthetic Polynucleotide
taatacgactcactatagggtacagttgttgtagtgttcccgcttacaacaacagaggagagttgtaatggggaacactaacctggcggcagcgcaaaagatg

SEQ ID NO: 17288 - DNA, 103 bp, Artificial Sequence
  Synthetic Polynucleotide
taatacgactcactataggggcatgtacagttgttgtagtgttcccgcttaacagaggagaaagcggatgcactacaacaacctggcggcagcgcaaaagatg

SEQ ID NO: 17289 - DNA, 103 bp, Artificial Sequence
  Synthetic Polynucleotide
taatacgactcactatagggctttagcatgtacagttgttgtagtgttccaacagaggagaggaacaatgcaacaactgaacctggcggcagcgcaaaagatg

SEQ ID NO: 17290 - DNA, 103 bp, Artificial Sequence
  Synthetic Polynucleotide
taatacgactcactatagggtaaggctttagcatgtacagttgttgtagtaacagaggagaactacaatgactgtacataacctggcggcagcgcaaaagatg

SEQ ID NO: 17291 - DNA, 103 bp, Artificial Sequence
  Synthetic Polynucleotide
taatacgactcactatagggtggggttgacgtgccactaagatcaagcggaacagaggagaccgcttatgcttagtggcaacctggcggcagcgcaaaagatg

SEQ ID NO: 17292 - DNA, 103 bp, Artificial Sequence
  Synthetic Polynucleotide
taatacgactcactatagggtcttttaaggctttagcatgtacagttgttaacagaggagaaacaacatgacatgctaaaacctggcggcagcgcaaaagatg

SEQ ID NO: 17293 - DNA, 103 bp, Artificial Sequence
  Synthetic Polynucleotide
taatacgactcactatagggtgcgctcttttaaggctttagcatgtacagaacagaggagactgtacatgctaaagcctaacctggcggcagcgcaaaagatg

SEQ ID NO: 17294 - DNA, 103 bp, Artificial Sequence
  Synthetic Polynucleotide
taatacgactcactatagggtaccatgcgctcttttaaggctttagcatgaacagaggagacatgctatggccttaaaaaacctggcggcagcgcaaaagatg

SEQ ID NO: 17295 - DNA, 103 bp, Artificial Sequence
  Synthetic Polynucleotide
taatacgactcactatagggaactttaccatgcgctcttttaaggctttaaacagaggagataaagcatgaaaagagcgaacctggcggcagcgcaaaagatg

SEQ ID NO: 17296 - DNA, 103 bp, Artificial Sequence
  Synthetic Polynucleotide
taatacgactcactatagggagtttaactttaccatgcgctcttttaaggaacagaggagaccttaaatgagcgcatggaacctggcggcagcgcaaaagatg

SEQ ID NO: 17297 - DNA, 103 bp, Artificial Sequence
  Synthetic Polynucleotide
taatacgactcactatagggagtaaagtttaactttaccatgcgctctttaacagaggagaaaagagatgatggtaaagaacctggcggcagcgcaaaagatg

SEQ ID NO: 17298 - DNA, 103 bp, Artificial Sequence
  Synthetic Polynucleotide
taatacgactcactatagggcttacagtaaagtttaactttaccatgcgcaacagaggagagcgcatatgaaagttaaaaacctggcggcagcgcaaaagatg

SEQ ID NO: 17299 - DNA, 103 bp, Artificial Sequence
  Synthetic Polynucleotide
taatacgactcactatagggtgcatcttacagtaaagtttaactttaccaaacagaggagatggtaaatgtaaactttaaacctggcggcagcgcaaaagatg

SEQ ID NO: 17300 - DNA, 103 bp, Artificial Sequence
  Synthetic Polynucleotide
taatacgactcactatagggagggctgcatcttacagtaaagtttaacttaacagaggagaaagttaatgtttactgtaaacctggcggcagcgcaaaagatg

SEQ ID NO: 17301 - DNA, 103 bp, Artificial Sequence
  Synthetic Polynucleotide
taatacgactcactatagggatgtcagggctgcatcttacagtaaagtttaacagaggagaaaacttatgtgtaagatgaacctggcggcagcgcaaaagatg

SEQ ID NO: 17302 - DNA, 103 bp, Artificial Sequence
  Synthetic Polynucleotide
taatacgactcactataggggcgcttggggttgacgtgccactaagatcaaacagaggagatgatctatgtggcacgtcaacctggcggcagcgcaaaagatg

SEQ ID NO: 17303 - DNA, 103 bp, Artificial Sequence
  Synthetic Polynucleotide
taatacgactcactatagggaccccatgtcagggctgcatcttacagtaaaacagaggagattactgatggatgcagccaacctggcggcagcgcaaaagatg

SEQ ID NO: 17304 - DNA, 103 bp, Artificial Sequence
  Synthetic Polynucleotide
taatacgactcactatagggtagtaaccccatgtcagggctgcatcttacaacagaggagagtaagaatgagccctgacaacctggcggcagcgcaaaagatg

SEQ ID NO: 17305 - DNA, 103 bp, Artificial Sequence
  Synthetic Polynucleotide
taatacgactcactatagggtctgttagtaaccccatgtcagggctgcataacagaggagaatgcagatgtgacatgggaacctggcggcagcgcaaaagatg

SEQ ID NO: 17306 - DNA, 103 bp, Artificial Sequence
  Synthetic Polynucleotide
taatacgactcactatagggcagcctctgttagtaaccccatgtcagggcaacagaggagagccctgatgtggggttacaacctggcggcagcgcaaaagatg

SEQ ID NO: 17307 - DNA, 103 bp, Artificial Sequence
  Synthetic Polynucleotide
taatacgactcactatagggtacatcagcctctgttagtaaccccatgtcaacagaggagagacatgatgttactaacaaacctggcggcagcgcaaaagatg

SEQ ID NO: 17308 - DNA, 103 bp, Artificial Sequence
  Synthetic Polynucleotide
taatacgactcactatagggtgttgtacatcagcctctgttagtaaccccaacagaggagaggggttatgaacagaggcaacctggcggcagcgcaaaagatg

SEQ ID NO: 17309 - DNA, 103 bp, Artificial Sequence
  Synthetic Polynucleotide
taatacgactcactataggggccactgttgtacatcagcctctgttagtaaacagaggagatactaaatgaggctgatgaacctggcggcagcgcaaaagatg

SEQ ID NO: 17310 - DNA, 103 bp, Artificial Sequence
  Synthetic Polynucleotide
taatacgactcactatagggtgtaagccactgttgtacatcagcctctgtaacagaggagaacagagatggatgtacaaaacctggcggcagcgcaaaagatg

SEQ ID NO: 17311 - DNA, 103 bp, Artificial Sequence
  Synthetic Polynucleotide
taatacgactcactatagggcaccatgtaagccactgttgtacatcagccaacagaggagaggctgaatgacaacagtgaacctggcggcagcgcaaaagatg

SEQ ID NO: 17312 - DNA, 103 bp, Artificial Sequence
  Synthetic Polynucleotide
taatacgactcactatagggcattacaccatgtaagccactgttgtacataacagaggagaatgtacatgagtggcttaaacctggcggcagcgcaaaagatg

SEQ ID NO: 17313 - DNA, 103 bp, Artificial Sequence
  Synthetic Polynucleotide
taatacgactcactatagggccggaagtcccgcctaccggcggcgaccggaacagaggagaccggtcatggccggtaggaacctggcggcagcgcaaaagatg

SEQ ID NO: 17314 - DNA, 103 bp, Artificial Sequence
  Synthetic Polynucleotide
taatacgactcactatagggggccagcgcttggggttgacgtgccactaaaacagaggagattagtgatgcgtcaacccaacctggcggcagcgcaaaagatg

SEQ ID NO: 17315 - DNA, 103 bp, Artificial Sequence
  Synthetic Polynucleotide
taatacgactcactatagggttgtgcattacaccatgtaagccactgttgaacagaggagacaacagatgcttacatggaacctggcggcagcgcaaaagatg

SEQ ID NO: 17316 - DNA, 103 bp, Artificial Sequence
  Synthetic Polynucleotide
taatacgactcactatagggcagctttgtgcattacaccatgtaagccacaacagaggagagtggctatgatggtgtaaaacctggcggcagcgcaaaagatg

SEQ ID NO: 17317 - DNA, 103 bp, Artificial Sequence
  Synthetic Polynucleotide
taatacgactcactatagggggtcccagctttgtgcattacaccatgtaaaacagaggagattacatatggtaatgcacaacctggcggcagcgcaaaagatg

SEQ ID NO: 17318 - DNA, 103 bp, Artificial Sequence
  Synthetic Polynucleotide
taatacgactcactatagggatagtggtcccagctttgtgcattacaccaaacagaggagatggtgtatggcacaaagcaacctggcggcagcgcaaaagatg

SEQ ID NO: 17319 - DNA, 103 bp, Artificial Sequence
  Synthetic Polynucleotide
taatacgactcactatagggttttcatagtggtcccagctttgtgcattaaacagaggagataatgcatgaagctgggaaacctggcggcagcgcaaaagatg

SEQ ID NO: 17320 - DNA, 103 bp, Artificial Sequence
  Synthetic Polynucleotide
taatacgactcactatagggcccagttttcatagtggtcccagctttgtgaacagaggagacacaaaatggggaccactaacctggcggcagcgcaaaagatg

SEQ ID NO: 17321 - DNA, 103 bp, Artificial Sequence
  Synthetic Polynucleotide
taatacgactcactatagggtattgcccagttttcatagtggtcccagctaacagaggagaagctggatgcactatgaaaacctggcggcagcgcaaaagatg

SEQ ID NO: 17322 - DNA, 103 bp, Artificial Sequence
  Synthetic Polynucleotide
taatacgactcactatagggtagtttattgcccagttttcatagtggtccaacagaggagaggaccaatgtgaaaactgaacctggcggcagcgcaaaagatg

SEQ ID NO: 17323 - DNA, 103 bp, Artificial Sequence
  Synthetic Polynucleotide
taatacgactcactatagggaagtgtagtttattgcccagttttcatagtaacagaggagaactatgatgactgggcaaaacctggcggcagcgcaaaagatg

SEQ ID NO: 17324 - DNA, 103 bp, Artificial Sequence
  Synthetic Polynucleotide
taatacgactcactatagggatcaaaagtgtagtttattgcccagttttcaacagaggagagaaaacatggcaataaacaacctggcggcagcgcaaaagatg

SEQ ID NO: 17325 - DNA, 103 bp, Artificial Sequence
  Synthetic Polynucleotide
taatacgactcactatagggctctgggccagcgcttggggttgacgtgccaacagaggagaggcacgatgaccccaagcaacctggcggcagcgcaaaagatg

SEQ ID NO: 17326 - DNA, 103 bp, Artificial Sequence
  Synthetic Polynucleotide
taatacgactcactataggggggaaatcaaaagtgtagtttattgcccagaacagaggagactgggcatgaaactacacaacctggcggcagcgcaaaagatg

SEQ ID NO: 17327 - DNA, 103 bp, Artificial Sequence
  Synthetic Polynucleotide
taatacgactcactatagggttccagggaaatcaaaagtgtagtttattgaacagaggagacaataaatgacacttttgaacctggcggcagcgcaaaagatg

SEQ ID NO: 17328 - DNA, 103 bp, Artificial Sequence
  Synthetic Polynucleotide
taatacgactcactatagggattaattccagggaaatcaaaagtgtagttaacagaggagaaactacatgtttgatttcaacctggcggcagcgcaaaagatg

SEQ ID NO: 17329 - DNA, 103 bp, Artificial Sequence
  Synthetic Polynucleotide
taatacgactcactatagggtctgcattaattccagggaaatcaaaagtgaacagaggagacactttatgtttccctggaacctggcggcagcgcaaaagatg

SEQ ID NO: 17330 - DNA, 103 bp, Artificial Sequence
  Synthetic Polynucleotide
taatacgactcactataggggggcatctgcattaattccagggaaatcaaaacagaggagattgattatgctggaattaaacctggcggcagcgcaaaagatg

SEQ ID NO: 17331 - DNA, 103 bp, Artificial Sequence
  Synthetic Polynucleotide
taatacgactcactataggggtggagggcatctgcattaattccagggaaaacagaggagattccctatgattaatgcaaacctggcggcagcgcaaaagatg

SEQ ID NO: 17332 - DNA, 103 bp, Artificial Sequence
  Synthetic Polynucleotide
taatacgactcactatagggtctgggtggagggcatctgcattaattccaaacagaggagatggaatatgtgcagatgcaacctggcggcagcgcaaaagatg

SEQ ID NO: 17333 - DNA, 103 bp, Artificial Sequence
  Synthetic Polynucleotide
taatacgactcactatagggggaggtctgggtggagggcatctgcattaaaacagaggagattaatgatgatgccctccaacctggcggcagcgcaaaagatg

SEQ ID NO: 17334 - DNA, 103 bp, Artificial Sequence
  Synthetic Polynucleotide
taatacgactcactatagggggtttggaggtctgggtggagggcatctgcaacagaggagagcagatatgctccacccaaacctggcggcagcgcaaaagatg

SEQ ID NO: 17335 - DNA, 103 bp, Artificial Sequence
  Synthetic Polynucleotide
taatacgactcactatagggggggtggtttggaggtctgggtggagggcaaacagaggagatgccctatgcccagacctaacctggcggcagcgcaaaagatg

SEQ ID NO: 17336 - DNA, 103 bp, Artificial Sequence
  Synthetic Polynucleotide
taatacgactcactataggggttggctctgggccagcgcttggggttgacaacagaggagagtcaacatgaagcgctggaacctggcggcagcgcaaaagatg

SEQ ID NO: 17337 - DNA, 103 bp, Artificial Sequence
  Synthetic Polynucleotide
taatacgactcactatagggcaattggggtggtttggaggtctgggtggaaacagaggagatccaccatgacctccaaaaacctggcggcagcgcaaaagatg

SEQ ID NO: 17338 - DNA, 103 bp, Artificial Sequence
  Synthetic Polynucleotide
taatacgactcactatagggtgtgacaattggggtggtttggaggtctggaacagaggagaccagacatgcaaaccaccaacctggcggcagcgcaaaagatg

SEQ ID NO: 17339 - DNA, 103 bp, Artificial Sequence
  Synthetic Polynucleotide
taatacgactcactataggggtgtctgtgacaattggggtggtttggaggaacagaggagacctccaatgcaccccaataacctggcggcagcgcaaaagatg

SEQ ID NO: 17340 - DNA, 103 bp, Artificial Sequence
  Synthetic Polynucleotide
taatacgactcactatagggtactggtgtctgtgacaattggggtggtttaacagaggagaaaaccaatgcaattgtcaaacctggcggcagcgcaaaagatg

SEQ ID NO: 17341 - DNA, 103 bp, Artificial Sequence
  Synthetic Polynucleotide
taatacgactcactataggggctgatactggtgtctgtgacaattggggtaacagaggagaaccccaatggtcacagacaacctggcggcagcgcaaaagatg

SEQ ID NO: 17342 - DNA, 103 bp, Artificial Sequence
  Synthetic Polynucleotide
taatacgactcactatagggctgctgctgatactggtgtctgtgacaattaacagaggagaaattgtatgagacaccagaacctggcggcagcgcaaaagatg

SEQ ID NO: 17343 - DNA, 103 bp, Artificial Sequence
  Synthetic Polynucleotide
taatacgactcactatagggcaccactgctgctgatactggtgtctgtgaaacagaggagatcacagatgccagtatcaaacctggcggcagcgcaaaagatg

SEQ ID NO: 17344 - DNA, 103 bp, Artificial Sequence
  Synthetic Polynucleotide
taatacgactcactatagggttcaccaccactgctgctgatactggtgtcaacagaggagagacaccatgatcagcagcaacctggcggcagcgcaaaagatg

SEQ ID NO: 17345 - DNA, 103 bp, Artificial Sequence
  Synthetic Polynucleotide
taatacgactcactataggggagctttcaccaccactgctgctgatactgaacagaggagacagtatatgcagcagtggaacctggcggcagcgcaaaagatg

SEQ ID NO: 17346 - DNA, 103 bp, Artificial Sequence
  Synthetic Polynucleotide
taatacgactcactatagggcttcagagctttcaccaccactgctgctgaaacagaggagatcagcaatggtggtggtgaacctggcggcagcgcaaaagatg

SEQ ID NO: 17347 - DNA, 103 bp, Artificial Sequence
  Synthetic Polynucleotide
taatacgactcactatagggttagggttggctctgggccagcgcttggggaacagaggagaccccaaatgctggcccagaacctggcggcagcgcaaaagatg

SEQ ID NO: 17348 - DNA, 103 bp, Artificial Sequence
  Synthetic Polynucleotide
taatacgactcactataggggagttcttcagagctttcaccaccactgctaacagaggagaagcagtatgggtgaaagcaacctggcggcagcgcaaaagatg

SEQ ID NO: 17349 - DNA, 103 bp, Artificial Sequence
  Synthetic Polynucleotide
taatacgactcactatagggtcactgagttcttcagagctttcaccaccaaacagaggagatggtggatgaagctctgaaacctggcggcagcgcaaaagatg

SEQ ID NO: 17350 - DNA, 103 bp, Artificial Sequence
  Synthetic Polynucleotide
taatacgactcactatagggtgctttcactgagttcttcagagctttcacaacagaggagagtgaaaatgctgaagaacaacctggcggcagcgcaaaagatg

SEQ ID NO: 17351 - DNA, 103 bp, Artificial Sequence
  Synthetic Polynucleotide
taatacgactcactatagggaaagctgctttcactgagttcttcagagctaacagaggagaagctctatggaactcagtaacctggcggcagcgcaaaagatg

SEQ ID NO: 17352 - DNA, 103 bp, Artificial Sequence
  Synthetic Polynucleotide
taatacgactcactatagggttaaaaaagctgctttcactgagttcttcaaacagaggagatgaagaatgcagtgaaagaacctggcggcagcgcaaaagatg

SEQ ID NO: 17353 - DNA, 103 bp, Artificial Sequence
  Synthetic Polynucleotide
taatacgactcactatagggtgaggttaaaaaagctgctttcactgagttaacagaggagaaactcaatgaaagcagctaacctggcggcagcgcaaaagatg

SEQ ID NO: 17354 - DNA, 103 bp, Artificial Sequence
  Synthetic Polynucleotide
taatacgactcactatagggggtgatgaggttaaaaaagctgctttcactaacagaggagaagtgaaatgagcttttttaacctggcggcagcgcaaaagatg

SEQ ID NO: 17355 - DNA, 103 bp, Artificial Sequence
  Synthetic Polynucleotide
taatacgactcactatagggcctggggtgatgaggttaaaaaagctgcttaacagaggagaaagcagatgttttaacctaacctggcggcagcgcaaaagatg

SEQ ID NO: 17356 - DNA, 103 bp, Artificial Sequence
  Synthetic Polynucleotide
taatacgactcactatagggaggcgcctggggtgatgaggttaaaaaagcaacagaggagagcttttatgacctcatcaaacctggcggcagcgcaaaagatg

SEQ ID NO: 17357 - DNA, 103 bp, Artificial Sequence
  Synthetic Polynucleotide
taatacgactcactataggggttccaggcgcctggggtgatgaggttaaaaacagaggagatttaacatgatcaccccaaacctggcggcagcgcaaaagatg

SEQ ID NO: 17358 - DNA, 103 bp, Artificial Sequence
  Synthetic Polynucleotide
taatacgactcactatagggcggaattagggttggctctgggccagcgctaacagaggagaagcgctatgccagagccaaacctggcggcagcgcaaaagatg

SEQ ID NO: 17359 - DNA, 103 bp, Artificial Sequence
  Synthetic Polynucleotide
taatacgactcactatagggtcagtgttccaggcgcctggggtgatgaggaacagaggagacctcatatgcccaggcgcaacctggcggcagcgcaaaagatg

SEQ ID NO: 17360 - DNA, 103 bp, Artificial Sequence
  Synthetic Polynucleotide
taatacgactcactataggggggtttcagtgttccaggcgcctggggtgaaacagaggagatcacccatggcgcctggaaacctggcggcagcgcaaaagatg

SEQ ID NO: 17361 - DNA, 103 bp, Artificial Sequence
  Synthetic Polynucleotide
taatacgactcactataggggcgcggggtttcagtgttccaggcgcctggaacagaggagaccaggcatgtggaacactaacctggcggcagcgcaaaagatg

SEQ ID NO: 17362 - DNA, 103 bp, Artificial Sequence
  Synthetic Polynucleotide
taatacgactcactatagggctagagcgcggggtttcagtgttccaggcgaacagaggagacgcctgatgcactgaaacaacctggcggcagcgcaaaagatg

SEQ ID NO: 17363 - DNA, 103 bp, Artificial Sequence
  Synthetic Polynucleotide
taatacgactcactataggggcgtactagagcgcggggtttcagtgttccaacagaggagaggaacaatgaaaccccgcaacctggcggcagcgcaaaagatg

SEQ ID NO: 17364 - DNA, 103 bp, Artificial Sequence
  Synthetic Polynucleotide
taatacgactcactataggggatgggcgtactagagcgcggggtttcagtaacagaggagaactgaaatgccgcgctctaacctggcggcagcgcaaaagatg

SEQ ID NO: 17365 - DNA, 103 bp, Artificial Sequence
  Synthetic Polynucleotide
taatacgactcactatagggccggggatgggcgtactagagcgcggggttaacagaggagaaaccccatgctctagtacaacctggcggcagcgcaaaagatg

SEQ ID NO: 17366 - DNA, 103 bp, Artificial Sequence
  Synthetic Polynucleotide
taatacgactcactatagggtggtcccggggatgggcgtactagagcgcgaacagaggagacgcgctatggtacgcccaaacctggcggcagcgcaaaagatg

SEQ ID NO: 17367 - DNA, 103 bp, Artificial Sequence
  Synthetic Polynucleotide
taatacgactcactatagggtgaactggtcccggggatgggcgtactagaaacagaggagatctagtatgcccatccccaacctggcggcagcgcaaaagatg

SEQ ID NO: 17368 - DNA, 103 bp, Artificial Sequence
  Synthetic Polynucleotide
taatacgactcactatagggtctcctgaactggtcccggggatgggcgtaaacagaggagatacgccatgccccgggacaacctggcggcagcgcaaaagatg

SEQ ID NO: 17369 - DNA, 103 bp, Artificial Sequence
  Synthetic Polynucleotide
taatacgactcactatagggacttccggaattagggttggctctgggccaaacagaggagatggcccatggccaaccctaacctggcggcagcgcaaaagatg

SEQ ID NO: 17370 - DNA, 103 bp, Artificial Sequence
  Synthetic Polynucleotide
taatacgactcactatagggatgattctcctgaactggtcccggggatggaacagaggagaccatccatgggaccagttaacctggcggcagcgcaaaagatg

SEQ ID NO: 17371 - DNA, 103 bp, Artificial Sequence
  Synthetic Polynucleotide
taatacgactcactataggggacaaatgattctcctgaactggtcccgggaacagaggagacccgggatgagttcaggaaacctggcggcagcgcaaaagatg

SEQ ID NO: 17372 - DNA, 103 bp, Artificial Sequence
  Synthetic Polynucleotide
taatacgactcactatagggcttccgacaaatgattctcctgaactggtcaacagaggagagaccagatgaggagaatcaacctggcggcagcgcaaaagatg

SEQ ID NO: 17373 - DNA, 103 bp, Artificial Sequence
  Synthetic Polynucleotide
taatacgactcactatagggctgggcttccgacaaatgattctcctgaacaacagaggagagttcagatgaatcatttgaacctggcggcagcgcaaaagatg

SEQ ID NO: 17374 - DNA, 103 bp, Artificial Sequence
  Synthetic Polynucleotide
taatacgactcactatagggggaaactgggcttccgacaaatgattctccaacagaggagaggagaaatgtttgtcggaaacctggcggcagcgcaaaagatg

SEQ ID NO: 17375 - DNA, 103 bp, Artificial Sequence
  Synthetic Polynucleotide
taatacgactcactatagggtcggaggaaactgggcttccgacaaatgataacagaggagaatcattatgcggaagcccaacctggcggcagcgcaaaagatg

SEQ ID NO: 17376 - DNA, 103 bp, Artificial Sequence
  Synthetic Polynucleotide
taatacgactcactatagggcaacttcggaggaaactgggcttccgacaaaacagaggagattgtcgatggcccagtttaacctggcggcagcgcaaaagatg

SEQ ID NO: 17377 - DNA, 103 bp, Artificial Sequence
  Synthetic Polynucleotide
taatacgactcactatagggagctacaacttcggaggaaactgggcttccaacagaggagaggaagcatggtttcctccaacctggcggcagcgcaaaagatg

SEQ ID NO: 17378 - DNA, 103 bp, Artificial Sequence
  Synthetic Polynucleotide
taatacgactcactataggggatgcagctacaacttcggaggaaactgggaacagaggagacccagtatgctccgaagtaacctggcggcagcgcaaaagatg

SEQ ID NO: 17379 - DNA, 103 bp, Artificial Sequence
  Synthetic Polynucleotide
taatacgactcactatagggcccacgatgcagctacaacttcggaggaaaaacagaggagatttcctatgaagttgtagaacctggcggcagcgcaaaagatg

SEQ ID NO: 17380 - DNA, 103 bp, Artificial Sequence
  Synthetic Polynucleotide
taatacgactcactataggggcgggacttccggaattagggttggctctgaacagaggagacagagcatgccctaattcaacctggcggcagcgcaaaagatg

SEQ ID NO: 17381 - DNA, 103 bp, Artificial Sequence
  Synthetic Polynucleotide
taatacgactcactatagggttcttcccacgatgcagctacaacttcggaaacagaggagatccgaaatggtagctgcaaacctggcggcagcgcaaaagatg

SEQ ID NO: 17382 - DNA, 103 bp, Artificial Sequence
  Synthetic Polynucleotide
taatacgactcactatagggaaggcttcttcccacgatgcagctacaactaacagaggagaagttgtatgtgcatcgtgaacctggcggcagcgcaaaagatg

SEQ ID NO: 17383 - DNA, 103 bp, Artificial Sequence
  Synthetic Polynucleotide
taatacgactcactatagggtgtagaaggcttcttcccacgatgcagctaaacagaggagatagctgatgcgtgggaagaacctggcggcagcgcaaaagatg

SEQ ID NO: 17384 - DNA, 103 bp, Artificial Sequence
  Synthetic Polynucleotide
taatacgactcactatagggaggtgtgtagaaggcttcttcccacgatgcaacagaggagagcatcgatggaagaagccaacctggcggcagcgcaaaagatg

SEQ ID NO: 17385 - DNA, 103 bp, Artificial Sequence
  Synthetic Polynucleotide
taatacgactcactataggggccaaaggtgtgtagaaggcttcttcccacaacagaggagagtgggaatgagccttctaaacctggcggcagcgcaaaagatg

SEQ ID NO: 17386 - DNA, 103 bp, Artificial Sequence
  Synthetic Polynucleotide
taatacgactcactatagggggtctgccaaaggtgtgtagaaggcttcttaacagaggagaaagaagatgtctacacacaacctggcggcagcgcaaaagatg

SEQ ID NO: 17387 - DNA, 103 bp, Artificial Sequence
  Synthetic Polynucleotide
taatacgactcactatagggaaactggtctgccaaaggtgtgtagaaggcaacagaggagagccttcatgacacctttgaacctggcggcagcgcaaaagatg

SEQ ID NO: 17388 - DNA, 103 bp, Artificial Sequence
  Synthetic Polynucleotide
taatacgactcactatagggtcacgaaactggtctgccaaaggtgtgtagaacagaggagactacacatgtttggcagaaacctggcggcagcgcaaaagatg

SEQ ID NO: 17389 - DNA, 103 bp, Artificial Sequence
  Synthetic Polynucleotide
taatacgactcactatagggacagttcacgaaactggtctgccaaaggtgaacagaggagacaccttatgcagaccagtaacctggcggcagcgcaaaagatg

SEQ ID NO: 17390 - DNA, 103 bp, Artificial Sequence
  Synthetic Polynucleotide
taatacgactcactatagggaactaacagttcacgaaactggtctgccaaaacagaggagattggcaatgcagtttcgtaacctggcggcagcgcaaaagatg

SEQ ID NO: 17391 - DNA, 103 bp, Artificial Sequence
  Synthetic Polynucleotide
taatacgactcactatagggggtgggcgggacttccggaattagggttggaacagaggagaccaaccatgattccggaaaacctggcggcagcgcaaaagatg

SEQ ID NO: 17392 - DNA, 103 bp, Artificial Sequence
  Synthetic Polynucleotide
taatacgactcactatagggaccccaactaacagttcacgaaactggtctaacagaggagaagaccaatgtcgtgaactaacctggcggcagcgcaaaagatg

SEQ ID NO: 17393 - DNA, 103 bp, Artificial Sequence
  Synthetic Polynucleotide
taatacgactcactatagggaatcaaccccaactaacagttcacgaaactaacagaggagaagtttcatgaactgttagaacctggcggcagcgcaaaagatg

SEQ ID NO: 17394 - DNA, 103 bp, Artificial Sequence
  Synthetic Polynucleotide
taatacgactcactatagggcacataatcaaccccaactaacagttcacgaacagaggagacgtgaaatgttagttgggaacctggcggcagcgcaaaagatg

SEQ ID NO: 17395 - DNA, 103 bp, Artificial Sequence
  Synthetic Polynucleotide
taatacgactcactatagggtcccacacataatcaaccccaactaacagtaacagaggagaactgttatgtggggttgaaacctggcggcagcgcaaaagatg

SEQ ID NO: 17396 - DNA, 103 bp, Artificial Sequence
  Synthetic Polynucleotide
taatacgactcactatagggcaccgtcccacacataatcaaccccaactaaacagaggagatagttgatgttgattatgaacctggcggcagcgcaaaagatg

SEQ ID NO: 17397 - DNA, 103 bp, Artificial Sequence
  Synthetic Polynucleotide
taatacgactcactatagggccttacaccgtcccacacataatcaaccccaacagaggagaggggttatgtatgtgtggaacctggcggcagcgcaaaagatg

SEQ ID NO: 17398 - DNA, 103 bp, Artificial Sequence
  Synthetic Polynucleotide
taatacgactcactatagggaaaccccttacaccgtcccacacataatcaaacagaggagatgattaatggtgggacggaacctggcggcagcgcaaaagatg

SEQ ID NO: 17399 - DNA, 103 bp, Artificial Sequence
  Synthetic Polynucleotide
taatacgactcactatagggcaggtaaaccccttacaccgtcccacacataacagaggagaatgtgtatgacggtgtaaaacctggcggcagcgcaaaagatg

SEQ ID NO: 17400 - DNA, 103 bp, Artificial Sequence
  Synthetic Polynucleotide
taatacgactcactatagggacacacaggtaaaccccttacaccgtcccaaacagaggagatgggacatggtaaggggtaacctggcggcagcgcaaaagatg

SEQ ID NO: 17401 - DNA, 103 bp, Artificial Sequence
  Synthetic Polynucleotide
taatacgactcactatagggacacaacacacaggtaaaccccttacaccgaacagaggagacggtgtatggggtttaccaacctggcggcagcgcaaaagatg

SEQ ID NO: 17402 - DNA, 103 bp, Artificial Sequence
  Synthetic Polynucleotide
taatacgactcactatagggcttccggtgggcgggacttccggaattaggaacagaggagacctaatatgggaagtcccaacctggcggcagcgcaaaagatg

SEQ ID NO: 17403 - DNA, 103 bp, Artificial Sequence
  Synthetic Polynucleotide
taatacgactcactataggggttgcacacaacacacaggtaaaccccttaaacagaggagataagggatgtacctgtgtaacctggcggcagcgcaaaagatg

SEQ ID NO: 17404 - DNA, 103 bp, Artificial Sequence
  Synthetic Polynucleotide
taatacgactcactatagggaatatgttgcacacaacacacaggtaaaccaacagaggagaggtttaatggtgtgttgtaacctggcggcagcgcaaaagatg

SEQ ID NO: 17405 - DNA, 103 bp, Artificial Sequence
  Synthetic Polynucleotide
taatacgactcactatagggttgttaatatgttgcacacaacacacaggtaacagaggagaacctgtatgttgtgtgcaaacctggcggcagcgcaaaagatg

SEQ ID NO: 17406 - DNA, 103 bp, Artificial Sequence
  Synthetic Polynucleotide
taatacgactcactatagggcactattgttaatatgttgcacacaacacaaacagaggagatgtgttatgtgcaacataaacctggcggcagcgcaaaagatg

SEQ ID NO: 17407 - DNA, 103 bp, Artificial Sequence
  Synthetic Polynucleotide
taatacgactcactatagggtcccccactattgttaatatgttgcacacaaacagaggagatgtgtgatgcatattaacaacctggcggcagcgcaaaagatg

SEQ ID NO: 17408 - DNA, 103 bp, Artificial Sequence
  Synthetic Polynucleotide
taatacgactcactatagggaagcctcccccactattgttaatatgttgcaacagaggagagcaacaatgtaacaatagaacctggcggcagcgcaaaagatg

SEQ ID NO: 17409 - DNA, 103 bp, Artificial Sequence
  Synthetic Polynucleotide
taatacgactcactataggggtcccaagcctcccccactattgttaatataacagaggagaatattaatgatagtggggaacctggcggcagcgcaaaagatg

SEQ ID NO: 17410 - DNA, 103 bp, Artificial Sequence
  Synthetic Polynucleotide
taatacgactcactatagggacaaagtcccaagcctcccccactattgttaacagaggagaaacaatatggggggaggcaacctggcggcagcgcaaaagatg

SEQ ID NO: 17411 - DNA, 103 bp, Artificial Sequence
  Synthetic Polynucleotide
taatacgactcactatagggtggggacaaagtcccaagcctcccccactaaacagaggagatagtggatgaggcttgggaacctggcggcagcgcaaaagatg

SEQ ID NO: 17412 - DNA, 103 bp, Artificial Sequence
  Synthetic Polynucleotide
taatacgactcactatagggtgcaatggggacaaagtcccaagcctccccaacagaggagaggggagatgtgggactttaacctggcggcagcgcaaaagatg

SEQ ID NO: 17413 - DNA, 103 bp, Artificial Sequence
  Synthetic Polynucleotide
taatacgactcactatagggcgtcacttccggtgggcgggacttccggaaaacagaggagattccggatgtcccgcccaaacctggcggcagcgcaaaagatg

SEQ ID NO: 17414 - DNA, 103 bp, Artificial Sequence
  Synthetic Polynucleotide
taatacgactcactatagggattaatgcaatggggacaaagtcccaagccaacagaggagaggcttgatgctttgtcccaacctggcggcagcgcaaaagatg

SEQ ID NO: 17415 - DNA, 103 bp, Artificial Sequence
  Synthetic Polynucleotide
taatacgactcactatagggcctacattaatgcaatggggacaaagtcccaacagaggagagggactatgtccccattgaacctggcggcagcgcaaaagatg

SEQ ID NO: 17416 - DNA, 103 bp, Artificial Sequence
  Synthetic Polynucleotide
taatacgactcactatagggaagcccctacattaatgcaatggggacaaaaacagaggagatttgtcatgattgcattaaacctggcggcagcgcaaaagatg

SEQ ID NO: 17417 - DNA, 103 bp, Artificial Sequence
  Synthetic Polynucleotide
taatacgactcactatagggataccaagcccctacattaatgcaatggggaacagaggagaccccatatgattaatgtaaacctggcggcagcgcaaaagatg

SEQ ID NO: 17418 - DNA, 103 bp, Artificial Sequence
  Synthetic Polynucleotide
taatacgactcactatagggccattataccaagcccctacattaatgcaaaacagaggagattgcatatgtgtaggggcaacctggcggcagcgcaaaagatg

SEQ ID NO: 17419 - DNA, 103 bp, Artificial Sequence
  Synthetic Polynucleotide
taatacgactcactatagggtccatccattataccaagcccctacattaaaacagaggagattaatgatggggcttggtaacctggcggcagcgcaaaagatg

SEQ ID NO: 17420 - DNA, 103 bp, Artificial Sequence
  Synthetic Polynucleotide
taatacgactcactatagggaaatttccatccattataccaagcccctacaacagaggagagtagggatgtggtataataacctggcggcagcgcaaaagatg

SEQ ID NO: 17421 - DNA, 103 bp, Artificial Sequence
  Synthetic Polynucleotide
taatacgactcactatagggtctcgaaatttccatccattataccaagccaacagaggagaggcttgatgtaatggatgaacctggcggcagcgcaaaagatg

SEQ ID NO: 17422 - DNA, 103 bp, Artificial Sequence
  Synthetic Polynucleotide
taatacgactcactatagggtaaattctcgaaatttccatccattataccaacagaggagaggtataatggatggaaataacctggcggcagcgcaaaagatg

SEQ ID NO: 17423 - DNA, 103 bp, Artificial Sequence
  Synthetic Polynucleotide
taatacgactcactatagggtggggtaaattctcgaaatttccatccattaacagaggagaaatggaatgaaatttcgaaacctggcggcagcgcaaaagatg

SEQ ID NO: 17424 - DNA, 103 bp, Artificial Sequence
  Synthetic Polynucleotide
taatacgactcactatagggttgtaccggaagtcccgcctaccggcggcgaacagaggagacgccgcatgtaggcgggaaacctggcggcagcgcaaaagatg

SEQ ID NO: 17425 - DNA, 103 bp, Artificial Sequence
  Synthetic Polynucleotide
taatacgactcactatagggtgtgacgtcacttccggtgggcgggacttcaacagaggagagaagtcatgcccaccggaaacctggcggcagcgcaaaagatg

SEQ ID NO: 17426 - DNA, 103 bp, Artificial Sequence
  Synthetic Polynucleotide
taatacgactcactatagggaaatctggggtaaattctcgaaatttccataacagaggagaatggaaatgtcgagaattaacctggcggcagcgcaaaagatg

SEQ ID NO: 17427 - DNA, 103 bp, Artificial Sequence
  Synthetic Polynucleotide
taatacgactcactataggggcaccaaatctggggtaaattctcgaaattaacagaggagaaatttcatgaatttacccaacctggcggcagcgcaaaagatg

SEQ ID NO: 17428 - DNA, 103 bp, Artificial Sequence
  Synthetic Polynucleotide
taatacgactcactatagggacatcgcaccaaatctggggtaaattctcgaacagaggagacgagaaatgaccccagataacctggcggcagcgcaaaagatg

SEQ ID NO: 17429 - DNA, 103 bp, Artificial Sequence
  Synthetic Polynucleotide
taatacgactcactatagggcagctacatcgcaccaaatctggggtaaataacagaggagaatttacatgagatttggtaacctggcggcagcgcaaaagatg

SEQ ID NO: 17430 - DNA, 103 bp, Artificial Sequence
  Synthetic Polynucleotide
taatacgactcactatagggcatggcagctacatcgcaccaaatctggggaacagaggagaccccagatgtggtgcgataacctggcggcagcgcaaaagatg

SEQ ID NO: 17431 - DNA, 103 bp, Artificial Sequence
  Synthetic Polynucleotide
taatacgactcactatagggtcccacatggcagctacatcgcaccaaatcaacagaggagagatttgatgcgatgtagcaacctggcggcagcgcaaaagatg

SEQ ID NO: 17432 - DNA, 103 bp, Artificial Sequence
  Synthetic Polynucleotide
taatacgactcactataggggaagctcccacatggcagctacatcgcaccaacagaggagaggtgcgatgtagctgccaaacctggcggcagcgcaaaagatg

SEQ ID NO: 17433 - DNA, 103 bp, Artificial Sequence
  Synthetic Polynucleotide
taatacgactcactataggggattagaagctcccacatggcagctacatcaacagaggagagatgtaatggccatgtggaacctggcggcagcgcaaaagatg

SEQ ID NO: 17434 - DNA, 103 bp, Artificial Sequence
  Synthetic Polynucleotide
taatacgactcactatagggaaagggattagaagctcccacatggcagctaacagaggagaagctgcatggtgggagctaacctggcggcagcgcaaaagatg

SEQ ID NO: 17435 - DNA, 103 bp, Artificial Sequence
  Synthetic Polynucleotide
taatacgactcactatagggacagaaaagggattagaagctcccacatggaacagaggagaccatgtatgagcttctaaaacctggcggcagcgcaaaagatg

SEQ ID NO: 17436 - DNA, 103 bp, Artificial Sequence
  Synthetic Polynucleotide
taatacgactcactatagggtttcctgtgacgtcacttccggtgggcgggaacagaggagacccgccatgcggaagtgaaacctggcggcagcgcaaaagatg

SEQ ID NO: 17437 - DNA, 103 bp, Artificial Sequence
  Synthetic Polynucleotide
taatacgactcactatagggttagcacagaaaagggattagaagctcccaaacagaggagatgggagatgctaatccctaacctggcggcagcgcaaaagatg

SEQ ID NO: 17438 - DNA, 103 bp, Artificial Sequence
  Synthetic Polynucleotide
taatacgactcactataggggcaggttagcacagaaaagggattagaagcaacagaggagagcttctatgcccttttctaacctggcggcagcgcaaaagatg

SEQ ID NO: 17439 - DNA, 103 bp, Artificial Sequence
  Synthetic Polynucleotide
taatacgactcactatagggtttttgcaggttagcacagaaaagggattaaacagaggagataatccatgttctgtgctaacctggcggcagcgcaaaagatg

SEQ ID NO: 17440 - DNA, 103 bp, Artificial Sequence
  Synthetic Polynucleotide
taatacgactcactatagggcacattttttgcaggttagcacagaaaaggaacagaggagaccttttatgtgctaacctaacctggcggcagcgcaaaagatg

SEQ ID NO: 17441 - DNA, 103 bp, Artificial Sequence
  Synthetic Polynucleotide
taatacgactcactataggggtaagcacattttttgcaggttagcacagaaacagaggagatctgtgatgacctgcaaaaacctggcggcagcgcaaaagatg

SEQ ID NO: 17442 - DNA, 103 bp, Artificial Sequence
  Synthetic Polynucleotide
taatacgactcactataggggacaggtaagcacattttttgcaggttagcaacagaggagagctaacatgcaaaaaatgaacctggcggcagcgcaaaagatg

SEQ ID NO: 17443 - DNA, 103 bp, Artificial Sequence
  Synthetic Polynucleotide
taatacgactcactatagggatccagacaggtaagcacattttttgcaggaacagaggagacctgcaatgaatgtgcttaacctggcggcagcgcaaaagatg

SEQ ID NO: 17444 - DNA, 103 bp, Artificial Sequence
  Synthetic Polynucleotide
taatacgactcactatagggttgcaatccagacaggtaagcacattttttaacagaggagaaaaaaaatggcttacctgaacctggcggcagcgcaaaagatg

SEQ ID NO: 17445 - DNA, 103 bp, Artificial Sequence
  Synthetic Polynucleotide
taatacgactcactatagggaagctttgcaatccagacaggtaagcacataacagaggagaatgtgcatgcctgtctggaacctggcggcagcgcaaaagatg

SEQ ID NO: 17446 - DNA, 103 bp, Artificial Sequence
  Synthetic Polynucleotide
taatacgactcactatagggctacaaagctttgcaatccagacaggtaagaacagaggagacttaccatgctggattgcaacctggcggcagcgcaaaagatg

SEQ ID NO: 17447 - DNA, 103 bp, Artificial Sequence
  Synthetic Polynucleotide
taatacgactcactatagggcgtcatttcctgtgacgtcacttccggtggaacagaggagaccaccgatggtgacgtcaaacctggcggcagcgcaaaagatg

SEQ ID NO: 17448 - DNA, 103 bp, Artificial Sequence
  Synthetic Polynucleotide
taatacgactcactatagggataatctacaaagctttgcaatccagacagaacagaggagactgtctatgttgcaaagcaacctggcggcagcgcaaaagatg

SEQ ID NO: 17449 - DNA, 103 bp, Artificial Sequence
  Synthetic Polynucleotide
taatacgactcactatagggtactcataatctacaaagctttgcaatccaaacagaggagatggattatgaagctttgtaacctggcggcagcgcaaaagatg

SEQ ID NO: 17450 - DNA, 103 bp, Artificial Sequence
  Synthetic Polynucleotide
taatacgactcactatagggttctttactcataatctacaaagctttgcaaacagaggagatgcaaaatgttgtagattaacctggcggcagcgcaaaagatg

SEQ ID NO: 17451 - DNA, 103 bp, Artificial Sequence
  Synthetic Polynucleotide
taatacgactcactatagggccactttctttactcataatctacaaagctaacagaggagaagctttatggattatgagaacctggcggcagcgcaaaagatg

SEQ ID NO: 17452 - DNA, 103 bp, Artificial Sequence
  Synthetic Polynucleotide
taatacgactcactatagggatttgccactttctttactcataatctacaaacagaggagatgtagaatgtgagtaaagaacctggcggcagcgcaaaagatg

SEQ ID NO: 17453 - DNA, 103 bp, Artificial Sequence
  Synthetic Polynucleotide
taatacgactcactatagggccaccatttgccactttctttactcataataacagaggagaattatgatgaaagaaagtaacctggcggcagcgcaaaagatg

SEQ ID NO: 17454 - DNA, 103 bp, Artificial Sequence
  Synthetic Polynucleotide
taatacgactcactatagggctttcccaccatttgccactttctttactcaacagaggagagagtaaatgaagtggcaaaacctggcggcagcgcaaaagatg

SEQ ID NO: 17455 - DNA, 103 bp, Artificial Sequence
  Synthetic Polynucleotide
taatacgactcactatagggcatcactttcccaccatttgccactttcttaacagaggagaaagaaaatggcaaatggtaacctggcggcagcgcaaaagatg

SEQ ID NO: 17456 - DNA, 103 bp, Artificial Sequence
  Synthetic Polynucleotide
taatacgactcactatagggttcatcatcactttcccaccatttgccactaacagaggagaagtggcatgtggtgggaaaacctggcggcagcgcaaaagatg

SEQ ID NO: 17457 - DNA, 103 bp, Artificial Sequence
  Synthetic Polynucleotide
taatacgactcactataggggcaaattcatcatcactttcccaccatttgaacagaggagacaaatgatgggaaagtgaaacctggcggcagcgcaaaagatg

SEQ ID NO: 17458 - DNA, 103 bp, Artificial Sequence
  Synthetic Polynucleotide
taatacgactcactatagggtgtgacgtcatttcctgtgacgtcacttccaacagaggagaggaagtatggtcacaggaaacctggcggcagcgcaaaagatg

SEQ ID NO: 17459 - DNA, 103 bp, Artificial Sequence
  Synthetic Polynucleotide
taatacgactcactatagggctttagcaaattcatcatcactttcccaccaacagaggagaggtgggatggtgatgatgaacctggcggcagcgcaaaagatg

SEQ ID NO: 17460 - DNA, 103 bp, Artificial Sequence
  Synthetic Polynucleotide
taatacgactcactatagggcacagctttagcaaattcatcatcactttcaacagaggagagaaagtatggatgaatttaacctggcggcagcgcaaaagatg

SEQ ID NO: 17461 - DNA, 103 bp, Artificial Sequence
  Synthetic Polynucleotide
taatacgactcactatagggtgatacacagctttagcaaattcatcatcaaacagaggagatgatgaatgatttgctaaaacctggcggcagcgcaaaagatg

SEQ ID NO: 17462 - DNA, 103 bp, Artificial Sequence
  Synthetic Polynucleotide
taatacgactcactatagggattgctgatacacagctttagcaaattcataacagaggagaatgaatatgctaaagctgaacctggcggcagcgcaaaagatg

SEQ ID NO: 17463 - DNA, 103 bp, Artificial Sequence
  Synthetic Polynucleotide
taatacgactcactatagggcacaaattgctgatacacagctttagcaaaaacagaggagatttgctatggctgtgtataacctggcggcagcgcaaaagatg

SEQ ID NO: 17464 - DNA, 103 bp, Artificial Sequence
  Synthetic Polynucleotide
taatacgactcactatagggaattccacaaattgctgatacacagctttaaacagaggagataaagcatggtatcagcaaacctggcggcagcgcaaaagatg

SEQ ID NO: 17465 - DNA, 103 bp, Artificial Sequence
  Synthetic Polynucleotide
taatacgactcactatagggcataaaattccacaaattgctgatacacagaacagaggagactgtgtatgagcaatttgaacctggcggcagcgcaaaagatg

SEQ ID NO: 17466 - DNA, 103 bp, Artificial Sequence
  Synthetic Polynucleotide
taatacgactcactatagggcttttcataaaattccacaaattgctgataaacagaggagatatcagatgtttgtggaaaacctggcggcagcgcaaaagatg

SEQ ID NO: 17467 - DNA, 103 bp, Artificial Sequence
  Synthetic Polynucleotide
taatacgactcactataggggtaaccttttcataaaattccacaaattgcaacagaggagagcaattatgggaattttaaacctggcggcagcgcaaaagatg

SEQ ID NO: 17468 - DNA, 103 bp, Artificial Sequence
  Synthetic Polynucleotide
taatacgactcactatagggttccagtaaccttttcataaaattccacaaaacagaggagattgtggatgtttatgaaaaacctggcggcagcgcaaaagatg

SEQ ID NO: 17469 - DNA, 103 bp, Artificial Sequence
  Synthetic Polynucleotide
taatacgactcactatagggtttcctgtgacgtcatttcctgtgacgtcaaacagaggagatgacgtatgaggaaatgaaacctggcggcagcgcaaaagatg

SEQ ID NO: 17470 - DNA, 103 bp, Artificial Sequence
  Synthetic Polynucleotide
taatacgactcactataggggtctgttccagtaaccttttcataaaattcaacagaggagagaatttatggaaaaggttaacctggcggcagcgcaaaagatg

SEQ ID NO: 17471 - DNA, 103 bp, Artificial Sequence
  Synthetic Polynucleotide
taatacgactcactatagggtctaagtctgttccagtaaccttttcataaaacagaggagattatgaatgggttactggaacctggcggcagcgcaaaagatg

SEQ ID NO: 17472 - DNA, 103 bp, Artificial Sequence
  Synthetic Polynucleotide
taatacgactcactatagggtaagctctaagtctgttccagtaaccttttaacagaggagaaaaaggatgctggaacagaacctggcggcagcgcaaaagatg

SEQ ID NO: 17473 - DNA, 103 bp, Artificial Sequence
  Synthetic Polynucleotide
taatacgactcactatagggttgaataagctctaagtctgttccagtaacaacagaggagagttactatgacagacttaaacctggcggcagcgcaaaagatg

SEQ ID NO: 17474 - DNA, 103 bp, Artificial Sequence
  Synthetic Polynucleotide
taatacgactcactatagggaatatttgaataagctctaagtctgttccaaacagaggagatggaacatgcttagagctaacctggcggcagcgcaaaagatg

SEQ ID NO: 17475 - DNA, 103 bp, Artificial Sequence
  Synthetic Polynucleotide
taatacgactcactatagggcttttaatatttgaataagctctaagtctgaacagaggagacagactatgagcttattcaacctggcggcagcgcaaaagatg

SEQ ID NO: 17476 - DNA, 103 bp, Artificial Sequence
  Synthetic Polynucleotide
taatacgactcactatagggatgatcttttaatatttgaataagctctaaaacagaggagattagagatgattcaaataaacctggcggcagcgcaaaagatg

SEQ ID NO: 17477 - DNA, 103 bp, Artificial Sequence
  Synthetic Polynucleotide
taatacgactcactatagggttataatgatcttttaatatttgaataagcaacagaggagagcttatatgaatattaaaaacctggcggcagcgcaaaagatg

SEQ ID NO: 17478 - DNA, 103 bp, Artificial Sequence
  Synthetic Polynucleotide
taatacgactcactatagggaaatattataatgatcttttaatatttgaaaacagaggagattcaaaatgtaaaagatcaacctggcggcagcgcaaaagatg

SEQ ID NO: 17479 - DNA, 103 bp, Artificial Sequence
  Synthetic Polynucleotide
taatacgactcactatagggtaaagaaatattataatgatcttttaatataacagaggagaatattaatggatcattataacctggcggcagcgcaaaagatg

SEQ ID NO: 17480 - DNA, 103 bp, Artificial Sequence
  Synthetic Polynucleotide
taatacgactcactatagggcgtcatttcctgtgacgtcatttcctgtgaaacagaggagatcacagatgatgacgtcaaacctggcggcagcgcaaaagatg

SEQ ID NO: 17481 - DNA, 103 bp, Artificial Sequence
  Synthetic Polynucleotide
taatacgactcactatagggttatctaaagaaatattataatgatcttttaacagaggagaaaaagaatgttataatataacctggcggcagcgcaaaagatg

SEQ ID NO: 17482 - DNA, 103 bp, Artificial Sequence
  Synthetic Polynucleotide
taatacgactcactatagggggggattatctaaagaaatattataatgataacagaggagaatcattatgatatttcttaacctggcggcagcgcaaaagatg

SEQ ID NO: 17483 - DNA, 103 bp, Artificial Sequence
  Synthetic Polynucleotide
taatacgactcactatagggttctaggggattatctaaagaaatattataaacagaggagatataatatgtctttagataacctggcggcagcgcaaaagatg

SEQ ID NO: 17484 - DNA, 103 bp, Artificial Sequence
  Synthetic Polynucleotide
taatacgactcactataggggggttttctaggggattatctaaagaaataaacagaggagatatttcatgagataatccaacctggcggcagcgcaaaagatg

SEQ ID NO: 17485 - DNA, 103 bp, Artificial Sequence
  Synthetic Polynucleotide
taatacgactcactatagggaggatgggttttctaggggattatctaaagaacagaggagactttagatgatcccctagaacctggcggcagcgcaaaagatg

SEQ ID NO: 17486 - DNA, 103 bp, Artificial Sequence
  Synthetic Polynucleotide
taatacgactcactatagggcagagaggatgggttttctaggggattatcaacagaggagagataatatgctagaaaacaacctggcggcagcgcaaaagatg

SEQ ID NO: 17487 - DNA, 103 bp, Artificial Sequence
  Synthetic Polynucleotide
taatacgactcactatagggtcaaacagagaggatgggttttctaggggaaacagaggagatcccctatgaaacccatcaacctggcggcagcgcaaaagatg

SEQ ID NO: 17488 - DNA, 103 bp, Artificial Sequence
  Synthetic Polynucleotide
taatacgactcactatagggctaagtcaaacagagaggatgggttttctaaacagaggagatagaaaatgcatcctctcaacctggcggcagcgcaaaagatg

SEQ ID NO: 17489 - DNA, 103 bp, Artificial Sequence
  Synthetic Polynucleotide
taatacgactcactatagggagcaactaagtcaaacagagaggatgggttaacagaggagaaacccaatgtctctgtttaacctggcggcagcgcaaaagatg

SEQ ID NO: 17490 - DNA, 103 bp, Artificial Sequence
  Synthetic Polynucleotide
taatacgactcactatagggatgcgagcaactaagtcaaacagagaggataacagaggagaatcctcatggtttgacttaacctggcggcagcgcaaaagatg

SEQ ID NO: 17491 - DNA, 103 bp, Artificial Sequence
  Synthetic Polynucleotide
taatacgactcactatagggaattacgtcatttcctgtgacgtcatttccaacagaggagaggaaatatggtcacaggaaacctggcggcagcgcaaaagatg

SEQ ID NO: 17492 - DNA, 103 bp, Artificial Sequence
  Synthetic Polynucleotide
taatacgactcactatagggttttaatgcgagcaactaagtcaaacagagaacagaggagactctgtatgacttagttgaacctggcggcagcgcaaaagatg

SEQ ID NO: 17493 - DNA, 103 bp, Artificial Sequence
  Synthetic Polynucleotide
taatacgactcactataggggttatttttaatgcgagcaactaagtcaaaaacagaggagatttgacatggttgctcgcaacctggcggcagcgcaaaagatg

SEQ ID NO: 17494 - DNA, 103 bp, Artificial Sequence
  Synthetic Polynucleotide
taatacgactcactatagggttaaggttatttttaatgcgagcaactaagaacagaggagacttagtatgtcgcattaaaacctggcggcagcgcaaaagatg

SEQ ID NO: 17495 - DNA, 103 bp, Artificial Sequence
  Synthetic Polynucleotide
taatacgactcactatagggaatttttaaggttatttttaatgcgagcaaaacagaggagattgctcatgttaaaaataaacctggcggcagcgcaaaagatg

SEQ ID NO: 17496 - DNA, 103 bp, Artificial Sequence
  Synthetic Polynucleotide
taatacgactcactatagggtggagaatttttaaggttatttttaatgcgaacagaggagacgcattatgaataaccttaacctggcggcagcgcaaaagatg

SEQ ID NO: 17497 - DNA, 103 bp, Artificial Sequence
  Synthetic Polynucleotide
taatacgactcactatagggaagtctggagaatttttaaggttatttttaaacagaggagataaaaaatgccttaaaaaaacctggcggcagcgcaaaagatg

SEQ ID NO: 17498 - DNA, 103 bp, Artificial Sequence
  Synthetic Polynucleotide
taatacgactcactatagggtatataagtctggagaatttttaaggttataacagaggagaataaccatgaaaattctcaacctggcggcagcgcaaaagatg

SEQ ID NO: 17499 - DNA, 103 bp, Artificial Sequence
  Synthetic Polynucleotide
taatacgactcactatagggatgactatataagtctggagaatttttaagaacagaggagacttaaaatgtctccagacaacctggcggcagcgcaaaagatg

SEQ ID NO: 17500 - DNA, 103 bp, Artificial Sequence
  Synthetic Polynucleotide
taatacgactcactatagggaaatgatgactatataagtctggagaatttaacagaggagaaaattcatgagacttataaacctggcggcagcgcaaaagatg

SEQ ID NO: 17501 - DNA, 103 bp, Artificial Sequence
  Synthetic Polynucleotide
taatacgactcactatagggtttgaaaatgatgactatataagtctggagaacagaggagactccagatgtatatagtcaacctggcggcagcgcaaaagatg

SEQ ID NO: 17502 - DNA, 103 bp, Artificial Sequence
  Synthetic Polynucleotide
taatacgactcactatagggcggacaattacgtcatttcctgtgacgtcaaacagaggagatgacgtatgaggaaatgaaacctggcggcagcgcaaaagatg

SEQ ID NO: 17503 - DNA, 103 bp, Artificial Sequence
  Synthetic Polynucleotide
taatacgactcactatagggatgactttgaaaatgatgactatataagtcaacagaggagagacttaatgagtcatcataacctggcggcagcgcaaaagatg

SEQ ID NO: 17504 - DNA, 103 bp, Artificial Sequence
  Synthetic Polynucleotide
taatacgactcactatagggtgtccatgactttgaaaatgatgactatataacagaggagaatatagatgtcattttcaaacctggcggcagcgcaaaagatg

SEQ ID NO: 17505 - DNA, 103 bp, Artificial Sequence
  Synthetic Polynucleotide
taatacgactcactatagggataactgtccatgactttgaaaatgatgacaacagaggagagtcatcatgttcaaagtcaacctggcggcagcgcaaaagatg

SEQ ID NO: 17506 - DNA, 103 bp, Artificial Sequence
  Synthetic Polynucleotide
taatacgactcactataggggtcagataactgtccatgactttgaaaatgaacagaggagacattttatgagtcatggaaacctggcggcagcgcaaaagatg

SEQ ID NO: 17507 - DNA, 103 bp, Artificial Sequence
  Synthetic Polynucleotide
taatacgactcactataggggggtggtcagataactgtccatgactttgaaacagaggagatcaaagatgtggacagttaacctggcggcagcgcaaaagatg

SEQ ID NO: 17508 - DNA, 103 bp, Artificial Sequence
  Synthetic Polynucleotide
taatacgactcactatagggcatgggggtggtcagataactgtccatgacaacagaggagagtcatgatgagttatctgaacctggcggcagcgcaaaagatg

SEQ ID NO: 17509 - DNA, 103 bp, Artificial Sequence
  Synthetic Polynucleotide
taatacgactcactatagggtaaggcatgggggtggtcagataactgtccaacagaggagaggacagatgtctgaccacaacctggcggcagcgcaaaagatg

SEQ ID NO: 17510 - DNA, 103 bp, Artificial Sequence
  Synthetic Polynucleotide
taatacgactcactataggggatgataaggcatgggggtggtcagataacaacagaggagagttatcatgccacccccaaacctggcggcagcgcaaaagatg

SEQ ID NO: 17511 - DNA, 103 bp, Artificial Sequence
  Synthetic Polynucleotide
taatacgactcactatagggtactggatgataaggcatgggggtggtcagaacagaggagactgaccatgcccatgcctaacctggcggcagcgcaaaagatg

SEQ ID NO: 17512 - DNA, 103 bp, Artificial Sequence
  Synthetic Polynucleotide
taatacgactcactatagggactgctactggatgataaggcatgggggtgaacagaggagacaccccatggccttatcaaacctggcggcagcgcaaaagatg

SEQ ID NO: 17513 - DNA, 103 bp, Artificial Sequence
  Synthetic Polynucleotide
taatacgactcactataggggatggcggacaattacgtcatttcctgtgaaacagaggagatcacagatgatgacgtaaaacctggcggcagcgcaaaagatg

SEQ ID NO: 17514 - DNA, 103 bp, Artificial Sequence
  Synthetic Polynucleotide
taatacgactcactataggggcatgactgctactggatgataaggcatggaacagaggagaccatgcatgatcatccagaacctggcggcagcgcaaaagatg

SEQ ID NO: 17515 - DNA, 103 bp, Artificial Sequence
  Synthetic Polynucleotide
taatacgactcactataggggttctgcatgactgctactggatgataaggaacagaggagaccttatatgccagtagcaaacctggcggcagcgcaaaagatg

SEQ ID NO: 17516 - DNA, 103 bp, Artificial Sequence
  Synthetic Polynucleotide
taatacgactcactatagggtctaggttctgcatgactgctactggatgaaacagaggagatcatccatgagcagtcataacctggcggcagcgcaaaagatg

SEQ ID NO: 17517 - DNA, 103 bp, Artificial Sequence
  Synthetic Polynucleotide
taatacgactcactatagggtctcctctaggttctgcatgactgctactgaacagaggagacagtagatgtcatgcagaaacctggcggcagcgcaaaagatg

SEQ ID NO: 17518 - DNA, 103 bp, Artificial Sequence
  Synthetic Polynucleotide
taatacgactcactatagggcatcttctcctctaggttctgcatgactgcaacagaggagagcagtcatgcagaacctaaacctggcggcagcgcaaaagatg

SEQ ID NO: 17519 - DNA, 103 bp, Artificial Sequence
  Synthetic Polynucleotide
taatacgactcactatagggtactgcatcttctcctctaggttctgcatgaacagaggagacatgcaatgcctagaggaaacctggcggcagcgcaaaagatg

SEQ ID NO: 17520 - DNA, 103 bp, Artificial Sequence
  Synthetic Polynucleotide
taatacgactcactataggggataatactgcatcttctcctctaggttctaacagaggagaagaaccatgaggagaagaaacctggcggcagcgcaaaagatg

SEQ ID NO: 17521 - DNA, 103 bp, Artificial Sequence
  Synthetic Polynucleotide
taatacgactcactatagggcactagataatactgcatcttctcctctagaacagaggagactagagatgaagatgcagaacctggcggcagcgcaaaagatg

SEQ ID NO: 17522 - DNA, 103 bp, Artificial Sequence
  Synthetic Polynucleotide
taatacgactcactataggggtcttcactagataatactgcatcttctccaacagaggagaggagaaatggcagtattaaacctggcggcagcgcaaaagatg

SEQ ID NO: 17523 - DNA, 103 bp, Artificial Sequence
  Synthetic Polynucleotide
taatacgactcactatagggtgtaagtcttcactagataatactgcatctaacagaggagaagatgcatgattatctagaacctggcggcagcgcaaaagatg

SEQ ID NO: 17524 - DNA, 103 bp, Artificial Sequence
  Synthetic Polynucleotide
taatacgactcactatagggtacaagatggcggacaattacgtcatttccaacagaggagaggaaatatggtaattgtcaacctggcggcagcgcaaaagatg

SEQ ID NO: 17525 - DNA, 103 bp, Artificial Sequence
  Synthetic Polynucleotide
taatacgactcactataggggcttgtgtaagtcttcactagataatactgaacagaggagacagtatatgctagtgaagaacctggcggcagcgcaaaagatg

SEQ ID NO: 17526 - DNA, 103 bp, Artificial Sequence
  Synthetic Polynucleotide
taatacgactcactatagggcccaggcttgtgtaagtcttcactagataaaacagaggagattatctatggaagacttaaacctggcggcagcgcaaaagatg

SEQ ID NO: 17527 - DNA, 103 bp, Artificial Sequence
  Synthetic Polynucleotide
taatacgactcactatagggacttgcccaggcttgtgtaagtcttcactaaacagaggagatagtgaatgcttacacaaaacctggcggcagcgcaaaagatg

SEQ ID NO: 17528 - DNA, 103 bp, Artificial Sequence
  Synthetic Polynucleotide
taatacgactcactatagggcgctaacttgcccaggcttgtgtaagtcttaacagaggagaaagactatgacaagcctgaacctggcggcagcgcaaaagatg

SEQ ID NO: 17529 - DNA, 103 bp, Artificial Sequence
  Synthetic Polynucleotide
taatacgactcactatagggttgtacgctaacttgcccaggcttgtgtaaaacagaggagattacacatgcctgggcaaaacctggcggcagcgcaaaagatg

SEQ ID NO: 17530 - DNA, 103 bp, Artificial Sequence
  Synthetic Polynucleotide
taatacgactcactatagggggtagttgtacgctaacttgcccaggcttgaacagaggagacaagccatggcaagttagaacctggcggcagcgcaaaagatg

SEQ ID NO: 17531 - DNA, 103 bp, Artificial Sequence
  Synthetic Polynucleotide
taatacgactcactatagggtaccgggtagttgtacgctaacttgcccagaacagaggagactgggcatgttagcgtacaacctggcggcagcgcaaaagatg

SEQ ID NO: 17532 - DNA, 103 bp, Artificial Sequence
  Synthetic Polynucleotide
taatacgactcactataggggttagtaccgggtagttgtacgctaacttgaacagaggagacaagttatggtacaactaaacctggcggcagcgcaaaagatg

SEQ ID NO: 17533 - DNA, 103 bp, Artificial Sequence
  Synthetic Polynucleotide
taatacgactcactatagggacatagttagtaccgggtagttgtacgctaaacagaggagatagcgtatgactacccggaacctggcggcagcgcaaaagatg

SEQ ID NO: 17534 - DNA, 103 bp, Artificial Sequence
  Synthetic Polynucleotide
taatacgactcactataggggcccaacatagttagtaccgggtagttgtaaacagaggagatacaacatgccggtactaaacctggcggcagcgcaaaagatg

SEQ ID NO: 17535 - DNA, 103 bp, Artificial Sequence
  Synthetic Polynucleotide
taatacgactcactatagggccatcttgtaccggaagtcccgcctaccggaacagaggagaccggtaatggggacttccaacctggcggcagcgcaaaagatg

SEQ ID NO: 17536 - DNA, 103 bp, Artificial Sequence
  Synthetic Polynucleotide
taatacgactcactatagggtccggtacaagatggcggacaattacgtcaaacagaggagatgacgtatgtgtccgccaaacctggcggcagcgcaaaagatg

SEQ ID NO: 17537 - DNA, 103 bp, Artificial Sequence
  Synthetic Polynucleotide
taatacgactcactataggggccaggcccaacatagttagtaccgggtagaacagaggagactacccatgactaactataacctggcggcagcgcaaaagatg

SEQ ID NO: 17538 - DNA, 103 bp, Artificial Sequence
  Synthetic Polynucleotide
taatacgactcactatagggtcattgccaggcccaacatagttagtaccgaacagaggagacggtacatgctatgttggaacctggcggcagcgcaaaagatg

SEQ ID NO: 17539 - DNA, 103 bp, Artificial Sequence
  Synthetic Polynucleotide
taatacgactcactataggggtagctcattgccaggcccaacatagttagaacagaggagactaactatgttgggcctgaacctggcggcagcgcaaaagatg

SEQ ID NO: 17540 - DNA, 103 bp, Artificial Sequence
  Synthetic Polynucleotide
taatacgactcactatagggagcttgtagctcattgccaggcccaacataaacagaggagatatgttatgcctggcaataacctggcggcagcgcaaaagatg

SEQ ID NO: 17541 - DNA, 103 bp, Artificial Sequence
  Synthetic Polynucleotide
taatacgactcactatagggggcccagcttgtagctcattgccaggcccaaacagaggagatgggccatgcaatgagctaacctggcggcagcgcaaaagatg

SEQ ID NO: 17542 - DNA, 103 bp, Artificial Sequence
  Synthetic Polynucleotide
taatacgactcactataggggcgggggcccagcttgtagctcattgccagaacagaggagactggcaatgagctacaagaacctggcggcagcgcaaaagatg

SEQ ID NO: 17543 - DNA, 103 bp, Artificial Sequence
  Synthetic Polynucleotide
taatacgactcactatagggactttgcgggggcccagcttgtagctcattaacagaggagaaatgagatgcaagctgggaacctggcggcagcgcaaaagatg

SEQ ID NO: 17544 - DNA, 103 bp, Artificial Sequence
  Synthetic Polynucleotide
taatacgactcactatagggacagcactttgcgggggcccagcttgtagcaacagaggagagctacaatgtgggcccccaacctggcggcagcgcaaaagatg

SEQ ID NO: 17545 - DNA, 103 bp, Artificial Sequence
  Synthetic Polynucleotide
taatacgactcactatagggtgtcaacagcactttgcgggggcccagcttaacagaggagaaagctgatgccccgcaaaaacctggcggcagcgcaaaagatg

SEQ ID NO: 17546 - DNA, 103 bp, Artificial Sequence
  Synthetic Polynucleotide
taatacgactcactatagggagcactgtcaacagcactttgcgggggcccaacagaggagagggcccatgcaaagtgctaacctggcggcagcgcaaaagatg

SEQ ID NO: 17547 - DNA, 103 bp, Artificial Sequence
  Synthetic Polynucleotide
taatacgactcactatagggggacttccggtacaagatggcggacaattaaacagaggagataattgatggccatcttgaacctggcggcagcgcaaaagatg

SEQ ID NO: 17548 - DNA, 103 bp, Artificial Sequence
  Synthetic Polynucleotide
taatacgactcactatagggcttgcagcactgtcaacagcactttgcgggaacagaggagacccgcaatgtgctgttgaaacctggcggcagcgcaaaagatg

SEQ ID NO: 17549 - DNA, 103 bp, Artificial Sequence
  Synthetic Polynucleotide
taatacgactcactataggggaatccttgcagcactgtcaacagcactttaacagaggagaaaagtgatgttgacagtgaacctggcggcagcgcaaaagatg

SEQ ID NO: 17550 - DNA, 103 bp, Artificial Sequence
  Synthetic Polynucleotide
taatacgactcactataggggtcatgaatccttgcagcactgtcaacagcaacagaggagagctgttatgagtgctgcaaacctggcggcagcgcaaaagatg

SEQ ID NO: 17551 - DNA, 103 bp, Artificial Sequence
  Synthetic Polynucleotide
taatacgactcactatagggctaaagtcatgaatccttgcagcactgtcaaacagaggagatgacagatgtgcaaggataacctggcggcagcgcaaaagatg

SEQ ID NO: 17552 - DNA, 103 bp, Artificial Sequence
  Synthetic Polynucleotide
taatacgactcactatagggtatacctaaagtcatgaatccttgcagcacaacagaggagagtgctgatgggattcatgaacctggcggcagcgcaaaagatg

SEQ ID NO: 17553 - DNA, 103 bp, Artificial Sequence
  Synthetic Polynucleotide
taatacgactcactatagggttggctatacctaaagtcatgaatccttgcaacagaggagagcaaggatgcatgactttaacctggcggcagcgcaaaagatg

SEQ ID NO: 17554 - DNA, 103 bp, Artificial Sequence
  Synthetic Polynucleotide
taatacgactcactataggggccagttggctatacctaaagtcatgaatcaacagaggagagattcaatgctttaggtaaacctggcggcagcgcaaaagatg

SEQ ID NO: 17555 - DNA, 103 bp, Artificial Sequence
  Synthetic Polynucleotide
taatacgactcactatagggacttagccagttggctatacctaaagtcataacagaggagaatgactatgggtatagccaacctggcggcagcgcaaaagatg

SEQ ID NO: 17556 - DNA, 103 bp, Artificial Sequence
  Synthetic Polynucleotide
taatacgactcactatagggtcccaacttagccagttggctatacctaaaaacagaggagatttaggatgagccaactgaacctggcggcagcgcaaaagatg

SEQ ID NO: 17557 - DNA, 103 bp, Artificial Sequence
  Synthetic Polynucleotide
taatacgactcactatagggtttattcccaacttagccagttggctatacaacagaggagagtatagatgactggctaaaacctggcggcagcgcaaaagatg

SEQ ID NO: 17558 - DNA, 103 bp, Artificial Sequence
  Synthetic Polynucleotide
taatacgactcactatagggaggcgggacttccggtacaagatggcggacaacagaggagagtccgcatgcttgtaccgaacctggcggcagcgcaaaagatg

SEQ ID NO: 17559 - DNA, 103 bp, Artificial Sequence
  Synthetic Polynucleotide
taatacgactcactatagggatggatttattcccaacttagccagttggcaacagaggagagccaacatgctaagttggaacctggcggcagcgcaaaagatg

SEQ ID NO: 17560 - DNA, 103 bp, Artificial Sequence
  Synthetic Polynucleotide
taatacgactcactatagggagtatatggatttattcccaacttagccagaacagaggagactggctatgttgggaataaacctggcggcagcgcaaaagatg

SEQ ID NO: 17561 - DNA, 103 bp, Artificial Sequence
  Synthetic Polynucleotide
taatacgactcactatagggcaatgagtatatggatttattcccaacttaaacagaggagataagttatgaataaatccaacctggcggcagcgcaaaagatg

SEQ ID NO: 17562 - DNA, 103 bp, Artificial Sequence
  Synthetic Polynucleotide
taatacgactcactatagggcagtccaatgagtatatggatttattcccaaacagaggagatgggaaatgatccatataaacctggcggcagcgcaaaagatg

SEQ ID NO: 17563 - DNA, 103 bp, Artificial Sequence
  Synthetic Polynucleotide
taatacgactcactatagggtgctacagtccaatgagtatatggatttataacagaggagaataaatatgtatactcataacctggcggcagcgcaaaagatg

SEQ ID NO: 17564 - DNA, 103 bp, Artificial Sequence
  Synthetic Polynucleotide
taatacgactcactatagggtcatctgctacagtccaatgagtatatggaaacagaggagatccataatgtcattggacaacctggcggcagcgcaaaagatg

SEQ ID NO: 17565 - DNA, 103 bp, Artificial Sequence
  Synthetic Polynucleotide
taatacgactcactataggggctcttcatctgctacagtccaatgagtataacagaggagaatactcatgggactgtagaacctggcggcagcgcaaaagatg

SEQ ID NO: 17566 - DNA, 103 bp, Artificial Sequence
  Synthetic Polynucleotide
taatacgactcactatagggtaaaagctcttcatctgctacagtccaatgaacagaggagacattggatggtagcagataacctggcggcagcgcaaaagatg

SEQ ID NO: 17567 - DNA, 103 bp, Artificial Sequence
  Synthetic Polynucleotide
taatacgactcactatagggttttttaaaagctcttcatctgctacagtcaacagaggagagactgtatgagatgaagaaacctggcggcagcgcaaaagatg

SEQ ID NO: 17568 - DNA, 103 bp, Artificial Sequence
  Synthetic Polynucleotide
taatacgactcactatagggttatattttttaaaagctcttcatctgctaaacagaggagatagcagatgaagagctttaacctggcggcagcgcaaaagatg

SEQ ID NO: 17569 - DNA, 103 bp, Artificial Sequence
  Synthetic Polynucleotide
taatacgactcactatagggccggtaggcgggacttccggtacaagatggaacagaggagaccatctatgaccggaagtaacctggcggcagcgcaaaagatg

SEQ ID NO: 17570 - DNA, 103 bp, Artificial Sequence
  Synthetic Polynucleotide
taatacgactcactatagggattttttatattttttaaaagctcttcatcaacagaggagagatgaaatgcttttaaaaaacctggcggcagcgcaaaagatg

SEQ ID NO: 17571 - DNA, 103 bp, Artificial Sequence
  Synthetic Polynucleotide
taatacgactcactataggggtttcattttttatattttttaaaagctctaacagaggagaagagctatgaaaaaatataacctggcggcagcgcaaaagatg

SEQ ID NO: 17572 - DNA, 103 bp, Artificial Sequence
  Synthetic Polynucleotide
taatacgactcactatagggacccagtttcattttttatattttttaaaaaacagaggagattttaaatgatataaaaaaacctggcggcagcgcaaaagatg

SEQ ID NO: 17573 - DNA, 103 bp, Artificial Sequence
  Synthetic Polynucleotide
taatacgactcactatagggttgaaacccagtttcattttttatatttttaacagaggagaaaaaatatgaaaaatgaaaacctggcggcagcgcaaaagatg

SEQ ID NO: 17574 - DNA, 103 bp, Artificial Sequence
  Synthetic Polynucleotide
taatacgactcactatagggtgtgcttgaaacccagtttcattttttataaacagaggagatataaaatgtgaaactggaacctggcggcagcgcaaaagatg

SEQ ID NO: 17575 - DNA, 103 bp, Artificial Sequence
  Synthetic Polynucleotide
taatacgactcactatagggctacttgtgcttgaaacccagtttcattttaacagaggagaaaaatgatgctgggtttcaacctggcggcagcgcaaaagatg

SEQ ID NO: 17576 - DNA, 103 bp, Artificial Sequence
  Synthetic Polynucleotide
taatacgactcactatagggttttactacttgtgcttgaaacccagtttcaacagaggagagaaactatgtttcaagcaaacctggcggcagcgcaaaagatg

SEQ ID NO: 17577 - DNA, 103 bp, Artificial Sequence
  Synthetic Polynucleotide
taatacgactcactatagggtagtcttttactacttgtgcttgaaacccaaacagaggagatgggttatgagcacaagtaacctggcggcagcgcaaaagatg

SEQ ID NO: 17578 - DNA, 103 bp, Artificial Sequence
  Synthetic Polynucleotide
taatacgactcactatagggtaaagtagtcttttactacttgtgcttgaaaacagaggagattcaagatgaagtagtaaaacctggcggcagcgcaaaagatg

SEQ ID NO: 17579 - DNA, 103 bp, Artificial Sequence
  Synthetic Polynucleotide
taatacgactcactatagggtaaagtaaagtagtcttttactacttgtgcaacagaggagagcacaaatggtaaaagacaacctggcggcagcgcaaaagatg

SEQ ID NO: 17580 - DNA, 103 bp, Artificial Sequence
  Synthetic Polynucleotide
taatacgactcactatagggcgccgccggtaggcgggacttccggtacaaaacagaggagattgtacatgaagtcccgcaacctggcggcagcgcaaaagatg

SEQ ID NO: 17581 - DNA, 103 bp, Artificial Sequence
  Synthetic Polynucleotide
taatacgactcactatagggccttttaaagtaaagtagtcttttactactaacagaggagaagtagtatgagactacttaacctggcggcagcgcaaaagatg

SEQ ID NO: 17582 - DNA, 103 bp, Artificial Sequence
  Synthetic Polynucleotide
taatacgactcactatagggctgcaccttttaaagtaaagtagtcttttaaacagaggagataaaagatgactttacttaacctggcggcagcgcaaaagatg

SEQ ID NO: 17583 - DNA, 103 bp, Artificial Sequence
  Synthetic Polynucleotide
taatacgactcactatagggggcagctgcaccttttaaagtaaagtagtcaacagaggagagactacatgactttaaaaaacctggcggcagcgcaaaagatg

SEQ ID NO: 17584 - DNA, 103 bp, Artificial Sequence
  Synthetic Polynucleotide
taatacgactcactatagggacaggggcagctgcaccttttaaagtaaagaacagaggagactttacatgaaaaggtgcaacctggcggcagcgcaaaagatg

SEQ ID NO: 17585 - DNA, 103 bp, Artificial Sequence
  Synthetic Polynucleotide
taatacgactcactataggggggccacaggggcagctgcaccttttaaagaacagaggagactttaaatggtgcagctgaacctggcggcagcgcaaaagatg

SEQ ID NO: 17586 - DNA, 103 bp, Artificial Sequence
  Synthetic Polynucleotide
taatacgactcactatagggaaaatgggccacaggggcagctgcacctttaacagaggagaaaaggtatggctgcccctaacctggcggcagcgcaaaagatg

SEQ ID NO: 17587 - DNA, 103 bp, Artificial Sequence
  Synthetic Polynucleotide
taatacgactcactatagggccttgaaaatgggccacaggggcagctgcaaacagaggagatgcagcatgccctgtggcaacctggcggcagcgcaaaagatg

SEQ ID NO: 17588 - DNA, 103 bp, Artificial Sequence
  Synthetic Polynucleotide
taatacgactcactatagggaacttccttgaaaatgggccacaggggcagaacagaggagactgcccatgtggcccattaacctggcggcagcgcaaaagatg

SEQ ID NO: 17589 - DNA, 103 bp, Artificial Sequence
  Synthetic Polynucleotide
taatacgactcactatagggcggcaaacttccttgaaaatgggccacaggaacagaggagacctgtgatgcattttcaaaacctggcggcagcgcaaaagatg

SEQ ID NO: 17590 - DNA, 103 bp, Artificial Sequence
  Synthetic Polynucleotide
taatacgactcactatagggacttccggcaaacttccttgaaaatgggccaacagaggagaggcccaatgtcaaggaagaacctggcggcagcgcaaaagatg

SEQ ID NO: 17591 - DNA, 103 bp, Artificial Sequence
  Synthetic Polynucleotide
taatacgactcactatagggccggtcgccgccggtaggcgggacttccggaacagaggagaccggaaatgccgcctaccaacctggcggcagcgcaaaagatg

SEQ ID NO: 17592 - DNA, 103 bp, Artificial Sequence
  Synthetic Polynucleotide
taatacgactcactatagggcgggaacttccggcaaacttccttgaaaataacagaggagaattttcatggaagtttgcaacctggcggcagcgcaaaagatg

SEQ ID NO: 17593 - DNA, 103 bp, Artificial Sequence
  Synthetic Polynucleotide
taatacgactcactataggggtaagcgggaacttccggcaaacttccttgaacagaggagacaaggaatgttgccggaaaacctggcggcagcgcaaaagatg

SEQ ID NO: 17594 - DNA, 103 bp, Artificial Sequence
  Synthetic Polynucleotide
taatacgactcactataggggcgttgtaagcgggaacttccggcaaacttaacagaggagaaagtttatgggaagttccaacctggcggcagcgcaaaagatg

SEQ ID NO: 17595 - DNA, 103 bp, Artificial Sequence
  Synthetic Polynucleotide
taatacgactcactatagggctgaggcgttgtaagcgggaacttccggcaaacagaggagatgccggatgttcccgcttaacctggcggcagcgcaaaagatg

SEQ ID NO: 17596 - DNA, 103 bp, Artificial Sequence
  Synthetic Polynucleotide
taatacgactcactatagggtttttctgaggcgttgtaagcgggaacttcaacagaggagagaagttatggcttacaacaacctggcggcagcgcaaaagatg

SEQ ID NO: 17597 - DNA, 103 bp, Artificial Sequence
  Synthetic Polynucleotide
taatacgactcactataggggggtatttttctgaggcgttgtaagcgggaaacagaggagatcccgcatgcaacgcctcaacctggcggcagcgcaaaagatg

SEQ ID NO: 17598 - DNA, 103 bp, Artificial Sequence
  Synthetic Polynucleotide
taatacgactcactatagggtgcttgggtatttttctgaggcgttgtaagaacagaggagacttacaatgcctcagaaaaacctggcggcagcgcaaaagatg

SEQ ID NO: 17599 - DNA, 103 bp, Artificial Sequence
  Synthetic Polynucleotide
taatacgactcactatagggagtcatgcttgggtatttttctgaggcgttaacagaggagaaacgccatggaaaaatacaacctggcggcagcgcaaaagatg

SEQ ID NO: 17600 - DNA, 103 bp, Artificial Sequence
  Synthetic Polynucleotide
taatacgactcactatagggactgaagtcatgcttgggtatttttctgagaacagaggagactcagaatgatacccaagaacctggcggcagcgcaaaagatg

SEQ ID NO: 17601 - DNA, 103 bp, Artificial Sequence
  Synthetic Polynucleotide
taatacgactcactatagggaattaactgaagtcatgcttgggtatttttaacagaggagaaaaaatatgcaagcatgaaacctggcggcagcgcaaaagatg

SEQ ID NO: 17602 - DNA, 103 bp, Artificial Sequence
  Synthetic Polynucleotide
taatacgactcactatagggtgccgccggtcgccgccggtaggcgggactaacagaggagaagtcccatgtaccggcggaacctggcggcagcgcaaaagatg

SEQ ID NO: 17603 - DNA, 103 bp, Artificial Sequence
  Synthetic Polynucleotide
taatacgactcactatagggtgcagaattaactgaagtcatgcttgggtaaacagaggagatacccaatgatgacttcaaacctggcggcagcgcaaaagatg

SEQ ID NO: 17604 - DNA, 103 bp, Artificial Sequence
  Synthetic Polynucleotide
taatacgactcactataggggcttctgcagaattaactgaagtcatgcttaacagaggagaaagcatatgttcagttaaaacctggcggcagcgcaaaagatg

SEQ ID NO: 17605 - DNA, 103 bp, Artificial Sequence
  Synthetic Polynucleotide
taatacgactcactatagggtgctggcttctgcagaattaactgaagtcaaacagaggagatgacttatgttaattctgaacctggcggcagcgcaaaagatg

SEQ ID NO: 17606 - DNA, 103 bp, Artificial Sequence
  Synthetic Polynucleotide
taatacgactcactatagggaccagtgctggcttctgcagaattaactgaaacagaggagatcagttatgtctgcagaaaacctggcggcagcgcaaaagatg

SEQ ID NO: 17607 - DNA, 103 bp, Artificial Sequence
  Synthetic Polynucleotide
taatacgactcactatagggcctgcaccagtgctggcttctgcagaattaaacagaggagataattcatgagaagccagaacctggcggcagcgcaaaagatg

SEQ ID NO: 17608 - DNA, 103 bp, Artificial Sequence
  Synthetic Polynucleotide
taatacgactcactatagggcccctcctgcaccagtgctggcttctgcagaacagaggagactgcagatgccagcactgaacctggcggcagcgcaaaagatg

SEQ ID NO: 17609 - DNA, 103 bp, Artificial Sequence
  Synthetic Polynucleotide
taatacgactcactataggggcccccccctcctgcaccagtgctggcttcaacagaggagagaagccatgactggtgcaaacctggcggcagcgcaaaagatg

SEQ ID NO: 17610 - DNA, 103 bp, Artificial Sequence
  Synthetic Polynucleotide
taatacgactcactatagggttactgcccccccctcctgcaccagtgctgaacagaggagacagcacatgtgcaggaggaacctggcggcagcgcaaaagatg

SEQ ID NO: 17611 - DNA, 103 bp, Artificial Sequence
  Synthetic Polynucleotide
taatacgactcactatagggcaggattactgcccccccctcctgcaccagaacagaggagactggtgatggagggggggaacctggcggcagcgcaaaagatg

SEQ ID NO: 17612 - DNA, 103 bp, Artificial Sequence
  Synthetic Polynucleotide
taatacgactcactatagggtttgacaggattactgcccccccctcctgcaacagaggagagcaggaatggggggcagtaacctggcggcagcgcaaaagatg

SEQ ID NO: 17613 - DNA, 103 bp, Artificial Sequence
  Synthetic Polynucleotide
taatacgactcactatagggtcagatgccgccggtcgccgccggtaggcgaacagaggagacgcctaatggcggcgaccaacctggcggcagcgcaaaagatg

SEQ ID NO: 17614 - DNA, 103 bp, Artificial Sequence
  Synthetic Polynucleotide
taatacgactcactatagggatgcttttgacaggattactgcccccccctaacagaggagaagggggatgcagtaatccaacctggcggcagcgcaaaagatg

SEQ ID NO: 17615 - DNA, 103 bp, Artificial Sequence
  Synthetic Polynucleotide
taatacgactcactatagggtccacatgcttttgacaggattactgccccaacagaggagaggggcaatgatcctgtcaaacctggcggcagcgcaaaagatg

SEQ ID NO: 17616 - DNA, 103 bp, Artificial Sequence
  Synthetic Polynucleotide
taatacgactcactatagggctcactccacatgcttttgacaggattactaacagaggagaagtaatatggtcaaaagcaacctggcggcagcgcaaaagatg

SEQ ID NO: 17617 - DNA, 103 bp, Artificial Sequence
  Synthetic Polynucleotide
taatacgactcactataggggccccctcactccacatgcttttgacaggaaacagaggagatcctgtatgaagcatgtgaacctggcggcagcgcaaaagatg

SEQ ID NO: 17618 - DNA, 103 bp, Artificial Sequence
  Synthetic Polynucleotide
taatacgactcactatagggaagtggccccctcactccacatgcttttgaaacagaggagatcaaaaatgtgtggagtgaacctggcggcagcgcaaaagatg

SEQ ID NO: 17619 - DNA, 103 bp, Artificial Sequence
  Synthetic Polynucleotide
taatacgactcactatagggactaaaagtggccccctcactccacatgctaacagaggagaagcatgatgagtgaggggaacctggcggcagcgcaaaagatg

SEQ ID NO: 17620 - DNA, 103 bp, Artificial Sequence
  Synthetic Polynucleotide
taatacgactcactatagggttggcactaaaagtggccccctcactccacaacagaggagagtggagatggggggccacaacctggcggcagcgcaaaagatg

SEQ ID NO: 17621 - DNA, 103 bp, Artificial Sequence
  Synthetic Polynucleotide
taatacgactcactatagggcagagttggcactaaaagtggccccctcacaacagaggagagtgaggatgccacttttaaacctggcggcagcgcaaaagatg

SEQ ID NO: 17622 - DNA, 103 bp, Artificial Sequence
  Synthetic Polynucleotide
taatacgactcactatagggagtcacagagttggcactaaaagtggccccaacagaggagaggggccatgtttagtgccaacctggcggcagcgcaaaagatg

SEQ ID NO: 17623 - DNA, 103 bp, Artificial Sequence
  Synthetic Polynucleotide
taatacgactcactataggggtacaagtcacagagttggcactaaaagtgaacagaggagacactttatgtgccaactcaacctggcggcagcgcaaaagatg

SEQ ID NO: 17624 - DNA, 103 bp, Artificial Sequence
  Synthetic Polynucleotide
taatacgactcactatagggccaaatcagatgccgccggtcgccgccggtaacagaggagaaccggcatggaccggcggaacctggcggcagcgcaaaagatg

SEQ ID NO: 17625 - DNA, 103 bp, Artificial Sequence
  Synthetic Polynucleotide
taatacgactcactatagggaaaatgtacaagtcacagagttggcactaaaacagaggagattagtgatgactctgtgaaacctggcggcagcgcaaaagatg

SEQ ID NO: 17626 - DNA, 103 bp, Artificial Sequence
  Synthetic Polynucleotide
taatacgactcactatagggtctagaaaatgtacaagtcacagagttggcaacagaggagagccaacatggtgacttgtaacctggcggcagcgcaaaagatg

SEQ ID NO: 17627 - DNA, 103 bp, Artificial Sequence
  Synthetic Polynucleotide
taatacgactcactatagggaactgtctagaaaatgtacaagtcacagagaacagaggagactctgtatgttgtacattaacctggcggcagcgcaaaagatg

SEQ ID NO: 17628 - DNA, 103 bp, Artificial Sequence
  Synthetic Polynucleotide
taatacgactcactatagggttaaaaactgtctagaaaatgtacaagtcaaacagaggagatgacttatgcattttctaaacctggcggcagcgcaaaagatg

SEQ ID NO: 17629 - DNA, 103 bp, Artificial Sequence
  Synthetic Polynucleotide
taatacgactcactatagggtggaattaaaaactgtctagaaaatgtacaaacagaggagatgtacaatgtctagacagaacctggcggcagcgcaaaagatg

SEQ ID NO: 17630 - DNA, 103 bp, Artificial Sequence
  Synthetic Polynucleotide
taatacgactcactatagggtcatatggaattaaaaactgtctagaaaataacagaggagaattttcatgacagtttttaacctggcggcagcgcaaaagatg

SEQ ID NO: 17631 - DNA, 103 bp, Artificial Sequence
  Synthetic Polynucleotide
taatacgactcactatagggctgggtcatatggaattaaaaactgtctagaacagaggagactagacatgttttaattcaacctggcggcagcgcaaaagatg

SEQ ID NO: 17632 - DNA, 103 bp, Artificial Sequence
  Synthetic Polynucleotide
taatacgactcactataggggtgctctgggtcatatggaattaaaaactgaacagaggagacagtttatgattccatataacctggcggcagcgcaaaagatg

SEQ ID NO: 17633 - DNA, 103 bp, Artificial Sequence
  Synthetic Polynucleotide
taatacgactcactatagggtaatggtgctctgggtcatatggaattaaaaacagaggagatttaatatgatatgacccaacctggcggcagcgcaaaagatg

SEQ ID NO: 17634 - DNA, 103 bp, Artificial Sequence
  Synthetic Polynucleotide
taatacgactcactatagggccttataatggtgctctgggtcatatggaaaacagaggagattccatatgacccagagcaacctggcggcagcgcaaaagatg

SEQ ID NO: 17635 - DNA, 103 bp, Artificial Sequence
  Synthetic Polynucleotide
taatacgactcactatagggagacaccaaatcagatgccgccggtcgccgaacagaggagacggcgaatggcggcatctaacctggcggcagcgcaaaagatg

SEQ ID NO: 17636 - DNA, 103 bp, Artificial Sequence
  Synthetic Polynucleotide
taatacgactcactatagggaaacaccttataatggtgctctgggtcataaacagaggagatatgacatggagcaccataacctggcggcagcgcaaaagatg

SEQ ID NO: 17637 - DNA, 103 bp, Artificial Sequence
  Synthetic Polynucleotide
taatacgactcactatagggggagaaaacaccttataatggtgctctgggaacagaggagacccagaatgccattataaaacctggcggcagcgcaaaagatg

SEQ ID NO: 17638 - DNA, 103 bp, Artificial Sequence
  Synthetic Polynucleotide
taatacgactcactatagggctgcgggagaaaacaccttataatggtgctaacagaggagaagcaccatgataaggtgtaacctggcggcagcgcaaaagatg

SEQ ID NO: 17639 - DNA, 103 bp, Artificial Sequence
  Synthetic Polynucleotide
taatacgactcactatagggacttgctgcgggagaaaacaccttataatgaacagaggagacattatatggtgttttctaacctggcggcagcgcaaaagatg

SEQ ID NO: 17640 - DNA, 103 bp, Artificial Sequence
  Synthetic Polynucleotide
taatacgactcactatagggcagctacttgctgcgggagaaaacaccttaaacagaggagataaggtatgttctcccgcaacctggcggcagcgcaaaagatg

SEQ ID NO: 17641 - DNA, 103 bp, Artificial Sequence
  Synthetic Polynucleotide
taatacgactcactatagggtgtggcagctacttgctgcgggagaaaacaaacagaggagatgttttatgccgcagcaaaacctggcggcagcgcaaaagatg

SEQ ID NO: 17642 - DNA, 103 bp, Artificial Sequence
  Synthetic Polynucleotide
taatacgactcactatagggggcattgtggcagctacttgctgcgggagaaacagaggagatctcccatggcaagtagcaacctggcggcagcgcaaaagatg

SEQ ID NO: 17643 - DNA, 103 bp, Artificial Sequence
  Synthetic Polynucleotide
taatacgactcactatagggccactggcattgtggcagctacttgctgcgaacagaggagacgcagcatgtagctgccaaacctggcggcagcgcaaaagatg

SEQ ID NO: 17644 - DNA, 103 bp, Artificial Sequence
  Synthetic Polynucleotide
taatacgactcactatagggcctttccactggcattgtggcagctacttgaacagaggagacaagtaatggccacaatgaacctggcggcagcgcaaaagatg

SEQ ID NO: 17645 - DNA, 103 bp, Artificial Sequence
  Synthetic Polynucleotide
taatacgactcactatagggtgcctcctttccactggcattgtggcagctaacagaggagaagctgcatgaatgccagtaacctggcggcagcgcaaaagatg

SEQ ID NO: 17646 - DNA, 103 bp, Artificial Sequence
  Synthetic Polynucleotide
taatacgactcactataggggtccgccatcttgtaccggaagtcccgcctaacagaggagaaggcggatgttccggtacaacctggcggcagcgcaaaagatg

SEQ ID NO: 17647 - DNA, 103 bp, Artificial Sequence
  Synthetic Polynucleotide
taatacgactcactatagggaaagaagacaccaaatcagatgccgccggtaacagaggagaaccggcatgatctgatttaacctggcggcagcgcaaaagatg

SEQ ID NO: 17648 - DNA, 103 bp, Artificial Sequence
  Synthetic Polynucleotide
taatacgactcactatagggacctttgcctcctttccactggcattgtggaacagaggagaccacaaatgcagtggaaaaacctggcggcagcgcaaaagatg

SEQ ID NO: 17649 - DNA, 103 bp, Artificial Sequence
  Synthetic Polynucleotide
taatacgactcactatagggtgcaaacctttgcctcctttccactggcataacagaggagaatgccaatggaaaggaggaacctggcggcagcgcaaaagatg

SEQ ID NO: 17650 - DNA, 103 bp, Artificial Sequence
  Synthetic Polynucleotide
taatacgactcactatagggaatggtgcaaacctttgcctcctttccactaacagaggagaagtggaatggaggcaaagaacctggcggcagcgcaaaagatg

SEQ ID NO: 17651 - DNA, 103 bp, Artificial Sequence
  Synthetic Polynucleotide
taatacgactcactatagggggactaatggtgcaaacctttgcctcctttaacagaggagaaaaggaatgaaaggtttgaacctggcggcagcgcaaaagatg

SEQ ID NO: 17652 - DNA, 103 bp, Artificial Sequence
  Synthetic Polynucleotide
taatacgactcactatagggttatgggactaatggtgcaaacctttgcctaacagaggagaaggcaaatgtttgcaccaaacctggcggcagcgcaaaagatg

SEQ ID NO: 17653 - DNA, 103 bp, Artificial Sequence
  Synthetic Polynucleotide
taatacgactcactatagggtcccattatgggactaatggtgcaaaccttaacagaggagaaaggttatgaccattagtaacctggcggcagcgcaaaagatg

SEQ ID NO: 17654 - DNA, 103 bp, Artificial Sequence
  Synthetic Polynucleotide
taatacgactcactataggggagtatcccattatgggactaatggtgcaaaacagaggagattgcacatgtagtcccataacctggcggcagcgcaaaagatg

SEQ ID NO: 17655 - DNA, 103 bp, Artificial Sequence
  Synthetic Polynucleotide
taatacgactcactataggggggttgagtatcccattatgggactaatggaacagaggagaccattaatgccataatggaacctggcggcagcgcaaaagatg

SEQ ID NO: 17656 - DNA, 103 bp, Artificial Sequence
  Synthetic Polynucleotide
taatacgactcactatagggccatggggttgagtatcccattatgggactaacagaggagaagtcccatgatgggatacaacctggcggcagcgcaaaagatg

SEQ ID NO: 17657 - DNA, 103 bp, Artificial Sequence
  Synthetic Polynucleotide
taatacgactcactatagggtatctccatggggttgagtatcccattatgaacagaggagacataatatgatactcaacaacctggcggcagcgcaaaagatg

SEQ ID NO: 17658 - DNA, 103 bp, Artificial Sequence
  Synthetic Polynucleotide
taatacgactcactatagggatttaaaagaagacaccaaatcagatgccgaacagaggagacggcatatgatttggtgtaacctggcggcagcgcaaaagatg

SEQ ID NO: 17659 - DNA, 103 bp, Artificial Sequence
  Synthetic Polynucleotide
taatacgactcactatagggctaaatatctccatggggttgagtatcccaaacagaggagatgggatatgcaaccccataacctggcggcagcgcaaaagatg

SEQ ID NO: 17660 - DNA, 103 bp, Artificial Sequence
  Synthetic Polynucleotide
taatacgactcactatagggaaaatctaaatatctccatggggttgagtaaacagaggagatactcaatgccatggagaaacctggcggcagcgcaaaagatg

SEQ ID NO: 17661 - DNA, 103 bp, Artificial Sequence
  Synthetic Polynucleotide
taatacgactcactataggggcattaaaatctaaatatctccatggggttaacagaggagaaaccccatggagatatttaacctggcggcagcgcaaaagatg

SEQ ID NO: 17662 - DNA, 103 bp, Artificial Sequence
  Synthetic Polynucleotide
taatacgactcactatagggttaaagcattaaaatctaaatatctccatgaacagaggagacatggaatgatttagattaacctggcggcagcgcaaaagatg

SEQ ID NO: 17663 - DNA, 103 bp, Artificial Sequence
  Synthetic Polynucleotide
taatacgactcactatagggtaagtttaaagcattaaaatctaaatatctaacagaggagaagatatatggattttaataacctggcggcagcgcaaaagatg

SEQ ID NO: 17664 - DNA, 103 bp, Artificial Sequence
  Synthetic Polynucleotide
taatacgactcactatagggaaaaataagtttaaagcattaaaatctaaaaacagaggagatttagaatgtaatgctttaacctggcggcagcgcaaaagatg

SEQ ID NO: 17665 - DNA, 103 bp, Artificial Sequence
  Synthetic Polynucleotide
taatacgactcactataggggtgaaaaaaataagtttaaagcattaaaataacagaggagaattttaatgctttaaactaacctggcggcagcgcaaaagatg

SEQ ID NO: 17666 - DNA, 103 bp, Artificial Sequence
  Synthetic Polynucleotide
taatacgactcactatagggtaaaggtgaaaaaaataagtttaaagcattaacagaggagaaatgctatgaacttatttaacctggcggcagcgcaaaagatg

SEQ ID NO: 17667 - DNA, 103 bp, Artificial Sequence
  Synthetic Polynucleotide
taatacgactcactatagggaactctaaaggtgaaaaaaataagtttaaaaacagaggagatttaaaatgatttttttcaacctggcggcagcgcaaaagatg

SEQ ID NO: 17668 - DNA, 103 bp, Artificial Sequence
  Synthetic Polynucleotide
taatacgactcactataggggctgaaactctaaaggtgaaaaaaataagtaacagaggagaacttatatgtttcaccttaacctggcggcagcgcaaaagatg

SEQ ID NO: 17669 - DNA, 103 bp, Artificial Sequence
  Synthetic Polynucleotide
taatacgactcactatagggctaaaatttaaaagaagacaccaaatcagaaacagaggagatctgatatggtgtcttctaacctggcggcagcgcaaaagatg

SEQ ID NO: 17670 - DNA, 103 bp, Artificial Sequence
  Synthetic Polynucleotide
taatacgactcactatagggtaagtgctgaaactctaaaggtgaaaaaaaaacagaggagattttttatgcctttagagaacctggcggcagcgcaaaagatg

SEQ ID NO: 17671 - DNA, 103 bp, Artificial Sequence
  Synthetic Polynucleotide
taatacgactcactatagggtcaattaagtgctgaaactctaaaggtgaaaacagaggagattcaccatgagagtttcaaacctggcggcagcgcaaaagatg

SEQ ID NO: 17672 - DNA, 103 bp, Artificial Sequence
  Synthetic Polynucleotide
taatacgactcactatagggaattttcaattaagtgctgaaactctaaagaacagaggagactttagatgttcagcactaacctggcggcagcgcaaaagatg

SEQ ID NO: 17673 - DNA, 103 bp, Artificial Sequence
  Synthetic Polynucleotide
taatacgactcactatagggtccataattttcaattaagtgctgaaactcaacagaggagagagtttatgcacttaattaacctggcggcagcgcaaaagatg

SEQ ID NO: 17674 - DNA, 103 bp, Artificial Sequence
  Synthetic Polynucleotide
taatacgactcactatagggatacttccataattttcaattaagtgctgaaacagaggagatcagcaatgaattgaaaaaacctggcggcagcgcaaaagatg

SEQ ID NO: 17675 - DNA, 103 bp, Artificial Sequence
  Synthetic Polynucleotide
taatacgactcactataggggagctatacttccataattttcaattaagtaacagaggagaacttaaatgaaaattatgaacctggcggcagcgcaaaagatg

SEQ ID NO: 17676 - DNA, 103 bp, Artificial Sequence
  Synthetic Polynucleotide
taatacgactcactatagggatcaggagctatacttccataattttcaataacagaggagaattgaaatgtatggaagtaacctggcggcagcgcaaaagatg

SEQ ID NO: 17677 - DNA, 103 bp, Artificial Sequence
  Synthetic Polynucleotide
taatacgactcactatagggaaagcatcaggagctatacttccataatttaacagaggagaaaattaatgaagtatagcaacctggcggcagcgcaaaagatg

SEQ ID NO: 17678 - DNA, 103 bp, Artificial Sequence
  Synthetic Polynucleotide
taatacgactcactatagggcagttaaagcatcaggagctatacttccataacagaggagaatggaaatgtagctcctgaacctggcggcagcgcaaaagatg

SEQ ID NO: 17679 - DNA, 103 bp, Artificial Sequence
  Synthetic Polynucleotide
taatacgactcactatagggggttacagttaaagcatcaggagctatactaacagaggagaagtataatgcctgatgctaacctggcggcagcgcaaaagatg

SEQ ID NO: 17680 - DNA, 103 bp, Artificial Sequence
  Synthetic Polynucleotide
taatacgactcactataggggcccgctaaaatttaaaagaagacaccaaaaacagaggagatttggtatgttcttttaaaacctggcggcagcgcaaaagatg

SEQ ID NO: 17681 - DNA, 103 bp, Artificial Sequence
  Synthetic Polynucleotide
taatacgactcactataggggatatggttacagttaaagcatcaggagctaacagaggagaagctccatgtgctttaacaacctggcggcagcgcaaaagatg

SEQ ID NO: 17682 - DNA, 103 bp, Artificial Sequence
  Synthetic Polynucleotide
taatacgactcactatagggtttctgatatggttacagttaaagcatcagaacagaggagactgatgatgtaactgtaaaacctggcggcagcgcaaaagatg

SEQ ID NO: 17683 - DNA, 103 bp, Artificial Sequence
  Synthetic Polynucleotide
taatacgactcactatagggagcaatttctgatatggttacagttaaagcaacagaggagagctttaatggtaaccataaacctggcggcagcgcaaaagatg

SEQ ID NO: 17684 - DNA, 103 bp, Artificial Sequence
  Synthetic Polynucleotide
taatacgactcactatagggttaacagcaatttctgatatggttacagttaacagaggagaaactgtatgcatatcagaaacctggcggcagcgcaaaagatg

SEQ ID NO: 17685 - DNA, 103 bp, Artificial Sequence
  Synthetic Polynucleotide
taatacgactcactatagggcatccttaacagcaatttctgatatggttaaacagaggagataaccaatgcagaaattgaacctggcggcagcgcaaaagatg

SEQ ID NO: 17686 - DNA, 103 bp, Artificial Sequence
  Synthetic Polynucleotide
taatacgactcactatagggtgtaacatccttaacagcaatttctgatataacagaggagaatatcaatgattgctgttaacctggcggcagcgcaaaagatg

SEQ ID NO: 17687 - DNA, 103 bp, Artificial Sequence
  Synthetic Polynucleotide
taatacgactcactatagggttgtctgtaacatccttaacagcaatttctaacagaggagaagaaatatgtgttaaggaaacctggcggcagcgcaaaagatg

SEQ ID NO: 17688 - DNA, 103 bp, Artificial Sequence
  Synthetic Polynucleotide
taatacgactcactatagggcagttttgtctgtaacatccttaacagcaaaacagaggagattgctgatgaggatgttaaacctggcggcagcgcaaaagatg

SEQ ID NO: 17689 - DNA, 103 bp, Artificial Sequence
  Synthetic Polynucleotide
taatacgactcactatagggccctccagttttgtctgtaacatccttaacaacagaggagagttaagatggttacagacaacctggcggcagcgcaaaagatg

SEQ ID NO: 17690 - DNA, 103 bp, Artificial Sequence
  Synthetic Polynucleotide
taatacgactcactatagggaccccccctccagttttgtctgtaacatccaacagaggagaggatgtatgagacaaaacaacctggcggcagcgcaaaagatg

SEQ ID NO: 17691 - DNA, 103 bp, Artificial Sequence
  Synthetic Polynucleotide
taatacgactcactatagggaaaaagcccgctaaaatttaaaagaagacaaacagaggagatgtcttatgttaaattttaacctggcggcagcgcaaaagatg

SEQ ID NO: 17692 - DNA, 103 bp, Artificial Sequence
  Synthetic Polynucleotide
taatacgactcactatagggcctgcaccccccctccagttttgtctgtaaaacagaggagattacagatgaaactggagaacctggcggcagcgcaaaagatg

SEQ ID NO: 17693 - DNA, 103 bp, Artificial Sequence
  Synthetic Polynucleotide
taatacgactcactatagggagtaacctgcaccccccctccagttttgtcaacagaggagagacaaaatgggaggggggaacctggcggcagcgcaaaagatg

SEQ ID NO: 17694 - DNA, 103 bp, Artificial Sequence
  Synthetic Polynucleotide
taatacgactcactatagggctgtcagtaacctgcaccccccctccagttaacagaggagaaactggatggggggtgcaaacctggcggcagcgcaaaagatg

SEQ ID NO: 17695 - DNA, 103 bp, Artificial Sequence
  Synthetic Polynucleotide
taatacgactcactatagggtagtgctgtcagtaacctgcaccccccctcaacagaggagagaggggatgtgcaggttaaacctggcggcagcgcaaaagatg

SEQ ID NO: 17696 - DNA, 103 bp, Artificial Sequence
  Synthetic Polynucleotide
taatacgactcactatagggccctgtagtgctgtcagtaacctgcaccccaacagaggagaggggtgatggttactgacaacctggcggcagcgcaaaagatg

SEQ ID NO: 17697 - DNA, 103 bp, Artificial Sequence
  Synthetic Polynucleotide
taatacgactcactatagggaggcgccctgtagtgctgtcagtaacctgcaacagaggagagcaggtatgtgacagcacaacctggcggcagcgcaaaagatg

SEQ ID NO: 17698 - DNA, 103 bp, Artificial Sequence
  Synthetic Polynucleotide
taatacgactcactatagggtgcataggcgccctgtagtgctgtcagtaaaacagaggagattactgatggcactacagaacctggcggcagcgcaaaagatg

SEQ ID NO: 17699 - DNA, 103 bp, Artificial Sequence
  Synthetic Polynucleotide
taatacgactcactatagggtaacatgcataggcgccctgtagtgctgtcaacagaggagagacagcatgacagggcgcaacctggcggcagcgcaaaagatg

SEQ ID NO: 17700 - DNA, 103 bp, Artificial Sequence
  Synthetic Polynucleotide
taatacgactcactatagggtctactaacatgcataggcgccctgtagtgaacagaggagacactacatggcgcctatgaacctggcggcagcgcaaaagatg

SEQ ID NO: 17701 - DNA, 103 bp, Artificial Sequence
  Synthetic Polynucleotide
taatacgactcactatagggcatggtctactaacatgcataggcgccctgaacagaggagacagggcatgtatgcatgtaacctggcggcagcgcaaaagatg

SEQ ID NO: 17702 - DNA, 103 bp, Artificial Sequence
  Synthetic Polynucleotide
taatacgactcactatagggcgggaaaaaagcccgctaaaatttaaaagaaacagaggagatcttttatgttttagcggaacctggcggcagcgcaaaagatg

SEQ ID NO: 17703 - DNA, 103 bp, Artificial Sequence
  Synthetic Polynucleotide
taatacgactcactataggggtattcatggtctactaacatgcataggcgaacagaggagacgcctaatgatgttagtaaacctggcggcagcgcaaaagatg

SEQ ID NO: 17704 - DNA, 103 bp, Artificial Sequence
  Synthetic Polynucleotide
taatacgactcactatagggtacttgtattcatggtctactaacatgcataacagaggagaatgcatatgagtagaccaaacctggcggcagcgcaaaagatg

SEQ ID NO: 17705 - DNA, 103 bp, Artificial Sequence
  Synthetic Polynucleotide
taatacgactcactatagggatgggtacttgtattcatggtctactaacaaacagaggagatgttagatgaccatgaataacctggcggcagcgcaaaagatg

SEQ ID NO: 17706 - DNA, 103 bp, Artificial Sequence
  Synthetic Polynucleotide
taatacgactcactatagggcacatatgggtacttgtattcatggtctacaacagaggagagtagacatggaatacaagaacctggcggcagcgcaaaagatg

SEQ ID NO: 17707 - DNA, 103 bp, Artificial Sequence
  Synthetic Polynucleotide
taatacgactcactatagggcctaacacatatgggtacttgtattcatggaacagaggagaccatgaatgcaagtacccaacctggcggcagcgcaaaagatg

SEQ ID NO: 17708 - DNA, 103 bp, Artificial Sequence
  Synthetic Polynucleotide
taatacgactcactatagggcttgccctaacacatatgggtacttgtattaacagaggagaaatacaatgacccatatgaacctggcggcagcgcaaaagatg

SEQ ID NO: 17709 - DNA, 103 bp, Artificial Sequence
  Synthetic Polynucleotide
taatacgactcactatagggttgaccttgccctaacacatatgggtacttaacagaggagaaagtacatgtatgtgttaaacctggcggcagcgcaaaagatg

SEQ ID NO: 17710 - DNA, 103 bp, Artificial Sequence
  Synthetic Polynucleotide
taatacgactcactataggggtatcttgaccttgccctaacacatatgggaacagaggagacccataatggttagggcaaacctggcggcagcgcaaaagatg

SEQ ID NO: 17711 - DNA, 103 bp, Artificial Sequence
  Synthetic Polynucleotide
taatacgactcactatagggctaaagtatcttgaccttgccctaacacataacagaggagaatgtgtatgggcaaggtcaacctggcggcagcgcaaaagatg

SEQ ID NO: 17712 - DNA, 103 bp, Artificial Sequence
  Synthetic Polynucleotide
taatacgactcactatagggtggggctaaagtatcttgaccttgccctaaaacagaggagattagggatgggtcaagataacctggcggcagcgcaaaagatg

SEQ ID NO: 17713 - DNA, 103 bp, Artificial Sequence
  Synthetic Polynucleotide
taatacgactcactatagggtaaggcgggaaaaaagcccgctaaaatttaaacagaggagataaattatggcgggctttaacctggcggcagcgcaaaagatg

SEQ ID NO: 17714 - DNA, 103 bp, Artificial Sequence
  Synthetic Polynucleotide
taatacgactcactatagggagttctggggctaaagtatcttgaccttgcaacagaggagagcaaggatgagatactttaacctggcggcagcgcaaaagatg

SEQ ID NO: 17715 - DNA, 103 bp, Artificial Sequence
  Synthetic Polynucleotide
taatacgactcactatagggtaggaagttctggggctaaagtatcttgacaacagaggagagtcaagatgctttagcccaacctggcggcagcgcaaaagatg

SEQ ID NO: 17716 - DNA, 103 bp, Artificial Sequence
  Synthetic Polynucleotide
taatacgactcactatagggccaaataggaagttctggggctaaagtatcaacagaggagagatactatggccccagaaaacctggcggcagcgcaaaagatg

SEQ ID NO: 17717 - DNA, 103 bp, Artificial Sequence
  Synthetic Polynucleotide
taatacgactcactatagggtatacccaaataggaagttctggggctaaaaacagaggagatttagcatgagaacttccaacctggcggcagcgcaaaagatg

SEQ ID NO: 17718 - DNA, 103 bp, Artificial Sequence
  Synthetic Polynucleotide
taatacgactcactataggggaaagtatacccaaataggaagttctggggaacagaggagaccccagatgttcctatttaacctggcggcagcgcaaaagatg

SEQ ID NO: 17719 - DNA, 103 bp, Artificial Sequence
  Synthetic Polynucleotide
taatacgactcactatagggagggggaaagtatacccaaataggaagttcaacagaggagagaacttatgatttgggtaaacctggcggcagcgcaaaagatg

SEQ ID NO: 17720 - DNA, 103 bp, Artificial Sequence
  Synthetic Polynucleotide
taatacgactcactatagggtattgagggggaaagtatacccaaataggaaacagaggagatcctatatgggtatacttaacctggcggcagcgcaaaagatg

SEQ ID NO: 17721 - DNA, 103 bp, Artificial Sequence
  Synthetic Polynucleotide
taatacgactcactatagggaagcatattgagggggaaagtatacccaaaaacagaggagatttgggatgactttccccaacctggcggcagcgcaaaagatg

SEQ ID NO: 17722 - DNA, 103 bp, Artificial Sequence
  Synthetic Polynucleotide
taatacgactcactatagggtaagtaagcatattgagggggaaagtatacaacagaggagagtatacatgccccctcaaaacctggcggcagcgcaaaagatg

SEQ ID NO: 17723 - DNA, 103 bp, Artificial Sequence
  Synthetic Polynucleotide
taatacgactcactatagggactgttaagtaagcatattgagggggaaagaacagaggagactttccatgtcaatatgcaacctggcggcagcgcaaaagatg

SEQ ID NO: 17724 - DNA, 103 bp, Artificial Sequence
  Synthetic Polynucleotide
taatacgactcactatagggttgcataaggcgggaaaaaagcccgctaaaaacagaggagatttagcatgcttttttccaacctggcggcagcgcaaaagatg

SEQ ID NO: 17725 - DNA, 103 bp, Artificial Sequence
  Synthetic Polynucleotide
taatacgactcactatagggctcctactgttaagtaagcatattgaggggaacagaggagacccctcatgatgcttactaacctggcggcagcgcaaaagatg

SEQ ID NO: 17726 - DNA, 103 bp, Artificial Sequence
  Synthetic Polynucleotide
taatacgactcactatagggaacatctcctactgttaagtaagcatattgaacagaggagacaatatatgtacttaacaaacctggcggcagcgcaaaagatg

SEQ ID NO: 17727 - DNA, 103 bp, Artificial Sequence
  Synthetic Polynucleotide
taatacgactcactataggggtgttaacatctcctactgttaagtaagcaaacagaggagatgcttaatgaacagtaggaacctggcggcagcgcaaaagatg

SEQ ID NO: 17728 - DNA, 103 bp, Artificial Sequence
  Synthetic Polynucleotide
taatacgactcactatagggcttgtgtgttaacatctcctactgttaagtaacagaggagaacttaaatgtaggagatgaacctggcggcagcgcaaaagatg

SEQ ID NO: 17729 - DNA, 103 bp, Artificial Sequence
  Synthetic Polynucleotide
taatacgactcactatagggaattccttgtgtgttaacatctcctactgtaacagaggagaacagtaatggatgttaacaacctggcggcagcgcaaaagatg

SEQ ID NO: 17730 - DNA, 103 bp, Artificial Sequence
  Synthetic Polynucleotide
taatacgactcactatagggccagaaattccttgtgtgttaacatctcctaacagaggagaaggagaatgtaacacacaaacctggcggcagcgcaaaagatg

SEQ ID NO: 17731 - DNA, 103 bp, Artificial Sequence
  Synthetic Polynucleotide
taatacgactcactatagggtgtctccagaaattccttgtgtgttaacataacagaggagaatgttaatgcacaaggaaaacctggcggcagcgcaaaagatg

SEQ ID NO: 17732 - DNA, 103 bp, Artificial Sequence
  Synthetic Polynucleotide
taatacgactcactatagggtttgctgtctccagaaattccttgtgtgttaacagaggagaaacacaatgggaatttctaacctggcggcagcgcaaaagatg

SEQ ID NO: 17733 - DNA, 103 bp, Artificial Sequence
  Synthetic Polynucleotide
taatacgactcactatagggaattttttgctgtctccagaaattccttgtaacagaggagaacaaggatgttctggagaaacctggcggcagcgcaaaagatg

SEQ ID NO: 17734 - DNA, 103 bp, Artificial Sequence
  Synthetic Polynucleotide
taatacgactcactatagggttgctaattttttgctgtctccagaaattcaacagaggagagaatttatggagacagcaaacctggcggcagcgcaaaagatg

SEQ ID NO: 17735 - DNA, 103 bp, Artificial Sequence
  Synthetic Polynucleotide
taatacgactcactatagggcccatttgcataaggcgggaaaaaagcccgaacagaggagacgggctatgttcccgcctaacctggcggcagcgcaaaagatg

SEQ ID NO: 17736 - DNA, 103 bp, Artificial Sequence
  Synthetic Polynucleotide
taatacgactcactatagggttcacttgctaattttttgctgtctccagaaacagaggagatctggaatgagcaaaaaaaacctggcggcagcgcaaaagatg

SEQ ID NO: 17737 - DNA, 103 bp, Artificial Sequence
  Synthetic Polynucleotide
taatacgactcactataggggattcttcacttgctaattttttgctgtctaacagaggagaagacagatgaaaattagcaacctggcggcagcgcaaaagatg

SEQ ID NO: 17738 - DNA, 103 bp, Artificial Sequence
  Synthetic Polynucleotide
taatacgactcactatagggatgctgattcttcacttgctaattttttgcaacagaggagagcaaaaatgtagcaagtgaacctggcggcagcgcaaaagatg

SEQ ID NO: 17739 - DNA, 103 bp, Artificial Sequence
  Synthetic Polynucleotide
taatacgactcactatagggataaaatgctgattcttcacttgctaatttaacagaggagaaaattaatgagtgaagaaaacctggcggcagcgcaaaagatg

SEQ ID NO: 17740 - DNA, 103 bp, Artificial Sequence
  Synthetic Polynucleotide
taatacgactcactatagggaaaacataaaatgctgattcttcacttgctaacagaggagaagcaagatgagaatcagcaacctggcggcagcgcaaaagatg

SEQ ID NO: 17741 - DNA, 103 bp, Artificial Sequence
  Synthetic Polynucleotide
taatacgactcactataggggttccaaaacataaaatgctgattcttcacaacagaggagagtgaagatgcagcattttaacctggcggcagcgcaaaagatg

SEQ ID NO: 17742 - DNA, 103 bp, Artificial Sequence
  Synthetic Polynucleotide
taatacgactcactatagggactgtgttccaaaacataaaatgctgattcaacagaggagagaatcaatgttttatgttaacctggcggcagcgcaaaagatg

SEQ ID NO: 17743 - DNA, 103 bp, Artificial Sequence
  Synthetic Polynucleotide
taatacgactcactatagggaaagaactgtgttccaaaacataaaatgctaacagaggagaagcattatgtgttttggaaacctggcggcagcgcaaaagatg

SEQ ID NO: 17744 - DNA, 103 bp, Artificial Sequence
  Synthetic Polynucleotide
taatacgactcactataggggctgaaaagaactgtgttccaaaacataaaaacagaggagatttatgatgtggaacacaaacctggcggcagcgcaaaagatg

SEQ ID NO: 17745 - DNA, 103 bp, Artificial Sequence
  Synthetic Polynucleotide
taatacgactcactatagggtaaaagctgaaaagaactgtgttccaaaacaacagaggagagttttgatgcacagttctaacctggcggcagcgcaaaagatg

SEQ ID NO: 17746 - DNA, 103 bp, Artificial Sequence
  Synthetic Polynucleotide
taatacgactcactatagggggctgcccatttgcataaggcgggaaaaaaaacagaggagattttttatggccttatgcaacctggcggcagcgcaaaagatg

SEQ ID NO: 17747 - DNA, 103 bp, Artificial Sequence
  Synthetic Polynucleotide
taatacgactcactataggggtacctaaaagctgaaaagaactgtgttccaacagaggagaggaacaatgttcttttcaaacctggcggcagcgcaaaagatg

SEQ ID NO: 17748 - DNA, 103 bp, Artificial Sequence
  Synthetic Polynucleotide
taatacgactcactatagggctcctgtacctaaaagctgaaaagaactgtaacagaggagaacagttatgttcagctttaacctggcggcagcgcaaaagatg

SEQ ID NO: 17749 - DNA, 103 bp, Artificial Sequence
  Synthetic Polynucleotide
taatacgactcactatagggtgtacctcctgtacctaaaagctgaaaagaaacagaggagatcttttatgcttttaggtaacctggcggcagcgcaaaagatg

SEQ ID NO: 17750 - DNA, 103 bp, Artificial Sequence
  Synthetic Polynucleotide
taatacgactcactataggggttgctgtacctcctgtacctaaaagctgaaacagaggagatcagctatgaggtacaggaacctggcggcagcgcaaaagatg

SEQ ID NO: 17751 - DNA, 103 bp, Artificial Sequence
  Synthetic Polynucleotide
taatacgactcactatagggacatagttgctgtacctcctgtacctaaaaaacagaggagattttagatgcaggaggtaaacctggcggcagcgcaaaagatg

SEQ ID NO: 17752 - DNA, 103 bp, Artificial Sequence
  Synthetic Polynucleotide
taatacgactcactatagggataagacatagttgctgtacctcctgtaccaacagaggagaggtacaatgggtacagcaaacctggcggcagcgcaaaagatg

SEQ ID NO: 17753 - DNA, 103 bp, Artificial Sequence
  Synthetic Polynucleotide
taatacgactcactatagggaacttataagacatagttgctgtacctcctaacagaggagaaggaggatgagcaactataacctggcggcagcgcaaaagatg

SEQ ID NO: 17754 - DNA, 103 bp, Artificial Sequence
  Synthetic Polynucleotide
taatacgactcactataggggaggaaacttataagacatagttgctgtacaacagaggagagtacagatgctatgtcttaacctggcggcagcgcaaaagatg

SEQ ID NO: 17755 - DNA, 103 bp, Artificial Sequence
  Synthetic Polynucleotide
taatacgactcactatagggcactggaggaaacttataagacatagttgcaacagaggagagcaactatgtcttataagaacctggcggcagcgcaaaagatg

SEQ ID NO: 17756 - DNA, 103 bp, Artificial Sequence
  Synthetic Polynucleotide
taatacgactcactataggggggggcactggaggaaacttataagacataaacagaggagatatgtcatgtaagtttccaacctggcggcagcgcaaaagatg

SEQ ID NO: 17757 - DNA, 103 bp, Artificial Sequence
  Synthetic Polynucleotide
taatacgactcactatagggtaattgtccgccatcttgtaccggaagtccaacagaggagaggacttatggtacaagataacctggcggcagcgcaaaagatg

SEQ ID NO: 17758 - DNA, 103 bp, Artificial Sequence
  Synthetic Polynucleotide
taatacgactcactatagggaaaatggctgcccatttgcataaggcgggaaacagaggagatcccgcatgatgcaaatgaacctggcggcagcgcaaaagatg

SEQ ID NO: 17759 - DNA, 103 bp, Artificial Sequence
  Synthetic Polynucleotide
taatacgactcactatagggtttctgggggcactggaggaaacttataagaacagaggagacttataatgttcctccagaacctggcggcagcgcaaaagatg

SEQ ID NO: 17760 - DNA, 103 bp, Artificial Sequence
  Synthetic Polynucleotide
taatacgactcactatagggtaaattttctgggggcactggaggaaacttaacagaggagaaagtttatgccagtgcccaacctggcggcagcgcaaaagatg

SEQ ID NO: 17761 - DNA, 103 bp, Artificial Sequence
  Synthetic Polynucleotide
taatacgactcactatagggccctctaaattttctgggggcactggaggaaacagaggagatcctccatggcccccagaaacctggcggcagcgcaaaagatg

SEQ ID NO: 17762 - DNA, 103 bp, Artificial Sequence
  Synthetic Polynucleotide
taatacgactcactatagggtgcagccctctaaattttctgggggcactgaacagaggagacagtgcatgcagaaaattaacctggcggcagcgcaaaagatg

SEQ ID NO: 17763 - DNA, 103 bp, Artificial Sequence
  Synthetic Polynucleotide
taatacgactcactatagggttgactgcagccctctaaattttctgggggaacagaggagacccccaatgaatttagagaacctggcggcagcgcaaaagatg

SEQ ID NO: 17764 - DNA, 103 bp, Artificial Sequence
  Synthetic Polynucleotide
taatacgactcactatagggaagtgttgactgcagccctctaaattttctaacagaggagaagaaaaatgagagggctgaacctggcggcagcgcaaaagatg

SEQ ID NO: 17765 - DNA, 103 bp, Artificial Sequence
  Synthetic Polynucleotide
taatacgactcactatagggcataaaagtgttgactgcagccctctaaataacagaggagaatttagatggctgcagtcaacctggcggcagcgcaaaagatg

SEQ ID NO: 17766 - DNA, 103 bp, Artificial Sequence
  Synthetic Polynucleotide
taatacgactcactatagggcatctcataaaagtgttgactgcagccctcaacagaggagagagggcatgagtcaacacaacctggcggcagcgcaaaagatg

SEQ ID NO: 17767 - DNA, 103 bp, Artificial Sequence
  Synthetic Polynucleotide
taatacgactcactatagggttgtacatctcataaaagtgttgactgcagaacagaggagactgcagatgacacttttaaacctggcggcagcgcaaaagatg

SEQ ID NO: 17768 - DNA, 103 bp, Artificial Sequence
  Synthetic Polynucleotide
taatacgactcactatagggagggattgtacatctcataaaagtgttgacaacagaggagagtcaacatgtttatgagaaacctggcggcagcgcaaaagatg

SEQ ID NO: 17769 - DNA, 103 bp, Artificial Sequence
  Synthetic Polynucleotide
taatacgactcactatagggcacttaaaatggctgcccatttgcataaggaacagaggagaccttatatgaatgggcagaacctggcggcagcgcaaaagatg

SEQ ID NO: 17770 - DNA, 103 bp, Artificial Sequence
  Synthetic Polynucleotide
taatacgactcactataggggtataagggattgtacatctcataaaagtgaacagaggagacactttatggagatgtacaacctggcggcagcgcaaaagatg

SEQ ID NO: 17771 - DNA, 103 bp, Artificial Sequence
  Synthetic Polynucleotide
taatacgactcactataggggatccgtataagggattgtacatctcataaaacagaggagattatgaatggtacaatccaacctggcggcagcgcaaaagatg

SEQ ID NO: 17772 - DNA, 103 bp, Artificial Sequence
  Synthetic Polynucleotide
taatacgactcactatagggagcgggatccgtataagggattgtacatctaacagaggagaagatgtatgatcccttataacctggcggcagcgcaaaagatg

SEQ ID NO: 17773 - DNA, 103 bp, Artificial Sequence
  Synthetic Polynucleotide
taatacgactcactatagggccctaagcgggatccgtataagggattgtaaacagaggagatacaatatgttatacggaaacctggcggcagcgcaaaagatg

SEQ ID NO: 17774 - DNA, 103 bp, Artificial Sequence
  Synthetic Polynucleotide
taatacgactcactatagggggaacccctaagcgggatccgtataagggaaacagaggagatcccttatgcggatcccgaacctggcggcagcgcaaaagatg

SEQ ID NO: 17775 - DNA, 103 bp, Artificial Sequence
  Synthetic Polynucleotide
taatacgactcactatagggtgtcaggaacccctaagcgggatccgtataaacagaggagatatacgatgcccgcttagaacctggcggcagcgcaaaagatg

SEQ ID NO: 17776 - DNA, 103 bp, Artificial Sequence
  Synthetic Polynucleotide
taatacgactcactatagggtaatgtgtcaggaacccctaagcgggatccaacagaggagaggatccatgttaggggttaacctggcggcagcgcaaaagatg

SEQ ID NO: 17777 - DNA, 103 bp, Artificial Sequence
  Synthetic Polynucleotide
taatacgactcactatagggcctcctaatgtgtcaggaacccctaagcggaacagaggagaccgcttatgggttcctgaaacctggcggcagcgcaaaagatg

SEQ ID NO: 17778 - DNA, 103 bp, Artificial Sequence
  Synthetic Polynucleotide
taatacgactcactatagggggtcacctcctaatgtgtcaggaacccctaaacagaggagataggggatgctgacacataacctggcggcagcgcaaaagatg

SEQ ID NO: 17779 - DNA, 103 bp, Artificial Sequence
  Synthetic Polynucleotide
taatacgactcactatagggttttgggtcacctcctaatgtgtcaggaacaacagaggagagttcctatgacattaggaaacctggcggcagcgcaaaagatg

SEQ ID NO: 17780 - DNA, 103 bp, Artificial Sequence
  Synthetic Polynucleotide
taatacgactcactatagggtaaaacacttaaaatggctgcccatttgcaaacagaggagatgcaaaatggcagccattaacctggcggcagcgcaaaagatg

SEQ ID NO: 17781 - DNA, 103 bp, Artificial Sequence
  Synthetic Polynucleotide
taatacgactcactatagggctaaattttgggtcacctcctaatgtgtcaaacagaggagatgacacatgaggaggtgaaacctggcggcagcgcaaaagatg

SEQ ID NO: 17782 - DNA, 103 bp, Artificial Sequence
  Synthetic Polynucleotide
taatacgactcactatagggaagatctaaattttgggtcacctcctaatgaacagaggagacattagatggtgacccaaaacctggcggcagcgcaaaagatg

SEQ ID NO: 17783 - DNA, 103 bp, Artificial Sequence
  Synthetic Polynucleotide
taatacgactcactatagggtgttaaagatctaaattttgggtcacctccaacagaggagaggaggtatgccaaaatttaacctggcggcagcgcaaaagatg

SEQ ID NO: 17784 - DNA, 103 bp, Artificial Sequence
  Synthetic Polynucleotide
taatacgactcactatagggtcatgtgttaaagatctaaattttgggtcaaacagaggagatgacccatgatttagatcaacctggcggcagcgcaaaagatg

SEQ ID NO: 17785 - DNA, 103 bp, Artificial Sequence
  Synthetic Polynucleotide
taatacgactcactatagggggtcttcatgtgttaaagatctaaattttgaacagaggagacaaaatatggatctttaaaacctggcggcagcgcaaaagatg

SEQ ID NO: 17786 - DNA, 103 bp, Artificial Sequence
  Synthetic Polynucleotide
taatacgactcactatagggtgcatggtcttcatgtgttaaagatctaaaaacagaggagatttagaatgttaacacataacctggcggcagcgcaaaagatg

SEQ ID NO: 17787 - DNA, 103 bp, Artificial Sequence
  Synthetic Polynucleotide
taatacgactcactatagggtgaattgcatggtcttcatgtgttaaagataacagaggagaatctttatgacatgaagaaacctggcggcagcgcaaaagatg

SEQ ID NO: 17788 - DNA, 103 bp, Artificial Sequence
  Synthetic Polynucleotide
taatacgactcactatagggggggctgaattgcatggtcttcatgtgttaaacagaggagataacacatgaagaccatgaacctggcggcagcgcaaaagatg

SEQ ID NO: 17789 - DNA, 103 bp, Artificial Sequence
  Synthetic Polynucleotide
taatacgactcactataggggttttggggctgaattgcatggtcttcatgaacagaggagacatgaaatgcatgcaattaacctggcggcagcgcaaaagatg

SEQ ID NO: 17790 - DNA, 103 bp, Artificial Sequence
  Synthetic Polynucleotide
taatacgactcactatagggatgaagttttggggctgaattgcatggtctaacagaggagaagaccaatgaattcagccaacctggcggcagcgcaaaagatg

SEQ ID NO: 17791 - DNA, 103 bp, Artificial Sequence
  Synthetic Polynucleotide
taatacgactcactatagggtatagtaaaacacttaaaatggctgcccataacagaggagaatgggcatgcattttaagaacctggcggcagcgcaaaagatg

SEQ ID NO: 17792 - DNA, 103 bp, Artificial Sequence
  Synthetic Polynucleotide
taatacgactcactatagggctggcatgaagttttggggctgaattgcataacagaggagaatgcaaatgagccccaaaaacctggcggcagcgcaaaagatg

SEQ ID NO: 17793 - DNA, 103 bp, Artificial Sequence
  Synthetic Polynucleotide
taatacgactcactatagggtggccctggcatgaagttttggggctgaataacagaggagaattcagatgcaaaacttcaacctggcggcagcgcaaaagatg

SEQ ID NO: 17794 - DNA, 103 bp, Artificial Sequence
  Synthetic Polynucleotide
taatacgactcactatagggactagtggccctggcatgaagttttggggcaacagaggagagccccaatgcttcatgccaacctggcggcagcgcaaaagatg

SEQ ID NO: 17795 - DNA, 103 bp, Artificial Sequence
  Synthetic Polynucleotide
taatacgactcactatagggagtttactagtggccctggcatgaagttttaacagaggagaaaaactatgtgccagggcaacctggcggcagcgcaaaagatg

SEQ ID NO: 17796 - DNA, 103 bp, Artificial Sequence
  Synthetic Polynucleotide
taatacgactcactatagggcactgagtttactagtggccctggcatgaaaacagaggagattcatgatggggccactaaacctggcggcagcgcaaaagatg

SEQ ID NO: 17797 - DNA, 103 bp, Artificial Sequence
  Synthetic Polynucleotide
taatacgactcactataggggtagacactgagtttactagtggccctggcaacagaggagagccaggatgactagtaaaaacctggcggcagcgcaaaagatg

SEQ ID NO: 17798 - DNA, 103 bp, Artificial Sequence
  Synthetic Polynucleotide
taatacgactcactatagggcctttgtagacactgagtttactagtggccaacagaggagaggccacatgtaaactcagaacctggcggcagcgcaaaagatg

SEQ ID NO: 17799 - DNA, 103 bp, Artificial Sequence
  Synthetic Polynucleotide
taatacgactcactatagggtccctcctttgtagacactgagtttactagaacagaggagactagtaatgtcagtgtctaacctggcggcagcgcaaaagatg

SEQ ID NO: 17800 - DNA, 103 bp, Artificial Sequence
  Synthetic Polynucleotide
taatacgactcactatagggctgtctccctcctttgtagacactgagtttaacagaggagaaaactcatggtctacaaaaacctggcggcagcgcaaaagatg

SEQ ID NO: 17801 - DNA, 103 bp, Artificial Sequence
  Synthetic Polynucleotide
taatacgactcactatagggtagagctgtctccctcctttgtagacactgaacagaggagacagtgtatgcaaaggaggaacctggcggcagcgcaaaagatg

SEQ ID NO: 17802 - DNA, 103 bp, Artificial Sequence
  Synthetic Polynucleotide
taatacgactcactatagggaaaattatagtaaaacacttaaaatggctgaacagaggagacagccaatgtaagtgtttaacctggcggcagcgcaaaagatg

SEQ ID NO: 17803 - DNA, 103 bp, Artificial Sequence
  Synthetic Polynucleotide
taatacgactcactatagggagtattagagctgtctccctcctttgtagaaacagaggagatctacaatggagggagacaacctggcggcagcgcaaaagatg

SEQ ID NO: 17804 - DNA, 103 bp, Artificial Sequence
  Synthetic Polynucleotide
taatacgactcactataggggctccagtattagagctgtctccctcctttaacagaggagaaaaggaatgagacagctcaacctggcggcagcgcaaaagatg

SEQ ID NO: 17805 - DNA, 103 bp, Artificial Sequence
  Synthetic Polynucleotide
taatacgactcactatagggtcccagctccagtattagagctgtctccctaacagaggagaagggagatggctctaataaacctggcggcagcgcaaaagatg

SEQ ID NO: 17806 - DNA, 103 bp, Artificial Sequence
  Synthetic Polynucleotide
taatacgactcactatagggggctttcccagctccagtattagagctgtcaacagaggagagacagcatgaatactggaaacctggcggcagcgcaaaagatg

SEQ ID NO: 17807 - DNA, 103 bp, Artificial Sequence
  Synthetic Polynucleotide
taatacgactcactataggggttaaggctttcccagctccagtattagagaacagaggagactctaaatgtggagctggaacctggcggcagcgcaaaagatg

SEQ ID NO: 17808 - DNA, 103 bp, Artificial Sequence
  Synthetic Polynucleotide
taatacgactcactatagggggcctgttaaggctttcccagctccagtataacagaggagaatactgatgctgggaaagaacctggcggcagcgcaaaagatg

SEQ ID NO: 17809 - DNA, 103 bp, Artificial Sequence
  Synthetic Polynucleotide
taatacgactcactataggggctaaggcctgttaaggctttcccagctccaacagaggagaggagctatgaaagccttaaacctggcggcagcgcaaaagatg

SEQ ID NO: 17810 - DNA, 103 bp, Artificial Sequence
  Synthetic Polynucleotide
taatacgactcactatagggcctgtgctaaggcctgttaaggctttcccaaacagaggagatgggaaatgcttaacaggaacctggcggcagcgcaaaagatg

SEQ ID NO: 17811 - DNA, 103 bp, Artificial Sequence
  Synthetic Polynucleotide
taatacgactcactatagggaggtacctgtgctaaggcctgttaaggcttaacagaggagaaagcctatgcaggccttaaacctggcggcagcgcaaaagatg

SEQ ID NO: 17812 - DNA, 103 bp, Artificial Sequence
  Synthetic Polynucleotide
taatacgactcactatagggttgagaggtacctgtgctaaggcctgttaaaacagaggagattaacaatgcttagcacaaacctggcggcagcgcaaaagatg

SEQ ID NO: 17813 - DNA, 103 bp, Artificial Sequence
  Synthetic Polynucleotide
taatacgactcactatagggccaataaaattatagtaaaacacttaaaataacagaggagaattttaatggttttactaaacctggcggcagcgcaaaagatg

SEQ ID NO: 17814 - DNA, 103 bp, Artificial Sequence
  Synthetic Polynucleotide
taatacgactcactataggggtgttttgagaggtacctgtgctaaggcctaacagaggagaaggcctatgcacaggtacaacctggcggcagcgcaaaagatg

SEQ ID NO: 17815 - DNA, 103 bp, Artificial Sequence
  Synthetic Polynucleotide
taatacgactcactatagggttctagtgttttgagaggtacctgtgctaaaacagaggagattagcaatggtacctctcaacctggcggcagcgcaaaagatg

SEQ ID NO: 17816 - DNA, 103 bp, Artificial Sequence
  Synthetic Polynucleotide
taatacgactcactatagggggatattctagtgttttgagaggtacctgtaacagaggagaacaggtatgtctcaaaacaacctggcggcagcgcaaaagatg

SEQ ID NO: 17817 - DNA, 103 bp, Artificial Sequence
  Synthetic Polynucleotide
taatacgactcactatagggcgtaaggatattctagtgttttgagaggtaaacagaggagatacctcatgaaacactagaacctggcggcagcgcaaaagatg

SEQ ID NO: 17818 - DNA, 103 bp, Artificial Sequence
  Synthetic Polynucleotide
taatacgactcactatagggccgggcgtaaggatattctagtgttttgagaacagaggagactcaaaatgctagaatataacctggcggcagcgcaaaagatg

SEQ ID NO: 17819 - DNA, 103 bp, Artificial Sequence
  Synthetic Polynucleotide
taatacgactcactatagggtggccccgggcgtaaggatattctagtgttaacagaggagaaacactatgatatccttaaacctggcggcagcgcaaaagatg

SEQ ID NO: 17820 - DNA, 103 bp, Artificial Sequence
  Synthetic Polynucleotide
taatacgactcactataggggacactggccccgggcgtaaggatattctaaacagaggagatagaatatgcttacgcccaacctggcggcagcgcaaaagatg

SEQ ID NO: 17821 - DNA, 103 bp, Artificial Sequence
  Synthetic Polynucleotide
taatacgactcactataggggctgagacactggccccgggcgtaaggataaacagaggagatatcctatggcccggggcaacctggcggcagcgcaaaagatg

SEQ ID NO: 17822 - DNA, 103 bp, Artificial Sequence
  Synthetic Polynucleotide
taatacgactcactataggggtacggctgagacactggccccgggcgtaaaacagaggagattacgcatggggccagtgaacctggcggcagcgcaaaagatg

SEQ ID NO: 17823 - DNA, 103 bp, Artificial Sequence
  Synthetic Polynucleotide
taatacgactcactatagggtggtggtacggctgagacactggccccgggaacagaggagacccgggatgagtgtctcaaacctggcggcagcgcaaaagatg

SEQ ID NO: 17824 - DNA, 103 bp, Artificial Sequence
  Synthetic Polynucleotide
taatacgactcactatagggactgaccaataaaattatagtaaaacacttaacagaggagaaagtgtatgactataattaacctggcggcagcgcaaaagatg

SEQ ID NO: 17825 - DNA, 103 bp, Artificial Sequence
  Synthetic Polynucleotide
taatacgactcactatagggcccagtggtggtacggctgagacactggccaacagaggagaggccagatgctcagccgtaacctggcggcagcgcaaaagatg

SEQ ID NO: 17826 - DNA, 103 bp, Artificial Sequence
  Synthetic Polynucleotide
taatacgactcactatagggtgtgtcccagtggtggtacggctgagacacaacagaggagagtgtctatgccgtaccacaacctggcggcagcgcaaaagatg

SEQ ID NO: 17827 - DNA, 103 bp, Artificial Sequence
  Synthetic Polynucleotide
taatacgactcactatagggttatctgtgtcccagtggtggtacggctgaaacagaggagatcagccatgccaccactgaacctggcggcagcgcaaaagatg

SEQ ID NO: 17828 - DNA, 103 bp, Artificial Sequence
  Synthetic Polynucleotide
taatacgactcactatagggcatatttatctgtgtcccagtggtggtacgaacagaggagacgtaccatgactgggacaaacctggcggcagcgcaaaagatg

SEQ ID NO: 17829 - DNA, 103 bp, Artificial Sequence
  Synthetic Polynucleotide
taatacgactcactatagggtgtgacatatttatctgtgtcccagtggtgaacagaggagacaccacatggacacagataacctggcggcagcgcaaaagatg

SEQ ID NO: 17830 - DNA, 103 bp, Artificial Sequence
  Synthetic Polynucleotide
taatacgactcactatagggattcctgtgacatatttatctgtgtcccagaacagaggagactgggaatgagataaataaacctggcggcagcgcaaaagatg

SEQ ID NO: 17831 - DNA, 103 bp, Artificial Sequence
  Synthetic Polynucleotide
taatacgactcactatagggcatttattcctgtgacatatttatctgtgtaacagaggagaacacagatgaatatgtcaaacctggcggcagcgcaaaagatg

SEQ ID NO: 17832 - DNA, 103 bp, Artificial Sequence
  Synthetic Polynucleotide
taatacgactcactatagggaatagcatttattcctgtgacatatttatcaacagaggagagataaaatggtcacaggaaacctggcggcagcgcaaaagatg

SEQ ID NO: 17833 - DNA, 103 bp, Artificial Sequence
  Synthetic Polynucleotide
taatacgactcactatagggtgagaaatagcatttattcctgtgacatataacagaggagaatatgtatgaggaataaaaacctggcggcagcgcaaaagatg

SEQ ID NO: 17834 - DNA, 103 bp, Artificial Sequence
  Synthetic Polynucleotide
taatacgactcactataggggaccatgagaaatagcatttattcctgtgaaacagaggagatcacagatgtaaatgctaaacctggcggcagcgcaaaagatg

SEQ ID NO: 17835 - DNA, 103 bp, Artificial Sequence
  Synthetic Polynucleotide
taatacgactcactatagggacaaaactgaccaataaaattatagtaaaaaacagaggagattttacatgaattttattaacctggcggcagcgcaaaagatg

SEQ ID NO: 17836 - DNA, 103 bp, Artificial Sequence
  Synthetic Polynucleotide
taatacgactcactatagggggtctgaccatgagaaatagcatttattccaacagaggagaggaataatggctatttctaacctggcggcagcgcaaaagatg

SEQ ID NO: 17837 - DNA, 103 bp, Artificial Sequence
  Synthetic Polynucleotide
taatacgactcactatagggtaagtggtctgaccatgagaaatagcatttaacagaggagaaaatgcatgttctcatggaacctggcggcagcgcaaaagatg

SEQ ID NO: 17838 - DNA, 103 bp, Artificial Sequence
  Synthetic Polynucleotide
taatacgactcactatagggtaccataagtggtctgaccatgagaaatagaacagaggagactatttatgatggtcagaaacctggcggcagcgcaaaagatg

SEQ ID NO: 17839 - DNA, 103 bp, Artificial Sequence
  Synthetic Polynucleotide
taatacgactcactatagggagcgttaccataagtggtctgaccatgagaaacagaggagatctcatatgcagaccactaacctggcggcagcgcaaaagatg

SEQ ID NO: 17840 - DNA, 103 bp, Artificial Sequence
  Synthetic Polynucleotide
taatacgactcactatagggtcttcagcgttaccataagtggtctgaccaaacagaggagatggtcaatgcacttatggaacctggcggcagcgcaaaagatg

SEQ ID NO: 17841 - DNA, 103 bp, Artificial Sequence
  Synthetic Polynucleotide
taatacgactcactatagggctttgtcttcagcgttaccataagtggtctaacagaggagaagaccaatgatggtaacgaacctggcggcagcgcaaaagatg

SEQ ID NO: 17842 - DNA, 103 bp, Artificial Sequence
  Synthetic Polynucleotide
taatacgactcactatagggatactctttgtcttcagcgttaccataagtaacagaggagaacttatatgaacgctgaaaacctggcggcagcgcaaaagatg

SEQ ID NO: 17843 - DNA, 103 bp, Artificial Sequence
  Synthetic Polynucleotide
taatacgactcactatagggtgctgatactctttgtcttcagcgttaccaaacagaggagatggtaaatgtgaagacaaaacctggcggcagcgcaaaagatg

SEQ ID NO: 17844 - DNA, 103 bp, Artificial Sequence
  Synthetic Polynucleotide
taatacgactcactatagggctccttgctgatactctttgtcttcagcgtaacagaggagaacgctgatgacaaagagtaacctggcggcagcgcaaaagatg

SEQ ID NO: 17845 - DNA, 103 bp, Artificial Sequence
  Synthetic Polynucleotide
taatacgactcactatagggacccactccttgctgatactctttgtcttcaacagaggagagaagacatggagtatcagaacctggcggcagcgcaaaagatg

SEQ ID NO: 17846 - DNA, 103 bp, Artificial Sequence
  Synthetic Polynucleotide
taatacgactcactatagggccgttacaaaactgaccaataaaattatagaacagaggagactataaatgtattggtcaaacctggcggcagcgcaaaagatg

SEQ ID NO: 17847 - DNA, 103 bp, Artificial Sequence
  Synthetic Polynucleotide
taatacgactcactatagggaatctacccactccttgctgatactctttgaacagaggagacaaagaatgtcagcaaggaacctggcggcagcgcaaaagatg

SEQ ID NO: 17848 - DNA, 103 bp, Artificial Sequence
  Synthetic Polynucleotide
taatacgactcactatagggttggaaatctacccactccttgctgatactaacagaggagaagtatcatgaaggagtggaacctggcggcagcgcaaaagatg

SEQ ID NO: 17849 - DNA, 103 bp, Artificial Sequence
  Synthetic Polynucleotide
taatacgactcactatagggttcatttggaaatctacccactccttgctgaacagaggagacagcaaatggtgggtagaaacctggcggcagcgcaaaagatg

SEQ ID NO: 17850 - DNA, 103 bp, Artificial Sequence
  Synthetic Polynucleotide
taatacgactcactatagggtctttttcatttggaaatctacccactcctaacagaggagaaggagtatgtagatttccaacctggcggcagcgcaaaagatg

SEQ ID NO: 17851 - DNA, 103 bp, Artificial Sequence
  Synthetic Polynucleotide
taatacgactcactataggggctgttctttttcatttggaaatctacccaaacagaggagatgggtaatgttccaaatgaacctggcggcagcgcaaaagatg

SEQ ID NO: 17852 - DNA, 103 bp, Artificial Sequence
  Synthetic Polynucleotide
taatacgactcactatagggttttagctgttctttttcatttggaaatctaacagaggagaagatttatgaatgaaaaaaacctggcggcagcgcaaaagatg

SEQ ID NO: 17853 - DNA, 103 bp, Artificial Sequence
  Synthetic Polynucleotide
taatacgactcactatagggaactgttttagctgttctttttcatttggaaacagaggagatccaaaatgaaaagaacaaacctggcggcagcgcaaaagatg

SEQ ID NO: 17854 - DNA, 103 bp, Artificial Sequence
  Synthetic Polynucleotide
taatacgactcactatagggcctgtaactgttttagctgttctttttcataacagaggagaatgaaaatgaacagctaaaacctggcggcagcgcaaaagatg

SEQ ID NO: 17855 - DNA, 103 bp, Artificial Sequence
  Synthetic Polynucleotide
taatacgactcactatagggtaaaccctgtaactgttttagctgttctttaacagaggagaaaagaaatgctaaaacagaacctggcggcagcgcaaaagatg

SEQ ID NO: 17856 - DNA, 103 bp, Artificial Sequence
  Synthetic Polynucleotide
taatacgactcactatagggatgtttaaaccctgtaactgttttagctgtaacagaggagaacagctatgacagttacaaacctggcggcagcgcaaaagatg

SEQ ID NO: 17857 - DNA, 103 bp, Artificial Sequence
  Synthetic Polynucleotide
taatacgactcactatagggtttaaccgttacaaaactgaccaataaaataacagaggagaattttaatggtcagttttaacctggcggcagcgcaaaagatg

SEQ ID NO: 17858 - DNA, 103 bp, Artificial Sequence
  Synthetic Polynucleotide
taatacgactcactatagggtgtgcatgtttaaaccctgtaactgttttaaacagaggagataaaacatgtacagggttaacctggcggcagcgcaaaagatg

SEQ ID NO: 17859 - DNA, 103 bp, Artificial Sequence
  Synthetic Polynucleotide
taatacgactcactataggggtaggtgtgcatgtttaaaccctgtaactgaacagaggagacagttaatgggtttaaacaacctggcggcagcgcaaaagatg

SEQ ID NO: 17860 - DNA, 103 bp, Artificial Sequence
  Synthetic Polynucleotide
taatacgactcactatagggggaaagtaggtgtgcatgtttaaaccctgtaacagaggagaacagggatgaaacatgcaaacctggcggcagcgcaaaagatg

SEQ ID NO: 17861 - DNA, 103 bp, Artificial Sequence
  Synthetic Polynucleotide
taatacgactcactatagggtattgggaaagtaggtgtgcatgtttaaacaacagaggagagtttaaatgtgcacacctaacctggcggcagcgcaaaagatg

SEQ ID NO: 17862 - DNA, 103 bp, Artificial Sequence
  Synthetic Polynucleotide
taatacgactcactatagggtcctttattgggaaagtaggtgtgcatgttaacagaggagaaacatgatgacctactttaacctggcggcagcgcaaaagatg

SEQ ID NO: 17863 - DNA, 103 bp, Artificial Sequence
  Synthetic Polynucleotide
taatacgactcactatagggtgggttcctttattgggaaagtaggtgtgcaacagaggagagcacacatgctttcccaaaacctggcggcagcgcaaaagatg

SEQ ID NO: 17864 - DNA, 103 bp, Artificial Sequence
  Synthetic Polynucleotide
taatacgactcactatagggattgctgggttcctttattgggaaagtaggaacagaggagacctactatgccaataaagaacctggcggcagcgcaaaagatg

SEQ ID NO: 17865 - DNA, 103 bp, Artificial Sequence
  Synthetic Polynucleotide
taatacgactcactatagggtgtatattgctgggttcctttattgggaaaaacagaggagatttcccatgaaaggaaccaacctggcggcagcgcaaaagatg

SEQ ID NO: 17866 - DNA, 103 bp, Artificial Sequence
  Synthetic Polynucleotide
taatacgactcactatagggtgatctgtatattgctgggttcctttattgaacagaggagacaataaatgaacccagcaaacctggcggcagcgcaaaagatg

SEQ ID NO: 17867 - DNA, 103 bp, Artificial Sequence
  Synthetic Polynucleotide
taatacgactcactatagggcaatttgatctgtatattgctgggttccttaacagaggagaaaggaaatgagcaatataaacctggcggcagcgcaaaagatg

SEQ ID NO: 17868 - DNA, 103 bp, Artificial Sequence
  Synthetic Polynucleotide
taatacgactcactatagggtgacgtaattgtccgccatcttgtaccggaaacagaggagatccggtatgagatggcggaacctggcggcagcgcaaaagatg

SEQ ID NO: 17869 - DNA, 103 bp, Artificial Sequence
  Synthetic Polynucleotide
taatacgactcactatagggcccattttaaccgttacaaaactgaccaataacagaggagaattggtatgttttgtaacaacctggcggcagcgcaaaagatg

SEQ ID NO: 17870 - DNA, 103 bp, Artificial Sequence
  Synthetic Polynucleotide
taatacgactcactataggggcgctcaatttgatctgtatattgctgggtaacagaggagaacccagatgtatacagataacctggcggcagcgcaaaagatg

SEQ ID NO: 17871 - DNA, 103 bp, Artificial Sequence
  Synthetic Polynucleotide
taatacgactcactatagggagggggcgctcaatttgatctgtatattgcaacagaggagagcaataatgagatcaaataacctggcggcagcgcaaaagatg

SEQ ID NO: 17872 - DNA, 103 bp, Artificial Sequence
  Synthetic Polynucleotide
taatacgactcactatagggccattagggggcgctcaatttgatctgtataacagaggagaatacagatgaaattgagcaacctggcggcagcgcaaaagatg

SEQ ID NO: 17873 - DNA, 103 bp, Artificial Sequence
  Synthetic Polynucleotide
taatacgactcactatagggacccaccattagggggcgctcaatttgatcaacagaggagagatcaaatggagcgccccaacctggcggcagcgcaaaagatg

SEQ ID NO: 17874 - DNA, 103 bp, Artificial Sequence
  Synthetic Polynucleotide
taatacgactcactatagggacagaacccaccattagggggcgctcaattaacagaggagaaattgaatgccccctaataacctggcggcagcgcaaaagatg

SEQ ID NO: 17875 - DNA, 103 bp, Artificial Sequence
  Synthetic Polynucleotide
taatacgactcactatagggtccatacagaacccaccattagggggcgctaacagaggagaagcgccatgtaatggtggaacctggcggcagcgcaaaagatg

SEQ ID NO: 17876 - DNA, 103 bp, Artificial Sequence
  Synthetic Polynucleotide
taatacgactcactatagggtctgttccatacagaacccaccattaggggaacagaggagacccctaatggtgggttctaacctggcggcagcgcaaaagatg

SEQ ID NO: 17877 - DNA, 103 bp, Artificial Sequence
  Synthetic Polynucleotide
taatacgactcactataggggctcttctgttccatacagaacccaccattaacagaggagaaatggtatgttctgtatgaacctggcggcagcgcaaaagatg

SEQ ID NO: 17878 - DNA, 103 bp, Artificial Sequence
  Synthetic Polynucleotide
taatacgactcactataggggaagggctcttctgttccatacagaacccaaacagaggagatgggttatgtatggaacaaacctggcggcagcgcaaaagatg

SEQ ID NO: 17879 - DNA, 103 bp, Artificial Sequence
  Synthetic Polynucleotide
taatacgactcactatagggatagtgaagggctcttctgttccatacagaaacagaggagatctgtaatgaacagaagaaacctggcggcagcgcaaaagatg

SEQ ID NO: 17880 - DNA, 103 bp, Artificial Sequence
  Synthetic Polynucleotide
taatacgactcactatagggctccgcccattttaaccgttacaaaactgaaacagaggagatcagttatgtaacggttaaacctggcggcagcgcaaaagatg

SEQ ID NO: 17881 - DNA, 103 bp, Artificial Sequence
  Synthetic Polynucleotide
taatacgactcactatagggctttcatagtgaagggctcttctgttccataacagaggagaatggaaatgaagagccctaacctggcggcagcgcaaaagatg

SEQ ID NO: 17882 - DNA, 103 bp, Artificial Sequence
  Synthetic Polynucleotide
taatacgactcactataggggctggctttcatagtgaagggctcttctgtaacagaggagaacagaaatgcccttcactaacctggcggcagcgcaaaagatg

SEQ ID NO: 17883 - DNA, 103 bp, Artificial Sequence
  Synthetic Polynucleotide
taatacgactcactatagggccacagctggctttcatagtgaagggctctaacagaggagaagagccatgcactatgaaaacctggcggcagcgcaaaagatg

SEQ ID NO: 17884 - DNA, 103 bp, Artificial Sequence
  Synthetic Polynucleotide
taatacgactcactatagggttactccacagctggctttcatagtgaaggaacagaggagaccttcaatgtgaaagccaaacctggcggcagcgcaaaagatg

SEQ ID NO: 17885 - DNA, 103 bp, Artificial Sequence
  Synthetic Polynucleotide
taatacgactcactataggggaattttactccacagctggctttcatagtaacagaggagaactatgatggccagctgtaacctggcggcagcgcaaaagatg

SEQ ID NO: 17886 - DNA, 103 bp, Artificial Sequence
  Synthetic Polynucleotide
taatacgactcactatagggatttggaattttactccacagctggctttcaacagaggagagaaagcatgctgtggagtaacctggcggcagcgcaaaagatg

SEQ ID NO: 17887 - DNA, 103 bp, Artificial Sequence
  Synthetic Polynucleotide
taatacgactcactatagggtctaaatttggaattttactccacagctggaacagaggagaccagctatggagtaaaataacctggcggcagcgcaaaagatg

SEQ ID NO: 17888 - DNA, 103 bp, Artificial Sequence
  Synthetic Polynucleotide
taatacgactcactatagggtgtcatctaaatttggaattttactccacaaacagaggagatgtggaatgaaattccaaaacctggcggcagcgcaaaagatg

SEQ ID NO: 17889 - DNA, 103 bp, Artificial Sequence
  Synthetic Polynucleotide
taatacgactcactatagggaaaactgtcatctaaatttggaattttactaacagaggagaagtaaaatgccaaatttaaacctggcggcagcgcaaaagatg

SEQ ID NO: 17890 - DNA, 103 bp, Artificial Sequence
  Synthetic Polynucleotide
taatacgactcactataggggttttaaaactgtcatctaaatttggaattaacagaggagaaattccatgtttagatgaaacctggcggcagcgcaaaagatg

SEQ ID NO: 17891 - DNA, 103 bp, Artificial Sequence
  Synthetic Polynucleotide
taatacgactcactatagggctacgctccgcccattttaaccgttacaaaaacagaggagatttgtaatggttaaaatgaacctggcggcagcgcaaaagatg

SEQ ID NO: 17892 - DNA, 103 bp, Artificial Sequence
  Synthetic Polynucleotide
taatacgactcactatagggactgagttttaaaactgtcatctaaatttgaacagaggagacaaattatgatgacagttaacctggcggcagcgcaaaagatg

SEQ ID NO: 17893 - DNA, 103 bp, Artificial Sequence
  Synthetic Polynucleotide
taatacgactcactatagggtgcaaactgagttttaaaactgtcatctaaaacagaggagattagatatgagttttaaaaacctggcggcagcgcaaaagatg

SEQ ID NO: 17894 - DNA, 103 bp, Artificial Sequence
  Synthetic Polynucleotide
taatacgactcactatagggaaggctgcaaactgagttttaaaactgtcaaacagaggagatgacagatgtaaaactcaaacctggcggcagcgcaaaagatg

SEQ ID NO: 17895 - DNA, 103 bp, Artificial Sequence
  Synthetic Polynucleotide
taatacgactcactatagggctcctaaggctgcaaactgagttttaaaacaacagaggagagttttaatgctcagtttgaacctggcggcagcgcaaaagatg

SEQ ID NO: 17896 - DNA, 103 bp, Artificial Sequence
  Synthetic Polynucleotide
taatacgactcactatagggccatcctcctaaggctgcaaactgagttttaacagaggagaaaaactatgtttgcagccaacctggcggcagcgcaaaagatg

SEQ ID NO: 17897 - DNA, 103 bp, Artificial Sequence
  Synthetic Polynucleotide
taatacgactcactatagggaaaccccatcctcctaaggctgcaaactgaaacagaggagatcagttatgagccttaggaacctggcggcagcgcaaaagatg

SEQ ID NO: 17898 - DNA, 103 bp, Artificial Sequence
  Synthetic Polynucleotide
taatacgactcactataggggatgcaaaccccatcctcctaaggctgcaaaacagaggagattgcagatgtaggaggataacctggcggcagcgcaaaagatg

SEQ ID NO: 17899 - DNA, 103 bp, Artificial Sequence
  Synthetic Polynucleotide
taatacgactcactatagggtggctgatgcaaaccccatcctcctaaggcaacagaggagagccttaatgggatggggtaacctggcggcagcgcaaaagatg

SEQ ID NO: 17900 - DNA, 103 bp, Artificial Sequence
  Synthetic Polynucleotide
taatacgactcactatagggggaggtggctgatgcaaaccccatcctcctaacagaggagaaggaggatggggtttgcaaacctggcggcagcgcaaaagatg

SEQ ID NO: 17901 - DNA, 103 bp, Artificial Sequence
  Synthetic Polynucleotide
taatacgactcactatagggtttgaggaggtggctgatgcaaaccccatcaacagaggagagatgggatgtgcatcagcaacctggcggcagcgcaaaagatg

SEQ ID NO: 17902 - DNA, 103 bp, Artificial Sequence
  Synthetic Polynucleotide
taatacgactcactatagggcccgcctacgctccgcccattttaaccgttaacagaggagaaacggtatgaatgggcggaacctggcggcagcgcaaaagatg

SEQ ID NO: 17903 - DNA, 103 bp, Artificial Sequence
  Synthetic Polynucleotide
taatacgactcactatagggaaatatttgaggaggtggctgatgcaaaccaacagaggagaggtttgatgcagccacctaacctggcggcagcgcaaaagatg

SEQ ID NO: 17904 - DNA, 103 bp, Artificial Sequence
  Synthetic Polynucleotide
taatacgactcactatagggtttaaaaatatttgaggaggtggctgatgcaacagaggagagcatcaatgacctcctcaaacctggcggcagcgcaaaagatg

SEQ ID NO: 17905 - DNA, 103 bp, Artificial Sequence
  Synthetic Polynucleotide
taatacgactcactatagggatatttttaaaaatatttgaggaggtggctaacagaggagaagccacatgctcaaatataacctggcggcagcgcaaaagatg

SEQ ID NO: 17906 - DNA, 103 bp, Artificial Sequence
  Synthetic Polynucleotide
taatacgactcactatagggtggtaatatttttaaaaatatttgaggaggaacagaggagacctcctatgatatttttaaacctggcggcagcgcaaaagatg

SEQ ID NO: 17907 - DNA, 103 bp, Artificial Sequence
  Synthetic Polynucleotide
taatacgactcactatagggctttgtggtaatatttttaaaaatatttgaaacagaggagatcaaatatgtttaaaaataacctggcggcagcgcaaaagatg

SEQ ID NO: 17908 - DNA, 103 bp, Artificial Sequence
  Synthetic Polynucleotide
taatacgactcactataggggcccactttgtggtaatatttttaaaaataaacagaggagatattttatgaaatattacaacctggcggcagcgcaaaagatg

SEQ ID NO: 17909 - DNA, 103 bp, Artificial Sequence
  Synthetic Polynucleotide
taatacgactcactatagggaattggcccactttgtggtaatatttttaaaacagaggagattaaaaatgttaccacaaaacctggcggcagcgcaaaagatg

SEQ ID NO: 17910 - DNA, 103 bp, Artificial Sequence
  Synthetic Polynucleotide
taatacgactcactatagggcctccaattggcccactttgtggtaatattaacagaggagaaatattatgacaaagtggaacctggcggcagcgcaaaagatg

SEQ ID NO: 17911 - DNA, 103 bp, Artificial Sequence
  Synthetic Polynucleotide
taatacgactcactatagggtaatacctccaattggcccactttgtggtaaacagaggagataccacatggtgggccaaaacctggcggcagcgcaaaagatg

SEQ ID NO: 17912 - DNA, 103 bp, Artificial Sequence
  Synthetic Polynucleotide
taatacgactcactatagggtgatttaatacctccaattggcccactttgaacagaggagacaaagtatgccaattggaaacctggcggcagcgcaaaagatg

SEQ ID NO: 17913 - DNA, 103 bp, Artificial Sequence
  Synthetic Polynucleotide
taatacgactcactatagggtagtccccgcctacgctccgcccattttaaaacagaggagattaaaaatggcggagcgtaacctggcggcagcgcaaaagatg

SEQ ID NO: 17914 - DNA, 103 bp, Artificial Sequence
  Synthetic Polynucleotide
taatacgactcactatagggcccattgatttaatacctccaattggcccaaacagaggagatgggccatgtggaggtataacctggcggcagcgcaaaagatg

SEQ ID NO: 17915 - DNA, 103 bp, Artificial Sequence
  Synthetic Polynucleotide
taatacgactcactatagggtaattcccattgatttaatacctccaattgaacagaggagacaattgatggtattaaataacctggcggcagcgcaaaagatg

SEQ ID NO: 17916 - DNA, 103 bp, Artificial Sequence
  Synthetic Polynucleotide
taatacgactcactatagggggtagtaattcccattgatttaatacctccaacagaggagaggaggtatgaaatcaatgaacctggcggcagcgcaaaagatg

SEQ ID NO: 17917 - DNA, 103 bp, Artificial Sequence
  Synthetic Polynucleotide
taatacgactcactatagggactaaggtagtaattcccattgatttaataaacagaggagatattaaatgaatgggaataacctggcggcagcgcaaaagatg

SEQ ID NO: 17918 - DNA, 103 bp, Artificial Sequence
  Synthetic Polynucleotide
taatacgactcactatagggactgaactaaggtagtaattcccattgattaacagaggagaaatcaaatggaattactaaacctggcggcagcgcaaaagatg

SEQ ID NO: 17919 - DNA, 103 bp, Artificial Sequence
  Synthetic Polynucleotide
taatacgactcactatagggggcatactgaactaaggtagtaattcccataacagaggagaatgggaatgactaccttaaacctggcggcagcgcaaaagatg

SEQ ID NO: 17920 - DNA, 103 bp, Artificial Sequence
  Synthetic Polynucleotide
taatacgactcactatagggcccacggcatactgaactaaggtagtaattaacagaggagaaattacatgcttagttcaaacctggcggcagcgcaaaagatg

SEQ ID NO: 17921 - DNA, 103 bp, Artificial Sequence
  Synthetic Polynucleotide
taatacgactcactatagggtaattcccacggcatactgaactaaggtagaacagaggagactacctatgttcagtatgaacctggcggcagcgcaaaagatg

SEQ ID NO: 17922 - DNA, 103 bp, Artificial Sequence
  Synthetic Polynucleotide
taatacgactcactatagggtgtcataattcccacggcatactgaactaaaacagaggagattagttatgtatgccgtgaacctggcggcagcgcaaaagatg

SEQ ID NO: 17923 - DNA, 103 bp, Artificial Sequence
  Synthetic Polynucleotide
taatacgactcactataggggttactgtcataattcccacggcatactgaaacagaggagatcagtaatgcgtgggaataacctggcggcagcgcaaaagatg

SEQ ID NO: 17924 - DNA, 103 bp, Artificial Sequence
  Synthetic Polynucleotide
taatacgactcactatagggtactgtagtccccgcctacgctccgcccataacagaggagaatgggcatggcgtaggcgaacctggcggcagcgcaaaagatg

SEQ ID NO: 17925 - DNA, 103 bp, Artificial Sequence
  Synthetic Polynucleotide
taatacgactcactatagggtcatggttactgtcataattcccacggcataacagaggagaatgccgatggaattatgaaacctggcggcagcgcaaaagatg

SEQ ID NO: 17926 - DNA, 103 bp, Artificial Sequence
  Synthetic Polynucleotide
taatacgactcactatagggaaatgtcatggttactgtcataattcccacaacagaggagagtgggaatgatgacagtaaacctggcggcagcgcaaaagatg

SEQ ID NO: 17927 - DNA, 103 bp, Artificial Sequence
  Synthetic Polynucleotide
taatacgactcactatagggaatttaaatgtcatggttactgtcataattaacagaggagaaattatatgagtaaccataacctggcggcagcgcaaaagatg

SEQ ID NO: 17928 - DNA, 103 bp, Artificial Sequence
  Synthetic Polynucleotide
taatacgactcactataggggccccaatttaaatgtcatggttactgtcaaacagaggagatgacagatgccatgacataacctggcggcagcgcaaaagatg

SEQ ID NO: 17929 - DNA, 103 bp, Artificial Sequence
  Synthetic Polynucleotide
taatacgactcactatagggacggggccccaatttaaatgtcatggttacaacagaggagagtaaccatgacatttaaaaacctggcggcagcgcaaaagatg

SEQ ID NO: 17930 - DNA, 103 bp, Artificial Sequence
  Synthetic Polynucleotide
taatacgactcactataggggctttacggggccccaatttaaatgtcatgaacagaggagacatgacatgtaaattgggaacctggcggcagcgcaaaagatg

SEQ ID NO: 17931 - DNA, 103 bp, Artificial Sequence
  Synthetic Polynucleotide
taatacgactcactatagggccgtagctttacggggccccaatttaaatgaacagaggagacatttaatgtggggccccaacctggcggcagcgcaaaagatg

SEQ ID NO: 17932 - DNA, 103 bp, Artificial Sequence
  Synthetic Polynucleotide
taatacgactcactatagggccgtcccgtagctttacggggccccaatttaacagaggagaaaattgatgccccgtaaaaacctggcggcagcgcaaaagatg

SEQ ID NO: 17933 - DNA, 103 bp, Artificial Sequence
  Synthetic Polynucleotide
taatacgactcactatagggttccaccgtcccgtagctttacggggccccaacagaggagaggggccatgtaaagctacaacctggcggcagcgcaaaagatg

SEQ ID NO: 17934 - DNA, 103 bp, Artificial Sequence
  Synthetic Polynucleotide
taatacgactcactataggggaggattccaccgtcccgtagctttacgggaacagaggagacccgtaatgctacgggacaacctggcggcagcgcaaaagatg

SEQ ID NO: 17935 - DNA, 103 bp, Artificial Sequence
  Synthetic Polynucleotide
taatacgactcactatagggatatatactgtagtccccgcctacgctccgaacagaggagacggagcatgggcggggacaacctggcggcagcgcaaaagatg

SEQ ID NO: 17936 - DNA, 103 bp, Artificial Sequence
  Synthetic Polynucleotide
taatacgactcactatagggaggttgaggattccaccgtcccgtagctttaacagaggagaaaagctatgggacggtggaacctggcggcagcgcaaaagatg

SEQ ID NO: 17937 - DNA, 103 bp, Artificial Sequence
  Synthetic Polynucleotide
taatacgactcactatagggactccaggttgaggattccaccgtcccgtaaacagaggagatacgggatggtggaatccaacctggcggcagcgcaaaagatg

SEQ ID NO: 17938 - DNA, 103 bp, Artificial Sequence
  Synthetic Polynucleotide
taatacgactcactataggggatatactccaggttgaggattccaccgtcaacagaggagagacggtatgatcctcaacaacctggcggcagcgcaaaagatg

SEQ ID NO: 17939 - DNA, 103 bp, Artificial Sequence
  Synthetic Polynucleotide
taatacgactcactatagggcgggggatatactccaggttgaggattccaaacagaggagatggaatatgcaacctggaaacctggcggcagcgcaaaagatg

SEQ ID NO: 17940 - DNA, 103 bp, Artificial Sequence
  Synthetic Polynucleotide
taatacgactcactataggggcgtgcgggggatatactccaggttgaggaaacagaggagatcctcaatgtggagtataaacctggcggcagcgcaaaagatg

SEQ ID NO: 17941 - DNA, 103 bp, Artificial Sequence
  Synthetic Polynucleotide
taatacgactcactatagggctgctgcgtgcgggggatatactccaggttaacagaggagaaacctgatgtatatccccaacctggcggcagcgcaaaagatg

SEQ ID NO: 17942 - DNA, 103 bp, Artificial Sequence
  Synthetic Polynucleotide
taatacgactcactatagggatgacctgctgcgtgcgggggatatactccaacagaggagaggagtaatgcccccgcacaacctggcggcagcgcaaaagatg

SEQ ID NO: 17943 - DNA, 103 bp, Artificial Sequence
  Synthetic Polynucleotide
taatacgactcactatagggggtaaatgacctgctgcgtgcgggggatataacagaggagaatatccatggcacgcagcaacctggcggcagcgcaaaagatg

SEQ ID NO: 17944 - DNA, 103 bp, Artificial Sequence
  Synthetic Polynucleotide
taatacgactcactatagggcatatggtaaatgacctgctgcgtgcggggaacagaggagaccccgcatgcagcaggtcaacctggcggcagcgcaaaagatg

SEQ ID NO: 17945 - DNA, 103 bp, Artificial Sequence
  Synthetic Polynucleotide
taatacgactcactatagggtagtacatatggtaaatgacctgctgcgtgaacagaggagacacgcaatgggtcatttaaacctggcggcagcgcaaaagatg

SEQ ID NO: 17946 - DNA, 103 bp, Artificial Sequence
  Synthetic Polynucleotide
taatacgactcactataggggtgctatatatactgtagtccccgcctacgaacagaggagacgtaggatgggactacagaacctggcggcagcgcaaaagatg

SEQ ID NO: 17947 - DNA, 103 bp, Artificial Sequence
  Synthetic Polynucleotide
taatacgactcactatagggtcatatagtacatatggtaaatgacctgctaacagaggagaagcaggatgtttaccataaacctggcggcagcgcaaaagatg

SEQ ID NO: 17948 - DNA, 103 bp, Artificial Sequence
  Synthetic Polynucleotide
taatacgactcactatagggtagggtcatatagtacatatggtaaatgacaacagaggagagtcattatgcatatgtacaacctggcggcagcgcaaaagatg

SEQ ID NO: 17949 - DNA, 103 bp, Artificial Sequence
  Synthetic Polynucleotide
taatacgactcactatagggagctgtagggtcatatagtacatatggtaaaacagaggagattaccaatggtactatataacctggcggcagcgcaaaagatg

SEQ ID NO: 17950 - DNA, 103 bp, Artificial Sequence
  Synthetic Polynucleotide
taatacgactcactatagggtctgtagctgtagggtcatatagtacatataacagaggagaatatgtatgatatgacccaacctggcggcagcgcaaaagatg

SEQ ID NO: 17951 - DNA, 103 bp, Artificial Sequence
  Synthetic Polynucleotide
taatacgactcactatagggttgcatctgtagctgtagggtcatatagtaaacagaggagatactatatgaccctacagaacctggcggcagcgcaaaagatg

SEQ ID NO: 17952 - DNA, 103 bp, Artificial Sequence
  Synthetic Polynucleotide
taatacgactcactatagggttgttttgcatctgtagctgtagggtcataaacagaggagatatgacatgacagctacaaacctggcggcagcgcaaaagatg

SEQ ID NO: 17953 - DNA, 103 bp, Artificial Sequence
  Synthetic Polynucleotide
taatacgactcactatagggtggtgttgttttgcatctgtagctgtagggaacagaggagaccctacatgtacagatgcaacctggcggcagcgcaaaagatg

SEQ ID NO: 17954 - DNA, 103 bp, Artificial Sequence
  Synthetic Polynucleotide
taatacgactcactataggggtctgtggtgttgttttgcatctgtagctgaacagaggagacagctaatgatgcaaaacaacctggcggcagcgcaaaagatg

SEQ ID NO: 17955 - DNA, 103 bp, Artificial Sequence
  Synthetic Polynucleotide
taatacgactcactatagggtccatgtctgtggtgttgttttgcatctgtaacagaggagaacagatatgaaacaacacaacctggcggcagcgcaaaagatg

SEQ ID NO: 17956 - DNA, 103 bp, Artificial Sequence
  Synthetic Polynucleotide
taatacgactcactatagggtcatatccatgtctgtggtgttgttttgcaaacagaggagatgcaaaatgacaccacagaacctggcggcagcgcaaaagatg

SEQ ID NO: 17957 - DNA, 103 bp, Artificial Sequence
  Synthetic Polynucleotide
taatacgactcactataggggtgctgtgctatatatactgtagtccccgcaacagaggagagcggggatgacagtatataacctggcggcagcgcaaaagatg

SEQ ID NO: 17958 - DNA, 103 bp, Artificial Sequence
  Synthetic Polynucleotide
taatacgactcactataggggcttttcatatccatgtctgtggtgttgttaacagaggagaaacaacatgacagacatgaacctggcggcagcgcaaaagatg

SEQ ID NO: 17959 - DNA, 103 bp, Artificial Sequence
  Synthetic Polynucleotide
taatacgactcactatagggttcaggcttttcatatccatgtctgtggtgaacagaggagacaccacatgcatggatataacctggcggcagcgcaaaagatg

SEQ ID NO: 17960 - DNA, 103 bp, Artificial Sequence
  Synthetic Polynucleotide
taatacgactcactatagggaattcttcaggcttttcatatccatgtctgaacagaggagacagacaatgatatgaaaaaacctggcggcagcgcaaaagatg

SEQ ID NO: 17961 - DNA, 103 bp, Artificial Sequence
  Synthetic Polynucleotide
taatacgactcactatagggtccacaattcttcaggcttttcatatccataacagaggagaatggatatgaaaagcctgaacctggcggcagcgcaaaagatg

SEQ ID NO: 17962 - DNA, 103 bp, Artificial Sequence
  Synthetic Polynucleotide
taatacgactcactatagggggctgtccacaattcttcaggcttttcataaacagaggagatatgaaatgcctgaagaaaacctggcggcagcgcaaaagatg

SEQ ID NO: 17963 - DNA, 103 bp, Artificial Sequence
  Synthetic Polynucleotide
taatacgactcactatagggcttttggctgtccacaattcttcaggctttaacagaggagaaaagccatgagaattgtgaacctggcggcagcgcaaaagatg

SEQ ID NO: 17964 - DNA, 103 bp, Artificial Sequence
  Synthetic Polynucleotide
taatacgactcactatagggcacggcttttggctgtccacaattcttcagaacagaggagactgaagatgtgtggacagaacctggcggcagcgcaaaagatg

SEQ ID NO: 17965 - DNA, 103 bp, Artificial Sequence
  Synthetic Polynucleotide
taatacgactcactataggggtgcacacggcttttggctgtccacaattcaacagaggagagaattgatgacagccaaaaacctggcggcagcgcaaaagatg

SEQ ID NO: 17966 - DNA, 103 bp, Artificial Sequence
  Synthetic Polynucleotide
taatacgactcactatagggaatgggtgcacacggcttttggctgtccacaacagaggagagtggacatgcaaaagccgaacctggcggcagcgcaaaagatg

SEQ ID NO: 17967 - DNA, 103 bp, Artificial Sequence
  Synthetic Polynucleotide
taatacgactcactatagggtttacaatgggtgcacacggcttttggctgaacagaggagacagccaatggccgtgtgcaacctggcggcagcgcaaaagatg

SEQ ID NO: 17968 - DNA, 103 bp, Artificial Sequence
  Synthetic Polynucleotide
taatacgactcactatagggcggcagtgctgtgctatatatactgtagtcaacagaggagagactacatgatatatagcaacctggcggcagcgcaaaagatg

SEQ ID NO: 17969 - DNA, 103 bp, Artificial Sequence
  Synthetic Polynucleotide
taatacgactcactataggggagtgtttacaatgggtgcacacggcttttaacagaggagaaaaagcatggtgcacccaaacctggcggcagcgcaaaagatg

SEQ ID NO: 17970 - DNA, 103 bp, Artificial Sequence
  Synthetic Polynucleotide
taatacgactcactataggggtggggagtgtttacaatgggtgcacacggaacagaggagaccgtgtatgcccattgtaaacctggcggcagcgcaaaagatg

SEQ ID NO: 17971 - DNA, 103 bp, Artificial Sequence
  Synthetic Polynucleotide
taatacgactcactataggggcacggtggggagtgtttacaatgggtgcaaacagaggagatgcaccatgtgtaaacacaacctggcggcagcgcaaaagatg

SEQ ID NO: 17972 - DNA, 103 bp, Artificial Sequence
  Synthetic Polynucleotide
taatacgactcactatagggtgagggcacggtggggagtgtttacaatggaacagaggagaccattgatgacactccccaacctggcggcagcgcaaaagatg

SEQ ID NO: 17973 - DNA, 103 bp, Artificial Sequence
  Synthetic Polynucleotide
taatacgactcactatagggctggctgagggcacggtggggagtgtttacaacagaggagagtaaacatgccccaccgtaacctggcggcagcgcaaaagatg

SEQ ID NO: 17974 - DNA, 103 bp, Artificial Sequence
  Synthetic Polynucleotide
taatacgactcactataggggcatcctggctgagggcacggtggggagtgaacagaggagacactccatgccgtgccctaacctggcggcagcgcaaaagatg

SEQ ID NO: 17975 - DNA, 103 bp, Artificial Sequence
  Synthetic Polynucleotide
taatacgactcactataggggttacgcatcctggctgagggcacggtgggaacagaggagacccaccatgccctcagccaacctggcggcagcgcaaaagatg

SEQ ID NO: 17976 - DNA, 103 bp, Artificial Sequence
  Synthetic Polynucleotide
taatacgactcactataggggtttagttacgcatcctggctgagggcacgaacagaggagacgtgccatgagccaggataacctggcggcagcgcaaaagatg

SEQ ID NO: 17977 - DNA, 103 bp, Artificial Sequence
  Synthetic Polynucleotide
taatacgactcactatagggtgggcgtttagttacgcatcctggctgaggaacagaggagacctcagatgggatgcgtaaacctggcggcagcgcaaaagatg

SEQ ID NO: 17978 - DNA, 103 bp, Artificial Sequence
  Synthetic Polynucleotide
taatacgactcactatagggactggtgggcgtttagttacgcatcctggcaacagaggagagccaggatgcgtaactaaaacctggcggcagcgcaaaagatg

SEQ ID NO: 17979 - DNA, 103 bp, Artificial Sequence
  Synthetic Polynucleotide
taatacgactcactatagggtgagtgggaacaacccactcccagttttaaaacagaggagattaaaaatgggagtgggtaacctggcggcagcgcaaaagatg

SEQ ID NO: 17980 - DNA, 103 bp, Artificial Sequence
  Synthetic Polynucleotide
taatacgactcactatagggtacaaagttaccgtaataacagagtacaacaacagaggagagttgtaatgtgttattacaacctggcggcagcgcaaaagatg

SEQ ID NO: 17981 - DNA, 103 bp, Artificial Sequence
  Synthetic Polynucleotide
taatacgactcactatagggcacttacgcattacgaccgcaaacccattgaacagaggagacaatggatgtgcggtcgtaacctggcggcagcgcaaaagatg

SEQ ID NO: 17982 - DNA, 103 bp, Artificial Sequence
  Synthetic Polynucleotide
taatacgactcactatagggtaaatctctttcaatagaacactctgctggaacagaggagaccagcaatgtgttctattaacctggcggcagcgcaaaagatg

SEQ ID NO: 17983 - DNA, 103 bp, Artificial Sequence
  Synthetic Polynucleotide
taatacgactcactatagggatccctaaatctctttcaatagaacactctaacagaggagaagagtgatgtattgaaagaacctggcggcagcgcaaaagatg

SEQ ID NO: 17984 - DNA, 103 bp, Artificial Sequence
  Synthetic Polynucleotide
taatacgactcactatagggttgctatccctaaatctctttcaatagaacaacagaggagagttctaatgaaagagattaacctggcggcagcgcaaaagatg

SEQ ID NO: 17985 - DNA, 103 bp, Artificial Sequence
  Synthetic Polynucleotide
taatacgactcactatagggcatatttgctatccctaaatctctttcaataacagaggagaattgaaatggatttagggaacctggcggcagcgcaaaagatg

SEQ ID NO: 17986 - DNA, 103 bp, Artificial Sequence
  Synthetic Polynucleotide
taatacgactcactatagggatagtcatatttgctatccctaaatctcttaacagaggagaaagagaatgagggatagcaacctggcggcagcgcaaaagatg

SEQ ID NO: 17987 - DNA, 103 bp, Artificial Sequence
  Synthetic Polynucleotide
taatacgactcactatagggtacctatagtcatatttgctatccctaaataacagaggagaatttagatgtagcaaataaacctggcggcagcgcaaaagatg

SEQ ID NO: 17988 - DNA, 103 bp, Artificial Sequence
  Synthetic Polynucleotide
taatacgactcactatagggtattatacctatagtcatatttgctatcccaacagaggagagggataatgaatatgactaacctggcggcagcgcaaaagatg

SEQ ID NO: 17989 - DNA, 103 bp, Artificial Sequence
  Synthetic Polynucleotide
taatacgactcactatagggttagctattatacctatagtcatatttgctaacagaggagaagcaaaatggactataggaacctggcggcagcgcaaaagatg

SEQ ID NO: 17990 - DNA, 103 bp, Artificial Sequence
  Synthetic Polynucleotide
taatacgactcactatagggccacattagctattatacctatagtcatataacagaggagaatatgaatgtaggtataaaacctggcggcagcgcaaaagatg

SEQ ID NO: 17991 - DNA, 103 bp, Artificial Sequence
  Synthetic Polynucleotide
taatacgactcactatagggagagaccacattagctattatacctatagtaacagaggagaactataatgataatagctaacctggcggcagcgcaaaagatg

SEQ ID NO: 17992 - DNA, 103 bp, Artificial Sequence
  Synthetic Polynucleotide
taatacgactcactatagggtcccgcacttacgcattacgaccgcaaaccaacagaggagaggtttgatgtcgtaatgcaacctggcggcagcgcaaaagatg

SEQ ID NO: 17993 - DNA, 103 bp, Artificial Sequence
  Synthetic Polynucleotide
taatacgactcactatagggactatagagaccacattagctattatacctaacagaggagaaggtatatgagctaatgtaacctggcggcagcgcaaaagatg

SEQ ID NO: 17994 - DNA, 103 bp, Artificial Sequence
  Synthetic Polynucleotide
taatacgactcactatagggcacctactatagagaccacattagctattaaacagaggagataatagatgatgtggtctaacctggcggcagcgcaaaagatg

SEQ ID NO: 17995 - DNA, 103 bp, Artificial Sequence
  Synthetic Polynucleotide
taatacgactcactataggggataacacctactatagagaccacattagcaacagaggagagctaatatggtctctataaacctggcggcagcgcaaaagatg

SEQ ID NO: 17996 - DNA, 103 bp, Artificial Sequence
  Synthetic Polynucleotide
taatacgactcactatagggatatagataacacctactatagagaccacaaacagaggagatgtggtatgtatagtaggaacctggcggcagcgcaaaagatg

SEQ ID NO: 17997 - DNA, 103 bp, Artificial Sequence
  Synthetic Polynucleotide
taatacgactcactatagggaaattatatagataacacctactatagagaaacagaggagatctctaatgtaggtgttaaacctggcggcagcgcaaaagatg

SEQ ID NO: 17998 - DNA, 103 bp, Artificial Sequence
  Synthetic Polynucleotide
taatacgactcactatagggtttataaattatatagataacacctactataacagaggagaatagtaatggttatctataacctggcggcagcgcaaaagatg

SEQ ID NO: 17999 - DNA, 103 bp, Artificial Sequence
  Synthetic Polynucleotide
taatacgactcactatagggaacaatttataaattatatagataacacctaacagaggagaaggtgtatgctatataataacctggcggcagcgcaaaagatg

SEQ ID NO: 18000 - DNA, 103 bp, Artificial Sequence
  Synthetic Polynucleotide
taatacgactcactatagggtacagaacaatttataaattatatagataaaacagaggagattatctatgtaatttataaacctggcggcagcgcaaaagatg

SEQ ID NO: 18001 - DNA, 103 bp, Artificial Sequence
  Synthetic Polynucleotide
taatacgactcactatagggaagtgtacagaacaatttataaattatataaacagaggagatatataatgtataaattgaacctggcggcagcgcaaaagatg

SEQ ID NO: 18002 - DNA, 103 bp, Artificial Sequence
  Synthetic Polynucleotide
taatacgactcactatagggccctgaagtgtacagaacaatttataaattaacagaggagaaatttaatgattgttctgaacctggcggcagcgcaaaagatg

SEQ ID NO: 18003 - DNA, 103 bp, Artificial Sequence
  Synthetic Polynucleotide
taatacgactcactatagggtcccatcccgcacttacgcattacgaccgcaacagaggagagcggtcatgatgcgtaagaacctggcggcagcgcaaaagatg

SEQ ID NO: 18004 - DNA, 103 bp, Artificial Sequence
  Synthetic Polynucleotide
taatacgactcactatagggatggaccctgaagtgtacagaacaatttataacagaggagaataaatatgtctgtacacaacctggcggcagcgcaaaagatg

SEQ ID NO: 18005 - DNA, 103 bp, Artificial Sequence
  Synthetic Polynucleotide
taatacgactcactatagggtgagtatggaccctgaagtgtacagaacaaaacagaggagattgttcatgacacttcagaacctggcggcagcgcaaaagatg

SEQ ID NO: 18006 - DNA, 103 bp, Artificial Sequence
  Synthetic Polynucleotide
taatacgactcactatagggtcccctgagtatggaccctgaagtgtacagaacagaggagactgtacatgtcagggtccaacctggcggcagcgcaaaagatg

SEQ ID NO: 18007 - DNA, 103 bp, Artificial Sequence
  Synthetic Polynucleotide
taatacgactcactatagggtaggttcccctgagtatggaccctgaagtgaacagaggagacacttcatggtccatactaacctggcggcagcgcaaaagatg

SEQ ID NO: 18008 - DNA, 103 bp, Artificial Sequence
  Synthetic Polynucleotide
taatacgactcactataggggggtttaggttcccctgagtatggaccctgaacagaggagacagggtatgtactcagggaacctggcggcagcgcaaaagatg

SEQ ID NO: 18009 - DNA, 103 bp, Artificial Sequence
  Synthetic Polynucleotide
taatacgactcactatagggcttttgggtttaggttcccctgagtatggaaacagaggagatccataatgaggggaaccaacctggcggcagcgcaaaagatg

SEQ ID NO: 18010 - DNA, 103 bp, Artificial Sequence
  Synthetic Polynucleotide
taatacgactcactatagggctctgcttttgggtttaggttcccctgagtaacagaggagaactcagatgaacctaaacaacctggcggcagcgcaaaagatg

SEQ ID NO: 18011 - DNA, 103 bp, Artificial Sequence
  Synthetic Polynucleotide
taatacgactcactatagggtggagctctgcttttgggtttaggttccccaacagaggagaggggaaatgaaacccaaaaacctggcggcagcgcaaaagatg

SEQ ID NO: 18012 - DNA, 103 bp, Artificial Sequence
  Synthetic Polynucleotide
taatacgactcactatagggctctctggagctctgcttttgggtttaggtaacagaggagaacctaaatgcaaaagcagaacctggcggcagcgcaaaagatg

SEQ ID NO: 18013 - DNA, 103 bp, Artificial Sequence
  Synthetic Polynucleotide
taatacgactcactatagggctcttctctctggagctctgcttttgggttaacagaggagaaacccaatggcagagctcaacctggcggcagcgcaaaagatg

SEQ ID NO: 18014 - DNA, 103 bp, Artificial Sequence
  Synthetic Polynucleotide
taatacgactcactataggggttggtcccatcccgcacttacgcattacgaacagaggagacgtaatatgtaagtgcggaacctggcggcagcgcaaaagatg

SEQ ID NO: 18015 - DNA, 103 bp, Artificial Sequence
  Synthetic Polynucleotide
taatacgactcactatagggaactactcttctctctggagctctgcttttaacagaggagaaaaagcatggctccagagaacctggcggcagcgcaaaagatg

SEQ ID NO: 18016 - DNA, 103 bp, Artificial Sequence
  Synthetic Polynucleotide
taatacgactcactatagggtgagtaactactcttctctctggagctctgaacagaggagacagagcatgagagagaagaacctggcggcagcgcaaaagatg

SEQ ID NO: 18017 - DNA, 103 bp, Artificial Sequence
  Synthetic Polynucleotide
taatacgactcactatagggggccctgagtaactactcttctctctggagaacagaggagactccagatggaagagtagaacctggcggcagcgcaaaagatg

SEQ ID NO: 18018 - DNA, 103 bp, Artificial Sequence
  Synthetic Polynucleotide
taatacgactcactatagggctctgggccctgagtaactactcttctctcaacagaggagagagagaatggtagttactaacctggcggcagcgcaaaagatg

SEQ ID NO: 18019 - DNA, 103 bp, Artificial Sequence
  Synthetic Polynucleotide
taatacgactcactatagggtcttcctctgggccctgagtaactactcttaacagaggagaaagagtatgtactcagggaacctggcggcagcgcaaaagatg

SEQ ID NO: 18020 - DNA, 103 bp, Artificial Sequence
  Synthetic Polynucleotide
taatacgactcactatagggcaaactcttcctctgggccctgagtaactaaacagaggagatagttaatgagggcccagaacctggcggcagcgcaaaagatg

SEQ ID NO: 18021 - DNA, 103 bp, Artificial Sequence
  Synthetic Polynucleotide
taatacgactcactataggggcgaccaaactcttcctctgggccctgagtaacagaggagaactcagatgccagaggaaaacctggcggcagcgcaaaagatg

SEQ ID NO: 18022 - DNA, 103 bp, Artificial Sequence
  Synthetic Polynucleotide
taatacgactcactatagggagtgagcgaccaaactcttcctctgggcccaacagaggagagggcccatgggaagagttaacctggcggcagcgcaaaagatg

SEQ ID NO: 18023 - DNA, 103 bp, Artificial Sequence
  Synthetic Polynucleotide
taatacgactcactatagggtgagtagtgagcgaccaaactcttcctctgaacagaggagacagaggatgagtttggtcaacctggcggcagcgcaaaagatg

SEQ ID NO: 18024 - DNA, 103 bp, Artificial Sequence
  Synthetic Polynucleotide
taatacgactcactatagggatgtttgagtagtgagcgaccaaactcttcaacagaggagagaagagatgggtcgctcaaacctggcggcagcgcaaaagatg

SEQ ID NO: 18025 - DNA, 103 bp, Artificial Sequence
  Synthetic Polynucleotide
taatacgactcactatagggaagtagttggtcccatcccgcacttacgcaaacagaggagatgcgtaatggcgggatggaacctggcggcagcgcaaaagatg

SEQ ID NO: 18026 - DNA, 103 bp, Artificial Sequence
  Synthetic Polynucleotide
taatacgactcactatagggcaattatgtttgagtagtgagcgaccaaacaacagaggagagtttggatgctcactactaacctggcggcagcgcaaaagatg

SEQ ID NO: 18027 - DNA, 103 bp, Artificial Sequence
  Synthetic Polynucleotide
taatacgactcactatagggcacagcaattatgtttgagtagtgagcgacaacagaggagagtcgctatgtactcaaacaacctggcggcagcgcaaaagatg

SEQ ID NO: 18028 - DNA, 103 bp, Artificial Sequence
  Synthetic Polynucleotide
taatacgactcactatagggcacaacacagcaattatgtttgagtagtgaaacagaggagatcactaatgaaacataataacctggcggcagcgcaaaagatg

SEQ ID NO: 18029 - DNA, 103 bp, Artificial Sequence
  Synthetic Polynucleotide
taatacgactcactataggggttgtcacaacacagcaattatgtttgagtaacagaggagaactcaaatgtaattgctgaacctggcggcagcgcaaaagatg

SEQ ID NO: 18030 - DNA, 103 bp, Artificial Sequence
  Synthetic Polynucleotide
taatacgactcactatagggtgtcggttgtcacaacacagcaattatgttaacagaggagaaacataatggctgtgttgaacctggcggcagcgcaaaagatg

SEQ ID NO: 18031 - DNA, 103 bp, Artificial Sequence
  Synthetic Polynucleotide
taatacgactcactataggggcctttgtcggttgtcacaacacagcaattaacagaggagaaattgcatggttgtgacaaacctggcggcagcgcaaaagatg

SEQ ID NO: 18032 - DNA, 103 bp, Artificial Sequence
  Synthetic Polynucleotide
taatacgactcactatagggaatttgcctttgtcggttgtcacaacacagaacagaggagactgtgtatggacaaccgaaacctggcggcagcgcaaaagatg

SEQ ID NO: 18033 - DNA, 103 bp, Artificial Sequence
  Synthetic Polynucleotide
taatacgactcactatagggctgtgaatttgcctttgtcggttgtcacaaaacagaggagattgtgaatgccgacaaagaacctggcggcagcgcaaaagatg

SEQ ID NO: 18034 - DNA, 103 bp, Artificial Sequence
  Synthetic Polynucleotide
taatacgactcactatagggaagacctgtgaatttgcctttgtcggttgtaacagaggagaacaaccatgaaaggcaaaaacctggcggcagcgcaaaagatg

SEQ ID NO: 18035 - DNA, 103 bp, Artificial Sequence
  Synthetic Polynucleotide
taatacgactcactatagggatgccaagacctgtgaatttgcctttgtcgaacagaggagacgacaaatgcaaattcacaacctggcggcagcgcaaaagatg

SEQ ID NO: 18036 - DNA, 103 bp, Artificial Sequence
  Synthetic Polynucleotide
taatacgactcactatagggacccaaagtagttggtcccatcccgcacttaacagaggagaaagtgcatgatgggaccaaacctggcggcagcgcaaaagatg

SEQ ID NO: 18037 - DNA, 103 bp, Artificial Sequence
  Synthetic Polynucleotide
taatacgactcactatagggcatatatgccaagacctgtgaatttgccttaacagaggagaaaggcaatgtcacaggtcaacctggcggcagcgcaaaagatg

SEQ ID NO: 18038 - DNA, 103 bp, Artificial Sequence
  Synthetic Polynucleotide
taatacgactcactatagggttggtcatatatgccaagacctgtgaatttaacagaggagaaaattcatgggtcttggcaacctggcggcagcgcaaaagatg

SEQ ID NO: 18039 - DNA, 103 bp, Artificial Sequence
  Synthetic Polynucleotide
taatacgactcactatagggatgacttggtcatatatgccaagacctgtgaacagaggagacacaggatgtggcatataaacctggcggcagcgcaaaagatg

SEQ ID NO: 18040 - DNA, 103 bp, Artificial Sequence
  Synthetic Polynucleotide
taatacgactcactataggggtaccatgacttggtcatatatgccaagacaacagaggagagtcttgatgtatatgaccaacctggcggcagcgcaaaagatg

SEQ ID NO: 18041 - DNA, 103 bp, Artificial Sequence
  Synthetic Polynucleotide
taatacgactcactatagggtggaagtaccatgacttggtcatatatgccaacagaggagaggcataatggaccaagtcaacctggcggcagcgcaaaagatg

SEQ ID NO: 18042 - DNA, 103 bp, Artificial Sequence
  Synthetic Polynucleotide
taatacgactcactatagggtgtgttggaagtaccatgacttggtcatataacagaggagaatatgaatgagtcatggtaacctggcggcagcgcaaaagatg

SEQ ID NO: 18043 - DNA, 103 bp, Artificial Sequence
  Synthetic Polynucleotide
taatacgactcactatagggcagaatgtgttggaagtaccatgacttggtaacagaggagaaccaagatgtggtacttcaacctggcggcagcgcaaaagatg

SEQ ID NO: 18044 - DNA, 103 bp, Artificial Sequence
  Synthetic Polynucleotide
taatacgactcactatagggtgggtcagaatgtgttggaagtaccatgacaacagaggagagtcatgatgcttccaacaaacctggcggcagcgcaaaagatg

SEQ ID NO: 18045 - DNA, 103 bp, Artificial Sequence
  Synthetic Polynucleotide
taatacgactcactataggggagcctgggtcagaatgtgttggaagtaccaacagaggagaggtactatgaacacattcaacctggcggcagcgcaaaagatg

SEQ ID NO: 18046 - DNA, 103 bp, Artificial Sequence
  Synthetic Polynucleotide
taatacgactcactatagggtctcagagcctgggtcagaatgtgttggaaaacagaggagattccaaatgattctgaccaacctggcggcagcgcaaaagatg

SEQ ID NO: 18047 - DNA, 103 bp, Artificial Sequence
  Synthetic Polynucleotide
taatacgactcactatagggcggacacccaaagtagttggtcccatcccgaacagaggagacgggatatgaccaactacaacctggcggcagcgcaaaagatg

SEQ ID NO: 18048 - DNA, 103 bp, Artificial Sequence
  Synthetic Polynucleotide
taatacgactcactatagggcaagatctcagagcctgggtcagaatgtgtaacagaggagaacacatatggacccaggcaacctggcggcagcgcaaaagatg

SEQ ID NO: 18049 - DNA, 103 bp, Artificial Sequence
  Synthetic Polynucleotide
taatacgactcactatagggtctaccaagatctcagagcctgggtcagaaaacagaggagattctgaatgaggctctgaaacctggcggcagcgcaaaagatg

SEQ ID NO: 18050 - DNA, 103 bp, Artificial Sequence
  Synthetic Polynucleotide
taatacgactcactatagggctccatctaccaagatctcagagcctgggtaacagaggagaacccagatgctgagatctaacctggcggcagcgcaaaagatg

SEQ ID NO: 18051 - DNA, 103 bp, Artificial Sequence
  Synthetic Polynucleotide
taatacgactcactatagggttttactccatctaccaagatctcagagccaacagaggagaggctctatgatcttggtaaacctggcggcagcgcaaaagatg

SEQ ID NO: 18052 - DNA, 103 bp, Artificial Sequence
  Synthetic Polynucleotide
taatacgactcactatagggttaacttttactccatctaccaagatctcaaacagaggagatgagatatgggtagatggaacctggcggcagcgcaaaagatg

SEQ ID NO: 18053 - DNA, 103 bp, Artificial Sequence
  Synthetic Polynucleotide
taatacgactcactatagggagaccttaacttttactccatctaccaagaaacagaggagatcttggatgatggagtaaaacctggcggcagcgcaaaagatg

SEQ ID NO: 18054 - DNA, 103 bp, Artificial Sequence
  Synthetic Polynucleotide
taatacgactcactatagggatcagagaccttaacttttactccatctacaacagaggagagtagatatggtaaaagttaacctggcggcagcgcaaaagatg

SEQ ID NO: 18055 - DNA, 103 bp, Artificial Sequence
  Synthetic Polynucleotide
taatacgactcactatagggtaggaatcagagaccttaacttttactccaaacagaggagatggagtatgagttaaggtaacctggcggcagcgcaaaagatg

SEQ ID NO: 18056 - DNA, 103 bp, Artificial Sequence
  Synthetic Polynucleotide
taatacgactcactatagggaatcataggaatcagagaccttaacttttaaacagaggagataaaagatgaggtctctgaacctggcggcagcgcaaaagatg

SEQ ID NO: 18057 - DNA, 103 bp, Artificial Sequence
  Synthetic Polynucleotide
taatacgactcactatagggatgcaaatcataggaatcagagaccttaacaacagaggagagttaagatgtctgattccaacctggcggcagcgcaaaagatg

SEQ ID NO: 18058 - DNA, 103 bp, Artificial Sequence
  Synthetic Polynucleotide
taatacgactcactatagggaaacacggacacccaaagtagttggtcccaaacagaggagatgggacatgctactttggaacctggcggcagcgcaaaagatg

SEQ ID NO: 18059 - DNA, 103 bp, Artificial Sequence
  Synthetic Polynucleotide
taatacgactcactatagggtggttatgcaaatcataggaatcagagaccaacagaggagaggtctcatgttcctatgaaacctggcggcagcgcaaaagatg

SEQ ID NO: 18060 - DNA, 103 bp, Artificial Sequence
  Synthetic Polynucleotide
taatacgactcactatagggcctcatggttatgcaaatcataggaatcagaacagaggagactgattatgatgatttgcaacctggcggcagcgcaaaagatg

SEQ ID NO: 18061 - DNA, 103 bp, Artificial Sequence
  Synthetic Polynucleotide
taatacgactcactatagggaacaccctcatggttatgcaaatcataggaaacagaggagatcctatatgttgcataacaacctggcggcagcgcaaaagatg

SEQ ID NO: 18062 - DNA, 103 bp, Artificial Sequence
  Synthetic Polynucleotide
taatacgactcactatagggagcttaacaccctcatggttatgcaaatcaaacagaggagatgatttatgtaaccatgaaacctggcggcagcgcaaaagatg

SEQ ID NO: 18063 - DNA, 103 bp, Artificial Sequence
  Synthetic Polynucleotide
taatacgactcactatagggtctctagcttaacaccctcatggttatgcaaacagaggagatgcataatgatgagggtgaacctggcggcagcgcaaaagatg

SEQ ID NO: 18064 - DNA, 103 bp, Artificial Sequence
  Synthetic Polynucleotide
taatacgactcactatagggtgtgatctctagcttaacaccctcatggttaacagaggagaaaccatatgggtgttaagaacctggcggcagcgcaaaagatg

SEQ ID NO: 18065 - DNA, 103 bp, Artificial Sequence
  Synthetic Polynucleotide
taatacgactcactatagggacaactgtgatctctagcttaacaccctcaaacagaggagatgagggatgtaagctagaaacctggcggcagcgcaaaagatg

SEQ ID NO: 18066 - DNA, 103 bp, Artificial Sequence
  Synthetic Polynucleotide
taatacgactcactatagggatttcacaactgtgatctctagcttaacacaacagaggagagtgttaatgtagagatcaaacctggcggcagcgcaaaagatg

SEQ ID NO: 18067 - DNA, 103 bp, Artificial Sequence
  Synthetic Polynucleotide
taatacgactcactatagggaattaatttcacaactgtgatctctagcttaacagaggagaaagctaatgatcacagttaacctggcggcagcgcaaaagatg

SEQ ID NO: 18068 - DNA, 103 bp, Artificial Sequence
  Synthetic Polynucleotide
taatacgactcactatagggtttctaattaatttcacaactgtgatctctaacagaggagaagagatatgagttgtgaaaacctggcggcagcgcaaaagatg

SEQ ID NO: 18069 - DNA, 103 bp, Artificial Sequence
  Synthetic Polynucleotide
taatacgactcactatagggacaggaaacacggacacccaaagtagttggaacagaggagaccaactatgttgggtgtcaacctggcggcagcgcaaaagatg

SEQ ID NO: 18070 - DNA, 103 bp, Artificial Sequence
  Synthetic Polynucleotide
taatacgactcactatagggtctcatttctaattaatttcacaactgtgaaacagaggagatcacagatgtgaaattaaaacctggcggcagcgcaaaagatg

SEQ ID NO: 18071 - DNA, 103 bp, Artificial Sequence
  Synthetic Polynucleotide
taatacgactcactatagggaaacttctcatttctaattaatttcacaacaacagaggagagttgtgatgttaattagaaacctggcggcagcgcaaaagatg

SEQ ID NO: 18072 - DNA, 103 bp, Artificial Sequence
  Synthetic Polynucleotide
taatacgactcactatagggtctttaaacttctcatttctaattaatttcaacagaggagagaaattatgtagaaatgaaacctggcggcagcgcaaaagatg

SEQ ID NO: 18073 - DNA, 103 bp, Artificial Sequence
  Synthetic Polynucleotide
taatacgactcactatagggtgatgtctttaaacttctcatttctaattaaacagaggagataattaatgatgagaagtaacctggcggcagcgcaaaagatg

SEQ ID NO: 18074 - DNA, 103 bp, Artificial Sequence
  Synthetic Polynucleotide
taatacgactcactatagggttttctgatgtctttaaacttctcatttctaacagaggagaagaaatatgaagtttaaaaacctggcggcagcgcaaaagatg

SEQ ID NO: 18075 - DNA, 103 bp, Artificial Sequence
  Synthetic Polynucleotide
taatacgactcactatagggaaatattttctgatgtctttaaacttctcaaacagaggagatgagaaatgtaaagacataacctggcggcagcgcaaaagatg

SEQ ID NO: 18076 - DNA, 103 bp, Artificial Sequence
  Synthetic Polynucleotide
taatacgactcactatagggagggtaaatattttctgatgtctttaaactaacagaggagaagtttaatgacatcagaaaacctggcggcagcgcaaaagatg

SEQ ID NO: 18077 - DNA, 103 bp, Artificial Sequence
  Synthetic Polynucleotide
taatacgactcactatagggacgtgagggtaaatattttctgatgtctttaacagaggagaaaagacatgagaaaatataacctggcggcagcgcaaaagatg

SEQ ID NO: 18078 - DNA, 103 bp, Artificial Sequence
  Synthetic Polynucleotide
taatacgactcactatagggtcttcacgtgagggtaaatattttctgatgaacagaggagacatcagatgatatttaccaacctggcggcagcgcaaaagatg

SEQ ID NO: 18079 - DNA, 103 bp, Artificial Sequence
  Synthetic Polynucleotide
taatacgactcactatagggagtcatcttcacgtgagggtaaatattttcaacagaggagagaaaatatgtaccctcacaacctggcggcagcgcaaaagatg

SEQ ID NO: 18080 - DNA, 103 bp, Artificial Sequence
  Synthetic Polynucleotide
taatacgactcactataggggaaaaacaggaaacacggacacccaaagtaaacagaggagatactttatgtgtccgtgtaacctggcggcagcgcaaaagatg

SEQ ID NO: 18081 - DNA, 103 bp, Artificial Sequence
  Synthetic Polynucleotide
taatacgactcactatagggaggatagtcatcttcacgtgagggtaaataaacagaggagatatttaatgtcacgtgaaaacctggcggcagcgcaaaagatg

SEQ ID NO: 18082 - DNA, 103 bp, Artificial Sequence
  Synthetic Polynucleotide
taatacgactcactatagggcaagcaggatagtcatcttcacgtgagggtaacagaggagaaccctcatgtgaagatgaaacctggcggcagcgcaaaagatg

SEQ ID NO: 18083 - DNA, 103 bp, Artificial Sequence
  Synthetic Polynucleotide
taatacgactcactatagggggttacaagcaggatagtcatcttcacgtgaacagaggagacacgtgatgatgactatcaacctggcggcagcgcaaaagatg

SEQ ID NO: 18084 - DNA, 103 bp, Artificial Sequence
  Synthetic Polynucleotide
taatacgactcactatagggggcaaggttacaagcaggatagtcatcttcaacagaggagagaagatatgtatcctgctaacctggcggcagcgcaaaagatg

SEQ ID NO: 18085 - DNA, 103 bp, Artificial Sequence
  Synthetic Polynucleotide
taatacgactcactatagggagtaaggcaaggttacaagcaggatagtcaaacagaggagatgactaatgtgcttgtaaaacctggcggcagcgcaaaagatg

SEQ ID NO: 18086 - DNA, 103 bp, Artificial Sequence
  Synthetic Polynucleotide
taatacgactcactatagggtagctagtaaggcaaggttacaagcaggataacagaggagaatcctgatggtaaccttgaacctggcggcagcgcaaaagatg

SEQ ID NO: 18087 - DNA, 103 bp, Artificial Sequence
  Synthetic Polynucleotide
taatacgactcactatagggttgattagctagtaaggcaaggttacaagcaacagaggagagcttgtatgcttgccttaaacctggcggcagcgcaaaagatg

SEQ ID NO: 18088 - DNA, 103 bp, Artificial Sequence
  Synthetic Polynucleotide
taatacgactcactatagggtcatcttgattagctagtaaggcaaggttaaacagaggagataacctatgcttactagcaacctggcggcagcgcaaaagatg

SEQ ID NO: 18089 - DNA, 103 bp, Artificial Sequence
  Synthetic Polynucleotide
taatacgactcactatagggttggctcatcttgattagctagtaaggcaaaacagaggagattgcctatgtagctaatcaacctggcggcagcgcaaaagatg

SEQ ID NO: 18090 - DNA, 103 bp, Artificial Sequence
  Synthetic Polynucleotide
taatacgactcactatagggtattgttggctcatcttgattagctagtaaaacagaggagattactaatgaatcaagataacctggcggcagcgcaaaagatg

SEQ ID NO: 18091 - DNA, 103 bp, Artificial Sequence
  Synthetic Polynucleotide
taatacgactcactatagggtggcgtacaaagttaccgtaataacagagtaacagaggagaactctgatgttacggtaaaacctggcggcagcgcaaaagatg

SEQ ID NO: 18092 - DNA, 103 bp, Artificial Sequence
  Synthetic Polynucleotide
taatacgactcactatagggcaaaagaaaaacaggaaacacggacacccaaacagaggagatgggtgatggtgtttcctaacctggcggcagcgcaaaagatg

SEQ ID NO: 18093 - DNA, 103 bp, Artificial Sequence
  Synthetic Polynucleotide
taatacgactcactatagggcttattattgttggctcatcttgattagctaacagaggagaagctaaatgagatgagccaacctggcggcagcgcaaaagatg

SEQ ID NO: 18094 - DNA, 103 bp, Artificial Sequence
  Synthetic Polynucleotide
taatacgactcactatagggcaacacttattattgttggctcatcttgataacagaggagaatcaagatgagccaacaaaacctggcggcagcgcaaaagatg

SEQ ID NO: 18095 - DNA, 103 bp, Artificial Sequence
  Synthetic Polynucleotide
taatacgactcactatagggatcaccaacacttattattgttggctcatcaacagaggagagatgagatgacaataataaacctggcggcagcgcaaaagatg

SEQ ID NO: 18096 - DNA, 103 bp, Artificial Sequence
  Synthetic Polynucleotide
taatacgactcactatagggactgcatcaccaacacttattattgttggcaacagaggagagccaacatgaataagtgtaacctggcggcagcgcaaaagatg

SEQ ID NO: 18097 - DNA, 103 bp, Artificial Sequence
  Synthetic Polynucleotide
taatacgactcactatagggaagatactgcatcaccaacacttattattgaacagaggagacaataaatggtgttggtgaacctggcggcagcgcaaaagatg

SEQ ID NO: 18098 - DNA, 103 bp, Artificial Sequence
  Synthetic Polynucleotide
taatacgactcactatagggaccataagatactgcatcaccaacacttataacagaggagaataagtatgggtgatgcaaacctggcggcagcgcaaaagatg

SEQ ID NO: 18099 - DNA, 103 bp, Artificial Sequence
  Synthetic Polynucleotide
taatacgactcactatagggatgttaccataagatactgcatcaccaacaaacagaggagatgttggatgtgcagtatcaacctggcggcagcgcaaaagatg

SEQ ID NO: 18100 - DNA, 103 bp, Artificial Sequence
  Synthetic Polynucleotide
taatacgactcactatagggataagatgttaccataagatactgcatcacaacagaggagagtgatgatgtatcttatgaacctggcggcagcgcaaaagatg

SEQ ID NO: 18101 - DNA, 103 bp, Artificial Sequence
  Synthetic Polynucleotide
taatacgactcactatagggactcaataagatgttaccataagatactgcaacagaggagagcagtaatgtatggtaacaacctggcggcagcgcaaaagatg

SEQ ID NO: 18102 - DNA, 103 bp, Artificial Sequence
  Synthetic Polynucleotide
taatacgactcactataggggtaccactcaataagatgttaccataagataacagaggagaatcttaatgtaacatcttaacctggcggcagcgcaaaagatg

SEQ ID NO: 18103 - DNA, 103 bp, Artificial Sequence
  Synthetic Polynucleotide
taatacgactcactataggggcaatcaaaagaaaaacaggaaacacggacaacagaggagagtccgtatgtcctgttttaacctggcggcagcgcaaaagatg

SEQ ID NO: 18104 - DNA, 103 bp, Artificial Sequence
  Synthetic Polynucleotide
taatacgactcactatagggtattggtaccactcaataagatgttaccataacagaggagaatggtaatgtcttattgaaacctggcggcagcgcaaaagatg

SEQ ID NO: 18105 - DNA, 103 bp, Artificial Sequence
  Synthetic Polynucleotide
taatacgactcactatagggtgcagtattggtaccactcaataagatgttaacagaggagaaacatcatgttgagtggtaacctggcggcagcgcaaaagatg

SEQ ID NO: 18106 - DNA, 103 bp, Artificial Sequence
  Synthetic Polynucleotide
taatacgactcactatagggattcgtgcagtattggtaccactcaataagaacagaggagacttattatgtggtaccaaaacctggcggcagcgcaaaagatg

SEQ ID NO: 18107 - DNA, 103 bp, Artificial Sequence
  Synthetic Polynucleotide
taatacgactcactatagggtgatcattcgtgcagtattggtaccactcaaacagaggagatgagtgatgccaatactgaacctggcggcagcgcaaaagatg

SEQ ID NO: 18108 - DNA, 103 bp, Artificial Sequence
  Synthetic Polynucleotide
taatacgactcactataggggtacttgatcattcgtgcagtattggtaccaacagaggagaggtaccatgactgcacgaaacctggcggcagcgcaaaagatg

SEQ ID NO: 18109 - DNA, 103 bp, Artificial Sequence
  Synthetic Polynucleotide
taatacgactcactatagggtaatggtacttgatcattcgtgcagtattgaacagaggagacaatacatgacgaatgataacctggcggcagcgcaaaagatg

SEQ ID NO: 18110 - DNA, 103 bp, Artificial Sequence
  Synthetic Polynucleotide
taatacgactcactatagggtcgggtaatggtacttgatcattcgtgcagaacagaggagactgcacatgtgatcaagtaacctggcggcagcgcaaaagatg

SEQ ID NO: 18111 - DNA, 103 bp, Artificial Sequence
  Synthetic Polynucleotide
taatacgactcactatagggttttgtcgggtaatggtacttgatcattcgaacagaggagacgaatgatgaagtaccataacctggcggcagcgcaaaagatg

SEQ ID NO: 18112 - DNA, 103 bp, Artificial Sequence
  Synthetic Polynucleotide
taatacgactcactatagggccagcttttgtcgggtaatggtacttgatcaacagaggagagatcaaatgccattacccaacctggcggcagcgcaaaagatg

SEQ ID NO: 18113 - DNA, 103 bp, Artificial Sequence
  Synthetic Polynucleotide
taatacgactcactatagggaatatccagcttttgtcgggtaatggtactaacagaggagaagtaccatgacccgacaaaacctggcggcagcgcaaaagatg

SEQ ID NO: 18114 - DNA, 103 bp, Artificial Sequence
  Synthetic Polynucleotide
taatacgactcactatagggaaaatgcaatcaaaagaaaaacaggaaacaaacagaggagatgtttcatgtttttctttaacctggcggcagcgcaaaagatg

SEQ ID NO: 18115 - DNA, 103 bp, Artificial Sequence
  Synthetic Polynucleotide
taatacgactcactatagggcccacaatatccagcttttgtcgggtaatgaacagaggagacattacatgacaaaagctaacctggcggcagcgcaaaagatg

SEQ ID NO: 18116 - DNA, 103 bp, Artificial Sequence
  Synthetic Polynucleotide
taatacgactcactatagggacacccccacaatatccagcttttgtcgggaacagaggagacccgacatgagctggataaacctggcggcagcgcaaaagatg

SEQ ID NO: 18117 - DNA, 103 bp, Artificial Sequence
  Synthetic Polynucleotide
taatacgactcactatagggacaaaacacccccacaatatccagcttttgaacagaggagacaaaagatggatattgtgaacctggcggcagcgcaaaagatg

SEQ ID NO: 18118 - DNA, 103 bp, Artificial Sequence
  Synthetic Polynucleotide
taatacgactcactatagggcttgtacaaaacacccccacaatatccagcaacagaggagagctggaatgtgtgggggtaacctggcggcagcgcaaaagatg

SEQ ID NO: 18119 - DNA, 103 bp, Artificial Sequence
  Synthetic Polynucleotide
taatacgactcactatagggccaaccttgtacaaaacacccccacaatataacagaggagaatattgatggggtgttttaacctggcggcagcgcaaaagatg

SEQ ID NO: 18120 - DNA, 103 bp, Artificial Sequence
  Synthetic Polynucleotide
taatacgactcactatagggtagagccaaccttgtacaaaacacccccacaacagaggagagtggggatgttttgtacaaacctggcggcagcgcaaaagatg

SEQ ID NO: 18121 - DNA, 103 bp, Artificial Sequence
  Synthetic Polynucleotide
taatacgactcactatagggaagaatagagccaaccttgtacaaaacaccaacagaggagaggtgttatgtacaaggttaacctggcggcagcgcaaaagatg

SEQ ID NO: 18122 - DNA, 103 bp, Artificial Sequence
  Synthetic Polynucleotide
taatacgactcactatagggataccaagaatagagccaaccttgtacaaaaacagaggagatttgtaatgggttggctcaacctggcggcagcgcaaaagatg

SEQ ID NO: 18123 - DNA, 103 bp, Artificial Sequence
  Synthetic Polynucleotide
taatacgactcactatagggcatgtataccaagaatagagccaaccttgtaacagaggagaacaaggatggctctattcaacctggcggcagcgcaaaagatg

SEQ ID NO: 18124 - DNA, 103 bp, Artificial Sequence
  Synthetic Polynucleotide
taatacgactcactatagggaccaacatgtataccaagaatagagccaacaacagaggagagttggcatgattcttggtaacctggcggcagcgcaaaagatg

SEQ ID NO: 18125 - DNA, 103 bp, Artificial Sequence
  Synthetic Polynucleotide
taatacgactcactatagggaccataaaatgcaatcaaaagaaaaacaggaacagaggagacctgttatgcttttgattaacctggcggcagcgcaaaagatg

SEQ ID NO: 18126 - DNA, 103 bp, Artificial Sequence
  Synthetic Polynucleotide
taatacgactcactatagggttgccaccaacatgtataccaagaatagagaacagaggagactctatatgtggtatacaaacctggcggcagcgcaaaagatg

SEQ ID NO: 18127 - DNA, 103 bp, Artificial Sequence
  Synthetic Polynucleotide
taatacgactcactatagggtaccattgccaccaacatgtataccaagaaaacagaggagattcttgatgtacatgttgaacctggcggcagcgcaaaagatg

SEQ ID NO: 18128 - DNA, 103 bp, Artificial Sequence
  Synthetic Polynucleotide
taatacgactcactatagggatctctaccattgccaccaacatgtataccaacagaggagaggtataatggttggtggcaacctggcggcagcgcaaaagatg

SEQ ID NO: 18129 - DNA, 103 bp, Artificial Sequence
  Synthetic Polynucleotide
taatacgactcactatagggaatccatctctaccattgccaccaacatgtaacagaggagaacatgtatgtggcaatggaacctggcggcagcgcaaaagatg

SEQ ID NO: 18130 - DNA, 103 bp, Artificial Sequence
  Synthetic Polynucleotide
taatacgactcactatagggcagaaaatccatctctaccattgccaccaaaacagaggagattggtgatgatggtagagaacctggcggcagcgcaaaagatg

SEQ ID NO: 18131 - DNA, 103 bp, Artificial Sequence
  Synthetic Polynucleotide
taatacgactcactatagggcattgcagaaaatccatctctaccattgccaacagaggagaggcaatatgagagatggaaacctggcggcagcgcaaaagatg

SEQ ID NO: 18132 - DNA, 103 bp, Artificial Sequence
  Synthetic Polynucleotide
taatacgactcactatagggagaagcattgcagaaaatccatctctaccaaacagaggagatggtagatgtggattttcaacctggcggcagcgcaaaagatg

SEQ ID NO: 18133 - DNA, 103 bp, Artificial Sequence
  Synthetic Polynucleotide
taatacgactcactatagggatttgagaagcattgcagaaaatccatctcaacagaggagagagatgatgtttctgcaaaacctggcggcagcgcaaaagatg

SEQ ID NO: 18134 - DNA, 103 bp, Artificial Sequence
  Synthetic Polynucleotide
taatacgactcactatagggataagatttgagaagcattgcagaaaatccaacagaggagaggatttatggcaatgcttaacctggcggcagcgcaaaagatg

SEQ ID NO: 18135 - DNA, 103 bp, Artificial Sequence
  Synthetic Polynucleotide
taatacgactcactatagggccaaaataagatttgagaagcattgcagaaaacagaggagattctgcatggcttctcaaaacctggcggcagcgcaaaagatg

SEQ ID NO: 18136 - DNA, 103 bp, Artificial Sequence
  Synthetic Polynucleotide
taatacgactcactatagggttgtcaccataaaatgcaatcaaaagaaaaaacagaggagattttctatggattgcattaacctggcggcagcgcaaaagatg

SEQ ID NO: 18137 - DNA, 103 bp, Artificial Sequence
  Synthetic Polynucleotide
taatacgactcactatagggtttcaccaaaataagatttgagaagcattgaacagaggagacaatgcatgtcaaatcttaacctggcggcagcgcaaaagatg

SEQ ID NO: 18138 - DNA, 103 bp, Artificial Sequence
  Synthetic Polynucleotide
taatacgactcactatagggctgggtttcaccaaaataagatttgagaagaacagaggagacttctcatgtcttattttaacctggcggcagcgcaaaagatg

SEQ ID NO: 18139 - DNA, 103 bp, Artificial Sequence
  Synthetic Polynucleotide
taatacgactcactatagggaaaccctgggtttcaccaaaataagatttgaacagaggagacaaatcatgttttggtgaaacctggcggcagcgcaaaagatg

SEQ ID NO: 18140 - DNA, 103 bp, Artificial Sequence
  Synthetic Polynucleotide
taatacgactcactatagggtgattaaaccctgggtttcaccaaaataagaacagaggagacttattatggtgaaacccaacctggcggcagcgcaaaagatg

SEQ ID NO: 18141 - DNA, 103 bp, Artificial Sequence
  Synthetic Polynucleotide
taatacgactcactatagggtttagtgattaaaccctgggtttcaccaaaaacagaggagatttggtatgacccagggtaacctggcggcagcgcaaaagatg

SEQ ID NO: 18142 - DNA, 103 bp, Artificial Sequence
  Synthetic Polynucleotide
taatacgactcactatagggagttctttagtgattaaaccctgggtttcaaacagaggagatgaaacatggggtttaataacctggcggcagcgcaaaagatg

SEQ ID NO: 18143 - DNA, 103 bp, Artificial Sequence
  Synthetic Polynucleotide
taatacgactcactatagggcaggaagttctttagtgattaaaccctgggaacagaggagacccaggatgtaatcactaaacctggcggcagcgcaaaagatg

SEQ ID NO: 18144 - DNA, 103 bp, Artificial Sequence
  Synthetic Polynucleotide
taatacgactcactatagggagatacaggaagttctttagtgattaaaccaacagaggagaggtttaatgactaaagaaaacctggcggcagcgcaaaagatg

SEQ ID NO: 18145 - DNA, 103 bp, Artificial Sequence
  Synthetic Polynucleotide
taatacgactcactatagggtttacagatacaggaagttctttagtgattaacagaggagaaatcacatgagaacttccaacctggcggcagcgcaaaagatg

SEQ ID NO: 18146 - DNA, 103 bp, Artificial Sequence
  Synthetic Polynucleotide
taatacgactcactatagggagttctttacagatacaggaagttctttagaacagaggagactaaagatgttcctgtataacctggcggcagcgcaaaagatg

SEQ ID NO: 18147 - DNA, 103 bp, Artificial Sequence
  Synthetic Polynucleotide
taatacgactcactatagggataaattgtcaccataaaatgcaatcaaaaaacagaggagattttgaatgcattttatgaacctggcggcagcgcaaaagatg

SEQ ID NO: 18148 - DNA, 103 bp, Artificial Sequence
  Synthetic Polynucleotide
taatacgactcactatagggtggtaagttctttacagatacaggaagttcaacagaggagagaacttatggtatctgtaaacctggcggcagcgcaaaagatg

SEQ ID NO: 18149 - DNA, 103 bp, Artificial Sequence
  Synthetic Polynucleotide
taatacgactcactatagggacggatggtaagttctttacagatacaggaaacagaggagatcctgtatgtgtaaagaaaacctggcggcagcgcaaaagatg

SEQ ID NO: 18150 - DNA, 103 bp, Artificial Sequence
  Synthetic Polynucleotide
taatacgactcactatagggcatgtacggatggtaagttctttacagataaacagaggagatatctgatgagaacttacaacctggcggcagcgcaaaagatg

SEQ ID NO: 18151 - DNA, 103 bp, Artificial Sequence
  Synthetic Polynucleotide
taatacgactcactatagggtgaaacatgtacggatggtaagttctttacaacagaggagagtaaagatgttaccatccaacctggcggcagcgcaaaagatg

SEQ ID NO: 18152 - DNA, 103 bp, Artificial Sequence
  Synthetic Polynucleotide
taatacgactcactatagggttagatgaaacatgtacggatggtaagttcaacagaggagagaacttatgatccgtacaaacctggcggcagcgcaaaagatg

SEQ ID NO: 18153 - DNA, 103 bp, Artificial Sequence
  Synthetic Polynucleotide
taatacgactcactataggggggttttagatgaaacatgtacggatggtaaacagaggagataccatatgtacatgtttaacctggcggcagcgcaaaagatg

SEQ ID NO: 18154 - DNA, 103 bp, Artificial Sequence
  Synthetic Polynucleotide
taatacgactcactatagggtagtcgggttttagatgaaacatgtacggaaacagaggagatccgtaatggtttcatctaacctggcggcagcgcaaaagatg

SEQ ID NO: 18155 - DNA, 103 bp, Artificial Sequence
  Synthetic Polynucleotide
taatacgactcactatagggggttgtagtcgggttttagatgaaacatgtaacagaggagaacatgtatgatctaaaacaacctggcggcagcgcaaaagatg

SEQ ID NO: 18156 - DNA, 103 bp, Artificial Sequence
  Synthetic Polynucleotide
taatacgactcactatagggcactaggttgtagtcgggttttagatgaaaaacagaggagatttcatatgaaacccgacaacctggcggcagcgcaaaagatg

SEQ ID NO: 18157 - DNA, 103 bp, Artificial Sequence
  Synthetic Polynucleotide
taatacgactcactatagggaaaaacactaggttgtagtcgggttttagaaacagaggagatctaaaatgcgactacaaaacctggcggcagcgcaaaagatg

SEQ ID NO: 18158 - DNA, 103 bp, Artificial Sequence
  Synthetic Polynucleotide
taatacgactcactatagggacactataaattgtcaccataaaatgcaataacagaggagaattgcaatgtatggtgacaacctggcggcagcgcaaaagatg

SEQ ID NO: 18159 - DNA, 103 bp, Artificial Sequence
  Synthetic Polynucleotide
taatacgactcactatagggtcatgaaaaacactaggttgtagtcgggttaacagaggagaaacccgatgacaacctagaacctggcggcagcgcaaaagatg

SEQ ID NO: 18160 - DNA, 103 bp, Artificial Sequence
  Synthetic Polynucleotide
taatacgactcactatagggaaacatcatgaaaaacactaggttgtagtcaacagaggagagactacatgctagtgtttaacctggcggcagcgcaaaagatg

SEQ ID NO: 18161 - DNA, 103 bp, Artificial Sequence
  Synthetic Polynucleotide
taatacgactcactatagggagggaaaacatcatgaaaaacactaggttgaacagaggagacaacctatggtttttcataacctggcggcagcgcaaaagatg

SEQ ID NO: 18162 - DNA, 103 bp, Artificial Sequence
  Synthetic Polynucleotide
taatacgactcactataggggttccagggaaaacatcatgaaaaacactaaacagaggagatagtgtatgtcatgatgtaacctggcggcagcgcaaaagatg

SEQ ID NO: 18163 - DNA, 103 bp, Artificial Sequence
  Synthetic Polynucleotide
taatacgactcactatagggcttttgttccagggaaaacatcatgaaaaaaacagaggagatttttcatgatgttttccaacctggcggcagcgcaaaagatg

SEQ ID NO: 18164 - DNA, 103 bp, Artificial Sequence
  Synthetic Polynucleotide
taatacgactcactatagggaggctcttttgttccagggaaaacatcatgaacagaggagacatgatatgttccctggaaacctggcggcagcgcaaaagatg

SEQ ID NO: 18165 - DNA, 103 bp, Artificial Sequence
  Synthetic Polynucleotide
taatacgactcactatagggactgcaggctcttttgttccagggaaaacaaacagaggagatgttttatgtggaacaaaaacctggcggcagcgcaaaagatg

SEQ ID NO: 18166 - DNA, 103 bp, Artificial Sequence
  Synthetic Polynucleotide
taatacgactcactatagggtaagaactgcaggctcttttgttccagggaaacagaggagatccctgatgcaaaagagcaacctggcggcagcgcaaaagatg

SEQ ID NO: 18167 - DNA, 103 bp, Artificial Sequence
  Synthetic Polynucleotide
taatacgactcactatagggactactaagaactgcaggctcttttgttccaacagaggagaggaacaatggagcctgcaaacctggcggcagcgcaaaagatg

SEQ ID NO: 18168 - DNA, 103 bp, Artificial Sequence
  Synthetic Polynucleotide
taatacgactcactatagggtcattactactaagaactgcaggctcttttaacagaggagaaaaagaatgtgcagttctaacctggcggcagcgcaaaagatg

SEQ ID NO: 18169 - DNA, 103 bp, Artificial Sequence
  Synthetic Polynucleotide
taatacgactcactatagggtctatacactataaattgtcaccataaaataacagaggagaattttaatgtgacaatttaacctggcggcagcgcaaaagatg

SEQ ID NO: 18170 - DNA, 103 bp, Artificial Sequence
  Synthetic Polynucleotide
taatacgactcactatagggttggatcattactactaagaactgcaggctaacagaggagaagcctgatgttcttagtaaacctggcggcagcgcaaaagatg

SEQ ID NO: 18171 - DNA, 103 bp, Artificial Sequence
  Synthetic Polynucleotide
taatacgactcactatagggtagtcttggatcattactactaagaactgcaacagaggagagcagttatgagtagtaataacctggcggcagcgcaaaagatg

SEQ ID NO: 18172 - DNA, 103 bp, Artificial Sequence
  Synthetic Polynucleotide
taatacgactcactataggggtttctagtcttggatcattactactaagaaacagaggagatcttagatgtaatgatccaacctggcggcagcgcaaaagatg

SEQ ID NO: 18173 - DNA, 103 bp, Artificial Sequence
  Synthetic Polynucleotide
taatacgactcactatagggagtcagtttctagtcttggatcattactacaacagaggagagtagtaatgatccaagacaacctggcggcagcgcaaaagatg

SEQ ID NO: 18174 - DNA, 103 bp, Artificial Sequence
  Synthetic Polynucleotide
taatacgactcactataggggtcaaagtcagtttctagtcttggatcattaacagaggagaaatgatatgagactagaaaacctggcggcagcgcaaaagatg

SEQ ID NO: 18175 - DNA, 103 bp, Artificial Sequence
  Synthetic Polynucleotide
taatacgactcactataggggctgagtcaaagtcagtttctagtcttggaaacagaggagatccaagatgagaaactgaaacctggcggcagcgcaaaagatg

SEQ ID NO: 18176 - DNA, 103 bp, Artificial Sequence
  Synthetic Polynucleotide
taatacgactcactatagggaaagtgctgagtcaaagtcagtttctagtcaacagaggagagactagatgctgactttgaacctggcggcagcgcaaaagatg

SEQ ID NO: 18177 - DNA, 103 bp, Artificial Sequence
  Synthetic Polynucleotide
taatacgactcactatagggggagaaaagtgctgagtcaaagtcagtttcaacagaggagagaaactatgtttgactcaaacctggcggcagcgcaaaagatg

SEQ ID NO: 18178 - DNA, 103 bp, Artificial Sequence
  Synthetic Polynucleotide
taatacgactcactatagggtatttggagaaaagtgctgagtcaaagtcaaacagaggagatgacttatgctcagcactaacctggcggcagcgcaaaagatg

SEQ ID NO: 18179 - DNA, 103 bp, Artificial Sequence
  Synthetic Polynucleotide
taatacgactcactatagggctttatatttggagaaaagtgctgagtcaaaacagaggagattgactatgcacttttctaacctggcggcagcgcaaaagatg

SEQ ID NO: 18180 - DNA, 103 bp, Artificial Sequence
  Synthetic Polynucleotide
taatacgactcactataggggacaatctatacactataaattgtcaccataacagaggagaatggtgatgatttatagtaacctggcggcagcgcaaaagatg

SEQ ID NO: 18181 - DNA, 103 bp, Artificial Sequence
  Synthetic Polynucleotide
taatacgactcactatagggattacctttatatttggagaaaagtgctgaaacagaggagatcagcaatgttctccaaaaacctggcggcagcgcaaaagatg

SEQ ID NO: 18182 - DNA, 103 bp, Artificial Sequence
  Synthetic Polynucleotide
taatacgactcactataggggcaggattacctttatatttggagaaaagtaacagaggagaacttttatgcaaatataaaacctggcggcagcgcaaaagatg

SEQ ID NO: 18183 - DNA, 103 bp, Artificial Sequence
  Synthetic Polynucleotide
taatacgactcactataggggacaagcaggattacctttatatttggagaaacagaggagatctccaatgataaaggtaaacctggcggcagcgcaaaagatg

SEQ ID NO: 18184 - DNA, 103 bp, Artificial Sequence
  Synthetic Polynucleotide
taatacgactcactatagggcacttgacaagcaggattacctttatatttaacagaggagaaaatatatgggtaatcctaacctggcggcagcgcaaaagatg

SEQ ID NO: 18185 - DNA, 103 bp, Artificial Sequence
  Synthetic Polynucleotide
taatacgactcactatagggggggtcacttgacaagcaggattacctttaaacagaggagataaaggatgtcctgcttgaacctggcggcagcgcaaaagatg

SEQ ID NO: 18186 - DNA, 103 bp, Artificial Sequence
  Synthetic Polynucleotide
taatacgactcactatagggtgtgtggggtcacttgacaagcaggattacaacagaggagagtaatcatgcttgtcaagaacctggcggcagcgcaaaagatg

SEQ ID NO: 18187 - DNA, 103 bp, Artificial Sequence
  Synthetic Polynucleotide
taatacgactcactatagggtttcatgtgtggggtcacttgacaagcaggaacagaggagacctgctatgcaagtgaccaacctggcggcagcgcaaaagatg

SEQ ID NO: 18188 - DNA, 103 bp, Artificial Sequence
  Synthetic Polynucleotide
taatacgactcactataggggcaattttcatgtgtggggtcacttgacaaaacagaggagattgtcaatggaccccacaaacctggcggcagcgcaaaagatg

SEQ ID NO: 18189 - DNA, 103 bp, Artificial Sequence
  Synthetic Polynucleotide
taatacgactcactatagggctacagcaattttcatgtgtggggtcacttaacagaggagaaagtgaatgcacacatgaaacctggcggcagcgcaaaagatg

SEQ ID NO: 18190 - DNA, 103 bp, Artificial Sequence
  Synthetic Polynucleotide
taatacgactcactatagggatgtgctacagcaattttcatgtgtggggtaacagaggagaaccccaatgatgaaaattaacctggcggcagcgcaaaagatg

SEQ ID NO: 18191 - DNA, 103 bp, Artificial Sequence
  Synthetic Polynucleotide
taatacgactcactatagggatgatgacaatctatacactataaattgtcaacagaggagagacaatatgtagtgtataaacctggcggcagcgcaaaagatg

SEQ ID NO: 18192 - DNA, 103 bp, Artificial Sequence
  Synthetic Polynucleotide
taatacgactcactataggggcataatgtgctacagcaattttcatgtgtaacagaggagaacacatatgaattgctgtaacctggcggcagcgcaaaagatg

SEQ ID NO: 18193 - DNA, 103 bp, Artificial Sequence
  Synthetic Polynucleotide
taatacgactcactataggggtgctgcataatgtgctacagcaattttcaaacagaggagatgaaaaatgctgtagcacaacctggcggcagcgcaaaagatg

SEQ ID NO: 18194 - DNA, 103 bp, Artificial Sequence
  Synthetic Polynucleotide
taatacgactcactatagggtaactgtgctgcataatgtgctacagcaataacagaggagaattgctatggcacattataacctggcggcagcgcaaaagatg

SEQ ID NO: 18195 - DNA, 103 bp, Artificial Sequence
  Synthetic Polynucleotide
taatacgactcactataggggtagataactgtgctgcataatgtgctacaaacagaggagatgtagcatgttatgcagcaacctggcggcagcgcaaaagatg

SEQ ID NO: 18196 - DNA, 103 bp, Artificial Sequence
  Synthetic Polynucleotide
taatacgactcactatagggctagtgtagataactgtgctgcataatgtgaacagaggagacacattatgcagcacagtaacctggcggcagcgcaaaagatg

SEQ ID NO: 18197 - DNA, 103 bp, Artificial Sequence
  Synthetic Polynucleotide
taatacgactcactatagggtatgtctagtgtagataactgtgctgcataaacagaggagatatgcaatgcagttatctaacctggcggcagcgcaaaagatg

SEQ ID NO: 18198 - DNA, 103 bp, Artificial Sequence
  Synthetic Polynucleotide
taatacgactcactatagggggatttatgtctagtgtagataactgtgctaacagaggagaagcacaatgatctacactaacctggcggcagcgcaaaagatg

SEQ ID NO: 18199 - DNA, 103 bp, Artificial Sequence
  Synthetic Polynucleotide
taatacgactcactataggggttgaggatttatgtctagtgtagataactaacagaggagaagttatatgcactagacaaacctggcggcagcgcaaaagatg

SEQ ID NO: 18200 - DNA, 103 bp, Artificial Sequence
  Synthetic Polynucleotide
taatacgactcactatagggaaggggttgaggatttatgtctagtgtagaaacagaggagatctacaatggacataaataacctggcggcagcgcaaaagatg

SEQ ID NO: 18201 - DNA, 103 bp, Artificial Sequence
  Synthetic Polynucleotide
taatacgactcactatagggaatgaaaggggttgaggatttatgtctagtaacagaggagaactagaatgaaatcctcaaacctggcggcagcgcaaaagatg

SEQ ID NO: 18202 - DNA, 103 bp, Artificial Sequence
  Synthetic Polynucleotide
taatacgactcactatagggaaaactggcgtacaaagttaccgtaataacaacagaggagagttattatggtaactttgaacctggcggcagcgcaaaagatg

SEQ ID NO: 18203 - DNA, 103 bp, Artificial Sequence
  Synthetic Polynucleotide
taatacgactcactatagggcacccatgatgacaatctatacactataaaaacagaggagatttataatgtatagattgaacctggcggcagcgcaaaagatg

SEQ ID NO: 18204 - DNA, 103 bp, Artificial Sequence
  Synthetic Polynucleotide
taatacgactcactatagggcttccaatgaaaggggttgaggatttatgtaacagaggagaacataaatgctcaaccccaacctggcggcagcgcaaaagatg

SEQ ID NO: 18205 - DNA, 103 bp, Artificial Sequence
  Synthetic Polynucleotide
taatacgactcactatagggactctcttccaatgaaaggggttgaggattaacagaggagaaatcctatgcccctttcaaacctggcggcagcgcaaaagatg

SEQ ID NO: 18206 - DNA, 103 bp, Artificial Sequence
  Synthetic Polynucleotide
taatacgactcactatagggaacacactctcttccaatgaaaggggttgaaacagaggagatcaaccatgttcattggaaacctggcggcagcgcaaaagatg

SEQ ID NO: 18207 - DNA, 103 bp, Artificial Sequence
  Synthetic Polynucleotide
taatacgactcactatagggtaccaaacacactctcttccaatgaaagggaacagaggagaccctttatgtggaagagaaacctggcggcagcgcaaaagatg

SEQ ID NO: 18208 - DNA, 103 bp, Artificial Sequence
  Synthetic Polynucleotide
taatacgactcactatagggctcaataccaaacacactctcttccaatgaaacagaggagatcattgatggagagtgtgaacctggcggcagcgcaaaagatg

SEQ ID NO: 18209 - DNA, 103 bp, Artificial Sequence
  Synthetic Polynucleotide
taatacgactcactatagggaatccctcaataccaaacacactctcttccaacagaggagaggaagaatgtgtgtttggaacctggcggcagcgcaaaagatg

SEQ ID NO: 18210 - DNA, 103 bp, Artificial Sequence
  Synthetic Polynucleotide
taatacgactcactatagggcttctaatccctcaataccaaacacactctaacagaggagaagagtgatgttggtattgaacctggcggcagcgcaaaagatg

SEQ ID NO: 18211 - DNA, 103 bp, Artificial Sequence
  Synthetic Polynucleotide
taatacgactcactatagggcaaagcttctaatccctcaataccaaacacaacagaggagagtgtttatgattgagggaaacctggcggcagcgcaaaagatg

SEQ ID NO: 18212 - DNA, 103 bp, Artificial Sequence
  Synthetic Polynucleotide
taatacgactcactatagggaaatccaaagcttctaatccctcaataccaaacagaggagatggtatatggggattagaaacctggcggcagcgcaaaagatg

SEQ ID NO: 18213 - DNA, 103 bp, Artificial Sequence
  Synthetic Polynucleotide
taatacgactcactatagggtatttaaatccaaagcttctaatccctcaaaacagaggagattgaggatgtagaagcttaacctggcggcagcgcaaaagatg

SEQ ID NO: 18214 - DNA, 103 bp, Artificial Sequence
  Synthetic Polynucleotide
taatacgactcactatagggttgtgcacccatgatgacaatctatacactaacagaggagaagtgtaatgattgtcatcaacctggcggcagcgcaaaagatg

SEQ ID NO: 18215 - DNA, 103 bp, Artificial Sequence
  Synthetic Polynucleotide
taatacgactcactatagggactagtatttaaatccaaagcttctaatccaacagaggagaggattaatggctttggataacctggcggcagcgcaaaagatg

SEQ ID NO: 18216 - DNA, 103 bp, Artificial Sequence
  Synthetic Polynucleotide
taatacgactcactatagggcctgcactagtatttaaatccaaagcttctaacagaggagaagaagcatgggatttaaaaacctggcggcagcgcaaaagatg

SEQ ID NO: 18217 - DNA, 103 bp, Artificial Sequence
  Synthetic Polynucleotide
taatacgactcactataggggaaatcctgcactagtatttaaatccaaagaacagaggagactttggatgtaaatactaaacctggcggcagcgcaaaagatg

SEQ ID NO: 18218 - DNA, 103 bp, Artificial Sequence
  Synthetic Polynucleotide
taatacgactcactatagggataaggaaatcctgcactagtatttaaatcaacagaggagagatttaatgactagtgcaaacctggcggcagcgcaaaagatg

SEQ ID NO: 18219 - DNA, 103 bp, Artificial Sequence
  Synthetic Polynucleotide
taatacgactcactataggggaaacataaggaaatcctgcactagtatttaacagaggagaaaatacatgtgcaggattaacctggcggcagcgcaaaagatg

SEQ ID NO: 18220 - DNA, 103 bp, Artificial Sequence
  Synthetic Polynucleotide
taatacgactcactatagggccagtgaaacataaggaaatcctgcactagaacagaggagactagtgatggatttccttaacctggcggcagcgcaaaagatg

SEQ ID NO: 18221 - DNA, 103 bp, Artificial Sequence
  Synthetic Polynucleotide
taatacgactcactatagggtattcccagtgaaacataaggaaatcctgcaacagaggagagcaggaatgccttatgttaacctggcggcagcgcaaaagatg

SEQ ID NO: 18222 - DNA, 103 bp, Artificial Sequence
  Synthetic Polynucleotide
taatacgactcactatagggttctttattcccagtgaaacataaggaaataacagaggagaatttccatgtgtttcactaacctggcggcagcgcaaaagatg

SEQ ID NO: 18223 - DNA, 103 bp, Artificial Sequence
  Synthetic Polynucleotide
taatacgactcactatagggctttcttctttattcccagtgaaacataagaacagaggagacttatgatgcactgggaaaacctggcggcagcgcaaaagatg

SEQ ID NO: 18224 - DNA, 103 bp, Artificial Sequence
  Synthetic Polynucleotide
taatacgactcactatagggaagatctttcttctttattcccagtgaaacaacagaggagagtttcaatgggaataaagaacctggcggcagcgcaaaagatg

SEQ ID NO: 18225 - DNA, 103 bp, Artificial Sequence
  Synthetic Polynucleotide
taatacgactcactataggggatacttgtgcacccatgatgacaatctataacagaggagaatagatatgcatcatgggaacctggcggcagcgcaaaagatg

SEQ ID NO: 18226 - DNA, 103 bp, Artificial Sequence
  Synthetic Polynucleotide
taatacgactcactatagggtctataagatctttcttctttattcccagtaacagaggagaactgggatgaaagaagaaaacctggcggcagcgcaaaagatg

SEQ ID NO: 18227 - DNA, 103 bp, Artificial Sequence
  Synthetic Polynucleotide
taatacgactcactatagggttttatctataagatctttcttctttattcaacagaggagagaataaatgagaaagatcaacctggcggcagcgcaaaagatg

SEQ ID NO: 18228 - DNA, 103 bp, Artificial Sequence
  Synthetic Polynucleotide
taatacgactcactatagggggtctttttatctataagatctttcttcttaacagaggagaaagaagatggatcttataaacctggcggcagcgcaaaagatg

SEQ ID NO: 18229 - DNA, 103 bp, Artificial Sequence
  Synthetic Polynucleotide
taatacgactcactatagggtctttggtctttttatctataagatctttcaacagaggagagaaagaatgtatagataaaacctggcggcagcgcaaaagatg

SEQ ID NO: 18230 - DNA, 103 bp, Artificial Sequence
  Synthetic Polynucleotide
taatacgactcactatagggtgatgtctttggtctttttatctataagataacagaggagaatcttaatgataaaaagaaacctggcggcagcgcaaaagatg

SEQ ID NO: 18231 - DNA, 103 bp, Artificial Sequence
  Synthetic Polynucleotide
taatacgactcactatagggttttgtgatgtctttggtctttttatctataacagaggagaatagatatgaagaccaaaaacctggcggcagcgcaaaagatg

SEQ ID NO: 18232 - DNA, 103 bp, Artificial Sequence
  Synthetic Polynucleotide
taatacgactcactatagggctaagttttgtgatgtctttggtctttttaaacagaggagataaaaaatgcaaagacataacctggcggcagcgcaaaagatg

SEQ ID NO: 18233 - DNA, 103 bp, Artificial Sequence
  Synthetic Polynucleotide
taatacgactcactatagggctttcctaagttttgtgatgtctttggtctaacagaggagaagaccaatgacatcacaaaacctggcggcagcgcaaaagatg

SEQ ID NO: 18234 - DNA, 103 bp, Artificial Sequence
  Synthetic Polynucleotide
taatacgactcactatagggaattgctttcctaagttttgtgatgtctttaacagaggagaaaagacatgacaaaacttaacctggcggcagcgcaaaagatg

SEQ ID NO: 18235 - DNA, 103 bp, Artificial Sequence
  Synthetic Polynucleotide
taatacgactcactatagggtcatcaattgctttcctaagttttgtgatgaacagaggagacatcacatgacttaggaaaacctggcggcagcgcaaaagatg

SEQ ID NO: 18236 - DNA, 103 bp, Artificial Sequence
  Synthetic Polynucleotide
taatacgactcactataggggtctagatacttgtgcacccatgatgacaaaacagaggagattgtcaatgtgggtgcacaacctggcggcagcgcaaaagatg

SEQ ID NO: 18237 - DNA, 103 bp, Artificial Sequence
  Synthetic Polynucleotide
taatacgactcactatagggcatattcatcaattgctttcctaagttttgaacagaggagacaaaacatgggaaagcaaaacctggcggcagcgcaaaagatg

SEQ ID NO: 18238 - DNA, 103 bp, Artificial Sequence
  Synthetic Polynucleotide
taatacgactcactatagggaataccatattcatcaattgctttcctaagaacagaggagacttaggatggcaattgataacctggcggcagcgcaaaagatg

SEQ ID NO: 18239 - DNA, 103 bp, Artificial Sequence
  Synthetic Polynucleotide
taatacgactcactatagggaaatcaataccatattcatcaattgctttcaacagaggagagaaagcatgtgatgaataaacctggcggcagcgcaaaagatg

SEQ ID NO: 18240 - DNA, 103 bp, Artificial Sequence
  Synthetic Polynucleotide
taatacgactcactatagggtaggcaaatcaataccatattcatcaattgaacagaggagacaattgatgaatatggtaaacctggcggcagcgcaaaagatg

SEQ ID NO: 18241 - DNA, 103 bp, Artificial Sequence
  Synthetic Polynucleotide
taatacgactcactatagggaaccataggcaaatcaataccatattcatcaacagaggagagatgaaatgggtattgataacctggcggcagcgcaaaagatg

SEQ ID NO: 18242 - DNA, 103 bp, Artificial Sequence
  Synthetic Polynucleotide
taatacgactcactatagggaaagtaaccataggcaaatcaataccatataacagaggagaatatggatgtgatttgccaacctggcggcagcgcaaaagatg

SEQ ID NO: 18243 - DNA, 103 bp, Artificial Sequence
  Synthetic Polynucleotide
taatacgactcactatagggtcagaaaagtaaccataggcaaatcaatacaacagaggagagtattgatgtgcctatggaacctggcggcagcgcaaaagatg

SEQ ID NO: 18244 - DNA, 103 bp, Artificial Sequence
  Synthetic Polynucleotide
taatacgactcactatagggatctttcagaaaagtaaccataggcaaatcaacagaggagagatttgatgatggttactaacctggcggcagcgcaaaagatg

SEQ ID NO: 18245 - DNA, 103 bp, Artificial Sequence
  Synthetic Polynucleotide
taatacgactcactatagggagttcatctttcagaaaagtaaccataggcaacagaggagagcctatatgtacttttctaacctggcggcagcgcaaaagatg

SEQ ID NO: 18246 - DNA, 103 bp, Artificial Sequence
  Synthetic Polynucleotide
taatacgactcactatagggttctaagttcatctttcagaaaagtaaccaaacagaggagatggttaatgttctgaaagaacctggcggcagcgcaaaagatg

SEQ ID NO: 18247 - DNA, 103 bp, Artificial Sequence
  Synthetic Polynucleotide
taatacgactcactatagggattttgtctagatacttgtgcacccatgataacagaggagaatcatgatggcacaagtaaacctggcggcagcgcaaaagatg

SEQ ID NO: 18248 - DNA, 103 bp, Artificial Sequence
  Synthetic Polynucleotide
taatacgactcactatagggcttctttctaagttcatctttcagaaaagtaacagaggagaacttttatgaaagatgaaaacctggcggcagcgcaaaagatg

SEQ ID NO: 18249 - DNA, 103 bp, Artificial Sequence
  Synthetic Polynucleotide
taatacgactcactatagggttttccttctttctaagttcatctttcagaaacagaggagatctgaaatgtgaacttagaacctggcggcagcgcaaaagatg

SEQ ID NO: 18250 - DNA, 103 bp, Artificial Sequence
  Synthetic Polynucleotide
taatacgactcactatagggttattttttccttctttctaagttcatcttaacagaggagaaagatgatgttagaaagaaacctggcggcagcgcaaaagatg

SEQ ID NO: 18251 - DNA, 103 bp, Artificial Sequence
  Synthetic Polynucleotide
taatacgactcactatagggatcttttattttttccttctttctaagttcaacagaggagagaacttatgaagaaggaaaacctggcggcagcgcaaaagatg

SEQ ID NO: 18252 - DNA, 103 bp, Artificial Sequence
  Synthetic Polynucleotide
taatacgactcactatagggtttccatcttttattttttccttctttctaaacagaggagatagaaaatgggaaaaaataacctggcggcagcgcaaaagatg

SEQ ID NO: 18253 - DNA, 103 bp, Artificial Sequence
  Synthetic Polynucleotide
taatacgactcactatagggtagtctttccatcttttattttttccttctaacagaggagaagaaggatgaaataaaagaacctggcggcagcgcaaaagatg

SEQ ID NO: 18254 - DNA, 103 bp, Artificial Sequence
  Synthetic Polynucleotide
taatacgactcactataggggactctagtctttccatcttttattttttcaacagaggagagaaaaaatgaaagatggaaacctggcggcagcgcaaaagatg

SEQ ID NO: 18255 - DNA, 103 bp, Artificial Sequence
  Synthetic Polynucleotide
taatacgactcactatagggtctatgactctagtctttccatcttttattaacagaggagaaataaaatgtggaaagacaacctggcggcagcgcaaaagatg

SEQ ID NO: 18256 - DNA, 103 bp, Artificial Sequence
  Synthetic Polynucleotide
taatacgactcactatagggtagcttctatgactctagtctttccatcttaacagaggagaaagatgatgagactagagaacctggcggcagcgcaaaagatg

SEQ ID NO: 18257 - DNA, 103 bp, Artificial Sequence
  Synthetic Polynucleotide
taatacgactcactatagggactattagcttctatgactctagtctttccaacagaggagaggaaagatgagagtcataaacctggcggcagcgcaaaagatg

SEQ ID NO: 18258 - DNA, 103 bp, Artificial Sequence
  Synthetic Polynucleotide
taatacgactcactatagggccaacattttgtctagatacttgtgcacccaacagaggagagggtgcatgagtatctagaacctggcggcagcgcaaaagatg

SEQ ID NO: 18259 - DNA, 103 bp, Artificial Sequence
  Synthetic Polynucleotide
taatacgactcactatagggttcacactattagcttctatgactctagtcaacagaggagagactagatgcatagaagcaacctggcggcagcgcaaaagatg

SEQ ID NO: 18260 - DNA, 103 bp, Artificial Sequence
  Synthetic Polynucleotide
taatacgactcactatagggtatcattcacactattagcttctatgactcaacagaggagagagtcaatgaagctaataaacctggcggcagcgcaaaagatg

SEQ ID NO: 18261 - DNA, 103 bp, Artificial Sequence
  Synthetic Polynucleotide
taatacgactcactatagggcacagtatcattcacactattagcttctataacagaggagaatagaaatgaatagtgtgaacctggcggcagcgcaaaagatg

SEQ ID NO: 18262 - DNA, 103 bp, Artificial Sequence
  Synthetic Polynucleotide
taatacgactcactatagggaataacacagtatcattcacactattagctaacagaggagaagctaaatgtgtgaatgaaacctggcggcagcgcaaaagatg

SEQ ID NO: 18263 - DNA, 103 bp, Artificial Sequence
  Synthetic Polynucleotide
taatacgactcactatagggttctgaataacacagtatcattcacactataacagaggagaatagtgatgatgatactgaacctggcggcagcgcaaaagatg

SEQ ID NO: 18264 - DNA, 103 bp, Artificial Sequence
  Synthetic Polynucleotide
taatacgactcactatagggtacacttctgaataacacagtatcattcacaacagaggagagtgaatatgactgtgttaaacctggcggcagcgcaaaagatg

SEQ ID NO: 18265 - DNA, 103 bp, Artificial Sequence
  Synthetic Polynucleotide
taatacgactcactatagggccaaatacacttctgaataacacagtatcaaacagaggagatgatacatggttattcagaacctggcggcagcgcaaaagatg

SEQ ID NO: 18266 - DNA, 103 bp, Artificial Sequence
  Synthetic Polynucleotide
taatacgactcactataggggatttccaaatacacttctgaataacacagaacagaggagactgtgtatgtcagaagtgaacctggcggcagcgcaaaagatg

SEQ ID NO: 18267 - DNA, 103 bp, Artificial Sequence
  Synthetic Polynucleotide
taatacgactcactataggggaaaagatttccaaatacacttctgaataaaacagaggagattattcatgagtgtatttaacctggcggcagcgcaaaagatg

SEQ ID NO: 18268 - DNA, 103 bp, Artificial Sequence
  Synthetic Polynucleotide
taatacgactcactataggggcagagaaaagatttccaaatacacttctgaacagaggagacagaagatgatttggaaaaacctggcggcagcgcaaaagatg

SEQ ID NO: 18269 - DNA, 103 bp, Artificial Sequence
  Synthetic Polynucleotide
taatacgactcactataggggtgtcccaacattttgtctagatacttgtgaacagaggagacacaagatgctagacaaaaacctggcggcagcgcaaaagatg

SEQ ID NO: 18270 - DNA, 103 bp, Artificial Sequence
  Synthetic Polynucleotide
taatacgactcactatagggggaaagcagagaaaagatttccaaatacacaacagaggagagtgtatatggaaatctttaacctggcggcagcgcaaaagatg

SEQ ID NO: 18271 - DNA, 103 bp, Artificial Sequence
  Synthetic Polynucleotide
taatacgactcactatagggtttgtggaaagcagagaaaagatttccaaaaacagaggagatttggaatgcttttctctaacctggcggcagcgcaaaagatg

SEQ ID NO: 18272 - DNA, 103 bp, Artificial Sequence
  Synthetic Polynucleotide
taatacgactcactataggggggtttttgtggaaagcagagaaaagatttaacagaggagaaaatctatgctctgctttaacctggcggcagcgcaaaagatg

SEQ ID NO: 18273 - DNA, 103 bp, Artificial Sequence
  Synthetic Polynucleotide
taatacgactcactatagggtacctgggtttttgtggaaagcagagaaaaaacagaggagattttctatgctttccacaaacctggcggcagcgcaaaagatg

SEQ ID NO: 18274 - DNA, 103 bp, Artificial Sequence
  Synthetic Polynucleotide
taatacgactcactataggggactatacctgggtttttgtggaaagcagaaacagaggagatctgctatgcacaaaaacaacctggcggcagcgcaaaagatg

SEQ ID NO: 18275 - DNA, 103 bp, Artificial Sequence
  Synthetic Polynucleotide
taatacgactcactatagggccagtgactatacctgggtttttgtggaaaaacagaggagatttccaatgaaacccaggaacctggcggcagcgcaaaagatg

SEQ ID NO: 18276 - DNA, 103 bp, Artificial Sequence
  Synthetic Polynucleotide
taatacgactcactatagggctgaaccagtgactatacctgggtttttgtaacagaggagaacaaaaatgcaggtatagaacctggcggcagcgcaaaagatg

SEQ ID NO: 18277 - DNA, 103 bp, Artificial Sequence
  Synthetic Polynucleotide
taatacgactcactatagggtactgctgaaccagtgactatacctgggttaacagaggagaaacccaatgatagtcactaacctggcggcagcgcaaaagatg

SEQ ID NO: 18278 - DNA, 103 bp, Artificial Sequence
  Synthetic Polynucleotide
taatacgactcactatagggcaccctactgctgaaccagtgactatacctaacagaggagaaggtatatgcactggttcaacctggcggcagcgcaaaagatg

SEQ ID NO: 18279 - DNA, 103 bp, Artificial Sequence
  Synthetic Polynucleotide
taatacgactcactatagggggtcacaccctactgctgaaccagtgactaaacagaggagatagtcaatggttcagcagaacctggcggcagcgcaaaagatg

SEQ ID NO: 18280 - DNA, 103 bp, Artificial Sequence
  Synthetic Polynucleotide
taatacgactcactatagggggagtgtgtcccaacattttgtctagatacaacagaggagagtatctatgcaaaatgttaacctggcggcagcgcaaaagatg

SEQ ID NO: 18281 - DNA, 103 bp, Artificial Sequence
  Synthetic Polynucleotide
taatacgactcactatagggttcagggtcacaccctactgctgaaccagtaacagaggagaactggtatggcagtagggaacctggcggcagcgcaaaagatg

SEQ ID NO: 18282 - DNA, 103 bp, Artificial Sequence
  Synthetic Polynucleotide
taatacgactcactatagggaatacttcagggtcacaccctactgctgaaaacagaggagattcagcatgagggtgtgaaacctggcggcagcgcaaaagatg

SEQ ID NO: 18283 - DNA, 103 bp, Artificial Sequence
  Synthetic Polynucleotide
taatacgactcactatagggaccagaatacttcagggtcacaccctactgaacagaggagacagtagatggtgaccctgaacctggcggcagcgcaaaagatg

SEQ ID NO: 18284 - DNA, 103 bp, Artificial Sequence
  Synthetic Polynucleotide
taatacgactcactatagggagttgaccagaatacttcagggtcacacccaacagaggagagggtgtatgcctgaagtaaacctggcggcagcgcaaaagatg

SEQ ID NO: 18285 - DNA, 103 bp, Artificial Sequence
  Synthetic Polynucleotide
taatacgactcactatagggggtatagttgaccagaatacttcagggtcaaacagaggagatgacccatgagtattctgaacctggcggcagcgcaaaagatg

SEQ ID NO: 18286 - DNA, 103 bp, Artificial Sequence
  Synthetic Polynucleotide
taatacgactcactatagggtgagaggtatagttgaccagaatacttcagaacagaggagactgaagatgtctggtcaaaacctggcggcagcgcaaaagatg

SEQ ID NO: 18287 - DNA, 103 bp, Artificial Sequence
  Synthetic Polynucleotide
taatacgactcactatagggtagcatgagaggtatagttgaccagaatacaacagaggagagtattcatgtcaactataaacctggcggcagcgcaaaagatg

SEQ ID NO: 18288 - DNA, 103 bp, Artificial Sequence
  Synthetic Polynucleotide
taatacgactcactatagggccatctagcatgagaggtatagttgaccagaacagaggagactggtcatgtatacctctaacctggcggcagcgcaaaagatg

SEQ ID NO: 18289 - DNA, 103 bp, Artificial Sequence
  Synthetic Polynucleotide
taatacgactcactatagggattctccatctagcatgagaggtatagttgaacagaggagacaactaatgctctcatgcaacctggcggcagcgcaaaagatg

SEQ ID NO: 18290 - DNA, 103 bp, Artificial Sequence
  Synthetic Polynucleotide
taatacgactcactatagggtaaacattctccatctagcatgagaggtataacagaggagaatacctatgatgctagataacctggcggcagcgcaaaagatg

SEQ ID NO: 18291 - DNA, 103 bp, Artificial Sequence
  Synthetic Polynucleotide
taatacgactcactatagggtgtgtggagtgtgtcccaacattttgtctaaacagaggagatagacaatgtgttgggacaacctggcggcagcgcaaaagatg

SEQ ID NO: 18292 - DNA, 103 bp, Artificial Sequence
  Synthetic Polynucleotide
taatacgactcactataggggccattaaacattctccatctagcatgagaaacagaggagatctcatatgagatggagaaacctggcggcagcgcaaaagatg

SEQ ID NO: 18293 - DNA, 103 bp, Artificial Sequence
  Synthetic Polynucleotide
taatacgactcactatagggcaaaagccattaaacattctccatctagcaaacagaggagatgctagatggagaatgttaacctggcggcagcgcaaaagatg

SEQ ID NO: 18294 - DNA, 103 bp, Artificial Sequence
  Synthetic Polynucleotide
taatacgactcactatagggataatcaaaagccattaaacattctccatcaacagaggagagatggaatgtgtttaatgaacctggcggcagcgcaaaagatg

SEQ ID NO: 18295 - DNA, 103 bp, Artificial Sequence
  Synthetic Polynucleotide
taatacgactcactatagggtttgaataatcaaaagccattaaacattctaacagaggagaagaatgatgaatggctttaacctggcggcagcgcaaaagatg

SEQ ID NO: 18296 - DNA, 103 bp, Artificial Sequence
  Synthetic Polynucleotide
taatacgactcactatagggcatagtttgaataatcaaaagccattaaacaacagaggagagtttaaatgcttttgattaacctggcggcagcgcaaaagatg

SEQ ID NO: 18297 - DNA, 103 bp, Artificial Sequence
  Synthetic Polynucleotide
taatacgactcactatagggaccatcatagtttgaataatcaaaagccataacagaggagaatggctatggattattcaaacctggcggcagcgcaaaagatg

SEQ ID NO: 18298 - DNA, 103 bp, Artificial Sequence
  Synthetic Polynucleotide
taatacgactcactatagggaggctaccatcatagtttgaataatcaaaaaacagaggagattttgaatgttcaaactaaacctggcggcagcgcaaaagatg

SEQ ID NO: 18299 - DNA, 103 bp, Artificial Sequence
  Synthetic Polynucleotide
taatacgactcactataggggatgtaggctaccatcatagtttgaataataacagaggagaattattatgactatgatgaacctggcggcagcgcaaaagatg

SEQ ID NO: 18300 - DNA, 103 bp, Artificial Sequence
  Synthetic Polynucleotide
taatacgactcactatagggaacgggatgtaggctaccatcatagtttgaaacagaggagatcaaacatggatggtagcaacctggcggcagcgcaaaagatg

SEQ ID NO: 18301 - DNA, 103 bp, Artificial Sequence
  Synthetic Polynucleotide
taatacgactcactatagggaaccaaacgggatgtaggctaccatcatagaacagaggagactatgaatgtagcctacaaacctggcggcagcgcaaaagatg

SEQ ID NO: 18302 - DNA, 103 bp, Artificial Sequence
  Synthetic Polynucleotide
taatacgactcactatagggaattttgtgtggagtgtgtcccaacattttaacagaggagaaaaatgatgggacacactaacctggcggcagcgcaaaagatg

SEQ ID NO: 18303 - DNA, 103 bp, Artificial Sequence
  Synthetic Polynucleotide
taatacgactcactatagggatttaaaccaaacgggatgtaggctaccataacagaggagaatggtaatgtacatcccgaacctggcggcagcgcaaaagatg

SEQ ID NO: 18304 - DNA, 103 bp, Artificial Sequence
  Synthetic Polynucleotide
taatacgactcactatagggaagacatttaaaccaaacgggatgtaggctaacagaggagaagcctaatgcccgtttggaacctggcggcagcgcaaaagatg

SEQ ID NO: 18305 - DNA, 103 bp, Artificial Sequence
  Synthetic Polynucleotide
taatacgactcactatagggatactaagacatttaaaccaaacgggatgtaacagaggagaacatccatgttggtttaaaacctggcggcagcgcaaaagatg

SEQ ID NO: 18306 - DNA, 103 bp, Artificial Sequence
  Synthetic Polynucleotide
taatacgactcactatagggagagcatactaagacatttaaaccaaacggaacagaggagaccgtttatgttaaatgtcaacctggcggcagcgcaaaagatg

SEQ ID NO: 18307 - DNA, 103 bp, Artificial Sequence
  Synthetic Polynucleotide
taatacgactcactatagggttctaagagcatactaagacatttaaaccaaacagaggagatggtttatgtgtcttagtaacctggcggcagcgcaaaagatg

SEQ ID NO: 18308 - DNA, 103 bp, Artificial Sequence
  Synthetic Polynucleotide
taatacgactcactatagggatgtcttctaagagcatactaagacatttaaacagaggagataaatgatgtagtatgctaacctggcggcagcgcaaaagatg

SEQ ID NO: 18309 - DNA, 103 bp, Artificial Sequence
  Synthetic Polynucleotide
taatacgactcactatagggaacctatgtcttctaagagcatactaagacaacagaggagagtcttaatgtgctcttagaacctggcggcagcgcaaaagatg

SEQ ID NO: 18310 - DNA, 103 bp, Artificial Sequence
  Synthetic Polynucleotide
taatacgactcactatagggggagaaacctatgtcttctaagagcatactaacagaggagaagtatgatgttagaagacaacctggcggcagcgcaaaagatg

SEQ ID NO: 18311 - DNA, 103 bp, Artificial Sequence
  Synthetic Polynucleotide
taatacgactcactatagggtgagaggagaaacctatgtcttctaagagcaacagaggagagctcttatgagacataggaacctggcggcagcgcaaaagatg

SEQ ID NO: 18312 - DNA, 103 bp, Artificial Sequence
  Synthetic Polynucleotide
taatacgactcactatagggtaagttgagaggagaaacctatgtcttctaaacagaggagatagaagatgtaggtttctaacctggcggcagcgcaaaagatg

SEQ ID NO: 18313 - DNA, 103 bp, Artificial Sequence
  Synthetic Polynucleotide
taatacgactcactatagggtgggaaaaactggcgtacaaagttaccgtaaacagaggagatacggtatgtttgtacgcaacctggcggcagcgcaaaagatg

SEQ ID NO: 18314 - DNA, 103 bp, Artificial Sequence
  Synthetic Polynucleotide
taatacgactcactatagggcactgaattttgtgtggagtgtgtcccaacaacagaggagagttgggatgcactccacaaacctggcggcagcgcaaaagatg

SEQ ID NO: 18315 - DNA, 103 bp, Artificial Sequence
  Synthetic Polynucleotide
taatacgactcactataggggttaataagttgagaggagaaacctatgtcaacagaggagagacataatgttctcctctaacctggcggcagcgcaaaagatg

SEQ ID NO: 18316 - DNA, 103 bp, Artificial Sequence
  Synthetic Polynucleotide
taatacgactcactatagggatctggttaataagttgagaggagaaacctaacagaggagaaggtttatgctctcaactaacctggcggcagcgcaaaagatg

SEQ ID NO: 18317 - DNA, 103 bp, Artificial Sequence
  Synthetic Polynucleotide
taatacgactcactatagggtacagatctggttaataagttgagaggagaaacagaggagatctcctatgaacttattaaacctggcggcagcgcaaaagatg

SEQ ID NO: 18318 - DNA, 103 bp, Artificial Sequence
  Synthetic Polynucleotide
taatacgactcactatagggagagttacagatctggttaataagttgagaaacagaggagatctcaaatgattaaccagaacctggcggcagcgcaaaagatg

SEQ ID NO: 18319 - DNA, 103 bp, Artificial Sequence
  Synthetic Polynucleotide
taatacgactcactatagggtgtttagagttacagatctggttaataagtaacagaggagaacttatatgccagatctgaacctggcggcagcgcaaaagatg

SEQ ID NO: 18320 - DNA, 103 bp, Artificial Sequence
  Synthetic Polynucleotide
taatacgactcactatagggatatatgtttagagttacagatctggttaaaacagaggagattaaccatgtctgtaactaacctggcggcagcgcaaaagatg

SEQ ID NO: 18321 - DNA, 103 bp, Artificial Sequence
  Synthetic Polynucleotide
taatacgactcactatagggtttgtatatatgtttagagttacagatctgaacagaggagacagatcatgaactctaaaaacctggcggcagcgcaaaagatg

SEQ ID NO: 18322 - DNA, 103 bp, Artificial Sequence
  Synthetic Polynucleotide
taatacgactcactatagggttagatttgtatatatgtttagagttacagaacagaggagactgtaaatgtaaacatataacctggcggcagcgcaaaagatg

SEQ ID NO: 18323 - DNA, 103 bp, Artificial Sequence
  Synthetic Polynucleotide
taatacgactcactatagggaatacttagatttgtatatatgtttagagtaacagaggagaactctaatgatatatacaaacctggcggcagcgcaaaagatg

SEQ ID NO: 18324 - DNA, 103 bp, Artificial Sequence
  Synthetic Polynucleotide
taatacgactcactatagggttcataatacttagatttgtatatatgtttaacagaggagaaaacatatgtacaaatctaacctggcggcagcgcaaaagatg

SEQ ID NO: 18325 - DNA, 103 bp, Artificial Sequence
  Synthetic Polynucleotide
taatacgactcactatagggttgctcactgaattttgtgtggagtgtgtcaacagaggagagacacaatgcacacaaaaaacctggcggcagcgcaaaagatg

SEQ ID NO: 18326 - DNA, 103 bp, Artificial Sequence
  Synthetic Polynucleotide
taatacgactcactatagggtccacttcataatacttagatttgtatataaacagaggagatatataatgatctaagtaaacctggcggcagcgcaaaagatg

SEQ ID NO: 18327 - DNA, 103 bp, Artificial Sequence
  Synthetic Polynucleotide
taatacgactcactatagggctccttccacttcataatacttagatttgtaacagaggagaacaaatatgagtattatgaacctggcggcagcgcaaaagatg

SEQ ID NO: 18328 - DNA, 103 bp, Artificial Sequence
  Synthetic Polynucleotide
taatacgactcactatagggcatacctccttccacttcataatacttagaaacagaggagatctaagatgtatgaagtgaacctggcggcagcgcaaaagatg

SEQ ID NO: 18329 - DNA, 103 bp, Artificial Sequence
  Synthetic Polynucleotide
taatacgactcactataggggatggcatacctccttccacttcataatacaacagaggagagtattaatgagtggaaggaacctggcggcagcgcaaaagatg

SEQ ID NO: 18330 - DNA, 103 bp, Artificial Sequence
  Synthetic Polynucleotide
taatacgactcactatagggatccagatggcatacctccttccacttcataacagaggagaatgaagatgaaggaggtaaacctggcggcagcgcaaaagatg

SEQ ID NO: 18331 - DNA, 103 bp, Artificial Sequence
  Synthetic Polynucleotide
taatacgactcactatagggagcacatccagatggcatacctccttccacaacagaggagagtggaaatgggtatgccaaacctggcggcagcgcaaaagatg

SEQ ID NO: 18332 - DNA, 103 bp, Artificial Sequence
  Synthetic Polynucleotide
taatacgactcactataggggtaccagcacatccagatggcatacctcctaacagaggagaaggaggatggccatctggaacctggcggcagcgcaaaagatg

SEQ ID NO: 18333 - DNA, 103 bp, Artificial Sequence
  Synthetic Polynucleotide
taatacgactcactatagggtactagtaccagcacatccagatggcatacaacagaggagagtatgcatgctggatgtgaacctggcggcagcgcaaaagatg

SEQ ID NO: 18334 - DNA, 103 bp, Artificial Sequence
  Synthetic Polynucleotide
taatacgactcactatagggaaaaatactagtaccagcacatccagatggaacagaggagaccatctatgtgtgctggtaacctggcggcagcgcaaaagatg

SEQ ID NO: 18335 - DNA, 103 bp, Artificial Sequence
  Synthetic Polynucleotide
taatacgactcactataggggtattaaaaatactagtaccagcacatccaaacagaggagatggatgatgtggtactagaacctggcggcagcgcaaaagatg

SEQ ID NO: 18336 - DNA, 103 bp, Artificial Sequence
  Synthetic Polynucleotide
taatacgactcactatagggatccattgctcactgaattttgtgtggagtaacagaggagaactccaatgaaaattcagaacctggcggcagcgcaaaagatg

SEQ ID NO: 18337 - DNA, 103 bp, Artificial Sequence
  Synthetic Polynucleotide
taatacgactcactatagggttattgtattaaaaatactagtaccagcacaacagaggagagtgctgatgctagtatttaacctggcggcagcgcaaaagatg

SEQ ID NO: 18338 - DNA, 103 bp, Artificial Sequence
  Synthetic Polynucleotide
taatacgactcactataggggttgattattgtattaaaaatactagtaccaacagaggagaggtactatgatttttaataacctggcggcagcgcaaaagatg

SEQ ID NO: 18339 - DNA, 103 bp, Artificial Sequence
  Synthetic Polynucleotide
taatacgactcactatagggatattgttgattattgtattaaaaatactaaacagaggagatagtatatgtaatacaataacctggcggcagcgcaaaagatg

SEQ ID NO: 18340 - DNA, 103 bp, Artificial Sequence
  Synthetic Polynucleotide
taatacgactcactatagggtgataatattgttgattattgtattaaaaaaacagaggagatttttaatgcaataatcaaacctggcggcagcgcaaaagatg

SEQ ID NO: 18341 - DNA, 103 bp, Artificial Sequence
  Synthetic Polynucleotide
taatacgactcactatagggtctaatgataatattgttgattattgtattaacagaggagaaatacaatgatcaacaataacctggcggcagcgcaaaagatg

SEQ ID NO: 18342 - DNA, 103 bp, Artificial Sequence
  Synthetic Polynucleotide
taatacgactcactatagggaaagttctaatgataatattgttgattattaacagaggagaaataatatgcaatattataacctggcggcagcgcaaaagatg

SEQ ID NO: 18343 - DNA, 103 bp, Artificial Sequence
  Synthetic Polynucleotide
taatacgactcactataggggtaccaaagttctaatgataatattgttgaaacagaggagatcaacaatgttatcattaaacctggcggcagcgcaaaagatg

SEQ ID NO: 18344 - DNA, 103 bp, Artificial Sequence
  Synthetic Polynucleotide
taatacgactcactatagggatctagtaccaaagttctaatgataatattaacagaggagaaatattatgattagaactaacctggcggcagcgcaaaagatg

SEQ ID NO: 18345 - DNA, 103 bp, Artificial Sequence
  Synthetic Polynucleotide
taatacgactcactatagggtaagcatctagtaccaaagttctaatgataaacagaggagatatcatatgaactttggtaacctggcggcagcgcaaaagatg

SEQ ID NO: 18346 - DNA, 103 bp, Artificial Sequence
  Synthetic Polynucleotide
taatacgactcactatagggtcttataagcatctagtaccaaagttctaaaacagaggagattagaaatgtggtactagaacctggcggcagcgcaaaagatg

SEQ ID NO: 18347 - DNA, 103 bp, Artificial Sequence
  Synthetic Polynucleotide
taatacgactcactataggggctagatccattgctcactgaattttgtgtaacagaggagaacacaaatgtcagtgagcaacctggcggcagcgcaaaagatg

SEQ ID NO: 18348 - DNA, 103 bp, Artificial Sequence
  Synthetic Polynucleotide
taatacgactcactatagggtatgttcttataagcatctagtaccaaagtaacagaggagaactttgatgctagatgctaacctggcggcagcgcaaaagatg

SEQ ID NO: 18349 - DNA, 103 bp, Artificial Sequence
  Synthetic Polynucleotide
taatacgactcactatagggagatctatgttcttataagcatctagtaccaacagaggagaggtactatgtgcttataaaacctggcggcagcgcaaaagatg

SEQ ID NO: 18350 - DNA, 103 bp, Artificial Sequence
  Synthetic Polynucleotide
taatacgactcactatagggtatctagatctatgttcttataagcatctaaacagaggagatagatgatgataagaacaaacctggcggcagcgcaaaagatg

SEQ ID NO: 18351 - DNA, 103 bp, Artificial Sequence
  Synthetic Polynucleotide
taatacgactcactatagggcagtttatctagatctatgttcttataagcaacagaggagagcttatatgaacatagataacctggcggcagcgcaaaagatg

SEQ ID NO: 18352 - DNA, 103 bp, Artificial Sequence
  Synthetic Polynucleotide
taatacgactcactatagggattttcagtttatctagatctatgttcttaaacagaggagataagaaatgagatctagaaacctggcggcagcgcaaaagatg

SEQ ID NO: 18353 - DNA, 103 bp, Artificial Sequence
  Synthetic Polynucleotide
taatacgactcactatagggctaagattttcagtttatctagatctatgtaacagaggagaacatagatgtagataaacaacctggcggcagcgcaaaagatg

SEQ ID NO: 18354 - DNA, 103 bp, Artificial Sequence
  Synthetic Polynucleotide
taatacgactcactatagggatatgctaagattttcagtttatctagatcaacagaggagagatctaatgaaactgaaaaacctggcggcagcgcaaaagatg

SEQ ID NO: 18355 - DNA, 103 bp, Artificial Sequence
  Synthetic Polynucleotide
taatacgactcactatagggtccccatatgctaagattttcagtttatctaacagaggagaagataaatggaaaatcttaacctggcggcagcgcaaaagatg

SEQ ID NO: 18356 - DNA, 103 bp, Artificial Sequence
  Synthetic Polynucleotide
taatacgactcactatagggcatcatccccatatgctaagattttcagttaacagaggagaaactgaatgtcttagcataacctggcggcagcgcaaaagatg

SEQ ID NO: 18357 - DNA, 103 bp, Artificial Sequence
  Synthetic Polynucleotide
taatacgactcactataggggatgacatcatccccatatgctaagattttaacagaggagaaaaatcatggcatatgggaacctggcggcagcgcaaaagatg

SEQ ID NO: 18358 - DNA, 103 bp, Artificial Sequence
  Synthetic Polynucleotide
taatacgactcactatagggtttaagctagatccattgctcactgaatttaacagaggagaaaattcatggagcaatggaacctggcggcagcgcaaaagatg

SEQ ID NO: 18359 - DNA, 103 bp, Artificial Sequence
  Synthetic Polynucleotide
taatacgactcactataggggaaaagatgacatcatccccatatgctaagaacagaggagacttagcatgtggggatgaaacctggcggcagcgcaaaagatg

SEQ ID NO: 18360 - DNA, 103 bp, Artificial Sequence
  Synthetic Polynucleotide
taatacgactcactatagggtataagaaaagatgacatcatccccatatgaacagaggagacatatgatgatgatgtcaaacctggcggcagcgcaaaagatg

SEQ ID NO: 18361 - DNA, 103 bp, Artificial Sequence
  Synthetic Polynucleotide
taatacgactcactatagggaaaattataagaaaagatgacatcatccccaacagaggagaggggatatggtcatctttaacctggcggcagcgcaaaagatg

SEQ ID NO: 18362 - DNA, 103 bp, Artificial Sequence
  Synthetic Polynucleotide
taatacgactcactatagggagtttaaaattataagaaaagatgacatcaaacagaggagatgatgtatgcttttcttaaacctggcggcagcgcaaaagatg

SEQ ID NO: 18363 - DNA, 103 bp, Artificial Sequence
  Synthetic Polynucleotide
taatacgactcactatagggtgtcaagtttaaaattataagaaaagatgaaacagaggagatcatctatgcttataattaacctggcggcagcgcaaaagatg

SEQ ID NO: 18364 - DNA, 103 bp, Artificial Sequence
  Synthetic Polynucleotide
taatacgactcactatagggtgccatgtcaagtttaaaattataagaaaaaacagaggagattttctatgaattttaaaaacctggcggcagcgcaaaagatg

SEQ ID NO: 18365 - DNA, 103 bp, Artificial Sequence
  Synthetic Polynucleotide
taatacgactcactatagggagaactgccatgtcaagtttaaaattataaaacagaggagattataaatgtaaacttgaaacctggcggcagcgcaaaagatg

SEQ ID NO: 18366 - DNA, 103 bp, Artificial Sequence
  Synthetic Polynucleotide
taatacgactcactatagggtggcaagaactgccatgtcaagtttaaaataacagaggagaattttaatgttgacatggaacctggcggcagcgcaaaagatg

SEQ ID NO: 18367 - DNA, 103 bp, Artificial Sequence
  Synthetic Polynucleotide
taatacgactcactatagggttctttggcaagaactgccatgtcaagtttaacagaggagaaaacttatgatggcagttaacctggcggcagcgcaaaagatg

SEQ ID NO: 18368 - DNA, 103 bp, Artificial Sequence
  Synthetic Polynucleotide
taatacgactcactatagggtctccttctttggcaagaactgccatgtcaaacagaggagatgacatatgagttcttgcaacctggcggcagcgcaaaagatg

SEQ ID NO: 18369 - DNA, 103 bp, Artificial Sequence
  Synthetic Polynucleotide
taatacgactcactatagggaataatttaagctagatccattgctcactgaacagaggagacagtgaatgatggatctaaacctggcggcagcgcaaaagatg

SEQ ID NO: 18370 - DNA, 103 bp, Artificial Sequence
  Synthetic Polynucleotide
taatacgactcactatagggatttttctccttctttggcaagaactgccaaacagaggagatggcagatgttgccaaagaacctggcggcagcgcaaaagatg

SEQ ID NO: 18371 - DNA, 103 bp, Artificial Sequence
  Synthetic Polynucleotide
taatacgactcactatagggtccatatttttctccttctttggcaagaacaacagaggagagttcttatgaaagaaggaaacctggcggcagcgcaaaagatg

SEQ ID NO: 18372 - DNA, 103 bp, Artificial Sequence
  Synthetic Polynucleotide
taatacgactcactataggggttagtccatatttttctccttctttggcaaacagaggagatgccaaatgaggagaaaaaacctggcggcagcgcaaaagatg

SEQ ID NO: 18373 - DNA, 103 bp, Artificial Sequence
  Synthetic Polynucleotide
taatacgactcactatagggtgattgttagtccatatttttctccttcttaacagaggagaaagaagatgaaaaatatgaacctggcggcagcgcaaaagatg

SEQ ID NO: 18374 - DNA, 103 bp, Artificial Sequence
  Synthetic Polynucleotide
taatacgactcactatagggaggggtgattgttagtccatatttttctccaacagaggagaggagaaatgtatggactaaacctggcggcagcgcaaaagatg

SEQ ID NO: 18375 - DNA, 103 bp, Artificial Sequence
  Synthetic Polynucleotide
taatacgactcactatagggtcagcaggggtgattgttagtccatattttaacagaggagaaaaataatgactaacaataacctggcggcagcgcaaaagatg

SEQ ID NO: 18376 - DNA, 103 bp, Artificial Sequence
  Synthetic Polynucleotide
taatacgactcactatagggacttatcagcaggggtgattgttagtccataacagaggagaatggacatgcaatcacccaacctggcggcagcgcaaaagatg

SEQ ID NO: 18377 - DNA, 103 bp, Artificial Sequence
  Synthetic Polynucleotide
taatacgactcactatagggatcagacttatcagcaggggtgattgttagaacagaggagactaacaatgacccctgctaacctggcggcagcgcaaaagatg

SEQ ID NO: 18378 - DNA, 103 bp, Artificial Sequence
  Synthetic Polynucleotide
taatacgactcactatagggaaaacatcagacttatcagcaggggtgattaacagaggagaaatcacatgtgctgataaaacctggcggcagcgcaaaagatg

SEQ ID NO: 18379 - DNA, 103 bp, Artificial Sequence
  Synthetic Polynucleotide
taatacgactcactatagggcttggaaaacatcagacttatcagcaggggaacagaggagacccctgatgataagtctgaacctggcggcagcgcaaaagatg

SEQ ID NO: 18380 - DNA, 103 bp, Artificial Sequence
  Synthetic Polynucleotide
taatacgactcactataggggttgaaataatttaagctagatccattgctaacagaggagaagcaatatgtctagcttaaacctggcggcagcgcaaaagatg

SEQ ID NO: 18381 - DNA, 103 bp, Artificial Sequence
  Synthetic Polynucleotide
taatacgactcactatagggcaattcttggaaaacatcagacttatcagcaacagaggagagctgatatgtctgatgttaacctggcggcagcgcaaaagatg

SEQ ID NO: 18382 - DNA, 103 bp, Artificial Sequence
  Synthetic Polynucleotide
taatacgactcactatagggtaggtcaattcttggaaaacatcagacttaaacagaggagataagtcatgtgttttccaaacctggcggcagcgcaaaagatg

SEQ ID NO: 18383 - DNA, 103 bp, Artificial Sequence
  Synthetic Polynucleotide
taatacgactcactatagggttttataggtcaattcttggaaaacatcagaacagaggagactgatgatgtccaagaataacctggcggcagcgcaaaagatg

SEQ ID NO: 18384 - DNA, 103 bp, Artificial Sequence
  Synthetic Polynucleotide
taatacgactcactatagggtacatttttataggtcaattcttggaaaacaacagaggagagttttcatggaattgaccaacctggcggcagcgcaaaagatg

SEQ ID NO: 18385 - DNA, 103 bp, Artificial Sequence
  Synthetic Polynucleotide
taatacgactcactatagggaaagttacatttttataggtcaattcttggaacagaggagaccaagaatggacctataaaacctggcggcagcgcaaaagatg

SEQ ID NO: 18386 - DNA, 103 bp, Artificial Sequence
  Synthetic Polynucleotide
taatacgactcactatagggtaagaaaagttacatttttataggtcaattaacagaggagaaattgaatgataaaaatgaacctggcggcagcgcaaaagatg

SEQ ID NO: 18387 - DNA, 103 bp, Artificial Sequence
  Synthetic Polynucleotide
taatacgactcactatagggtcttttaagaaaagttacatttttataggtaacagaggagaacctatatgaatgtaactaacctggcggcagcgcaaaagatg

SEQ ID NO: 18388 - DNA, 103 bp, Artificial Sequence
  Synthetic Polynucleotide
taatacgactcactatagggaatcctcttttaagaaaagttacatttttaaacagaggagataaaaaatgaacttttctaacctggcggcagcgcaaaagatg

SEQ ID NO: 18389 - DNA, 103 bp, Artificial Sequence
  Synthetic Polynucleotide
taatacgactcactatagggctctgaatcctcttttaagaaaagttacataacagaggagaatgtaaatgttcttaaaaaacctggcggcagcgcaaaagatg

SEQ ID NO: 18390 - DNA, 103 bp, Artificial Sequence
  Synthetic Polynucleotide
taatacgactcactatagggatcagctctgaatcctcttttaagaaaagtaacagaggagaacttttatgaaaagaggaaacctggcggcagcgcaaaagatg

SEQ ID NO: 18391 - DNA, 103 bp, Artificial Sequence
  Synthetic Polynucleotide
taatacgactcactatagggttgatgttgaaataatttaagctagatccaaacagaggagatggatcatgcttaaattaaacctggcggcagcgcaaaagatg

SEQ ID NO: 18392 - DNA, 103 bp, Artificial Sequence
  Synthetic Polynucleotide
taatacgactcactatagggcgctcatcagctctgaatcctcttttaagaaacagaggagatcttaaatgaggattcagaacctggcggcagcgcaaaagatg

SEQ ID NO: 18393 - DNA, 103 bp, Artificial Sequence
  Synthetic Polynucleotide
taatacgactcactatagggagtggcgctcatcagctctgaatcctctttaacagaggagaaaagagatgtcagagctgaacctggcggcagcgcaaaagatg

SEQ ID NO: 18394 - DNA, 103 bp, Artificial Sequence
  Synthetic Polynucleotide
taatacgactcactataggggaaagagtggcgctcatcagctctgaatccaacagaggagaggattcatggctgatgagaacctggcggcagcgcaaaagatg

SEQ ID NO: 18395 - DNA, 103 bp, Artificial Sequence
  Synthetic Polynucleotide
taatacgactcactatagggataaggaaagagtggcgctcatcagctctgaacagaggagacagagcatgtgagcgccaaacctggcggcagcgcaaaagatg

SEQ ID NO: 18396 - DNA, 103 bp, Artificial Sequence
  Synthetic Polynucleotide
taatacgactcactatagggggtgtataaggaaagagtggcgctcatcagaacagaggagactgatgatggccactcttaacctggcggcagcgcaaaagatg

SEQ ID NO: 18397 - DNA, 103 bp, Artificial Sequence
  Synthetic Polynucleotide
taatacgactcactatagggggtagggtgtataaggaaagagtggcgctcaacagaggagagagcgcatgtctttccttaacctggcggcagcgcaaaagatg

SEQ ID NO: 18398 - DNA, 103 bp, Artificial Sequence
  Synthetic Polynucleotide
taatacgactcactatagggggaaaggtagggtgtataaggaaagagtggaacagaggagaccactcatgccttatacaaacctggcggcagcgcaaaagatg

SEQ ID NO: 18399 - DNA, 103 bp, Artificial Sequence
  Synthetic Polynucleotide
taatacgactcactatagggccacaggaaaggtagggtgtataaggaaagaacagaggagactttccatgtacaccctaaacctggcggcagcgcaaaagatg

SEQ ID NO: 18400 - DNA, 103 bp, Artificial Sequence
  Synthetic Polynucleotide
taatacgactcactatagggctcagccacaggaaaggtagggtgtataagaacagaggagacttataatgcctacctttaacctggcggcagcgcaaaagatg

SEQ ID NO: 18401 - DNA, 103 bp, Artificial Sequence
  Synthetic Polynucleotide
taatacgactcactatagggtgaatctcagccacaggaaaggtagggtgtaacagaggagaacacccatgctttcctgtaacctggcggcagcgcaaaagatg

SEQ ID NO: 18402 - DNA, 103 bp, Artificial Sequence
  Synthetic Polynucleotide
taatacgactcactatagggaataattgatgttgaaataatttaagctagaacagaggagactagctatgattatttcaaacctggcggcagcgcaaaagatg

SEQ ID NO: 18403 - DNA, 103 bp, Artificial Sequence
  Synthetic Polynucleotide
taatacgactcactatagggagtcatgaatctcagccacaggaaaggtagaacagaggagactacctatgctgtggctgaacctggcggcagcgcaaaagatg

SEQ ID NO: 18404 - DNA, 103 bp, Artificial Sequence
  Synthetic Polynucleotide
taatacgactcactataggggatggagtcatgaatctcagccacaggaaaaacagaggagatttcctatggctgagattaacctggcggcagcgcaaaagatg

SEQ ID NO: 18405 - DNA, 103 bp, Artificial Sequence
  Synthetic Polynucleotide
taatacgactcactatagggcatctgatggagtcatgaatctcagccacaaacagaggagatgtggcatggattcatgaaacctggcggcagcgcaaaagatg

SEQ ID NO: 18406 - DNA, 103 bp, Artificial Sequence
  Synthetic Polynucleotide
taatacgactcactatagggtggtccatctgatggagtcatgaatctcagaacagaggagactgagaatgatgactccaaacctggcggcagcgcaaaagatg

SEQ ID NO: 18407 - DNA, 103 bp, Artificial Sequence
  Synthetic Polynucleotide
taatacgactcactataggggtttttggtccatctgatggagtcatgaataacagaggagaattcatatgtccatcagaaacctggcggcagcgcaaaagatg

SEQ ID NO: 18408 - DNA, 103 bp, Artificial Sequence
  Synthetic Polynucleotide
taatacgactcactataggggaagggtttttggtccatctgatggagtcaaacagaggagatgactcatgcagatggacaacctggcggcagcgcaaaagatg

SEQ ID NO: 18409 - DNA, 103 bp, Artificial Sequence
  Synthetic Polynucleotide
taatacgactcactatagggtacatgaagggtttttggtccatctgatggaacagaggagaccatcaatgggaccaaaaaacctggcggcagcgcaaaagatg

SEQ ID NO: 18410 - DNA, 103 bp, Artificial Sequence
  Synthetic Polynucleotide
taatacgactcactatagggctgcatacatgaagggtttttggtccatctaacagaggagaagatggatgaaaaaccctaacctggcggcagcgcaaaagatg

SEQ ID NO: 18411 - DNA, 103 bp, Artificial Sequence
  Synthetic Polynucleotide
taatacgactcactatagggtgttcctgcatacatgaagggtttttggtcaacagaggagagaccaaatgcccttcatgaacctggcggcagcgcaaaagatg

SEQ ID NO: 18412 - DNA, 103 bp, Artificial Sequence
  Synthetic Polynucleotide
taatacgactcactataggggcacgtgttcctgcatacatgaagggttttaacagaggagaaaaaccatgcatgtatgcaacctggcggcagcgcaaaagatg

SEQ ID NO: 18413 - DNA, 103 bp, Artificial Sequence
  Synthetic Polynucleotide
taatacgactcactatagggtttaaaataattgatgttgaaataatttaaaacagaggagattaaatatgttcaacatcaacctggcggcagcgcaaaagatg

SEQ ID NO: 18414 - DNA, 103 bp, Artificial Sequence
  Synthetic Polynucleotide
taatacgactcactatagggagatagcacgtgttcctgcatacatgaaggaacagaggagaccttcaatgatgcaggaaaacctggcggcagcgcaaaagatg

SEQ ID NO: 18415 - DNA, 103 bp, Artificial Sequence
  Synthetic Polynucleotide
taatacgactcactatagggcacaaagatagcacgtgttcctgcatacataacagaggagaatgtatatgggaacacgtaacctggcggcagcgcaaaagatg

SEQ ID NO: 18416 - DNA, 103 bp, Artificial Sequence
  Synthetic Polynucleotide
taatacgactcactatagggaatgacacaaagatagcacgtgttcctgcaaacagaggagatgcaggatgacgtgctataacctggcggcagcgcaaaagatg

SEQ ID NO: 18417 - DNA, 103 bp, Artificial Sequence
  Synthetic Polynucleotide
taatacgactcactatagggcattaaatgacacaaagatagcacgtgttcaacagaggagagaacacatgctatctttgaacctggcggcagcgcaaaagatg

SEQ ID NO: 18418 - DNA, 103 bp, Artificial Sequence
  Synthetic Polynucleotide
taatacgactcactatagggtgccacattaaatgacacaaagatagcacgaacagaggagacgtgctatgtttgtgtcaaacctggcggcagcgcaaaagatg

SEQ ID NO: 18419 - DNA, 103 bp, Artificial Sequence
  Synthetic Polynucleotide
taatacgactcactatagggcattatgccacattaaatgacacaaagataaacagaggagatatcttatggtcatttaaaacctggcggcagcgcaaaagatg

SEQ ID NO: 18420 - DNA, 103 bp, Artificial Sequence
  Synthetic Polynucleotide
taatacgactcactatagggtctaccattatgccacattaaatgacacaaaacagaggagattgtgtatgttaatgtggaacctggcggcagcgcaaaagatg

SEQ ID NO: 18421 - DNA, 103 bp, Artificial Sequence
  Synthetic Polynucleotide
taatacgactcactataggggcatgtctaccattatgccacattaaatgaaacagaggagatcatttatggtggcataaaacctggcggcagcgcaaaagatg

SEQ ID NO: 18422 - DNA, 103 bp, Artificial Sequence
  Synthetic Polynucleotide
taatacgactcactatagggggtatgcatgtctaccattatgccacattaaacagaggagataatgtatgataatggtaaacctggcggcagcgcaaaagatg

SEQ ID NO: 18423 - DNA, 103 bp, Artificial Sequence
  Synthetic Polynucleotide
taatacgactcactatagggttcctggtatgcatgtctaccattatgccaaacagaggagatggcatatgggtagacataacctggcggcagcgcaaaagatg

SEQ ID NO: 18424 - DNA, 103 bp, Artificial Sequence
  Synthetic Polynucleotide
taatacgactcactatagggaagggtgggaaaaactggcgtacaaagttaaacagaggagataacttatgacgccagttaacctggcggcagcgcaaaagatg

SEQ ID NO: 18425 - DNA, 103 bp, Artificial Sequence
  Synthetic Polynucleotide
taatacgactcactataggggcgtctttaaaataattgatgttgaaataaaacagaggagattatttatgcatcaattaaacctggcggcagcgcaaaagatg

SEQ ID NO: 18426 - DNA, 103 bp, Artificial Sequence
  Synthetic Polynucleotide
taatacgactcactatagggatgaattcctggtatgcatgtctaccattaaacagaggagataatggatgacatgcataaacctggcggcagcgcaaaagatg

SEQ ID NO: 18427 - DNA, 103 bp, Artificial Sequence
  Synthetic Polynucleotide
taatacgactcactatagggctttaatgaattcctggtatgcatgtctacaacagaggagagtagacatgcataccaggaacctggcggcagcgcaaaagatg

SEQ ID NO: 18428 - DNA, 103 bp, Artificial Sequence
  Synthetic Polynucleotide
taatacgactcactatagggtatacctttaatgaattcctggtatgcatgaacagaggagacatgcaatgcaggaattcaacctggcggcagcgcaaaagatg

SEQ ID NO: 18429 - DNA, 103 bp, Artificial Sequence
  Synthetic Polynucleotide
taatacgactcactatagggctgcgtatacctttaatgaattcctggtataacagaggagaataccaatgattcattaaaacctggcggcagcgcaaaagatg

SEQ ID NO: 18430 - DNA, 103 bp, Artificial Sequence
  Synthetic Polynucleotide
taatacgactcactatagggatacactgcgtatacctttaatgaattcctaacagaggagaaggaatatgttaaaggtaaacctggcggcagcgcaaaagatg

SEQ ID NO: 18431 - DNA, 103 bp, Artificial Sequence
  Synthetic Polynucleotide
taatacgactcactatagggggcagatacactgcgtatacctttaatgaaaacagaggagattcattatgggtatacgcaacctggcggcagcgcaaaagatg

SEQ ID NO: 18432 - DNA, 103 bp, Artificial Sequence
  Synthetic Polynucleotide
taatacgactcactatagggcgaccggcagatacactgcgtatacctttaaacagaggagataaaggatgacgcagtgtaacctggcggcagcgcaaaagatg

SEQ ID NO: 18433 - DNA, 103 bp, Artificial Sequence
  Synthetic Polynucleotide
taatacgactcactataggggtgcccgaccggcagatacactgcgtatacaacagaggagagtatacatggtgtatctgaacctggcggcagcgcaaaagatg

SEQ ID NO: 18434 - DNA, 103 bp, Artificial Sequence
  Synthetic Polynucleotide
taatacgactcactatagggatacagtgcccgaccggcagatacactgcgaacagaggagacgcagtatgtctgccggtaacctggcggcagcgcaaaagatg

SEQ ID NO: 18435 - DNA, 103 bp, Artificial Sequence
  Synthetic Polynucleotide
taatacgactcactatagggggtatatacagtgcccgaccggcagatacaaacagaggagatgtatcatgcggtcgggcaacctggcggcagcgcaaaagatg

SEQ ID NO: 18436 - DNA, 103 bp, Artificial Sequence
  Synthetic Polynucleotide
taatacgactcactatagggaagctgcgtctttaaaataattgatgttgaaacagaggagatcaacaatgattattttaaacctggcggcagcgcaaaagatg

SEQ ID NO: 18437 - DNA, 103 bp, Artificial Sequence
  Synthetic Polynucleotide
taatacgactcactatagggaagctggtatatacagtgcccgaccggcagaacagaggagactgccgatggggcactgtaacctggcggcagcgcaaaagatg

SEQ ID NO: 18438 - DNA, 103 bp, Artificial Sequence
  Synthetic Polynucleotide
taatacgactcactatagggttcataagctggtatatacagtgcccgaccaacagaggagaggtcggatgctgtatataaacctggcggcagcgcaaaagatg

SEQ ID NO: 18439 - DNA, 103 bp, Artificial Sequence
  Synthetic Polynucleotide
taatacgactcactatagggagaacttcataagctggtatatacagtgccaacagaggagaggcactatgtataccagcaacctggcggcagcgcaaaagatg

SEQ ID NO: 18440 - DNA, 103 bp, Artificial Sequence
  Synthetic Polynucleotide
taatacgactcactataggggttcaagaacttcataagctggtatatacaaacagaggagatgtataatgcagcttatgaacctggcggcagcgcaaaagatg

SEQ ID NO: 18441 - DNA, 103 bp, Artificial Sequence
  Synthetic Polynucleotide
taatacgactcactatagggttcatgttcaagaacttcataagctggtataacagaggagaataccaatgtatgaagttaacctggcggcagcgcaaaagatg

SEQ ID NO: 18442 - DNA, 103 bp, Artificial Sequence
  Synthetic Polynucleotide
taatacgactcactatagggtaccattcatgttcaagaacttcataagctaacagaggagaagcttaatgagttcttgaaacctggcggcagcgcaaaagatg

SEQ ID NO: 18443 - DNA, 103 bp, Artificial Sequence
  Synthetic Polynucleotide
taatacgactcactatagggtttcataccattcatgttcaagaacttcataacagaggagaatgaagatgttgaacatgaacctggcggcagcgcaaaagatg

SEQ ID NO: 18444 - DNA, 103 bp, Artificial Sequence
  Synthetic Polynucleotide
taatacgactcactatagggaaatttttcataccattcatgttcaagaacaacagaggagagttcttatgcatgaatggaacctggcggcagcgcaaaagatg

SEQ ID NO: 18445 - DNA, 103 bp, Artificial Sequence
  Synthetic Polynucleotide
taatacgactcactatagggatctaaaatttttcataccattcatgttcaaacagaggagatgaacaatgatggtatgaaacctggcggcagcgcaaaagatg

SEQ ID NO: 18446 - DNA, 103 bp, Artificial Sequence
  Synthetic Polynucleotide
taatacgactcactatagggtttatatctaaaatttttcataccattcataacagaggagaatgaatatgatgaaaaataacctggcggcagcgcaaaagatg

SEQ ID NO: 18447 - DNA, 103 bp, Artificial Sequence
  Synthetic Polynucleotide
taatacgactcactatagggacttgaagctgcgtctttaaaataattgataacagaggagaatcaatatgtttaaagacaacctggcggcagcgcaaaagatg

SEQ ID NO: 18448 - DNA, 103 bp, Artificial Sequence
  Synthetic Polynucleotide
taatacgactcactatagggacagttttatatctaaaatttttcataccaaacagaggagatggtatatgaaattttagaacctggcggcagcgcaaaagatg

SEQ ID NO: 18449 - DNA, 103 bp, Artificial Sequence
  Synthetic Polynucleotide
taatacgactcactatagggatttaacagttttatatctaaaatttttcaaacagaggagatgaaaaatgttagatataaacctggcggcagcgcaaaagatg

SEQ ID NO: 18450 - DNA, 103 bp, Artificial Sequence
  Synthetic Polynucleotide
taatacgactcactataggggctatatttaacagttttatatctaaaattaacagaggagaaattttatgtataaaactaacctggcggcagcgcaaaagatg

SEQ ID NO: 18451 - DNA, 103 bp, Artificial Sequence
  Synthetic Polynucleotide
taatacgactcactatagggaactagctatatttaacagttttatatctaaacagaggagatagataatgaactgttaaaacctggcggcagcgcaaaagatg

SEQ ID NO: 18452 - DNA, 103 bp, Artificial Sequence
  Synthetic Polynucleotide
taatacgactcactatagggtaataaactagctatatttaacagttttataacagaggagaataaaaatgttaaatataaacctggcggcagcgcaaaagatg

SEQ ID NO: 18453 - DNA, 103 bp, Artificial Sequence
  Synthetic Polynucleotide
taatacgactcactatagggaaaactaataaactagctatatttaacagtaacagaggagaactgttatgtatagctagaacctggcggcagcgcaaaagatg

SEQ ID NO: 18454 - DNA, 103 bp, Artificial Sequence
  Synthetic Polynucleotide
taatacgactcactataggggcaccacttgaagctgcgtctttaaaataaaacagaggagattatttatgagacgcagcaacctggcggcagcgcaaaagatg

SEQ ID NO: 18455 - DNA, 103 bp, Artificial Sequence
  Synthetic Polynucleotide
taatacgactcactatagggtagaagcaccacttgaagctgcgtctttaaaacagaggagattaaagatgcagcttcaaaacctggcggcagcgcaaaagatg

SEQ ID NO: 18456 - DNA, 103 bp, Artificial Sequence
  Synthetic Polynucleotide
taatacgactcactatagggcaatctagaagcaccacttgaagctgcgtcaacagaggagagacgcaatgtcaagtggtaacctggcggcagcgcaaaagatg

SEQ ID NO: 18457 - DNA, 103 bp, Artificial Sequence
  Synthetic Polynucleotide
taatacgactcactatagggaaatccaatctagaagcaccacttgaagctaacagaggagaagcttcatgtggtgcttcaacctggcggcagcgcaaaagatg

SEQ ID NO: 18458 - DNA, 103 bp, Artificial Sequence
  Synthetic Polynucleotide
taatacgactcactataggggagaaaaatccaatctagaagcaccacttgaacagaggagacaagtgatgcttctagataacctggcggcagcgcaaaagatg

SEQ ID NO: 18459 - DNA, 103 bp, Artificial Sequence
  Synthetic Polynucleotide
taatacgactcactataggggtcttgagaaaaatccaatctagaagcaccaacagaggagaggtgctatgagattggataacctggcggcagcgcaaaagatg

SEQ ID NO: 18460 - DNA, 103 bp, Artificial Sequence
  Synthetic Polynucleotide
taatacgactcactatagggctagggtcttgagaaaaatccaatctagaaaacagaggagattctagatgggatttttcaacctggcggcagcgcaaaagatg

SEQ ID NO: 18461 - DNA, 103 bp, Artificial Sequence
  Synthetic Polynucleotide
taatacgactcactatagggtggggaagggtgggaaaaactggcgtacaaaacagaggagattgtacatgagtttttccaacctggcggcagcgcaaaagatg

SEQ ID NO: 18462 - DNA, 103 bp, Artificial Sequence
  Synthetic Polynucleotide
taatacgactcactatagggatttactagggtcttgagaaaaatccaatcaacagaggagagattggatgtttctcaagaacctggcggcagcgcaaaagatg

SEQ ID NO: 18463 - DNA, 103 bp, Artificial Sequence
  Synthetic Polynucleotide
taatacgactcactatagggagtaaatttactagggtcttgagaaaaatcaacagaggagagattttatgcaagaccctaacctggcggcagcgcaaaagatg

SEQ ID NO: 18464 - DNA, 103 bp, Artificial Sequence
  Synthetic Polynucleotide
taatacgactcactatagggggatcagtaaatttactagggtcttgagaaaacagaggagattctcaatgccctagtaaaacctggcggcagcgcaaaagatg

SEQ ID NO: 18465 - DNA, 103 bp, Artificial Sequence
  Synthetic Polynucleotide
taatacgactcactatagggtaacaggatcagtaaatttactagggtcttaacagaggagaaagaccatggtaaatttaaacctggcggcagcgcaaaagatg

SEQ ID NO: 18466 - DNA, 103 bp, Artificial Sequence
  Synthetic Polynucleotide
taatacgactcactatagggatctttaacaggatcagtaaatttactaggaacagaggagacctagtatgtttactgataacctggcggcagcgcaaaagatg

SEQ ID NO: 18467 - DNA, 103 bp, Artificial Sequence
  Synthetic Polynucleotide
taatacgactcactatagggaacacatctttaacaggatcagtaaatttaaacagaggagataaattatgtgatcctgtaacctggcggcagcgcaaaagatg

SEQ ID NO: 18468 - DNA, 103 bp, Artificial Sequence
  Synthetic Polynucleotide
taatacgactcactatagggtttctaacacatctttaacaggatcagtaaaacagaggagattactgatgctgttaaagaacctggcggcagcgcaaaagatg

SEQ ID NO: 18469 - DNA, 103 bp, Artificial Sequence
  Synthetic Polynucleotide
taatacgactcactatagggacccttttctaacacatctttaacaggatcaacagaggagagatcctatgaaagatgtgaacctggcggcagcgcaaaagatg

SEQ ID NO: 18470 - DNA, 103 bp, Artificial Sequence
  Synthetic Polynucleotide
taatacgactcactatagggggaatacccttttctaacacatctttaacaaacagaggagatgttaaatgtgtgttagaaacctggcggcagcgcaaaagatg

SEQ ID NO: 18471 - DNA, 103 bp, Artificial Sequence
  Synthetic Polynucleotide
taatacgactcactataggggtgttggaatacccttttctaacacatcttaacagaggagaaagatgatgtagaaaaggaacctggcggcagcgcaaaagatg

SEQ ID NO: 18472 - DNA, 103 bp, Artificial Sequence
  Synthetic Polynucleotide
taatacgactcactatagggcattatggggaagggtgggaaaaactggcgaacagaggagacgccagatgttcccacccaacctggcggcagcgcaaaagatg

SEQ ID NO: 18473 - DNA, 103 bp, Artificial Sequence
  Synthetic Polynucleotide
taatacgactcactatagggttgaagtgttggaatacccttttctaacacaacagaggagagtgttaatgaagggtattaacctggcggcagcgcaaaagatg

SEQ ID NO: 18474 - DNA, 103 bp, Artificial Sequence
  Synthetic Polynucleotide
taatacgactcactatagggggtgattgaagtgttggaatacccttttctaacagaggagaagaaaaatgtattccaacaacctggcggcagcgcaaaagatg

SEQ ID NO: 18475 - DNA, 103 bp, Artificial Sequence
  Synthetic Polynucleotide
taatacgactcactatagggctgttggtgattgaagtgttggaataccctaacagaggagaagggtaatgcaacacttcaacctggcggcagcgcaaaagatg

SEQ ID NO: 18476 - DNA, 103 bp, Artificial Sequence
  Synthetic Polynucleotide
taatacgactcactatagggttcaactgttggtgattgaagtgttggaataacagaggagaattccaatgcttcaatcaaacctggcggcagcgcaaaagatg

SEQ ID NO: 18477 - DNA, 103 bp, Artificial Sequence
  Synthetic Polynucleotide
taatacgactcactatagggcaagcttcaactgttggtgattgaagtgttaacagaggagaaacactatgatcaccaacaacctggcggcagcgcaaaagatg

SEQ ID NO: 18478 - DNA, 103 bp, Artificial Sequence
  Synthetic Polynucleotide
taatacgactcactatagggaaccacaagcttcaactgttggtgattgaaaacagaggagattcaatatgcaacagttgaacctggcggcagcgcaaaagatg

SEQ ID NO: 18479 - DNA, 103 bp, Artificial Sequence
  Synthetic Polynucleotide
taatacgactcactatagggtgaataaccacaagcttcaactgttggtgaaacagaggagatcaccaatggttgaagctaacctggcggcagcgcaaaagatg

SEQ ID NO: 18480 - DNA, 103 bp, Artificial Sequence
  Synthetic Polynucleotide
taatacgactcactatagggctgtctgaataaccacaagcttcaactgttaacagaggagaaacagtatgagcttgtggaacctggcggcagcgcaaaagatg

SEQ ID NO: 18481 - DNA, 103 bp, Artificial Sequence
  Synthetic Polynucleotide
taatacgactcactatagggttagtctgtctgaataaccacaagcttcaaaacagaggagattgaagatggtggttattaacctggcggcagcgcaaaagatg

SEQ ID NO: 18482 - DNA, 103 bp, Artificial Sequence
  Synthetic Polynucleotide
taatacgactcactatagggctgtattagtctgtctgaataaccacaagcaacagaggagagcttgtatgtattcagacaacctggcggcagcgcaaaagatg

SEQ ID NO: 18483 - DNA, 103 bp, Artificial Sequence
  Synthetic Polynucleotide
taatacgactcactatagggagttacattatggggaagggtgggaaaaacaacagaggagagtttttatgacccttcccaacctggcggcagcgcaaaagatg

SEQ ID NO: 18484 - DNA, 103 bp, Artificial Sequence
  Synthetic Polynucleotide
taatacgactcactataggggttatctgtattagtctgtctgaataaccaaacagaggagatggttaatgagacagactaacctggcggcagcgcaaaagatg

SEQ ID NO: 18485 - DNA, 103 bp, Artificial Sequence
  Synthetic Polynucleotide
taatacgactcactatagggctcgggttatctgtattagtctgtctgaataacagaggagaattcagatggactaatacaacctggcggcagcgcaaaagatg

SEQ ID NO: 18486 - DNA, 103 bp, Artificial Sequence
  Synthetic Polynucleotide
taatacgactcactatagggatctcctcgggttatctgtattagtctgtcaacagaggagagacagaatgatacagataaacctggcggcagcgcaaaagatg

SEQ ID NO: 18487 - DNA, 103 bp, Artificial Sequence
  Synthetic Polynucleotide
taatacgactcactataggggtggaatctcctcgggttatctgtattagtaacagaggagaactaatatggataacccgaacctggcggcagcgcaaaagatg

SEQ ID NO: 18488 - DNA, 103 bp, Artificial Sequence
  Synthetic Polynucleotide
taatacgactcactatagggttatagtggaatctcctcgggttatctgtaaacagaggagatacagaatgcccgaggagaacctggcggcagcgcaaaagatg

SEQ ID NO: 18489 - DNA, 103 bp, Artificial Sequence
  Synthetic Polynucleotide
taatacgactcactatagggggatgttatagtggaatctcctcgggttataacagaggagaataaccatgggagattccaacctggcggcagcgcaaaagatg

SEQ ID NO: 18490 - DNA, 103 bp, Artificial Sequence
  Synthetic Polynucleotide
taatacgactcactatagggtcttgggatgttatagtggaatctcctcggaacagaggagaccgaggatgttccactataacctggcggcagcgcaaaagatg

SEQ ID NO: 18491 - DNA, 103 bp, Artificial Sequence
  Synthetic Polynucleotide
taatacgactcactatagggcagtatcttgggatgttatagtggaatctcaacagaggagagagattatgctataacataacctggcggcagcgcaaaagatg

SEQ ID NO: 18492 - DNA, 103 bp, Artificial Sequence
  Synthetic Polynucleotide
taatacgactcactatagggatttgcagtatcttgggatgttatagtggaaacagaggagatccactatgacatcccaaaacctggcggcagcgcaaaagatg

SEQ ID NO: 18493 - DNA, 103 bp, Artificial Sequence
  Synthetic Polynucleotide
taatacgactcactatagggactgcatttgcagtatcttgggatgttataaacagaggagatataacatgccaagatacaacctggcggcagcgcaaaagatg

SEQ ID NO: 18494 - DNA, 103 bp, Artificial Sequence
  Synthetic Polynucleotide
taatacgactcactatagggttctaagttacattatggggaagggtgggaaacagaggagatcccacatgtccccataaaacctggcggcagcgcaaaagatg

SEQ ID NO: 18495 - DNA, 103 bp, Artificial Sequence
  Synthetic Polynucleotide
taatacgactcactatagggcaacaactgcatttgcagtatcttgggatgaacagaggagacatcccatgatactgcaaaacctggcggcagcgcaaaagatg

SEQ ID NO: 18496 - DNA, 103 bp, Artificial Sequence
  Synthetic Polynucleotide
taatacgactcactatagggataagcaacaactgcatttgcagtatcttgaacagaggagacaagatatggcaaatgcaaacctggcggcagcgcaaaagatg

SEQ ID NO: 18497 - DNA, 103 bp, Artificial Sequence
  Synthetic Polynucleotide
taatacgactcactatagggacaccataagcaacaactgcatttgcagtaaacagaggagatactgcatgtgcagttgtaacctggcggcagcgcaaaagatg

SEQ ID NO: 18498 - DNA, 103 bp, Artificial Sequence
  Synthetic Polynucleotide
taatacgactcactataggggccacacaccataagcaacaactgcatttgaacagaggagacaaatgatgttgttgcttaacctggcggcagcgcaaaagatg

SEQ ID NO: 18499 - DNA, 103 bp, Artificial Sequence
  Synthetic Polynucleotide
taatacgactcactatagggtgatggccacacaccataagcaacaactgcaacagaggagagcagttatggcttatggtaacctggcggcagcgcaaaagatg

SEQ ID NO: 18500 - DNA, 103 bp, Artificial Sequence
  Synthetic Polynucleotide
taatacgactcactatagggaagtatgatggccacacaccataagcaacaaacagaggagatgttgcatgtggtgtgtgaacctggcggcagcgcaaaagatg

SEQ ID NO: 18501 - DNA, 103 bp, Artificial Sequence
  Synthetic Polynucleotide
taatacgactcactataggggagtcaagtatgatggccacacaccataagaacagaggagacttatgatgtgtggccataacctggcggcagcgcaaaagatg

SEQ ID NO: 18502 - DNA, 103 bp, Artificial Sequence
  Synthetic Polynucleotide
taatacgactcactatagggatctggagtcaagtatgatggccacacaccaacagaggagaggtgtgatgccatcatacaacctggcggcagcgcaaaagatg

SEQ ID NO: 18503 - DNA, 103 bp, Artificial Sequence
  Synthetic Polynucleotide
taatacgactcactataggggcatcatctggagtcaagtatgatggccacaacagaggagagtggccatgatacttgacaacctggcggcagcgcaaaagatg

SEQ ID NO: 18504 - DNA, 103 bp, Artificial Sequence
  Synthetic Polynucleotide
taatacgactcactatagggcagtcgcatcatctggagtcaagtatgatgaacagaggagacatcatatgtgactccagaacctggcggcagcgcaaaagatg

SEQ ID NO: 18505 - DNA, 103 bp, Artificial Sequence
  Synthetic Polynucleotide
taatacgactcactatagggcaaacttctaagttacattatggggaagggaacagaggagacccttcatgataatgtaaaacctggcggcagcgcaaaagatg

SEQ ID NO: 18506 - DNA, 103 bp, Artificial Sequence
  Synthetic Polynucleotide
taatacgactcactatagggaatagcagtcgcatcatctggagtcaagtaaacagaggagatacttgatgccagatgataacctggcggcagcgcaaaagatg

SEQ ID NO: 18507 - DNA, 103 bp, Artificial Sequence
  Synthetic Polynucleotide
taatacgactcactatagggttgtcaatagcagtcgcatcatctggagtcaacagaggagagactccatgtgatgcgacaacctggcggcagcgcaaaagatg

SEQ ID NO: 18508 - DNA, 103 bp, Artificial Sequence
  Synthetic Polynucleotide
taatacgactcactatagggtgggtttgtcaatagcagtcgcatcatctgaacagaggagacagatgatgcgactgctaaacctggcggcagcgcaaaagatg

SEQ ID NO: 18509 - DNA, 103 bp, Artificial Sequence
  Synthetic Polynucleotide
taatacgactcactatagggttgtgtgggtttgtcaatagcagtcgcatcaacagaggagagatgcgatggctattgacaacctggcggcagcgcaaaagatg

SEQ ID NO: 18510 - DNA, 103 bp, Artificial Sequence
  Synthetic Polynucleotide
taatacgactcactatagggtcaggttgtgtgggtttgtcaatagcagtcaacagaggagagactgcatgtgacaaaccaacctggcggcagcgcaaaagatg

SEQ ID NO: 18511 - DNA, 103 bp, Artificial Sequence
  Synthetic Polynucleotide
taatacgactcactatagggatgtatcaggttgtgtgggtttgtcaatagaacagaggagactattgatgaacccacacaacctggcggcagcgcaaaagatg

SEQ ID NO: 18512 - DNA, 103 bp, Artificial Sequence
  Synthetic Polynucleotide
taatacgactcactatagggggatgatgtatcaggttgtgtgggtttgtcaacagaggagagacaaaatgacacaacctaacctggcggcagcgcaaaagatg

SEQ ID NO: 18513 - DNA, 103 bp, Artificial Sequence
  Synthetic Polynucleotide
taatacgactcactatagggctgttggatgatgtatcaggttgtgtgggtaacagaggagaacccacatgacctgatacaacctggcggcagcgcaaaagatg

SEQ ID NO: 18514 - DNA, 103 bp, Artificial Sequence
  Synthetic Polynucleotide
taatacgactcactatagggagaatctgttggatgatgtatcaggttgtgaacagaggagacacaacatgatacatcataacctggcggcagcgcaaaagatg

SEQ ID NO: 18515 - DNA, 103 bp, Artificial Sequence
  Synthetic Polynucleotide
taatacgactcactatagggggtgtagaatctgttggatgatgtatcaggaacagaggagacctgatatgtcatccaacaacctggcggcagcgcaaaagatg

SEQ ID NO: 18516 - DNA, 103 bp, Artificial Sequence
  Synthetic Polynucleotide
taatacgactcactatagggtggagtgagtgggaacaacccactcccagtaacagaggagaactgggatggggttgttcaacctggcggcagcgcaaaagatg

SEQ ID NO: 18517 - DNA, 103 bp, Artificial Sequence
  Synthetic Polynucleotide
taatacgactcactatagggttgtacaaacttctaagttacattatggggaacagaggagaccccatatggtaacttagaacctggcggcagcgcaaaagatg

SEQ ID NO: 18518 - DNA, 103 bp, Artificial Sequence
  Synthetic Polynucleotide
taatacgactcactatagggtccaaggtgtagaatctgttggatgatgtaaacagaggagatacatcatgcaacagattaacctggcggcagcgcaaaagatg

SEQ ID NO: 18519 - DNA, 103 bp, Artificial Sequence
  Synthetic Polynucleotide
taatacgactcactataggggactgtccaaggtgtagaatctgttggatgaacagaggagacatccaatggattctacaaacctggcggcagcgcaaaagatg

SEQ ID NO: 18520 - DNA, 103 bp, Artificial Sequence
  Synthetic Polynucleotide
taatacgactcactatagggagaacgactgtccaaggtgtagaatctgttaacagaggagaaacagaatgtacaccttgaacctggcggcagcgcaaaagatg

SEQ ID NO: 18521 - DNA, 103 bp, Artificial Sequence
  Synthetic Polynucleotide
taatacgactcactataggggtccaagaacgactgtccaaggtgtagaataacagaggagaattctaatgcttggacagaacctggcggcagcgcaaaagatg

SEQ ID NO: 18522 - DNA, 103 bp, Artificial Sequence
  Synthetic Polynucleotide
taatacgactcactatagggcagatgtccaagaacgactgtccaaggtgtaacagaggagaacacctatgacagtcgttaacctggcggcagcgcaaaagatg

SEQ ID NO: 18523 - DNA, 103 bp, Artificial Sequence
  Synthetic Polynucleotide
taatacgactcactatagggtgaggcagatgtccaagaacgactgtccaaaacagaggagattggacatgcgttcttggaacctggcggcagcgcaaaagatg

SEQ ID NO: 18524 - DNA, 103 bp, Artificial Sequence
  Synthetic Polynucleotide
taatacgactcactatagggccagatgaggcagatgtccaagaacgactgaacagaggagacagtcgatgttggacatcaacctggcggcagcgcaaaagatg

SEQ ID NO: 18525 - DNA, 103 bp, Artificial Sequence
  Synthetic Polynucleotide
taatacgactcactatagggaccatccagatgaggcagatgtccaagaacaacagaggagagttcttatgcatctgcctaacctggcggcagcgcaaaagatg

SEQ ID NO: 18526 - DNA, 103 bp, Artificial Sequence
  Synthetic Polynucleotide
taatacgactcactatagggccaccaccatccagatgaggcagatgtccaaacagaggagatggacaatggcctcatctaacctggcggcagcgcaaaagatg

SEQ ID NO: 18527 - DNA, 103 bp, Artificial Sequence
  Synthetic Polynucleotide
taatacgactcactatagggaatttccaccaccatccagatgaggcagataacagaggagaatctgcatgatctggatgaacctggcggcagcgcaaaagatg

SEQ ID NO: 18528 - DNA, 103 bp, Artificial Sequence
  Synthetic Polynucleotide
taatacgactcactatagggtcatattgtacaaacttctaagttacattaaacagaggagataatgtatgttagaagttaacctggcggcagcgcaaaagatg

SEQ ID NO: 18529 - DNA, 103 bp, Artificial Sequence
  Synthetic Polynucleotide
taatacgactcactatagggcaggcaatttccaccaccatccagatgaggaacagaggagacctcatatggatggtggtaacctggcggcagcgcaaaagatg

SEQ ID NO: 18530 - DNA, 103 bp, Artificial Sequence
  Synthetic Polynucleotide
taatacgactcactatagggggcatcaggcaatttccaccaccatccagaaacagaggagatctggaatgtggtggaaaaacctggcggcagcgcaaaagatg

SEQ ID NO: 18531 - DNA, 103 bp, Artificial Sequence
  Synthetic Polynucleotide
taatacgactcactatagggttaagggcatcaggcaatttccaccaccataacagaggagaatggtgatggaaattgccaacctggcggcagcgcaaaagatg

SEQ ID NO: 18532 - DNA, 103 bp, Artificial Sequence
  Synthetic Polynucleotide
taatacgactcactatagggtgtttttaagggcatcaggcaatttccaccaacagaggagaggtggaatgtgcctgatgaacctggcggcagcgcaaaagatg

SEQ ID NO: 18533 - DNA, 103 bp, Artificial Sequence
  Synthetic Polynucleotide
taatacgactcactatagggacccatgtttttaagggcatcaggcaatttaacagaggagaaaattgatggatgcccttaacctggcggcagcgcaaaagatg

SEQ ID NO: 18534 - DNA, 103 bp, Artificial Sequence
  Synthetic Polynucleotide
taatacgactcactatagggaatatacccatgtttttaagggcatcaggcaacagaggagagcctgaatgccttaaaaaaacctggcggcagcgcaaaagatg

SEQ ID NO: 18535 - DNA, 103 bp, Artificial Sequence
  Synthetic Polynucleotide
taatacgactcactatagggcaccaaatatacccatgtttttaagggcataacagaggagaatgcccatgaaaacatggaacctggcggcagcgcaaaagatg

SEQ ID NO: 18536 - DNA, 103 bp, Artificial Sequence
  Synthetic Polynucleotide
taatacgactcactatagggattttcaccaaatatacccatgtttttaagaacagaggagacttaaaatgatgggtataaacctggcggcagcgcaaaagatg

SEQ ID NO: 18537 - DNA, 103 bp, Artificial Sequence
  Synthetic Polynucleotide
taatacgactcactatagggaacatattttcaccaaatatacccatgtttaacagaggagaaaacatatgtatatttggaacctggcggcagcgcaaaagatg

SEQ ID NO: 18538 - DNA, 103 bp, Artificial Sequence
  Synthetic Polynucleotide
taatacgactcactatagggggtaaaacatattttcaccaaatatacccaaacagaggagatgggtaatgttggtgaaaaacctggcggcagcgcaaaagatg

SEQ ID NO: 18539 - DNA, 103 bp, Artificial Sequence
  Synthetic Polynucleotide
taatacgactcactatagggattggtcatattgtacaaacttctaagttaaacagaggagataacttatgagtttgtacaacctggcggcagcgcaaaagatg

SEQ ID NO: 18540 - DNA, 103 bp, Artificial Sequence
  Synthetic Polynucleotide
taatacgactcactatagggaaaatggtaaaacatattttcaccaaatataacagaggagaatatttatggaaaatatgaacctggcggcagcgcaaaagatg

SEQ ID NO: 18541 - DNA, 103 bp, Artificial Sequence
  Synthetic Polynucleotide
taatacgactcactatagggcctagaaaatggtaaaacatattttcaccaaacagaggagatggtgaatgtatgttttaaacctggcggcagcgcaaaagatg

SEQ ID NO: 18542 - DNA, 103 bp, Artificial Sequence
  Synthetic Polynucleotide
taatacgactcactatagggatctccctagaaaatggtaaaacatattttaacagaggagaaaaataatgtttaccattaacctggcggcagcgcaaaagatg

SEQ ID NO: 18543 - DNA, 103 bp, Artificial Sequence
  Synthetic Polynucleotide
taatacgactcactatagggtccagatctccctagaaaatggtaaaacataacagaggagaatgtttatgcattttctaaacctggcggcagcgcaaaagatg

SEQ ID NO: 18544 - DNA, 103 bp, Artificial Sequence
  Synthetic Polynucleotide
taatacgactcactataggggtgtatccagatctccctagaaaatggtaaaacagaggagattaccaatgtctagggagaacctggcggcagcgcaaaagatg

SEQ ID NO: 18545 - DNA, 103 bp, Artificial Sequence
  Synthetic Polynucleotide
taatacgactcactataggggtattgtgtatccagatctccctagaaaataacagaggagaattttcatgggagatctgaacctggcggcagcgcaaaagatg

SEQ ID NO: 18546 - DNA, 103 bp, Artificial Sequence
  Synthetic Polynucleotide
taatacgactcactatagggtacatgtattgtgtatccagatctccctagaacagaggagactagggatgtctggatacaacctggcggcagcgcaaaagatg

SEQ ID NO: 18547 - DNA, 103 bp, Artificial Sequence
  Synthetic Polynucleotide
taatacgactcactatagggcattgtacatgtattgtgtatccagatctcaacagaggagagagatcatgatacacaataacctggcggcagcgcaaaagatg

SEQ ID NO: 18548 - DNA, 103 bp, Artificial Sequence
  Synthetic Polynucleotide
taatacgactcactatagggaattacattgtacatgtattgtgtatccagaacagaggagactggatatgcaatacatgaacctggcggcagcgcaaaagatg

SEQ ID NO: 18549 - DNA, 103 bp, Artificial Sequence
  Synthetic Polynucleotide
taatacgactcactataggggctagaattacattgtacatgtattgtgtaaacagaggagatacacaatgcatgtacaaaacctggcggcagcgcaaaagatg

SEQ ID NO: 18550 - DNA, 103 bp, Artificial Sequence
  Synthetic Polynucleotide
taatacgactcactatagggcacctattggtcatattgtacaaacttctaaacagaggagatagaagatggtacaatataacctggcggcagcgcaaaagatg

SEQ ID NO: 18551 - DNA, 103 bp, Artificial Sequence
  Synthetic Polynucleotide
taatacgactcactatagggaacttgctagaattacattgtacatgtattaacagaggagaaatacaatgacaatgtaaaacctggcggcagcgcaaaagatg

SEQ ID NO: 18552 - DNA, 103 bp, Artificial Sequence
  Synthetic Polynucleotide
taatacgactcactataggggatgaaacttgctagaattacattgtacataacagaggagaatgtacatggtaattctaaacctggcggcagcgcaaaagatg

SEQ ID NO: 18553 - DNA, 103 bp, Artificial Sequence
  Synthetic Polynucleotide
taatacgactcactatagggaccctgatgaaacttgctagaattacattgaacagaggagacaatgtatgtctagcaagaacctggcggcagcgcaaaagatg

SEQ ID NO: 18554 - DNA, 103 bp, Artificial Sequence
  Synthetic Polynucleotide
taatacgactcactatagggaataaaccctgatgaaacttgctagaattaaacagaggagataattcatgcaagtttcaaacctggcggcagcgcaaaagatg

SEQ ID NO: 18555 - DNA, 103 bp, Artificial Sequence
  Synthetic Polynucleotide
taatacgactcactatagggctattaataaaccctgatgaaacttgctagaacagaggagactagcaatgttcatcaggaacctggcggcagcgcaaaagatg

SEQ ID NO: 18556 - DNA, 103 bp, Artificial Sequence
  Synthetic Polynucleotide
taatacgactcactatagggggcaactattaataaaccctgatgaaacttaacagaggagaaagtttatgcagggtttaaacctggcggcagcgcaaaagatg

SEQ ID NO: 18557 - DNA, 103 bp, Artificial Sequence
  Synthetic Polynucleotide
taatacgactcactatagggatggcggcaactattaataaaccctgatgaaacagaggagatcatcaatgtttattaataacctggcggcagcgcaaaagatg

SEQ ID NO: 18558 - DNA, 103 bp, Artificial Sequence
  Synthetic Polynucleotide
taatacgactcactatagggctgggatggcggcaactattaataaaccctaacagaggagaagggttatgtaatagttgaacctggcggcagcgcaaaagatg

SEQ ID NO: 18559 - DNA, 103 bp, Artificial Sequence
  Synthetic Polynucleotide
taatacgactcactatagggatgttctgggatggcggcaactattaataaaacagaggagattattaatggttgccgccaacctggcggcagcgcaaaagatg

SEQ ID NO: 18560 - DNA, 103 bp, Artificial Sequence
  Synthetic Polynucleotide
taatacgactcactatagggaattgatgttctgggatggcggcaactattaacagaggagaaatagtatgcgccatcccaacctggcggcagcgcaaaagatg

SEQ ID NO: 18561 - DNA, 103 bp, Artificial Sequence
  Synthetic Polynucleotide
taatacgactcactatagggattgtcacctattggtcatattgtacaaacaacagaggagagtttgtatgatatgaccaaacctggcggcagcgcaaaagatg

SEQ ID NO: 18562 - DNA, 103 bp, Artificial Sequence
  Synthetic Polynucleotide
taatacgactcactatagggatgccaattgatgttctgggatggcggcaaaacagaggagattgccgatgtcccagaacaacctggcggcagcgcaaaagatg

SEQ ID NO: 18563 - DNA, 103 bp, Artificial Sequence
  Synthetic Polynucleotide
taatacgactcactatagggtgcagatgccaattgatgttctgggatggcaacagaggagagccatcatggaacatcaaaacctggcggcagcgcaaaagatg

SEQ ID NO: 18564 - DNA, 103 bp, Artificial Sequence
  Synthetic Polynucleotide
taatacgactcactatagggcttgttgcagatgccaattgatgttctgggaacagaggagacccagaatgtcaattggcaacctggcggcagcgcaaaagatg

SEQ ID NO: 18565 - DNA, 103 bp, Artificial Sequence
  Synthetic Polynucleotide
taatacgactcactatagggttccacttgttgcagatgccaattgatgttaacagaggagaaacatcatgtggcatctgaacctggcggcagcgcaaaagatg

SEQ ID NO: 18566 - DNA, 103 bp, Artificial Sequence
  Synthetic Polynucleotide
taatacgactcactatagggtacatttccacttgttgcagatgccaattgaacagaggagacaattgatgtctgcaacaaacctggcggcagcgcaaaagatg

SEQ ID NO: 18567 - DNA, 103 bp, Artificial Sequence
  Synthetic Polynucleotide
taatacgactcactatagggactgatacatttccacttgttgcagatgccaacagaggagaggcatcatgaacaagtggaacctggcggcagcgcaaaagatg

SEQ ID NO: 18568 - DNA, 103 bp, Artificial Sequence
  Synthetic Polynucleotide
taatacgactcactatagggacccgactgatacatttccacttgttgcagaacagaggagactgcaaatggtggaaatgaacctggcggcagcgcaaaagatg

SEQ ID NO: 18569 - DNA, 103 bp, Artificial Sequence
  Synthetic Polynucleotide
taatacgactcactatagggattgtacccgactgatacatttccacttgtaacagaggagaacaagtatgaatgtatcaaacctggcggcagcgcaaaagatg

SEQ ID NO: 18570 - DNA, 103 bp, Artificial Sequence
  Synthetic Polynucleotide
taatacgactcactataggggtgtgattgtacccgactgatacatttccaaacagaggagatggaaaatgatcagtcggaacctggcggcagcgcaaaagatg

SEQ ID NO: 18571 - DNA, 103 bp, Artificial Sequence
  Synthetic Polynucleotide
taatacgactcactatagggggtgggtgtgattgtacccgactgatacataacagaggagaatgtatatgtcgggtacaaacctggcggcagcgcaaaagatg

SEQ ID NO: 18572 - DNA, 103 bp, Artificial Sequence
  Synthetic Polynucleotide
taatacgactcactatagggggatgattgtcacctattggtcatattgtaaacagaggagatacaatatgaccaataggaacctggcggcagcgcaaaagatg

SEQ ID NO: 18573 - DNA, 103 bp, Artificial Sequence
  Synthetic Polynucleotide
taatacgactcactatagggacctgggtgggtgtgattgtacccgactgaaacagaggagatcagtcatgtacaatcacaacctggcggcagcgcaaaagatg

SEQ ID NO: 18574 - DNA, 103 bp, Artificial Sequence
  Synthetic Polynucleotide
taatacgactcactatagggtgctcacctgggtgggtgtgattgtacccgaacagaggagacgggtaatgtcacacccaaacctggcggcagcgcaaaagatg

SEQ ID NO: 18575 - DNA, 103 bp, Artificial Sequence
  Synthetic Polynucleotide
taatacgactcactatagggtaccttgctcacctgggtgggtgtgattgtaacagaggagaacaatcatgcccacccagaacctggcggcagcgcaaaagatg

SEQ ID NO: 18576 - DNA, 103 bp, Artificial Sequence
  Synthetic Polynucleotide
taatacgactcactatagggttctctaccttgctcacctgggtgggtgtgaacagaggagacacaccatgccaggtgagaacctggcggcagcgcaaaagatg

SEQ ID NO: 18577 - DNA, 103 bp, Artificial Sequence
  Synthetic Polynucleotide
taatacgactcactatagggactacttctctaccttgctcacctgggtggaacagaggagaccacccatgtgagcaaggaacctggcggcagcgcaaaagatg

SEQ ID NO: 18578 - DNA, 103 bp, Artificial Sequence
  Synthetic Polynucleotide
taatacgactcactatagggatggtactacttctctaccttgctcacctgaacagaggagacaggtgatgaaggtagagaacctggcggcagcgcaaaagatg

SEQ ID NO: 18579 - DNA, 103 bp, Artificial Sequence
  Synthetic Polynucleotide
taatacgactcactatagggccgtgatggtactacttctctaccttgctcaacagaggagagagcaaatgagagaagtaaacctggcggcagcgcaaaagatg

SEQ ID NO: 18580 - DNA, 103 bp, Artificial Sequence
  Synthetic Polynucleotide
taatacgactcactataggggatgtccgtgatggtactacttctctacctaacagaggagaaggtagatgagtagtaccaacctggcggcagcgcaaaagatg

SEQ ID NO: 18581 - DNA, 103 bp, Artificial Sequence
  Synthetic Polynucleotide
taatacgactcactatagggcactagatgtccgtgatggtactacttctcaacagaggagagagaagatgtaccatcacaacctggcggcagcgcaaaagatg

SEQ ID NO: 18582 - DNA, 103 bp, Artificial Sequence
  Synthetic Polynucleotide
taatacgactcactatagggattatcactagatgtccgtgatggtactacaacagaggagagtagtaatgtcacggacaaacctggcggcagcgcaaaagatg

SEQ ID NO: 18583 - DNA, 103 bp, Artificial Sequence
  Synthetic Polynucleotide
taatacgactcactatagggagtctggatgattgtcacctattggtcataaacagaggagatatgacatgtaggtgacaaacctggcggcagcgcaaaagatg

SEQ ID NO: 18584 - DNA, 103 bp, Artificial Sequence
  Synthetic Polynucleotide
taatacgactcactatagggcttttattatcactagatgtccgtgatggtaacagaggagaaccatcatggacatctagaacctggcggcagcgcaaaagatg

SEQ ID NO: 18585 - DNA, 103 bp, Artificial Sequence
  Synthetic Polynucleotide
taatacgactcactatagggtaggtcttttattatcactagatgtccgtgaacagaggagacacggaatgctagtgataaacctggcggcagcgcaaaagatg

SEQ ID NO: 18586 - DNA, 103 bp, Artificial Sequence
  Synthetic Polynucleotide
taatacgactcactatagggatcactaggtcttttattatcactagatgtaacagaggagaacatctatggataataaaaacctggcggcagcgcaaaagatg

SEQ ID NO: 18587 - DNA, 103 bp, Artificial Sequence
  Synthetic Polynucleotide
taatacgactcactatagggctgtcatcactaggtcttttattatcactaaacagaggagatagtgaatgtaaaagaccaacctggcggcagcgcaaaagatg

SEQ ID NO: 18588 - DNA, 103 bp, Artificial Sequence
  Synthetic Polynucleotide
taatacgactcactatagggaccaactgtcatcactaggtcttttattataacagaggagaataataatggacctagtgaacctggcggcagcgcaaaagatg

SEQ ID NO: 18589 - DNA, 103 bp, Artificial Sequence
  Synthetic Polynucleotide
taatacgactcactatagggatttaaccaactgtcatcactaggtcttttaacagaggagaaaaagaatgagtgatgacaacctggcggcagcgcaaaagatg

SEQ ID NO: 18590 - DNA, 103 bp, Artificial Sequence
  Synthetic Polynucleotide
taatacgactcactatagggtcaaaatttaaccaactgtcatcactaggtaacagaggagaacctagatgtgacagttgaacctggcggcagcgcaaaagatg

SEQ ID NO: 18591 - DNA, 103 bp, Artificial Sequence
  Synthetic Polynucleotide
taatacgactcactatagggttccatcaaaatttaaccaactgtcatcacaacagaggagagtgatgatggttggttaaaacctggcggcagcgcaaaagatg

SEQ ID NO: 18592 - DNA, 103 bp, Artificial Sequence
  Synthetic Polynucleotide
taatacgactcactatagggtaatgttccatcaaaatttaaccaactgtcaacagaggagagacagtatgttaaattttaacctggcggcagcgcaaaagatg

SEQ ID NO: 18593 - DNA, 103 bp, Artificial Sequence
  Synthetic Polynucleotide
taatacgactcactatagggccaagtaatgttccatcaaaatttaaccaaaacagaggagattggttatgttttgatggaacctggcggcagcgcaaaagatg

SEQ ID NO: 18594 - DNA, 103 bp, Artificial Sequence
  Synthetic Polynucleotide
taatacgactcactatagggttgacagtctggatgattgtcacctattggaacagaggagaccaataatggacaatcataacctggcggcagcgcaaaagatg

SEQ ID NO: 18595 - DNA, 103 bp, Artificial Sequence
  Synthetic Polynucleotide
taatacgactcactatagggagttaccaagtaatgttccatcaaaatttaaacagaggagataaattatgatggaacataacctggcggcagcgcaaaagatg

SEQ ID NO: 18596 - DNA, 103 bp, Artificial Sequence
  Synthetic Polynucleotide
taatacgactcactatagggaggtaagttaccaagtaatgttccatcaaaaacagaggagatttgatatgacattacttaacctggcggcagcgcaaaagatg

SEQ ID NO: 18597 - DNA, 103 bp, Artificial Sequence
  Synthetic Polynucleotide
taatacgactcactatagggtaaataggtaagttaccaagtaatgttccaaacagaggagatggaacatgacttggtaaaacctggcggcagcgcaaaagatg

SEQ ID NO: 18598 - DNA, 103 bp, Artificial Sequence
  Synthetic Polynucleotide
taatacgactcactatagggggggataaataggtaagttaccaagtaatgaacagaggagacattacatggtaacttacaacctggcggcagcgcaaaagatg

SEQ ID NO: 18599 - DNA, 103 bp, Artificial Sequence
  Synthetic Polynucleotide
taatacgactcactatagggttggtggggataaataggtaagttaccaagaacagaggagacttggtatgttacctattaacctggcggcagcgcaaaagatg

SEQ ID NO: 18600 - DNA, 103 bp, Artificial Sequence
  Synthetic Polynucleotide
taatacgactcactatagggatgtattggtggggataaataggtaagttaaacagaggagataacttatgtatttatccaacctggcggcagcgcaaaagatg

SEQ ID NO: 18601 - DNA, 103 bp, Artificial Sequence
  Synthetic Polynucleotide
taatacgactcactataggggattaatgtattggtggggataaataggtaaacagaggagatacctaatgatccccaccaacctggcggcagcgcaaaagatg

SEQ ID NO: 18602 - DNA, 103 bp, Artificial Sequence
  Synthetic Polynucleotide
taatacgactcactatagggccttagattaatgtattggtggggataaataacagaggagaatttatatgcaccaatacaacctggcggcagcgcaaaagatg

SEQ ID NO: 18603 - DNA, 103 bp, Artificial Sequence
  Synthetic Polynucleotide
taatacgactcactatagggttagtccttagattaatgtattggtggggaaacagaggagatccccaatgatacattaaaacctggcggcagcgcaaaagatg

SEQ ID NO: 18604 - DNA, 103 bp, Artificial Sequence
  Synthetic Polynucleotide
taatacgactcactatagggaattgttagtccttagattaatgtattggtaacagaggagaaccaatatgttaatctaaaacctggcggcagcgcaaaagatg

SEQ ID NO: 18605 - DNA, 103 bp, Artificial Sequence
  Synthetic Polynucleotide
taatacgactcactataggggacctttgacagtctggatgattgtcacctaacagaggagaaggtgaatgtcatccagaaacctggcggcagcgcaaaagatg

SEQ ID NO: 18606 - DNA, 103 bp, Artificial Sequence
  Synthetic Polynucleotide
taatacgactcactatagggagctgaattgttagtccttagattaatgtaaacagaggagatacattatgctaaggactaacctggcggcagcgcaaaagatg

SEQ ID NO: 18607 - DNA, 103 bp, Artificial Sequence
  Synthetic Polynucleotide
taatacgactcactatagggagggtagctgaattgttagtccttagattaaacagaggagataatctatggactaacaaaacctggcggcagcgcaaaagatg

SEQ ID NO: 18608 - DNA, 103 bp, Artificial Sequence
  Synthetic Polynucleotide
taatacgactcactatagggaaataagggtagctgaattgttagtccttaaacagaggagataaggaatgacaattcagaacctggcggcagcgcaaaagatg

SEQ ID NO: 18609 - DNA, 103 bp, Artificial Sequence
  Synthetic Polynucleotide
taatacgactcactatagggaggtaaaataagggtagctgaattgttagtaacagaggagaactaacatgtcagctaccaacctggcggcagcgcaaaagatg

SEQ ID NO: 18610 - DNA, 103 bp, Artificial Sequence
  Synthetic Polynucleotide
taatacgactcactatagggacataaggtaaaataagggtagctgaattgaacagaggagacaattcatgtacccttataacctggcggcagcgcaaaagatg

SEQ ID NO: 18611 - DNA, 103 bp, Artificial Sequence
  Synthetic Polynucleotide
taatacgactcactatagggcattgacataaggtaaaataagggtagctgaacagaggagacagctaatgttattttacaacctggcggcagcgcaaaagatg

SEQ ID NO: 18612 - DNA, 103 bp, Artificial Sequence
  Synthetic Polynucleotide
taatacgactcactatagggtacagcattgacataaggtaaaataagggtaacagaggagaacccttatgttaccttataacctggcggcagcgcaaaagatg

SEQ ID NO: 18613 - DNA, 103 bp, Artificial Sequence
  Synthetic Polynucleotide
taatacgactcactatagggattggtacagcattgacataaggtaaaataaacagaggagatattttatgttatgtcaaaacctggcggcagcgcaaaagatg

SEQ ID NO: 18614 - DNA, 103 bp, Artificial Sequence
  Synthetic Polynucleotide
taatacgactcactatagggagtccattggtacagcattgacataaggtaaacagaggagataccttatgtcaatgctgaacctggcggcagcgcaaaagatg

SEQ ID NO: 18615 - DNA, 103 bp, Artificial Sequence
  Synthetic Polynucleotide
taatacgactcactatagggcatagagtccattggtacagcattgacataaacagaggagatatgtcatggctgtaccaaacctggcggcagcgcaaaagatg

SEQ ID NO: 18616 - DNA, 103 bp, Artificial Sequence
  Synthetic Polynucleotide
taatacgactcactatagggtgcttgacctttgacagtctggatgattgtaacagaggagaacaatcatgcagactgtcaacctggcggcagcgcaaaagatg

SEQ ID NO: 18617 - DNA, 103 bp, Artificial Sequence
  Synthetic Polynucleotide
taatacgactcactatagggctaagcatagagtccattggtacagcattgaacagaggagacaatgcatgaccaatggaaacctggcggcagcgcaaaagatg

SEQ ID NO: 18618 - DNA, 103 bp, Artificial Sequence
  Synthetic Polynucleotide
taatacgactcactatagggtatgtctaagcatagagtccattggtacagaacagaggagactgtacatgtggactctaaacctggcggcagcgcaaaagatg

SEQ ID NO: 18619 - DNA, 103 bp, Artificial Sequence
  Synthetic Polynucleotide
taatacgactcactatagggattattatgtctaagcatagagtccattggaacagaggagaccaatgatgtctatgcttaacctggcggcagcgcaaaagatg

SEQ ID NO: 18620 - DNA, 103 bp, Artificial Sequence
  Synthetic Polynucleotide
taatacgactcactatagggctccaattattatgtctaagcatagagtccaacagaggagaggactcatggcttagacaaacctggcggcagcgcaaaagatg

SEQ ID NO: 18621 - DNA, 103 bp, Artificial Sequence
  Synthetic Polynucleotide
taatacgactcactatagggccaagctccaattattatgtctaagcatagaacagaggagactatgcatggacataataaacctggcggcagcgcaaaagatg

SEQ ID NO: 18622 - DNA, 103 bp, Artificial Sequence
  Synthetic Polynucleotide
taatacgactcactatagggtataaccaagctccaattattatgtctaagaacagaggagacttagaatgaataattggaacctggcggcagcgcaaaagatg

SEQ ID NO: 18623 - DNA, 103 bp, Artificial Sequence
  Synthetic Polynucleotide
taatacgactcactataggggggattataaccaagctccaattattatgtaacagaggagaacataaatgttggagcttaacctggcggcagcgcaaaagatg

SEQ ID NO: 18624 - DNA, 103 bp, Artificial Sequence
  Synthetic Polynucleotide
taatacgactcactatagggatattgggattataaccaagctccaattataacagaggagaataattatggcttggttaaacctggcggcagcgcaaaagatg

SEQ ID NO: 18625 - DNA, 103 bp, Artificial Sequence
  Synthetic Polynucleotide
taatacgactcactatagggagggcatattgggattataaccaagctccaaacagaggagatggagcatggttataatcaacctggcggcagcgcaaaagatg

SEQ ID NO: 18626 - DNA, 103 bp, Artificial Sequence
  Synthetic Polynucleotide
taatacgactcactatagggtgaagagggcatattgggattataaccaagaacagaggagacttggtatgaatcccaataacctggcggcagcgcaaaagatg

SEQ ID NO: 18627 - DNA, 103 bp, Artificial Sequence
  Synthetic Polynucleotide
taatacgactcactatagggatgggtggagtgagtgggaacaacccactcaacagaggagagagtggatggttcccactaacctggcggcagcgcaaaagatg

SEQ ID NO: 18628 - DNA, 103 bp, Artificial Sequence
  Synthetic Polynucleotide
taatacgactcactatagggagaagtgcttgacctttgacagtctggatgaacagaggagacatccaatgtgtcaaaggaacctggcggcagcgcaaaagatg

SEQ ID NO: 18629 - DNA, 103 bp, Artificial Sequence
  Synthetic Polynucleotide
taatacgactcactatagggggacctgaagagggcatattgggattataaaacagaggagattataaatgcaatatgccaacctggcggcagcgcaaaagatg

SEQ ID NO: 18630 - DNA, 103 bp, Artificial Sequence
  Synthetic Polynucleotide
taatacgactcactatagggaggttggacctgaagagggcatattgggataacagaggagaatcccaatgtgccctcttaacctggcggcagcgcaaaagatg

SEQ ID NO: 18631 - DNA, 103 bp, Artificial Sequence
  Synthetic Polynucleotide
taatacgactcactatagggcccccaggttggacctgaagagggcatattaacagaggagaaatatgatgtcttcaggtaacctggcggcagcgcaaaagatg

SEQ ID NO: 18632 - DNA, 103 bp, Artificial Sequence
  Synthetic Polynucleotide
taatacgactcactataggggtgtccccccaggttggacctgaagagggcaacagaggagagccctcatgaggtccaacaacctggcggcagcgcaaaagatg

SEQ ID NO: 18633 - DNA, 103 bp, Artificial Sequence
  Synthetic Polynucleotide
taatacgactcactatagggggattgtgtccccccaggttggacctgaagaacagaggagacttcagatgcaacctgggaacctggcggcagcgcaaaagatg

SEQ ID NO: 18634 - DNA, 103 bp, Artificial Sequence
  Synthetic Polynucleotide
taatacgactcactatagggggtatggattgtgtccccccaggttggaccaacagaggagaggtccaatgtggggggacaacctggcggcagcgcaaaagatg

SEQ ID NO: 18635 - DNA, 103 bp, Artificial Sequence
  Synthetic Polynucleotide
taatacgactcactatagggttataggtatggattgtgtccccccaggttaacagaggagaaacctgatgggacacaataacctggcggcagcgcaaaagatg

SEQ ID NO: 18636 - DNA, 103 bp, Artificial Sequence
  Synthetic Polynucleotide
taatacgactcactatagggtactgttataggtatggattgtgtccccccaacagaggagaggggggatgcaatccataaacctggcggcagcgcaaaagatg

SEQ ID NO: 18637 - DNA, 103 bp, Artificial Sequence
  Synthetic Polynucleotide
taatacgactcactatagggattgatactgttataggtatggattgtgtcaacagaggagagacacaatgcatacctataacctggcggcagcgcaaaagatg

SEQ ID NO: 18638 - DNA, 103 bp, Artificial Sequence
  Synthetic Polynucleotide
taatacgactcactatagggggctaattgatactgttataggtatggattaacagaggagaaatccaatgctataacagaacctggcggcagcgcaaaagatg

SEQ ID NO: 18639 - DNA, 103 bp, Artificial Sequence
  Synthetic Polynucleotide
taatacgactcactataggggaaacagaagtgcttgacctttgacagtctaacagaggagaagactgatgaaggtcaagaacctggcggcagcgcaaaagatg

SEQ ID NO: 18640 - DNA, 103 bp, Artificial Sequence
  Synthetic Polynucleotide
taatacgactcactatagggcatagggctaattgatactgttataggtataacagaggagaatacctatgacagtatcaaacctggcggcagcgcaaaagatg

SEQ ID NO: 18641 - DNA, 103 bp, Artificial Sequence
  Synthetic Polynucleotide
taatacgactcactataggggaaaacatagggctaattgatactgttataaacagaggagatataacatgatcaattagaacctggcggcagcgcaaaagatg

SEQ ID NO: 18642 - DNA, 103 bp, Artificial Sequence
  Synthetic Polynucleotide
taatacgactcactatagggattctgaaaacatagggctaattgatactgaacagaggagacagtatatgttagccctaaacctggcggcagcgcaaaagatg

SEQ ID NO: 18643 - DNA, 103 bp, Artificial Sequence
  Synthetic Polynucleotide
taatacgactcactatagggtgaaaattctgaaaacatagggctaattgaaacagaggagatcaattatgcctatgtttaacctggcggcagcgcaaaagatg

SEQ ID NO: 18644 - DNA, 103 bp, Artificial Sequence
  Synthetic Polynucleotide
taatacgactcactatagggggccctgaaaattctgaaaacatagggctaaacagaggagatagcccatggttttcagaaacctggcggcagcgcaaaagatg

SEQ ID NO: 18645 - DNA, 103 bp, Artificial Sequence
  Synthetic Polynucleotide
taatacgactcactatagggttcttggccctgaaaattctgaaaacatagaacagaggagactatgtatgcagaattttaacctggcggcagcgcaaaagatg

SEQ ID NO: 18646 - DNA, 103 bp, Artificial Sequence
  Synthetic Polynucleotide
taatacgactcactatagggcttacttcttggccctgaaaattctgaaaaaacagaggagattttcaatgttttcagggaacctggcggcagcgcaaaagatg

SEQ ID NO: 18647 - DNA, 103 bp, Artificial Sequence
  Synthetic Polynucleotide
taatacgactcactatagggacaaccttacttcttggccctgaaaattctaacagaggagaagaattatgagggccaagaacctggcggcagcgcaaaagatg

SEQ ID NO: 18648 - DNA, 103 bp, Artificial Sequence
  Synthetic Polynucleotide
taatacgactcactatagggtaaacacaaccttacttcttggccctgaaaaacagaggagatttcagatgcaagaagtaaacctggcggcagcgcaaaagatg

SEQ ID NO: 18649 - DNA, 103 bp, Artificial Sequence
  Synthetic Polynucleotide
taatacgactcactatagggggtactaaacacaaccttacttcttggcccaacagaggagagggccaatgagtaaggttaacctggcggcagcgcaaaagatg

SEQ ID NO: 18650 - DNA, 103 bp, Artificial Sequence
  Synthetic Polynucleotide
taatacgactcactatagggccggggaaacagaagtgcttgacctttgacaacagaggagagtcaaaatgcaagcacttaacctggcggcagcgcaaaagatg

SEQ ID NO: 18651 - DNA, 103 bp, Artificial Sequence
  Synthetic Polynucleotide
taatacgactcactatagggtgagtggtactaaacacaaccttacttcttaacagaggagaaagaagatgggttgtgttaacctggcggcagcgcaaaagatg

SEQ ID NO: 18652 - DNA, 103 bp, Artificial Sequence
  Synthetic Polynucleotide
taatacgactcactatagggaaccctgagtggtactaaacacaaccttacaacagaggagagtaaggatgtgtttagtaaacctggcggcagcgcaaaagatg

SEQ ID NO: 18653 - DNA, 103 bp, Artificial Sequence
  Synthetic Polynucleotide
taatacgactcactatagggtggtaaaccctgagtggtactaaacacaacaacagaggagagttgtgatgagtaccactaacctggcggcagcgcaaaagatg

SEQ ID NO: 18654 - DNA, 103 bp, Artificial Sequence
  Synthetic Polynucleotide
taatacgactcactatagggataactggtaaaccctgagtggtactaaacaacagaggagagtttagatgcactcagggaacctggcggcagcgcaaaagatg

SEQ ID NO: 18655 - DNA, 103 bp, Artificial Sequence
  Synthetic Polynucleotide
taatacgactcactatagggttaacataactggtaaaccctgagtggtacaacagaggagagtaccaatgagggtttacaacctggcggcagcgcaaaagatg

SEQ ID NO: 18656 - DNA, 103 bp, Artificial Sequence
  Synthetic Polynucleotide
taatacgactcactatagggaggtgttaacataactggtaaaccctgagtaacagaggagaactcagatgttaccagttaacctggcggcagcgcaaaagatg

SEQ ID NO: 18657 - DNA, 103 bp, Artificial Sequence
  Synthetic Polynucleotide
taatacgactcactataggggatccaggtgttaacataactggtaaacccaacagaggagagggtttatgagttatgttaacctggcggcagcgcaaaagatg

SEQ ID NO: 18658 - DNA, 103 bp, Artificial Sequence
  Synthetic Polynucleotide
taatacgactcactataggggcccagatccaggtgttaacataactggtaaacagaggagataccagatgtgttaacacaacctggcggcagcgcaaaagatg

SEQ ID NO: 18659 - DNA, 103 bp, Artificial Sequence
  Synthetic Polynucleotide
taatacgactcactataggggaattgcccagatccaggtgttaacataacaacagaggagagttatgatgacacctggaaacctggcggcagcgcaaaagatg

SEQ ID NO: 18660 - DNA, 103 bp, Artificial Sequence
  Synthetic Polynucleotide
taatacgactcactataggggttaagaattgcccagatccaggtgttaacaacagaggagagttaacatgtggatctggaacctggcggcagcgcaaaagatg

SEQ ID NO: 18661 - DNA, 103 bp, Artificial Sequence
  Synthetic Polynucleotide
taatacgactcactatagggattgaccggggaaacagaagtgcttgacctaacagaggagaaggtcaatgacttctgttaacctggcggcagcgcaaaagatg

SEQ ID NO: 18662 - DNA, 103 bp, Artificial Sequence
  Synthetic Polynucleotide
taatacgactcactatagggcagttgttaagaattgcccagatccaggtgaacagaggagacacctgatgctgggcaataacctggcggcagcgcaaaagatg

SEQ ID NO: 18663 - DNA, 103 bp, Artificial Sequence
  Synthetic Polynucleotide
taatacgactcactatagggatcatcagttgttaagaattgcccagatccaacagaggagaggatctatgcaattcttaaacctggcggcagcgcaaaagatg

SEQ ID NO: 18664 - DNA, 103 bp, Artificial Sequence
  Synthetic Polynucleotide
taatacgactcactatagggtgagtatcatcagttgttaagaattgcccaaacagaggagatgggcaatgcttaacaacaacctggcggcagcgcaaaagatg

SEQ ID NO: 18665 - DNA, 103 bp, Artificial Sequence
  Synthetic Polynucleotide
taatacgactcactataggggggattgagtatcatcagttgttaagaattaacagaggagaaattctatgcaactgatgaacctggcggcagcgcaaaagatg

SEQ ID NO: 18666 - DNA, 103 bp, Artificial Sequence
  Synthetic Polynucleotide
taatacgactcactatagggtgatggggattgagtatcatcagttgttaaaacagaggagattaacaatggatgatactaacctggcggcagcgcaaaagatg

SEQ ID NO: 18667 - DNA, 103 bp, Artificial Sequence
  Synthetic Polynucleotide
taatacgactcactatagggaacgctgatggggattgagtatcatcagttaacagaggagaaactgaatgtactcaatcaacctggcggcagcgcaaaagatg

SEQ ID NO: 18668 - DNA, 103 bp, Artificial Sequence
  Synthetic Polynucleotide
taatacgactcactatagggatggaaacgctgatggggattgagtatcataacagaggagaatgataatgaatccccataacctggcggcagcgcaaaagatg

SEQ ID NO: 18669 - DNA, 103 bp, Artificial Sequence
  Synthetic Polynucleotide
taatacgactcactataggggaagtatggaaacgctgatggggattgagtaacagaggagaactcaaatgccatcagcgaacctggcggcagcgcaaaagatg

SEQ ID NO: 18670 - DNA, 103 bp, Artificial Sequence
  Synthetic Polynucleotide
taatacgactcactataggggggtggaagtatggaaacgctgatggggataacagaggagaatccccatgagcgtttccaacctggcggcagcgcaaaagatg

SEQ ID NO: 18671 - DNA, 103 bp, Artificial Sequence
  Synthetic Polynucleotide
taatacgactcactatagggtggtcgggtggaagtatggaaacgctgatgaacagaggagacatcagatgttccatactaacctggcggcagcgcaaaagatg

SEQ ID NO: 18672 - DNA, 103 bp, Artificial Sequence
  Synthetic Polynucleotide
taatacgactcactatagggtcctcattgaccggggaaacagaagtgcttaacagaggagaaagcacatgtgtttccccaacctggcggcagcgcaaaagatg

SEQ ID NO: 18673 - DNA, 103 bp, Artificial Sequence
  Synthetic Polynucleotide
taatacgactcactatagggttccttggtcgggtggaagtatggaaacgcaacagaggagagcgtttatgtacttccacaacctggcggcagcgcaaaagatg

SEQ ID NO: 18674 - DNA, 103 bp, Artificial Sequence
  Synthetic Polynucleotide
taatacgactcactatagggaatatttccttggtcgggtggaagtatggaaacagaggagatccataatgccacccgacaacctggcggcagcgcaaaagatg

SEQ ID NO: 18675 - DNA, 103 bp, Artificial Sequence
  Synthetic Polynucleotide
taatacgactcactataggggtataaatatttccttggtcgggtggaagtaacagaggagaacttccatgcgaccaaggaacctggcggcagcgcaaaagatg

SEQ ID NO: 18676 - DNA, 103 bp, Artificial Sequence
  Synthetic Polynucleotide
taatacgactcactatagggtccaggtataaatatttccttggtcgggtgaacagaggagacacccgatgaaggaaataaacctggcggcagcgcaaaagatg

SEQ ID NO: 18677 - DNA, 103 bp, Artificial Sequence
  Synthetic Polynucleotide
taatacgactcactatagggacttgtccaggtataaatatttccttggtcaacagaggagagaccaaatgaatatttataacctggcggcagcgcaaaagatg

SEQ ID NO: 18678 - DNA, 103 bp, Artificial Sequence
  Synthetic Polynucleotide
taatacgactcactatagggtcctaacttgtccaggtataaatatttcctaacagaggagaaggaaaatgttatacctgaacctggcggcagcgcaaaagatg

SEQ ID NO: 18679 - DNA, 103 bp, Artificial Sequence
  Synthetic Polynucleotide
taatacgactcactatagggtaaattcctaacttgtccaggtataaatataacagaggagaatatttatgcctggacaaaacctggcggcagcgcaaaagatg

SEQ ID NO: 18680 - DNA, 103 bp, Artificial Sequence
  Synthetic Polynucleotide
taatacgactcactatagggtcaattaaattcctaacttgtccaggtataaacagaggagatataccatgacaagttagaacctggcggcagcgcaaaagatg

SEQ ID NO: 18681 - DNA, 103 bp, Artificial Sequence
  Synthetic Polynucleotide
taatacgactcactatagggacatttcaattaaattcctaacttgtccagaacagaggagactggacatgttaggaattaacctggcggcagcgcaaaagatg

SEQ ID NO: 18682 - DNA, 103 bp, Artificial Sequence
  Synthetic Polynucleotide
taatacgactcactatagggttggcacatttcaattaaattcctaacttgaacagaggagacaagttatgaatttaattaacctggcggcagcgcaaaagatg

SEQ ID NO: 18683 - DNA, 103 bp, Artificial Sequence
  Synthetic Polynucleotide
taatacgactcactataggggcatatcctcattgaccggggaaacagaagaacagaggagacttctgatgccccggtcaaacctggcggcagcgcaaaagatg

SEQ ID NO: 18684 - DNA, 103 bp, Artificial Sequence
  Synthetic Polynucleotide
taatacgactcactatagggtcaacttggcacatttcaattaaattcctaaacagaggagataggaaatgaattgaaataacctggcggcagcgcaaaagatg

SEQ ID NO: 18685 - DNA, 103 bp, Artificial Sequence
  Synthetic Polynucleotide
taatacgactcactataggggtgtgtcaacttggcacatttcaattaaataacagaggagaatttaaatgaaatgtgccaacctggcggcagcgcaaaagatg

SEQ ID NO: 18686 - DNA, 103 bp, Artificial Sequence
  Synthetic Polynucleotide
taatacgactcactatagggaatgagtgtgtcaacttggcacatttcaataacagaggagaattgaaatgtgccaagttaacctggcggcagcgcaaaagatg

SEQ ID NO: 18687 - DNA, 103 bp, Artificial Sequence
  Synthetic Polynucleotide
taatacgactcactatagggacaggaatgagtgtgtcaacttggcacattaacagaggagaaatgtgatgagttgacacaacctggcggcagcgcaaaagatg

SEQ ID NO: 18688 - DNA, 103 bp, Artificial Sequence
  Synthetic Polynucleotide
taatacgactcactatagggtgttaacaggaatgagtgtgtcaacttggcaacagaggagagccaagatgacacactcaaacctggcggcagcgcaaaagatg

SEQ ID NO: 18689 - DNA, 103 bp, Artificial Sequence
  Synthetic Polynucleotide
taatacgactcactatagggtgtattgttaacaggaatgagtgtgtcaacaacagaggagagttgacatgctcattcctaacctggcggcagcgcaaaagatg

SEQ ID NO: 18690 - DNA, 103 bp, Artificial Sequence
  Synthetic Polynucleotide
taatacgactcactatagggtcctgtgtattgttaacaggaatgagtgtgaacagaggagacacactatgtcctgttaaaacctggcggcagcgcaaaagatg

SEQ ID NO: 18691 - DNA, 103 bp, Artificial Sequence
  Synthetic Polynucleotide
taatacgactcactatagggcattttcctgtgtattgttaacaggaatgaaacagaggagatcattcatgttaacaataaacctggcggcagcgcaaaagatg

SEQ ID NO: 18692 - DNA, 103 bp, Artificial Sequence
  Synthetic Polynucleotide
taatacgactcactatagggtcttacattttcctgtgtattgttaacaggaacagaggagacctgttatgaatacacagaacctggcggcagcgcaaaagatg

SEQ ID NO: 18693 - DNA, 103 bp, Artificial Sequence
  Synthetic Polynucleotide
taatacgactcactatagggacagatcttacattttcctgtgtattgttaaacagaggagataacaaatgacaggaaaaaacctggcggcagcgcaaaagatg

SEQ ID NO: 18694 - DNA, 103 bp, Artificial Sequence
  Synthetic Polynucleotide
taatacgactcactataggggtaaagcatatcctcattgaccggggaaacaacagaggagagtttccatggtcaatgagaacctggcggcagcgcaaaagatg

SEQ ID NO: 18695 - DNA, 103 bp, Artificial Sequence
  Synthetic Polynucleotide
taatacgactcactatagggtattcacagatcttacattttcctgtgtataacagaggagaatacacatgaaaatgtaaaacctggcggcagcgcaaaagatg

SEQ ID NO: 18696 - DNA, 103 bp, Artificial Sequence
  Synthetic Polynucleotide
taatacgactcactataggggtacatattcacagatcttacattttcctgaacagaggagacaggaaatggtaagatctaacctggcggcagcgcaaaagatg

SEQ ID NO: 18697 - DNA, 103 bp, Artificial Sequence
  Synthetic Polynucleotide
taatacgactcactatagggacagtgtacatattcacagatcttacatttaacagaggagaaaatgtatgatctgtgaaaacctggcggcagcgcaaaagatg

SEQ ID NO: 18698 - DNA, 103 bp, Artificial Sequence
  Synthetic Polynucleotide
taatacgactcactatagggaatcaacagtgtacatattcacagatcttaaacagaggagataagatatgtgaatatgtaacctggcggcagcgcaaaagatg

SEQ ID NO: 18699 - DNA, 103 bp, Artificial Sequence
  Synthetic Polynucleotide
taatacgactcactataggggcgtaaatcaacagtgtacatattcacagaaacagaggagatctgtgatgatgtacactaacctggcggcagcgcaaaagatg

SEQ ID NO: 18700 - DNA, 103 bp, Artificial Sequence
  Synthetic Polynucleotide
taatacgactcactatagggtgtgtgcgtaaatcaacagtgtacatattcaacagaggagagaatatatgcactgttgaaacctggcggcagcgcaaaagatg

SEQ ID NO: 18701 - DNA, 103 bp, Artificial Sequence
  Synthetic Polynucleotide
taatacgactcactatagggcaacttgtgtgcgtaaatcaacagtgtacaaacagaggagatgtacaatgttgatttacaacctggcggcagcgcaaaagatg

SEQ ID NO: 18702 - DNA, 103 bp, Artificial Sequence
  Synthetic Polynucleotide
taatacgactcactatagggtaaatcaacttgtgtgcgtaaatcaacagtaacagaggagaactgttatgttacgcacaaacctggcggcagcgcaaaagatg

SEQ ID NO: 18703 - DNA, 103 bp, Artificial Sequence
  Synthetic Polynucleotide
taatacgactcactatagggttagctaaatcaacttgtgtgcgtaaatcaaacagaggagatgatttatgcacacaagtaacctggcggcagcgcaaaagatg

SEQ ID NO: 18704 - DNA, 103 bp, Artificial Sequence
  Synthetic Polynucleotide
taatacgactcactatagggcttctttagctaaatcaacttgtgtgcgtaaacagaggagatacgcaatgaagttgattaacctggcggcagcgcaaaagatg

SEQ ID NO: 18705 - DNA, 103 bp, Artificial Sequence
  Synthetic Polynucleotide
taatacgactcactatagggcttgggtaaagcatatcctcattgaccgggaacagaggagacccggtatgtgaggatataacctggcggcagcgcaaaagatg

SEQ ID NO: 18706 - DNA, 103 bp, Artificial Sequence
  Synthetic Polynucleotide
taatacgactcactatagggaaagacttctttagctaaatcaacttgtgtaacagaggagaacacaaatggatttagctaacctggcggcagcgcaaaagatg

SEQ ID NO: 18707 - DNA, 103 bp, Artificial Sequence
  Synthetic Polynucleotide
taatacgactcactatagggatagaaaagacttctttagctaaatcaactaacagaggagaagttgaatgagctaaagaaacctggcggcagcgcaaaagatg

SEQ ID NO: 18708 - DNA, 103 bp, Artificial Sequence
  Synthetic Polynucleotide
taatacgactcactatagggctggtatagaaaagacttctttagctaaataacagaggagaatttagatgaagaagtctaacctggcggcagcgcaaaagatg

SEQ ID NO: 18709 - DNA, 103 bp, Artificial Sequence
  Synthetic Polynucleotide
taatacgactcactatagggatctactggtatagaaaagacttctttagcaacagaggagagctaaaatggtcttttctaacctggcggcagcgcaaaagatg

SEQ ID NO: 18710 - DNA, 103 bp, Artificial Sequence
  Synthetic Polynucleotide
taatacgactcactataggggcaatatctactggtatagaaaagacttctaacagaggagaagaagtatgttctataccaacctggcggcagcgcaaaagatg

SEQ ID NO: 18711 - DNA, 103 bp, Artificial Sequence
  Synthetic Polynucleotide
taatacgactcactataggggtgaggcaatatctactggtatagaaaagaaacagaggagatcttttatgtaccagtagaacctggcggcagcgcaaaagatg

SEQ ID NO: 18712 - DNA, 103 bp, Artificial Sequence
  Synthetic Polynucleotide
taatacgactcactatagggaggttgtgaggcaatatctactggtatagaaacagaggagatctataatggtagatattaacctggcggcagcgcaaaagatg

SEQ ID NO: 18713 - DNA, 103 bp, Artificial Sequence
  Synthetic Polynucleotide
taatacgactcactataggggctaaaggttgtgaggcaatatctactggtaacagaggagaaccagtatgtattgcctcaacctggcggcagcgcaaaagatg

SEQ ID NO: 18714 - DNA, 103 bp, Artificial Sequence
  Synthetic Polynucleotide
taatacgactcactatagggtagtggctaaaggttgtgaggcaatatctaaacagaggagatagataatgcctcacaacaacctggcggcagcgcaaaagatg

SEQ ID NO: 18715 - DNA, 103 bp, Artificial Sequence
  Synthetic Polynucleotide
taatacgactcactataggggagagtagtggctaaaggttgtgaggcaataacagaggagaattgccatgcaacctttaaacctggcggcagcgcaaaagatg

SEQ ID NO: 18716 - DNA, 103 bp, Artificial Sequence
  Synthetic Polynucleotide
taatacgactcactatagggtttgccttgggtaaagcatatcctcattgaaacagaggagatcaatgatgatatgctttaacctggcggcagcgcaaaagatg

SEQ ID NO: 18717 - DNA, 103 bp, Artificial Sequence
  Synthetic Polynucleotide
taatacgactcactatagggcctatgagagtagtggctaaaggttgtgagaacagaggagactcacaatgtttagccacaacctggcggcagcgcaaaagatg

SEQ ID NO: 18718 - DNA, 103 bp, Artificial Sequence
  Synthetic Polynucleotide
taatacgactcactataggggttctcctatgagagtagtggctaaaggttaacagaggagaaaccttatgccactactcaacctggcggcagcgcaaaagatg

SEQ ID NO: 18719 - DNA, 103 bp, Artificial Sequence
  Synthetic Polynucleotide
taatacgactcactatagggtgcaagttctcctatgagagtagtggctaaaacagaggagattagccatgactctcataaacctggcggcagcgcaaaagatg

SEQ ID NO: 18720 - DNA, 103 bp, Artificial Sequence
  Synthetic Polynucleotide
taatacgactcactatagggtagcttgcaagttctcctatgagagtagtgaacagaggagacactacatgcataggagaaacctggcggcagcgcaaaagatg

SEQ ID NO: 18721 - DNA, 103 bp, Artificial Sequence
  Synthetic Polynucleotide
taatacgactcactatagggtgtaatagcttgcaagttctcctatgagagaacagaggagactctcaatggagaacttgaacctggcggcagcgcaaaagatg

SEQ ID NO: 18722 - DNA, 103 bp, Artificial Sequence
  Synthetic Polynucleotide
taatacgactcactataggggtgtgtgtaatagcttgcaagttctcctataacagaggagaataggaatgcttgcaagcaacctggcggcagcgcaaaagatg

SEQ ID NO: 18723 - DNA, 103 bp, Artificial Sequence
  Synthetic Polynucleotide
taatacgactcactataggggtccagtgtgtgtaatagcttgcaagttctaacagaggagaagaactatgaagctattaaacctggcggcagcgcaaaagatg

SEQ ID NO: 18724 - DNA, 103 bp, Artificial Sequence
  Synthetic Polynucleotide
taatacgactcactatagggtaccagtccagtgtgtgtaatagcttgcaaaacagaggagattgcaaatgattacacacaacctggcggcagcgcaaaagatg

SEQ ID NO: 18725 - DNA, 103 bp, Artificial Sequence
  Synthetic Polynucleotide
taatacgactcactatagggcagactaccagtccagtgtgtgtaatagctaacagaggagaagctatatgacacactggaacctggcggcagcgcaaaagatg

SEQ ID NO: 18726 - DNA, 103 bp, Artificial Sequence
  Synthetic Polynucleotide
taatacgactcactatagggaagcgcagactaccagtccagtgtgtgtaaaacagaggagattacacatgctggactggaacctggcggcagcgcaaaagatg

SEQ ID NO: 18727 - DNA, 103 bp, Artificial Sequence
  Synthetic Polynucleotide
taatacgactcactatagggaggtttttgccttgggtaaagcatatcctcaacagaggagagaggatatgctttacccaaacctggcggcagcgcaaaagatg

SEQ ID NO: 18728 - DNA, 103 bp, Artificial Sequence
  Synthetic Polynucleotide
taatacgactcactatagggagctaaagcgcagactaccagtccagtgtgaacagaggagacacactatgctggtagtcaacctggcggcagcgcaaaagatg

SEQ ID NO: 18729 - DNA, 103 bp, Artificial Sequence
  Synthetic Polynucleotide
taatacgactcactatagggcataaagctaaagcgcagactaccagtccaaacagaggagatggactatgagtctgcgcaacctggcggcagcgcaaaagatg

SEQ ID NO: 18730 - DNA, 103 bp, Artificial Sequence
  Synthetic Polynucleotide
taatacgactcactatagggcaaaacataaagctaaagcgcagactaccaaacagaggagatggtagatggcgctttagaacctggcggcagcgcaaaagatg

SEQ ID NO: 18731 - DNA, 103 bp, Artificial Sequence
  Synthetic Polynucleotide
taatacgactcactatagggaaccacaaaacataaagctaaagcgcagacaacagaggagagtctgcatgttagctttaaacctggcggcagcgcaaaagatg

SEQ ID NO: 18732 - DNA, 103 bp, Artificial Sequence
  Synthetic Polynucleotide
taatacgactcactatagggagcagaaccacaaaacataaagctaaagcgaacagaggagacgctttatgtttatgtttaacctggcggcagcgcaaaagatg

SEQ ID NO: 18733 - DNA, 103 bp, Artificial Sequence
  Synthetic Polynucleotide
taatacgactcactataggggagctagcagaaccacaaaacataaagctaaacagaggagatagcttatggttttgtggaacctggcggcagcgcaaaagatg

SEQ ID NO: 18734 - DNA, 103 bp, Artificial Sequence
  Synthetic Polynucleotide
taatacgactcactatagggaagtagagctagcagaaccacaaaacataaaacagaggagattatgtatggtggttctgaacctggcggcagcgcaaaagatg

SEQ ID NO: 18735 - DNA, 103 bp, Artificial Sequence
  Synthetic Polynucleotide
taatacgactcactatagggtttcaaagtagagctagcagaaccacaaaaaacagaggagattttgtatgtctgctagcaacctggcggcagcgcaaaagatg

SEQ ID NO: 18736 - DNA, 103 bp, Artificial Sequence
  Synthetic Polynucleotide
taatacgactcactatagggaatagtttcaaagtagagctagcagaaccaaacagaggagatggttcatgtagctctacaacctggcggcagcgcaaaagatg

SEQ ID NO: 18737 - DNA, 103 bp, Artificial Sequence
  Synthetic Polynucleotide
taatacgactcactatagggcaattaatagtttcaaagtagagctagcagaacagaggagactgctaatgctactttgaaacctggcggcagcgcaaaagatg

SEQ ID NO: 18738 - DNA, 103 bp, Artificial Sequence
  Synthetic Polynucleotide
taatacgactcactatagggaccgcatgggtggagtgagtgggaacaaccaacagaggagaggttgtatgcactcactcaacctggcggcagcgcaaaagatg

SEQ ID NO: 18739 - DNA, 103 bp, Artificial Sequence
  Synthetic Polynucleotide
taatacgactcactatagggctctaaggtttttgccttgggtaaagcataaacagaggagatatgctatgcccaaggcaaacctggcggcagcgcaaaagatg

SEQ ID NO: 18740 - DNA, 103 bp, Artificial Sequence
  Synthetic Polynucleotide
taatacgactcactataggggtatgcaattaatagtttcaaagtagagctaacagaggagaagctctatgttgaaactaaacctggcggcagcgcaaaagatg

SEQ ID NO: 18741 - DNA, 103 bp, Artificial Sequence
  Synthetic Polynucleotide
taatacgactcactatagggggagtgtatgcaattaatagtttcaaagtaaacagaggagatactttatgactattaataacctggcggcagcgcaaaagatg

SEQ ID NO: 18742 - DNA, 103 bp, Artificial Sequence
  Synthetic Polynucleotide
taatacgactcactatagggcaggaggagtgtatgcaattaatagtttcaaacagaggagatgaaacatgtaattgcataacctggcggcagcgcaaaagatg

SEQ ID NO: 18743 - DNA, 103 bp, Artificial Sequence
  Synthetic Polynucleotide
taatacgactcactatagggaacaccaggaggagtgtatgcaattaatagaacagaggagactattaatggcatacactaacctggcggcagcgcaaaagatg

SEQ ID NO: 18744 - DNA, 103 bp, Artificial Sequence
  Synthetic Polynucleotide
taatacgactcactatagggtttccaacaccaggaggagtgtatgcaattaacagaggagaaattgcatgcactcctccaacctggcggcagcgcaaaagatg

SEQ ID NO: 18745 - DNA, 103 bp, Artificial Sequence
  Synthetic Polynucleotide
taatacgactcactatagggtaggttttccaacaccaggaggagtgtatgaacagaggagacatacaatgctcctggtgaacctggcggcagcgcaaaagatg

SEQ ID NO: 18746 - DNA, 103 bp, Artificial Sequence
  Synthetic Polynucleotide
taatacgactcactatagggggatttaggttttccaacaccaggaggagtaacagaggagaactcctatgggtgttggaaacctggcggcagcgcaaaagatg

SEQ ID NO: 18747 - DNA, 103 bp, Artificial Sequence
  Synthetic Polynucleotide
taatacgactcactatagggctcctggatttaggttttccaacaccaggaaacagaggagatcctggatgtggaaaaccaacctggcggcagcgcaaaagatg

SEQ ID NO: 18748 - DNA, 103 bp, Artificial Sequence
  Synthetic Polynucleotide
taatacgactcactatagggcttctctcctggatttaggttttccaacacaacagaggagagtgttgatgaacctaaataacctggcggcagcgcaaaagatg

SEQ ID NO: 18749 - DNA, 103 bp, Artificial Sequence
  Synthetic Polynucleotide
taatacgactcactatagggcatggcttctctcctggatttaggttttccaacagaggagaggaaaaatgaaatccaggaacctggcggcagcgcaaaagatg

SEQ ID NO: 18750 - DNA, 103 bp, Artificial Sequence
  Synthetic Polynucleotide
taatacgactcactatagggacgatctctaaggtttttgccttgggtaaaaacagaggagatttaccatgggcaaaaacaacctggcggcagcgcaaaagatg

SEQ ID NO: 18751 - DNA, 103 bp, Artificial Sequence
  Synthetic Polynucleotide
taatacgactcactatagggccaagcatggcttctctcctggatttaggtaacagaggagaacctaaatgcaggagagaaacctggcggcagcgcaaaagatg

SEQ ID NO: 18752 - DNA, 103 bp, Artificial Sequence
  Synthetic Polynucleotide
taatacgactcactataggggtgtaccaagcatggcttctctcctggattaacagaggagaaatccaatggagaagccaaacctggcggcagcgcaaaagatg

SEQ ID NO: 18753 - DNA, 103 bp, Artificial Sequence
  Synthetic Polynucleotide
taatacgactcactatagggtaaatgtgtaccaagcatggcttctctcctaacagaggagaaggagaatggccatgcttaacctggcggcagcgcaaaagatg

SEQ ID NO: 18754 - DNA, 103 bp, Artificial Sequence
  Synthetic Polynucleotide
taatacgactcactatagggcacactaaatgtgtaccaagcatggcttctaacagaggagaagaagcatggcttggtacaacctggcggcagcgcaaaagatg

SEQ ID NO: 18755 - DNA, 103 bp, Artificial Sequence
  Synthetic Polynucleotide
taatacgactcactatagggcatcccacactaaatgtgtaccaagcatggaacagaggagaccatgcatggtacacattaacctggcggcagcgcaaaagatg

SEQ ID NO: 18756 - DNA, 103 bp, Artificial Sequence
  Synthetic Polynucleotide
taatacgactcactatagggccccacatcccacactaaatgtgtaccaagaacagaggagacttggtatgcatttagtgaacctggcggcagcgcaaaagatg

SEQ ID NO: 18757 - DNA, 103 bp, Artificial Sequence
  Synthetic Polynucleotide
taatacgactcactatagggtgcaaccccacatcccacactaaatgtgtaaacagaggagatacacaatgagtgtgggaaacctggcggcagcgcaaaagatg

SEQ ID NO: 18758 - DNA, 103 bp, Artificial Sequence
  Synthetic Polynucleotide
taatacgactcactatagggtggactgcaaccccacatcccacactaaataacagaggagaatttagatggggatgtggaacctggcggcagcgcaaaagatg

SEQ ID NO: 18759 - DNA, 103 bp, Artificial Sequence
  Synthetic Polynucleotide
taatacgactcactatagggggcggtggactgcaaccccacatcccacacaacagaggagagtgtggatggtggggttgaacctggcggcagcgcaaaagatg

SEQ ID NO: 18760 - DNA, 103 bp, Artificial Sequence
  Synthetic Polynucleotide
taatacgactcactatagggagtgaggcggtggactgcaaccccacatccaacagaggagaggatgtatggttgcagtcaacctggcggcagcgcaaaagatg

SEQ ID NO: 18761 - DNA, 103 bp, Artificial Sequence
  Synthetic Polynucleotide
taatacgactcactatagggggataacgatctctaaggtttttgccttggaacagaggagaccaaggatgaaaccttagaacctggcggcagcgcaaaagatg

SEQ ID NO: 18762 - DNA, 103 bp, Artificial Sequence
  Synthetic Polynucleotide
taatacgactcactatagggcaactagtgaggcggtggactgcaaccccaaacagaggagatggggtatgagtccaccgaacctggcggcagcgcaaaagatg

SEQ ID NO: 18763 - DNA, 103 bp, Artificial Sequence
  Synthetic Polynucleotide
taatacgactcactatagggtggtacaactagtgaggcggtggactgcaaaacagaggagattgcagatgaccgcctcaaacctggcggcagcgcaaaagatg

SEQ ID NO: 18764 - DNA, 103 bp, Artificial Sequence
  Synthetic Polynucleotide
taatacgactcactatagggacccatggtacaactagtgaggcggtggacaacagaggagagtccacatgctcactagtaacctggcggcagcgcaaaagatg

SEQ ID NO: 18765 - DNA, 103 bp, Artificial Sequence
  Synthetic Polynucleotide
taatacgactcactatagggcactaacccatggtacaactagtgaggcggaacagaggagaccgcctatgtagttgtacaacctggcggcagcgcaaaagatg

SEQ ID NO: 18766 - DNA, 103 bp, Artificial Sequence
  Synthetic Polynucleotide
taatacgactcactataggggctagcactaacccatggtacaactagtgaaacagaggagatcactaatggtaccatggaacctggcggcagcgcaaaagatg

SEQ ID NO: 18767 - DNA, 103 bp, Artificial Sequence
  Synthetic Polynucleotide
taatacgactcactatagggaaatggctagcactaacccatggtacaactaacagaggagaagttgtatgatgggttagaacctggcggcagcgcaaaagatg

SEQ ID NO: 18768 - DNA, 103 bp, Artificial Sequence
  Synthetic Polynucleotide
taatacgactcactatagggatctaaaatggctagcactaacccatggtaaacagaggagataccatatgttagtgctaaacctggcggcagcgcaaaagatg

SEQ ID NO: 18769 - DNA, 103 bp, Artificial Sequence
  Synthetic Polynucleotide
taatacgactcactatagggagtgaatctaaaatggctagcactaacccaaacagaggagatgggttatggctagccataacctggcggcagcgcaaaagatg

SEQ ID NO: 18770 - DNA, 103 bp, Artificial Sequence
  Synthetic Polynucleotide
taatacgactcactatagggggtgtagtgaatctaaaatggctagcactaaacagaggagatagtgcatgccattttagaacctggcggcagcgcaaaagatg

SEQ ID NO: 18771 - DNA, 103 bp, Artificial Sequence
  Synthetic Polynucleotide
taatacgactcactatagggtgtcaggtgtagtgaatctaaaatggctagaacagaggagactagccatgttagattcaaacctggcggcagcgcaaaagatg

SEQ ID NO: 18772 - DNA, 103 bp, Artificial Sequence
  Synthetic Polynucleotide
taatacgactcactatagggtgtggggataacgatctctaaggtttttgcaacagaggagagcaaaaatgttagagatcaacctggcggcagcgcaaaagatg

SEQ ID NO: 18773 - DNA, 103 bp, Artificial Sequence
  Synthetic Polynucleotide
taatacgactcactatagggatatgtgtcaggtgtagtgaatctaaaatgaacagaggagacattttatgttcactacaaacctggcggcagcgcaaaagatg

SEQ ID NO: 18774 - DNA, 103 bp, Artificial Sequence
  Synthetic Polynucleotide
taatacgactcactataggggaggaatatgtgtcaggtgtagtgaatctaaacagaggagatagattatgtacacctgaaacctggcggcagcgcaaaagatg

SEQ ID NO: 18775 - DNA, 103 bp, Artificial Sequence
  Synthetic Polynucleotide
taatacgactcactatagggcagctgaggaatatgtgtcaggtgtagtgaaacagaggagatcactaatgctgacacataacctggcggcagcgcaaaagatg

SEQ ID NO: 18776 - DNA, 103 bp, Artificial Sequence
  Synthetic Polynucleotide
taatacgactcactatagggataaccagctgaggaatatgtgtcaggtgtaacagaggagaacacctatgacatattccaacctggcggcagcgcaaaagatg

SEQ ID NO: 18777 - DNA, 103 bp, Artificial Sequence
  Synthetic Polynucleotide
taatacgactcactataggggtaatataaccagctgaggaatatgtgtcaaacagaggagatgacacatgttcctcagcaacctggcggcagcgcaaaagatg

SEQ ID NO: 18778 - DNA, 103 bp, Artificial Sequence
  Synthetic Polynucleotide
taatacgactcactatagggagcatgtaatataaccagctgaggaatatgaacagaggagacatattatgcagctggttaacctggcggcagcgcaaaagatg

SEQ ID NO: 18779 - DNA, 103 bp, Artificial Sequence
  Synthetic Polynucleotide
taatacgactcactataggggtaccagcatgtaatataaccagctgaggaaacagaggagatcctcaatgggttatattaacctggcggcagcgcaaaagatg

SEQ ID NO: 18780 - DNA, 103 bp, Artificial Sequence
  Synthetic Polynucleotide
taatacgactcactataggggtctggtaccagcatgtaatataaccagctaacagaggagaagctggatgtattacatgaacctggcggcagcgcaaaagatg

SEQ ID NO: 18781 - DNA, 103 bp, Artificial Sequence
  Synthetic Polynucleotide
taatacgactcactatagggagttggtctggtaccagcatgtaatataacaacagaggagagttataatgcatgctggtaacctggcggcagcgcaaaagatg

SEQ ID NO: 18782 - DNA, 103 bp, Artificial Sequence
  Synthetic Polynucleotide
taatacgactcactatagggtacaaagttggtctggtaccagcatgtaataacagaggagaattacaatgtggtaccagaacctggcggcagcgcaaaagatg

SEQ ID NO: 18783 - DNA, 103 bp, Artificial Sequence
  Synthetic Polynucleotide
taatacgactcactatagggggcagtgtggggataacgatctctaaggttaacagaggagaaaccttatggatcgttataacctggcggcagcgcaaaagatg

SEQ ID NO: 18784 - DNA, 103 bp, Artificial Sequence
  Synthetic Polynucleotide
taatacgactcactatagggggtactacaaagttggtctggtaccagcataacagaggagaatgctgatgccagaccaaaacctggcggcagcgcaaaagatg

SEQ ID NO: 18785 - DNA, 103 bp, Artificial Sequence
  Synthetic Polynucleotide
taatacgactcactatagggtatcaggtactacaaagttggtctggtaccaacagaggagaggtaccatgccaactttgaacctggcggcagcgcaaaagatg

SEQ ID NO: 18786 - DNA, 103 bp, Artificial Sequence
  Synthetic Polynucleotide
taatacgactcactatagggagtactatcaggtactacaaagttggtctgaacagaggagacagaccatgtttgtagtaaacctggcggcagcgcaaaagatg

SEQ ID NO: 18787 - DNA, 103 bp, Artificial Sequence
  Synthetic Polynucleotide
taatacgactcactatagggtctggagtactatcaggtactacaaagttgaacagaggagacaacttatgagtacctgaaacctggcggcagcgcaaaagatg

SEQ ID NO: 18788 - DNA, 103 bp, Artificial Sequence
  Synthetic Polynucleotide
taatacgactcactatagggcgttatctggagtactatcaggtactacaaaacagaggagattgtagatgctgatagtaaacctggcggcagcgcaaaagatg

SEQ ID NO: 18789 - DNA, 103 bp, Artificial Sequence
  Synthetic Polynucleotide
taatacgactcactatagggtttggcgttatctggagtactatcaggtacaacagaggagagtacctatgagtactccaaacctggcggcagcgcaaaagatg

SEQ ID NO: 18790 - DNA, 103 bp, Artificial Sequence
  Synthetic Polynucleotide
taatacgactcactatagggaccattttggcgttatctggagtactatcaaacagaggagatgatagatgtccagataaaacctggcggcagcgcaaaagatg

SEQ ID NO: 18791 - DNA, 103 bp, Artificial Sequence
  Synthetic Polynucleotide
taatacgactcactatagggtgcacaccattttggcgttatctggagtacaacagaggagagtactcatgataacgccaaacctggcggcagcgcaaaagatg

SEQ ID NO: 18792 - DNA, 103 bp, Artificial Sequence
  Synthetic Polynucleotide
taatacgactcactatagggaaccatgcacaccattttggcgttatctggaacagaggagaccagatatggccaaaatgaacctggcggcagcgcaaaagatg

SEQ ID NO: 18793 - DNA, 103 bp, Artificial Sequence
  Synthetic Polynucleotide
taatacgactcactataggggcagaaaccatgcacaccattttggcgttaaacagaggagataacgcatgaatggtgtgaacctggcggcagcgcaaaagatg

SEQ ID NO: 18794 - DNA, 103 bp, Artificial Sequence
  Synthetic Polynucleotide
taatacgactcactataggggtgtaggcagtgtggggataacgatctctaaacagaggagatagagaatgttatccccaaacctggcggcagcgcaaaagatg

SEQ ID NO: 18795 - DNA, 103 bp, Artificial Sequence
  Synthetic Polynucleotide
taatacgactcactatagggtgcatgcagaaaccatgcacaccattttggaacagaggagaccaaaaatgtgtgcatggaacctggcggcagcgcaaaagatg

SEQ ID NO: 18796 - DNA, 103 bp, Artificial Sequence
  Synthetic Polynucleotide
taatacgactcactatagggatctttgcatgcagaaaccatgcacaccataacagaggagaatggtgatgatggtttctaacctggcggcagcgcaaaagatg

SEQ ID NO: 18797 - DNA, 103 bp, Artificial Sequence
  Synthetic Polynucleotide
taatacgactcactatagggcaaaaatctttgcatgcagaaaccatgcacaacagaggagagtgcatatgttctgcatgaacctggcggcagcgcaaaagatg

SEQ ID NO: 18798 - DNA, 103 bp, Artificial Sequence
  Synthetic Polynucleotide
taatacgactcactatagggttaagcaaaaatctttgcatgcagaaaccaaacagaggagatggtttatgcatgcaaagaacctggcggcagcgcaaaagatg

SEQ ID NO: 18799 - DNA, 103 bp, Artificial Sequence
  Synthetic Polynucleotide
taatacgactcactatagggtaatcttaagcaaaaatctttgcatgcagaaacagaggagatctgcaatgaaagattttaacctggcggcagcgcaaaagatg

SEQ ID NO: 18800 - DNA, 103 bp, Artificial Sequence
  Synthetic Polynucleotide
taatacgactcactatagggctggctaatcttaagcaaaaatctttgcataacagaggagaatgcaaatgtttttgcttaacctggcggcagcgcaaaagatg

SEQ ID NO: 18801 - DNA, 103 bp, Artificial Sequence
  Synthetic Polynucleotide
taatacgactcactatagggtatctctggctaatcttaagcaaaaatcttaacagaggagaaagattatggcttaagataacctggcggcagcgcaaaagatg

SEQ ID NO: 18802 - DNA, 103 bp, Artificial Sequence
  Synthetic Polynucleotide
taatacgactcactataggggttagtatctctggctaatcttaagcaaaaaacagaggagattttgcatgagattagccaacctggcggcagcgcaaaagatg

SEQ ID NO: 18803 - DNA, 103 bp, Artificial Sequence
  Synthetic Polynucleotide
taatacgactcactatagggtgtaggttagtatctctggctaatcttaagaacagaggagacttaagatgagccagagaaacctggcggcagcgcaaaagatg

SEQ ID NO: 18804 - DNA, 103 bp, Artificial Sequence
  Synthetic Polynucleotide
taatacgactcactataggggtgtgtgtaggttagtatctctggctaatcaacagaggagagattagatggagatactaaacctggcggcagcgcaaaagatg

SEQ ID NO: 18805 - DNA, 103 bp, Artificial Sequence
  Synthetic Polynucleotide
taatacgactcactataggggctctgtgtaggcagtgtggggataacgataacagaggagaatcgttatgcccacactgaacctggcggcagcgcaaaagatg

SEQ ID NO: 18806 - DNA, 103 bp, Artificial Sequence
  Synthetic Polynucleotide
taatacgactcactatagggttcttgtgtgtgtaggttagtatctctggcaacagaggagagccagaatgactaacctaaacctggcggcagcgcaaaagatg

SEQ ID NO: 18807 - DNA, 103 bp, Artificial Sequence
  Synthetic Polynucleotide
taatacgactcactatagggactccttcttgtgtgtgtaggttagtatctaacagaggagaagatacatgcctacacacaacctggcggcagcgcaaaagatg

SEQ ID NO: 18808 - DNA, 103 bp, Artificial Sequence
  Synthetic Polynucleotide
taatacgactcactatagggtgagtactccttcttgtgtgtgtaggttagaacagaggagactaaccatgacacacaagaacctggcggcagcgcaaaagatg

SEQ ID NO: 18809 - DNA, 103 bp, Artificial Sequence
  Synthetic Polynucleotide
taatacgactcactatagggttgtgtgagtactccttcttgtgtgtgtagaacagaggagactacacatgcaagaaggaaacctggcggcagcgcaaaagatg

SEQ ID NO: 18810 - DNA, 103 bp, Artificial Sequence
  Synthetic Polynucleotide
taatacgactcactataggggggttttgtgtgagtactccttcttgtgtgaacagaggagacacacaatgaggagtactaacctggcggcagcgcaaaagatg

SEQ ID NO: 18811 - DNA, 103 bp, Artificial Sequence
  Synthetic Polynucleotide
taatacgactcactatagggcaactgggttttgtgtgagtactccttcttaacagaggagaaagaagatgtactcacacaacctggcggcagcgcaaaagatg

SEQ ID NO: 18812 - DNA, 103 bp, Artificial Sequence
  Synthetic Polynucleotide
taatacgactcactatagggattttcaactgggttttgtgtgagtactccaacagaggagaggagtaatgacacaaaacaacctggcggcagcgcaaaagatg

SEQ ID NO: 18813 - DNA, 103 bp, Artificial Sequence
  Synthetic Polynucleotide
taatacgactcactatagggatataattttcaactgggttttgtgtgagtaacagaggagaactcacatgaaacccagtaacctggcggcagcgcaaaagatg

SEQ ID NO: 18814 - DNA, 103 bp, Artificial Sequence
  Synthetic Polynucleotide
taatacgactcactatagggtatctatataattttcaactgggttttgtgaacagaggagacacaaaatgcagttgaaaaacctggcggcagcgcaaaagatg

SEQ ID NO: 18815 - DNA, 103 bp, Artificial Sequence
  Synthetic Polynucleotide
taatacgactcactatagggtacactatctatataattttcaactgggttaacagaggagaaacccaatggaaaattataacctggcggcagcgcaaaagatg

SEQ ID NO: 18816 - DNA, 103 bp, Artificial Sequence
  Synthetic Polynucleotide
taatacgactcactatagggactgggctctgtgtaggcagtgtggggataaacagaggagatatcccatgactgcctacaacctggcggcagcgcaaaagatg

SEQ ID NO: 18817 - DNA, 103 bp, Artificial Sequence
  Synthetic Polynucleotide
taatacgactcactatagggtttaatacactatctatataattttcaactaacagaggagaagttgaatgttatatagaaacctggcggcagcgcaaaagatg

SEQ ID NO: 18818 - DNA, 103 bp, Artificial Sequence
  Synthetic Polynucleotide
taatacgactcactatagggcttcatttaatacactatctatataattttaacagaggagaaaaattatgtagatagtgaacctggcggcagcgcaaaagatg

SEQ ID NO: 18819 - DNA, 103 bp, Artificial Sequence
  Synthetic Polynucleotide
taatacgactcactatagggaagaacttcatttaatacactatctatataaacagaggagatatataatgagtgtattaaacctggcggcagcgcaaaagatg

SEQ ID NO: 18820 - DNA, 103 bp, Artificial Sequence
  Synthetic Polynucleotide
taatacgactcactatagggaccacaagaacttcatttaatacactatctaacagaggagaagatagatgattaaatgaaacctggcggcagcgcaaaagatg

SEQ ID NO: 18821 - DNA, 103 bp, Artificial Sequence
  Synthetic Polynucleotide
taatacgactcactatagggttggcaccacaagaacttcatttaatacacaacagaggagagtgtatatgatgaagttcaacctggcggcagcgcaaaagatg

SEQ ID NO: 18822 - DNA, 103 bp, Artificial Sequence
  Synthetic Polynucleotide
taatacgactcactataggggatatttggcaccacaagaacttcatttaaaacagaggagattaaatatggttcttgtgaacctggcggcagcgcaaaagatg

SEQ ID NO: 18823 - DNA, 103 bp, Artificial Sequence
  Synthetic Polynucleotide
taatacgactcactatagggggttggatatttggcaccacaagaacttcaaacagaggagatgaagtatgtgtggtgccaacctggcggcagcgcaaaagatg

SEQ ID NO: 18824 - DNA, 103 bp, Artificial Sequence
  Synthetic Polynucleotide
taatacgactcactatagggtgctaggttggatatttggcaccacaagaaaacagaggagattcttgatgtgccaaataaacctggcggcagcgcaaaagatg

SEQ ID NO: 18825 - DNA, 103 bp, Artificial Sequence
  Synthetic Polynucleotide
taatacgactcactatagggagatgtgctaggttggatatttggcaccacaacagaggagagtggtgatgaatatccaaaacctggcggcagcgcaaaagatg

SEQ ID NO: 18826 - DNA, 103 bp, Artificial Sequence
  Synthetic Polynucleotide
taatacgactcactataggggacacagatgtgctaggttggatatttggcaacagaggagagccaaaatgccaacctagaacctggcggcagcgcaaaagatg

SEQ ID NO: 18827 - DNA, 103 bp, Artificial Sequence
  Synthetic Polynucleotide
taatacgactcactatagggatggtactgggctctgtgtaggcagtgtggaacagaggagaccacacatgctacacagaaacctggcggcagcgcaaaagatg

SEQ ID NO: 18828 - DNA, 103 bp, Artificial Sequence
  Synthetic Polynucleotide
taatacgactcactataggggacttgacacagatgtgctaggttggatataacagaggagaatatccatgctagcacataacctggcggcagcgcaaaagatg

SEQ ID NO: 18829 - DNA, 103 bp, Artificial Sequence
  Synthetic Polynucleotide
taatacgactcactatagggtgcatgacttgacacagatgtgctaggttgaacagaggagacaacctatgacatctgtgaacctggcggcagcgcaaaagatg

SEQ ID NO: 18830 - DNA, 103 bp, Artificial Sequence
  Synthetic Polynucleotide
taatacgactcactatagggggcgctgcatgacttgacacagatgtgctaaacagaggagatagcacatgtgtgtcaagaacctggcggcagcgcaaaagatg

SEQ ID NO: 18831 - DNA, 103 bp, Artificial Sequence
  Synthetic Polynucleotide
taatacgactcactatagggatgcaggcgctgcatgacttgacacagatgaacagaggagacatctgatgcaagtcatgaacctggcggcagcgcaaaagatg

SEQ ID NO: 18832 - DNA, 103 bp, Artificial Sequence
  Synthetic Polynucleotide
taatacgactcactatagggatccaatgcaggcgctgcatgacttgacacaacagaggagagtgtcaatgcatgcagcgaacctggcggcagcgcaaaagatg

SEQ ID NO: 18833 - DNA, 103 bp, Artificial Sequence
  Synthetic Polynucleotide
taatacgactcactataggggcagcatccaatgcaggcgctgcatgacttaacagaggagaaagtcaatgagcgcctgcaacctggcggcagcgcaaaagatg

SEQ ID NO: 18834 - DNA, 103 bp, Artificial Sequence
  Synthetic Polynucleotide
taatacgactcactatagggtttccgcagcatccaatgcaggcgctgcataacagaggagaatgcagatgctgcattggaacctggcggcagcgcaaaagatg

SEQ ID NO: 18835 - DNA, 103 bp, Artificial Sequence
  Synthetic Polynucleotide
taatacgactcactatagggtccggtttccgcagcatccaatgcaggcgcaacagaggagagcgcctatgttggatgctaacctggcggcagcgcaaaagatg

SEQ ID NO: 18836 - DNA, 103 bp, Artificial Sequence
  Synthetic Polynucleotide
taatacgactcactataggggtgtgtccggtttccgcagcatccaatgcaaacagaggagatgcattatgtgctgcggaaacctggcggcagcgcaaaagatg

SEQ ID NO: 18837 - DNA, 103 bp, Artificial Sequence
  Synthetic Polynucleotide
taatacgactcactatagggagctggtgtgtccggtttccgcagcatccaaacagaggagatggatgatgcggaaaccgaacctggcggcagcgcaaaagatg

SEQ ID NO: 18838 - DNA, 103 bp, Artificial Sequence
  Synthetic Polynucleotide
taatacgactcactatagggcaaaaatggtactgggctctgtgtaggcagaacagaggagactgcctatgcagagcccaaacctggcggcagcgcaaaagatg

SEQ ID NO: 18839 - DNA, 103 bp, Artificial Sequence
  Synthetic Polynucleotide
taatacgactcactatagggaacagagctggtgtgtccggtttccgcagcaacagaggagagctgcgatgaccggacacaacctggcggcagcgcaaaagatg

SEQ ID NO: 18840 - DNA, 103 bp, Artificial Sequence
  Synthetic Polynucleotide
taatacgactcactatagggggttgaacagagctggtgtgtccggtttccaacagaggagaggaaacatgacacaccagaacctggcggcagcgcaaaagatg

SEQ ID NO: 18841 - DNA, 103 bp, Artificial Sequence
  Synthetic Polynucleotide
taatacgactcactatagggcttcaggttgaacagagctggtgtgtccggaacagaggagaccggacatgccagctctgaacctggcggcagcgcaaaagatg

SEQ ID NO: 18842 - DNA, 103 bp, Artificial Sequence
  Synthetic Polynucleotide
taatacgactcactatagggcatatcttcaggttgaacagagctggtgtgaacagaggagacacaccatgtctgttcaaaacctggcggcagcgcaaaagatg

SEQ ID NO: 18843 - DNA, 103 bp, Artificial Sequence
  Synthetic Polynucleotide
taatacgactcactatagggtcaatcatatcttcaggttgaacagagctgaacagaggagacagctcatgtcaacctgaaacctggcggcagcgcaaaagatg

SEQ ID NO: 18844 - DNA, 103 bp, Artificial Sequence
  Synthetic Polynucleotide
taatacgactcactatagggtagtttcaatcatatcttcaggttgaacagaacagaggagactgttcatgctgaagataaacctggcggcagcgcaaaagatg

SEQ ID NO: 18845 - DNA, 103 bp, Artificial Sequence
  Synthetic Polynucleotide
taatacgactcactatagggatatctagtttcaatcatatcttcaggttgaacagaggagacaacctatggatatgattaacctggcggcagcgcaaaagatg

SEQ ID NO: 18846 - DNA, 103 bp, Artificial Sequence
  Synthetic Polynucleotide
taatacgactcactatagggataacatatctagtttcaatcatatcttcaaacagaggagatgaagaatggattgaaacaacctggcggcagcgcaaaagatg

SEQ ID NO: 18847 - DNA, 103 bp, Artificial Sequence
  Synthetic Polynucleotide
taatacgactcactatagggcagttataacatatctagtttcaatcatataacagaggagaatatgaatgaaactagataacctggcggcagcgcaaaagatg

SEQ ID NO: 18848 - DNA, 103 bp, Artificial Sequence
  Synthetic Polynucleotide
taatacgactcactatagggttgatcagttataacatatctagtttcaataacagaggagaattgaaatgagatatgttaacctggcggcagcgcaaaagatg

SEQ ID NO: 18849 - DNA, 103 bp, Artificial Sequence
  Synthetic Polynucleotide
taatacgactcactatagggacaacaccgcatgggtggagtgagtgggaaaacagaggagattcccaatgactccacccaacctggcggcagcgcaaaagatg

SEQ ID NO: 18850 - DNA, 103 bp, Artificial Sequence
  Synthetic Polynucleotide
taatacgactcactatagggtatatcaaaaatggtactgggctctgtgtaaacagaggagatacacaatgcccagtaccaacctggcggcagcgcaaaagatg

SEQ ID NO: 18851 - DNA, 103 bp, Artificial Sequence
  Synthetic Polynucleotide
taatacgactcactatagggcttgtttgatcagttataacatatctagttaacagaggagaaactagatgtgttataacaacctggcggcagcgcaaaagatg

SEQ ID NO: 18852 - DNA, 103 bp, Artificial Sequence
  Synthetic Polynucleotide
taatacgactcactatagggcatcccttgtttgatcagttataacatatcaacagaggagagatatgatgtaactgatcaacctggcggcagcgcaaaagatg

SEQ ID NO: 18853 - DNA, 103 bp, Artificial Sequence
  Synthetic Polynucleotide
taatacgactcactatagggtgtttcatcccttgtttgatcagttataacaacagaggagagttataatggatcaaacaaacctggcggcagcgcaaaagatg

SEQ ID NO: 18854 - DNA, 103 bp, Artificial Sequence
  Synthetic Polynucleotide
taatacgactcactatagggatacttgtttcatcccttgtttgatcagttaacagaggagaaactgaatgaacaagggaaacctggcggcagcgcaaaagatg

SEQ ID NO: 18855 - DNA, 103 bp, Artificial Sequence
  Synthetic Polynucleotide
taatacgactcactatagggtctcaatacttgtttcatcccttgtttgataacagaggagaatcaaaatggggatgaaaaacctggcggcagcgcaaaagatg

SEQ ID NO: 18856 - DNA, 103 bp, Artificial Sequence
  Synthetic Polynucleotide
taatacgactcactataggggaaactctcaatacttgtttcatcccttgtaacagaggagaacaaggatggaaacaagtaacctggcggcagcgcaaaagatg

SEQ ID NO: 18857 - DNA, 103 bp, Artificial Sequence
  Synthetic Polynucleotide
taatacgactcactatagggcctaagaaactctcaatacttgtttcatccaacagaggagaggatgaatgaagtattgaaacctggcggcagcgcaaaagatg

SEQ ID NO: 18858 - DNA, 103 bp, Artificial Sequence
  Synthetic Polynucleotide
taatacgactcactatagggacctacctaagaaactctcaatacttgtttaacagaggagaaaacaaatgttgagagttaacctggcggcagcgcaaaagatg

SEQ ID NO: 18859 - DNA, 103 bp, Artificial Sequence
  Synthetic Polynucleotide
taatacgactcactatagggccctgacctacctaagaaactctcaatactaacagaggagaagtattatgagtttcttaaacctggcggcagcgcaaaagatg

SEQ ID NO: 18860 - DNA, 103 bp, Artificial Sequence
  Synthetic Polynucleotide
taatacgactcactatagggatacaccctgacctacctaagaaactctcaaacagaggagatgagagatgcttaggtagaacctggcggcagcgcaaaagatg

SEQ ID NO: 18861 - DNA, 103 bp, Artificial Sequence
  Synthetic Polynucleotide
taatacgactcactatagggccaattatatcaaaaatggtactgggctctaacagaggagaagagccatgtaccattttaacctggcggcagcgcaaaagatg

SEQ ID NO: 18862 - DNA, 103 bp, Artificial Sequence
  Synthetic Polynucleotide
taatacgactcactatagggtagcgatacaccctgacctacctaagaaacaacagaggagagtttctatggtaggtcagaacctggcggcagcgcaaaagatg

SEQ ID NO: 18863 - DNA, 103 bp, Artificial Sequence
  Synthetic Polynucleotide
taatacgactcactatagggtatcatagcgatacaccctgacctacctaaaacagaggagattaggtatgtcagggtgtaacctggcggcagcgcaaaagatg

SEQ ID NO: 18864 - DNA, 103 bp, Artificial Sequence
  Synthetic Polynucleotide
taatacgactcactatagggaattctatcatagcgatacaccctgacctaaacagaggagataggtcatggtgtatcgcaacctggcggcagcgcaaaagatg

SEQ ID NO: 18865 - DNA, 103 bp, Artificial Sequence
  Synthetic Polynucleotide
taatacgactcactatagggtattaaattctatcatagcgatacaccctgaacagaggagacagggtatgtcgctatgaaacctggcggcagcgcaaaagatg

SEQ ID NO: 18866 - DNA, 103 bp, Artificial Sequence
  Synthetic Polynucleotide
taatacgactcactatagggacttgtattaaattctatcatagcgatacaaacagaggagatgtatcatgatgatagaaaacctggcggcagcgcaaaagatg

SEQ ID NO: 18867 - DNA, 103 bp, Artificial Sequence
  Synthetic Polynucleotide
taatacgactcactatagggtcactacttgtattaaattctatcatagcgaacagaggagacgctatatgagaatttaaaacctggcggcagcgcaaaagatg

SEQ ID NO: 18868 - DNA, 103 bp, Artificial Sequence
  Synthetic Polynucleotide
taatacgactcactatagggttttatcactacttgtattaaattctatcaaacagaggagatgatagatgttaatacaaaacctggcggcagcgcaaaagatg

SEQ ID NO: 18869 - DNA, 103 bp, Artificial Sequence
  Synthetic Polynucleotide
taatacgactcactatagggttcagttttatcactacttgtattaaattcaacagaggagagaatttatgacaagtagtaacctggcggcagcgcaaaagatg

SEQ ID NO: 18870 - DNA, 103 bp, Artificial Sequence
  Synthetic Polynucleotide
taatacgactcactatagggtcatgttcagttttatcactacttgtattaaacagaggagataatacatgtagtgataaaacctggcggcagcgcaaaagatg

SEQ ID NO: 18871 - DNA, 103 bp, Artificial Sequence
  Synthetic Polynucleotide
taatacgactcactatagggttttatcatgttcagttttatcactacttgaacagaggagacaagtaatgataaaactgaacctggcggcagcgcaaaagatg

SEQ ID NO: 18872 - DNA, 103 bp, Artificial Sequence
  Synthetic Polynucleotide
taatacgactcactatagggccaacccaattatatcaaaaatggtactggaacagaggagaccagtaatgtttttgataaacctggcggcagcgcaaaagatg

SEQ ID NO: 18873 - DNA, 103 bp, Artificial Sequence
  Synthetic Polynucleotide
taatacgactcactatagggaccaattttatcatgttcagttttatcactaacagaggagaagtgatatgactgaacataacctggcggcagcgcaaaagatg

SEQ ID NO: 18874 - DNA, 103 bp, Artificial Sequence
  Synthetic Polynucleotide
taatacgactcactatagggcctttaccaattttatcatgttcagttttaaacagaggagataaaacatgacatgataaaacctggcggcagcgcaaaagatg

SEQ ID NO: 18875 - DNA, 103 bp, Artificial Sequence
  Synthetic Polynucleotide
taatacgactcactatagggtgaatcctttaccaattttatcatgttcagaacagaggagactgaacatgataaaattgaacctggcggcagcgcaaaagatg

SEQ ID NO: 18876 - DNA, 103 bp, Artificial Sequence
  Synthetic Polynucleotide
taatacgactcactatagggtgttttgaatcctttaccaattttatcatgaacagaggagacatgatatgattggtaaaaacctggcggcagcgcaaaagatg

SEQ ID NO: 18877 - DNA, 103 bp, Artificial Sequence
  Synthetic Polynucleotide
taatacgactcactatagggttccatgttttgaatcctttaccaattttaaacagaggagataaaatatgtaaaggattaacctggcggcagcgcaaaagatg

SEQ ID NO: 18878 - DNA, 103 bp, Artificial Sequence
  Synthetic Polynucleotide
taatacgactcactatagggtaaccttccatgttttgaatcctttaccaaaacagaggagattggtaatggattcaaaaaacctggcggcagcgcaaaagatg

SEQ ID NO: 18879 - DNA, 103 bp, Artificial Sequence
  Synthetic Polynucleotide
taatacgactcactatagggaagactaaccttccatgttttgaatcctttaacagaggagaaaaggaatgaaaacatggaacctggcggcagcgcaaaagatg

SEQ ID NO: 18880 - DNA, 103 bp, Artificial Sequence
  Synthetic Polynucleotide
taatacgactcactatagggtcttgaagactaaccttccatgttttgaataacagaggagaattcaaatgatggaaggtaacctggcggcagcgcaaaagatg

SEQ ID NO: 18881 - DNA, 103 bp, Artificial Sequence
  Synthetic Polynucleotide
taatacgactcactatagggccatttcttgaagactaaccttccatgtttaacagaggagaaaacatatgaggttagtcaacctggcggcagcgcaaaagatg

SEQ ID NO: 18882 - DNA, 103 bp, Artificial Sequence
  Synthetic Polynucleotide
taatacgactcactatagggttgtgccatttcttgaagactaaccttccaaacagaggagatggaagatgagtcttcaaaacctggcggcagcgcaaaagatg

SEQ ID NO: 18883 - DNA, 103 bp, Artificial Sequence
  Synthetic Polynucleotide
taatacgactcactatagggagcgaccaacccaattatatcaaaaatggtaacagaggagaaccattatggatataattaacctggcggcagcgcaaaagatg

SEQ ID NO: 18884 - DNA, 103 bp, Artificial Sequence
  Synthetic Polynucleotide
taatacgactcactatagggctgatttgtgccatttcttgaagactaaccaacagaggagaggttagatgtcaagaaataacctggcggcagcgcaaaagatg

SEQ ID NO: 18885 - DNA, 103 bp, Artificial Sequence
  Synthetic Polynucleotide
taatacgactcactatagggttcttctgatttgtgccatttcttgaagacaacagaggagagtcttcatgaaatggcacaacctggcggcagcgcaaaagatg

SEQ ID NO: 18886 - DNA, 103 bp, Artificial Sequence
  Synthetic Polynucleotide
taatacgactcactatagggatattttcttctgatttgtgccatttcttgaacagaggagacaagaaatggcacaaatcaacctggcggcagcgcaaaagatg

SEQ ID NO: 18887 - DNA, 103 bp, Artificial Sequence
  Synthetic Polynucleotide
taatacgactcactatagggaattcatattttcttctgatttgtgccattaacagaggagaaatggcatgaatcagaagaacctggcggcagcgcaaaagatg

SEQ ID NO: 18888 - DNA, 103 bp, Artificial Sequence
  Synthetic Polynucleotide
taatacgactcactatagggtgaataattcatattttcttctgatttgtgaacagaggagacacaaaatggaagaaaataacctggcggcagcgcaaaagatg

SEQ ID NO: 18889 - DNA, 103 bp, Artificial Sequence
  Synthetic Polynucleotide
taatacgactcactatagggatatgtgaataattcatattttcttctgataacagaggagaatcagaatgaaatatgaaaacctggcggcagcgcaaaagatg

SEQ ID NO: 18890 - DNA, 103 bp, Artificial Sequence
  Synthetic Polynucleotide
taatacgactcactatagggcttgtatatgtgaataattcatattttcttaacagaggagaaagaaaatgtgaattattaacctggcggcagcgcaaaagatg

SEQ ID NO: 18891 - DNA, 103 bp, Artificial Sequence
  Synthetic Polynucleotide
taatacgactcactatagggcaaatcttgtatatgtgaataattcatattaacagaggagaaatatgatgtattcacataacctggcggcagcgcaaaagatg

SEQ ID NO: 18892 - DNA, 103 bp, Artificial Sequence
  Synthetic Polynucleotide
taatacgactcactatagggtgaatcaaatcttgtatatgtgaataattcaacagaggagagaattaatgacatatacaaacctggcggcagcgcaaaagatg

SEQ ID NO: 18893 - DNA, 103 bp, Artificial Sequence
  Synthetic Polynucleotide
taatacgactcactatagggatctctgaatcaaatcttgtatatgtgaataacagaggagaattcacatgtacaagattaacctggcggcagcgcaaaagatg

SEQ ID NO: 18894 - DNA, 103 bp, Artificial Sequence
  Synthetic Polynucleotide
taatacgactcactatagggcagggagcgaccaacccaattatatcaaaaaacagaggagattttgaatgaattgggttaacctggcggcagcgcaaaagatg

SEQ ID NO: 18895 - DNA, 103 bp, Artificial Sequence
  Synthetic Polynucleotide
taatacgactcactatagggttgttatctctgaatcaaatcttgtatatgaacagaggagacatataatggatttgattaacctggcggcagcgcaaaagatg

SEQ ID NO: 18896 - DNA, 103 bp, Artificial Sequence
  Synthetic Polynucleotide
taatacgactcactataggggactattgttatctctgaatcaaatcttgtaacagaggagaacaagaatggattcagagaacctggcggcagcgcaaaagatg

SEQ ID NO: 18897 - DNA, 103 bp, Artificial Sequence
  Synthetic Polynucleotide
taatacgactcactataggggcagtgactattgttatctctgaatcaaataacagaggagaatttgaatgagagataacaacctggcggcagcgcaaaagatg

SEQ ID NO: 18898 - DNA, 103 bp, Artificial Sequence
  Synthetic Polynucleotide
taatacgactcactatagggcggctgcagtgactattgttatctctgaataacagaggagaattcagatgtaacaatagaacctggcggcagcgcaaaagatg

SEQ ID NO: 18899 - DNA, 103 bp, Artificial Sequence
  Synthetic Polynucleotide
taatacgactcactatagggagctgcggctgcagtgactattgttatctcaacagaggagagagataatgatagtcactaacctggcggcagcgcaaaagatg

SEQ ID NO: 18900 - DNA, 103 bp, Artificial Sequence
  Synthetic Polynucleotide
taatacgactcactatagggccttgagctgcggctgcagtgactattgttaacagaggagaaacaatatgcactgcagcaacctggcggcagcgcaaaagatg

SEQ ID NO: 18901 - DNA, 103 bp, Artificial Sequence
  Synthetic Polynucleotide
taatacgactcactatagggcatttccttgagctgcggctgcagtgactaaacagaggagatagtcaatgcagccgcagaacctggcggcagcgcaaaagatg

SEQ ID NO: 18902 - DNA, 103 bp, Artificial Sequence
  Synthetic Polynucleotide
taatacgactcactatagggactatcatttccttgagctgcggctgcagtaacagaggagaactgcaatggcagctcaaaacctggcggcagcgcaaaagatg

SEQ ID NO: 18903 - DNA, 103 bp, Artificial Sequence
  Synthetic Polynucleotide
taatacgactcactatagggtgtccactatcatttccttgagctgcggctaacagaggagaagccgcatgtcaaggaaaaacctggcggcagcgcaaaagatg

SEQ ID NO: 18904 - DNA, 103 bp, Artificial Sequence
  Synthetic Polynucleotide
taatacgactcactatagggctatatgtccactatcatttccttgagctgaacagaggagacagctcatggaaatgataaacctggcggcagcgcaaaagatg

SEQ ID NO: 18905 - DNA, 103 bp, Artificial Sequence
  Synthetic Polynucleotide
taatacgactcactataggggtttgcagggagcgaccaacccaattatataacagaggagaatataaatgggttggtcgaacctggcggcagcgcaaaagatg

SEQ ID NO: 18906 - DNA, 103 bp, Artificial Sequence
  Synthetic Polynucleotide
taatacgactcactatagggcaatactatatgtccactatcatttccttgaacagaggagacaaggaatggatagtggaaacctggcggcagcgcaaaagatg

SEQ ID NO: 18907 - DNA, 103 bp, Artificial Sequence
  Synthetic Polynucleotide
taatacgactcactatagggaattgcaatactatatgtccactatcatttaacagaggagaaaatgaatgtggacatataacctggcggcagcgcaaaagatg

SEQ ID NO: 18908 - DNA, 103 bp, Artificial Sequence
  Synthetic Polynucleotide
taatacgactcactatagggacataaattgcaatactatatgtccactataacagaggagaatagtgatgatatagtataacctggcggcagcgcaaaagatg

SEQ ID NO: 18909 - DNA, 103 bp, Artificial Sequence
  Synthetic Polynucleotide
taatacgactcactatagggtacatacataaattgcaatactatatgtccaacagaggagaggacatatggtattgcaaaacctggcggcagcgcaaaagatg

SEQ ID NO: 18910 - DNA, 103 bp, Artificial Sequence
  Synthetic Polynucleotide
taatacgactcactataggggggggtacatacataaattgcaatactataaacagaggagatatagtatggcaatttataacctggcggcagcgcaaaagatg

SEQ ID NO: 18911 - DNA, 103 bp, Artificial Sequence
  Synthetic Polynucleotide
taatacgactcactatagggctcctgggggtacatacataaattgcaataaacagaggagatattgcatgttatgtatgaacctggcggcagcgcaaaagatg

SEQ ID NO: 18912 - DNA, 103 bp, Artificial Sequence
  Synthetic Polynucleotide
taatacgactcactatagggaggtgctcctgggggtacatacataaattgaacagaggagacaatttatgtatgtacccaacctggcggcagcgcaaaagatg

SEQ ID NO: 18913 - DNA, 103 bp, Artificial Sequence
  Synthetic Polynucleotide
taatacgactcactataggggggacaggtgctcctgggggtacatacataaacagaggagatatgtaatgacccccaggaacctggcggcagcgcaaaagatg

SEQ ID NO: 18914 - DNA, 103 bp, Artificial Sequence
  Synthetic Polynucleotide
taatacgactcactatagggtttcggggacaggtgctcctgggggtacataacagaggagaatgtacatgcaggagcacaacctggcggcagcgcaaaagatg

SEQ ID NO: 18915 - DNA, 103 bp, Artificial Sequence
  Synthetic Polynucleotide
taatacgactcactatagggacgtttttcggggacaggtgctcctgggggaacagaggagacccccaatggcacctgtcaacctggcggcagcgcaaaagatg

SEQ ID NO: 18916 - DNA, 103 bp, Artificial Sequence
  Synthetic Polynucleotide
taatacgactcactataggggctgggtttgcagggagcgaccaacccaataacagaggagaattgggatggtcgctcccaacctggcggcagcgcaaaagatg

SEQ ID NO: 18917 - DNA, 103 bp, Artificial Sequence
  Synthetic Polynucleotide
taatacgactcactatagggtcatcacgtttttcggggacaggtgctcctaacagaggagaaggagcatgtgtccccgaaacctggcggcagcgcaaaagatg

SEQ ID NO: 18918 - DNA, 103 bp, Artificial Sequence
  Synthetic Polynucleotide
taatacgactcactatagggtgtaatcatcacgtttttcggggacaggtgaacagaggagacacctgatgccgaaaaacaacctggcggcagcgcaaaagatg

SEQ ID NO: 18919 - DNA, 103 bp, Artificial Sequence
  Synthetic Polynucleotide
taatacgactcactatagggccatgtgtaatcatcacgtttttcggggacaacagaggagagtccccatgaaacgtgataacctggcggcagcgcaaaagatg

SEQ ID NO: 18920 - DNA, 103 bp, Artificial Sequence
  Synthetic Polynucleotide
taatacgactcactataggggattgccatgtgtaatcatcacgtttttcgaacagaggagacgaaaaatgtgatgattaaacctggcggcagcgcaaaagatg

SEQ ID NO: 18921 - DNA, 103 bp, Artificial Sequence
  Synthetic Polynucleotide
taatacgactcactatagggttcctgattgccatgtgtaatcatcacgttaacagaggagaaacgtgatgattacacataacctggcggcagcgcaaaagatg

SEQ ID NO: 18922 - DNA, 103 bp, Artificial Sequence
  Synthetic Polynucleotide
taatacgactcactatagggatttgttcctgattgccatgtgtaatcatcaacagaggagagatgatatgacatggcaaaacctggcggcagcgcaaaagatg

SEQ ID NO: 18923 - DNA, 103 bp, Artificial Sequence
  Synthetic Polynucleotide
taatacgactcactataggggatgcatttgttcctgattgccatgtgtaaaacagaggagattacacatggcaatcaggaacctggcggcagcgcaaaagatg

SEQ ID NO: 18924 - DNA, 103 bp, Artificial Sequence
  Synthetic Polynucleotide
taatacgactcactatagggacacagatgcatttgttcctgattgccatgaacagaggagacatggcatgcaggaacaaaacctggcggcagcgcaaaagatg

SEQ ID NO: 18925 - DNA, 103 bp, Artificial Sequence
  Synthetic Polynucleotide
taatacgactcactatagggccagaacacagatgcatttgttcctgattgaacagaggagacaatcaatgacaaatgcaaacctggcggcagcgcaaaagatg

SEQ ID NO: 18926 - DNA, 103 bp, Artificial Sequence
  Synthetic Polynucleotide
taatacgactcactatagggtcttgccagaacacagatgcatttgttcctaacagaggagaaggaacatgtgcatctgtaacctggcggcagcgcaaaagatg

SEQ ID NO: 18927 - DNA, 103 bp, Artificial Sequence
  Synthetic Polynucleotide
taatacgactcactatagggctactgctgggtttgcagggagcgaccaacaacagaggagagttggtatgtccctgcaaaacctggcggcagcgcaaaagatg

SEQ ID NO: 18928 - DNA, 103 bp, Artificial Sequence
  Synthetic Polynucleotide
taatacgactcactataggggtccttcttgccagaacacagatgcatttgaacagaggagacaaatgatgctgtgttctaacctggcggcagcgcaaaagatg

SEQ ID NO: 18929 - DNA, 103 bp, Artificial Sequence
  Synthetic Polynucleotide
taatacgactcactatagggtggttgtccttcttgccagaacacagatgcaacagaggagagcatctatgttctggcaaaacctggcggcagcgcaaaagatg

SEQ ID NO: 18930 - DNA, 103 bp, Artificial Sequence
  Synthetic Polynucleotide
taatacgactcactataggggggtatggttgtccttcttgccagaacacaaacagaggagatgtgttatggcaagaaggaacctggcggcagcgcaaaagatg

SEQ ID NO: 18931 - DNA, 103 bp, Artificial Sequence
  Synthetic Polynucleotide
taatacgactcactatagggatctggggtatggttgtccttcttgccagaaacagaggagatctggcatgaaggacaacaacctggcggcagcgcaaaagatg

SEQ ID NO: 18932 - DNA, 103 bp, Artificial Sequence
  Synthetic Polynucleotide
taatacgactcactatagggtgtgaatctggggtatggttgtccttcttgaacagaggagacaagaaatgcaaccatacaacctggcggcagcgcaaaagatg

SEQ ID NO: 18933 - DNA, 103 bp, Artificial Sequence
  Synthetic Polynucleotide
taatacgactcactataggggggattgtgaatctggggtatggttgtcctaacagaggagaaggacaatgataccccagaacctggcggcagcgcaaaagatg

SEQ ID NO: 18934 - DNA, 103 bp, Artificial Sequence
  Synthetic Polynucleotide
taatacgactcactatagggtaaaagggattgtgaatctggggtatggttaacagaggagaaaccatatgccagattcaaacctggcggcagcgcaaaagatg

SEQ ID NO: 18935 - DNA, 103 bp, Artificial Sequence
  Synthetic Polynucleotide
taatacgactcactataggggctcataaaagggattgtgaatctggggtaaacagaggagataccccatgttcacaatcaacctggcggcagcgcaaaagatg

SEQ ID NO: 18936 - DNA, 103 bp, Artificial Sequence
  Synthetic Polynucleotide
taatacgactcactataggggcaatgctcataaaagggattgtgaatctgaacagaggagacagattatgaatccctttaacctggcggcagcgcaaaagatg

SEQ ID NO: 18937 - DNA, 103 bp, Artificial Sequence
  Synthetic Polynucleotide
taatacgactcactatagggctgatgcaatgctcataaaagggattgtgaaacagaggagatcacaaatgcttttatgaaacctggcggcagcgcaaaagatg

SEQ ID NO: 18938 - DNA, 103 bp, Artificial Sequence
  Synthetic Polynucleotide
taatacgactcactatagggcaggtctactgctgggtttgcagggagcgaaacagaggagatcgctcatggcaaacccaaacctggcggcagcgcaaaagatg

SEQ ID NO: 18939 - DNA, 103 bp, Artificial Sequence
  Synthetic Polynucleotide
taatacgactcactatagggataggctgatgcaatgctcataaaagggataacagaggagaatccctatgatgagcattaacctggcggcagcgcaaaagatg

SEQ ID NO: 18940 - DNA, 103 bp, Artificial Sequence
  Synthetic Polynucleotide
taatacgactcactatagggatgtaataggctgatgcaatgctcataaaaaacagaggagattttatatgcattgcatcaacctggcggcagcgcaaaagatg

SEQ ID NO: 18941 - DNA, 103 bp, Artificial Sequence
  Synthetic Polynucleotide
taatacgactcactatagggaaaacatgtaataggctgatgcaatgctcaaacagaggagatgagcaatgcatcagcctaacctggcggcagcgcaaaagatg

SEQ ID NO: 18942 - DNA, 103 bp, Artificial Sequence
  Synthetic Polynucleotide
taatacgactcactatagggatcataaaacatgtaataggctgatgcaataacagaggagaattgcaatggcctattacaacctggcggcagcgcaaaagatg

SEQ ID NO: 18943 - DNA, 103 bp, Artificial Sequence
  Synthetic Polynucleotide
taatacgactcactatagggtaaccatcataaaacatgtaataggctgataacagaggagaatcagcatgttacatgttaacctggcggcagcgcaaaagatg

SEQ ID NO: 18944 - DNA, 103 bp, Artificial Sequence
  Synthetic Polynucleotide
taatacgactcactatagggcatcataaccatcataaaacatgtaataggaacagaggagacctattatgtgttttatgaacctggcggcagcgcaaaagatg

SEQ ID NO: 18945 - DNA, 103 bp, Artificial Sequence
  Synthetic Polynucleotide
taatacgactcactatagggatcaccatcataaccatcataaaacatgtaaacagaggagatacatgatgtatgatggtaacctggcggcagcgcaaaagatg

SEQ ID NO: 18946 - DNA, 103 bp, Artificial Sequence
  Synthetic Polynucleotide
taatacgactcactataggggcactatcaccatcataaccatcataaaacaacagaggagagttttaatgtggttatgaaacctggcggcagcgcaaaagatg

SEQ ID NO: 18947 - DNA, 103 bp, Artificial Sequence
  Synthetic Polynucleotide
taatacgactcactatagggatgctgcactatcaccatcataaccatcataacagaggagaatgatgatgatgatggtgaacctggcggcagcgcaaaagatg

SEQ ID NO: 18948 - DNA, 103 bp, Artificial Sequence
  Synthetic Polynucleotide
taatacgactcactatagggttttgatgctgcactatcaccatcataaccaacagaggagaggttatatgggtgatagtaacctggcggcagcgcaaaagatg

SEQ ID NO: 18949 - DNA, 103 bp, Artificial Sequence
  Synthetic Polynucleotide
taatacgactcactatagggtctgccaggtctactgctgggtttgcagggaacagaggagaccctgcatgcccagcagtaacctggcggcagcgcaaaagatg

SEQ ID NO: 18950 - DNA, 103 bp, Artificial Sequence
  Synthetic Polynucleotide
taatacgactcactatagggccgtattttgatgctgcactatcaccatcaaacagaggagatgatggatgtagtgcagcaacctggcggcagcgcaaaagatg

SEQ ID NO: 18951 - DNA, 103 bp, Artificial Sequence
  Synthetic Polynucleotide
taatacgactcactatagggcagaaccgtattttgatgctgcactatcacaacagaggagagtgataatgcagcatcaaaacctggcggcagcgcaaaagatg

SEQ ID NO: 18952 - DNA, 103 bp, Artificial Sequence
  Synthetic Polynucleotide
taatacgactcactataggggactacagaaccgtattttgatgctgcactaacagaggagaagtgcaatgtcaaaatacaacctggcggcagcgcaaaagatg

SEQ ID NO: 18953 - DNA, 103 bp, Artificial Sequence
  Synthetic Polynucleotide
taatacgactcactatagggttagtgactacagaaccgtattttgatgctaacagaggagaagcatcatgatacggttcaacctggcggcagcgcaaaagatg

SEQ ID NO: 18954 - DNA, 103 bp, Artificial Sequence
  Synthetic Polynucleotide
taatacgactcactatagggtatcattagtgactacagaaccgtattttgaacagaggagacaaaatatggttctgtagaacctggcggcagcgcaaaagatg

SEQ ID NO: 18955 - DNA, 103 bp, Artificial Sequence
  Synthetic Polynucleotide
taatacgactcactatagggtcccatatcattagtgactacagaaccgtaaacagaggagatacggtatggtagtcactaacctggcggcagcgcaaaagatg

SEQ ID NO: 18956 - DNA, 103 bp, Artificial Sequence
  Synthetic Polynucleotide
taatacgactcactatagggatggttcccatatcattagtgactacagaaaacagaggagattctgtatgcactaatgaaacctggcggcagcgcaaaagatg

SEQ ID NO: 18957 - DNA, 103 bp, Artificial Sequence
  Synthetic Polynucleotide
taatacgactcactatagggcacatatggttcccatatcattagtgactaaacagaggagatagtcaatgatgatatggaacctggcggcagcgcaaaagatg

SEQ ID NO: 18958 - DNA, 103 bp, Artificial Sequence
  Synthetic Polynucleotide
taatacgactcactatagggtctaacacatatggttcccatatcattagtaacagaggagaactaatatgatgggaaccaacctggcggcagcgcaaaagatg

SEQ ID NO: 18959 - DNA, 103 bp, Artificial Sequence
  Synthetic Polynucleotide
taatacgactcactatagggactattctaacacatatggttcccatatcaaacagaggagatgatatatgaaccatatgaacctggcggcagcgcaaaagatg

SEQ ID NO: 18960 - DNA, 103 bp, Artificial Sequence
  Synthetic Polynucleotide
taatacgactcactatagggagagtacaacaccgcatgggtggagtgagtaacagaggagaactcacatgacccatgcgaacctggcggcagcgcaaaagatg

SEQ ID NO: 18961 - DNA, 103 bp, Artificial Sequence
  Synthetic Polynucleotide
taatacgactcactatagggcctcatctgccaggtctactgctgggtttgaacagaggagacaaaccatgcagtagaccaacctggcggcagcgcaaaagatg

SEQ ID NO: 18962 - DNA, 103 bp, Artificial Sequence
  Synthetic Polynucleotide
taatacgactcactatagggatgtcactattctaacacatatggttcccaaacagaggagatgggaaatgtatgtgttaaacctggcggcagcgcaaaagatg

SEQ ID NO: 18963 - DNA, 103 bp, Artificial Sequence
  Synthetic Polynucleotide
taatacgactcactataggggttggatgtcactattctaacacatatggtaacagaggagaaccataatggttagaataaacctggcggcagcgcaaaagatg

SEQ ID NO: 18964 - DNA, 103 bp, Artificial Sequence
  Synthetic Polynucleotide
taatacgactcactatagggttttggttggatgtcactattctaacacataacagaggagaatgtgtatgaatagtgacaacctggcggcagcgcaaaagatg

SEQ ID NO: 18965 - DNA, 103 bp, Artificial Sequence
  Synthetic Polynucleotide
taatacgactcactatagggcgtgtttttggttggatgtcactattctaaaacagaggagattagaaatgtgacatccaaacctggcggcagcgcaaaagatg

SEQ ID NO: 18966 - DNA, 103 bp, Artificial Sequence
  Synthetic Polynucleotide
taatacgactcactatagggtgaatcgtgtttttggttggatgtcactataacagaggagaatagtgatgtccaaccaaaacctggcggcagcgcaaaagatg

SEQ ID NO: 18967 - DNA, 103 bp, Artificial Sequence
  Synthetic Polynucleotide
taatacgactcactatagggatatttgaatcgtgtttttggttggatgtcaacagaggagagacatcatgccaaaaacaaacctggcggcagcgcaaaagatg

SEQ ID NO: 18968 - DNA, 103 bp, Artificial Sequence
  Synthetic Polynucleotide
taatacgactcactatagggacacaatatttgaatcgtgtttttggttggaacagaggagaccaaccatgaacacgattaacctggcggcagcgcaaaagatg

SEQ ID NO: 18969 - DNA, 103 bp, Artificial Sequence
  Synthetic Polynucleotide
taatacgactcactataggggcggcacacaatatttgaatcgtgtttttgaacagaggagacaaaaaatggattcaaataacctggcggcagcgcaaaagatg

SEQ ID NO: 18970 - DNA, 103 bp, Artificial Sequence
  Synthetic Polynucleotide
taatacgactcactatagggtaaatgcggcacacaatatttgaatcgtgtaacagaggagaacacgaatgaaatattgtaacctggcggcagcgcaaaagatg

SEQ ID NO: 18971 - DNA, 103 bp, Artificial Sequence
  Synthetic Polynucleotide
taatacgactcactatagggtgtggtaaatgcggcacacaatatttgaataacagaggagaattcaaatgttgtgtgccaacctggcggcagcgcaaaagatg

SEQ ID NO: 18972 - DNA, 103 bp, Artificial Sequence
  Synthetic Polynucleotide
taatacgactcactatagggtccagcctcatctgccaggtctactgctggaacagaggagaccagcaatggacctggcaaacctggcggcagcgcaaaagatg

SEQ ID NO: 18973 - DNA, 103 bp, Artificial Sequence
  Synthetic Polynucleotide
taatacgactcactatagggggccttgtggtaaatgcggcacacaatattaacagaggagaaatattatgtgccgcattaacctggcggcagcgcaaaagatg

SEQ ID NO: 18974 - DNA, 103 bp, Artificial Sequence
  Synthetic Polynucleotide
taatacgactcactatagggtgtttggccttgtggtaaatgcggcacacaaacagaggagatgtgtgatgcatttaccaaacctggcggcagcgcaaaagatg

SEQ ID NO: 18975 - DNA, 103 bp, Artificial Sequence
  Synthetic Polynucleotide
taatacgactcactatagggttatatgtttggccttgtggtaaatgcggcaacagaggagagccgcaatgaccacaaggaacctggcggcagcgcaaaagatg

SEQ ID NO: 18976 - DNA, 103 bp, Artificial Sequence
  Synthetic Polynucleotide
taatacgactcactatagggtgcttttatatgtttggccttgtggtaaataacagaggagaatttacatgaaggccaaaaacctggcggcagcgcaaaagatg

SEQ ID NO: 18977 - DNA, 103 bp, Artificial Sequence
  Synthetic Polynucleotide
taatacgactcactatagggcaccatgcttttatatgtttggccttgtggaacagaggagaccacaaatgcaaacatataacctggcggcagcgcaaaagatg

SEQ ID NO: 18978 - DNA, 103 bp, Artificial Sequence
  Synthetic Polynucleotide
taatacgactcactataggggaggacaccatgcttttatatgtttggcctaacagaggagaaggccaatgatataaaagaacctggcggcagcgcaaaagatg

SEQ ID NO: 18979 - DNA, 103 bp, Artificial Sequence
  Synthetic Polynucleotide
taatacgactcactatagggtgggcgaggacaccatgcttttatatgtttaacagaggagaaaacatatgaaagcatggaacctggcggcagcgcaaaagatg

SEQ ID NO: 18980 - DNA, 103 bp, Artificial Sequence
  Synthetic Polynucleotide
taatacgactcactatagggcttggtgggcgaggacaccatgcttttataaacagaggagatataaaatgatggtgtccaacctggcggcagcgcaaaagatg

SEQ ID NO: 18981 - DNA, 103 bp, Artificial Sequence
  Synthetic Polynucleotide
taatacgactcactatagggcagcccttggtgggcgaggacaccatgcttaacagaggagaaagcatatggtcctcgccaacctggcggcagcgcaaaagatg

SEQ ID NO: 18982 - DNA, 103 bp, Artificial Sequence
  Synthetic Polynucleotide
taatacgactcactatagggggcaacagcccttggtgggcgaggacaccaaacagaggagatggtgtatgcgcccaccaaacctggcggcagcgcaaaagatg

SEQ ID NO: 18983 - DNA, 103 bp, Artificial Sequence
  Synthetic Polynucleotide
taatacgactcactataggggaatgtccagcctcatctgccaggtctactaacagaggagaagtagaatgggcagatgaaacctggcggcagcgcaaaagatg

SEQ ID NO: 18984 - DNA, 103 bp, Artificial Sequence
  Synthetic Polynucleotide
taatacgactcactatagggtgataggcaacagcccttggtgggcgaggaaacagaggagatcctcgatgaccaagggcaacctggcggcagcgcaaaagatg

SEQ ID NO: 18985 - DNA, 103 bp, Artificial Sequence
  Synthetic Polynucleotide
taatacgactcactatagggtgtgttgataggcaacagcccttggtgggcaacagaggagagcccacatggggctgttgaacctggcggcagcgcaaaagatg

SEQ ID NO: 18986 - DNA, 103 bp, Artificial Sequence
  Synthetic Polynucleotide
taatacgactcactataggggtgtgtgtgttgataggcaacagcccttggaacagaggagaccaaggatggttgcctataacctggcggcagcgcaaaagatg

SEQ ID NO: 18987 - DNA, 103 bp, Artificial Sequence
  Synthetic Polynucleotide
taatacgactcactataggggttgagtgtgtgtgttgataggcaacagccaacagaggagaggctgtatgctatcaacaaacctggcggcagcgcaaaagatg

SEQ ID NO: 18988 - DNA, 103 bp, Artificial Sequence
  Synthetic Polynucleotide
taatacgactcactatagggaattggttgagtgtgtgtgttgataggcaaaacagaggagattgcctatgaacacacacaacctggcggcagcgcaaaagatg

SEQ ID NO: 18989 - DNA, 103 bp, Artificial Sequence
  Synthetic Polynucleotide
taatacgactcactatagggtatgtaattggttgagtgtgtgtgttgataaacagaggagatatcaaatgacacactcaaacctggcggcagcgcaaaagatg

SEQ ID NO: 18990 - DNA, 103 bp, Artificial Sequence
  Synthetic Polynucleotide
taatacgactcactataggggatggtatgtaattggttgagtgtgtgtgtaacagaggagaacacacatgctcaaccaaaacctggcggcagcgcaaaagatg

SEQ ID NO: 18991 - DNA, 103 bp, Artificial Sequence
  Synthetic Polynucleotide
taatacgactcactatagggcattggatggtatgtaattggttgagtgtgaacagaggagacacactatgccaattacaaacctggcggcagcgcaaaagatg

SEQ ID NO: 18992 - DNA, 103 bp, Artificial Sequence
  Synthetic Polynucleotide
taatacgactcactatagggctcaccattggatggtatgtaattggttgaaacagaggagatcaaccatgtacataccaaacctggcggcagcgcaaaagatg

SEQ ID NO: 18993 - DNA, 103 bp, Artificial Sequence
  Synthetic Polynucleotide
taatacgactcactataggggtggcctcaccattggatggtatgtaattgaacagaggagacaattaatgaccatccaaaacctggcggcagcgcaaaagatg

SEQ ID NO: 18994 - DNA, 103 bp, Artificial Sequence
  Synthetic Polynucleotide
taatacgactcactataggggtggggaatgtccagcctcatctgccaggtaacagaggagaacctggatgatgaggctgaacctggcggcagcgcaaaagatg

SEQ ID NO: 18995 - DNA, 103 bp, Artificial Sequence
  Synthetic Polynucleotide
taatacgactcactataggggagttgtggcctcaccattggatggtatgtaacagaggagaacatacatgccaatggtgaacctggcggcagcgcaaaagatg

SEQ ID NO: 18996 - DNA, 103 bp, Artificial Sequence
  Synthetic Polynucleotide
taatacgactcactatagggaatctgagttgtggcctcaccattggatggaacagaggagaccatccatgggtgaggccaacctggcggcagcgcaaaagatg

SEQ ID NO: 18997 - DNA, 103 bp, Artificial Sequence
  Synthetic Polynucleotide
taatacgactcactataggggttttaatctgagttgtggcctcaccattgaacagaggagacaatggatgggccacaacaacctggcggcagcgcaaaagatg

SEQ ID NO: 18998 - DNA, 103 bp, Artificial Sequence
  Synthetic Polynucleotide
taatacgactcactataggggtctggttttaatctgagttgtggcctcacaacagaggagagtgaggatgcaactcagaaacctggcggcagcgcaaaagatg

SEQ ID NO: 18999 - DNA, 103 bp, Artificial Sequence
  Synthetic Polynucleotide
taatacgactcactatagggatcaggtctggttttaatctgagttgtggcaacagaggagagccacaatgcagattaaaaacctggcggcagcgcaaaagatg

SEQ ID NO: 19000 - DNA, 103 bp, Artificial Sequence
  Synthetic Polynucleotide
taatacgactcactatagggaaaacatcaggtctggttttaatctgagttaacagaggagaaactcaatgtaaaaccagaacctggcggcagcgcaaaagatg

SEQ ID NO: 19001 - DNA, 103 bp, Artificial Sequence
  Synthetic Polynucleotide
taatacgactcactatagggcggtaaaaacatcaggtctggttttaatctaacagaggagaagattaatgccagacctgaacctggcggcagcgcaaaagatg

SEQ ID NO: 19002 - DNA, 103 bp, Artificial Sequence
  Synthetic Polynucleotide
taatacgactcactatagggtgtaacggtaaaaacatcaggtctggttttaacagaggagaaaaaccatgcctgatgttaacctggcggcagcgcaaaagatg

SEQ ID NO: 19003 - DNA, 103 bp, Artificial Sequence
  Synthetic Polynucleotide
taatacgactcactatagggacgtttgtaacggtaaaaacatcaggtctgaacagaggagacagaccatgtgtttttacaacctggcggcagcgcaaaagatg

SEQ ID NO: 19004 - DNA, 103 bp, Artificial Sequence
  Synthetic Polynucleotide
taatacgactcactataggggtccgacgtttgtaacggtaaaaacatcagaacagaggagactgatgatgttaccgttaaacctggcggcagcgcaaaagatg

SEQ ID NO: 19005 - DNA, 103 bp, Artificial Sequence
  Synthetic Polynucleotide
taatacgactcactatagggcgccagtggggaatgtccagcctcatctgcaacagaggagagcagatatggctggacataacctggcggcagcgcaaaagatg

SEQ ID NO: 19006 - DNA, 103 bp, Artificial Sequence
  Synthetic Polynucleotide
taatacgactcactatagggagatggtccgacgtttgtaacggtaaaaacaacagaggagagtttttatggttacaaacaacctggcggcagcgcaaaagatg

SEQ ID NO: 19007 - DNA, 103 bp, Artificial Sequence
  Synthetic Polynucleotide
taatacgactcactatagggatactagatggtccgacgtttgtaacggtaaacagaggagataccgtatgaaacgtcggaacctggcggcagcgcaaaagatg

SEQ ID NO: 19008 - DNA, 103 bp, Artificial Sequence
  Synthetic Polynucleotide
taatacgactcactatagggcaaacatactagatggtccgacgtttgtaaaacagaggagattacaaatgtcggaccataacctggcggcagcgcaaaagatg

SEQ ID NO: 19009 - DNA, 103 bp, Artificial Sequence
  Synthetic Polynucleotide
taatacgactcactatagggatgtacaaacatactagatggtccgacgttaacagaggagaaacgtcatgccatctagtaacctggcggcagcgcaaaagatg

SEQ ID NO: 19010 - DNA, 103 bp, Artificial Sequence
  Synthetic Polynucleotide
taatacgactcactatagggcccacatgtacaaacatactagatggtccgaacagaggagacggaccatgtagtatgttaacctggcggcagcgcaaaagatg

SEQ ID NO: 19011 - DNA, 103 bp, Artificial Sequence
  Synthetic Polynucleotide
taatacgactcactatagggagttacccacatgtacaaacatactagatgaacagaggagacatctaatgtgtttgtacaacctggcggcagcgcaaaagatg

SEQ ID NO: 19012 - DNA, 103 bp, Artificial Sequence
  Synthetic Polynucleotide
taatacgactcactataggggattaagttacccacatgtacaaacatactaacagaggagaagtatgatggtacatgtgaacctggcggcagcgcaaaagatg

SEQ ID NO: 19013 - DNA, 103 bp, Artificial Sequence
  Synthetic Polynucleotide
taatacgactcactatagggctatagattaagttacccacatgtacaaacaacagaggagagtttgtatgtgtgggtaaaacctggcggcagcgcaaaagatg

SEQ ID NO: 19014 - DNA, 103 bp, Artificial Sequence
  Synthetic Polynucleotide
taatacgactcactataggggatttctatagattaagttacccacatgtaaacagaggagatacatgatggtaacttaaaacctggcggcagcgcaaaagatg

SEQ ID NO: 19015 - DNA, 103 bp, Artificial Sequence
  Synthetic Polynucleotide
taatacgactcactatagggatgaagatttctatagattaagttacccacaacagaggagagtgggtatgttaatctataacctggcggcagcgcaaaagatg

SEQ ID NO: 19016 - DNA, 103 bp, Artificial Sequence
  Synthetic Polynucleotide
taatacgactcactatagggactgtcgccagtggggaatgtccagcctcaaacagaggagatgaggcatgacattccccaacctggcggcagcgcaaaagatg

SEQ ID NO: 19017 - DNA, 103 bp, Artificial Sequence
  Synthetic Polynucleotide
taatacgactcactatagggaagagatgaagatttctatagattaagttaaacagaggagataacttatgctatagaaaaacctggcggcagcgcaaaagatg

SEQ ID NO: 19018 - DNA, 103 bp, Artificial Sequence
  Synthetic Polynucleotide
taatacgactcactatagggaattaaagagatgaagatttctatagattaaacagaggagataatctatggaaatcttcaacctggcggcagcgcaaaagatg

SEQ ID NO: 19019 - DNA, 103 bp, Artificial Sequence
  Synthetic Polynucleotide
taatacgactcactatagggatcagaattaaagagatgaagatttctataaacagaggagatatagaatgcttcatctcaacctggcggcagcgcaaaagatg

SEQ ID NO: 19020 - DNA, 103 bp, Artificial Sequence
  Synthetic Polynucleotide
taatacgactcactatagggtcaagatcagaattaaagagatgaagatttaacagaggagaaaatctatgtctctttaaaacctggcggcagcgcaaaagatg

SEQ ID NO: 19021 - DNA, 103 bp, Artificial Sequence
  Synthetic Polynucleotide
taatacgactcactatagggaatcatcaagatcagaattaaagagatgaaaacagaggagattcatcatgttaattctgaacctggcggcagcgcaaaagatg

SEQ ID NO: 19022 - DNA, 103 bp, Artificial Sequence
  Synthetic Polynucleotide
taatacgactcactatagggaatagaatcatcaagatcagaattaaagagaacagaggagactctttatgtctgatcttaacctggcggcagcgcaaaagatg

SEQ ID NO: 19023 - DNA, 103 bp, Artificial Sequence
  Synthetic Polynucleotide
taatacgactcactatagggacaagaatagaatcatcaagatcagaattaaacagaggagataattcatgtcttgatgaaacctggcggcagcgcaaaagatg

SEQ ID NO: 19024 - DNA, 103 bp, Artificial Sequence
  Synthetic Polynucleotide
taatacgactcactatagggatgatacaagaatagaatcatcaagatcagaacagaggagactgatcatgatgattctaaacctggcggcagcgcaaaagatg

SEQ ID NO: 19025 - DNA, 103 bp, Artificial Sequence
  Synthetic Polynucleotide
taatacgactcactatagggggagtatgatacaagaatagaatcatcaagaacagaggagacttgatatgtctattcttaacctggcggcagcgcaaaagatg

SEQ ID NO: 19026 - DNA, 103 bp, Artificial Sequence
  Synthetic Polynucleotide
taatacgactcactatagggtcactggagtatgatacaagaatagaatcaaacagaggagatgattcatgtcttgtatcaacctggcggcagcgcaaaagatg

SEQ ID NO: 19027 - DNA, 103 bp, Artificial Sequence
  Synthetic Polynucleotide
taatacgactcactatagggggaccactgtcgccagtggggaatgtccagaacagaggagactggacatgccccactggaacctggcggcagcgcaaaagatg

SEQ ID NO: 19028 - DNA, 103 bp, Artificial Sequence
  Synthetic Polynucleotide
taatacgactcactatagggttagatcactggagtatgatacaagaatagaacagaggagactattcatgtatcatactaacctggcggcagcgcaaaagatg

SEQ ID NO: 19029 - DNA, 103 bp, Artificial Sequence
  Synthetic Polynucleotide
taatacgactcactatagggtatgattagatcactggagtatgatacaagaacagaggagacttgtaatgtactccagtaacctggcggcagcgcaaaagatg

SEQ ID NO: 19030 - DNA, 103 bp, Artificial Sequence
  Synthetic Polynucleotide
taatacgactcactatagggcgatatatgattagatcactggagtatgataacagaggagaatcataatgcagtgatctaacctggcggcagcgcaaaagatg

SEQ ID NO: 19031 - DNA, 103 bp, Artificial Sequence
  Synthetic Polynucleotide
taatacgactcactatagggttgttcgatatatgattagatcactggagtaacagaggagaactccaatgatctaatcaaacctggcggcagcgcaaaagatg

SEQ ID NO: 19032 - DNA, 103 bp, Artificial Sequence
  Synthetic Polynucleotide
taatacgactcactatagggagtgtttgttcgatatatgattagatcactaacagaggagaagtgatatgatcatatataacctggcggcagcgcaaaagatg

SEQ ID NO: 19033 - DNA, 103 bp, Artificial Sequence
  Synthetic Polynucleotide
taatacgactcactatagggccttcagtgtttgttcgatatatgattagaaacagaggagatctaatatgatatcgaacaacctggcggcagcgcaaaagatg

SEQ ID NO: 19034 - DNA, 103 bp, Artificial Sequence
  Synthetic Polynucleotide
taatacgactcactatagggcattaccttcagtgtttgttcgatatatgaaacagaggagatcatatatggaacaaacaaacctggcggcagcgcaaaagatg

SEQ ID NO: 19035 - DNA, 103 bp, Artificial Sequence
  Synthetic Polynucleotide
taatacgactcactatagggcacatcattaccttcagtgtttgttcgataaacagaggagatatcgaatgaacactgaaaacctggcggcagcgcaaaagatg

SEQ ID NO: 19036 - DNA, 103 bp, Artificial Sequence
  Synthetic Polynucleotide
taatacgactcactataggggggatcacatcattaccttcagtgtttgttaacagaggagaaacaaaatgtgaaggtaaaacctggcggcagcgcaaaagatg

SEQ ID NO: 19037 - DNA, 103 bp, Artificial Sequence
  Synthetic Polynucleotide
taatacgactcactatagggaattagggatcacatcattaccttcagtgtaacagaggagaacactgatggtaatgatgaacctggcggcagcgcaaaagatg

SEQ ID NO: 19038 - DNA, 103 bp, Artificial Sequence
  Synthetic Polynucleotide
taatacgactcactatagggaggctggaccactgtcgccagtggggaatgaacagaggagacattccatgctggcgacaaacctggcggcagcgcaaaagatg

SEQ ID NO: 19039 - DNA, 103 bp, Artificial Sequence
  Synthetic Polynucleotide
taatacgactcactatagggatcacaattagggatcacatcattaccttcaacagaggagagaaggtatggatgtgatcaacctggcggcagcgcaaaagatg

SEQ ID NO: 19040 - DNA, 103 bp, Artificial Sequence
  Synthetic Polynucleotide
taatacgactcactataggggtgcaatcacaattagggatcacatcattaaacagaggagataatgaatggatccctaaaacctggcggcagcgcaaaagatg

SEQ ID NO: 19041 - DNA, 103 bp, Artificial Sequence
  Synthetic Polynucleotide
taatacgactcactatagggattcagtgcaatcacaattagggatcacataacagaggagaatgtgaatgctaattgtgaacctggcggcagcgcaaaagatg

SEQ ID NO: 19042 - DNA, 103 bp, Artificial Sequence
  Synthetic Polynucleotide
taatacgactcactatagggtgtacattcagtgcaatcacaattagggataacagaggagaatccctatgtgtgattgcaacctggcggcagcgcaaaagatg

SEQ ID NO: 19043 - DNA, 103 bp, Artificial Sequence
  Synthetic Polynucleotide
taatacgactcactatagggtaatatgtacattcagtgcaatcacaattaaacagaggagataattgatgttgcactgaaacctggcggcagcgcaaaagatg

SEQ ID NO: 19044 - DNA, 103 bp, Artificial Sequence
  Synthetic Polynucleotide
taatacgactcactatagggggcagtaatatgtacattcagtgcaatcacaacagaggagagtgattatgctgaatgtaaacctggcggcagcgcaaaagatg

SEQ ID NO: 19045 - DNA, 103 bp, Artificial Sequence
  Synthetic Polynucleotide
taatacgactcactataggggtggtggcagtaatatgtacattcagtgcaaacagaggagatgcactatgtgtacatataacctggcggcagcgcaaaagatg

SEQ ID NO: 19046 - DNA, 103 bp, Artificial Sequence
  Synthetic Polynucleotide
taatacgactcactatagggtctttgtggtggcagtaatatgtacattcaaacagaggagatgaatgatgatattactgaacctggcggcagcgcaaaagatg

SEQ ID NO: 19047 - DNA, 103 bp, Artificial Sequence
  Synthetic Polynucleotide
taatacgactcactatagggacctatctttgtggtggcagtaatatgtacaacagaggagagtacatatgactgccaccaacctggcggcagcgcaaaagatg

SEQ ID NO: 19048 - DNA, 103 bp, Artificial Sequence
  Synthetic Polynucleotide
taatacgactcactatagggaaaatacctatctttgtggtggcagtaataaacagaggagatattacatgcaccacaaaaacctggcggcagcgcaaaagatg

SEQ ID NO: 19049 - DNA, 103 bp, Artificial Sequence
  Synthetic Polynucleotide
taatacgactcactatagggcacgcaggctggaccactgtcgccagtgggaacagaggagacccactatggacagtggtaacctggcggcagcgcaaaagatg

SEQ ID NO: 19050 - DNA, 103 bp, Artificial Sequence
  Synthetic Polynucleotide
taatacgactcactatagggataggaaaatacctatctttgtggtggcagaacagaggagactgccaatgcaaagatagaacctggcggcagcgcaaaagatg

SEQ ID NO: 19051 - DNA, 103 bp, Artificial Sequence
  Synthetic Polynucleotide
taatacgactcactatagggctctgataggaaaatacctatctttgtggtaacagaggagaaccacaatgataggtattaacctggcggcagcgcaaaagatg

SEQ ID NO: 19052 - DNA, 103 bp, Artificial Sequence
  Synthetic Polynucleotide
taatacgactcactatagggagtaactctgataggaaaatacctatctttaacagaggagaaaagatatgtattttcctaacctggcggcagcgcaaaagatg

SEQ ID NO: 19053 - DNA, 103 bp, Artificial Sequence
  Synthetic Polynucleotide
taatacgactcactatagggtgtgcagtaactctgataggaaaatacctaaacagaggagataggtaatgtcctatcagaacctggcggcagcgcaaaagatg

SEQ ID NO: 19054 - DNA, 103 bp, Artificial Sequence
  Synthetic Polynucleotide
taatacgactcactatagggaatcatgtgcagtaactctgataggaaaataacagaggagaattttcatgtcagagttaaacctggcggcagcgcaaaagatg

SEQ ID NO: 19055 - DNA, 103 bp, Artificial Sequence
  Synthetic Polynucleotide
taatacgactcactatagggataccaatcatgtgcagtaactctgataggaacagaggagacctatcatggttactgcaaacctggcggcagcgcaaaagatg

SEQ ID NO: 19056 - DNA, 103 bp, Artificial Sequence
  Synthetic Polynucleotide
taatacgactcactatagggatctcataccaatcatgtgcagtaactctgaacagaggagacagagtatgtgcacatgaaacctggcggcagcgcaaaagatg

SEQ ID NO: 19057 - DNA, 103 bp, Artificial Sequence
  Synthetic Polynucleotide
taatacgactcactatagggcttgaatctcataccaatcatgtgcagtaaaacagaggagattactgatgatgattggtaacctggcggcagcgcaaaagatg

SEQ ID NO: 19058 - DNA, 103 bp, Artificial Sequence
  Synthetic Polynucleotide
taatacgactcactatagggtgattcttgaatctcataccaatcatgtgcaacagaggagagcacatatgtggtatgagaacctggcggcagcgcaaaagatg

SEQ ID NO: 19059 - DNA, 103 bp, Artificial Sequence
  Synthetic Polynucleotide
taatacgactcactatagggtattctgattcttgaatctcataccaatcaaacagaggagatgattgatgtgagattcaaacctggcggcagcgcaaaagatg

SEQ ID NO: 19060 - DNA, 103 bp, Artificial Sequence
  Synthetic Polynucleotide
taatacgactcactataggggcagccacgcaggctggaccactgtcgccaaacagaggagatggcgaatgtggtccagcaacctggcggcagcgcaaaagatg

SEQ ID NO: 19061 - DNA, 103 bp, Artificial Sequence
  Synthetic Polynucleotide
taatacgactcactatagggggtaatattctgattcttgaatctcataccaacagaggagaggtatgatgttcaagaataacctggcggcagcgcaaaagatg

SEQ ID NO: 19062 - DNA, 103 bp, Artificial Sequence
  Synthetic Polynucleotide
taatacgactcactatagggttttgggtaatattctgattcttgaatctcaacagaggagagagattatggaatcagaaaacctggcggcagcgcaaaagatg

SEQ ID NO: 19063 - DNA, 103 bp, Artificial Sequence
  Synthetic Polynucleotide
taatacgactcactatagggatatgttttgggtaatattctgattcttgaaacagaggagatcaagaatgagaatattaaacctggcggcagcgcaaaagatg

SEQ ID NO: 19064 - DNA, 103 bp, Artificial Sequence
  Synthetic Polynucleotide
taatacgactcactatagggattggatatgttttgggtaatattctgattaacagaggagaaatcagatgattacccaaaacctggcggcagcgcaaaagatg

SEQ ID NO: 19065 - DNA, 103 bp, Artificial Sequence
  Synthetic Polynucleotide
taatacgactcactatagggattatattggatatgttttgggtaatattcaacagaggagagaatatatgccaaaacataacctggcggcagcgcaaaagatg

SEQ ID NO: 19066 - DNA, 103 bp, Artificial Sequence
  Synthetic Polynucleotide
taatacgactcactatagggaggagattatattggatatgttttgggtaaaacagaggagattacccatgacatatccaaacctggcggcagcgcaaaagatg

SEQ ID NO: 19067 - DNA, 103 bp, Artificial Sequence
  Synthetic Polynucleotide
taatacgactcactatagggcaatcaggagattatattggatatgttttgaacagaggagacaaaacatgtccaatataaacctggcggcagcgcaaaagatg

SEQ ID NO: 19068 - DNA, 103 bp, Artificial Sequence
  Synthetic Polynucleotide
taatacgactcactatagggctctccaatcaggagattatattggatatgaacagaggagacatatcatgtataatctcaacctggcggcagcgcaaaagatg

SEQ ID NO: 19069 - DNA, 103 bp, Artificial Sequence
  Synthetic Polynucleotide
taatacgactcactatagggggaccctctccaatcaggagattatattggaacagaggagaccaataatgtctcctgataacctggcggcagcgcaaaagatg

SEQ ID NO: 19070 - DNA, 103 bp, Artificial Sequence
  Synthetic Polynucleotide
taatacgactcactatagggcacaaggaccctctccaatcaggagattataacagaggagaataatcatgtgattggagaacctggcggcagcgcaaaagatg

SEQ ID NO: 19071 - DNA, 103 bp, Artificial Sequence
  Synthetic Polynucleotide
taatacgactcactatagggataacagagtacaacaccgcatgggtggagaacagaggagactccacatgtgcggtgttaacctggcggcagcgcaaaagatg

SEQ ID NO: 19072 - DNA, 103 bp, Artificial Sequence
  Synthetic Polynucleotide
taatacgactcactatagggagcaggcagccacgcaggctggaccactgtaacagaggagaacagtgatgcagcctgcgaacctggcggcagcgcaaaagatg

SEQ ID NO: 19073 - DNA, 103 bp, Artificial Sequence
  Synthetic Polynucleotide
taatacgactcactatagggtggttcacaaggaccctctccaatcaggagaacagaggagactcctgatgggagagggtaacctggcggcagcgcaaaagatg

SEQ ID NO: 19074 - DNA, 103 bp, Artificial Sequence
  Synthetic Polynucleotide
taatacgactcactatagggtctcctggttcacaaggaccctctccaatcaacagaggagagattggatggggtccttgaacctggcggcagcgcaaaagatg

SEQ ID NO: 19075 - DNA, 103 bp, Artificial Sequence
  Synthetic Polynucleotide
taatacgactcactatagggcacaatctcctggttcacaaggaccctctcaacagaggagagagaggatgcttgtgaacaacctggcggcagcgcaaaagatg

SEQ ID NO: 19076 - DNA, 103 bp, Artificial Sequence
  Synthetic Polynucleotide
taatacgactcactatagggtcctccacaatctcctggttcacaaggaccaacagaggagaggtcctatggaaccaggaaacctggcggcagcgcaaaagatg

SEQ ID NO: 19077 - DNA, 103 bp, Artificial Sequence
  Synthetic Polynucleotide
taatacgactcactatagggagttttcctccacaatctcctggttcacaaaacagaggagattgtgaatgaggagattgaacctggcggcagcgcaaaagatg

SEQ ID NO: 19078 - DNA, 103 bp, Artificial Sequence
  Synthetic Polynucleotide
taatacgactcactatagggacaatagttttcctccacaatctcctggttaacagaggagaaaccagatgattgtggagaacctggcggcagcgcaaaagatg

SEQ ID NO: 19079 - DNA, 103 bp, Artificial Sequence
  Synthetic Polynucleotide
taatacgactcactatagggtttacacaatagttttcctccacaatctccaacagaggagaggagatatgggaggaaaaaacctggcggcagcgcaaaagatg

SEQ ID NO: 19080 - DNA, 103 bp, Artificial Sequence
  Synthetic Polynucleotide
taatacgactcactatagggccatgtttacacaatagttttcctccacaaaacagaggagattgtggatgaaaactattaacctggcggcagcgcaaaagatg

SEQ ID NO: 19081 - DNA, 103 bp, Artificial Sequence
  Synthetic Polynucleotide
taatacgactcactatagggtaacaccatgtttacacaatagttttcctcaacagaggagagaggaaatgtattgtgtaaacctggcggcagcgcaaaagatg

SEQ ID NO: 19082 - DNA, 103 bp, Artificial Sequence
  Synthetic Polynucleotide
taatacgactcactatagggacctataacaccatgtttacacaatagtttaacagaggagaaaactaatgtgtaaacataacctggcggcagcgcaaaagatg

SEQ ID NO: 19083 - DNA, 103 bp, Artificial Sequence
  Synthetic Polynucleotide
taatacgactcactataggggggtgagcaggcagccacgcaggctggaccaacagaggagaggtccaatgtgcgtggctaacctggcggcagcgcaaaagatg

SEQ ID NO: 19084 - DNA, 103 bp, Artificial Sequence
  Synthetic Polynucleotide
taatacgactcactatagggatcatacctataacaccatgtttacacaataacagaggagaattgtgatgacatggtgtaacctggcggcagcgcaaaagatg

SEQ ID NO: 19085 - DNA, 103 bp, Artificial Sequence
  Synthetic Polynucleotide
taatacgactcactatagggctgtaatcatacctataacaccatgtttacaacagaggagagtaaacatggtgttatagaacctggcggcagcgcaaaagatg

SEQ ID NO: 19086 - DNA, 103 bp, Artificial Sequence
  Synthetic Polynucleotide
taatacgactcactatagggtccagctgtaatcatacctataacaccatgaacagaggagacatggtatgataggtatgaacctggcggcagcgcaaaagatg

SEQ ID NO: 19087 - DNA, 103 bp, Artificial Sequence
  Synthetic Polynucleotide
taatacgactcactatagggtcacctccagctgtaatcatacctataacaaacagaggagatgttatatgtatgattacaacctggcggcagcgcaaaagatg

SEQ ID NO: 19088 - DNA, 103 bp, Artificial Sequence
  Synthetic Polynucleotide
taatacgactcactataggggaccttcacctccagctgtaatcatacctaaacagaggagataggtaatgttacagctgaacctggcggcagcgcaaaagatg

SEQ ID NO: 19089 - DNA, 103 bp, Artificial Sequence
  Synthetic Polynucleotide
taatacgactcactatagggaacgtgaccttcacctccagctgtaatcataacagaggagaatgattatggctggaggtaacctggcggcagcgcaaaagatg

SEQ ID NO: 19090 - DNA, 103 bp, Artificial Sequence
  Synthetic Polynucleotide
taatacgactcactatagggaaagcaacgtgaccttcacctccagctgtaaacagaggagatacagcatgaggtgaaggaacctggcggcagcgcaaaagatg

SEQ ID NO: 19091 - DNA, 103 bp, Artificial Sequence
  Synthetic Polynucleotide
taatacgactcactatagggcaataaaagcaacgtgaccttcacctccagaacagaggagactggagatgaaggtcacgaacctggcggcagcgcaaaagatg

SEQ ID NO: 19092 - DNA, 103 bp, Artificial Sequence
  Synthetic Polynucleotide
taatacgactcactatagggcaggtcaataaaagcaacgtgaccttcaccaacagaggagaggtgaaatgcacgttgctaacctggcggcagcgcaaaagatg

SEQ ID NO: 19093 - DNA, 103 bp, Artificial Sequence
  Synthetic Polynucleotide
taatacgactcactatagggtttctcaggtcaataaaagcaacgtgacctaacagaggagaaggtcaatgtgcttttataacctggcggcagcgcaaaagatg

SEQ ID NO: 19094 - DNA, 103 bp, Artificial Sequence
  Synthetic Polynucleotide
taatacgactcactatagggaagaagggtgagcaggcagccacgcaggctaacagaggagaagcctgatgggctgcctgaacctggcggcagcgcaaaagatg

SEQ ID NO: 19095 - DNA, 103 bp, Artificial Sequence
  Synthetic Polynucleotide
taatacgactcactatagggggaattttctcaggtcaataaaagcaacgtaacagaggagaacgttgatgttattgaccaacctggcggcagcgcaaaagatg

SEQ ID NO: 19096 - DNA, 103 bp, Artificial Sequence
  Synthetic Polynucleotide
taatacgactcactatagggacactggaattttctcaggtcaataaaagcaacagaggagagcttttatggacctgagaaacctggcggcagcgcaaaagatg

SEQ ID NO: 19097 - DNA, 103 bp, Artificial Sequence
  Synthetic Polynucleotide
taatacgactcactatagggtcagcacactggaattttctcaggtcaataaacagaggagatattgaatggagaaaattaacctggcggcagcgcaaaagatg

SEQ ID NO: 19098 - DNA, 103 bp, Artificial Sequence
  Synthetic Polynucleotide
taatacgactcactataggggctcctcagcacactggaattttctcaggtaacagaggagaacctgaatgaattccagtaacctggcggcagcgcaaaagatg

SEQ ID NO: 19099 - DNA, 103 bp, Artificial Sequence
  Synthetic Polynucleotide
taatacgactcactatagggcccttgctcctcagcacactggaattttctaacagaggagaagaaaaatgcagtgtgctaacctggcggcagcgcaaaagatg

SEQ ID NO: 19100 - DNA, 103 bp, Artificial Sequence
  Synthetic Polynucleotide
taatacgactcactataggggataacccttgctcctcagcacactggaataacagaggagaattccaatgtgctgaggaaacctggcggcagcgcaaaagatg

SEQ ID NO: 19101 - DNA, 103 bp, Artificial Sequence
  Synthetic Polynucleotide
taatacgactcactatagggaatcagataacccttgctcctcagcacactaacagaggagaagtgtgatgaggagcaagaacctggcggcagcgcaaaagatg

SEQ ID NO: 19102 - DNA, 103 bp, Artificial Sequence
  Synthetic Polynucleotide
taatacgactcactatagggcacataatcagataacccttgctcctcagcaacagaggagagctgagatgcaagggttaaacctggcggcagcgcaaaagatg

SEQ ID NO: 19103 - DNA, 103 bp, Artificial Sequence
  Synthetic Polynucleotide
taatacgactcactatagggtgttccacataatcagataacccttgctccaacagaggagaggagcaatggttatctgaaacctggcggcagcgcaaaagatg

SEQ ID NO: 19104 - DNA, 103 bp, Artificial Sequence
  Synthetic Polynucleotide
taatacgactcactatagggcaagatgttccacataatcagataacccttaacagaggagaaagggtatgctgattatgaacctggcggcagcgcaaaagatg

SEQ ID NO: 19105 - DNA, 103 bp, Artificial Sequence
  Synthetic Polynucleotide
taatacgactcactatagggcacccaagaagggtgagcaggcagccacgcaacagaggagagcgtggatgcctgctcacaacctggcggcagcgcaaaagatg

SEQ ID NO: 19106 - DNA, 103 bp, Artificial Sequence
  Synthetic Polynucleotide
taatacgactcactatagggttgaccaagatgttccacataatcagataaaacagaggagattatctatgtatgtggaaaacctggcggcagcgcaaaagatg

SEQ ID NO: 19107 - DNA, 103 bp, Artificial Sequence
  Synthetic Polynucleotide
taatacgactcactatagggaagacttgaccaagatgttccacataatcaaacagaggagatgattaatgggaacatctaacctggcggcagcgcaaaagatg

SEQ ID NO: 19108 - DNA, 103 bp, Artificial Sequence
  Synthetic Polynucleotide
taatacgactcactatagggcaccaaagacttgaccaagatgttccacataacagaggagaatgtggatgatcttggtcaacctggcggcagcgcaaaagatg

SEQ ID NO: 19109 - DNA, 103 bp, Artificial Sequence
  Synthetic Polynucleotide
taatacgactcactataggggcctacaccaaagacttgaccaagatgttcaacagaggagagaacatatgggtcaagtcaacctggcggcagcgcaaaagatg

SEQ ID NO: 19110 - DNA, 103 bp, Artificial Sequence
  Synthetic Polynucleotide
taatacgactcactatagggacgaagcctacaccaaagacttgaccaagaaacagaggagatcttggatgagtctttggaacctggcggcagcgcaaaagatg

SEQ ID NO: 19111 - DNA, 103 bp, Artificial Sequence
  Synthetic Polynucleotide
taatacgactcactatagggtgtctacgaagcctacaccaaagacttgacaacagaggagagtcaagatgttggtgtagaacctggcggcagcgcaaaagatg

SEQ ID NO: 19112 - DNA, 103 bp, Artificial Sequence
  Synthetic Polynucleotide
taatacgactcactataggggatgctgtctacgaagcctacaccaaagacaacagaggagagtctttatggtaggcttcaacctggcggcagcgcaaaagatg

SEQ ID NO: 19113 - DNA, 103 bp, Artificial Sequence
  Synthetic Polynucleotide
taatacgactcactatagggtgtttgatgctgtctacgaagcctacaccaaacagaggagatggtgtatgcttcgtagaaacctggcggcagcgcaaaagatg

SEQ ID NO: 19114 - DNA, 103 bp, Artificial Sequence
  Synthetic Polynucleotide
taatacgactcactatagggcctgttgtttgatgctgtctacgaagcctaaacagaggagataggctatgtagacagcaaacctggcggcagcgcaaaagatg

SEQ ID NO: 19115 - DNA, 103 bp, Artificial Sequence
  Synthetic Polynucleotide
taatacgactcactataggggtttacctgttgtttgatgctgtctacgaaaacagaggagattcgtaatgagcatcaaaaacctggcggcagcgcaaaagatg

SEQ ID NO: 19116 - DNA, 103 bp, Artificial Sequence
  Synthetic Polynucleotide
taatacgactcactatagggcttctcacccaagaagggtgagcaggcagcaacagaggagagctgccatgtcacccttcaacctggcggcagcgcaaaagatg

SEQ ID NO: 19117 - DNA, 103 bp, Artificial Sequence
  Synthetic Polynucleotide
taatacgactcactatagggataaagtttacctgttgtttgatgctgtctaacagaggagaagacagatgcaaacaacaaacctggcggcagcgcaaaagatg

SEQ ID NO: 19118 - DNA, 103 bp, Artificial Sequence
  Synthetic Polynucleotide
taatacgactcactatagggggttgataaagtttacctgttgtttgatgcaacagaggagagcatcaatgaacaggtaaaacctggcggcagcgcaaaagatg

SEQ ID NO: 19119 - DNA, 103 bp, Artificial Sequence
  Synthetic Polynucleotide
taatacgactcactatagggagtggggttgataaagtttacctgttgtttaacagaggagaaaacaaatggtaaactttaacctggcggcagcgcaaaagatg

SEQ ID NO: 19120 - DNA, 103 bp, Artificial Sequence
  Synthetic Polynucleotide
taatacgactcactatagggttactagtggggttgataaagtttacctgtaacagaggagaacaggtatgctttatcaaaacctggcggcagcgcaaaagatg

SEQ ID NO: 19121 - DNA, 103 bp, Artificial Sequence
  Synthetic Polynucleotide
taatacgactcactatagggcaattttactagtggggttgataaagtttaaacagaggagataaactatgtcaaccccaaacctggcggcagcgcaaaagatg

SEQ ID NO: 19122 - DNA, 103 bp, Artificial Sequence
  Synthetic Polynucleotide
taatacgactcactatagggtgaaccaattttactagtggggttgataaaaacagaggagatttatcatgcccactagtaacctggcggcagcgcaaaagatg

SEQ ID NO: 19123 - DNA, 103 bp, Artificial Sequence
  Synthetic Polynucleotide
taatacgactcactatagggacttttgaaccaattttactagtggggttgaacagaggagacaacccatgtagtaaaataacctggcggcagcgcaaaagatg

SEQ ID NO: 19124 - DNA, 103 bp, Artificial Sequence
  Synthetic Polynucleotide
taatacgactcactatagggtaatcacttttgaaccaattttactagtggaacagaggagaccactaatgaaattggttaacctggcggcagcgcaaaagatg

SEQ ID NO: 19125 - DNA, 103 bp, Artificial Sequence
  Synthetic Polynucleotide
taatacgactcactatagggccatttaatcacttttgaaccaattttactaacagaggagaagtaaaatgggttcaaaaaacctggcggcagcgcaaaagatg

SEQ ID NO: 19126 - DNA, 103 bp, Artificial Sequence
  Synthetic Polynucleotide
taatacgactcactatagggaacaaccatttaatcacttttgaaccaattaacagaggagaaattggatgaaaagtgataacctggcggcagcgcaaaagatg

SEQ ID NO: 19127 - DNA, 103 bp, Artificial Sequence
  Synthetic Polynucleotide
taatacgactcactatagggttaggcttctcacccaagaagggtgagcagaacagaggagactgctcatgcttcttgggaacctggcggcagcgcaaaagatg

SEQ ID NO: 19128 - DNA, 103 bp, Artificial Sequence
  Synthetic Polynucleotide
taatacgactcactatagggtcctcaacaaccatttaatcacttttgaacaacagaggagagttcaaatgtgattaaataacctggcggcagcgcaaaagatg

SEQ ID NO: 19129 - DNA, 103 bp, Artificial Sequence
  Synthetic Polynucleotide
taatacgactcactatagggaactatcctcaacaaccatttaatcactttaacagaggagaaaagtgatgaaatggttgaacctggcggcagcgcaaaagatg

SEQ ID NO: 19130 - DNA, 103 bp, Artificial Sequence
  Synthetic Polynucleotide
taatacgactcactataggggctgaaactatcctcaacaaccatttaatcaacagaggagagattaaatggttgttgagaacctggcggcagcgcaaaagatg

SEQ ID NO: 19131 - DNA, 103 bp, Artificial Sequence
  Synthetic Polynucleotide
taatacgactcactatagggtcatagctgaaactatcctcaacaaccattaacagaggagaaatggtatgtgaggatagaacctggcggcagcgcaaaagatg

SEQ ID NO: 19132 - DNA, 103 bp, Artificial Sequence
  Synthetic Polynucleotide
taatacgactcactatagggtattatcatagctgaaactatcctcaacaaaacagaggagattgttgatgatagtttcaaacctggcggcagcgcaaaagatg

SEQ ID NO: 19133 - DNA, 103 bp, Artificial Sequence
  Synthetic Polynucleotide
taatacgactcactatagggaccattattatcatagctgaaactatcctcaacagaggagagaggatatgttcagctataacctggcggcagcgcaaaagatg

SEQ ID NO: 19134 - DNA, 103 bp, Artificial Sequence
  Synthetic Polynucleotide
taatacgactcactatagggtccttaccattattatcatagctgaaactaaacagaggagatagtttatgctatgataaaacctggcggcagcgcaaaagatg

SEQ ID NO: 19135 - DNA, 103 bp, Artificial Sequence
  Synthetic Polynucleotide
taatacgactcactatagggactattccttaccattattatcatagctgaaacagaggagatcagctatgataataatgaacctggcggcagcgcaaaagatg

SEQ ID NO: 19136 - DNA, 103 bp, Artificial Sequence
  Synthetic Polynucleotide
taatacgactcactatagggtcagaactattccttaccattattatcataaacagaggagatatgatatgaatggtaagaacctggcggcagcgcaaaagatg

SEQ ID NO: 19137 - DNA, 103 bp, Artificial Sequence
  Synthetic Polynucleotide
taatacgactcactataggggtggatcagaactattccttaccattattaaacagaggagataataaatgtaaggaataaacctggcggcagcgcaaaagatg

SEQ ID NO: 19138 - DNA, 103 bp, Artificial Sequence
  Synthetic Polynucleotide
taatacgactcactatagggaataattaggcttctcacccaagaagggtgaacagaggagacaccctatgtgggtgagaaacctggcggcagcgcaaaagatg

SEQ ID NO: 19139 - DNA, 103 bp, Artificial Sequence
  Synthetic Polynucleotide
taatacgactcactatagggagtttgtggatcagaactattccttaccataacagaggagaatggtaatgaatagttctaacctggcggcagcgcaaaagatg

SEQ ID NO: 19140 - DNA, 103 bp, Artificial Sequence
  Synthetic Polynucleotide
taatacgactcactatagggattacagtttgtggatcagaactattccttaacagaggagaaaggaaatgttctgatccaacctggcggcagcgcaaaagatg

SEQ ID NO: 19141 - DNA, 103 bp, Artificial Sequence
  Synthetic Polynucleotide
taatacgactcactatagggtggcaattacagtttgtggatcagaactataacagaggagaatagttatgatccacaaaaacctggcggcagcgcaaaagatg

SEQ ID NO: 19142 - DNA, 103 bp, Artificial Sequence
  Synthetic Polynucleotide
taatacgactcactataggggagagtggcaattacagtttgtggatcagaaacagaggagatctgatatgcaaactgtaaacctggcggcagcgcaaaagatg

SEQ ID NO: 19143 - DNA, 103 bp, Artificial Sequence
  Synthetic Polynucleotide
taatacgactcactatagggagggtgagagtggcaattacagtttgtggaaacagaggagatccacaatgtgtaattgcaacctggcggcagcgcaaaagatg

SEQ ID NO: 19144 - DNA, 103 bp, Artificial Sequence
  Synthetic Polynucleotide
taatacgactcactatagggctagaagggtgagagtggcaattacagtttaacagaggagaaaactgatgttgccactcaacctggcggcagcgcaaaagatg

SEQ ID NO: 19145 - DNA, 103 bp, Artificial Sequence
  Synthetic Polynucleotide
taatacgactcactatagggacaacctagaagggtgagagtggcaattacaacagaggagagtaattatgactctcaccaacctggcggcagcgcaaaagatg

SEQ ID NO: 19146 - DNA, 103 bp, Artificial Sequence
  Synthetic Polynucleotide
taatacgactcactatagggcctgaacaacctagaagggtgagagtggcaaacagaggagatgccacatgcacccttctaacctggcggcagcgcaaaagatg

SEQ ID NO: 19147 - DNA, 103 bp, Artificial Sequence
  Synthetic Polynucleotide
taatacgactcactataggggtgagcctgaacaacctagaagggtgagagaacagaggagactctcaatgttctaggttaacctggcggcagcgcaaaagatg

SEQ ID NO: 19148 - DNA, 103 bp, Artificial Sequence
  Synthetic Polynucleotide
taatacgactcactatagggccatggtgagcctgaacaacctagaagggtaacagaggagaacccttatgggttgttcaaacctggcggcagcgcaaaagatg

SEQ ID NO: 19149 - DNA, 103 bp, Artificial Sequence
  Synthetic Polynucleotide
taatacgactcactatagggttgtcaataattaggcttctcacccaagaaaacagaggagattcttgatggagaagcctaacctggcggcagcgcaaaagatg

SEQ ID NO: 19150 - DNA, 103 bp, Artificial Sequence
  Synthetic Polynucleotide
taatacgactcactatagggaacctccatggtgagcctgaacaacctagaaacagaggagatctaggatgttcaggctcaacctggcggcagcgcaaaagatg

SEQ ID NO: 19151 - DNA, 103 bp, Artificial Sequence
  Synthetic Polynucleotide
taatacgactcactatagggtaagaaacctccatggtgagcctgaacaacaacagaggagagttgttatggctcaccataacctggcggcagcgcaaaagatg

SEQ ID NO: 19152 - DNA, 103 bp, Artificial Sequence
  Synthetic Polynucleotide
taatacgactcactatagggctctttaagaaacctccatggtgagcctgaaacagaggagatcaggcatgccatggaggaacctggcggcagcgcaaaagatg

SEQ ID NO: 19153 - DNA, 103 bp, Artificial Sequence
  Synthetic Polynucleotide
taatacgactcactatagggagtttctctttaagaaacctccatggtgagaacagaggagactcaccatggaggtttctaacctggcggcagcgcaaaagatg

SEQ ID NO: 19154 - DNA, 103 bp, Artificial Sequence
  Synthetic Polynucleotide
taatacgactcactatagggcacagagtttctctttaagaaacctccatgaacagaggagacatggaatgttcttaaagaacctggcggcagcgcaaaagatg

SEQ ID NO: 19155 - DNA, 103 bp, Artificial Sequence
  Synthetic Polynucleotide
taatacgactcactatagggccacgcacagagtttctctttaagaaacctaacagaggagaaggtttatgaaagagaaaaacctggcggcagcgcaaaagatg

SEQ ID NO: 19156 - DNA, 103 bp, Artificial Sequence
  Synthetic Polynucleotide
taatacgactcactatagggtggagccacgcacagagtttctctttaagaaacagaggagatcttaaatggaaactctgaacctggcggcagcgcaaaagatg

SEQ ID NO: 19157 - DNA, 103 bp, Artificial Sequence
  Synthetic Polynucleotide
taatacgactcactatagggtaagctggagccacgcacagagtttctcttaacagaggagaaagagaatgtctgtgcgtaacctggcggcagcgcaaaagatg

SEQ ID NO: 19158 - DNA, 103 bp, Artificial Sequence
  Synthetic Polynucleotide
taatacgactcactatagggatagctaagctggagccacgcacagagtttaacagaggagaaaactcatggcgtggctcaacctggcggcagcgcaaaagatg

SEQ ID NO: 19159 - DNA, 103 bp, Artificial Sequence
  Synthetic Polynucleotide
taatacgactcactatagggtgtacatagctaagctggagccacgcacagaacagaggagactgtgcatggctccagctaacctggcggcagcgcaaaagatg

SEQ ID NO: 19160 - DNA, 103 bp, Artificial Sequence
  Synthetic Polynucleotide
taatacgactcactatagggacaccttgtcaataattaggcttctcacccaacagaggagagggtgaatggcctaattaaacctggcggcagcgcaaaagatg

SEQ ID NO: 19161 - DNA, 103 bp, Artificial Sequence
  Synthetic Polynucleotide
taatacgactcactataggggcttatgtacatagctaagctggagccacgaacagaggagacgtggcatgagcttagctaacctggcggcagcgcaaaagatg

SEQ ID NO: 19162 - DNA, 103 bp, Artificial Sequence
  Synthetic Polynucleotide
taatacgactcactatagggagactgcttatgtacatagctaagctggagaacagaggagactccagatgagctatgtaaacctggcggcagcgcaaaagatg

SEQ ID NO: 19163 - DNA, 103 bp, Artificial Sequence
  Synthetic Polynucleotide
taatacgactcactataggggaatcagactgcttatgtacatagctaagcaacagaggagagcttagatgtgtacataaaacctggcggcagcgcaaaagatg

SEQ ID NO: 19164 - DNA, 103 bp, Artificial Sequence
  Synthetic Polynucleotide
taatacgactcactataggggccatgaatcagactgcttatgtacatagcaacagaggagagctatgatgataagcagtaacctggcggcagcgcaaaagatg

SEQ ID NO: 19165 - DNA, 103 bp, Artificial Sequence
  Synthetic Polynucleotide
taatacgactcactatagggcttgagccatgaatcagactgcttatgtacaacagaggagagtacatatgcagtctgataacctggcggcagcgcaaaagatg

SEQ ID NO: 19166 - DNA, 103 bp, Artificial Sequence
  Synthetic Polynucleotide
taatacgactcactatagggaatttcttgagccatgaatcagactgcttaaacagaggagataagcaatgtgattcatgaacctggcggcagcgcaaaagatg

SEQ ID NO: 19167 - DNA, 103 bp, Artificial Sequence
  Synthetic Polynucleotide
taatacgactcactatagggcagtaaatttcttgagccatgaatcagactaacagaggagaagtctgatgcatggctcaaacctggcggcagcgcaaaagatg

SEQ ID NO: 19168 - DNA, 103 bp, Artificial Sequence
  Synthetic Polynucleotide
taatacgactcactatagggcgcttcagtaaatttcttgagccatgaatcaacagaggagagattcaatgctcaagaaaaacctggcggcagcgcaaaagatg

SEQ ID NO: 19169 - DNA, 103 bp, Artificial Sequence
  Synthetic Polynucleotide
taatacgactcactatagggttacacgcttcagtaaatttcttgagccataacagaggagaatggctatggaaatttacaacctggcggcagcgcaaaagatg

SEQ ID NO: 19170 - DNA, 103 bp, Artificial Sequence
  Synthetic Polynucleotide
taatacgactcactatagggctgcgttacacgcttcagtaaatttcttgaaacagaggagatcaagaatgttactgaagaacctggcggcagcgcaaaagatg

SEQ ID NO: 19171 - DNA, 103 bp, Artificial Sequence
  Synthetic Polynucleotide
taatacgactcactatagggtcttcacaccttgtcaataattaggcttctaacagaggagaagaagcatgattattgacaacctggcggcagcgcaaaagatg

SEQ ID NO: 19172 - DNA, 103 bp, Artificial Sequence
  Synthetic Polynucleotide
taatacgactcactatagggacgtgctgcgttacacgcttcagtaaatttaacagaggagaaaatttatggaagcgtgtaacctggcggcagcgcaaaagatg

SEQ ID NO: 19173 - DNA, 103 bp, Artificial Sequence
  Synthetic Polynucleotide
taatacgactcactatagggagcccacgtgctgcgttacacgcttcagtaaacagaggagatactgaatggtgtaacgcaacctggcggcagcgcaaaagatg

SEQ ID NO: 19174 - DNA, 103 bp, Artificial Sequence
  Synthetic Polynucleotide
taatacgactcactatagggactctagcccacgtgctgcgttacacgcttaacagaggagaaagcgtatgacgcagcacaacctggcggcagcgcaaaagatg

SEQ ID NO: 19175 - DNA, 103 bp, Artificial Sequence
  Synthetic Polynucleotide
taatacgactcactatagggaatccactctagcccacgtgctgcgttacaaacagaggagatgtaacatggcacgtgggaacctggcggcagcgcaaaagatg

SEQ ID NO: 19176 - DNA, 103 bp, Artificial Sequence
  Synthetic Polynucleotide
taatacgactcactatagggtgtccaatccactctagcccacgtgctgcgaacagaggagacgcagcatgtgggctagaaacctggcggcagcgcaaaagatg

SEQ ID NO: 19177 - DNA, 103 bp, Artificial Sequence
  Synthetic Polynucleotide
taatacgactcactatagggtcttttgtccaatccactctagcccacgtgaacagaggagacacgtgatgtagagtggaaacctggcggcagcgcaaaagatg

SEQ ID NO: 19178 - DNA, 103 bp, Artificial Sequence
  Synthetic Polynucleotide
taatacgactcactatagggagatatcttttgtccaatccactctagcccaacagaggagagggctaatgtggattggaaacctggcggcagcgcaaaagatg

SEQ ID NO: 19179 - DNA, 103 bp, Artificial Sequence
  Synthetic Polynucleotide
taatacgactcactatagggaatttagatatcttttgtccaatccactctaacagaggagaagagtgatgtggacaaaaaacctggcggcagcgcaaaagatg

SEQ ID NO: 19180 - DNA, 103 bp, Artificial Sequence
  Synthetic Polynucleotide
taatacgactcactatagggctataaatttagatatcttttgtccaatccaacagaggagaggattgatgaaaagatataacctggcggcagcgcaaaagatg

SEQ ID NO: 19181 - DNA, 103 bp, Artificial Sequence
  Synthetic Polynucleotide
taatacgactcactatagggccaatctataaatttagatatcttttgtccaacagaggagaggacaaatgatatctaaaaacctggcggcagcgcaaaagatg

SEQ ID NO: 19182 - DNA, 103 bp, Artificial Sequence
  Synthetic Polynucleotide
taatacgactcactatagggccgtaataacagagtacaacaccgcatgggaacagaggagacccatgatgtgttgtactaacctggcggcagcgcaaaagatg

SEQ ID NO: 19183 - DNA, 103 bp, Artificial Sequence
  Synthetic Polynucleotide
taatacgactcactataggggcggctcttcacaccttgtcaataattaggaacagaggagacctaatatgtgacaaggtaacctggcggcagcgcaaaagatg

SEQ ID NO: 19184 - DNA, 103 bp, Artificial Sequence
  Synthetic Polynucleotide
taatacgactcactatagggtttatccaatctataaatttagatatctttaacagaggagaaaagatatgtaaatttataacctggcggcagcgcaaaagatg

SEQ ID NO: 19185 - DNA, 103 bp, Artificial Sequence
  Synthetic Polynucleotide
taatacgactcactatagggtactctttatccaatctataaatttagataaacagaggagatatctaatgttatagattaacctggcggcagcgcaaaagatg

SEQ ID NO: 19186 - DNA, 103 bp, Artificial Sequence
  Synthetic Polynucleotide
taatacgactcactatagggtaacatactctttatccaatctataaatttaacagaggagaaaatttatggattggataaacctggcggcagcgcaaaagatg

SEQ ID NO: 19187 - DNA, 103 bp, Artificial Sequence
  Synthetic Polynucleotide
taatacgactcactatagggtgtggtaacatactctttatccaatctataaacagaggagatatagaatggataaagagaacctggcggcagcgcaaaagatg

SEQ ID NO: 19188 - DNA, 103 bp, Artificial Sequence
  Synthetic Polynucleotide
taatacgactcactataggggagcctgtggtaacatactctttatccaataacagaggagaattggaatgagagtatgtaacctggcggcagcgcaaaagatg

SEQ ID NO: 19189 - DNA, 103 bp, Artificial Sequence
  Synthetic Polynucleotide
taatacgactcactatagggcaattgagcctgtggtaacatactctttataacagaggagaataaagatgatgttaccaaacctggcggcagcgcaaaagatg

SEQ ID NO: 19190 - DNA, 103 bp, Artificial Sequence
  Synthetic Polynucleotide
taatacgactcactatagggattttcaattgagcctgtggtaacatactcaacagaggagagagtatatgaccacaggcaacctggcggcagcgcaaaagatg

SEQ ID NO: 19191 - DNA, 103 bp, Artificial Sequence
  Synthetic Polynucleotide
taatacgactcactatagggaatcaattttcaattgagcctgtggtaacaaacagaggagatgttacatgaggctcaataacctggcggcagcgcaaaagatg

SEQ ID NO: 19192 - DNA, 103 bp, Artificial Sequence
  Synthetic Polynucleotide
taatacgactcactatagggtaggtaatcaattttcaattgagcctgtggaacagaggagaccacagatgcaattgaaaaacctggcggcagcgcaaaagatg

SEQ ID NO: 19193 - DNA, 103 bp, Artificial Sequence
  Synthetic Polynucleotide
taatacgactcactatagggttggttaggtaatcaattttcaattgagccaacagaggagaggctcaatggaaaattgaaacctggcggcagcgcaaaagatg

SEQ ID NO: 19194 - DNA, 103 bp, Artificial Sequence
  Synthetic Polynucleotide
taatacgactcactatagggcacacgcggctcttcacaccttgtcaataaaacagaggagattattgatgaggtgtgaaaacctggcggcagcgcaaaagatg

SEQ ID NO: 19195 - DNA, 103 bp, Artificial Sequence
  Synthetic Polynucleotide
taatacgactcactatagggttaatttggttaggtaatcaattttcaattaacagaggagaaattgaatgttgattaccaacctggcggcagcgcaaaagatg

SEQ ID NO: 19196 - DNA, 103 bp, Artificial Sequence
  Synthetic Polynucleotide
taatacgactcactatagggttgttttaatttggttaggtaatcaattttaacagaggagaaaaattatgtacctaaccaacctggcggcagcgcaaaagatg

SEQ ID NO: 19197 - DNA, 103 bp, Artificial Sequence
  Synthetic Polynucleotide
taatacgactcactatagggttaagttgttttaatttggttaggtaatcaaacagaggagatgattaatgaaccaaattaacctggcggcagcgcaaaagatg

SEQ ID NO: 19198 - DNA, 103 bp, Artificial Sequence
  Synthetic Polynucleotide
taatacgactcactatagggagagattaagttgttttaatttggttaggtaacagaggagaacctaaatgaattaaaacaacctggcggcagcgcaaaagatg

SEQ ID NO: 19199 - DNA, 103 bp, Artificial Sequence
  Synthetic Polynucleotide
taatacgactcactatagggctctaagagattaagttgttttaatttggtaacagaggagaaccaaaatgaaacaacttaacctggcggcagcgcaaaagatg

SEQ ID NO: 19200 - DNA, 103 bp, Artificial Sequence
  Synthetic Polynucleotide
taatacgactcactatagggtgtttctctaagagattaagttgttttaataacagaggagaattaaaatgacttaatctaacctggcggcagcgcaaaagatg

SEQ ID NO: 19201 - DNA, 103 bp, Artificial Sequence
  Synthetic Polynucleotide
taatacgactcactatagggctatttgtttctctaagagattaagttgttaacagaggagaaacaacatgatctcttagaacctggcggcagcgcaaaagatg

SEQ ID NO: 19202 - DNA, 103 bp, Artificial Sequence
  Synthetic Polynucleotide
taatacgactcactatagggtgtttctatttgtttctctaagagattaagaacagaggagacttaatatgttagagaaaaacctggcggcagcgcaaaagatg

SEQ ID NO: 19203 - DNA, 103 bp, Artificial Sequence
  Synthetic Polynucleotide
taatacgactcactatagggctaattgtttctatttgtttctctaagagaaacagaggagatctcttatggaaacaaataacctggcggcagcgcaaaagatg

SEQ ID NO: 19204 - DNA, 103 bp, Artificial Sequence
  Synthetic Polynucleotide
taatacgactcactatagggcaagtctaattgtttctatttgtttctctaaacagaggagatagagaatgaaatagaaaaacctggcggcagcgcaaaagatg

SEQ ID NO: 19205 - DNA, 103 bp, Artificial Sequence
  Synthetic Polynucleotide
taatacgactcactatagggctgagcacacgcggctcttcacaccttgtcaacagaggagagacaagatgtgaagagccaacctggcggcagcgcaaaagatg

SEQ ID NO: 19206 - DNA, 103 bp, Artificial Sequence
  Synthetic Polynucleotide
taatacgactcactatagggaggtgcaagtctaattgtttctatttgtttaacagaggagaaaacaaatggaaacaattaacctggcggcagcgcaaaagatg

SEQ ID NO: 19207 - DNA, 103 bp, Artificial Sequence
  Synthetic Polynucleotide
taatacgactcactatagggctagcaggtgcaagtctaattgtttctattaacagaggagaaatagaatgaattagactaacctggcggcagcgcaaaagatg

SEQ ID NO: 19208 - DNA, 103 bp, Artificial Sequence
  Synthetic Polynucleotide
taatacgactcactataggggaacactagcaggtgcaagtctaattgtttaacagaggagaaaacaaatggacttgcacaacctggcggcagcgcaaaagatg

SEQ ID NO: 19209 - DNA, 103 bp, Artificial Sequence
  Synthetic Polynucleotide
taatacgactcactatagggctcctgaacactagcaggtgcaagtctaataacagaggagaattagaatggcacctgctaacctggcggcagcgcaaaagatg

SEQ ID NO: 19210 - DNA, 103 bp, Artificial Sequence
  Synthetic Polynucleotide
taatacgactcactatagggattttctcctgaacactagcaggtgcaagtaacagaggagaacttgcatgtgctagtgtaacctggcggcagcgcaaaagatg

SEQ ID NO: 19211 - DNA, 103 bp, Artificial Sequence
  Synthetic Polynucleotide
taatacgactcactatagggtgaaaattttctcctgaacactagcaggtgaacagaggagacacctgatggtgttcaggaacctggcggcagcgcaaaagatg

SEQ ID NO: 19212 - DNA, 103 bp, Artificial Sequence
  Synthetic Polynucleotide
taatacgactcactatagggttcaatgaaaattttctcctgaacactagcaacagaggagagctagtatgcaggagaaaaacctggcggcagcgcaaaagatg

SEQ ID NO: 19213 - DNA, 103 bp, Artificial Sequence
  Synthetic Polynucleotide
taatacgactcactatagggtttatttcaatgaaaattttctcctgaacaaacagaggagatgttcaatggaaaattttaacctggcggcagcgcaaaagatg

SEQ ID NO: 19214 - DNA, 103 bp, Artificial Sequence
  Synthetic Polynucleotide
taatacgactcactataggggggtgtttatttcaatgaaaattttctcctaacagaggagaaggagaatgttttcattgaacctggcggcagcgcaaaagatg

SEQ ID NO: 19215 - DNA, 103 bp, Artificial Sequence
  Synthetic Polynucleotide
taatacgactcactatagggatgaagggtgtttatttcaatgaaaattttaacagaggagaaaaattatgattgaaataaacctggcggcagcgcaaaagatg

SEQ ID NO: 19216 - DNA, 103 bp, Artificial Sequence
  Synthetic Polynucleotide
taatacgactcactataggggcacactgagcacacgcggctcttcacaccaacagaggagaggtgtgatgagccgcgtgaacctggcggcagcgcaaaagatg

SEQ ID NO: 19217 - DNA, 103 bp, Artificial Sequence
  Synthetic Polynucleotide
taatacgactcactatagggaaatcatgaagggtgtttatttcaatgaaaaacagaggagatttcatatgaataaacacaacctggcggcagcgcaaaagatg

SEQ ID NO: 19218 - DNA, 103 bp, Artificial Sequence
  Synthetic Polynucleotide
taatacgactcactatagggaggataaatcatgaagggtgtttatttcaaaacagaggagattgaaaatgacacccttcaacctggcggcagcgcaaaagatg

SEQ ID NO: 19219 - DNA, 103 bp, Artificial Sequence
  Synthetic Polynucleotide
taatacgactcactatagggttttaaggataaatcatgaagggtgtttataacagaggagaataaacatgcttcatgataacctggcggcagcgcaaaagatg

SEQ ID NO: 19220 - DNA, 103 bp, Artificial Sequence
  Synthetic Polynucleotide
taatacgactcactatagggaagaattttaaggataaatcatgaagggtgaacagaggagacaccctatgtgatttatcaacctggcggcagcgcaaaagatg

SEQ ID NO: 19221 - DNA, 103 bp, Artificial Sequence
  Synthetic Polynucleotide
taatacgactcactataggggtggtaagaattttaaggataaatcatgaaaacagaggagattcatgatgtatccttaaaacctggcggcagcgcaaaagatg

SEQ ID NO: 19222 - DNA, 103 bp, Artificial Sequence
  Synthetic Polynucleotide
taatacgactcactatagggatacagtggtaagaattttaaggataaatcaacagaggagagatttaatgttaaaattcaacctggcggcagcgcaaaagatg

SEQ ID NO: 19223 - DNA, 103 bp, Artificial Sequence
  Synthetic Polynucleotide
taatacgactcactataggggatgcatacagtggtaagaattttaaggataacagaggagaatccttatgattcttaccaacctggcggcagcgcaaaagatg

SEQ ID NO: 19224 - DNA, 103 bp, Artificial Sequence
  Synthetic Polynucleotide
taatacgactcactatagggcttcagatgcatacagtggtaagaattttaaacagaggagataaaatatgtaccactgtaacctggcggcagcgcaaaagatg

SEQ ID NO: 19225 - DNA, 103 bp, Artificial Sequence
  Synthetic Polynucleotide
taatacgactcactatagggacgtgcttcagatgcatacagtggtaagaaaacagaggagattcttaatgctgtatgcaaacctggcggcagcgcaaaagatg

SEQ ID NO: 19226 - DNA, 103 bp, Artificial Sequence
  Synthetic Polynucleotide
taatacgactcactatagggattctacgtgcttcagatgcatacagtggtaacagaggagaaccactatgtgcatctgaaacctggcggcagcgcaaaagatg

SEQ ID NO: 19227 - DNA, 103 bp, Artificial Sequence
  Synthetic Polynucleotide
taatacgactcactatagggaggaagcacactgagcacacgcggctcttcaacagaggagagaagagatgcgtgtgctcaacctggcggcagcgcaaaagatg

SEQ ID NO: 19228 - DNA, 103 bp, Artificial Sequence
  Synthetic Polynucleotide
taatacgactcactatagggtcttaattctacgtgcttcagatgcatacaaacagaggagatgtatgatgctgaagcacaacctggcggcagcgcaaaagatg

SEQ ID NO: 19229 - DNA, 103 bp, Artificial Sequence
  Synthetic Polynucleotide
taatacgactcactatagggtaaattcttaattctacgtgcttcagatgcaacagaggagagcatctatggcacgtagaaacctggcggcagcgcaaaagatg

SEQ ID NO: 19230 - DNA, 103 bp, Artificial Sequence
  Synthetic Polynucleotide
taatacgactcactatagggatatataaattcttaattctacgtgcttcaaacagaggagatgaagcatgtagaattaaaacctggcggcagcgcaaaagatg

SEQ ID NO: 19231 - DNA, 103 bp, Artificial Sequence
  Synthetic Polynucleotide
taatacgactcactatagggatttgatatataaattcttaattctacgtgaacagaggagacacgtaatgttaagaattaacctggcggcagcgcaaaagatg

SEQ ID NO: 19232 - DNA, 103 bp, Artificial Sequence
  Synthetic Polynucleotide
taatacgactcactatagggactgcatttgatatataaattcttaattctaacagaggagaagaattatgaatttatataacctggcggcagcgcaaaagatg

SEQ ID NO: 19233 - DNA, 103 bp, Artificial Sequence
  Synthetic Polynucleotide
taatacgactcactatagggacattactgcatttgatatataaattcttaaacagaggagataagaaatgatatatcaaaacctggcggcagcgcaaaagatg

SEQ ID NO: 19234 - DNA, 103 bp, Artificial Sequence
  Synthetic Polynucleotide
taatacgactcactatagggtaataacattactgcatttgatatataaataacagaggagaatttatatgtcaaatgcaaacctggcggcagcgcaaaagatg

SEQ ID NO: 19235 - DNA, 103 bp, Artificial Sequence
  Synthetic Polynucleotide
taatacgactcactatagggccctttaataacattactgcatttgatataaacagaggagatatatcatgtgcagtaataacctggcggcagcgcaaaagatg

SEQ ID NO: 19236 - DNA, 103 bp, Artificial Sequence
  Synthetic Polynucleotide
taatacgactcactatagggtttccccctttaataacattactgcatttgaacagaggagacaaatgatgtaatgttataacctggcggcagcgcaaaagatg

SEQ ID NO: 19237 - DNA, 103 bp, Artificial Sequence
  Synthetic Polynucleotide
taatacgactcactatagggtcctctttccccctttaataacattactgcaacagaggagagcagtaatgttattaaagaacctggcggcagcgcaaaagatg

SEQ ID NO: 19238 - DNA, 103 bp, Artificial Sequence
  Synthetic Polynucleotide
taatacgactcactataggggccggaggaagcacactgagcacacgcggcaacagaggagagccgcgatggctcagtgtaacctggcggcagcgcaaaagatg

SEQ ID NO: 19239 - DNA, 103 bp, Artificial Sequence
  Synthetic Polynucleotide
taatacgactcactatagggttcattcctctttccccctttaataacattaacagaggagaaatgttatgaaagggggaaacctggcggcagcgcaaaagatg

SEQ ID NO: 19240 - DNA, 103 bp, Artificial Sequence
  Synthetic Polynucleotide
taatacgactcactatagggactggttcattcctctttccccctttaataaacagaggagatattaaatggggaaagagaacctggcggcagcgcaaaagatg

SEQ ID NO: 19241 - DNA, 103 bp, Artificial Sequence
  Synthetic Polynucleotide
taatacgactcactatagggctgcaactggttcattcctctttcccccttaacagaggagaaaggggatgagaggaatgaacctggcggcagcgcaaaagatg

SEQ ID NO: 19242 - DNA, 103 bp, Artificial Sequence
  Synthetic Polynucleotide
taatacgactcactatagggtagaactgcaactggttcattcctctttccaacagaggagaggaaagatgaatgaaccaaacctggcggcagcgcaaaagatg

SEQ ID NO: 19243 - DNA, 103 bp, Artificial Sequence
  Synthetic Polynucleotide
taatacgactcactatagggtgtattagaactgcaactggttcattcctcaacagaggagagaggaaatgaccagttgcaacctggcggcagcgcaaaagatg

SEQ ID NO: 19244 - DNA, 103 bp, Artificial Sequence
  Synthetic Polynucleotide
taatacgactcactatagggaaccatgtattagaactgcaactggttcataacagaggagaatgaacatgttgcagttcaacctggcggcagcgcaaaagatg

SEQ ID NO: 19245 - DNA, 103 bp, Artificial Sequence
  Synthetic Polynucleotide
taatacgactcactatagggaggagaaccatgtattagaactgcaactggaacagaggagaccagttatggttctaataaacctggcggcagcgcaaaagatg

SEQ ID NO: 19246 - DNA, 103 bp, Artificial Sequence
  Synthetic Polynucleotide
taatacgactcactataggggtaccaggagaaccatgtattagaactgcaaacagaggagatgcagtatgaatacatggaacctggcggcagcgcaaaagatg

SEQ ID NO: 19247 - DNA, 103 bp, Artificial Sequence
  Synthetic Polynucleotide
taatacgactcactatagggttccagtaccaggagaaccatgtattagaaaacagaggagattctaaatgatggttctcaacctggcggcagcgcaaaagatg

SEQ ID NO: 19248 - DNA, 103 bp, Artificial Sequence
  Synthetic Polynucleotide
taatacgactcactatagggagattttccagtaccaggagaaccatgtataacagaggagaatacatatgtctcctggtaacctggcggcagcgcaaaagatg

SEQ ID NO: 19249 - DNA, 103 bp, Artificial Sequence
  Synthetic Polynucleotide
taatacgactcactatagggcaggggccggaggaagcacactgagcacacaacagaggagagtgtgcatggtgtgcttcaacctggcggcagcgcaaaagatg

SEQ ID NO: 19250 - DNA, 103 bp, Artificial Sequence
  Synthetic Polynucleotide
taatacgactcactataggggcaagagattttccagtaccaggagaaccaaacagaggagatggttcatgtggtactggaacctggcggcagcgcaaaagatg

SEQ ID NO: 19251 - DNA, 103 bp, Artificial Sequence
  Synthetic Polynucleotide
taatacgactcactatagggaagtggcaagagattttccagtaccaggagaacagaggagactcctgatgctggaaaataacctggcggcagcgcaaaagatg

SEQ ID NO: 19252 - DNA, 103 bp, Artificial Sequence
  Synthetic Polynucleotide
taatacgactcactatagggaacagaagtggcaagagattttccagtaccaacagaggagaggtactatgaaatctcttaacctggcggcagcgcaaaagatg

SEQ ID NO: 19253 - DNA, 103 bp, Artificial Sequence
  Synthetic Polynucleotide
taatacgactcactataggggcaagaacagaagtggcaagagattttccaaacagaggagatggaaaatgtcttgccacaacctggcggcagcgcaaaagatg

SEQ ID NO: 19254 - DNA, 103 bp, Artificial Sequence
  Synthetic Polynucleotide
taatacgactcactatagggttcgagcaagaacagaagtggcaagagattaacagaggagaaatctcatgccacttctgaacctggcggcagcgcaaaagatg

SEQ ID NO: 19255 - DNA, 103 bp, Artificial Sequence
  Synthetic Polynucleotide
taatacgactcactatagggtagcattcgagcaagaacagaagtggcaagaacagaggagacttgccatgtctgttcttaacctggcggcagcgcaaaagatg

SEQ ID NO: 19256 - DNA, 103 bp, Artificial Sequence
  Synthetic Polynucleotide
taatacgactcactatagggacagttagcattcgagcaagaacagaagtgaacagaggagacacttcatgtcttgctcgaacctggcggcagcgcaaaagatg

SEQ ID NO: 19257 - DNA, 103 bp, Artificial Sequence
  Synthetic Polynucleotide
taatacgactcactatagggtctcaacagttagcattcgagcaagaacagaacagaggagactgttcatgctcgaatgcaacctggcggcagcgcaaaagatg

SEQ ID NO: 19258 - DNA, 103 bp, Artificial Sequence
  Synthetic Polynucleotide
taatacgactcactatagggatcagtctcaacagttagcattcgagcaagaacagaggagacttgctatgatgctaactaacctggcggcagcgcaaaagatg

SEQ ID NO: 19259 - DNA, 103 bp, Artificial Sequence
  Synthetic Polynucleotide
taatacgactcactatagggtatatatcagtctcaacagttagcattcgaaacagaggagatcgaatatgaactgttgaaacctggcggcagcgcaaaagatg

SEQ ID NO: 19260 - DNA, 103 bp, Artificial Sequence
  Synthetic Polynucleotide
taatacgactcactatagggacattcaggggccggaggaagcacactgagaacagaggagactcagtatgcttcctccgaacctggcggcagcgcaaaagatg

SEQ ID NO: 19261 - DNA, 103 bp, Artificial Sequence
  Synthetic Polynucleotide
taatacgactcactatagggaagaatatatatcagtctcaacagttagcaaacagaggagatgctaaatgttgagactgaacctggcggcagcgcaaaagatg

SEQ ID NO: 19262 - DNA, 103 bp, Artificial Sequence
  Synthetic Polynucleotide
taatacgactcactataggggggcaaagaatatatatcagtctcaacagtaacagaggagaactgttatgactgatataaacctggcggcagcgcaaaagatg

SEQ ID NO: 19263 - DNA, 103 bp, Artificial Sequence
  Synthetic Polynucleotide
taatacgactcactatagggtctgggggcaaagaatatatatcagtctcaaacagaggagatgagacatgtatatattcaacctggcggcagcgcaaaagatg

SEQ ID NO: 19264 - DNA, 103 bp, Artificial Sequence
  Synthetic Polynucleotide
taatacgactcactatagggtaggatctgggggcaaagaatatatatcagaacagaggagactgataatgattctttgcaacctggcggcagcgcaaaagatg

SEQ ID NO: 19265 - DNA, 103 bp, Artificial Sequence
  Synthetic Polynucleotide
taatacgactcactatagggatatttaggatctgggggcaaagaatatataacagaggagaatatatatgttgcccccaaacctggcggcagcgcaaaagatg

SEQ ID NO: 19266 - DNA, 103 bp, Artificial Sequence
  Synthetic Polynucleotide
taatacgactcactatagggtcaaaatatttaggatctgggggcaaagaaaacagaggagattctttatgcccagatccaacctggcggcagcgcaaaagatg

SEQ ID NO: 19267 - DNA, 103 bp, Artificial Sequence
  Synthetic Polynucleotide
taatacgactcactatagggacccatcaaaatatttaggatctgggggcaaacagaggagatgccccatgatcctaaataacctggcggcagcgcaaaagatg

SEQ ID NO: 19268 - DNA, 103 bp, Artificial Sequence
  Synthetic Polynucleotide
taatacgactcactatagggatcatacccatcaaaatatttaggatctggaacagaggagaccagatatgaaatattttaacctggcggcagcgcaaaagatg

SEQ ID NO: 19269 - DNA, 103 bp, Artificial Sequence
  Synthetic Polynucleotide
taatacgactcactatagggtgttgatcatacccatcaaaatatttaggaaacagaggagatcctaaatgttttgatggaacctggcggcagcgcaaaagatg

SEQ ID NO: 19270 - DNA, 103 bp, Artificial Sequence
  Synthetic Polynucleotide
taatacgactcactatagggcactctgttgatcatacccatcaaaatattaacagaggagaaatattatgatgggtatgaacctggcggcagcgcaaaagatg

SEQ ID NO: 19271 - DNA, 103 bp, Artificial Sequence
  Synthetic Polynucleotide
taatacgactcactatagggtagccacattcaggggccggaggaagcacaaacagaggagatgtgctatgtccggccccaacctggcggcagcgcaaaagatg

SEQ ID NO: 19272 - DNA, 103 bp, Artificial Sequence
  Synthetic Polynucleotide
taatacgactcactatagggaacaacactctgttgatcatacccatcaaaaacagaggagatttgatatgtatgatcaaaacctggcggcagcgcaaaagatg

SEQ ID NO: 19273 - DNA, 103 bp, Artificial Sequence
  Synthetic Polynucleotide
taatacgactcactatagggatgataacaacactctgttgatcatacccaaacagaggagatgggtaatgtcaacagagaacctggcggcagcgcaaaagatg

SEQ ID NO: 19274 - DNA, 103 bp, Artificial Sequence
  Synthetic Polynucleotide
taatacgactcactatagggcatccatgataacaacactctgttgatcataacagaggagaatgatcatgagagtgttgaacctggcggcagcgcaaaagatg

SEQ ID NO: 19275 - DNA, 103 bp, Artificial Sequence
  Synthetic Polynucleotide
taatacgactcactataggggatatcatccatgataacaacactctgttgaacagaggagacaacagatggttgttatcaacctggcggcagcgcaaaagatg

SEQ ID NO: 19276 - DNA, 103 bp, Artificial Sequence
  Synthetic Polynucleotide
taatacgactcactatagggtgcatgatatcatccatgataacaacactcaacagaggagagagtgtatgtatcatggaaacctggcggcagcgcaaaagatg

SEQ ID NO: 19277 - DNA, 103 bp, Artificial Sequence
  Synthetic Polynucleotide
taatacgactcactataggggattttgcatgatatcatccatgataacaaaacagaggagattgttaatgtggatgataaacctggcggcagcgcaaaagatg

SEQ ID NO: 19278 - DNA, 103 bp, Artificial Sequence
  Synthetic Polynucleotide
taatacgactcactatagggactaggattttgcatgatatcatccatgataacagaggagaatcatgatggatatcatgaacctggcggcagcgcaaaagatg

SEQ ID NO: 19279 - DNA, 103 bp, Artificial Sequence
  Synthetic Polynucleotide
taatacgactcactatagggtcaccactaggattttgcatgatatcatccaacagaggagaggatgaatgcatgcaaaaaacctggcggcagcgcaaaagatg

SEQ ID NO: 19280 - DNA, 103 bp, Artificial Sequence
  Synthetic Polynucleotide
taatacgactcactatagggtgtcttcaccactaggattttgcatgatataacagaggagaatatcaatgaaaatcctaaacctggcggcagcgcaaaagatg

SEQ ID NO: 19281 - DNA, 103 bp, Artificial Sequence
  Synthetic Polynucleotide
taatacgactcactatagggagtcatgtcttcaccactaggattttgcataacagaggagaatgcaaatgcctagtggtaacctggcggcagcgcaaaagatg

SEQ ID NO: 19282 - DNA, 103 bp, Artificial Sequence
  Synthetic Polynucleotide
taatacgactcactatagggaaggttagccacattcaggggccggaggaaaacagaggagattcctcatgcccctgaataacctggcggcagcgcaaaagatg

SEQ ID NO: 19283 - DNA, 103 bp, Artificial Sequence
  Synthetic Polynucleotide
taatacgactcactatagggaacaaagtcatgtcttcaccactaggatttaacagaggagaaaatccatgtggtgaagaaacctggcggcagcgcaaaagatg

SEQ ID NO: 19284 - DNA, 103 bp, Artificial Sequence
  Synthetic Polynucleotide
taatacgactcactatagggggcaaaacaaagtcatgtcttcaccactagaacagaggagactagtgatgaagacatgaaacctggcggcagcgcaaaagatg

SEQ ID NO: 19285 - DNA, 103 bp, Artificial Sequence
  Synthetic Polynucleotide
taatacgactcactatagggcatttggcaaaacaaagtcatgtcttcaccaacagaggagaggtgaaatgatgactttgaacctggcggcagcgcaaaagatg

SEQ ID NO: 19286 - DNA, 103 bp, Artificial Sequence
  Synthetic Polynucleotide
taatacgactcactataggggataccatttggcaaaacaaagtcatgtctaacagaggagaagacatatgtttgttttgaacctggcggcagcgcaaaagatg

SEQ ID NO: 19287 - DNA, 103 bp, Artificial Sequence
  Synthetic Polynucleotide
taatacgactcactatagggcactcgataccatttggcaaaacaaagtcaaacagaggagatgacttatgtttgccaaaaacctggcggcagcgcaaaagatg

SEQ ID NO: 19288 - DNA, 103 bp, Artificial Sequence
  Synthetic Polynucleotide
taatacgactcactatagggagggacactcgataccatttggcaaaacaaaacagaggagattgtttatgcaaatggtaaacctggcggcagcgcaaaagatg

SEQ ID NO: 19289 - DNA, 103 bp, Artificial Sequence
  Synthetic Polynucleotide
taatacgactcactatagggatgaaagggacactcgataccatttggcaaaacagaggagattgccaatgggtatcgagaacctggcggcagcgcaaaagatg

SEQ ID NO: 19290 - DNA, 103 bp, Artificial Sequence
  Synthetic Polynucleotide
taatacgactcactataggggaggtatgaaagggacactcgataccatttaacagaggagaaaatggatgcgagtgtccaacctggcggcagcgcaaaagatg

SEQ ID NO: 19291 - DNA, 103 bp, Artificial Sequence
  Synthetic Polynucleotide
taatacgactcactatagggcataggaggtatgaaagggacactcgatacaacagaggagagtatcgatggtccctttcaacctggcggcagcgcaaaagatg

SEQ ID NO: 19292 - DNA, 103 bp, Artificial Sequence
  Synthetic Polynucleotide
taatacgactcactatagggtctgccataggaggtatgaaagggacactcaacagaggagagagtgtatgtttcataccaacctggcggcagcgcaaaagatg

SEQ ID NO: 19293 - DNA, 103 bp, Artificial Sequence
  Synthetic Polynucleotide
taatacgactcactatagggagttaccgtaataacagagtacaacaccgcaacagaggagagcggtgatgtactctgttaacctggcggcagcgcaaaagatg

SEQ ID NO: 19294 - DNA, 103 bp, Artificial Sequence
  Synthetic Polynucleotide
taatacgactcactataggggggttaaggttagccacattcaggggccggaacagaggagaccggccatggaatgtggcaacctggcggcagcgcaaaagatg

SEQ ID NO: 19295 - DNA, 103 bp, Artificial Sequence
  Synthetic Polynucleotide
taatacgactcactataggggaagatctgccataggaggtatgaaagggaaacagaggagatcccttatgtacctcctaaacctggcggcagcgcaaaagatg

SEQ ID NO: 19296 - DNA, 103 bp, Artificial Sequence
  Synthetic Polynucleotide
taatacgactcactatagggatctggaagatctgccataggaggtatgaaaacagaggagattcataatgcctatggcaaacctggcggcagcgcaaaagatg

SEQ ID NO: 19297 - DNA, 103 bp, Artificial Sequence
  Synthetic Polynucleotide
taatacgactcactatagggcctttatctggaagatctgccataggaggtaacagaggagaacctccatgggcagatctaacctggcggcagcgcaaaagatg

SEQ ID NO: 19298 - DNA, 103 bp, Artificial Sequence
  Synthetic Polynucleotide
taatacgactcactataggggttttcctttatctggaagatctgccatagaacagaggagactatggatgatcttccagaacctggcggcagcgcaaaagatg

SEQ ID NO: 19299 - DNA, 103 bp, Artificial Sequence
  Synthetic Polynucleotide
taatacgactcactatagggaaatggttttcctttatctggaagatctgcaacagaggagagcagatatgccagataaaaacctggcggcagcgcaaaagatg

SEQ ID NO: 19300 - DNA, 103 bp, Artificial Sequence
  Synthetic Polynucleotide
taatacgactcactataggggatgtaaatggttttcctttatctggaagaaacagaggagatcttccatgtaaaggaaaaacctggcggcagcgcaaaagatg

SEQ ID NO: 19301 - DNA, 103 bp, Artificial Sequence
  Synthetic Polynucleotide
taatacgactcactatagggacttggatgtaaatggttttcctttatctgaacagaggagacagataatggaaaaccataacctggcggcagcgcaaaagatg

SEQ ID NO: 19302 - DNA, 103 bp, Artificial Sequence
  Synthetic Polynucleotide
taatacgactcactatagggtacaaacttggatgtaaatggttttcctttaacagaggagaaaaggaatgccatttacaaacctggcggcagcgcaaaagatg

SEQ ID NO: 19303 - DNA, 103 bp, Artificial Sequence
  Synthetic Polynucleotide
taatacgactcactataggggcaagtacaaacttggatgtaaatggttttaacagaggagaaaaaccatgtacatccaaaacctggcggcagcgcaaaagatg

SEQ ID NO: 19304 - DNA, 103 bp, Artificial Sequence
  Synthetic Polynucleotide
taatacgactcactatagggtgcttgcaagtacaaacttggatgtaaatgaacagaggagacatttaatgccaagtttgaacctggcggcagcgcaaaagatg

SEQ ID NO: 19305 - DNA, 103 bp, Artificial Sequence
  Synthetic Polynucleotide
taatacgactcactatagggctgcagggttaaggttagccacattcagggaacagaggagaccctgaatgtggctaaccaacctggcggcagcgcaaaagatg

SEQ ID NO: 19306 - DNA, 103 bp, Artificial Sequence
  Synthetic Polynucleotide
taatacgactcactatagggattagtgcttgcaagtacaaacttggatgtaacagaggagaacatccatgtttgtacttaacctggcggcagcgcaaaagatg

SEQ ID NO: 19307 - DNA, 103 bp, Artificial Sequence
  Synthetic Polynucleotide
taatacgactcactataggggtgtgattagtgcttgcaagtacaaacttgaacagaggagacaagttatgacttgcaagaacctggcggcagcgcaaaagatg

SEQ ID NO: 19308 - DNA, 103 bp, Artificial Sequence
  Synthetic Polynucleotide
taatacgactcactataggggtagagtgtgattagtgcttgcaagtacaaaacagaggagattgtacatgcaagcactaaacctggcggcagcgcaaaagatg

SEQ ID NO: 19309 - DNA, 103 bp, Artificial Sequence
  Synthetic Polynucleotide
taatacgactcactatagggtgttagtagagtgtgattagtgcttgcaagaacagaggagacttgcaatgactaatcacaacctggcggcagcgcaaaagatg

SEQ ID NO: 19310 - DNA, 103 bp, Artificial Sequence
  Synthetic Polynucleotide
taatacgactcactatagggggtggtgttagtagagtgtgattagtgcttaacagaggagaaagcacatgtcacactctaacctggcggcagcgcaaaagatg

SEQ ID NO: 19311 - DNA, 103 bp, Artificial Sequence
  Synthetic Polynucleotide
taatacgactcactatagggctgttggtggtgttagtagagtgtgattagaacagaggagactaatcatgctctactaaaacctggcggcagcgcaaaagatg

SEQ ID NO: 19312 - DNA, 103 bp, Artificial Sequence
  Synthetic Polynucleotide
taatacgactcactatagggagatactgttggtggtgttagtagagtgtgaacagaggagacacactatgctaacaccaaacctggcggcagcgcaaaagatg

SEQ ID NO: 19313 - DNA, 103 bp, Artificial Sequence
  Synthetic Polynucleotide
taatacgactcactatagggaatgaagatactgttggtggtgttagtagaaacagaggagatctactatgaccaccaacaacctggcggcagcgcaaaagatg

SEQ ID NO: 19314 - DNA, 103 bp, Artificial Sequence
  Synthetic Polynucleotide
taatacgactcactatagggctggtaatgaagatactgttggtggtgttaaacagaggagataacacatgcaacagtataacctggcggcagcgcaaaagatg

SEQ ID NO: 19315 - DNA, 103 bp, Artificial Sequence
  Synthetic Polynucleotide
taatacgactcactatagggcattgctggtaatgaagatactgttggtggaacagaggagaccaccaatggtatcttcaaacctggcggcagcgcaaaagatg

SEQ ID NO: 19316 - DNA, 103 bp, Artificial Sequence
  Synthetic Polynucleotide
taatacgactcactatagggaacggctgcagggttaaggttagccacattaacagaggagaaatgtgatgaaccttaacaacctggcggcagcgcaaaagatg

SEQ ID NO: 19317 - DNA, 103 bp, Artificial Sequence
  Synthetic Polynucleotide
taatacgactcactatagggcttgccattgctggtaatgaagatactgttaacagaggagaaacagtatgttcattaccaacctggcggcagcgcaaaagatg

SEQ ID NO: 19318 - DNA, 103 bp, Artificial Sequence
  Synthetic Polynucleotide
taatacgactcactatagggaccttcttgccattgctggtaatgaagataaacagaggagatatcttatgtaccagcaaaacctggcggcagcgcaaaagatg

SEQ ID NO: 19319 - DNA, 103 bp, Artificial Sequence
  Synthetic Polynucleotide
taatacgactcactataggggtaaaaccttcttgccattgctggtaatgaaacagaggagatcattaatggcaatggcaaacctggcggcagcgcaaaagatg

SEQ ID NO: 19320 - DNA, 103 bp, Artificial Sequence
  Synthetic Polynucleotide
taatacgactcactatagggtcaaagtaaaaccttcttgccattgctggtaacagaggagaaccagcatgggcaagaagaacctggcggcagcgcaaaagatg

SEQ ID NO: 19321 - DNA, 103 bp, Artificial Sequence
  Synthetic Polynucleotide
taatacgactcactatagggctagatcaaagtaaaaccttcttgccattgaacagaggagacaatggatggaaggttttaacctggcggcagcgcaaaagatg

SEQ ID NO: 19322 - DNA, 103 bp, Artificial Sequence
  Synthetic Polynucleotide
taatacgactcactatagggaatgtctagatcaaagtaaaaccttcttgcaacagaggagagcaagaatgttttactttaacctggcggcagcgcaaaagatg

SEQ ID NO: 19323 - DNA, 103 bp, Artificial Sequence
  Synthetic Polynucleotide
taatacgactcactatagggacttgaatgtctagatcaaagtaaaaccttaacagaggagaaaggttatgctttgatctaacctggcggcagcgcaaaagatg

SEQ ID NO: 19324 - DNA, 103 bp, Artificial Sequence
  Synthetic Polynucleotide
taatacgactcactatagggtcttaacttgaatgtctagatcaaagtaaaaacagaggagatttactatgatctagacaaacctggcggcagcgcaaaagatg

SEQ ID NO: 19325 - DNA, 103 bp, Artificial Sequence
  Synthetic Polynucleotide
taatacgactcactatagggctctttcttaacttgaatgtctagatcaaaaacagaggagatttgatatggacattcaaaacctggcggcagcgcaaaagatg

SEQ ID NO: 19326 - DNA, 103 bp, Artificial Sequence
  Synthetic Polynucleotide
taatacgactcactatagggagatactctttcttaacttgaatgtctagaaacagaggagatctagaatgtcaagttaaaacctggcggcagcgcaaaagatg

SEQ ID NO: 19327 - DNA, 103 bp, Artificial Sequence
  Synthetic Polynucleotide
taatacgactcactatagggtgggcaacggctgcagggttaaggttagccaacagaggagaggctaaatgtaaccctgcaacctggcggcagcgcaaaagatg

SEQ ID NO: 19328 - DNA, 103 bp, Artificial Sequence
  Synthetic Polynucleotide
taatacgactcactatagggctaaaagatactctttcttaacttgaatgtaacagaggagaacattcatgttaagaaagaacctggcggcagcgcaaaagatg

SEQ ID NO: 19329 - DNA, 103 bp, Artificial Sequence
  Synthetic Polynucleotide
taatacgactcactataggggccatctaaaagatactctttcttaacttgaacagaggagacaagttatgaaagagtataacctggcggcagcgcaaaagatg

SEQ ID NO: 19330 - DNA, 103 bp, Artificial Sequence
  Synthetic Polynucleotide
taatacgactcactatagggagtttgccatctaaaagatactctttcttaaacagaggagataagaaatggtatcttttaacctggcggcagcgcaaaagatg

SEQ ID NO: 19331 - DNA, 103 bp, Artificial Sequence
  Synthetic Polynucleotide
taatacgactcactatagggtatctagtttgccatctaaaagatactcttaacagaggagaaagagtatgttttagatgaacctggcggcagcgcaaaagatg

SEQ ID NO: 19332 - DNA, 103 bp, Artificial Sequence
  Synthetic Polynucleotide
taatacgactcactatagggtgctatatctagtttgccatctaaaagataaacagaggagatatcttatggatggcaaaaacctggcggcagcgcaaaagatg

SEQ ID NO: 19333 - DNA, 103 bp, Artificial Sequence
  Synthetic Polynucleotide
taatacgactcactatagggctttttgctatatctagtttgccatctaaaaacagaggagatttagaatgcaaactagaaacctggcggcagcgcaaaagatg

SEQ ID NO: 19334 - DNA, 103 bp, Artificial Sequence
  Synthetic Polynucleotide
taatacgactcactataggggaaagctttttgctatatctagtttgccataacagaggagaatggcaatgtagatatagaacctggcggcagcgcaaaagatg

SEQ ID NO: 19335 - DNA, 103 bp, Artificial Sequence
  Synthetic Polynucleotide
taatacgactcactatagggtggtcgaaagctttttgctatatctagtttaacagaggagaaaactaatgatagcaaaaaacctggcggcagcgcaaaagatg

SEQ ID NO: 19336 - DNA, 103 bp, Artificial Sequence
  Synthetic Polynucleotide
taatacgactcactatagggtcacatggtcgaaagctttttgctatatctaacagaggagaagatatatgaaaaagcttaacctggcggcagcgcaaaagatg

SEQ ID NO: 19337 - DNA, 103 bp, Artificial Sequence
  Synthetic Polynucleotide
taatacgactcactatagggtaacatcacatggtcgaaagctttttgctaaacagaggagatagcaaatggctttcgacaacctggcggcagcgcaaaagatg

SEQ ID NO: 19338 - DNA, 103 bp, Artificial Sequence
  Synthetic Polynucleotide
taatacgactcactataggggattatgggcaacggctgcagggttaaggtaacagaggagaaccttaatgctgcagccgaacctggcggcagcgcaaaagatg

SEQ ID NO: 19339 - DNA, 103 bp, Artificial Sequence
  Synthetic Polynucleotide
taatacgactcactatagggaatattaacatcacatggtcgaaagcttttaacagaggagaaaaagcatgcgaccatgtaacctggcggcagcgcaaaagatg

SEQ ID NO: 19340 - DNA, 103 bp, Artificial Sequence
  Synthetic Polynucleotide
taatacgactcactatagggattttaatattaacatcacatggtcgaaagaacagaggagactttcgatgatgtgatgtaacctggcggcagcgcaaaagatg

SEQ ID NO: 19341 - DNA, 103 bp, Artificial Sequence
  Synthetic Polynucleotide
taatacgactcactatagggtgcctattttaatattaacatcacatggtcaacagaggagagaccatatgatgttaataaacctggcggcagcgcaaaagatg

SEQ ID NO: 19342 - DNA, 103 bp, Artificial Sequence
  Synthetic Polynucleotide
taatacgactcactatagggagcattgcctattttaatattaacatcacaaacagaggagatgtgatatgaatattaaaaacctggcggcagcgcaaaagatg

SEQ ID NO: 19343 - DNA, 103 bp, Artificial Sequence
  Synthetic Polynucleotide
taatacgactcactatagggcacttagcattgcctattttaatattaacaaacagaggagatgttaaatgtaaaataggaacctggcggcagcgcaaaagatg

SEQ ID NO: 19344 - DNA, 103 bp, Artificial Sequence
  Synthetic Polynucleotide
taatacgactcactataggggacagcacttagcattgcctattttaatataacagaggagaatattaatgtaggcaatgaacctggcggcagcgcaaaagatg

SEQ ID NO: 19345 - DNA, 103 bp, Artificial Sequence
  Synthetic Polynucleotide
taatacgactcactatagggaaatggacagcacttagcattgcctattttaacagaggagaaaaataatgaatgctaagaacctggcggcagcgcaaaagatg

SEQ ID NO: 19346 - DNA, 103 bp, Artificial Sequence
  Synthetic Polynucleotide
taatacgactcactatagggcagataaatggacagcacttagcattgcctaacagaggagaaggcaaatgtaagtgctgaacctggcggcagcgcaaaagatg

SEQ ID NO: 19347 - DNA, 103 bp, Artificial Sequence
  Synthetic Polynucleotide
taatacgactcactatagggttccacagataaatggacagcacttagcataacagaggagaatgctaatggctgtccataacctggcggcagcgcaaaagatg

SEQ ID NO: 19348 - DNA, 103 bp, Artificial Sequence
  Synthetic Polynucleotide
taatacgactcactatagggagcttttccacagataaatggacagcacttaacagaggagaaagtgcatgccatttatcaacctggcggcagcgcaaaagatg

SEQ ID NO: 19349 - DNA, 103 bp, Artificial Sequence
  Synthetic Polynucleotide
taatacgactcactatagggcattggattatgggcaacggctgcagggttaacagaggagaaaccctatggccgttgccaacctggcggcagcgcaaaagatg

SEQ ID NO: 19350 - DNA, 103 bp, Artificial Sequence
  Synthetic Polynucleotide
taatacgactcactatagggtctacagcttttccacagataaatggacagaacagaggagactgtccatgtatctgtggaacctggcggcagcgcaaaagatg

SEQ ID NO: 19351 - DNA, 103 bp, Artificial Sequence
  Synthetic Polynucleotide
taatacgactcactatagggtaaactctacagcttttccacagataaatgaacagaggagacatttaatggtggaaaagaacctggcggcagcgcaaaagatg

SEQ ID NO: 19352 - DNA, 103 bp, Artificial Sequence
  Synthetic Polynucleotide
taatacgactcactatagggatctttaaactctacagcttttccacagataacagaggagaatctgtatgaaagctgtaaacctggcggcagcgcaaaagatg

SEQ ID NO: 19353 - DNA, 103 bp, Artificial Sequence
  Synthetic Polynucleotide
taatacgactcactatagggtttctatctttaaactctacagcttttccaaacagaggagatggaaaatgtgtagagttaacctggcggcagcgcaaaagatg

SEQ ID NO: 19354 - DNA, 103 bp, Artificial Sequence
  Synthetic Polynucleotide
taatacgactcactatagggatgaatttctatctttaaactctacagcttaacagaggagaaagctgatgagtttaaagaacctggcggcagcgcaaaagatg

SEQ ID NO: 19355 - DNA, 103 bp, Artificial Sequence
  Synthetic Polynucleotide
taatacgactcactatagggtgtacatgaatttctatctttaaactctacaacagaggagagtagagatgaaagatagaaacctggcggcagcgcaaaagatg

SEQ ID NO: 19356 - DNA, 103 bp, Artificial Sequence
  Synthetic Polynucleotide
taatacgactcactatagggaaggttgtacatgaatttctatctttaaacaacagaggagagtttaaatgtagaaattcaacctggcggcagcgcaaaagatg

SEQ ID NO: 19357 - DNA, 103 bp, Artificial Sequence
  Synthetic Polynucleotide
taatacgactcactatagggaagacaaggttgtacatgaatttctatcttaacagaggagaaagataatgattcatgtaaacctggcggcagcgcaaaagatg

SEQ ID NO: 19358 - DNA, 103 bp, Artificial Sequence
  Synthetic Polynucleotide
taatacgactcactatagggagataaagacaaggttgtacatgaatttctaacagaggagaagaaatatgtgtacaaccaacctggcggcagcgcaaaagatg

SEQ ID NO: 19359 - DNA, 103 bp, Artificial Sequence
  Synthetic Polynucleotide
taatacgactcactatagggaattgagataaagacaaggttgtacatgaaaacagaggagattcatgatgaaccttgtcaacctggcggcagcgcaaaagatg

SEQ ID NO: 19360 - DNA, 103 bp, Artificial Sequence
  Synthetic Polynucleotide
taatacgactcactatagggaaacccattggattatgggcaacggctgcaaacagaggagatgcagcatgtgcccataaaacctggcggcagcgcaaaagatg

SEQ ID NO: 19361 - DNA, 103 bp, Artificial Sequence
  Synthetic Polynucleotide
taatacgactcactatagggtatacaattgagataaagacaaggttgtacaacagaggagagtacaaatgtgtctttataacctggcggcagcgcaaaagatg

SEQ ID NO: 19362 - DNA, 103 bp, Artificial Sequence
  Synthetic Polynucleotide
taatacgactcactatagggatgactatacaattgagataaagacaaggtaacagaggagaaccttgatgttatctcaaaacctggcggcagcgcaaaagatg

SEQ ID NO: 19363 - DNA, 103 bp, Artificial Sequence
  Synthetic Polynucleotide
taatacgactcactatagggtttatatgactatacaattgagataaagacaacagaggagagtctttatgtcaattgtaaacctggcggcagcgcaaaagatg

SEQ ID NO: 19364 - DNA, 103 bp, Artificial Sequence
  Synthetic Polynucleotide
taatacgactcactatagggcttcctttatatgactatacaattgagataaacagaggagatatctcatgtgtatagtcaacctggcggcagcgcaaaagatg

SEQ ID NO: 19365 - DNA, 103 bp, Artificial Sequence
  Synthetic Polynucleotide
taatacgactcactatagggatcttcttcctttatatgactatacaattgaacagaggagacaattgatgagtcatataaacctggcggcagcgcaaaagatg

SEQ ID NO: 19366 - DNA, 103 bp, Artificial Sequence
  Synthetic Polynucleotide
taatacgactcactatagggctcctatcttcttcctttatatgactatacaacagaggagagtatagatgtataaaggaaacctggcggcagcgcaaaagatg

SEQ ID NO: 19367 - DNA, 103 bp, Artificial Sequence
  Synthetic Polynucleotide
taatacgactcactatagggttcttctcctatcttcttcctttatatgacaacagaggagagtcataatgaggaagaagaacctggcggcagcgcaaaagatg

SEQ ID NO: 19368 - DNA, 103 bp, Artificial Sequence
  Synthetic Polynucleotide
taatacgactcactatagggactgcttcttctcctatcttcttcctttataacagaggagaataaagatggaagataggaacctggcggcagcgcaaaagatg

SEQ ID NO: 19369 - DNA, 103 bp, Artificial Sequence
  Synthetic Polynucleotide
taatacgactcactataggggctgcactgcttcttctcctatcttcttccaacagaggagaggaagaatgtaggagaagaacctggcggcagcgcaaaagatg

SEQ ID NO: 19370 - DNA, 103 bp, Artificial Sequence
  Synthetic Polynucleotide
taatacgactcactatagggcttgtgctgcactgcttcttctcctatcttaacagaggagaaagataatggaagaagcaaacctggcggcagcgcaaaagatg

SEQ ID NO: 19371 - DNA, 103 bp, Artificial Sequence
  Synthetic Polynucleotide
taatacgactcactatagggaccgcaaacccattggattatgggcaacggaacagaggagaccgttgatgataatccaaaacctggcggcagcgcaaaagatg

SEQ ID NO: 19372 - DNA, 103 bp, Artificial Sequence
  Synthetic Polynucleotide
taatacgactcactatagggcattgcttgtgctgcactgcttcttctcctaacagaggagaaggagaatgagcagtgcaaacctggcggcagcgcaaaagatg

SEQ ID NO: 19373 - DNA, 103 bp, Artificial Sequence
  Synthetic Polynucleotide
taatacgactcactataggggcctccattgcttgtgctgcactgcttcttaacagaggagaaagaagatgtgcagcacaaacctggcggcagcgcaaaagatg

SEQ ID NO: 19374 - DNA, 103 bp, Artificial Sequence
  Synthetic Polynucleotide
taatacgactcactatagggatatagcctccattgcttgtgctgcactgcaacagaggagagcagtgatgcacaagcaaaacctggcggcagcgcaaaagatg

SEQ ID NO: 19375 - DNA, 103 bp, Artificial Sequence
  Synthetic Polynucleotide
taatacgactcactatagggttgaaatatagcctccattgcttgtgctgcaacagaggagagcagcaatggcaatggagaacctggcggcagcgcaaaagatg

SEQ ID NO: 19376 - DNA, 103 bp, Artificial Sequence
  Synthetic Polynucleotide
taatacgactcactatagggataccttgaaatatagcctccattgcttgtaacagaggagaacaagcatgggaggctataacctggcggcagcgcaaaagatg

SEQ ID NO: 19377 - DNA, 103 bp, Artificial Sequence
  Synthetic Polynucleotide
taatacgactcactatagggggtctataccttgaaatatagcctccattgaacagaggagacaatggatgctatatttcaacctggcggcagcgcaaaagatg

SEQ ID NO: 19378 - DNA, 103 bp, Artificial Sequence
  Synthetic Polynucleotide
taatacgactcactatagggttggaggtctataccttgaaatatagcctcaacagaggagagaggctatgtttcaaggtaacctggcggcagcgcaaaagatg

SEQ ID NO: 19379 - DNA, 103 bp, Artificial Sequence
  Synthetic Polynucleotide
taatacgactcactatagggggagattggaggtctataccttgaaatataaacagaggagatatattatgaggtatagaaacctggcggcagcgcaaaagatg

SEQ ID NO: 19380 - DNA, 103 bp, Artificial Sequence
  Synthetic Polynucleotide
taatacgactcactataggggtggaggagattggaggtctataccttgaaaacagaggagattcaagatgtagacctccaacctggcggcagcgcaaaagatg

SEQ ID NO: 19381 - DNA, 103 bp, Artificial Sequence
  Synthetic Polynucleotide
taatacgactcactatagggtggaggtggaggagattggaggtctataccaacagaggagaggtataatgctccaatctaacctggcggcagcgcaaaagatg

SEQ ID NO: 19382 - DNA, 103 bp, Artificial Sequence
  Synthetic Polynucleotide
taatacgactcactatagggttacgaccgcaaacccattggattatgggcaacagaggagagcccatatgccaatgggtaacctggcggcagcgcaaaagatg

SEQ ID NO: 19383 - DNA, 103 bp, Artificial Sequence
  Synthetic Polynucleotide
taatacgactcactatagggatggctggaggtggaggagattggaggtctaacagaggagaagacctatgatctcctccaacctggcggcagcgcaaaagatg

SEQ ID NO: 19384 - DNA, 103 bp, Artificial Sequence
  Synthetic Polynucleotide
taatacgactcactatagggcagctatggctggaggtggaggagattggaaacagaggagatccaatatgctccacctcaacctggcggcagcgcaaaagatg

SEQ ID NO: 19385 - DNA, 103 bp, Artificial Sequence
  Synthetic Polynucleotide
taatacgactcactataggggaggtcagctatggctggaggtggaggagaaacagaggagatctcctatgcctccagccaacctggcggcagcgcaaaagatg

SEQ ID NO: 19386 - DNA, 103 bp, Artificial Sequence
  Synthetic Polynucleotide
taatacgactcactatagggctaaggaggtcagctatggctggaggtggaaacagaggagatccaccatgagccatagcaacctggcggcagcgcaaaagatg

SEQ ID NO: 19387 - DNA, 103 bp, Artificial Sequence
  Synthetic Polynucleotide
taatacgactcactatagggcagacctaaggaggtcagctatggctggagaacagaggagactccagatgtagctgaccaacctggcggcagcgcaaaagatg

SEQ ID NO: 19388 - DNA, 103 bp, Artificial Sequence
  Synthetic Polynucleotide
taatacgactcactatagggtttcacagacctaaggaggtcagctatggcaacagaggagagccataatggacctccttaacctggcggcagcgcaaaagatg

SEQ ID NO: 19389 - DNA, 103 bp, Artificial Sequence
  Synthetic Polynucleotide
taatacgactcactatagggggtgttttcacagacctaaggaggtcagctaacagaggagaagctgaatgccttaggtcaacctggcggcagcgcaaaagatg

SEQ ID NO: 19390 - DNA, 103 bp, Artificial Sequence
  Synthetic Polynucleotide
taatacgactcactatagggtctctggtgttttcacagacctaaggaggtaacagaggagaacctccatgggtctgtgaaacctggcggcagcgcaaaagatg

SEQ ID NO: 19391 - DNA, 103 bp, Artificial Sequence
  Synthetic Polynucleotide
taatacgactcactatagggaatgatctctggtgttttcacagacctaagaacagaggagacttaggatggtgaaaacaaacctggcggcagcgcaaaagatg

SEQ ID NO: 19392 - DNA, 103 bp, Artificial Sequence
  Synthetic Polynucleotide
taatacgactcactatagggtacttaatgatctctggtgttttcacagacaacagaggagagtctgtatgaacaccagaaacctggcggcagcgcaaaagatg

SEQ ID NO: 19393 - DNA, 103 bp, Artificial Sequence
  Synthetic Polynucleotide
taatacgactcactatagggacgcattacgaccgcaaacccattggattaaacagaggagataatccatggggtttgcgaacctggcggcagcgcaaaagatg

SEQ ID NO: 19394 - DNA, 103 bp, Artificial Sequence
  Synthetic Polynucleotide
taatacgactcactatagggggcaatacttaatgatctctggtgttttcaaacagaggagatgaaaaatgcagagatcaaacctggcggcagcgcaaaagatg

SEQ ID NO: 19395 - DNA, 103 bp, Artificial Sequence
  Synthetic Polynucleotide
taatacgactcactatagggatcttggcaatacttaatgatctctggtgtaacagaggagaacaccaatgatcattaagaacctggcggcagcgcaaaagatg

SEQ ID NO: 19396 - DNA, 103 bp, Artificial Sequence
  Synthetic Polynucleotide
taatacgactcactatagggttattatcttggcaatacttaatgatctctaacagaggagaagagatatgtaagtattgaacctggcggcagcgcaaaagatg

SEQ ID NO: 19397 - DNA, 103 bp, Artificial Sequence
  Synthetic Polynucleotide
taatacgactcactatagggtccaattattatcttggcaatacttaatgaaacagaggagatcattaatgattgccaagaacctggcggcagcgcaaaagatg

SEQ ID NO: 19398 - DNA, 103 bp, Artificial Sequence
  Synthetic Polynucleotide
taatacgactcactatagggaacaatccaattattatcttggcaatacttaacagaggagaaagtatatgcaagataataacctggcggcagcgcaaaagatg

SEQ ID NO: 19399 - DNA, 103 bp, Artificial Sequence
  Synthetic Polynucleotide
taatacgactcactataggggctggaacaatccaattattatcttggcaaaacagaggagattgccaatgtaataattgaacctggcggcagcgcaaaagatg

SEQ ID NO: 19400 - DNA, 103 bp, Artificial Sequence
  Synthetic Polynucleotide
taatacgactcactatagggactctgctggaacaatccaattattatcttaacagaggagaaagataatgattggattgaacctggcggcagcgcaaaagatg

SEQ ID NO: 19401 - DNA, 103 bp, Artificial Sequence
  Synthetic Polynucleotide
taatacgactcactatagggagaacactctgctggaacaatccaattattaacagaggagaaataatatgattgttccaaacctggcggcagcgcaaaagatg

SEQ ID NO: 19402 - DNA, 103 bp, Artificial Sequence
  Synthetic Polynucleotide
taatacgactcactatagggtcaatagaacactctgctggaacaatccaaaacagaggagattggatatgtccagcagaaacctggcggcagcgcaaaagatg

SEQ ID NO: 19403 - DNA, 103 bp, Artificial Sequence
  Synthetic Polynucleotide
taatacgactcactatagggctctttcaatagaacactctgctggaacaaaacagaggagattgttcatgcagagtgttaacctggcggcagcgcaaaagatg

SEQ ID NO: 19404 - DNA, 103 bp, Artificial Sequence
  Synthetic Polynucleotide
taatacgactcactatagggctcatctttcaatatctacctgctttcgctaacagaggagaagcgaaatgaggtagataaacctggcggcagcgcaaaagatg

SEQ ID NO: 19405 - DNA, 103 bp, Artificial Sequence
  Synthetic Polynucleotide
taatacgactcactataggggacgggatgatagagagaacgtacgtttcgaacagaggagacgaaacatgcgttctctcaacctggcggcagcgcaaaagatg

SEQ ID NO: 19406 - DNA, 103 bp, Artificial Sequence
  Synthetic Polynucleotide
taatacgactcactataggggtcaccatttgcctatgagaccgatgctggaacagaggagaccagcaatggtctcatagaacctggcggcagcgcaaaagatg

SEQ ID NO: 19407 - DNA, 103 bp, Artificial Sequence
  Synthetic Polynucleotide
taatacgactcactatagggttgttgtcaccatttgcctatgagaccgataacagaggagaatcggtatgataggcaaaaacctggcggcagcgcaaaagatg

SEQ ID NO: 19408 - DNA, 103 bp, Artificial Sequence
  Synthetic Polynucleotide
taatacgactcactataggggttggttgttgtcaccatttgcctatgagaaacagaggagatctcatatgcaaatggtgaacctggcggcagcgcaaaagatg

SEQ ID NO: 19409 - DNA, 103 bp, Artificial Sequence
  Synthetic Polynucleotide
taatacgactcactatagggagtgggttggttgttgtcaccatttgcctaaacagaggagataggcaatgggtgacaacaacctggcggcagcgcaaaagatg

SEQ ID NO: 19410 - DNA, 103 bp, Artificial Sequence
  Synthetic Polynucleotide
taatacgactcactatagggtgattagtgggttggttgttgtcaccatttaacagaggagaaaatggatgcaacaaccaaacctggcggcagcgcaaaagatg

SEQ ID NO: 19411 - DNA, 103 bp, Artificial Sequence
  Synthetic Polynucleotide
taatacgactcactatagggatgtctgattagtgggttggttgttgtcacaacagaggagagtgacaatgaccaacccaaacctggcggcagcgcaaaagatg

SEQ ID NO: 19412 - DNA, 103 bp, Artificial Sequence
  Synthetic Polynucleotide
taatacgactcactatagggttctcatgtctgattagtgggttggttgttaacagaggagaaacaacatgcccactaataacctggcggcagcgcaaaagatg

SEQ ID NO: 19413 - DNA, 103 bp, Artificial Sequence
  Synthetic Polynucleotide
taatacgactcactatagggttctgttctcatgtctgattagtgggttggaacagaggagaccaaccatgtaatcagacaacctggcggcagcgcaaaagatg

SEQ ID NO: 19414 - DNA, 103 bp, Artificial Sequence
  Synthetic Polynucleotide
taatacgactcactatagggaaccattctgttctcatgtctgattagtggaacagaggagaccactaatgagacatgagaacctggcggcagcgcaaaagatg

SEQ ID NO: 19415 - DNA, 103 bp, Artificial Sequence
  Synthetic Polynucleotide
taatacgactcactataggggctaaaaccattctgttctcatgtctgattaacagaggagaaatcagatgtgagaacagaacctggcggcagcgcaaaagatg

SEQ ID NO: 19416 - DNA, 103 bp, Artificial Sequence
  Synthetic Polynucleotide
taatacgactcactatagggggcctgacgggatgatagagagaacgtacgaacagaggagacgtacgatgtctctatcaaacctggcggcagcgcaaaagatg

SEQ ID NO: 19417 - DNA, 103 bp, Artificial Sequence
  Synthetic Polynucleotide
taatacgactcactatagggtgctggctaaaaccattctgttctcatgtcaacagaggagagacatgatgacagaatggaacctggcggcagcgcaaaagatg

SEQ ID NO: 19418 - DNA, 103 bp, Artificial Sequence
  Synthetic Polynucleotide
taatacgactcactatagggtgtagtgctggctaaaaccattctgttctcaacagaggagagagaacatgatggttttaaacctggcggcagcgcaaaagatg

SEQ ID NO: 19419 - DNA, 103 bp, Artificial Sequence
  Synthetic Polynucleotide
taatacgactcactatagggttagctgtagtgctggctaaaaccattctgaacagaggagacagaatatgtttagccagaacctggcggcagcgcaaaagatg

SEQ ID NO: 19420 - DNA, 103 bp, Artificial Sequence
  Synthetic Polynucleotide
taatacgactcactatagggtagccttagctgtagtgctggctaaaaccaaacagaggagatggtttatgccagcactaaacctggcggcagcgcaaaagatg

SEQ ID NO: 19421 - DNA, 103 bp, Artificial Sequence
  Synthetic Polynucleotide
taatacgactcactatagggctccatagccttagctgtagtgctggctaaaacagaggagattagccatgactacagctaacctggcggcagcgcaaaagatg

SEQ ID NO: 19422 - DNA, 103 bp, Artificial Sequence
  Synthetic Polynucleotide
taatacgactcactatagggatttgctccatagccttagctgtagtgctgaacagaggagacagcacatgagctaaggcaacctggcggcagcgcaaaagatg

SEQ ID NO: 19423 - DNA, 103 bp, Artificial Sequence
  Synthetic Polynucleotide
taatacgactcactatagggcagccatttgctccatagccttagctgtagaacagaggagactacagatgaggctatggaacctggcggcagcgcaaaagatg

SEQ ID NO: 19424 - DNA, 103 bp, Artificial Sequence
  Synthetic Polynucleotide
taatacgactcactatagggcgatccagccatttgctccatagccttagcaacagaggagagctaagatgatggagcaaaacctggcggcagcgcaaaagatg

SEQ ID NO: 19425 - DNA, 103 bp, Artificial Sequence
  Synthetic Polynucleotide
taatacgactcactatagggtcactcgatccagccatttgctccatagccaacagaggagaggctatatggcaaatggcaacctggcggcagcgcaaaagatg

SEQ ID NO: 19426 - DNA, 103 bp, Artificial Sequence
  Synthetic Polynucleotide
taatacgactcactatagggcttgctcactcgatccagccatttgctccaaacagaggagatggagcatgtggctggataacctggcggcagcgcaaaagatg

SEQ ID NO: 19427 - DNA, 103 bp, Artificial Sequence
  Synthetic Polynucleotide
taatacgactcactataggggagggggcctgacgggatgatagagagaacaacagaggagagttctcatgatcatcccgaacctggcggcagcgcaaaagatg

SEQ ID NO: 19428 - DNA, 103 bp, Artificial Sequence
  Synthetic Polynucleotide
taatacgactcactatagggtgctgcttgctcactcgatccagccatttgaacagaggagacaaatgatgggatcgagtaacctggcggcagcgcaaaagatg

SEQ ID NO: 19429 - DNA, 103 bp, Artificial Sequence
  Synthetic Polynucleotide
taatacgactcactataggggcctctgctgcttgctcactcgatccagccaacagaggagaggctggatggagtgagcaaacctggcggcagcgcaaaagatg

SEQ ID NO: 19430 - DNA, 103 bp, Artificial Sequence
  Synthetic Polynucleotide
taatacgactcactatagggccatggcctctgctgcttgctcactcgatcaacagaggagagatcgaatgagcaagcagaacctggcggcagcgcaaaagatg

SEQ ID NO: 19431 - DNA, 103 bp, Artificial Sequence
  Synthetic Polynucleotide
taatacgactcactatagggaacctccatggcctctgctgcttgctcactaacagaggagaagtgagatggcagcagagaacctggcggcagcgcaaaagatg

SEQ ID NO: 19432 - DNA, 103 bp, Artificial Sequence
  Synthetic Polynucleotide
taatacgactcactatagggctagcaacctccatggcctctgctgcttgcaacagaggagagcaagcatgagaggccataacctggcggcagcgcaaaagatg

SEQ ID NO: 19433 - DNA, 103 bp, Artificial Sequence
  Synthetic Polynucleotide
taatacgactcactatagggcctgactagcaacctccatggcctctgctgaacagaggagacagcagatgccatggaggaacctggcggcagcgcaaaagatg

SEQ ID NO: 19434 - DNA, 103 bp, Artificial Sequence
  Synthetic Polynucleotide
taatacgactcactatagggcctagcctgactagcaacctccatggcctcaacagaggagagaggccatggaggttgctaacctggcggcagcgcaaaagatg

SEQ ID NO: 19435 - DNA, 103 bp, Artificial Sequence
  Synthetic Polynucleotide
taatacgactcactatagggatttgcctagcctgactagcaacctccatgaacagaggagacatggaatgtgctagtcaaacctggcggcagcgcaaaagatg

SEQ ID NO: 19436 - DNA, 103 bp, Artificial Sequence
  Synthetic Polynucleotide
taatacgactcactataggggcaccatttgcctagcctgactagcaacctaacagaggagaaggttgatggtcaggctaaacctggcggcagcgcaaaagatg

SEQ ID NO: 19437 - DNA, 103 bp, Artificial Sequence
  Synthetic Polynucleotide
taatacgactcactatagggcgcttgcaccatttgcctagcctgactagcaacagaggagagctagtatggctaggcaaaacctggcggcagcgcaaaagatg

SEQ ID NO: 19438 - DNA, 103 bp, Artificial Sequence
  Synthetic Polynucleotide
taatacgactcactataggggctttgagggggcctgacgggatgatagagaacagaggagactctatatgcccgtcaggaacctggcggcagcgcaaaagatg

SEQ ID NO: 19439 - DNA, 103 bp, Artificial Sequence
  Synthetic Polynucleotide
taatacgactcactatagggctcatcgcttgcaccatttgcctagcctgaaacagaggagatcaggcatggcaaatggtaacctggcggcagcgcaaaagatg

SEQ ID NO: 19440 - DNA, 103 bp, Artificial Sequence
  Synthetic Polynucleotide
taatacgactcactatagggtggttctcatcgcttgcaccatttgcctagaacagaggagactaggcatgtggtgcaagaacctggcggcagcgcaaaagatg

SEQ ID NO: 19441 - DNA, 103 bp, Artificial Sequence
  Synthetic Polynucleotide
taatacgactcactatagggcccaatggttctcatcgcttgcaccatttgaacagaggagacaaatgatgcaagcgatgaacctggcggcagcgcaaaagatg

SEQ ID NO: 19442 - DNA, 103 bp, Artificial Sequence
  Synthetic Polynucleotide
taatacgactcactatagggtgagtcccaatggttctcatcgcttgcaccaacagaggagaggtgcaatggatgagaacaacctggcggcagcgcaaaagatg

SEQ ID NO: 19443 - DNA, 103 bp, Artificial Sequence
  Synthetic Polynucleotide
taatacgactcactatagggtaggatgagtcccaatggttctcatcgcttaacagaggagaaagcgaatggaaccattgaacctggcggcagcgcaaaagatg

SEQ ID NO: 19444 - DNA, 103 bp, Artificial Sequence
  Synthetic Polynucleotide
taatacgactcactatagggggagctaggatgagtcccaatggttctcataacagaggagaatgagaatgattgggactaacctggcggcagcgcaaaagatg

SEQ ID NO: 19445 - DNA, 103 bp, Artificial Sequence
  Synthetic Polynucleotide
taatacgactcactataggggcactggagctaggatgagtcccaatggttaacagaggagaaaccatatggactcatccaacctggcggcagcgcaaaagatg

SEQ ID NO: 19446 - DNA, 103 bp, Artificial Sequence
  Synthetic Polynucleotide
taatacgactcactataggggaccagcactggagctaggatgagtcccaaaacagaggagattgggaatgatcctagctaacctggcggcagcgcaaaagatg

SEQ ID NO: 19447 - DNA, 103 bp, Artificial Sequence
  Synthetic Polynucleotide
taatacgactcactatagggtttcagaccagcactggagctaggatgagtaacagaggagaactcatatgagctccagtaacctggcggcagcgcaaaagatg

SEQ ID NO: 19448 - DNA, 103 bp, Artificial Sequence
  Synthetic Polynucleotide
taatacgactcactatagggtcatttttcagaccagcactggagctaggaaacagaggagatcctagatgcagtgctggaacctggcggcagcgcaaaagatg

SEQ ID NO: 19449 - DNA, 103 bp, Artificial Sequence
  Synthetic Polynucleotide
taatacgactcactatagggtctcggctttgagggggcctgacgggatgaaacagaggagatcatccatgcaggcccccaacctggcggcagcgcaaaagatg

SEQ ID NO: 19450 - DNA, 103 bp, Artificial Sequence
  Synthetic Polynucleotide
taatacgactcactataggggaagatcatttttcagaccagcactggagcaacagaggagagctccaatgctggtctgaaacctggcggcagcgcaaaagatg

SEQ ID NO: 19451 - DNA, 103 bp, Artificial Sequence
  Synthetic Polynucleotide
taatacgactcactatagggttcaagaagatcatttttcagaccagcactaacagaggagaagtgctatgctgaaaaataacctggcggcagcgcaaaagatg

SEQ ID NO: 19452 - DNA, 103 bp, Artificial Sequence
  Synthetic Polynucleotide
taatacgactcactatagggaaattttcaagaagatcatttttcagaccaaacagaggagatggtctatgaaatgatctaacctggcggcagcgcaaaagatg

SEQ ID NO: 19453 - DNA, 103 bp, Artificial Sequence
  Synthetic Polynucleotide
taatacgactcactatagggcctgcaaattttcaagaagatcatttttcaaacagaggagatgaaaaatgatcttcttgaacctggcggcagcgcaaaagatg

SEQ ID NO: 19454 - DNA, 103 bp, Artificial Sequence
  Synthetic Polynucleotide
taatacgactcactatagggataggcctgcaaattttcaagaagatcattaacagaggagaaatgatatgcttgaaaataacctggcggcagcgcaaaagatg

SEQ ID NO: 19455 - DNA, 103 bp, Artificial Sequence
  Synthetic Polynucleotide
taatacgactcactatagggttctgataggcctgcaaattttcaagaagaaacagaggagatcttctatgaaatttgcaaacctggcggcagcgcaaaagatg

SEQ ID NO: 19456 - DNA, 103 bp, Artificial Sequence
  Synthetic Polynucleotide
taatacgactcactatagggttcgtttctgataggcctgcaaattttcaaaacagaggagattgaaaatgtgcaggcctaacctggcggcagcgcaaaagatg

SEQ ID NO: 19457 - DNA, 103 bp, Artificial Sequence
  Synthetic Polynucleotide
taatacgactcactatagggccccattcgtttctgataggcctgcaaattaacagaggagaaatttgatggcctatcagaacctggcggcagcgcaaaagatg

SEQ ID NO: 19458 - DNA, 103 bp, Artificial Sequence
  Synthetic Polynucleotide
taatacgactcactatagggtgcacccccattcgtttctgataggcctgcaacagaggagagcaggcatgtcagaaacgaacctggcggcagcgcaaaagatg

SEQ ID NO: 19459 - DNA, 103 bp, Artificial Sequence
  Synthetic Polynucleotide
taatacgactcactataggggcatctgcacccccattcgtttctgataggaacagaggagacctatcatgaacgaatggaacctggcggcagcgcaaaagatg

SEQ ID NO: 19460 - DNA, 103 bp, Artificial Sequence
  Synthetic Polynucleotide
taatacgactcactatagggtgcgatctcggctttgagggggcctgacggaacagaggagaccgtcaatgcccctcaaaaacctggcggcagcgcaaaagatg

SEQ ID NO: 19461 - DNA, 103 bp, Artificial Sequence
  Synthetic Polynucleotide
taatacgactcactatagggccgttgcatctgcacccccattcgtttctgaacagaggagacagaaaatgatgggggtgaacctggcggcagcgcaaaagatg

SEQ ID NO: 19462 - DNA, 103 bp, Artificial Sequence
  Synthetic Polynucleotide
taatacgactcactatagggttgaaccgttgcatctgcacccccattcgtaacagaggagaacgaatatgggtgcagataacctggcggcagcgcaaaagatg

SEQ ID NO: 19463 - DNA, 103 bp, Artificial Sequence
  Synthetic Polynucleotide
taatacgactcactatagggatcacttgaaccgttgcatctgcacccccaaacagaggagatgggggatgagatgcaacaacctggcggcagcgcaaaagatg

SEQ ID NO: 19464 - DNA, 103 bp, Artificial Sequence
  Synthetic Polynucleotide
taatacgactcactatagggagaggatcacttgaaccgttgcatctgcacaacagaggagagtgcagatgcaacggttcaacctggcggcagcgcaaaagatg

SEQ ID NO: 19465 - DNA, 103 bp, Artificial Sequence
  Synthetic Polynucleotide
taatacgactcactatagggtagcgagaggatcacttgaaccgttgcatcaacagaggagagatgcaatggttcaagtgaacctggcggcagcgcaaaagatg

SEQ ID NO: 19466 - DNA, 103 bp, Artificial Sequence
  Synthetic Polynucleotide
taatacgactcactatagggggcaatagcgagaggatcacttgaaccgttaacagaggagaaacggtatgagtgatcctaacctggcggcagcgcaaaagatg

SEQ ID NO: 19467 - DNA, 103 bp, Artificial Sequence
  Synthetic Polynucleotide
taatacgactcactatagggtttgcggcaatagcgagaggatcacttgaaaacagaggagattcaagatgtcctctcgcaacctggcggcagcgcaaaagatg

SEQ ID NO: 19468 - DNA, 103 bp, Artificial Sequence
  Synthetic Polynucleotide
taatacgactcactatagggtgatatttgcggcaatagcgagaggatcacaacagaggagagtgatcatgtcgctattgaacctggcggcagcgcaaaagatg

SEQ ID NO: 19469 - DNA, 103 bp, Artificial Sequence
  Synthetic Polynucleotide
taatacgactcactatagggcccaatgatatttgcggcaatagcgagaggaacagaggagacctctcatgattgccgcaaacctggcggcagcgcaaaagatg

SEQ ID NO: 19470 - DNA, 103 bp, Artificial Sequence
  Synthetic Polynucleotide
taatacgactcactatagggaagatcccaatgatatttgcggcaatagcgaacagaggagacgctatatgcgcaaatataacctggcggcagcgcaaaagatg

SEQ ID NO: 19471 - DNA, 103 bp, Artificial Sequence
  Synthetic Polynucleotide
taatacgactcactatagggctctgtgcgatctcggctttgagggggcctaacagaggagaaggcccatgcaaagccgaaacctggcggcagcgcaaaagatg

SEQ ID NO: 19472 - DNA, 103 bp, Artificial Sequence
  Synthetic Polynucleotide
taatacgactcactatagggagtgcaagatcccaatgatatttgcggcaaaacagaggagattgccgatgatatcattgaacctggcggcagcgcaaaagatg

SEQ ID NO: 19473 - DNA, 103 bp, Artificial Sequence
  Synthetic Polynucleotide
taatacgactcactatagggtatcaagtgcaagatcccaatgatatttgcaacagaggagagcaaatatgattgggatcaacctggcggcagcgcaaaagatg

SEQ ID NO: 19474 - DNA, 103 bp, Artificial Sequence
  Synthetic Polynucleotide
taatacgactcactatagggcacaatatcaagtgcaagatcccaatgataaacagaggagatatcatatggatcttgcaaacctggcggcagcgcaaaagatg

SEQ ID NO: 19475 - DNA, 103 bp, Artificial Sequence
  Synthetic Polynucleotide
taatacgactcactataggggaatccacaatatcaagtgcaagatcccaaaacagaggagattgggaatgtgcacttgaaacctggcggcagcgcaaaagatg

SEQ ID NO: 19476 - DNA, 103 bp, Artificial Sequence
  Synthetic Polynucleotide
taatacgactcactatagggatcaagaatccacaatatcaagtgcaagataacagaggagaatcttgatgttgatattgaacctggcggcagcgcaaaagatg

SEQ ID NO: 19477 - DNA, 103 bp, Artificial Sequence
  Synthetic Polynucleotide
taatacgactcactatagggagacgatcaagaatccacaatatcaagtgcaacagaggagagcacttatgattgtggataacctggcggcagcgcaaaagatg

SEQ ID NO: 19478 - DNA, 103 bp, Artificial Sequence
  Synthetic Polynucleotide
taatacgactcactatagggaaaaaagacgatcaagaatccacaatatcaaacagaggagatgatatatgggattcttgaacctggcggcagcgcaaaagatg

SEQ ID NO: 19479 - DNA, 103 bp, Artificial Sequence
  Synthetic Polynucleotide
taatacgactcactatagggtttgaaaaaaagacgatcaagaatccacaaaacagaggagattgtggatgcttgatcgtaacctggcggcagcgcaaaagatg

SEQ ID NO: 19480 - DNA, 103 bp, Artificial Sequence
  Synthetic Polynucleotide
taatacgactcactatagggatgcatttgaaaaaaagacgatcaagaatcaacagaggagagattctatgtcgtcttttaacctggcggcagcgcaaaagatg

SEQ ID NO: 19481 - DNA, 103 bp, Artificial Sequence
  Synthetic Polynucleotide
taatacgactcactatagggggtaaatgcatttgaaaaaaagacgatcaaaacagaggagattgatcatgtttttttcaaacctggcggcagcgcaaaagatg

SEQ ID NO: 19482 - DNA, 103 bp, Artificial Sequence
  Synthetic Polynucleotide
taatacgactcactatagggcaagtctctgtgcgatctcggctttgagggaacagaggagaccctcaatgccgagatcgaacctggcggcagcgcaaaagatg

SEQ ID NO: 19483 - DNA, 103 bp, Artificial Sequence
  Synthetic Polynucleotide
taatacgactcactataggggcgacggtaaatgcatttgaaaaaaagacgaacagaggagacgtcttatgttcaaatgcaacctggcggcagcgcaaaagatg

SEQ ID NO: 19484 - DNA, 103 bp, Artificial Sequence
  Synthetic Polynucleotide
taatacgactcactatagggttaaagcgacggtaaatgcatttgaaaaaaaacagaggagattttttatgatgcatttaaacctggcggcagcgcaaaagatg

SEQ ID NO: 19485 - DNA, 103 bp, Artificial Sequence
  Synthetic Polynucleotide
taatacgactcactatagggcgtatttaaagcgacggtaaatgcatttgaaacagaggagatcaaatatgtttaccgtcaacctggcggcagcgcaaaagatg

SEQ ID NO: 19486 - DNA, 103 bp, Artificial Sequence
  Synthetic Polynucleotide
taatacgactcactatagggcagtccgtatttaaagcgacggtaaatgcaaacagaggagatgcattatgcgtcgctttaacctggcggcagcgcaaaagatg

SEQ ID NO: 19487 - DNA, 103 bp, Artificial Sequence
  Synthetic Polynucleotide
taatacgactcactatagggcctttcagtccgtatttaaagcgacggtaaaacagaggagattaccgatgctttaaataaacctggcggcagcgcaaaagatg

SEQ ID NO: 19488 - DNA, 103 bp, Artificial Sequence
  Synthetic Polynucleotide
taatacgactcactataggggccctcctttcagtccgtatttaaagcgacaacagaggagagtcgctatgaatacggacaacctggcggcagcgcaaaagatg

SEQ ID NO: 19489 - DNA, 103 bp, Artificial Sequence
  Synthetic Polynucleotide
taatacgactcactatagggagaaggccctcctttcagtccgtatttaaaaacagaggagatttaaaatgggactgaaaaacctggcggcagcgcaaaagatg

SEQ ID NO: 19490 - DNA, 103 bp, Artificial Sequence
  Synthetic Polynucleotide
taatacgactcactatagggtccgtagaaggccctcctttcagtccgtataacagaggagaatacggatggaaaggaggaacctggcggcagcgcaaaagatg

SEQ ID NO: 19491 - DNA, 103 bp, Artificial Sequence
  Synthetic Polynucleotide
taatacgactcactatagggctccttccgtagaaggccctcctttcagtcaacagaggagagactgaatggagggccttaacctggcggcagcgcaaaagatg

SEQ ID NO: 19492 - DNA, 103 bp, Artificial Sequence
  Synthetic Polynucleotide
taatacgactcactatagggtggcactccttccgtagaaggccctcctttaacagaggagaaaaggaatgccttctacgaacctggcggcagcgcaaaagatg

SEQ ID NO: 19493 - DNA, 103 bp, Artificial Sequence
  Synthetic Polynucleotide
taatacgactcactatagggatcttcaagtctctgtgcgatctcggctttaacagaggagaaaagccatgatcgcacagaacctggcggcagcgcaaaagatg

SEQ ID NO: 19494 - DNA, 103 bp, Artificial Sequence
  Synthetic Polynucleotide
taatacgactcactataggggactttggcactccttccgtagaaggccctaacagaggagaagggccatgtacggaaggaacctggcggcagcgcaaaagatg

SEQ ID NO: 19495 - DNA, 103 bp, Artificial Sequence
  Synthetic Polynucleotide
taatacgactcactatagggtcatagactttggcactccttccgtagaagaacagaggagacttctaatgaaggagtgcaacctggcggcagcgcaaaagatg

SEQ ID NO: 19496 - DNA, 103 bp, Artificial Sequence
  Synthetic Polynucleotide
taatacgactcactatagggttccctcatagactttggcactccttccgtaacagaggagaacggaaatggtgccaaagaacctggcggcagcgcaaaagatg

SEQ ID NO: 19497 - DNA, 103 bp, Artificial Sequence
  Synthetic Polynucleotide
taatacgactcactatagggtattcttccctcatagactttggcactcctaacagaggagaaggagtatgaaagtctataacctggcggcagcgcaaaagatg

SEQ ID NO: 19498 - DNA, 103 bp, Artificial Sequence
  Synthetic Polynucleotide
taatacgactcactatagggttcgatattcttccctcatagactttggcaaacagaggagatgccaaatgctatgagggaacctggcggcagcgcaaaagatg

SEQ ID NO: 19499 - DNA, 103 bp, Artificial Sequence
  Synthetic Polynucleotide
taatacgactcactatagggttcctttcgatattcttccctcatagacttaacagaggagaaagtctatgagggaagaaaacctggcggcagcgcaaaagatg

SEQ ID NO: 19500 - DNA, 103 bp, Artificial Sequence
  Synthetic Polynucleotide
taatacgactcactatagggtgctgttcctttcgatattcttccctcataaacagaggagatatgagatgagaatatcgaacctggcggcagcgcaaaagatg

SEQ ID NO: 19501 - DNA, 103 bp, Artificial Sequence
  Synthetic Polynucleotide
taatacgactcactatagggcactctgctgttcctttcgatattcttcccaacagaggagagggaagatgatcgaaaggaacctggcggcagcgcaaaagatg

SEQ ID NO: 19502 - DNA, 103 bp, Artificial Sequence
  Synthetic Polynucleotide
taatacgactcactatagggcacagcactctgctgttcctttcgatattcaacagaggagagaatatatgaaggaacagaacctggcggcagcgcaaaagatg

SEQ ID NO: 19503 - DNA, 103 bp, Artificial Sequence
  Synthetic Polynucleotide
taatacgactcactataggggcatccacagcactctgctgttcctttcgaaacagaggagatcgaaaatgacagcagagaacctggcggcagcgcaaaagatg

SEQ ID NO: 19504 - DNA, 103 bp, Artificial Sequence
  Synthetic Polynucleotide
taatacgactcactatagggaagacatcttcaagtctctgtgcgatctcgaacagaggagacgagatatgacagagactaacctggcggcagcgcaaaagatg

SEQ ID NO: 19505 - DNA, 103 bp, Artificial Sequence
  Synthetic Polynucleotide
taatacgactcactatagggcgtcagcatccacagcactctgctgttcctaacagaggagaaggaacatgagagtgctgaacctggcggcagcgcaaaagatg

SEQ ID NO: 19506 - DNA, 103 bp, Artificial Sequence
  Synthetic Polynucleotide
taatacgactcactatagggaccatcgtcagcatccacagcactctgctgaacagaggagacagcagatggctgtggataacctggcggcagcgcaaaagatg

SEQ ID NO: 19507 - DNA, 103 bp, Artificial Sequence
  Synthetic Polynucleotide
taatacgactcactatagggaaatgaccatcgtcagcatccacagcactcaacagaggagagagtgcatgggatgctgaaacctggcggcagcgcaaaagatg

SEQ ID NO: 19508 - DNA, 103 bp, Artificial Sequence
  Synthetic Polynucleotide
taatacgactcactatagggtgacaaaatgaccatcgtcagcatccacagaacagaggagactgtggatgctgacgatgaacctggcggcagcgcaaaagatg

SEQ ID NO: 19509 - DNA, 103 bp, Artificial Sequence
  Synthetic Polynucleotide
taatacgactcactatagggtatgctgacaaaatgaccatcgtcagcatcaacagaggagagatgctatggatggtcataacctggcggcagcgcaaaagatg

SEQ ID NO: 19510 - DNA, 103 bp, Artificial Sequence
  Synthetic Polynucleotide
taatacgactcactatagggagctctatgctgacaaaatgaccatcgtcaaacagaggagatgacgaatgtcattttgtaacctggcggcagcgcaaaagatg

SEQ ID NO: 19511 - DNA, 103 bp, Artificial Sequence
  Synthetic Polynucleotide
taatacgactcactatagggactccagctctatgctgacaaaatgaccataacagaggagaatggtcatgttgtcagcaaacctggcggcagcgcaaaagatg

SEQ ID NO: 19512 - DNA, 103 bp, Artificial Sequence
  Synthetic Polynucleotide
taatacgactcactatagggtttttactccagctctatgctgacaaaatgaacagaggagacattttatgagcatagagaacctggcggcagcgcaaaagatg

SEQ ID NO: 19513 - DNA, 103 bp, Artificial Sequence
  Synthetic Polynucleotide
taatacgactcactataggggtagttttttactccagctctatgctgacaaacagaggagatgtcagatgagagctggaaacctggcggcagcgcaaaagatg

SEQ ID NO: 19514 - DNA, 103 bp, Artificial Sequence
  Synthetic Polynucleotide
taatacgactcactatagggacaaggtagttttttactccagctctatgcaacagaggagagcatagatgtggagtaaaaacctggcggcagcgcaaaagatg

SEQ ID NO: 19515 - DNA, 103 bp, Artificial Sequence
  Synthetic Polynucleotide
taatacgactcactataggggaagactcatctttcaatatctacctgcttaacagaggagaaagcagatggatattgaaaacctggcggcagcgcaaaagatg

SEQ ID NO: 19516 - DNA, 103 bp, Artificial Sequence
  Synthetic Polynucleotide
taatacgactcactatagggctgcaaagacatcttcaagtctctgtgcgaaacagaggagatcgcacatggacttgaagaacctggcggcagcgcaaaagatg

SEQ ID NO: 19517 - DNA, 103 bp, Artificial Sequence
  Synthetic Polynucleotide
taatacgactcactatagggtagaaacaaggtagttttttactccagctcaacagaggagagagctgatgtaaaaaactaacctggcggcagcgcaaaagatg

SEQ ID NO: 19518 - DNA, 103 bp, Artificial Sequence
  Synthetic Polynucleotide
taatacgactcactatagggcttccctgcaaagacatcttcaagtctctgaacagaggagacagagaatggaagatgtcaacctggcggcagcgcaaaagatg

SEQ ID NO: 19519 - DNA, 103 bp, Artificial Sequence
  Synthetic Polynucleotide
taatacgactcactataggggtgttcttccctgcaaagacatcttcaagtaacagaggagaacttgaatgtgtctttgcaacctggcggcagcgcaaaagatg

SEQ ID NO: 19520 - DNA, 103 bp, Artificial Sequence
  Synthetic Polynucleotide
taatacgactcactataggggatcggtgttcttccctgcaaagacatcttaacagaggagaaagatgatgttgcagggaaacctggcggcagcgcaaaagatg

SEQ ID NO: 19521 - DNA, 103 bp, Artificial Sequence
  Synthetic Polynucleotide
taatacgactcactatagggctcaagatcggtgttcttccctgcaaagacaacagaggagagtctttatggggaagaacaacctggcggcagcgcaaaagatg

SEQ ID NO: 19522 - DNA, 103 bp, Artificial Sequence
  Synthetic Polynucleotide
taatacgactcactatagggagaacctcaagatcggtgttcttccctgcaaacagaggagatgcaggatggaacaccgaaacctggcggcagcgcaaaagatg

SEQ ID NO: 19523 - DNA, 103 bp, Artificial Sequence
  Synthetic Polynucleotide
taatacgactcactatagggccatgagaacctcaagatcggtgttcttccaacagaggagaggaagaatgccgatcttgaacctggcggcagcgcaaaagatg

SEQ ID NO: 19524 - DNA, 103 bp, Artificial Sequence
  Synthetic Polynucleotide
taatacgactcactatagggccattccatgagaacctcaagatcggtgttaacagaggagaaacaccatgcttgaggttaacctggcggcagcgcaaaagatg

SEQ ID NO: 19525 - DNA, 103 bp, Artificial Sequence
  Synthetic Polynucleotide
taatacgactcactatagggtttagccattccatgagaacctcaagatcgaacagaggagacgatctatgggttctcataacctggcggcagcgcaaaagatg

SEQ ID NO: 19526 - DNA, 103 bp, Artificial Sequence
  Synthetic Polynucleotide
taatacgactcactatagggttgtctttagccattccatgagaacctcaaaacagaggagattgaggatgtcatggaataacctggcggcagcgcaaaagatg

SEQ ID NO: 19527 - DNA, 103 bp, Artificial Sequence
  Synthetic Polynucleotide
taatacgactcactatagggggttagaagactcatctttcaatatctaccaacagaggagaggtagaatgtgaaagatgaacctggcggcagcgcaaaagatg

SEQ ID NO: 19528 - DNA, 103 bp, Artificial Sequence
  Synthetic Polynucleotide
taatacgactcactatagggtggtcttgtctttagccattccatgagaacaacagaggagagttctcatggaatggctaaacctggcggcagcgcaaaagatg

SEQ ID NO: 19529 - DNA, 103 bp, Artificial Sequence
  Synthetic Polynucleotide
taatacgactcactatagggaggattggtcttgtctttagccattccatgaacagaggagacatggaatggctaaagacaacctggcggcagcgcaaaagatg

SEQ ID NO: 19530 - DNA, 103 bp, Artificial Sequence
  Synthetic Polynucleotide
taatacgactcactataggggtgacaggattggtcttgtctttagccattaacagaggagaaatggcatgagacaagacaacctggcggcagcgcaaaagatg

SEQ ID NO: 19531 - DNA, 103 bp, Artificial Sequence
  Synthetic Polynucleotide
taatacgactcactatagggcagaggtgacaggattggtcttgtctttagaacagaggagactaaagatgagaccaatcaacctggcggcagcgcaaaagatg

SEQ ID NO: 19532 - DNA, 103 bp, Artificial Sequence
  Synthetic Polynucleotide
taatacgactcactatagggttagtcagaggtgacaggattggtcttgtcaacagaggagagacaagatgaatcctgtcaacctggcggcagcgcaaaagatg

SEQ ID NO: 19533 - DNA, 103 bp, Artificial Sequence
  Synthetic Polynucleotide
taatacgactcactatagggtccccttagtcagaggtgacaggattggtcaacagaggagagaccaaatgtgtcacctcaacctggcggcagcgcaaaagatg

SEQ ID NO: 19534 - DNA, 103 bp, Artificial Sequence
  Synthetic Polynucleotide
taatacgactcactatagggtaaaatccccttagtcagaggtgacaggataacagaggagaatcctgatgcctctgactaacctggcggcagcgcaaaagatg

SEQ ID NO: 19535 - DNA, 103 bp, Artificial Sequence
  Synthetic Polynucleotide
taatacgactcactatagggaatcctaaaatccccttagtcagaggtgacaacagaggagagtcaccatggactaagggaacctggcggcagcgcaaaagatg

SEQ ID NO: 19536 - DNA, 103 bp, Artificial Sequence
  Synthetic Polynucleotide
taatacgactcactatagggacacaaatcctaaaatccccttagtcagagaacagaggagactctgaatgaggggatttaacctggcggcagcgcaaaagatg

SEQ ID NO: 19537 - DNA, 103 bp, Artificial Sequence
  Synthetic Polynucleotide
taatacgactcactatagggcgtgaacacaaatcctaaaatccccttagtaacagaggagaactaagatgattttaggaaacctggcggcagcgcaaaagatg

SEQ ID NO: 19538 - DNA, 103 bp, Artificial Sequence
  Synthetic Polynucleotide
taatacgactcactatagggacctcggttagaagactcatctttcaatataacagaggagaatattgatggatgagtctaacctggcggcagcgcaaaagatg

SEQ ID NO: 19539 - DNA, 103 bp, Artificial Sequence
  Synthetic Polynucleotide
taatacgactcactataggggtgagcgtgaacacaaatcctaaaatccccaacagaggagaggggatatgaggatttgtaacctggcggcagcgcaaaagatg

SEQ ID NO: 19540 - DNA, 103 bp, Artificial Sequence
  Synthetic Polynucleotide
taatacgactcactataggggcacggtgagcgtgaacacaaatcctaaaaaacagaggagattttagatgttgtgttcaaacctggcggcagcgcaaaagatg

SEQ ID NO: 19541 - DNA, 103 bp, Artificial Sequence
  Synthetic Polynucleotide
taatacgactcactatagggactgggcacggtgagcgtgaacacaaatccaacagaggagaggatttatgttcacgctcaacctggcggcagcgcaaaagatg

SEQ ID NO: 19542 - DNA, 103 bp, Artificial Sequence
  Synthetic Polynucleotide
taatacgactcactatagggcgctcactgggcacggtgagcgtgaacacaaacagaggagatgtgttatggctcaccgtaacctggcggcagcgcaaaagatg

SEQ ID NO: 19543 - DNA, 103 bp, Artificial Sequence
  Synthetic Polynucleotide
taatacgactcactataggggtcctcgctcactgggcacggtgagcgtgaaacagaggagatcacgcatgccgtgcccaaacctggcggcagcgcaaaagatg

SEQ ID NO: 19544 - DNA, 103 bp, Artificial Sequence
  Synthetic Polynucleotide
taatacgactcactatagggctgcagtcctcgctcactgggcacggtgagaacagaggagactcaccatgcccagtgagaacctggcggcagcgcaaaagatg

SEQ ID NO: 19545 - DNA, 103 bp, Artificial Sequence
  Synthetic Polynucleotide
taatacgactcactatagggctacgctgcagtcctcgctcactgggcacgaacagaggagacgtgccatgtgagcgaggaacctggcggcagcgcaaaagatg

SEQ ID NO: 19546 - DNA, 103 bp, Artificial Sequence
  Synthetic Polynucleotide
taatacgactcactatagggagcgtctacgctgcagtcctcgctcactggaacagaggagaccagtgatggaggactgcaacctggcggcagcgcaaaagatg

SEQ ID NO: 19547 - DNA, 103 bp, Artificial Sequence
  Synthetic Polynucleotide
taatacgactcactataggggacaaagcgtctacgctgcagtcctcgctcaacagaggagagagcgaatgctgcagcgtaacctggcggcagcgcaaaagatg

SEQ ID NO: 19548 - DNA, 103 bp, Artificial Sequence
  Synthetic Polynucleotide
taatacgactcactatagggttttggacaaagcgtctacgctgcagtcctaacagaggagaaggactatggcgtagacgaacctggcggcagcgcaaaagatg

SEQ ID NO: 19549 - DNA, 103 bp, Artificial Sequence
  Synthetic Polynucleotide
taatacgactcactatagggtttcgacctcggttagaagactcatctttcaacagaggagagaaagaatggtcttctaaaacctggcggcagcgcaaaagatg

SEQ ID NO: 19550 - DNA, 103 bp, Artificial Sequence
  Synthetic Polynucleotide
taatacgactcactataggggggcattttggacaaagcgtctacgctgcaaacagaggagatgcagcatggacgctttgaacctggcggcagcgcaaaagatg

SEQ ID NO: 19551 - DNA, 103 bp, Artificial Sequence
  Synthetic Polynucleotide
taatacgactcactatagggattaagggcattttggacaaagcgtctacgaacagaggagacgtagaatgtttgtccaaaacctggcggcagcgcaaaagatg

SEQ ID NO: 19552 - DNA, 103 bp, Artificial Sequence
  Synthetic Polynucleotide
taatacgactcactatagggttcccattaagggcattttggacaaagcgtaacagaggagaacgcttatgccaaaatgcaacctggcggcagcgcaaaagatg

SEQ ID NO: 19553 - DNA, 103 bp, Artificial Sequence
  Synthetic Polynucleotide
taatacgactcactatagggccccgttcccattaagggcattttggacaaaacagaggagattgtccatgatgcccttaaacctggcggcagcgcaaaagatg

SEQ ID NO: 19554 - DNA, 103 bp, Artificial Sequence
  Synthetic Polynucleotide
taatacgactcactatagggtggatccccgttcccattaagggcattttgaacagaggagacaaaatatgcttaatgggaacctggcggcagcgcaaaagatg

SEQ ID NO: 19555 - DNA, 103 bp, Artificial Sequence
  Synthetic Polynucleotide
taatacgactcactatagggttatttggatccccgttcccattaagggcaaacagaggagatgccctatgtgggaacggaacctggcggcagcgcaaaagatg

SEQ ID NO: 19556 - DNA, 103 bp, Artificial Sequence
  Synthetic Polynucleotide
taatacgactcactatagggccatgttatttggatccccgttcccattaaaacagaggagattaatgatgacggggatcaacctggcggcagcgcaaaagatg

SEQ ID NO: 19557 - DNA, 103 bp, Artificial Sequence
  Synthetic Polynucleotide
taatacgactcactatagggtttgtccatgttatttggatccccgttcccaacagaggagagggaacatggatccaaataacctggcggcagcgcaaaagatg

SEQ ID NO: 19558 - DNA, 103 bp, Artificial Sequence
  Synthetic Polynucleotide
taatacgactcactatagggactgctttgtccatgttatttggatccccgaacagaggagacggggaatgaaataacataacctggcggcagcgcaaaagatg

SEQ ID NO: 19559 - DNA, 103 bp, Artificial Sequence
  Synthetic Polynucleotide
taatacgactcactataggggtttaactgctttgtccatgttatttggataacagaggagaatccaaatgacatggacaaacctggcggcagcgcaaaagatg

SEQ ID NO: 19560 - DNA, 103 bp, Artificial Sequence
  Synthetic Polynucleotide
taatacgactcactataggggtacgtttcgacctcggttagaagactcataacagaggagaatgagtatgctaaccgagaacctggcggcagcgcaaaagatg

SEQ ID NO: 19561 - DNA, 103 bp, Artificial Sequence
  Synthetic Polynucleotide
taatacgactcactatagggatacagtttaactgctttgtccatgttattaacagaggagaaataacatggacaaagcaaacctggcggcagcgcaaaagatg

SEQ ID NO: 19562 - DNA, 103 bp, Artificial Sequence
  Synthetic Polynucleotide
taatacgactcactatagggttcctatacagtttaactgctttgtccatgaacagaggagacatggaatgagcagttaaaacctggcggcagcgcaaaagatg

SEQ ID NO: 19563 - DNA, 103 bp, Artificial Sequence
  Synthetic Polynucleotide
taatacgactcactatagggtgagcttcctatacagtttaactgctttgtaacagaggagaacaaagatgttaaactgtaacctggcggcagcgcaaaagatg

SEQ ID NO: 19564 - DNA, 103 bp, Artificial Sequence
  Synthetic Polynucleotide
taatacgactcactatagggcctcttgagcttcctatacagtttaactgcaacagaggagagcagttatgctgtataggaacctggcggcagcgcaaaagatg

SEQ ID NO: 19565 - DNA, 103 bp, Artificial Sequence
  Synthetic Polynucleotide
taatacgactcactatagggatctccctcttgagcttcctatacagtttaaacagaggagataaactatgtaggaagctaacctggcggcagcgcaaaagatg

SEQ ID NO: 19566 - DNA, 103 bp, Artificial Sequence
  Synthetic Polynucleotide
taatacgactcactatagggatgttatctccctcttgagcttcctatacaaacagaggagatgtataatgagctcaagaaacctggcggcagcgcaaaagatg

SEQ ID NO: 19567 - DNA, 103 bp, Artificial Sequence
  Synthetic Polynucleotide
taatacgactcactatagggatggaatgttatctccctcttgagcttcctaacagaggagaaggaagatgaagagggagaacctggcggcagcgcaaaagatg

SEQ ID NO: 19568 - DNA, 103 bp, Artificial Sequence
  Synthetic Polynucleotide
taatacgactcactataggggccccatggaatgttatctccctcttgagcaacagaggagagctcaaatgggagataacaacctggcggcagcgcaaaagatg

SEQ ID NO: 19569 - DNA, 103 bp, Artificial Sequence
  Synthetic Polynucleotide
taatacgactcactatagggctttggccccatggaatgttatctccctctaacagaggagaagagggatgtaacattccaacctggcggcagcgcaaaagatg

SEQ ID NO: 19570 - DNA, 103 bp, Artificial Sequence
  Synthetic Polynucleotide
taatacgactcactataggggatttctttggccccatggaatgttatctcaacagaggagagagataatgttccatgggaacctggcggcagcgcaaaagatg

SEQ ID NO: 19571 - DNA, 103 bp, Artificial Sequence
  Synthetic Polynucleotide
taatacgactcactatagggagaacgtacgtttcgacctcggttagaagaaacagaggagatcttctatgcgaggtcgaaacctggcggcagcgcaaaagatg

SEQ ID NO: 19572 - DNA, 103 bp, Artificial Sequence
  Synthetic Polynucleotide
taatacgactcactatagggagtgagatttctttggccccatggaatgttaacagaggagaaacattatgtggggccaaaacctggcggcagcgcaaaagatg

SEQ ID NO: 19573 - DNA, 103 bp, Artificial Sequence
  Synthetic Polynucleotide
taatacgactcactatagggaactgagtgagatttctttggccccatggaaacagaggagatccatgatgccaaagaaaaacctggcggcagcgcaaaagatg

SEQ ID NO: 19574 - DNA, 103 bp, Artificial Sequence
  Synthetic Polynucleotide
taatacgactcactatagggagaataactgagtgagatttctttggccccaacagaggagaggggccatggaaatctcaaacctggcggcagcgcaaaagatg

SEQ ID NO: 19575 - DNA, 103 bp, Artificial Sequence
  Synthetic Polynucleotide
taatacgactcactatagggccagcagaataactgagtgagatttctttgaacagaggagacaaagaatgctcactcagaacctggcggcagcgcaaaagatg

SEQ ID NO: 19576 - DNA, 103 bp, Artificial Sequence
  Synthetic Polynucleotide
taatacgactcactataggggtgcaccagcagaataactgagtgagatttaacagaggagaaaatctatgtcagttattaacctggcggcagcgcaaaagatg

SEQ ID NO: 19577 - DNA, 103 bp, Artificial Sequence
  Synthetic Polynucleotide
taatacgactcactatagggggcaagtgcaccagcagaataactgagtgaaacagaggagatcactcatgtattctgctaacctggcggcagcgcaaaagatg

SEQ ID NO: 19578 - DNA, 103 bp, Artificial Sequence
  Synthetic Polynucleotide
taatacgactcactatagggcaactggcaagtgcaccagcagaataactgaacagaggagacagttaatgtgctggtgcaacctggcggcagcgcaaaagatg

SEQ ID NO: 19579 - DNA, 103 bp, Artificial Sequence
  Synthetic Polynucleotide
taatacgactcactatagggccatacaactggcaagtgcaccagcagaataacagaggagaattctgatggtgcacttgaacctggcggcagcgcaaaagatg

SEQ ID NO: 19580 - DNA, 103 bp, Artificial Sequence
  Synthetic Polynucleotide
taatacgactcactataggggaggcccatacaactggcaagtgcaccagcaacagaggagagctggtatgcttgccagtaacctggcggcagcgcaaaagatg

SEQ ID NO: 19581 - DNA, 103 bp, Artificial Sequence
  Synthetic Polynucleotide
taatacgactcactatagggtatatgaggcccatacaactggcaagtgcaaacagaggagatgcactatgcagttgtataacctggcggcagcgcaaaagatg

SEQ ID NO: 19582 - DNA, 103 bp, Artificial Sequence
  Synthetic Polynucleotide
taatacgactcactatagggtagagagaacgtacgtttcgacctcggttaaacagaggagataaccgatgtcgaaacgtaacctggcggcagcgcaaaagatg

SEQ ID NO: 19583 - DNA, 103 bp, Artificial Sequence
  Synthetic Polynucleotide
taatacgactcactatagggtgttgtatatgaggcccatacaactggcaaaacagaggagattgccaatggtatgggccaacctggcggcagcgcaaaagatg

SEQ ID NO: 19584 - DNA, 103 bp, Artificial Sequence
  Synthetic Polynucleotide
taatacgactcactatagggcatcctgttgtatatgaggcccatacaactaacagaggagaagttgtatgggcctcataaacctggcggcagcgcaaaagatg

SEQ ID NO: 19585 - DNA, 103 bp, Artificial Sequence
  Synthetic Polynucleotide
taatacgactcactataggggcccccatcctgttgtatatgaggcccataaacagaggagatatgggatgcatatacaaaacctggcggcagcgcaaaagatg

SEQ ID NO: 19586 - DNA, 103 bp, Artificial Sequence
  Synthetic Polynucleotide
taatacgactcactatagggtcacagcccccatcctgttgtatatgaggcaacagaggagagcctcaatgacaacaggaaacctggcggcagcgcaaaagatg

SEQ ID NO: 19587 - DNA, 103 bp, Artificial Sequence
  Synthetic Polynucleotide
taatacgactcactatagggagtggtcacagcccccatcctgttgtatataacagaggagaatatacatgaggatggggaacctggcggcagcgcaaaagatg

SEQ ID NO: 19588 - DNA, 103 bp, Artificial Sequence
  Synthetic Polynucleotide
taatacgactcactatagggacttcagtggtcacagcccccatcctgttgaacagaggagacaacagatggggggctgtaacctggcggcagcgcaaaagatg

SEQ ID NO: 19589 - DNA, 103 bp, Artificial Sequence
  Synthetic Polynucleotide
taatacgactcactatagggatgccacttcagtggtcacagcccccatccaacagaggagaggatggatgctgtgaccaaacctggcggcagcgcaaaagatg

SEQ ID NO: 19590 - DNA, 103 bp, Artificial Sequence
  Synthetic Polynucleotide
taatacgactcactataggggccaaatgccacttcagtggtcacagccccaacagaggagaggggctatgaccactgaaaacctggcggcagcgcaaaagatg

SEQ ID NO: 19591 - DNA, 103 bp, Artificial Sequence
  Synthetic Polynucleotide
taatacgactcactatagggaccaggccaaatgccacttcagtggtcacaaacagaggagatgtgacatgtgaagtggcaacctggcggcagcgcaaaagatg

SEQ ID NO: 19592 - DNA, 103 bp, Artificial Sequence
  Synthetic Polynucleotide
taatacgactcactatagggcacataccaggccaaatgccacttcagtggaacagaggagaccactgatgtggcatttgaacctggcggcagcgcaaaagatg

SEQ ID NO: 19593 - DNA, 103 bp, Artificial Sequence
  Synthetic Polynucleotide
taatacgactcactataggggatgatagagagaacgtacgtttcgacctcaacagaggagagaggtcatgacgtacgttaacctggcggcagcgcaaaagatg

SEQ ID NO: 19594 - DNA, 103 bp, Artificial Sequence
  Synthetic Polynucleotide
taatacgactcactatagggggttgcacataccaggccaaatgccacttcaacagaggagagaagtgatgtttggcctgaacctggcggcagcgcaaaagatg

SEQ ID NO: 19595 - DNA, 103 bp, Artificial Sequence
  Synthetic Polynucleotide
taatacgactcactatagggtcacaggttgcacataccaggccaaatgccaacagaggagaggcattatgcctggtatgaacctggcggcagcgcaaaagatg

SEQ ID NO: 19596 - DNA, 103 bp, Artificial Sequence
  Synthetic Polynucleotide
taatacgactcactatagggtctgttcacaggttgcacataccaggccaaaacagaggagattggccatgtatgtgcaaaacctggcggcagcgcaaaagatg

SEQ ID NO: 19597 - DNA, 103 bp, Artificial Sequence
  Synthetic Polynucleotide
taatacgactcactatagggagcaatctgttcacaggttgcacataccagaacagaggagactggtaatggcaacctgtaacctggcggcagcgcaaaagatg

SEQ ID NO: 19598 - DNA, 103 bp, Artificial Sequence
  Synthetic Polynucleotide
taatacgactcactataggggagtcagcaatctgttcacaggttgcacataacagaggagaatgtgcatgctgtgaacaaacctggcggcagcgcaaaagatg

SEQ ID NO: 19599 - DNA, 103 bp, Artificial Sequence
  Synthetic Polynucleotide
taatacgactcactataggggctgggagtcagcaatctgttcacaggttgaacagaggagacaacctatgaacagattgaacctggcggcagcgcaaaagatg

SEQ ID NO: 19600 - DNA, 103 bp, Artificial Sequence
  Synthetic Polynucleotide
taatacgactcactatagggccgatgctgggagtcagcaatctgttcacaaacagaggagatgtgaaatgattgctgacaacctggcggcagcgcaaaagatg

SEQ ID NO: 19601 - DNA, 103 bp, Artificial Sequence
  Synthetic Polynucleotide
taatacgactcactatagggtgagaccgatgctgggagtcagcaatctgtaacagaggagaacagatatgtgactcccaaacctggcggcagcgcaaaagatg

SEQ ID NO: 19602 - DNA, 103 bp, Artificial Sequence
  Synthetic Polynucleotide
taatacgactcactataggggcctatgagaccgatgctgggagtcagcaaaacagaggagattgctgatgcccagcatcaacctggcggcagcgcaaaagatg

SEQ ID NO: 19603 - DNA, 103 bp, Artificial Sequence
  Synthetic Polynucleotide
taatacgactcactatagggcatttgcctatgagaccgatgctgggagtcaacagaggagagactccatgcatcggtctaacctggcggcagcgcaaaagatg

SEQ ID NO: 19604 - DNA, 103 bp, Artificial Sequence
  Synthetic Polynucleotide
taatacgactcactatagggttccatttcgaatcagtacctgcttttgctaacagaggagaagcaaaatgaggtactgaaacctggcggcagcgcaaaagatg

SEQ ID NO: 19605 - DNA, 103 bp, Artificial Sequence
  Synthetic Polynucleotide
taatacgactcactatagggtgcaagttcgacaatcatcgggttgaagcaaacagaggagatgcttcatgccgatgattaacctggcggcagcgcaaaagatg

SEQ ID NO: 19606 - DNA, 103 bp, Artificial Sequence
  Synthetic Polynucleotide
taatacgactcactataggggctttcctcgtcgagagtgtagtctgccttaacagaggagaaaggcaatgtacactctcaacctggcggcagcgcaaaagatg

SEQ ID NO: 19607 - DNA, 103 bp, Artificial Sequence
  Synthetic Polynucleotide
taatacgactcactataggggccctgctttcctcgtcgagagtgtagtctaacagaggagaagactaatgtctcgacgaaacctggcggcagcgcaaaagatg

SEQ ID NO: 19608 - DNA, 103 bp, Artificial Sequence
  Synthetic Polynucleotide
taatacgactcactatagggtcctagccctgctttcctcgtcgagagtgtaacagaggagaacactcatgacgaggaaaaacctggcggcagcgcaaaagatg

SEQ ID NO: 19609 - DNA, 103 bp, Artificial Sequence
  Synthetic Polynucleotide
taatacgactcactatagggtttaatcctagccctgctttcctcgtcgagaacagaggagactcgacatggaaagcaggaacctggcggcagcgcaaaagatg

SEQ ID NO: 19610 - DNA, 103 bp, Artificial Sequence
  Synthetic Polynucleotide
taatacgactcactatagggctggttttaatcctagccctgctttcctcgaacagaggagacgaggaatgcagggctagaacctggcggcagcgcaaaagatg

SEQ ID NO: 19611 - DNA, 103 bp, Artificial Sequence
  Synthetic Polynucleotide
taatacgactcactatagggatagcctggttttaatcctagccctgctttaacagaggagaaaagcaatgctaggattaaacctggcggcagcgcaaaagatg

SEQ ID NO: 19612 - DNA, 103 bp, Artificial Sequence
  Synthetic Polynucleotide
taatacgactcactatagggggtaaatagcctggttttaatcctagccctaacagaggagaagggctatgattaaaaccaacctggcggcagcgcaaaagatg

SEQ ID NO: 19613 - DNA, 103 bp, Artificial Sequence
  Synthetic Polynucleotide
taatacgactcactatagggcttatggtaaatagcctggttttaatcctaaacagaggagataggatatgaaccaggctaacctggcggcagcgcaaaagatg

SEQ ID NO: 19614 - DNA, 103 bp, Artificial Sequence
  Synthetic Polynucleotide
taatacgactcactatagggcttgtcttatggtaaatagcctggttttaaaacagaggagattaaaaatgggctatttaaacctggcggcagcgcaaaagatg

SEQ ID NO: 19615 - DNA, 103 bp, Artificial Sequence
  Synthetic Polynucleotide
taatacgactcactatagggcatttcttgtcttatggtaaatagcctggtaacagaggagaaccaggatgtttaccataaacctggcggcagcgcaaaagatg

SEQ ID NO: 19616 - DNA, 103 bp, Artificial Sequence
  Synthetic Polynucleotide
taatacgactcactatagggttttctgcaagttcgacaatcatcgggttgaacagaggagacaacccatggattgtcgaaacctggcggcagcgcaaaagatg

SEQ ID NO: 19617 - DNA, 103 bp, Artificial Sequence
  Synthetic Polynucleotide
taatacgactcactatagggttggccatttcttgtcttatggtaaatagcaacagaggagagctattatgcataagacaaacctggcggcagcgcaaaagatg

SEQ ID NO: 19618 - DNA, 103 bp, Artificial Sequence
  Synthetic Polynucleotide
taatacgactcactatagggctctgttggccatttcttgtcttatggtaaaacagaggagattaccaatggacaagaaaaacctggcggcagcgcaaaagatg

SEQ ID NO: 19619 - DNA, 103 bp, Artificial Sequence
  Synthetic Polynucleotide
taatacgactcactataggggaggcctctgttggccatttcttgtcttataacagaggagaataagaatggaaatggccaacctggcggcagcgcaaaagatg

SEQ ID NO: 19620 - DNA, 103 bp, Artificial Sequence
  Synthetic Polynucleotide
taatacgactcactatagggtcccagaggcctctgttggccatttcttgtaacagaggagaacaagaatgggccaacagaacctggcggcagcgcaaaagatg

SEQ ID NO: 19621 - DNA, 103 bp, Artificial Sequence
  Synthetic Polynucleotide
taatacgactcactatagggaggaatcccagaggcctctgttggccatttaacagaggagaaaatggatgacagaggccaacctggcggcagcgcaaaagatg

SEQ ID NO: 19622 - DNA, 103 bp, Artificial Sequence
  Synthetic Polynucleotide
taatacgactcactatagggacgaaaggaatcccagaggcctctgttggcaacagaggagagccaacatgggcctctggaacctggcggcagcgcaaaagatg

SEQ ID NO: 19623 - DNA, 103 bp, Artificial Sequence
  Synthetic Polynucleotide
taatacgactcactataggggactgacgaaaggaatcccagaggcctctgaacagaggagacagaggatgctgggattcaacctggcggcagcgcaaaagatg

SEQ ID NO: 19624 - DNA, 103 bp, Artificial Sequence
  Synthetic Polynucleotide
taatacgactcactatagggtttcggactgacgaaaggaatcccagaggcaacagaggagagcctctatgattcctttcaacctggcggcagcgcaaaagatg

SEQ ID NO: 19625 - DNA, 103 bp, Artificial Sequence
  Synthetic Polynucleotide
taatacgactcactataggggcctctttcggactgacgaaaggaatcccaaacagaggagatgggatatgtttcgtcagaacctggcggcagcgcaaaagatg

SEQ ID NO: 19626 - DNA, 103 bp, Artificial Sequence
  Synthetic Polynucleotide
taatacgactcactatagggtcttcgcctctttcggactgacgaaaggaaaacagaggagattccttatgtcagtccgaaacctggcggcagcgcaaaagatg

SEQ ID NO: 19627 - DNA, 103 bp, Artificial Sequence
  Synthetic Polynucleotide
taatacgactcactatagggttgctttttctgcaagttcgacaatcatcgaacagaggagacgatgaatgtcgaacttgaacctggcggcagcgcaaaagatg

SEQ ID NO: 19628 - DNA, 103 bp, Artificial Sequence
  Synthetic Polynucleotide
taatacgactcactatagggttgtttcttcgcctctttcggactgacgaaaacagaggagattcgtcatgccgaaagagaacctggcggcagcgcaaaagatg

SEQ ID NO: 19629 - DNA, 103 bp, Artificial Sequence
  Synthetic Polynucleotide
taatacgactcactatagggttcaattgtttcttcgcctctttcggactgaacagaggagacagtccatgagaggcgaaaacctggcggcagcgcaaaagatg

SEQ ID NO: 19630 - DNA, 103 bp, Artificial Sequence
  Synthetic Polynucleotide
taatacgactcactatagggttttcttcaattgtttcttcgcctctttcgaacagaggagacgaaagatgcgaagaaacaacctggcggcagcgcaaaagatg

SEQ ID NO: 19631 - DNA, 103 bp, Artificial Sequence
  Synthetic Polynucleotide
taatacgactcactatagggcaaatttttcttcaattgtttcttcgcctcaacagaggagagaggcgatgaaacaattgaacctggcggcagcgcaaaagatg

SEQ ID NO: 19632 - DNA, 103 bp, Artificial Sequence
  Synthetic Polynucleotide
taatacgactcactataggggatttcaaatttttcttcaattgtttcttcaacagaggagagaagaaatgattgaagaaaacctggcggcagcgcaaaagatg

SEQ ID NO: 19633 - DNA, 103 bp, Artificial Sequence
  Synthetic Polynucleotide
taatacgactcactatagggcctgagatttcaaatttttcttcaattgttaacagaggagaaacaatatgagaaaaattaacctggcggcagcgcaaaagatg

SEQ ID NO: 19634 - DNA, 103 bp, Artificial Sequence
  Synthetic Polynucleotide
taatacgactcactatagggtagttcctgagatttcaaatttttcttcaaaacagaggagattgaagatgaatttgaaaaacctggcggcagcgcaaaagatg

SEQ ID NO: 19635 - DNA, 103 bp, Artificial Sequence
  Synthetic Polynucleotide
taatacgactcactatagggacgcatagttcctgagatttcaaatttttcaacagaggagagaaaaaatggaaatctcaaacctggcggcagcgcaaaagatg

SEQ ID NO: 19636 - DNA, 103 bp, Artificial Sequence
  Synthetic Polynucleotide
taatacgactcactatagggagcctacgcatagttcctgagatttcaaataacagaggagaatttgaatgctcaggaacaacctggcggcagcgcaaaagatg

SEQ ID NO: 19637 - DNA, 103 bp, Artificial Sequence
  Synthetic Polynucleotide
taatacgactcactatagggcggcaagcctacgcatagttcctgagatttaacagaggagaaaatctatggaactatgcaacctggcggcagcgcaaaagatg

SEQ ID NO: 19638 - DNA, 103 bp, Artificial Sequence
  Synthetic Polynucleotide
taatacgactcactatagggtttcattgctttttctgcaagttcgacaataacagaggagaattgtcatgcttgcagaaaacctggcggcagcgcaaaagatg

SEQ ID NO: 19639 - DNA, 103 bp, Artificial Sequence
  Synthetic Polynucleotide
taatacgactcactatagggttggtcggcaagcctacgcatagttcctgaaacagaggagatcaggaatgatgcgtaggaacctggcggcagcgcaaaagatg

SEQ ID NO: 19640 - DNA, 103 bp, Artificial Sequence
  Synthetic Polynucleotide
taatacgactcactatagggagactttggtcggcaagcctacgcatagttaacagaggagaaactatatgtaggcttgcaacctggcggcagcgcaaaagatg

SEQ ID NO: 19641 - DNA, 103 bp, Artificial Sequence
  Synthetic Polynucleotide
taatacgactcactataggggtgggagactttggtcggcaagcctacgcaaacagaggagatgcgtaatgttgccgaccaacctggcggcagcgcaaaagatg

SEQ ID NO: 19642 - DNA, 103 bp, Artificial Sequence
  Synthetic Polynucleotide
taatacgactcactatagggtttcggtgggagactttggtcggcaagcctaacagaggagaaggcttatggaccaaagtaacctggcggcagcgcaaaagatg

SEQ ID NO: 19643 - DNA, 103 bp, Artificial Sequence
  Synthetic Polynucleotide
taatacgactcactataggggagaatttcggtgggagactttggtcggcaaacagaggagatgccgaatgaagtctcccaacctggcggcagcgcaaaagatg

SEQ ID NO: 19644 - DNA, 103 bp, Artificial Sequence
  Synthetic Polynucleotide
taatacgactcactatagggggcaggagaatttcggtgggagactttggtaacagaggagaaccaaaatgtcccaccgaaacctggcggcagcgcaaaagatg

SEQ ID NO: 19645 - DNA, 103 bp, Artificial Sequence
  Synthetic Polynucleotide
taatacgactcactatagggctcaaggcaggagaatttcggtgggagactaacagaggagaagtctcatgccgaaattcaacctggcggcagcgcaaaagatg

SEQ ID NO: 19646 - DNA, 103 bp, Artificial Sequence
  Synthetic Polynucleotide
taatacgactcactatagggaaattctcaaggcaggagaatttcggtgggaacagaggagacccaccatgattctcctgaacctggcggcagcgcaaaagatg

SEQ ID NO: 19647 - DNA, 103 bp, Artificial Sequence
  Synthetic Polynucleotide
taatacgactcactatagggctctaaaattctcaaggcaggagaatttcgaacagaggagacgaaatatgcctgccttgaacctggcggcagcgcaaaagatg

SEQ ID NO: 19648 - DNA, 103 bp, Artificial Sequence
  Synthetic Polynucleotide
taatacgactcactatagggataggctctaaaattctcaaggcaggagaaaacagaggagattctccatgcttgagaataacctggcggcagcgcaaaagatg

SEQ ID NO: 19649 - DNA, 103 bp, Artificial Sequence
  Synthetic Polynucleotide
taatacgactcactatagggtactctttcattgctttttctgcaagttcgaacagaggagacgaactatgagaaaaagcaacctggcggcagcgcaaaagatg

SEQ ID NO: 19650 - DNA, 103 bp, Artificial Sequence
  Synthetic Polynucleotide
taatacgactcactatagggtccacataggctctaaaattctcaaggcagaacagaggagactgcctatggaattttagaacctggcggcagcgcaaaagatg

SEQ ID NO: 19651 - DNA, 103 bp, Artificial Sequence
  Synthetic Polynucleotide
taatacgactcactatagggatccatccacataggctctaaaattctcaaaacagaggagattgagaatgttagagcctaacctggcggcagcgcaaaagatg

SEQ ID NO: 19652 - DNA, 103 bp, Artificial Sequence
  Synthetic Polynucleotide
taatacgactcactatagggttcgaatccatccacataggctctaaaattaacagaggagaaattttatggcctatgtgaacctggcggcagcgcaaaagatg

SEQ ID NO: 19653 - DNA, 103 bp, Artificial Sequence
  Synthetic Polynucleotide
taatacgactcactatagggttcggttcgaatccatccacataggctctaaacagaggagatagagcatgtgtggatggaacctggcggcagcgcaaaagatg

SEQ ID NO: 19654 - DNA, 103 bp, Artificial Sequence
  Synthetic Polynucleotide
taatacgactcactatagggagccgttcggttcgaatccatccacataggaacagaggagacctatgatgatggattcgaacctggcggcagcgcaaaagatg

SEQ ID NO: 19655 - DNA, 103 bp, Artificial Sequence
  Synthetic Polynucleotide
taatacgactcactatagggaatgcagccgttcggttcgaatccatccacaacagaggagagtggatatgttcgaaccgaacctggcggcagcgcaaaagatg

SEQ ID NO: 19656 - DNA, 103 bp, Artificial Sequence
  Synthetic Polynucleotide
taatacgactcactatagggccctcaatgcagccgttcggttcgaatccaaacagaggagatggattatgaccgaacggaacctggcggcagcgcaaaagatg

SEQ ID NO: 19657 - DNA, 103 bp, Artificial Sequence
  Synthetic Polynucleotide
taatacgactcactataggggcttgccctcaatgcagccgttcggttcgaaacagaggagatcgaacatgacggctgcaaacctggcggcagcgcaaaagatg

SEQ ID NO: 19658 - DNA, 103 bp, Artificial Sequence
  Synthetic Polynucleotide
taatacgactcactatagggagaaagcttgccctcaatgcagccgttcggaacagaggagaccgaacatgtgcattgagaacctggcggcagcgcaaaagatg

SEQ ID NO: 19659 - DNA, 103 bp, Artificial Sequence
  Synthetic Polynucleotide
taatacgactcactatagggatttgagaaagcttgccctcaatgcagccgaacagaggagacggctgatgtgagggcaaaacctggcggcagcgcaaaagatg

SEQ ID NO: 19660 - DNA, 103 bp, Artificial Sequence
  Synthetic Polynucleotide
taatacgactcactatagggctccatactctttcattgctttttctgcaaaacagaggagattgcagatgaagcaatgaaacctggcggcagcgcaaaagatg

SEQ ID NO: 19661 - DNA, 103 bp, Artificial Sequence
  Synthetic Polynucleotide
taatacgactcactatagggtggacatttgagaaagcttgccctcaatgcaacagaggagagcattgatggcaagctttaacctggcggcagcgcaaaagatg

SEQ ID NO: 19662 - DNA, 103 bp, Artificial Sequence
  Synthetic Polynucleotide
taatacgactcactatagggttctttggacatttgagaaagcttgccctcaacagaggagagagggcatgctttctcaaaacctggcggcagcgcaaaagatg

SEQ ID NO: 19663 - DNA, 103 bp, Artificial Sequence
  Synthetic Polynucleotide
taatacgactcactatagggttcacttctttggacatttgagaaagcttgaacagaggagacaagctatgtcaaatgtcaacctggcggcagcgcaaaagatg

SEQ ID NO: 19664 - DNA, 103 bp, Artificial Sequence
  Synthetic Polynucleotide
taatacgactcactatagggtggcattcacttctttggacatttgagaaaaacagaggagatttctcatgtgtccaaagaacctggcggcagcgcaaaagatg

SEQ ID NO: 19665 - DNA, 103 bp, Artificial Sequence
  Synthetic Polynucleotide
taatacgactcactatagggaattttggcattcacttctttggacatttgaacagaggagacaaatgatgaaagaagtgaacctggcggcagcgcaaaagatg

SEQ ID NO: 19666 - DNA, 103 bp, Artificial Sequence
  Synthetic Polynucleotide
taatacgactcactatagggggttcaattttggcattcacttctttggacaacagaggagagtccaaatgagtgaatgcaacctggcggcagcgcaaaagatg

SEQ ID NO: 19667 - DNA, 103 bp, Artificial Sequence
  Synthetic Polynucleotide
taatacgactcactataggggaaaaggttcaattttggcattcacttcttaacagaggagaaagaagatgatgccaaaaaacctggcggcagcgcaaaagatg

SEQ ID NO: 19668 - DNA, 103 bp, Artificial Sequence
  Synthetic Polynucleotide
taatacgactcactatagggcttcagaaaaggttcaattttggcattcacaacagaggagagtgaatatgaaaattgaaaacctggcggcagcgcaaaagatg

SEQ ID NO: 19669 - DNA, 103 bp, Artificial Sequence
  Synthetic Polynucleotide
taatacgactcactataggggttgtcttcagaaaaggttcaattttggcaaacagaggagatgccaaatgtgaacctttaacctggcggcagcgcaaaagatg

SEQ ID NO: 19670 - DNA, 103 bp, Artificial Sequence
  Synthetic Polynucleotide
taatacgactcactatagggttggtgttgtcttcagaaaaggttcaatttaacagaggagaaaattgatgcttttctgaaacctggcggcagcgcaaaagatg

SEQ ID NO: 19671 - DNA, 103 bp, Artificial Sequence
  Synthetic Polynucleotide
taatacgactcactatagggatcctctccatactctttcattgctttttcaacagaggagagaaaaaatgatgaaagagaacctggcggcagcgcaaaagatg

SEQ ID NO: 19672 - DNA, 103 bp, Artificial Sequence
  Synthetic Polynucleotide
taatacgactcactatagggtggtcttggtgttgtcttcagaaaaggttcaacagaggagagaacctatgctgaagacaaacctggcggcagcgcaaaagatg

SEQ ID NO: 19673 - DNA, 103 bp, Artificial Sequence
  Synthetic Polynucleotide
taatacgactcactatagggttgattggtcttggtgttgtcttcagaaaaaacagaggagattttctatggacaacaccaacctggcggcagcgcaaaagatg

SEQ ID NO: 19674 - DNA, 103 bp, Artificial Sequence
  Synthetic Polynucleotide
taatacgactcactataggggaagtttgattggtcttggtgttgtcttcaaacagaggagatgaagaatgcaccaagacaacctggcggcagcgcaaaagatg

SEQ ID NO: 19675 - DNA, 103 bp, Artificial Sequence
  Synthetic Polynucleotide
taatacgactcactatagggattaggaagtttgattggtcttggtgttgtaacagaggagaacaacaatgagaccaatcaacctggcggcagcgcaaaagatg

SEQ ID NO: 19676 - DNA, 103 bp, Artificial Sequence
  Synthetic Polynucleotide
taatacgactcactatagggggtccattaggaagtttgattggtcttggtaacagaggagaaccaagatgaatcaaactaacctggcggcagcgcaaaagatg

SEQ ID NO: 19677 - DNA, 103 bp, Artificial Sequence
  Synthetic Polynucleotide
taatacgactcactatagggaaggaggtccattaggaagtttgattggtcaacagaggagagaccaaatgaacttcctaaacctggcggcagcgcaaaagatg

SEQ ID NO: 19678 - DNA, 103 bp, Artificial Sequence
  Synthetic Polynucleotide
taatacgactcactatagggataacaaggaggtccattaggaagtttgataacagaggagaatcaaaatgcctaatggaaacctggcggcagcgcaaaagatg

SEQ ID NO: 19679 - DNA, 103 bp, Artificial Sequence
  Synthetic Polynucleotide
taatacgactcactatagggcgctgataacaaggaggtccattaggaagtaacagaggagaacttccatgtggacctccaacctggcggcagcgcaaaagatg

SEQ ID NO: 19680 - DNA, 103 bp, Artificial Sequence
  Synthetic Polynucleotide
taatacgactcactatagggtggaccgctgataacaaggaggtccattagaacagaggagactaatgatgctccttgttaacctggcggcagcgcaaaagatg

SEQ ID NO: 19681 - DNA, 103 bp, Artificial Sequence
  Synthetic Polynucleotide
taatacgactcactataggggaatttggaccgctgataacaaggaggtccaacagaggagaggacctatgtgttatcagaacctggcggcagcgcaaaagatg

SEQ ID NO: 19682 - DNA, 103 bp, Artificial Sequence
  Synthetic Polynucleotide
taatacgactcactatagggttcagatcctctccatactctttcattgctaacagaggagaagcaatatgagagtatggaacctggcggcagcgcaaaagatg

SEQ ID NO: 19683 - DNA, 103 bp, Artificial Sequence
  Synthetic Polynucleotide
taatacgactcactatagggaggaggaatttggaccgctgataacaaggaaacagaggagatccttgatgtcagcggtcaacctggcggcagcgcaaaagatg

SEQ ID NO: 19684 - DNA, 103 bp, Artificial Sequence
  Synthetic Polynucleotide
taatacgactcactatagggccatcaggaggaatttggaccgctgataacaacagaggagagttatcatgggtccaaataacctggcggcagcgcaaaagatg

SEQ ID NO: 19685 - DNA, 103 bp, Artificial Sequence
  Synthetic Polynucleotide
taatacgactcactatagggagcatccatcaggaggaatttggaccgctgaacagaggagacagcggatgaaattcctcaacctggcggcagcgcaaaagatg

SEQ ID NO: 19686 - DNA, 103 bp, Artificial Sequence
  Synthetic Polynucleotide
taatacgactcactatagggttcaaagcatccatcaggaggaatttggacaacagaggagagtccaaatgcctcctgataacctggcggcagcgcaaaagatg

SEQ ID NO: 19687 - DNA, 103 bp, Artificial Sequence
  Synthetic Polynucleotide
taatacgactcactatagggtcaatttcaaagcatccatcaggaggaattaacagaggagaaattccatgtgatggatgaacctggcggcagcgcaaaagatg

SEQ ID NO: 19688 - DNA, 103 bp, Artificial Sequence
  Synthetic Polynucleotide
taatacgactcactatagggaatgctcaatttcaaagcatccatcaggagaacagaggagactcctgatggatgctttgaacctggcggcagcgcaaaagatg

SEQ ID NO: 19689 - DNA, 103 bp, Artificial Sequence
  Synthetic Polynucleotide
taatacgactcactatagggtcttcaatgctcaatttcaaagcatccatcaacagaggagagatggaatgtttgaaattaacctggcggcagcgcaaaagatg

SEQ ID NO: 19690 - DNA, 103 bp, Artificial Sequence
  Synthetic Polynucleotide
taatacgactcactatagggttgggtcttcaatgctcaatttcaaagcataacagaggagaatgcttatgaattgagcaaacctggcggcagcgcaaaagatg

SEQ ID NO: 19691 - DNA, 103 bp, Artificial Sequence
  Synthetic Polynucleotide
taatacgactcactatagggatgacttgggtcttcaatgctcaatttcaaaacagaggagattgaaaatgagcattgaaaacctggcggcagcgcaaaagatg

SEQ ID NO: 19692 - DNA, 103 bp, Artificial Sequence
  Synthetic Polynucleotide
taatacgactcactatagggccttcatgacttgggtcttcaatgctcaataacagaggagaattgagatgtgaagacccaacctggcggcagcgcaaaagatg

SEQ ID NO: 19693 - DNA, 103 bp, Artificial Sequence
  Synthetic Polynucleotide
taatacgactcactatagggcaattttcagatcctctccatactctttcaaacagaggagatgaaagatgatggagaggaacctggcggcagcgcaaaagatg

SEQ ID NO: 19694 - DNA, 103 bp, Artificial Sequence
  Synthetic Polynucleotide
taatacgactcactatagggcttctccttcatgacttgggtcttcaatgcaacagaggagagcattgatgacccaagtcaacctggcggcagcgcaaaagatg

SEQ ID NO: 19695 - DNA, 103 bp, Artificial Sequence
  Synthetic Polynucleotide
taatacgactcactatagggaatcccttctccttcatgacttgggtcttcaacagaggagagaagacatgagtcatgaaaacctggcggcagcgcaaaagatg

SEQ ID NO: 19696 - DNA, 103 bp, Artificial Sequence
  Synthetic Polynucleotide
taatacgactcactatagggaatggaatcccttctccttcatgacttgggaacagaggagacccaagatgtgaaggagaaacctggcggcagcgcaaaagatg

SEQ ID NO: 19697 - DNA, 103 bp, Artificial Sequence
  Synthetic Polynucleotide
taatacgactcactatagggcatataatggaatcccttctccttcatgacaacagaggagagtcatgatggagaagggaaacctggcggcagcgcaaaagatg

SEQ ID NO: 19698 - DNA, 103 bp, Artificial Sequence
  Synthetic Polynucleotide
taatacgactcactatagggcgcatcatataatggaatcccttctccttcaacagaggagagaaggaatggggattccaaacctggcggcagcgcaaaagatg

SEQ ID NO: 19699 - DNA, 103 bp, Artificial Sequence
  Synthetic Polynucleotide
taatacgactcactatagggttgatcgcatcatataatggaatcccttctaacagaggagaagaaggatgtccattataaacctggcggcagcgcaaaagatg

SEQ ID NO: 19700 - DNA, 103 bp, Artificial Sequence
  Synthetic Polynucleotide
taatacgactcactatagggtgcacttgatcgcatcatataatggaatccaacagaggagaggattcatgtatatgatgaacctggcggcagcgcaaaagatg

SEQ ID NO: 19701 - DNA, 103 bp, Artificial Sequence
  Synthetic Polynucleotide
taatacgactcactatagggttttatgcacttgatcgcatcatataatggaacagaggagaccattaatggatgcgatcaacctggcggcagcgcaaaagatg

SEQ ID NO: 19702 - DNA, 103 bp, Artificial Sequence
  Synthetic Polynucleotide
taatacgactcactatagggaatgtttttatgcacttgatcgcatcatataacagaggagaatatgaatggatcaagtgaacctggcggcagcgcaaaagatg

SEQ ID NO: 19703 - DNA, 103 bp, Artificial Sequence
  Synthetic Polynucleotide
taatacgactcactatagggcaaagaatgtttttatgcacttgatcgcataacagaggagaatgcgaatgagtgcataaaacctggcggcagcgcaaaagatg

SEQ ID NO: 19704 - DNA, 103 bp, Artificial Sequence
  Synthetic Polynucleotide
taatacgactcactatagggtgtttcaattttcagatcctctccatactcaacagaggagagagtatatggaggatctgaacctggcggcagcgcaaaagatg

SEQ ID NO: 19705 - DNA, 103 bp, Artificial Sequence
  Synthetic Polynucleotide
taatacgactcactatagggccatccaaagaatgtttttatgcacttgataacagaggagaatcaagatgataaaaacaaacctggcggcagcgcaaaagatg

SEQ ID NO: 19706 - DNA, 103 bp, Artificial Sequence
  Synthetic Polynucleotide
taatacgactcactatagggtctttccatccaaagaatgtttttatgcacaacagaggagagtgcatatgaacattcttaacctggcggcagcgcaaaagatg

SEQ ID NO: 19707 - DNA, 103 bp, Artificial Sequence
  Synthetic Polynucleotide
taatacgactcactatagggaaggttctttccatccaaagaatgtttttaaacagaggagataaaaaatgtctttggataacctggcggcagcgcaaaagatg

SEQ ID NO: 19708 - DNA, 103 bp, Artificial Sequence
  Synthetic Polynucleotide
taatacgactcactatagggtatataaggttctttccatccaaagaatgtaacagaggagaacattcatgggatggaaaaacctggcggcagcgcaaaagatg

SEQ ID NO: 19709 - DNA, 103 bp, Artificial Sequence
  Synthetic Polynucleotide
taatacgactcactatagggttgactatataaggttctttccatccaaagaacagaggagactttggatggaaagaaccaacctggcggcagcgcaaaagatg

SEQ ID NO: 19710 - DNA, 103 bp, Artificial Sequence
  Synthetic Polynucleotide
taatacgactcactataggggtggtttgactatataaggttctttccatcaacagaggagagatggaatgaaccttataaacctggcggcagcgcaaaagatg

SEQ ID NO: 19711 - DNA, 103 bp, Artificial Sequence
  Synthetic Polynucleotide
taatacgactcactatagggttcgtgtggtttgactatataaggttctttaacagaggagaaaagaaatgtatatagtcaacctggcggcagcgcaaaagatg

SEQ ID NO: 19712 - DNA, 103 bp, Artificial Sequence
  Synthetic Polynucleotide
taatacgactcactatagggcccttttcgtgtggtttgactatataaggtaacagaggagaaccttaatgagtcaaaccaacctggcggcagcgcaaaagatg

SEQ ID NO: 19713 - DNA, 103 bp, Artificial Sequence
  Synthetic Polynucleotide
taatacgactcactatagggttattcccttttcgtgtggtttgactatataacagaggagaatatagatgaaccacacgaacctggcggcagcgcaaaagatg

SEQ ID NO: 19714 - DNA, 103 bp, Artificial Sequence
  Synthetic Polynucleotide
taatacgactcactatagggtgaatttattcccttttcgtgtggtttgacaacagaggagagtcaaaatgcacgaaaagaacctggcggcagcgcaaaagatg

SEQ ID NO: 19715 - DNA, 103 bp, Artificial Sequence
  Synthetic Polynucleotide
taatacgactcactatagggaaatcttccatttcgaatcagtacctgcttaacagaggagaaagcagatgctgattcgaaacctggcggcagcgcaaaagatg

SEQ ID NO: 19716 - DNA, 103 bp, Artificial Sequence
  Synthetic Polynucleotide
taatacgactcactatagggttgtttgtttcaattttcagatcctctccaaacagaggagatggagaatgtctgaaaataacctggcggcagcgcaaaagatg

SEQ ID NO: 19717 - DNA, 103 bp, Artificial Sequence
  Synthetic Polynucleotide
taatacgactcactatagggtaatttgaatttattcccttttcgtgtggtaacagaggagaaccacaatgaaagggaataacctggcggcagcgcaaaagatg

SEQ ID NO: 19718 - DNA, 103 bp, Artificial Sequence
  Synthetic Polynucleotide
taatacgactcactataggggcaggtaatttgaatttattcccttttcgtaacagaggagaacgaaaatggaataaattaacctggcggcagcgcaaaagatg

SEQ ID NO: 19719 - DNA, 103 bp, Artificial Sequence
  Synthetic Polynucleotide
taatacgactcactatagggtgacagcaggtaatttgaatttattcccttaacagaggagaaagggaatgaattcaaataacctggcggcagcgcaaaagatg

SEQ ID NO: 19720 - DNA, 103 bp, Artificial Sequence
  Synthetic Polynucleotide
taatacgactcactatagggttccatgacagcaggtaatttgaatttattaacagaggagaaataaaatgaaattacctaacctggcggcagcgcaaaagatg

SEQ ID NO: 19721 - DNA, 103 bp, Artificial Sequence
  Synthetic Polynucleotide
taatacgactcactatagggcttgcttccatgacagcaggtaatttgaataacagaggagaattcaaatgacctgctgtaacctggcggcagcgcaaaagatg

SEQ ID NO: 19722 - DNA, 103 bp, Artificial Sequence
  Synthetic Polynucleotide
taatacgactcactatagggcaatacttgcttccatgacagcaggtaattaacagaggagaaattacatgctgtcatggaacctggcggcagcgcaaaagatg

SEQ ID NO: 19723 - DNA, 103 bp, Artificial Sequence
  Synthetic Polynucleotide
taatacgactcactatagggtctgacaatacttgcttccatgacagcaggaacagaggagacctgctatgatggaagcaaacctggcggcagcgcaaaagatg

SEQ ID NO: 19724 - DNA, 103 bp, Artificial Sequence
  Synthetic Polynucleotide
taatacgactcactataggggcaattctgacaatacttgcttccatgacaaacagaggagatgtcatatgagcaagtataacctggcggcagcgcaaaagatg

SEQ ID NO: 19725 - DNA, 103 bp, Artificial Sequence
  Synthetic Polynucleotide
taatacgactcactataggggtcctgcaattctgacaatacttgcttccaaacagaggagatggaagatggtattgtcaaacctggcggcagcgcaaaagatg

SEQ ID NO: 19726 - DNA, 103 bp, Artificial Sequence
  Synthetic Polynucleotide
taatacgactcactatagggtcaatgtcctgcaattctgacaatacttgcaacagaggagagcaagtatggtcagaattaacctggcggcagcgcaaaagatg

SEQ ID NO: 19727 - DNA, 103 bp, Artificial Sequence
  Synthetic Polynucleotide
taatacgactcactatagggcaaatttgtttgtttcaattttcagatcctaacagaggagaaggatcatgaaattgaaaaacctggcggcagcgcaaaagatg

SEQ ID NO: 19728 - DNA, 103 bp, Artificial Sequence
  Synthetic Polynucleotide
taatacgactcactatagggcattttcaatgtcctgcaattctgacaataaacagaggagatattgtatgaattgcaggaacctggcggcagcgcaaaagatg

SEQ ID NO: 19729 - DNA, 103 bp, Artificial Sequence
  Synthetic Polynucleotide
taatacgactcactatagggctcctcattttcaatgtcctgcaattctgaaacagaggagatcagaaatgcaggacattaacctggcggcagcgcaaaagatg

SEQ ID NO: 19730 - DNA, 103 bp, Artificial Sequence
  Synthetic Polynucleotide
taatacgactcactatagggatcttctcctcattttcaatgtcctgcaataacagaggagaattgcaatgcattgaaaaaacctggcggcagcgcaaaagatg

SEQ ID NO: 19731 - DNA, 103 bp, Artificial Sequence
  Synthetic Polynucleotide
taatacgactcactatagggttgggatcttctcctcattttcaatgtcctaacagaggagaaggacaatgaaaatgaggaacctggcggcagcgcaaaagatg

SEQ ID NO: 19732 - DNA, 103 bp, Artificial Sequence
  Synthetic Polynucleotide
taatacgactcactatagggagtccttgggatcttctcctcattttcaataacagaggagaattgaaatggaggagaagaacctggcggcagcgcaaaagatg

SEQ ID NO: 19733 - DNA, 103 bp, Artificial Sequence
  Synthetic Polynucleotide
taatacgactcactatagggtttttagtccttgggatcttctcctcatttaacagaggagaaaatgaatggaagatcccaacctggcggcagcgcaaaagatg

SEQ ID NO: 19734 - DNA, 103 bp, Artificial Sequence
  Synthetic Polynucleotide
taatacgactcactatagggtcatgtttttagtccttgggatcttctcctaacagaggagaaggagaatgtcccaaggaaacctggcggcagcgcaaaagatg

SEQ ID NO: 19735 - DNA, 103 bp, Artificial Sequence
  Synthetic Polynucleotide
taatacgactcactatagggtttcttcatgtttttagtccttgggatcttaacagaggagaaagatcatgaggactaaaaacctggcggcagcgcaaaagatg

SEQ ID NO: 19736 - DNA, 103 bp, Artificial Sequence
  Synthetic Polynucleotide
taatacgactcactatagggctcgttttcttcatgtttttagtccttgggaacagaggagacccaagatgtaaaaacataacctggcggcagcgcaaaagatg

SEQ ID NO: 19737 - DNA, 103 bp, Artificial Sequence
  Synthetic Polynucleotide
taatacgactcactataggggttgactcgttttcttcatgtttttagtccaacagaggagaggactaatgacatgaagaaacctggcggcagcgcaaaagatg

SEQ ID NO: 19738 - DNA, 103 bp, Artificial Sequence
  Synthetic Polynucleotide
taatacgactcactatagggtgctgcaaatttgtttgtttcaattttcagaacagaggagactgaaaatggaaacaaacaacctggcggcagcgcaaaagatg

SEQ ID NO: 19739 - DNA, 103 bp, Artificial Sequence
  Synthetic Polynucleotide
taatacgactcactatagggctttagttgactcgttttcttcatgtttttaacagaggagaaaaaacatgaagaaaacgaacctggcggcagcgcaaaagatg

SEQ ID NO: 19740 - DNA, 103 bp, Artificial Sequence
  Synthetic Polynucleotide
taatacgactcactataggggcccactttagttgactcgttttcttcatgaacagaggagacatgaaatgaacgagtcaaacctggcggcagcgcaaaagatg

SEQ ID NO: 19741 - DNA, 103 bp, Artificial Sequence
  Synthetic Polynucleotide
taatacgactcactatagggcaagagcccactttagttgactcgttttctaacagaggagaagaaaaatggtcaactaaaacctggcggcagcgcaaaagatg

SEQ ID NO: 19742 - DNA, 103 bp, Artificial Sequence
  Synthetic Polynucleotide
taatacgactcactatagggttcaccaagagcccactttagttgactcgtaacagaggagaacgagtatgctaaagtggaacctggcggcagcgcaaaagatg

SEQ ID NO: 19743 - DNA, 103 bp, Artificial Sequence
  Synthetic Polynucleotide
taatacgactcactatagggatgttttcaccaagagcccactttagttgaaacagaggagatcaactatggtgggctctaacctggcggcagcgcaaaagatg

SEQ ID NO: 19744 - DNA, 103 bp, Artificial Sequence
  Synthetic Polynucleotide
taatacgactcactataggggtgccatgttttcaccaagagcccactttaaacagaggagataaagtatgctcttggtgaacctggcggcagcgcaaaagatg

SEQ ID NO: 19745 - DNA, 103 bp, Artificial Sequence
  Synthetic Polynucleotide
taatacgactcactatagggctctggtgccatgttttcaccaagagcccaaacagaggagatgggctatgggtgaaaacaacctggcggcagcgcaaaagatg

SEQ ID NO: 19746 - DNA, 103 bp, Artificial Sequence
  Synthetic Polynucleotide
taatacgactcactatagggactttctctggtgccatgttttcaccaagaaacagaggagatcttggatgaaacatggcaacctggcggcagcgcaaaagatg

SEQ ID NO: 19747 - DNA, 103 bp, Artificial Sequence
  Synthetic Polynucleotide
taatacgactcactatagggagtctactttctctggtgccatgttttcacaacagaggagagtgaaaatgtggcaccagaacctggcggcagcgcaaaagatg

SEQ ID NO: 19748 - DNA, 103 bp, Artificial Sequence
  Synthetic Polynucleotide
taatacgactcactataggggtcaaagtctactttctctggtgccatgttaacagaggagaaacatgatgccagagaaaaacctggcggcagcgcaaaagatg

SEQ ID NO: 19749 - DNA, 103 bp, Artificial Sequence
  Synthetic Polynucleotide
taatacgactcactatagggcatattgctgcaaatttgtttgtttcaattaacagaggagaaattgaatgaaacaaattaacctggcggcagcgcaaaagatg

SEQ ID NO: 19750 - DNA, 103 bp, Artificial Sequence
  Synthetic Polynucleotide
taatacgactcactatagggcagttgtcaaagtctactttctctggtgccaacagaggagaggcaccatggaaagtagaaacctggcggcagcgcaaaagatg

SEQ ID NO: 19751 - DNA, 103 bp, Artificial Sequence
  Synthetic Polynucleotide
taatacgactcactatagggctctgcagttgtcaaagtctactttctctgaacagaggagacagagaatgtagactttgaacctggcggcagcgcaaaagatg

SEQ ID NO: 19752 - DNA, 103 bp, Artificial Sequence
  Synthetic Polynucleotide
taatacgactcactatagggtatgtctctgcagttgtcaaagtctactttaacagaggagaaaagtaatgtttgacaacaacctggcggcagcgcaaaagatg

SEQ ID NO: 19753 - DNA, 103 bp, Artificial Sequence
  Synthetic Polynucleotide
taatacgactcactatagggtcgcttatgtctctgcagttgtcaaagtctaacagaggagaagacttatgcaactgcagaacctggcggcagcgcaaaagatg

SEQ ID NO: 19754 - DNA, 103 bp, Artificial Sequence
  Synthetic Polynucleotide
taatacgactcactatagggtcaaatcgcttatgtctctgcagttgtcaaaacagaggagattgacaatggcagagacaaacctggcggcagcgcaaaagatg

SEQ ID NO: 19755 - DNA, 103 bp, Artificial Sequence
  Synthetic Polynucleotide
taatacgactcactatagggttgcttcaaatcgcttatgtctctgcagttaacagaggagaaactgcatggacataagcaacctggcggcagcgcaaaagatg

SEQ ID NO: 19756 - DNA, 103 bp, Artificial Sequence
  Synthetic Polynucleotide
taatacgactcactatagggtcatattgcttcaaatcgcttatgtctctgaacagaggagacagagaatgaagcgatttaacctggcggcagcgcaaaagatg

SEQ ID NO: 19757 - DNA, 103 bp, Artificial Sequence
  Synthetic Polynucleotide
taatacgactcactatagggcactatcatattgcttcaaatcgcttatgtaacagaggagaacataaatgatttgaagcaacctggcggcagcgcaaaagatg

SEQ ID NO: 19758 - DNA, 103 bp, Artificial Sequence
  Synthetic Polynucleotide
taatacgactcactatagggttcgtcactatcatattgcttcaaatcgctaacagaggagaagcgatatgaagcaatataacctggcggcagcgcaaaagatg

SEQ ID NO: 19759 - DNA, 103 bp, Artificial Sequence
  Synthetic Polynucleotide
taatacgactcactatagggtcaggttcgtcactatcatattgcttcaaaaacagaggagatttgaaatgatatgatagaacctggcggcagcgcaaaagatg

SEQ ID NO: 19760 - DNA, 103 bp, Artificial Sequence
  Synthetic Polynucleotide
taatacgactcactataggggggtgcatattgctgcaaatttgtttgtttaacagaggagaaaacaaatgaatttgcagaacctggcggcagcgcaaaagatg

SEQ ID NO: 19761 - DNA, 103 bp, Artificial Sequence
  Synthetic Polynucleotide
taatacgactcactatagggttaattcaggttcgtcactatcatattgctaacagaggagaagcaatatgatagtgacgaacctggcggcagcgcaaaagatg

SEQ ID NO: 19762 - DNA, 103 bp, Artificial Sequence
  Synthetic Polynucleotide
taatacgactcactatagggtgaccttaattcaggttcgtcactatcataaacagaggagatatgatatggacgaacctaacctggcggcagcgcaaaagatg

SEQ ID NO: 19763 - DNA, 103 bp, Artificial Sequence
  Synthetic Polynucleotide
taatacgactcactataggggaaagtgaccttaattcaggttcgtcactaaacagaggagatagtgaatgacctgaattaacctggcggcagcgcaaaagatg

SEQ ID NO: 19764 - DNA, 103 bp, Artificial Sequence
  Synthetic Polynucleotide
taatacgactcactatagggagcttgaaagtgaccttaattcaggttcgtaacagaggagaacgaacatgaattaaggtaacctggcggcagcgcaaaagatg

SEQ ID NO: 19765 - DNA, 103 bp, Artificial Sequence
  Synthetic Polynucleotide
taatacgactcactatagggtatccagcttgaaagtgaccttaattcaggaacagaggagacctgaaatgaggtcacttaacctggcggcagcgcaaaagatg

SEQ ID NO: 19766 - DNA, 103 bp, Artificial Sequence
  Synthetic Polynucleotide
taatacgactcactatagggttctgtatccagcttgaaagtgaccttaataacagaggagaattaagatgactttcaagaacctggcggcagcgcaaaagatg

SEQ ID NO: 19767 - DNA, 103 bp, Artificial Sequence
  Synthetic Polynucleotide
taatacgactcactatagggactcattctgtatccagcttgaaagtgaccaacagaggagaggtcacatgcaagctggaaacctggcggcagcgcaaaagatg

SEQ ID NO: 19768 - DNA, 103 bp, Artificial Sequence
  Synthetic Polynucleotide
taatacgactcactataggggttgaactcattctgtatccagcttgaaagaacagaggagactttcaatgtggatacagaacctggcggcagcgcaaaagatg

SEQ ID NO: 19769 - DNA, 103 bp, Artificial Sequence
  Synthetic Polynucleotide
taatacgactcactataggggccttgttgaactcattctgtatccagcttaacagaggagaaagctgatgacagaatgaaacctggcggcagcgcaaaagatg

SEQ ID NO: 19770 - DNA, 103 bp, Artificial Sequence
  Synthetic Polynucleotide
taatacgactcactatagggcgcaggccttgttgaactcattctgtatccaacagaggagaggatacatgatgagttcaaacctggcggcagcgcaaaagatg

SEQ ID NO: 19771 - DNA, 103 bp, Artificial Sequence
  Synthetic Polynucleotide
taatacgactcactatagggcaagtgggtgcatattgctgcaaatttgttaacagaggagaaacaaaatggcagcaataaacctggcggcagcgcaaaagatg

SEQ ID NO: 19772 - DNA, 103 bp, Artificial Sequence
  Synthetic Polynucleotide
taatacgactcactatagggtagctcgcaggccttgttgaactcattctgaacagaggagacagaatatgttcaacaagaacctggcggcagcgcaaaagatg

SEQ ID NO: 19773 - DNA, 103 bp, Artificial Sequence
  Synthetic Polynucleotide
taatacgactcactatagggtcagttagctcgcaggccttgttgaactcaaacagaggagatgagttatgcaaggcctgaacctggcggcagcgcaaaagatg

SEQ ID NO: 19774 - DNA, 103 bp, Artificial Sequence
  Synthetic Polynucleotide
taatacgactcactatagggttgaatcagttagctcgcaggccttgttgaaacagaggagatcaacaatgcctgcgagcaacctggcggcagcgcaaaagatg

SEQ ID NO: 19775 - DNA, 103 bp, Artificial Sequence
  Synthetic Polynucleotide
taatacgactcactatagggccagattgaatcagttagctcgcaggccttaacagaggagaaaggccatggagctaactaacctggcggcagcgcaaaagatg

SEQ ID NO: 19776 - DNA, 103 bp, Artificial Sequence
  Synthetic Polynucleotide
taatacgactcactatagggtctatccagattgaatcagttagctcgcagaacagaggagactgcgaatgaactgattcaacctggcggcagcgcaaaagatg

SEQ ID NO: 19777 - DNA, 103 bp, Artificial Sequence
  Synthetic Polynucleotide
taatacgactcactatagggcgagctctatccagattgaatcagttagctaacagaggagaagctaaatgattcaatctaacctggcggcagcgcaaaagatg

SEQ ID NO: 19778 - DNA, 103 bp, Artificial Sequence
  Synthetic Polynucleotide
taatacgactcactatagggttcatcgagctctatccagattgaatcagtaacagaggagaactgatatgatctggataaacctggcggcagcgcaaaagatg

SEQ ID NO: 19779 - DNA, 103 bp, Artificial Sequence
  Synthetic Polynucleotide
taatacgactcactatagggccaatttcatcgagctctatccagattgaaaacagaggagattcaatatggatagagctaacctggcggcagcgcaaaagatg

SEQ ID NO: 19780 - DNA, 103 bp, Artificial Sequence
  Synthetic Polynucleotide
taatacgactcactatagggcctctccaatttcatcgagctctatccagaaacagaggagatctggaatgagctcgatgaacctggcggcagcgcaaaagatg

SEQ ID NO: 19781 - DNA, 103 bp, Artificial Sequence
  Synthetic Polynucleotide
taatacgactcactatagggtacgtcctctccaatttcatcgagctctataacagaggagaatagagatggatgaaattaacctggcggcagcgcaaaagatg

SEQ ID NO: 19782 - DNA, 103 bp, Artificial Sequence
  Synthetic Polynucleotide
taatacgactcactatagggacctccaagtgggtgcatattgctgcaaataacagaggagaatttgcatgaatatgcacaacctggcggcagcgcaaaagatg

SEQ ID NO: 19783 - DNA, 103 bp, Artificial Sequence
  Synthetic Polynucleotide
taatacgactcactatagggggggctacgtcctctccaatttcatcgagcaacagaggagagctcgaatgaattggagaaacctggcggcagcgcaaaagatg

SEQ ID NO: 19784 - DNA, 103 bp, Artificial Sequence
  Synthetic Polynucleotide
taatacgactcactatagggcaattggggctacgtcctctccaatttcataacagaggagaatgaaaatggagaggacgaacctggcggcagcgcaaaagatg

SEQ ID NO: 19785 - DNA, 103 bp, Artificial Sequence
  Synthetic Polynucleotide
taatacgactcactataggggtactcaattggggctacgtcctctccaataacagaggagaattggaatggacgtagccaacctggcggcagcgcaaaagatg

SEQ ID NO: 19786 - DNA, 103 bp, Artificial Sequence
  Synthetic Polynucleotide
taatacgactcactataggggcaatgtactcaattggggctacgtcctctaacagaggagaagaggaatgagccccaataacctggcggcagcgcaaaagatg

SEQ ID NO: 19787 - DNA, 103 bp, Artificial Sequence
  Synthetic Polynucleotide
taatacgactcactatagggtgcttgcaatgtactcaattggggctacgtaacagaggagaacgtagatgcaattgagtaacctggcggcagcgcaaaagatg

SEQ ID NO: 19788 - DNA, 103 bp, Artificial Sequence
  Synthetic Polynucleotide
taatacgactcactatagggcctcatgcttgcaatgtactcaattggggcaacagaggagagccccaatggagtacattaacctggcggcagcgcaaaagatg

SEQ ID NO: 19789 - DNA, 103 bp, Artificial Sequence
  Synthetic Polynucleotide
taatacgactcactatagggttcctcctcatgcttgcaatgtactcaattaacagaggagaaattgaatgcattgcaagaacctggcggcagcgcaaaagatg

SEQ ID NO: 19790 - DNA, 103 bp, Artificial Sequence
  Synthetic Polynucleotide
taatacgactcactatagggaataattcctcctcatgcttgcaatgtactaacagaggagaagtacaatgcaagcatgaaacctggcggcagcgcaaaagatg

SEQ ID NO: 19791 - DNA, 103 bp, Artificial Sequence
  Synthetic Polynucleotide
taatacgactcactatagggtgtgaaataattcctcctcatgcttgcaataacagaggagaattgcaatgatgaggaggaacctggcggcagcgcaaaagatg

SEQ ID NO: 19792 - DNA, 103 bp, Artificial Sequence
  Synthetic Polynucleotide
taatacgactcactatagggtctgctgtgaaataattcctcctcatgcttaacagaggagaaagcatatggaggaattaaacctggcggcagcgcaaaagatg

SEQ ID NO: 19793 - DNA, 103 bp, Artificial Sequence
  Synthetic Polynucleotide
taatacgactcactatagggaacatacctccaagtgggtgcatattgctgaacagaggagacagcaaatggcacccactaacctggcggcagcgcaaaagatg

SEQ ID NO: 19794 - DNA, 103 bp, Artificial Sequence
  Synthetic Polynucleotide
taatacgactcactatagggacacctctgctgtgaaataattcctcctcaaacagaggagatgaggaatgattatttcaaacctggcggcagcgcaaaagatg

SEQ ID NO: 19795 - DNA, 103 bp, Artificial Sequence
  Synthetic Polynucleotide
taatacgactcactatagggatgggacacctctgctgtgaaataattcctaacagaggagaaggaatatgttcacagcaaacctggcggcagcgcaaaagatg

SEQ ID NO: 19796 - DNA, 103 bp, Artificial Sequence
  Synthetic Polynucleotide
taatacgactcactatagggctacaatgggacacctctgctgtgaaataaaacagaggagattatttatgagcagaggtaacctggcggcagcgcaaaagatg

SEQ ID NO: 19797 - DNA, 103 bp, Artificial Sequence
  Synthetic Polynucleotide
taatacgactcactatagggtggctctacaatgggacacctctgctgtgaaacagaggagatcacagatgaggtgtcccaacctggcggcagcgcaaaagatg

SEQ ID NO: 19798 - DNA, 103 bp, Artificial Sequence
  Synthetic Polynucleotide
taatacgactcactatagggctcagtggctctacaatgggacacctctgcaacagaggagagcagagatgtcccattgtaacctggcggcagcgcaaaagatg

SEQ ID NO: 19799 - DNA, 103 bp, Artificial Sequence
  Synthetic Polynucleotide
taatacgactcactatagggatgtactcagtggctctacaatgggacaccaacagaggagaggtgtcatgttgtagagcaacctggcggcagcgcaaaagatg

SEQ ID NO: 19800 - DNA, 103 bp, Artificial Sequence
  Synthetic Polynucleotide
taatacgactcactatagggtcattatgtactcagtggctctacaatgggaacagaggagacccattatggagccactgaacctggcggcagcgcaaaagatg

SEQ ID NO: 19801 - DNA, 103 bp, Artificial Sequence
  Synthetic Polynucleotide
taatacgactcactatagggccccttcattatgtactcagtggctctacaaacagaggagatgtagaatgactgagtacaacctggcggcagcgcaaaagatg

SEQ ID NO: 19802 - DNA, 103 bp, Artificial Sequence
  Synthetic Polynucleotide
taatacgactcactatagggtatacccccttcattatgtactcagtggctaacagaggagaagccacatggtacataataacctggcggcagcgcaaaagatg

SEQ ID NO: 19803 - DNA, 103 bp, Artificial Sequence
  Synthetic Polynucleotide
taatacgactcactatagggtaatgtatacccccttcattatgtactcagaacagaggagactgagtatgtaatgaaggaacctggcggcagcgcaaaagatg

SEQ ID NO: 19804 - DNA, 103 bp, Artificial Sequence
  Synthetic Polynucleotide
taatacgactcactatagggcatgaaacatacctccaagtgggtgcatataacagaggagaatatgcatgcacttggagaacctggcggcagcgcaaaagatg

SEQ ID NO: 19805 - DNA, 103 bp, Artificial Sequence
  Synthetic Polynucleotide
taatacgactcactatagggagtattaatgtatacccccttcattatgtaaacagaggagatacataatgaagggggtaaacctggcggcagcgcaaaagatg

SEQ ID NO: 19806 - DNA, 103 bp, Artificial Sequence
  Synthetic Polynucleotide
taatacgactcactatagggagggcagtattaatgtatacccccttcattaacagaggagaaatgaaatgggtatacataacctggcggcagcgcaaaagatg

SEQ ID NO: 19807 - DNA, 103 bp, Artificial Sequence
  Synthetic Polynucleotide
taatacgactcactatagggtgagcagggcagtattaatgtataccccctaacagaggagaagggggatgacattaataaacctggcggcagcgcaaaagatg

SEQ ID NO: 19808 - DNA, 103 bp, Artificial Sequence
  Synthetic Polynucleotide
taatacgactcactatagggtgcattgagcagggcagtattaatgtatacaacagaggagagtatacatgaatactgccaacctggcggcagcgcaaaagatg

SEQ ID NO: 19809 - DNA, 103 bp, Artificial Sequence
  Synthetic Polynucleotide
taatacgactcactatagggcaggatgcattgagcagggcagtattaatgaacagaggagacattaaatgtgccctgctaacctggcggcagcgcaaaagatg

SEQ ID NO: 19810 - DNA, 103 bp, Artificial Sequence
  Synthetic Polynucleotide
taatacgactcactatagggctgcacaggatgcattgagcagggcagtataacagaggagaatactgatgtgctcaatgaacctggcggcagcgcaaaagatg

SEQ ID NO: 19811 - DNA, 103 bp, Artificial Sequence
  Synthetic Polynucleotide
taatacgactcactatagggcattgctgcacaggatgcattgagcagggcaacagaggagagccctgatgaatgcatccaacctggcggcagcgcaaaagatg

SEQ ID NO: 19812 - DNA, 103 bp, Artificial Sequence
  Synthetic Polynucleotide
taatacgactcactatagggtcgtccattgctgcacaggatgcattgagcaacagaggagagctcaaatgatcctgtgcaacctggcggcagcgcaaaagatg

SEQ ID NO: 19813 - DNA, 103 bp, Artificial Sequence
  Synthetic Polynucleotide
taatacgactcactataggggaaaatcgtccattgctgcacaggatgcataacagaggagaatgcatatggtgcagcaaaacctggcggcagcgcaaaagatg

SEQ ID NO: 19814 - DNA, 103 bp, Artificial Sequence
  Synthetic Polynucleotide
taatacgactcactatagggtagttgaaaatcgtccattgctgcacaggaaacagaggagatcctgtatggcaatggacaacctggcggcagcgcaaaagatg

SEQ ID NO: 19815 - DNA, 103 bp, Artificial Sequence
  Synthetic Polynucleotide
taatacgactcactataggggaatacatgaaacatacctccaagtgggtgaacagaggagacacccaatgggaggtatgaacctggcggcagcgcaaaagatg

SEQ ID NO: 19816 - DNA, 103 bp, Artificial Sequence
  Synthetic Polynucleotide
taatacgactcactatagggggaattagttgaaaatcgtccattgctgcaaacagaggagatgcagcatgggacgatttaacctggcggcagcgcaaaagatg

SEQ ID NO: 19817 - DNA, 103 bp, Artificial Sequence
  Synthetic Polynucleotide
taatacgactcactatagggtcatgggaattagttgaaaatcgtccattgaacagaggagacaatggatgattttcaacaacctggcggcagcgcaaaagatg

SEQ ID NO: 19818 - DNA, 103 bp, Artificial Sequence
  Synthetic Polynucleotide
taatacgactcactataggggcttatcatgggaattagttgaaaatcgtcaacagaggagagacgatatgcaactaattaacctggcggcagcgcaaaagatg

SEQ ID NO: 19819 - DNA, 103 bp, Artificial Sequence
  Synthetic Polynucleotide
taatacgactcactatagggcacttgcttatcatgggaattagttgaaaaaacagaggagattttcaatgaattcccataacctggcggcagcgcaaaagatg

SEQ ID NO: 19820 - DNA, 103 bp, Artificial Sequence
  Synthetic Polynucleotide
taatacgactcactatagggttctgcacttgcttatcatgggaattagttaacagaggagaaactaaatgccatgataaaacctggcggcagcgcaaaagatg

SEQ ID NO: 19821 - DNA, 103 bp, Artificial Sequence
  Synthetic Polynucleotide
taatacgactcactatagggtttagttctgcacttgcttatcatgggaataacagaggagaattcccatgataagcaagaacctggcggcagcgcaaaagatg

SEQ ID NO: 19822 - DNA, 103 bp, Artificial Sequence
  Synthetic Polynucleotide
taatacgactcactatagggccctctttagttctgcacttgcttatcatgaacagaggagacatgatatgcaagtgcagaacctggcggcagcgcaaaagatg

SEQ ID NO: 19823 - DNA, 103 bp, Artificial Sequence
  Synthetic Polynucleotide
taatacgactcactataggggccttccctctttagttctgcacttgcttaaacagaggagataagcaatggcagaactaaacctggcggcagcgcaaaagatg

SEQ ID NO: 19824 - DNA, 103 bp, Artificial Sequence
  Synthetic Polynucleotide
taatacgactcactatagggttttcgccttccctctttagttctgcacttaacagaggagaaagtgcatgactaaagagaacctggcggcagcgcaaaagatg

SEQ ID NO: 19825 - DNA, 103 bp, Artificial Sequence
  Synthetic Polynucleotide
taatacgactcactatagggttggtttttcgccttccctctttagttctgaacagaggagacagaacatgagagggaagaacctggcggcagcgcaaaagatg

SEQ ID NO: 19826 - DNA, 103 bp, Artificial Sequence
  Synthetic Polynucleotide
taatacgactcactataggggcacaaaatcttccatttcgaatcagtaccaacagaggagaggtactatgtcgaaatggaacctggcggcagcgcaaaagatg

SEQ ID NO: 19827 - DNA, 103 bp, Artificial Sequence
  Synthetic Polynucleotide
taatacgactcactatagggaatctgaatacatgaaacatacctccaagtaacagaggagaacttggatgtatgtttcaaacctggcggcagcgcaaaagatg

SEQ ID NO: 19828 - DNA, 103 bp, Artificial Sequence
  Synthetic Polynucleotide
taatacgactcactatagggataaattggtttttcgccttccctctttagaacagaggagactaaagatggaaggcgaaaacctggcggcagcgcaaaagatg

SEQ ID NO: 19829 - DNA, 103 bp, Artificial Sequence
  Synthetic Polynucleotide
taatacgactcactatagggtccatataaattggtttttcgccttccctcaacagaggagagagggaatgcgaaaaaccaacctggcggcagcgcaaaagatg

SEQ ID NO: 19830 - DNA, 103 bp, Artificial Sequence
  Synthetic Polynucleotide
taatacgactcactatagggatgaatccatataaattggtttttcgccttaacagaggagaaaggcgatgaaccaatttaacctggcggcagcgcaaaagatg

SEQ ID NO: 19831 - DNA, 103 bp, Artificial Sequence
  Synthetic Polynucleotide
taatacgactcactatagggttatgatgaatccatataaattggtttttcaacagaggagagaaaaaatgatttatatgaacctggcggcagcgcaaaagatg

SEQ ID NO: 19832 - DNA, 103 bp, Artificial Sequence
  Synthetic Polynucleotide
taatacgactcactatagggtccctttatgatgaatccatataaattggtaacagaggagaaccaatatgtatggattcaacctggcggcagcgcaaaagatg

SEQ ID NO: 19833 - DNA, 103 bp, Artificial Sequence
  Synthetic Polynucleotide
taatacgactcactataggggatcttccctttatgatgaatccatataaaaacagaggagatttataatgattcatcataacctggcggcagcgcaaaagatg

SEQ ID NO: 19834 - DNA, 103 bp, Artificial Sequence
  Synthetic Polynucleotide
taatacgactcactatagggaatgagatcttccctttatgatgaatccataacagaggagaatggatatgtcataaaggaacctggcggcagcgcaaaagatg

SEQ ID NO: 19835 - DNA, 103 bp, Artificial Sequence
  Synthetic Polynucleotide
taatacgactcactatagggccttaaatgagatcttccctttatgatgaaaacagaggagattcatcatgaagggaagaaacctggcggcagcgcaaaagatg

SEQ ID NO: 19836 - DNA, 103 bp, Artificial Sequence
  Synthetic Polynucleotide
taatacgactcactatagggtcattccttaaatgagatcttccctttatgaacagaggagacataaaatgaagatctcaaacctggcggcagcgcaaaagatg

SEQ ID NO: 19837 - DNA, 103 bp, Artificial Sequence
  Synthetic Polynucleotide
taatacgactcactatagggctgtgtcattccttaaatgagatcttccctaacagaggagaagggaaatgctcatttaaaacctggcggcagcgcaaaagatg

SEQ ID NO: 19838 - DNA, 103 bp, Artificial Sequence
  Synthetic Polynucleotide
taatacgactcactatagggatgaaaatctgaatacatgaaacatacctcaacagaggagagaggtaatgttcatgtataacctggcggcagcgcaaaagatg

SEQ ID NO: 19839 - DNA, 103 bp, Artificial Sequence
  Synthetic Polynucleotide
taatacgactcactatagggcacatctgtgtcattccttaaatgagatctaacagaggagaagatctatgttaaggaataacctggcggcagcgcaaaagatg

SEQ ID NO: 19840 - DNA, 103 bp, Artificial Sequence
  Synthetic Polynucleotide
taatacgactcactatagggtttaccacatctgtgtcattccttaaatgaaacagaggagatcatttatggaatgacacaacctggcggcagcgcaaaagatg

SEQ ID NO: 19841 - DNA, 103 bp, Artificial Sequence
  Synthetic Polynucleotide
taatacgactcactatagggcaaagtttaccacatctgtgtcattccttaaacagaggagataaggaatgacacagatgaacctggcggcagcgcaaaagatg

SEQ ID NO: 19842 - DNA, 103 bp, Artificial Sequence
  Synthetic Polynucleotide
taatacgactcactataggggctcacaaagtttaccacatctgtgtcattaacagaggagaaatgacatggatgtggtaaacctggcggcagcgcaaaagatg

SEQ ID NO: 19843 - DNA, 103 bp, Artificial Sequence
  Synthetic Polynucleotide
taatacgactcactatagggtccatgctcacaaagtttaccacatctgtgaacagaggagacacagaatgggtaaacttaacctggcggcagcgcaaaagatg

SEQ ID NO: 19844 - DNA, 103 bp, Artificial Sequence
  Synthetic Polynucleotide
taatacgactcactatagggaaaactccatgctcacaaagtttaccacataacagaggagaatgtggatgactttgtgaaacctggcggcagcgcaaaagatg

SEQ ID NO: 19845 - DNA, 103 bp, Artificial Sequence
  Synthetic Polynucleotide
taatacgactcactataggggagagaaaactccatgctcacaaagtttacaacagaggagagtaaacatggtgagcatgaacctggcggcagcgcaaaagatg

SEQ ID NO: 19846 - DNA, 103 bp, Artificial Sequence
  Synthetic Polynucleotide
taatacgactcactatagggtcagtgagagaaaactccatgctcacaaagaacagaggagactttgtatgcatggagttaacctggcggcagcgcaaaagatg

SEQ ID NO: 19847 - DNA, 103 bp, Artificial Sequence
  Synthetic Polynucleotide
taatacgactcactatagggtcgggtcagtgagagaaaactccatgctcaaacagaggagatgagcaatgagttttctcaacctggcggcagcgcaaaagatg

SEQ ID NO: 19848 - DNA, 103 bp, Artificial Sequence
  Synthetic Polynucleotide
taatacgactcactatagggaagtctcgggtcagtgagagaaaactccataacagaggagaatggagatgtctctcactaacctggcggcagcgcaaaagatg

SEQ ID NO: 19849 - DNA, 103 bp, Artificial Sequence
  Synthetic Polynucleotide
taatacgactcactatagggatgaaatgaaaatctgaatacatgaaacataacagaggagaatgtttatggtattcagaaacctggcggcagcgcaaaagatg

SEQ ID NO: 19850 - DNA, 103 bp, Artificial Sequence
  Synthetic Polynucleotide
taatacgactcactatagggggctcaagtctcgggtcagtgagagaaaacaacagaggagagttttcatgcactgacccaacctggcggcagcgcaaaagatg

SEQ ID NO: 19851 - DNA, 103 bp, Artificial Sequence
  Synthetic Polynucleotide
taatacgactcactatagggtatgtggctcaagtctcgggtcagtgagagaacagaggagactctcaatgacccgagacaacctggcggcagcgcaaaagatg

SEQ ID NO: 19852 - DNA, 103 bp, Artificial Sequence
  Synthetic Polynucleotide
taatacgactcactatagggccatttatgtggctcaagtctcgggtcagtaacagaggagaactgacatgagacttgagaacctggcggcagcgcaaaagatg

SEQ ID NO: 19853 - DNA, 103 bp, Artificial Sequence
  Synthetic Polynucleotide
taatacgactcactatagggttctcccatttatgtggctcaagtctcgggaacagaggagacccgagatgtgagccacaaacctggcggcagcgcaaaagatg

SEQ ID NO: 19854 - DNA, 103 bp, Artificial Sequence
  Synthetic Polynucleotide
taatacgactcactatagggagtatttctcccatttatgtggctcaagtcaacagaggagagacttgatgcacataaataacctggcggcagcgcaaaagatg

SEQ ID NO: 19855 - DNA, 103 bp, Artificial Sequence
  Synthetic Polynucleotide
taatacgactcactataggggacacagtatttctcccatttatgtggctcaacagaggagagagccaatgaaatgggagaacctggcggcagcgcaaaagatg

SEQ ID NO: 19856 - DNA, 103 bp, Artificial Sequence
  Synthetic Polynucleotide
taatacgactcactatagggtcaaggacacagtatttctcccatttatgtaacagaggagaacataaatgggagaaataaacctggcggcagcgcaaaagatg

SEQ ID NO: 19857 - DNA, 103 bp, Artificial Sequence
  Synthetic Polynucleotide
taatacgactcactatagggctatctcaaggacacagtatttctcccattaacagaggagaaatgggatgaatactgtgaacctggcggcagcgcaaaagatg

SEQ ID NO: 19858 - DNA, 103 bp, Artificial Sequence
  Synthetic Polynucleotide
taatacgactcactatagggatctcctatctcaaggacacagtatttctcaacagaggagagagaaaatgtgtgtccttaacctggcggcagcgcaaaagatg

SEQ ID NO: 19859 - DNA, 103 bp, Artificial Sequence
  Synthetic Polynucleotide
taatacgactcactatagggaacatatctcctatctcaaggacacagtataacagaggagaatactgatgccttgagataacctggcggcagcgcaaaagatg

SEQ ID NO: 19860 - DNA, 103 bp, Artificial Sequence
  Synthetic Polynucleotide
taatacgactcactatagggcattgatgaaatgaaaatctgaatacatgaaacagaggagatcatgtatgcagattttcaacctggcggcagcgcaaaagatg

SEQ ID NO: 19861 - DNA, 103 bp, Artificial Sequence
  Synthetic Polynucleotide
taatacgactcactatagggttagtaacatatctcctatctcaaggacacaacagaggagagtgtccatgagataggagaacctggcggcagcgcaaaagatg

SEQ ID NO: 19862 - DNA, 103 bp, Artificial Sequence
  Synthetic Polynucleotide
taatacgactcactatagggacttcttagtaacatatctcctatctcaagaacagaggagacttgagatgggagatatgaacctggcggcagcgcaaaagatg

SEQ ID NO: 19863 - DNA, 103 bp, Artificial Sequence
  Synthetic Polynucleotide
taatacgactcactatagggatggcacttcttagtaacatatctcctatcaacagaggagagataggatgtatgttactaacctggcggcagcgcaaaagatg

SEQ ID NO: 19864 - DNA, 103 bp, Artificial Sequence
  Synthetic Polynucleotide
taatacgactcactatagggggcctatggcacttcttagtaacatatctcaacagaggagagagataatgtactaagaaaacctggcggcagcgcaaaagatg

SEQ ID NO: 19865 - DNA, 103 bp, Artificial Sequence
  Synthetic Polynucleotide
taatacgactcactatagggaatttggcctatggcacttcttagtaacataacagaggagaatgttaatgagaagtgccaacctggcggcagcgcaaaagatg

SEQ ID NO: 19866 - DNA, 103 bp, Artificial Sequence
  Synthetic Polynucleotide
taatacgactcactatagggcttgaaatttggcctatggcacttcttagtaacagaggagaactaagatgtgccataggaacctggcggcagcgcaaaagatg

SEQ ID NO: 19867 - DNA, 103 bp, Artificial Sequence
  Synthetic Polynucleotide
taatacgactcactatagggtaggccttgaaatttggcctatggcacttcaacagaggagagaagtgatgtaggccaaaaacctggcggcagcgcaaaagatg

SEQ ID NO: 19868 - DNA, 103 bp, Artificial Sequence
  Synthetic Polynucleotide
taatacgactcactataggggaacataggccttgaaatttggcctatggcaacagaggagagccataatgcaaatttcaaacctggcggcagcgcaaaagatg

SEQ ID NO: 19869 - DNA, 103 bp, Artificial Sequence
  Synthetic Polynucleotide
taatacgactcactatagggtacaagaacataggccttgaaatttggcctaacagaggagaaggccaatgttcaaggccaacctggcggcagcgcaaaagatg

SEQ ID NO: 19870 - DNA, 103 bp, Artificial Sequence
  Synthetic Polynucleotide
taatacgactcactatagggtcacatacaagaacataggccttgaaatttaacagaggagaaaatttatgggcctatgtaacctggcggcagcgcaaaagatg

SEQ ID NO: 19871 - DNA, 103 bp, Artificial Sequence
  Synthetic Polynucleotide
taatacgactcactatagggttgttcattgatgaaatgaaaatctgaataaacagaggagatattcaatgtttcatttcaacctggcggcagcgcaaaagatg

SEQ ID NO: 19872 - DNA, 103 bp, Artificial Sequence
  Synthetic Polynucleotide
taatacgactcactatagggtgtcctcacatacaagaacataggccttgaaacagaggagatcaaggatgatgttcttgaacctggcggcagcgcaaaagatg

SEQ ID NO: 19873 - DNA, 103 bp, Artificial Sequence
  Synthetic Polynucleotide
taatacgactcactatagggccgtttgtcctcacatacaagaacataggcaacagaggagagcctatatgcttgtatgtaacctggcggcagcgcaaaagatg

SEQ ID NO: 19874 - DNA, 103 bp, Artificial Sequence
  Synthetic Polynucleotide
taatacgactcactatagggatgttccgtttgtcctcacatacaagaacaaacagaggagatgttctatgatgtgaggaaacctggcggcagcgcaaaagatg

SEQ ID NO: 19875 - DNA, 103 bp, Artificial Sequence
  Synthetic Polynucleotide
taatacgactcactatagggctttgatgttccgtttgtcctcacatacaaaacagaggagattgtatatgaggacaaacaacctggcggcagcgcaaaagatg

SEQ ID NO: 19876 - DNA, 103 bp, Artificial Sequence
  Synthetic Polynucleotide
taatacgactcactatagggttgacctttgatgttccgtttgtcctcacaaacagaggagatgtgagatgaaacggaacaacctggcggcagcgcaaaagatg

SEQ ID NO: 19877 - DNA, 103 bp, Artificial Sequence
  Synthetic Polynucleotide
taatacgactcactatagggtcattttgacctttgatgttccgtttgtccaacagaggagaggacaaatggaacatcaaaacctggcggcagcgcaaaagatg

SEQ ID NO: 19878 - DNA, 103 bp, Artificial Sequence
  Synthetic Polynucleotide
taatacgactcactatagggccatttcattttgacctttgatgttccgttaacagaggagaaacggaatgtcaaaggtcaacctggcggcagcgcaaaagatg

SEQ ID NO: 19879 - DNA, 103 bp, Artificial Sequence
  Synthetic Polynucleotide
taatacgactcactatagggattccccatttcattttgacctttgatgttaacagaggagaaacatcatgggtcaaaataacctggcggcagcgcaaaagatg

SEQ ID NO: 19880 - DNA, 103 bp, Artificial Sequence
  Synthetic Polynucleotide
taatacgactcactatagggtctccattccccatttcattttgacctttgaacagaggagacaaaggatgaaatgaaataacctggcggcagcgcaaaagatg

SEQ ID NO: 19881 - DNA, 103 bp, Artificial Sequence
  Synthetic Polynucleotide
taatacgactcactatagggtctcatctccattccccatttcattttgacaacagaggagagtcaaaatgaaatggggaaacctggcggcagcgcaaaagatg

SEQ ID NO: 19882 - DNA, 103 bp, Artificial Sequence
  Synthetic Polynucleotide
taatacgactcactatagggtcgccttgttcattgatgaaatgaaaatctaacagaggagaagatttatgtttcatcaaaacctggcggcagcgcaaaagatg

SEQ ID NO: 19883 - DNA, 103 bp, Artificial Sequence
  Synthetic Polynucleotide
taatacgactcactatagggcaacgtctcatctccattccccatttcattaacagaggagaaatgaaatggggaatggaaacctggcggcagcgcaaaagatg

SEQ ID NO: 19884 - DNA, 103 bp, Artificial Sequence
  Synthetic Polynucleotide
taatacgactcactatagggggaggcaacgtctcatctccattccccattaacagaggagaaatgggatgtggagatgaaacctggcggcagcgcaaaagatg

SEQ ID NO: 19885 - DNA, 103 bp, Artificial Sequence
  Synthetic Polynucleotide
taatacgactcactatagggctgaaggaggcaacgtctcatctccattccaacagaggagaggaatgatgatgagacgtaacctggcggcagcgcaaaagatg

SEQ ID NO: 19886 - DNA, 103 bp, Artificial Sequence
  Synthetic Polynucleotide
taatacgactcactatagggagtgactgaaggaggcaacgtctcatctccaacagaggagaggagatatgacgttgcctaacctggcggcagcgcaaaagatg

SEQ ID NO: 19887 - DNA, 103 bp, Artificial Sequence
  Synthetic Polynucleotide
taatacgactcactataggggctggagtgactgaaggaggcaacgtctcaaacagaggagatgagacatggcctccttcaacctggcggcagcgcaaaagatg

SEQ ID NO: 19888 - DNA, 103 bp, Artificial Sequence
  Synthetic Polynucleotide
taatacgactcactataggggatctgctggagtgactgaaggaggcaacgaacagaggagacgttgcatgcttcagtcaaacctggcggcagcgcaaaagatg

SEQ ID NO: 19889 - DNA, 103 bp, Artificial Sequence
  Synthetic Polynucleotide
taatacgactcactatagggctctcgatctgctggagtgactgaaggaggaacagaggagacctcctatggtcactccaaacctggcggcagcgcaaaagatg

SEQ ID NO: 19890 - DNA, 103 bp, Artificial Sequence
  Synthetic Polynucleotide
taatacgactcactatagggtcatgctctcgatctgctggagtgactgaaaacagaggagattcagtatgtccagcagaaacctggcggcagcgcaaaagatg

SEQ ID NO: 19891 - DNA, 103 bp, Artificial Sequence
  Synthetic Polynucleotide
taatacgactcactatagggttcaatcatgctctcgatctgctggagtgaaacagaggagatcactcatgcagatcgagaacctggcggcagcgcaaaagatg

SEQ ID NO: 19892 - DNA, 103 bp, Artificial Sequence
  Synthetic Polynucleotide
taatacgactcactatagggtcggcttcaatcatgctctcgatctgctggaacagaggagaccagcaatgcgagagcataacctggcggcagcgcaaaagatg

SEQ ID NO: 19893 - DNA, 103 bp, Artificial Sequence
  Synthetic Polynucleotide
taatacgactcactatagggttgattcgccttgttcattgatgaaatgaaaacagaggagattcattatgtcaatgaacaacctggcggcagcgcaaaagatg

SEQ ID NO: 19894 - DNA, 103 bp, Artificial Sequence
  Synthetic Polynucleotide
taatacgactcactatagggaggactcggcttcaatcatgctctcgatctaacagaggagaagatcgatggcatgattgaacctggcggcagcgcaaaagatg

SEQ ID NO: 19895 - DNA, 103 bp, Artificial Sequence
  Synthetic Polynucleotide
taatacgactcactatagggaatcgaggactcggcttcaatcatgctctcaacagaggagagagagcatgattgaagccaacctggcggcagcgcaaaagatg

SEQ ID NO: 19896 - DNA, 103 bp, Artificial Sequence
  Synthetic Polynucleotide
taatacgactcactatagggtctttaatcgaggactcggcttcaatcatgaacagaggagacatgatatgagccgagtcaacctggcggcagcgcaaaagatg

SEQ ID NO: 19897 - DNA, 103 bp, Artificial Sequence
  Synthetic Polynucleotide
taatacgactcactatagggctttctctttaatcgaggactcggcttcaaaacagaggagattgaagatgagtcctcgaaacctggcggcagcgcaaaagatg

SEQ ID NO: 19898 - DNA, 103 bp, Artificial Sequence
  Synthetic Polynucleotide
taatacgactcactatagggcatgtctttctctttaatcgaggactcggcaacagaggagagccgagatgtcgattaaaaacctggcggcagcgcaaaagatg

SEQ ID NO: 19899 - DNA, 103 bp, Artificial Sequence
  Synthetic Polynucleotide
taatacgactcactatagggttggtcatgtctttctctttaatcgaggacaacagaggagagtcctcatgtaaagagaaaacctggcggcagcgcaaaagatg

SEQ ID NO: 19900 - DNA, 103 bp, Artificial Sequence
  Synthetic Polynucleotide
taatacgactcactatagggactctttggtcatgtctttctctttaatcgaacagaggagacgattaatgagaaagacaaacctggcggcagcgcaaaagatg

SEQ ID NO: 19901 - DNA, 103 bp, Artificial Sequence
  Synthetic Polynucleotide
taatacgactcactatagggaaaaaactctttggtcatgtctttctctttaacagaggagaaaagagatggacatgaccaacctggcggcagcgcaaaagatg

SEQ ID NO: 19902 - DNA, 103 bp, Artificial Sequence
  Synthetic Polynucleotide
taatacgactcactatagggttctcaaaaaactctttggtcatgtctttcaacagaggagagaaagaatggaccaaagaaacctggcggcagcgcaaaagatg

SEQ ID NO: 19903 - DNA, 103 bp, Artificial Sequence
  Synthetic Polynucleotide
taatacgactcactatagggatttattctcaaaaaactctttggtcatgtaacagaggagaacatgaatgaagagttttaacctggcggcagcgcaaaagatg

SEQ ID NO: 19904 - DNA, 103 bp, Artificial Sequence
  Synthetic Polynucleotide
taatacgactcactatagggcactattgattcgccttgttcattgatgaaaacagaggagattcatcatggaacaaggcaacctggcggcagcgcaaaagatg

SEQ ID NO: 19905 - DNA, 103 bp, Artificial Sequence
  Synthetic Polynucleotide
taatacgactcactatagggttctgatttattctcaaaaaactctttggtaacagaggagaaccaaaatgttttttgagaacctggcggcagcgcaaaagatg

SEQ ID NO: 19906 - DNA, 103 bp, Artificial Sequence
  Synthetic Polynucleotide
taatacgactcactatagggcatgcttctgatttattctcaaaaaactctaacagaggagaagagttatgtgagaataaaacctggcggcagcgcaaaagatg

SEQ ID NO: 19907 - DNA, 103 bp, Artificial Sequence
  Synthetic Polynucleotide
taatacgactcactatagggtgggccatgcttctgatttattctcaaaaaaacagaggagatttttgatgataaatcagaacctggcggcagcgcaaaagatg

SEQ ID NO: 19908 - DNA, 103 bp, Artificial Sequence
  Synthetic Polynucleotide
taatacgactcactatagggcccaatgggccatgcttctgatttattctcaacagaggagagagaatatgtcagaagcaaacctggcggcagcgcaaaagatg

SEQ ID NO: 19909 - DNA, 103 bp, Artificial Sequence
  Synthetic Polynucleotide
taatacgactcactataggggactccccaatgggccatgcttctgatttaaacagaggagataaatcatgagcatggccaacctggcggcagcgcaaaagatg

SEQ ID NO: 19910 - DNA, 103 bp, Artificial Sequence
  Synthetic Polynucleotide
taatacgactcactatagggtgggggactccccaatgggccatgcttctgaacagaggagacagaagatgggcccattgaacctggcggcagcgcaaaagatg

SEQ ID NO: 19911 - DNA, 103 bp, Artificial Sequence
  Synthetic Polynucleotide
taatacgactcactatagggtcccttgggggactccccaatgggccatgcaacagaggagagcatggatgattggggagaacctggcggcagcgcaaaagatg

SEQ ID NO: 19912 - DNA, 103 bp, Artificial Sequence
  Synthetic Polynucleotide
taatacgactcactatagggtccactcccttgggggactccccaatgggcaacagaggagagcccatatgggagtccccaacctggcggcagcgcaaaagatg

SEQ ID NO: 19913 - DNA, 103 bp, Artificial Sequence
  Synthetic Polynucleotide
taatacgactcactatagggcttcttccactcccttgggggactccccaaaacagaggagattggggatgcccccaaggaacctggcggcagcgcaaaagatg

SEQ ID NO: 19914 - DNA, 103 bp, Artificial Sequence
  Synthetic Polynucleotide
taatacgactcactatagggggaaccttcttccactcccttgggggactcaacagaggagagagtccatgaagggagtgaacctggcggcagcgcaaaagatg

SEQ ID NO: 19915 - DNA, 103 bp, Artificial Sequence
  Synthetic Polynucleotide
taatacgactcactatagggtctaccactattgattcgccttgttcattgaacagaggagacaatgaatgaggcgaatcaacctggcggcagcgcaaaagatg

SEQ ID NO: 19916 - DNA, 103 bp, Artificial Sequence
  Synthetic Polynucleotide
taatacgactcactatagggccaatggaaccttcttccactcccttggggaacagaggagaccccaaatgagtggaagaaacctggcggcagcgcaaaagatg

SEQ ID NO: 19917 - DNA, 103 bp, Artificial Sequence
  Synthetic Polynucleotide
taatacgactcactatagggctttcccaatggaaccttcttccactccctaacagaggagaagggagatgaagaaggttaacctggcggcagcgcaaaagatg

SEQ ID NO: 19918 - DNA, 103 bp, Artificial Sequence
  Synthetic Polynucleotide
taatacgactcactatagggacagactttcccaatggaaccttcttccacaacagaggagagtggaaatgggttccattaacctggcggcagcgcaaaagatg

SEQ ID NO: 19919 - DNA, 103 bp, Artificial Sequence
  Synthetic Polynucleotide
taatacgactcactataggggtcctacagactttcccaatggaaccttctaacagaggagaagaaggatgcattgggaaaacctggcggcagcgcaaaagatg

SEQ ID NO: 19920 - DNA, 103 bp, Artificial Sequence
  Synthetic Polynucleotide
taatacgactcactatagggatagagtcctacagactttcccaatggaacaacagaggagagttccaatgggaaagtctaacctggcggcagcgcaaaagatg

SEQ ID NO: 19921 - DNA, 103 bp, Artificial Sequence
  Synthetic Polynucleotide
taatacgactcactatagggagccaatagagtcctacagactttcccaataacagaggagaattgggatggtctgtaggaacctggcggcagcgcaaaagatg

SEQ ID NO: 19922 - DNA, 103 bp, Artificial Sequence
  Synthetic Polynucleotide
taatacgactcactataggggacttagccaatagagtcctacagactttcaacagaggagagaaagtatgtaggactctaacctggcggcagcgcaaaagatg

SEQ ID NO: 19923 - DNA, 103 bp, Artificial Sequence
  Synthetic Polynucleotide
taatacgactcactatagggacactgacttagccaatagagtcctacagaaacagaggagatctgtaatgctctattggaacctggcggcagcgcaaaagatg

SEQ ID NO: 19924 - DNA, 103 bp, Artificial Sequence
  Synthetic Polynucleotide
taatacgactcactatagggattgaacactgacttagccaatagagtcctaacagaggagaaggactatgttggctaagaacctggcggcagcgcaaaagatg

SEQ ID NO: 19925 - DNA, 103 bp, Artificial Sequence
  Synthetic Polynucleotide
taatacgactcactatagggaggctattgaacactgacttagccaatagaaacagaggagatctattatgtaagtcagtaacctggcggcagcgcaaaagatg

SEQ ID NO: 19926 - DNA, 103 bp, Artificial Sequence
  Synthetic Polynucleotide
taatacgactcactatagggcaagttctaccactattgattcgccttgttaacagaggagaaacaagatgaatcaatagaacctggcggcagcgcaaaagatg

SEQ ID NO: 19927 - DNA, 103 bp, Artificial Sequence
  Synthetic Polynucleotide
taatacgactcactatagggcatacaggctattgaacactgacttagccaaacagaggagatggctaatgcagtgttcaaacctggcggcagcgcaaaagatg

SEQ ID NO: 19928 - DNA, 103 bp, Artificial Sequence
  Synthetic Polynucleotide
taatacgactcactatagggtgatgcatacaggctattgaacactgacttaacagaggagaaagtcaatgttcaatagcaacctggcggcagcgcaaaagatg

SEQ ID NO: 19929 - DNA, 103 bp, Artificial Sequence
  Synthetic Polynucleotide
taatacgactcactatagggtgtggtgatgcatacaggctattgaacactaacagaggagaagtgttatgtagcctgtaaacctggcggcagcgcaaaagatg

SEQ ID NO: 19930 - DNA, 103 bp, Artificial Sequence
  Synthetic Polynucleotide
taatacgactcactatagggccaattgtggtgatgcatacaggctattgaaacagaggagatcaataatgtgtatgcataacctggcggcagcgcaaaagatg

SEQ ID NO: 19931 - DNA, 103 bp, Artificial Sequence
  Synthetic Polynucleotide
taatacgactcactatagggtccttccaattgtggtgatgcatacaggctaacagaggagaagcctgatggcatcaccaaacctggcggcagcgcaaaagatg

SEQ ID NO: 19932 - DNA, 103 bp, Artificial Sequence
  Synthetic Polynucleotide
taatacgactcactataggggaaaatccttccaattgtggtgatgcatacaacagaggagagtatgcatgaccacaattaacctggcggcagcgcaaaagatg

SEQ ID NO: 19933 - DNA, 103 bp, Artificial Sequence
  Synthetic Polynucleotide
taatacgactcactatagggccgctgaaaatccttccaattgtggtgatgaacagaggagacatcacatgaattggaagaacctggcggcagcgcaaaagatg

SEQ ID NO: 19934 - DNA, 103 bp, Artificial Sequence
  Synthetic Polynucleotide
taatacgactcactatagggtgactccgctgaaaatccttccaattgtggaacagaggagaccacaaatggaaggatttaacctggcggcagcgcaaaagatg

SEQ ID NO: 19935 - DNA, 103 bp, Artificial Sequence
  Synthetic Polynucleotide
taatacgactcactatagggtttcttgactccgctgaaaatccttccaataacagaggagaattggaatgattttcagcaacctggcggcagcgcaaaagatg

SEQ ID NO: 19936 - DNA, 103 bp, Artificial Sequence
  Synthetic Polynucleotide
taatacgactcactataggggcagttttcttgactccgctgaaaatccttaacagaggagaaaggatatgcagcggagtaacctggcggcagcgcaaaagatg

SEQ ID NO: 19937 - DNA, 103 bp, Artificial Sequence
  Synthetic Polynucleotide
taatacgactcactatagggttgtcgcacaaaatcttccatttcgaatcaaacagaggagatgattcatgatggaagataacctggcggcagcgcaaaagatg

SEQ ID NO: 19938 - DNA, 103 bp, Artificial Sequence
  Synthetic Polynucleotide
taatacgactcactatagggatcatcaagttctaccactattgattcgccaacagaggagaggcgaaatgatagtggtaaacctggcggcagcgcaaaagatg

SEQ ID NO: 19939 - DNA, 103 bp, Artificial Sequence
  Synthetic Polynucleotide
taatacgactcactatagggaagaagcagttttcttgactccgctgaaaaaacagaggagattttcaatggagtcaagaaacctggcggcagcgcaaaagatg

SEQ ID NO: 19940 - DNA, 103 bp, Artificial Sequence
  Synthetic Polynucleotide
taatacgactcactatagggacaacaagaagcagttttcttgactccgctaacagaggagaagcggaatgaagaaaactaacctggcggcagcgcaaaagatg

SEQ ID NO: 19941 - DNA, 103 bp, Artificial Sequence
  Synthetic Polynucleotide
taatacgactcactatagggcctgaacaacaagaagcagttttcttgactaacagaggagaagtcaaatgaactgcttcaacctggcggcagcgcaaaagatg

SEQ ID NO: 19942 - DNA, 103 bp, Artificial Sequence
  Synthetic Polynucleotide
taatacgactcactatagggaagagcctgaacaacaagaagcagttttctaacagaggagaagaaaaatgcttcttgttaacctggcggcagcgcaaaagatg

SEQ ID NO: 19943 - DNA, 103 bp, Artificial Sequence
  Synthetic Polynucleotide
taatacgactcactatagggtccctaagagcctgaacaacaagaagcagtaacagaggagaactgctatgtgttgttcaaacctggcggcagcgcaaaagatg

SEQ ID NO: 19944 - DNA, 103 bp, Artificial Sequence
  Synthetic Polynucleotide
taatacgactcactatagggggttgtccctaagagcctgaacaacaagaaaacagaggagattcttgatgttcaggctcaacctggcggcagcgcaaaagatg

SEQ ID NO: 19945 - DNA, 103 bp, Artificial Sequence
  Synthetic Polynucleotide
taatacgactcactatagggttcgaggttgtccctaagagcctgaacaacaacagaggagagttgttatggctcttaggaacctggcggcagcgcaaaagatg

SEQ ID NO: 19946 - DNA, 103 bp, Artificial Sequence
  Synthetic Polynucleotide
taatacgactcactatagggccaggttcgaggttgtccctaagagcctgaaacagaggagatcaggcatgtagggacaaaacctggcggcagcgcaaaagatg

SEQ ID NO: 19947 - DNA, 103 bp, Artificial Sequence
  Synthetic Polynucleotide
taatacgactcactatagggaggtcccaggttcgaggttgtccctaagagaacagaggagactcttaatgacaacctcgaacctggcggcagcgcaaaagatg

SEQ ID NO: 19948 - DNA, 103 bp, Artificial Sequence
  Synthetic Polynucleotide
taatacgactcactatagggatcaaaggtcccaggttcgaggttgtccctaacagaggagaagggacatgctcgaacctaacctggcggcagcgcaaaagatg

SEQ ID NO: 19949 - DNA, 103 bp, Artificial Sequence
  Synthetic Polynucleotide
taatacgactcactatagggtttggatcatcaagttctaccactattgataacagaggagaatcaatatgggtagaactaacctggcggcagcgcaaaagatg

SEQ ID NO: 19950 - DNA, 103 bp, Artificial Sequence
  Synthetic Polynucleotide
taatacgactcactatagggccgagatcaaaggtcccaggttcgaggttgaacagaggagacaacctatgacctgggacaacctggcggcagcgcaaaagatg

SEQ ID NO: 19951 - DNA, 103 bp, Artificial Sequence
  Synthetic Polynucleotide
taatacgactcactataggggccccccgagatcaaaggtcccaggttcgaaacagaggagatcgaacatgggacctttgaacctggcggcagcgcaaaagatg

SEQ ID NO: 19952 - DNA, 103 bp, Artificial Sequence
  Synthetic Polynucleotide
taatacgactcactatagggatatagccccccgagatcaaaggtcccaggaacagaggagacctgggatgtttgatctcaacctggcggcagcgcaaaagatg

SEQ ID NO: 19953 - DNA, 103 bp, Artificial Sequence
  Synthetic Polynucleotide
taatacgactcactataggggcttcatatagccccccgagatcaaaggtcaacagaggagagaccttatgtctcgggggaacctggcggcagcgcaaaagatg

SEQ ID NO: 19954 - DNA, 103 bp, Artificial Sequence
  Synthetic Polynucleotide
taatacgactcactatagggcaattgcttcatatagccccccgagatcaaaacagaggagattgatcatggggggctataacctggcggcagcgcaaaagatg

SEQ ID NO: 19955 - DNA, 103 bp, Artificial Sequence
  Synthetic Polynucleotide
taatacgactcactatagggctcctcaattgcttcatatagccccccgagaacagaggagactcgggatgctatatgaaaacctggcggcagcgcaaaagatg

SEQ ID NO: 19956 - DNA, 103 bp, Artificial Sequence
  Synthetic Polynucleotide
taatacgactcactatagggaggcactcctcaattgcttcatatagccccaacagaggagaggggctatgtgaagcaataacctggcggcagcgcaaaagatg

SEQ ID NO: 19957 - DNA, 103 bp, Artificial Sequence
  Synthetic Polynucleotide
taatacgactcactatagggtaatcaggcactcctcaattgcttcatataaacagaggagatatatgatgcaattgaggaacctggcggcagcgcaaaagatg

SEQ ID NO: 19958 - DNA, 103 bp, Artificial Sequence
  Synthetic Polynucleotide
taatacgactcactatagggatcattaatcaggcactcctcaattgcttcaacagaggagagaagcaatggaggagtgcaacctggcggcagcgcaaaagatg

SEQ ID NO: 19959 - DNA, 103 bp, Artificial Sequence
  Synthetic Polynucleotide
taatacgactcactatagggcagggatcattaatcaggcactcctcaattaacagaggagaaattgaatggtgcctgataacctggcggcagcgcaaaagatg

SEQ ID NO: 19960 - DNA, 103 bp, Artificial Sequence
  Synthetic Polynucleotide
taatacgactcactataggggtgcatttggatcatcaagttctaccactaaacagaggagatagtggatgaacttgatgaacctggcggcagcgcaaaagatg

SEQ ID NO: 19961 - DNA, 103 bp, Artificial Sequence
  Synthetic Polynucleotide
taatacgactcactatagggaaacccagggatcattaatcaggcactcctaacagaggagaaggagtatgtgattaatgaacctggcggcagcgcaaaagatg

SEQ ID NO: 19962 - DNA, 103 bp, Artificial Sequence
  Synthetic Polynucleotide
taatacgactcactataggggagcaaaacccagggatcattaatcaggcaaacagaggagatgcctgatgaatgatcccaacctggcggcagcgcaaaagatg

SEQ ID NO: 19963 - DNA, 103 bp, Artificial Sequence
  Synthetic Polynucleotide
taatacgactcactataggggcattgagcaaaacccagggatcattaatcaacagaggagagattaaatgtccctgggtaacctggcggcagcgcaaaagatg

SEQ ID NO: 19964 - DNA, 103 bp, Artificial Sequence
  Synthetic Polynucleotide
taatacgactcactatagggaagatgcattgagcaaaacccagggatcataacagaggagaatgatcatggggttttgcaacctggcggcagcgcaaaagatg

SEQ ID NO: 19965 - DNA, 103 bp, Artificial Sequence
  Synthetic Polynucleotide
taatacgactcactataggggaaccaagatgcattgagcaaaacccagggaacagaggagaccctggatgttgctcaataacctggcggcagcgcaaaagatg

SEQ ID NO: 19966 - DNA, 103 bp, Artificial Sequence
  Synthetic Polynucleotide
taatacgactcactataggggagttgaaccaagatgcattgagcaaaaccaacagaggagaggttttatgcaatgcatcaacctggcggcagcgcaaaagatg

SEQ ID NO: 19967 - DNA, 103 bp, Artificial Sequence
  Synthetic Polynucleotide
taatacgactcactatagggggaaggagttgaaccaagatgcattgagcaaacagaggagatgctcaatgcatcttggtaacctggcggcagcgcaaaagatg

SEQ ID NO: 19968 - DNA, 103 bp, Artificial Sequence
  Synthetic Polynucleotide
taatacgactcactatagggtgtcaggaaggagttgaaccaagatgcattaacagaggagaaatgcaatgtggttcaacaacctggcggcagcgcaaaagatg

SEQ ID NO: 19969 - DNA, 103 bp, Artificial Sequence
  Synthetic Polynucleotide
taatacgactcactataggggcatgtgtcaggaaggagttgaaccaagataacagaggagaatcttgatgcaactccttaacctggcggcagcgcaaaagatg

SEQ ID NO: 19970 - DNA, 103 bp, Artificial Sequence
  Synthetic Polynucleotide
taatacgactcactatagggttaatgcatgtgtcaggaaggagttgaaccaacagaggagaggttcaatgccttcctgaaacctggcggcagcgcaaaagatg

SEQ ID NO: 19971 - DNA, 103 bp, Artificial Sequence
  Synthetic Polynucleotide
taatacgactcactatagggtaacagtgcatttggatcatcaagttctacaacagaggagagtagaaatggatgatccaaacctggcggcagcgcaaaagatg

SEQ ID NO: 19972 - DNA, 103 bp, Artificial Sequence
  Synthetic Polynucleotide
taatacgactcactatagggctattttaatgcatgtgtcaggaaggagttaacagaggagaaactccatgctgacacataacctggcggcagcgcaaaagatg

SEQ ID NO: 19973 - DNA, 103 bp, Artificial Sequence
  Synthetic Polynucleotide
taatacgactcactatagggcataactattttaatgcatgtgtcaggaagaacagaggagacttcctatgacatgcattaacctggcggcagcgcaaaagatg

SEQ ID NO: 19974 - DNA, 103 bp, Artificial Sequence
  Synthetic Polynucleotide
taatacgactcactatagggactgccataactattttaatgcatgtgtcaaacagaggagatgacacatgcattaaaataacctggcggcagcgcaaaagatg

SEQ ID NO: 19975 - DNA, 103 bp, Artificial Sequence
  Synthetic Polynucleotide
taatacgactcactataggggtagcactgccataactattttaatgcatgaacagaggagacatgcaatgaaatagttaaacctggcggcagcgcaaaagatg

SEQ ID NO: 19976 - DNA, 103 bp, Artificial Sequence
  Synthetic Polynucleotide
taatacgactcactatagggaaatagtagcactgccataactattttaataacagaggagaattaaaatggttatggcaaacctggcggcagcgcaaaagatg

SEQ ID NO: 19977 - DNA, 103 bp, Artificial Sequence
  Synthetic Polynucleotide
taatacgactcactatagggataacaaatagtagcactgccataactattaacagaggagaaatagtatgggcagtgctaacctggcggcagcgcaaaagatg

SEQ ID NO: 19978 - DNA, 103 bp, Artificial Sequence
  Synthetic Polynucleotide
taatacgactcactatagggtacggataacaaatagtagcactgccataaaacagaggagattatggatgtgctactataacctggcggcagcgcaaaagatg

SEQ ID NO: 19979 - DNA, 103 bp, Artificial Sequence
  Synthetic Polynucleotide
taatacgactcactataggggacagtacggataacaaatagtagcactgcaacagaggagagcagtgatgctatttgttaacctggcggcagcgcaaaagatg

SEQ ID NO: 19980 - DNA, 103 bp, Artificial Sequence
  Synthetic Polynucleotide
taatacgactcactatagggttttggacagtacggataacaaatagtagcaacagaggagagctactatgtgttatccgaacctggcggcagcgcaaaagatg

SEQ ID NO: 19981 - DNA, 103 bp, Artificial Sequence
  Synthetic Polynucleotide
taatacgactcactatagggtacttttttggacagtacggataacaaataaacagaggagatatttgatgtccgtactgaacctggcggcagcgcaaaagatg

SEQ ID NO: 19982 - DNA, 103 bp, Artificial Sequence
  Synthetic Polynucleotide
taatacgactcactatagggtgctttaacagtgcatttggatcatcaagtaacagaggagaacttgaatgtccaaatgcaacctggcggcagcgcaaaagatg

SEQ ID NO: 19983 - DNA, 103 bp, Artificial Sequence
  Synthetic Polynucleotide
taatacgactcactatagggcaaggtacttttttggacagtacggataacaacagaggagagttatcatgactgtccaaaacctggcggcagcgcaaaagatg

SEQ ID NO: 19984 - DNA, 103 bp, Artificial Sequence
  Synthetic Polynucleotide
taatacgactcactatagggagaaacaaggtacttttttggacagtacggaacagaggagaccgtacatgccaaaaaagaacctggcggcagcgcaaaagatg

SEQ ID NO: 19985 - DNA, 103 bp, Artificial Sequence
  Synthetic Polynucleotide
taatacgactcactatagggatctgtgctttaacagtgcatttggatcataacagaggagaatgatcatgatgcactgtaacctggcggcagcgcaaaagatg

SEQ ID NO: 19986 - DNA, 103 bp, Artificial Sequence
  Synthetic Polynucleotide
taatacgactcactatagggttcaaatctgtgctttaacagtgcatttggaacagaggagaccaaatatgctgttaaagaacctggcggcagcgcaaaagatg

SEQ ID NO: 19987 - DNA, 103 bp, Artificial Sequence
  Synthetic Polynucleotide
taatacgactcactatagggattatttcaaatctgtgctttaacagtgcaaacagaggagatgcactatgaaagcacagaacctggcggcagcgcaaaagatg

SEQ ID NO: 19988 - DNA, 103 bp, Artificial Sequence
  Synthetic Polynucleotide
taatacgactcactatagggcctcgattatttcaaatctgtgctttaacaaacagaggagatgttaaatgacagatttgaacctggcggcagcgcaaaagatg

SEQ ID NO: 19989 - DNA, 103 bp, Artificial Sequence
  Synthetic Polynucleotide
taatacgactcactatagggtctcccctcgattatttcaaatctgtgcttaacagaggagaaagcacatgtttgaaataaacctggcggcagcgcaaaagatg

SEQ ID NO: 19990 - DNA, 103 bp, Artificial Sequence
  Synthetic Polynucleotide
taatacgactcactatagggaagcattgtcgcacaaaatcttccatttcgaacagaggagacgaaatatgagattttgtaacctggcggcagcgcaaaagatg

SEQ ID NO: 19991 - DNA, 103 bp, Artificial Sequence
  Synthetic Polynucleotide
taatacgactcactatagggctgtctctcccctcgattatttcaaatctgaacagaggagacagattatgaataatcgaaacctggcggcagcgcaaaagatg

SEQ ID NO: 19992 - DNA, 103 bp, Artificial Sequence
  Synthetic Polynucleotide
taatacgactcactatagggttgttctgtctctcccctcgattatttcaaaacagaggagattgaaaatgtcgaggggaaacctggcggcagcgcaaaagatg

SEQ ID NO: 19993 - DNA, 103 bp, Artificial Sequence
  Synthetic Polynucleotide
taatacgactcactatagggggccattgttctgtctctcccctcgattataacagaggagaataatcatggggagagacaacctggcggcagcgcaaaagatg

SEQ ID NO: 19994 - DNA, 103 bp, Artificial Sequence
  Synthetic Polynucleotide
taatacgactcactataggggtccaggccattgttctgtctctcccctcgaacagaggagacgagggatgagacagaacaacctggcggcagcgcaaaagatg

SEQ ID NO: 19995 - DNA, 103 bp, Artificial Sequence
  Synthetic Polynucleotide
taatacgactcactatagggctactgtccaggccattgttctgtctctccaacagaggagaggagagatggaacaatggaacctggcggcagcgcaaaagatg

SEQ ID NO: 19996 - DNA, 103 bp, Artificial Sequence
  Synthetic Polynucleotide
taatacgactcactataggggtttactactgtccaggccattgttctgtcaacagaggagagacagaatgatggcctggaacctggcggcagcgcaaaagatg

SEQ ID NO: 19997 - DNA, 103 bp, Artificial Sequence
  Synthetic Polynucleotide
taatacgactcactatagggatactgtttactactgtccaggccattgttaacagaggagaaacaatatgctggacagtaacctggcggcagcgcaaaagatg

SEQ ID NO: 19998 - DNA, 103 bp, Artificial Sequence
  Synthetic Polynucleotide
taatacgactcactatagggtgcagatactgtttactactgtccaggccaaacagaggagatggcctatgcagtagtaaaacctggcggcagcgcaaaagatg

SEQ ID NO: 19999 - DNA, 103 bp, Artificial Sequence
  Synthetic Polynucleotide
taatacgactcactatagggagtgttgcagatactgtttactactgtccaaacagaggagatggacaatggtaaacagtaacctggcggcagcgcaaaagatg

SEQ ID NO: 20000 - DNA, 103 bp, Artificial Sequence
  Synthetic Polynucleotide
taatacgactcactatagggccagtagtgttgcagatactgtttactactaacagaggagaagtagtatgcagtatctgaacctggcggcagcgcaaaagatg

SEQ ID NO: 20001 - DNA, 103 bp, Artificial Sequence
  Synthetic Polynucleotide
taatacgactcactatagggggttgaagcattgtcgcacaaaatcttccaaacagaggagatggaagatgttgtgcgacaacctggcggcagcgcaaaagatg

SEQ ID NO: 20002 - DNA, 103 bp, Artificial Sequence
  Synthetic Polynucleotide
taatacgactcactatagggctgctccagtagtgttgcagatactgtttaaacagaggagataaacaatgtctgcaacaaacctggcggcagcgcaaaagatg

SEQ ID NO: 20003 - DNA, 103 bp, Artificial Sequence
  Synthetic Polynucleotide
taatacgactcactatagggtttttctgctccagtagtgttgcagatactaacagaggagaagtatcatgaacactactaacctggcggcagcgcaaaagatg

SEQ ID NO: 20004 - DNA, 103 bp, Artificial Sequence
  Synthetic Polynucleotide
taatacgactcactatagggtttggtttttctgctccagtagtgttgcagaacagaggagactgcaaatgtactggagcaacctggcggcagcgcaaaagatg

SEQ ID NO: 20005 - DNA, 103 bp, Artificial Sequence
  Synthetic Polynucleotide
taatacgactcactataggggaaactttggtttttctgctccagtagtgtaacagaggagaacactaatggagcagaaaaacctggcggcagcgcaaaagatg

SEQ ID NO: 20006 - DNA, 103 bp, Artificial Sequence
  Synthetic Polynucleotide
taatacgactcactatagggtggtagaaactttggtttttctgctccagtaacagaggagaactggaatggaaaaaccaaacctggcggcagcgcaaaagatg

SEQ ID NO: 20007 - DNA, 103 bp, Artificial Sequence
  Synthetic Polynucleotide
taatacgactcactatagggaaatctggtagaaactttggtttttctgctaacagaggagaagcagaatgaccaaagttaacctggcggcagcgcaaaagatg

SEQ ID NO: 20008 - DNA, 103 bp, Artificial Sequence
  Synthetic Polynucleotide
taatacgactcactatagggcatacaaatctggtagaaactttggtttttaacagaggagaaaaaacatgagtttctacaacctggcggcagcgcaaaagatg

SEQ ID NO: 20009 - DNA, 103 bp, Artificial Sequence
  Synthetic Polynucleotide
taatacgactcactataggggtaatcatacaaatctggtagaaactttggaacagaggagaccaaagatgctaccagataacctggcggcagcgcaaaagatg

SEQ ID NO: 20010 - DNA, 103 bp, Artificial Sequence
  Synthetic Polynucleotide
taatacgactcactatagggtccttgtaatcatacaaatctggtagaaacaacagaggagagtttctatgagatttgtaaacctggcggcagcgcaaaagatg

SEQ ID NO: 20011 - DNA, 103 bp, Artificial Sequence
  Synthetic Polynucleotide
taatacgactcactatagggtattctccttgtaatcatacaaatctggtaaacagaggagataccagatgtgtatgattaacctggcggcagcgcaaaagatg

SEQ ID NO: 20012 - DNA, 103 bp, Artificial Sequence
  Synthetic Polynucleotide
taatacgactcactatagggcatcgggttgaagcattgtcgcacaaaatcaacagaggagagattttatgcgacaatgcaacctggcggcagcgcaaaagatg

SEQ ID NO: 20013 - DNA, 103 bp, Artificial Sequence
  Synthetic Polynucleotide
taatacgactcactataggggaatctattctccttgtaatcatacaaatcaacagaggagagatttgatggattacaagaacctggcggcagcgcaaaagatg

SEQ ID NO: 20014 - DNA, 103 bp, Artificial Sequence
  Synthetic Polynucleotide
taatacgactcactatagggtcgatgaatctattctccttgtaatcatacaacagaggagagtatgaatgcaaggagaaaacctggcggcagcgcaaaagatg

SEQ ID NO: 20015 - DNA, 103 bp, Artificial Sequence
  Synthetic Polynucleotide
taatacgactcactatagggcaatttcgatgaatctattctccttgtaataacagaggagaattacaatgagaatagataacctggcggcagcgcaaaagatg

SEQ ID NO: 20016 - DNA, 103 bp, Artificial Sequence
  Synthetic Polynucleotide
taatacgactcactatagggcactccaatttcgatgaatctattctccttaacagaggagaaaggagatgagattcatcaacctggcggcagcgcaaaagatg

SEQ ID NO: 20017 - DNA, 103 bp, Artificial Sequence
  Synthetic Polynucleotide
taatacgactcactatagggcttgtcactccaatttcgatgaatctattcaacagaggagagaatagatgcatcgaaataacctggcggcagcgcaaaagatg

SEQ ID NO: 20018 - DNA, 103 bp, Artificial Sequence
  Synthetic Polynucleotide
taatacgactcactatagggctcttcttgtcactccaatttcgatgaatcaacagaggagagattcaatgaaattggagaacctggcggcagcgcaaaagatg

SEQ ID NO: 20019 - DNA, 103 bp, Artificial Sequence
  Synthetic Polynucleotide
taatacgactcactataggggacttctcttcttgtcactccaatttcgataacagaggagaatcgaaatgggagtgacaaacctggcggcagcgcaaaagatg

SEQ ID NO: 20020 - DNA, 103 bp, Artificial Sequence
  Synthetic Polynucleotide
taatacgactcactatagggatgtggacttctcttcttgtcactccaattaacagaggagaaattggatggacaagaagaacctggcggcagcgcaaaagatg

SEQ ID NO: 20021 - DNA, 103 bp, Artificial Sequence
  Synthetic Polynucleotide
taatacgactcactatagggaatatatgtggacttctcttcttgtcactcaacagaggagagagtgaatggaagagaagaacctggcggcagcgcaaaagatg

SEQ ID NO: 20022 - DNA, 103 bp, Artificial Sequence
  Synthetic Polynucleotide
taatacgactcactatagggaaggtaatatatgtggacttctcttcttgtaacagaggagaacaagaatggaagtccacaacctggcggcagcgcaaaagatg

SEQ ID NO: 20023 - DNA, 103 bp, Artificial Sequence
  Synthetic Polynucleotide
taatacgactcactatagggacaatcatcgggttgaagcattgtcgcacaaacagaggagatgtgcgatgatgcttcaaaacctggcggcagcgcaaaagatg

SEQ ID NO: 20024 - DNA, 103 bp, Artificial Sequence
  Synthetic Polynucleotide
taatacgactcactatagggttttcaaggtaatatatgtggacttctcttaacagaggagaaagagaatgccacatataaacctggcggcagcgcaaaagatg

SEQ ID NO: 20025 - DNA, 103 bp, Artificial Sequence
  Synthetic Polynucleotide
taatacgactcactatagggtggccttttcaaggtaatatatgtggacttaacagaggagaaagtccatgtatattaccaacctggcggcagcgcaaaagatg

SEQ ID NO: 20026 - DNA, 103 bp, Artificial Sequence
  Synthetic Polynucleotide
taatacgactcactatagggtttattggccttttcaaggtaatatatgtgaacagaggagacacataatgtaccttgaaaacctggcggcagcgcaaaagatg

SEQ ID NO: 20027 - DNA, 103 bp, Artificial Sequence
  Synthetic Polynucleotide
taatacgactcactatagggttaattttattggccttttcaaggtaatataacagaggagaatattaatgtgaaaaggcaacctggcggcagcgcaaaagatg

SEQ ID NO: 20028 - DNA, 103 bp, Artificial Sequence
  Synthetic Polynucleotide
taatacgactcactatagggcagatttaattttattggccttttcaaggtaacagaggagaaccttgatgaggccaataaacctggcggcagcgcaaaagatg

SEQ ID NO: 20029 - DNA, 103 bp, Artificial Sequence
  Synthetic Polynucleotide
taatacgactcactataggggttctcagatttaattttattggccttttcaacagaggagagaaaagatgaataaaattaacctggcggcagcgcaaaagatg

SEQ ID NO: 20030 - DNA, 103 bp, Artificial Sequence
  Synthetic Polynucleotide
taatacgactcactatagggtgtgtgttctcagatttaattttattggccaacagaggagaggccaaatgaattaaatcaacctggcggcagcgcaaaagatg

SEQ ID NO: 20031 - DNA, 103 bp, Artificial Sequence
  Synthetic Polynucleotide
taatacgactcactataggggaatgtgtgtgttctcagatttaattttataacagaggagaataaaaatgaatctgagaaacctggcggcagcgcaaaagatg

SEQ ID NO: 20032 - DNA, 103 bp, Artificial Sequence
  Synthetic Polynucleotide
taatacgactcactataggggatgtgaatgtgtgtgttctcagatttaataacagaggagaattaaaatggagaacacaaacctggcggcagcgcaaaagatg

SEQ ID NO: 20033 - DNA, 103 bp, Artificial Sequence
  Synthetic Polynucleotide
taatacgactcactataggggagaagatgtgaatgtgtgtgttctcagataacagaggagaatctgaatgcacacacataacctggcggcagcgcaaaagatg

SEQ ID NO: 20034 - DNA, 103 bp, Artificial Sequence
  Synthetic Polynucleotide
taatacgactcactataggggttcgacaatcatcgggttgaagcattgtcaacagaggagagacaatatgtcaacccgaaacctggcggcagcgcaaaagatg

SEQ ID NO: 20035 - DNA, 103 bp, Artificial Sequence
  Synthetic Polynucleotide
taatacgactcactatagggtgaatgagaagatgtgaatgtgtgtgttctaacagaggagaagaacaatgacattcacaaacctggcggcagcgcaaaagatg

SEQ ID NO: 20036 - DNA, 103 bp, Artificial Sequence
  Synthetic Polynucleotide
taatacgactcactatagggcccagtgaatgagaagatgtgaatgtgtgtaacagaggagaacacacatgcacatcttcaacctggcggcagcgcaaaagatg

SEQ ID NO: 20037 - DNA, 103 bp, Artificial Sequence
  Synthetic Polynucleotide
taatacgactcactatagggtcctccccagtgaatgagaagatgtgaatgaacagaggagacattcaatgcttctcattaacctggcggcagcgcaaaagatg

SEQ ID NO: 20038 - DNA, 103 bp, Artificial Sequence
  Synthetic Polynucleotide
taatacgactcactatagggctatttcctccccagtgaatgagaagatgtaacagaggagaacatctatgcattcactgaacctggcggcagcgcaaaagatg

SEQ ID NO: 20039 - DNA, 103 bp, Artificial Sequence
  Synthetic Polynucleotide
taatacgactcactatagggtgtggctatttcctccccagtgaatgagaaaacagaggagattctcaatgactggggagaacctggcggcagcgcaaaagatg

SEQ ID NO: 20040 - DNA, 103 bp, Artificial Sequence
  Synthetic Polynucleotide
taatacgactcactataggggcctttgtggctatttcctccccagtgaataacagaggagaattcacatgggaggaaataacctggcggcagcgcaaaagatg

SEQ ID NO: 20041 - DNA, 103 bp, Artificial Sequence
  Synthetic Polynucleotide
taatacgactcactatagggagtctgcctttgtggctatttcctccccagaacagaggagactggggatgaaatagccaaacctggcggcagcgcaaaagatg

SEQ ID NO: 20042 - DNA, 103 bp, Artificial Sequence
  Synthetic Polynucleotide
taatacgactcactatagggagtgtagtctgcctttgtggctatttcctcaacagaggagagaggaaatggccacaaagaacctggcggcagcgcaaaagatg

SEQ ID NO: 20043 - DNA, 103 bp, Artificial Sequence
  Synthetic Polynucleotide
taatacgactcactatagggtcgagagtgtagtctgcctttgtggctattaacagaggagaaatagcatgaaaggcagaaacctggcggcagcgcaaaagatg

SEQ ID NO: 20044 - DNA, 103 bp, Artificial Sequence
  Synthetic Polynucleotide
taatacgactcactatagggcctcgtcgagagtgtagtctgcctttgtggaacagaggagaccacaaatgcagactacaaacctggcggcagcgcaaaagatg

SEQ ID NO: 20045 - DNA, 103 bp, Artificial Sequence
  Synthetic Polynucleotide
taatacgactcactatagggaaccaaaaatgcctaggatccccggtgcgcaacagaggagagcgcacatgggatcctagaacctggcggcagcgcaaaagatg

SEQ ID NO: 20046 - DNA, 103 bp, Artificial Sequence
  Synthetic Polynucleotide
taatacgactcactatagggaatgtcactatttgtcccattttaaataggaacagaggagacctattatgaatgggacaaacctggcggcagcgcaaaagatg

SEQ ID NO: 20047 - DNA, 103 bp, Artificial Sequence
  Synthetic Polynucleotide
taatacgactcactatagggaaatcgcagctcattgcctcatactgattgaacagaggagacaatcaatgtgaggcaataacctggcggcagcgcaaaagatg

SEQ ID NO: 20048 - DNA, 103 bp, Artificial Sequence
  Synthetic Polynucleotide
taatacgactcactatagggcattaaaatcgcagctcattgcctcatactaacagaggagaagtatgatgcaatgagctaacctggcggcagcgcaaaagatg

SEQ ID NO: 20049 - DNA, 103 bp, Artificial Sequence
  Synthetic Polynucleotide
taatacgactcactatagggtcccccattaaaatcgcagctcattgcctcaacagaggagagaggcaatgagctgcgataacctggcggcagcgcaaaagatg

SEQ ID NO: 20050 - DNA, 103 bp, Artificial Sequence
  Synthetic Polynucleotide
taatacgactcactatagggatctttcccccattaaaatcgcagctcattaacagaggagaaatgagatgcgattttaaaacctggcggcagcgcaaaagatg

SEQ ID NO: 20051 - DNA, 103 bp, Artificial Sequence
  Synthetic Polynucleotide
taatacgactcactatagggcactaatctttcccccattaaaatcgcagcaacagaggagagctgcgatgttaatggggaacctggcggcagcgcaaaagatg

SEQ ID NO: 20052 - DNA, 103 bp, Artificial Sequence
  Synthetic Polynucleotide
taatacgactcactatagggctgcacactaatctttcccccattaaaatcaacagaggagagattttatggggggaaagaacctggcggcagcgcaaaagatg

SEQ ID NO: 20053 - DNA, 103 bp, Artificial Sequence
  Synthetic Polynucleotide
taatacgactcactatagggttgtactgcacactaatctttcccccattaaacagaggagataatggatgaaagattagaacctggcggcagcgcaaaagatg

SEQ ID NO: 20054 - DNA, 103 bp, Artificial Sequence
  Synthetic Polynucleotide
taatacgactcactatagggtcaggttgtactgcacactaatctttccccaacagaggagaggggaaatgttagtgtgcaacctggcggcagcgcaaaagatg

SEQ ID NO: 20055 - DNA, 103 bp, Artificial Sequence
  Synthetic Polynucleotide
taatacgactcactataggggtgactcaggttgtactgcacactaatcttaacagaggagaaagattatggtgcagtacaacctggcggcagcgcaaaagatg

SEQ ID NO: 20056 - DNA, 103 bp, Artificial Sequence
  Synthetic Polynucleotide
taatacgactcactatagggtagctgtgactcaggttgtactgcacactaaacagaggagatagtgtatggtacaacctaacctggcggcagcgcaaaagatg

SEQ ID NO: 20057 - DNA, 103 bp, Artificial Sequence
  Synthetic Polynucleotide
taatacgactcactatagggggaagaatgtcactatttgtcccattttaaaacagaggagattaaaaatggacaaatagaacctggcggcagcgcaaaagatg

SEQ ID NO: 20058 - DNA, 103 bp, Artificial Sequence
  Synthetic Polynucleotide
taatacgactcactatagggcagcatagctgtgactcaggttgtactgcaaacagaggagatgcagtatgacctgagtcaacctggcggcagcgcaaaagatg

SEQ ID NO: 20059 - DNA, 103 bp, Artificial Sequence
  Synthetic Polynucleotide
taatacgactcactatagggatccccagcatagctgtgactcaggttgtaaacagaggagatacaacatgagtcacagcaacctggcggcagcgcaaaagatg

SEQ ID NO: 20060 - DNA, 103 bp, Artificial Sequence
  Synthetic Polynucleotide
taatacgactcactataggggctgcatccccagcatagctgtgactcaggaacagaggagacctgagatgcagctatgcaacctggcggcagcgcaaaagatg

SEQ ID NO: 20061 - DNA, 103 bp, Artificial Sequence
  Synthetic Polynucleotide
taatacgactcactatagggggttggctgcatccccagcatagctgtgacaacagaggagagtcacaatgatgctggggaacctggcggcagcgcaaaagatg

SEQ ID NO: 20062 - DNA, 103 bp, Artificial Sequence
  Synthetic Polynucleotide
taatacgactcactatagggacaatggttggctgcatccccagcatagctaacagaggagaagctatatgggggatgcaaacctggcggcagcgcaaaagatg

SEQ ID NO: 20063 - DNA, 103 bp, Artificial Sequence
  Synthetic Polynucleotide
taatacgactcactataggggtaccacaatggttggctgcatccccagcaaacagaggagatgctggatgtgcagccaaaacctggcggcagcgcaaaagatg

SEQ ID NO: 20064 - DNA, 103 bp, Artificial Sequence
  Synthetic Polynucleotide
taatacgactcactatagggcaacagtaccacaatggttggctgcatcccaacagaggagagggatgatgccaaccattaacctggcggcagcgcaaaagatg

SEQ ID NO: 20065 - DNA, 103 bp, Artificial Sequence
  Synthetic Polynucleotide
taatacgactcactatagggatttgcaacagtaccacaatggttggctgcaacagaggagagcagccatgcattgtggtaacctggcggcagcgcaaaagatg

SEQ ID NO: 20066 - DNA, 103 bp, Artificial Sequence
  Synthetic Polynucleotide
taatacgactcactatagggacaccatttgcaacagtaccacaatggttgaacagaggagacaaccaatgtggtactgtaacctggcggcagcgcaaaagatg

SEQ ID NO: 20067 - DNA, 103 bp, Artificial Sequence
  Synthetic Polynucleotide
taatacgactcactataggggtaacacaccatttgcaacagtaccacaataacagaggagaattgtgatgctgttgcaaaacctggcggcagcgcaaaagatg

SEQ ID NO: 20068 - DNA, 103 bp, Artificial Sequence
  Synthetic Polynucleotide
taatacgactcactatagggttcctggaagaatgtcactatttgtcccataacagaggagaatgggaatgatagtgacaaacctggcggcagcgcaaaagatg

SEQ ID NO: 20069 - DNA, 103 bp, Artificial Sequence
  Synthetic Polynucleotide
taatacgactcactatagggagtctgtaacacaccatttgcaacagtaccaacagaggagaggtactatggcaaatggtaacctggcggcagcgcaaaagatg

SEQ ID NO: 20070 - DNA, 103 bp, Artificial Sequence
  Synthetic Polynucleotide
taatacgactcactatagggataaaagtctgtaacacaccatttgcaacaaacagaggagatgttgcatgtggtgtgttaacctggcggcagcgcaaaagatg

SEQ ID NO: 20071 - DNA, 103 bp, Artificial Sequence
  Synthetic Polynucleotide
taatacgactcactatagggtcctcataaaagtctgtaacacaccatttgaacagaggagacaaatgatgtgttacagaaacctggcggcagcgcaaaagatg

SEQ ID NO: 20072 - DNA, 103 bp, Artificial Sequence
  Synthetic Polynucleotide
taatacgactcactatagggagccatcctcataaaagtctgtaacacaccaacagaggagaggtgtgatgcagacttttaacctggcggcagcgcaaaagatg

SEQ ID NO: 20073 - DNA, 103 bp, Artificial Sequence
  Synthetic Polynucleotide
taatacgactcactatagggccccaagccatcctcataaaagtctgtaacaacagaggagagttacaatgttttatgagaacctggcggcagcgcaaaagatg

SEQ ID NO: 20074 - DNA, 103 bp, Artificial Sequence
  Synthetic Polynucleotide
taatacgactcactatagggtcccaccccaagccatcctcataaaagtctaacagaggagaagacttatgtgaggatggaacctggcggcagcgcaaaagatg

SEQ ID NO: 20075 - DNA, 103 bp, Artificial Sequence
  Synthetic Polynucleotide
taatacgactcactataggggtagctcccaccccaagccatcctcataaaaacagaggagatttatgatgatggcttggaacctggcggcagcgcaaaagatg

SEQ ID NO: 20076 - DNA, 103 bp, Artificial Sequence
  Synthetic Polynucleotide
taatacgactcactataggggcaatgtagctcccaccccaagccatcctcaacagaggagagaggatatgttggggtggaacctggcggcagcgcaaaagatg

SEQ ID NO: 20077 - DNA, 103 bp, Artificial Sequence
  Synthetic Polynucleotide
taatacgactcactatagggcaagagcaatgtagctcccaccccaagccaaacagaggagatggcttatggtgggagctaacctggcggcagcgcaaaagatg

SEQ ID NO: 20078 - DNA, 103 bp, Artificial Sequence
  Synthetic Polynucleotide
taatacgactcactatagggtgagtcaagagcaatgtagctcccaccccaaacagaggagatggggtatgagctacattaacctggcggcagcgcaaaagatg

SEQ ID NO: 20079 - DNA, 103 bp, Artificial Sequence
  Synthetic Polynucleotide
taatacgactcactatagggggcacttcctggaagaatgtcactatttgtaacagaggagaacaaatatggacattcttaacctggcggcagcgcaaaagatg

SEQ ID NO: 20080 - DNA, 103 bp, Artificial Sequence
  Synthetic Polynucleotide
taatacgactcactatagggcggcctgagtcaagagcaatgtagctcccaaacagaggagatgggagatgcattgctctaacctggcggcagcgcaaaagatg

SEQ ID NO: 20081 - DNA, 103 bp, Artificial Sequence
  Synthetic Polynucleotide
taatacgactcactatagggtgccacggcctgagtcaagagcaatgtagcaacagaggagagctacaatgctcttgactaacctggcggcagcgcaaaagatg

SEQ ID NO: 20082 - DNA, 103 bp, Artificial Sequence
  Synthetic Polynucleotide
taatacgactcactatagggccagttgccacggcctgagtcaagagcaataacagaggagaattgctatggactcaggcaacctggcggcagcgcaaaagatg

SEQ ID NO: 20083 - DNA, 103 bp, Artificial Sequence
  Synthetic Polynucleotide
taatacgactcactatagggcagtcccagttgccacggcctgagtcaagaaacagaggagatcttgaatgaggccgtggaacctggcggcagcgcaaaagatg

SEQ ID NO: 20084 - DNA, 103 bp, Artificial Sequence
  Synthetic Polynucleotide
taatacgactcactatagggtaatacagtcccagttgccacggcctgagtaacagaggagaactcagatggtggcaactaacctggcggcagcgcaaaagatg

SEQ ID NO: 20085 - DNA, 103 bp, Artificial Sequence
  Synthetic Polynucleotide
taatacgactcactatagggagtcataatacagtcccagttgccacggccaacagaggagaggccgtatgaactgggacaacctggcggcagcgcaaaagatg

SEQ ID NO: 20086 - DNA, 103 bp, Artificial Sequence
  Synthetic Polynucleotide
taatacgactcactatagggtaactagtcataatacagtcccagttgccaaacagaggagatggcaaatgggactgtataacctggcggcagcgcaaaagatg

SEQ ID NO: 20087 - DNA, 103 bp, Artificial Sequence
  Synthetic Polynucleotide
taatacgactcactatagggattgataactagtcataatacagtcccagtaacagaggagaactgggatggtattatgaaacctggcggcagcgcaaaagatg

SEQ ID NO: 20088 - DNA, 103 bp, Artificial Sequence
  Synthetic Polynucleotide
taatacgactcactatagggcagatattgataactagtcataatacagtcaacagaggagagactgtatgatgactagtaacctggcggcagcgcaaaagatg

SEQ ID NO: 20089 - DNA, 103 bp, Artificial Sequence
  Synthetic Polynucleotide
taatacgactcactatagggattatcagatattgataactagtcataataaacagaggagatattatatgtagttatcaaacctggcggcagcgcaaaagatg

SEQ ID NO: 20090 - DNA, 103 bp, Artificial Sequence
  Synthetic Polynucleotide
taatacgactcactatagggcatgaggcacttcctggaagaatgtcactaaacagaggagatagtgaatgtcttccaggaacctggcggcagcgcaaaagatg

SEQ ID NO: 20091 - DNA, 103 bp, Artificial Sequence
  Synthetic Polynucleotide
taatacgactcactatagggtttggattatcagatattgataactagtcaaacagaggagatgactaatgatcaatatcaacctggcggcagcgcaaaagatg

SEQ ID NO: 20092 - DNA, 103 bp, Artificial Sequence
  Synthetic Polynucleotide
taatacgactcactatagggtgtattttggattatcagatattgataactaacagaggagaagttatatgtatctgataaacctggcggcagcgcaaaagatg

SEQ ID NO: 20093 - DNA, 103 bp, Artificial Sequence
  Synthetic Polynucleotide
taatacgactcactatagggcaggttgtattttggattatcagatattgaaacagaggagatcaataatggataatccaaacctggcggcagcgcaaaagatg

SEQ ID NO: 20094 - DNA, 103 bp, Artificial Sequence
  Synthetic Polynucleotide
taatacgactcactatagggcttcccaggttgtattttggattatcagataacagaggagaatctgaatgtccaaaataaacctggcggcagcgcaaaagatg

SEQ ID NO: 20095 - DNA, 103 bp, Artificial Sequence
  Synthetic Polynucleotide
taatacgactcactataggggtgatcttcccaggttgtattttggattataacagaggagaataatcatgaatacaaccaacctggcggcagcgcaaaagatg

SEQ ID NO: 20096 - DNA, 103 bp, Artificial Sequence
  Synthetic Polynucleotide
taatacgactcactatagggtggcagtgatcttcccaggttgtattttggaacagaggagaccaaaaatgaacctgggaaacctggcggcagcgcaaaagatg

SEQ ID NO: 20097 - DNA, 103 bp, Artificial Sequence
  Synthetic Polynucleotide
taatacgactcactatagggagaattggcagtgatcttcccaggttgtataacagaggagaatacaaatggggaagatcaacctggcggcagcgcaaaagatg

SEQ ID NO: 20098 - DNA, 103 bp, Artificial Sequence
  Synthetic Polynucleotide
taatacgactcactatagggtctcgagaattggcagtgatcttcccaggtaacagaggagaacctggatggatcactgcaacctggcggcagcgcaaaagatg

SEQ ID NO: 20099 - DNA, 103 bp, Artificial Sequence
  Synthetic Polynucleotide
taatacgactcactataggggatggtctcgagaattggcagtgatcttccaacagaggagaggaagaatgctgccaattaacctggcggcagcgcaaaagatg

SEQ ID NO: 20100 - DNA, 103 bp, Artificial Sequence
  Synthetic Polynucleotide
taatacgactcactatagggtgggagatggtctcgagaattggcagtgataacagaggagaatcactatgaattctcgaaacctggcggcagcgcaaaagatg

SEQ ID NO: 20101 - DNA, 103 bp, Artificial Sequence
  Synthetic Polynucleotide
taatacgactcactatagggtattacatgaggcacttcctggaagaatgtaacagaggagaacattcatgcaggaagtgaacctggcggcagcgcaaaagatg

SEQ ID NO: 20102 - DNA, 103 bp, Artificial Sequence
  Synthetic Polynucleotide
taatacgactcactatagggaccgatgggagatggtctcgagaattggcaaacagaggagatgccaaatgtcgagaccaaacctggcggcagcgcaaaagatg

SEQ ID NO: 20103 - DNA, 103 bp, Artificial Sequence
  Synthetic Polynucleotide
taatacgactcactatagggagataaccgatgggagatggtctcgagaataacagaggagaattctcatgaccatctccaacctggcggcagcgcaaaagatg

SEQ ID NO: 20104 - DNA, 103 bp, Artificial Sequence
  Synthetic Polynucleotide
taatacgactcactataggggcccgagataaccgatgggagatggtctcgaacagaggagacgagacatgctcccatcgaacctggcggcagcgcaaaagatg

SEQ ID NO: 20105 - DNA, 103 bp, Artificial Sequence
  Synthetic Polynucleotide
taatacgactcactataggggaggagcccgagataaccgatgggagatggaacagaggagaccatctatgatcggttataacctggcggcagcgcaaaagatg

SEQ ID NO: 20106 - DNA, 103 bp, Artificial Sequence
  Synthetic Polynucleotide
taatacgactcactatagggtgtgagaggagcccgagataaccgatgggaaacagaggagatcccatatgttatctcggaacctggcggcagcgcaaaagatg

SEQ ID NO: 20107 - DNA, 103 bp, Artificial Sequence
  Synthetic Polynucleotide
taatacgactcactatagggtcctttgtgagaggagcccgagataaccgaaacagaggagatcggttatgtcgggctccaacctggcggcagcgcaaaagatg

SEQ ID NO: 20108 - DNA, 103 bp, Artificial Sequence
  Synthetic Polynucleotide
taatacgactcactatagggtctagtcctttgtgagaggagcccgagataaacagaggagatatctcatgctcctctcaaacctggcggcagcgcaaaagatg

SEQ ID NO: 20109 - DNA, 103 bp, Artificial Sequence
  Synthetic Polynucleotide
taatacgactcactatagggatatctctagtcctttgtgagaggagcccgaacagaggagacgggctatgctcacaaagaacctggcggcagcgcaaaagatg

SEQ ID NO: 20110 - DNA, 103 bp, Artificial Sequence
  Synthetic Polynucleotide
taatacgactcactatagggtataaatatctctagtcctttgtgagaggaaacagaggagatcctctatgaaaggactaaacctggcggcagcgcaaaagatg

SEQ ID NO: 20111 - DNA, 103 bp, Artificial Sequence
  Synthetic Polynucleotide
taatacgactcactatagggactaatataaatatctctagtcctttgtgaaacagaggagatcacaaatgactagagataacctggcggcagcgcaaaagatg

SEQ ID NO: 20112 - DNA, 103 bp, Artificial Sequence
  Synthetic Polynucleotide
taatacgactcactatagggtcttctattacatgaggcacttcctggaagaacagaggagacttccaatgagtgcctcaaacctggcggcagcgcaaaagatg

SEQ ID NO: 20113 - DNA, 103 bp, Artificial Sequence
  Synthetic Polynucleotide
taatacgactcactatagggcttctactaatataaatatctctagtccttaacagaggagaaaggacatgagatatttaaacctggcggcagcgcaaaagatg

SEQ ID NO: 20114 - DNA, 103 bp, Artificial Sequence
  Synthetic Polynucleotide
taatacgactcactataggggcaatcttctactaatataaatatctctagaacagaggagactagagatgtttatattaaacctggcggcagcgcaaaagatg

SEQ ID NO: 20115 - DNA, 103 bp, Artificial Sequence
  Synthetic Polynucleotide
taatacgactcactataggggcctagcaatcttctactaatataaatatcaacagaggagagatattatgattagtagaaacctggcggcagcgcaaaagatg

SEQ ID NO: 20116 - DNA, 103 bp, Artificial Sequence
  Synthetic Polynucleotide
taatacgactcactatagggaatgtgcctagcaatcttctactaatataaaacagaggagattatatatgtagaagattaacctggcggcagcgcaaaagatg

SEQ ID NO: 20117 - DNA, 103 bp, Artificial Sequence
  Synthetic Polynucleotide
taatacgactcactatagggatgtgaatgtgcctagcaatcttctactaaaacagaggagattagtaatggattgctagaacctggcggcagcgcaaaagatg

SEQ ID NO: 20118 - DNA, 103 bp, Artificial Sequence
  Synthetic Polynucleotide
taatacgactcactatagggtgtccatgtgaatgtgcctagcaatcttctaacagaggagaagaagaatgctaggcacaaacctggcggcagcgcaaaagatg

SEQ ID NO: 20119 - DNA, 103 bp, Artificial Sequence
  Synthetic Polynucleotide
taatacgactcactataggggacagtgtccatgtgaatgtgcctagcaataacagaggagaattgctatgcacattcacaacctggcggcagcgcaaaagatg

SEQ ID NO: 20120 - DNA, 103 bp, Artificial Sequence
  Synthetic Polynucleotide
taatacgactcactatagggaatctgacagtgtccatgtgaatgtgcctaaacagaggagataggcaatgtcacatggaaacctggcggcagcgcaaaagatg

SEQ ID NO: 20121 - DNA, 103 bp, Artificial Sequence
  Synthetic Polynucleotide
taatacgactcactatagggttcagaatctgacagtgtccatgtgaatgtaacagaggagaacattcatgtggacactgaacctggcggcagcgcaaaagatg

SEQ ID NO: 20122 - DNA, 103 bp, Artificial Sequence
  Synthetic Polynucleotide
taatacgactcactatagggtcaccttcagaatctgacagtgtccatgtgaacagaggagacacatgatgactgtcagaaacctggcggcagcgcaaaagatg

SEQ ID NO: 20123 - DNA, 103 bp, Artificial Sequence
  Synthetic Polynucleotide
taatacgactcactatagggtcacctcttctattacatgaggcacttcctaacagaggagaaggaagatgctcatgtaaaacctggcggcagcgcaaaagatg

SEQ ID NO: 20124 - DNA, 103 bp, Artificial Sequence
  Synthetic Polynucleotide
taatacgactcactatagggtgtcttcaccttcagaatctgacagtgtccaacagaggagaggacacatgcagattctgaacctggcggcagcgcaaaagatg

SEQ ID NO: 20125 - DNA, 103 bp, Artificial Sequence
  Synthetic Polynucleotide
taatacgactcactatagggtggtgtgtcttcaccttcagaatctgacagaacagaggagactgtcaatgtctgaaggtaacctggcggcagcgcaaaagatg

SEQ ID NO: 20126 - DNA, 103 bp, Artificial Sequence
  Synthetic Polynucleotide
taatacgactcactatagggccccctggtgtgtcttcaccttcagaatctaacagaggagaagattcatgaggtgaagaaacctggcggcagcgcaaaagatg

SEQ ID NO: 20127 - DNA, 103 bp, Artificial Sequence
  Synthetic Polynucleotide
taatacgactcactatagggaatatccccctggtgtgtcttcaccttcagaacagaggagactgaagatgaagacacacaacctggcggcagcgcaaaagatg

SEQ ID NO: 20128 - DNA, 103 bp, Artificial Sequence
  Synthetic Polynucleotide
taatacgactcactatagggcagacaatatccccctggtgtgtcttcaccaacagaggagaggtgaaatgacaccagggaacctggcggcagcgcaaaagatg

SEQ ID NO: 20129 - DNA, 103 bp, Artificial Sequence
  Synthetic Polynucleotide
taatacgactcactatagggctggtcagacaatatccccctggtgtgtctaacagaggagaagacacatgagggggataaacctggcggcagcgcaaaagatg

SEQ ID NO: 20130 - DNA, 103 bp, Artificial Sequence
  Synthetic Polynucleotide
taatacgactcactatagggtccacctggtcagacaatatccccctggtgaacagaggagacaccagatggatattgtcaacctggcggcagcgcaaaagatg

SEQ ID NO: 20131 - DNA, 103 bp, Artificial Sequence
  Synthetic Polynucleotide
taatacgactcactatagggtagcatccacctggtcagacaatatcccccaacagaggagagggggaatgtgtctgaccaacctggcggcagcgcaaaagatg

SEQ ID NO: 20132 - DNA, 103 bp, Artificial Sequence
  Synthetic Polynucleotide
taatacgactcactatagggtcaattagcatccacctggtcagacaatataacagaggagaatattgatggaccaggtgaacctggcggcagcgcaaaagatg

SEQ ID NO: 20133 - DNA, 103 bp, Artificial Sequence
  Synthetic Polynucleotide
taatacgactcactatagggcagcctcaattagcatccacctggtcagacaacagaggagagtctgaatgggtggatgcaacctggcggcagcgcaaaagatg

SEQ ID NO: 20134 - DNA, 103 bp, Artificial Sequence
  Synthetic Polynucleotide
taatacgactcactataggggttcatcacctcttctattacatgaggcacaacagaggagagtgcctatggtaatagaaaacctggcggcagcgcaaaagatg

SEQ ID NO: 20135 - DNA, 103 bp, Artificial Sequence
  Synthetic Polynucleotide
taatacgactcactatagggtagttcagcctcaattagcatccacctggtaacagaggagaaccaggatgatgctaattaacctggcggcagcgcaaaagatg

SEQ ID NO: 20136 - DNA, 103 bp, Artificial Sequence
  Synthetic Polynucleotide
taatacgactcactatagggcattttagttcagcctcaattagcatccacaacagaggagagtggatatgaattgaggcaacctggcggcagcgcaaaagatg

SEQ ID NO: 20137 - DNA, 103 bp, Artificial Sequence
  Synthetic Polynucleotide
taatacgactcactatagggcgaagcattttagttcagcctcaattagcaaacagaggagatgctaaatgaggctgaacaacctggcggcagcgcaaaagatg

SEQ ID NO: 20138 - DNA, 103 bp, Artificial Sequence
  Synthetic Polynucleotide
taatacgactcactataggggttcccgaagcattttagttcagcctcaataacagaggagaattgagatggaactaaaaaacctggcggcagcgcaaaagatg

SEQ ID NO: 20139 - DNA, 103 bp, Artificial Sequence
  Synthetic Polynucleotide
taatacgactcactataggggctgtgttcccgaagcattttagttcagccaacagaggagaggctgaatgaaaatgcttaacctggcggcagcgcaaaagatg

SEQ ID NO: 20140 - DNA, 103 bp, Artificial Sequence
  Synthetic Polynucleotide
taatacgactcactatagggccacagctgtgttcccgaagcattttagttaacagaggagaaactaaatggcttcgggaaacctggcggcagcgcaaaagatg

SEQ ID NO: 20141 - DNA, 103 bp, Artificial Sequence
  Synthetic Polynucleotide
taatacgactcactatagggttttgccacagctgtgttcccgaagcatttaacagaggagaaaatgcatggggaacacaaacctggcggcagcgcaaaagatg

SEQ ID NO: 20142 - DNA, 103 bp, Artificial Sequence
  Synthetic Polynucleotide
taatacgactcactatagggttacattttgccacagctgtgttcccgaagaacagaggagacttcggatgcacagctgtaacctggcggcagcgcaaaagatg

SEQ ID NO: 20143 - DNA, 103 bp, Artificial Sequence
  Synthetic Polynucleotide
taatacgactcactatagggtctcattacattttgccacagctgtgttccaacagaggagaggaacaatgctgtggcaaaacctggcggcagcgcaaaagatg

SEQ ID NO: 20144 - DNA, 103 bp, Artificial Sequence
  Synthetic Polynucleotide
taatacgactcactatagggatgcttctcattacattttgccacagctgtaacagaggagaacagctatggcaaaatgtaacctggcggcagcgcaaaagatg

SEQ ID NO: 20145 - DNA, 103 bp, Artificial Sequence
  Synthetic Polynucleotide
taatacgactcactatagggacaatgttcatcacctcttctattacatgaaacagaggagatcatgtatgagaagaggtaacctggcggcagcgcaaaagatg

SEQ ID NO: 20146 - DNA, 103 bp, Artificial Sequence
  Synthetic Polynucleotide
taatacgactcactatagggtcatcatgcttctcattacattttgccacaaacagaggagatgtggcatgatgtaatgaaacctggcggcagcgcaaaagatg

SEQ ID NO: 20147 - DNA, 103 bp, Artificial Sequence
  Synthetic Polynucleotide
taatacgactcactatagggattcctcatcatgcttctcattacattttgaacagaggagacaaaatatgatgagaagcaacctggcggcagcgcaaaagatg

SEQ ID NO: 20148 - DNA, 103 bp, Artificial Sequence
  Synthetic Polynucleotide
taatacgactcactatagggacaaaattcctcatcatgcttctcattacaaacagaggagatgtaatatgaagcatgataacctggcggcagcgcaaaagatg

SEQ ID NO: 20149 - DNA, 103 bp, Artificial Sequence
  Synthetic Polynucleotide
taatacgactcactatagggatgtcacaaaattcctcatcatgcttctcaaacagaggagatgagaaatgtgatgaggaaacctggcggcagcgcaaaagatg

SEQ ID NO: 20150 - DNA, 103 bp, Artificial Sequence
  Synthetic Polynucleotide
taatacgactcactatagggtcagcatgtcacaaaattcctcatcatgctaacagaggagaagcatgatgaggaattttaacctggcggcagcgcaaaagatg

SEQ ID NO: 20151 - DNA, 103 bp, Artificial Sequence
  Synthetic Polynucleotide
taatacgactcactatagggcagcctcagcatgtcacaaaattcctcatcaacagaggagagatgagatgttttgtgacaacctggcggcagcgcaaaagatg

SEQ ID NO: 20152 - DNA, 103 bp, Artificial Sequence
  Synthetic Polynucleotide
taatacgactcactatagggtcaaacagcctcagcatgtcacaaaattccaacagaggagaggaattatgtgacatgctaacctggcggcagcgcaaaagatg

SEQ ID NO: 20153 - DNA, 103 bp, Artificial Sequence
  Synthetic Polynucleotide
taatacgactcactatagggtgaagtcaaacagcctcagcatgtcacaaaaacagaggagatttgtgatgtgctgaggcaacctggcggcagcgcaaaagatg

SEQ ID NO: 20154 - DNA, 103 bp, Artificial Sequence
  Synthetic Polynucleotide
taatacgactcactatagggtttgttgaagtcaaacagcctcagcatgtcaacagaggagagacatgatgaggctgtttaacctggcggcagcgcaaaagatg

SEQ ID NO: 20155 - DNA, 103 bp, Artificial Sequence
  Synthetic Polynucleotide
taatacgactcactataggggcttgtttgttgaagtcaaacagcctcagcaacagaggagagctgagatggtttgacttaacctggcggcagcgcaaaagatg

SEQ ID NO: 20156 - DNA, 103 bp, Artificial Sequence
  Synthetic Polynucleotide
taatacgactcactatagggtgcgcaaccaaaaatgcctaggatccccggaacagaggagaccggggatgctaggcattaacctggcggcagcgcaaaagatg

SEQ ID NO: 20157 - DNA, 103 bp, Artificial Sequence
  Synthetic Polynucleotide
taatacgactcactatagggtgagaacaatgttcatcacctcttctattaaacagaggagataatagatgaggtgatgaaacctggcggcagcgcaaaagatg

SEQ ID NO: 20158 - DNA, 103 bp, Artificial Sequence
  Synthetic Polynucleotide
taatacgactcactataggggaatggcttgtttgttgaagtcaaacagccaacagaggagaggctgtatgacttcaacaaacctggcggcagcgcaaaagatg

SEQ ID NO: 20159 - DNA, 103 bp, Artificial Sequence
  Synthetic Polynucleotide
taatacgactcactatagggcctttgaatggcttgtttgttgaagtcaaaaacagaggagatttgacatgaacaaacaaaacctggcggcagcgcaaaagatg

SEQ ID NO: 20160 - DNA, 103 bp, Artificial Sequence
  Synthetic Polynucleotide
taatacgactcactatagggttcaacctttgaatggcttgtttgttgaagaacagaggagacttcaaatgacaagccataacctggcggcagcgcaaaagatg

SEQ ID NO: 20161 - DNA, 103 bp, Artificial Sequence
  Synthetic Polynucleotide
taatacgactcactatagggcagctttcaacctttgaatggcttgtttgtaacagaggagaacaaacatgccattcaaaaacctggcggcagcgcaaaagatg

SEQ ID NO: 20162 - DNA, 103 bp, Artificial Sequence
  Synthetic Polynucleotide
taatacgactcactatagggtgcttcagctttcaacctttgaatggcttgaacagaggagacaagccatgcaaaggttgaacctggcggcagcgcaaaagatg

SEQ ID NO: 20163 - DNA, 103 bp, Artificial Sequence
  Synthetic Polynucleotide
taatacgactcactatagggatttgtgcttcagctttcaacctttgaatgaacagaggagacattcaatggttgaaagcaacctggcggcagcgcaaaagatg

SEQ ID NO: 20164 - DNA, 103 bp, Artificial Sequence
  Synthetic Polynucleotide
taatacgactcactatagggtgctcatttgtgcttcagctttcaacctttaacagaggagaaaaggtatgaagctgaagaacctggcggcagcgcaaaagatg

SEQ ID NO: 20165 - DNA, 103 bp, Artificial Sequence
  Synthetic Polynucleotide
taatacgactcactatagggctgaatgctcatttgtgcttcagctttcaaaacagaggagattgaaaatggaagcacaaaacctggcggcagcgcaaaagatg

SEQ ID NO: 20166 - DNA, 103 bp, Artificial Sequence
  Synthetic Polynucleotide
taatacgactcactatagggatcaactgaatgctcatttgtgcttcagctaacagaggagaagctgaatgacaaatgagaacctggcggcagcgcaaaagatg

SEQ ID NO: 20167 - DNA, 103 bp, Artificial Sequence
  Synthetic Polynucleotide
taatacgactcactatagggtgttgatcaactgaatgctcatttgtgcttaacagaggagaaagcacatgtgagcattcaacctggcggcagcgcaaaagatg

SEQ ID NO: 20168 - DNA, 103 bp, Artificial Sequence
  Synthetic Polynucleotide
taatacgactcactatagggtgcaatgagaacaatgttcatcacctcttcaacagaggagagaagagatgatgaacattaacctggcggcagcgcaaaagatg

SEQ ID NO: 20169 - DNA, 103 bp, Artificial Sequence
  Synthetic Polynucleotide
taatacgactcactatagggtgctttgttgatcaactgaatgctcatttgaacagaggagacaaatgatgattcagttgaacctggcggcagcgcaaaagatg

SEQ ID NO: 20170 - DNA, 103 bp, Artificial Sequence
  Synthetic Polynucleotide
taatacgactcactatagggtttactgctttgttgatcaactgaatgctcaacagaggagagagcatatggttgatcaaaacctggcggcagcgcaaaagatg

SEQ ID NO: 20171 - DNA, 103 bp, Artificial Sequence
  Synthetic Polynucleotide
taatacgactcactatagggaagcatttactgctttgttgatcaactgaaaacagaggagattcagtatgtcaacaaagaacctggcggcagcgcaaaagatg

SEQ ID NO: 20172 - DNA, 103 bp, Artificial Sequence
  Synthetic Polynucleotide
taatacgactcactatagggtatcaaagcatttactgctttgttgatcaaaacagaggagattgatcatgaaagcagtaaacctggcggcagcgcaaaagatg

SEQ ID NO: 20173 - DNA, 103 bp, Artificial Sequence
  Synthetic Polynucleotide
taatacgactcactatagggtcatttatcaaagcatttactgctttgttgaacagaggagacaacaaatgagtaaatgcaacctggcggcagcgcaaaagatg

SEQ ID NO: 20174 - DNA, 103 bp, Artificial Sequence
  Synthetic Polynucleotide
taatacgactcactataggggttggtcatttatcaaagcatttactgcttaacagaggagaaagcagatgatgctttgaaacctggcggcagcgcaaaagatg

SEQ ID NO: 20175 - DNA, 103 bp, Artificial Sequence
  Synthetic Polynucleotide
taatacgactcactatagggtataagttggtcatttatcaaagcatttacaacagaggagagtaaatatgttgataaataacctggcggcagcgcaaaagatg

SEQ ID NO: 20176 - DNA, 103 bp, Artificial Sequence
  Synthetic Polynucleotide
taatacgactcactatagggttcattataagttggtcatttatcaaagcaaacagaggagatgctttatgaaatgaccaaacctggcggcagcgcaaaagatg

SEQ ID NO: 20177 - DNA, 103 bp, Artificial Sequence
  Synthetic Polynucleotide
taatacgactcactatagggggttcttcattataagttggtcatttatcaaacagaggagatgataaatgaccaacttaaacctggcggcagcgcaaaagatg

SEQ ID NO: 20178 - DNA, 103 bp, Artificial Sequence
  Synthetic Polynucleotide
taatacgactcactatagggtagatggttcttcattataagttggtcattaacagaggagaaatgacatgcttataatgaacctggcggcagcgcaaaagatg

SEQ ID NO: 20179 - DNA, 103 bp, Artificial Sequence
  Synthetic Polynucleotide
taatacgactcactataggggacagtgcaatgagaacaatgttcatcaccaacagaggagaggtgatatgcattgttctaacctggcggcagcgcaaaagatg

SEQ ID NO: 20180 - DNA, 103 bp, Artificial Sequence
  Synthetic Polynucleotide
taatacgactcactatagggtcccgtagatggttcttcattataagttggaacagaggagaccaactatgaatgaagaaaacctggcggcagcgcaaaagatg

SEQ ID NO: 20181 - DNA, 103 bp, Artificial Sequence
  Synthetic Polynucleotide
taatacgactcactatagggtgatgtcccgtagatggttcttcattataaaacagaggagattataaatgagaaccatcaacctggcggcagcgcaaaagatg

SEQ ID NO: 20182 - DNA, 103 bp, Artificial Sequence
  Synthetic Polynucleotide
taatacgactcactatagggtcccatgatgtcccgtagatggttcttcataacagaggagaatgaagatgcatctacggaacctggcggcagcgcaaaagatg

SEQ ID NO: 20183 - DNA, 103 bp, Artificial Sequence
  Synthetic Polynucleotide
taatacgactcactatagggggaattcccatgatgtcccgtagatggttcaacagaggagagaaccaatgacgggacataacctggcggcagcgcaaaagatg

SEQ ID NO: 20184 - DNA, 103 bp, Artificial Sequence
  Synthetic Polynucleotide
taatacgactcactatagggagtatggaattcccatgatgtcccgtagataacagaggagaatctacatgacatcatggaacctggcggcagcgcaaaagatg

SEQ ID NO: 20185 - DNA, 103 bp, Artificial Sequence
  Synthetic Polynucleotide
taatacgactcactatagggattacagtatggaattcccatgatgtcccgaacagaggagacgggacatgatgggaattaacctggcggcagcgcaaaagatg

SEQ ID NO: 20186 - DNA, 103 bp, Artificial Sequence
  Synthetic Polynucleotide
taatacgactcactatagggctgtaattacagtatggaattcccatgatgaacagaggagacatcatatgaattccataaacctggcggcagcgcaaaagatg

SEQ ID NO: 20187 - DNA, 103 bp, Artificial Sequence
  Synthetic Polynucleotide
taatacgactcactatagggacttgctgtaattacagtatggaattcccaaacagaggagatgggaaatgcatactgtaaacctggcggcagcgcaaaagatg

SEQ ID NO: 20188 - DNA, 103 bp, Artificial Sequence
  Synthetic Polynucleotide
taatacgactcactatagggccaatacttgctgtaattacagtatggaataacagaggagaattccaatgtgtaattacaacctggcggcagcgcaaaagatg

SEQ ID NO: 20189 - DNA, 103 bp, Artificial Sequence
  Synthetic Polynucleotide
taatacgactcactatagggaggtaccaatacttgctgtaattacagtataacagaggagaatactgatgttacagcaaaacctggcggcagcgcaaaagatg

SEQ ID NO: 20190 - DNA, 103 bp, Artificial Sequence
  Synthetic Polynucleotide
taatacgactcactataggggtacagacagtgcaatgagaacaatgttcaaacagaggagatgaacaatgttctcattgaacctggcggcagcgcaaaagatg

SEQ ID NO: 20191 - DNA, 103 bp, Artificial Sequence
  Synthetic Polynucleotide
taatacgactcactatagggggttgaggtaccaatacttgctgtaattacaacagaggagagtaattatggcaagtattaacctggcggcagcgcaaaagatg

SEQ ID NO: 20192 - DNA, 103 bp, Artificial Sequence
  Synthetic Polynucleotide
taatacgactcactatagggtgtgtggttgaggtaccaatacttgctgtaaacagaggagatacagcatgtattggtacaacctggcggcagcgcaaaagatg

SEQ ID NO: 20193 - DNA, 103 bp, Artificial Sequence
  Synthetic Polynucleotide
taatacgactcactataggggtagttgtgtggttgaggtaccaatacttgaacagaggagacaagtaatggtacctcaaaacctggcggcagcgcaaaagatg

SEQ ID NO: 20194 - DNA, 103 bp, Artificial Sequence
  Synthetic Polynucleotide
taatacgactcactatagggtcccagtagttgtgtggttgaggtaccaataacagaggagaattggtatgtcaaccacaaacctggcggcagcgcaaaagatg

SEQ ID NO: 20195 - DNA, 103 bp, Artificial Sequence
  Synthetic Polynucleotide
taatacgactcactatagggtgttctcccagtagttgtgtggttgaggtaaacagaggagatacctcatgcacacaactaacctggcggcagcgcaaaagatg

SEQ ID NO: 20196 - DNA, 103 bp, Artificial Sequence
  Synthetic Polynucleotide
taatacgactcactatagggagtgatgttctcccagtagttgtgtggttgaacagaggagacaaccaatgaactactggaacctggcggcagcgcaaaagatg

SEQ ID NO: 20197 - DNA, 103 bp, Artificial Sequence
  Synthetic Polynucleotide
taatacgactcactatagggtgggcagtgatgttctcccagtagttgtgtaacagaggagaacacaaatgctgggagaaaacctggcggcagcgcaaaagatg

SEQ ID NO: 20198 - DNA, 103 bp, Artificial Sequence
  Synthetic Polynucleotide
taatacgactcactatagggacatttgggcagtgatgttctcccagtagtaacagaggagaactactatgagaacatcaaacctggcggcagcgcaaaagatg

SEQ ID NO: 20199 - DNA, 103 bp, Artificial Sequence
  Synthetic Polynucleotide
taatacgactcactatagggagccaacatttgggcagtgatgttctcccaaacagaggagatgggagatgatcactgccaacctggcggcagcgcaaaagatg

SEQ ID NO: 20200 - DNA, 103 bp, Artificial Sequence
  Synthetic Polynucleotide
taatacgactcactatagggatacaagccaacatttgggcagtgatgttcaacagaggagagaacatatgtgcccaaataacctggcggcagcgcaaaagatg

SEQ ID NO: 20201 - DNA, 103 bp, Artificial Sequence
  Synthetic Polynucleotide
taatacgactcactatagggtgctagtacagacagtgcaatgagaacaataacagaggagaattgttatgattgcactgaacctggcggcagcgcaaaagatg

SEQ ID NO: 20202 - DNA, 103 bp, Artificial Sequence
  Synthetic Polynucleotide
taatacgactcactatagggatttgatacaagccaacatttgggcagtgaaacagaggagatcactgatgaaatgttggaacctggcggcagcgcaaaagatg

SEQ ID NO: 20203 - DNA, 103 bp, Artificial Sequence
  Synthetic Polynucleotide
taatacgactcactataggggaaccatttgatacaagccaacatttgggcaacagaggagagcccaaatgttggcttgtaacctggcggcagcgcaaaagatg

SEQ ID NO: 20204 - DNA, 103 bp, Artificial Sequence
  Synthetic Polynucleotide
taatacgactcactatagggagtatgaaccatttgatacaagccaacattaacagaggagaaatgttatgttgtatcaaaacctggcggcagcgcaaaagatg

SEQ ID NO: 20205 - DNA, 103 bp, Artificial Sequence
  Synthetic Polynucleotide
taatacgactcactataggggttcaagtatgaaccatttgatacaagccaaacagaggagatggcttatgtcaaatggtaacctggcggcagcgcaaaagatg

SEQ ID NO: 20206 - DNA, 103 bp, Artificial Sequence
  Synthetic Polynucleotide
taatacgactcactataggggtctcgttcaagtatgaaccatttgatacaaacagaggagatgtatcatgtggttcataaacctggcggcagcgcaaaagatg

SEQ ID NO: 20207 - DNA, 103 bp, Artificial Sequence
  Synthetic Polynucleotide
taatacgactcactatagggagtgggtctcgttcaagtatgaaccatttgaacagaggagacaaatgatgcatacttgaaacctggcggcagcgcaaaagatg

SEQ ID NO: 20208 - DNA, 103 bp, Artificial Sequence
  Synthetic Polynucleotide
taatacgactcactatagggagaaaagtgggtctcgttcaagtatgaaccaacagaggagaggttcaatgttgaacgagaacctggcggcagcgcaaaagatg

SEQ ID NO: 20209 - DNA, 103 bp, Artificial Sequence
  Synthetic Polynucleotide
taatacgactcactatagggtcatcagaaaagtgggtctcgttcaagtataacagaggagaatacttatgcgagacccaaacctggcggcagcgcaaaagatg

SEQ ID NO: 20210 - DNA, 103 bp, Artificial Sequence
  Synthetic Polynucleotide
taatacgactcactatagggcaatatcatcagaaaagtgggtctcgttcaaacagaggagatgaacgatgcccacttttaacctggcggcagcgcaaaagatg

SEQ ID NO: 20211 - DNA, 103 bp, Artificial Sequence
  Synthetic Polynucleotide
taatacgactcactatagggttgttcaatatcatcagaaaagtgggtctcaacagaggagagagaccatgttttctgataacctggcggcagcgcaaaagatg

SEQ ID NO: 20212 - DNA, 103 bp, Artificial Sequence
  Synthetic Polynucleotide
taatacgactcactatagggagcactgctagtacagacagtgcaatgagaaacagaggagatctcatatgactgtctgtaacctggcggcagcgcaaaagatg

SEQ ID NO: 20213 - DNA, 103 bp, Artificial Sequence
  Synthetic Polynucleotide
taatacgactcactataggggcttgttgttcaatatcatcagaaaagtggaacagaggagaccacttatgtgatgatataacctggcggcagcgcaaaagatg

SEQ ID NO: 20214 - DNA, 103 bp, Artificial Sequence
  Synthetic Polynucleotide
taatacgactcactatagggtgtcagcttgttgttcaatatcatcagaaaaacagaggagatttctgatgatattgaacaacctggcggcagcgcaaaagatg

SEQ ID NO: 20215 - DNA, 103 bp, Artificial Sequence
  Synthetic Polynucleotide
taatacgactcactatagggcatattgtcagcttgttgttcaatatcatcaacagaggagagatgatatggaacaacaaaacctggcggcagcgcaaaagatg

SEQ ID NO: 20216 - DNA, 103 bp, Artificial Sequence
  Synthetic Polynucleotide
taatacgactcactataggggtgatcatattgtcagcttgttgttcaataaacagaggagatattgaatgacaagctgaaacctggcggcagcgcaaaagatg

SEQ ID NO: 20217 - DNA, 103 bp, Artificial Sequence
  Synthetic Polynucleotide
taatacgactcactatagggtctcagtgatcatattgtcagcttgttgttaacagaggagaaacaacatgctgacaataaacctggcggcagcgcaaaagatg

SEQ ID NO: 20218 - DNA, 103 bp, Artificial Sequence
  Synthetic Polynucleotide
taatacgactcactatagggtaacatctcagtgatcatattgtcagcttgaacagaggagacaagctatgaatatgatcaacctggcggcagcgcaaaagatg

SEQ ID NO: 20219 - DNA, 103 bp, Artificial Sequence
  Synthetic Polynucleotide
taatacgactcactatagggttctgtaacatctcagtgatcatattgtcaaacagaggagatgacaaatggatcactgaaacctggcggcagcgcaaaagatg

SEQ ID NO: 20220 - DNA, 103 bp, Artificial Sequence
  Synthetic Polynucleotide
taatacgactcactatagggactccttctgtaacatctcagtgatcatataacagaggagaatatgaatgctgagatgtaacctggcggcagcgcaaaagatg

SEQ ID NO: 20221 - DNA, 103 bp, Artificial Sequence
  Synthetic Polynucleotide
taatacgactcactatagggcatatactccttctgtaacatctcagtgataacagaggagaatcactatgatgttacagaacctggcggcagcgcaaaagatg

SEQ ID NO: 20222 - DNA, 103 bp, Artificial Sequence
  Synthetic Polynucleotide
taatacgactcactatagggctctccatatactccttctgtaacatctcaaacagaggagatgagatatgacagaaggaaacctggcggcagcgcaaaagatg

SEQ ID NO: 20223 - DNA, 103 bp, Artificial Sequence
  Synthetic Polynucleotide
taatacgactcactatagggctttcagcactgctagtacagacagtgcaaaacagaggagattgcacatgctgtactagaacctggcggcagcgcaaaagatg

SEQ ID NO: 20224 - DNA, 103 bp, Artificial Sequence
  Synthetic Polynucleotide
taatacgactcactatagggcctgcctctccatatactccttctgtaacaaacagaggagatgttacatgaggagtataaacctggcggcagcgcaaaagatg

SEQ ID NO: 20225 - DNA, 103 bp, Artificial Sequence
  Synthetic Polynucleotide
taatacgactcactatagggcttcccctgcctctccatatactccttctgaacagaggagacagaagatgtatatggagaacctggcggcagcgcaaaagatg

SEQ ID NO: 20226 - DNA, 103 bp, Artificial Sequence
  Synthetic Polynucleotide
taatacgactcactatagggggtgtcttcccctgcctctccatatactccaacagaggagaggagtaatgggagaggcaaacctggcggcagcgcaaaagatg

SEQ ID NO: 20227 - DNA, 103 bp, Artificial Sequence
  Synthetic Polynucleotide
taatacgactcactatagggccaatggtgtcttcccctgcctctccatataacagaggagaatatggatgggcaggggaaacctggcggcagcgcaaaagatg

SEQ ID NO: 20228 - DNA, 103 bp, Artificial Sequence
  Synthetic Polynucleotide
taatacgactcactatagggtagacccaatggtgtcttcccctgcctctcaacagaggagagagaggatggggaagacaaacctggcggcagcgcaaaagatg

SEQ ID NO: 20229 - DNA, 103 bp, Artificial Sequence
  Synthetic Polynucleotide
taatacgactcactatagggtcaactagacccaatggtgtcttcccctgcaacagaggagagcagggatggacaccattaacctggcggcagcgcaaaagatg

SEQ ID NO: 20230 - DNA, 103 bp, Artificial Sequence
  Synthetic Polynucleotide
taatacgactcactatagggagaggtcaactagacccaatggtgtcttccaacagaggagaggaagaatgcattgggtcaacctggcggcagcgcaaaagatg

SEQ ID NO: 20231 - DNA, 103 bp, Artificial Sequence
  Synthetic Polynucleotide
taatacgactcactatagggcacaaagaggtcaactagacccaatggtgtaacagaggagaacaccaatgggtctagttaacctggcggcagcgcaaaagatg

SEQ ID NO: 20232 - DNA, 103 bp, Artificial Sequence
  Synthetic Polynucleotide
taatacgactcactatagggctgaacacaaagaggtcaactagacccaataacagaggagaattgggatgagttgacctaacctggcggcagcgcaaaagatg

SEQ ID NO: 20233 - DNA, 103 bp, Artificial Sequence
  Synthetic Polynucleotide
taatacgactcactatagggttgtgctgaacacaaagaggtcaactagacaacagaggagagtctagatgacctctttgaacctggcggcagcgcaaaagatg

SEQ ID NO: 20234 - DNA, 103 bp, Artificial Sequence
  Synthetic Polynucleotide
taatacgactcactatagggcagacctttcagcactgctagtacagacagaacagaggagactgtctatgctagcagtgaacctggcggcagcgcaaaagatg

SEQ ID NO: 20235 - DNA, 103 bp, Artificial Sequence
  Synthetic Polynucleotide
taatacgactcactataggggaaacttgtgctgaacacaaagaggtcaacaacagaggagagttgacatgtttgtgttcaacctggcggcagcgcaaaagatg

SEQ ID NO: 20236 - DNA, 103 bp, Artificial Sequence
  Synthetic Polynucleotide
taatacgactcactatagggagatagaaacttgtgctgaacacaaagaggaacagaggagacctcttatggttcagcacaacctggcggcagcgcaaaagatg

SEQ ID NO: 20237 - DNA, 103 bp, Artificial Sequence
  Synthetic Polynucleotide
taatacgactcactatagggtaataagatagaaacttgtgctgaacacaaaacagaggagattgtgtatggcacaagttaacctggcggcagcgcaaaagatg

SEQ ID NO: 20238 - DNA, 103 bp, Artificial Sequence
  Synthetic Polynucleotide
taatacgactcactataggggatgctaataagatagaaacttgtgctgaaaacagaggagattcagcatgagtttctataacctggcggcagcgcaaaagatg

SEQ ID NO: 20239 - DNA, 103 bp, Artificial Sequence
  Synthetic Polynucleotide
taatacgactcactatagggaggaagatgctaataagatagaaacttgtgaacagaggagacacaagatgctatcttataacctggcggcagcgcaaaagatg

SEQ ID NO: 20240 - DNA, 103 bp, Artificial Sequence
  Synthetic Polynucleotide
taatacgactcactatagggggtgaaggaagatgctaataagatagaaacaacagaggagagtttctatgttattagcaaacctggcggcagcgcaaaagatg

SEQ ID NO: 20241 - DNA, 103 bp, Artificial Sequence
  Synthetic Polynucleotide
taatacgactcactataggggactaggtgaaggaagatgctaataagataaacagaggagatatcttatgagcatcttcaacctggcggcagcgcaaaagatg

SEQ ID NO: 20242 - DNA, 103 bp, Artificial Sequence
  Synthetic Polynucleotide
taatacgactcactatagggattttgactaggtgaaggaagatgctaataaacagaggagatattagatgcttccttcaaacctggcggcagcgcaaaagatg

SEQ ID NO: 20243 - DNA, 103 bp, Artificial Sequence
  Synthetic Polynucleotide
taatacgactcactatagggttggtattttgactaggtgaaggaagatgcaacagaggagagcatctatgttcacctagaacctggcggcagcgcaaaagatg

SEQ ID NO: 20244 - DNA, 103 bp, Artificial Sequence
  Synthetic Polynucleotide
taatacgactcactatagggatgagttggtattttgactaggtgaaggaaaacagaggagattccttatgctagtcaaaaacctggcggcagcgcaaaagatg

SEQ ID NO: 20245 - DNA, 103 bp, Artificial Sequence
  Synthetic Polynucleotide
taatacgactcactatagggttgtacagacctttcagcactgctagtacaaacagaggagatgtactatgagtgctgaaaacctggcggcagcgcaaaagatg

SEQ ID NO: 20246 - DNA, 103 bp, Artificial Sequence
  Synthetic Polynucleotide
taatacgactcactatagggtgcctatgagttggtattttgactaggtgaaacagaggagatcacctatgcaaaataccaacctggcggcagcgcaaaagatg

SEQ ID NO: 20247 - DNA, 103 bp, Artificial Sequence
  Synthetic Polynucleotide
taatacgactcactatagggcaatatgcctatgagttggtattttgactaaacagaggagatagtcaatgtaccaactcaacctggcggcagcgcaaaagatg

SEQ ID NO: 20248 - DNA, 103 bp, Artificial Sequence
  Synthetic Polynucleotide
taatacgactcactataggggcctacaatatgcctatgagttggtattttaacagaggagaaaaataatgactcataggaacctggcggcagcgcaaaagatg

SEQ ID NO: 20249 - DNA, 103 bp, Artificial Sequence
  Synthetic Polynucleotide
taatacgactcactataggggacttgcctacaatatgcctatgagttggtaacagaggagaaccaacatgtaggcatataacctggcggcagcgcaaaagatg

SEQ ID NO: 20250 - DNA, 103 bp, Artificial Sequence
  Synthetic Polynucleotide
taatacgactcactataggggacacgacttgcctacaatatgcctatgagaacagaggagactcataatgatattgtagaacctggcggcagcgcaaaagatg

SEQ ID NO: 20251 - DNA, 103 bp, Artificial Sequence
  Synthetic Polynucleotide
taatacgactcactatagggtttgggacacgacttgcctacaatatgcctaacagaggagaaggcatatggtaggcaagaacctggcggcagcgcaaaagatg

SEQ ID NO: 20252 - DNA, 103 bp, Artificial Sequence
  Synthetic Polynucleotide
taatacgactcactatagggtgaggtttgggacacgacttgcctacaataaacagaggagatattgtatgcaagtcgtgaacctggcggcagcgcaaaagatg

SEQ ID NO: 20253 - DNA, 103 bp, Artificial Sequence
  Synthetic Polynucleotide
taatacgactcactatagggatctgtgaggtttgggacacgacttgcctaaacagaggagataggcaatgcgtgtcccaaacctggcggcagcgcaaaagatg

SEQ ID NO: 20254 - DNA, 103 bp, Artificial Sequence
  Synthetic Polynucleotide
taatacgactcactatagggattcaatctgtgaggtttgggacacgacttaacagaggagaaagtcgatgcccaaacctaacctggcggcagcgcaaaagatg

SEQ ID NO: 20255 - DNA, 103 bp, Artificial Sequence
  Synthetic Polynucleotide
taatacgactcactatagggatatgattcaatctgtgaggtttgggacacaacagaggagagtgtccatgacctcacagaacctggcggcagcgcaaaagatg

SEQ ID NO: 20256 - DNA, 103 bp, Artificial Sequence
  Synthetic Polynucleotide
taatacgactcactatagggcaaaattgtacagacctttcagcactgctaaacagaggagatagcagatgtgaaaggtcaacctggcggcagcgcaaaagatg

SEQ ID NO: 20257 - DNA, 103 bp, Artificial Sequence
  Synthetic Polynucleotide
taatacgactcactatagggtgcccatatgattcaatctgtgaggtttggaacagaggagaccaaacatgacagattgaaacctggcggcagcgcaaaagatg

SEQ ID NO: 20258 - DNA, 103 bp, Artificial Sequence
  Synthetic Polynucleotide
taatacgactcactatagggacaaatgcccatatgattcaatctgtgaggaacagaggagacctcacatgttgaatcataacctggcggcagcgcaaaagatg

SEQ ID NO: 20259 - DNA, 103 bp, Artificial Sequence
  Synthetic Polynucleotide
taatacgactcactatagggcaggaacaaatgcccatatgattcaatctgaacagaggagacagattatgtcatatgggaacctggcggcagcgcaaaagatg

SEQ ID NO: 20260 - DNA, 103 bp, Artificial Sequence
  Synthetic Polynucleotide
taatacgactcactataggggtccacaggaacaaatgcccatatgattcaaacagaggagatgaatcatgtgggcatttaacctggcggcagcgcaaaagatg

SEQ ID NO: 20261 - DNA, 103 bp, Artificial Sequence
  Synthetic Polynucleotide
taatacgactcactataggggtagagtccacaggaacaaatgcccatatgaacagaggagacatatgatgatttgttccaacctggcggcagcgcaaaagatg

SEQ ID NO: 20262 - DNA, 103 bp, Artificial Sequence
  Synthetic Polynucleotide
taatacgactcactatagggtgtttgtagagtccacaggaacaaatgcccaacagaggagagggcatatgttcctgtggaacctggcggcagcgcaaaagatg

SEQ ID NO: 20263 - DNA, 103 bp, Artificial Sequence
  Synthetic Polynucleotide
taatacgactcactatagggcaggctgtttgtagagtccacaggaacaaaaacagaggagatttgttatggtggactctaacctggcggcagcgcaaaagatg

SEQ ID NO: 20264 - DNA, 103 bp, Artificial Sequence
  Synthetic Polynucleotide
taatacgactcactatagggcacaccaggctgtttgtagagtccacaggaaacagaggagatcctgtatgctctacaaaaacctggcggcagcgcaaaagatg

SEQ ID NO: 20265 - DNA, 103 bp, Artificial Sequence
  Synthetic Polynucleotide
taatacgactcactatagggacaggcacaccaggctgtttgtagagtccaaacagaggagatggactatgcaaacagccaacctggcggcagcgcaaaagatg

SEQ ID NO: 20266 - DNA, 103 bp, Artificial Sequence
  Synthetic Polynucleotide
taatacgactcactatagggatttcacaggcacaccaggctgtttgtagaaacagaggagatctacaatgagcctggtgaacctggcggcagcgcaaaagatg

SEQ ID NO: 20267 - DNA, 103 bp, Artificial Sequence
  Synthetic Polynucleotide
taatacgactcactatagggtgaattgcgcaaccaaaaatgcctaggatcaacagaggagagatcctatgcatttttggaacctggcggcagcgcaaaagatg

SEQ ID NO: 20268 - DNA, 103 bp, Artificial Sequence
  Synthetic Polynucleotide
taatacgactcactatagggcgttgcaaaattgtacagacctttcagcacaacagaggagagtgctgatgggtctgtacaacctggcggcagcgcaaaagatg

SEQ ID NO: 20269 - DNA, 103 bp, Artificial Sequence
  Synthetic Polynucleotide
taatacgactcactatagggcttccatttcacaggcacaccaggctgtttaacagaggagaaaacagatgggtgtgcctaacctggcggcagcgcaaaagatg

SEQ ID NO: 20270 - DNA, 103 bp, Artificial Sequence
  Synthetic Polynucleotide
taatacgactcactatagggcatctcttccatttcacaggcacaccaggcaacagaggagagcctggatggcctgtgaaaacctggcggcagcgcaaaagatg

SEQ ID NO: 20271 - DNA, 103 bp, Artificial Sequence
  Synthetic Polynucleotide
taatacgactcactatagggggtctcatctcttccatttcacaggcacacaacagaggagagtgtgcatgtgaaatggaaacctggcggcagcgcaaaagatg

SEQ ID NO: 20272 - DNA, 103 bp, Artificial Sequence
  Synthetic Polynucleotide
taatacgactcactatagggacaagggtctcatctcttccatttcacaggaacagaggagacctgtgatgtggaagagaaacctggcggcagcgcaaaagatg

SEQ ID NO: 20273 - DNA, 103 bp, Artificial Sequence
  Synthetic Polynucleotide
taatacgactcactatagggccctgacaagggtctcatctcttccatttcaacagaggagagaaatgatggagatgagaaacctggcggcagcgcaaaagatg

SEQ ID NO: 20274 - DNA, 103 bp, Artificial Sequence
  Synthetic Polynucleotide
taatacgactcactataggggggggccctgacaagggtctcatctcttccaacagaggagaggaagaatggagacccttaacctggcggcagcgcaaaagatg

SEQ ID NO: 20275 - DNA, 103 bp, Artificial Sequence
  Synthetic Polynucleotide
taatacgactcactataggggtcacgggggccctgacaagggtctcatctaacagaggagaagatgaatgccttgtcagaacctggcggcagcgcaaaagatg

SEQ ID NO: 20276 - DNA, 103 bp, Artificial Sequence
  Synthetic Polynucleotide
taatacgactcactatagggggtgggtcacgggggccctgacaagggtctaacagaggagaagacccatgtcagggcccaacctggcggcagcgcaaaagatg

SEQ ID NO: 20277 - DNA, 103 bp, Artificial Sequence
  Synthetic Polynucleotide
taatacgactcactatagggtaggcggtgggtcacgggggccctgacaagaacagaggagacttgtcatggcccccgtgaacctggcggcagcgcaaaagatg

SEQ ID NO: 20278 - DNA, 103 bp, Artificial Sequence
  Synthetic Polynucleotide
taatacgactcactataggggccaataggcggtgggtcacgggggccctgaacagaggagacagggcatgcgtgacccaaacctggcggcagcgcaaaagatg

SEQ ID NO: 20279 - DNA, 103 bp, Artificial Sequence
  Synthetic Polynucleotide
taatacgactcactatagggccacacgttgcaaaattgtacagacctttcaacagaggagagaaaggatggtacaatttaacctggcggcagcgcaaaagatg

SEQ ID NO: 20280 - DNA, 103 bp, Artificial Sequence
  Synthetic Polynucleotide
taatacgactcactatagggccaccgccaataggcggtgggtcacgggggaacagaggagacccccgatgcccaccgccaacctggcggcagcgcaaaagatg

SEQ ID NO: 20281 - DNA, 103 bp, Artificial Sequence
  Synthetic Polynucleotide
taatacgactcactataggggtgacccaccgccaataggcggtgggtcacaacagaggagagtgaccatgcgcctattgaacctggcggcagcgcaaaagatg

SEQ ID NO: 20282 - DNA, 103 bp, Artificial Sequence
  Synthetic Polynucleotide
taatacgactcactatagggcccccgtgacccaccgccaataggcggtggaacagaggagaccaccgatgattggcggtaacctggcggcagcgcaaaagatg

SEQ ID NO: 20283 - DNA, 103 bp, Artificial Sequence
  Synthetic Polynucleotide
taatacgactcactatagggggacgcccccgtgacccaccgccaataggcaacagaggagagcctatatgcggtgggtcaacctggcggcagcgcaaaagatg

SEQ ID NO: 20284 - DNA, 103 bp, Artificial Sequence
  Synthetic Polynucleotide
taatacgactcactatagggtaaatggacgcccccgtgacccaccgccaaaacagaggagattggcgatgggtcacgggaacctggcggcagcgcaaaagatg

SEQ ID NO: 20285 - DNA, 103 bp, Artificial Sequence
  Synthetic Polynucleotide
taatacgactcactatagggttctgtaaatggacgcccccgtgacccaccaacagaggagaggtgggatgcgggggcgtaacctggcggcagcgcaaaagatg

SEQ ID NO: 20286 - DNA, 103 bp, Artificial Sequence
  Synthetic Polynucleotide
taatacgactcactatagggagtcgttctgtaaatggacgcccccgtgacaacagaggagagtcacgatggcgtccattaacctggcggcagcgcaaaagatg

SEQ ID NO: 20287 - DNA, 103 bp, Artificial Sequence
  Synthetic Polynucleotide
taatacgactcactatagggcctagagtcgttctgtaaatggacgcccccaacagaggagagggggcatgcatttacagaacctggcggcagcgcaaaagatg

SEQ ID NO: 20288 - DNA, 103 bp, Artificial Sequence
  Synthetic Polynucleotide
taatacgactcactatagggcgacacctagagtcgttctgtaaatggacgaacagaggagacgtccaatgacagaacgaaacctggcggcagcgcaaaagatg

SEQ ID NO: 20289 - DNA, 103 bp, Artificial Sequence
  Synthetic Polynucleotide
taatacgactcactatagggaacatcgacacctagagtcgttctgtaaataacagaggagaatttacatgacgactctaaacctggcggcagcgcaaaagatg

SEQ ID NO: 20290 - DNA, 103 bp, Artificial Sequence
  Synthetic Polynucleotide
taatacgactcactatagggcaaggccacacgttgcaaaattgtacagacaacagaggagagtctgtatgattttgcaaaacctggcggcagcgcaaaagatg

SEQ ID NO: 20291 - DNA, 103 bp, Artificial Sequence
  Synthetic Polynucleotide
taatacgactcactatagggttcagaacatcgacacctagagtcgttctgaacagaggagacagaacatgtctaggtgtaacctggcggcagcgcaaaagatg

SEQ ID NO: 20292 - DNA, 103 bp, Artificial Sequence
  Synthetic Polynucleotide
taatacgactcactatagggtggtgttcagaacatcgacacctagagtcgaacagaggagacgactcatggtgtcgatgaacctggcggcagcgcaaaagatg

SEQ ID NO: 20293 - DNA, 103 bp, Artificial Sequence
  Synthetic Polynucleotide
taatacgactcactatagggagatatggtgttcagaacatcgacacctagaacagaggagactaggtatggatgttctgaacctggcggcagcgcaaaagatg

SEQ ID NO: 20294 - DNA, 103 bp, Artificial Sequence
  Synthetic Polynucleotide
taatacgactcactatagggcccagagatatggtgttcagaacatcgacaaacagaggagatgtcgaatgtctgaacacaacctggcggcagcgcaaaagatg

SEQ ID NO: 20295 - DNA, 103 bp, Artificial Sequence
  Synthetic Polynucleotide
taatacgactcactatagggtgctgcccagagatatggtgttcagaacataacagaggagaatgttcatgacaccatataacctggcggcagcgcaaaagatg

SEQ ID NO: 20296 - DNA, 103 bp, Artificial Sequence
  Synthetic Polynucleotide
taatacgactcactatagggagcagtgctgcccagagatatggtgttcagaacagaggagactgaacatgatatctctgaacctggcggcagcgcaaaagatg

SEQ ID NO: 20297 - DNA, 103 bp, Artificial Sequence
  Synthetic Polynucleotide
taatacgactcactatagggttgagagcagtgctgcccagagatatggtgaacagaggagacaccatatgtctgggcagaacctggcggcagcgcaaaagatg

SEQ ID NO: 20298 - DNA, 103 bp, Artificial Sequence
  Synthetic Polynucleotide
taatacgactcactatagggcggttttgagagcagtgctgcccagagataaacagaggagatatctcatggcagcactgaacctggcggcagcgcaaaagatg

SEQ ID NO: 20299 - DNA, 103 bp, Artificial Sequence
  Synthetic Polynucleotide
taatacgactcactatagggcacatcggttttgagagcagtgctgcccagaacagaggagactgggcatgactgctctcaacctggcggcagcgcaaaagatg

SEQ ID NO: 20300 - DNA, 103 bp, Artificial Sequence
  Synthetic Polynucleotide
taatacgactcactatagggctgaacacatcggttttgagagcagtgctgaacagaggagacagcacatgtctcaaaacaacctggcggcagcgcaaaagatg

SEQ ID NO: 20301 - DNA, 103 bp, Artificial Sequence
  Synthetic Polynucleotide
taatacgactcactatagggaccaacaaggccacacgttgcaaaattgtaaacagaggagatacaatatggcaacgtgtaacctggcggcagcgcaaaagatg

SEQ ID NO: 20302 - DNA, 103 bp, Artificial Sequence
  Synthetic Polynucleotide
taatacgactcactataggggaggactgaacacatcggttttgagagcagaacagaggagactgctcatgaaaccgatgaacctggcggcagcgcaaaagatg

SEQ ID NO: 20303 - DNA, 103 bp, Artificial Sequence
  Synthetic Polynucleotide
taatacgactcactataggggtcaggaggactgaacacatcggttttgagaacagaggagactcaaaatggatgtgttcaacctggcggcagcgcaaaagatg

SEQ ID NO: 20304 - DNA, 103 bp, Artificial Sequence
  Synthetic Polynucleotide
taatacgactcactataggggcagtgtcaggaggactgaacacatcggttaacagaggagaaaccgaatggttcagtccaacctggcggcagcgcaaaagatg

SEQ ID NO: 20305 - DNA, 103 bp, Artificial Sequence
  Synthetic Polynucleotide
taatacgactcactatagggatgcagcagtgtcaggaggactgaacacataacagaggagaatgtgtatggtcctcctgaacctggcggcagcgcaaaagatg

SEQ ID NO: 20306 - DNA, 103 bp, Artificial Sequence
  Synthetic Polynucleotide
taatacgactcactataggggtttgatgcagcagtgtcaggaggactgaaaacagaggagattcagtatgcctgacactaacctggcggcagcgcaaaagatg

SEQ ID NO: 20307 - DNA, 103 bp, Artificial Sequence
  Synthetic Polynucleotide
taatacgactcactatagggatcatgtttgatgcagcagtgtcaggaggaaacagaggagatcctccatgcactgctgcaacctggcggcagcgcaaaagatg

SEQ ID NO: 20308 - DNA, 103 bp, Artificial Sequence
  Synthetic Polynucleotide
taatacgactcactatagggactgcatcatgtttgatgcagcagtgtcagaacagaggagactgacaatgctgcatcaaaacctggcggcagcgcaaaagatg

SEQ ID NO: 20309 - DNA, 103 bp, Artificial Sequence
  Synthetic Polynucleotide
taatacgactcactatagggaatggactgcatcatgtttgatgcagcagtaacagaggagaactgctatgtcaaacatgaacctggcggcagcgcaaaagatg

SEQ ID NO: 20310 - DNA, 103 bp, Artificial Sequence
  Synthetic Polynucleotide
taatacgactcactataggggcactaatggactgcatcatgtttgatgcaaacagaggagatgcatcatgcatgatgcaaacctggcggcagcgcaaaagatg

SEQ ID NO: 20311 - DNA, 103 bp, Artificial Sequence
  Synthetic Polynucleotide
taatacgactcactatagggactgtgcactaatggactgcatcatgtttgaacagaggagacaaacaatgtgcagtccaaacctggcggcagcgcaaaagatg

SEQ ID NO: 20312 - DNA, 103 bp, Artificial Sequence
  Synthetic Polynucleotide
taatacgactcactatagggaccaaaccaacaaggccacacgttgcaaaaaacagaggagattttgcatggtgtggcctaacctggcggcagcgcaaaagatg

SEQ ID NO: 20313 - DNA, 103 bp, Artificial Sequence
  Synthetic Polynucleotide
taatacgactcactatagggccctcactgtgcactaatggactgcatcataacagaggagaatgatgatgtccattagtaacctggcggcagcgcaaaagatg

SEQ ID NO: 20314 - DNA, 103 bp, Artificial Sequence
  Synthetic Polynucleotide
taatacgactcactatagggataacccctcactgtgcactaatggactgcaacagaggagagcagtcatgtagtgcacaaacctggcggcagcgcaaaagatg

SEQ ID NO: 20315 - DNA, 103 bp, Artificial Sequence
  Synthetic Polynucleotide
taatacgactcactatagggaggaaataacccctcactgtgcactaatggaacagaggagaccattaatgcacagtgagaacctggcggcagcgcaaaagatg

SEQ ID NO: 20316 - DNA, 103 bp, Artificial Sequence
  Synthetic Polynucleotide
taatacgactcactatagggtaaagaggaaataacccctcactgtgcactaacagaggagaagtgcaatgtgaggggttaacctggcggcagcgcaaaagatg

SEQ ID NO: 20317 - DNA, 103 bp, Artificial Sequence
  Synthetic Polynucleotide
taatacgactcactatagggggcggtaaagaggaaataacccctcactgtaacagaggagaacagtgatgggttatttcaacctggcggcagcgcaaaagatg

SEQ ID NO: 20318 - DNA, 103 bp, Artificial Sequence
  Synthetic Polynucleotide
taatacgactcactatagggaaagaggcggtaaagaggaaataacccctcaacagaggagagaggggatgtttcctcttaacctggcggcagcgcaaaagatg

SEQ ID NO: 20319 - DNA, 103 bp, Artificial Sequence
  Synthetic Polynucleotide
taatacgactcactataggggaagaaaagaggcggtaaagaggaaataacaacagaggagagttattatgtctttaccgaacctggcggcagcgcaaaagatg

SEQ ID NO: 20320 - DNA, 103 bp, Artificial Sequence
  Synthetic Polynucleotide
taatacgactcactataggggaaaagaagaaaagaggcggtaaagaggaaaacagaggagattcctcatgaccgcctctaacctggcggcagcgcaaaagatg

SEQ ID NO: 20321 - DNA, 103 bp, Artificial Sequence
  Synthetic Polynucleotide
taatacgactcactatagggttgttgaaaagaagaaaagaggcggtaaagaacagaggagactttacatgctcttttctaacctggcggcagcgcaaaagatg

SEQ ID NO: 20322 - DNA, 103 bp, Artificial Sequence
  Synthetic Polynucleotide
taatacgactcactatagggtgtcgttgttgaaaagaagaaaagaggcggaacagaggagaccgcctatgttcttctttaacctggcggcagcgcaaaagatg

SEQ ID NO: 20323 - DNA, 103 bp, Artificial Sequence
  Synthetic Polynucleotide
taatacgactcactatagggaagtgaccaaaccaacaaggccacacgttgaacagaggagacaacgtatggccttgttgaacctggcggcagcgcaaaagatg

SEQ ID NO: 20324 - DNA, 103 bp, Artificial Sequence
  Synthetic Polynucleotide
taatacgactcactatagggacaggtgtcgttgttgaaaagaagaaaagaaacagaggagatcttttatgcttttcaacaacctggcggcagcgcaaaagatg

SEQ ID NO: 20325 - DNA, 103 bp, Artificial Sequence
  Synthetic Polynucleotide
taatacgactcactatagggtgcacacaggtgtcgttgttgaaaagaagaaacagaggagatcttctatgcaacaacgaaacctggcggcagcgcaaaagatg

SEQ ID NO: 20326 - DNA, 103 bp, Artificial Sequence
  Synthetic Polynucleotide
taatacgactcactatagggccacatgcacacaggtgtcgttgttgaaaaaacagaggagattttcaatgacgacacctaacctggcggcagcgcaaaagatg

SEQ ID NO: 20327 - DNA, 103 bp, Artificial Sequence
  Synthetic Polynucleotide
taatacgactcactatagggttatgccacatgcacacaggtgtcgttgttaacagaggagaaacaacatgacctgtgtgaacctggcggcagcgcaaaagatg

SEQ ID NO: 20328 - DNA, 103 bp, Artificial Sequence
  Synthetic Polynucleotide
taatacgactcactatagggaagacttatgccacatgcacacaggtgtcgaacagaggagacgacacatgtgtgcatgtaacctggcggcagcgcaaaagatg

SEQ ID NO: 20329 - DNA, 103 bp, Artificial Sequence
  Synthetic Polynucleotide
taatacgactcactataggggtataaagacttatgccacatgcacacaggaacagaggagacctgtgatgatgtggcataacctggcggcagcgcaaaagatg

SEQ ID NO: 20330 - DNA, 103 bp, Artificial Sequence
  Synthetic Polynucleotide
taatacgactcactataggggaccagtataaagacttatgccacatgcacaacagaggagagtgcatatggcataagtcaacctggcggcagcgcaaaagatg

SEQ ID NO: 20331 - DNA, 103 bp, Artificial Sequence
  Synthetic Polynucleotide
taatacgactcactatagggtctgggaccagtataaagacttatgccacaaacagaggagatgtggcatgagtctttataacctggcggcagcgcaaaagatg

SEQ ID NO: 20332 - DNA, 103 bp, Artificial Sequence
  Synthetic Polynucleotide
taatacgactcactatagggtgcagtctgggaccagtataaagacttatgaacagaggagacataagatgttatactggaacctggcggcagcgcaaaagatg

SEQ ID NO: 20333 - DNA, 103 bp, Artificial Sequence
  Synthetic Polynucleotide
taatacgactcactataggggaaaatgcagtctgggaccagtataaagacaacagaggagagtctttatgctggtcccaaacctggcggcagcgcaaaagatg

SEQ ID NO: 20334 - DNA, 103 bp, Artificial Sequence
  Synthetic Polynucleotide
taatacgactcactataggggaggaaagtgaccaaaccaacaaggccacaaacagaggagatgtggcatggttggtttgaacctggcggcagcgcaaaagatg

SEQ ID NO: 20335 - DNA, 103 bp, Artificial Sequence
  Synthetic Polynucleotide
taatacgactcactatagggagtatgaaaatgcagtctgggaccagtataaacagaggagatatactatgcccagactgaacctggcggcagcgcaaaagatg

SEQ ID NO: 20336 - DNA, 103 bp, Artificial Sequence
  Synthetic Polynucleotide
taatacgactcactatagggcaggaagtatgaaaatgcagtctgggaccaaacagaggagatggtccatgactgcatttaacctggcggcagcgcaaaagatg

SEQ ID NO: 20337 - DNA, 103 bp, Artificial Sequence
  Synthetic Polynucleotide
taatacgactcactataggggattccaggaagtatgaaaatgcagtctggaacagaggagaccagacatgattttcataaacctggcggcagcgcaaaagatg

SEQ ID NO: 20338 - DNA, 103 bp, Artificial Sequence
  Synthetic Polynucleotide
taatacgactcactatagggaaactgattccaggaagtatgaaaatgcagaacagaggagactgcatatgcatacttccaacctggcggcagcgcaaaagatg

SEQ ID NO: 20339 - DNA, 103 bp, Artificial Sequence
  Synthetic Polynucleotide
taatacgactcactatagggcagtaaaactgattccaggaagtatgaaaaaacagaggagattttcaatgttcctggaaaacctggcggcagcgcaaaagatg

SEQ ID NO: 20340 - DNA, 103 bp, Artificial Sequence
  Synthetic Polynucleotide
taatacgactcactataggggacctcagtaaaactgattccaggaagtataacagaggagaatacttatgggaatcagtaacctggcggcagcgcaaaagatg

SEQ ID NO: 20341 - DNA, 103 bp, Artificial Sequence
  Synthetic Polynucleotide
taatacgactcactatagggatattgacctcagtaaaactgattccaggaaacagaggagatcctggatgcagttttacaacctggcggcagcgcaaaagatg

SEQ ID NO: 20342 - DNA, 103 bp, Artificial Sequence
  Synthetic Polynucleotide
taatacgactcactatagggaattgatattgacctcagtaaaactgattcaacagaggagagaatcaatgttactgaggaacctggcggcagcgcaaaagatg

SEQ ID NO: 20343 - DNA, 103 bp, Artificial Sequence
  Synthetic Polynucleotide
taatacgactcactatagggaaactaattgatattgacctcagtaaaactaacagaggagaagttttatggaggtcaataacctggcggcagcgcaaaagatg

SEQ ID NO: 20344 - DNA, 103 bp, Artificial Sequence
  Synthetic Polynucleotide
taatacgactcactatagggacattaaactaattgatattgacctcagtaaacagaggagatactgaatgcaatatcaaaacctggcggcagcgcaaaagatg

SEQ ID NO: 20345 - DNA, 103 bp, Artificial Sequence
  Synthetic Polynucleotide
taatacgactcactatagggaacaggaggaaagtgaccaaaccaacaaggaacagaggagaccttgtatgtttggtcacaacctggcggcagcgcaaaagatg

SEQ ID NO: 20346 - DNA, 103 bp, Artificial Sequence
  Synthetic Polynucleotide
taatacgactcactatagggaaaagacattaaactaattgatattgacctaacagaggagaaggtcaatgtcaattagtaacctggcggcagcgcaaaagatg

SEQ ID NO: 20347 - DNA, 103 bp, Artificial Sequence
  Synthetic Polynucleotide
taatacgactcactatagggggaagaaaagacattaaactaattgatattaacagaggagaaatatcatgtagtttaataacctggcggcagcgcaaaagatg

SEQ ID NO: 20348 - DNA, 103 bp, Artificial Sequence
  Synthetic Polynucleotide
taatacgactcactatagggcacaaggaagaaaagacattaaactaattgaacagaggagacaattaatgtaatgtcttaacctggcggcagcgcaaaagatg

SEQ ID NO: 20349 - DNA, 103 bp, Artificial Sequence
  Synthetic Polynucleotide
taatacgactcactatagggtgaatcacaaggaagaaaagacattaaactaacagaggagaagtttaatgtcttttcttaacctggcggcagcgcaaaagatg

SEQ ID NO: 20350 - DNA, 103 bp, Artificial Sequence
  Synthetic Polynucleotide
taatacgactcactatagggctccttgaatcacaaggaagaaaagacattaacagaggagaaatgtcatgtcttccttgaacctggcggcagcgcaaaagatg

SEQ ID NO: 20351 - DNA, 103 bp, Artificial Sequence
  Synthetic Polynucleotide
taatacgactcactatagggggaaactccttgaatcacaaggaagaaaagaacagaggagacttttcatgcttgtgattaacctggcggcagcgcaaaagatg

SEQ ID NO: 20352 - DNA, 103 bp, Artificial Sequence
  Synthetic Polynucleotide
taatacgactcactatagggcataaggaaactccttgaatcacaaggaagaacagaggagacttcctatggattcaaggaacctggcggcagcgcaaaagatg

SEQ ID NO: 20353 - DNA, 103 bp, Artificial Sequence
  Synthetic Polynucleotide
taatacgactcactataggggatgacataaggaaactccttgaatcacaaaacagaggagattgtgaatgaaggagtttaacctggcggcagcgcaaaagatg

SEQ ID NO: 20354 - DNA, 103 bp, Artificial Sequence
  Synthetic Polynucleotide
taatacgactcactatagggggtccgatgacataaggaaactccttgaataacagaggagaattcaaatggtttccttaaacctggcggcagcgcaaaagatg

SEQ ID NO: 20355 - DNA, 103 bp, Artificial Sequence
  Synthetic Polynucleotide
taatacgactcactatagggtcaggggtccgatgacataaggaaactcctaacagaggagaaggagtatgcttatgtcaaacctggcggcagcgcaaaagatg

SEQ ID NO: 20356 - DNA, 103 bp, Artificial Sequence
  Synthetic Polynucleotide
taatacgactcactatagggcacacaacaggaggaaagtgaccaaaccaaaacagaggagattggttatgtcactttccaacctggcggcagcgcaaaagatg

SEQ ID NO: 20357 - DNA, 103 bp, Artificial Sequence
  Synthetic Polynucleotide
taatacgactcactatagggacctgtcaggggtccgatgacataaggaaaaacagaggagatttcctatggtcatcggaaacctggcggcagcgcaaaagatg

SEQ ID NO: 20358 - DNA, 103 bp, Artificial Sequence
  Synthetic Polynucleotide
taatacgactcactatagggtcattacctgtcaggggtccgatgacataaaacagaggagattatgtatgcggacccctaacctggcggcagcgcaaaagatg

SEQ ID NO: 20359 - DNA, 103 bp, Artificial Sequence
  Synthetic Polynucleotide
taatacgactcactatagggtatggtcattacctgtcaggggtccgatgaaacagaggagatcatcgatgccctgacagaacctggcggcagcgcaaaagatg

SEQ ID NO: 20360 - DNA, 103 bp, Artificial Sequence
  Synthetic Polynucleotide
taatacgactcactatagggcggaatatggtcattacctgtcaggggtccaacagaggagaggacccatgacaggtaataacctggcggcagcgcaaaagatg

SEQ ID NO: 20361 - DNA, 103 bp, Artificial Sequence
  Synthetic Polynucleotide
taatacgactcactatagggtcccccggaatatggtcattacctgtcaggaacagaggagacctgacatgtaatgaccaaacctggcggcagcgcaaaagatg

SEQ ID NO: 20362 - DNA, 103 bp, Artificial Sequence
  Synthetic Polynucleotide
taatacgactcactatagggtgcactcccccggaatatggtcattacctgaacagaggagacaggtaatgaccatattcaacctggcggcagcgcaaaagatg

SEQ ID NO: 20363 - DNA, 103 bp, Artificial Sequence
  Synthetic Polynucleotide
taatacgactcactatagggattgatgcactcccccggaatatggtcattaacagaggagaaatgacatgattccggggaacctggcggcagcgcaaaagatg

SEQ ID NO: 20364 - DNA, 103 bp, Artificial Sequence
  Synthetic Polynucleotide
taatacgactcactatagggctgtcattgatgcactcccccggaatatggaacagaggagaccatatatggggggagtgaacctggcggcagcgcaaaagatg

SEQ ID NO: 20365 - DNA, 103 bp, Artificial Sequence
  Synthetic Polynucleotide
taatacgactcactatagggcagtgctgtcattgatgcactcccccggaaaacagaggagattccggatgagtgcatcaaacctggcggcagcgcaaaagatg

SEQ ID NO: 20366 - DNA, 103 bp, Artificial Sequence
  Synthetic Polynucleotide
taatacgactcactatagggttgaccagtgctgtcattgatgcactccccaacagaggagaggggagatgatcaatgacaacctggcggcagcgcaaaagatg

SEQ ID NO: 20367 - DNA, 103 bp, Artificial Sequence
  Synthetic Polynucleotide
taatacgactcactatagggcctaccacacaacaggaggaaagtgaccaaaacagaggagattggtcatgttcctcctgaacctggcggcagcgcaaaagatg

SEQ ID NO: 20368 - DNA, 103 bp, Artificial Sequence
  Synthetic Polynucleotide
taatacgactcactatagggcgggcttgaccagtgctgtcattgatgcacaacagaggagagtgcatatgtgacagcacaacctggcggcagcgcaaaagatg

SEQ ID NO: 20369 - DNA, 103 bp, Artificial Sequence
  Synthetic Polynucleotide
taatacgactcactatagggacaaccgggcttgaccagtgctgtcattgaaacagaggagatcaatgatggcactggtcaacctggcggcagcgcaaaagatg

SEQ ID NO: 20370 - DNA, 103 bp, Artificial Sequence
  Synthetic Polynucleotide
taatacgactcactataggggctacacaaccgggcttgaccagtgctgtcaacagaggagagacagcatgggtcaagccaacctggcggcagcgcaaaagatg

SEQ ID NO: 20371 - DNA, 103 bp, Artificial Sequence
  Synthetic Polynucleotide
taatacgactcactatagggtcttcgctacacaaccgggcttgaccagtgaacagaggagacactggatgagcccggttaacctggcggcagcgcaaaagatg

SEQ ID NO: 20372 - DNA, 103 bp, Artificial Sequence
  Synthetic Polynucleotide
taatacgactcactatagggagacctcttcgctacacaaccgggcttgacaacagaggagagtcaagatgggttgtgtaaacctggcggcagcgcaaaagatg

SEQ ID NO: 20373 - DNA, 103 bp, Artificial Sequence
  Synthetic Polynucleotide
taatacgactcactataggggtcacagacctcttcgctacacaaccgggcaacagaggagagcccggatgtgtagcgaaaacctggcggcagcgcaaaagatg

SEQ ID NO: 20374 - DNA, 103 bp, Artificial Sequence
  Synthetic Polynucleotide
taatacgactcactatagggttgatgtcacagacctcttcgctacacaacaacagaggagagttgtgatgcgaagaggtaacctggcggcagcgcaaaagatg

SEQ ID NO: 20375 - DNA, 103 bp, Artificial Sequence
  Synthetic Polynucleotide
taatacgactcactatagggtgggattgatgtcacagacctcttcgctacaacagaggagagtagcgatgaggtctgtgaacctggcggcagcgcaaaagatg

SEQ ID NO: 20376 - DNA, 103 bp, Artificial Sequence
  Synthetic Polynucleotide
taatacgactcactatagggtcacatgggattgatgtcacagacctcttcaacagaggagagaagagatgtgtgacatcaacctggcggcagcgcaaaagatg

SEQ ID NO: 20377 - DNA, 103 bp, Artificial Sequence
  Synthetic Polynucleotide
taatacgactcactatagggagtactcacatgggattgatgtcacagaccaacagaggagaggtctgatgcatcaatccaacctggcggcagcgcaaaagatg

SEQ ID NO: 20378 - DNA, 103 bp, Artificial Sequence
  Synthetic Polynucleotide
taatacgactcactatagggacacttgaattgcgcaaccaaaaatgcctaaacagaggagataggcaatgttggttgcgaacctggcggcagcgcaaaagatg

SEQ ID NO: 20379 - DNA, 103 bp, Artificial Sequence
  Synthetic Polynucleotide
taatacgactcactatagggcaagacctaccacacaacaggaggaaagtgaacagaggagacactttatgcctgttgtgaacctggcggcagcgcaaaagatg

SEQ ID NO: 20380 - DNA, 103 bp, Artificial Sequence
  Synthetic Polynucleotide
taatacgactcactatagggtgctaagtactcacatgggattgatgtcacaacagaggagagtgacaatgatcccatgtaacctggcggcagcgcaaaagatg

SEQ ID NO: 20381 - DNA, 103 bp, Artificial Sequence
  Synthetic Polynucleotide
taatacgactcactatagggcaggatgctaagtactcacatgggattgataacagaggagaatcaatatgatgtgagtaaacctggcggcagcgcaaaagatg

SEQ ID NO: 20382 - DNA, 103 bp, Artificial Sequence
  Synthetic Polynucleotide
taatacgactcactatagggtcaagcaggatgctaagtactcacatgggaaacagaggagatcccatatgagtacttagaacctggcggcagcgcaaaagatg

SEQ ID NO: 20383 - DNA, 103 bp, Artificial Sequence
  Synthetic Polynucleotide
taatacgactcactataggggcagttcaagcaggatgctaagtactcacaaacagaggagatgtgagatgttagcatccaacctggcggcagcgcaaaagatg

SEQ ID NO: 20384 - DNA, 103 bp, Artificial Sequence
  Synthetic Polynucleotide
taatacgactcactatagggttaaagcagttcaagcaggatgctaagtacaacagaggagagtacttatgatcctgcttaacctggcggcagcgcaaaagatg

SEQ ID NO: 20385 - DNA, 103 bp, Artificial Sequence
  Synthetic Polynucleotide
taatacgactcactatagggctgatttaaagcagttcaagcaggatgctaaacagaggagatagcatatggcttgaactaacctggcggcagcgcaaaagatg

SEQ ID NO: 20386 - DNA, 103 bp, Artificial Sequence
  Synthetic Polynucleotide
taatacgactcactatagggacctactgatttaaagcagttcaagcaggaaacagaggagatcctgcatgaactgctttaacctggcggcagcgcaaaagatg

SEQ ID NO: 20387 - DNA, 103 bp, Artificial Sequence
  Synthetic Polynucleotide
taatacgactcactatagggcgtgaacctactgatttaaagcagttcaagaacagaggagacttgaaatgctttaaatcaacctggcggcagcgcaaaagatg

SEQ ID NO: 20388 - DNA, 103 bp, Artificial Sequence
  Synthetic Polynucleotide
taatacgactcactatagggtcttccgtgaacctactgatttaaagcagtaacagaggagaactgctatgaatcagtagaacctggcggcagcgcaaaagatg

SEQ ID NO: 20389 - DNA, 103 bp, Artificial Sequence
  Synthetic Polynucleotide
taatacgactcactatagggacacttcttccgtgaacctactgatttaaaaacagaggagatttaaaatggtaggttcaaacctggcggcagcgcaaaagatg

SEQ ID NO: 20390 - DNA, 103 bp, Artificial Sequence
  Synthetic Polynucleotide
taatacgactcactatagggttgtgcaagacctaccacacaacaggaggaaacagaggagatcctccatgtgtgtggtaaacctggcggcagcgcaaaagatg

SEQ ID NO: 20391 - DNA, 103 bp, Artificial Sequence
  Synthetic Polynucleotide
taatacgactcactatagggtacatacacttcttccgtgaacctactgataacagaggagaatcagtatgttcacggaaaacctggcggcagcgcaaaagatg

SEQ ID NO: 20392 - DNA, 103 bp, Artificial Sequence
  Synthetic Polynucleotide
taatacgactcactataggggctgctacatacacttcttccgtgaacctaaacagaggagataggttatgggaagaagtaacctggcggcagcgcaaaagatg

SEQ ID NO: 20393 - DNA, 103 bp, Artificial Sequence
  Synthetic Polynucleotide
taatacgactcactatagggttcaggctgctacatacacttcttccgtgaaacagaggagatcacggatgaagtgtatgaacctggcggcagcgcaaaagatg

SEQ ID NO: 20394 - DNA, 103 bp, Artificial Sequence
  Synthetic Polynucleotide
taatacgactcactatagggccaagttcaggctgctacatacacttcttcaacagaggagagaagaaatgtatgtagcaaacctggcggcagcgcaaaagatg

SEQ ID NO: 20395 - DNA, 103 bp, Artificial Sequence
  Synthetic Polynucleotide
taatacgactcactatagggatcaaccaagttcaggctgctacatacactaacagaggagaagtgtaatgagcagcctgaacctggcggcagcgcaaaagatg

SEQ ID NO: 20396 - DNA, 103 bp, Artificial Sequence
  Synthetic Polynucleotide
taatacgactcactatagggcctctatcaaccaagttcaggctgctacataacagaggagaatgtagatgcctgaacttaacctggcggcagcgcaaaagatg

SEQ ID NO: 20397 - DNA, 103 bp, Artificial Sequence
  Synthetic Polynucleotide
taatacgactcactatagggattgccctctatcaaccaagttcaggctgcaacagaggagagcagccatgacttggttgaacctggcggcagcgcaaaagatg

SEQ ID NO: 20398 - DNA, 103 bp, Artificial Sequence
  Synthetic Polynucleotide
taatacgactcactatagggtggaaattgccctctatcaaccaagttcagaacagaggagactgaacatggttgatagaaacctggcggcagcgcaaaagatg

SEQ ID NO: 20399 - DNA, 103 bp, Artificial Sequence
  Synthetic Polynucleotide
taatacgactcactatagggtccagtggaaattgccctctatcaaccaagaacagaggagacttggtatgtagagggcaaacctggcggcagcgcaaaagatg

SEQ ID NO: 20400 - DNA, 103 bp, Artificial Sequence
  Synthetic Polynucleotide
taatacgactcactataggggaagatccagtggaaattgccctctatcaaaacagaggagattgataatgggcaatttcaacctggcggcagcgcaaaagatg

SEQ ID NO: 20401 - DNA, 103 bp, Artificial Sequence
  Synthetic Polynucleotide
taatacgactcactatagggactggttgtgcaagacctaccacacaacagaacagaggagactgttgatgggtaggtctaacctggcggcagcgcaaaagatg

SEQ ID NO: 20402 - DNA, 103 bp, Artificial Sequence
  Synthetic Polynucleotide
taatacgactcactataggggacctgaagatccagtggaaattgccctctaacagaggagaagagggatgtttccactgaacctggcggcagcgcaaaagatg

SEQ ID NO: 20403 - DNA, 103 bp, Artificial Sequence
  Synthetic Polynucleotide
taatacgactcactatagggaggaagacctgaagatccagtggaaattgcaacagaggagagcaattatgactggatctaacctggcggcagcgcaaaagatg

SEQ ID NO: 20404 - DNA, 103 bp, Artificial Sequence
  Synthetic Polynucleotide
taatacgactcactatagggattgaaggaagacctgaagatccagtggaaaacagaggagattccacatgatcttcaggaacctggcggcagcgcaaaagatg

SEQ ID NO: 20405 - DNA, 103 bp, Artificial Sequence
  Synthetic Polynucleotide
taatacgactcactatagggtggacattgaaggaagacctgaagatccagaacagaggagactggatatgcaggtcttcaacctggcggcagcgcaaaagatg

SEQ ID NO: 20406 - DNA, 103 bp, Artificial Sequence
  Synthetic Polynucleotide
taatacgactcactatagggctggatggacattgaaggaagacctgaagaaacagaggagatcttcaatgcttccttcaaacctggcggcagcgcaaaagatg

SEQ ID NO: 20407 - DNA, 103 bp, Artificial Sequence
  Synthetic Polynucleotide
taatacgactcactatagggaagacctggatggacattgaaggaagacctaacagaggagaaggtctatgttcaatgtcaacctggcggcagcgcaaaagatg

SEQ ID NO: 20408 - DNA, 103 bp, Artificial Sequence
  Synthetic Polynucleotide
taatacgactcactatagggatgctaagacctggatggacattgaaggaaaacagaggagattccttatgtgtccatccaacctggcggcagcgcaaaagatg

SEQ ID NO: 20409 - DNA, 103 bp, Artificial Sequence
  Synthetic Polynucleotide
taatacgactcactatagggcccaaatgctaagacctggatggacattgaaacagaggagatcaatgatgatccaggtcaacctggcggcagcgcaaaagatg

SEQ ID NO: 20410 - DNA, 103 bp, Artificial Sequence
  Synthetic Polynucleotide
taatacgactcactatagggcttgacccaaatgctaagacctggatggacaacagaggagagtccatatgggtcttagcaacctggcggcagcgcaaaagatg

SEQ ID NO: 20411 - DNA, 103 bp, Artificial Sequence
  Synthetic Polynucleotide
taatacgactcactatagggtgcaacttgacccaaatgctaagacctggaaacagaggagatccaggatgtagcatttgaacctggcggcagcgcaaaagatg

SEQ ID NO: 20412 - DNA, 103 bp, Artificial Sequence
  Synthetic Polynucleotide
taatacgactcactatagggtaaagactggttgtgcaagacctaccacacaacagaggagagtgtggatggtcttgcacaacctggcggcagcgcaaaagatg

SEQ ID NO: 20413 - DNA, 103 bp, Artificial Sequence
  Synthetic Polynucleotide
taatacgactcactatagggaatgctgcaacttgacccaaatgctaagacaacagaggagagtcttaatgtttgggtcaaacctggcggcagcgcaaaagatg

SEQ ID NO: 20414 - DNA, 103 bp, Artificial Sequence
  Synthetic Polynucleotide
taatacgactcactataggggatgcaatgctgcaacttgacccaaatgctaacagaggagaagcattatggtcaagttgaacctggcggcagcgcaaaagatg

SEQ ID NO: 20415 - DNA, 103 bp, Artificial Sequence
  Synthetic Polynucleotide
taatacgactcactatagggtcaaggatgcaatgctgcaacttgacccaaaacagaggagattgggtatggttgcagcaaacctggcggcagcgcaaaagatg

SEQ ID NO: 20416 - DNA, 103 bp, Artificial Sequence
  Synthetic Polynucleotide
taatacgactcactataggggaccctcaaggatgcaatgctgcaacttgaaacagaggagatcaagtatgagcattgcaaacctggcggcagcgcaaaagatg

SEQ ID NO: 20417 - DNA, 103 bp, Artificial Sequence
  Synthetic Polynucleotide
taatacgactcactatagggctgatgaccctcaaggatgcaatgctgcaaaacagaggagattgcagatgtgcatccttaacctggcggcagcgcaaaagatg

SEQ ID NO: 20418 - DNA, 103 bp, Artificial Sequence
  Synthetic Polynucleotide
taatacgactcactatagggctcagctgatgaccctcaaggatgcaatgcaacagaggagagcattgatgccttgagggaacctggcggcagcgcaaaagatg

SEQ ID NO: 20419 - DNA, 103 bp, Artificial Sequence
  Synthetic Polynucleotide
taatacgactcactatagggctattctcagctgatgaccctcaaggatgcaacagaggagagcatccatgagggtcatcaacctggcggcagcgcaaaagatg

SEQ ID NO: 20420 - DNA, 103 bp, Artificial Sequence
  Synthetic Polynucleotide
taatacgactcactatagggcttacctattctcagctgatgaccctcaagaacagaggagacttgagatgcatcagctgaacctggcggcagcgcaaaagatg

SEQ ID NO: 20421 - DNA, 103 bp, Artificial Sequence
  Synthetic Polynucleotide
taatacgactcactatagggctgggcttacctattctcagctgatgacccaacagaggagagggtcaatggctgagaataacctggcggcagcgcaaaagatg

SEQ ID NO: 20422 - DNA, 103 bp, Artificial Sequence
  Synthetic Polynucleotide
taatacgactcactatagggtaccgctgggcttacctattctcagctgataacagaggagaatcagcatggaataggtaaacctggcggcagcgcaaaagatg

SEQ ID NO: 20423 - DNA, 103 bp, Artificial Sequence
  Synthetic Polynucleotide
taatacgactcactatagggctttataaagactggttgtgcaagacctacaacagaggagagtaggtatggcacaaccaaacctggcggcagcgcaaaagatg

SEQ ID NO: 20424 - DNA, 103 bp, Artificial Sequence
  Synthetic Polynucleotide
taatacgactcactataggggggtttaccgctgggcttacctattctcagaacagaggagactgagaatgggtaagcccaacctggcggcagcgcaaaagatg

SEQ ID NO: 20425 - DNA, 103 bp, Artificial Sequence
  Synthetic Polynucleotide
taatacgactcactatagggcggcagggtttaccgctgggcttacctattaacagaggagaaataggatggcccagcggaacctggcggcagcgcaaaagatg

SEQ ID NO: 20426 - DNA, 103 bp, Artificial Sequence
  Synthetic Polynucleotide
taatacgactcactataggggcagtcggcagggtttaccgctgggcttacaacagaggagagtaagcatggcggtaaacaacctggcggcagcgcaaaagatg

SEQ ID NO: 20427 - DNA, 103 bp, Artificial Sequence
  Synthetic Polynucleotide
taatacgactcactatagggtccctgcagtcggcagggtttaccgctgggaacagaggagacccagcatgaaaccctgcaacctggcggcagcgcaaaagatg

SEQ ID NO: 20428 - DNA, 103 bp, Artificial Sequence
  Synthetic Polynucleotide
taatacgactcactataggggtaaatccctgcagtcggcagggtttaccgaacagaggagacggtaaatgctgccgactaacctggcggcagcgcaaaagatg

SEQ ID NO: 20429 - DNA, 103 bp, Artificial Sequence
  Synthetic Polynucleotide
taatacgactcactatagggttccagtaaatccctgcagtcggcagggttaacagaggagaaaccctatggactgcaggaacctggcggcagcgcaaaagatg

SEQ ID NO: 20430 - DNA, 103 bp, Artificial Sequence
  Synthetic Polynucleotide
taatacgactcactatagggaacaattccagtaaatccctgcagtcggcaaacagaggagatgccgaatgcagggatttaacctggcggcagcgcaaaagatg

SEQ ID NO: 20431 - DNA, 103 bp, Artificial Sequence
  Synthetic Polynucleotide
taatacgactcactatagggacagcaacaattccagtaaatccctgcagtaacagaggagaactgcaatgatttactggaacctggcggcagcgcaaaagatg

SEQ ID NO: 20432 - DNA, 103 bp, Artificial Sequence
  Synthetic Polynucleotide
taatacgactcactatagggagctgacagcaacaattccagtaaatccctaacagaggagaagggatatgctggaattgaacctggcggcagcgcaaaagatg

SEQ ID NO: 20433 - DNA, 103 bp, Artificial Sequence
  Synthetic Polynucleotide
taatacgactcactatagggcagaaagctgacagcaacaattccagtaaaaacagaggagatttactatgattgttgctaacctggcggcagcgcaaaagatg

SEQ ID NO: 20434 - DNA, 103 bp, Artificial Sequence
  Synthetic Polynucleotide
taatacgactcactatagggaacccctttataaagactggttgtgcaagaaacagaggagatcttgcatgaccagtcttaacctggcggcagcgcaaaagatg

SEQ ID NO: 20435 - DNA, 103 bp, Artificial Sequence
  Synthetic Polynucleotide
taatacgactcactatagggagccacagaaagctgacagcaacaattccaaacagaggagatggaatatgtgctgtcagaacctggcggcagcgcaaaagatg

SEQ ID NO: 20436 - DNA, 103 bp, Artificial Sequence
  Synthetic Polynucleotide
taatacgactcactatagggtgggaagccacagaaagctgacagcaacaaaacagaggagattgttgatgtcagctttcaacctggcggcagcgcaaaagatg

SEQ ID NO: 20437 - DNA, 103 bp, Artificial Sequence
  Synthetic Polynucleotide
taatacgactcactatagggtcagatgggaagccacagaaagctgacagcaacagaggagagctgtcatgtttctgtggaacctggcggcagcgcaaaagatg

SEQ ID NO: 20438 - DNA, 103 bp, Artificial Sequence
  Synthetic Polynucleotide
taatacgactcactatagggtggaatcagatgggaagccacagaaagctgaacagaggagacagcttatggtggcttccaacctggcggcagcgcaaaagatg

SEQ ID NO: 20439 - DNA, 103 bp, Artificial Sequence
  Synthetic Polynucleotide
taatacgactcactatagggtgatctggaatcagatgggaagccacagaaaacagaggagattctgtatgttcccatctaacctggcggcagcgcaaaagatg

SEQ ID NO: 20440 - DNA, 103 bp, Artificial Sequence
  Synthetic Polynucleotide
taatacgactcactataggggtcgttgatctggaatcagatgggaagccaaacagaggagatggcttatgatctgattcaacctggcggcagcgcaaaagatg

SEQ ID NO: 20441 - DNA, 103 bp, Artificial Sequence
  Synthetic Polynucleotide
taatacgactcactatagggacactgtcgttgatctggaatcagatgggaaacagaggagatcccatatgattccagataacctggcggcagcgcaaaagatg

SEQ ID NO: 20442 - DNA, 103 bp, Artificial Sequence
  Synthetic Polynucleotide
taatacgactcactatagggggaaaacactgtcgttgatctggaatcagaaacagaggagatctgatatgagatcaacgaacctggcggcagcgcaaaagatg

SEQ ID NO: 20443 - DNA, 103 bp, Artificial Sequence
  Synthetic Polynucleotide
taatacgactcactataggggcctgggaaaacactgtcgttgatctggaaaacagaggagattccagatgaacgacagtaacctggcggcagcgcaaaagatg

SEQ ID NO: 20444 - DNA, 103 bp, Artificial Sequence
  Synthetic Polynucleotide
taatacgactcactataggggaagggcctgggaaaacactgtcgttgatcaacagaggagagatcaaatgcagtgttttaacctggcggcagcgcaaaagatg

SEQ ID NO: 20445 - DNA, 103 bp, Artificial Sequence
  Synthetic Polynucleotide
taatacgactcactatagggtcataaacccctttataaagactggttgtgaacagaggagacacaacatgtctttataaaacctggcggcagcgcaaaagatg

SEQ ID NO: 20446 - DNA, 103 bp, Artificial Sequence
  Synthetic Polynucleotide
taatacgactcactatagggaacaggaagggcctgggaaaacactgtcgtaacagaggagaacgacaatgttttcccagaacctggcggcagcgcaaaagatg

SEQ ID NO: 20447 - DNA, 103 bp, Artificial Sequence
  Synthetic Polynucleotide
taatacgactcactatagggtcaataacaggaagggcctgggaaaacactaacagaggagaagtgttatgccaggccctaacctggcggcagcgcaaaagatg

SEQ ID NO: 20448 - DNA, 103 bp, Artificial Sequence
  Synthetic Polynucleotide
taatacgactcactataggggaacctcaataacaggaagggcctgggaaaaacagaggagatttcccatgcccttcctgaacctggcggcagcgcaaaagatg

SEQ ID NO: 20449 - DNA, 103 bp, Artificial Sequence
  Synthetic Polynucleotide
taatacgactcactatagggatcaagaacctcaataacaggaagggcctgaacagaggagacaggccatgcctgttattaacctggcggcagcgcaaaagatg

SEQ ID NO: 20450 - DNA, 103 bp, Artificial Sequence
  Synthetic Polynucleotide
taatacgactcactatagggattgcatcaagaacctcaataacaggaaggaacagaggagaccttccatgtattgaggtaacctggcggcagcgcaaaagatg

SEQ ID NO: 20451 - DNA, 103 bp, Artificial Sequence
  Synthetic Polynucleotide
taatacgactcactatagggcatatattgcatcaagaacctcaataacagaacagaggagactgttaatgaggttcttgaacctggcggcagcgcaaaagatg

SEQ ID NO: 20452 - DNA, 103 bp, Artificial Sequence
  Synthetic Polynucleotide
taatacgactcactatagggatggccatatattgcatcaagaacctcaataacagaggagaattgagatgcttgatgcaaacctggcggcagcgcaaaagatg

SEQ ID NO: 20453 - DNA, 103 bp, Artificial Sequence
  Synthetic Polynucleotide
taatacgactcactataggggatggatggccatatattgcatcaagaaccaacagaggagaggttctatgtgcaatataaacctggcggcagcgcaaaagatg

SEQ ID NO: 20454 - DNA, 103 bp, Artificial Sequence
  Synthetic Polynucleotide
taatacgactcactatagggcaggagatggatggccatatattgcatcaaaacagaggagattgatgatgtatatggccaacctggcggcagcgcaaaagatg

SEQ ID NO: 20455 - DNA, 103 bp, Artificial Sequence
  Synthetic Polynucleotide
taatacgactcactatagggtttgtcaggagatggatggccatatattgcaacagaggagagcaataatgggccatccaaacctggcggcagcgcaaaagatg

SEQ ID NO: 20456 - DNA, 103 bp, Artificial Sequence
  Synthetic Polynucleotide
taatacgactcactataggggaagctcataaacccctttataaagactggaacagaggagaccagtcatgataaaggggaacctggcggcagcgcaaaagatg

SEQ ID NO: 20457 - DNA, 103 bp, Artificial Sequence
  Synthetic Polynucleotide
taatacgactcactatagggatttgtttgtcaggagatggatggccatataacagaggagaatatggatgtccatctccaacctggcggcagcgcaaaagatg

SEQ ID NO: 20458 - DNA, 103 bp, Artificial Sequence
  Synthetic Polynucleotide
taatacgactcactatagggacaagatttgtttgtcaggagatggatggcaacagaggagagccatcatgctcctgacaaacctggcggcagcgcaaaagatg

SEQ ID NO: 20459 - DNA, 103 bp, Artificial Sequence
  Synthetic Polynucleotide
taatacgactcactatagggactctacaagatttgtttgtcaggagatggaacagaggagaccatctatggacaaacaaaacctggcggcagcgcaaaagatg

SEQ ID NO: 20460 - DNA, 103 bp, Artificial Sequence
  Synthetic Polynucleotide
taatacgactcactatagggaacatactctacaagatttgtttgtcaggaaacagaggagatcctgaatgacaaatcttaacctggcggcagcgcaaaagatg

SEQ ID NO: 20461 - DNA, 103 bp, Artificial Sequence
  Synthetic Polynucleotide
taatacgactcactatagggatgaaaacatactctacaagatttgtttgtaacagaggagaacaaacatgtcttgtagaaacctggcggcagcgcaaaagatg

SEQ ID NO: 20462 - DNA, 103 bp, Artificial Sequence
  Synthetic Polynucleotide
taatacgactcactatagggtccttatgaaaacatactctacaagatttgaacagaggagacaaatcatgtagagtatgaacctggcggcagcgcaaaagatg

SEQ ID NO: 20463 - DNA, 103 bp, Artificial Sequence
  Synthetic Polynucleotide
taatacgactcactatagggaggaatccttatgaaaacatactctacaagaacagaggagacttgtaatgtatgttttcaacctggcggcagcgcaaaagatg

SEQ ID NO: 20464 - DNA, 103 bp, Artificial Sequence
  Synthetic Polynucleotide
taatacgactcactataggggtgaaaggaatccttatgaaaacatactctaacagaggagaagagtaatgtttcataagaacctggcggcagcgcaaaagatg

SEQ ID NO: 20465 - DNA, 103 bp, Artificial Sequence
  Synthetic Polynucleotide
taatacgactcactatagggccctggtgaaaggaatccttatgaaaacataacagaggagaatgtttatgtaaggattcaacctggcggcagcgcaaaagatg

SEQ ID NO: 20466 - DNA, 103 bp, Artificial Sequence
  Synthetic Polynucleotide
taatacgactcactataggggacacccctggtgaaaggaatccttatgaaaacagaggagattcataatgattcctttcaacctggcggcagcgcaaaagatg

SEQ ID NO: 20467 - DNA, 103 bp, Artificial Sequence
  Synthetic Polynucleotide
taatacgactcactatagggagtctgaagctcataaacccctttataaagaacagaggagactttatatgggggtttataacctggcggcagcgcaaaagatg

SEQ ID NO: 20468 - DNA, 103 bp, Artificial Sequence
  Synthetic Polynucleotide
taatacgactcactatagggtttcagacacccctggtgaaaggaatccttaacagaggagaaaggatatgtttcaccagaacctggcggcagcgcaaaagatg

SEQ ID NO: 20469 - DNA, 103 bp, Artificial Sequence
  Synthetic Polynucleotide
taatacgactcactataggggttcatttcagacacccctggtgaaaggaaaacagaggagattccttatgccaggggtgaacctggcggcagcgcaaaagatg

SEQ ID NO: 20470 - DNA, 103 bp, Artificial Sequence
  Synthetic Polynucleotide
taatacgactcactatagggggaatgttcatttcagacacccctggtgaaaacagaggagattcaccatgggtgtctgaaacctggcggcagcgcaaaagatg

SEQ ID NO: 20471 - DNA, 103 bp, Artificial Sequence
  Synthetic Polynucleotide
taatacgactcactatagggctcttggaatgttcatttcagacacccctgaacagaggagacaggggatgctgaaatgaaacctggcggcagcgcaaaagatg

SEQ ID NO: 20472 - DNA, 103 bp, Artificial Sequence
  Synthetic Polynucleotide
taatacgactcactataggggaaggctcttggaatgttcatttcagacacaacagaggagagtgtctatgatgaacattaacctggcggcagcgcaaaagatg

SEQ ID NO: 20473 - DNA, 103 bp, Artificial Sequence
  Synthetic Polynucleotide
taatacgactcactataggggtcaagaaggctcttggaatgttcatttcaaacagaggagatgaaatatgcattccaagaacctggcggcagcgcaaaagatg

SEQ ID NO: 20474 - DNA, 103 bp, Artificial Sequence
  Synthetic Polynucleotide
taatacgactcactatagggtaaaggtcaagaaggctcttggaatgttcaaacagaggagatgaacaatgcaagagcctaacctggcggcagcgcaaaagatg

SEQ ID NO: 20475 - DNA, 103 bp, Artificial Sequence
  Synthetic Polynucleotide
taatacgactcactatagggcattttaaaggtcaagaaggctcttggaataacagaggagaattccaatggccttcttgaacctggcggcagcgcaaaagatg

SEQ ID NO: 20476 - DNA, 103 bp, Artificial Sequence
  Synthetic Polynucleotide
taatacgactcactatagggaaatccattttaaaggtcaagaaggctcttaacagaggagaaagagcatgcttgaccttaacctggcggcagcgcaaaagatg

SEQ ID NO: 20477 - DNA, 103 bp, Artificial Sequence
  Synthetic Polynucleotide
taatacgactcactatagggtcctcaaatccattttaaaggtcaagaaggaacagaggagaccttctatgcctttaaaaaacctggcggcagcgcaaaagatg

SEQ ID NO: 20478 - DNA, 103 bp, Artificial Sequence
  Synthetic Polynucleotide
taatacgactcactatagggtccagagtctgaagctcataaacccctttaaacagaggagataaaggatgttatgagctaacctggcggcagcgcaaaagatg

SEQ ID NO: 20479 - DNA, 103 bp, Artificial Sequence
  Synthetic Polynucleotide
taatacgactcactatagggtggtatcctcaaatccattttaaaggtcaaaacagaggagattgaccatgaaaatggataacctggcggcagcgcaaaagatg

SEQ ID NO: 20480 - DNA, 103 bp, Artificial Sequence
  Synthetic Polynucleotide
taatacgactcactatagggatggatggtatcctcaaatccattttaaagaacagaggagactttaaatgggatttgagaacctggcggcagcgcaaaagatg

SEQ ID NO: 20481 - DNA, 103 bp, Artificial Sequence
  Synthetic Polynucleotide
taatacgactcactatagggagacaatggatggtatcctcaaatccatttaacagaggagaaaatggatgtgaggatacaacctggcggcagcgcaaaagatg

SEQ ID NO: 20482 - DNA, 103 bp, Artificial Sequence
  Synthetic Polynucleotide
taatacgactcactatagggacctcagacaatggatggtatcctcaaatcaacagaggagagatttgatgataccatccaacctggcggcagcgcaaaagatg

SEQ ID NO: 20483 - DNA, 103 bp, Artificial Sequence
  Synthetic Polynucleotide
taatacgactcactataggggtgtcacctcagacaatggatggtatcctcaacagaggagagaggatatgatccattgtaacctggcggcagcgcaaaagatg

SEQ ID NO: 20484 - DNA, 103 bp, Artificial Sequence
  Synthetic Polynucleotide
taatacgactcactatagggtcaaggtgtcacctcagacaatggatggtaaacagaggagataccatatgttgtctgagaacctggcggcagcgcaaaagatg

SEQ ID NO: 20485 - DNA, 103 bp, Artificial Sequence
  Synthetic Polynucleotide
taatacgactcactataggggacaatcaaggtgtcacctcagacaatggaaacagaggagatccattatgtgaggtgacaacctggcggcagcgcaaaagatg

SEQ ID NO: 20486 - DNA, 103 bp, Artificial Sequence
  Synthetic Polynucleotide
taatacgactcactatagggttggagacaatcaaggtgtcacctcagacaaacagaggagatgtctgatgtgacaccttaacctggcggcagcgcaaaagatg

SEQ ID NO: 20487 - DNA, 103 bp, Artificial Sequence
  Synthetic Polynucleotide
taatacgactcactatagggatatgttggagacaatcaaggtgtcacctcaacagaggagagaggtgatgccttgattgaacctggcggcagcgcaaaagatg

SEQ ID NO: 20488 - DNA, 103 bp, Artificial Sequence
  Synthetic Polynucleotide
taatacgactcactatagggtggcaatatgttggagacaatcaaggtgtcaacagaggagagacaccatgattgtctccaacctggcggcagcgcaaaagatg

SEQ ID NO: 20489 - DNA, 103 bp, Artificial Sequence
  Synthetic Polynucleotide
taatacgactcactatagggataggacacttgaattgcgcaaccaaaaataacagaggagaatttttatgtgcgcaattaacctggcggcagcgcaaaagatg

SEQ ID NO: 20490 - DNA, 103 bp, Artificial Sequence
  Synthetic Polynucleotide
taatacgactcactatagggttagttccagagtctgaagctcataaacccaacagaggagagggtttatgagcttcagaaacctggcggcagcgcaaaagatg

SEQ ID NO: 20491 - DNA, 103 bp, Artificial Sequence
  Synthetic Polynucleotide
taatacgactcactataggggatggtggcaatatgttggagacaatcaagaacagaggagacttgatatgctccaacataacctggcggcagcgcaaaagatg

SEQ ID NO: 20492 - DNA, 103 bp, Artificial Sequence
  Synthetic Polynucleotide
taatacgactcactatagggtgctggatggtggcaatatgttggagacaaaacagaggagattgtctatgacatattgcaacctggcggcagcgcaaaagatg

SEQ ID NO: 20493 - DNA, 103 bp, Artificial Sequence
  Synthetic Polynucleotide
taatacgactcactatagggttgcatgctggatggtggcaatatgttggaaacagaggagatccaacatgttgccaccaaacctggcggcagcgcaaaagatg

SEQ ID NO: 20494 - DNA, 103 bp, Artificial Sequence
  Synthetic Polynucleotide
taatacgactcactatagggggagcttgcatgctggatggtggcaatatgaacagaggagacatattatgaccatccagaacctggcggcagcgcaaaagatg

SEQ ID NO: 20495 - DNA, 103 bp, Artificial Sequence
  Synthetic Polynucleotide
taatacgactcactatagggaggcaggagcttgcatgctggatggtggcaaacagaggagatgccacatgccagcatgcaacctggcggcagcgcaaaagatg

SEQ ID NO: 20496 - DNA, 103 bp, Artificial Sequence
  Synthetic Polynucleotide
taatacgactcactatagggtgtgaaggcaggagcttgcatgctggatggaacagaggagaccatccatgatgcaagctaacctggcggcagcgcaaaagatg

SEQ ID NO: 20497 - DNA, 103 bp, Artificial Sequence
  Synthetic Polynucleotide
taatacgactcactataggggcagctgtgaaggcaggagcttgcatgctgaacagaggagacagcatatgagctcctgcaacctggcggcagcgcaaaagatg

SEQ ID NO: 20498 - DNA, 103 bp, Artificial Sequence
  Synthetic Polynucleotide
taatacgactcactatagggtgggtgcagctgtgaaggcaggagcttgcaaacagaggagatgcaagatgctgccttcaaacctggcggcagcgcaaaagatg

SEQ ID NO: 20499 - DNA, 103 bp, Artificial Sequence
  Synthetic Polynucleotide
taatacgactcactatagggtagcttgggtgcagctgtgaaggcaggagcaacagaggagagctcctatgttcacagctaacctggcggcagcgcaaaagatg

SEQ ID NO: 20500 - DNA, 103 bp, Artificial Sequence
  Synthetic Polynucleotide
taatacgactcactatagggaattttagcttgggtgcagctgtgaaggcaaacagaggagatgccttatgagctgcaccaacctggcggcagcgcaaaagatg

SEQ ID NO: 20501 - DNA, 103 bp, Artificial Sequence
  Synthetic Polynucleotide
taatacgactcactatagggcatgtttagttccagagtctgaagctcataaacagaggagatatgagatgcagactctgaacctggcggcagcgcaaaagatg

SEQ ID NO: 20502 - DNA, 103 bp, Artificial Sequence
  Synthetic Polynucleotide
taatacgactcactataggggttataattttagcttgggtgcagctgtgaaacagaggagatcacagatgcacccaagcaacctggcggcagcgcaaaagatg

SEQ ID NO: 20503 - DNA, 103 bp, Artificial Sequence
  Synthetic Polynucleotide
taatacgactcactatagggctcaggttataattttagcttgggtgcagcaacagaggagagctgcaatgaagctaaaaaacctggcggcagcgcaaaagatg

SEQ ID NO: 20504 - DNA, 103 bp, Artificial Sequence
  Synthetic Polynucleotide
taatacgactcactatagggaatatctcaggttataattttagcttgggtaacagaggagaacccaaatgaaaattataaacctggcggcagcgcaaaagatg

SEQ ID NO: 20505 - DNA, 103 bp, Artificial Sequence
  Synthetic Polynucleotide
taatacgactcactatagggctttgaatatctcaggttataattttagctaacagaggagaagctaaatgtataacctgaacctggcggcagcgcaaaagatg

SEQ ID NO: 20506 - DNA, 103 bp, Artificial Sequence
  Synthetic Polynucleotide
taatacgactcactatagggaagctctttgaatatctcaggttataatttaacagaggagaaaattaatgcctgagataaacctggcggcagcgcaaaagatg

SEQ ID NO: 20507 - DNA, 103 bp, Artificial Sequence
  Synthetic Polynucleotide
taatacgactcactatagggaagaaaagctctttgaatatctcaggttataacagaggagaataaccatggatattcaaaacctggcggcagcgcaaaagatg

SEQ ID NO: 20508 - DNA, 103 bp, Artificial Sequence
  Synthetic Polynucleotide
taatacgactcactatagggacaccaagaaaagctctttgaatatctcagaacagaggagactgagaatgtcaaagagcaacctggcggcagcgcaaaagatg

SEQ ID NO: 20509 - DNA, 103 bp, Artificial Sequence
  Synthetic Polynucleotide
taatacgactcactataggggattgacaccaagaaaagctctttgaatataacagaggagaatattcatggagcttttcaacctggcggcagcgcaaaagatg

SEQ ID NO: 20510 - DNA, 103 bp, Artificial Sequence
  Synthetic Polynucleotide
taatacgactcactatagggaatatgattgacaccaagaaaagctctttgaacagaggagacaaagaatgtttcttggtaacctggcggcagcgcaaaagatg

SEQ ID NO: 20511 - DNA, 103 bp, Artificial Sequence
  Synthetic Polynucleotide
taatacgactcactatagggtcctaaatatgattgacaccaagaaaagctaacagaggagaagctttatgtggtgtcaaaacctggcggcagcgcaaaagatg

SEQ ID NO: 20512 - DNA, 103 bp, Artificial Sequence
  Synthetic Polynucleotide
taatacgactcactataggggtctccatgtttagttccagagtctgaagcaacagaggagagcttcaatgtctggaactaacctggcggcagcgcaaaagatg

SEQ ID NO: 20513 - DNA, 103 bp, Artificial Sequence
  Synthetic Polynucleotide
taatacgactcactatagggtcccatcctaaatatgattgacaccaagaaaacagaggagattcttgatgtcaatcataaacctggcggcagcgcaaaagatg

SEQ ID NO: 20514 - DNA, 103 bp, Artificial Sequence
  Synthetic Polynucleotide
taatacgactcactatagggagtcatcccatcctaaatatgattgacaccaacagaggagaggtgtcatgcatatttagaacctggcggcagcgcaaaagatg

SEQ ID NO: 20515 - DNA, 103 bp, Artificial Sequence
  Synthetic Polynucleotide
taatacgactcactatagggctcaaagtcatcccatcctaaatatgattgaacagaggagacaatcaatgttaggatggaacctggcggcagcgcaaaagatg

SEQ ID NO: 20516 - DNA, 103 bp, Artificial Sequence
  Synthetic Polynucleotide
taatacgactcactataggggctgactcaaagtcatcccatcctaaatataacagaggagaatatttatgatgggatgaaacctggcggcagcgcaaaagatg

SEQ ID NO: 20517 - DNA, 103 bp, Artificial Sequence
  Synthetic Polynucleotide
taatacgactcactataggggacaggctgactcaaagtcatcccatcctaaacagaggagataggatatgatgactttgaacctggcggcagcgcaaaagatg

SEQ ID NO: 20518 - DNA, 103 bp, Artificial Sequence
  Synthetic Polynucleotide
taatacgactcactatagggacttagacaggctgactcaaagtcatcccaaacagaggagatgggatatgtttgagtcaaacctggcggcagcgcaaaagatg

SEQ ID NO: 20519 - DNA, 103 bp, Artificial Sequence
  Synthetic Polynucleotide
taatacgactcactatagggttcagacttagacaggctgactcaaagtcaaacagaggagatgacttatggtcagcctgaacctggcggcagcgcaaaagatg

SEQ ID NO: 20520 - DNA, 103 bp, Artificial Sequence
  Synthetic Polynucleotide
taatacgactcactatagggaacacttcagacttagacaggctgactcaaaacagaggagattgagtatgcctgtctaaaacctggcggcagcgcaaaagatg

SEQ ID NO: 20521 - DNA, 103 bp, Artificial Sequence
  Synthetic Polynucleotide
taatacgactcactatagggatcccaacacttcagacttagacaggctgaaacagaggagatcagccatgctaagtctgaacctggcggcagcgcaaaagatg

SEQ ID NO: 20522 - DNA, 103 bp, Artificial Sequence
  Synthetic Polynucleotide
taatacgactcactatagggaaagtatcccaacacttcagacttagacagaacagaggagactgtctatgtctgaagtgaacctggcggcagcgcaaaagatg

SEQ ID NO: 20523 - DNA, 103 bp, Artificial Sequence
  Synthetic Polynucleotide
taatacgactcactatagggtgagtgtctccatgtttagttccagagtctaacagaggagaagactcatgaactaaacaaacctggcggcagcgcaaaagatg

SEQ ID NO: 20524 - DNA, 103 bp, Artificial Sequence
  Synthetic Polynucleotide
taatacgactcactatagggacagcaaagtatcccaacacttcagacttaaacagaggagataagtcatgagtgttgggaacctggcggcagcgcaaaagatg

SEQ ID NO: 20525 - DNA, 103 bp, Artificial Sequence
  Synthetic Polynucleotide
taatacgactcactatagggtctacacagcaaagtatcccaacacttcagaacagaggagactgaagatgtgggatactaacctggcggcagcgcaaaagatg

SEQ ID NO: 20526 - DNA, 103 bp, Artificial Sequence
  Synthetic Polynucleotide
taatacgactcactatagggtttgatctacacagcaaagtatcccaacacaacagaggagagtgttgatgtactttgctaacctggcggcagcgcaaaagatg

SEQ ID NO: 20527 - DNA, 103 bp, Artificial Sequence
  Synthetic Polynucleotide
taatacgactcactatagggttgggtttgatctacacagcaaagtatcccaacagaggagagggataatgtgctgtgtaaacctggcggcagcgcaaaagatg

SEQ ID NO: 20528 - DNA, 103 bp, Artificial Sequence
  Synthetic Polynucleotide
taatacgactcactatagggcagatttgggtttgatctacacagcaaagtaacagaggagaactttgatgtgtagatcaaacctggcggcagcgcaaaagatg

SEQ ID NO: 20529 - DNA, 103 bp, Artificial Sequence
  Synthetic Polynucleotide
taatacgactcactatagggattgacagatttgggtttgatctacacagcaacagaggagagctgtgatgatcaaacccaacctggcggcagcgcaaaagatg

SEQ ID NO: 20530 - DNA, 103 bp, Artificial Sequence
  Synthetic Polynucleotide
taatacgactcactatagggcaagcattgacagatttgggtttgatctacaacagaggagagtagatatgacccaaatcaacctggcggcagcgcaaaagatg

SEQ ID NO: 20531 - DNA, 103 bp, Artificial Sequence
  Synthetic Polynucleotide
taatacgactcactatagggcagtacaagcattgacagatttgggtttgaaacagaggagatcaaacatgaatctgtcaaacctggcggcagcgcaaaagatg

SEQ ID NO: 20532 - DNA, 103 bp, Artificial Sequence
  Synthetic Polynucleotide
taatacgactcactatagggtgatgcagtacaagcattgacagatttgggaacagaggagacccaaaatggtcaatgctaacctggcggcagcgcaaaagatg

SEQ ID NO: 20533 - DNA, 103 bp, Artificial Sequence
  Synthetic Polynucleotide
taatacgactcactatagggttgaatgatgcagtacaagcattgacagataacagaggagaatctgtatgtgcttgtacaacctggcggcagcgcaaaagatg

SEQ ID NO: 20534 - DNA, 103 bp, Artificial Sequence
  Synthetic Polynucleotide
taatacgactcactatagggcatattgagtgtctccatgtttagttccagaacagaggagactggaaatgaacatggagaacctggcggcagcgcaaaagatg

SEQ ID NO: 20535 - DNA, 103 bp, Artificial Sequence
  Synthetic Polynucleotide
taatacgactcactatagggttgacttgaatgatgcagtacaagcattgaaacagaggagatcaatgatggtactgcataacctggcggcagcgcaaaagatg

SEQ ID NO: 20536 - DNA, 103 bp, Artificial Sequence
  Synthetic Polynucleotide
taatacgactcactataggggcaggttgacttgaatgatgcagtacaagcaacagaggagagcttgtatggcatcattcaacctggcggcagcgcaaaagatg

SEQ ID NO: 20537 - DNA, 103 bp, Artificial Sequence
  Synthetic Polynucleotide
taatacgactcactatagggcaggggcaggttgacttgaatgatgcagtaaacagaggagatactgcatgattcaagtcaacctggcggcagcgcaaaagatg

SEQ ID NO: 20538 - DNA, 103 bp, Artificial Sequence
  Synthetic Polynucleotide
taatacgactcactatagggcaaaacaggggcaggttgacttgaatgatgaacagaggagacatcatatgagtcaacctaacctggcggcagcgcaaaagatg

SEQ ID NO: 20539 - DNA, 103 bp, Artificial Sequence
  Synthetic Polynucleotide
taatacgactcactatagggtctgacaaaacaggggcaggttgacttgaaaacagaggagattcaagatgacctgccccaacctggcggcagcgcaaaagatg

SEQ ID NO: 20540 - DNA, 103 bp, Artificial Sequence
  Synthetic Polynucleotide
taatacgactcactataggggcatgtctgacaaaacaggggcaggttgacaacagaggagagtcaacatgcccctgtttaacctggcggcagcgcaaaagatg

SEQ ID NO: 20541 - DNA, 103 bp, Artificial Sequence
  Synthetic Polynucleotide
taatacgactcactatagggcactggcatgtctgacaaaacaggggcaggaacagaggagacctgccatggttttgtcaaacctggcggcagcgcaaaagatg

SEQ ID NO: 20542 - DNA, 103 bp, Artificial Sequence
  Synthetic Polynucleotide
taatacgactcactatagggtctgacactggcatgtctgacaaaacagggaacagaggagaccctgtatggtcagacataacctggcggcagcgcaaaagatg

SEQ ID NO: 20543 - DNA, 103 bp, Artificial Sequence
  Synthetic Polynucleotide
taatacgactcactatagggccaagtctgacactggcatgtctgacaaaaaacagaggagattttgtatgacatgccagaacctggcggcagcgcaaaagatg

SEQ ID NO: 20544 - DNA, 103 bp, Artificial Sequence
  Synthetic Polynucleotide
taatacgactcactatagggccatgccaagtctgacactggcatgtctgaaacagaggagatcagacatgccagtgtcaaacctggcggcagcgcaaaagatg

SEQ ID NO: 20545 - DNA, 103 bp, Artificial Sequence
  Synthetic Polynucleotide
taatacgactcactatagggatggtcatattgagtgtctccatgtttagtaacagaggagaactaaaatgggagacactaacctggcggcagcgcaaaagatg

SEQ ID NO: 20546 - DNA, 103 bp, Artificial Sequence
  Synthetic Polynucleotide
taatacgactcactatagggcgggaccatgccaagtctgacactggcatgaacagaggagacatgccatggtcagacttaacctggcggcagcgcaaaagatg

SEQ ID NO: 20547 - DNA, 103 bp, Artificial Sequence
  Synthetic Polynucleotide
taatacgactcactatagggcagttcgggaccatgccaagtctgacactgaacagaggagacagtgtatgacttggcataacctggcggcagcgcaaaagatg

SEQ ID NO: 20548 - DNA, 103 bp, Artificial Sequence
  Synthetic Polynucleotide
taatacgactcactataggggtaatcagttcgggaccatgccaagtctgaaacagaggagatcagacatggcatggtccaacctggcggcagcgcaaaagatg

SEQ ID NO: 20549 - DNA, 103 bp, Artificial Sequence
  Synthetic Polynucleotide
taatacgactcactataggggctcagtaatcagttcgggaccatgccaagaacagaggagacttggcatggtcccgaacaacctggcggcagcgcaaaagatg

SEQ ID NO: 20550 - DNA, 103 bp, Artificial Sequence
  Synthetic Polynucleotide
taatacgactcactataggggagttgctcagtaatcagttcgggaccatgaacagaggagacatggtatggaactgattaacctggcggcagcgcaaaagatg

SEQ ID NO: 20551 - DNA, 103 bp, Artificial Sequence
  Synthetic Polynucleotide
taatacgactcactatagggatgcagagttgctcagtaatcagttcgggaaacagaggagatcccgaatggattactgaaacctggcggcagcgcaaaagatg

SEQ ID NO: 20552 - DNA, 103 bp, Artificial Sequence
  Synthetic Polynucleotide
taatacgactcactataggggaaaaatgcagagttgctcagtaatcagttaacagaggagaaactgaatgctgagcaacaacctggcggcagcgcaaaagatg

SEQ ID NO: 20553 - DNA, 103 bp, Artificial Sequence
  Synthetic Polynucleotide
taatacgactcactataggggatgtgaaaaatgcagagttgctcagtaataacagaggagaattactatgcaactctgcaacctggcggcagcgcaaaagatg

SEQ ID NO: 20554 - DNA, 103 bp, Artificial Sequence
  Synthetic Polynucleotide
taatacgactcactatagggtttgggatgtgaaaaatgcagagttgctcaaacagaggagatgagcaatgctgcattttaacctggcggcagcgcaaaagatg

SEQ ID NO: 20555 - DNA, 103 bp, Artificial Sequence
  Synthetic Polynucleotide
taatacgactcactataggggagagtttgggatgtgaaaaatgcagagttaacagaggagaaactctatgtttttcacaaacctggcggcagcgcaaaagatg

SEQ ID NO: 20556 - DNA, 103 bp, Artificial Sequence
  Synthetic Polynucleotide
taatacgactcactataggggaggcatggtcatattgagtgtctccatgtaacagaggagaacatggatgcactcaataaacctggcggcagcgcaaaagatg

SEQ ID NO: 20557 - DNA, 103 bp, Artificial Sequence
  Synthetic Polynucleotide
taatacgactcactataggggtggtgagagtttgggatgtgaaaaatgcaaacagaggagatgcattatgcacatcccaaacctggcggcagcgcaaaagatg

SEQ ID NO: 20558 - DNA, 103 bp, Artificial Sequence
  Synthetic Polynucleotide
taatacgactcactatagggatggagtggtgagagtttgggatgtgaaaaaacagaggagattttcaatgcccaaactcaacctggcggcagcgcaaaagatg

SEQ ID NO: 20559 - DNA, 103 bp, Artificial Sequence
  Synthetic Polynucleotide
taatacgactcactataggggagagatggagtggtgagagtttgggatgtaacagaggagaacatccatgactctcaccaacctggcggcagcgcaaaagatg

SEQ ID NO: 20560 - DNA, 103 bp, Artificial Sequence
  Synthetic Polynucleotide
taatacgactcactataggggctgggagagatggagtggtgagagtttggaacagaggagaccaaacatgcaccactccaacctggcggcagcgcaaaagatg

SEQ ID NO: 20561 - DNA, 103 bp, Artificial Sequence
  Synthetic Polynucleotide
taatacgactcactatagggctcgggctgggagagatggagtggtgagagaacagaggagactctcaatgctccatctcaacctggcggcagcgcaaaagatg

SEQ ID NO: 20562 - DNA, 103 bp, Artificial Sequence
  Synthetic Polynucleotide
taatacgactcactatagggaggggctcgggctgggagagatggagtggtaacagaggagaaccactatgtctctcccaaacctggcggcagcgcaaaagatg

SEQ ID NO: 20563 - DNA, 103 bp, Artificial Sequence
  Synthetic Polynucleotide
taatacgactcactatagggaatcaaggggctcgggctgggagagatggaaacagaggagatccatcatgcccagcccgaacctggcggcagcgcaaaagatg

SEQ ID NO: 20564 - DNA, 103 bp, Artificial Sequence
  Synthetic Polynucleotide
taatacgactcactataggggtggtaatcaaggggctcgggctgggagagaacagaggagactctccatgcccgagcccaacctggcggcagcgcaaaagatg

SEQ ID NO: 20565 - DNA, 103 bp, Artificial Sequence
  Synthetic Polynucleotide
taatacgactcactataggggagtggtggtaatcaaggggctcgggctggaacagaggagaccagccatggccccttgaaacctggcggcagcgcaaaagatg

SEQ ID NO: 20566 - DNA, 103 bp, Artificial Sequence
  Synthetic Polynucleotide
taatacgactcactatagggggaatgagtggtggtaatcaaggggctcggaacagaggagaccgagcatgttgattaccaacctggcggcagcgcaaaagatg

SEQ ID NO: 20567 - DNA, 103 bp, Artificial Sequence
  Synthetic Polynucleotide
taatacgactcactatagggggagagaggcatggtcatattgagtgtctcaacagaggagagagacaatgaatatgaccaacctggcggcagcgcaaaagatg

SEQ ID NO: 20568 - DNA, 103 bp, Artificial Sequence
  Synthetic Polynucleotide
taatacgactcactatagggtgataggaatgagtggtggtaatcaaggggaacagaggagaccccttatgtaccaccacaacctggcggcagcgcaaaagatg

SEQ ID NO: 20569 - DNA, 103 bp, Artificial Sequence
  Synthetic Polynucleotide
taatacgactcactataggggaatatgataggaatgagtggtggtaatcaaacagaggagatgattaatgccactcattaacctggcggcagcgcaaaagatg

SEQ ID NO: 20570 - DNA, 103 bp, Artificial Sequence
  Synthetic Polynucleotide
taatacgactcactatagggctcctgaatatgataggaatgagtggtggtaacagaggagaaccaccatgcattcctataacctggcggcagcgcaaaagatg

SEQ ID NO: 20571 - DNA, 103 bp, Artificial Sequence
  Synthetic Polynucleotide
taatacgactcactataggggagctctcctgaatatgataggaatgagtgaacagaggagacactcaatgctatcatataacctggcggcagcgcaaaagatg

SEQ ID NO: 20572 - DNA, 103 bp, Artificial Sequence
  Synthetic Polynucleotide
taatacgactcactatagggaagaagagctctcctgaatatgataggaataacagaggagaattcctatgatattcaggaacctggcggcagcgcaaaagatg

SEQ ID NO: 20573 - DNA, 103 bp, Artificial Sequence
  Synthetic Polynucleotide
taatacgactcactataggggaccaaagaagagctctcctgaatatgataaacagaggagatatcatatgcaggagagcaacctggcggcagcgcaaaagatg

SEQ ID NO: 20574 - DNA, 103 bp, Artificial Sequence
  Synthetic Polynucleotide
taatacgactcactatagggaacttgaccaaagaagagctctcctgaataaacagaggagatattcaatggagctcttcaacctggcggcagcgcaaaagatg

SEQ ID NO: 20575 - DNA, 103 bp, Artificial Sequence
  Synthetic Polynucleotide
taatacgactcactatagggacagcaacttgaccaaagaagagctctcctaacagaggagaaggagaatgcttctttggaacctggcggcagcgcaaaagatg

SEQ ID NO: 20576 - DNA, 103 bp, Artificial Sequence
  Synthetic Polynucleotide
taatacgactcactatagggagctcacagcaacttgaccaaagaagagctaacagaggagaagctctatgttggtcaagaacctggcggcagcgcaaaagatg

SEQ ID NO: 20577 - DNA, 103 bp, Artificial Sequence
  Synthetic Polynucleotide
taatacgactcactatagggacctaagctcacagcaacttgaccaaagaaaacagaggagattctttatgcaagttgctaacctggcggcagcgcaaaagatg

SEQ ID NO: 20578 - DNA, 103 bp, Artificial Sequence
  Synthetic Polynucleotide
taatacgactcactataggggtgcaggagagaggcatggtcatattgagtaacagaggagaactcaaatggaccatgccaacctggcggcagcgcaaaagatg

SEQ ID NO: 20579 - DNA, 103 bp, Artificial Sequence
  Synthetic Polynucleotide
taatacgactcactataggggggcaacctaagctcacagcaacttgaccaaacagaggagatggtcaatgtgctgtgagaacctggcggcagcgcaaaagatg

SEQ ID NO: 20580 - DNA, 103 bp, Artificial Sequence
  Synthetic Polynucleotide
taatacgactcactatagggtatatgggcaacctaagctcacagcaacttaacagaggagaaagttgatgtgagcttagaacctggcggcagcgcaaaagatg

SEQ ID NO: 20581 - DNA, 103 bp, Artificial Sequence
  Synthetic Polynucleotide
taatacgactcactataggggtgtctatatgggcaacctaagctcacagcaacagaggagagctgtgatgttaggttgcaacctggcggcagcgcaaaagatg

SEQ ID NO: 20582 - DNA, 103 bp, Artificial Sequence
  Synthetic Polynucleotide
taatacgactcactatagggtgcaggtgtctatatgggcaacctaagctcaacagaggagagagcttatgttgcccataaacctggcggcagcgcaaaagatg

SEQ ID NO: 20583 - DNA, 103 bp, Artificial Sequence
  Synthetic Polynucleotide
taatacgactcactatagggttaagtgcaggtgtctatatgggcaacctaaacagaggagataggttatgcatatagacaacctggcggcagcgcaaaagatg

SEQ ID NO: 20584 - DNA, 103 bp, Artificial Sequence
  Synthetic Polynucleotide
taatacgactcactatagggggccattaagtgcaggtgtctatatgggcaaacagaggagatgcccaatgagacacctgaacctggcggcagcgcaaaagatg

SEQ ID NO: 20585 - DNA, 103 bp, Artificial Sequence
  Synthetic Polynucleotide
taatacgactcactatagggagaaaggccattaagtgcaggtgtctatataacagaggagaatatagatgcctgcacttaacctggcggcagcgcaaaagatg

SEQ ID NO: 20586 - DNA, 103 bp, Artificial Sequence
  Synthetic Polynucleotide
taatacgactcactatagggagaacagaaaggccattaagtgcaggtgtcaacagaggagagacaccatgacttaatggaacctggcggcagcgcaaaagatg

SEQ ID NO: 20587 - DNA, 103 bp, Artificial Sequence
  Synthetic Polynucleotide
taatacgactcactatagggtgatcagaacagaaaggccattaagtgcagaacagaggagactgcacatgatggcctttaacctggcggcagcgcaaaagatg

SEQ ID NO: 20588 - DNA, 103 bp, Artificial Sequence
  Synthetic Polynucleotide
taatacgactcactatagggaaaggtgatcagaacagaaaggccattaagaacagaggagacttaatatgctttctgttaacctggcggcagcgcaaaagatg

SEQ ID NO: 20589 - DNA, 103 bp, Artificial Sequence
  Synthetic Polynucleotide
taatacgactcactatagggtctttgtgcaggagagaggcatggtcatataacagaggagaatatgaatgtgcctctctaacctggcggcagcgcaaaagatg

SEQ ID NO: 20590 - DNA, 103 bp, Artificial Sequence
  Synthetic Polynucleotide
taatacgactcactatagggaagtcaaaggtgatcagaacagaaaggccaaacagaggagatggcctatgtgttctgataacctggcggcagcgcaaaagatg

SEQ ID NO: 20591 - DNA, 103 bp, Artificial Sequence
  Synthetic Polynucleotide
taatacgactcactatagggagttaaagtcaaaggtgatcagaacagaaaaacagaggagatttctgatgtgatcacctaacctggcggcagcgcaaaagatg

SEQ ID NO: 20592 - DNA, 103 bp, Artificial Sequence
  Synthetic Polynucleotide
taatacgactcactatagggagagaagttaaagtcaaaggtgatcagaacaacagaggagagttctgatgacctttgacaacctggcggcagcgcaaaagatg

SEQ ID NO: 20593 - DNA, 103 bp, Artificial Sequence
  Synthetic Polynucleotide
taatacgactcactataggggatctagagaagttaaagtcaaaggtgatcaacagaggagagatcacatgtgactttaaaacctggcggcagcgcaaaagatg

SEQ ID NO: 20594 - DNA, 103 bp, Artificial Sequence
  Synthetic Polynucleotide
taatacgactcactatagggccgctgatctagagaagttaaagtcaaaggaacagaggagacctttgatgttaacttctaacctggcggcagcgcaaaagatg

SEQ ID NO: 20595 - DNA, 103 bp, Artificial Sequence
  Synthetic Polynucleotide
taatacgactcactatagggcttagccgctgatctagagaagttaaagtcaacagaggagagactttatgttctctagaaacctggcggcagcgcaaaagatg

SEQ ID NO: 20596 - DNA, 103 bp, Artificial Sequence
  Synthetic Polynucleotide
taatacgactcactatagggttaatcttagccgctgatctagagaagttaaacagaggagataacttatgtagatcagcaacctggcggcagcgcaaaagatg

SEQ ID NO: 20597 - DNA, 103 bp, Artificial Sequence
  Synthetic Polynucleotide
taatacgactcactatagggacttattaatcttagccgctgatctagagaaacagaggagatctctaatgcagcggctaaacctggcggcagcgcaaaagatg

SEQ ID NO: 20598 - DNA, 103 bp, Artificial Sequence
  Synthetic Polynucleotide
taatacgactcactatagggagatgacttattaatcttagccgctgatctaacagaggagaagatcaatggctaagattaacctggcggcagcgcaaaagatg

SEQ ID NO: 20599 - DNA, 103 bp, Artificial Sequence
  Synthetic Polynucleotide
taatacgactcactatagggacctcagatgacttattaatcttagccgctaacagaggagaagcggcatggattaataaaacctggcggcagcgcaaaagatg

SEQ ID NO: 20600 - DNA, 103 bp, Artificial Sequence
  Synthetic Polynucleotide
taatacgactcactatagggtttaaataggacacttgaattgcgcaaccaaacagaggagatggttgatgaattcaagtaacctggcggcagcgcaaaagatg

SEQ ID NO: 20601 - DNA, 103 bp, Artificial Sequence
  Synthetic Polynucleotide
taatacgactcactataggggttgttctttgtgcaggagagaggcatggtaacagaggagaaccatgatgctctcctgcaacctggcggcagcgcaaaagatg

SEQ ID NO: 20602 - DNA, 103 bp, Artificial Sequence
  Synthetic Polynucleotide
taatacgactcactatagggctctaacctcagatgacttattaatcttagaacagaggagactaagaatgataagtcataacctggcggcagcgcaaaagatg

SEQ ID NO: 20603 - DNA, 103 bp, Artificial Sequence
  Synthetic Polynucleotide
taatacgactcactatagggtgggactctaacctcagatgacttattaataacagaggagaattaatatgtcatctgagaacctggcggcagcgcaaaagatg

SEQ ID NO: 20604 - DNA, 103 bp, Artificial Sequence
  Synthetic Polynucleotide
taatacgactcactatagggagagttgggactctaacctcagatgacttaaacagaggagataagtcatgtgaggttagaacctggcggcagcgcaaaagatg

SEQ ID NO: 20605 - DNA, 103 bp, Artificial Sequence
  Synthetic Polynucleotide
taatacgactcactatagggtactgagagttgggactctaacctcagatgaacagaggagacatctgatgttagagtccaacctggcggcagcgcaaaagatg

SEQ ID NO: 20606 - DNA, 103 bp, Artificial Sequence
  Synthetic Polynucleotide
taatacgactcactataggggagtatactgagagttgggactctaacctcaacagaggagagaggttatggtcccaactaacctggcggcagcgcaaaagatg

SEQ ID NO: 20607 - DNA, 103 bp, Artificial Sequence
  Synthetic Polynucleotide
taatacgactcactatagggcaaaagagtatactgagagttgggactctaaacagaggagatagagtatgaactctcagaacctggcggcagcgcaaaagatg

SEQ ID NO: 20608 - DNA, 103 bp, Artificial Sequence
  Synthetic Polynucleotide
taatacgactcactatagggctcaacaaaagagtatactgagagttgggaaacagaggagatcccaaatgtcagtatacaacctggcggcagcgcaaaagatg

SEQ ID NO: 20609 - DNA, 103 bp, Artificial Sequence
  Synthetic Polynucleotide
taatacgactcactatagggatcaactcaacaaaagagtatactgagagtaacagaggagaactctcatgatactctttaacctggcggcagcgcaaaagatg

SEQ ID NO: 20610 - DNA, 103 bp, Artificial Sequence
  Synthetic Polynucleotide
taatacgactcactatagggttaaaatcaactcaacaaaagagtatactgaacagaggagacagtatatgcttttgttgaacctggcggcagcgcaaaagatg

SEQ ID NO: 20611 - DNA, 103 bp, Artificial Sequence
  Synthetic Polynucleotide
taatacgactcactatagggttgaattaaaatcaactcaacaaaagagtaaacagaggagatactctatggttgagttgaacctggcggcagcgcaaaagatg

SEQ ID NO: 20612 - DNA, 103 bp, Artificial Sequence
  Synthetic Polynucleotide
taatacgactcactatagggtgactgttgttctttgtgcaggagagaggcaacagaggagagcctctatgctgcacaaaaacctggcggcagcgcaaaagatg

SEQ ID NO: 20613 - DNA, 103 bp, Artificial Sequence
  Synthetic Polynucleotide
taatacgactcactatagggtcttgttgaattaaaatcaactcaacaaaaaacagaggagattttgtatggttgattttaacctggcggcagcgcaaaagatg

SEQ ID NO: 20614 - DNA, 103 bp, Artificial Sequence
  Synthetic Polynucleotide
taatacgactcactatagggaacaatcttgttgaattaaaatcaactcaaaacagaggagattgagtatgttttaattcaacctggcggcagcgcaaaagatg

SEQ ID NO: 20615 - DNA, 103 bp, Artificial Sequence
  Synthetic Polynucleotide
taatacgactcactatagggcggtcaacaatcttgttgaattaaaatcaaaacagaggagattgattatgattcaacaaaacctggcggcagcgcaaaagatg

SEQ ID NO: 20616 - DNA, 103 bp, Artificial Sequence
  Synthetic Polynucleotide
taatacgactcactatagggtcaagcggtcaacaatcttgttgaattaaaaacagaggagatttaatatgacaagattgaacctggcggcagcgcaaaagatg

SEQ ID NO: 20617 - DNA, 103 bp, Artificial Sequence
  Synthetic Polynucleotide
taatacgactcactatagggctaaatcaagcggtcaacaatcttgttgaaaacagaggagattcaacatgattgttgacaacctggcggcagcgcaaaagatg

SEQ ID NO: 20618 - DNA, 103 bp, Artificial Sequence
  Synthetic Polynucleotide
taatacgactcactataggggggacctaaatcaagcggtcaacaatcttgaacagaggagacaagatatgtgaccgcttaacctggcggcagcgcaaaagatg

SEQ ID NO: 20619 - DNA, 103 bp, Artificial Sequence
  Synthetic Polynucleotide
taatacgactcactataggggttgagggacctaaatcaagcggtcaacaaaacagaggagattgttgatggcttgatttaacctggcggcagcgcaaaagatg

SEQ ID NO: 20620 - DNA, 103 bp, Artificial Sequence
  Synthetic Polynucleotide
taatacgactcactatagggaaacggttgagggacctaaatcaagcggtcaacagaggagagaccgcatgatttaggtcaacctggcggcagcgcaaaagatg

SEQ ID NO: 20621 - DNA, 103 bp, Artificial Sequence
  Synthetic Polynucleotide
taatacgactcactatagggatttgaaacggttgagggacctaaatcaagaacagaggagacttgatatgggtccctcaaacctggcggcagcgcaaaagatg

SEQ ID NO: 20622 - DNA, 103 bp, Artificial Sequence
  Synthetic Polynucleotide
taatacgactcactatagggcaatgatttgaaacggttgagggacctaaaaacagaggagatttaggatgctcaaccgtaacctggcggcagcgcaaaagatg

SEQ ID NO: 20623 - DNA, 103 bp, Artificial Sequence
  Synthetic Polynucleotide
taatacgactcactatagggaatgatgactgttgttctttgtgcaggagaaacagaggagatctcctatgcaaagaacaaacctggcggcagcgcaaaagatg

SEQ ID NO: 20624 - DNA, 103 bp, Artificial Sequence
  Synthetic Polynucleotide
taatacgactcactataggggatgacaatgatttgaaacggttgagggacaacagaggagagtccctatgccgtttcaaaacctggcggcagcgcaaaagatg

SEQ ID NO: 20625 - DNA, 103 bp, Artificial Sequence
  Synthetic Polynucleotide
taatacgactcactataggggaagggatgacaatgatttgaaacggttgaaacagaggagatcaaccatgtcaaatcataacctggcggcagcgcaaaagatg

SEQ ID NO: 20626 - DNA, 103 bp, Artificial Sequence
  Synthetic Polynucleotide
taatacgactcactatagggggagagaagggatgacaatgatttgaaacgaacagaggagacgtttcatgtcattgtcaaacctggcggcagcgcaaaagatg

SEQ ID NO: 20627 - DNA, 103 bp, Artificial Sequence
  Synthetic Polynucleotide
taatacgactcactatagggcgcaaggagagaagggatgacaatgatttgaacagaggagacaaatcatggtcatccctaacctggcggcagcgcaaaagatg

SEQ ID NO: 20628 - DNA, 103 bp, Artificial Sequence
  Synthetic Polynucleotide
taatacgactcactatagggtgatgcgcaaggagagaagggatgacaatgaacagaggagacattgtatgcccttctctaacctggcggcagcgcaaaagatg

SEQ ID NO: 20629 - DNA, 103 bp, Artificial Sequence
  Synthetic Polynucleotide
taatacgactcactatagggacggttgatgcgcaaggagagaagggatgaaacagaggagatcatccatgctctccttgaacctggcggcagcgcaaaagatg

SEQ ID NO: 20630 - DNA, 103 bp, Artificial Sequence
  Synthetic Polynucleotide
taatacgactcactataggggttcaacggttgatgcgcaaggagagaaggaacagaggagaccttctatgcttgcgcataacctggcggcagcgcaaaagatg

SEQ ID NO: 20631 - DNA, 103 bp, Artificial Sequence
  Synthetic Polynucleotide
taatacgactcactataggggtaatgttcaacggttgatgcgcaaggagaaacagaggagatctcctatggcatcaaccaacctggcggcagcgcaaaagatg

SEQ ID NO: 20632 - DNA, 103 bp, Artificial Sequence
  Synthetic Polynucleotide
taatacgactcactatagggagtcagtaatgttcaacggttgatgcgcaaaacagaggagattgcgcatgaaccgttgaaacctggcggcagcgcaaaagatg

SEQ ID NO: 20633 - DNA, 103 bp, Artificial Sequence
  Synthetic Polynucleotide
taatacgactcactatagggtccgaagtcagtaatgttcaacggttgatgaacagaggagacatcaaatgttgaacattaacctggcggcagcgcaaaagatg

SEQ ID NO: 20634 - DNA, 103 bp, Artificial Sequence
  Synthetic Polynucleotide
taatacgactcactatagggtatataatgatgactgttgttctttgtgcaaacagaggagatgcacaatgaacaacagtaacctggcggcagcgcaaaagatg

SEQ ID NO: 20635 - DNA, 103 bp, Artificial Sequence
  Synthetic Polynucleotide
taatacgactcactatagggacttctccgaagtcagtaatgttcaacggtaacagaggagaaccgttatgcattactgaaacctggcggcagcgcaaaagatg

SEQ ID NO: 20636 - DNA, 103 bp, Artificial Sequence
  Synthetic Polynucleotide
taatacgactcactatagggacttgacttctccgaagtcagtaatgttcaaacagaggagatgaacaatgctgacttcgaacctggcggcagcgcaaaagatg

SEQ ID NO: 20637 - DNA, 103 bp, Artificial Sequence
  Synthetic Polynucleotide
taatacgactcactatagggcatggacttgacttctccgaagtcagtaataacagaggagaattactatgttcggagaaaacctggcggcagcgcaaaagatg

SEQ ID NO: 20638 - DNA, 103 bp, Artificial Sequence
  Synthetic Polynucleotide
taatacgactcactatagggttttacatggacttgacttctccgaagtcaaacagaggagatgacttatgagaagtcaaaacctggcggcagcgcaaaagatg

SEQ ID NO: 20639 - DNA, 103 bp, Artificial Sequence
  Synthetic Polynucleotide
taatacgactcactatagggggctcttttacatggacttgacttctccgaaacagaggagatcggagatgtcaagtccaaacctggcggcagcgcaaaagatg

SEQ ID NO: 20640 - DNA, 103 bp, Artificial Sequence
  Synthetic Polynucleotide
taatacgactcactataggggcccaggctcttttacatggacttgacttcaacagaggagagaagtcatgtccatgtaaaacctggcggcagcgcaaaagatg

SEQ ID NO: 20641 - DNA, 103 bp, Artificial Sequence
  Synthetic Polynucleotide
taatacgactcactatagggaagatgcccaggctcttttacatggacttgaacagaggagacaagtcatggtaaaagagaacctggcggcagcgcaaaagatg

SEQ ID NO: 20642 - DNA, 103 bp, Artificial Sequence
  Synthetic Polynucleotide
taatacgactcactatagggggtgaaagatgcccaggctcttttacatggaacagaggagaccatgtatgagagcctggaacctggcggcagcgcaaaagatg

SEQ ID NO: 20643 - DNA, 103 bp, Artificial Sequence
  Synthetic Polynucleotide
taatacgactcactatagggcaggtggtgaaagatgcccaggctcttttaaacagaggagataaaagatgctgggcatcaacctggcggcagcgcaaaagatg

SEQ ID NO: 20644 - DNA, 103 bp, Artificial Sequence
  Synthetic Polynucleotide
taatacgactcactatagggaactacaggtggtgaaagatgcccaggctcaacagaggagagagcctatgcatctttcaaacctggcggcagcgcaaaagatg

SEQ ID NO: 20645 - DNA, 103 bp, Artificial Sequence
  Synthetic Polynucleotide
taatacgactcactatagggaccattatataatgatgactgttgttctttaacagaggagaaaagaaatgcagtcatcaaacctggcggcagcgcaaaagatg

SEQ ID NO: 20646 - DNA, 103 bp, Artificial Sequence
  Synthetic Polynucleotide
taatacgactcactatagggcatcaaactacaggtggtgaaagatgcccaaacagaggagatgggcaatgttcaccaccaacctggcggcagcgcaaaagatg

SEQ ID NO: 20647 - DNA, 103 bp, Artificial Sequence
  Synthetic Polynucleotide
taatacgactcactatagggtccaacatcaaactacaggtggtgaaagataacagaggagaatctttatgcacctgtagaacctggcggcagcgcaaaagatg

SEQ ID NO: 20648 - DNA, 103 bp, Artificial Sequence
  Synthetic Polynucleotide
taatacgactcactatagggactgctccaacatcaaactacaggtggtgaaacagaggagatcaccaatggtagtttgaaacctggcggcagcgcaaaagatg

SEQ ID NO: 20649 - DNA, 103 bp, Artificial Sequence
  Synthetic Polynucleotide
taatacgactcactatagggtggttactgctccaacatcaaactacaggtaacagaggagaacctgtatgttgatgttgaacctggcggcagcgcaaaagatg

SEQ ID NO: 20650 - DNA, 103 bp, Artificial Sequence
  Synthetic Polynucleotide
taatacgactcactatagggttatctggttactgctccaacatcaaactaaacagaggagatagtttatggttggagcaaacctggcggcagcgcaaaagatg

SEQ ID NO: 20651 - DNA, 103 bp, Artificial Sequence
  Synthetic Polynucleotide
taatacgactcactataggggggaattatctggttactgctccaacatcaaacagaggagatgatgtatgagcagtaacaacctggcggcagcgcaaaagatg

SEQ ID NO: 20652 - DNA, 103 bp, Artificial Sequence
  Synthetic Polynucleotide
taatacgactcactataggggaggagggaattatctggttactgctccaaaacagaggagattggagatgtaaccagataacctggcggcagcgcaaaagatg

SEQ ID NO: 20653 - DNA, 103 bp, Artificial Sequence
  Synthetic Polynucleotide
taatacgactcactatagggtctttgaggagggaattatctggttactgcaacagaggagagcagtaatgagataattcaacctggcggcagcgcaaaagatg

SEQ ID NO: 20654 - DNA, 103 bp, Artificial Sequence
  Synthetic Polynucleotide
taatacgactcactatagggcacaatctttgaggagggaattatctggttaacagaggagaaaccagatgattccctccaacctggcggcagcgcaaaagatg

SEQ ID NO: 20655 - DNA, 103 bp, Artificial Sequence
  Synthetic Polynucleotide
taatacgactcactataggggtggacacaatctttgaggagggaattatcaacagaggagagataatatgctcctcaaaaacctggcggcagcgcaaaagatg

SEQ ID NO: 20656 - DNA, 103 bp, Artificial Sequence
  Synthetic Polynucleotide
taatacgactcactatagggtgcccaccattatataatgatgactgttgtaacagaggagaacaacaatgatcattataaacctggcggcagcgcaaaagatg

SEQ ID NO: 20657 - DNA, 103 bp, Artificial Sequence
  Synthetic Polynucleotide
taatacgactcactatagggtttttgtggacacaatctttgaggagggaaaacagaggagattccctatgcaaagattgaacctggcggcagcgcaaaagatg

SEQ ID NO: 20658 - DNA, 103 bp, Artificial Sequence
  Synthetic Polynucleotide
taatacgactcactatagggaatcctttttgtggacacaatctttgaggaaacagaggagatcctcaatgattgtgtccaacctggcggcagcgcaaaagatg

SEQ ID NO: 20659 - DNA, 103 bp, Artificial Sequence
  Synthetic Polynucleotide
taatacgactcactatagggaataaaatcctttttgtggacacaatctttaacagaggagaaaagatatggtccacaaaaacctggcggcagcgcaaaagatg

SEQ ID NO: 20660 - DNA, 103 bp, Artificial Sequence
  Synthetic Polynucleotide
taatacgactcactatagggaaggaaataaaatcctttttgtggacacaaaacagaggagattgtgtatgcaaaaaggaaacctggcggcagcgcaaaagatg

SEQ ID NO: 20661 - DNA, 103 bp, Artificial Sequence
  Synthetic Polynucleotide
taatacgactcactatagggcctcaaaggaaataaaatcctttttgtggaaacagaggagatccacaatgaggattttaaacctggcggcagcgcaaaagatg

SEQ ID NO: 20662 - DNA, 103 bp, Artificial Sequence
  Synthetic Polynucleotide
taatacgactcactataggggagtgcctcaaaggaaataaaatcctttttaacagaggagaaaaaagatgtttatttccaacctggcggcagcgcaaaagatg

SEQ ID NO: 20663 - DNA, 103 bp, Artificial Sequence
  Synthetic Polynucleotide
taatacgactcactataggggcgatgagtgcctcaaaggaaataaaatccaacagaggagaggatttatgttcctttgaaacctggcggcagcgcaaaagatg

SEQ ID NO: 20664 - DNA, 103 bp, Artificial Sequence
  Synthetic Polynucleotide
taatacgactcactatagggatctggcgatgagtgcctcaaaggaaataaaacagaggagattatttatgttgaggcacaacctggcggcagcgcaaaagatg

SEQ ID NO: 20665 - DNA, 103 bp, Artificial Sequence
  Synthetic Polynucleotide
taatacgactcactatagggcaacaatctggcgatgagtgcctcaaaggaaacagaggagatcctttatggcactcatcaacctggcggcagcgcaaaagatg

SEQ ID NO: 20666 - DNA, 103 bp, Artificial Sequence
  Synthetic Polynucleotide
taatacgactcactatagggcaacacaacaatctggcgatgagtgcctcaaacagaggagatgaggcatgcatcgccagaacctggcggcagcgcaaaagatg

SEQ ID NO: 20667 - DNA, 103 bp, Artificial Sequence
  Synthetic Polynucleotide
taatacgactcactatagggctcattgcccaccattatataatgatgactaacagaggagaagtcatatgtatataatgaacctggcggcagcgcaaaagatg

SEQ ID NO: 20668 - DNA, 103 bp, Artificial Sequence
  Synthetic Polynucleotide
taatacgactcactataggggcatacaacacaacaatctggcgatgagtgaacagaggagacactcaatgccagattgtaacctggcggcagcgcaaaagatg

SEQ ID NO: 20669 - DNA, 103 bp, Artificial Sequence
  Synthetic Polynucleotide
taatacgactcactatagggtgtgtgcatacaacacaacaatctggcgataacagaggagaatcgccatgttgttgtgtaacctggcggcagcgcaaaagatg

SEQ ID NO: 20670 - DNA, 103 bp, Artificial Sequence
  Synthetic Polynucleotide
taatacgactcactatagggtttgttgtgtgcatacaacacaacaatctgaacagaggagacagattatggtgttgtataacctggcggcagcgcaaaagatg

SEQ ID NO: 20671 - DNA, 103 bp, Artificial Sequence
  Synthetic Polynucleotide
taatacgactcactatagggagttctttgttgtgtgcatacaacacaacaaacagaggagatgttgtatggtatgcacaaacctggcggcagcgcaaaagatg

SEQ ID NO: 20672 - DNA, 103 bp, Artificial Sequence
  Synthetic Polynucleotide
taatacgactcactataggggtctcagttctttgttgtgtgcatacaacaaacagaggagatgttgtatgcacacaacaaacctggcggcagcgcaaaagatg

SEQ ID NO: 20673 - DNA, 103 bp, Artificial Sequence
  Synthetic Polynucleotide
taatacgactcactatagggagatagtctcagttctttgttgtgtgcataaacagaggagatatgcaatgaacaaagaaaacctggcggcagcgcaaaagatg

SEQ ID NO: 20674 - DNA, 103 bp, Artificial Sequence
  Synthetic Polynucleotide
taatacgactcactatagggttggcagatagtctcagttctttgttgtgtaacagaggagaacacaaatgagaactgagaacctggcggcagcgcaaaagatg

SEQ ID NO: 20675 - DNA, 103 bp, Artificial Sequence
  Synthetic Polynucleotide
taatacgactcactatagggtcattttggcagatagtctcagttctttgtaacagaggagaacaaagatgtgagactataacctggcggcagcgcaaaagatg

SEQ ID NO: 20676 - DNA, 103 bp, Artificial Sequence
  Synthetic Polynucleotide
taatacgactcactatagggttttgtcattttggcagatagtctcagttcaacagaggagagaactgatgctatctgccaacctggcggcagcgcaaaagatg

SEQ ID NO: 20677 - DNA, 103 bp, Artificial Sequence
  Synthetic Polynucleotide
taatacgactcactatagggtttgcttttgtcattttggcagatagtctcaacagaggagagagactatgtgccaaaataacctggcggcagcgcaaaagatg

SEQ ID NO: 20678 - DNA, 103 bp, Artificial Sequence
  Synthetic Polynucleotide
taatacgactcactatagggcctgtctcattgcccaccattatataatgaaacagaggagatcattaatgaatggtgggaacctggcggcagcgcaaaagatg

SEQ ID NO: 20679 - DNA, 103 bp, Artificial Sequence
  Synthetic Polynucleotide
taatacgactcactatagggtgcgctttgcttttgtcattttggcagataaacagaggagatatctgatgaaatgacaaaacctggcggcagcgcaaaagatg

SEQ ID NO: 20680 - DNA, 103 bp, Artificial Sequence
  Synthetic Polynucleotide
taatacgactcactatagggtggattgcgctttgcttttgtcattttggcaacagaggagagccaaaatgacaaaagcaaacctggcggcagcgcaaaagatg

SEQ ID NO: 20681 - DNA, 103 bp, Artificial Sequence
  Synthetic Polynucleotide
taatacgactcactataggggctattggattgcgctttgcttttgtcattaacagaggagaaatgacatgagcaaagcgaacctggcggcagcgcaaaagatg

SEQ ID NO: 20682 - DNA, 103 bp, Artificial Sequence
  Synthetic Polynucleotide
taatacgactcactatagggcctaggctattggattgcgctttgcttttgaacagaggagacaaaagatgagcgcaatcaacctggcggcagcgcaaaagatg

SEQ ID NO: 20683 - DNA, 103 bp, Artificial Sequence
  Synthetic Polynucleotide
taatacgactcactatagggtggatcctaggctattggattgcgctttgcaacagaggagagcaaagatgaatccaataaacctggcggcagcgcaaaagatg

SEQ ID NO: 20684 - DNA, 103 bp, Artificial Sequence
  Synthetic Polynucleotide
taatacgactcactatagggcacagtggatcctaggctattggattgcgcaacagaggagagcgcaaatgaatagcctaaacctggcggcagcgcaaaagatg

SEQ ID NO: 20685 - DNA, 103 bp, Artificial Sequence
  Synthetic Polynucleotide
taatacgactcactatagggctagtcctgtctcattgcccaccattatataacagaggagaatataaatgtgggcaatgaacctggcggcagcgcaaaagatg

SEQ ID NO: 20686 - DNA, 103 bp, Artificial Sequence
  Synthetic Polynucleotide
taatacgactcactatagggcagttctagtcctgtctcattgcccaccataacagaggagaatggtgatgaatgagacaaacctggcggcagcgcaaaagatg

SEQ ID NO: 20687 - DNA, 103 bp, Artificial Sequence
  Synthetic Polynucleotide
taatacgactcactatagggcccattttaaataggacacttgaattgcgcaacagaggagagcgcaaatgaagtgtcctaacctggcggcagcgcaaaagatg

SEQ ID NO: 20688 - DNA, 103 bp, Artificial Sequence
  Synthetic Polynucleotide
taatacgactcactatagggaaggtcagttctagtcctgtctcattgcccaacagaggagagggcaaatggacaggactaacctggcggcagcgcaaaagatg

SEQ ID NO: 20689 - DNA, 103 bp, Artificial Sequence
  Synthetic Polynucleotide
taatacgactcactatagggtggtcaaggtcagttctagtcctgtctcataacagaggagaatgagaatggactagaacaacctggcggcagcgcaaaagatg

SEQ ID NO: 20690 - DNA, 103 bp, Artificial Sequence
  Synthetic Polynucleotide
taatacgactcactatagggcgtgttggtcaaggtcagttctagtcctgtaacagaggagaacaggaatggaactgaccaacctggcggcagcgcaaaagatg

SEQ ID NO: 20691 - DNA, 103 bp, Artificial Sequence
  Synthetic Polynucleotide
taatacgactcactatagggatgctcgtgttggtcaaggtcagttctagtaacagaggagaactagaatggaccttgacaacctggcggcagcgcaaaagatg

SEQ ID NO: 20692 - DNA, 103 bp, Artificial Sequence
  Synthetic Polynucleotide
taatacgactcactatagggtaataatgctcgtgttggtcaaggtcagttaacagaggagaaactgaatgtgaccaacaaacctggcggcagcgcaaaagatg

SEQ ID NO: 20693 - DNA, 103 bp, Artificial Sequence
  Synthetic Polynucleotide
taatacgactcactataggggtgattaataatgctcgtgttggtcaaggtaacagaggagaaccttgatgaacacgagcaacctggcggcagcgcaaaagatg

SEQ ID NO: 20694 - DNA, 103 bp, Artificial Sequence
  Synthetic Polynucleotide
taatacgactcactatagggaatttgtgattaataatgctcgtgttggtcaacagaggagagaccaaatggagcattataacctggcggcagcgcaaaagatg

SEQ ID NO: 20695 - DNA, 103 bp, Artificial Sequence
  Synthetic Polynucleotide
taatacgactcactatagggtgcaaaatttgtgattaataatgctcgtgtaacagaggagaacacgaatgttattaatcaacctggcggcagcgcaaaagatg

SEQ ID NO: 20696 - DNA, 103 bp, Artificial Sequence
  Synthetic Polynucleotide
taatacgactcactatagggcagattgcaaaatttgtgattaataatgctaacagaggagaagcattatgaatcacaaaaacctggcggcagcgcaaaagatg

SEQ ID NO: 20697 - DNA, 103 bp, Artificial Sequence
  Synthetic Polynucleotide
taatacgactcactatagggtcagacagattgcaaaatttgtgattaataaacagaggagatattaaatgcaaattttgaacctggcggcagcgcaaaagatg

SEQ ID NO: 20698 - DNA, 103 bp, Artificial Sequence
  Synthetic Polynucleotide
taatacgactcactatagggtttgtcccattttaaataggacacttgaataacagaggagaattcaaatgtcctatttaaacctggcggcagcgcaaaagatg

SEQ ID NO: 20699 - DNA, 103 bp, Artificial Sequence
  Synthetic Polynucleotide
taatacgactcactataggggggcatcagacagattgcaaaatttgtgataacagaggagaatcacaatgtttgcaatcaacctggcggcagcgcaaaagatg

SEQ ID NO: 20700 - DNA, 103 bp, Artificial Sequence
  Synthetic Polynucleotide
taatacgactcactatagggtttgtgggcatcagacagattgcaaaatttaacagaggagaaaatttatgaatctgtctaacctggcggcagcgcaaaagatg

SEQ ID NO: 20701 - DNA, 103 bp, Artificial Sequence
  Synthetic Polynucleotide
taatacgactcactatagggttctttttgtgggcatcagacagattgcaaaacagaggagattgcaaatggtctgatgcaacctggcggcagcgcaaaagatg

SEQ ID NO: 20702 - DNA, 103 bp, Artificial Sequence
  Synthetic Polynucleotide
taatacgactcactatagggagaggttctttttgtgggcatcagacagataacagaggagaatctgtatgatgcccacaaacctggcggcagcgcaaaagatg

SEQ ID NO: 20703 - DNA, 103 bp, Artificial Sequence
  Synthetic Polynucleotide
taatacgactcactataggggtcatagaggttctttttgtgggcatcagaaacagaggagatctgatatgcacaaaaagaacctggcggcagcgcaaaagatg

SEQ ID NO: 20704 - DNA, 103 bp, Artificial Sequence
  Synthetic Polynucleotide
taatacgactcactataggggcgtggtcatagaggttctttttgtgggcaaacagaggagatgcccaatgaaagaacctaacctggcggcagcgcaaaagatg

SEQ ID NO: 20705 - DNA, 103 bp, Artificial Sequence
  Synthetic Polynucleotide
taatacgactcactatagggtaagagcgtggtcatagaggttctttttgtaacagaggagaacaaaaatgacctctatgaacctggcggcagcgcaaaagatg

SEQ ID NO: 20706 - DNA, 103 bp, Artificial Sequence
  Synthetic Polynucleotide
taatacgactcactataggggctcataagagcgtggtcatagaggttcttaacagaggagaaagaacatgtatgaccacaacctggcggcagcgcaaaagatg

SEQ ID NO: 20707 - DNA, 103 bp, Artificial Sequence
  Synthetic Polynucleotide
taatacgactcactatagggattatgctcataagagcgtggtcatagaggaacagaggagacctctaatgccacgctctaacctggcggcagcgcaaaagatg

SEQ ID NO: 20708 - DNA, 103 bp, Artificial Sequence
  Synthetic Polynucleotide
taatacgactcactatagggttgagattatgctcataagagcgtggtcataacagaggagaatgaccatgctcttatgaaacctggcggcagcgcaaaagatg

SEQ ID NO: 20709 - DNA, 103 bp, Artificial Sequence
  Synthetic Polynucleotide
taatacgactcactatagggcactatttgtcccattttaaataggacactaacagaggagaagtgtcatgtttaaaatgaacctggcggcagcgcaaaagatg

SEQ ID NO: 20710 - DNA, 103 bp, Artificial Sequence
  Synthetic Polynucleotide
taatacgactcactataggggaaagttgagattatgctcataagagcgtgaacagaggagacacgctatgatgagcataaacctggcggcagcgcaaaagatg

SEQ ID NO: 20711 - DNA, 103 bp, Artificial Sequence
  Synthetic Polynucleotide
taatacgactcactatagggaagtggaaagttgagattatgctcataagaaacagaggagatcttatatgcataatctcaacctggcggcagcgcaaaagatg

SEQ ID NO: 20712 - DNA, 103 bp, Artificial Sequence
  Synthetic Polynucleotide
taatacgactcactatagggtggacaagtggaaagttgagattatgctcaaacagaggagatgagcaatgtctcaacttaacctggcggcagcgcaaaagatg

SEQ ID NO: 20713 - DNA, 103 bp, Artificial Sequence
  Synthetic Polynucleotide
taatacgactcactatagggggggatggacaagtggaaagttgagattataacagaggagaataatcatgactttccacaacctggcggcagcgcaaaagatg

SEQ ID NO: 20714 - DNA, 103 bp, Artificial Sequence
  Synthetic Polynucleotide
taatacgactcactatagggaagttggggatggacaagtggaaagttgagaacagaggagactcaacatgccacttgtcaacctggcggcagcgcaaaagatg

SEQ ID NO: 20715 - DNA, 103 bp, Artificial Sequence
  Synthetic Polynucleotide
taatacgactcactataggggattgaagttggggatggacaagtggaaagaacagaggagactttccatgtgtccatccaacctggcggcagcgcaaaagatg

SEQ ID NO: 20716 - DNA, 103 bp, Artificial Sequence
  Synthetic Polynucleotide
taatacgactcactatagggatactgattgaagttggggatggacaagtgaacagaggagacacttgatgatccccaacaacctggcggcagcgcaaaagatg

SEQ ID NO: 20717 - DNA, 103 bp, Artificial Sequence
  Synthetic Polynucleotide
taatacgactcactataggggcctcatactgattgaagttggggatggacaacagaggagagtccatatgcaacttcaaaacctggcggcagcgcaaaagatg

SEQ ID NO: 20718 - DNA, 103 bp, Artificial Sequence
  Synthetic Polynucleotide
taatacgactcactatagggtcattgcctcatactgattgaagttggggaaacagaggagatccccaatgtcaatcagtaacctggcggcagcgcaaaagatg

SEQ ID NO: 20719 - DNA, 103 bp, Artificial Sequence
  Synthetic Polynucleotide
taatacgactcactataggggcagctcattgcctcatactgattgaagttaacagaggagaaacttcatgcagtatgagaacctggcggcagcgcaaaagatg

SEQ ID NO: 20720 - DNA, 103 bp, Artificial Sequence
  Synthetic Polynucleotide
taatacgactcactatagggaacagttcgtaaggctgttggttaaaattcaacagaggagagaatttatgccaacagccaacctggcggcagcgcaaaagatg

SEQ ID NO: 20721 - DNA, 103 bp, Artificial Sequence
  Synthetic Polynucleotide
taatacgactcactatagggtgagagagctgtaaccaccgtttagatgagaacagaggagactcatcatgacggtggttaacctggcggcagcgcaaaagatg

SEQ ID NO: 20722 - DNA, 103 bp, Artificial Sequence
  Synthetic Polynucleotide
taatacgactcactataggggctttcttactcctttgctttatgcgccagaacagaggagactggcgatgaaagcaaagaacctggcggcagcgcaaaagatg

SEQ ID NO: 20723 - DNA, 103 bp, Artificial Sequence
  Synthetic Polynucleotide
taatacgactcactatagggcatggagctaccccataactcttctggtttaacagaggagaaaaccaatggagttatggaacctggcggcagcgcaaaagatg

SEQ ID NO: 20724 - DNA, 103 bp, Artificial Sequence
  Synthetic Polynucleotide
taatacgactcactatagggaaacgcatggagctaccccataactcttctaacagaggagaagaagaatgatggggtagaacctggcggcagcgcaaaagatg

SEQ ID NO: 20725 - DNA, 103 bp, Artificial Sequence
  Synthetic Polynucleotide
taatacgactcactatagggaacataaacgcatggagctaccccataactaacagaggagaagttatatggtagctccaaacctggcggcagcgcaaaagatg

SEQ ID NO: 20726 - DNA, 103 bp, Artificial Sequence
  Synthetic Polynucleotide
taatacgactcactatagggtattgaacataaacgcatggagctaccccaaacagaggagatggggtatgtccatgcgtaacctggcggcagcgcaaaagatg

SEQ ID NO: 20727 - DNA, 103 bp, Artificial Sequence
  Synthetic Polynucleotide
taatacgactcactatagggccgtctattgaacataaacgcatggagctaaacagaggagatagctcatggcgtttatgaacctggcggcagcgcaaaagatg

SEQ ID NO: 20728 - DNA, 103 bp, Artificial Sequence
  Synthetic Polynucleotide
taatacgactcactatagggggtatccgtctattgaacataaacgcatggaacagaggagaccatgcatgtatgttcaaaacctggcggcagcgcaaaagatg

SEQ ID NO: 20729 - DNA, 103 bp, Artificial Sequence
  Synthetic Polynucleotide
taatacgactcactataggggggtaggtatccgtctattgaacataaacgaacagaggagacgtttaatgtcaatagacaacctggcggcagcgcaaaagatg

SEQ ID NO: 20730 - DNA, 103 bp, Artificial Sequence
  Synthetic Polynucleotide
taatacgactcactataggggcgtagggtaggtatccgtctattgaacataacagaggagaatgttcatgagacggataaacctggcggcagcgcaaaagatg

SEQ ID NO: 20731 - DNA, 103 bp, Artificial Sequence
  Synthetic Polynucleotide
taatacgactcactatagggcatccgcgtagggtaggtatccgtctattgaacagaggagacaatagatggatacctacaacctggcggcagcgcaaaagatg

SEQ ID NO: 20732 - DNA, 103 bp, Artificial Sequence
  Synthetic Polynucleotide
taatacgactcactatagggacaagcatccgcgtagggtaggtatccgtcaacagaggagagacggaatgctaccctacaacctggcggcagcgcaaaagatg

SEQ ID NO: 20733 - DNA, 103 bp, Artificial Sequence
  Synthetic Polynucleotide
taatacgactcactatagggttgccgctttcttactcctttgctttatgcaacagaggagagcataaatgaaaggagtaaacctggcggcagcgcaaaagatg

SEQ ID NO: 20734 - DNA, 103 bp, Artificial Sequence
  Synthetic Polynucleotide
taatacgactcactatagggaattgacaagcatccgcgtagggtaggtataacagaggagaatacctatgctacgcggaaacctggcggcagcgcaaaagatg

SEQ ID NO: 20735 - DNA, 103 bp, Artificial Sequence
  Synthetic Polynucleotide
taatacgactcactatagggatgccaattgacaagcatccgcgtagggtaaacagaggagataccctatgcggatgcttaacctggcggcagcgcaaaagatg

SEQ ID NO: 20736 - DNA, 103 bp, Artificial Sequence
  Synthetic Polynucleotide
taatacgactcactataggggcgacatgccaattgacaagcatccgcgtaaacagaggagatacgcgatggcttgtcaaaacctggcggcagcgcaaaagatg

SEQ ID NO: 20737 - DNA, 103 bp, Artificial Sequence
  Synthetic Polynucleotide
taatacgactcactatagggggtatgcgacatgccaattgacaagcatccaacagaggagaggatgcatgtcaattggcaacctggcggcagcgcaaaagatg

SEQ ID NO: 20738 - DNA, 103 bp, Artificial Sequence
  Synthetic Polynucleotide
taatacgactcactatagggcgtaaggtatgcgacatgccaattgacaagaacagaggagacttgtcatgtggcatgtcaacctggcggcagcgcaaaagatg

SEQ ID NO: 20739 - DNA, 103 bp, Artificial Sequence
  Synthetic Polynucleotide
taatacgactcactatagggtccatcgtaaggtatgcgacatgccaattgaacagaggagacaattgatgtgtcgcataaacctggcggcagcgcaaaagatg

SEQ ID NO: 20740 - DNA, 103 bp, Artificial Sequence
  Synthetic Polynucleotide
taatacgactcactatagggctcactccatcgtaaggtatgcgacatgccaacagaggagaggcatgatgcataccttaaacctggcggcagcgcaaaagatg

SEQ ID NO: 20741 - DNA, 103 bp, Artificial Sequence
  Synthetic Polynucleotide
taatacgactcactatagggctatcctcactccatcgtaaggtatgcgacaacagaggagagtcgcaatgcttacgatgaacctggcggcagcgcaaaagatg

SEQ ID NO: 20742 - DNA, 103 bp, Artificial Sequence
  Synthetic Polynucleotide
taatacgactcactatagggtacaactatcctcactccatcgtaaggtataacagaggagaatacctatggatggagtgaacctggcggcagcgcaaaagatg

SEQ ID NO: 20743 - DNA, 103 bp, Artificial Sequence
  Synthetic Polynucleotide
taatacgactcactatagggtggtctacaactatcctcactccatcgtaaaacagaggagattacgaatgagtgaggataacctggcggcagcgcaaaagatg

SEQ ID NO: 20744 - DNA, 103 bp, Artificial Sequence
  Synthetic Polynucleotide
taatacgactcactatagggaattcttgccgctttcttactcctttgcttaacagaggagaaagcaaatgagtaagaaaaacctggcggcagcgcaaaagatg

SEQ ID NO: 20745 - DNA, 103 bp, Artificial Sequence
  Synthetic Polynucleotide
taatacgactcactatagggcgttatggtctacaactatcctcactccataacagaggagaatggagatgggatagttgaacctggcggcagcgcaaaagatg

SEQ ID NO: 20746 - DNA, 103 bp, Artificial Sequence
  Synthetic Polynucleotide
taatacgactcactataggggtaaacgttatggtctacaactatcctcacaacagaggagagtgaggatggttgtagacaacctggcggcagcgcaaaagatg

SEQ ID NO: 20747 - DNA, 103 bp, Artificial Sequence
  Synthetic Polynucleotide
taatacgactcactatagggcaagtgtaaacgttatggtctacaactatcaacagaggagagatagtatgagaccataaaacctggcggcagcgcaaaagatg

SEQ ID NO: 20748 - DNA, 103 bp, Artificial Sequence
  Synthetic Polynucleotide
taatacgactcactatagggtcaatcaagtgtaaacgttatggtctacaaaacagaggagattgtagatgataacgtttaacctggcggcagcgcaaaagatg

SEQ ID NO: 20749 - DNA, 103 bp, Artificial Sequence
  Synthetic Polynucleotide
taatacgactcactataggggcgggtcaatcaagtgtaaacgttatggtcaacagaggagagaccatatggtttacactaacctggcggcagcgcaaaagatg

SEQ ID NO: 20750 - DNA, 103 bp, Artificial Sequence
  Synthetic Polynucleotide
taatacgactcactatagggctagcgcgggtcaatcaagtgtaaacgttaaacagaggagataacgtatgcacttgattaacctggcggcagcgcaaaagatg

SEQ ID NO: 20751 - DNA, 103 bp, Artificial Sequence
  Synthetic Polynucleotide
taatacgactcactatagggaccgcctagcgcgggtcaatcaagtgtaaaaacagaggagatttacaatggattgacccaacctggcggcagcgcaaaagatg

SEQ ID NO: 20752 - DNA, 103 bp, Artificial Sequence
  Synthetic Polynucleotide
taatacgactcactatagggtaggtaccgcctagcgcgggtcaatcaagtaacagaggagaacttgaatgacccgcgctaacctggcggcagcgcaaaagatg

SEQ ID NO: 20753 - DNA, 103 bp, Artificial Sequence
  Synthetic Polynucleotide
taatacgactcactatagggattactaggtaccgcctagcgcgggtcaataacagaggagaattgacatgcgctaggcgaacctggcggcagcgcaaaagatg

SEQ ID NO: 20754 - DNA, 103 bp, Artificial Sequence
  Synthetic Polynucleotide
taatacgactcactatagggcgcacattactaggtaccgcctagcgcgggaacagaggagacccgcgatgggcggtaccaacctggcggcagcgcaaaagatg

SEQ ID NO: 20755 - DNA, 103 bp, Artificial Sequence
  Synthetic Polynucleotide
taatacgactcactatagggcttgtaattcttgccgctttcttactccttaacagaggagaaaggagatggaaagcggcaacctggcggcagcgcaaaagatg

SEQ ID NO: 20756 - DNA, 103 bp, Artificial Sequence
  Synthetic Polynucleotide
taatacgactcactatagggcccttcgcacattactaggtaccgcctagcaacagaggagagctaggatgtacctagtaaacctggcggcagcgcaaaagatg

SEQ ID NO: 20757 - DNA, 103 bp, Artificial Sequence
  Synthetic Polynucleotide
taatacgactcactatagggatgcgcccttcgcacattactaggtaccgcaacagaggagagcggtaatgagtaatgtgaacctggcggcagcgcaaaagatg

SEQ ID NO: 20758 - DNA, 103 bp, Artificial Sequence
  Synthetic Polynucleotide
taatacgactcactatagggtcgcaatgcgcccttcgcacattactaggtaacagaggagaacctagatgtgtgcgaagaacctggcggcagcgcaaaagatg

SEQ ID NO: 20759 - DNA, 103 bp, Artificial Sequence
  Synthetic Polynucleotide
taatacgactcactatagggtcgactcgcaatgcgcccttcgcacattacaacagaggagagtaatgatggaagggcgcaacctggcggcagcgcaaaagatg

SEQ ID NO: 20760 - DNA, 103 bp, Artificial Sequence
  Synthetic Polynucleotide
taatacgactcactataggggagttcttgtaattcttgccgctttcttacaacagaggagagtaagaatgcggcaagaaaacctggcggcagcgcaaaagatg

SEQ ID NO: 20761 - DNA, 103 bp, Artificial Sequence
  Synthetic Polynucleotide
taatacgactcactatagggtgcatgagttcttgtaattcttgccgctttaacagaggagaaaagcgatgagaattacaaacctggcggcagcgcaaaagatg

SEQ ID NO: 20762 - DNA, 103 bp, Artificial Sequence
  Synthetic Polynucleotide
taatacgactcactatagggaagcctgcatgagttcttgtaattcttgccaacagaggagaggcaagatgtacaagaacaacctggcggcagcgcaaaagatg

SEQ ID NO: 20763 - DNA, 103 bp, Artificial Sequence
  Synthetic Polynucleotide
taatacgactcactatagggccatcaagcctgcatgagttcttgtaattcaacagaggagagaattaatggaactcatgaacctggcggcagcgcaaaagatg

SEQ ID NO: 20764 - DNA, 103 bp, Artificial Sequence
  Synthetic Polynucleotide
taatacgactcactatagggagatgccatcaagcctgcatgagttcttgtaacagaggagaacaagaatgcatgcaggcaacctggcggcagcgcaaaagatg

SEQ ID NO: 20765 - DNA, 103 bp, Artificial Sequence
  Synthetic Polynucleotide
taatacgactcactatagggtaaaaagatgccatcaagcctgcatgagttaacagaggagaaactcaatgaggcttgataacctggcggcagcgcaaaagatg

SEQ ID NO: 20766 - DNA, 103 bp, Artificial Sequence
  Synthetic Polynucleotide
taatacgactcactatagggcgacctgagagagctgtaaccaccgtttagaacagaggagactaaacatgggttacagcaacctggcggcagcgcaaaagatg

SEQ ID NO: 20767 - DNA, 103 bp, Artificial Sequence
  Synthetic Polynucleotide
taatacgactcactatagggcgtagtaaaaagatgccatcaagcctgcataacagaggagaatgcagatgtgatggcataacctggcggcagcgcaaaagatg

SEQ ID NO: 20768 - DNA, 103 bp, Artificial Sequence
  Synthetic Polynucleotide
taatacgactcactataggggtctgcgtagtaaaaagatgccatcaagccaacagaggagaggcttgatggcatcttttaacctggcggcagcgcaaaagatg

SEQ ID NO: 20769 - DNA, 103 bp, Artificial Sequence
  Synthetic Polynucleotide
taatacgactcactatagggaagttgtctgcgtagtaaaaagatgccatcaacagaggagagatggcatgtttttactaaacctggcggcagcgcaaaagatg

SEQ ID NO: 20770 - DNA, 103 bp, Artificial Sequence
  Synthetic Polynucleotide
taatacgactcactataggggtttaaagttgtctgcgtagtaaaaagatgaacagaggagacatcttatgactacgcagaacctggcggcagcgcaaaagatg

SEQ ID NO: 20771 - DNA, 103 bp, Artificial Sequence
  Synthetic Polynucleotide
taatacgactcactatagggctcttgtttaaagttgtctgcgtagtaaaaaacagaggagattttacatggcagacaacaacctggcggcagcgcaaaagatg

SEQ ID NO: 20772 - DNA, 103 bp, Artificial Sequence
  Synthetic Polynucleotide
taatacgactcactatagggaaaatctcttgtttaaagttgtctgcgtagaacagaggagactacgcatgcaactttaaaacctggcggcagcgcaaaagatg

SEQ ID NO: 20773 - DNA, 103 bp, Artificial Sequence
  Synthetic Polynucleotide
taatacgactcactatagggatttcaaaatctcttgtttaaagttgtctgaacagaggagacagacaatgttaaacaagaacctggcggcagcgcaaaagatg

SEQ ID NO: 20774 - DNA, 103 bp, Artificial Sequence
  Synthetic Polynucleotide
taatacgactcactataggggtgatatttcaaaatctcttgtttaaagttaacagaggagaaactttatgcaagagattaacctggcggcagcgcaaaagatg

SEQ ID NO: 20775 - DNA, 103 bp, Artificial Sequence
  Synthetic Polynucleotide
taatacgactcactatagggctcgagtgatatttcaaaatctcttgtttaaacagaggagataaacaatggattttgaaaacctggcggcagcgcaaaagatg

SEQ ID NO: 20776 - DNA, 103 bp, Artificial Sequence
  Synthetic Polynucleotide
taatacgactcactatagggcatgtctcgagtgatatttcaaaatctcttaacagaggagaaagagaatgtgaaatatcaacctggcggcagcgcaaaagatg

SEQ ID NO: 20777 - DNA, 103 bp, Artificial Sequence
  Synthetic Polynucleotide
taatacgactcactatagggtcactcgacctgagagagctgtaaccaccgaacagaggagacggtggatgcagctctctaacctggcggcagcgcaaaagatg

SEQ ID NO: 20778 - DNA, 103 bp, Artificial Sequence
  Synthetic Polynucleotide
taatacgactcactatagggacttacatgtctcgagtgatatttcaaaataacagaggagaattttgatgtatcactcgaacctggcggcagcgcaaaagatg

SEQ ID NO: 20779 - DNA, 103 bp, Artificial Sequence
  Synthetic Polynucleotide
taatacgactcactatagggtccgtacttacatgtctcgagtgatatttcaacagaggagagaaataatgctcgagacaaacctggcggcagcgcaaaagatg

SEQ ID NO: 20780 - DNA, 103 bp, Artificial Sequence
  Synthetic Polynucleotide
taatacgactcactatagggctatctccgtacttacatgtctcgagtgataacagaggagaatcactatggacatgtaaaacctggcggcagcgcaaaagatg

SEQ ID NO: 20781 - DNA, 103 bp, Artificial Sequence
  Synthetic Polynucleotide
taatacgactcactatagggtaccactatctccgtacttacatgtctcgaaacagaggagatcgagaatggtaagtacgaacctggcggcagcgcaaaagatg

SEQ ID NO: 20782 - DNA, 103 bp, Artificial Sequence
  Synthetic Polynucleotide
taatacgactcactatagggcgccctaccactatctccgtacttacatgtaacagaggagaacatgtatgtacggagataacctggcggcagcgcaaaagatg

SEQ ID NO: 20783 - DNA, 103 bp, Artificial Sequence
  Synthetic Polynucleotide
taatacgactcactatagggagtcacgccctaccactatctccgtacttaaacagaggagataagtaatgagatagtggaacctggcggcagcgcaaaagatg

SEQ ID NO: 20784 - DNA, 103 bp, Artificial Sequence
  Synthetic Polynucleotide
taatacgactcactatagggcctatagtcacgccctaccactatctccgtaacagaggagaacggagatggtggtagggaacctggcggcagcgcaaaagatg

SEQ ID NO: 20785 - DNA, 103 bp, Artificial Sequence
  Synthetic Polynucleotide
taatacgactcactatagggtcaaacctatagtcacgccctaccactatcaacagaggagagatagtatgagggcgtgaaacctggcggcagcgcaaaagatg

SEQ ID NO: 20786 - DNA, 103 bp, Artificial Sequence
  Synthetic Polynucleotide
taatacgactcactatagggtaaagtcaaacctatagtcacgccctaccaaacagaggagatggtagatggtgactataaacctggcggcagcgcaaaagatg

SEQ ID NO: 20787 - DNA, 103 bp, Artificial Sequence
  Synthetic Polynucleotide
taatacgactcactatagggacttctaaagtcaaacctatagtcacgcccaacagaggagagggcgtatgtataggtttaacctggcggcagcgcaaaagatg

SEQ ID NO: 20788 - DNA, 103 bp, Artificial Sequence
  Synthetic Polynucleotide
taatacgactcactatagggccgattcactcgacctgagagagctgtaacaacagaggagagttacaatgctctcaggtaacctggcggcagcgcaaaagatg

SEQ ID NO: 20789 - DNA, 103 bp, Artificial Sequence
  Synthetic Polynucleotide
taatacgactcactatagggagtagacttctaaagtcaaacctatagtcaaacagaggagatgactaatggtttgacttaacctggcggcagcgcaaaagatg

SEQ ID NO: 20790 - DNA, 103 bp, Artificial Sequence
  Synthetic Polynucleotide
taatacgactcactataggggatgtagtagacttctaaagtcaaacctataacagaggagaataggtatgactttagaaaacctggcggcagcgcaaaagatg

SEQ ID NO: 20791 - DNA, 103 bp, Artificial Sequence
  Synthetic Polynucleotide
taatacgactcactatagggagcatgatgtagtagacttctaaagtcaaaaacagaggagatttgacatgagaagtctaaacctggcggcagcgcaaaagatg

SEQ ID NO: 20792 - DNA, 103 bp, Artificial Sequence
  Synthetic Polynucleotide
taatacgactcactataggggcaccagcatgatgtagtagacttctaaagaacagaggagactttagatgtctactacaaacctggcggcagcgcaaaagatg

SEQ ID NO: 20793 - DNA, 103 bp, Artificial Sequence
  Synthetic Polynucleotide
taatacgactcactatagggtacaagcaccagcatgatgtagtagacttcaacagaggagagaagtcatgtacatcatgaacctggcggcagcgcaaaagatg

SEQ ID NO: 20794 - DNA, 103 bp, Artificial Sequence
  Synthetic Polynucleotide
taatacgactcactatagggtgccatacaagcaccagcatgatgtagtagaacagaggagactactaatgcatgctggtaacctggcggcagcgcaaaagatg

SEQ ID NO: 20795 - DNA, 103 bp, Artificial Sequence
  Synthetic Polynucleotide
taatacgactcactatagggtaatgtgccatacaagcaccagcatgatgtaacagaggagaacatcaatgtggtgcttgaacctggcggcagcgcaaaagatg

SEQ ID NO: 20796 - DNA, 103 bp, Artificial Sequence
  Synthetic Polynucleotide
taatacgactcactatagggagcaataatgtgccatacaagcaccagcataacagaggagaatgctgatgcttgtatggaacctggcggcagcgcaaaagatg

SEQ ID NO: 20797 - DNA, 103 bp, Artificial Sequence
  Synthetic Polynucleotide
taatacgactcactatagggcgtcaagcaataatgtgccatacaagcaccaacagaggagaggtgctatgatggcacataacctggcggcagcgcaaaagatg

SEQ ID NO: 20798 - DNA, 103 bp, Artificial Sequence
  Synthetic Polynucleotide
taatacgactcactatagggtcacccgtcaagcaataatgtgccatacaaaacagaggagattgtatatgacattattgaacctggcggcagcgcaaaagatg

SEQ ID NO: 20799 - DNA, 103 bp, Artificial Sequence
  Synthetic Polynucleotide
taatacgactcactataggggtgggccgattcactcgacctgagagagctaacagaggagaagctctatgaggtcgagtaacctggcggcagcgcaaaagatg

SEQ ID NO: 20800 - DNA, 103 bp, Artificial Sequence
  Synthetic Polynucleotide
taatacgactcactatagggccagttcacccgtcaagcaataatgtgccaaacagaggagatggcacatgattgcttgaaacctggcggcagcgcaaaagatg

SEQ ID NO: 20801 - DNA, 103 bp, Artificial Sequence
  Synthetic Polynucleotide
taatacgactcactatagggaatgtccagttcacccgtcaagcaataatgaacagaggagacattatatgttgacgggtaacctggcggcagcgcaaaagatg

SEQ ID NO: 20802 - DNA, 103 bp, Artificial Sequence
  Synthetic Polynucleotide
taatacgactcactatagggacattaatgtccagttcacccgtcaagcaaaacagaggagattgcttatggggtgaactaacctggcggcagcgcaaaagatg

SEQ ID NO: 20803 - DNA, 103 bp, Artificial Sequence
  Synthetic Polynucleotide
taatacgactcactatagggttaggacattaatgtccagttcacccgtcaaacagaggagatgacggatgaactggacaaacctggcggcagcgcaaaagatg

SEQ ID NO: 20804 - DNA, 103 bp, Artificial Sequence
  Synthetic Polynucleotide
taatacgactcactataggggctacttaggacattaatgtccagttcaccaacagaggagaggtgaaatggacattaataacctggcggcagcgcaaaagatg

SEQ ID NO: 20805 - DNA, 103 bp, Artificial Sequence
  Synthetic Polynucleotide
taatacgactcactatagggttatggctacttaggacattaatgtccagtaacagaggagaactggaatgtaatgtcctaacctggcggcagcgcaaaagatg

SEQ ID NO: 20806 - DNA, 103 bp, Artificial Sequence
  Synthetic Polynucleotide
taatacgactcactatagggttgttttatggctacttaggacattaatgtaacagaggagaacattaatgtcctaagtaaacctggcggcagcgcaaaagatg

SEQ ID NO: 20807 - DNA, 103 bp, Artificial Sequence
  Synthetic Polynucleotide
taatacgactcactatagggagagtttgttttatggctacttaggacattaacagaggagaaatgtcatgagtagccataacctggcggcagcgcaaaagatg

SEQ ID NO: 20808 - DNA, 103 bp, Artificial Sequence
  Synthetic Polynucleotide
taatacgactcactataggggcggtagagtttgttttatggctacttaggaacagaggagacctaagatgccataaaacaacctggcggcagcgcaaaagatg

SEQ ID NO: 20809 - DNA, 103 bp, Artificial Sequence
  Synthetic Polynucleotide
taatacgactcactatagggtgactgcggtagagtttgttttatggctacaacagaggagagtagccatgaaacaaactaacctggcggcagcgcaaaagatg

SEQ ID NO: 20810 - DNA, 103 bp, Artificial Sequence
  Synthetic Polynucleotide
taatacgactcactatagggtaccagtgggccgattcactcgacctgagaaacagaggagatctcagatggagtgaatcaacctggcggcagcgcaaaagatg

SEQ ID NO: 20811 - DNA, 103 bp, Artificial Sequence
  Synthetic Polynucleotide
taatacgactcactatagggtacagtgactgcggtagagtttgttttatgaacagaggagacataaaatgaactctaccaacctggcggcagcgcaaaagatg

SEQ ID NO: 20812 - DNA, 103 bp, Artificial Sequence
  Synthetic Polynucleotide
taatacgactcactataggggaaagtacagtgactgcggtagagtttgttaacagaggagaaacaaaatgtaccgcagtaacctggcggcagcgcaaaagatg

SEQ ID NO: 20813 - DNA, 103 bp, Artificial Sequence
  Synthetic Polynucleotide
taatacgactcactatagggcatttgaaagtacagtgactgcggtagagtaacagaggagaactctaatgcagtcactgaacctggcggcagcgcaaaagatg

SEQ ID NO: 20814 - DNA, 103 bp, Artificial Sequence
  Synthetic Polynucleotide
taatacgactcactatagggatcagcatttgaaagtacagtgactgcggtaacagaggagaaccgcaatgactgtacttaacctggcggcagcgcaaaagatg

SEQ ID NO: 20815 - DNA, 103 bp, Artificial Sequence
  Synthetic Polynucleotide
taatacgactcactatagggaaaccatcagcatttgaaagtacagtgactaacagaggagaagtcacatgactttcaaaaacctggcggcagcgcaaaagatg

SEQ ID NO: 20816 - DNA, 103 bp, Artificial Sequence
  Synthetic Polynucleotide
taatacgactcactatagggtagacaaaccatcagcatttgaaagtacagaacagaggagactgtacatgcaaatgctgaacctggcggcagcgcaaaagatg

SEQ ID NO: 20817 - DNA, 103 bp, Artificial Sequence
  Synthetic Polynucleotide
taatacgactcactatagggtaaaatagacaaaccatcagcatttgaaagaacagaggagactttcaatggctgatggtaacctggcggcagcgcaaaagatg

SEQ ID NO: 20818 - DNA, 103 bp, Artificial Sequence
  Synthetic Polynucleotide
taatacgactcactataggggctcctaaaatagacaaaccatcagcatttaacagaggagaaaatgcatgtggtttgtcaacctggcggcagcgcaaaagatg

SEQ ID NO: 20819 - DNA, 103 bp, Artificial Sequence
  Synthetic Polynucleotide
taatacgactcactatagggcgtctgctcctaaaatagacaaaccatcagaacagaggagactgatgatgtgtctatttaacctggcggcagcgcaaaagatg

SEQ ID NO: 20820 - DNA, 103 bp, Artificial Sequence
  Synthetic Polynucleotide
taatacgactcactatagggcaacacgtctgctcctaaaatagacaaaccaacagaggagaggtttgatgattttaggaaacctggcggcagcgcaaaagatg

SEQ ID NO: 20821 - DNA, 103 bp, Artificial Sequence
  Synthetic Polynucleotide
taatacgactcactatagggtaccctaccagtgggccgattcactcgaccaacagaggagaggtcgaatgaatcggcccaacctggcggcagcgcaaaagatg

SEQ ID NO: 20822 - DNA, 103 bp, Artificial Sequence
  Synthetic Polynucleotide
taatacgactcactatagggagatacaacacgtctgctcctaaaatagacaacagaggagagtctatatgaggagcagaaacctggcggcagcgcaaaagatg

SEQ ID NO: 20823 - DNA, 103 bp, Artificial Sequence
  Synthetic Polynucleotide
taatacgactcactatagggtggggagatacaacacgtctgctcctaaaaaacagaggagattttagatgcagacgtgtaacctggcggcagcgcaaaagatg

SEQ ID NO: 20824 - DNA, 103 bp, Artificial Sequence
  Synthetic Polynucleotide
taatacgactcactatagggggcattggggagatacaacacgtctgctccaacagaggagaggagcaatggtgttgtataacctggcggcagcgcaaaagatg

SEQ ID NO: 20825 - DNA, 103 bp, Artificial Sequence
  Synthetic Polynucleotide
taatacgactcactatagggtttagggcattggggagatacaacacgtctaacagaggagaagacgtatggtatctcccaacctggcggcagcgcaaaagatg

SEQ ID NO: 20826 - DNA, 103 bp, Artificial Sequence
  Synthetic Polynucleotide
taatacgactcactatagggtcatttttagggcattggggagatacaacaaacagaggagatgttgtatgtccccaatgaacctggcggcagcgcaaaagatg

SEQ ID NO: 20827 - DNA, 103 bp, Artificial Sequence
  Synthetic Polynucleotide
taatacgactcactataggggtccatcatttttagggcattggggagataaacagaggagatatctcatgaatgccctaaacctggcggcagcgcaaaagatg

SEQ ID NO: 20828 - DNA, 103 bp, Artificial Sequence
  Synthetic Polynucleotide
taatacgactcactatagggttaatgtccatcatttttagggcattggggaacagaggagaccccaaatgcctaaaaataacctggcggcagcgcaaaagatg

SEQ ID NO: 20829 - DNA, 103 bp, Artificial Sequence
  Synthetic Polynucleotide
taatacgactcactatagggaaatattaatgtccatcatttttagggcataacagaggagaatgcccatgaaatgatggaacctggcggcagcgcaaaagatg

SEQ ID NO: 20830 - DNA, 103 bp, Artificial Sequence
  Synthetic Polynucleotide
taatacgactcactataggggttgaaaatattaatgtccatcatttttagaacagaggagactaaaaatgatggacattaacctggcggcagcgcaaaagatg

SEQ ID NO: 20831 - DNA, 103 bp, Artificial Sequence
  Synthetic Polynucleotide
taatacgactcactatagggatacagttgaaaatattaatgtccatcattaacagaggagaaatgatatgcattaatataacctggcggcagcgcaaaagatg

SEQ ID NO: 20832 - DNA, 103 bp, Artificial Sequence
  Synthetic Polynucleotide
taatacgactcactatagggagtattaccctaccagtgggccgattcactaacagaggagaagtgaaatggcccactggaacctggcggcagcgcaaaagatg

SEQ ID NO: 20833 - DNA, 103 bp, Artificial Sequence
  Synthetic Polynucleotide
taatacgactcactatagggggtaaatacagttgaaaatattaatgtccaaacagaggagatggacaatgatattttcaaacctggcggcagcgcaaaagatg

SEQ ID NO: 20834 - DNA, 103 bp, Artificial Sequence
  Synthetic Polynucleotide
taatacgactcactatagggtaagaggtaaatacagttgaaaatattaataacagaggagaattaatatgttcaactgtaacctggcggcagcgcaaaagatg

SEQ ID NO: 20835 - DNA, 103 bp, Artificial Sequence
  Synthetic Polynucleotide
taatacgactcactataggggctgctaagaggtaaatacagttgaaaataaacagaggagatattttatgctgtatttaaacctggcggcagcgcaaaagatg

SEQ ID NO: 20836 - DNA, 103 bp, Artificial Sequence
  Synthetic Polynucleotide
taatacgactcactatagggaagccgctgctaagaggtaaatacagttgaaacagaggagatcaactatgtttacctctaacctggcggcagcgcaaaagatg

SEQ ID NO: 20837 - DNA, 103 bp, Artificial Sequence
  Synthetic Polynucleotide
taatacgactcactatagggttcgcaagccgctgctaagaggtaaatacaaacagaggagatgtattatgctcttagcaaacctggcggcagcgcaaaagatg

SEQ ID NO: 20838 - DNA, 103 bp, Artificial Sequence
  Synthetic Polynucleotide
taatacgactcactatagggttactttcgcaagccgctgctaagaggtaaaacagaggagattacctatgagcagcggcaacctggcggcagcgcaaaagatg

SEQ ID NO: 20839 - DNA, 103 bp, Artificial Sequence
  Synthetic Polynucleotide
taatacgactcactatagggtaatgttactttcgcaagccgctgctaagaaacagaggagatcttagatgcggcttgcgaacctggcggcagcgcaaaagatg

SEQ ID NO: 20840 - DNA, 103 bp, Artificial Sequence
  Synthetic Polynucleotide
taatacgactcactatagggaaaaataatgttactttcgcaagccgctgcaacagaggagagcagcgatgtgcgaaagtaacctggcggcagcgcaaaagatg

SEQ ID NO: 20841 - DNA, 103 bp, Artificial Sequence
  Synthetic Polynucleotide
taatacgactcactatagggtcatcaaaaataatgttactttcgcaagccaacagaggagaggcttgatgaagtaacataacctggcggcagcgcaaaagatg

SEQ ID NO: 20842 - DNA, 103 bp, Artificial Sequence
  Synthetic Polynucleotide
taatacgactcactatagggtaacatcatcaaaaataatgttactttcgcaacagaggagagcgaaaatgacattatttaacctggcggcagcgcaaaagatg

SEQ ID NO: 20843 - DNA, 103 bp, Artificial Sequence
  Synthetic Polynucleotide
taatacgactcactatagggtcatcagtattaccctaccagtgggccgataacagaggagaatcggcatgctggtagggaacctggcggcagcgcaaaagatg

SEQ ID NO: 20844 - DNA, 103 bp, Artificial Sequence
  Synthetic Polynucleotide
taatacgactcactatagggcaaaataacatcatcaaaaataatgttactaacagaggagaagtaacatgatttttgataacctggcggcagcgcaaaagatg

SEQ ID NO: 20845 - DNA, 103 bp, Artificial Sequence
  Synthetic Polynucleotide
taatacgactcactatagggcccgtcaaaataacatcatcaaaaataatgaacagaggagacattatatgtgatgatgtaacctggcggcagcgcaaaagatg

SEQ ID NO: 20846 - DNA, 103 bp, Artificial Sequence
  Synthetic Polynucleotide
taatacgactcactatagggcaccacccgtcaaaataacatcatcaaaaaaacagaggagatttttgatgatgttatttaacctggcggcagcgcaaaagatg

SEQ ID NO: 20847 - DNA, 103 bp, Artificial Sequence
  Synthetic Polynucleotide
taatacgactcactatagggggaaccaccacccgtcaaaataacatcatcaacagaggagagatgatatgattttgacgaacctggcggcagcgcaaaagatg

SEQ ID NO: 20848 - DNA, 103 bp, Artificial Sequence
  Synthetic Polynucleotide
taatacgactcactatagggtaagaggaaccaccacccgtcaaaataacaaacagaggagatgttatatggacgggtggaacctggcggcagcgcaaaagatg

SEQ ID NO: 20849 - DNA, 103 bp, Artificial Sequence
  Synthetic Polynucleotide
taatacgactcactatagggcattataagaggaaccaccacccgtcaaaaaacagaggagattttgaatggtggtggttaacctggcggcagcgcaaaagatg

SEQ ID NO: 20850 - DNA, 103 bp, Artificial Sequence
  Synthetic Polynucleotide
taatacgactcactatagggaggcacattataagaggaaccaccacccgtaacagaggagaacgggtatgggttcctctaacctggcggcagcgcaaaagatg

SEQ ID NO: 20851 - DNA, 103 bp, Artificial Sequence
  Synthetic Polynucleotide
taatacgactcactatagggtaagcaggcacattataagaggaaccaccaaacagaggagatggtggatgctcttataaaacctggcggcagcgcaaaagatg

SEQ ID NO: 20852 - DNA, 103 bp, Artificial Sequence
  Synthetic Polynucleotide
taatacgactcactatagggcattgtaagcaggcacattataagaggaacaacagaggagagttcctatgataatgtgcaacctggcggcagcgcaaaagatg

SEQ ID NO: 20853 - DNA, 103 bp, Artificial Sequence
  Synthetic Polynucleotide
taatacgactcactatagggtgcagcattgtaagcaggcacattataagaaacagaggagatcttatatggtgcctgctaacctggcggcagcgcaaaagatg

SEQ ID NO: 20854 - DNA, 103 bp, Artificial Sequence
  Synthetic Polynucleotide
taatacgactcactatagggctggatcatcagtattaccctaccagtgggaacagaggagacccactatgagggtaataaacctggcggcagcgcaaaagatg

SEQ ID NO: 20855 - DNA, 103 bp, Artificial Sequence
  Synthetic Polynucleotide
taatacgactcactatagggcactgtgcagcattgtaagcaggcacattaaacagaggagataatgtatgtgcttacaaaacctggcggcagcgcaaaagatg

SEQ ID NO: 20856 - DNA, 103 bp, Artificial Sequence
  Synthetic Polynucleotide
taatacgactcactatagggggctccactgtgcagcattgtaagcaggcaaacagaggagatgcctgatgacaatgctgaacctggcggcagcgcaaaagatg

SEQ ID NO: 20857 - DNA, 103 bp, Artificial Sequence
  Synthetic Polynucleotide
taatacgactcactatagggatggcggctccactgtgcagcattgtaagcaacagaggagagcttacatggctgcacagaacctggcggcagcgcaaaagatg

SEQ ID NO: 20858 - DNA, 103 bp, Artificial Sequence
  Synthetic Polynucleotide
taatacgactcactatagggtgcaaatggcggctccactgtgcagcattgaacagaggagacaatgcatgacagtggagaacctggcggcagcgcaaaagatg

SEQ ID NO: 20859 - DNA, 103 bp, Artificial Sequence
  Synthetic Polynucleotide
taatacgactcactatagggtattgtgcaaatggcggctccactgtgcagaacagaggagactgcacatgggagccgccaacctggcggcagcgcaaaagatg

SEQ ID NO: 20860 - DNA, 103 bp, Artificial Sequence
  Synthetic Polynucleotide
taatacgactcactataggggatggtattgtgcaaatggcggctccactgaacagaggagacagtggatgcgccatttgaacctggcggcagcgcaaaagatg

SEQ ID NO: 20861 - DNA, 103 bp, Artificial Sequence
  Synthetic Polynucleotide
taatacgactcactatagggtagatgatggtattgtgcaaatggcggctcaacagaggagagagccgatgtttgcacaaaacctggcggcagcgcaaaagatg

SEQ ID NO: 20862 - DNA, 103 bp, Artificial Sequence
  Synthetic Polynucleotide
taatacgactcactataggggcagatagatgatggtattgtgcaaatggcaacagaggagagccattatgacaataccaaacctggcggcagcgcaaaagatg

SEQ ID NO: 20863 - DNA, 103 bp, Artificial Sequence
  Synthetic Polynucleotide
taatacgactcactatagggatgaagcagatagatgatggtattgtgcaaaacagaggagattgcacatgaccatcatcaacctggcggcagcgcaaaagatg

SEQ ID NO: 20864 - DNA, 103 bp, Artificial Sequence
  Synthetic Polynucleotide
taatacgactcactatagggtgtagatgaagcagatagatgatggtattgaacagaggagacaatacatgcatctatctaacctggcggcagcgcaaaagatg

SEQ ID NO: 20865 - DNA, 103 bp, Artificial Sequence
  Synthetic Polynucleotide
taatacgactcactatagggtaaccaacagttcgtaaggctgttggttaaaacagaggagattaaccatgagccttacgaacctggcggcagcgcaaaagatg

SEQ ID NO: 20866 - DNA, 103 bp, Artificial Sequence
  Synthetic Polynucleotide
taatacgactcactataggggaacactggatcatcagtattaccctaccaaacagaggagatggtagatgaatactgataacctggcggcagcgcaaaagatg

SEQ ID NO: 20867 - DNA, 103 bp, Artificial Sequence
  Synthetic Polynucleotide
taatacgactcactatagggtgctctgtagatgaagcagatagatgatggaacagaggagaccatcaatgatctgcttcaacctggcggcagcgcaaaagatg

SEQ ID NO: 20868 - DNA, 103 bp, Artificial Sequence
  Synthetic Polynucleotide
taatacgactcactatagggaccattgctctgtagatgaagcagatagataacagaggagaatctatatgcttcatctaaacctggcggcagcgcaaaagatg

SEQ ID NO: 20869 - DNA, 103 bp, Artificial Sequence
  Synthetic Polynucleotide
taatacgactcactatagggccgtcaccattgctctgtagatgaagcagaaacagaggagatctgctatgtctacagagaacctggcggcagcgcaaaagatg

SEQ ID NO: 20870 - DNA, 103 bp, Artificial Sequence
  Synthetic Polynucleotide
taatacgactcactatagggaacccccgtcaccattgctctgtagatgaaaacagaggagattcatcatgagagcaatgaacctggcggcagcgcaaaagatg

SEQ ID NO: 20871 - DNA, 103 bp, Artificial Sequence
  Synthetic Polynucleotide
taatacgactcactataggggtcacaacccccgtcaccattgctctgtagaacagaggagactacagatgaatggtgacaacctggcggcagcgcaaaagatg

SEQ ID NO: 20872 - DNA, 103 bp, Artificial Sequence
  Synthetic Polynucleotide
taatacgactcactataggggctccgtcacaacccccgtcaccattgctcaacagaggagagagcaaatgtgacgggggaacctggcggcagcgcaaaagatg

SEQ ID NO: 20873 - DNA, 103 bp, Artificial Sequence
  Synthetic Polynucleotide
taatacgactcactatagggccaaagctccgtcacaacccccgtcaccataacagaggagaatggtgatgggggttgtgaacctggcggcagcgcaaaagatg

SEQ ID NO: 20874 - DNA, 103 bp, Artificial Sequence
  Synthetic Polynucleotide
taatacgactcactatagggcaatgccaaagctccgtcacaacccccgtcaacagaggagagacgggatgtgtgacggaaacctggcggcagcgcaaaagatg

SEQ ID NO: 20875 - DNA, 103 bp, Artificial Sequence
  Synthetic Polynucleotide
taatacgactcactataggggccgtcaatgccaaagctccgtcacaacccaacagaggagagggttgatgcggagctttaacctggcggcagcgcaaaagatg

SEQ ID NO: 20876 - DNA, 103 bp, Artificial Sequence
  Synthetic Polynucleotide
taatacgactcactatagggaaccggccgtcaatgccaaagctccgtcacaacagaggagagtgacgatgctttggcataacctggcggcagcgcaaaagatg

SEQ ID NO: 20877 - DNA, 103 bp, Artificial Sequence
  Synthetic Polynucleotide
taatacgactcactatagggctgttgaacactggatcatcagtattacccaacagaggagagggtaaatgtgatgatccaacctggcggcagcgcaaaagatg

SEQ ID NO: 20878 - DNA, 103 bp, Artificial Sequence
  Synthetic Polynucleotide
taatacgactcactataggggtgtaaaccggccgtcaatgccaaagctccaacagaggagaggagctatggcattgacgaacctggcggcagcgcaaaagatg

SEQ ID NO: 20879 - DNA, 103 bp, Artificial Sequence
  Synthetic Polynucleotide
taatacgactcactatagggactgagtgtaaaccggccgtcaatgccaaaaacagaggagatttggcatggacggccggaacctggcggcagcgcaaaagatg

SEQ ID NO: 20880 - DNA, 103 bp, Artificial Sequence
  Synthetic Polynucleotide
taatacgactcactatagggtcatcactgagtgtaaaccggccgtcaatgaacagaggagacattgaatgccggtttacaacctggcggcagcgcaaaagatg

SEQ ID NO: 20881 - DNA, 103 bp, Artificial Sequence
  Synthetic Polynucleotide
taatacgactcactataggggaccgtcatcactgagtgtaaaccggccgtaacagaggagaacggccatgttacactcaaacctggcggcagcgcaaaagatg

SEQ ID NO: 20882 - DNA, 103 bp, Artificial Sequence
  Synthetic Polynucleotide
taatacgactcactataggggcaacgaccgtcatcactgagtgtaaaccgaacagaggagacggtttatgctcagtgataacctggcggcagcgcaaaagatg

SEQ ID NO: 20883 - DNA, 103 bp, Artificial Sequence
  Synthetic Polynucleotide
taatacgactcactatagggtgtgggcaacgaccgtcatcactgagtgtaaacagaggagatacactatgtgatgacggaacctggcggcagcgcaaaagatg

SEQ ID NO: 20884 - DNA, 103 bp, Artificial Sequence
  Synthetic Polynucleotide
taatacgactcactatagggatcactgtgggcaacgaccgtcatcactgaaacagaggagatcagtgatgacggtcgttaacctggcggcagcgcaaaagatg

SEQ ID NO: 20885 - DNA, 103 bp, Artificial Sequence
  Synthetic Polynucleotide
taatacgactcactatagggccttcatcactgtgggcaacgaccgtcatcaacagaggagagatgacatgcgttgcccaaacctggcggcagcgcaaaagatg

SEQ ID NO: 20886 - DNA, 103 bp, Artificial Sequence
  Synthetic Polynucleotide
taatacgactcactatagggagccgccttcatcactgtgggcaacgaccgaacagaggagacggtcgatgcccacagtgaacctggcggcagcgcaaaagatg

SEQ ID NO: 20887 - DNA, 103 bp, Artificial Sequence
  Synthetic Polynucleotide
taatacgactcactatagggcataaagccgccttcatcactgtgggcaacaacagaggagagttgccatgagtgatgaaaacctggcggcagcgcaaaagatg

SEQ ID NO: 20888 - DNA, 103 bp, Artificial Sequence
  Synthetic Polynucleotide
taatacgactcactatagggagccactgttgaacactggatcatcagtataacagaggagaatactgatgatccagtgtaacctggcggcagcgcaaaagatg

SEQ ID NO: 20889 - DNA, 103 bp, Artificial Sequence
  Synthetic Polynucleotide
taatacgactcactatagggtctcgcataaagccgccttcatcactgtggaacagaggagaccacagatgtgaaggcggaacctggcggcagcgcaaaagatg

SEQ ID NO: 20890 - DNA, 103 bp, Artificial Sequence
  Synthetic Polynucleotide
taatacgactcactatagggagacgtctcgcataaagccgccttcatcacaacagaggagagtgatgatggcggctttaaacctggcggcagcgcaaaagatg

SEQ ID NO: 20891 - DNA, 103 bp, Artificial Sequence
  Synthetic Polynucleotide
taatacgactcactataggggcgtaagacgtctcgcataaagccgccttcaacagaggagagaaggcatgtttatgcgaaacctggcggcagcgcaaaagatg

SEQ ID NO: 20892 - DNA, 103 bp, Artificial Sequence
  Synthetic Polynucleotide
taatacgactcactatagggagggagcgtaagacgtctcgcataaagccgaacagaggagacggcttatggcgagacgtaacctggcggcagcgcaaaagatg

SEQ ID NO: 20893 - DNA, 103 bp, Artificial Sequence
  Synthetic Polynucleotide
taatacgactcactatagggaatgtagggagcgtaagacgtctcgcataaaacagaggagattatgcatgacgtcttacaacctggcggcagcgcaaaagatg

SEQ ID NO: 20894 - DNA, 103 bp, Artificial Sequence
  Synthetic Polynucleotide
taatacgactcactatagggtccataatgtagggagcgtaagacgtctcgaacagaggagacgagacatgttacgctccaacctggcggcagcgcaaaagatg

SEQ ID NO: 20895 - DNA, 103 bp, Artificial Sequence
  Synthetic Polynucleotide
taatacgactcactataggggctggtccataatgtagggagcgtaagacgaacagaggagacgtcttatgctccctacaaacctggcggcagcgcaaaagatg

SEQ ID NO: 20896 - DNA, 103 bp, Artificial Sequence
  Synthetic Polynucleotide
taatacgactcactatagggcttttgctggtccataatgtagggagcgtaaacagaggagatacgctatgtacattatgaacctggcggcagcgcaaaagatg

SEQ ID NO: 20897 - DNA, 103 bp, Artificial Sequence
  Synthetic Polynucleotide
taatacgactcactatagggaatgccttttgctggtccataatgtagggaaacagaggagatccctaatgtatggaccaaacctggcggcagcgcaaaagatg

SEQ ID NO: 20898 - DNA, 103 bp, Artificial Sequence
  Synthetic Polynucleotide
taatacgactcactatagggaccacaatgccttttgctggtccataatgtaacagaggagaacattaatgaccagcaaaaacctggcggcagcgcaaaagatg

SEQ ID NO: 20899 - DNA, 103 bp, Artificial Sequence
  Synthetic Polynucleotide
taatacgactcactatagggacttaagccactgttgaacactggatcatcaacagaggagagatgatatggtgttcaacaacctggcggcagcgcaaaagatg

SEQ ID NO: 20900 - DNA, 103 bp, Artificial Sequence
  Synthetic Polynucleotide
taatacgactcactatagggcagcaaccacaatgccttttgctggtccataacagaggagaatggacatgcaaaaggcaaacctggcggcagcgcaaaagatg

SEQ ID NO: 20901 - DNA, 103 bp, Artificial Sequence
  Synthetic Polynucleotide
taatacgactcactatagggtggatcagcaaccacaatgccttttgctggaacagaggagaccagcaatgggcattgtgaacctggcggcagcgcaaaagatg

SEQ ID NO: 20902 - DNA, 103 bp, Artificial Sequence
  Synthetic Polynucleotide
taatacgactcactatagggctgtgtggatcagcaaccacaatgccttttaacagaggagaaaaaggatgtgtggttgcaacctggcggcagcgcaaaagatg

SEQ ID NO: 20903 - DNA, 103 bp, Artificial Sequence
  Synthetic Polynucleotide
taatacgactcactatagggcagtcctgtgtggatcagcaaccacaatgcaacagaggagagcattgatgttgctgatcaacctggcggcagcgcaaaagatg

SEQ ID NO: 20904 - DNA, 103 bp, Artificial Sequence
  Synthetic Polynucleotide
taatacgactcactatagggatttacagtcctgtgtggatcagcaaccacaacagaggagagtggttatggatccacacaacctggcggcagcgcaaaagatg

SEQ ID NO: 20905 - DNA, 103 bp, Artificial Sequence
  Synthetic Polynucleotide
taatacgactcactataggggcgtgatttacagtcctgtgtggatcagcaaacagaggagatgctgaatgacacaggacaacctggcggcagcgcaaaagatg

SEQ ID NO: 20906 - DNA, 103 bp, Artificial Sequence
  Synthetic Polynucleotide
taatacgactcactataggggcaacgcgtgatttacagtcctgtgtggataacagaggagaatccacatgggactgtaaaacctggcggcagcgcaaaagatg

SEQ ID NO: 20907 - DNA, 103 bp, Artificial Sequence
  Synthetic Polynucleotide
taatacgactcactatagggtacaggcaacgcgtgatttacagtcctgtgaacagaggagacacaggatggtaaatcacaacctggcggcagcgcaaaagatg

SEQ ID NO: 20908 - DNA, 103 bp, Artificial Sequence
  Synthetic Polynucleotide
taatacgactcactatagggatcagtacaggcaacgcgtgatttacagtcaacagaggagagactgtatgtcacgcgttaacctggcggcagcgcaaaagatg

SEQ ID NO: 20909 - DNA, 103 bp, Artificial Sequence
  Synthetic Polynucleotide
taatacgactcactatagggcatacatcagtacaggcaacgcgtgatttaaacagaggagataaatcatgcgttgcctgaacctggcggcagcgcaaaagatg

SEQ ID NO: 20910 - DNA, 103 bp, Artificial Sequence
  Synthetic Polynucleotide
taatacgactcactatagggacgaaacttaagccactgttgaacactggaaacagaggagatccagtatgcaacagtggaacctggcggcagcgcaaaagatg

SEQ ID NO: 20911 - DNA, 103 bp, Artificial Sequence
  Synthetic Polynucleotide
taatacgactcactatagggcggctcatacatcagtacaggcaacgcgtgaacagaggagacacgcgatgcctgtactgaacctggcggcagcgcaaaagatg

SEQ ID NO: 20912 - DNA, 103 bp, Artificial Sequence
  Synthetic Polynucleotide
taatacgactcactatagggcaagtcggctcatacatcagtacaggcaacaacagaggagagttgccatgactgatgtaaacctggcggcagcgcaaaagatg

SEQ ID NO: 20913 - DNA, 103 bp, Artificial Sequence
  Synthetic Polynucleotide
taatacgactcactatagggcatcccaagtcggctcatacatcagtacagaacagaggagactgtacatgtgtatgagcaacctggcggcagcgcaaaagatg

SEQ ID NO: 20914 - DNA, 103 bp, Artificial Sequence
  Synthetic Polynucleotide
taatacgactcactatagggtatggcatcccaagtcggctcatacatcagaacagaggagactgatgatggagccgactaacctggcggcagcgcaaaagatg

SEQ ID NO: 20915 - DNA, 103 bp, Artificial Sequence
  Synthetic Polynucleotide
taatacgactcactatagggccgcatatggcatcccaagtcggctcatacaacagaggagagtatgaatggacttgggaaacctggcggcagcgcaaaagatg

SEQ ID NO: 20916 - DNA, 103 bp, Artificial Sequence
  Synthetic Polynucleotide
taatacgactcactatagggacatgccgcatatggcatcccaagtcggctaacagaggagaagccgaatggggatgccaaacctggcggcagcgcaaaagatg

SEQ ID NO: 20917 - DNA, 103 bp, Artificial Sequence
  Synthetic Polynucleotide
taatacgactcactatagggatcccacatgccgcatatggcatcccaagtaacagaggagaacttggatggccatatgcaacctggcggcagcgcaaaagatg

SEQ ID NO: 20918 - DNA, 103 bp, Artificial Sequence
  Synthetic Polynucleotide
taatacgactcactatagggacataatcccacatgccgcatatggcatccaacagaggagaggatgcatgatgcggcataacctggcggcagcgcaaaagatg

SEQ ID NO: 20919 - DNA, 103 bp, Artificial Sequence
  Synthetic Polynucleotide
taatacgactcactatagggcagtcacataatcccacatgccgcatatggaacagaggagaccatatatggcatgtgggaacctggcggcagcgcaaaagatg

SEQ ID NO: 20920 - DNA, 103 bp, Artificial Sequence
  Synthetic Polynucleotide
taatacgactcactatagggagcaacagtcacataatcccacatgccgcaaacagaggagatgcggcatgtgggattataacctggcggcagcgcaaaagatg

SEQ ID NO: 20921 - DNA, 103 bp, Artificial Sequence
  Synthetic Polynucleotide
taatacgactcactatagggccagcacgaaacttaagccactgttgaacaaacagaggagatgttcaatggtggcttaaaacctggcggcagcgcaaaagatg

SEQ ID NO: 20922 - DNA, 103 bp, Artificial Sequence
  Synthetic Polynucleotide
taatacgactcactataggggccgtagcaacagtcacataatcccacatgaacagaggagacatgtgatgttatgtgacaacctggcggcagcgcaaaagatg

SEQ ID NO: 20923 - DNA, 103 bp, Artificial Sequence
  Synthetic Polynucleotide
taatacgactcactatagggaaccagccgtagcaacagtcacataatcccaacagaggagagggattatgtgactgttgaacctggcggcagcgcaaaagatg

SEQ ID NO: 20924 - DNA, 103 bp, Artificial Sequence
  Synthetic Polynucleotide
taatacgactcactatagggtactaaaccagccgtagcaacagtcacataaacagaggagatatgtgatggttgctacgaacctggcggcagcgcaaaagatg

SEQ ID NO: 20925 - DNA, 103 bp, Artificial Sequence
  Synthetic Polynucleotide
taatacgactcactatagggagatgtactaaaccagccgtagcaacagtcaacagaggagagactgtatgtacggctggaacctggcggcagcgcaaaagatg

SEQ ID NO: 20926 - DNA, 103 bp, Artificial Sequence
  Synthetic Polynucleotide
taatacgactcactatagggcagacagatgtactaaaccagccgtagcaaaacagaggagattgctaatgctggtttagaacctggcggcagcgcaaaagatg

SEQ ID NO: 20927 - DNA, 103 bp, Artificial Sequence
  Synthetic Polynucleotide
taatacgactcactatagggcggatcagacagatgtactaaaccagccgtaacagaggagaacggctatgttagtacataacctggcggcagcgcaaaagatg

SEQ ID NO: 20928 - DNA, 103 bp, Artificial Sequence
  Synthetic Polynucleotide
taatacgactcactatagggtcacacggatcagacagatgtactaaaccaaacagaggagatggtttatgacatctgtcaacctggcggcagcgcaaaagatg

SEQ ID NO: 20929 - DNA, 103 bp, Artificial Sequence
  Synthetic Polynucleotide
taatacgactcactatagggtcagctcacacggatcagacagatgtactaaacagaggagatagtacatgtgtctgatcaacctggcggcagcgcaaaagatg

SEQ ID NO: 20930 - DNA, 103 bp, Artificial Sequence
  Synthetic Polynucleotide
taatacgactcactatagggtgctatcagctcacacggatcagacagatgaacagaggagacatctgatggatccgtgtaacctggcggcagcgcaaaagatg

SEQ ID NO: 20931 - DNA, 103 bp, Artificial Sequence
  Synthetic Polynucleotide
taatacgactcactatagggtcatgtgctatcagctcacacggatcagacaacagaggagagtctgaatggtgtgagctaacctggcggcagcgcaaaagatg

SEQ ID NO: 20932 - DNA, 103 bp, Artificial Sequence
  Synthetic Polynucleotide
taatacgactcactatagggtagctccagcacgaaacttaagccactgttaacagaggagaaacagtatgttaagtttcaacctggcggcagcgcaaaagatg

SEQ ID NO: 20933 - DNA, 103 bp, Artificial Sequence
  Synthetic Polynucleotide
taatacgactcactatagggatatgtcatgtgctatcagctcacacggataacagaggagaatccgtatgagctgatagaacctggcggcagcgcaaaagatg

SEQ ID NO: 20934 - DNA, 103 bp, Artificial Sequence
  Synthetic Polynucleotide
taatacgactcactatagggaggatatatgtcatgtgctatcagctcacaaacagaggagatgtgagatgatagcacataacctggcggcagcgcaaaagatg

SEQ ID NO: 20935 - DNA, 103 bp, Artificial Sequence
  Synthetic Polynucleotide
taatacgactcactatagggatagtaggatatatgtcatgtgctatcagcaacagaggagagctgatatgacatgacataacctggcggcagcgcaaaagatg

SEQ ID NO: 20936 - DNA, 103 bp, Artificial Sequence
  Synthetic Polynucleotide
taatacgactcactatagggtaatgatagtaggatatatgtcatgtgctaaacagaggagatagcacatgacatatatcaacctggcggcagcgcaaaagatg

SEQ ID NO: 20937 - DNA, 103 bp, Artificial Sequence
  Synthetic Polynucleotide
taatacgactcactatagggagcagtaatgatagtaggatatatgtcatgaacagaggagacatgacatgtatcctactaacctggcggcagcgcaaaagatg

SEQ ID NO: 20938 - DNA, 103 bp, Artificial Sequence
  Synthetic Polynucleotide
taatacgactcactatagggtcaggagcagtaatgatagtaggatatatgaacagaggagacatataatgtactatcataacctggcggcagcgcaaaagatg

SEQ ID NO: 20939 - DNA, 103 bp, Artificial Sequence
  Synthetic Polynucleotide
taatacgactcactatagggtgtcatcaggagcagtaatgatagtaggataacagaggagaatcctaatgtcattactgaacctggcggcagcgcaaaagatg

SEQ ID NO: 20940 - DNA, 103 bp, Artificial Sequence
  Synthetic Polynucleotide
taatacgactcactatagggtaaattgtcatcaggagcagtaatgatagtaacagaggagaactatcatgactgctcctaacctggcggcagcgcaaaagatg

SEQ ID NO: 20941 - DNA, 103 bp, Artificial Sequence
  Synthetic Polynucleotide
taatacgactcactatagggcgtactaaattgtcatcaggagcagtaatgaacagaggagacattacatgtcctgatgaaacctggcggcagcgcaaaagatg

SEQ ID NO: 20942 - DNA, 103 bp, Artificial Sequence
  Synthetic Polynucleotide
taatacgactcactatagggttgcacgtactaaattgtcatcaggagcagaacagaggagactgctcatgatgacaattaacctggcggcagcgcaaaagatg

SEQ ID NO: 20943 - DNA, 103 bp, Artificial Sequence
  Synthetic Polynucleotide
taatacgactcactatagggccgggtagctccagcacgaaacttaagccaaacagaggagatggcttatgtttcgtgctaacctggcggcagcgcaaaagatg

SEQ ID NO: 20944 - DNA, 103 bp, Artificial Sequence
  Synthetic Polynucleotide
taatacgactcactatagggctccattgcacgtactaaattgtcatcaggaacagaggagacctgatatgaatttagtaaacctggcggcagcgcaaaagatg

SEQ ID NO: 20945 - DNA, 103 bp, Artificial Sequence
  Synthetic Polynucleotide
taatacgactcactatagggcttgactccattgcacgtactaaattgtcaaacagaggagatgacaaatgagtacgtgcaacctggcggcagcgcaaaagatg

SEQ ID NO: 20946 - DNA, 103 bp, Artificial Sequence
  Synthetic Polynucleotide
taatacgactcactatagggcaagtcttgactccattgcacgtactaaataacagaggagaatttagatggtgcaatggaacctggcggcagcgcaaaagatg

SEQ ID NO: 20947 - DNA, 103 bp, Artificial Sequence
  Synthetic Polynucleotide
taatacgactcactatagggagcctcaagtcttgactccattgcacgtacaacagaggagagtacgtatgatggagtcaaacctggcggcagcgcaaaagatg

SEQ ID NO: 20948 - DNA, 103 bp, Artificial Sequence
  Synthetic Polynucleotide
taatacgactcactatagggagcgcagcctcaagtcttgactccattgcaaacagaggagatgcaatatggtcaagactaacctggcggcagcgcaaaagatg

SEQ ID NO: 20949 - DNA, 103 bp, Artificial Sequence
  Synthetic Polynucleotide
taatacgactcactatagggccggaagcgcagcctcaagtcttgactccaaacagaggagatggagtatggacttgaggaacctggcggcagcgcaaaagatg

SEQ ID NO: 20950 - DNA, 103 bp, Artificial Sequence
  Synthetic Polynucleotide
taatacgactcactatagggaaatgccggaagcgcagcctcaagtcttgaaacagaggagatcaagaatggaggctgcgaacctggcggcagcgcaaaagatg

SEQ ID NO: 20951 - DNA, 103 bp, Artificial Sequence
  Synthetic Polynucleotide
taatacgactcactataggggaagcaaatgccggaagcgcagcctcaagtaacagaggagaacttgaatgtgcgcttccaacctggcggcagcgcaaaagatg

SEQ ID NO: 20952 - DNA, 103 bp, Artificial Sequence
  Synthetic Polynucleotide
taatacgactcactatagggagtttgaagcaaatgccggaagcgcagcctaacagaggagaaggctgatgttccggcataacctggcggcagcgcaaaagatg

SEQ ID NO: 20953 - DNA, 103 bp, Artificial Sequence
  Synthetic Polynucleotide
taatacgactcactatagggaatgtagtttgaagcaaatgccggaagcgcaacagaggagagcgcttatggcatttgctaacctggcggcagcgcaaaagatg

SEQ ID NO: 20954 - DNA, 103 bp, Artificial Sequence
  Synthetic Polynucleotide
taatacgactcactatagggtacagccgggtagctccagcacgaaacttaaacagaggagataagttatgtgctggagcaacctggcggcagcgcaaaagatg

SEQ ID NO: 20955 - DNA, 103 bp, Artificial Sequence
  Synthetic Polynucleotide
taatacgactcactatagggttatgaatgtagtttgaagcaaatgccggaaacagaggagatccggcatgtgcttcaaaaacctggcggcagcgcaaaagatg

SEQ ID NO: 20956 - DNA, 103 bp, Artificial Sequence
  Synthetic Polynucleotide
taatacgactcactatagggccaagttatgaatgtagtttgaagcaaatgaacagaggagacatttgatgcaaactacaaacctggcggcagcgcaaaagatg

SEQ ID NO: 20957 - DNA, 103 bp, Artificial Sequence
  Synthetic Polynucleotide
taatacgactcactatagggcatcgccaagttatgaatgtagtttgaagcaacagaggagagcttcaatgtacattcataacctggcggcagcgcaaaagatg

SEQ ID NO: 20958 - DNA, 103 bp, Artificial Sequence
  Synthetic Polynucleotide
taatacgactcactatagggataaacatcgccaagttatgaatgtagtttaacagaggagaaaactaatgtcataacttaacctggcggcagcgcaaaagatg

SEQ ID NO: 20959 - DNA, 103 bp, Artificial Sequence
  Synthetic Polynucleotide
taatacgactcactatagggcacccataaacatcgccaagttatgaatgtaacagaggagaacattcatgacttggcgaaacctggcggcagcgcaaaagatg

SEQ ID NO: 20960 - DNA, 103 bp, Artificial Sequence
  Synthetic Polynucleotide
taatacgactcactataggggccaacacccataaacatcgccaagttatgaacagaggagacataacatggcgatgtttaacctggcggcagcgcaaaagatg

SEQ ID NO: 20961 - DNA, 103 bp, Artificial Sequence
  Synthetic Polynucleotide
taatacgactcactatagggtctccgccaacacccataaacatcgccaagaacagaggagacttggcatggtttatgggaacctggcggcagcgcaaaagatg

SEQ ID NO: 20962 - DNA, 103 bp, Artificial Sequence
  Synthetic Polynucleotide
taatacgactcactatagggactgatctccgccaacacccataaacatcgaacagaggagacgatgtatgtgggtgttgaacctggcggcagcgcaaaagatg

SEQ ID NO: 20963 - DNA, 103 bp, Artificial Sequence
  Synthetic Polynucleotide
taatacgactcactatagggtccacactgatctccgccaacacccataaaaacagaggagatttatgatggttggcggaaacctggcggcagcgcaaaagatg

SEQ ID NO: 20964 - DNA, 103 bp, Artificial Sequence
  Synthetic Polynucleotide
taatacgactcactataggggctcttccacactgatctccgccaacacccaacagaggagagggtgtatgcggagatcaaacctggcggcagcgcaaaagatg

SEQ ID NO: 20965 - DNA, 103 bp, Artificial Sequence
  Synthetic Polynucleotide
taatacgactcactatagggggttttacagccgggtagctccagcacgaaaacagaggagattcgtgatggagctacccaacctggcggcagcgcaaaagatg

SEQ ID NO: 20966 - DNA, 103 bp, Artificial Sequence
  Synthetic Polynucleotide
taatacgactcactatagggcagctgctcttccacactgatctccgccaaaacagaggagattggcgatgatcagtgtgaacctggcggcagcgcaaaagatg

SEQ ID NO: 20967 - DNA, 103 bp, Artificial Sequence
  Synthetic Polynucleotide
taatacgactcactatagggggtatcagctgctcttccacactgatctccaacagaggagaggagatatgtgtggaagaaacctggcggcagcgcaaaagatg

SEQ ID NO: 20968 - DNA, 103 bp, Artificial Sequence
  Synthetic Polynucleotide
taatacgactcactatagggattagggtatcagctgctcttccacactgaaacagaggagatcagtgatgaagagcagcaacctggcggcagcgcaaaagatg

SEQ ID NO: 20969 - DNA, 103 bp, Artificial Sequence
  Synthetic Polynucleotide
taatacgactcactatagggcttcaattagggtatcagctgctcttccacaacagaggagagtggaaatgcagctgataaacctggcggcagcgcaaaagatg

SEQ ID NO: 20970 - DNA, 103 bp, Artificial Sequence
  Synthetic Polynucleotide
taatacgactcactatagggcccggcttcaattagggtatcagctgctctaacagaggagaagagcaatggataccctaaacctggcggcagcgcaaaagatg

SEQ ID NO: 20971 - DNA, 103 bp, Artificial Sequence
  Synthetic Polynucleotide
taatacgactcactatagggtaaaccccggcttcaattagggtatcagctaacagaggagaagctgaatgcctaattgaaacctggcggcagcgcaaaagatg

SEQ ID NO: 20972 - DNA, 103 bp, Artificial Sequence
  Synthetic Polynucleotide
taatacgactcactatagggaaacataaaccccggcttcaattagggtataacagaggagaatacccatgttgaagccgaacctggcggcagcgcaaaagatg

SEQ ID NO: 20973 - DNA, 103 bp, Artificial Sequence
  Synthetic Polynucleotide
taatacgactcactatagggggaacaaacataaaccccggcttcaattagaacagaggagactaattatggccggggttaacctggcggcagcgcaaaagatg

SEQ ID NO: 20974 - DNA, 103 bp, Artificial Sequence
  Synthetic Polynucleotide
taatacgactcactataggggatagggaacaaacataaaccccggcttcaaacagaggagatgaagcatgggtttatgtaacctggcggcagcgcaaaagatg

SEQ ID NO: 20975 - DNA, 103 bp, Artificial Sequence
  Synthetic Polynucleotide
taatacgactcactatagggtgcctgatagggaacaaacataaaccccggaacagaggagaccggggatgatgtttgttaacctggcggcagcgcaaaagatg

SEQ ID NO: 20976 - DNA, 103 bp, Artificial Sequence
  Synthetic Polynucleotide
taatacgactcactatagggtattttaaccaacagttcgtaaggctgttgaacagaggagacaacagatgtacgaactgaacctggcggcagcgcaaaagatg

SEQ ID NO: 20977 - DNA, 103 bp, Artificial Sequence
  Synthetic Polynucleotide
taatacgactcactatagggtttcgggttttacagccgggtagctccagcaacagaggagagctggaatgacccggctgaacctggcggcagcgcaaaagatg

SEQ ID NO: 20978 - DNA, 103 bp, Artificial Sequence
  Synthetic Polynucleotide
taatacgactcactataggggtccgtgcctgatagggaacaaacataaacaacagaggagagtttatatgtgttccctaaacctggcggcagcgcaaaagatg

SEQ ID NO: 20979 - DNA, 103 bp, Artificial Sequence
  Synthetic Polynucleotide
taatacgactcactatagggttggcgtccgtgcctgatagggaacaaacaaacagaggagatgtttgatgcctatcaggaacctggcggcagcgcaaaagatg

SEQ ID NO: 20980 - DNA, 103 bp, Artificial Sequence
  Synthetic Polynucleotide
taatacgactcactataggggacggttggcgtccgtgcctgatagggaacaacagaggagagttcccatgcaggcacggaacctggcggcagcgcaaaagatg

SEQ ID NO: 20981 - DNA, 103 bp, Artificial Sequence
  Synthetic Polynucleotide
taatacgactcactatagggcacgtgacggttggcgtccgtgcctgatagaacagaggagactatcaatgacggacgccaacctggcggcagcgcaaaagatg

SEQ ID NO: 20982 - DNA, 103 bp, Artificial Sequence
  Synthetic Polynucleotide
taatacgactcactatagggttcaacacgtgacggttggcgtccgtgcctaacagaggagaaggcacatgcgccaaccgaacctggcggcagcgcaaaagatg

SEQ ID NO: 20983 - DNA, 103 bp, Artificial Sequence
  Synthetic Polynucleotide
taatacgactcactatagggtacccttcaacacgtgacggttggcgtccgaacagaggagacggacgatgaccgtcacgaacctggcggcagcgcaaaagatg

SEQ ID NO: 20984 - DNA, 103 bp, Artificial Sequence
  Synthetic Polynucleotide
taatacgactcactatagggcattgtacccttcaacacgtgacggttggcaacagaggagagccaacatgcacgtgttgaacctggcggcagcgcaaaagatg

SEQ ID NO: 20985 - DNA, 103 bp, Artificial Sequence
  Synthetic Polynucleotide
taatacgactcactatagggggtgccattgtacccttcaacacgtgacggaacagaggagaccgtcaatggttgaagggaacctggcggcagcgcaaaagatg

SEQ ID NO: 20986 - DNA, 103 bp, Artificial Sequence
  Synthetic Polynucleotide
taatacgactcactatagggaccagggtgccattgtacccttcaacacgtaacagaggagaacgtgtatgagggtacaaaacctggcggcagcgcaaaagatg

SEQ ID NO: 20987 - DNA, 103 bp, Artificial Sequence
  Synthetic Polynucleotide
taatacgactcactatagggccagaaccagggtgccattgtacccttcaaaacagaggagattgaagatgacaatggcaaacctggcggcagcgcaaaagatg

SEQ ID NO: 20988 - DNA, 103 bp, Artificial Sequence
  Synthetic Polynucleotide
taatacgactcactatagggttaactttcgggttttacagccgggtagctaacagaggagaagctacatggctgtaaaaaacctggcggcagcgcaaaagatg

SEQ ID NO: 20989 - DNA, 103 bp, Artificial Sequence
  Synthetic Polynucleotide
taatacgactcactatagggtcaacccagaaccagggtgccattgtacccaacagaggagagggtacatgggcaccctgaacctggcggcagcgcaaaagatg

SEQ ID NO: 20990 - DNA, 103 bp, Artificial Sequence
  Synthetic Polynucleotide
taatacgactcactatagggtggattcaacccagaaccagggtgccattgaacagaggagacaatggatgcctggttctaacctggcggcagcgcaaaagatg

SEQ ID NO: 20991 - DNA, 103 bp, Artificial Sequence
  Synthetic Polynucleotide
taatacgactcactataggggccagtggattcaacccagaaccagggtgcaacagaggagagcacccatgttctgggttaacctggcggcagcgcaaaagatg

SEQ ID NO: 20992 - DNA, 103 bp, Artificial Sequence
  Synthetic Polynucleotide
taatacgactcactatagggaataagccagtggattcaacccagaaccagaacagaggagactggttatgggttgaatcaacctggcggcagcgcaaaagatg

SEQ ID NO: 20993 - DNA, 103 bp, Artificial Sequence
  Synthetic Polynucleotide
taatacgactcactatagggcgcgaaataagccagtggattcaacccagaaacagaggagatctgggatgaatccactgaacctggcggcagcgcaaaagatg

SEQ ID NO: 20994 - DNA, 103 bp, Artificial Sequence
  Synthetic Polynucleotide
taatacgactcactataggggaggtcgcgaaataagccagtggattcaacaacagaggagagttgaaatgactggcttaaacctggcggcagcgcaaaagatg

SEQ ID NO: 20995 - DNA, 103 bp, Artificial Sequence
  Synthetic Polynucleotide
taatacgactcactatagggcacgagaggtcgcgaaataagccagtggataacagaggagaatccacatgcttatttcgaacctggcggcagcgcaaaagatg

SEQ ID NO: 20996 - DNA, 103 bp, Artificial Sequence
  Synthetic Polynucleotide
taatacgactcactatagggtaaaacacgagaggtcgcgaaataagccagaacagaggagactggctatgttcgcgaccaacctggcggcagcgcaaaagatg

SEQ ID NO: 20997 - DNA, 103 bp, Artificial Sequence
  Synthetic Polynucleotide
taatacgactcactataggggacattaaaacacgagaggtcgcgaaataaaacagaggagattatttatggacctctcgaacctggcggcagcgcaaaagatg

SEQ ID NO: 20998 - DNA, 103 bp, Artificial Sequence
  Synthetic Polynucleotide
taatacgactcactatagggccagggacattaaaacacgagaggtcgcgaaacagaggagatcgcgaatgctcgtgtttaacctggcggcagcgcaaaagatg

SEQ ID NO: 20999 - DNA, 103 bp, Artificial Sequence
  Synthetic Polynucleotide
taatacgactcactatagggagttgttaactttcgggttttacagccgggaacagaggagacccggcatgaaaacccgaaacctggcggcagcgcaaaagatg

SEQ ID NO: 21000 - DNA, 103 bp, Artificial Sequence
  Synthetic Polynucleotide
taatacgactcactatagggtgagtccagggacattaaaacacgagaggtaacagaggagaacctctatggttttaatgaacctggcggcagcgcaaaagatg

SEQ ID NO: 21001 - DNA, 103 bp, Artificial Sequence
  Synthetic Polynucleotide
taatacgactcactatagggagcggtgagtccagggacattaaaacacgaaacagaggagatcgtgtatgaatgtccctaacctggcggcagcgcaaaagatg

SEQ ID NO: 21002 - DNA, 103 bp, Artificial Sequence
  Synthetic Polynucleotide
taatacgactcactatagggtagccagcggtgagtccagggacattaaaaaacagaggagattttaaatgccctggactaacctggcggcagcgcaaaagatg

SEQ ID NO: 21003 - DNA, 103 bp, Artificial Sequence
  Synthetic Polynucleotide
taatacgactcactatagggggccatagccagcggtgagtccagggacataacagaggagaatgtccatggactcaccgaacctggcggcagcgcaaaagatg

SEQ ID NO: 21004 - DNA, 103 bp, Artificial Sequence
  Synthetic Polynucleotide
taatacgactcactatagggttgtgggccatagccagcggtgagtccaggaacagaggagacctggaatgaccgctggcaacctggcggcagcgcaaaagatg

SEQ ID NO: 21005 - DNA, 103 bp, Artificial Sequence
  Synthetic Polynucleotide
taatacgactcactatagggatagcttgtgggccatagccagcggtgagtaacagaggagaactcacatgtggctatggaacctggcggcagcgcaaaagatg

SEQ ID NO: 21006 - DNA, 103 bp, Artificial Sequence
  Synthetic Polynucleotide
taatacgactcactatagggcgtatatagcttgtgggccatagccagcggaacagaggagaccgctgatgatggcccacaacctggcggcagcgcaaaagatg

SEQ ID NO: 21007 - DNA, 103 bp, Artificial Sequence
  Synthetic Polynucleotide
taatacgactcactatagggactgccgtatatagcttgtgggccatagccaacagaggagaggctatatgccacaagctaacctggcggcagcgcaaaagatg

SEQ ID NO: 21008 - DNA, 103 bp, Artificial Sequence
  Synthetic Polynucleotide
taatacgactcactatagggactacactgccgtatatagcttgtgggccaaacagaggagatggcccatgagctatataaacctggcggcagcgcaaaagatg

SEQ ID NO: 21009 - DNA, 103 bp, Artificial Sequence
  Synthetic Polynucleotide
taatacgactcactataggggtgttactacactgccgtatatagcttgtgaacagaggagacacaagatgtatacggcaaacctggcggcagcgcaaaagatg

SEQ ID NO: 21010 - DNA, 103 bp, Artificial Sequence
  Synthetic Polynucleotide
taatacgactcactatagggcgcgaagttgttaactttcgggttttacagaacagaggagactgtaaatgccgaaagttaacctggcggcagcgcaaaagatg

SEQ ID NO: 21011 - DNA, 103 bp, Artificial Sequence
  Synthetic Polynucleotide
taatacgactcactataggggggtagtgttactacactgccgtatatagcaacagaggagagctataatgggcagtgtaaacctggcggcagcgcaaaagatg

SEQ ID NO: 21012 - DNA, 103 bp, Artificial Sequence
  Synthetic Polynucleotide
taatacgactcactatagggataccgggtagtgttactacactgccgtataacagaggagaatacggatgtgtagtaacaacctggcggcagcgcaaaagatg

SEQ ID NO: 21013 - DNA, 103 bp, Artificial Sequence
  Synthetic Polynucleotide
taatacgactcactatagggcctgcataccgggtagtgttactacactgcaacagaggagagcagtgatgtaacactacaacctggcggcagcgcaaaagatg

SEQ ID NO: 21014 - DNA, 103 bp, Artificial Sequence
  Synthetic Polynucleotide
taatacgactcactatagggacaagcctgcataccgggtagtgttactacaacagaggagagtagtaatgctacccggtaacctggcggcagcgcaaaagatg

SEQ ID NO: 21015 - DNA, 103 bp, Artificial Sequence
  Synthetic Polynucleotide
taatacgactcactatagggtactcacaagcctgcataccgggtagtgttaacagaggagaaacactatgcggtatgcaaacctggcggcagcgcaaaagatg

SEQ ID NO: 21016 - DNA, 103 bp, Artificial Sequence
  Synthetic Polynucleotide
taatacgactcactatagggcagtgtactcacaagcctgcataccgggtaaacagaggagatacccgatgtgcaggcttaacctggcggcagcgcaaaagatg

SEQ ID NO: 21017 - DNA, 103 bp, Artificial Sequence
  Synthetic Polynucleotide
taatacgactcactatagggagacccagtgtactcacaagcctgcataccaacagaggagaggtatgatggcttgtgagaacctggcggcagcgcaaaagatg

SEQ ID NO: 21018 - DNA, 103 bp, Artificial Sequence
  Synthetic Polynucleotide
taatacgactcactatagggccgcgagacccagtgtactcacaagcctgcaacagaggagagcaggcatgtgagtacacaacctggcggcagcgcaaaagatg

SEQ ID NO: 21019 - DNA, 103 bp, Artificial Sequence
  Synthetic Polynucleotide
taatacgactcactatagggaggaaccgcgagacccagtgtactcacaagaacagaggagacttgtgatgacactgggtaacctggcggcagcgcaaaagatg

SEQ ID NO: 21020 - DNA, 103 bp, Artificial Sequence
  Synthetic Polynucleotide
taatacgactcactatagggatcgtaggaaccgcgagacccagtgtactcaacagaggagagagtacatggggtctcgcaacctggcggcagcgcaaaagatg

SEQ ID NO: 21021 - DNA, 103 bp, Artificial Sequence
  Synthetic Polynucleotide
taatacgactcactatagggggtgacgcgaagttgttaactttcgggtttaacagaggagaaaacccatgagttaacaaaacctggcggcagcgcaaaagatg

SEQ ID NO: 21022 - DNA, 103 bp, Artificial Sequence
  Synthetic Polynucleotide
taatacgactcactatagggtaataatcgtaggaaccgcgagacccagtgaacagaggagacactggatgtcgcggttcaacctggcggcagcgcaaaagatg

SEQ ID NO: 21023 - DNA, 103 bp, Artificial Sequence
  Synthetic Polynucleotide
taatacgactcactatagggcgttgtaataatcgtaggaaccgcgagaccaacagaggagaggtctcatggttcctacgaacctggcggcagcgcaaaagatg

SEQ ID NO: 21024 - DNA, 103 bp, Artificial Sequence
  Synthetic Polynucleotide
taatacgactcactataggggcccacgttgtaataatcgtaggaaccgcgaacagaggagacgcggtatgtacgattataacctggcggcagcgcaaaagatg

SEQ ID NO: 21025 - DNA, 103 bp, Artificial Sequence
  Synthetic Polynucleotide
taatacgactcactataggggtccagcccacgttgtaataatcgtaggaaaacagaggagattcctaatgttattacaaaacctggcggcagcgcaaaagatg

SEQ ID NO: 21026 - DNA, 103 bp, Artificial Sequence
  Synthetic Polynucleotide
taatacgactcactataggggtgatgtccagcccacgttgtaataatcgtaacagaggagaacgattatgacaacgtggaacctggcggcagcgcaaaagatg

SEQ ID NO: 21027 - DNA, 103 bp, Artificial Sequence
  Synthetic Polynucleotide
taatacgactcactatagggcctcagtgatgtccagcccacgttgtaataaacagaggagatattacatggtgggctggaacctggcggcagcgcaaaagatg

SEQ ID NO: 21028 - DNA, 103 bp, Artificial Sequence
  Synthetic Polynucleotide
taatacgactcactatagggtgcttcctcagtgatgtccagcccacgttgaacagaggagacaacgtatgctggacatcaacctggcggcagcgcaaaagatg

SEQ ID NO: 21029 - DNA, 103 bp, Artificial Sequence
  Synthetic Polynucleotide
taatacgactcactataggggagggtgcttcctcagtgatgtccagcccaaacagaggagatgggctatgcatcactgaaacctggcggcagcgcaaaagatg

SEQ ID NO: 21030 - DNA, 103 bp, Artificial Sequence
  Synthetic Polynucleotide
taatacgactcactatagggcaacagagggtgcttcctcagtgatgtccaaacagaggagatggacaatgctgaggaagaacctggcggcagcgcaaaagatg

SEQ ID NO: 21031 - DNA, 103 bp, Artificial Sequence
  Synthetic Polynucleotide
taatacgactcactatagggaagaccaacagagggtgcttcctcagtgataacagaggagaatcactatggaagcacccaacctggcggcagcgcaaaagatg

SEQ ID NO: 21032 - DNA, 103 bp, Artificial Sequence
  Synthetic Polynucleotide
taatacgactcactatagggatggaggtgacgcgaagttgttaactttcgaacagaggagacgaaagatgacaacttcgaacctggcggcagcgcaaaagatg

SEQ ID NO: 21033 - DNA, 103 bp, Artificial Sequence
  Synthetic Polynucleotide
taatacgactcactatagggtggccaagaccaacagagggtgcttcctcaaacagaggagatgaggaatgaccctctgtaacctggcggcagcgcaaaagatg

SEQ ID NO: 21034 - DNA, 103 bp, Artificial Sequence
  Synthetic Polynucleotide
taatacgactcactatagggattgttggccaagaccaacagagggtgcttaacagaggagaaagcacatgctgttggtcaacctggcggcagcgcaaaagatg

SEQ ID NO: 21035 - DNA, 103 bp, Artificial Sequence
  Synthetic Polynucleotide
taatacgactcactatagggaccctattgttggccaagaccaacagagggaacagaggagaccctctatgggtcttggcaacctggcggcagcgcaaaagatg

SEQ ID NO: 21036 - DNA, 103 bp, Artificial Sequence
  Synthetic Polynucleotide
taatacgactcactatagggctcctaccctattgttggccaagaccaacaaacagaggagatgttggatgtggccaacaaacctggcggcagcgcaaaagatg

SEQ ID NO: 21037 - DNA, 103 bp, Artificial Sequence
  Synthetic Polynucleotide
taatacgactcactatagggaccatctcctaccctattgttggccaagacaacagaggagagtcttgatgaacaataggaacctggcggcagcgcaaaagatg

SEQ ID NO: 21038 - DNA, 103 bp, Artificial Sequence
  Synthetic Polynucleotide
taatacgactcactataggggcaataccatctcctaccctattgttggccaacagaggagaggccaaatgtagggtaggaacctggcggcagcgcaaaagatg

SEQ ID NO: 21039 - DNA, 103 bp, Artificial Sequence
  Synthetic Polynucleotide
taatacgactcactatagggcatgggcaataccatctcctaccctattgtaacagaggagaacaataatgtaggagatgaacctggcggcagcgcaaaagatg

SEQ ID NO: 21040 - DNA, 103 bp, Artificial Sequence
  Synthetic Polynucleotide
taatacgactcactatagggctgaacatgggcaataccatctcctaccctaacagaggagaagggtaatggatggtattaacctggcggcagcgcaaaagatg

SEQ ID NO: 21041 - DNA, 103 bp, Artificial Sequence
  Synthetic Polynucleotide
taatacgactcactatagggccgacctgaacatgggcaataccatctcctaacagaggagaaggagaatgtattgcccaaacctggcggcagcgcaaaagatg

SEQ ID NO: 21042 - DNA, 103 bp, Artificial Sequence
  Synthetic Polynucleotide
taatacgactcactatagggctcttccgacctgaacatgggcaataccataacagaggagaatggtaatgcccatgttcaacctggcggcagcgcaaaagatg

SEQ ID NO: 21043 - DNA, 103 bp, Artificial Sequence
  Synthetic Polynucleotide
taatacgactcactatagggaaaccatggaggtgacgcgaagttgttaacaacagaggagagttaacatgttcgcgtcaaacctggcggcagcgcaaaagatg

SEQ ID NO: 21044 - DNA, 103 bp, Artificial Sequence
  Synthetic Polynucleotide
taatacgactcactatagggggcctctcttccgacctgaacatgggcaataacagaggagaattgccatggttcaggtcaacctggcggcagcgcaaaagatg

SEQ ID NO: 21045 - DNA, 103 bp, Artificial Sequence
  Synthetic Polynucleotide
taatacgactcactatagggatgttggcctctcttccgacctgaacatggaacagaggagaccatgtatgggtcggaagaacctggcggcagcgcaaaagatg

SEQ ID NO: 21046 - DNA, 103 bp, Artificial Sequence
  Synthetic Polynucleotide
taatacgactcactatagggaaggtatgttggcctctcttccgacctgaaaacagaggagattcaggatggaagagaggaacctggcggcagcgcaaaagatg

SEQ ID NO: 21047 - DNA, 103 bp, Artificial Sequence
  Synthetic Polynucleotide
taatacgactcactatagggcaaccaaggtatgttggcctctcttccgacaacagaggagagtcggaatggaggccaacaacctggcggcagcgcaaaagatg

SEQ ID NO: 21048 - DNA, 103 bp, Artificial Sequence
  Synthetic Polynucleotide
taatacgactcactatagggggtaacaaccaaggtatgttggcctctcttaacagaggagaaagagaatgcaacataccaacctggcggcagcgcaaaagatg

SEQ ID NO: 21049 - DNA, 103 bp, Artificial Sequence
  Synthetic Polynucleotide
taatacgactcactataggggaccgggtaacaaccaaggtatgttggcctaacagaggagaaggccaatgtaccttggtaacctggcggcagcgcaaaagatg

SEQ ID NO: 21050 - DNA, 103 bp, Artificial Sequence
  Synthetic Polynucleotide
taatacgactcactatagggtggctgaccgggtaacaaccaaggtatgttaacagaggagaaacataatgtggttgttaaacctggcggcagcgcaaaagatg

SEQ ID NO: 21051 - DNA, 103 bp, Artificial Sequence
  Synthetic Polynucleotide
taatacgactcactatagggctctgtggctgaccgggtaacaaccaaggtaacagaggagaaccttgatggttacccggaacctggcggcagcgcaaaagatg

SEQ ID NO: 21052 - DNA, 103 bp, Artificial Sequence
  Synthetic Polynucleotide
taatacgactcactatagggcacgcctctgtggctgaccgggtaacaaccaacagaggagaggttgtatgccggtcagcaacctggcggcagcgcaaaagatg

SEQ ID NO: 21053 - DNA, 103 bp, Artificial Sequence
  Synthetic Polynucleotide
taatacgactcactataggggcattcacgcctctgtggctgaccgggtaaaacagaggagattacccatgcagccacagaacctggcggcagcgcaaaagatg

SEQ ID NO: 21054 - DNA, 103 bp, Artificial Sequence
  Synthetic Polynucleotide
taatacgactcactatagggccgacaaaccatggaggtgacgcgaagttgaacagaggagacaacttatggtcacctccaacctggcggcagcgcaaaagatg

SEQ ID NO: 21055 - DNA, 103 bp, Artificial Sequence
  Synthetic Polynucleotide
taatacgactcactataggggctgtgcattcacgcctctgtggctgaccgaacagaggagacggtcaatgacagaggcgaacctggcggcagcgcaaaagatg

SEQ ID NO: 21056 - DNA, 103 bp, Artificial Sequence
  Synthetic Polynucleotide
taatacgactcactatagggctgtagctgtgcattcacgcctctgtggctaacagaggagaagccacatgggcgtgaataacctggcggcagcgcaaaagatg

SEQ ID NO: 21057 - DNA, 103 bp, Artificial Sequence
  Synthetic Polynucleotide
taatacgactcactatagggatgacctgtagctgtgcattcacgcctctgaacagaggagacagaggatggaatgcacaaacctggcggcagcgcaaaagatg

SEQ ID NO: 21058 - DNA, 103 bp, Artificial Sequence
  Synthetic Polynucleotide
taatacgactcactataggggttccatgacctgtagctgtgcattcacgcaacagaggagagcgtgaatgcacagctacaacctggcggcagcgcaaaagatg

SEQ ID NO: 21059 - DNA, 103 bp, Artificial Sequence
  Synthetic Polynucleotide
taatacgactcactatagggttgtagttccatgacctgtagctgtgcattaacagaggagaaatgcaatgctacaggtcaacctggcggcagcgcaaaagatg

SEQ ID NO: 21060 - DNA, 103 bp, Artificial Sequence
  Synthetic Polynucleotide
taatacgactcactatagggagcacttgtagttccatgacctgtagctgtaacagaggagaacagctatgggtcatggaaacctggcggcagcgcaaaagatg

SEQ ID NO: 21061 - DNA, 103 bp, Artificial Sequence
  Synthetic Polynucleotide
taatacgactcactatagggcaactagcacttgtagttccatgacctgtaaacagaggagatacaggatgtggaactacaacctggcggcagcgcaaaagatg

SEQ ID NO: 21062 - DNA, 103 bp, Artificial Sequence
  Synthetic Polynucleotide
taatacgactcactataggggttggcaactagcacttgtagttccatgacaacagaggagagtcatgatgctacaagtgaacctggcggcagcgcaaaagatg

SEQ ID NO: 21063 - DNA, 103 bp, Artificial Sequence
  Synthetic Polynucleotide
taatacgactcactatagggtttgtgttggcaactagcacttgtagttccaacagaggagaggaactatgagtgctagtaacctggcggcagcgcaaaagatg

SEQ ID NO: 21064 - DNA, 103 bp, Artificial Sequence
  Synthetic Polynucleotide
taatacgactcactatagggggtcgtttgtgttggcaactagcacttgtaaacagaggagatacaagatgtagttgccaaacctggcggcagcgcaaaagatg

SEQ ID NO: 21065 - DNA, 103 bp, Artificial Sequence
  Synthetic Polynucleotide
taatacgactcactatagggacagaccgacaaaccatggaggtgacgcgaaacagaggagatcgcgtatgctccatggtaacctggcggcagcgcaaaagatg

SEQ ID NO: 21066 - DNA, 103 bp, Artificial Sequence
  Synthetic Polynucleotide
taatacgactcactatagggtgtcaggtcgtttgtgttggcaactagcacaacagaggagagtgctaatggccaacacaaacctggcggcagcgcaaaagatg

SEQ ID NO: 21067 - DNA, 103 bp, Artificial Sequence
  Synthetic Polynucleotide
taatacgactcactatagggtcctctgtcaggtcgtttgtgttggcaactaacagaggagaagttgcatgcacaaacgaaacctggcggcagcgcaaaagatg

SEQ ID NO: 21068 - DNA, 103 bp, Artificial Sequence
  Synthetic Polynucleotide
taatacgactcactatagggaaggttcctctgtcaggtcgtttgtgttggaacagaggagaccaacaatgacgacctgaaacctggcggcagcgcaaaagatg

SEQ ID NO: 21069 - DNA, 103 bp, Artificial Sequence
  Synthetic Polynucleotide
taatacgactcactatagggcatctaaggttcctctgtcaggtcgtttgtaacagaggagaacaaacatgctgacagagaacctggcggcagcgcaaaagatg

SEQ ID NO: 21070 - DNA, 103 bp, Artificial Sequence
  Synthetic Polynucleotide
taatacgactcactataggggtattcatctaaggttcctctgtcaggtcgaacagaggagacgacctatgagaggaaccaacctggcggcagcgcaaaagatg

SEQ ID NO: 21071 - DNA, 103 bp, Artificial Sequence
  Synthetic Polynucleotide
taatacgactcactatagggcaaatgtattcatctaaggttcctctgtcaaacagaggagatgacagatgaaccttagaaacctggcggcagcgcaaaagatg

SEQ ID NO: 21072 - DNA, 103 bp, Artificial Sequence
  Synthetic Polynucleotide
taatacgactcactatagggtaccccaaatgtattcatctaaggttcctcaacagaggagagaggaaatgtagatgaataacctggcggcagcgcaaaagatg

SEQ ID NO: 21073 - DNA, 103 bp, Artificial Sequence
  Synthetic Polynucleotide
taatacgactcactataggggaacctaccccaaatgtattcatctaaggtaacagaggagaaccttaatggaatacattaacctggcggcagcgcaaaagatg

SEQ ID NO: 21074 - DNA, 103 bp, Artificial Sequence
  Synthetic Polynucleotide
taatacgactcactataggggttgagaacctaccccaaatgtattcatctaacagaggagaagatgaatgcatttggggaacctggcggcagcgcaaaagatg

SEQ ID NO: 21075 - DNA, 103 bp, Artificial Sequence
  Synthetic Polynucleotide
taatacgactcactatagggtaccagttgagaacctaccccaaatgtattaacagaggagaaatacaatgggggtaggtaacctggcggcagcgcaaaagatg

SEQ ID NO: 21076 - DNA, 103 bp, Artificial Sequence
  Synthetic Polynucleotide
taatacgactcactataggggccttacagaccgacaaaccatggaggtgaaacagaggagatcacctatgtggtttgtcaacctggcggcagcgcaaaagatg

SEQ ID NO: 21077 - DNA, 103 bp, Artificial Sequence
  Synthetic Polynucleotide
taatacgactcactataggggaaaataccagttgagaacctaccccaaataacagaggagaatttggatgaggttctcaaacctggcggcagcgcaaaagatg

SEQ ID NO: 21078 - DNA, 103 bp, Artificial Sequence
  Synthetic Polynucleotide
taatacgactcactatagggggatggaaaataccagttgagaacctacccaacagaggagagggtagatgctcaactggaacctggcggcagcgcaaaagatg

SEQ ID NO: 21079 - DNA, 103 bp, Artificial Sequence
  Synthetic Polynucleotide
taatacgactcactatagggcggctggatggaaaataccagttgagaaccaacagaggagaggttctatgctggtatttaacctggcggcagcgcaaaagatg

SEQ ID NO: 21080 - DNA, 103 bp, Artificial Sequence
  Synthetic Polynucleotide
taatacgactcactatagggcaactcggctggatggaaaataccagttgaaacagaggagatcaactatgattttccataacctggcggcagcgcaaaagatg

SEQ ID NO: 21081 - DNA, 103 bp, Artificial Sequence
  Synthetic Polynucleotide
taatacgactcactataggggaagtcaactcggctggatggaaaataccaaacagaggagatggtatatgccatccagcaacctggcggcagcgcaaaagatg

SEQ ID NO: 21082 - DNA, 103 bp, Artificial Sequence
  Synthetic Polynucleotide
taatacgactcactatagggtaaaagaagtcaactcggctggatggaaaaaacagaggagattttccatgcagccgagtaacctggcggcagcgcaaaagatg

SEQ ID NO: 21083 - DNA, 103 bp, Artificial Sequence
  Synthetic Polynucleotide
taatacgactcactataggggtttgtaaaagaagtcaactcggctggatgaacagaggagacatccaatggagttgactaacctggcggcagcgcaaaagatg

SEQ ID NO: 21084 - DNA, 103 bp, Artificial Sequence
  Synthetic Polynucleotide
taatacgactcactatagggtcgacgtttgtaaaagaagtcaactcggctaacagaggagaagccgaatggacttctttaacctggcggcagcgcaaaagatg

SEQ ID NO: 21085 - DNA, 103 bp, Artificial Sequence
  Synthetic Polynucleotide
taatacgactcactatagggtcatttcgacgtttgtaaaagaagtcaactaacagaggagaagttgaatgcttttacaaaacctggcggcagcgcaaaagatg

SEQ ID NO: 21086 - DNA, 103 bp, Artificial Sequence
  Synthetic Polynucleotide
taatacgactcactatagggaattctcatttcgacgtttgtaaaagaagtaacagaggagaacttctatgacaaacgtcaacctggcggcagcgcaaaagatg

SEQ ID NO: 21087 - DNA, 103 bp, Artificial Sequence
  Synthetic Polynucleotide
taatacgactcactatagggctctatattttaaccaacagttcgtaaggcaacagaggagagccttaatgactgttggtaacctggcggcagcgcaaaagatg

SEQ ID NO: 21088 - DNA, 103 bp, Artificial Sequence
  Synthetic Polynucleotide
taatacgactcactatagggcgcaggccttacagaccgacaaaccatggaaacagaggagatccatgatgtgtcggtctaacctggcggcagcgcaaaagatg

SEQ ID NO: 21089 - DNA, 103 bp, Artificial Sequence
  Synthetic Polynucleotide
taatacgactcactatagggcaacgaattctcatttcgacgtttgtaaaaaacagaggagattttacatgcgtcgaaataacctggcggcagcgcaaaagatg

SEQ ID NO: 21090 - DNA, 103 bp, Artificial Sequence
  Synthetic Polynucleotide
taatacgactcactatagggcccaacaacgaattctcatttcgacgtttgaacagaggagacaaacgatgaaatgagaaaacctggcggcagcgcaaaagatg

SEQ ID NO: 21091 - DNA, 103 bp, Artificial Sequence
  Synthetic Polynucleotide
taatacgactcactatagggttcagcccaacaacgaattctcatttcgacaacagaggagagtcgaaatgagaattcgtaacctggcggcagcgcaaaagatg

SEQ ID NO: 21092 - DNA, 103 bp, Artificial Sequence
  Synthetic Polynucleotide
taatacgactcactataggggaatcttcagcccaacaacgaattctcattaacagaggagaaatgagatgtcgttgttgaacctggcggcagcgcaaaagatg

SEQ ID NO: 21093 - DNA, 103 bp, Artificial Sequence
  Synthetic Polynucleotide
taatacgactcactatagggcgtttgaatcttcagcccaacaacgaattcaacagaggagagaattcatggttgggctgaacctggcggcagcgcaaaagatg

SEQ ID NO: 21094 - DNA, 103 bp, Artificial Sequence
  Synthetic Polynucleotide
taatacgactcactatagggatctccgtttgaatcttcagcccaacaacgaacagaggagacgttgtatggctgaagataacctggcggcagcgcaaaagatg

SEQ ID NO: 21095 - DNA, 103 bp, Artificial Sequence
  Synthetic Polynucleotide
taatacgactcactatagggaggacatctccgtttgaatcttcagcccaaaacagaggagattgggcatgagattcaaaaacctggcggcagcgcaaaagatg

SEQ ID NO: 21096 - DNA, 103 bp, Artificial Sequence
  Synthetic Polynucleotide
taatacgactcactatagggtttctaggacatctccgtttgaatcttcagaacagaggagactgaagatgcaaacggagaacctggcggcagcgcaaaagatg

SEQ ID NO: 21097 - DNA, 103 bp, Artificial Sequence
  Synthetic Polynucleotide
taatacgactcactatagggacccgtttctaggacatctccgtttgaatcaacagaggagagattcaatgggagatgtcaacctggcggcagcgcaaaagatg

SEQ ID NO: 21098 - DNA, 103 bp, Artificial Sequence
  Synthetic Polynucleotide
taatacgactcactatagggggggcacccgtttctaggacatctccgtttaacagaggagaaaacggatgtgtcctagaaacctggcggcagcgcaaaagatg

SEQ ID NO: 21099 - DNA, 103 bp, Artificial Sequence
  Synthetic Polynucleotide
taatacgactcactatagggagaatcgcaggccttacagaccgacaaaccaacagaggagaggtttgatggtctgtaagaacctggcggcagcgcaaaagatg

SEQ ID NO: 21100 - DNA, 103 bp, Artificial Sequence
  Synthetic Polynucleotide
taatacgactcactatagggtaaccggggcacccgtttctaggacatctcaacagaggagagagatgatgtagaaacggaacctggcggcagcgcaaaagatg

SEQ ID NO: 21101 - DNA, 103 bp, Artificial Sequence
  Synthetic Polynucleotide
taatacgactcactataggggtctttaaccggggcacccgtttctaggacaacagaggagagtcctaatgacgggtgccaacctggcggcagcgcaaaagatg

SEQ ID NO: 21102 - DNA, 103 bp, Artificial Sequence
  Synthetic Polynucleotide
taatacgactcactatagggactatgtctttaaccggggcacccgtttctaacagaggagaagaaacatgtgccccggtaacctggcggcagcgcaaaagatg

SEQ ID NO: 21103 - DNA, 103 bp, Artificial Sequence
  Synthetic Polynucleotide
taatacgactcactatagggcctccactatgtctttaaccggggcacccgaacagaggagacgggtgatgcggttaaagaacctggcggcagcgcaaaagatg

SEQ ID NO: 21104 - DNA, 103 bp, Artificial Sequence
  Synthetic Polynucleotide
taatacgactcactatagggaccgccctccactatgtctttaaccggggcaacagaggagagccccgatgaaagacataaacctggcggcagcgcaaaagatg

SEQ ID NO: 21105 - DNA, 103 bp, Artificial Sequence
  Synthetic Polynucleotide
taatacgactcactatagggtccacaccgccctccactatgtctttaaccaacagaggagaggttaaatgcatagtggaaacctggcggcagcgcaaaagatg

SEQ ID NO: 21106 - DNA, 103 bp, Artificial Sequence
  Synthetic Polynucleotide
taatacgactcactatagggtaatctccacaccgccctccactatgtcttaacagaggagaaagacaatgtggagggcgaacctggcggcagcgcaaaagatg

SEQ ID NO: 21107 - DNA, 103 bp, Artificial Sequence
  Synthetic Polynucleotide
taatacgactcactatagggcacactaatctccacaccgccctccactataacagaggagaatagtgatgggcggtgtgaacctggcggcagcgcaaaagatg

SEQ ID NO: 21108 - DNA, 103 bp, Artificial Sequence
  Synthetic Polynucleotide
taatacgactcactataggggcgttcacactaatctccacaccgccctccaacagaggagaggagggatgtgtggagataacctggcggcagcgcaaaagatg

SEQ ID NO: 21109 - DNA, 103 bp, Artificial Sequence
  Synthetic Polynucleotide
taatacgactcactatagggggatagcgttcacactaatctccacaccgcaacagaggagagcggtgatgagattagtgaacctggcggcagcgcaaaagatg

SEQ ID NO: 21110 - DNA, 103 bp, Artificial Sequence
  Synthetic Polynucleotide
taatacgactcactataggggaataagaatcgcaggccttacagaccgacaacagaggagagtcggtatgtaaggcctgaacctggcggcagcgcaaaagatg

SEQ ID NO: 21111 - DNA, 103 bp, Artificial Sequence
  Synthetic Polynucleotide
taatacgactcactatagggaagtaggatagcgttcacactaatctccacaacagaggagagtggagatgagtgtgaacaacctggcggcagcgcaaaagatg

SEQ ID NO: 21112 - DNA, 103 bp, Artificial Sequence
  Synthetic Polynucleotide
taatacgactcactatagggttagtaagtaggatagcgttcacactaatcaacagaggagagattagatggaacgctataacctggcggcagcgcaaaagatg

SEQ ID NO: 21113 - DNA, 103 bp, Artificial Sequence
  Synthetic Polynucleotide
taatacgactcactatagggttgagttagtaagtaggatagcgttcacacaacagaggagagtgtgaatgctatcctacaacctggcggcagcgcaaaagatg

SEQ ID NO: 21114 - DNA, 103 bp, Artificial Sequence
  Synthetic Polynucleotide
taatacgactcactatagggatccgttgagttagtaagtaggatagcgttaacagaggagaaacgctatgctacttactaacctggcggcagcgcaaaagatg

SEQ ID NO: 21115 - DNA, 103 bp, Artificial Sequence
  Synthetic Polynucleotide
taatacgactcactatagggatatgatccgttgagttagtaagtaggataaacagaggagatatcctatgtactaactcaacctggcggcagcgcaaaagatg

SEQ ID NO: 21116 - DNA, 103 bp, Artificial Sequence
  Synthetic Polynucleotide
taatacgactcactatagggtccttatatgatccgttgagttagtaagtaaacagaggagatacttaatgactcaacggaacctggcggcagcgcaaaagatg

SEQ ID NO: 21117 - DNA, 103 bp, Artificial Sequence
  Synthetic Polynucleotide
taatacgactcactatagggaaccgtccttatatgatccgttgagttagtaacagaggagaactaacatgacggatcataacctggcggcagcgcaaaagatg

SEQ ID NO: 21118 - DNA, 103 bp, Artificial Sequence
  Synthetic Polynucleotide
taatacgactcactataggggctggaaccgtccttatatgatccgttgagaacagaggagactcaacatgtcatataagaacctggcggcagcgcaaaagatg

SEQ ID NO: 21119 - DNA, 103 bp, Artificial Sequence
  Synthetic Polynucleotide
taatacgactcactatagggtcacagctggaaccgtccttatatgatccgaacagaggagacggatcatgtaaggacggaacctggcggcagcgcaaaagatg

SEQ ID NO: 21120 - DNA, 103 bp, Artificial Sequence
  Synthetic Polynucleotide
taatacgactcactatagggtcgtctcacagctggaaccgtccttatatgaacagaggagacatataatgacggttccaaacctggcggcagcgcaaaagatg

SEQ ID NO: 21121 - DNA, 103 bp, Artificial Sequence
  Synthetic Polynucleotide
taatacgactcactatagggcgttagaataagaatcgcaggccttacagaaacagaggagatctgtaatgcctgcgattaacctggcggcagcgcaaaagatg

SEQ ID NO: 21122 - DNA, 103 bp, Artificial Sequence
  Synthetic Polynucleotide
taatacgactcactatagggtaggttcgtctcacagctggaaccgtccttaacagaggagaaaggacatgtccagctgtaacctggcggcagcgcaaaagatg

SEQ ID NO: 21123 - DNA, 103 bp, Artificial Sequence
  Synthetic Polynucleotide
taatacgactcactatagggcttgataggttcgtctcacagctggaaccgaacagaggagacggttcatgctgtgagacaacctggcggcagcgcaaaagatg

SEQ ID NO: 21124 - DNA, 103 bp, Artificial Sequence
  Synthetic Polynucleotide
taatacgactcactatagggtccggcttgataggttcgtctcacagctggaacagaggagaccagctatgagacgaaccaacctggcggcagcgcaaaagatg

SEQ ID NO: 21125 - DNA, 103 bp, Artificial Sequence
  Synthetic Polynucleotide
taatacgactcactatagggttggctccggcttgataggttcgtctcacaaacagaggagatgtgagatgaacctatcaaacctggcggcagcgcaaaagatg

SEQ ID NO: 21126 - DNA, 103 bp, Artificial Sequence
  Synthetic Polynucleotide
taatacgactcactatagggggtatttggctccggcttgataggttcgtcaacagaggagagacgaaatgatcaagccgaacctggcggcagcgcaaaagatg

SEQ ID NO: 21127 - DNA, 103 bp, Artificial Sequence
  Synthetic Polynucleotide
taatacgactcactatagggttcaaggtatttggctccggcttgataggtaacagaggagaacctatatggccggagccaacctggcggcagcgcaaaagatg

SEQ ID NO: 21128 - DNA, 103 bp, Artificial Sequence
  Synthetic Polynucleotide
taatacgactcactataggggcctcttcaaggtatttggctccggcttgaaacagaggagatcaagcatgagccaaataaacctggcggcagcgcaaaagatg

SEQ ID NO: 21129 - DNA, 103 bp, Artificial Sequence
  Synthetic Polynucleotide
taatacgactcactatagggtccgtgcctcttcaaggtatttggctccggaacagaggagaccggagatgaataccttgaacctggcggcagcgcaaaagatg

SEQ ID NO: 21130 - DNA, 103 bp, Artificial Sequence
  Synthetic Polynucleotide
taatacgactcactatagggacgactccgtgcctcttcaaggtatttggcaacagaggagagccaaaatgcttgaagagaacctggcggcagcgcaaaagatg

SEQ ID NO: 21131 - DNA, 103 bp, Artificial Sequence
  Synthetic Polynucleotide
taatacgactcactataggggtcccacgactccgtgcctcttcaaggtataacagaggagaatacctatgagaggcacgaacctggcggcagcgcaaaagatg

SEQ ID NO: 21132 - DNA, 103 bp, Artificial Sequence
  Synthetic Polynucleotide
taatacgactcactatagggactggcgttagaataagaatcgcaggccttaacagaggagaaaggccatggattcttataacctggcggcagcgcaaaagatg

SEQ ID NO: 21133 - DNA, 103 bp, Artificial Sequence
  Synthetic Polynucleotide
taatacgactcactatagggacattgtcccacgactccgtgcctcttcaaaacagaggagattgaagatgcacggagtcaacctggcggcagcgcaaaagatg

SEQ ID NO: 21134 - DNA, 103 bp, Artificial Sequence
  Synthetic Polynucleotide
taatacgactcactatagggagttgacattgtcccacgactccgtgcctcaacagaggagagaggcaatgagtcgtgggaacctggcggcagcgcaaaagatg

SEQ ID NO: 21135 - DNA, 103 bp, Artificial Sequence
  Synthetic Polynucleotide
taatacgactcactatagggttcaaagttgacattgtcccacgactccgtaacagaggagaacggagatgtgggacaataacctggcggcagcgcaaaagatg

SEQ ID NO: 21136 - DNA, 103 bp, Artificial Sequence
  Synthetic Polynucleotide
taatacgactcactatagggtcctattcaaagttgacattgtcccacgacaacagaggagagtcgtgatgcaatgtcaaaacctggcggcagcgcaaaagatg

SEQ ID NO: 21137 - DNA, 103 bp, Artificial Sequence
  Synthetic Polynucleotide
taatacgactcactatagggtatgatcctattcaaagttgacattgtcccaacagaggagagggacaatgtcaactttgaacctggcggcagcgcaaaagatg

SEQ ID NO: 21138 - DNA, 103 bp, Artificial Sequence
  Synthetic Polynucleotide
taatacgactcactatagggcctcctatgatcctattcaaagttgacattaacagaggagaaatgtcatgtttgaatagaacctggcggcagcgcaaaagatg

SEQ ID NO: 21139 - DNA, 103 bp, Artificial Sequence
  Synthetic Polynucleotide
taatacgactcactatagggactgccctcctatgatcctattcaaagttgaacagaggagacaacttatgataggatcaaacctggcggcagcgcaaaagatg

SEQ ID NO: 21140 - DNA, 103 bp, Artificial Sequence
  Synthetic Polynucleotide
taatacgactcactataggggaacaactgccctcctatgatcctattcaaaacagaggagattgaatatgatcataggaaacctggcggcagcgcaaaagatg

SEQ ID NO: 21141 - DNA, 103 bp, Artificial Sequence
  Synthetic Polynucleotide
taatacgactcactatagggtctctgaacaactgccctcctatgatcctaaacagaggagataggatatgaggagggcaaacctggcggcagcgcaaaagatg

SEQ ID NO: 21142 - DNA, 103 bp, Artificial Sequence
  Synthetic Polynucleotide
taatacgactcactataggggcagttctctgaacaactgccctcctatgaaacagaggagatcatagatgggcagttgtaacctggcggcagcgcaaaagatg

SEQ ID NO: 21143 - DNA, 103 bp, Artificial Sequence
  Synthetic Polynucleotide
taatacgactcactatagggcatctactggcgttagaataagaatcgcagaacagaggagactgcgaatgttattctaaaacctggcggcagcgcaaaagatg

SEQ ID NO: 21144 - DNA, 103 bp, Artificial Sequence
  Synthetic Polynucleotide
taatacgactcactatagggaggttgcagttctctgaacaactgccctccaacagaggagaggagggatgttgttcagaaacctggcggcagcgcaaaagatg

SEQ ID NO: 21145 - DNA, 103 bp, Artificial Sequence
  Synthetic Polynucleotide
taatacgactcactatagggcttataggttgcagttctctgaacaactgcaacagaggagagcagttatgcagagaactaacctggcggcagcgcaaaagatg

SEQ ID NO: 21146 - DNA, 103 bp, Artificial Sequence
  Synthetic Polynucleotide
taatacgactcactatagggtcccacttataggttgcagttctctgaacaaacagaggagatgttcaatgaactgcaacaacctggcggcagcgcaaaagatg

SEQ ID NO: 21147 - DNA, 103 bp, Artificial Sequence
  Synthetic Polynucleotide
taatacgactcactatagggcctcctcccacttataggttgcagttctctaacagaggagaagagaaatgcaacctataaacctggcggcagcgcaaaagatg

SEQ ID NO: 21148 - DNA, 103 bp, Artificial Sequence
  Synthetic Polynucleotide
taatacgactcactatagggggcaccctcctcccacttataggttgcagtaacagaggagaactgcaatgtataagtggaacctggcggcagcgcaaaagatg

SEQ ID NO: 21149 - DNA, 103 bp, Artificial Sequence
  Synthetic Polynucleotide
taatacgactcactataggggtggcggcaccctcctcccacttataggttaacagaggagaaacctaatggtgggaggaaacctggcggcagcgcaaaagatg

SEQ ID NO: 21150 - DNA, 103 bp, Artificial Sequence
  Synthetic Polynucleotide
taatacgactcactatagggaggctgtggcggcaccctcctcccacttataacagaggagaataagtatgaggagggtgaacctggcggcagcgcaaaagatg

SEQ ID NO: 21151 - DNA, 103 bp, Artificial Sequence
  Synthetic Polynucleotide
taatacgactcactatagggggttgaggctgtggcggcaccctcctcccaaacagaggagatgggagatgggtgccgccaacctggcggcagcgcaaaagatg

SEQ ID NO: 21152 - DNA, 103 bp, Artificial Sequence
  Synthetic Polynucleotide
taatacgactcactataggggtatgggttgaggctgtggcggcaccctccaacagaggagaggagggatgcgccacagcaacctggcggcagcgcaaaagatg

SEQ ID NO: 21153 - DNA, 103 bp, Artificial Sequence
  Synthetic Polynucleotide
taatacgactcactatagggtgcacgtatgggttgaggctgtggcggcacaacagaggagagtgccgatgcagcctcaaaacctggcggcagcgcaaaagatg

SEQ ID NO: 21154 - DNA, 103 bp, Artificial Sequence
  Synthetic Polynucleotide
taatacgactcactatagggtccggcatctactggcgttagaataagaataacagaggagaattcttatgctaacgccaaacctggcggcagcgcaaaagatg

SEQ ID NO: 21155 - DNA, 103 bp, Artificial Sequence
  Synthetic Polynucleotide
taatacgactcactatagggatacttgcacgtatgggttgaggctgtggcaacagaggagagccacaatgtcaacccataacctggcggcagcgcaaaagatg

SEQ ID NO: 21156 - DNA, 103 bp, Artificial Sequence
  Synthetic Polynucleotide
taatacgactcactatagggctggtatacttgcacgtatgggttgaggctaacagaggagaagcctcatgccatacgtgaacctggcggcagcgcaaaagatg

SEQ ID NO: 21157 - DNA, 103 bp, Artificial Sequence
  Synthetic Polynucleotide
taatacgactcactatagggttcgactggtatacttgcacgtatgggttgaacagaggagacaacccatgcgtgcaagtaacctggcggcagcgcaaaagatg

SEQ ID NO: 21158 - DNA, 103 bp, Artificial Sequence
  Synthetic Polynucleotide
taatacgactcactataggggtagtttcgactggtatacttgcacgtatgaacagaggagacatacgatgaagtataccaacctggcggcagcgcaaaagatg

SEQ ID NO: 21159 - DNA, 103 bp, Artificial Sequence
  Synthetic Polynucleotide
taatacgactcactatagggccttagtagtttcgactggtatacttgcacaacagaggagagtgcaaatgtaccagtcgaacctggcggcagcgcaaaagatg

SEQ ID NO: 21160 - DNA, 103 bp, Artificial Sequence
  Synthetic Polynucleotide
taatacgactcactatagggcacttccttagtagtttcgactggtatactaacagaggagaagtataatggtcgaaactaacctggcggcagcgcaaaagatg

SEQ ID NO: 21161 - DNA, 103 bp, Artificial Sequence
  Synthetic Polynucleotide
taatacgactcactatagggaagctcacttccttagtagtttcgactggtaacagaggagaaccagtatgaactactaaaacctggcggcagcgcaaaagatg

SEQ ID NO: 21162 - DNA, 103 bp, Artificial Sequence
  Synthetic Polynucleotide
taatacgactcactatagggtggataagctcacttccttagtagtttcgaaacagaggagatcgaaaatgctaaggaagaacctggcggcagcgcaaaagatg

SEQ ID NO: 21163 - DNA, 103 bp, Artificial Sequence
  Synthetic Polynucleotide
taatacgactcactataggggaccctggataagctcacttccttagtagtaacagaggagaactactatggaagtgagcaacctggcggcagcgcaaaagatg

SEQ ID NO: 21164 - DNA, 103 bp, Artificial Sequence
  Synthetic Polynucleotide
taatacgactcactatagggggtccgaccctggataagctcacttccttaaacagaggagataaggaatggagcttatcaacctggcggcagcgcaaaagatg

SEQ ID NO: 21165 - DNA, 103 bp, Artificial Sequence
  Synthetic Polynucleotide
taatacgactcactatagggttttttccggcatctactggcgttagaataaacagaggagatattctatggccagtagaaacctggcggcagcgcaaaagatg

SEQ ID NO: 21166 - DNA, 103 bp, Artificial Sequence
  Synthetic Polynucleotide
taatacgactcactataggggtatcggtccgaccctggataagctcacttaacagaggagaaagtgaatgtatccagggaacctggcggcagcgcaaaagatg

SEQ ID NO: 21167 - DNA, 103 bp, Artificial Sequence
  Synthetic Polynucleotide
taatacgactcactatagggtatgcgtatcggtccgaccctggataagctaacagaggagaagcttaatgagggtcggaaacctggcggcagcgcaaaagatg

SEQ ID NO: 21168 - DNA, 103 bp, Artificial Sequence
  Synthetic Polynucleotide
taatacgactcactataggggggtttatgcgtatcggtccgaccctggataacagaggagaatccagatgcggaccgataacctggcggcagcgcaaaagatg

SEQ ID NO: 21169 - DNA, 103 bp, Artificial Sequence
  Synthetic Polynucleotide
taatacgactcactatagggtgctcgggtttatgcgtatcggtccgacccaacagaggagagggtcgatgcgatacgcaaacctggcggcagcgcaaaagatg

SEQ ID NO: 21170 - DNA, 103 bp, Artificial Sequence
  Synthetic Polynucleotide
taatacgactcactataggggaagatgctcgggtttatgcgtatcggtccaacagaggagaggaccgatgcgcataaacaacctggcggcagcgcaaaagatg

SEQ ID NO: 21171 - DNA, 103 bp, Artificial Sequence
  Synthetic Polynucleotide
taatacgactcactatagggggttggaagatgctcgggtttatgcgtatcaacagaggagagatacgatgaaacccgagaacctggcggcagcgcaaaagatg

SEQ ID NO: 21172 - DNA, 103 bp, Artificial Sequence
  Synthetic Polynucleotide
taatacgactcactataggggctgcggttggaagatgctcgggtttatgcaacagaggagagcataaatgcgagcatctaacctggcggcagcgcaaaagatg

SEQ ID NO: 21173 - DNA, 103 bp, Artificial Sequence
  Synthetic Polynucleotide
taatacgactcactatagggccgttgctgcggttggaagatgctcgggttaacagaggagaaacccgatgatcttccaaaacctggcggcagcgcaaaagatg

SEQ ID NO: 21174 - DNA, 103 bp, Artificial Sequence
  Synthetic Polynucleotide
taatacgactcactatagggaatgtccgttgctgcggttggaagatgctcaacagaggagagagcatatgccaaccgcaaacctggcggcagcgcaaaagatg

SEQ ID NO: 21175 - DNA, 103 bp, Artificial Sequence
  Synthetic Polynucleotide
taatacgactcactatagggctgggaatgtccgttgctgcggttggaagaaacagaggagatcttccatgcgcagcaacaacctggcggcagcgcaaaagatg

SEQ ID NO: 21176 - DNA, 103 bp, Artificial Sequence
  Synthetic Polynucleotide
taatacgactcactatagggccctattttttccggcatctactggcgttaaacagaggagataacgcatgtagatgccgaacctggcggcagcgcaaaagatg

SEQ ID NO: 21177 - DNA, 103 bp, Artificial Sequence
  Synthetic Polynucleotide
taatacgactcactatagggttcgactgggaatgtccgttgctgcggttgaacagaggagacaaccgatgcaacggacaaacctggcggcagcgcaaaagatg

SEQ ID NO: 21178 - DNA, 103 bp, Artificial Sequence
  Synthetic Polynucleotide
taatacgactcactatagggtccagttcgactgggaatgtccgttgctgcaacagaggagagcagcaatggacattcccaacctggcggcagcgcaaaagatg

SEQ ID NO: 21179 - DNA, 103 bp, Artificial Sequence
  Synthetic Polynucleotide
taatacgactcactatagggcattctccagttcgactgggaatgtccgttaacagaggagaaacggaatgtcccagtcgaacctggcggcagcgcaaaagatg

SEQ ID NO: 21180 - DNA, 103 bp, Artificial Sequence
  Synthetic Polynucleotide
taatacgactcactatagggaggttcattctccagttcgactgggaatgtaacagaggagaacattcatggtcgaactgaacctggcggcagcgcaaaagatg

SEQ ID NO: 21181 - DNA, 103 bp, Artificial Sequence
  Synthetic Polynucleotide
taatacgactcactatagggggcgtaggttcattctccagttcgactgggaacagaggagacccagtatgactggagaaaacctggcggcagcgcaaaagatg

SEQ ID NO: 21182 - DNA, 103 bp, Artificial Sequence
  Synthetic Polynucleotide
taatacgactcactatagggctactggcgtaggttcattctccagttcgaaacagaggagatcgaacatgagaatgaacaacctggcggcagcgcaaaagatg

SEQ ID NO: 21183 - DNA, 103 bp, Artificial Sequence
  Synthetic Polynucleotide
taatacgactcactatagggtagagctactggcgtaggttcattctccagaacagaggagactggagatggaacctacgaacctggcggcagcgcaaaagatg

SEQ ID NO: 21184 - DNA, 103 bp, Artificial Sequence
  Synthetic Polynucleotide
taatacgactcactataggggcttctagagctactggcgtaggttcattcaacagaggagagaatgaatgtacgccagtaacctggcggcagcgcaaaagatg

SEQ ID NO: 21185 - DNA, 103 bp, Artificial Sequence
  Synthetic Polynucleotide
taatacgactcactataggggctctgcttctagagctactggcgtaggttaacagaggagaaacctaatgcagtagctcaacctggcggcagcgcaaaagatg

SEQ ID NO: 21186 - DNA, 103 bp, Artificial Sequence
  Synthetic Polynucleotide
taatacgactcactatagggcggtggctctgcttctagagctactggcgtaacagaggagaacgccaatggctctagaaaacctggcggcagcgcaaaagatg

SEQ ID NO: 21187 - DNA, 103 bp, Artificial Sequence
  Synthetic Polynucleotide
taatacgactcactatagggccataccctattttttccggcatctactggaacagaggagaccagtaatggccggaaaaaacctggcggcagcgcaaaagatg

SEQ ID NO: 21188 - DNA, 103 bp, Artificial Sequence
  Synthetic Polynucleotide
taatacgactcactatagggtcgcccggtggctctgcttctagagctactaacagaggagaagtagcatgagaagcagaaacctggcggcagcgcaaaagatg

SEQ ID NO: 21189 - DNA, 103 bp, Artificial Sequence
  Synthetic Polynucleotide
taatacgactcactatagggcattttcgcccggtggctctgcttctagagaacagaggagactctagatgcagagccacaacctggcggcagcgcaaaagatg

SEQ ID NO: 21190 - DNA, 103 bp, Artificial Sequence
  Synthetic Polynucleotide
taatacgactcactatagggttacacattttcgcccggtggctctgcttcaacagaggagagaagcaatgccaccgggcaacctggcggcagcgcaaaagatg

SEQ ID NO: 21191 - DNA, 103 bp, Artificial Sequence
  Synthetic Polynucleotide
taatacgactcactatagggcacttttacacattttcgcccggtggctctaacagaggagaagagccatggggcgaaaaaacctggcggcagcgcaaaagatg

SEQ ID NO: 21192 - DNA, 103 bp, Artificial Sequence
  Synthetic Polynucleotide
taatacgactcactataggggtagacacttttacacattttcgcccggtgaacagaggagacaccggatgaaaatgtgtaacctggcggcagcgcaaaagatg

SEQ ID NO: 21193 - DNA, 103 bp, Artificial Sequence
  Synthetic Polynucleotide
taatacgactcactatagggcccaagtagacacttttacacattttcgccaacagaggagaggcgaaatggtgtaaaagaacctggcggcagcgcaaaagatg

SEQ ID NO: 21194 - DNA, 103 bp, Artificial Sequence
  Synthetic Polynucleotide
taatacgactcactatagggtgctccccaagtagacacttttacacatttaacagaggagaaaatgtatgaaagtgtctaacctggcggcagcgcaaaagatg

SEQ ID NO: 21195 - DNA, 103 bp, Artificial Sequence
  Synthetic Polynucleotide
taatacgactcactatagggaactctgctccccaagtagacacttttacaaacagaggagatgtaaaatggtctacttgaacctggcggcagcgcaaaagatg

SEQ ID NO: 21196 - DNA, 103 bp, Artificial Sequence
  Synthetic Polynucleotide
taatacgactcactatagggcagaaaactctgctccccaagtagacacttaacagaggagaaagtgtatgcttggggagaacctggcggcagcgcaaaagatg

SEQ ID NO: 21197 - DNA, 103 bp, Artificial Sequence
  Synthetic Polynucleotide
taatacgactcactatagggacggacagaaaactctgctccccaagtagaaacagaggagatctactatgggagcagagaacctggcggcagcgcaaaagatg

SEQ ID NO: 21198 - DNA, 103 bp, Artificial Sequence
  Synthetic Polynucleotide
taatacgactcactatagggatgagctctatattttaaccaacagttcgtaacagaggagaacgaacatgtggttaaaaaacctggcggcagcgcaaaagatg

SEQ ID NO: 21199 - DNA, 103 bp, Artificial Sequence
  Synthetic Polynucleotide
taatacgactcactatagggccaacccataccctattttttccggcatctaacagaggagaagatgcatgaaaaaatagaacctggcggcagcgcaaaagatg

SEQ ID NO: 21200 - DNA, 103 bp, Artificial Sequence
  Synthetic Polynucleotide
taatacgactcactatagggtgcaaacggacagaaaactctgctccccaaaacagaggagattggggatgagagttttcaacctggcggcagcgcaaaagatg

SEQ ID NO: 21201 - DNA, 103 bp, Artificial Sequence
  Synthetic Polynucleotide
taatacgactcactatagggcgtcctgcaaacggacagaaaactctgctcaacagaggagagagcagatgtttctgtccaacctggcggcagcgcaaaagatg

SEQ ID NO: 21202 - DNA, 103 bp, Artificial Sequence
  Synthetic Polynucleotide
taatacgactcactatagggaactacgtcctgcaaacggacagaaaactcaacagaggagagagtttatggtccgtttgaacctggcggcagcgcaaaagatg

SEQ ID NO: 21203 - DNA, 103 bp, Artificial Sequence
  Synthetic Polynucleotide
taatacgactcactatagggactcgaactacgtcctgcaaacggacagaaaacagaggagattctgtatgtttgcaggaaacctggcggcagcgcaaaagatg

SEQ ID NO: 21204 - DNA, 103 bp, Artificial Sequence
  Synthetic Polynucleotide
taatacgactcactatagggccaatactcgaactacgtcctgcaaacggaaacagaggagatccgttatgaggacgtagaacctggcggcagcgcaaaagatg

SEQ ID NO: 21205 - DNA, 103 bp, Artificial Sequence
  Synthetic Polynucleotide
taatacgactcactatagggataccccaatactcgaactacgtcctgcaaaacagaggagattgcagatggtagttcgaaacctggcggcagcgcaaaagatg

SEQ ID NO: 21206 - DNA, 103 bp, Artificial Sequence
  Synthetic Polynucleotide
taatacgactcactataggggtgcaataccccaatactcgaactacgtccaacagaggagaggacgtatgtcgagtattaacctggcggcagcgcaaaagatg

SEQ ID NO: 21207 - DNA, 103 bp, Artificial Sequence
  Synthetic Polynucleotide
taatacgactcactatagggataacgtgcaataccccaatactcgaactaaacagaggagatagttcatgtattggggtaacctggcggcagcgcaaaagatg

SEQ ID NO: 21208 - DNA, 103 bp, Artificial Sequence
  Synthetic Polynucleotide
taatacgactcactatagggaagatataacgtgcaataccccaatactcgaacagaggagacgagtaatggggtattgcaacctggcggcagcgcaaaagatg

SEQ ID NO: 21209 - DNA, 103 bp, Artificial Sequence
  Synthetic Polynucleotide
taatacgactcactatagggcagggaagatataacgtgcaataccccaataacagaggagaattgggatgttgcacgttaacctggcggcagcgcaaaagatg

SEQ ID NO: 21210 - DNA, 103 bp, Artificial Sequence
  Synthetic Polynucleotide
taatacgactcactataggggggtgccaacccataccctattttttccggaacagaggagaccggaaatgatagggtataacctggcggcagcgcaaaagatg

SEQ ID NO: 21211 - DNA, 103 bp, Artificial Sequence
  Synthetic Polynucleotide
taatacgactcactatagggcgccacagggaagatataacgtgcaataccaacagaggagaggtattatgcgttatatcaacctggcggcagcgcaaaagatg

SEQ ID NO: 21212 - DNA, 103 bp, Artificial Sequence
  Synthetic Polynucleotide
taatacgactcactatagggatccccgccacagggaagatataacgtgcaaacagaggagatgcacgatgtatcttcccaacctggcggcagcgcaaaagatg

SEQ ID NO: 21213 - DNA, 103 bp, Artificial Sequence
  Synthetic Polynucleotide
taatacgactcactatagggttgatatccccgccacagggaagatataacaacagaggagagttataatgtccctgtggaacctggcggcagcgcaaaagatg

SEQ ID NO: 21214 - DNA, 103 bp, Artificial Sequence
  Synthetic Polynucleotide
taatacgactcactatagggtctttttgatatccccgccacagggaagataacagaggagaatcttcatggtggcggggaacctggcggcagcgcaaaagatg

SEQ ID NO: 21215 - DNA, 103 bp, Artificial Sequence
  Synthetic Polynucleotide
taatacgactcactataggggattgtctttttgatatccccgccacagggaacagaggagaccctgtatgggggatatcaacctggcggcagcgcaaaagatg

SEQ ID NO: 21216 - DNA, 103 bp, Artificial Sequence
  Synthetic Polynucleotide
taatacgactcactatagggtctctgattgtctttttgatatccccgccaaacagaggagatggcggatgtatcaaaaaaacctggcggcagcgcaaaagatg

SEQ ID NO: 21217 - DNA, 103 bp, Artificial Sequence
  Synthetic Polynucleotide
taatacgactcactatagggaacgctctctgattgtctttttgatatcccaacagaggagagggataatgaaaagacaaaacctggcggcagcgcaaaagatg

SEQ ID NO: 21218 - DNA, 103 bp, Artificial Sequence
  Synthetic Polynucleotide
taatacgactcactatagggtaaaaaacgctctctgattgtctttttgataacagaggagaatcaaaatgacaatcagaaacctggcggcagcgcaaaagatg

SEQ ID NO: 21219 - DNA, 103 bp, Artificial Sequence
  Synthetic Polynucleotide
taatacgactcactatagggaacagtaaaaaacgctctctgattgtctttaacagaggagaaaagacatgcagagagcgaacctggcggcagcgcaaaagatg

SEQ ID NO: 21220 - DNA, 103 bp, Artificial Sequence
  Synthetic Polynucleotide
taatacgactcactatagggttaataacagtaaaaaacgctctctgattgaacagaggagacaatcaatgagcgtttttaacctggcggcagcgcaaaagatg

SEQ ID NO: 21221 - DNA, 103 bp, Artificial Sequence
  Synthetic Polynucleotide
taatacgactcactatagggaagcggggtgccaacccataccctatttttaacagaggagaaaaaatatggtatgggttaacctggcggcagcgcaaaagatg

SEQ ID NO: 21222 - DNA, 103 bp, Artificial Sequence
  Synthetic Polynucleotide
taatacgactcactatagggtagttttaataacagtaaaaaacgctctctaacagaggagaagagagatgtttttactgaacctggcggcagcgcaaaagatg

SEQ ID NO: 21223 - DNA, 103 bp, Artificial Sequence
  Synthetic Polynucleotide
taatacgactcactatagggtttgttagttttaataacagtaaaaaacgcaacagaggagagcgtttatgactgttattaacctggcggcagcgcaaaagatg

SEQ ID NO: 21224 - DNA, 103 bp, Artificial Sequence
  Synthetic Polynucleotide
taatacgactcactatagggcagtttttgttagttttaataacagtaaaaaacagaggagattttacatgtattaaaacaacctggcggcagcgcaaaagatg

SEQ ID NO: 21225 - DNA, 103 bp, Artificial Sequence
  Synthetic Polynucleotide
taatacgactcactatagggatcaacagtttttgttagttttaataacagaacagaggagactgttaatgaaactaacaaacctggcggcagcgcaaaagatg

SEQ ID NO: 21226 - DNA, 103 bp, Artificial Sequence
  Synthetic Polynucleotide
taatacgactcactatagggttagtatcaacagtttttgttagttttaataacagaggagaattaaaatgaacaaaaacaacctggcggcagcgcaaaagatg

SEQ ID NO: 21227 - DNA, 103 bp, Artificial Sequence
  Synthetic Polynucleotide
taatacgactcactatagggtgtttttagtatcaacagtttttgttagttaacagaggagaaactaaatgaaactgttgaacctggcggcagcgcaaaagatg

SEQ ID NO: 21228 - DNA, 103 bp, Artificial Sequence
  Synthetic Polynucleotide
taatacgactcactatagggccagatgtttttagtatcaacagtttttgtaacagaggagaacaaaaatggttgatactaacctggcggcagcgcaaaagatg

SEQ ID NO: 21229 - DNA, 103 bp, Artificial Sequence
  Synthetic Polynucleotide
taatacgactcactatagggttatcccagatgtttttagtatcaacagttaacagaggagaaactgtatgtactaaaaaaacctggcggcagcgcaaaagatg

SEQ ID NO: 21230 - DNA, 103 bp, Artificial Sequence
  Synthetic Polynucleotide
taatacgactcactatagggtcactttatcccagatgtttttagtatcaaaacagaggagattgataatgaaaacatctaacctggcggcagcgcaaaagatg

SEQ ID NO: 21231 - DNA, 103 bp, Artificial Sequence
  Synthetic Polynucleotide
taatacgactcactatagggacgattcactttatcccagatgtttttagtaacagaggagaactaaaatgatctgggataacctggcggcagcgcaaaagatg

SEQ ID NO: 21232 - DNA, 103 bp, Artificial Sequence
  Synthetic Polynucleotide
taatacgactcactatagggtacggaagcggggtgccaacccataccctaaacagaggagatagggtatgggttggcacaacctggcggcagcgcaaaagatg

SEQ ID NO: 21233 - DNA, 103 bp, Artificial Sequence
  Synthetic Polynucleotide
taatacgactcactatagggacagaacgattcactttatcccagatgtttaacagaggagaaaacatatgggataaagtaacctggcggcagcgcaaaagatg

SEQ ID NO: 21234 - DNA, 103 bp, Artificial Sequence
  Synthetic Polynucleotide
taatacgactcactatagggcaaagacagaacgattcactttatcccagaaacagaggagatctgggatgaagtgaatcaacctggcggcagcgcaaaagatg

SEQ ID NO: 21235 - DNA, 103 bp, Artificial Sequence
  Synthetic Polynucleotide
taatacgactcactataggggccaacaaagacagaacgattcactttatcaacagaggagagataaaatgaatcgttctaacctggcggcagcgcaaaagatg

SEQ ID NO: 21236 - DNA, 103 bp, Artificial Sequence
  Synthetic Polynucleotide
taatacgactcactatagggcctgagccaacaaagacagaacgattcactaacagaggagaagtgaaatgttctgtcttaacctggcggcagcgcaaaagatg

SEQ ID NO: 21237 - DNA, 103 bp, Artificial Sequence
  Synthetic Polynucleotide
taatacgactcactatagggtatgtcctgagccaacaaagacagaacgataacagaggagaatcgttatgtctttgttgaacctggcggcagcgcaaaagatg

SEQ ID NO: 21238 - DNA, 103 bp, Artificial Sequence
  Synthetic Polynucleotide
taatacgactcactatagggatttttatgtcctgagccaacaaagacagaaacagaggagatctgtcatggttggctcaaacctggcggcagcgcaaaagatg

SEQ ID NO: 21239 - DNA, 103 bp, Artificial Sequence
  Synthetic Polynucleotide
taatacgactcactatagggcataaatttttatgtcctgagccaacaaagaacagaggagactttgtatgctcaggacaaacctggcggcagcgcaaaagatg

SEQ ID NO: 21240 - DNA, 103 bp, Artificial Sequence
  Synthetic Polynucleotide
taatacgactcactatagggccttccataaatttttatgtcctgagccaaaacagaggagattggctatggacataaaaaacctggcggcagcgcaaaagatg

SEQ ID NO: 21241 - DNA, 103 bp, Artificial Sequence
  Synthetic Polynucleotide
taatacgactcactatagggcttatccttccataaatttttatgtcctgaaacagaggagatcaggaatgaaaaatttaaacctggcggcagcgcaaaagatg

SEQ ID NO: 21242 - DNA, 103 bp, Artificial Sequence
  Synthetic Polynucleotide
taatacgactcactatagggaagaacttatccttccataaatttttatgtaacagaggagaacataaatgtttatggaaaacctggcggcagcgcaaaagatg

SEQ ID NO: 21243 - DNA, 103 bp, Artificial Sequence
  Synthetic Polynucleotide
taatacgactcactatagggaaacgtacggaagcggggtgccaacccataaacagaggagatatgggatggcaccccgcaacctggcggcagcgcaaaagatg

SEQ ID NO: 21244 - DNA, 103 bp, Artificial Sequence
  Synthetic Polynucleotide
taatacgactcactataggggtcccaagaacttatccttccataaattttaacagaggagaaaaattatgggaaggataaacctggcggcagcgcaaaagatg

SEQ ID NO: 21245 - DNA, 103 bp, Artificial Sequence
  Synthetic Polynucleotide
taatacgactcactatagggatttagtcccaagaacttatccttccataaaacagaggagattatggatggataagttcaacctggcggcagcgcaaaagatg

SEQ ID NO: 21246 - DNA, 103 bp, Artificial Sequence
  Synthetic Polynucleotide
taatacgactcactatagggttgtaatttagtcccaagaacttatccttcaacagaggagagaaggaatggttcttgggaacctggcggcagcgcaaaagatg

SEQ ID NO: 21247 - DNA, 103 bp, Artificial Sequence
  Synthetic Polynucleotide
taatacgactcactatagggctttcttgtaatttagtcccaagaacttataacagaggagaataagtatgtgggactaaaacctggcggcagcgcaaaagatg

SEQ ID NO: 21248 - DNA, 103 bp, Artificial Sequence
  Synthetic Polynucleotide
taatacgactcactatagggattatctttcttgtaatttagtcccaagaaaacagaggagattcttgatgctaaattacaacctggcggcagcgcaaaagatg

SEQ ID NO: 21249 - DNA, 103 bp, Artificial Sequence
  Synthetic Polynucleotide
taatacgactcactatagggcgctgattatctttcttgtaatttagtcccaacagaggagagggactatgttacaagaaaacctggcggcagcgcaaaagatg

SEQ ID NO: 21250 - DNA, 103 bp, Artificial Sequence
  Synthetic Polynucleotide
taatacgactcactataggggaaaacgctgattatctttcttgtaatttaaacagaggagataaattatgagaaagataaacctggcggcagcgcaaaagatg

SEQ ID NO: 21251 - DNA, 103 bp, Artificial Sequence
  Synthetic Polynucleotide
taatacgactcactataggggaagagaaaacgctgattatctttcttgtaaacagaggagatacaagatggataatcagaacctggcggcagcgcaaaagatg

SEQ ID NO: 21252 - DNA, 103 bp, Artificial Sequence
  Synthetic Polynucleotide
taatacgactcactatagggagaatgaagagaaaacgctgattatctttcaacagaggagagaaagaatgtcagcgtttaacctggcggcagcgcaaaagatg

SEQ ID NO: 21253 - DNA, 103 bp, Artificial Sequence
  Synthetic Polynucleotide
taatacgactcactatagggaagacagaatgaagagaaaacgctgattataacagaggagaataatcatggttttctctaacctggcggcagcgcaaaagatg

SEQ ID NO: 21254 - DNA, 103 bp, Artificial Sequence
  Synthetic Polynucleotide
taatacgactcactatagggctggaaaacgtacggaagcggggtgccaacaacagaggagagttggcatgccgcttccgaacctggcggcagcgcaaaagatg

SEQ ID NO: 21255 - DNA, 103 bp, Artificial Sequence
  Synthetic Polynucleotide
taatacgactcactatagggcaagcaagacagaatgaagagaaaacgctgaacagaggagacagcgtatgctcttcattaacctggcggcagcgcaaaagatg

SEQ ID NO: 21256 - DNA, 103 bp, Artificial Sequence
  Synthetic Polynucleotide
taatacgactcactatagggagaagcaagcaagacagaatgaagagaaaaaacagaggagattttctatgcattctgtcaacctggcggcagcgcaaaagatg

SEQ ID NO: 21257 - DNA, 103 bp, Artificial Sequence
  Synthetic Polynucleotide
taatacgactcactatagggagaaaagaagcaagcaagacagaatgaagaaacagaggagatcttcaatgtgtcttgctaacctggcggcagcgcaaaagatg

SEQ ID NO: 21258 - DNA, 103 bp, Artificial Sequence
  Synthetic Polynucleotide
taatacgactcactatagggttggcagaaaagaagcaagcaagacagaataacagaggagaattctgatgtgcttgcttaacctggcggcagcgcaaaagatg

SEQ ID NO: 21259 - DNA, 103 bp, Artificial Sequence
  Synthetic Polynucleotide
taatacgactcactatagggtctgattggcagaaaagaagcaagcaagacaacagaggagagtcttgatggcttcttttaacctggcggcagcgcaaaagatg

SEQ ID NO: 21260 - DNA, 103 bp, Artificial Sequence
  Synthetic Polynucleotide
taatacgactcactataggggggcatctgattggcagaaaagaagcaagcaacagaggagagcttgcatgttttctgccaacctggcggcagcgcaaaagatg

SEQ ID NO: 21261 - DNA, 103 bp, Artificial Sequence
  Synthetic Polynucleotide
taatacgactcactataggggaaacgggcatctgattggcagaaaagaagaacagaggagacttcttatgtgccaatcaaacctggcggcagcgcaaaagatg

SEQ ID NO: 21262 - DNA, 103 bp, Artificial Sequence
  Synthetic Polynucleotide
taatacgactcactatagggactaagaaacgggcatctgattggcagaaaaacagaggagatttctgatgatcagatgcaacctggcggcagcgcaaaagatg

SEQ ID NO: 21263 - DNA, 103 bp, Artificial Sequence
  Synthetic Polynucleotide
taatacgactcactatagggactcaactaagaaacgggcatctgattggcaacagaggagagccaatatgatgcccgttaacctggcggcagcgcaaaagatg

SEQ ID NO: 21264 - DNA, 103 bp, Artificial Sequence
  Synthetic Polynucleotide
taatacgactcactatagggtactgactcaactaagaaacgggcatctgaaacagaggagatcagatatgcgtttcttaaacctggcggcagcgcaaaagatg

SEQ ID NO: 21265 - DNA, 103 bp, Artificial Sequence
  Synthetic Polynucleotide
taatacgactcactatagggagagactggaaaacgtacggaagcggggtgaacagaggagacaccccatgtccgtacgtaacctggcggcagcgcaaaagatg

SEQ ID NO: 21266 - DNA, 103 bp, Artificial Sequence
  Synthetic Polynucleotide
taatacgactcactatagggttaattactgactcaactaagaaacgggcaaacagaggagatgcccgatgcttagttgaaacctggcggcagcgcaaaagatg

SEQ ID NO: 21267 - DNA, 103 bp, Artificial Sequence
  Synthetic Polynucleotide
taatacgactcactatagggccgttttaattactgactcaactaagaaacaacagaggagagtttctatgttgagtcagaacctggcggcagcgcaaaagatg

SEQ ID NO: 21268 - DNA, 103 bp, Artificial Sequence
  Synthetic Polynucleotide
taatacgactcactatagggtagttccgttttaattactgactcaactaaaacagaggagattagttatgtcagtaattaacctggcggcagcgcaaaagatg

SEQ ID NO: 21269 - DNA, 103 bp, Artificial Sequence
  Synthetic Polynucleotide
taatacgactcactatagggtggcgtagttccgttttaattactgactcaaacagaggagatgagtcatgaattaaaacaacctggcggcagcgcaaaagatg

SEQ ID NO: 21270 - DNA, 103 bp, Artificial Sequence
  Synthetic Polynucleotide
taatacgactcactataggggcaagtggcgtagttccgttttaattactgaacagaggagacagtaaatgaaacggaacaacctggcggcagcgcaaaagatg

SEQ ID NO: 21271 - DNA, 103 bp, Artificial Sequence
  Synthetic Polynucleotide
taatacgactcactataggggccaggcaagtggcgtagttccgttttaataacagaggagaattaaaatggaactacgcaacctggcggcagcgcaaaagatg

SEQ ID NO: 21272 - DNA, 103 bp, Artificial Sequence
  Synthetic Polynucleotide
taatacgactcactatagggaatctgccaggcaagtggcgtagttccgttaacagaggagaaacggaatgacgccacttaacctggcggcagcgcaaaagatg

SEQ ID NO: 21273 - DNA, 103 bp, Artificial Sequence
  Synthetic Polynucleotide
taatacgactcactataggggactaaatctgccaggcaagtggcgtagttaacagaggagaaactacatgacttgcctgaacctggcggcagcgcaaaagatg

SEQ ID NO: 21274 - DNA, 103 bp, Artificial Sequence
  Synthetic Polynucleotide
taatacgactcactatagggttttagactaaatctgccaggcaagtggcgaacagaggagacgccacatgcctggcagaaacctggcggcagcgcaaaagatg

SEQ ID NO: 21275 - DNA, 103 bp, Artificial Sequence
  Synthetic Polynucleotide
taatacgactcactatagggcttgtttttagactaaatctgccaggcaagaacagaggagacttgccatgcagatttagaacctggcggcagcgcaaaagatg

SEQ ID NO: 21276 - DNA, 103 bp, Artificial Sequence
  Synthetic Polynucleotide
taatacgactcactatagggagaccagagactggaaaacgtacggaagcgaacagaggagacgcttcatgacgttttccaacctggcggcagcgcaaaagatg

SEQ ID NO: 21277 - DNA, 103 bp, Artificial Sequence
  Synthetic Polynucleotide
taatacgactcactatagggcttgacttgtttttagactaaatctgccagaacagaggagactggcaatgttagtctaaaacctggcggcagcgcaaaagatg

SEQ ID NO: 21278 - DNA, 103 bp, Artificial Sequence
  Synthetic Polynucleotide
taatacgactcactatagggtgcctcttgacttgtttttagactaaatctaacagaggagaagatttatgctaaaaacaaacctggcggcagcgcaaaagatg

SEQ ID NO: 21279 - DNA, 103 bp, Artificial Sequence
  Synthetic Polynucleotide
taatacgactcactataggggatcgtgcctcttgacttgtttttagactaaacagaggagatagtctatgaacaagtcaaacctggcggcagcgcaaaagatg

SEQ ID NO: 21280 - DNA, 103 bp, Artificial Sequence
  Synthetic Polynucleotide
taatacgactcactatagggccagagatcgtgcctcttgacttgtttttaaacagaggagataaaaaatggtcaagaggaacctggcggcagcgcaaaagatg

SEQ ID NO: 21281 - DNA, 103 bp, Artificial Sequence
  Synthetic Polynucleotide
taatacgactcactatagggcaaagccagagatcgtgcctcttgacttgtaacagaggagaacaagtatggaggcacgaaacctggcggcagcgcaaaagatg

SEQ ID NO: 21282 - DNA, 103 bp, Artificial Sequence
  Synthetic Polynucleotide
taatacgactcactatagggtaactcaaagccagagatcgtgcctcttgaaacagaggagatcaagaatgacgatctctaacctggcggcagcgcaaaagatg

SEQ ID NO: 21283 - DNA, 103 bp, Artificial Sequence
  Synthetic Polynucleotide
taatacgactcactataggggaaaataactcaaagccagagatcgtgcctaacagaggagaaggcacatgctctggcttaacctggcggcagcgcaaaagatg

SEQ ID NO: 21284 - DNA, 103 bp, Artificial Sequence
  Synthetic Polynucleotide
taatacgactcactatagggcaatagaaaataactcaaagccagagatcgaacagaggagacgatctatggctttgagtaacctggcggcagcgcaaaagatg

SEQ ID NO: 21285 - DNA, 103 bp, Artificial Sequence
  Synthetic Polynucleotide
taatacgactcactataggggaggtcaatagaaaataactcaaagccagaaacagaggagatctggcatggagttatttaacctggcggcagcgcaaaagatg

SEQ ID NO: 21286 - DNA, 103 bp, Artificial Sequence
  Synthetic Polynucleotide
taatacgactcactatagggtagttgaggtcaatagaaaataactcaaagaacagaggagactttgaatgattttctataacctggcggcagcgcaaaagatg

SEQ ID NO: 21287 - DNA, 103 bp, Artificial Sequence
  Synthetic Polynucleotide
taatacgactcactatagggacagtagaccagagactggaaaacgtacggaacagaggagaccgtacatgttccagtctaacctggcggcagcgcaaaagatg

SEQ ID NO: 21288 - DNA, 103 bp, Artificial Sequence
  Synthetic Polynucleotide
taatacgactcactatagggtcggttagttgaggtcaatagaaaataactaacagaggagaagttatatgctattgaccaacctggcggcagcgcaaaagatg

SEQ ID NO: 21289 - DNA, 103 bp, Artificial Sequence
  Synthetic Polynucleotide
taatacgactcactataggggggagtcggttagttgaggtcaatagaaaaaacagaggagattttctatggacctcaacaacctggcggcagcgcaaaagatg

SEQ ID NO: 21290 - DNA, 103 bp, Artificial Sequence
  Synthetic Polynucleotide
taatacgactcactataggggcagagggagtcggttagttgaggtcaataaacagaggagatattgaatgcaactaaccaacctggcggcagcgcaaaagatg

SEQ ID NO: 21291 - DNA, 103 bp, Artificial Sequence
  Synthetic Polynucleotide
taatacgactcactatagggtggtggcagagggagtcggttagttgaggtaacagaggagaacctcaatgaaccgactcaacctggcggcagcgcaaaagatg

SEQ ID NO: 21292 - DNA, 103 bp, Artificial Sequence
  Synthetic Polynucleotide
taatacgactcactatagggtcaactggtggcagagggagtcggttagttaacagaggagaaactaaatgactccctctaacctggcggcagcgcaaaagatg

SEQ ID NO: 21293 - DNA, 103 bp, Artificial Sequence
  Synthetic Polynucleotide
taatacgactcactatagggccggatcaactggtggcagagggagtcggtaacagaggagaaccgacatgctctgccacaacctggcggcagcgcaaaagatg

SEQ ID NO: 21294 - DNA, 103 bp, Artificial Sequence
  Synthetic Polynucleotide
taatacgactcactatagggtatttccggatcaactggtggcagagggagaacagaggagactccctatgccaccagttaacctggcggcagcgcaaaagatg

SEQ ID NO: 21295 - DNA, 103 bp, Artificial Sequence
  Synthetic Polynucleotide
taatacgactcactataggggcaattatttccggatcaactggtggcagaaacagaggagatctgccatgagttgatccaacctggcggcagcgcaaaagatg

SEQ ID NO: 21296 - DNA, 103 bp, Artificial Sequence
  Synthetic Polynucleotide
taatacgactcactatagggcctctgcaattatttccggatcaactggtgaacagaggagacaccagatgatccggaaaaacctggcggcagcgcaaaagatg

SEQ ID NO: 21297 - DNA, 103 bp, Artificial Sequence
  Synthetic Polynucleotide
taatacgactcactatagggcctctcctctgcaattatttccggatcaacaacagaggagagttgatatggaaataattaacctggcggcagcgcaaaagatg

SEQ ID NO: 21298 - DNA, 103 bp, Artificial Sequence
  Synthetic Polynucleotide
taatacgactcactatagggattcaacagtagaccagagactggaaaacgaacagaggagacgttttatggtctctggtaacctggcggcagcgcaaaagatg

SEQ ID NO: 21299 - DNA, 103 bp, Artificial Sequence
  Synthetic Polynucleotide
taatacgactcactatagggcccaccctctcctctgcaattatttccggaaacagaggagatccggaatgaattgcagaaacctggcggcagcgcaaaagatg

SEQ ID NO: 21300 - DNA, 103 bp, Artificial Sequence
  Synthetic Polynucleotide
taatacgactcactatagggtatgacccaccctctcctctgcaattatttaacagaggagaaaataaatgcagaggagaaacctggcggcagcgcaaaagatg

SEQ ID NO: 21301 - DNA, 103 bp, Artificial Sequence
  Synthetic Polynucleotide
taatacgactcactatagggatacttatgacccaccctctcctctgcaataacagaggagaattgcaatggagagggtgaacctggcggcagcgcaaaagatg

SEQ ID NO: 21302 - DNA, 103 bp, Artificial Sequence
  Synthetic Polynucleotide
taatacgactcactatagggaatttatacttatgacccaccctctcctctaacagaggagaagaggaatgggtgggtcaaacctggcggcagcgcaaaagatg

SEQ ID NO: 21303 - DNA, 103 bp, Artificial Sequence
  Synthetic Polynucleotide
taatacgactcactataggggtttcaatttatacttatgacccaccctctaacagaggagaagagggatggtcataagtaacctggcggcagcgcaaaagatg

SEQ ID NO: 21304 - DNA, 103 bp, Artificial Sequence
  Synthetic Polynucleotide
taatacgactcactatagggatgtggtttcaatttatacttatgacccacaacagaggagagtgggtatgaagtataaaaacctggcggcagcgcaaaagatg

SEQ ID NO: 21305 - DNA, 103 bp, Artificial Sequence
  Synthetic Polynucleotide
taatacgactcactatagggcctttatgtggtttcaatttatacttatgaaacagaggagatcataaatgtaaattgaaaacctggcggcagcgcaaaagatg

SEQ ID NO: 21306 - DNA, 103 bp, Artificial Sequence
  Synthetic Polynucleotide
taatacgactcactatagggcagcacctttatgtggtttcaatttatactaacagaggagaagtataatgtgaaaccacaacctggcggcagcgcaaaagatg

SEQ ID NO: 21307 - DNA, 103 bp, Artificial Sequence
  Synthetic Polynucleotide
taatacgactcactatagggaagtccagcacctttatgtggtttcaatttaacagaggagaaaattgatgccacataaaaacctggcggcagcgcaaaagatg

SEQ ID NO: 21308 - DNA, 103 bp, Artificial Sequence
  Synthetic Polynucleotide
taatacgactcactatagggaccttaagtccagcacctttatgtggtttcaacagaggagagaaaccatgtaaaggtgcaacctggcggcagcgcaaaagatg

SEQ ID NO: 21309 - DNA, 103 bp, Artificial Sequence
  Synthetic Polynucleotide
taatacgactcactatagggtttagatgagctctatattttaaccaacagaacagaggagactgttgatgaaaatatagaacctggcggcagcgcaaaagatg

SEQ ID NO: 21310 - DNA, 103 bp, Artificial Sequence
  Synthetic Polynucleotide
taatacgactcactatagggttgagattcaacagtagaccagagactggaaacagaggagatccagtatgtggtctactaacctggcggcagcgcaaaagatg

SEQ ID NO: 21311 - DNA, 103 bp, Artificial Sequence
  Synthetic Polynucleotide
taatacgactcactatagggtattaaccttaagtccagcacctttatgtgaacagaggagacacataatggtgctggacaacctggcggcagcgcaaaagatg

SEQ ID NO: 21312 - DNA, 103 bp, Artificial Sequence
  Synthetic Polynucleotide
taatacgactcactatagggatgtatattaaccttaagtccagcacctttaacagaggagaaaaggtatgggacttaagaacctggcggcagcgcaaaagatg

SEQ ID NO: 21313 - DNA, 103 bp, Artificial Sequence
  Synthetic Polynucleotide
taatacgactcactatagggctagcatgtatattaaccttaagtccagcaaacagaggagatgctggatgtaaggttaaaacctggcggcagcgcaaaagatg

SEQ ID NO: 21314 - DNA, 103 bp, Artificial Sequence
  Synthetic Polynucleotide
taatacgactcactatagggcttcgctagcatgtatattaaccttaagtcaacagaggagagacttaatgttaatatacaacctggcggcagcgcaaaagatg

SEQ ID NO: 21315 - DNA, 103 bp, Artificial Sequence
  Synthetic Polynucleotide
taatacgactcactatagggtatcacttcgctagcatgtatattaaccttaacagaggagaaaggttatgatacatgctaacctggcggcagcgcaaaagatg

SEQ ID NO: 21316 - DNA, 103 bp, Artificial Sequence
  Synthetic Polynucleotide
taatacgactcactatagggccggctatcacttcgctagcatgtatattaaacagaggagataatatatgtgctagcgaaacctggcggcagcgcaaaagatg

SEQ ID NO: 21317 - DNA, 103 bp, Artificial Sequence
  Synthetic Polynucleotide
taatacgactcactatagggtgcacccggctatcacttcgctagcatgtaaacagaggagatacatgatggcgaagtgaaacctggcggcagcgcaaaagatg

SEQ ID NO: 21318 - DNA, 103 bp, Artificial Sequence
  Synthetic Polynucleotide
taatacgactcactatagggtttcttgcacccggctatcacttcgctagcaacagaggagagctagcatggtgatagccaacctggcggcagcgcaaaagatg

SEQ ID NO: 21319 - DNA, 103 bp, Artificial Sequence
  Synthetic Polynucleotide
taatacgactcactataggggcatgtttcttgcacccggctatcacttcgaacagaggagacgaagtatgagccgggtgaacctggcggcagcgcaaaagatg

SEQ ID NO: 21320 - DNA, 103 bp, Artificial Sequence
  Synthetic Polynucleotide
taatacgactcactataggggataagcatgtttcttgcacccggctatcaaacagaggagatgatagatgggtgcaagaaacctggcggcagcgcaaaagatg

SEQ ID NO: 21321 - DNA, 103 bp, Artificial Sequence
  Synthetic Polynucleotide
taatacgactcactatagggcagctttgagattcaacagtagaccagagaaacagaggagatctctgatgtactgttgaaacctggcggcagcgcaaaagatg

SEQ ID NO: 21322 - DNA, 103 bp, Artificial Sequence
  Synthetic Polynucleotide
taatacgactcactatagggaaccggataagcatgtttcttgcacccggcaacagaggagagccgggatgaagaaacataacctggcggcagcgcaaaagatg

SEQ ID NO: 21323 - DNA, 103 bp, Artificial Sequence
  Synthetic Polynucleotide
taatacgactcactatagggatataaaccggataagcatgtttcttgcacaacagaggagagtgcaaatgacatgcttaaacctggcggcagcgcaaaagatg

SEQ ID NO: 21324 - DNA, 103 bp, Artificial Sequence
  Synthetic Polynucleotide
taatacgactcactatagggaactaatataaaccggataagcatgtttctaacagaggagaagaaacatgcttatccggaacctggcggcagcgcaaaagatg

SEQ ID NO: 21325 - DNA, 103 bp, Artificial Sequence
  Synthetic Polynucleotide
taatacgactcactatagggtttaaaactaatataaaccggataagcatgaacagaggagacatgctatgccggtttataacctggcggcagcgcaaaagatg

SEQ ID NO: 21326 - DNA, 103 bp, Artificial Sequence
  Synthetic Polynucleotide
taatacgactcactatagggatttctttaaaactaatataaaccggataaaacagaggagattatccatgttatattagaacctggcggcagcgcaaaagatg

SEQ ID NO: 21327 - DNA, 103 bp, Artificial Sequence
  Synthetic Polynucleotide
taatacgactcactatagggcactcatttctttaaaactaatataaaccgaacagaggagacggtttatgttagttttaaacctggcggcagcgcaaaagatg

SEQ ID NO: 21328 - DNA, 103 bp, Artificial Sequence
  Synthetic Polynucleotide
taatacgactcactatagggtaaaccactcatttctttaaaactaatataaacagaggagatatattatgtttaaagaaaacctggcggcagcgcaaaagatg

SEQ ID NO: 21329 - DNA, 103 bp, Artificial Sequence
  Synthetic Polynucleotide
taatacgactcactatagggacgaataaaccactcatttctttaaaactaaacagaggagatagtttatgagaaatgagaacctggcggcagcgcaaaagatg

SEQ ID NO: 21330 - DNA, 103 bp, Artificial Sequence
  Synthetic Polynucleotide
taatacgactcactatagggtatcaacgaataaaccactcatttctttaaaacagaggagattaaagatgtgagtggttaacctggcggcagcgcaaaagatg

SEQ ID NO: 21331 - DNA, 103 bp, Artificial Sequence
  Synthetic Polynucleotide
taatacgactcactatagggaaacatatcaacgaataaaccactcatttcaacagaggagagaaatgatgggtttattcaacctggcggcagcgcaaaagatg

SEQ ID NO: 21332 - DNA, 103 bp, Artificial Sequence
  Synthetic Polynucleotide
taatacgactcactatagggggtgacagctttgagattcaacagtagaccaacagaggagaggtctaatgttgaatctcaacctggcggcagcgcaaaagatg

SEQ ID NO: 21333 - DNA, 103 bp, Artificial Sequence
  Synthetic Polynucleotide
taatacgactcactatagggtcatcaaacatatcaacgaataaaccactcaacagaggagagagtggatgattcgttgaaacctggcggcagcgcaaaagatg

SEQ ID NO: 21334 - DNA, 103 bp, Artificial Sequence
  Synthetic Polynucleotide
taatacgactcactatagggcttgatcatcaaacatatcaacgaataaacaacagaggagagtttatatgttgatatgtaacctggcggcagcgcaaaagatg

SEQ ID NO: 21335 - DNA, 103 bp, Artificial Sequence
  Synthetic Polynucleotide
taatacgactcactatagggggcaacttgatcatcaaacatatcaacgaaaacagaggagattcgttatgatgtttgataacctggcggcagcgcaaaagatg

SEQ ID NO: 21336 - DNA, 103 bp, Artificial Sequence
  Synthetic Polynucleotide
taatacgactcactataggggccgcggcaacttgatcatcaaacatatcaaacagaggagatgatatatgtgatgatcaaacctggcggcagcgcaaaagatg

SEQ ID NO: 21337 - DNA, 103 bp, Artificial Sequence
  Synthetic Polynucleotide
taatacgactcactataggggtagtgccgcggcaacttgatcatcaaacaaacagaggagatgtttgatgatcaagttgaacctggcggcagcgcaaaagatg

SEQ ID NO: 21338 - DNA, 103 bp, Artificial Sequence
  Synthetic Polynucleotide
taatacgactcactataggggtaaagtagtgccgcggcaacttgatcatcaacagaggagagatgatatggttgccgcgaacctggcggcagcgcaaaagatg

SEQ ID NO: 21339 - DNA, 103 bp, Artificial Sequence
  Synthetic Polynucleotide
taatacgactcactatagggacactgtaaagtagtgccgcggcaacttgaaacagaggagatcaagtatgcgcggcactaacctggcggcagcgcaaaagatg

SEQ ID NO: 21340 - DNA, 103 bp, Artificial Sequence
  Synthetic Polynucleotide
taatacgactcactatagggctgagacactgtaaagtagtgccgcggcaaaacagaggagattgccgatgcactactttaacctggcggcagcgcaaaagatg

SEQ ID NO: 21341 - DNA, 103 bp, Artificial Sequence
  Synthetic Polynucleotide
taatacgactcactatagggagtaactgagacactgtaaagtagtgccgcaacagaggagagcggcaatgctttacagtaacctggcggcagcgcaaaagatg

SEQ ID NO: 21342 - DNA, 103 bp, Artificial Sequence
  Synthetic Polynucleotide
taatacgactcactatagggtcacaagtaactgagacactgtaaagtagtaacagaggagaactactatgcagtgtctcaacctggcggcagcgcaaaagatg

SEQ ID NO: 21343 - DNA, 103 bp, Artificial Sequence
  Synthetic Polynucleotide
taatacgactcactatagggtttttggtgacagctttgagattcaacagtaacagaggagaactgttatgtctcaaagcaacctggcggcagcgcaaaagatg

SEQ ID NO: 21344 - DNA, 103 bp, Artificial Sequence
  Synthetic Polynucleotide
taatacgactcactatagggtaccatcacaagtaactgagacactgtaaaaacagaggagatttacaatgtctcagttaaacctggcggcagcgcaaaagatg

SEQ ID NO: 21345 - DNA, 103 bp, Artificial Sequence
  Synthetic Polynucleotide
taatacgactcactatagggcatattaccatcacaagtaactgagacactaacagaggagaagtgtcatggttacttgtaacctggcggcagcgcaaaagatg

SEQ ID NO: 21346 - DNA, 103 bp, Artificial Sequence
  Synthetic Polynucleotide
taatacgactcactataggggccgtcatattaccatcacaagtaactgagaacagaggagactcagtatgttgtgatggaacctggcggcagcgcaaaagatg

SEQ ID NO: 21347 - DNA, 103 bp, Artificial Sequence
  Synthetic Polynucleotide
taatacgactcactatagggcttgggccgtcatattaccatcacaagtaaaacagaggagattacttatgatggtaataaacctggcggcagcgcaaaagatg

SEQ ID NO: 21348 - DNA, 103 bp, Artificial Sequence
  Synthetic Polynucleotide
taatacgactcactatagggagcctcttgggccgtcatattaccatcacaaacagaggagatgtgatatgaatatgacgaacctggcggcagcgcaaaagatg

SEQ ID NO: 21349 - DNA, 103 bp, Artificial Sequence
  Synthetic Polynucleotide
taatacgactcactatagggcacatagcctcttgggccgtcatattaccaaacagaggagatggtaaatggacggcccaaacctggcggcagcgcaaaagatg

SEQ ID NO: 21350 - DNA, 103 bp, Artificial Sequence
  Synthetic Polynucleotide
taatacgactcactatagggcaaaacacatagcctcttgggccgtcatataacagaggagaatatgaatgcccaagaggaacctggcggcagcgcaaaagatg

SEQ ID NO: 21351 - DNA, 103 bp, Artificial Sequence
  Synthetic Polynucleotide
taatacgactcactataggggactgcaaaacacatagcctcttgggccgtaacagaggagaacggccatggaggctatgaacctggcggcagcgcaaaagatg

SEQ ID NO: 21352 - DNA, 103 bp, Artificial Sequence
  Synthetic Polynucleotide
taatacgactcactataggggctgcgactgcaaaacacatagcctcttggaacagaggagaccaagaatgtatgtgtttaacctggcggcagcgcaaaagatg

SEQ ID NO: 21353 - DNA, 103 bp, Artificial Sequence
  Synthetic Polynucleotide
taatacgactcactatagggggatcgctgcgactgcaaaacacatagcctaacagaggagaaggctaatggttttgcagaacctggcggcagcgcaaaagatg

SEQ ID NO: 21354 - DNA, 103 bp, Artificial Sequence
  Synthetic Polynucleotide
taatacgactcactataggggtcattttttggtgacagctttgagattcaaacagaggagatgaatcatgaagctgtcaaacctggcggcagcgcaaaagatg

SEQ ID NO: 21355 - DNA, 103 bp, Artificial Sequence
  Synthetic Polynucleotide
taatacgactcactatagggtgatcggatcgctgcgactgcaaaacacataacagaggagaatgtgtatggcagtcgcaaacctggcggcagcgcaaaagatg

SEQ ID NO: 21356 - DNA, 103 bp, Artificial Sequence
  Synthetic Polynucleotide
taatacgactcactataggggtgtctgatcggatcgctgcgactgcaaaaaacagaggagattttgcatgcgcagcgataacctggcggcagcgcaaaagatg

SEQ ID NO: 21357 - DNA, 103 bp, Artificial Sequence
  Synthetic Polynucleotide
taatacgactcactatagggctcgtgtgtctgatcggatcgctgcgactgaacagaggagacagtcgatgcgatccgataacctggcggcagcgcaaaagatg

SEQ ID NO: 21358 - DNA, 103 bp, Artificial Sequence
  Synthetic Polynucleotide
taatacgactcactatagggcacacctcgtgtgtctgatcggatcgctgcaacagaggagagcagcgatgcgatcagacaacctggcggcagcgcaaaagatg

SEQ ID NO: 21359 - DNA, 103 bp, Artificial Sequence
  Synthetic Polynucleotide
taatacgactcactataggggcaatcacacctcgtgtgtctgatcggatcaacagaggagagatccgatgagacacacgaacctggcggcagcgcaaaagatg

SEQ ID NO: 21360 - DNA, 103 bp, Artificial Sequence
  Synthetic Polynucleotide
taatacgactcactataggggatctgcaatcacacctcgtgtgtctgatcaacagaggagagatcagatgcacgaggtgaacctggcggcagcgcaaaagatg

SEQ ID NO: 21361 - DNA, 103 bp, Artificial Sequence
  Synthetic Polynucleotide
taatacgactcactataggggcttagatctgcaatcacacctcgtgtgtcaacagaggagagacacaatgggtgtgattaacctggcggcagcgcaaaagatg

SEQ ID NO: 21362 - DNA, 103 bp, Artificial Sequence
  Synthetic Polynucleotide
taatacgactcactatagggagatcgcttagatctgcaatcacacctcgtaacagaggagaacgaggatggattgcagaaacctggcggcagcgcaaaagatg

SEQ ID NO: 21363 - DNA, 103 bp, Artificial Sequence
  Synthetic Polynucleotide
taatacgactcactatagggttaatagatcgcttagatctgcaatcacacaacagaggagagtgtgaatgcagatctaaaacctggcggcagcgcaaaagatg

SEQ ID NO: 21364 - DNA, 103 bp, Artificial Sequence
  Synthetic Polynucleotide
taatacgactcactatagggcatttttaatagatcgcttagatctgcaataacagaggagaattgcaatgctaagcgataacctggcggcagcgcaaaagatg

SEQ ID NO: 21365 - DNA, 103 bp, Artificial Sequence
  Synthetic Polynucleotide
taatacgactcactatagggttgaggtcattttttggtgacagctttgagaacagaggagactcaaaatggtcaccaaaaacctggcggcagcgcaaaagatg

SEQ ID NO: 21366 - DNA, 103 bp, Artificial Sequence
  Synthetic Polynucleotide
taatacgactcactataggggcaagcatttttaatagatcgcttagatctaacagaggagaagatctatgcgatctattaacctggcggcagcgcaaaagatg

SEQ ID NO: 21367 - DNA, 103 bp, Artificial Sequence
  Synthetic Polynucleotide
taatacgactcactatagggctagcgcaagcatttttaatagatcgcttaaacagaggagataagcgatgtattaaaaaaacctggcggcagcgcaaaagatg

SEQ ID NO: 21368 - DNA, 103 bp, Artificial Sequence
  Synthetic Polynucleotide
taatacgactcactatagggtgccgctagcgcaagcatttttaatagatcaacagaggagagatctaatgaaaatgcttaacctggcggcagcgcaaaagatg

SEQ ID NO: 21369 - DNA, 103 bp, Artificial Sequence
  Synthetic Polynucleotide
taatacgactcactatagggcaccatgccgctagcgcaagcatttttaataacagaggagaattaaaatggcttgcgctaacctggcggcagcgcaaaagatg

SEQ ID NO: 21370 - DNA, 103 bp, Artificial Sequence
  Synthetic Polynucleotide
taatacgactcactatagggagggacaccatgccgctagcgcaagcatttaacagaggagaaaatgcatgcgctagcggaacctggcggcagcgcaaaagatg

SEQ ID NO: 21371 - DNA, 103 bp, Artificial Sequence
  Synthetic Polynucleotide
taatacgactcactataggggaagtagggacaccatgccgctagcgcaagaacagaggagacttgcgatggcggcatggaacctggcggcagcgcaaaagatg

SEQ ID NO: 21372 - DNA, 103 bp, Artificial Sequence
  Synthetic Polynucleotide
taatacgactcactatagggtcaacgaagtagggacaccatgccgctagcaacagaggagagctagcatgatggtgtccaacctggcggcagcgcaaaagatg

SEQ ID NO: 21373 - DNA, 103 bp, Artificial Sequence
  Synthetic Polynucleotide
taatacgactcactatagggttaattcaacgaagtagggacaccatgccgaacagaggagacggcatatggtccctactaacctggcggcagcgcaaaagatg

SEQ ID NO: 21374 - DNA, 103 bp, Artificial Sequence
  Synthetic Polynucleotide
taatacgactcactatagggacactttaattcaacgaagtagggacaccaaacagaggagatggtgtatgtacttcgttaacctggcggcagcgcaaaagatg

SEQ ID NO: 21375 - DNA, 103 bp, Artificial Sequence
  Synthetic Polynucleotide
taatacgactcactatagggtgcagacactttaattcaacgaagtagggaaacagaggagatccctaatgcgttgaattaacctggcggcagcgcaaaagatg

SEQ ID NO: 21376 - DNA, 103 bp, Artificial Sequence
  Synthetic Polynucleotide
taatacgactcactatagggagtagttgaggtcattttttggtgacagctaacagaggagaagctgtatgcaaaaaatgaacctggcggcagcgcaaaagatg

SEQ ID NO: 21377 - DNA, 103 bp, Artificial Sequence
  Synthetic Polynucleotide
taatacgactcactatagggttccttgcagacactttaattcaacgaagtaacagaggagaacttcgatgaattaaagtaacctggcggcagcgcaaaagatg

SEQ ID NO: 21378 - DNA, 103 bp, Artificial Sequence
  Synthetic Polynucleotide
taatacgactcactatagggcccccttccttgcagacactttaattcaacaacagaggagagttgaaatgaagtgtctgaacctggcggcagcgcaaaagatg

SEQ ID NO: 21379 - DNA, 103 bp, Artificial Sequence
  Synthetic Polynucleotide
taatacgactcactataggggcaaccccccttccttgcagacactttaataacagaggagaattaaaatgtctgcaaggaacctggcggcagcgcaaaagatg

SEQ ID NO: 21380 - DNA, 103 bp, Artificial Sequence
  Synthetic Polynucleotide
taatacgactcactatagggtttcagcaaccccccttccttgcagacactaacagaggagaagtgtcatgaaggaagggaacctggcggcagcgcaaaagatg

SEQ ID NO: 21381 - DNA, 103 bp, Artificial Sequence
  Synthetic Polynucleotide
taatacgactcactatagggatcaatttcagcaaccccccttccttgcagaacagaggagactgcaaatgaggggggttaacctggcggcagcgcaaaagatg

SEQ ID NO: 21382 - DNA, 103 bp, Artificial Sequence
  Synthetic Polynucleotide
taatacgactcactatagggaaaacatcaatttcagcaaccccccttcctaacagaggagaaggaagatgggttgctgaaacctggcggcagcgcaaaagatg

SEQ ID NO: 21383 - DNA, 103 bp, Artificial Sequence
  Synthetic Polynucleotide
taatacgactcactatagggcagacaaaacatcaatttcagcaaccccccaacagaggagaggggggatgctgaaattgaacctggcggcagcgcaaaagatg

SEQ ID NO: 21384 - DNA, 103 bp, Artificial Sequence
  Synthetic Polynucleotide
taatacgactcactatagggagcttcagacaaaacatcaatttcagcaacaacagaggagagttgctatgattgatgttaacctggcggcagcgcaaaagatg

SEQ ID NO: 21385 - DNA, 103 bp, Artificial Sequence
  Synthetic Polynucleotide
taatacgactcactatagggagtttagcttcagacaaaacatcaatttcaaacagaggagatgaaatatgtgttttgtcaacctggcggcagcgcaaaagatg

SEQ ID NO: 21386 - DNA, 103 bp, Artificial Sequence
  Synthetic Polynucleotide
taatacgactcactatagggaccttagtttagcttcagacaaaacatcaaaacagaggagattgatgatgtgtctgaagaacctggcggcagcgcaaaagatg

SEQ ID NO: 21387 - DNA, 103 bp, Artificial Sequence
  Synthetic Polynucleotide
taatacgactcactatagggtggggagtagttgaggtcattttttggtgaaacagaggagatcaccaatgaatgacctcaacctggcggcagcgcaaaagatg

SEQ ID NO: 21388 - DNA, 103 bp, Artificial Sequence
  Synthetic Polynucleotide
taatacgactcactatagggtttcaaccttagtttagcttcagacaaaacaacagaggagagttttgatggaagctaaaaacctggcggcagcgcaaaagatg

SEQ ID NO: 21389 - DNA, 103 bp, Artificial Sequence
  Synthetic Polynucleotide
taatacgactcactatagggggttctttcaaccttagtttagcttcagacaacagaggagagtctgaatgtaaactaagaacctggcggcagcgcaaaagatg

SEQ ID NO: 21390 - DNA, 103 bp, Artificial Sequence
  Synthetic Polynucleotide
taatacgactcactatagggcagcgggttctttcaaccttagtttagcttaacagaggagaaagctaatgtaaggttgaaacctggcggcagcgcaaaagatg

SEQ ID NO: 21391 - DNA, 103 bp, Artificial Sequence
  Synthetic Polynucleotide
taatacgactcactatagggtggtacagcgggttctttcaaccttagtttaacagaggagaaaactaatgttgaaagaaaacctggcggcagcgcaaaagatg

SEQ ID NO: 21392 - DNA, 103 bp, Artificial Sequence
  Synthetic Polynucleotide
taatacgactcactataggggcgtatggtacagcgggttctttcaaccttaacagaggagaaaggttatgagaacccgcaacctggcggcagcgcaaaagatg

SEQ ID NO: 21393 - DNA, 103 bp, Artificial Sequence
  Synthetic Polynucleotide
taatacgactcactatagggcgtaggcgtatggtacagcgggttctttcaaacagaggagatgaaagatgccgctgtacaacctggcggcagcgcaaaagatg

SEQ ID NO: 21394 - DNA, 103 bp, Artificial Sequence
  Synthetic Polynucleotide
taatacgactcactatagggaccctcgtaggcgtatggtacagcgggttcaacagaggagagaacccatggtaccatacaacctggcggcagcgcaaaagatg

SEQ ID NO: 21395 - DNA, 103 bp, Artificial Sequence
  Synthetic Polynucleotide
taatacgactcactatagggctttcaccctcgtaggcgtatggtacagcgaacagaggagacgctgtatgatacgcctaaacctggcggcagcgcaaaagatg

SEQ ID NO: 21396 - DNA, 103 bp, Artificial Sequence
  Synthetic Polynucleotide
taatacgactcactatagggtttcgctttcaccctcgtaggcgtatggtaaacagaggagataccatatgcctacgaggaacctggcggcagcgcaaaagatg

SEQ ID NO: 21397 - DNA, 103 bp, Artificial Sequence
  Synthetic Polynucleotide
taatacgactcactataggggagcctttcgctttcaccctcgtaggcgtaaacagaggagatacgccatggagggtgaaaacctggcggcagcgcaaaagatg

SEQ ID NO: 21398 - DNA, 103 bp, Artificial Sequence
  Synthetic Polynucleotide
taatacgactcactatagggtcatttggggagtagttgaggtcattttttaacagaggagaaaaaaaatgcctcaactaaacctggcggcagcgcaaaagatg

SEQ ID NO: 21399 - DNA, 103 bp, Artificial Sequence
  Synthetic Polynucleotide
taatacgactcactatagggagacggagcctttcgctttcaccctcgtagaacagaggagactacgaatgtgaaagcgaaacctggcggcagcgcaaaagatg

SEQ ID NO: 21400 - DNA, 103 bp, Artificial Sequence
  Synthetic Polynucleotide
taatacgactcactatagggcggccagacggagcctttcgctttcaccctaacagaggagaagggtgatggcgaaaggcaacctggcggcagcgcaaaagatg

SEQ ID NO: 21401 - DNA, 103 bp, Artificial Sequence
  Synthetic Polynucleotide
taatacgactcactatagggccgtacggccagacggagcctttcgctttcaacagaggagagaaagcatgaggctccgtaacctggcggcagcgcaaaagatg

SEQ ID NO: 21402 - DNA, 103 bp, Artificial Sequence
  Synthetic Polynucleotide
taatacgactcactatagggacttgccgtacggccagacggagcctttcgaacagaggagacgaaagatgccgtctggcaacctggcggcagcgcaaaagatg

SEQ ID NO: 21403 - DNA, 103 bp, Artificial Sequence
  Synthetic Polynucleotide
taatacgactcactatagggtaaatacttgccgtacggccagacggagccaacagaggagaggctccatgtggccgtacaacctggcggcagcgcaaaagatg

SEQ ID NO: 21404 - DNA, 103 bp, Artificial Sequence
  Synthetic Polynucleotide
taatacgactcactatagggctcattaaatacttgccgtacggccagacgaacagaggagacgtctgatggtacggcaaaacctggcggcagcgcaaaagatg

SEQ ID NO: 21405 - DNA, 103 bp, Artificial Sequence
  Synthetic Polynucleotide
taatacgactcactatagggagctcctcattaaatacttgccgtacggccaacagaggagaggccgtatggcaagtattaacctggcggcagcgcaaaagatg

SEQ ID NO: 21406 - DNA, 103 bp, Artificial Sequence
  Synthetic Polynucleotide
taatacgactcactataggggtttaagctcctcattaaatacttgccgtaaacagaggagatacggcatgtatttaatgaacctggcggcagcgcaaaagatg

SEQ ID NO: 21407 - DNA, 103 bp, Artificial Sequence
  Synthetic Polynucleotide
taatacgactcactatagggttcgggtttaagctcctcattaaatacttgaacagaggagacaagtaatgaatgaggagaacctggcggcagcgcaaaagatg

SEQ ID NO: 21408 - DNA, 103 bp, Artificial Sequence
  Synthetic Polynucleotide
taatacgactcactatagggacatcttcgggtttaagctcctcattaaataacagaggagaatttaaatgggagcttaaaacctggcggcagcgcaaaagatg

SEQ ID NO: 21409 - DNA, 103 bp, Artificial Sequence
  Synthetic Polynucleotide
taatacgactcactatagggtgtgttcatttggggagtagttgaggtcataacagaggagaatgaccatgactactcccaacctggcggcagcgcaaaagatg

SEQ ID NO: 21410 - DNA, 103 bp, Artificial Sequence
  Synthetic Polynucleotide
taatacgactcactataggggtctaacatcttcgggtttaagctcctcataacagaggagaatgaggatgttaaacccgaacctggcggcagcgcaaaagatg

SEQ ID NO: 21411 - DNA, 103 bp, Artificial Sequence
  Synthetic Polynucleotide
taatacgactcactatagggtcttagtctaacatcttcgggtttaagctcaacagaggagagagcttatgcccgaagataacctggcggcagcgcaaaagatg

SEQ ID NO: 21412 - DNA, 103 bp, Artificial Sequence
  Synthetic Polynucleotide
taatacgactcactatagggttcgttcttagtctaacatcttcgggtttaaacagaggagataaaccatgagatgttagaacctggcggcagcgcaaaagatg

SEQ ID NO: 21413 - DNA, 103 bp, Artificial Sequence
  Synthetic Polynucleotide
taatacgactcactatagggcttccttcgttcttagtctaacatcttcggaacagaggagaccgaagatgttagactaaaacctggcggcagcgcaaaagatg

SEQ ID NO: 21414 - DNA, 103 bp, Artificial Sequence
  Synthetic Polynucleotide
taatacgactcactataggggaaatcttccttcgttcttagtctaacatcaacagaggagagatgttatgctaagaacgaacctggcggcagcgcaaaagatg

SEQ ID NO: 21415 - DNA, 103 bp, Artificial Sequence
  Synthetic Polynucleotide
taatacgactcactataggggaccagaaatcttccttcgttcttagtctaaacagaggagatagactatgaacgaaggaaacctggcggcagcgcaaaagatg

SEQ ID NO: 21416 - DNA, 103 bp, Artificial Sequence
  Synthetic Polynucleotide
taatacgactcactataggggggacgaccagaaatcttccttcgttcttaaacagaggagataagaaatgaggaagattaacctggcggcagcgcaaaagatg

SEQ ID NO: 21417 - DNA, 103 bp, Artificial Sequence
  Synthetic Polynucleotide
taatacgactcactatagggccaacgggacgaccagaaatcttccttcgtaacagaggagaacgaagatggatttctggaacctggcggcagcgcaaaagatg

SEQ ID NO: 21418 - DNA, 103 bp, Artificial Sequence
  Synthetic Polynucleotide
taatacgactcactatagggcacagccaacgggacgaccagaaatcttccaacagaggagaggaagaatgctggtcgtcaacctggcggcagcgcaaaagatg

SEQ ID NO: 21419 - DNA, 103 bp, Artificial Sequence
  Synthetic Polynucleotide
taatacgactcactatagggctgcccacagccaacgggacgaccagaaataacagaggagaatttctatgcgtcccgttaacctggcggcagcgcaaaagatg

SEQ ID NO: 21420 - DNA, 103 bp, Artificial Sequence
  Synthetic Polynucleotide
taatacgactcactatagggcaccgtttagatgagctctatattttaaccaacagaggagaggttaaatgatagagctcaacctggcggcagcgcaaaagatg

SEQ ID NO: 21421 - DNA, 103 bp, Artificial Sequence
  Synthetic Polynucleotide
taatacgactcactatagggactgatgtgttcatttggggagtagttgagaacagaggagactcaacatgtccccaaataacctggcggcagcgcaaaagatg

SEQ ID NO: 21422 - DNA, 103 bp, Artificial Sequence
  Synthetic Polynucleotide
taatacgactcactatagggattcgctgcccacagccaacgggacgaccaaacagaggagatggtcgatgcgttggctgaacctggcggcagcgcaaaagatg

SEQ ID NO: 21423 - DNA, 103 bp, Artificial Sequence
  Synthetic Polynucleotide
taatacgactcactatagggccaccattcgctgcccacagccaacgggacaacagaggagagtcccgatggctgtgggcaacctggcggcagcgcaaaagatg

SEQ ID NO: 21424 - DNA, 103 bp, Artificial Sequence
  Synthetic Polynucleotide
taatacgactcactatagggaatgtccaccattcgctgcccacagccaacaacagaggagagttggcatggggcagcgaaacctggcggcagcgcaaaagatg

SEQ ID NO: 21425 - DNA, 103 bp, Artificial Sequence
  Synthetic Polynucleotide
taatacgactcactatagggtctggaatgtccaccattcgctgcccacagaacagaggagactgtggatggcgaatggtaacctggcggcagcgcaaaagatg

SEQ ID NO: 21426 - DNA, 103 bp, Artificial Sequence
  Synthetic Polynucleotide
taatacgactcactatagggagggctctggaatgtccaccattcgctgccaacagaggagaggcagcatgtggtggacaaacctggcggcagcgcaaaagatg

SEQ ID NO: 21427 - DNA, 103 bp, Artificial Sequence
  Synthetic Polynucleotide
taatacgactcactataggggctcaagggctctggaatgtccaccattcgaacagaggagacgaatgatggacattccaaacctggcggcagcgcaaaagatg

SEQ ID NO: 21428 - DNA, 103 bp, Artificial Sequence
  Synthetic Polynucleotide
taatacgactcactatagggagcatgctcaagggctctggaatgtccaccaacagaggagaggtggaatgtccagagccaacctggcggcagcgcaaaagatg

SEQ ID NO: 21429 - DNA, 103 bp, Artificial Sequence
  Synthetic Polynucleotide
taatacgactcactatagggggatgagcatgctcaagggctctggaatgtaacagaggagaacattcatgagcccttgaaacctggcggcagcgcaaaagatg

SEQ ID NO: 21430 - DNA, 103 bp, Artificial Sequence
  Synthetic Polynucleotide
taatacgactcactatagggactcaggatgagcatgctcaagggctctggaacagaggagaccagagatgttgagcatgaacctggcggcagcgcaaaagatg

SEQ ID NO: 21431 - DNA, 103 bp, Artificial Sequence
  Synthetic Polynucleotide
taatacgactcactatagggtctcaactcaggatgagcatgctcaagggcaacagaggagagcccttatgcatgctcataacctggcggcagcgcaaaagatg

SEQ ID NO: 21432 - DNA, 103 bp, Artificial Sequence
  Synthetic Polynucleotide
taatacgactcactatagggtgaacactgatgtgttcatttggggagtagaacagaggagactactcatgaaatgaacaaacctggcggcagcgcaaaagatg

SEQ ID NO: 21433 - DNA, 103 bp, Artificial Sequence
  Synthetic Polynucleotide
taatacgactcactatagggctagttctcaactcaggatgagcatgctcaaacagaggagatgagcaatgtcatcctgaaacctggcggcagcgcaaaagatg

SEQ ID NO: 21434 - DNA, 103 bp, Artificial Sequence
  Synthetic Polynucleotide
taatacgactcactatagggctttcctagttctcaactcaggatgagcataacagaggagaatgctcatgctgagttgaaacctggcggcagcgcaaaagatg

SEQ ID NO: 21435 - DNA, 103 bp, Artificial Sequence
  Synthetic Polynucleotide
taatacgactcactatagggaagctctttcctagttctcaactcaggatgaacagaggagacatcctatgttgagaactaacctggcggcagcgcaaaagatg

SEQ ID NO: 21436 - DNA, 103 bp, Artificial Sequence
  Synthetic Polynucleotide
taatacgactcactataggggccctaagctctttcctagttctcaactcaaacagaggagatgagttatgaactaggaaaacctggcggcagcgcaaaagatg

SEQ ID NO: 21437 - DNA, 103 bp, Artificial Sequence
  Synthetic Polynucleotide
taatacgactcactatagggtataagccctaagctctttcctagttctcaaacagaggagatgagaaatgggaaagagcaacctggcggcagcgcaaaagatg

SEQ ID NO: 21438 - DNA, 103 bp, Artificial Sequence
  Synthetic Polynucleotide
taatacgactcactatagggtttcctataagccctaagctctttcctagtaacagaggagaactaggatggagcttaggaacctggcggcagcgcaaaagatg

SEQ ID NO: 21439 - DNA, 103 bp, Artificial Sequence
  Synthetic Polynucleotide
taatacgactcactatagggacacatttcctataagccctaagctctttcaacagaggagagaaagaatgtagggcttaaacctggcggcagcgcaaaagatg

SEQ ID NO: 21440 - DNA, 103 bp, Artificial Sequence
  Synthetic Polynucleotide
taatacgactcactatagggctaggacacatttcctataagccctaagctaacagaggagaagcttaatgcttataggaaacctggcggcagcgcaaaagatg

SEQ ID NO: 21441 - DNA, 103 bp, Artificial Sequence
  Synthetic Polynucleotide
taatacgactcactatagggttgttctaggacacatttcctataagccctaacagaggagaagggctatgaggaaatgtaacctggcggcagcgcaaaagatg

SEQ ID NO: 21442 - DNA, 103 bp, Artificial Sequence
  Synthetic Polynucleotide
taatacgactcactatagggttccattgttctaggacacatttcctataaaacagaggagattatagatgatgtgtcctaacctggcggcagcgcaaaagatg

SEQ ID NO: 21443 - DNA, 103 bp, Artificial Sequence
  Synthetic Polynucleotide
taatacgactcactatagggagaattgaacactgatgtgttcatttggggaacagaggagaccccaaatgaacacatcaaacctggcggcagcgcaaaagatg

SEQ ID NO: 21444 - DNA, 103 bp, Artificial Sequence
  Synthetic Polynucleotide
taatacgactcactatagggtattcttccattgttctaggacacatttccaacagaggagaggaaatatgtcctagaacaacctggcggcagcgcaaaagatg

SEQ ID NO: 21445 - DNA, 103 bp, Artificial Sequence
  Synthetic Polynucleotide
taatacgactcactatagggcgggttattcttccattgttctaggacacaaacagaggagatgtgtcatggaacaatggaacctggcggcagcgcaaaagatg

SEQ ID NO: 21446 - DNA, 103 bp, Artificial Sequence
  Synthetic Polynucleotide
taatacgactcactatagggtccatcgggttattcttccattgttctaggaacagaggagacctagaatgatggaagaaaacctggcggcagcgcaaaagatg

SEQ ID NO: 21447 - DNA, 103 bp, Artificial Sequence
  Synthetic Polynucleotide
taatacgactcactatagggaatcatccatcgggttattcttccattgttaacagaggagaaacaatatgagaataaccaacctggcggcagcgcaaaagatg

SEQ ID NO: 21448 - DNA, 103 bp, Artificial Sequence
  Synthetic Polynucleotide
taatacgactcactatagggatcccaatcatccatcgggttattcttccaaacagaggagatggaagatgaacccgatgaacctggcggcagcgcaaaagatg

SEQ ID NO: 21449 - DNA, 103 bp, Artificial Sequence
  Synthetic Polynucleotide
taatacgactcactatagggtttccatcccaatcatccatcgggttattcaacagaggagagaataaatggatggatgaaacctggcggcagcgcaaaagatg

SEQ ID NO: 21450 - DNA, 103 bp, Artificial Sequence
  Synthetic Polynucleotide
taatacgactcactatagggagacctttccatcccaatcatccatcgggtaacagaggagaacccgaatgatgattgggaacctggcggcagcgcaaaagatg

SEQ ID NO: 21451 - DNA, 103 bp, Artificial Sequence
  Synthetic Polynucleotide
taatacgactcactatagggaacaaagacctttccatcccaatcatccataacagaggagaatggatatgtgggatggaaacctggcggcagcgcaaaagatg

SEQ ID NO: 21452 - DNA, 103 bp, Artificial Sequence
  Synthetic Polynucleotide
taatacgactcactatagggggagtaacaaagacctttccatcccaatcaaacagaggagatgattgatgtggaaaggtaacctggcggcagcgcaaaagatg

SEQ ID NO: 21453 - DNA, 103 bp, Artificial Sequence
  Synthetic Polynucleotide
taatacgactcactataggggactaggagtaacaaagacctttccatcccaacagaggagagggatgatgaggtctttgaacctggcggcagcgcaaaagatg

SEQ ID NO: 21454 - DNA, 103 bp, Artificial Sequence
  Synthetic Polynucleotide
taatacgactcactatagggcgcgtagaattgaacactgatgtgttcattaacagaggagaaatgaaatgatcagtgttaacctggcggcagcgcaaaagatg

SEQ ID NO: 21455 - DNA, 103 bp, Artificial Sequence
  Synthetic Polynucleotide
taatacgactcactatagggtttttgactaggagtaacaaagacctttccaacagaggagaggaaagatgtttgttactaacctggcggcagcgcaaaagatg

SEQ ID NO: 21456 - DNA, 103 bp, Artificial Sequence
  Synthetic Polynucleotide
taatacgactcactatagggtcaagtttttgactaggagtaacaaagaccaacagaggagaggtcttatgtactcctagaacctggcggcagcgcaaaagatg

SEQ ID NO: 21457 - DNA, 103 bp, Artificial Sequence
  Synthetic Polynucleotide
taatacgactcactatagggcgtgttcaagtttttgactaggagtaacaaaacagaggagattgttaatgctagtcaaaaacctggcggcagcgcaaaagatg

SEQ ID NO: 21458 - DNA, 103 bp, Artificial Sequence
  Synthetic Polynucleotide
taatacgactcactatagggtttaccgtgttcaagtttttgactaggagtaacagaggagaactcctatgcaaaaacttaacctggcggcagcgcaaaagatg

SEQ ID NO: 21459 - DNA, 103 bp, Artificial Sequence
  Synthetic Polynucleotide
taatacgactcactatagggcggcttttaccgtgttcaagtttttgactaaacagaggagatagtcaatgacttgaacaaacctggcggcagcgcaaaagatg

SEQ ID NO: 21460 - DNA, 103 bp, Artificial Sequence
  Synthetic Polynucleotide
taatacgactcactataggggtagtcggcttttaccgtgttcaagtttttaacagaggagaaaaaacatgaacacggtaaacctggcggcagcgcaaaagatg

SEQ ID NO: 21461 - DNA, 103 bp, Artificial Sequence
  Synthetic Polynucleotide
taatacgactcactatagggtagtagtagtcggcttttaccgtgttcaagaacagaggagacttgaaatgggtaaaagcaacctggcggcagcgcaaaagatg

SEQ ID NO: 21462 - DNA, 103 bp, Artificial Sequence
  Synthetic Polynucleotide
taatacgactcactatagggcacgctagtagtagtcggcttttaccgtgtaacagaggagaacacggatgaagccgactaacctggcggcagcgcaaaagatg

SEQ ID NO: 21463 - DNA, 103 bp, Artificial Sequence
  Synthetic Polynucleotide
taatacgactcactatagggtgtcacacgctagtagtagtcggcttttacaacagaggagagtaaaaatggactactacaacctggcggcagcgcaaaagatg

SEQ ID NO: 21464 - DNA, 103 bp, Artificial Sequence
  Synthetic Polynucleotide
taatacgactcactatagggtaacgtgtcacacgctagtagtagtcggctaacagaggagaagccgaatgctactagcgaacctggcggcagcgcaaaagatg

SEQ ID NO: 21465 - DNA, 103 bp, Artificial Sequence
  Synthetic Polynucleotide
taatacgactcactatagggggcctcgcgtagaattgaacactgatgtgtaacagaggagaacacatatgtgttcaattaacctggcggcagcgcaaaagatg

SEQ ID NO: 21466 - DNA, 103 bp, Artificial Sequence
  Synthetic Polynucleotide
taatacgactcactatagggtaagataacgtgtcacacgctagtagtagtaacagaggagaactactatgagcgtgtgaaacctggcggcagcgcaaaagatg

SEQ ID NO: 21467 - DNA, 103 bp, Artificial Sequence
  Synthetic Polynucleotide
taatacgactcactatagggacaggtaagataacgtgtcacacgctagtaaacagaggagatactagatggtgacacgtaacctggcggcagcgcaaaagatg

SEQ ID NO: 21468 - DNA, 103 bp, Artificial Sequence
  Synthetic Polynucleotide
taatacgactcactataggggaaccacaggtaagataacgtgtcacacgcaacagaggagagcgtgtatgacgttatctaacctggcggcagcgcaaaagatg

SEQ ID NO: 21469 - DNA, 103 bp, Artificial Sequence
  Synthetic Polynucleotide
taatacgactcactatagggtattcgaaccacaggtaagataacgtgtcaaacagaggagatgacacatgatcttacctaacctggcggcagcgcaaaagatg

SEQ ID NO: 21470 - DNA, 103 bp, Artificial Sequence
  Synthetic Polynucleotide
taatacgactcactatagggaaaaatattcgaaccacaggtaagataacgaacagaggagacgttatatgacctgtggtaacctggcggcagcgcaaaagatg

SEQ ID NO: 21471 - DNA, 103 bp, Artificial Sequence
  Synthetic Polynucleotide
taatacgactcactatagggctttaaaaaatattcgaaccacaggtaagaaacagaggagatcttacatgtggttcgaaaacctggcggcagcgcaaaagatg

SEQ ID NO: 21472 - DNA, 103 bp, Artificial Sequence
  Synthetic Polynucleotide
taatacgactcactatagggactggctttaaaaaatattcgaaccacaggaacagaggagacctgtgatgcgaatatttaacctggcggcagcgcaaaagatg

SEQ ID NO: 21473 - DNA, 103 bp, Artificial Sequence
  Synthetic Polynucleotide
taatacgactcactatagggtctcaactggctttaaaaaatattcgaaccaacagaggagaggttcgatgattttttaaaacctggcggcagcgcaaaagatg

SEQ ID NO: 21474 - DNA, 103 bp, Artificial Sequence
  Synthetic Polynucleotide
taatacgactcactatagggcgctgtctcaactggctttaaaaaatattcaacagaggagagaatatatgttaaagccaaacctggcggcagcgcaaaagatg

SEQ ID NO: 21475 - DNA, 103 bp, Artificial Sequence
  Synthetic Polynucleotide
taatacgactcactataggggcccacgctgtctcaactggctttaaaaaaaacagaggagattttttatggccagttgaaacctggcggcagcgcaaaagatg

SEQ ID NO: 21476 - DNA, 103 bp, Artificial Sequence
  Synthetic Polynucleotide
taatacgactcactatagggtctacggcctcgcgtagaattgaacactgaaacagaggagatcagtgatgaattctacgaacctggcggcagcgcaaaagatg

SEQ ID NO: 21477 - DNA, 103 bp, Artificial Sequence
  Synthetic Polynucleotide
taatacgactcactatagggtgttagcccacgctgtctcaactggctttaaacagaggagataaagcatgttgagacagaacctggcggcagcgcaaaagatg

SEQ ID NO: 21478 - DNA, 103 bp, Artificial Sequence
  Synthetic Polynucleotide
taatacgactcactatagggccgtttgttagcccacgctgtctcaactggaacagaggagaccagttatgacagcgtggaacctggcggcagcgcaaaagatg

SEQ ID NO: 21479 - DNA, 103 bp, Artificial Sequence
  Synthetic Polynucleotide
taatacgactcactatagggagtgtccgtttgttagcccacgctgtctcaaacagaggagatgagacatggtgggctaaaacctggcggcagcgcaaaagatg

SEQ ID NO: 21480 - DNA, 103 bp, Artificial Sequence
  Synthetic Polynucleotide
taatacgactcactatagggtcaaaagtgtccgtttgttagcccacgctgaacagaggagacagcgtatgctaacaaacaacctggcggcagcgcaaaagatg

SEQ ID NO: 21481 - DNA, 103 bp, Artificial Sequence
  Synthetic Polynucleotide
taatacgactcactatagggtgggttcaaaagtgtccgtttgttagcccaaacagaggagatgggctatgaaacggacaaacctggcggcagcgcaaaagatg

SEQ ID NO: 21482 - DNA, 103 bp, Artificial Sequence
  Synthetic Polynucleotide
taatacgactcactatagggactcctgggttcaaaagtgtccgtttgttaaacagaggagataacaaatggacacttttaacctggcggcagcgcaaaagatg

SEQ ID NO: 21483 - DNA, 103 bp, Artificial Sequence
  Synthetic Polynucleotide
taatacgactcactatagggttataactcctgggttcaaaagtgtccgttaacagaggagaaacggaatgttttgaaccaacctggcggcagcgcaaaagatg

SEQ ID NO: 21484 - DNA, 103 bp, Artificial Sequence
  Synthetic Polynucleotide
taatacgactcactataggggtgatttataactcctgggttcaaaagtgtaacagaggagaacacttatgaacccaggaaacctggcggcagcgcaaaagatg

SEQ ID NO: 21485 - DNA, 103 bp, Artificial Sequence
  Synthetic Polynucleotide
taatacgactcactatagggttgtagtgatttataactcctgggttcaaaaacagaggagatttgaaatgaggagttataacctggcggcagcgcaaaagatg

SEQ ID NO: 21486 - DNA, 103 bp, Artificial Sequence
  Synthetic Polynucleotide
taatacgactcactatagggccactttgtagtgatttataactcctgggtaacagaggagaacccagatgttataaatcaacctggcggcagcgcaaaagatg

SEQ ID NO: 21487 - DNA, 103 bp, Artificial Sequence
  Synthetic Polynucleotide
taatacgactcactatagggaccactctacggcctcgcgtagaattgaacaacagaggagagttcaaatgtacgcgaggaacctggcggcagcgcaaaagatg

SEQ ID NO: 21488 - DNA, 103 bp, Artificial Sequence
  Synthetic Polynucleotide
taatacgactcactatagggcttggccactttgtagtgatttataactccaacagaggagaggagttatgaatcactacaacctggcggcagcgcaaaagatg

SEQ ID NO: 21489 - DNA, 103 bp, Artificial Sequence
  Synthetic Polynucleotide
taatacgactcactatagggaagtccttggccactttgtagtgatttataaacagaggagatataaaatgctacaaagtaacctggcggcagcgcaaaagatg

SEQ ID NO: 21490 - DNA, 103 bp, Artificial Sequence
  Synthetic Polynucleotide
taatacgactcactatagggcttcgaagtccttggccactttgtagtgataacagaggagaatcactatgaagtggccaaacctggcggcagcgcaaaagatg

SEQ ID NO: 21491 - DNA, 103 bp, Artificial Sequence
  Synthetic Polynucleotide
taatacgactcactatagggcaaaccttcgaagtccttggccactttgtaaacagaggagatacaaaatggccaaggacaacctggcggcagcgcaaaagatg

SEQ ID NO: 21492 - DNA, 103 bp, Artificial Sequence
  Synthetic Polynucleotide
taatacgactcactataggggttagcaaaccttcgaagtccttggccactaacagaggagaagtggcatgggacttcgaaacctggcggcagcgcaaaagatg

SEQ ID NO: 21493 - DNA, 103 bp, Artificial Sequence
  Synthetic Polynucleotide
taatacgactcactatagggggtctgttagcaaaccttcgaagtccttggaacagaggagaccaaggatgtcgaaggttaacctggcggcagcgcaaaagatg

SEQ ID NO: 21494 - DNA, 103 bp, Artificial Sequence
  Synthetic Polynucleotide
taatacgactcactatagggagttgggtctgttagcaaaccttcgaagtcaacagaggagagacttcatgggtttgctaaacctggcggcagcgcaaaagatg

SEQ ID NO: 21495 - DNA, 103 bp, Artificial Sequence
  Synthetic Polynucleotide
taatacgactcactatagggggctgagttgggtctgttagcaaaccttcgaacagaggagacgaaggatggctaacagaaacctggcggcagcgcaaaagatg

SEQ ID NO: 21496 - DNA, 103 bp, Artificial Sequence
  Synthetic Polynucleotide
taatacgactcactatagggcttctggctgagttgggtctgttagcaaacaacagaggagagtttgcatgcagacccaaaacctggcggcagcgcaaaagatg

SEQ ID NO: 21497 - DNA, 103 bp, Artificial Sequence
  Synthetic Polynucleotide
taatacgactcactatagggcccatcttctggctgagttgggtctgttagaacagaggagactaacaatgccaactcagaacctggcggcagcgcaaaagatg

SEQ ID NO: 21498 - DNA, 103 bp, Artificial Sequence
  Synthetic Polynucleotide
taatacgactcactatagggctgataccactctacggcctcgcgtagaataacagaggagaattctaatggaggccgtaaacctggcggcagcgcaaaagatg

SEQ ID NO: 21499 - DNA, 103 bp, Artificial Sequence
  Synthetic Polynucleotide
taatacgactcactatagggtgatgcccatcttctggctgagttgggtctaacagaggagaagacccatgtcagccagaaacctggcggcagcgcaaaagatg

SEQ ID NO: 21500 - DNA, 103 bp, Artificial Sequence
  Synthetic Polynucleotide
taatacgactcactatagggcacgctgatgcccatcttctggctgagttgaacagaggagacaactcatgcagaagatgaacctggcggcagcgcaaaagatg

SEQ ID NO: 21501 - DNA, 103 bp, Artificial Sequence
  Synthetic Polynucleotide
taatacgactcactataggggtcatcacgctgatgcccatcttctggctgaacagaggagacagccaatggatgggcataacctggcggcagcgcaaaagatg

SEQ ID NO: 21502 - DNA, 103 bp, Artificial Sequence
  Synthetic Polynucleotide
taatacgactcactatagggaccaggtcatcacgctgatgcccatcttctaacagaggagaagaagaatggcatcagcgaacctggcggcagcgcaaaagatg

SEQ ID NO: 21503 - DNA, 103 bp, Artificial Sequence
  Synthetic Polynucleotide
taatacgactcactatagggtataaaccaggtcatcacgctgatgcccataacagaggagaatgggcatgagcgtgatgaacctggcggcagcgcaaaagatg

SEQ ID NO: 21504 - DNA, 103 bp, Artificial Sequence
  Synthetic Polynucleotide
taatacgactcactatagggaagactataaaccaggtcatcacgctgatgaacagaggagacatcagatggatgacctgaacctggcggcagcgcaaaagatg

SEQ ID NO: 21505 - DNA, 103 bp, Artificial Sequence
  Synthetic Polynucleotide
taatacgactcactatagggaagtcaagactataaaccaggtcatcacgcaacagaggagagcgtgaatgcctggtttaaacctggcggcagcgcaaaagatg

SEQ ID NO: 21506 - DNA, 103 bp, Artificial Sequence
  Synthetic Polynucleotide
taatacgactcactatagggcttcgaagtcaagactataaaccaggtcataacagaggagaatgaccatgtttatagtcaacctggcggcagcgcaaaagatg

SEQ ID NO: 21507 - DNA, 103 bp, Artificial Sequence
  Synthetic Polynucleotide
taatacgactcactataggggaagtcttcgaagtcaagactataaaccagaacagaggagactggttatgagtcttgacaacctggcggcagcgcaaaagatg

SEQ ID NO: 21508 - DNA, 103 bp, Artificial Sequence
  Synthetic Polynucleotide
taatacgactcactataggggaattgaagtcttcgaagtcaagactataaaacagaggagattatagatgtgacttcgaaacctggcggcagcgcaaaagatg

SEQ ID NO: 21509 - DNA, 103 bp, Artificial Sequence
  Synthetic Polynucleotide
taatacgactcactatagggatcgcctgataccactctacggcctcgcgtaacagaggagaacgcgaatgcgtagagtgaacctggcggcagcgcaaaagatg

SEQ ID NO: 21510 - DNA, 103 bp, Artificial Sequence
  Synthetic Polynucleotide
taatacgactcactataggggttgtgaattgaagtcttcgaagtcaagacaacagaggagagtcttgatgtcgaagactaacctggcggcagcgcaaaagatg

SEQ ID NO: 21511 - DNA, 103 bp, Artificial Sequence
  Synthetic Polynucleotide
taatacgactcactatagggcgagtgttgtgaattgaagtcttcgaagtcaacagaggagagacttcatggacttcaataacctggcggcagcgcaaaagatg

SEQ ID NO: 21512 - DNA, 103 bp, Artificial Sequence
  Synthetic Polynucleotide
taatacgactcactataggggttaacgagtgttgtgaattgaagtcttcgaacagaggagacgaagaatgcaattcacaaacctggcggcagcgcaaaagatg

SEQ ID NO: 21513 - DNA, 103 bp, Artificial Sequence
  Synthetic Polynucleotide
taatacgactcactataggggatttgttaacgagtgttgtgaattgaagtaacagaggagaacttcaatgcacaacactaacctggcggcagcgcaaaagatg

SEQ ID NO: 21514 - DNA, 103 bp, Artificial Sequence
  Synthetic Polynucleotide
taatacgactcactatagggtttctgatttgttaacgagtgttgtgaattaacagaggagaaattcaatgcactcgttaaacctggcggcagcgcaaaagatg

SEQ ID NO: 21515 - DNA, 103 bp, Artificial Sequence
  Synthetic Polynucleotide
taatacgactcactatagggacaagtttctgatttgttaacgagtgttgtaacagaggagaacaacaatggttaacaaaaacctggcggcagcgcaaaagatg

SEQ ID NO: 21516 - DNA, 103 bp, Artificial Sequence
  Synthetic Polynucleotide
taatacgactcactatagggcaaagacaagtttctgatttgttaacgagtaacagaggagaactcgtatgcaaatcagaaacctggcggcagcgcaaaagatg

SEQ ID NO: 21517 - DNA, 103 bp, Artificial Sequence
  Synthetic Polynucleotide
taatacgactcactatagggttcttcaaagacaagtttctgatttgttaaaacagaggagattaacaatgcagaaacttaacctggcggcagcgcaaaagatg

SEQ ID NO: 21518 - DNA, 103 bp, Artificial Sequence
  Synthetic Polynucleotide
taatacgactcactatagggaataattcttcaaagacaagtttctgatttaacagaggagaaaatcaatgacttgtcttaacctggcggcagcgcaaaagatg

SEQ ID NO: 21519 - DNA, 103 bp, Artificial Sequence
  Synthetic Polynucleotide
taatacgactcactatagggggttgaataattcttcaaagacaagtttctaacagaggagaagaaacatgtctttgaagaacctggcggcagcgcaaaagatg

SEQ ID NO: 21520 - DNA, 103 bp, Artificial Sequence
  Synthetic Polynucleotide
taatacgactcactataggggacctatcgcctgataccactctacggcctaacagaggagaaggccgatgagtggtatcaacctggcggcagcgcaaaagatg

SEQ ID NO: 21521 - DNA, 103 bp, Artificial Sequence
  Synthetic Polynucleotide
taatacgactcactatagggaatgtggttgaataattcttcaaagacaagaacagaggagacttgtcatggaagaattaaacctggcggcagcgcaaaagatg

SEQ ID NO: 21522 - DNA, 103 bp, Artificial Sequence
  Synthetic Polynucleotide
taatacgactcactatagggagcccaatgtggttgaataattcttcaaagaacagaggagactttgaatgattattcaaaacctggcggcagcgcaaaagatg

SEQ ID NO: 21523 - DNA, 103 bp, Artificial Sequence
  Synthetic Polynucleotide
taatacgactcactatagggtgcttagcccaatgtggttgaataattcttaacagaggagaaagaatatgtcaaccacaaacctggcggcagcgcaaaagatg

SEQ ID NO: 21524 - DNA, 103 bp, Artificial Sequence
  Synthetic Polynucleotide
taatacgactcactatagggtttgttgcttagcccaatgtggttgaataaaacagaggagattattcatgcacattgggaacctggcggcagcgcaaaagatg

SEQ ID NO: 21525 - DNA, 103 bp, Artificial Sequence
  Synthetic Polynucleotide
taatacgactcactataggggtatctttgttgcttagcccaatgtggttgaacagaggagacaaccaatgtgggctaagaacctggcggcagcgcaaaagatg

SEQ ID NO: 21526 - DNA, 103 bp, Artificial Sequence
  Synthetic Polynucleotide
taatacgactcactatagggttgccgtatctttgttgcttagcccaatgtaacagaggagaacattgatgtaagcaacaaacctggcggcagcgcaaaagatg

SEQ ID NO: 21527 - DNA, 103 bp, Artificial Sequence
  Synthetic Polynucleotide
taatacgactcactatagggcagtcttgccgtatctttgttgcttagcccaacagaggagagggctaatgaacaaagataacctggcggcagcgcaaaagatg

SEQ ID NO: 21528 - DNA, 103 bp, Artificial Sequence
  Synthetic Polynucleotide
taatacgactcactatagggttgaccagtcttgccgtatctttgttgcttaacagaggagaaagcaaatgagatacggcaacctggcggcagcgcaaaagatg

SEQ ID NO: 21529 - DNA, 103 bp, Artificial Sequence
  Synthetic Polynucleotide
taatacgactcactatagggaactcttgaccagtcttgccgtatctttgtaacagaggagaacaaagatgcggcaagacaacctggcggcagcgcaaaagatg

SEQ ID NO: 21530 - DNA, 103 bp, Artificial Sequence
  Synthetic Polynucleotide
taatacgactcactatagggatcaaaactcttgaccagtcttgccgtatcaacagaggagagatacgatgagactggtcaacctggcggcagcgcaaaagatg

SEQ ID NO: 21531 - DNA, 103 bp, Artificial Sequence
  Synthetic Polynucleotide
taatacgactcactataggggtaaccaccgtttagatgagctctatatttaacagaggagaaaatatatggctcatctaaacctggcggcagcgcaaaagatg

SEQ ID NO: 21532 - DNA, 103 bp, Artificial Sequence
  Synthetic Polynucleotide
taatacgactcactatagggtttcagacctatcgcctgataccactctacaacagaggagagtagagatgtatcaggcgaacctggcggcagcgcaaaagatg

SEQ ID NO: 21533 - DNA, 103 bp, Artificial Sequence
  Synthetic Polynucleotide
taatacgactcactatagggatttgatcaaaactcttgaccagtcttgccaacagaggagaggcaagatgggtcaagagaacctggcggcagcgcaaaagatg

SEQ ID NO: 21534 - DNA, 103 bp, Artificial Sequence
  Synthetic Polynucleotide
taatacgactcactatagggtaatcatttgatcaaaactcttgaccagtcaacagaggagagactggatgagagttttgaacctggcggcagcgcaaaagatg

SEQ ID NO: 21535 - DNA, 103 bp, Artificial Sequence
  Synthetic Polynucleotide
taatacgactcactatagggatatataatcatttgatcaaaactcttgacaacagaggagagtcaagatgtttgatcaaaacctggcggcagcgcaaaagatg

SEQ ID NO: 21536 - DNA, 103 bp, Artificial Sequence
  Synthetic Polynucleotide
taatacgactcactatagggccatcatatataatcatttgatcaaaactcaacagaggagagagtttatgtcaaatgataacctggcggcagcgcaaaagatg

SEQ ID NO: 21537 - DNA, 103 bp, Artificial Sequence
  Synthetic Polynucleotide
taatacgactcactatagggttttcccatcatatataatcatttgatcaaaacagaggagattgatcatgtgattatataacctggcggcagcgcaaaagatg

SEQ ID NO: 21538 - DNA, 103 bp, Artificial Sequence
  Synthetic Polynucleotide
taatacgactcactatagggcgggcttttcccatcatatataatcatttgaacagaggagacaaatgatgatatatgataacctggcggcagcgcaaaagatg

SEQ ID NO: 21539 - DNA, 103 bp, Artificial Sequence
  Synthetic Polynucleotide
taatacgactcactatagggccaagcgggcttttcccatcatatataatcaacagaggagagattatatgtgatgggaaaacctggcggcagcgcaaaagatg

SEQ ID NO: 21540 - DNA, 103 bp, Artificial Sequence
  Synthetic Polynucleotide
taatacgactcactatagggctcgaccaagcgggcttttcccatcatataaacagaggagatatatgatgggaaaagccaacctggcggcagcgcaaaagatg

SEQ ID NO: 21541 - DNA, 103 bp, Artificial Sequence
  Synthetic Polynucleotide
taatacgactcactatagggtctcactcgaccaagcgggcttttcccatcaacagaggagagatgggatgagcccgcttaacctggcggcagcgcaaaagatg

SEQ ID NO: 21542 - DNA, 103 bp, Artificial Sequence
  Synthetic Polynucleotide
taatacgactcactataggggtacctctcactcgaccaagcgggcttttcaacagaggagagaaaagatggcttggtcgaacctggcggcagcgcaaaagatg

SEQ ID NO: 21543 - DNA, 103 bp, Artificial Sequence
  Synthetic Polynucleotide
taatacgactcactatagggaactctttcagacctatcgcctgataccacaacagaggagagtggtaatgggcgataggaacctggcggcagcgcaaaagatg

SEQ ID NO: 21544 - DNA, 103 bp, Artificial Sequence
  Synthetic Polynucleotide
taatacgactcactatagggtaagcgtacctctcactcgaccaagcgggcaacagaggagagcccgcatggtcgagtgaaacctggcggcagcgcaaaagatg

SEQ ID NO: 21545 - DNA, 103 bp, Artificial Sequence
  Synthetic Polynucleotide
taatacgactcactatagggactcataagcgtacctctcactcgaccaagaacagaggagacttggtatggtgagaggtaacctggcggcagcgcaaaagatg

SEQ ID NO: 21546 - DNA, 103 bp, Artificial Sequence
  Synthetic Polynucleotide
taatacgactcactatagggtgtccactcataagcgtacctctcactcgaaacagaggagatcgagtatgaggtacgctaacctggcggcagcgcaaaagatg

SEQ ID NO: 21547 - DNA, 103 bp, Artificial Sequence
  Synthetic Polynucleotide
taatacgactcactatagggccctgtgtccactcataagcgtacctctcaaacagaggagatgagagatgcgcttatgaaacctggcggcagcgcaaaagatg

SEQ ID NO: 21548 - DNA, 103 bp, Artificial Sequence
  Synthetic Polynucleotide
taatacgactcactatagggcgtggccctgtgtccactcataagcgtaccaacagaggagaggtacgatgatgagtggaaacctggcggcagcgcaaaagatg

SEQ ID NO: 21549 - DNA, 103 bp, Artificial Sequence
  Synthetic Polynucleotide
taatacgactcactatagggaacgtcgtggccctgtgtccactcataagcaacagaggagagcttatatgtggacacagaacctggcggcagcgcaaaagatg

SEQ ID NO: 21550 - DNA, 103 bp, Artificial Sequence
  Synthetic Polynucleotide
taatacgactcactatagggttatgaacgtcgtggccctgtgtccactcaaacagaggagatgagtgatgacagggccaaacctggcggcagcgcaaaagatg

SEQ ID NO: 21551 - DNA, 103 bp, Artificial Sequence
  Synthetic Polynucleotide
taatacgactcactatagggtgtatttatgaacgtcgtggccctgtgtccaacagaggagaggacacatggccacgacgaacctggcggcagcgcaaaagatg

SEQ ID NO: 21552 - DNA, 103 bp, Artificial Sequence
  Synthetic Polynucleotide
taatacgactcactatagggagtactgtatttatgaacgtcgtggccctgaacagaggagacagggcatggacgttcataacctggcggcagcgcaaaagatg

SEQ ID NO: 21553 - DNA, 103 bp, Artificial Sequence
  Synthetic Polynucleotide
taatacgactcactatagggtattcagtactgtatttatgaacgtcgtggaacagaggagaccacgaatgtcataaataaacctggcggcagcgcaaaagatg

SEQ ID NO: 21554 - DNA, 103 bp, Artificial Sequence
  Synthetic Polynucleotide
taatacgactcactataggggtgtaaactctttcagacctatcgcctgataacagaggagaatcaggatgtaggtctgaaacctggcggcagcgcaaaagatg

SEQ ID NO: 21555 - DNA, 103 bp, Artificial Sequence
  Synthetic Polynucleotide
taatacgactcactatagggagccgtattcagtactgtatttatgaacgtaacagaggagaacgttcatgaatacagtaaacctggcggcagcgcaaaagatg

SEQ ID NO: 21556 - DNA, 103 bp, Artificial Sequence
  Synthetic Polynucleotide
taatacgactcactatagggaggtaagccgtattcagtactgtatttatgaacagaggagacataaaatgagtactgaaaacctggcggcagcgcaaaagatg

SEQ ID NO: 21557 - DNA, 103 bp, Artificial Sequence
  Synthetic Polynucleotide
taatacgactcactatagggcaagaaggtaagccgtattcagtactgtataacagaggagaatacagatgtgaatacggaacctggcggcagcgcaaaagatg

SEQ ID NO: 21558 - DNA, 103 bp, Artificial Sequence
  Synthetic Polynucleotide
taatacgactcactatagggggctgcaagaaggtaagccgtattcagtacaacagaggagagtactgatgacggcttacaacctggcggcagcgcaaaagatg

SEQ ID NO: 21559 - DNA, 103 bp, Artificial Sequence
  Synthetic Polynucleotide
taatacgactcactatagggagtccggctgcaagaaggtaagccgtattcaacagaggagagaatacatgttaccttctaacctggcggcagcgcaaaagatg

SEQ ID NO: 21560 - DNA, 103 bp, Artificial Sequence
  Synthetic Polynucleotide
taatacgactcactatagggtctgtagtccggctgcaagaaggtaagccgaacagaggagacggcttatgttcttgcagaacctggcggcagcgcaaaagatg

SEQ ID NO: 21561 - DNA, 103 bp, Artificial Sequence
  Synthetic Polynucleotide
taatacgactcactatagggctcagtctgtagtccggctgcaagaaggtaaacagaggagataccttatggcagccggaaacctggcggcagcgcaaaagatg

SEQ ID NO: 21562 - DNA, 103 bp, Artificial Sequence
  Synthetic Polynucleotide
taatacgactcactataggggacaactcagtctgtagtccggctgcaagaaacagaggagatcttgcatgcggactacaaacctggcggcagcgcaaaagatg

SEQ ID NO: 21563 - DNA, 103 bp, Artificial Sequence
  Synthetic Polynucleotide
taatacgactcactatagggggtaggacaactcagtctgtagtccggctgaacagaggagacagccgatgtacagactgaacctggcggcagcgcaaaagatg

SEQ ID NO: 21564 - DNA, 103 bp, Artificial Sequence
  Synthetic Polynucleotide
taatacgactcactatagggaacatggtaggacaactcagtctgtagtccaacagaggagaggactaatgactgagttgaacctggcggcagcgcaaaagatg

SEQ ID NO: 21565 - DNA, 103 bp, Artificial Sequence
  Synthetic Polynucleotide
taatacgactcactatagggcggcagtgtaaactctttcagacctatcgcaacagaggagagcgataatgctgaaagagaacctggcggcagcgcaaaagatg

SEQ ID NO: 21566 - DNA, 103 bp, Artificial Sequence
  Synthetic Polynucleotide
taatacgactcactatagggtcaccaacatggtaggacaactcagtctgtaacagaggagaacagacatggttgtcctaaacctggcggcagcgcaaaagatg

SEQ ID NO: 21567 - DNA, 103 bp, Artificial Sequence
  Synthetic Polynucleotide
taatacgactcactatagggcgtcatcaccaacatggtaggacaactcagaacagaggagactgagtatgcctaccatgaacctggcggcagcgcaaaagatg

SEQ ID NO: 21568 - DNA, 103 bp, Artificial Sequence
  Synthetic Polynucleotide
taatacgactcactatagggaatcacgtcatcaccaacatggtaggacaaaacagaggagattgtccatgcatgttggtaacctggcggcagcgcaaaagatg

SEQ ID NO: 21569 - DNA, 103 bp, Artificial Sequence
  Synthetic Polynucleotide
taatacgactcactatagggtaaaaaatcacgtcatcaccaacatggtagaacagaggagactaccaatgtggtgatgaaacctggcggcagcgcaaaagatg

SEQ ID NO: 21570 - DNA, 103 bp, Artificial Sequence
  Synthetic Polynucleotide
taatacgactcactataggggagagtaaaaaatcacgtcatcaccaacataacagaggagaatgttgatgatgacgtgaaacctggcggcagcgcaaaagatg

SEQ ID NO: 21571 - DNA, 103 bp, Artificial Sequence
  Synthetic Polynucleotide
taatacgactcactatagggtttctgagagtaaaaaatcacgtcatcaccaacagaggagaggtgatatggtgatttttaacctggcggcagcgcaaaagatg

SEQ ID NO: 21572 - DNA, 103 bp, Artificial Sequence
  Synthetic Polynucleotide
taatacgactcactatagggctggctttctgagagtaaaaaatcacgtcaaacagaggagatgacgtatgtttttactcaacctggcggcagcgcaaaagatg

SEQ ID NO: 21573 - DNA, 103 bp, Artificial Sequence
  Synthetic Polynucleotide
taatacgactcactatagggctgcactggctttctgagagtaaaaaatcaaacagaggagatgatttatgactctcagaaacctggcggcagcgcaaaagatg

SEQ ID NO: 21574 - DNA, 103 bp, Artificial Sequence
  Synthetic Polynucleotide
taatacgactcactatagggcttttctgcactggctttctgagagtaaaaaacagaggagattttacatgcagaaagccaacctggcggcagcgcaaaagatg

SEQ ID NO: 21575 - DNA, 103 bp, Artificial Sequence
  Synthetic Polynucleotide
taatacgactcactatagggtataacttttctgcactggctttctgagagaacagaggagactctcaatgagccagtgcaacctggcggcagcgcaaaagatg

SEQ ID NO: 21576 - DNA, 103 bp, Artificial Sequence
  Synthetic Polynucleotide
taatacgactcactatagggtaatgcggcagtgtaaactctttcagacctaacagaggagaaggtctatgagagtttacaacctggcggcagcgcaaaagatg

SEQ ID NO: 21577 - DNA, 103 bp, Artificial Sequence
  Synthetic Polynucleotide
taatacgactcactatagggcatcgtataacttttctgcactggctttctaacagaggagaagaaagatggtgcagaaaaacctggcggcagcgcaaaagatg

SEQ ID NO: 21578 - DNA, 103 bp, Artificial Sequence
  Synthetic Polynucleotide
taatacgactcactatagggcaattcatcgtataacttttctgcactggcaacagaggagagccagtatggaaaagttaaacctggcggcagcgcaaaagatg

SEQ ID NO: 21579 - DNA, 103 bp, Artificial Sequence
  Synthetic Polynucleotide
taatacgactcactatagggctgctcaattcatcgtataacttttctgcaaacagaggagatgcagaatggttatacgaaacctggcggcagcgcaaaagatg

SEQ ID NO: 21580 - DNA, 103 bp, Artificial Sequence
  Synthetic Polynucleotide
taatacgactcactatagggcaaacctgctcaattcatcgtataacttttaacagaggagaaaaagtatgacgatgaataacctggcggcagcgcaaaagatg

SEQ ID NO: 21581 - DNA, 103 bp, Artificial Sequence
  Synthetic Polynucleotide
taatacgactcactataggggacaccaaacctgctcaattcatcgtataaaacagaggagattatacatggaattgagcaacctggcggcagcgcaaaagatg

SEQ ID NO: 21582 - DNA, 103 bp, Artificial Sequence
  Synthetic Polynucleotide
taatacgactcactatagggcatctgacaccaaacctgctcaattcatcgaacagaggagacgatgaatggagcaggttaacctggcggcagcgcaaaagatg

SEQ ID NO: 21583 - DNA, 103 bp, Artificial Sequence
  Synthetic Polynucleotide
taatacgactcactatagggggttgcatctgacaccaaacctgctcaattaacagaggagaaattgaatgggtttggtgaacctggcggcagcgcaaaagatg

SEQ ID NO: 21584 - DNA, 103 bp, Artificial Sequence
  Synthetic Polynucleotide
taatacgactcactatagggatgtgggttgcatctgacaccaaacctgctaacagaggagaagcaggatgggtgtcagaaacctggcggcagcgcaaaagatg

SEQ ID NO: 21585 - DNA, 103 bp, Artificial Sequence
  Synthetic Polynucleotide
taatacgactcactatagggtgtttatgtgggttgcatctgacaccaaacaacagaggagagtttggatgcagatgcaaaacctggcggcagcgcaaaagatg

SEQ ID NO: 21586 - DNA, 103 bp, Artificial Sequence
  Synthetic Polynucleotide
taatacgactcactatagggcacactgtttatgtgggttgcatctgacacaacagaggagagtgtcaatggcaacccacaacctggcggcagcgcaaaagatg

SEQ ID NO: 21587 - DNA, 103 bp, Artificial Sequence
  Synthetic Polynucleotide
taatacgactcactatagggtagtttaatgcggcagtgtaaactctttcaaacagaggagatgaaagatgttacactgcaacctggcggcagcgcaaaagatg

SEQ ID NO: 21588 - DNA, 103 bp, Artificial Sequence
  Synthetic Polynucleotide
taatacgactcactataggggctagcacactgtttatgtgggttgcatctaacagaggagaagatgcatgccacataaaaacctggcggcagcgcaaaagatg

SEQ ID NO: 21589 - DNA, 103 bp, Artificial Sequence
  Synthetic Polynucleotide
taatacgactcactatagggtattcgctagcacactgtttatgtgggttgaacagaggagacaacccatgtaaacagtgaacctggcggcagcgcaaaagatg

SEQ ID NO: 21590 - DNA, 103 bp, Artificial Sequence
  Synthetic Polynucleotide
taatacgactcactatagggcactgtattcgctagcacactgtttatgtgaacagaggagacacataatgagtgtgctaaacctggcggcagcgcaaaagatg

SEQ ID NO: 21591 - DNA, 103 bp, Artificial Sequence
  Synthetic Polynucleotide
taatacgactcactatagggttctccactgtattcgctagcacactgtttaacagaggagaaaacagatggctagcgaaaacctggcggcagcgcaaaagatg

SEQ ID NO: 21592 - DNA, 103 bp, Artificial Sequence
  Synthetic Polynucleotide
taatacgactcactatagggaaaaattctccactgtattcgctagcacacaacagaggagagtgtgcatgcgaatacagaacctggcggcagcgcaaaagatg

SEQ ID NO: 21593 - DNA, 103 bp, Artificial Sequence
  Synthetic Polynucleotide
taatacgactcactatagggccctcaaaaattctccactgtattcgctagaacagaggagactagcgatgacagtggagaacctggcggcagcgcaaaagatg

SEQ ID NO: 21594 - DNA, 103 bp, Artificial Sequence
  Synthetic Polynucleotide
taatacgactcactatagggagctaccctcaaaaattctccactgtattcaacagaggagagaatacatgggagaatttaacctggcggcagcgcaaaagatg

SEQ ID NO: 21595 - DNA, 103 bp, Artificial Sequence
  Synthetic Polynucleotide
taatacgactcactataggggtatgagctaccctcaaaaattctccactgaacagaggagacagtggatgatttttgagaacctggcggcagcgcaaaagatg

SEQ ID NO: 21596 - DNA, 103 bp, Artificial Sequence
  Synthetic Polynucleotide
taatacgactcactatagggacttagtatgagctaccctcaaaaattctcaacagaggagagagaatatgtgagggtagaacctggcggcagcgcaaaagatg

SEQ ID NO: 21597 - DNA, 103 bp, Artificial Sequence
  Synthetic Polynucleotide
taatacgactcactataggggaagaacttagtatgagctaccctcaaaaaaacagaggagatttttgatggtagctcataacctggcggcagcgcaaaagatg

SEQ ID NO: 21598 - DNA, 103 bp, Artificial Sequence
  Synthetic Polynucleotide
taatacgactcactatagggaacggtagtttaatgcggcagtgtaaactcaacagaggagagagtttatgctgccgcataacctggcggcagcgcaaaagatg

SEQ ID NO: 21599 - DNA, 103 bp, Artificial Sequence
  Synthetic Polynucleotide
taatacgactcactataggggagctgaagaacttagtatgagctaccctcaacagaggagagagggtatgtcatactaaaacctggcggcagcgcaaaagatg

SEQ ID NO: 21600 - DNA, 103 bp, Artificial Sequence
  Synthetic Polynucleotide
taatacgactcactatagggagccagagctgaagaacttagtatgagctaaacagaggagatagctcatgctaagttctaacctggcggcagcgcaaaagatg

SEQ ID NO: 21601 - DNA, 103 bp, Artificial Sequence
  Synthetic Polynucleotide
taatacgactcactatagggaacatagccagagctgaagaacttagtatgaacagaggagacatactatgttcttcagcaacctggcggcagcgcaaaagatg

SEQ ID NO: 21602 - DNA, 103 bp, Artificial Sequence
  Synthetic Polynucleotide
taatacgactcactatagggcttgaaacatagccagagctgaagaacttaaacagaggagataagttatgcagctctggaacctggcggcagcgcaaaagatg

SEQ ID NO: 21603 - DNA, 103 bp, Artificial Sequence
  Synthetic Polynucleotide
taatacgactcactatagggtggctcttgaaacatagccagagctgaagaaacagaggagatcttcaatgctggctatgaacctggcggcagcgcaaaagatg

SEQ ID NO: 21604 - DNA, 103 bp, Artificial Sequence
  Synthetic Polynucleotide
taatacgactcactatagggagcgatggctcttgaaacatagccagagctaacagaggagaagctctatgtatgtttcaaacctggcggcagcgcaaaagatg

SEQ ID NO: 21605 - DNA, 103 bp, Artificial Sequence
  Synthetic Polynucleotide
taatacgactcactatagggcagctagcgatggctcttgaaacatagccaaacagaggagatggctaatgttcaagagcaacctggcggcagcgcaaaagatg

SEQ ID NO: 21606 - DNA, 103 bp, Artificial Sequence
  Synthetic Polynucleotide
taatacgactcactatagggttacacagctagcgatggctcttgaaacataacagaggagaatgtttatggagccatcgaacctggcggcagcgcaaaagatg

SEQ ID NO: 21607 - DNA, 103 bp, Artificial Sequence
  Synthetic Polynucleotide
taatacgactcactatagggtccacttacacagctagcgatggctcttgaaacagaggagatcaagaatgatcgctagcaacctggcggcagcgcaaaagatg

SEQ ID NO: 21608 - DNA, 103 bp, Artificial Sequence
  Synthetic Polynucleotide
taatacgactcactatagggcagtttccacttacacagctagcgatggctaacagaggagaagccatatgtagctgtgtaacctggcggcagcgcaaaagatg

SEQ ID NO: 21609 - DNA, 103 bp, Artificial Sequence
  Synthetic Polynucleotide
taatacgactcactatagggcgtagaacggtagtttaatgcggcagtgtaaacagaggagatacactatggcattaaacaacctggcggcagcgcaaaagatg

SEQ ID NO: 21610 - DNA, 103 bp, Artificial Sequence
  Synthetic Polynucleotide
taatacgactcactatagggacacccagtttccacttacacagctagcgaaacagaggagatcgctaatggtgtaagtgaacctggcggcagcgcaaaagatg

SEQ ID NO: 21611 - DNA, 103 bp, Artificial Sequence
  Synthetic Polynucleotide
taatacgactcactataggggtctgacacccagtttccacttacacagctaacagaggagaagctgtatgagtggaaacaacctggcggcagcgcaaaagatg

SEQ ID NO: 21612 - DNA, 103 bp, Artificial Sequence
  Synthetic Polynucleotide
taatacgactcactatagggacatggtctgacacccagtttccacttacaaacagaggagatgtaagatgaaactgggtaacctggcggcagcgcaaaagatg

SEQ ID NO: 21613 - DNA, 103 bp, Artificial Sequence
  Synthetic Polynucleotide
taatacgactcactatagggccaacacatggtctgacacccagtttccacaacagaggagagtggaaatggggtgtcagaacctggcggcagcgcaaaagatg

SEQ ID NO: 21614 - DNA, 103 bp, Artificial Sequence
  Synthetic Polynucleotide
taatacgactcactatagggtctgtccaacacatggtctgacacccagttaacagaggagaaactggatgtcagaccataacctggcggcagcgcaaaagatg

SEQ ID NO: 21615 - DNA, 103 bp, Artificial Sequence
  Synthetic Polynucleotide
taatacgactcactatagggtctcgtctgtccaacacatggtctgacaccaacagaggagaggtgtcatgccatgtgttaacctggcggcagcgcaaaagatg

SEQ ID NO: 21616 - DNA, 103 bp, Artificial Sequence
  Synthetic Polynucleotide
taatacgactcactatagggacgcttctcgtctgtccaacacatggtctgaacagaggagacagaccatgtgttggacaaacctggcggcagcgcaaaagatg

SEQ ID NO: 21617 - DNA, 103 bp, Artificial Sequence
  Synthetic Polynucleotide
taatacgactcactatagggtgtcaacgcttctcgtctgtccaacacatgaacagaggagacatgtgatggacagacgaaacctggcggcagcgcaaaagatg

SEQ ID NO: 21618 - DNA, 103 bp, Artificial Sequence
  Synthetic Polynucleotide
taatacgactcactataggggcatttgtcaacgcttctcgtctgtccaacaacagaggagagttggaatgacgagaagcaacctggcggcagcgcaaaagatg

SEQ ID NO: 21619 - DNA, 103 bp, Artificial Sequence
  Synthetic Polynucleotide
taatacgactcactatagggcaacagcatttgtcaacgcttctcgtctgtaacagaggagaacagacatgaagcgttgaaacctggcggcagcgcaaaagatg

SEQ ID NO: 21620 - DNA, 103 bp, Artificial Sequence
  Synthetic Polynucleotide
taatacgactcactatagggcggatcgtagaacggtagtttaatgcggcaaacagaggagatgccgcatgaaactaccgaacctggcggcagcgcaaaagatg

SEQ ID NO: 21621 - DNA, 103 bp, Artificial Sequence
  Synthetic Polynucleotide
taatacgactcactatagggacaagcaacagcatttgtcaacgcttctcgaacagaggagacgagaaatgttgacaaataacctggcggcagcgcaaaagatg

SEQ ID NO: 21622 - DNA, 103 bp, Artificial Sequence
  Synthetic Polynucleotide
taatacgactcactatagggcgaacacaagcaacagcatttgtcaacgctaacagaggagaagcgttatgaaatgctgtaacctggcggcagcgcaaaagatg

SEQ ID NO: 21623 - DNA, 103 bp, Artificial Sequence
  Synthetic Polynucleotide
taatacgactcactatagggtagtacgaacacaagcaacagcatttgtcaaacagaggagatgacaaatgctgttgcttaacctggcggcagcgcaaaagatg

SEQ ID NO: 21624 - DNA, 103 bp, Artificial Sequence
  Synthetic Polynucleotide
taatacgactcactatagggtaggatagtacgaacacaagcaacagcattaacagaggagaaatgctatggcttgtgttaacctggcggcagcgcaaaagatg

SEQ ID NO: 21625 - DNA, 103 bp, Artificial Sequence
  Synthetic Polynucleotide
taatacgactcactatagggctgtttaggatagtacgaacacaagcaacaaacagaggagatgttgcatgtgttcgtacaacctggcggcagcgcaaaagatg

SEQ ID NO: 21626 - DNA, 103 bp, Artificial Sequence
  Synthetic Polynucleotide
taatacgactcactatagggtggttctgtttaggatagtacgaacacaagaacagaggagacttgtgatggtactatccaacctggcggcagcgcaaaagatg

SEQ ID NO: 21627 - DNA, 103 bp, Artificial Sequence
  Synthetic Polynucleotide
taatacgactcactatagggggacttggttctgtttaggatagtacgaacaacagaggagagttcgtatgatcctaaacaacctggcggcagcgcaaaagatg

SEQ ID NO: 21628 - DNA, 103 bp, Artificial Sequence
  Synthetic Polynucleotide
taatacgactcactatagggtagccggacttggttctgtttaggatagtaaacagaggagatactatatgaaacagaacaacctggcggcagcgcaaaagatg

SEQ ID NO: 21629 - DNA, 103 bp, Artificial Sequence
  Synthetic Polynucleotide
taatacgactcactatagggtgttgtagccggacttggttctgtttaggaaacagaggagatcctaaatggaaccaagtaacctggcggcagcgcaaaagatg

SEQ ID NO: 21630 - DNA, 103 bp, Artificial Sequence
  Synthetic Polynucleotide
taatacgactcactatagggcgggttgttgtagccggacttggttctgttaacagaggagaaacagaatgaagtccggcaacctggcggcagcgcaaaagatg

SEQ ID NO: 21631 - DNA, 103 bp, Artificial Sequence
  Synthetic Polynucleotide
taatacgactcactatagggcctgacggatcgtagaacggtagtttaatgaacagaggagacattaaatgaccgttctaaacctggcggcagcgcaaaagatg

SEQ ID NO: 21632 - DNA, 103 bp, Artificial Sequence
  Synthetic Polynucleotide
taatacgactcactatagggcctatcgggttgttgtagccggacttggttaacagaggagaaaccaaatgcggctacaaaacctggcggcagcgcaaaagatg

SEQ ID NO: 21633 - DNA, 103 bp, Artificial Sequence
  Synthetic Polynucleotide
taatacgactcactatagggcacgacctatcgggttgttgtagccggactaacagaggagaagtccgatgacaacaaccaacctggcggcagcgcaaaagatg

SEQ ID NO: 21634 - DNA, 103 bp, Artificial Sequence
  Synthetic Polynucleotide
taatacgactcactatagggcacaacacgacctatcgggttgttgtagccaacagaggagaggctacatgaacccgataaacctggcggcagcgcaaaagatg

SEQ ID NO: 21635 - DNA, 103 bp, Artificial Sequence
  Synthetic Polynucleotide
taatacgactcactatagggaaggccacaacacgacctatcgggttgttgaacagaggagacaacaaatggataggtcgaacctggcggcagcgcaaaagatg

SEQ ID NO: 21636 - DNA, 103 bp, Artificial Sequence
  Synthetic Polynucleotide
taatacgactcactatagggcacttaaggccacaacacgacctatcgggtaacagaggagaacccgaatggtcgtgttgaacctggcggcagcgcaaaagatg

SEQ ID NO: 21637 - DNA, 103 bp, Artificial Sequence
  Synthetic Polynucleotide
taatacgactcactatagggagcaacacttaaggccacaacacgacctataacagaggagaataggtatggttgtggccaacctggcggcagcgcaaaagatg

SEQ ID NO: 21638 - DNA, 103 bp, Artificial Sequence
  Synthetic Polynucleotide
taatacgactcactatagggcgtttagcaacacttaaggccacaacacgaaacagaggagatcgtgtatgggccttaagaacctggcggcagcgcaaaagatg

SEQ ID NO: 21639 - DNA, 103 bp, Artificial Sequence
  Synthetic Polynucleotide
taatacgactcactatagggaacatcgtttagcaacacttaaggccacaaaacagaggagattgtggatgtaagtgttgaacctggcggcagcgcaaaagatg

SEQ ID NO: 21640 - DNA, 103 bp, Artificial Sequence
  Synthetic Polynucleotide
taatacgactcactatagggaacgcaacatcgtttagcaacacttaaggcaacagaggagagccttaatggttgctaaaaacctggcggcagcgcaaaagatg

SEQ ID NO: 21641 - DNA, 103 bp, Artificial Sequence
  Synthetic Polynucleotide
taatacgactcactatagggaattcaacgcaacatcgtttagcaacacttaacagaggagaaagtgtatgtaaacgatgaacctggcggcagcgcaaaagatg

SEQ ID NO: 21642 - DNA, 103 bp, Artificial Sequence
  Synthetic Polynucleotide
taatacgactcactataggggagctgtaaccaccgtttagatgagctctaaacagaggagatagagcatgtctaaacggaacctggcggcagcgcaaaagatg

SEQ ID NO: 21643 - DNA, 103 bp, Artificial Sequence
  Synthetic Polynucleotide
taatacgactcactatagggataggcctgacggatcgtagaacggtagttaacagaggagaaactacatgtctacgatcaacctggcggcagcgcaaaagatg

SEQ ID NO: 21644 - DNA, 103 bp, Artificial Sequence
  Synthetic Polynucleotide
taatacgactcactatagggattgtaattcaacgcaacatcgtttagcaaaacagaggagattgctaatggatgttgcgaacctggcggcagcgcaaaagatg

SEQ ID NO: 21645 - DNA, 103 bp, Artificial Sequence
  Synthetic Polynucleotide
taatacgactcactatagggaacatattgtaattcaacgcaacatcgtttaacagaggagaaaacgaatgtgcgttgaaaacctggcggcagcgcaaaagatg

SEQ ID NO: 21646 - DNA, 103 bp, Artificial Sequence
  Synthetic Polynucleotide
taatacgactcactatagggatctcaacatattgtaattcaacgcaacataacagaggagaatgttgatgtgaattacaaacctggcggcagcgcaaaagatg

SEQ ID NO: 21647 - DNA, 103 bp, Artificial Sequence
  Synthetic Polynucleotide
taatacgactcactatagggacaacatctcaacatattgtaattcaacgcaacagaggagagcgttgatgtacaatatgaacctggcggcagcgcaaaagatg

SEQ ID NO: 21648 - DNA, 103 bp, Artificial Sequence
  Synthetic Polynucleotide
taatacgactcactatagggatataacaacatctcaacatattgtaattcaacagaggagagaattaatgtatgttgagaacctggcggcagcgcaaaagatg

SEQ ID NO: 21649 - DNA, 103 bp, Artificial Sequence
  Synthetic Polynucleotide
taatacgactcactatagggcggccatataacaacatctcaacatattgtaacagaggagaacaataatgtgagatgttaacctggcggcagcgcaaaagatg

SEQ ID NO: 21650 - DNA, 103 bp, Artificial Sequence
  Synthetic Polynucleotide
taatacgactcactatagggaggctcggccatataacaacatctcaacataacagaggagaatgttgatgtgttgttataacctggcggcagcgcaaaagatg

SEQ ID NO: 21651 - DNA, 103 bp, Artificial Sequence
  Synthetic Polynucleotide
taatacgactcactatagggtagacaggctcggccatataacaacatctcaacagaggagagagatgatgttatatggcaacctggcggcagcgcaaaagatg

SEQ ID NO: 21652 - DNA, 103 bp, Artificial Sequence
  Synthetic Polynucleotide
taatacgactcactatagggtcagatagacaggctcggccatataacaacaacagaggagagttgttatgtggccgagcaacctggcggcagcgcaaaagatg

SEQ ID NO: 21653 - DNA, 103 bp, Artificial Sequence
  Synthetic Polynucleotide
taatacgactcactatagggcaccatcagatagacaggctcggccatataaacagaggagatatatgatggagcctgtcaacctggcggcagcgcaaaagatg

SEQ ID NO: 21654 - DNA, 103 bp, Artificial Sequence
  Synthetic Polynucleotide
taatacgactcactataggggcttgataggcctgacggatcgtagaacggaacagaggagaccgttcatggatccgtcaaacctggcggcagcgcaaaagatg

SEQ ID NO: 21655 - DNA, 103 bp, Artificial Sequence
  Synthetic Polynucleotide
taatacgactcactatagggtacaacaccatcagatagacaggctcggccaacagaggagaggccgaatgtgtctatctaacctggcggcagcgcaaaagatg

SEQ ID NO: 21656 - DNA, 103 bp, Artificial Sequence
  Synthetic Polynucleotide
taatacgactcactatagggccatatacaacaccatcagatagacaggctaacagaggagaagcctgatgatctgatggaacctggcggcagcgcaaaagatg

SEQ ID NO: 21657 - DNA, 103 bp, Artificial Sequence
  Synthetic Polynucleotide
taatacgactcactatagggtagttccatatacaacaccatcagatagacaacagaggagagtctatatgatggtgttgaacctggcggcagcgcaaaagatg

SEQ ID NO: 21658 - DNA, 103 bp, Artificial Sequence
  Synthetic Polynucleotide
taatacgactcactatagggatttttagttccatatacaacaccatcagaaacagaggagatctgatatggttgtatataacctggcggcagcgcaaaagatg

SEQ ID NO: 21659 - DNA, 103 bp, Artificial Sequence
  Synthetic Polynucleotide
taatacgactcactatagggtaactatttttagttccatatacaacaccaaacagaggagatggtgtatgatatggaacaacctggcggcagcgcaaaagatg

SEQ ID NO: 21660 - DNA, 103 bp, Artificial Sequence
  Synthetic Polynucleotide
taatacgactcactatagggtcacataactatttttagttccatatacaaaacagaggagattgtatatggaactaaaaaacctggcggcagcgcaaaagatg

SEQ ID NO: 21661 - DNA, 103 bp, Artificial Sequence
  Synthetic Polynucleotide
taatacgactcactatagggcttggtcacataactatttttagttccataaacagaggagatatggaatgaaaaatagtaacctggcggcagcgcaaaagatg

SEQ ID NO: 21662 - DNA, 103 bp, Artificial Sequence
  Synthetic Polynucleotide
taatacgactcactatagggtccaccttggtcacataactatttttagttaacagaggagaaactaaatgtagttatgtaacctggcggcagcgcaaaagatg

SEQ ID NO: 21663 - DNA, 103 bp, Artificial Sequence
  Synthetic Polynucleotide
taatacgactcactatagggtcatgtccaccttggtcacataactattttaacagaggagaaaaataatgatgtgaccaaacctggcggcagcgcaaaagatg

SEQ ID NO: 21664 - DNA, 103 bp, Artificial Sequence
  Synthetic Polynucleotide
taatacgactcactatagggtatattcatgtccaccttggtcacataactaacagaggagaagttatatgaccaaggtgaacctggcggcagcgcaaaagatg

SEQ ID NO: 21665 - DNA, 103 bp, Artificial Sequence
  Synthetic Polynucleotide
taatacgactcactatagggctgtagcttgataggcctgacggatcgtagaacagaggagactacgaatggtcaggcctaacctggcggcagcgcaaaagatg

SEQ ID NO: 21666 - DNA, 103 bp, Artificial Sequence
  Synthetic Polynucleotide
taatacgactcactataggggaatttatattcatgtccaccttggtcacaaacagaggagatgtgacatgggtggacataacctggcggcagcgcaaaagatg

SEQ ID NO: 21667 - DNA, 103 bp, Artificial Sequence
  Synthetic Polynucleotide
taatacgactcactatagggaatccgaatttatattcatgtccaccttggaacagaggagaccaaggatgacatgaataaacctggcggcagcgcaaaagatg

SEQ ID NO: 21668 - DNA, 103 bp, Artificial Sequence
  Synthetic Polynucleotide
taatacgactcactatagggttctaaatccgaatttatattcatgtccacaacagaggagagtggacatgaatataaataacctggcggcagcgcaaaagatg

SEQ ID NO: 21669 - DNA, 103 bp, Artificial Sequence
  Synthetic Polynucleotide
taatacgactcactataggggtttgttctaaatccgaatttatattcatgaacagaggagacatgaaatgaaattcggaaacctggcggcagcgcaaaagatg

SEQ ID NO: 21670 - DNA, 103 bp, Artificial Sequence
  Synthetic Polynucleotide
taatacgactcactatagggcgtgtgtttgttctaaatccgaatttatataacagaggagaatataaatgcggatttagaacctggcggcagcgcaaaagatg

SEQ ID NO: 21671 - DNA, 103 bp, Artificial Sequence
  Synthetic Polynucleotide
taatacgactcactatagggaaagccgtgtgtttgttctaaatccgaattaacagaggagaaattcgatgttagaacaaaacctggcggcagcgcaaaagatg

SEQ ID NO: 21672 - DNA, 103 bp, Artificial Sequence
  Synthetic Polynucleotide
taatacgactcactatagggtacttaaagccgtgtgtttgttctaaatccaacagaggagaggatttatgacaaacacaaacctggcggcagcgcaaaagatg

SEQ ID NO: 21673 - DNA, 103 bp, Artificial Sequence
  Synthetic Polynucleotide
taatacgactcactatagggtctcgtacttaaagccgtgtgtttgttctaaacagaggagatagaacatgcacacggctaacctggcggcagcgcaaaagatg

SEQ ID NO: 21674 - DNA, 103 bp, Artificial Sequence
  Synthetic Polynucleotide
taatacgactcactatagggattagtctcgtacttaaagccgtgtgtttgaacagaggagacaaacaatgggctttaagaacctggcggcagcgcaaaagatg

SEQ ID NO: 21675 - DNA, 103 bp, Artificial Sequence
  Synthetic Polynucleotide
taatacgactcactataggggtggcattagtctcgtacttaaagccgtgtaacagaggagaacacggatgtaagtacgaaacctggcggcagcgcaaaagatg

SEQ ID NO: 21676 - DNA, 103 bp, Artificial Sequence
  Synthetic Polynucleotide
taatacgactcactatagggattcactgtagcttgataggcctgacggataacagaggagaatccgtatggcctatcaaaacctggcggcagcgcaaaagatg

SEQ ID NO: 21677 - DNA, 103 bp, Artificial Sequence
  Synthetic Polynucleotide
taatacgactcactatagggctgtcgtggcattagtctcgtacttaaagcaacagaggagagctttaatgacgagactaaacctggcggcagcgcaaaagatg

SEQ ID NO: 21678 - DNA, 103 bp, Artificial Sequence
  Synthetic Polynucleotide
taatacgactcactatagggatagtctgtcgtggcattagtctcgtacttaacagaggagaaagtacatgactaatgccaacctggcggcagcgcaaaagatg

SEQ ID NO: 21679 - DNA, 103 bp, Artificial Sequence
  Synthetic Polynucleotide
taatacgactcactatagggcgtagatagtctgtcgtggcattagtctcgaacagaggagacgagacatgtgccacgacaacctggcggcagcgcaaaagatg

SEQ ID NO: 21680 - DNA, 103 bp, Artificial Sequence
  Synthetic Polynucleotide
taatacgactcactataggggatgacgtagatagtctgtcgtggcattagaacagaggagactaatgatgcgacagactaacctggcggcagcgcaaaagatg

SEQ ID NO: 21681 - DNA, 103 bp, Artificial Sequence
  Synthetic Polynucleotide
taatacgactcactatagggagtgtgatgacgtagatagtctgtcgtggcaacagaggagagccacgatggactatctaaacctggcggcagcgcaaaagatg

SEQ ID NO: 21682 - DNA, 103 bp, Artificial Sequence
  Synthetic Polynucleotide
taatacgactcactataggggttgaagtgtgatgacgtagatagtctgtcaacagaggagagacagaatgtctacgtcaaacctggcggcagcgcaaaagatg

SEQ ID NO: 21683 - DNA, 103 bp, Artificial Sequence
  Synthetic Polynucleotide
taatacgactcactatagggcaatggttgaagtgtgatgacgtagatagtaacagaggagaactatcatggtcatcacaaacctggcggcagcgcaaaagatg

SEQ ID NO: 21684 - DNA, 103 bp, Artificial Sequence
  Synthetic Polynucleotide
taatacgactcactataggggctctcaatggttgaagtgtgatgacgtagaacagaggagactacgtatgcacacttcaaacctggcggcagcgcaaaagatg

SEQ ID NO: 21685 - DNA, 103 bp, Artificial Sequence
  Synthetic Polynucleotide
taatacgactcactatagggattacgctctcaatggttgaagtgtgatgaaacagaggagatcatcaatgttcaaccataacctggcggcagcgcaaaagatg

SEQ ID NO: 21686 - DNA, 103 bp, Artificial Sequence
  Synthetic Polynucleotide
taatacgactcactatagggttaacattacgctctcaatggttgaagtgtaacagaggagaacacttatgccattgagaaacctggcggcagcgcaaaagatg

SEQ ID NO: 21687 - DNA, 103 bp, Artificial Sequence
  Synthetic Polynucleotide
taatacgactcactatagggtgaacattcactgtagcttgataggcctgaaacagaggagatcaggcatgtcaagctacaacctggcggcagcgcaaaagatg

SEQ ID NO: 21688 - DNA, 103 bp, Artificial Sequence
  Synthetic Polynucleotide
taatacgactcactatagggttgctttaacattacgctctcaatggttgaaacagaggagatcaaccatggagagcgtaaacctggcggcagcgcaaaagatg

SEQ ID NO: 21689 - DNA, 103 bp, Artificial Sequence
  Synthetic Polynucleotide
taatacgactcactatagggccatattgctttaacattacgctctcaatgaacagaggagacattgaatgcgtaatgttaacctggcggcagcgcaaaagatg

SEQ ID NO: 21690 - DNA, 103 bp, Artificial Sequence
  Synthetic Polynucleotide
taatacgactcactatagggcagcaccatattgctttaacattacgctctaacagaggagaagagcgatgtgttaaagcaacctggcggcagcgcaaaagatg

SEQ ID NO: 21691 - DNA, 103 bp, Artificial Sequence
  Synthetic Polynucleotide
taatacgactcactatagggtatgtcagcaccatattgctttaacattacaacagaggagagtaatgatgaagcaatataacctggcggcagcgcaaaagatg

SEQ ID NO: 21692 - DNA, 103 bp, Artificial Sequence
  Synthetic Polynucleotide
taatacgactcactatagggtccgctatgtcagcaccatattgctttaacaacagaggagagttaaaatgatatggtgcaacctggcggcagcgcaaaagatg

SEQ ID NO: 21693 - DNA, 103 bp, Artificial Sequence
  Synthetic Polynucleotide
taatacgactcactatagggtgatttccgctatgtcagcaccatattgctaacagaggagaagcaatatggtgctgacaaacctggcggcagcgcaaaagatg

SEQ ID NO: 21694 - DNA, 103 bp, Artificial Sequence
  Synthetic Polynucleotide
taatacgactcactatagggggccatgatttccgctatgtcagcaccataaacagaggagatatggtatggacatagcgaacctggcggcagcgcaaaagatg

SEQ ID NO: 21695 - DNA, 103 bp, Artificial Sequence
  Synthetic Polynucleotide
taatacgactcactataggggactgggccatgatttccgctatgtcagcaaacagaggagatgctgaatgagcggaaataacctggcggcagcgcaaaagatg

SEQ ID NO: 21696 - DNA, 103 bp, Artificial Sequence
  Synthetic Polynucleotide
taatacgactcactatagggagcttgactgggccatgatttccgctatgtaacagaggagaacatagatgaaatcatggaacctggcggcagcgcaaaagatg

SEQ ID NO: 21697 - DNA, 103 bp, Artificial Sequence
  Synthetic Polynucleotide
taatacgactcactatagggcatccagcttgactgggccatgatttccgcaacagaggagagcggaaatgatggcccagaacctggcggcagcgcaaaagatg

SEQ ID NO: 21698 - DNA, 103 bp, Artificial Sequence
  Synthetic Polynucleotide
taatacgactcactataggggccagtgaacattcactgtagcttgataggaacagaggagacctatcatgctacagtgaaacctggcggcagcgcaaaagatg

SEQ ID NO: 21699 - DNA, 103 bp, Artificial Sequence
  Synthetic Polynucleotide
taatacgactcactataggggatttcatccagcttgactgggccatgattaacagaggagaaatcatatgccagtcaagaacctggcggcagcgcaaaagatg

SEQ ID NO: 21700 - DNA, 103 bp, Artificial Sequence
  Synthetic Polynucleotide
taatacgactcactatagggccatggatttcatccagcttgactgggccaaacagaggagatggcccatgcaagctggaaacctggcggcagcgcaaaagatg

SEQ ID NO: 21701 - DNA, 103 bp, Artificial Sequence
  Synthetic Polynucleotide
taatacgactcactatagggtgcttccatggatttcatccagcttgactgaacagaggagacagtcaatgtggatgaaaaacctggcggcagcgcaaaagatg

SEQ ID NO: 21702 - DNA, 103 bp, Artificial Sequence
  Synthetic Polynucleotide
taatacgactcactataggggagcttgcttccatggatttcatccagcttaacagaggagaaagctgatggaaatccataacctggcggcagcgcaaaagatg

SEQ ID NO: 21703 - DNA, 103 bp, Artificial Sequence
  Synthetic Polynucleotide
taatacgactcactatagggctctagagcttgcttccatggatttcatccaacagaggagaggatgaatgccatggaagaacctggcggcagcgcaaaagatg

SEQ ID NO: 21704 - DNA, 103 bp, Artificial Sequence
  Synthetic Polynucleotide
taatacgactcactatagggcttgactctagagcttgcttccatggatttaacagaggagaaaatccatggaagcaagcaacctggcggcagcgcaaaagatg

SEQ ID NO: 21705 - DNA, 103 bp, Artificial Sequence
  Synthetic Polynucleotide
taatacgactcactataggggatggcttgactctagagcttgcttccatgaacagaggagacatggaatgaagctctagaacctggcggcagcgcaaaagatg

SEQ ID NO: 21706 - DNA, 103 bp, Artificial Sequence
  Synthetic Polynucleotide
taatacgactcactatagggtatttgatggcttgactctagagcttgcttaacagaggagaaagcaaatgctagagtcaaacctggcggcagcgcaaaagatg

SEQ ID NO: 21707 - DNA, 103 bp, Artificial Sequence
  Synthetic Polynucleotide
taatacgactcactataggggcgcatatttgatggcttgactctagagctaacagaggagaagctctatggtcaagccaaacctggcggcagcgcaaaagatg

SEQ ID NO: 21708 - DNA, 103 bp, Artificial Sequence
  Synthetic Polynucleotide
taatacgactcactataggggtaatgcgcatatttgatggcttgactctaaacagaggagatagagtatggccatcaaaaacctggcggcagcgcaaaagatg

SEQ ID NO: 21709 - DNA, 103 bp, Artificial Sequence
  Synthetic Polynucleotide
taatacgactcactatagggtatgcgccagtgaacattcactgtagcttgaacagaggagacaagctatggtgaatgttaacctggcggcagcgcaaaagatg

SEQ ID NO: 21710 - DNA, 103 bp, Artificial Sequence
  Synthetic Polynucleotide
taatacgactcactatagggaaaaggtaatgcgcatatttgatggcttgaaacagaggagatcaagcatgcaaatatgcaacctggcggcagcgcaaaagatg

SEQ ID NO: 21711 - DNA, 103 bp, Artificial Sequence
  Synthetic Polynucleotide
taatacgactcactatagggccttgaaaaggtaatgcgcatatttgatggaacagaggagaccatcaatgatgcgcattaacctggcggcagcgcaaaagatg

SEQ ID NO: 21712 - DNA, 103 bp, Artificial Sequence
  Synthetic Polynucleotide
taatacgactcactatagggtctccccttgaaaaggtaatgcgcatatttaacagaggagaaaatatatgcattaccttaacctggcggcagcgcaaaagatg

SEQ ID NO: 21713 - DNA, 103 bp, Artificial Sequence
  Synthetic Polynucleotide
taatacgactcactatagggccaaatctccccttgaaaaggtaatgcgcaaacagaggagatgcgcaatgccttttcaaaacctggcggcagcgcaaaagatg

SEQ ID NO: 21714 - DNA, 103 bp, Artificial Sequence
  Synthetic Polynucleotide
taatacgactcactatagggcttacccaaatctccccttgaaaaggtaataacagaggagaattaccatgtcaaggggaaacctggcggcagcgcaaaagatg

SEQ ID NO: 21715 - DNA, 103 bp, Artificial Sequence
  Synthetic Polynucleotide
taatacgactcactatagggacgtacttacccaaatctccccttgaaaagaacagaggagacttttcatggggagatttaacctggcggcagcgcaaaagatg

SEQ ID NO: 21716 - DNA, 103 bp, Artificial Sequence
  Synthetic Polynucleotide
taatacgactcactataggggcattacgtacttacccaaatctccccttgaacagaggagacaagggatgatttgggtaaacctggcggcagcgcaaaagatg

SEQ ID NO: 21717 - DNA, 103 bp, Artificial Sequence
  Synthetic Polynucleotide
taatacgactcactatagggcacaggcattacgtacttacccaaatctccaacagaggagaggagatatgggtaagtacaacctggcggcagcgcaaaagatg

SEQ ID NO: 21718 - DNA, 103 bp, Artificial Sequence
  Synthetic Polynucleotide
taatacgactcactatagggtcagacacaggcattacgtacttacccaaaaacagaggagatttgggatggtacgtaataacctggcggcagcgcaaaagatg

SEQ ID NO: 21719 - DNA, 103 bp, Artificial Sequence
  Synthetic Polynucleotide
taatacgactcactatagggctacctcagacacaggcattacgtacttacaacagaggagagtaagtatgtaatgcctgaacctggcggcagcgcaaaagatg

SEQ ID NO: 21720 - DNA, 103 bp, Artificial Sequence
  Synthetic Polynucleotide
taatacgactcactatagggtgctttatgcgccagtgaacattcactgtaaacagaggagatacagtatgtgttcactgaacctggcggcagcgcaaaagatg

SEQ ID NO: 21721 - DNA, 103 bp, Artificial Sequence
  Synthetic Polynucleotide
taatacgactcactatagggctttcctacctcagacacaggcattacgtaaacagaggagatacgtaatgcctgtgtctaacctggcggcagcgcaaaagatg

SEQ ID NO: 21722 - DNA, 103 bp, Artificial Sequence
  Synthetic Polynucleotide
taatacgactcactataggggggaactttcctacctcagacacaggcattaacagaggagaaatgccatggtctgaggtaacctggcggcagcgcaaaagatg

SEQ ID NO: 21723 - DNA, 103 bp, Artificial Sequence
  Synthetic Polynucleotide
taatacgactcactataggggtaccgggaactttcctacctcagacacagaacagaggagactgtgtatgaggtaggaaaacctggcggcagcgcaaaagatg

SEQ ID NO: 21724 - DNA, 103 bp, Artificial Sequence
  Synthetic Polynucleotide
taatacgactcactatagggttctagtaccgggaactttcctacctcagaaacagaggagatctgagatgggaaagttcaacctggcggcagcgcaaaagatg

SEQ ID NO: 21725 - DNA, 103 bp, Artificial Sequence
  Synthetic Polynucleotide
taatacgactcactatagggacaccttctagtaccgggaactttcctaccaacagaggagaggtaggatggttcccggtaacctggcggcagcgcaaaagatg

SEQ ID NO: 21726 - DNA, 103 bp, Artificial Sequence
  Synthetic Polynucleotide
taatacgactcactatagggcaaacacaccttctagtaccgggaactttcaacagaggagagaaagtatgcggtactagaacctggcggcagcgcaaaagatg

SEQ ID NO: 21727 - DNA, 103 bp, Artificial Sequence
  Synthetic Polynucleotide
taatacgactcactatagggccgttcaaacacaccttctagtaccgggaaaacagaggagattcccgatgctagaaggtaacctggcggcagcgcaaaagatg

SEQ ID NO: 21728 - DNA, 103 bp, Artificial Sequence
  Synthetic Polynucleotide
taatacgactcactatagggggataccgttcaaacacaccttctagtaccaacagaggagaggtactatgaggtgtgttaacctggcggcagcgcaaaagatg

SEQ ID NO: 21729 - DNA, 103 bp, Artificial Sequence
  Synthetic Polynucleotide
taatacgactcactataggggtagaggataccgttcaaacacaccttctaaacagaggagatagaagatgtgtttgaacaacctggcggcagcgcaaaagatg

SEQ ID NO: 21730 - DNA, 103 bp, Artificial Sequence
  Synthetic Polynucleotide
taatacgactcactatagggcattagtagaggataccgttcaaacacaccaacagaggagaggtgtgatggaacggtataacctggcggcagcgcaaaagatg

SEQ ID NO: 21731 - DNA, 103 bp, Artificial Sequence
  Synthetic Polynucleotide
taatacgactcactatagggtcctttgctttatgcgccagtgaacattcaaacagaggagatgaatgatgactggcgcaaacctggcggcagcgcaaaagatg

SEQ ID NO: 21732 - DNA, 103 bp, Artificial Sequence
  Synthetic Polynucleotide
taatacgactcactatagggatcatcattagtagaggataccgttcaaacaacagaggagagtttgaatggtatcctctaacctggcggcagcgcaaaagatg

SEQ ID NO: 21733 - DNA, 103 bp, Artificial Sequence
  Synthetic Polynucleotide
taatacgactcactatagggcctttatcatcattagtagaggataccgttaacagaggagaaacggtatgctctactaaaacctggcggcagcgcaaaagatg

SEQ ID NO: 21734 - DNA, 103 bp, Artificial Sequence
  Synthetic Polynucleotide
taatacgactcactatagggacgttcctttatcatcattagtagaggataaacagaggagatatcctatgctaatgatgaacctggcggcagcgcaaaagatg

SEQ ID NO: 21735 - DNA, 103 bp, Artificial Sequence
  Synthetic Polynucleotide
taatacgactcactataggggggatacgttcctttatcatcattagtagaaacagaggagatctactatggatgataaaaacctggcggcagcgcaaaagatg

SEQ ID NO: 21736 - DNA, 103 bp, Artificial Sequence
  Synthetic Polynucleotide
taatacgactcactatagggttaaggggatacgttcctttatcatcattaaacagaggagataatgaatgtaaaggaacaacctggcggcagcgcaaaagatg

SEQ ID NO: 21737 - DNA, 103 bp, Artificial Sequence
  Synthetic Polynucleotide
taatacgactcactatagggcgctcttaaggggatacgttcctttatcataacagaggagaatgataatggaacgtatcaacctggcggcagcgcaaaagatg

SEQ ID NO: 21738 - DNA, 103 bp, Artificial Sequence
  Synthetic Polynucleotide
taatacgactcactatagggatagccgctcttaaggggatacgttcctttaacagaggagaaaaggaatgtatccccttaacctggcggcagcgcaaaagatg

SEQ ID NO: 21739 - DNA, 103 bp, Artificial Sequence
  Synthetic Polynucleotide
taatacgactcactatagggggtctatagccgctcttaaggggatacgttaacagaggagaaacgtaatgccttaagagaacctggcggcagcgcaaaagatg

SEQ ID NO: 21740 - DNA, 103 bp, Artificial Sequence
  Synthetic Polynucleotide
taatacgactcactatagggtgccaggtctatagccgctcttaaggggataacagaggagaatccccatgagagcggctaacctggcggcagcgcaaaagatg

SEQ ID NO: 21741 - DNA, 103 bp, Artificial Sequence
  Synthetic Polynucleotide
taatacgactcactatagggcttcttgccaggtctatagccgctcttaagaacagaggagacttaagatgggctatagaaacctggcggcagcgcaaaagatg

SEQ ID NO: 21742 - DNA, 103 bp, Artificial Sequence
  Synthetic Polynucleotide
taatacgactcactatagggcttactcctttgctttatgcgccagtgaacaacagaggagagttcacatgcgcataaagaacctggcggcagcgcaaaagatg

SEQ ID NO: 21743 - DNA, 103 bp, Artificial Sequence
  Synthetic Polynucleotide
taatacgactcactatagggctgcacttcttgccaggtctatagccgctcaacagaggagagagcggatgtagacctggaacctggcggcagcgcaaaagatg

SEQ ID NO: 21744 - DNA, 103 bp, Artificial Sequence
  Synthetic Polynucleotide
taatacgactcactatagggaaagcctgcacttcttgccaggtctatagcaacagaggagagctataatgctggcaagaaacctggcggcagcgcaaaagatg

SEQ ID NO: 21745 - DNA, 103 bp, Artificial Sequence
  Synthetic Polynucleotide
taatacgactcactatagggcaactaaagcctgcacttcttgccaggtctaacagaggagaagacctatgaagaagtgcaacctggcggcagcgcaaaagatg

SEQ ID NO: 21746 - DNA, 103 bp, Artificial Sequence
  Synthetic Polynucleotide
taatacgactcactatagggtaagacaactaaagcctgcacttcttgccaaacagaggagatggcaaatggtgcaggctaacctggcggcagcgcaaaagatg

SEQ ID NO: 21747 - DNA, 103 bp, Artificial Sequence
  Synthetic Polynucleotide
taatacgactcactatagggtcccgtaagacaactaaagcctgcacttctaacagaggagaagaagtatgggctttagtaacctggcggcagcgcaaaagatg

SEQ ID NO: 21748 - DNA, 103 bp, Artificial Sequence
  Synthetic Polynucleotide
taatacgactcactatagggggttttcccgtaagacaactaaagcctgcaaacagaggagatgcaggatgtagttgtctaacctggcggcagcgcaaaagatg

SEQ ID NO: 21749 - DNA, 103 bp, Artificial Sequence
  Synthetic Polynucleotide
taatacgactcactatagggcttctggttttcccgtaagacaactaaagcaacagaggagagctttaatggtcttacggaacctggcggcagcgcaaaagatg

SEQ ID NO: 21750 - DNA, 103 bp, Artificial Sequence
  Synthetic Polynucleotide
taatacgactcactatagggtaactcttctggttttcccgtaagacaactaacagaggagaagttgtatgacgggaaaaaacctggcggcagcgcaaaagatg

SEQ ID NO: 21751 - DNA, 103 bp, Artificial Sequence
  Synthetic Polynucleotide
taatacgactcactatagggccccataactcttctggttttcccgtaagaaacagaggagatcttacatgaaaaccagaaacctggcggcagcgcaaaagatg

SEQ ID NO: 21752 - DNA, 103 bp, Artificial Sequence
  Synthetic Polynucleotide
taatacgactcactatagggagctaccccataactcttctggttttcccgaacagaggagacgggaaatgcagaagagtaacctggcggcagcgcaaaagatg

SEQ ID NO: 21753 - DNA, 103 bp, Artificial Sequence
  Synthetic Polynucleotide
taatacgactcactatagggaaaatcatcatctcttgtttttgtgtgtctaacagaggagaagacacatgaaaacaagaaacctggcggcagcgcaaaagatg

SEQ ID NO: 21754 - DNA, 103 bp, Artificial Sequence
  Synthetic Polynucleotide
taatacgactcactataggggtcttaatgtcaatgttaatattcttctttaacagaggagaaaagaaatgtattaacataacctggcggcagcgcaaaagatg

SEQ ID NO: 21755 - DNA, 103 bp, Artificial Sequence
  Synthetic Polynucleotide
taatacgactcactataggggggagaaaaagactgcaaaatgacagaaagaacagaggagactttctatgattttgcagaacctggcggcagcgcaaaagatg

SEQ ID NO: 21756 - DNA, 103 bp, Artificial Sequence
  Synthetic Polynucleotide
taatacgactcactatagggctgggaatcaccatgttttggacaaaagctaacagaggagaagctttatgccaaaacataacctggcggcagcgcaaaagatg

SEQ ID NO: 21757 - DNA, 103 bp, Artificial Sequence
  Synthetic Polynucleotide
taatacgactcactatagggagttcctgggaatcaccatgttttggacaaaacagaggagattgtccatgacatggtgaaacctggcggcagcgcaaaagatg

SEQ ID NO: 21758 - DNA, 103 bp, Artificial Sequence
  Synthetic Polynucleotide
taatacgactcactatagggagaaaagttcctgggaatcaccatgttttgaacagaggagacaaaacatggtgattcccaacctggcggcagcgcaaaagatg

SEQ ID NO: 21759 - DNA, 103 bp, Artificial Sequence
  Synthetic Polynucleotide
taatacgactcactatagggtttgtagaaaagttcctgggaatcaccatgaacagaggagacatggtatgtcccaggaaaacctggcggcagcgcaaaagatg

SEQ ID NO: 21760 - DNA, 103 bp, Artificial Sequence
  Synthetic Polynucleotide
taatacgactcactatagggactgatttgtagaaaagttcctgggaatcaaacagaggagatgattcatgggaacttttaacctggcggcagcgcaaaagatg

SEQ ID NO: 21761 - DNA, 103 bp, Artificial Sequence
  Synthetic Polynucleotide
taatacgactcactatagggcgtaaactgatttgtagaaaagttcctgggaacagaggagacccaggatgttttctacaaacctggcggcagcgcaaaagatg

SEQ ID NO: 21762 - DNA, 103 bp, Artificial Sequence
  Synthetic Polynucleotide
taatacgactcactatagggttgtacgtaaactgatttgtagaaaagttcaacagaggagagaacttatgtacaaatcaaacctggcggcagcgcaaaagatg

SEQ ID NO: 21763 - DNA, 103 bp, Artificial Sequence
  Synthetic Polynucleotide
taatacgactcactatagggtaagattgtacgtaaactgatttgtagaaaaacagaggagatttctaatgatcagtttaaacctggcggcagcgcaaaagatg

SEQ ID NO: 21764 - DNA, 103 bp, Artificial Sequence
  Synthetic Polynucleotide
taatacgactcactatagggattagtaagattgtacgtaaactgatttgtaacagaggagaacaaatatgtttacgtacaacctggcggcagcgcaaaagatg

SEQ ID NO: 21765 - DNA, 103 bp, Artificial Sequence
  Synthetic Polynucleotide
taatacgactcactatagggactagattagtaagattgtacgtaaactgaaacagaggagatcagttatggtacaatctaacctggcggcagcgcaaaagatg

SEQ ID NO: 21766 - DNA, 103 bp, Artificial Sequence
  Synthetic Polynucleotide
taatacgactcactataggggtttcgggagaaaaagactgcaaaatgacaaacagaggagatgtcatatggcagtctttaacctggcggcagcgcaaaagatg

SEQ ID NO: 21767 - DNA, 103 bp, Artificial Sequence
  Synthetic Polynucleotide
taatacgactcactatagggtcaatactagattagtaagattgtacgtaaaacagaggagattacgtatgatcttactaaacctggcggcagcgcaaaagatg

SEQ ID NO: 21768 - DNA, 103 bp, Artificial Sequence
  Synthetic Polynucleotide
taatacgactcactatagggcacgctcaatactagattagtaagattgtaaacagaggagatacaatatgactaatctaaacctggcggcagcgcaaaagatg

SEQ ID NO: 21769 - DNA, 103 bp, Artificial Sequence
  Synthetic Polynucleotide
taatacgactcactatagggttttgcacgctcaatactagattagtaagaaacagaggagatcttacatgtctagtattaacctggcggcagcgcaaaagatg

SEQ ID NO: 21770 - DNA, 103 bp, Artificial Sequence
  Synthetic Polynucleotide
taatacgactcactataggggaagcttttgcacgctcaatactagattagaacagaggagactaatcatgtattgagcgaacctggcggcagcgcaaaagatg

SEQ ID NO: 21771 - DNA, 103 bp, Artificial Sequence
  Synthetic Polynucleotide
taatacgactcactatagggatcaggaagcttttgcacgctcaatactagaacagaggagactagtaatgagcgtgcaaaacctggcggcagcgcaaaagatg

SEQ ID NO: 21772 - DNA, 103 bp, Artificial Sequence
  Synthetic Polynucleotide
taatacgactcactataggggcatcatcaggaagcttttgcacgctcaataacagaggagaattgagatggcaaaagctaacctggcggcagcgcaaaagatg

SEQ ID NO: 21773 - DNA, 103 bp, Artificial Sequence
  Synthetic Polynucleotide
taatacgactcactataggggccaagcatcatcaggaagcttttgcacgcaacagaggagagcgtgcatgagcttcctgaacctggcggcagcgcaaaagatg

SEQ ID NO: 21774 - DNA, 103 bp, Artificial Sequence
  Synthetic Polynucleotide
taatacgactcactatagggcgggcgccaagcatcatcaggaagcttttgaacagaggagacaaaagatgcctgatgataacctggcggcagcgcaaaagatg

SEQ ID NO: 21775 - DNA, 103 bp, Artificial Sequence
  Synthetic Polynucleotide
taatacgactcactatagggttggacgggcgccaagcatcatcaggaagcaacagaggagagcttccatgtgatgcttgaacctggcggcagcgcaaaagatg

SEQ ID NO: 21776 - DNA, 103 bp, Artificial Sequence
  Synthetic Polynucleotide
taatacgactcactatagggtgtctttggacgggcgccaagcatcatcagaacagaggagactgatgatgcttggcgccaacctggcggcagcgcaaaagatg

SEQ ID NO: 21777 - DNA, 103 bp, Artificial Sequence
  Synthetic Polynucleotide
taatacgactcactatagggaacgagtttcgggagaaaaagactgcaaaaaacagaggagattttgcatgctttttctcaacctggcggcagcgcaaaagatg

SEQ ID NO: 21778 - DNA, 103 bp, Artificial Sequence
  Synthetic Polynucleotide
taatacgactcactatagggtaatttgtctttggacgggcgccaagcatcaacagaggagagatgctatgcgcccgtccaacctggcggcagcgcaaaagatg

SEQ ID NO: 21779 - DNA, 103 bp, Artificial Sequence
  Synthetic Polynucleotide
taatacgactcactatagggccgattaatttgtctttggacgggcgccaaaacagaggagattggcgatggtccaaagaaacctggcggcagcgcaaaagatg

SEQ ID NO: 21780 - DNA, 103 bp, Artificial Sequence
  Synthetic Polynucleotide
taatacgactcactatagggtgtttccgattaatttgtctttggacgggcaacagaggagagcccgtatgaagacaaataacctggcggcagcgcaaaagatg

SEQ ID NO: 21781 - DNA, 103 bp, Artificial Sequence
  Synthetic Polynucleotide
taatacgactcactatagggcatggtgtttccgattaatttgtctttggaaacagaggagatccaaaatgaaattaatcaacctggcggcagcgcaaaagatg

SEQ ID NO: 21782 - DNA, 103 bp, Artificial Sequence
  Synthetic Polynucleotide
taatacgactcactataggggggtgcatggtgtttccgattaatttgtctaacagaggagaagacaaatgaatcggaaaaacctggcggcagcgcaaaagatg

SEQ ID NO: 21783 - DNA, 103 bp, Artificial Sequence
  Synthetic Polynucleotide
taatacgactcactatagggccgcagggtgcatggtgtttccgattaattaacagaggagaaattaaatggaaacaccaaacctggcggcagcgcaaaagatg

SEQ ID NO: 21784 - DNA, 103 bp, Artificial Sequence
  Synthetic Polynucleotide
taatacgactcactatagggagaaaccgcagggtgcatggtgtttccgataacagaggagaatcggaatgaccatgcacaacctggcggcagcgcaaaagatg

SEQ ID NO: 21785 - DNA, 103 bp, Artificial Sequence
  Synthetic Polynucleotide
taatacgactcactatagggtgtacagaaaccgcagggtgcatggtgtttaacagaggagaaaacacatggcaccctgcaacctggcggcagcgcaaaagatg

SEQ ID NO: 21786 - DNA, 103 bp, Artificial Sequence
  Synthetic Polynucleotide
taatacgactcactatagggttgggtgtacagaaaccgcagggtgcatggaacagaggagaccatgcatgctgcggtttaacctggcggcagcgcaaaagatg

SEQ ID NO: 21787 - DNA, 103 bp, Artificial Sequence
  Synthetic Polynucleotide
taatacgactcactatagggcaggtttgggtgtacagaaaccgcagggtgaacagaggagacaccctatggtttctgtaaacctggcggcagcgcaaaagatg

SEQ ID NO: 21788 - DNA, 103 bp, Artificial Sequence
  Synthetic Polynucleotide
taatacgactcactatagggccgacaacgagtttcgggagaaaaagactgaacagaggagacagtctatgtctcccgaaaacctggcggcagcgcaaaagatg

SEQ ID NO: 21789 - DNA, 103 bp, Artificial Sequence
  Synthetic Polynucleotide
taatacgactcactatagggggcggcaggtttgggtgtacagaaaccgcaaacagaggagatgcggtatgtgtacacccaacctggcggcagcgcaaaagatg

SEQ ID NO: 21790 - DNA, 103 bp, Artificial Sequence
  Synthetic Polynucleotide
taatacgactcactatagggcaataggcggcaggtttgggtgtacagaaaaacagaggagatttctgatgacccaaaccaacctggcggcagcgcaaaagatg

SEQ ID NO: 21791 - DNA, 103 bp, Artificial Sequence
  Synthetic Polynucleotide
taatacgactcactatagggtaggacaataggcggcaggtttgggtgtacaacagaggagagtacacatgaacctgccgaacctggcggcagcgcaaaagatg

SEQ ID NO: 21792 - DNA, 103 bp, Artificial Sequence
  Synthetic Polynucleotide
taatacgactcactataggggttggtaggacaataggcggcaggtttgggaacagaggagacccaaaatggccgcctataacctggcggcagcgcaaaagatg

SEQ ID NO: 21793 - DNA, 103 bp, Artificial Sequence
  Synthetic Polynucleotide
taatacgactcactatagggtaactgttggtaggacaataggcggcaggtaacagaggagaacctgcatgctattgtccaacctggcggcagcgcaaaagatg

SEQ ID NO: 21794 - DNA, 103 bp, Artificial Sequence
  Synthetic Polynucleotide
taatacgactcactatagggttttttaactgttggtaggacaataggcggaacagaggagaccgcctatggtcctaccaaacctggcggcagcgcaaaagatg

SEQ ID NO: 21795 - DNA, 103 bp, Artificial Sequence
  Synthetic Polynucleotide
taatacgactcactataggggcttgttttttaactgttggtaggacaataaacagaggagatattgtatgaccaacagtaacctggcggcagcgcaaaagatg

SEQ ID NO: 21796 - DNA, 103 bp, Artificial Sequence
  Synthetic Polynucleotide
taatacgactcactataggggataggcttgttttttaactgttggtaggaaacagaggagatcctacatgcagttaaaaaacctggcggcagcgcaaaagatg

SEQ ID NO: 21797 - DNA, 103 bp, Artificial Sequence
  Synthetic Polynucleotide
taatacgactcactatagggctgacgataggcttgttttttaactgttggaacagaggagaccaacaatgaaaaaacaaaacctggcggcagcgcaaaagatg

SEQ ID NO: 21798 - DNA, 103 bp, Artificial Sequence
  Synthetic Polynucleotide
taatacgactcactatagggttatgctgacgataggcttgttttttaactaacagaggagaagttaaatgacaagcctaaacctggcggcagcgcaaaagatg

SEQ ID NO: 21799 - DNA, 103 bp, Artificial Sequence
  Synthetic Polynucleotide
taatacgactcactatagggggtctccgacaacgagtttcgggagaaaaaaacagaggagatttttcatgcgaaactcgaacctggcggcagcgcaaaagatg

SEQ ID NO: 21800 - DNA, 103 bp, Artificial Sequence
  Synthetic Polynucleotide
taatacgactcactataggggattcttatgctgacgataggcttgtttttaacagaggagaaaaaacatgcctatcgtcaacctggcggcagcgcaaaagatg

SEQ ID NO: 21801 - DNA, 103 bp, Artificial Sequence
  Synthetic Polynucleotide
taatacgactcactataggggttaggattcttatgctgacgataggcttgaacagaggagacaagccatgcgtcagcataacctggcggcagcgcaaaagatg

SEQ ID NO: 21802 - DNA, 103 bp, Artificial Sequence
  Synthetic Polynucleotide
taatacgactcactatagggccattgttaggattcttatgctgacgatagaacagaggagactatcgatggcataagaaaacctggcggcagcgcaaaagatg

SEQ ID NO: 21803 - DNA, 103 bp, Artificial Sequence
  Synthetic Polynucleotide
taatacgactcactataggggtggtccattgttaggattcttatgctgacaacagaggagagtcagcatgagaatcctaaacctggcggcagcgcaaaagatg

SEQ ID NO: 21804 - DNA, 103 bp, Artificial Sequence
  Synthetic Polynucleotide
taatacgactcactatagggcagcagtggtccattgttaggattcttatgaacagaggagacataagatgcctaacaataacctggcggcagcgcaaaagatg

SEQ ID NO: 21805 - DNA, 103 bp, Artificial Sequence
  Synthetic Polynucleotide
taatacgactcactatagggatggccagcagtggtccattgttaggattcaacagaggagagaatccatgcaatggaccaacctggcggcagcgcaaaagatg

SEQ ID NO: 21806 - DNA, 103 bp, Artificial Sequence
  Synthetic Polynucleotide
taatacgactcactatagggcagatatggccagcagtggtccattgttagaacagaggagactaacaatggaccactgcaacctggcggcagcgcaaaagatg

SEQ ID NO: 21807 - DNA, 103 bp, Artificial Sequence
  Synthetic Polynucleotide
taatacgactcactataggggatgccagatatggccagcagtggtccattaacagaggagaaatggaatgctgctggccaacctggcggcagcgcaaaagatg

SEQ ID NO: 21808 - DNA, 103 bp, Artificial Sequence
  Synthetic Polynucleotide
taatacgactcactatagggtgaaggatgccagatatggccagcagtggtaacagaggagaaccactatgggccatatcaacctggcggcagcgcaaaagatg

SEQ ID NO: 21809 - DNA, 103 bp, Artificial Sequence
  Synthetic Polynucleotide
taatacgactcactataggggttgatgaaggatgccagatatggccagcaaacagaggagatgctggatgtatctggcaaacctggcggcagcgcaaaagatg

SEQ ID NO: 21810 - DNA, 103 bp, Artificial Sequence
  Synthetic Polynucleotide
taatacgactcactatagggagctcggtctccgacaacgagtttcgggagaacagaggagactcccgatgctcgttgtcaacctggcggcagcgcaaaagatg

SEQ ID NO: 21811 - DNA, 103 bp, Artificial Sequence
  Synthetic Polynucleotide
taatacgactcactatagggcctcagttgatgaaggatgccagatatggcaacagaggagagccataatgggcatccttaacctggcggcagcgcaaaagatg

SEQ ID NO: 21812 - DNA, 103 bp, Artificial Sequence
  Synthetic Polynucleotide
taatacgactcactatagggtcaaccctcagttgatgaaggatgccagataacagaggagaatctggatgccttcatcaaacctggcggcagcgcaaaagatg

SEQ ID NO: 21813 - DNA, 103 bp, Artificial Sequence
  Synthetic Polynucleotide
taatacgactcactatagggctttttcaaccctcagttgatgaaggatgcaacagaggagagcatccatgatcaactgaaacctggcggcagcgcaaaagatg

SEQ ID NO: 21814 - DNA, 103 bp, Artificial Sequence
  Synthetic Polynucleotide
taatacgactcactatagggtgggactttttcaaccctcagttgatgaagaacagaggagacttcatatgctgagggttaacctggcggcagcgcaaaagatg

SEQ ID NO: 21815 - DNA, 103 bp, Artificial Sequence
  Synthetic Polynucleotide
taatacgactcactatagggttctctgggactttttcaaccctcagttgaaacagaggagatcaactatgggttgaaaaaacctggcggcagcgcaaaagatg

SEQ ID NO: 21816 - DNA, 103 bp, Artificial Sequence
  Synthetic Polynucleotide
taatacgactcactatagggtcgtcttctctgggactttttcaaccctcaaacagaggagatgagggatgaaaaagtccaacctggcggcagcgcaaaagatg

SEQ ID NO: 21817 - DNA, 103 bp, Artificial Sequence
  Synthetic Polynucleotide
taatacgactcactatagggtaagctcgtcttctctgggactttttcaacaacagaggagagttgaaatggtcccagagaacctggcggcagcgcaaaagatg

SEQ ID NO: 21818 - DNA, 103 bp, Artificial Sequence
  Synthetic Polynucleotide
taatacgactcactatagggctgaataagctcgtcttctctgggacttttaacagaggagaaaaagtatgagagaagacaacctggcggcagcgcaaaagatg

SEQ ID NO: 21819 - DNA, 103 bp, Artificial Sequence
  Synthetic Polynucleotide
taatacgactcactatagggaaatcctgaataagctcgtcttctctgggaaacagaggagatcccagatgagacgagctaacctggcggcagcgcaaaagatg

SEQ ID NO: 21820 - DNA, 103 bp, Artificial Sequence
  Synthetic Polynucleotide
taatacgactcactatagggaagtgaaatcctgaataagctcgtcttctcaacagaggagagagaagatgagcttattcaacctggcggcagcgcaaaagatg

SEQ ID NO: 21821 - DNA, 103 bp, Artificial Sequence
  Synthetic Polynucleotide
taatacgactcactatagggatgctagctcggtctccgacaacgagtttcaacagaggagagaaactatgtgtcggagaaacctggcggcagcgcaaaagatg

SEQ ID NO: 21822 - DNA, 103 bp, Artificial Sequence
  Synthetic Polynucleotide
taatacgactcactataggggcaggaagtgaaatcctgaataagctcgtcaacagaggagagacgagatgattcaggataacctggcggcagcgcaaaagatg

SEQ ID NO: 21823 - DNA, 103 bp, Artificial Sequence
  Synthetic Polynucleotide
taatacgactcactatagggtgtcggcaggaagtgaaatcctgaataagcaacagaggagagcttatatgggatttcacaacctggcggcagcgcaaaagatg

SEQ ID NO: 21824 - DNA, 103 bp, Artificial Sequence
  Synthetic Polynucleotide
taatacgactcactataggggaacatgtcggcaggaagtgaaatcctgaaaacagaggagattcaggatgtcacttcctaacctggcggcagcgcaaaagatg

SEQ ID NO: 21825 - DNA, 103 bp, Artificial Sequence
  Synthetic Polynucleotide
taatacgactcactatagggactgagaacatgtcggcaggaagtgaaatcaacagaggagagatttcatgtcctgccgaaacctggcggcagcgcaaaagatg

SEQ ID NO: 21826 - DNA, 103 bp, Artificial Sequence
  Synthetic Polynucleotide
taatacgactcactatagggcttttactgagaacatgtcggcaggaagtgaacagaggagacacttcatgccgacatgtaacctggcggcagcgcaaaagatg

SEQ ID NO: 21827 - DNA, 103 bp, Artificial Sequence
  Synthetic Polynucleotide
taatacgactcactataggggccctcttttactgagaacatgtcggcaggaacagaggagacctgccatgatgttctcaaacctggcggcagcgcaaaagatg

SEQ ID NO: 21828 - DNA, 103 bp, Artificial Sequence
  Synthetic Polynucleotide
taatacgactcactatagggatcatgccctcttttactgagaacatgtcgaacagaggagacgacatatgctcagtaaaaacctggcggcagcgcaaaagatg

SEQ ID NO: 21829 - DNA, 103 bp, Artificial Sequence
  Synthetic Polynucleotide
taatacgactcactatagggtcttcatcatgccctcttttactgagaacaaacagaggagatgttctatgtaaaagaggaacctggcggcagcgcaaaagatg

SEQ ID NO: 21830 - DNA, 103 bp, Artificial Sequence
  Synthetic Polynucleotide
taatacgactcactatagggtcttttcttcatcatgccctcttttactgaaacagaggagatcagtaatggagggcatgaacctggcggcagcgcaaaagatg

SEQ ID NO: 21831 - DNA, 103 bp, Artificial Sequence
  Synthetic Polynucleotide
taatacgactcactatagggtctcctcttttcttcatcatgccctcttttaacagaggagaaaaagaatgcatgatgaaaacctggcggcagcgcaaaagatg

SEQ ID NO: 21832 - DNA, 103 bp, Artificial Sequence
  Synthetic Polynucleotide
taatacgactcactatagggtttcgatgctagctcggtctccgacaacgaaacagaggagatcgttgatggagaccgagaacctggcggcagcgcaaaagatg

SEQ ID NO: 21833 - DNA, 103 bp, Artificial Sequence
  Synthetic Polynucleotide
taatacgactcactatagggaaccttctcctcttttcttcatcatgccctaacagaggagaagggcaatgtgaagaaaaaacctggcggcagcgcaaaagatg

SEQ ID NO: 21834 - DNA, 103 bp, Artificial Sequence
  Synthetic Polynucleotide
taatacgactcactatagggcggagaaccttctcctcttttcttcatcataacagaggagaatgatgatgaaaagaggaaacctggcggcagcgcaaaagatg

SEQ ID NO: 21835 - DNA, 103 bp, Artificial Sequence
  Synthetic Polynucleotide
taatacgactcactatagggactaccggagaaccttctcctcttttcttcaacagaggagagaagaaatgaggagaaggaacctggcggcagcgcaaaagatg

SEQ ID NO: 21836 - DNA, 103 bp, Artificial Sequence
  Synthetic Polynucleotide
taatacgactcactatagggaataaactaccggagaaccttctcctctttaacagaggagaaaagagatgaaggttctcaacctggcggcagcgcaaaagatg

SEQ ID NO: 21837 - DNA, 103 bp, Artificial Sequence
  Synthetic Polynucleotide
taatacgactcactatagggttggaaataaactaccggagaaccttctccaacagaggagaggagaaatgtctccggtaaacctggcggcagcgcaaaagatg

SEQ ID NO: 21838 - DNA, 103 bp, Artificial Sequence
  Synthetic Polynucleotide
taatacgactcactatagggggcgcttggaaataaactaccggagaacctaacagaggagaaggttcatgggtagtttaaacctggcggcagcgcaaaagatg

SEQ ID NO: 21839 - DNA, 103 bp, Artificial Sequence
  Synthetic Polynucleotide
taatacgactcactatagggtctcaggcgcttggaaataaactaccggagaacagaggagactccggatgtttatttccaacctggcggcagcgcaaaagatg

SEQ ID NO: 21840 - DNA, 103 bp, Artificial Sequence
  Synthetic Polynucleotide
taatacgactcactatagggaaaattctcaggcgcttggaaataaactacaacagaggagagtagttatgttccaagcgaacctggcggcagcgcaaaagatg

SEQ ID NO: 21841 - DNA, 103 bp, Artificial Sequence
  Synthetic Polynucleotide
taatacgactcactatagggaaaggaaaattctcaggcgcttggaaataaaacagaggagattatttatgagcgcctgaaacctggcggcagcgcaaaagatg

SEQ ID NO: 21842 - DNA, 103 bp, Artificial Sequence
  Synthetic Polynucleotide
taatacgactcactatagggcattcaaaggaaaattctcaggcgcttggaaacagaggagatccaagatgctgagaattaacctggcggcagcgcaaaagatg

SEQ ID NO: 21843 - DNA, 103 bp, Artificial Sequence
  Synthetic Polynucleotide
taatacgactcactatagggggccttttcgatgctagctcggtctccgacaacagaggagagtcggaatgcgagctagcaacctggcggcagcgcaaaagatg

SEQ ID NO: 21844 - DNA, 103 bp, Artificial Sequence
  Synthetic Polynucleotide
taatacgactcactataggggaagccattcaaaggaaaattctcaggcgcaacagaggagagcgcctatgaattttcctaacctggcggcagcgcaaaagatg

SEQ ID NO: 21845 - DNA, 103 bp, Artificial Sequence
  Synthetic Polynucleotide
taatacgactcactatagggttgttgaagccattcaaaggaaaattctcaaacagaggagatgagaaatgtcctttgaaaacctggcggcagcgcaaaagatg

SEQ ID NO: 21846 - DNA, 103 bp, Artificial Sequence
  Synthetic Polynucleotide
taatacgactcactataggggccggttgttgaagccattcaaaggaaaataacagaggagaattttcatgtgaatggctaacctggcggcagcgcaaaagatg

SEQ ID NO: 21847 - DNA, 103 bp, Artificial Sequence
  Synthetic Polynucleotide
taatacgactcactatagggaacttgccggttgttgaagccattcaaaggaacagaggagacctttgatgggcttcaacaacctggcggcagcgcaaaagatg

SEQ ID NO: 21848 - DNA, 103 bp, Artificial Sequence
  Synthetic Polynucleotide
taatacgactcactatagggagcacaacttgccggttgttgaagccattcaacagaggagagaatggatgcaacaaccgaacctggcggcagcgcaaaagatg

SEQ ID NO: 21849 - DNA, 103 bp, Artificial Sequence
  Synthetic Polynucleotide
taatacgactcactatagggatgctagcacaacttgccggttgttgaagcaacagaggagagcttcaatgaccggcaagaacctggcggcagcgcaaaagatg

SEQ ID NO: 21850 - DNA, 103 bp, Artificial Sequence
  Synthetic Polynucleotide
taatacgactcactatagggagcatatgctagcacaacttgccggttgttaacagaggagaaacaacatgcaagttgtgaacctggcggcagcgcaaaagatg

SEQ ID NO: 21851 - DNA, 103 bp, Artificial Sequence
  Synthetic Polynucleotide
taatacgactcactataggggggttagcatatgctagcacaacttgccggaacagaggagaccggcaatgtgtgctagcaacctggcggcagcgcaaaagatg

SEQ ID NO: 21852 - DNA, 103 bp, Artificial Sequence
  Synthetic Polynucleotide
taatacgactcactataggggtgtcgggttagcatatgctagcacaacttaacagaggagaaagttgatgtagcatatgaacctggcggcagcgcaaaagatg

SEQ ID NO: 21853 - DNA, 103 bp, Artificial Sequence
  Synthetic Polynucleotide
taatacgactcactatagggactgagtgtcgggttagcatatgctagcacaacagaggagagtgctaatgtatgctaacaacctggcggcagcgcaaaagatg

SEQ ID NO: 21854 - DNA, 103 bp, Artificial Sequence
  Synthetic Polynucleotide
taatacgactcactatagggctcagggccttttcgatgctagctcggtctaacagaggagaagaccgatgtagcatcgaaacctggcggcagcgcaaaagatg

SEQ ID NO: 21855 - DNA, 103 bp, Artificial Sequence
  Synthetic Polynucleotide
taatacgactcactatagggacagcactgagtgtcgggttagcatatgctaacagaggagaagcataatgtaacccgacaacctggcggcagcgcaaaagatg

SEQ ID NO: 21856 - DNA, 103 bp, Artificial Sequence
  Synthetic Polynucleotide
taatacgactcactatagggattaaacagcactgagtgtcgggttagcataacagaggagaatgctaatgcgacactcaaacctggcggcagcgcaaaagatg

SEQ ID NO: 21857 - DNA, 103 bp, Artificial Sequence
  Synthetic Polynucleotide
taatacgactcactatagggatcttattaaacagcactgagtgtcgggttaacagaggagaaacccgatgctcagtgctaacctggcggcagcgcaaaagatg

SEQ ID NO: 21858 - DNA, 103 bp, Artificial Sequence
  Synthetic Polynucleotide
taatacgactcactatagggcaattatcttattaaacagcactgagtgtcaacagaggagagacactatgtgctgtttaaacctggcggcagcgcaaaagatg

SEQ ID NO: 21859 - DNA, 103 bp, Artificial Sequence
  Synthetic Polynucleotide
taatacgactcactatagggttacccaattatcttattaaacagcactgaaacagaggagatcagtgatgtttaataagaacctggcggcagcgcaaaagatg

SEQ ID NO: 21860 - DNA, 103 bp, Artificial Sequence
  Synthetic Polynucleotide
taatacgactcactatagggttgtcttacccaattatcttattaaacagcaacagaggagagctgttatgtaagataataacctggcggcagcgcaaaagatg

SEQ ID NO: 21861 - DNA, 103 bp, Artificial Sequence
  Synthetic Polynucleotide
taatacgactcactatagggggccattgtcttacccaattatcttattaaaacagaggagattaataatgtaattgggtaacctggcggcagcgcaaaagatg

SEQ ID NO: 21862 - DNA, 103 bp, Artificial Sequence
  Synthetic Polynucleotide
taatacgactcactatagggagaagggccattgtcttacccaattatcttaacagaggagaaagataatggggtaagacaacctggcggcagcgcaaaagatg

SEQ ID NO: 21863 - DNA, 103 bp, Artificial Sequence
  Synthetic Polynucleotide
taatacgactcactatagggtgtacagaagggccattgtcttacccaattaacagaggagaaattggatgagacaatggaacctggcggcagcgcaaaagatg

SEQ ID NO: 21864 - DNA, 103 bp, Artificial Sequence
  Synthetic Polynucleotide
taatacgactcactatagggccctttgtacagaagggccattgtcttaccaacagaggagaggtaagatgatggcccttaacctggcggcagcgcaaaagatg

SEQ ID NO: 21865 - DNA, 103 bp, Artificial Sequence
  Synthetic Polynucleotide
taatacgactcactataggggactagtcttaatgtcaatgttaatattctaacagaggagaagaataatgacattgacaaacctggcggcagcgcaaaagatg

SEQ ID NO: 21866 - DNA, 103 bp, Artificial Sequence
  Synthetic Polynucleotide
taatacgactcactatagggcttgtctcagggccttttcgatgctagctcaacagaggagagagctaatgtcgaaaaggaacctggcggcagcgcaaaagatg

SEQ ID NO: 21867 - DNA, 103 bp, Artificial Sequence
  Synthetic Polynucleotide
taatacgactcactatagggtcagaccctttgtacagaagggccattgtcaacagaggagagacaatatgccttctgtaaacctggcggcagcgcaaaagatg

SEQ ID NO: 21868 - DNA, 103 bp, Artificial Sequence
  Synthetic Polynucleotide
taatacgactcactatagggctgaatcagaccctttgtacagaagggccaaacagaggagatggcccatgtgtacaaagaacctggcggcagcgcaaaagatg

SEQ ID NO: 21869 - DNA, 103 bp, Artificial Sequence
  Synthetic Polynucleotide
taatacgactcactatagggtctatctgaatcagaccctttgtacagaagaacagaggagacttctgatgaaagggtctaacctggcggcagcgcaaaagatg

SEQ ID NO: 21870 - DNA, 103 bp, Artificial Sequence
  Synthetic Polynucleotide
taatacgactcactatagggaaatatctatctgaatcagaccctttgtacaacagaggagagtacaaatggtctgattcaacctggcggcagcgcaaaagatg

SEQ ID NO: 21871 - DNA, 103 bp, Artificial Sequence
  Synthetic Polynucleotide
taatacgactcactatagggctgacaaatatctatctgaatcagacccttaacagaggagaaagggtatgattcagataaacctggcggcagcgcaaaagatg

SEQ ID NO: 21872 - DNA, 103 bp, Artificial Sequence
  Synthetic Polynucleotide
taatacgactcactatagggtgaatctgacaaatatctatctgaatcagaaacagaggagatctgatatggatagatataacctggcggcagcgcaaaagatg

SEQ ID NO: 21873 - DNA, 103 bp, Artificial Sequence
  Synthetic Polynucleotide
taatacgactcactatagggctgcatgaatctgacaaatatctatctgaaaacagaggagattcagaatgatatttgtcaacctggcggcagcgcaaaagatg

SEQ ID NO: 21874 - DNA, 103 bp, Artificial Sequence
  Synthetic Polynucleotide
taatacgactcactatagggtgatcctgcatgaatctgacaaatatctataacagaggagaatagatatgtgtcagattaacctggcggcagcgcaaaagatg

SEQ ID NO: 21875 - DNA, 103 bp, Artificial Sequence
  Synthetic Polynucleotide
taatacgactcactatagggtaaaatgatcctgcatgaatctgacaaataaacagaggagatatttgatggattcatgcaacctggcggcagcgcaaaagatg

SEQ ID NO: 21876 - DNA, 103 bp, Artificial Sequence
  Synthetic Polynucleotide
taatacgactcactatagggcaacttaaaatgatcctgcatgaatctgacaacagaggagagtcagaatgatgcaggataacctggcggcagcgcaaaagatg

SEQ ID NO: 21877 - DNA, 103 bp, Artificial Sequence
  Synthetic Polynucleotide
taatacgactcactatagggtgttacttgtctcagggccttttcgatgctaacagaggagaagcatcatgaaggccctgaacctggcggcagcgcaaaagatg

SEQ ID NO: 21878 - DNA, 103 bp, Artificial Sequence
  Synthetic Polynucleotide
taatacgactcactatagggaaaatcaacttaaaatgatcctgcatgaataacagaggagaattcatatgggatcatttaacctggcggcagcgcaaaagatg

SEQ ID NO: 21879 - DNA, 103 bp, Artificial Sequence
  Synthetic Polynucleotide
taatacgactcactatagggctattaaaatcaacttaaaatgatcctgcaaacagaggagatgcaggatgattttaagtaacctggcggcagcgcaaaagatg

SEQ ID NO: 21880 - DNA, 103 bp, Artificial Sequence
  Synthetic Polynucleotide
taatacgactcactatagggaagcactattaaaatcaacttaaaatgatcaacagaggagagatcatatgaagttgattaacctggcggcagcgcaaaagatg

SEQ ID NO: 21881 - DNA, 103 bp, Artificial Sequence
  Synthetic Polynucleotide
taatacgactcactatagggggttaaagcactattaaaatcaacttaaaaaacagaggagattttaaatggattttaataacctggcggcagcgcaaaagatg

SEQ ID NO: 21882 - DNA, 103 bp, Artificial Sequence
  Synthetic Polynucleotide
taatacgactcactatagggtgaagggttaaagcactattaaaatcaactaacagaggagaagttgaatgtaatagtgcaacctggcggcagcgcaaaagatg

SEQ ID NO: 21883 - DNA, 103 bp, Artificial Sequence
  Synthetic Polynucleotide
taatacgactcactatagggagcagtgaagggttaaagcactattaaaataacagaggagaattttaatggtgctttaaaacctggcggcagcgcaaaagatg

SEQ ID NO: 21884 - DNA, 103 bp, Artificial Sequence
  Synthetic Polynucleotide
taatacgactcactatagggagggtagcagtgaagggttaaagcactattaacagaggagaaatagtatgttaacccttaacctggcggcagcgcaaaagatg

SEQ ID NO: 21885 - DNA, 103 bp, Artificial Sequence
  Synthetic Polynucleotide
taatacgactcactatagggcctttagggtagcagtgaagggttaaagcaaacagaggagatgctttatgccttcactgaacctggcggcagcgcaaaagatg

SEQ ID NO: 21886 - DNA, 103 bp, Artificial Sequence
  Synthetic Polynucleotide
taatacgactcactatagggtcaatcctttagggtagcagtgaagggttaaacagaggagataacccatgactgctaccaacctggcggcagcgcaaaagatg

SEQ ID NO: 21887 - DNA, 103 bp, Artificial Sequence
  Synthetic Polynucleotide
taatacgactcactatagggctcaatcaatcctttagggtagcagtgaagaacagaggagacttcacatgtaccctaaaaacctggcggcagcgcaaaagatg

SEQ ID NO: 21888 - DNA, 103 bp, Artificial Sequence
  Synthetic Polynucleotide
taatacgactcactatagggtgcactgttacttgtctcagggccttttcgaacagaggagacgaaaaatgcctgagacaaacctggcggcagcgcaaaagatg

SEQ ID NO: 21889 - DNA, 103 bp, Artificial Sequence
  Synthetic Polynucleotide
taatacgactcactatagggatcagctcaatcaatcctttagggtagcagaacagaggagactgctaatgtaaaggattaacctggcggcagcgcaaaagatg

SEQ ID NO: 21890 - DNA, 103 bp, Artificial Sequence
  Synthetic Polynucleotide
taatacgactcactatagggggttaatcagctcaatcaatcctttagggtaacagaggagaaccctaatggattgattgaacctggcggcagcgcaaaagatg

SEQ ID NO: 21891 - DNA, 103 bp, Artificial Sequence
  Synthetic Polynucleotide
taatacgactcactatagggttataggttaatcagctcaatcaatcctttaacagaggagaaaaggaatgattgagctgaacctggcggcagcgcaaaagatg

SEQ ID NO: 21892 - DNA, 103 bp, Artificial Sequence
  Synthetic Polynucleotide
taatacgactcactatagggatacattataggttaatcagctcaatcaataacagaggagaattgatatggctgattaaaacctggcggcagcgcaaaagatg

SEQ ID NO: 21893 - DNA, 103 bp, Artificial Sequence
  Synthetic Polynucleotide
taatacgactcactatagggaagttatacattataggttaatcagctcaaaacagaggagattgagcatgttaacctataacctggcggcagcgcaaaagatg

SEQ ID NO: 21894 - DNA, 103 bp, Artificial Sequence
  Synthetic Polynucleotide
taatacgactcactatagggaaaagaagttatacattataggttaatcagaacagaggagactgattatgctataatgtaacctggcggcagcgcaaaagatg

SEQ ID NO: 21895 - DNA, 103 bp, Artificial Sequence
  Synthetic Polynucleotide
taatacgactcactatagggggtttaaaagaagttatacattataggttaaacagaggagataacctatgatgtataacaacctggcggcagcgcaaaagatg

SEQ ID NO: 21896 - DNA, 103 bp, Artificial Sequence
  Synthetic Polynucleotide
taatacgactcactatagggttagcggtttaaaagaagttatacattataaacagaggagatataatatgtaacttcttaacctggcggcagcgcaaaagatg

SEQ ID NO: 21897 - DNA, 103 bp, Artificial Sequence
  Synthetic Polynucleotide
taatacgactcactatagggttgatttagcggtttaaaagaagttatacaaacagaggagatgtataatgtcttttaaaaacctggcggcagcgcaaaagatg

SEQ ID NO: 21898 - DNA, 103 bp, Artificial Sequence
  Synthetic Polynucleotide
taatacgactcactatagggtatgattgatttagcggtttaaaagaagttaacagaggagaaacttcatgtaaaccgctaacctggcggcagcgcaaaagatg

SEQ ID NO: 21899 - DNA, 103 bp, Artificial Sequence
  Synthetic Polynucleotide
taatacgactcactatagggcctgatgcactgttacttgtctcagggcctaacagaggagaaggcccatggacaagtaaaacctggcggcagcgcaaaagatg

SEQ ID NO: 21900 - DNA, 103 bp, Artificial Sequence
  Synthetic Polynucleotide
taatacgactcactatagggaaacttatgattgatttagcggtttaaaagaacagaggagacttttaatgcgctaaatcaacctggcggcagcgcaaaagatg

SEQ ID NO: 21901 - DNA, 103 bp, Artificial Sequence
  Synthetic Polynucleotide
taatacgactcactatagggctgacaaacttatgattgatttagcggtttaacagaggagaaaaccgatgaatcaatcaaacctggcggcagcgcaaaagatg

SEQ ID NO: 21902 - DNA, 103 bp, Artificial Sequence
  Synthetic Polynucleotide
taatacgactcactatagggatgatctgacaaacttatgattgatttagcaacagaggagagctaaaatgatcataagtaacctggcggcagcgcaaaagatg

SEQ ID NO: 21903 - DNA, 103 bp, Artificial Sequence
  Synthetic Polynucleotide
taatacgactcactatagggcctatatgatctgacaaacttatgattgataacagaggagaatcaatatgaagtttgtcaacctggcggcagcgcaaaagatg

SEQ ID NO: 21904 - DNA, 103 bp, Artificial Sequence
  Synthetic Polynucleotide
taatacgactcactatagggttcatcctatatgatctgacaaacttatgaaacagaggagatcataaatgtgtcagatcaacctggcggcagcgcaaaagatg

SEQ ID NO: 21905 - DNA, 103 bp, Artificial Sequence
  Synthetic Polynucleotide
taatacgactcactatagggtaacattcatcctatatgatctgacaaactaacagaggagaagtttgatggatcatataaacctggcggcagcgcaaaagatg

SEQ ID NO: 21906 - DNA, 103 bp, Artificial Sequence
  Synthetic Polynucleotide
taatacgactcactatagggcgtattaacattcatcctatatgatctgacaacagaggagagtcagaatgtataggatgaacctggcggcagcgcaaaagatg

SEQ ID NO: 21907 - DNA, 103 bp, Artificial Sequence
  Synthetic Polynucleotide
taatacgactcactatagggtatcacgtattaacattcatcctatatgataacagaggagaatcataatggatgaatgtaacctggcggcagcgcaaaagatg

SEQ ID NO: 21908 - DNA, 103 bp, Artificial Sequence
  Synthetic Polynucleotide
taatacgactcactatagggccatttatcacgtattaacattcatcctataacagaggagaataggaatgatgttaataaacctggcggcagcgcaaaagatg

SEQ ID NO: 21909 - DNA, 103 bp, Artificial Sequence
  Synthetic Polynucleotide
taatacgactcactatagggaggaaccatttatcacgtattaacattcataacagaggagaatgaatatgaatacgtgaaacctggcggcagcgcaaaagatg

SEQ ID NO: 21910 - DNA, 103 bp, Artificial Sequence
  Synthetic Polynucleotide
taatacgactcactatagggttgttcctgatgcactgttacttgtctcagaacagaggagactgagaatggtaacagtgaacctggcggcagcgcaaaagatg

SEQ ID NO: 21911 - DNA, 103 bp, Artificial Sequence
  Synthetic Polynucleotide
taatacgactcactatagggtgaataggaaccatttatcacgtattaacaaacagaggagatgttaaatggtgataaataacctggcggcagcgcaaaagatg

SEQ ID NO: 21912 - DNA, 103 bp, Artificial Sequence
  Synthetic Polynucleotide
taatacgactcactatagggaaaactgaataggaaccatttatcacgtataacagaggagaatacgtatgaaatggttcaacctggcggcagcgcaaaagatg

SEQ ID NO: 21913 - DNA, 103 bp, Artificial Sequence
  Synthetic Polynucleotide
taatacgactcactatagggaaagtaaaactgaataggaaccatttatcaaacagaggagatgataaatggttcctattaacctggcggcagcgcaaaagatg

SEQ ID NO: 21914 - DNA, 103 bp, Artificial Sequence
  Synthetic Polynucleotide
taatacgactcactatagggaggttaaagtaaaactgaataggaaccattaacagaggagaaatggtatgtattcagttaacctggcggcagcgcaaaagatg

SEQ ID NO: 21915 - DNA, 103 bp, Artificial Sequence
  Synthetic Polynucleotide
taatacgactcactatagggctatgaggttaaagtaaaactgaataggaaaacagaggagattcctaatgagttttactaacctggcggcagcgcaaaagatg

SEQ ID NO: 21916 - DNA, 103 bp, Artificial Sequence
  Synthetic Polynucleotide
taatacgactcactatagggatttactatgaggttaaagtaaaactgaataacagaggagaattcagatgtactttaacaacctggcggcagcgcaaaagatg

SEQ ID NO: 21917 - DNA, 103 bp, Artificial Sequence
  Synthetic Polynucleotide
taatacgactcactatagggataagatttactatgaggttaaagtaaaacaacagaggagagttttaatgtaacctcataacctggcggcagcgcaaaagatg

SEQ ID NO: 21918 - DNA, 103 bp, Artificial Sequence
  Synthetic Polynucleotide
taatacgactcactataggggtcttataagatttactatgaggttaaagtaacagaggagaactttaatgtcatagtaaaacctggcggcagcgcaaaagatg

SEQ ID NO: 21919 - DNA, 103 bp, Artificial Sequence
  Synthetic Polynucleotide
taatacgactcactataggggagtagtcttataagatttactatgaggttaacagaggagaaacctcatggtaaatcttaacctggcggcagcgcaaaagatg

SEQ ID NO: 21920 - DNA, 103 bp, Artificial Sequence
  Synthetic Polynucleotide
taatacgactcactatagggaagatgagtagtcttataagatttactatgaacagaggagacatagtatgtcttataagaacctggcggcagcgcaaaagatg

SEQ ID NO: 21921 - DNA, 103 bp, Artificial Sequence
  Synthetic Polynucleotide
taatacgactcactatagggatcccttgttcctgatgcactgttacttgtaacagaggagaacaagtatgagtgcatcaaacctggcggcagcgcaaaagatg

SEQ ID NO: 21922 - DNA, 103 bp, Artificial Sequence
  Synthetic Polynucleotide
taatacgactcactatagggacttgaagatgagtagtcttataagatttaaacagaggagataaatcatgtaagactacaacctggcggcagcgcaaaagatg

SEQ ID NO: 21923 - DNA, 103 bp, Artificial Sequence
  Synthetic Polynucleotide
taatacgactcactataggggatcaacttgaagatgagtagtcttataagaacagaggagacttataatgctactcatcaacctggcggcagcgcaaaagatg

SEQ ID NO: 21924 - DNA, 103 bp, Artificial Sequence
  Synthetic Polynucleotide
taatacgactcactataggggaattgatcaacttgaagatgagtagtcttaacagaggagaaagactatgcatcttcaaaacctggcggcagcgcaaaagatg

SEQ ID NO: 21925 - DNA, 103 bp, Artificial Sequence
  Synthetic Polynucleotide
taatacgactcactatagggtctttgaattgatcaacttgaagatgagtaaacagaggagatactcaatgtcaagttgaaacctggcggcagcgcaaaagatg

SEQ ID NO: 21926 - DNA, 103 bp, Artificial Sequence
  Synthetic Polynucleotide
taatacgactcactatagggaattatctttgaattgatcaacttgaagataacagaggagaatcttcatgttgatcaataacctggcggcagcgcaaaagatg

SEQ ID NO: 21927 - DNA, 103 bp, Artificial Sequence
  Synthetic Polynucleotide
taatacgactcactatagggagggaaattatctttgaattgatcaacttgaacagaggagacaagttatgcaattcaaaaacctggcggcagcgcaaaagatg

SEQ ID NO: 21928 - DNA, 103 bp, Artificial Sequence
  Synthetic Polynucleotide
taatacgactcactatagggttagaagggaaattatctttgaattgatcaaacagaggagatgatcaatgcaaagataaaacctggcggcagcgcaaaagatg

SEQ ID NO: 21929 - DNA, 103 bp, Artificial Sequence
  Synthetic Polynucleotide
taatacgactcactatagggttattttagaagggaaattatctttgaattaacagaggagaaattcaatgataatttccaacctggcggcagcgcaaaagatg

SEQ ID NO: 21930 - DNA, 103 bp, Artificial Sequence
  Synthetic Polynucleotide
taatacgactcactatagggtcttattattttagaagggaaattatctttaacagaggagaaaagatatgttcccttctaacctggcggcagcgcaaaagatg

SEQ ID NO: 21931 - DNA, 103 bp, Artificial Sequence
  Synthetic Polynucleotide
taatacgactcactataggggtttttcttattattttagaagggaaattaaacagaggagataatttatgttctaaaataacctggcggcagcgcaaaagatg

SEQ ID NO: 21932 - DNA, 103 bp, Artificial Sequence
  Synthetic Polynucleotide
taatacgactcactatagggttacaatcccttgttcctgatgcactgttaaacagaggagataacagatgatcaggaacaacctggcggcagcgcaaaagatg

SEQ ID NO: 21933 - DNA, 103 bp, Artificial Sequence
  Synthetic Polynucleotide
taatacgactcactatagggcattagtttttcttattattttagaagggaaacagaggagatcccttatgaaataataaaacctggcggcagcgcaaaagatg

SEQ ID NO: 21934 - DNA, 103 bp, Artificial Sequence
  Synthetic Polynucleotide
taatacgactcactatagggttcttcattagtttttcttattattttagaaacagaggagatctaaaatgataagaaaaaacctggcggcagcgcaaaagatg

SEQ ID NO: 21935 - DNA, 103 bp, Artificial Sequence
  Synthetic Polynucleotide
taatacgactcactatagggtaatgttcttcattagtttttcttattattaacagaggagaaataatatgaaaaactaaaacctggcggcagcgcaaaagatg

SEQ ID NO: 21936 - DNA, 103 bp, Artificial Sequence
  Synthetic Polynucleotide
taatacgactcactataggggcaattaatgttcttcattagtttttcttaaacagaggagataagaaatgctaatgaagaacctggcggcagcgcaaaagatg

SEQ ID NO: 21937 - DNA, 103 bp, Artificial Sequence
  Synthetic Polynucleotide
taatacgactcactatagggacctagcaattaatgttcttcattagttttaacagaggagaaaaactatggaagaacataacctggcggcagcgcaaaagatg

SEQ ID NO: 21938 - DNA, 103 bp, Artificial Sequence
  Synthetic Polynucleotide
taatacgactcactatagggcctttacctagcaattaatgttcttcattaaacagaggagataatgaatgacattaattaacctggcggcagcgcaaaagatg

SEQ ID NO: 21939 - DNA, 103 bp, Artificial Sequence
  Synthetic Polynucleotide
taatacgactcactatagggaattgcctttacctagcaattaatgttcttaacagaggagaaagaacatgaattgctagaacctggcggcagcgcaaaagatg

SEQ ID NO: 21940 - DNA, 103 bp, Artificial Sequence
  Synthetic Polynucleotide
taatacgactcactatagggaacttaattgcctttacctagcaattaatgaacagaggagacattaaatgctaggtaaaaacctggcggcagcgcaaaagatg

SEQ ID NO: 21941 - DNA, 103 bp, Artificial Sequence
  Synthetic Polynucleotide
taatacgactcactatagggcaaagaacttaattgcctttacctagcaataacagaggagaattgctatgtaaaggcaaaacctggcggcagcgcaaaagatg

SEQ ID NO: 21942 - DNA, 103 bp, Artificial Sequence
  Synthetic Polynucleotide
taatacgactcactatagggaagttcaaagaacttaattgcctttacctaaacagaggagataggtaatggcaattaagaacctggcggcagcgcaaaagatg

SEQ ID NO: 21943 - DNA, 103 bp, Artificial Sequence
  Synthetic Polynucleotide
taatacgactcactataggggtatgttacaatcccttgttcctgatgcacaacagaggagagtgcatatggaacaagggaacctggcggcagcgcaaaagatg

SEQ ID NO: 21944 - DNA, 103 bp, Artificial Sequence
  Synthetic Polynucleotide
taatacgactcactatagggttgcaaagttcaaagaacttaattgcctttaacagaggagaaaaggcatgtaagttcttaacctggcggcagcgcaaaagatg

SEQ ID NO: 21945 - DNA, 103 bp, Artificial Sequence
  Synthetic Polynucleotide
taatacgactcactatagggtacttttgcaaagttcaaagaacttaattgaacagaggagacaattaatgtctttgaacaacctggcggcagcgcaaaagatg

SEQ ID NO: 21946 - DNA, 103 bp, Artificial Sequence
  Synthetic Polynucleotide
taatacgactcactatagggaaccttacttttgcaaagttcaaagaacttaacagaggagaaagttcatggaactttgcaacctggcggcagcgcaaaagatg

SEQ ID NO: 21947 - DNA, 103 bp, Artificial Sequence
  Synthetic Polynucleotide
taatacgactcactatagggagtgaaaccttacttttgcaaagttcaaagaacagaggagactttgaatgttgcaaaagaacctggcggcagcgcaaaagatg

SEQ ID NO: 21948 - DNA, 103 bp, Artificial Sequence
  Synthetic Polynucleotide
taatacgactcactatagggtcactagtgaaaccttacttttgcaaagttaacagaggagaaactttatgaaagtaaggaacctggcggcagcgcaaaagatg

SEQ ID NO: 21949 - DNA, 103 bp, Artificial Sequence
  Synthetic Polynucleotide
taatacgactcactatagggtttactcactagtgaaaccttacttttgcaaacagaggagatgcaaaatgaaggtttcaaacctggcggcagcgcaaaagatg

SEQ ID NO: 21950 - DNA, 103 bp, Artificial Sequence
  Synthetic Polynucleotide
taatacgactcactatagggaggaatttactcactagtgaaaccttacttaacagaggagaaagtaaatgttcactagtaacctggcggcagcgcaaaagatg

SEQ ID NO: 21951 - DNA, 103 bp, Artificial Sequence
  Synthetic Polynucleotide
taatacgactcactatagggaatacaggaatttactcactagtgaaacctaacagaggagaaggtttatgtagtgagtaaacctggcggcagcgcaaaagatg

SEQ ID NO: 21952 - DNA, 103 bp, Artificial Sequence
  Synthetic Polynucleotide
taatacgactcactatagggctactaatacaggaatttactcactagtgaaacagaggagatcactaatgagtaaattcaacctggcggcagcgcaaaagatg

SEQ ID NO: 21953 - DNA, 103 bp, Artificial Sequence
  Synthetic Polynucleotide
taatacgactcactatagggttaatctactaatacaggaatttactcactaacagaggagaagtgagatgattcctgtaaacctggcggcagcgcaaaagatg

SEQ ID NO: 21954 - DNA, 103 bp, Artificial Sequence
  Synthetic Polynucleotide
taatacgactcactatagggttggggtatgttacaatcccttgttcctgaaacagaggagatcaggaatgagggattgtaacctggcggcagcgcaaaagatg

SEQ ID NO: 21955 - DNA, 103 bp, Artificial Sequence
  Synthetic Polynucleotide
taatacgactcactatagggtggttttaatctactaatacaggaatttacaacagaggagagtaaatatgtgtattagtaacctggcggcagcgcaaaagatg

SEQ ID NO: 21956 - DNA, 103 bp, Artificial Sequence
  Synthetic Polynucleotide
taatacgactcactatagggttccttggttttaatctactaatacaggaaaacagaggagattcctgatgtagtagattaacctggcggcagcgcaaaagatg

SEQ ID NO: 21957 - DNA, 103 bp, Artificial Sequence
  Synthetic Polynucleotide
taatacgactcactatagggggtgcttccttggttttaatctactaatacaacagaggagagtattaatggattaaaacaacctggcggcagcgcaaaagatg

SEQ ID NO: 21958 - DNA, 103 bp, Artificial Sequence
  Synthetic Polynucleotide
taatacgactcactataggggtcggggtgcttccttggttttaatctactaacagaggagaagtagaatgaaaccaaggaacctggcggcagcgcaaaagatg

SEQ ID NO: 21959 - DNA, 103 bp, Artificial Sequence
  Synthetic Polynucleotide
taatacgactcactatagggttcatgtcggggtgcttccttggttttaataacagaggagaattaaaatgaaggaagcaaacctggcggcagcgcaaaagatg

SEQ ID NO: 21960 - DNA, 103 bp, Artificial Sequence
  Synthetic Polynucleotide
taatacgactcactatagggtggtcttcatgtcggggtgcttccttggttaacagaggagaaaccaaatgagcaccccgaacctggcggcagcgcaaaagatg

SEQ ID NO: 21961 - DNA, 103 bp, Artificial Sequence
  Synthetic Polynucleotide
taatacgactcactatagggatatatggtcttcatgtcggggtgcttcctaacagaggagaaggaagatgcccgacatgaacctggcggcagcgcaaaagatg

SEQ ID NO: 21962 - DNA, 103 bp, Artificial Sequence
  Synthetic Polynucleotide
taatacgactcactatagggagaaaatatatggtcttcatgtcggggtgcaacagaggagagcacccatgcatgaagacaacctggcggcagcgcaaaagatg

SEQ ID NO: 21963 - DNA, 103 bp, Artificial Sequence
  Synthetic Polynucleotide
taatacgactcactatagggtaatcagaaaatatatggtcttcatgtcggaacagaggagaccgacaatgagaccatataacctggcggcagcgcaaaagatg

SEQ ID NO: 21964 - DNA, 103 bp, Artificial Sequence
  Synthetic Polynucleotide
taatacgactcactataggggagactaatcagaaaatatatggtcttcataacagaggagaatgaagatgatatattttaacctggcggcagcgcaaaagatg

SEQ ID NO: 21965 - DNA, 103 bp, Artificial Sequence
  Synthetic Polynucleotide
taatacgactcactatagggaatgattggggtatgttacaatcccttgttaacagaggagaaacaagatgttgtaacataacctggcggcagcgcaaaagatg

SEQ ID NO: 21966 - DNA, 103 bp, Artificial Sequence
  Synthetic Polynucleotide
taatacgactcactatagggaaaatgagactaatcagaaaatatatggtcaacagaggagagaccatatgttttctgataacctggcggcagcgcaaaagatg

SEQ ID NO: 21967 - DNA, 103 bp, Artificial Sequence
  Synthetic Polynucleotide
taatacgactcactatagggggattaaaatgagactaatcagaaaatataaacagaggagatatattatgtgattagtcaacctggcggcagcgcaaaagatg

SEQ ID NO: 21968 - DNA, 103 bp, Artificial Sequence
  Synthetic Polynucleotide
taatacgactcactatagggactttggattaaaatgagactaatcagaaaaacagaggagatttctgatgagtctcattaacctggcggcagcgcaaaagatg

SEQ ID NO: 21969 - DNA, 103 bp, Artificial Sequence
  Synthetic Polynucleotide
taatacgactcactatagggtttatactttggattaaaatgagactaatcaacagaggagagattagatgcattttaataacctggcggcagcgcaaaagatg

SEQ ID NO: 21970 - DNA, 103 bp, Artificial Sequence
  Synthetic Polynucleotide
taatacgactcactataggggagtttttatactttggattaaaatgagacaacagaggagagtctcaatgtaatccaaaaacctggcggcagcgcaaaagatg

SEQ ID NO: 21971 - DNA, 103 bp, Artificial Sequence
  Synthetic Polynucleotide
taatacgactcactatagggagggagagtttttatactttggattaaaataacagaggagaattttaatgcaaagtataaacctggcggcagcgcaaaagatg

SEQ ID NO: 21972 - DNA, 103 bp, Artificial Sequence
  Synthetic Polynucleotide
taatacgactcactatagggaaaacagggagagtttttatactttggattaacagaggagaaatccaatgtataaaaacaacctggcggcagcgcaaaagatg

SEQ ID NO: 21973 - DNA, 103 bp, Artificial Sequence
  Synthetic Polynucleotide
taatacgactcactatagggtttctaaaacagggagagtttttatactttaacagaggagaaaagtaatgaaactctccaacctggcggcagcgcaaaagatg

SEQ ID NO: 21974 - DNA, 103 bp, Artificial Sequence
  Synthetic Polynucleotide
taatacgactcactatagggagcaatttctaaaacagggagagtttttataacagaggagaataaaaatgctccctgttaacctggcggcagcgcaaaagatg

SEQ ID NO: 21975 - DNA, 103 bp, Artificial Sequence
  Synthetic Polynucleotide
taatacgactcactatagggttactagcaatttctaaaacagggagagttaacagaggagaaactctatgtgttttagaaacctggcggcagcgcaaaagatg

SEQ ID NO: 21976 - DNA, 103 bp, Artificial Sequence
  Synthetic Polynucleotide
taatacgactcactatagggaaaatgactagtcttaatgtcaatgttaataacagaggagaattaacatggacattaagaacctggcggcagcgcaaaagatg

SEQ ID NO: 21977 - DNA, 103 bp, Artificial Sequence
  Synthetic Polynucleotide
taatacgactcactataggggagccaatgattggggtatgttacaatcccaacagaggagagggattatgacataccccaacctggcggcagcgcaaaagatg

SEQ ID NO: 21978 - DNA, 103 bp, Artificial Sequence
  Synthetic Polynucleotide
taatacgactcactatagggggctgttactagcaatttctaaaacagggaaacagaggagatccctgatgtagaaattgaacctggcggcagcgcaaaagatg

SEQ ID NO: 21979 - DNA, 103 bp, Artificial Sequence
  Synthetic Polynucleotide
taatacgactcactatagggaggttggctgttactagcaatttctaaaacaacagaggagagttttaatgattgctagtaacctggcggcagcgcaaaagatg

SEQ ID NO: 21980 - DNA, 103 bp, Artificial Sequence
  Synthetic Polynucleotide
taatacgactcactatagggtcttgaggttggctgttactagcaatttctaacagaggagaagaaatatgtagtaacagaacctggcggcagcgcaaaagatg

SEQ ID NO: 21981 - DNA, 103 bp, Artificial Sequence
  Synthetic Polynucleotide
taatacgactcactatagggctacatcttgaggttggctgttactagcaaaacagaggagattgctaatgacagccaacaacctggcggcagcgcaaaagatg

SEQ ID NO: 21982 - DNA, 103 bp, Artificial Sequence
  Synthetic Polynucleotide
taatacgactcactatagggtgaatctacatcttgaggttggctgttactaacagaggagaagtaacatgcaacctcaaaacctggcggcagcgcaaaagatg

SEQ ID NO: 21983 - DNA, 103 bp, Artificial Sequence
  Synthetic Polynucleotide
taatacgactcactatagggcacactgaatctacatcttgaggttggctgaacagaggagacagccaatgtcaagatgtaacctggcggcagcgcaaaagatg

SEQ ID NO: 21984 - DNA, 103 bp, Artificial Sequence
  Synthetic Polynucleotide
taatacgactcactatagggcggagcacactgaatctacatcttgaggttaacagaggagaaacctcatgatgtagattaacctggcggcagcgcaaaagatg

SEQ ID NO: 21985 - DNA, 103 bp, Artificial Sequence
  Synthetic Polynucleotide
taatacgactcactatagggggttccggagcacactgaatctacatcttgaacagaggagacaagatatggattcagtgaacctggcggcagcgcaaaagatg

SEQ ID NO: 21986 - DNA, 103 bp, Artificial Sequence
  Synthetic Polynucleotide
taatacgactcactatagggtggagggttccggagcacactgaatctacaaacagaggagatgtagaatgagtgtgctcaacctggcggcagcgcaaaagatg

SEQ ID NO: 21987 - DNA, 103 bp, Artificial Sequence
  Synthetic Polynucleotide
taatacgactcactatagggtcttttggagggttccggagcacactgaataacagaggagaattcagatggctccggaaaacctggcggcagcgcaaaagatg

SEQ ID NO: 21988 - DNA, 103 bp, Artificial Sequence
  Synthetic Polynucleotide
taatacgactcactataggggtagtgagccaatgattggggtatgttacaaacagaggagatgtaacatgccccaatcaaacctggcggcagcgcaaaagatg

SEQ ID NO: 21989 - DNA, 103 bp, Artificial Sequence
  Synthetic Polynucleotide
taatacgactcactatagggttctgtcttttggagggttccggagcacacaacagaggagagtgtgcatgggaaccctcaacctggcggcagcgcaaaagatg

SEQ ID NO: 21990 - DNA, 103 bp, Artificial Sequence
  Synthetic Polynucleotide
taatacgactcactatagggacatcttctgtcttttggagggttccggagaacagaggagactccggatgcctccaaaaaacctggcggcagcgcaaaagatg

SEQ ID NO: 21991 - DNA, 103 bp, Artificial Sequence
  Synthetic Polynucleotide
taatacgactcactataggggatgaacatcttctgtcttttggagggttcaacagaggagagaacccatgaaaagacagaacctggcggcagcgcaaaagatg

SEQ ID NO: 21992 - DNA, 103 bp, Artificial Sequence
  Synthetic Polynucleotide
taatacgactcactatagggcatcagatgaacatcttctgtcttttggagaacagaggagactccaaatgacagaagataacctggcggcagcgcaaaagatg

SEQ ID NO: 21993 - DNA, 103 bp, Artificial Sequence
  Synthetic Polynucleotide
taatacgactcactatagggaatcccatcagatgaacatcttctgtctttaacagaggagaaaagacatgagatgttcaaacctggcggcagcgcaaaagatg

SEQ ID NO: 21994 - DNA, 103 bp, Artificial Sequence
  Synthetic Polynucleotide
taatacgactcactataggggtgtaaatcccatcagatgaacatcttctgaacagaggagacagaagatgttcatctgaaacctggcggcagcgcaaaagatg

SEQ ID NO: 21995 - DNA, 103 bp, Artificial Sequence
  Synthetic Polynucleotide
taatacgactcactatagggactcagtgtaaatcccatcagatgaacatcaacagaggagagatgttatgctgatgggaaacctggcggcagcgcaaaagatg

SEQ ID NO: 21996 - DNA, 103 bp, Artificial Sequence
  Synthetic Polynucleotide
taatacgactcactatagggtgcccactcagtgtaaatcccatcagatgaaacagaggagatcatctatggggatttacaacctggcggcagcgcaaaagatg

SEQ ID NO: 21997 - DNA, 103 bp, Artificial Sequence
  Synthetic Polynucleotide
taatacgactcactatagggctttttgcccactcagtgtaaatcccatcaaacagaggagatgatggatgttacactgaaacctggcggcagcgcaaaagatg

SEQ ID NO: 21998 - DNA, 103 bp, Artificial Sequence
  Synthetic Polynucleotide
taatacgactcactatagggagcaactttttgcccactcagtgtaaatccaacagaggagaggatttatgctgagtgggaacctggcggcagcgcaaaagatg

SEQ ID NO: 21999 - DNA, 103 bp, Artificial Sequence
  Synthetic Polynucleotide
taatacgactcactataggggacctgtagtgagccaatgattggggtatgaacagaggagacataccatgatcattggcaacctggcggcagcgcaaaagatg

SEQ ID NO: 22000 - DNA, 103 bp, Artificial Sequence
  Synthetic Polynucleotide
taatacgactcactataggggaatcagcaactttttgcccactcagtgtaaacagaggagatacactatgtgggcaaaaaacctggcggcagcgcaaaagatg

SEQ ID NO: 22001 - DNA, 103 bp, Artificial Sequence
  Synthetic Polynucleotide
taatacgactcactatagggaaggggaatcagcaactttttgcccactcaaacagaggagatgagtgatgaaaaagttgaacctggcggcagcgcaaaagatg

SEQ ID NO: 22002 - DNA, 103 bp, Artificial Sequence
  Synthetic Polynucleotide
taatacgactcactatagggttccaaaggggaatcagcaactttttgcccaacagaggagagggcaaatggttgctgataacctggcggcagcgcaaaagatg

SEQ ID NO: 22003 - DNA, 103 bp, Artificial Sequence
  Synthetic Polynucleotide
taatacgactcactataggggatgcttccaaaggggaatcagcaacttttaacagaggagaaaaagtatgtgattccccaacctggcggcagcgcaaaagatg

SEQ ID NO: 22004 - DNA, 103 bp, Artificial Sequence
  Synthetic Polynucleotide
taatacgactcactataggggtttagatgcttccaaaggggaatcagcaaaacagaggagattgctgatgcccctttggaacctggcggcagcgcaaaagatg

SEQ ID NO: 22005 - DNA, 103 bp, Artificial Sequence
  Synthetic Polynucleotide
taatacgactcactatagggccatcgtttagatgcttccaaaggggaatcaacagaggagagattccatgttggaagcaaacctggcggcagcgcaaaagatg

SEQ ID NO: 22006 - DNA, 103 bp, Artificial Sequence
  Synthetic Polynucleotide
taatacgactcactatagggaaagcccatcgtttagatgcttccaaagggaacagaggagaccctttatgagcatctaaaacctggcggcagcgcaaaagatg

SEQ ID NO: 22007 - DNA, 103 bp, Artificial Sequence
  Synthetic Polynucleotide
taatacgactcactatagggtcctgaaagcccatcgtttagatgcttccaaacagaggagatggaagatgctaaacgataacctggcggcagcgcaaaagatg

SEQ ID NO: 22008 - DNA, 103 bp, Artificial Sequence
  Synthetic Polynucleotide
taatacgactcactatagggacctgtcctgaaagcccatcgtttagatgcaacagaggagagcatctatgcgatgggctaacctggcggcagcgcaaaagatg

SEQ ID NO: 22009 - DNA, 103 bp, Artificial Sequence
  Synthetic Polynucleotide
taatacgactcactatagggggaacacctgtcctgaaagcccatcgtttaaacagaggagataaacgatgggctttcagaacctggcggcagcgcaaaagatg

SEQ ID NO: 22010 - DNA, 103 bp, Artificial Sequence
  Synthetic Polynucleotide
taatacgactcactatagggcatgtgacctgtagtgagccaatgattgggaacagaggagacccaatatgtggctcactaacctggcggcagcgcaaaagatg

SEQ ID NO: 22011 - DNA, 103 bp, Artificial Sequence
  Synthetic Polynucleotide
taatacgactcactatagggtgggaggaacacctgtcctgaaagcccatcaacagaggagagatgggatgtcaggacagaacctggcggcagcgcaaaagatg

SEQ ID NO: 22012 - DNA, 103 bp, Artificial Sequence
  Synthetic Polynucleotide
taatacgactcactataggggttcttgggaggaacacctgtcctgaaagcaacagaggagagctttcatgacaggtgttaacctggcggcagcgcaaaagatg

SEQ ID NO: 22013 - DNA, 103 bp, Artificial Sequence
  Synthetic Polynucleotide
taatacgactcactatagggtcaacgttcttgggaggaacacctgtcctgaacagaggagacaggacatgtgttcctccaacctggcggcagcgcaaaagatg

SEQ ID NO: 22014 - DNA, 103 bp, Artificial Sequence
  Synthetic Polynucleotide
taatacgactcactatagggtatactcaacgttcttgggaggaacacctgaacagaggagacaggtgatgctcccaagaaacctggcggcagcgcaaaagatg

SEQ ID NO: 22015 - DNA, 103 bp, Artificial Sequence
  Synthetic Polynucleotide
taatacgactcactatagggttccgtatactcaacgttcttgggaggaacaacagaggagagttcctatgaagaacgttaacctggcggcagcgcaaaagatg

SEQ ID NO: 22016 - DNA, 103 bp, Artificial Sequence
  Synthetic Polynucleotide
taatacgactcactatagggtctccttccgtatactcaacgttcttgggaaacagaggagatcccaaatgcgttgagtaaacctggcggcagcgcaaaagatg

SEQ ID NO: 22017 - DNA, 103 bp, Artificial Sequence
  Synthetic Polynucleotide
taatacgactcactatagggcttcttctccttccgtatactcaacgttctaacagaggagaagaacgatgagtatacggaacctggcggcagcgcaaaagatg

SEQ ID NO: 22018 - DNA, 103 bp, Artificial Sequence
  Synthetic Polynucleotide
taatacgactcactatagggtttggcttcttctccttccgtatactcaacaacagaggagagttgagatgacggaaggaaacctggcggcagcgcaaaagatg

SEQ ID NO: 22019 - DNA, 103 bp, Artificial Sequence
  Synthetic Polynucleotide
taatacgactcactatagggcatgttttggcttcttctccttccgtatacaacagaggagagtatacatgaggagaagaaacctggcggcagcgcaaaagatg

SEQ ID NO: 22020 - DNA, 103 bp, Artificial Sequence
  Synthetic Polynucleotide
taatacgactcactatagggtgtaacatgttttggcttcttctccttccgaacagaggagacggaagatgaagaagccaaacctggcggcagcgcaaaagatg

SEQ ID NO: 22021 - DNA, 103 bp, Artificial Sequence
  Synthetic Polynucleotide
taatacgactcactatagggactttcatgtgacctgtagtgagccaatgaaacagaggagatcattgatgcactacaggaacctggcggcagcgcaaaagatg

SEQ ID NO: 22022 - DNA, 103 bp, Artificial Sequence
  Synthetic Polynucleotide
taatacgactcactatagggtatattgtaacatgttttggcttcttctccaacagaggagaggagaaatggccaaaacaaacctggcggcagcgcaaaagatg

SEQ ID NO: 22023 - DNA, 103 bp, Artificial Sequence
  Synthetic Polynucleotide
taatacgactcactatagggacacttatattgtaacatgttttggcttctaacagaggagaagaagcatgaacatgttaaacctggcggcagcgcaaaagatg

SEQ ID NO: 22024 - DNA, 103 bp, Artificial Sequence
  Synthetic Polynucleotide
taatacgactcactatagggctgttacacttatattgtaacatgttttggaacagaggagaccaaaaatggttacaataaacctggcggcagcgcaaaagatg

SEQ ID NO: 22025 - DNA, 103 bp, Artificial Sequence
  Synthetic Polynucleotide
taatacgactcactatagggagggtctgttacacttatattgtaacatgtaacagaggagaacatgtatgaatataagtaacctggcggcagcgcaaaagatg

SEQ ID NO: 22026 - DNA, 103 bp, Artificial Sequence
  Synthetic Polynucleotide
taatacgactcactatagggccagaagggtctgttacacttatattgtaaaacagaggagattacaaatgaagtgtaacaacctggcggcagcgcaaaagatg

SEQ ID NO: 22027 - DNA, 103 bp, Artificial Sequence
  Synthetic Polynucleotide
taatacgactcactatagggattttccagaagggtctgttacacttatataacagaggagaatataaatgtaacagaccaacctggcggcagcgcaaaagatg

SEQ ID NO: 22028 - DNA, 103 bp, Artificial Sequence
  Synthetic Polynucleotide
taatacgactcactatagggcaaggattttccagaagggtctgttacactaacagaggagaagtgtaatggacccttctaacctggcggcagcgcaaaagatg

SEQ ID NO: 22029 - DNA, 103 bp, Artificial Sequence
  Synthetic Polynucleotide
taatacgactcactatagggagcagcaaggattttccagaagggtctgttaacagaggagaaacagaatgttctggaaaaacctggcggcagcgcaaaagatg

SEQ ID NO: 22030 - DNA, 103 bp, Artificial Sequence
  Synthetic Polynucleotide
taatacgactcactataggggatccagcagcaaggattttccagaagggtaacagaggagaacccttatggaaaatcctaacctggcggcagcgcaaaagatg

SEQ ID NO: 22031 - DNA, 103 bp, Artificial Sequence
  Synthetic Polynucleotide
taatacgactcactataggggggaggatccagcagcaaggattttccagaaacagaggagatctggaatgtccttgctgaacctggcggcagcgcaaaagatg

SEQ ID NO: 22032 - DNA, 103 bp, Artificial Sequence
  Synthetic Polynucleotide
taatacgactcactatagggagattactttcatgtgacctgtagtgagccaacagaggagaggctcaatgcaggtcacaaacctggcggcagcgcaaaagatg

SEQ ID NO: 22033 - DNA, 103 bp, Artificial Sequence
  Synthetic Polynucleotide
taatacgactcactatagggttactgggaggatccagcagcaaggattttaacagaggagaaaaatcatggctgctggaaacctggcggcagcgcaaaagatg

SEQ ID NO: 22034 - DNA, 103 bp, Artificial Sequence
  Synthetic Polynucleotide
taatacgactcactatagggggatattactgggaggatccagcagcaaggaacagaggagaccttgcatgtggatcctcaacctggcggcagcgcaaaagatg

SEQ ID NO: 22035 - DNA, 103 bp, Artificial Sequence
  Synthetic Polynucleotide
taatacgactcactatagggatcgcggatattactgggaggatccagcagaacagaggagactgctgatgcctcccagtaacctggcggcagcgcaaaagatg

SEQ ID NO: 22036 - DNA, 103 bp, Artificial Sequence
  Synthetic Polynucleotide
taatacgactcactataggggggtaatcgcggatattactgggaggatccaacagaggagaggatccatgcagtaatataacctggcggcagcgcaaaagatg

SEQ ID NO: 22037 - DNA, 103 bp, Artificial Sequence
  Synthetic Polynucleotide
taatacgactcactatagggatttagggtaatcgcggatattactgggagaacagaggagactcccaatgatatccgcgaacctggcggcagcgcaaaagatg

SEQ ID NO: 22038 - DNA, 103 bp, Artificial Sequence
  Synthetic Polynucleotide
taatacgactcactatagggtttacatttagggtaatcgcggatattactaacagaggagaagtaatatgcgcgattacaacctggcggcagcgcaaaagatg

SEQ ID NO: 22039 - DNA, 103 bp, Artificial Sequence
  Synthetic Polynucleotide
taatacgactcactatagggacagttttacatttagggtaatcgcggataaacagaggagatatccgatgttaccctaaaacctggcggcagcgcaaaagatg

SEQ ID NO: 22040 - DNA, 103 bp, Artificial Sequence
  Synthetic Polynucleotide
taatacgactcactataggggatgaacagttttacatttagggtaatcgcaacagaggagagcgattatgctaaatgtaaacctggcggcagcgcaaaagatg

SEQ ID NO: 22041 - DNA, 103 bp, Artificial Sequence
  Synthetic Polynucleotide
taatacgactcactatagggaatatgatgaacagttttacatttagggtaaacagaggagataccctatgtgtaaaactaacctggcggcagcgcaaaagatg

SEQ ID NO: 22042 - DNA, 103 bp, Artificial Sequence
  Synthetic Polynucleotide
taatacgactcactatagggccttgaatatgatgaacagttttacatttaaacagaggagataaatgatgaactgttcaaacctggcggcagcgcaaaagatg

SEQ ID NO: 22043 - DNA, 103 bp, Artificial Sequence
  Synthetic Polynucleotide
taatacgactcactatagggcccaaagattactttcatgtgacctgtagtaacagaggagaactacaatgcacatgaaaaacctggcggcagcgcaaaagatg

SEQ ID NO: 22044 - DNA, 103 bp, Artificial Sequence
  Synthetic Polynucleotide
taatacgactcactatagggtttgaccttgaatatgatgaacagttttacaacagaggagagtaaaaatgttcatcataaacctggcggcagcgcaaaagatg

SEQ ID NO: 22045 - DNA, 103 bp, Artificial Sequence
  Synthetic Polynucleotide
taatacgactcactatagggagggttttgaccttgaatatgatgaacagtaacagaggagaactgttatgcatattcaaaacctggcggcagcgcaaaagatg

SEQ ID NO: 22046 - DNA, 103 bp, Artificial Sequence
  Synthetic Polynucleotide
taatacgactcactataggggcatgagggttttgaccttgaatatgatgaaacagaggagatcatcaatgtcaaggtcaaacctggcggcagcgcaaaagatg

SEQ ID NO: 22047 - DNA, 103 bp, Artificial Sequence
  Synthetic Polynucleotide
taatacgactcactatagggcctgtgcatgagggttttgaccttgaatataacagaggagaatattcatggtcaaaaccaacctggcggcagcgcaaaagatg

SEQ ID NO: 22048 - DNA, 103 bp, Artificial Sequence
  Synthetic Polynucleotide
taatacgactcactatagggaatcccctgtgcatgagggttttgaccttgaacagaggagacaaggtatgaaccctcataacctggcggcagcgcaaaagatg

SEQ ID NO: 22049 - DNA, 103 bp, Artificial Sequence
  Synthetic Polynucleotide
taatacgactcactatagggagggcaatcccctgtgcatgagggttttgaaacagaggagatcaaaaatgtcatgcacaaacctggcggcagcgcaaaagatg

SEQ ID NO: 22050 - DNA, 103 bp, Artificial Sequence
  Synthetic Polynucleotide
taatacgactcactatagggaatggagggcaatcccctgtgcatgagggtaacagaggagaaccctcatgcacaggggaaacctggcggcagcgcaaaagatg

SEQ ID NO: 22051 - DNA, 103 bp, Artificial Sequence
  Synthetic Polynucleotide
taatacgactcactatagggccacaaatggagggcaatcccctgtgcatgaacagaggagacatgcaatggggattgccaacctggcggcagcgcaaaagatg

SEQ ID NO: 22052 - DNA, 103 bp, Artificial Sequence
  Synthetic Polynucleotide
taatacgactcactataggggccccccacaaatggagggcaatcccctgtaacagaggagaacagggatgtgccctccaaacctggcggcagcgcaaaagatg

SEQ ID NO: 22053 - DNA, 103 bp, Artificial Sequence
  Synthetic Polynucleotide
taatacgactcactatagggaaaatgccccccacaaatggagggcaatccaacagaggagaggattgatgtccatttgtaacctggcggcagcgcaaaagatg

SEQ ID NO: 22054 - DNA, 103 bp, Artificial Sequence
  Synthetic Polynucleotide
taatacgactcactatagggaaaatcccaaagattactttcatgtgacctaacagaggagaaggtcaatggaaagtaataacctggcggcagcgcaaaagatg

SEQ ID NO: 22055 - DNA, 103 bp, Artificial Sequence
  Synthetic Polynucleotide
taatacgactcactatagggcaagaaaaatgccccccacaaatggagggcaacagaggagagccctcatgttgtgggggaacctggcggcagcgcaaaagatg

SEQ ID NO: 22056 - DNA, 103 bp, Artificial Sequence
  Synthetic Polynucleotide
taatacgactcactatagggtcatacaagaaaaatgccccccacaaatggaacagaggagaccatttatggggggcattaacctggcggcagcgcaaaagatg

SEQ ID NO: 22057 - DNA, 103 bp, Artificial Sequence
  Synthetic Polynucleotide
taatacgactcactatagggcgcgatcatacaagaaaaatgccccccacaaacagaggagatgtgggatgcatttttctaacctggcggcagcgcaaaagatg

SEQ ID NO: 22058 - DNA, 103 bp, Artificial Sequence
  Synthetic Polynucleotide
taatacgactcactatagggggcaacgcgatcatacaagaaaaatgccccaacagaggagaggggcaatgttcttgtataacctggcggcagcgcaaaagatg

SEQ ID NO: 22059 - DNA, 103 bp, Artificial Sequence
  Synthetic Polynucleotide
taatacgactcactataggggtagaggcaacgcgatcatacaagaaaaataacagaggagaatttttatggtatgatcgaacctggcggcagcgcaaaagatg

SEQ ID NO: 22060 - DNA, 103 bp, Artificial Sequence
  Synthetic Polynucleotide
taatacgactcactatagggttgttgtagaggcaacgcgatcatacaagaaacagaggagatcttgtatgatcgcgttgaacctggcggcagcgcaaaagatg

SEQ ID NO: 22061 - DNA, 103 bp, Artificial Sequence
  Synthetic Polynucleotide
taatacgactcactataggggtacattgttgtagaggcaacgcgatcataaacagaggagatatgatatggttgcctctaacctggcggcagcgcaaaagatg

SEQ ID NO: 22062 - DNA, 103 bp, Artificial Sequence
  Synthetic Polynucleotide
taatacgactcactatagggcctcggtacattgttgtagaggcaacgcgaaacagaggagatcgcgtatgctctacaacaacctggcggcagcgcaaaagatg

SEQ ID NO: 22063 - DNA, 103 bp, Artificial Sequence
  Synthetic Polynucleotide
taatacgactcactatagggccttgcctcggtacattgttgtagaggcaaaacagaggagattgcctatgcaacaatgtaacctggcggcagcgcaaaagatg

SEQ ID NO: 22064 - DNA, 103 bp, Artificial Sequence
  Synthetic Polynucleotide
taatacgactcactataggggaagaccttgcctcggtacattgttgtagaaacagaggagatctacaatgatgtaccgaaacctggcggcagcgcaaaagatg

SEQ ID NO: 22065 - DNA, 103 bp, Artificial Sequence
  Synthetic Polynucleotide
taatacgactcactatagggatcttaaaatcccaaagattactttcatgtaacagaggagaacatgaatgtaatctttgaacctggcggcagcgcaaaagatg

SEQ ID NO: 22066 - DNA, 103 bp, Artificial Sequence
  Synthetic Polynucleotide
taatacgactcactatagggtcagtgaagaccttgcctcggtacattgttaacagaggagaaacaatatgccgaggcaaaacctggcggcagcgcaaaagatg

SEQ ID NO: 22067 - DNA, 103 bp, Artificial Sequence
  Synthetic Polynucleotide
taatacgactcactatagggttccttcagtgaagaccttgcctcggtacaaacagaggagatgtaccatggcaaggtctaacctggcggcagcgcaaaagatg

SEQ ID NO: 22068 - DNA, 103 bp, Artificial Sequence
  Synthetic Polynucleotide
taatacgactcactatagggtatatttccttcagtgaagaccttgcctcgaacagaggagacgaggcatggtcttcactaacctggcggcagcgcaaaagatg

SEQ ID NO: 22069 - DNA, 103 bp, Artificial Sequence
  Synthetic Polynucleotide
taatacgactcactataggggctgctatatttccttcagtgaagaccttgaacagaggagacaaggtatgcactgaaggaacctggcggcagcgcaaaagatg

SEQ ID NO: 22070 - DNA, 103 bp, Artificial Sequence
  Synthetic Polynucleotide
taatacgactcactatagggtcatagctgctatatttccttcagtgaagaaacagaggagatcttcaatgaaggaaataaacctggcggcagcgcaaaagatg

SEQ ID NO: 22071 - DNA, 103 bp, Artificial Sequence
  Synthetic Polynucleotide
taatacgactcactatagggaacaatcatagctgctatatttccttcagtaacagaggagaactgaaatgaatatagcaaacctggcggcagcgcaaaagatg

SEQ ID NO: 22072 - DNA, 103 bp, Artificial Sequence
  Synthetic Polynucleotide
taatacgactcactatagggttattaacaatcatagctgctatatttcctaacagaggagaaggaaaatgagcagctataacctggcggcagcgcaaaagatg

SEQ ID NO: 22073 - DNA, 103 bp, Artificial Sequence
  Synthetic Polynucleotide
taatacgactcactatagggctgtcttattaacaatcatagctgctatataacagaggagaatatagatgctatgattgaacctggcggcagcgcaaaagatg

SEQ ID NO: 22074 - DNA, 103 bp, Artificial Sequence
  Synthetic Polynucleotide
taatacgactcactataggggtgaactgtcttattaacaatcatagctgcaacagaggagagcagctatgattgttaataacctggcggcagcgcaaaagatg

SEQ ID NO: 22075 - DNA, 103 bp, Artificial Sequence
  Synthetic Polynucleotide
taatacgactcactatagggattctgtgaactgtcttattaacaatcataaacagaggagatatgatatgtaataagacaacctggcggcagcgcaaaagatg

SEQ ID NO: 22076 - DNA, 103 bp, Artificial Sequence
  Synthetic Polynucleotide
taatacgactcactataggggctagatcttaaaatcccaaagattactttaacagaggagaaaagtaatgtttgggattaacctggcggcagcgcaaaagatg

SEQ ID NO: 22077 - DNA, 103 bp, Artificial Sequence
  Synthetic Polynucleotide
taatacgactcactatagggaaatcattctgtgaactgtcttattaacaaaacagaggagattgttaatgagacagttcaacctggcggcagcgcaaaagatg

SEQ ID NO: 22078 - DNA, 103 bp, Artificial Sequence
  Synthetic Polynucleotide
taatacgactcactatagggagaaaaaatcattctgtgaactgtcttattaacagaggagaaataagatggttcacagaaacctggcggcagcgcaaaagatg

SEQ ID NO: 22079 - DNA, 103 bp, Artificial Sequence
  Synthetic Polynucleotide
taatacgactcactatagggtgcctagaaaaaatcattctgtgaactgtcaacagaggagagacagtatgcagaatgataacctggcggcagcgcaaaagatg

SEQ ID NO: 22080 - DNA, 103 bp, Artificial Sequence
  Synthetic Polynucleotide
taatacgactcactataggggtccttgcctagaaaaaatcattctgtgaaaacagaggagattcacaatgtgattttttaacctggcggcagcgcaaaagatg

SEQ ID NO: 22081 - DNA, 103 bp, Artificial Sequence
  Synthetic Polynucleotide
taatacgactcactatagggaccttgtccttgcctagaaaaaatcattctaacagaggagaagaatgatgttttctaggaacctggcggcagcgcaaaagatg

SEQ ID NO: 22082 - DNA, 103 bp, Artificial Sequence
  Synthetic Polynucleotide
taatacgactcactatagggcgataaccttgtccttgcctagaaaaaatcaacagaggagagattttatgtaggcaaggaacctggcggcagcgcaaaagatg

SEQ ID NO: 22083 - DNA, 103 bp, Artificial Sequence
  Synthetic Polynucleotide
taatacgactcactatagggtgtgacgataaccttgtccttgcctagaaaaacagaggagatttctaatgaaggacaagaacctggcggcagcgcaaaagatg

SEQ ID NO: 22084 - DNA, 103 bp, Artificial Sequence
  Synthetic Polynucleotide
taatacgactcactataggggttcatgtgacgataaccttgtccttgcctaacagaggagaaggcaaatgcaaggttataacctggcggcagcgcaaaagatg

SEQ ID NO: 22085 - DNA, 103 bp, Artificial Sequence
  Synthetic Polynucleotide
taatacgactcactataggggtcaagttcatgtgacgataaccttgtcctaacagaggagaaggacaatgttatcgtcaaacctggcggcagcgcaaaagatg

SEQ ID NO: 22086 - DNA, 103 bp, Artificial Sequence
  Synthetic Polynucleotide
taatacgactcactatagggtggaggtcaagttcatgtgacgataaccttaacagaggagaaaggttatggtcacatgaaacctggcggcagcgcaaaagatg

SEQ ID NO: 22087 - DNA, 103 bp, Artificial Sequence
  Synthetic Polynucleotide
taatacgactcactatagggttaacaaaatgactagtcttaatgtcaatgaacagaggagacattgaatgtaagactagaacctggcggcagcgcaaaagatg

SEQ ID NO: 22088 - DNA, 103 bp, Artificial Sequence
  Synthetic Polynucleotide
taatacgactcactatagggatgaagctagatcttaaaatcccaaagattaacagaggagaaatcttatggattttaagaacctggcggcagcgcaaaagatg

SEQ ID NO: 22089 - DNA, 103 bp, Artificial Sequence
  Synthetic Polynucleotide
taatacgactcactatagggattggtggaggtcaagttcatgtgacgataaacagaggagatatcgtatgatgaacttgaacctggcggcagcgcaaaagatg

SEQ ID NO: 22090 - DNA, 103 bp, Artificial Sequence
  Synthetic Polynucleotide
taatacgactcactatagggtatttattggtggaggtcaagttcatgtgaaacagaggagatcacatatgcttgacctcaacctggcggcagcgcaaaagatg

SEQ ID NO: 22091 - DNA, 103 bp, Artificial Sequence
  Synthetic Polynucleotide
taatacgactcactatagggtccaatatttattggtggaggtcaagttcaaacagaggagatgaactatgcctccaccaaacctggcggcagcgcaaaagatg

SEQ ID NO: 22092 - DNA, 103 bp, Artificial Sequence
  Synthetic Polynucleotide
taatacgactcactataggggcttgtccaatatttattggtggaggtcaaaacagaggagattgaccatgaccaataaaaacctggcggcagcgcaaaagatg

SEQ ID NO: 22093 - DNA, 103 bp, Artificial Sequence
  Synthetic Polynucleotide
taatacgactcactatagggttgctgcttgtccaatatttattggtggagaacagaggagactccacatgtaaatattgaacctggcggcagcgcaaaagatg

SEQ ID NO: 22094 - DNA, 103 bp, Artificial Sequence
  Synthetic Polynucleotide
taatacgactcactatagggtttcattgctgcttgtccaatatttattggaacagaggagaccaataatgattggacaaaacctggcggcagcgcaaaagatg

SEQ ID NO: 22095 - DNA, 103 bp, Artificial Sequence
  Synthetic Polynucleotide
taatacgactcactatagggctgcgtttcattgctgcttgtccaatatttaacagaggagaaaatatatgacaagcagcaacctggcggcagcgcaaaagatg

SEQ ID NO: 22096 - DNA, 103 bp, Artificial Sequence
  Synthetic Polynucleotide
taatacgactcactatagggtttctctgcgtttcattgctgcttgtccaaaacagaggagattggacatgcagcaatgaaacctggcggcagcgcaaaagatg

SEQ ID NO: 22097 - DNA, 103 bp, Artificial Sequence
  Synthetic Polynucleotide
taatacgactcactatagggtatcatttctctgcgtttcattgctgcttgaacagaggagacaagcaatgatgaaacgcaacctggcggcagcgcaaaagatg

SEQ ID NO: 22098 - DNA, 103 bp, Artificial Sequence
  Synthetic Polynucleotide
taatacgactcactatagggtcccgtatcatttctctgcgtttcattgctaacagaggagaagcaatatgacgcagagaaacctggcggcagcgcaaaagatg

SEQ ID NO: 22099 - DNA, 103 bp, Artificial Sequence
  Synthetic Polynucleotide
taatacgactcactatagggttaaaatgaagctagatcttaaaatcccaaaacagaggagattgggaatgtaagatctaaacctggcggcagcgcaaaagatg

SEQ ID NO: 22100 - DNA, 103 bp, Artificial Sequence
  Synthetic Polynucleotide
taatacgactcactatagggaaacatcccgtatcatttctctgcgtttcaaacagaggagatgaaacatggagaaatgaaacctggcggcagcgcaaaagatg

SEQ ID NO: 22101 - DNA, 103 bp, Artificial Sequence
  Synthetic Polynucleotide
taatacgactcactatagggtgccaaaacatcccgtatcatttctctgcgaacagaggagacgcagaatgatgatacggaacctggcggcagcgcaaaagatg

SEQ ID NO: 22102 - DNA, 103 bp, Artificial Sequence
  Synthetic Polynucleotide
taatacgactcactataggggaggatgccaaaacatcccgtatcatttctaacagaggagaagaaatatgacgggatgtaacctggcggcagcgcaaaagatg

SEQ ID NO: 22103 - DNA, 103 bp, Artificial Sequence
  Synthetic Polynucleotide
taatacgactcactatagggtcttggaggatgccaaaacatcccgtatcaaacagaggagatgatacatgatgttttggaacctggcggcagcgcaaaagatg

SEQ ID NO: 22104 - DNA, 103 bp, Artificial Sequence
  Synthetic Polynucleotide
taatacgactcactatagggtgtattcttggaggatgccaaaacatcccgaacagaggagacgggatatgttggcatccaacctggcggcagcgcaaaagatg

SEQ ID NO: 22105 - DNA, 103 bp, Artificial Sequence
  Synthetic Polynucleotide
taatacgactcactatagggggagttgtattcttggaggatgccaaaacaaacagaggagatgttttatgatcctccaaaacctggcggcagcgcaaaagatg

SEQ ID NO: 22106 - DNA, 103 bp, Artificial Sequence
  Synthetic Polynucleotide
taatacgactcactatagggtttgtggagttgtattcttggaggatgccaaacagaggagatggcatatgccaagaataaacctggcggcagcgcaaaagatg

SEQ ID NO: 22107 - DNA, 103 bp, Artificial Sequence
  Synthetic Polynucleotide
taatacgactcactataggggattgtttgtggagttgtattcttggaggaaacagaggagatcctccatgaatacaactaacctggcggcagcgcaaaagatg

SEQ ID NO: 22108 - DNA, 103 bp, Artificial Sequence
  Synthetic Polynucleotide
taatacgactcactatagggtgtttgattgtttgtggagttgtattcttgaacagaggagacaagaaatgaactccacaaacctggcggcagcgcaaaagatg

SEQ ID NO: 22109 - DNA, 103 bp, Artificial Sequence
  Synthetic Polynucleotide
taatacgactcactataggggggcatgtttgattgtttgtggagttgtataacagaggagaatacaaatgcacaaacaaaacctggcggcagcgcaaaagatg

SEQ ID NO: 22110 - DNA, 103 bp, Artificial Sequence
  Synthetic Polynucleotide
taatacgactcactatagggaaactttaaaatgaagctagatcttaaaataacagaggagaattttaatgtctagcttcaacctggcggcagcgcaaaagatg

SEQ ID NO: 22111 - DNA, 103 bp, Artificial Sequence
  Synthetic Polynucleotide
taatacgactcactatagggatggagggcatgtttgattgtttgtggagtaacagaggagaactccaatgacaatcaaaaacctggcggcagcgcaaaagatg

SEQ ID NO: 22112 - DNA, 103 bp, Artificial Sequence
  Synthetic Polynucleotide
taatacgactcactatagggaagagatggagggcatgtttgattgtttgtaacagaggagaacaaacatgcaaacatgcaacctggcggcagcgcaaaagatg

SEQ ID NO: 22113 - DNA, 103 bp, Artificial Sequence
  Synthetic Polynucleotide
taatacgactcactatagggggtttaagagatggagggcatgtttgattgaacagaggagacaatcaatgatgccctccaacctggcggcagcgcaaaagatg

SEQ ID NO: 22114 - DNA, 103 bp, Artificial Sequence
  Synthetic Polynucleotide
taatacgactcactatagggatggaggtttaagagatggagggcatgtttaacagaggagaaaacatatgctccatctcaacctggcggcagcgcaaaagatg

SEQ ID NO: 22115 - DNA, 103 bp, Artificial Sequence
  Synthetic Polynucleotide
taatacgactcactatagggcagggatggaggtttaagagatggagggcaaacagaggagatgccctatgtctcttaaaaacctggcggcagcgcaaaagatg

SEQ ID NO: 22116 - DNA, 103 bp, Artificial Sequence
  Synthetic Polynucleotide
taatacgactcactataggggtgggcagggatggaggtttaagagatggaaacagaggagatccatcatgtaaacctccaacctggcggcagcgcaaaagatg

SEQ ID NO: 22117 - DNA, 103 bp, Artificial Sequence
  Synthetic Polynucleotide
taatacgactcactatagggttactgtgggcagggatggaggtttaagagaacagaggagactcttaatgctccatcccaacctggcggcagcgcaaaagatg

SEQ ID NO: 22118 - DNA, 103 bp, Artificial Sequence
  Synthetic Polynucleotide
taatacgactcactatagggcggagttactgtgggcagggatggaggtttaacagaggagaaaacctatgtccctgcccaacctggcggcagcgcaaaagatg

SEQ ID NO: 22119 - DNA, 103 bp, Artificial Sequence
  Synthetic Polynucleotide
taatacgactcactatagggatgctcggagttactgtgggcagggatggaaacagaggagatccatcatggcccacagtaacctggcggcagcgcaaaagatg

SEQ ID NO: 22120 - DNA, 103 bp, Artificial Sequence
  Synthetic Polynucleotide
taatacgactcactatagggagtgaatgctcggagttactgtgggcagggaacagaggagaccctgcatgcagtaactcaacctggcggcagcgcaaaagatg

SEQ ID NO: 22121 - DNA, 103 bp, Artificial Sequence
  Synthetic Polynucleotide
taatacgactcactatagggaagacaaactttaaaatgaagctagatcttaacagaggagaaagatcatgcttcattttaacctggcggcagcgcaaaagatg

SEQ ID NO: 22122 - DNA, 103 bp, Artificial Sequence
  Synthetic Polynucleotide
taatacgactcactatagggtgtagagtgaatgctcggagttactgtgggaacagaggagacccacaatgactccgagcaacctggcggcagcgcaaaagatg

SEQ ID NO: 22123 - DNA, 103 bp, Artificial Sequence
  Synthetic Polynucleotide
taatacgactcactataggggtatttgtagagtgaatgctcggagttactaacagaggagaagtaacatggagcattcaaacctggcggcagcgcaaaagatg

SEQ ID NO: 22124 - DNA, 103 bp, Artificial Sequence
  Synthetic Polynucleotide
taatacgactcactatagggtttgagtatttgtagagtgaatgctcggagaacagaggagactccgaatgttcactctaaacctggcggcagcgcaaaagatg

SEQ ID NO: 22125 - DNA, 103 bp, Artificial Sequence
  Synthetic Polynucleotide
taatacgactcactatagggattaatttgagtatttgtagagtgaatgctaacagaggagaagcattatgtctacaaataacctggcggcagcgcaaaagatg

SEQ ID NO: 22126 - DNA, 103 bp, Artificial Sequence
  Synthetic Polynucleotide
taatacgactcactataggggcagtattaatttgagtatttgtagagtgaaacagaggagatcactcatgaaatactcaaacctggcggcagcgcaaaagatg

SEQ ID NO: 22127 - DNA, 103 bp, Artificial Sequence
  Synthetic Polynucleotide
taatacgactcactatagggatttagcagtattaatttgagtatttgtagaacagaggagactacaaatgctcaaattaaacctggcggcagcgcaaaagatg

SEQ ID NO: 22128 - DNA, 103 bp, Artificial Sequence
  Synthetic Polynucleotide
taatacgactcactatagggtccagatttagcagtattaatttgagtattaacagaggagaaatactatgattaatactaacctggcggcagcgcaaaagatg

SEQ ID NO: 22129 - DNA, 103 bp, Artificial Sequence
  Synthetic Polynucleotide
taatacgactcactatagggatagttccagatttagcagtattaatttgaaacagaggagatcaaatatgtactgctaaaacctggcggcagcgcaaaagatg

SEQ ID NO: 22130 - DNA, 103 bp, Artificial Sequence
  Synthetic Polynucleotide
taatacgactcactatagggggttcatagttccagatttagcagtattaaaacagaggagattaataatgctaaatctgaacctggcggcagcgcaaaagatg

SEQ ID NO: 22131 - DNA, 103 bp, Artificial Sequence
  Synthetic Polynucleotide
taatacgactcactatagggacttgggttcatagttccagatttagcagtaacagaggagaactgctatgtctggaactaacctggcggcagcgcaaaagatg

SEQ ID NO: 22132 - DNA, 103 bp, Artificial Sequence
  Synthetic Polynucleotide
taatacgactcactatagggggattaagacaaactttaaaatgaagctagaacagaggagactagctatgttttaaagtaacctggcggcagcgcaaaagatg

SEQ ID NO: 22133 - DNA, 103 bp, Artificial Sequence
  Synthetic Polynucleotide
taatacgactcactatagggtcgctacttgggttcatagttccagatttaaacagaggagataaatcatgaactatgaaaacctggcggcagcgcaaaagatg

SEQ ID NO: 22134 - DNA, 103 bp, Artificial Sequence
  Synthetic Polynucleotide
taatacgactcactatagggcatcgtcgctacttgggttcatagttccagaacagaggagactggaaatgtgaacccaaaacctggcggcagcgcaaaagatg

SEQ ID NO: 22135 - DNA, 103 bp, Artificial Sequence
  Synthetic Polynucleotide
taatacgactcactataggggtcctcatcgtcgctacttgggttcatagtaacagaggagaactatgatgccaagtagcaacctggcggcagcgcaaaagatg

SEQ ID NO: 22136 - DNA, 103 bp, Artificial Sequence
  Synthetic Polynucleotide
taatacgactcactatagggataaggtcctcatcgtcgctacttgggttcaacagaggagagaacccatgtagcgacgaaacctggcggcagcgcaaaagatg

SEQ ID NO: 22137 - DNA, 103 bp, Artificial Sequence
  Synthetic Polynucleotide
taatacgactcactatagggaaatcataaggtcctcatcgtcgctacttgaacagaggagacaagtaatgacgatgaggaacctggcggcagcgcaaaagatg

SEQ ID NO: 22138 - DNA, 103 bp, Artificial Sequence
  Synthetic Polynucleotide
taatacgactcactataggggccggaaatcataaggtcctcatcgtcgctaacagaggagaagcgacatggaggaccttaacctggcggcagcgcaaaagatg

SEQ ID NO: 22139 - DNA, 103 bp, Artificial Sequence
  Synthetic Polynucleotide
taatacgactcactatagggcctgagccggaaatcataaggtcctcatcgaacagaggagacgatgaatgccttatgataacctggcggcagcgcaaaagatg

SEQ ID NO: 22140 - DNA, 103 bp, Artificial Sequence
  Synthetic Polynucleotide
taatacgactcactatagggcagatcctgagccggaaatcataaggtcctaacagaggagaaggaccatgtgatttccgaacctggcggcagcgcaaaagatg

SEQ ID NO: 22141 - DNA, 103 bp, Artificial Sequence
  Synthetic Polynucleotide
taatacgactcactatagggttctccagatcctgagccggaaatcataagaacagaggagacttatgatgtccggctcaaacctggcggcagcgcaaaagatg

SEQ ID NO: 22142 - DNA, 103 bp, Artificial Sequence
  Synthetic Polynucleotide
taatacgactcactatagggccctgttctccagatcctgagccggaaatcaacagaggagagatttcatgctcaggatcaacctggcggcagcgcaaaagatg

SEQ ID NO: 22143 - DNA, 103 bp, Artificial Sequence
  Synthetic Polynucleotide
taatacgactcactatagggctgatggattaagacaaactttaaaatgaaaacagaggagattcattatgaagtttgtcaacctggcggcagcgcaaaagatg

SEQ ID NO: 22144 - DNA, 103 bp, Artificial Sequence
  Synthetic Polynucleotide
taatacgactcactatagggggggcccctgttctccagatcctgagccggaacagaggagaccggctatggatctggagaacctggcggcagcgcaaaagatg

SEQ ID NO: 22145 - DNA, 103 bp, Artificial Sequence
  Synthetic Polynucleotide
taatacgactcactatagggtgtgtggggcccctgttctccagatcctgaaacagaggagatcaggaatgggagaacagaacctggcggcagcgcaaaagatg

SEQ ID NO: 22146 - DNA, 103 bp, Artificial Sequence
  Synthetic Polynucleotide
taatacgactcactatagggagagttgtgtggggcccctgttctccagataacagaggagaatctggatgacaggggccaacctggcggcagcgcaaaagatg

SEQ ID NO: 22147 - DNA, 103 bp, Artificial Sequence
  Synthetic Polynucleotide
taatacgactcactatagggcattaagagttgtgtggggcccctgttctcaacagaggagagagaacatgggccccacaaacctggcggcagcgcaaaagatg

SEQ ID NO: 22148 - DNA, 103 bp, Artificial Sequence
  Synthetic Polynucleotide
taatacgactcactataggggactacattaagagttgtgtggggcccctgaacagaggagacaggggatgcacacaactaacctggcggcagcgcaaaagatg

SEQ ID NO: 22149 - DNA, 103 bp, Artificial Sequence
  Synthetic Polynucleotide
taatacgactcactatagggtcagtgactacattaagagttgtgtggggcaacagaggagagccccaatgaactcttaaaacctggcggcagcgcaaaagatg

SEQ ID NO: 22150 - DNA, 103 bp, Artificial Sequence
  Synthetic Polynucleotide
taatacgactcactatagggtctgttcagtgactacattaagagttgtgtaacagaggagaacacaaatgttaatgtagaacctggcggcagcgcaaaagatg

SEQ ID NO: 22151 - DNA, 103 bp, Artificial Sequence
  Synthetic Polynucleotide
taatacgactcactatagggttgtttctgttcagtgactacattaagagtaacagaggagaactcttatggtagtcactaacctggcggcagcgcaaaagatg

SEQ ID NO: 22152 - DNA, 103 bp, Artificial Sequence
  Synthetic Polynucleotide
taatacgactcactataggggacgattgtttctgttcagtgactacattaaacagaggagataatgtatgcactgaacaaacctggcggcagcgcaaaagatg

SEQ ID NO: 22153 - DNA, 103 bp, Artificial Sequence
  Synthetic Polynucleotide
taatacgactcactatagggttgttgacgattgtttctgttcagtgactaaacagaggagatagtcaatgaacagaaacaacctggcggcagcgcaaaagatg

SEQ ID NO: 22154 - DNA, 103 bp, Artificial Sequence
  Synthetic Polynucleotide
taatacgactcactatagggactccctgatggattaagacaaactttaaaaacagaggagatttaaaatgtgtcttaataacctggcggcagcgcaaaagatg

SEQ ID NO: 22155 - DNA, 103 bp, Artificial Sequence
  Synthetic Polynucleotide
taatacgactcactatagggcaatattgttgacgattgtttctgttcagtaacagaggagaactgaaatgaaacaatcgaacctggcggcagcgcaaaagatg

SEQ ID NO: 22156 - DNA, 103 bp, Artificial Sequence
  Synthetic Polynucleotide
taatacgactcactataggggtggacaatattgttgacgattgtttctgtaacagaggagaacagaaatgatcgtcaacaacctggcggcagcgcaaaagatg

SEQ ID NO: 22157 - DNA, 103 bp, Artificial Sequence
  Synthetic Polynucleotide
taatacgactcactatagggaaggagtggacaatattgttgacgattgttaacagaggagaaacaatatgcaacaatataacctggcggcagcgcaaaagatg

SEQ ID NO: 22158 - DNA, 103 bp, Artificial Sequence
  Synthetic Polynucleotide
taatacgactcactatagggtagtgaaggagtggacaatattgttgacgaaacagaggagatcgtcaatgatattgtccaacctggcggcagcgcaaaagatg

SEQ ID NO: 22159 - DNA, 103 bp, Artificial Sequence
  Synthetic Polynucleotide
taatacgactcactatagggggatgtagtgaaggagtggacaatattgttaacagaggagaaacaatatggtccactccaacctggcggcagcgcaaaagatg

SEQ ID NO: 22160 - DNA, 103 bp, Artificial Sequence
  Synthetic Polynucleotide
taatacgactcactatagggtgcttggatgtagtgaaggagtggacaataaacagaggagatattgtatgctccttcacaacctggcggcagcgcaaaagatg

SEQ ID NO: 22161 - DNA, 103 bp, Artificial Sequence
  Synthetic Polynucleotide
taatacgactcactatagggtgaggtgcttggatgtagtgaaggagtggaaacagaggagatccactatgtcactacataacctggcggcagcgcaaaagatg

SEQ ID NO: 22162 - DNA, 103 bp, Artificial Sequence
  Synthetic Polynucleotide
taatacgactcactatagggtgttgtgaggtgcttggatgtagtgaaggaaacagaggagatccttcatgacatccaagaacctggcggcagcgcaaaagatg

SEQ ID NO: 22163 - DNA, 103 bp, Artificial Sequence
  Synthetic Polynucleotide
taatacgactcactataggggctcatgttgtgaggtgcttggatgtagtgaacagaggagacactacatgcaagcacctaacctggcggcagcgcaaaagatg

SEQ ID NO: 22164 - DNA, 103 bp, Artificial Sequence
  Synthetic Polynucleotide
taatacgactcactataggggttttgctcatgttgtgaggtgcttggatgaacagaggagacatccaatgacctcacaaaacctggcggcagcgcaaaagatg

SEQ ID NO: 22165 - DNA, 103 bp, Artificial Sequence
  Synthetic Polynucleotide
taatacgactcactatagggagtttactccctgatggattaagacaaactaacagaggagaagtttgatgtaatccatcaacctggcggcagcgcaaaagatg

SEQ ID NO: 22166 - DNA, 103 bp, Artificial Sequence
  Synthetic Polynucleotide
taatacgactcactataggggtactgttttgctcatgttgtgaggtgcttaacagaggagaaagcacatgacaacatgaaacctggcggcagcgcaaaagatg

SEQ ID NO: 22167 - DNA, 103 bp, Artificial Sequence
  Synthetic Polynucleotide
taatacgactcactataggggattcgtactgttttgctcatgttgtgaggaacagaggagacctcacatgatgagcaaaaacctggcggcagcgcaaaagatg

SEQ ID NO: 22168 - DNA, 103 bp, Artificial Sequence
  Synthetic Polynucleotide
taatacgactcactatagggggaaggattcgtactgttttgctcatgttgaacagaggagacaacatatgcaaaacagtaacctggcggcagcgcaaaagatg

SEQ ID NO: 22169 - DNA, 103 bp, Artificial Sequence
  Synthetic Polynucleotide
taatacgactcactatagggtgtcgggaaggattcgtactgttttgctcaaacagaggagatgagcaatgcagtacgaaaacctggcggcagcgcaaaagatg

SEQ ID NO: 22170 - DNA, 103 bp, Artificial Sequence
  Synthetic Polynucleotide
taatacgactcactatagggcagcatgtcgggaaggattcgtactgttttaacagaggagaaaaacaatgcgaatccttaacctggcggcagcgcaaaagatg

SEQ ID NO: 22171 - DNA, 103 bp, Artificial Sequence
  Synthetic Polynucleotide
taatacgactcactatagggagttacagcatgtcgggaaggattcgtactaacagaggagaagtacgatgccttcccgaaacctggcggcagcgcaaaagatg

SEQ ID NO: 22172 - DNA, 103 bp, Artificial Sequence
  Synthetic Polynucleotide
taatacgactcactatagggtgctcagttacagcatgtcgggaaggattcaacagaggagagaatccatgccgacatgcaacctggcggcagcgcaaaagatg

SEQ ID NO: 22173 - DNA, 103 bp, Artificial Sequence
  Synthetic Polynucleotide
taatacgactcactatagggcattgtgctcagttacagcatgtcgggaagaacagaggagacttcccatgatgctgtaaaacctggcggcagcgcaaaagatg

SEQ ID NO: 22174 - DNA, 103 bp, Artificial Sequence
  Synthetic Polynucleotide
taatacgactcactatagggggttccattgtgctcagttacagcatgtcgaacagaggagacgacatatggtaactgagaacctggcggcagcgcaaaagatg

SEQ ID NO: 22175 - DNA, 103 bp, Artificial Sequence
  Synthetic Polynucleotide
taatacgactcactataggggggtcggttccattgtgctcagttacagcaaacagaggagatgctgtatgtgagcacaaaacctggcggcagcgcaaaagatg

SEQ ID NO: 22176 - DNA, 103 bp, Artificial Sequence
  Synthetic Polynucleotide
taatacgactcactatagggcaccaagtttactccctgatggattaagacaacagaggagagtcttaatgcatcagggaaacctggcggcagcgcaaaagatg

SEQ ID NO: 22177 - DNA, 103 bp, Artificial Sequence
  Synthetic Polynucleotide
taatacgactcactatagggttgttgggtcggttccattgtgctcagttaaacagaggagataactgatgacaatggaaaacctggcggcagcgcaaaagatg

SEQ ID NO: 22178 - DNA, 103 bp, Artificial Sequence
  Synthetic Polynucleotide
taatacgactcactatagggttgtgttgttgggtcggttccattgtgctcaacagaggagagagcacatgggaaccgacaacctggcggcagcgcaaaagatg

SEQ ID NO: 22179 - DNA, 103 bp, Artificial Sequence
  Synthetic Polynucleotide
taatacgactcactataggggctggttgtgttgttgggtcggttccattgaacagaggagacaatggatgcgacccaacaacctggcggcagcgcaaaagatg

SEQ ID NO: 22180 - DNA, 103 bp, Artificial Sequence
  Synthetic Polynucleotide
taatacgactcactataggggcgttgctggttgtgttgttgggtcggttcaacagaggagagaaccgatgcaacaacacaacctggcggcagcgcaaaagatg

SEQ ID NO: 22181 - DNA, 103 bp, Artificial Sequence
  Synthetic Polynucleotide
taatacgactcactataggggaggagcgttgctggttgtgttgttgggtcaacagaggagagacccaatgacacaaccaaacctggcggcagcgcaaaagatg

SEQ ID NO: 22182 - DNA, 103 bp, Artificial Sequence
  Synthetic Polynucleotide
taatacgactcactatagggttgttgaggagcgttgctggttgtgttgttaacagaggagaaacaacatgaccagcaacaacctggcggcagcgcaaaagatg

SEQ ID NO: 22183 - DNA, 103 bp, Artificial Sequence
  Synthetic Polynucleotide
taatacgactcactatagggtagtattgttgaggagcgttgctggttgtgaacagaggagacacaacatgcaacgctccaacctggcggcagcgcaaaagatg

SEQ ID NO: 22184 - DNA, 103 bp, Artificial Sequence
  Synthetic Polynucleotide
taatacgactcactatagggtgtattagtattgttgaggagcgttgctggaacagaggagaccagcaatgctcctcaacaacctggcggcagcgcaaaagatg

SEQ ID NO: 22185 - DNA, 103 bp, Artificial Sequence
  Synthetic Polynucleotide
taatacgactcactatagggggagttgtattagtattgttgaggagcgttaacagaggagaaacgctatgcaacaatacaacctggcggcagcgcaaaagatg

SEQ ID NO: 22186 - DNA, 103 bp, Artificial Sequence
  Synthetic Polynucleotide
taatacgactcactatagggaggtgggagttgtattagtattgttgaggaaacagaggagatcctcaatgatactaataaacctggcggcagcgcaaaagatg

SEQ ID NO: 22187 - DNA, 103 bp, Artificial Sequence
  Synthetic Polynucleotide
taatacgactcactatagggcctgtcaccaagtttactccctgatggattaacagaggagaaatccaatggggagtaaaaacctggcggcagcgcaaaagatg

SEQ ID NO: 22188 - DNA, 103 bp, Artificial Sequence
  Synthetic Polynucleotide
taatacgactcactataggggttataggtgggagttgtattagtattgttaacagaggagaaacaatatgaatacaactaacctggcggcagcgcaaaagatg

SEQ ID NO: 22189 - DNA, 103 bp, Artificial Sequence
  Synthetic Polynucleotide
taatacgactcactatagggagagtgttataggtgggagttgtattagtaaacagaggagatactaaatgaactcccacaacctggcggcagcgcaaaagatg

SEQ ID NO: 22190 - DNA, 103 bp, Artificial Sequence
  Synthetic Polynucleotide
taatacgactcactatagggacttgagagtgttataggtgggagttgtataacagaggagaatacaaatgccacctataaacctggcggcagcgcaaaagatg

SEQ ID NO: 22191 - DNA, 103 bp, Artificial Sequence
  Synthetic Polynucleotide
taatacgactcactataggggttgtacttgagagtgttataggtgggagtaacagaggagaactcccatgtataacactaacctggcggcagcgcaaaagatg

SEQ ID NO: 22192 - DNA, 103 bp, Artificial Sequence
  Synthetic Polynucleotide
taatacgactcactatagggctgaggttgtacttgagagtgttataggtgaacagaggagacacctaatgcactctcaaaacctggcggcagcgcaaaagatg

SEQ ID NO: 22193 - DNA, 103 bp, Artificial Sequence
  Synthetic Polynucleotide
taatacgactcactataggggagtactgaggttgtacttgagagtgttataacagaggagaataacaatgtcaagtacaaacctggcggcagcgcaaaagatg

SEQ ID NO: 22194 - DNA, 103 bp, Artificial Sequence
  Synthetic Polynucleotide
taatacgactcactatagggggaaggagtactgaggttgtacttgagagtaacagaggagaactctcatgtacaacctcaacctggcggcagcgcaaaagatg

SEQ ID NO: 22195 - DNA, 103 bp, Artificial Sequence
  Synthetic Polynucleotide
taatacgactcactatagggggaggggaaggagtactgaggttgtacttgaacagaggagacaagtaatgcctcagtacaacctggcggcagcgcaaaagatg

SEQ ID NO: 22196 - DNA, 103 bp, Artificial Sequence
  Synthetic Polynucleotide
taatacgactcactataggggggttggaggggaaggagtactgaggttgtaacagaggagaacaaccatggtactccttaacctggcggcagcgcaaaagatg

SEQ ID NO: 22197 - DNA, 103 bp, Artificial Sequence
  Synthetic Polynucleotide
taatacgactcactataggggttgcgggttggaggggaaggagtactgagaacagaggagactcagtatgccttcccctaacctggcggcagcgcaaaagatg

SEQ ID NO: 22198 - DNA, 103 bp, Artificial Sequence
  Synthetic Polynucleotide
taatacgactcactataggggaatattaacaaaatgactagtcttaatgtaacagaggagaacattaatgctagtcattaacctggcggcagcgcaaaagatg

SEQ ID NO: 22199 - DNA, 103 bp, Artificial Sequence
  Synthetic Polynucleotide
taatacgactcactatagggcatgacctgtcaccaagtttactccctgataacagaggagaatcaggatgtaaacttggaacctggcggcagcgcaaaagatg

SEQ ID NO: 22200 - DNA, 103 bp, Artificial Sequence
  Synthetic Polynucleotide
taatacgactcactataggggtgatgttgcgggttggaggggaaggagtaaacagaggagatactccatgccctccaacaacctggcggcagcgcaaaagatg

SEQ ID NO: 22201 - DNA, 103 bp, Artificial Sequence
  Synthetic Polynucleotide
taatacgactcactatagggtattggtgatgttgcgggttggaggggaagaacagaggagacttcccatgcaacccgcaaacctggcggcagcgcaaaagatg

SEQ ID NO: 22202 - DNA, 103 bp, Artificial Sequence
  Synthetic Polynucleotide
taatacgactcactatagggatcattattggtgatgttgcgggttggaggaacagaggagacctccaatgcgcaacatcaacctggcggcagcgcaaaagatg

SEQ ID NO: 22203 - DNA, 103 bp, Artificial Sequence
  Synthetic Polynucleotide
taatacgactcactatagggtgtgtatcattattggtgatgttgcgggttaacagaggagaaacccgatgcatcaccaaaacctggcggcagcgcaaaagatg

SEQ ID NO: 22204 - DNA, 103 bp, Artificial Sequence
  Synthetic Polynucleotide
taatacgactcactatagggcacgttgtgtatcattattggtgatgttgcaacagaggagagcaacaatgccaataatgaacctggcggcagcgcaaaagatg

SEQ ID NO: 22205 - DNA, 103 bp, Artificial Sequence
  Synthetic Polynucleotide
taatacgactcactatagggtagttcacgttgtgtatcattattggtgataacagaggagaatcaccatgaatgatacaaacctggcggcagcgcaaaagatg

SEQ ID NO: 22206 - DNA, 103 bp, Artificial Sequence
  Synthetic Polynucleotide
taatacgactcactatagggtctgctagttcacgttgtgtatcattattgaacagaggagacaataaatgtacacaacgaacctggcggcagcgcaaaagatg

SEQ ID NO: 22207 - DNA, 103 bp, Artificial Sequence
  Synthetic Polynucleotide
taatacgactcactatagggcgctttctgctagttcacgttgtgtatcataacagaggagaatgataatgaacgtgaacaacctggcggcagcgcaaaagatg

SEQ ID NO: 22208 - DNA, 103 bp, Artificial Sequence
  Synthetic Polynucleotide
taatacgactcactatagggttgttcgctttctgctagttcacgttgtgtaacagaggagaacacaaatggaactagcaaacctggcggcagcgcaaaagatg

SEQ ID NO: 22209 - DNA, 103 bp, Artificial Sequence
  Synthetic Polynucleotide
taatacgactcactatagggttggtttgttcgctttctgctagttcacgtaacagaggagaacgtgaatgagcagaaagaacctggcggcagcgcaaaagatg

SEQ ID NO: 22210 - DNA, 103 bp, Artificial Sequence
  Synthetic Polynucleotide
taatacgactcactatagggggcatcatgacctgtcaccaagtttactccaacagaggagaggagtaatgttggtgacaaacctggcggcagcgcaaaagatg

SEQ ID NO: 22211 - DNA, 103 bp, Artificial Sequence
  Synthetic Polynucleotide
taatacgactcactataggggagcattggtttgttcgctttctgctagttaacagaggagaaactagatgaaagcgaacaacctggcggcagcgcaaaagatg

SEQ ID NO: 22212 - DNA, 103 bp, Artificial Sequence
  Synthetic Polynucleotide
taatacgactcactatagggcaactgagcattggtttgttcgctttctgcaacagaggagagcagaaatggaacaaaccaacctggcggcagcgcaaaagatg

SEQ ID NO: 22213 - DNA, 103 bp, Artificial Sequence
  Synthetic Polynucleotide
taatacgactcactataggggtgttcaactgagcattggtttgttcgcttaacagaggagaaagcgaatgaaccaatgcaacctggcggcagcgcaaaagatg

SEQ ID NO: 22214 - DNA, 103 bp, Artificial Sequence
  Synthetic Polynucleotide
taatacgactcactataggggagttgtgttcaactgagcattggtttgttaacagaggagaaacaaaatgatgctcagtaacctggcggcagcgcaaaagatg

SEQ ID NO: 22215 - DNA, 103 bp, Artificial Sequence
  Synthetic Polynucleotide
taatacgactcactatagggatctagagttgtgttcaactgagcattggtaacagaggagaaccaatatgcagttgaacaacctggcggcagcgcaaaagatg

SEQ ID NO: 22216 - DNA, 103 bp, Artificial Sequence
  Synthetic Polynucleotide
taatacgactcactataggggttggatctagagttgtgttcaactgagcaaacagaggagatgctcaatggaacacaacaacctggcggcagcgcaaaagatg

SEQ ID NO: 22217 - DNA, 103 bp, Artificial Sequence
  Synthetic Polynucleotide
taatacgactcactatagggtttctgttggatctagagttgtgttcaactaacagaggagaagttgaatgcaactctagaacctggcggcagcgcaaaagatg

SEQ ID NO: 22218 - DNA, 103 bp, Artificial Sequence
  Synthetic Polynucleotide
taatacgactcactataggggggattttctgttggatctagagttgtgttaacagaggagaaacacaatgctagatccaaacctggcggcagcgcaaaagatg

SEQ ID NO: 22219 - DNA, 103 bp, Artificial Sequence
  Synthetic Polynucleotide
taatacgactcactataggggtggtgggattttctgttggatctagagttaacagaggagaaactctatgtccaacagaaacctggcggcagcgcaaaagatg

SEQ ID NO: 22220 - DNA, 103 bp, Artificial Sequence
  Synthetic Polynucleotide
taatacgactcactataggggtcctgtggtgggattttctgttggatctaaacagaggagatagatcatgcagaaaatcaacctggcggcagcgcaaaagatg

SEQ ID NO: 22221 - DNA, 103 bp, Artificial Sequence
  Synthetic Polynucleotide
taatacgactcactatagggtcataggcatcatgacctgtcaccaagtttaacagaggagaaaacttatggacaggtcaaacctggcggcagcgcaaaagatg

SEQ ID NO: 22222 - DNA, 103 bp, Artificial Sequence
  Synthetic Polynucleotide
taatacgactcactataggggtcttgtcctgtggtgggattttctgttggaacagaggagaccaacaatgaatcccaccaacctggcggcagcgcaaaagatg

SEQ ID NO: 22223 - DNA, 103 bp, Artificial Sequence
  Synthetic Polynucleotide
taatacgactcactatagggttggtgtcttgtcctgtggtgggattttctaacagaggagaagaaaaatgcaccacaggaacctggcggcagcgcaaaagatg

SEQ ID NO: 22224 - DNA, 103 bp, Artificial Sequence
  Synthetic Polynucleotide
taatacgactcactatagggtgctgttggtgtcttgtcctgtggtgggataacagaggagaatcccaatgcaggacaagaacctggcggcagcgcaaaagatg

SEQ ID NO: 22225 - DNA, 103 bp, Artificial Sequence
  Synthetic Polynucleotide
taatacgactcactatagggggttgtgctgttggtgtcttgtcctgtggtaacagaggagaaccacaatgcaagacaccaacctggcggcagcgcaaaagatg

SEQ ID NO: 22226 - DNA, 103 bp, Artificial Sequence
  Synthetic Polynucleotide
taatacgactcactatagggatgttggttgtgctgttggtgtcttgtcctaacagaggagaaggacaatgcaccaacagaacctggcggcagcgcaaaagatg

SEQ ID NO: 22227 - DNA, 103 bp, Artificial Sequence
  Synthetic Polynucleotide
taatacgactcactatagggtgatgatgttggttgtgctgttggtgtcttaacagaggagaaagacaatgacagcacaaaacctggcggcagcgcaaaagatg

SEQ ID NO: 22228 - DNA, 103 bp, Artificial Sequence
  Synthetic Polynucleotide
taatacgactcactatagggcgtcatgatgatgttggttgtgctgttggtaacagaggagaaccaacatgacaaccaacaacctggcggcagcgcaaaagatg

SEQ ID NO: 22229 - DNA, 103 bp, Artificial Sequence
  Synthetic Polynucleotide
taatacgactcactataggggatgtcgtcatgatgatgttggttgtgctgaacagaggagacagcacatgcaacatcataacctggcggcagcgcaaaagatg

SEQ ID NO: 22230 - DNA, 103 bp, Artificial Sequence
  Synthetic Polynucleotide
taatacgactcactatagggtatctgatgtcgtcatgatgatgttggttgaacagaggagacaaccaatgtcatcatgaaacctggcggcagcgcaaaagatg

SEQ ID NO: 22231 - DNA, 103 bp, Artificial Sequence
  Synthetic Polynucleotide
taatacgactcactatagggtgttatatctgatgtcgtcatgatgatgttaacagaggagaaacatcatgatgacgacaaacctggcggcagcgcaaaagatg

SEQ ID NO: 22232 - DNA, 103 bp, Artificial Sequence
  Synthetic Polynucleotide
taatacgactcactatagggtactgtcataggcatcatgacctgtcaccaaacagaggagatggtgaatggtcatgatgaacctggcggcagcgcaaaagatg

SEQ ID NO: 22233 - DNA, 103 bp, Artificial Sequence
  Synthetic Polynucleotide
taatacgactcactatagggttgcttgttatatctgatgtcgtcatgatgaacagaggagacatcatatggacatcagaaacctggcggcagcgcaaaagatg

SEQ ID NO: 22234 - DNA, 103 bp, Artificial Sequence
  Synthetic Polynucleotide
taatacgactcactatagggggtgtttgcttgttatatctgatgtcgtcaaacagaggagatgacgaatgcagatataaaacctggcggcagcgcaaaagatg

SEQ ID NO: 22235 - DNA, 103 bp, Artificial Sequence
  Synthetic Polynucleotide
taatacgactcactatagggtgtggggtgtttgcttgttatatctgatgtaacagaggagaacatcaatgataacaagcaacctggcggcagcgcaaaagatg

SEQ ID NO: 22236 - DNA, 103 bp, Artificial Sequence
  Synthetic Polynucleotide
taatacgactcactataggggaatttgtggggtgtttgcttgttatatctaacagaggagaagatatatgaagcaaacaaacctggcggcagcgcaaaagatg

SEQ ID NO: 22237 - DNA, 103 bp, Artificial Sequence
  Synthetic Polynucleotide
taatacgactcactataggggagaagaatttgtggggtgtttgcttgttaaacagaggagataacaaatgaacaccccaaacctggcggcagcgcaaaagatg

SEQ ID NO: 22238 - DNA, 103 bp, Artificial Sequence
  Synthetic Polynucleotide
taatacgactcactatagggatccggagaagaatttgtggggtgtttgctaacagaggagaagcaaaatgcccacaaataacctggcggcagcgcaaaagatg

SEQ ID NO: 22239 - DNA, 103 bp, Artificial Sequence
  Synthetic Polynucleotide
taatacgactcactatagggctagaatccggagaagaatttgtggggtgtaacagaggagaacacccatgaaattcttcaacctggcggcagcgcaaaagatg

SEQ ID NO: 22240 - DNA, 103 bp, Artificial Sequence
  Synthetic Polynucleotide
taatacgactcactatagggtcggactagaatccggagaagaatttgtggaacagaggagaccacaaatgcttctccggaacctggcggcagcgcaaaagatg

SEQ ID NO: 22241 - DNA, 103 bp, Artificial Sequence
  Synthetic Polynucleotide
taatacgactcactatagggggttgtcggactagaatccggagaagaattaacagaggagaaattctatgccggattctaacctggcggcagcgcaaaagatg

SEQ ID NO: 22242 - DNA, 103 bp, Artificial Sequence
  Synthetic Polynucleotide
taatacgactcactataggggggcgggttgtcggactagaatccggagaaaacagaggagattctccatgttctagtccaacctggcggcagcgcaaaagatg

SEQ ID NO: 22243 - DNA, 103 bp, Artificial Sequence
  Synthetic Polynucleotide
taatacgactcactataggggatgatactgtcataggcatcatgacctgtaacagaggagaacaggtatggatgcctataacctggcggcagcgcaaaagatg

SEQ ID NO: 22244 - DNA, 103 bp, Artificial Sequence
  Synthetic Polynucleotide
taatacgactcactatagggtaggagggcgggttgtcggactagaatccgaacagaggagacggattatggtccgacaaaacctggcggcagcgcaaaagatg

SEQ ID NO: 22245 - DNA, 103 bp, Artificial Sequence
  Synthetic Polynucleotide
taatacgactcactataggggtatataggagggcgggttgtcggactagaaacagaggagatctagtatgacaacccgcaacctggcggcagcgcaaaagatg

SEQ ID NO: 22246 - DNA, 103 bp, Artificial Sequence
  Synthetic Polynucleotide
taatacgactcactatagggctaaagtatataggagggcgggttgtcggaaacagaggagatccgacatgccgccctccaacctggcggcagcgcaaaagatg

SEQ ID NO: 22247 - DNA, 103 bp, Artificial Sequence
  Synthetic Polynucleotide
taatacgactcactatagggtctttctaaagtatataggagggcgggttgaacagaggagacaacccatgctcctatataacctggcggcagcgcaaaagatg

SEQ ID NO: 22248 - DNA, 103 bp, Artificial Sequence
  Synthetic Polynucleotide
taatacgactcactatagggtcgtttctttctaaagtatataggagggcgaacagaggagacgccctatgatatactttaacctggcggcagcgcaaaagatg

SEQ ID NO: 22249 - DNA, 103 bp, Artificial Sequence
  Synthetic Polynucleotide
taatacgactcactatagggatgcttcgtttctttctaaagtatataggaaacagaggagatcctatatgctttagaaaaacctggcggcagcgcaaaagatg

SEQ ID NO: 22250 - DNA, 103 bp, Artificial Sequence
  Synthetic Polynucleotide
taatacgactcactatagggagaaaatgcttcgtttctttctaaagtataaacagaggagatatactatggaaagaaacaacctggcggcagcgcaaaagatg

SEQ ID NO: 22251 - DNA, 103 bp, Artificial Sequence
  Synthetic Polynucleotide
taatacgactcactatagggtttccagaaaatgcttcgtttctttctaaaaacagaggagatttagaatgaaacgaagcaacctggcggcagcgcaaaagatg

SEQ ID NO: 22252 - DNA, 103 bp, Artificial Sequence
  Synthetic Polynucleotide
taatacgactcactatagggccttctttccagaaaatgcttcgtttctttaacagaggagaaaagaaatgaagcattttaacctggcggcagcgcaaaagatg

SEQ ID NO: 22253 - DNA, 103 bp, Artificial Sequence
  Synthetic Polynucleotide
taatacgactcactatagggtatcaccttctttccagaaaatgcttcgttaacagaggagaaacgaaatgttttctggaaacctggcggcagcgcaaaagatg

SEQ ID NO: 22254 - DNA, 103 bp, Artificial Sequence
  Synthetic Polynucleotide
taatacgactcactatagggttactgatgatactgtcataggcatcatgaaacagaggagatcatgaatgctatgacagaacctggcggcagcgcaaaagatg

SEQ ID NO: 22255 - DNA, 103 bp, Artificial Sequence
  Synthetic Polynucleotide
taatacgactcactataggggaatatatcaccttctttccagaaaatgctaacagaggagaagcattatgtggaaagaaaacctggcggcagcgcaaaagatg

SEQ ID NO: 22256 - DNA, 103 bp, Artificial Sequence
  Synthetic Polynucleotide
taatacgactcactatagggaacgggaatatatcaccttctttccagaaaaacagaggagatttctgatgagaaggtgaaacctggcggcagcgcaaaagatg

SEQ ID NO: 22257 - DNA, 103 bp, Artificial Sequence
  Synthetic Polynucleotide
taatacgactcactatagggctaaaaacgggaatatatcaccttctttccaacagaggagaggaaagatggtgatatataacctggcggcagcgcaaaagatg

SEQ ID NO: 22258 - DNA, 103 bp, Artificial Sequence
  Synthetic Polynucleotide
taatacgactcactatagggcccatctaaaaacgggaatatatcaccttcaacagaggagagaaggtatgatattcccgaacctggcggcagcgcaaaagatg

SEQ ID NO: 22259 - DNA, 103 bp, Artificial Sequence
  Synthetic Polynucleotide
taatacgactcactatagggattaacccatctaaaaacgggaatatatcaaacagaggagatgatatatgcccgtttttaacctggcggcagcgcaaaagatg

SEQ ID NO: 22260 - DNA, 103 bp, Artificial Sequence
  Synthetic Polynucleotide
taatacgactcactatagggtatttattaacccatctaaaaacgggaataaacagaggagatattccatgttttagatgaacctggcggcagcgcaaaagatg

SEQ ID NO: 22261 - DNA, 103 bp, Artificial Sequence
  Synthetic Polynucleotide
taatacgactcactatagggttcagtatttattaacccatctaaaaacggaacagaggagaccgtttatggatgggttaaacctggcggcagcgcaaaagatg

SEQ ID NO: 22262 - DNA, 103 bp, Artificial Sequence
  Synthetic Polynucleotide
taatacgactcactatagggtcaatttcagtatttattaacccatctaaaaacagaggagatttagaatggttaataaaaacctggcggcagcgcaaaagatg

SEQ ID NO: 22263 - DNA, 103 bp, Artificial Sequence
  Synthetic Polynucleotide
taatacgactcactatagggcaaaatcaatttcagtatttattaacccataacagaggagaatgggtatgtaaatactgaacctggcggcagcgcaaaagatg

SEQ ID NO: 22264 - DNA, 103 bp, Artificial Sequence
  Synthetic Polynucleotide
taatacgactcactatagggtggatcaaaatcaatttcagtatttattaaaacagaggagattaataatgactgaaattaacctggcggcagcgcaaaagatg

SEQ ID NO: 22265 - DNA, 103 bp, Artificial Sequence
  Synthetic Polynucleotide
taatacgactcactatagggctgaattactgatgatactgtcataggcataacagaggagaatgcctatgacagtatcaaacctggcggcagcgcaaaagatg

SEQ ID NO: 22266 - DNA, 103 bp, Artificial Sequence
  Synthetic Polynucleotide
taatacgactcactataggggggattggatcaaaatcaatttcagtatttaacagaggagaaaatacatgaattgatttaacctggcggcagcgcaaaagatg

SEQ ID NO: 22267 - DNA, 103 bp, Artificial Sequence
  Synthetic Polynucleotide
taatacgactcactatagggtgtttgggattggatcaaaatcaatttcagaacagaggagactgaaaatgattttgatcaacctggcggcagcgcaaaagatg

SEQ ID NO: 22268 - DNA, 103 bp, Artificial Sequence
  Synthetic Polynucleotide
taatacgactcactatagggttctgtgtttgggattggatcaaaatcaataacagaggagaattgatatggatccaatcaacctggcggcagcgcaaaagatg

SEQ ID NO: 22269 - DNA, 103 bp, Artificial Sequence
  Synthetic Polynucleotide
taatacgactcactatagggattgtttctgtgtttgggattggatcaaaaaacagaggagattttgaatgaatcccaaaaacctggcggcagcgcaaaagatg

SEQ ID NO: 22270 - DNA, 103 bp, Artificial Sequence
  Synthetic Polynucleotide
taatacgactcactatagggcaaagattgtttctgtgtttgggattggataacagaggagaatccaaatgcaaacacagaacctggcggcagcgcaaaagatg

SEQ ID NO: 22271 - DNA, 103 bp, Artificial Sequence
  Synthetic Polynucleotide
taatacgactcactatagggttcatcaaagattgtttctgtgtttgggataacagaggagaatcccaatgacagaaacaaacctggcggcagcgcaaaagatg

SEQ ID NO: 22272 - DNA, 103 bp, Artificial Sequence
  Synthetic Polynucleotide
taatacgactcactatagggggagattcatcaaagattgtttctgtgtttaacagaggagaaaacacatgaacaatcttaacctggcggcagcgcaaaagatg

SEQ ID NO: 22273 - DNA, 103 bp, Artificial Sequence
  Synthetic Polynucleotide
taatacgactcactatagggagctgggagattcatcaaagattgtttctgaacagaggagacagaaaatgtctttgatgaacctggcggcagcgcaaaagatg

SEQ ID NO: 22274 - DNA, 103 bp, Artificial Sequence
  Synthetic Polynucleotide
taatacgactcactatagggattaaagctgggagattcatcaaagattgtaacagaggagaacaatcatggatgaatctaacctggcggcagcgcaaaagatg

SEQ ID NO: 22275 - DNA, 103 bp, Artificial Sequence
  Synthetic Polynucleotide
taatacgactcactataggggaagtattaaagctgggagattcatcaaagaacagaggagactttgaatgatctcccagaacctggcggcagcgcaaaagatg

SEQ ID NO: 22276 - DNA, 103 bp, Artificial Sequence
  Synthetic Polynucleotide
taatacgactcactatagggtcctactgaattactgatgatactgtcataaacagaggagatatgacatgatcatcagtaacctggcggcagcgcaaaagatg

SEQ ID NO: 22277 - DNA, 103 bp, Artificial Sequence
  Synthetic Polynucleotide
taatacgactcactatagggtagttgaagtattaaagctgggagattcataacagaggagaatgaatatgccagctttaaacctggcggcagcgcaaaagatg

SEQ ID NO: 22278 - DNA, 103 bp, Artificial Sequence
  Synthetic Polynucleotide
taatacgactcactatagggctcattagttgaagtattaaagctgggagaaacagaggagatctcccatgtttaatactaacctggcggcagcgcaaaagatg

SEQ ID NO: 22279 - DNA, 103 bp, Artificial Sequence
  Synthetic Polynucleotide
taatacgactcactatagggtgttcctcattagttgaagtattaaagctgaacagaggagacagcttatgtacttcaacaacctggcggcagcgcaaaagatg

SEQ ID NO: 22280 - DNA, 103 bp, Artificial Sequence
  Synthetic Polynucleotide
taatacgactcactatagggtgtgttgttcctcattagttgaagtattaaaacagaggagattaataatgcaactaatgaacctggcggcagcgcaaaagatg

SEQ ID NO: 22281 - DNA, 103 bp, Artificial Sequence
  Synthetic Polynucleotide
taatacgactcactataggggggagtgtgttgttcctcattagttgaagtaacagaggagaacttcaatgaatgaggaaaacctggcggcagcgcaaaagatg

SEQ ID NO: 22282 - DNA, 103 bp, Artificial Sequence
  Synthetic Polynucleotide
taatacgactcactatagggttcgggggagtgtgttgttcctcattagttaacagaggagaaactaaatgggaacaacaaacctggcggcagcgcaaaagatg

SEQ ID NO: 22283 - DNA, 103 bp, Artificial Sequence
  Synthetic Polynucleotide
taatacgactcactatagggtgatattcgggggagtgtgttgttcctcataacagaggagaatgaggatgaacacactcaacctggcggcagcgcaaaagatg

SEQ ID NO: 22284 - DNA, 103 bp, Artificial Sequence
  Synthetic Polynucleotide
taatacgactcactatagggtaaactgatattcgggggagtgtgttgttcaacagaggagagaacaaatgactcccccgaacctggcggcagcgcaaaagatg

SEQ ID NO: 22285 - DNA, 103 bp, Artificial Sequence
  Synthetic Polynucleotide
taatacgactcactatagggaaagttaaactgatattcgggggagtgtgtaacagaggagaacacacatgcccgaatataacctggcggcagcgcaaaagatg

SEQ ID NO: 22286 - DNA, 103 bp, Artificial Sequence
  Synthetic Polynucleotide
taatacgactcactatagggaagagaaagttaaactgatattcgggggagaacagaggagactccccatgatatcagttaacctggcggcagcgcaaaagatg

SEQ ID NO: 22287 - DNA, 103 bp, Artificial Sequence
  Synthetic Polynucleotide
taatacgactcactataggggtttgtcctactgaattactgatgatactgaacagaggagacagtatatgcagtaattcaacctggcggcagcgcaaaagatg

SEQ ID NO: 22288 - DNA, 103 bp, Artificial Sequence
  Synthetic Polynucleotide
taatacgactcactatagggaaaataagagaaagttaaactgatattcggaacagaggagaccgaatatgagtttaactaacctggcggcagcgcaaaagatg

SEQ ID NO: 22289 - DNA, 103 bp, Artificial Sequence
  Synthetic Polynucleotide
taatacgactcactatagggtcaggaaaataagagaaagttaaactgataaacagaggagatatcagatgaactttctcaacctggcggcagcgcaaaagatg

SEQ ID NO: 22290 - DNA, 103 bp, Artificial Sequence
  Synthetic Polynucleotide
taatacgactcactatagggttttatcaggaaaataagagaaagttaaacaacagaggagagtttaaatgtctcttattaacctggcggcagcgcaaaagatg

SEQ ID NO: 22291 - DNA, 103 bp, Artificial Sequence
  Synthetic Polynucleotide
taatacgactcactatagggtccatttttatcaggaaaataagagaaagtaacagaggagaactttcatgtattttcctaacctggcggcagcgcaaaagatg

SEQ ID NO: 22292 - DNA, 103 bp, Artificial Sequence
  Synthetic Polynucleotide
taatacgactcactataggggtatctccatttttatcaggaaaataagagaacagaggagactcttaatgtcctgataaaacctggcggcagcgcaaaagatg

SEQ ID NO: 22293 - DNA, 103 bp, Artificial Sequence
  Synthetic Polynucleotide
taatacgactcactatagggaggcagtatctccatttttatcaggaaaataacagaggagaattttcatgataaaaatgaacctggcggcagcgcaaaagatg

SEQ ID NO: 22294 - DNA, 103 bp, Artificial Sequence
  Synthetic Polynucleotide
taatacgactcactatagggagagtaggcagtatctccatttttatcaggaacagaggagacctgatatgaatggagataacctggcggcagcgcaaaagatg

SEQ ID NO: 22295 - DNA, 103 bp, Artificial Sequence
  Synthetic Polynucleotide
taatacgactcactatagggtccccagagtaggcagtatctccatttttaaacagaggagataaaaaatgagatactgcaacctggcggcagcgcaaaagatg

SEQ ID NO: 22296 - DNA, 103 bp, Artificial Sequence
  Synthetic Polynucleotide
taatacgactcactatagggcgttttccccagagtaggcagtatctccataacagaggagaatggagatgctgcctactaacctggcggcagcgcaaaagatg

SEQ ID NO: 22297 - DNA, 103 bp, Artificial Sequence
  Synthetic Polynucleotide
taatacgactcactatagggattctcgttttccccagagtaggcagtatcaacagaggagagatactatgtactctgggaacctggcggcagcgcaaaagatg

SEQ ID NO: 22298 - DNA, 103 bp, Artificial Sequence
  Synthetic Polynucleotide
taatacgactcactatagggatctagtttgtcctactgaattactgatgaaacagaggagatcatcaatgattcagtagaacctggcggcagcgcaaaagatg

SEQ ID NO: 22299 - DNA, 103 bp, Artificial Sequence
  Synthetic Polynucleotide
taatacgactcactatagggcaatcattctcgttttccccagagtaggcaaacagaggagatgcctaatgtggggaaaaaacctggcggcagcgcaaaagatg

SEQ ID NO: 22300 - DNA, 103 bp, Artificial Sequence
  Synthetic Polynucleotide
taatacgactcactatagggcatcacaatcattctcgttttccccagagtaacagaggagaactctgatgaaaacgagaaacctggcggcagcgcaaaagatg

SEQ ID NO: 22301 - DNA, 103 bp, Artificial Sequence
  Synthetic Polynucleotide
taatacgactcactatagggctctgcatcacaatcattctcgttttccccaacagaggagaggggaaatggagaatgataacctggcggcagcgcaaaagatg

SEQ ID NO: 22302 - DNA, 103 bp, Artificial Sequence
  Synthetic Polynucleotide
taatacgactcactatagggctcaactctgcatcacaatcattctcgtttaacagaggagaaaacgaatgtgattgtgaaacctggcggcagcgcaaaagatg

SEQ ID NO: 22303 - DNA, 103 bp, Artificial Sequence
  Synthetic Polynucleotide
taatacgactcactatagggaaatcctcaactctgcatcacaatcattctaacagaggagaagaatgatggtgatgcagaacctggcggcagcgcaaaagatg

SEQ ID NO: 22304 - DNA, 103 bp, Artificial Sequence
  Synthetic Polynucleotide
taatacgactcactatagggactccaaatcctcaactctgcatcacaatcaacagaggagagattgtatggcagagttgaacctggcggcagcgcaaaagatg

SEQ ID NO: 22305 - DNA, 103 bp, Artificial Sequence
  Synthetic Polynucleotide
taatacgactcactatagggtgcacactccaaatcctcaactctgcatcaaacagaggagatgatgcatggttgaggataacctggcggcagcgcaaaagatg

SEQ ID NO: 22306 - DNA, 103 bp, Artificial Sequence
  Synthetic Polynucleotide
taatacgactcactatagggcctcctgcacactccaaatcctcaactctgaacagaggagacagagtatgggatttggaaacctggcggcagcgcaaaagatg

SEQ ID NO: 22307 - DNA, 103 bp, Artificial Sequence
  Synthetic Polynucleotide
taatacgactcactatagggatcgtcctcctgcacactccaaatcctcaaaacagaggagattgaggatgtggagtgtgaacctggcggcagcgcaaaagatg

SEQ ID NO: 22308 - DNA, 103 bp, Artificial Sequence
  Synthetic Polynucleotide
taatacgactcactataggggccaaatcgtcctcctgcacactccaaatcaacagaggagagatttgatgtgtgcaggaaacctggcggcagcgcaaaagatg

SEQ ID NO: 22309 - DNA, 103 bp, Artificial Sequence
  Synthetic Polynucleotide
taatacgactcactatagggttaaagaatattaacaaaatgactagtcttaacagaggagaaagactatgcattttgttaacctggcggcagcgcaaaagatg

SEQ ID NO: 22310 - DNA, 103 bp, Artificial Sequence
  Synthetic Polynucleotide
taatacgactcactatagggtgagaatctagtttgtcctactgaattactaacagaggagaagtaatatggtaggacaaaacctggcggcagcgcaaaagatg

SEQ ID NO: 22311 - DNA, 103 bp, Artificial Sequence
  Synthetic Polynucleotide
taatacgactcactatagggctgccgccaaatcgtcctcctgcacactccaacagaggagaggagtgatgaggaggacgaacctggcggcagcgcaaaagatg

SEQ ID NO: 22312 - DNA, 103 bp, Artificial Sequence
  Synthetic Polynucleotide
taatacgactcactatagggaagccctgccgccaaatcgtcctcctgcacaacagaggagagtgcagatggacgatttgaacctggcggcagcgcaaaagatg

SEQ ID NO: 22313 - DNA, 103 bp, Artificial Sequence
  Synthetic Polynucleotide
taatacgactcactatagggcagctaagccctgccgccaaatcgtcctccaacagaggagaggaggaatgtttggcggcaacctggcggcagcgcaaaagatg

SEQ ID NO: 22314 - DNA, 103 bp, Artificial Sequence
  Synthetic Polynucleotide
taatacgactcactataggggtatccagctaagccctgccgccaaatcgtaacagaggagaacgattatgcggcagggcaacctggcggcagcgcaaaagatg

SEQ ID NO: 22315 - DNA, 103 bp, Artificial Sequence
  Synthetic Polynucleotide
taatacgactcactatagggaaatggtatccagctaagccctgccgccaaaacagaggagattggcgatggggcttagcaacctggcggcagcgcaaaagatg

SEQ ID NO: 22316 - DNA, 103 bp, Artificial Sequence
  Synthetic Polynucleotide
taatacgactcactatagggccaaaaaatggtatccagctaagccctgccaacagaggagaggcaggatgtagctggataacctggcggcagcgcaaaagatg

SEQ ID NO: 22317 - DNA, 103 bp, Artificial Sequence
  Synthetic Polynucleotide
taatacgactcactatagggcagggccaaaaaatggtatccagctaagccaacagaggagaggcttaatgggataccataacctggcggcagcgcaaaagatg

SEQ ID NO: 22318 - DNA, 103 bp, Artificial Sequence
  Synthetic Polynucleotide
taatacgactcactataggggattccagggccaaaaaatggtatccagctaacagaggagaagctggatgccattttttaacctggcggcagcgcaaaagatg

SEQ ID NO: 22319 - DNA, 103 bp, Artificial Sequence
  Synthetic Polynucleotide
taatacgactcactatagggccttcgattccagggccaaaaaatggtatcaacagaggagagataccatgttttggcccaacctggcggcagcgcaaaagatg

SEQ ID NO: 22320 - DNA, 103 bp, Artificial Sequence
  Synthetic Polynucleotide
taatacgactcactatagggagagtccttcgattccagggccaaaaaatgaacagaggagacattttatggccctggaaaacctggcggcagcgcaaaagatg

SEQ ID NO: 22321 - DNA, 103 bp, Artificial Sequence
  Synthetic Polynucleotide
taatacgactcactatagggagccctgagaatctagtttgtcctactgaaaacagaggagattcagtatgacaaactagaacctggcggcagcgcaaaagatg

SEQ ID NO: 22322 - DNA, 103 bp, Artificial Sequence
  Synthetic Polynucleotide
taatacgactcactatagggagtatagagtccttcgattccagggccaaaaacagaggagatttggcatgggaatcgaaaacctggcggcagcgcaaaagatg

SEQ ID NO: 22323 - DNA, 103 bp, Artificial Sequence
  Synthetic Polynucleotide
taatacgactcactatagggccggcagtatagagtccttcgattccagggaacagaggagaccctggatgcgaaggactaacctggcggcagcgcaaaagatg

SEQ ID NO: 22324 - DNA, 103 bp, Artificial Sequence
  Synthetic Polynucleotide
taatacgactcactatagggttaaaccggcagtatagagtccttcgattcaacagaggagagaatcgatggactctataaacctggcggcagcgcaaaagatg

SEQ ID NO: 22325 - DNA, 103 bp, Artificial Sequence
  Synthetic Polynucleotide
taatacgactcactatagggtttgattaaaccggcagtatagagtccttcaacagaggagagaaggaatgtatactgccaacctggcggcagcgcaaaagatg

SEQ ID NO: 22326 - DNA, 103 bp, Artificial Sequence
  Synthetic Polynucleotide
taatacgactcactatagggtgatttttgattaaaccggcagtatagagtaacagaggagaactctaatgtgccggtttaacctggcggcagcgcaaaagatg

SEQ ID NO: 22327 - DNA, 103 bp, Artificial Sequence
  Synthetic Polynucleotide
taatacgactcactatagggtgttctgatttttgattaaaccggcagtataacagaggagaatactgatggtttaatcaaacctggcggcagcgcaaaagatg

SEQ ID NO: 22328 - DNA, 103 bp, Artificial Sequence
  Synthetic Polynucleotide
taatacgactcactatagggtaaattgttctgatttttgattaaaccggcaacagaggagagccggtatgatcaaaaataacctggcggcagcgcaaaagatg

SEQ ID NO: 22329 - DNA, 103 bp, Artificial Sequence
  Synthetic Polynucleotide
taatacgactcactatagggcaaactaaattgttctgatttttgattaaaaacagaggagatttaatatgaaatcagaaaacctggcggcagcgcaaaagatg

SEQ ID NO: 22330 - DNA, 103 bp, Artificial Sequence
  Synthetic Polynucleotide
taatacgactcactatagggacctacaaactaaattgttctgatttttgaaacagaggagatcaaaaatgagaacaattaacctggcggcagcgcaaaagatg

SEQ ID NO: 22331 - DNA, 103 bp, Artificial Sequence
  Synthetic Polynucleotide
taatacgactcactatagggcctcaacctacaaactaaattgttctgattaacagaggagaaatcagatgaatttagttaacctggcggcagcgcaaaagatg

SEQ ID NO: 22332 - DNA, 103 bp, Artificial Sequence
  Synthetic Polynucleotide
taatacgactcactatagggtaagaagccctgagaatctagtttgtcctaaacagaggagataggacatgctagattctaacctggcggcagcgcaaaagatg

SEQ ID NO: 22333 - DNA, 103 bp, Artificial Sequence
  Synthetic Polynucleotide
taatacgactcactatagggaagcgcctcaacctacaaactaaattgttcaacagaggagagaacaaatgagtttgtagaacctggcggcagcgcaaaagatg

SEQ ID NO: 22334 - DNA, 103 bp, Artificial Sequence
  Synthetic Polynucleotide
taatacgactcactatagggtagctaagcgcctcaacctacaaactaaataacagaggagaatttagatggtaggttgaaacctggcggcagcgcaaaagatg

SEQ ID NO: 22335 - DNA, 103 bp, Artificial Sequence
  Synthetic Polynucleotide
taatacgactcactatagggttgattagctaagcgcctcaacctacaaacaacagaggagagtttgtatgttgaggcgcaacctggcggcagcgcaaaagatg

SEQ ID NO: 22336 - DNA, 103 bp, Artificial Sequence
  Synthetic Polynucleotide
taatacgactcactataggggcagtttgattagctaagcgcctcaacctaaacagaggagataggttatggcgcttagcaacctggcggcagcgcaaaagatg

SEQ ID NO: 22337 - DNA, 103 bp, Artificial Sequence
  Synthetic Polynucleotide
taatacgactcactatagggatttagcagtttgattagctaagcgcctcaaacagaggagatgaggcatgtagctaatcaacctggcggcagcgcaaaagatg

SEQ ID NO: 22338 - DNA, 103 bp, Artificial Sequence
  Synthetic Polynucleotide
taatacgactcactatagggcaaggatttagcagtttgattagctaagcgaacagaggagacgcttaatgaatcaaactaacctggcggcagcgcaaaagatg

SEQ ID NO: 22339 - DNA, 103 bp, Artificial Sequence
  Synthetic Polynucleotide
taatacgactcactatagggagctccaaggatttagcagtttgattagctaacagaggagaagctaaatgaactgctaaaacctggcggcagcgcaaaagatg

SEQ ID NO: 22340 - DNA, 103 bp, Artificial Sequence
  Synthetic Polynucleotide
taatacgactcactatagggacaagagctccaaggatttagcagtttgataacagaggagaatcaaaatgctaaatcctaacctggcggcagcgcaaaagatg

SEQ ID NO: 22341 - DNA, 103 bp, Artificial Sequence
  Synthetic Polynucleotide
taatacgactcactatagggccttaacaagagctccaaggatttagcagtaacagaggagaactgctatgtccttggagaacctggcggcagcgcaaaagatg

SEQ ID NO: 22342 - DNA, 103 bp, Artificial Sequence
  Synthetic Polynucleotide
taatacgactcactataggggtgacccttaacaagagctccaaggatttaaacagaggagataaatcatgggagctcttaacctggcggcagcgcaaaagatg

SEQ ID NO: 22343 - DNA, 103 bp, Artificial Sequence
  Synthetic Polynucleotide
taatacgactcactatagggcacaataagaagccctgagaatctagtttgaacagaggagacaaactatgttctcagggaacctggcggcagcgcaaaagatg

SEQ ID NO: 22344 - DNA, 103 bp, Artificial Sequence
  Synthetic Polynucleotide
taatacgactcactatagggcggttgtgacccttaacaagagctccaaggaacagaggagaccttggatgtcttgttaaaacctggcggcagcgcaaaagatg

SEQ ID NO: 22345 - DNA, 103 bp, Artificial Sequence
  Synthetic Polynucleotide
taatacgactcactatagggttcctcggttgtgacccttaacaagagctcaacagaggagagagctcatgttaagggtcaacctggcggcagcgcaaaagatg

SEQ ID NO: 22346 - DNA, 103 bp, Artificial Sequence
  Synthetic Polynucleotide
taatacgactcactataggggtcctttcctcggttgtgacccttaacaagaacagaggagacttgttatgggtcacaacaacctggcggcagcgcaaaagatg

SEQ ID NO: 22347 - DNA, 103 bp, Artificial Sequence
  Synthetic Polynucleotide
taatacgactcactatagggaaaatgtcctttcctcggttgtgacccttaaacagaggagataagggatgcaaccgaggaacctggcggcagcgcaaaagatg

SEQ ID NO: 22348 - DNA, 103 bp, Artificial Sequence
  Synthetic Polynucleotide
taatacgactcactatagggtaaggaaaatgtcctttcctcggttgtgacaacagaggagagtcacaatggaggaaaggaacctggcggcagcgcaaaagatg

SEQ ID NO: 22349 - DNA, 103 bp, Artificial Sequence
  Synthetic Polynucleotide
taatacgactcactatagggttgattaaggaaaatgtcctttcctcggttaacagaggagaaaccgaatgaaggacattaacctggcggcagcgcaaaagatg

SEQ ID NO: 22350 - DNA, 103 bp, Artificial Sequence
  Synthetic Polynucleotide
taatacgactcactataggggcctattgattaaggaaaatgtcctttcctaacagaggagaaggaaaatgcattttcctaacctggcggcagcgcaaaagatg

SEQ ID NO: 22351 - DNA, 103 bp, Artificial Sequence
  Synthetic Polynucleotide
taatacgactcactatagggtgcatgcctattgattaaggaaaatgtcctaacagaggagaaggacaatgtccttaatcaacctggcggcagcgcaaaagatg

SEQ ID NO: 22352 - DNA, 103 bp, Artificial Sequence
  Synthetic Polynucleotide
taatacgactcactatagggtcaattgcatgcctattgattaaggaaaataacagaggagaattttcatgaatcaatagaacctggcggcagcgcaaaagatg

SEQ ID NO: 22353 - DNA, 103 bp, Artificial Sequence
  Synthetic Polynucleotide
taatacgactcactatagggaaaagtcaattgcatgcctattgattaaggaacagaggagaccttaaatgataggcatgaacctggcggcagcgcaaaagatg

SEQ ID NO: 22354 - DNA, 103 bp, Artificial Sequence
  Synthetic Polynucleotide
taatacgactcactataggggttttcacaataagaagccctgagaatctaaacagaggagatagattatgagggcttctaacctggcggcagcgcaaaagatg

SEQ ID NO: 22355 - DNA, 103 bp, Artificial Sequence
  Synthetic Polynucleotide
taatacgactcactatagggaagcaaaaagtcaattgcatgcctattgataacagaggagaatcaatatgcatgcaattaacctggcggcagcgcaaaagatg

SEQ ID NO: 22356 - DNA, 103 bp, Artificial Sequence
  Synthetic Polynucleotide
taatacgactcactatagggctcgtaagcaaaaagtcaattgcatgcctaaacagaggagataggcaatgaattgacttaacctggcggcagcgcaaaagatg

SEQ ID NO: 22357 - DNA, 103 bp, Artificial Sequence
  Synthetic Polynucleotide
taatacgactcactatagggcccacctcgtaagcaaaaagtcaattgcataacagaggagaatgcaaatgactttttgcaacctggcggcagcgcaaaagatg

SEQ ID NO: 22358 - DNA, 103 bp, Artificial Sequence
  Synthetic Polynucleotide
taatacgactcactatagggtccgccccacctcgtaagcaaaaagtcaataacagaggagaattgacatgttgcttacgaacctggcggcagcgcaaaagatg

SEQ ID NO: 22359 - DNA, 103 bp, Artificial Sequence
  Synthetic Polynucleotide
taatacgactcactatagggcatgttccgccccacctcgtaagcaaaaagaacagaggagactttttatgtacgaggtgaacctggcggcagcgcaaaagatg

SEQ ID NO: 22360 - DNA, 103 bp, Artificial Sequence
  Synthetic Polynucleotide
taatacgactcactatagggccttgcatgttccgccccacctcgtaagcaaacagaggagatgcttaatgggtggggcgaacctggcggcagcgcaaaagatg

SEQ ID NO: 22361 - DNA, 103 bp, Artificial Sequence
  Synthetic Polynucleotide
taatacgactcactatagggtagcaccttgcatgttccgccccacctcgtaacagaggagaacgaggatgggcggaacaaacctggcggcagcgcaaaagatg

SEQ ID NO: 22362 - DNA, 103 bp, Artificial Sequence
  Synthetic Polynucleotide
taatacgactcactatagggggtcctagcaccttgcatgttccgccccacaacagaggagagtggggatgaacatgcaaaacctggcggcagcgcaaaagatg

SEQ ID NO: 22363 - DNA, 103 bp, Artificial Sequence
  Synthetic Polynucleotide
taatacgactcactatagggaatcaggtcctagcaccttgcatgttccgcaacagaggagagcggaaatggcaaggtgcaacctggcggcagcgcaaaagatg

SEQ ID NO: 22364 - DNA, 103 bp, Artificial Sequence
  Synthetic Polynucleotide
taatacgactcactataggggcaacaatcaggtcctagcaccttgcatgtaacagaggagaacatgcatggtgctaggaaacctggcggcagcgcaaaagatg

SEQ ID NO: 22365 - DNA, 103 bp, Artificial Sequence
  Synthetic Polynucleotide
taatacgactcactataggggaactgttttcacaataagaagccctgagaaacagaggagatctcagatgttcttattgaacctggcggcagcgcaaaagatg

SEQ ID NO: 22366 - DNA, 103 bp, Artificial Sequence
  Synthetic Polynucleotide
taatacgactcactatagggcctatgcaacaatcaggtcctagcaccttgaacagaggagacaaggtatgaggacctgaaacctggcggcagcgcaaaagatg

SEQ ID NO: 22367 - DNA, 103 bp, Artificial Sequence
  Synthetic Polynucleotide
taatacgactcactatagggctattcctatgcaacaatcaggtcctagcaaacagaggagatgctagatgctgattgttaacctggcggcagcgcaaaagatg

SEQ ID NO: 22368 - DNA, 103 bp, Artificial Sequence
  Synthetic Polynucleotide
taatacgactcactatagggatcttctattcctatgcaacaatcaggtccaacagaggagaggacctatgtgttgcataaacctggcggcagcgcaaaagatg

SEQ ID NO: 22369 - DNA, 103 bp, Artificial Sequence
  Synthetic Polynucleotide
taatacgactcactataggggatagatcttctattcctatgcaacaatcaaacagaggagatgattgatgcataggaataacctggcggcagcgcaaaagatg

SEQ ID NO: 22370 - DNA, 103 bp, Artificial Sequence
  Synthetic Polynucleotide
taatacgactcactatagggttttagatagatcttctattcctatgcaacaacagaggagagttgcaatggaatagaagaacctggcggcagcgcaaaagatg

SEQ ID NO: 22371 - DNA, 103 bp, Artificial Sequence
  Synthetic Polynucleotide
taatacgactcactataggggatatttttagatagatcttctattcctataacagaggagaataggaatggaagatctaaacctggcggcagcgcaaaagatg

SEQ ID NO: 22372 - DNA, 103 bp, Artificial Sequence
  Synthetic Polynucleotide
taatacgactcactatagggtctgagatatttttagatagatcttctattaacagaggagaaatagaatgtctatctaaaacctggcggcagcgcaaaagatg

SEQ ID NO: 22373 - DNA, 103 bp, Artificial Sequence
  Synthetic Polynucleotide
taatacgactcactatagggtttgttctgagatatttttagatagatcttaacagaggagaaagatcatgctaaaaataaacctggcggcagcgcaaaagatg

SEQ ID NO: 22374 - DNA, 103 bp, Artificial Sequence
  Synthetic Polynucleotide
taatacgactcactataggggtcgatttgttctgagatatttttagatagaacagaggagactatctatgaatatctcaaacctggcggcagcgcaaaagatg

SEQ ID NO: 22375 - DNA, 103 bp, Artificial Sequence
  Synthetic Polynucleotide
taatacgactcactatagggattttgtcgatttgttctgagatatttttaaacagaggagataaaaaatgctcagaacaaacctggcggcagcgcaaaagatg

SEQ ID NO: 22376 - DNA, 103 bp, Artificial Sequence
  Synthetic Polynucleotide
taatacgactcactatagggctctagaactgttttcacaataagaagcccaacagaggagagggcttatgattgtgaaaaacctggcggcagcgcaaaagatg

SEQ ID NO: 22377 - DNA, 103 bp, Artificial Sequence
  Synthetic Polynucleotide
taatacgactcactatagggttctgattttgtcgatttgttctgagatataacagaggagaatatctatgaacaaatcgaacctggcggcagcgcaaaagatg

SEQ ID NO: 22378 - DNA, 103 bp, Artificial Sequence
  Synthetic Polynucleotide
taatacgactcactatagggatcctttctgattttgtcgatttgttctgaaacagaggagatcagaaatgatcgacaaaaacctggcggcagcgcaaaagatg

SEQ ID NO: 22379 - DNA, 103 bp, Artificial Sequence
  Synthetic Polynucleotide
taatacgactcactatagggtgttcatcctttctgattttgtcgatttgtaacagaggagaacaaatatgcaaaatcagaacctggcggcagcgcaaaagatg

SEQ ID NO: 22380 - DNA, 103 bp, Artificial Sequence
  Synthetic Polynucleotide
taatacgactcactatagggccttttgttcatcctttctgattttgtcgaaacagaggagatcgacaatgtcagaaaggaacctggcggcagcgcaaaagatg

SEQ ID NO: 22381 - DNA, 103 bp, Artificial Sequence
  Synthetic Polynucleotide
taatacgactcactatagggttcctccttttgttcatcctttctgattttaacagaggagaaaaatcatgaaggatgaaaacctggcggcagcgcaaaagatg

SEQ ID NO: 22382 - DNA, 103 bp, Artificial Sequence
  Synthetic Polynucleotide
taatacgactcactatagggccagtttcctccttttgttcatcctttctgaacagaggagacagaaaatgtgaacaaaaaacctggcggcagcgcaaaagatg

SEQ ID NO: 22383 - DNA, 103 bp, Artificial Sequence
  Synthetic Polynucleotide
taatacgactcactatagggcccagccagtttcctccttttgttcatcctaacagaggagaaggatgatgaaaaggaggaacctggcggcagcgcaaaagatg

SEQ ID NO: 22384 - DNA, 103 bp, Artificial Sequence
  Synthetic Polynucleotide
taatacgactcactatagggtagaccccagccagtttcctccttttgttcaacagaggagagaacaaatggaggaaactaacctggcggcagcgcaaaagatg

SEQ ID NO: 22385 - DNA, 103 bp, Artificial Sequence
  Synthetic Polynucleotide
taatacgactcactatagggccacctagaccccagccagtttcctcctttaacagaggagaaaaggaatgaactggctgaacctggcggcagcgcaaaagatg

SEQ ID NO: 22386 - DNA, 103 bp, Artificial Sequence
  Synthetic Polynucleotide
taatacgactcactatagggatttgccacctagaccccagccagtttcctaacagaggagaaggaaaatggctggggtcaacctggcggcagcgcaaaagatg

SEQ ID NO: 22387 - DNA, 103 bp, Artificial Sequence
  Synthetic Polynucleotide
taatacgactcactatagggatgaactctagaactgttttcacaataagaaacagaggagatcttatatggaaaacagtaacctggcggcagcgcaaaagatg

SEQ ID NO: 22388 - DNA, 103 bp, Artificial Sequence
  Synthetic Polynucleotide
taatacgactcactatagggccaccatttgccacctagaccccagccagtaacagaggagaactggcatgggtctaggtaacctggcggcagcgcaaaagatg

SEQ ID NO: 22389 - DNA, 103 bp, Artificial Sequence
  Synthetic Polynucleotide
taatacgactcactataggggatgtccaccatttgccacctagaccccagaacagaggagactggggatgaggtggcaaaacctggcggcagcgcaaaagatg

SEQ ID NO: 22390 - DNA, 103 bp, Artificial Sequence
  Synthetic Polynucleotide
taatacgactcactatagggagtcagatgtccaccatttgccacctagacaacagaggagagtctagatggcaaatggtaacctggcggcagcgcaaaagatg

SEQ ID NO: 22391 - DNA, 103 bp, Artificial Sequence
  Synthetic Polynucleotide
taatacgactcactatagggaccccagtcagatgtccaccatttgccaccaacagaggagaggtggcatgtggtggacaaacctggcggcagcgcaaaagatg

SEQ ID NO: 22392 - DNA, 103 bp, Artificial Sequence
  Synthetic Polynucleotide
taatacgactcactatagggagaacaccccagtcagatgtccaccatttgaacagaggagacaaatgatggacatctgaaacctggcggcagcgcaaaagatg

SEQ ID NO: 22393 - DNA, 103 bp, Artificial Sequence
  Synthetic Polynucleotide
taatacgactcactatagggtggtgagaacaccccagtcagatgtccaccaacagaggagaggtggaatgctgactgggaacctggcggcagcgcaaaagatg

SEQ ID NO: 22394 - DNA, 103 bp, Artificial Sequence
  Synthetic Polynucleotide
taatacgactcactatagggcaaattggtgagaacaccccagtcagatgtaacagaggagaacatctatgtggggtgttaacctggcggcagcgcaaaagatg

SEQ ID NO: 22395 - DNA, 103 bp, Artificial Sequence
  Synthetic Polynucleotide
taatacgactcactatagggatgcccaaattggtgagaacaccccagtcaaacagaggagatgactgatgtgttctcacaacctggcggcagcgcaaaagatg

SEQ ID NO: 22396 - DNA, 103 bp, Artificial Sequence
  Synthetic Polynucleotide
taatacgactcactataggggcaggatgcccaaattggtgagaacaccccaacagaggagaggggtgatgtcaccaattaacctggcggcagcgcaaaagatg

SEQ ID NO: 22397 - DNA, 103 bp, Artificial Sequence
  Synthetic Polynucleotide
taatacgactcactatagggtagtagcaggatgcccaaattggtgagaacaacagaggagagttctcatgaatttgggcaacctggcggcagcgcaaaagatg

SEQ ID NO: 22398 - DNA, 103 bp, Artificial Sequence
  Synthetic Polynucleotide
taatacgactcactataggggtaggatgaactctagaactgttttcacaaaacagaggagattgtgaatgcagttctagaacctggcggcagcgcaaaagatg

SEQ ID NO: 22399 - DNA, 103 bp, Artificial Sequence
  Synthetic Polynucleotide
taatacgactcactataggggataatagtagcaggatgcccaaattggtgaacagaggagacaccaaatggggcatcctaacctggcggcagcgcaaaagatg

SEQ ID NO: 22400 - DNA, 103 bp, Artificial Sequence
  Synthetic Polynucleotide
taatacgactcactatagggctatagataatagtagcaggatgcccaaataacagaggagaatttggatgtcctgctacaacctggcggcagcgcaaaagatg

SEQ ID NO: 22401 - DNA, 103 bp, Artificial Sequence
  Synthetic Polynucleotide
taatacgactcactatagggaacagctatagataatagtagcaggatgccaacagaggagaggcatcatgctactattaaacctggcggcagcgcaaaagatg

SEQ ID NO: 22402 - DNA, 103 bp, Artificial Sequence
  Synthetic Polynucleotide
taatacgactcactatagggatcagaacagctatagataatagtagcaggaacagaggagacctgctatgattatctataacctggcggcagcgcaaaagatg

SEQ ID NO: 22403 - DNA, 103 bp, Artificial Sequence
  Synthetic Polynucleotide
taatacgactcactataggggagcaatcagaacagctatagataatagtaaacagaggagatactatatgctatagctgaacctggcggcagcgcaaaagatg

SEQ ID NO: 22404 - DNA, 103 bp, Artificial Sequence
  Synthetic Polynucleotide
taatacgactcactatagggggacagagcaatcagaacagctatagataaaacagaggagattatctatggctgttctgaacctggcggcagcgcaaaagatg

SEQ ID NO: 22405 - DNA, 103 bp, Artificial Sequence
  Synthetic Polynucleotide
taatacgactcactatagggatacaggacagagcaatcagaacagctataaacagaggagatatagcatgtctgattgcaacctggcggcagcgcaaaagatg

SEQ ID NO: 22406 - DNA, 103 bp, Artificial Sequence
  Synthetic Polynucleotide
taatacgactcactataggggacagatacaggacagagcaatcagaacagaacagaggagactgttcatgttgctctgtaacctggcggcagcgcaaaagatg

SEQ ID NO: 22407 - DNA, 103 bp, Artificial Sequence
  Synthetic Polynucleotide
taatacgactcactataggggatacgacagatacaggacagagcaatcagaacagaggagactgattatgctgtcctgtaacctggcggcagcgcaaaagatg

SEQ ID NO: 22408 - DNA, 103 bp, Artificial Sequence
  Synthetic Polynucleotide
taatacgactcactataggggtgaagatacgacagatacaggacagagcaaacagaggagatgctctatgctgtatctgaacctggcggcagcgcaaaagatg

SEQ ID NO: 22409 - DNA, 103 bp, Artificial Sequence
  Synthetic Polynucleotide
taatacgactcactatagggtttttgtaggatgaactctagaactgttttaacagaggagaaaaacaatgctagagttcaacctggcggcagcgcaaaagatg

SEQ ID NO: 22410 - DNA, 103 bp, Artificial Sequence
  Synthetic Polynucleotide
taatacgactcactatagggatttagtgaagatacgacagatacaggacaaacagaggagatgtcctatgtctgtcgtaaacctggcggcagcgcaaaagatg

SEQ ID NO: 22411 - DNA, 103 bp, Artificial Sequence
  Synthetic Polynucleotide
taatacgactcactatagggaatgtatttagtgaagatacgacagatacaaacagaggagatgtatcatgcgtatcttcaacctggcggcagcgcaaaagatg

SEQ ID NO: 22412 - DNA, 103 bp, Artificial Sequence
  Synthetic Polynucleotide
taatacgactcactatagggcatccaatgtatttagtgaagatacgacagaacagaggagactgtcgatgcttcactaaaacctggcggcagcgcaaaagatg

SEQ ID NO: 22413 - DNA, 103 bp, Artificial Sequence
  Synthetic Polynucleotide
taatacgactcactatagggtatgtcatccaatgtatttagtgaagatacaacagaggagagtatctatgctaaatacaaacctggcggcagcgcaaaagatg

SEQ ID NO: 22414 - DNA, 103 bp, Artificial Sequence
  Synthetic Polynucleotide
taatacgactcactatagggaactttatgtcatccaatgtatttagtgaaaacagaggagattcactatgtacattggaaacctggcggcagcgcaaaagatg

SEQ ID NO: 22415 - DNA, 103 bp, Artificial Sequence
  Synthetic Polynucleotide
taatacgactcactatagggttgtaaactttatgtcatccaatgtatttaaacagaggagataaataatgtggatgacaaacctggcggcagcgcaaaagatg

SEQ ID NO: 22416 - DNA, 103 bp, Artificial Sequence
  Synthetic Polynucleotide
taatacgactcactatagggaaccattgtaaactttatgtcatccaatgtaacagaggagaacattgatggacataaagaacctggcggcagcgcaaaagatg

SEQ ID NO: 22417 - DNA, 103 bp, Artificial Sequence
  Synthetic Polynucleotide
taatacgactcactataggggctctaaccattgtaaactttatgtcatccaacagaggagaggatgaatgaaagtttacaacctggcggcagcgcaaaagatg

SEQ ID NO: 22418 - DNA, 103 bp, Artificial Sequence
  Synthetic Polynucleotide
taatacgactcactatagggctaaagctctaaccattgtaaactttatgtaacagaggagaacataaatgttacaatggaacctggcggcagcgcaaaagatg

SEQ ID NO: 22419 - DNA, 103 bp, Artificial Sequence
  Synthetic Polynucleotide
taatacgactcactatagggctttcctaaagctctaaccattgtaaacttaacagaggagaaagtttatgatggttagaaacctggcggcagcgcaaaagatg

SEQ ID NO: 22420 - DNA, 103 bp, Artificial Sequence
  Synthetic Polynucleotide
taatacgactcactatagggatcttttaaagaatattaacaaaatgactaaacagaggagatagtcaatgtgttaatataacctggcggcagcgcaaaagatg

SEQ ID NO: 22421 - DNA, 103 bp, Artificial Sequence
  Synthetic Polynucleotide
taatacgactcactatagggtcagttttttgtaggatgaactctagaactaacagaggagaagttctatggttcatcctaacctggcggcagcgcaaaagatg

SEQ ID NO: 22422 - DNA, 103 bp, Artificial Sequence
  Synthetic Polynucleotide
taatacgactcactatagggagcaactttcctaaagctctaaccattgtaaacagaggagatacaatatgtagagctttaacctggcggcagcgcaaaagatg

SEQ ID NO: 22423 - DNA, 103 bp, Artificial Sequence
  Synthetic Polynucleotide
taatacgactcactatagggtcagcagcaactttcctaaagctctaaccaaacagaggagatggttaatgctttaggaaaacctggcggcagcgcaaaagatg

SEQ ID NO: 22424 - DNA, 103 bp, Artificial Sequence
  Synthetic Polynucleotide
taatacgactcactatagggagggctcagcagcaactttcctaaagctctaacagaggagaagagctatgggaaagttgaacctggcggcagcgcaaaagatg

SEQ ID NO: 22425 - DNA, 103 bp, Artificial Sequence
  Synthetic Polynucleotide
taatacgactcactataggggacaaagggctcagcagcaactttcctaaaaacagaggagatttaggatggttgctgctaacctggcggcagcgcaaaagatg

SEQ ID NO: 22426 - DNA, 103 bp, Artificial Sequence
  Synthetic Polynucleotide
taatacgactcactataggggattagacaaagggctcagcagcaactttcaacagaggagagaaagtatgtgctgagccaacctggcggcagcgcaaaagatg

SEQ ID NO: 22427 - DNA, 103 bp, Artificial Sequence
  Synthetic Polynucleotide
taatacgactcactatagggcagtagattagacaaagggctcagcagcaaaacagaggagattgctgatgagccctttgaacctggcggcagcgcaaaagatg

SEQ ID NO: 22428 - DNA, 103 bp, Artificial Sequence
  Synthetic Polynucleotide
taatacgactcactataggggatttcagtagattagacaaagggctcagcaacagaggagagctgagatgtttgtctaaaacctggcggcagcgcaaaagatg

SEQ ID NO: 22429 - DNA, 103 bp, Artificial Sequence
  Synthetic Polynucleotide
taatacgactcactatagggaagtcgatttcagtagattagacaaagggcaacagaggagagcccttatgctaatctacaacctggcggcagcgcaaaagatg

SEQ ID NO: 22430 - DNA, 103 bp, Artificial Sequence
  Synthetic Polynucleotide
taatacgactcactatagggtctttaagtcgatttcagtagattagacaaaacagaggagattgtctatgctactgaaaaacctggcggcagcgcaaaagatg

SEQ ID NO: 22431 - DNA, 103 bp, Artificial Sequence
  Synthetic Polynucleotide
taatacgactcactatagggaggattctttaagtcgatttcagtagattaaacagaggagataatctatggaaatcgacaacctggcggcagcgcaaaagatg

SEQ ID NO: 22432 - DNA, 103 bp, Artificial Sequence
  Synthetic Polynucleotide
taatacgactcactatagggctgaatcagttttttgtaggatgaactctaaacagaggagatagagtatgtcctacaaaaacctggcggcagcgcaaaagatg

SEQ ID NO: 22433 - DNA, 103 bp, Artificial Sequence
  Synthetic Polynucleotide
taatacgactcactatagggccctgaggattctttaagtcgatttcagtaaacagaggagatactgaatgcgacttaaaaacctggcggcagcgcaaaagatg

SEQ ID NO: 22434 - DNA, 103 bp, Artificial Sequence
  Synthetic Polynucleotide
taatacgactcactatagggaagctccctgaggattctttaagtcgatttaacagaggagaaaatcgatgtaaagaatcaacctggcggcagcgcaaaagatg

SEQ ID NO: 22435 - DNA, 103 bp, Artificial Sequence
  Synthetic Polynucleotide
taatacgactcactataggggttataagctccctgaggattctttaagtcaacagaggagagacttaatgaatcctcagaacctggcggcagcgcaaaagatg

SEQ ID NO: 22436 - DNA, 103 bp, Artificial Sequence
  Synthetic Polynucleotide
taatacgactcactatagggattgagttataagctccctgaggattctttaacagaggagaaaagaaatgtcagggagcaacctggcggcagcgcaaaagatg

SEQ ID NO: 22437 - DNA, 103 bp, Artificial Sequence
  Synthetic Polynucleotide
taatacgactcactatagggttcacattgagttataagctccctgaggataacagaggagaatcctcatggagcttataaacctggcggcagcgcaaaagatg

SEQ ID NO: 22438 - DNA, 103 bp, Artificial Sequence
  Synthetic Polynucleotide
taatacgactcactatagggatcgattcacattgagttataagctccctgaacagaggagacagggaatgtataactcaaacctggcggcagcgcaaaagatg

SEQ ID NO: 22439 - DNA, 103 bp, Artificial Sequence
  Synthetic Polynucleotide
taatacgactcactatagggagggaatcgattcacattgagttataagctaacagaggagaagcttaatgctcaatgtgaacctggcggcagcgcaaaagatg

SEQ ID NO: 22440 - DNA, 103 bp, Artificial Sequence
  Synthetic Polynucleotide
taatacgactcactatagggtatatagggaatcgattcacattgagttataacagaggagaataactatgtgtgaatcgaacctggcggcagcgcaaaagatg

SEQ ID NO: 22441 - DNA, 103 bp, Artificial Sequence
  Synthetic Polynucleotide
taatacgactcactatagggaacaatatatagggaatcgattcacattgaaacagaggagatcaatgatgatcgattccaacctggcggcagcgcaaaagatg

SEQ ID NO: 22442 - DNA, 103 bp, Artificial Sequence
  Synthetic Polynucleotide
taatacgactcactatagggcgatcaacaatatatagggaatcgattcacaacagaggagagtgaatatgttccctataaacctggcggcagcgcaaaagatg

SEQ ID NO: 22443 - DNA, 103 bp, Artificial Sequence
  Synthetic Polynucleotide
taatacgactcactatagggcacccctgaatcagttttttgtaggatgaaaacagaggagattcatcatgcaaaaaactaacctggcggcagcgcaaaagatg

SEQ ID NO: 22444 - DNA, 103 bp, Artificial Sequence
  Synthetic Polynucleotide
taatacgactcactatagggcatcacgatcaacaatatatagggaatcgaaacagaggagatcgattatgtatatattgaacctggcggcagcgcaaaagatg

SEQ ID NO: 22445 - DNA, 103 bp, Artificial Sequence
  Synthetic Polynucleotide
taatacgactcactatagggtatatcatcacgatcaacaatatatagggaaacagaggagatccctaatgattgttgataacctggcggcagcgcaaaagatg

SEQ ID NO: 22446 - DNA, 103 bp, Artificial Sequence
  Synthetic Polynucleotide
taatacgactcactatagggactgctatatcatcacgatcaacaatatataacagaggagaatatatatgtgatcgtgaaacctggcggcagcgcaaaagatg

SEQ ID NO: 22447 - DNA, 103 bp, Artificial Sequence
  Synthetic Polynucleotide
taatacgactcactatagggacttgactgctatatcatcacgatcaacaaaacagaggagattgttgatggtgatgataaacctggcggcagcgcaaaagatg

SEQ ID NO: 22448 - DNA, 103 bp, Artificial Sequence
  Synthetic Polynucleotide
taatacgactcactataggggtgacacttgactgctatatcatcacgatcaacagaggagagatcgtatggatatagcaaacctggcggcagcgcaaaagatg

SEQ ID NO: 22449 - DNA, 103 bp, Artificial Sequence
  Synthetic Polynucleotide
taatacgactcactatagggtgatggtgacacttgactgctatatcatcaaacagaggagatgatgaatgagcagtcaaaacctggcggcagcgcaaaagatg

SEQ ID NO: 22450 - DNA, 103 bp, Artificial Sequence
  Synthetic Polynucleotide
taatacgactcactatagggcctaatgatggtgacacttgactgctatataacagaggagaatatagatgtcaagtgtcaacctggcggcagcgcaaaagatg

SEQ ID NO: 22451 - DNA, 103 bp, Artificial Sequence
  Synthetic Polynucleotide
taatacgactcactatagggttgctcctaatgatggtgacacttgactgcaacagaggagagcagtcatgtgtcaccataacctggcggcagcgcaaaagatg

SEQ ID NO: 22452 - DNA, 103 bp, Artificial Sequence
  Synthetic Polynucleotide
taatacgactcactatagggaagaattgctcctaatgatggtgacacttgaacagaggagacaagtgatgccatcattaaacctggcggcagcgcaaaagatg

SEQ ID NO: 22453 - DNA, 103 bp, Artificial Sequence
  Synthetic Polynucleotide
taatacgactcactatagggatcagaagaattgctcctaatgatggtgacaacagaggagagtcaccatgattaggagcaacctggcggcagcgcaaaagatg

SEQ ID NO: 22454 - DNA, 103 bp, Artificial Sequence
  Synthetic Polynucleotide
taatacgactcactatagggaatgccacccctgaatcagttttttgtaggaacagaggagacctacaatgaactgattcaacctggcggcagcgcaaaagatg

SEQ ID NO: 22455 - DNA, 103 bp, Artificial Sequence
  Synthetic Polynucleotide
taatacgactcactatagggattggatcagaagaattgctcctaatgatgaacagaggagacatcatatggagcaattcaacctggcggcagcgcaaaagatg

SEQ ID NO: 22456 - DNA, 103 bp, Artificial Sequence
  Synthetic Polynucleotide
taatacgactcactatagggaatgcattggatcagaagaattgctcctaaaacagaggagattaggaatgattcttctgaacctggcggcagcgcaaaagatg

SEQ ID NO: 22457 - DNA, 103 bp, Artificial Sequence
  Synthetic Polynucleotide
taatacgactcactatagggacttcaatgcattggatcagaagaattgctaacagaggagaagcaatatgtctgatccaaacctggcggcagcgcaaaagatg

SEQ ID NO: 22458 - DNA, 103 bp, Artificial Sequence
  Synthetic Polynucleotide
taatacgactcactatagggtagtgacttcaatgcattggatcagaagaaaacagaggagattcttcatgtccaatgcaaacctggcggcagcgcaaaagatg

SEQ ID NO: 22459 - DNA, 103 bp, Artificial Sequence
  Synthetic Polynucleotide
taatacgactcactataggggtaattagtgacttcaatgcattggatcagaacagaggagactgatcatgtgcattgaaaacctggcggcagcgcaaaagatg

SEQ ID NO: 22460 - DNA, 103 bp, Artificial Sequence
  Synthetic Polynucleotide
taatacgactcactatagggtagaagtaattagtgacttcaatgcattggaacagaggagaccaatgatgtgaagtcacaacctggcggcagcgcaaaagatg

SEQ ID NO: 22461 - DNA, 103 bp, Artificial Sequence
  Synthetic Polynucleotide
taatacgactcactataggggattttagaagtaattagtgacttcaatgcaacagaggagagcattgatgtcactaattaacctggcggcagcgcaaaagatg

SEQ ID NO: 22462 - DNA, 103 bp, Artificial Sequence
  Synthetic Polynucleotide
taatacgactcactatagggataaggattttagaagtaattagtgacttcaacagaggagagaagtcatgaattacttcaacctggcggcagcgcaaaagatg

SEQ ID NO: 22463 - DNA, 103 bp, Artificial Sequence
  Synthetic Polynucleotide
taatacgactcactatagggtaaagataaggattttagaagtaattagtgaacagaggagacactaaatgcttctaaaaaacctggcggcagcgcaaaagatg

SEQ ID NO: 22464 - DNA, 103 bp, Artificial Sequence
  Synthetic Polynucleotide
taatacgactcactatagggcggattaaagataaggattttagaagtaataacagaggagaattactatgaaaatccttaacctggcggcagcgcaaaagatg

SEQ ID NO: 22465 - DNA, 103 bp, Artificial Sequence
  Synthetic Polynucleotide
taatacgactcactataggggatgcaatgccacccctgaatcagttttttaacagaggagaaaaaaaatgattcaggggaacctggcggcagcgcaaaagatg

SEQ ID NO: 22466 - DNA, 103 bp, Artificial Sequence
  Synthetic Polynucleotide
taatacgactcactatagggatattcggattaaagataaggattttagaaaacagaggagattctaaatgccttatcttaacctggcggcagcgcaaaagatg

SEQ ID NO: 22467 - DNA, 103 bp, Artificial Sequence
  Synthetic Polynucleotide
taatacgactcactatagggtgtgaatattcggattaaagataaggatttaacagaggagaaaatccatgtctttaatcaacctggcggcagcgcaaaagatg

SEQ ID NO: 22468 - DNA, 103 bp, Artificial Sequence
  Synthetic Polynucleotide
taatacgactcactatagggttctatgtgaatattcggattaaagataagaacagaggagacttatcatgaatccgaataacctggcggcagcgcaaaagatg

SEQ ID NO: 22469 - DNA, 103 bp, Artificial Sequence
  Synthetic Polynucleotide
taatacgactcactatagggttgatttctatgtgaatattcggattaaagaacagaggagactttaaatggaatattcaaacctggcggcagcgcaaaagatg

SEQ ID NO: 22470 - DNA, 103 bp, Artificial Sequence
  Synthetic Polynucleotide
taatacgactcactatagggcaaaattgatttctatgtgaatattcggataacagaggagaatccgaatgttcacatagaacctggcggcagcgcaaaagatg

SEQ ID NO: 22471 - DNA, 103 bp, Artificial Sequence
  Synthetic Polynucleotide
taatacgactcactatagggtttcccaaaattgatttctatgtgaatattaacagaggagaaatattatgatagaaatcaacctggcggcagcgcaaaagatg

SEQ ID NO: 22472 - DNA, 103 bp, Artificial Sequence
  Synthetic Polynucleotide
taatacgactcactatagggggaattttcccaaaattgatttctatgtgaaacagaggagatcacatatgaatcaatttaacctggcggcagcgcaaaagatg

SEQ ID NO: 22473 - DNA, 103 bp, Artificial Sequence
  Synthetic Polynucleotide
taatacgactcactatagggctactggaattttcccaaaattgatttctaaacagaggagatagaaaatgattttgggaaacctggcggcagcgcaaaagatg

SEQ ID NO: 22474 - DNA, 103 bp, Artificial Sequence
  Synthetic Polynucleotide
taatacgactcactatagggacgcactactggaattttcccaaaattgataacagaggagaatcaatatggggaaaattaacctggcggcagcgcaaaagatg

SEQ ID NO: 22475 - DNA, 103 bp, Artificial Sequence
  Synthetic Polynucleotide
taatacgactcactatagggaaaagacgcactactggaattttcccaaaaaacagaggagattttggatgaattccagtaacctggcggcagcgcaaaagatg

SEQ ID NO: 22476 - DNA, 103 bp, Artificial Sequence
  Synthetic Polynucleotide
taatacgactcactatagggaagtggatgcaatgccacccctgaatcagtaacagaggagaactgatatgggggtggcaaacctggcggcagcgcaaaagatg

SEQ ID NO: 22477 - DNA, 103 bp, Artificial Sequence
  Synthetic Polynucleotide
taatacgactcactatagggacatgaaaagacgcactactggaattttccaacagaggagaggaaaaatgcagtagtgcaacctggcggcagcgcaaaagatg

SEQ ID NO: 22478 - DNA, 103 bp, Artificial Sequence
  Synthetic Polynucleotide
taatacgactcactatagggaagtgacatgaaaagacgcactactggaataacagaggagaattccaatggtgcgtcttaacctggcggcagcgcaaaagatg

SEQ ID NO: 22479 - DNA, 103 bp, Artificial Sequence
  Synthetic Polynucleotide
taatacgactcactatagggcagagaagtgacatgaaaagacgcactactaacagaggagaagtagtatgtcttttcataacctggcggcagcgcaaaagatg

SEQ ID NO: 22480 - DNA, 103 bp, Artificial Sequence
  Synthetic Polynucleotide
taatacgactcactatagggaggttcagagaagtgacatgaaaagacgcaaacagaggagatgcgtcatgtcatgtcacaacctggcggcagcgcaaaagatg

SEQ ID NO: 22481 - DNA, 103 bp, Artificial Sequence
  Synthetic Polynucleotide
taatacgactcactataggggtcttaggttcagagaagtgacatgaaaagaacagaggagacttttcatgtcacttctcaacctggcggcagcgcaaaagatg

SEQ ID NO: 22482 - DNA, 103 bp, Artificial Sequence
  Synthetic Polynucleotide
taatacgactcactatagggttatggtcttaggttcagagaagtgacatgaacagaggagacatgtcatgtctctgaacaacctggcggcagcgcaaaagatg

SEQ ID NO: 22483 - DNA, 103 bp, Artificial Sequence
  Synthetic Polynucleotide
taatacgactcactatagggatttattatggtcttaggttcagagaagtgaacagaggagacacttcatggaacctaagaacctggcggcagcgcaaaagatg

SEQ ID NO: 22484 - DNA, 103 bp, Artificial Sequence
  Synthetic Polynucleotide
taatacgactcactatagggccaatatttattatggtcttaggttcagagaacagaggagactctgaatgtaagaccataacctggcggcagcgcaaaagatg

SEQ ID NO: 22485 - DNA, 103 bp, Artificial Sequence
  Synthetic Polynucleotide
taatacgactcactatagggtttaaccaatatttattatggtcttaggttaacagaggagaaacctaatgccataataaaacctggcggcagcgcaaaagatg

SEQ ID NO: 22486 - DNA, 103 bp, Artificial Sequence
  Synthetic Polynucleotide
taatacgactcactatagggacctctttaaccaatatttattatggtcttaacagaggagaaagaccatgataaatattaacctggcggcagcgcaaaagatg

SEQ ID NO: 22487 - DNA, 103 bp, Artificial Sequence
  Synthetic Polynucleotide
taatacgactcactatagggcgcacaagtggatgcaatgccacccctgaaaacagaggagattcaggatgggcattgcaaacctggcggcagcgcaaaagatg

SEQ ID NO: 22488 - DNA, 103 bp, Artificial Sequence
  Synthetic Polynucleotide
taatacgactcactatagggagctgacctctttaaccaatatttattatgaacagaggagacataatatgtattggttaaacctggcggcagcgcaaaagatg

SEQ ID NO: 22489 - DNA, 103 bp, Artificial Sequence
  Synthetic Polynucleotide
taatacgactcactatagggtgaccagctgacctctttaaccaatatttaaacagaggagataaataatggttaaagagaacctggcggcagcgcaaaagatg

SEQ ID NO: 22490 - DNA, 103 bp, Artificial Sequence
  Synthetic Polynucleotide
taatacgactcactatagggaagattgaccagctgacctctttaaccaataacagaggagaattggtatgagaggtcagaacctggcggcagcgcaaaagatg

SEQ ID NO: 22491 - DNA, 103 bp, Artificial Sequence
  Synthetic Polynucleotide
taatacgactcactatagggaatagaagattgaccagctgacctctttaaaacagaggagattaaagatgtcagctggtaacctggcggcagcgcaaaagatg

SEQ ID NO: 22492 - DNA, 103 bp, Artificial Sequence
  Synthetic Polynucleotide
taatacgactcactatagggatgaaaatagaagattgaccagctgacctcaacagaggagagaggtcatgtggtcaatcaacctggcggcagcgcaaaagatg

SEQ ID NO: 22493 - DNA, 103 bp, Artificial Sequence
  Synthetic Polynucleotide
taatacgactcactatagggttaatatgaaaatagaagattgaccagctgaacagaggagacagctgatgaatcttctaaacctggcggcagcgcaaaagatg

SEQ ID NO: 22494 - DNA, 103 bp, Artificial Sequence
  Synthetic Polynucleotide
taatacgactcactatagggtatctttaatatgaaaatagaagattgaccaacagaggagaggtcaaatgtctattttcaacctggcggcagcgcaaaagatg

SEQ ID NO: 22495 - DNA, 103 bp, Artificial Sequence
  Synthetic Polynucleotide
taatacgactcactatagggcagtatatctttaatatgaaaatagaagataacagaggagaatcttcatgtttcatattaacctggcggcagcgcaaaagatg

SEQ ID NO: 22496 - DNA, 103 bp, Artificial Sequence
  Synthetic Polynucleotide
taatacgactcactatagggctgagcagtatatctttaatatgaaaatagaacagaggagactatttatgtattaaagaaacctggcggcagcgcaaaagatg

SEQ ID NO: 22497 - DNA, 103 bp, Artificial Sequence
  Synthetic Polynucleotide
taatacgactcactatagggagtttctgagcagtatatctttaatatgaaaacagaggagattcataatgaagatatacaacctggcggcagcgcaaaagatg

SEQ ID NO: 22498 - DNA, 103 bp, Artificial Sequence
  Synthetic Polynucleotide
taatacgactcactatagggaggtccgcacaagtggatgcaatgccacccaacagaggagagggtggatgtgcatccacaacctggcggcagcgcaaaagatg

SEQ ID NO: 22499 - DNA, 103 bp, Artificial Sequence
  Synthetic Polynucleotide
taatacgactcactatagggctaggagtttctgagcagtatatctttaataacagaggagaattaaaatgatactgctcaacctggcggcagcgcaaaagatg

SEQ ID NO: 22500 - DNA, 103 bp, Artificial Sequence
  Synthetic Polynucleotide
taatacgactcactataggggcaaactaggagtttctgagcagtatatctaacagaggagaagatatatggctcagaaaaacctggcggcagcgcaaaagatg

SEQ ID NO: 22501 - DNA, 103 bp, Artificial Sequence
  Synthetic Polynucleotide
taatacgactcactataggggggttgcaaactaggagtttctgagcagtaaacagaggagatactgcatggaaactcctaacctggcggcagcgcaaaagatg

SEQ ID NO: 22502 - DNA, 103 bp, Artificial Sequence
  Synthetic Polynucleotide
taatacgactcactatagggagattgggttgcaaactaggagtttctgagaacagaggagactcagaatgtcctagtttaacctggcggcagcgcaaaagatg

SEQ ID NO: 22503 - DNA, 103 bp, Artificial Sequence
  Synthetic Polynucleotide
taatacgactcactatagggttccaagattgggttgcaaactaggagtttaacagaggagaaaactcatggtttgcaacaacctggcggcagcgcaaaagatg

SEQ ID NO: 22504 - DNA, 103 bp, Artificial Sequence
  Synthetic Polynucleotide
taatacgactcactatagggtatttttccaagattgggttgcaaactaggaacagaggagacctagtatgcaacccaataacctggcggcagcgcaaaagatg

SEQ ID NO: 22505 - DNA, 103 bp, Artificial Sequence
  Synthetic Polynucleotide
taatacgactcactatagggaggtttatttttccaagattgggttgcaaaaacagaggagatttgcaatgcaatcttggaacctggcggcagcgcaaaagatg

SEQ ID NO: 22506 - DNA, 103 bp, Artificial Sequence
  Synthetic Polynucleotide
taatacgactcactatagggagaggaggtttatttttccaagattgggttaacagaggagaaacccaatgttggaaaaaaacctggcggcagcgcaaaagatg

SEQ ID NO: 22507 - DNA, 103 bp, Artificial Sequence
  Synthetic Polynucleotide
taatacgactcactatagggtcaaaagaggaggtttatttttccaagattaacagaggagaaatcttatgaaaataaacaacctggcggcagcgcaaaagatg

SEQ ID NO: 22508 - DNA, 103 bp, Artificial Sequence
  Synthetic Polynucleotide
taatacgactcactatagggtatgatcaaaagaggaggtttatttttccaaacagaggagatggaaaatgaaacctcctaacctggcggcagcgcaaaagatg

SEQ ID NO: 22509 - DNA, 103 bp, Artificial Sequence
  Synthetic Polynucleotide
taatacgactcactatagggttttgaggtccgcacaagtggatgcaatgcaacagaggagagcattgatgccacttgtgaacctggcggcagcgcaaaagatg

SEQ ID NO: 22510 - DNA, 103 bp, Artificial Sequence
  Synthetic Polynucleotide
taatacgactcactatagggatagttatgatcaaaagaggaggtttatttaacagaggagaaaataaatgtcctcttttaacctggcggcagcgcaaaagatg

SEQ ID NO: 22511 - DNA, 103 bp, Artificial Sequence
  Synthetic Polynucleotide
taatacgactcactatagggtagagatagttatgatcaaaagaggaggttaacagaggagaaacctcatgttttgatcaaacctggcggcagcgcaaaagatg

SEQ ID NO: 22512 - DNA, 103 bp, Artificial Sequence
  Synthetic Polynucleotide
taatacgactcactatagggattgatagagatagttatgatcaaaagaggaacagaggagacctcttatgatcataactaacctggcggcagcgcaaaagatg

SEQ ID NO: 22513 - DNA, 103 bp, Artificial Sequence
  Synthetic Polynucleotide
taatacgactcactatagggaagacattgatagagatagttatgatcaaaaacagaggagatttgatatgaactatctcaacctggcggcagcgcaaaagatg

SEQ ID NO: 22514 - DNA, 103 bp, Artificial Sequence
  Synthetic Polynucleotide
taatacgactcactatagggtgttcaagacattgatagagatagttatgaaacagaggagatcataaatgtctctatcaaacctggcggcagcgcaaaagatg

SEQ ID NO: 22515 - DNA, 103 bp, Artificial Sequence
  Synthetic Polynucleotide
taatacgactcactatagggttaagtgttcaagacattgatagagatagtaacagaggagaactatcatgatcaatgtcaacctggcggcagcgcaaaagatg

SEQ ID NO: 22516 - DNA, 103 bp, Artificial Sequence
  Synthetic Polynucleotide
taatacgactcactatagggtaatattaagtgttcaagacattgatagagaacagaggagactctatatgtgtcttgaaaacctggcggcagcgcaaaagatg

SEQ ID NO: 22517 - DNA, 103 bp, Artificial Sequence
  Synthetic Polynucleotide
taatacgactcactataggggttaataatattaagtgttcaagacattgaaacagaggagatcaatgatgtgaacacttaacctggcggcagcgcaaaagatg

SEQ ID NO: 22518 - DNA, 103 bp, Artificial Sequence
  Synthetic Polynucleotide
taatacgactcactatagggaagttgttaataatattaagtgttcaagacaacagaggagagtcttgatgacttaatataacctggcggcagcgcaaaagatg

SEQ ID NO: 22519 - DNA, 103 bp, Artificial Sequence
  Synthetic Polynucleotide
taatacgactcactatagggaaaataagttgttaataatattaagtgttcaacagaggagagaacacatgatattattaaacctggcggcagcgcaaaagatg

SEQ ID NO: 22520 - DNA, 103 bp, Artificial Sequence
  Synthetic Polynucleotide
taatacgactcactatagggtttacttttgaggtccgcacaagtggatgcaacagaggagagcatccatgtgtgcggacaacctggcggcagcgcaaaagatg

SEQ ID NO: 22521 - DNA, 103 bp, Artificial Sequence
  Synthetic Polynucleotide
taatacgactcactatagggaaataaaaataagttgttaataatattaagaacagaggagacttaatatgattaacaacaacctggcggcagcgcaaaagatg

SEQ ID NO: 22522 - DNA, 103 bp, Artificial Sequence
  Synthetic Polynucleotide
taatacgactcactatagggagattaaataaaaataagttgttaataataaacagaggagatattatatgcaacttattaacctggcggcagcgcaaaagatg

SEQ ID NO: 22523 - DNA, 103 bp, Artificial Sequence
  Synthetic Polynucleotide
taatacgactcactatagggttaaaagattaaataaaaataagttgttaaaacagaggagattaacaatgtatttttataacctggcggcagcgcaaaagatg

SEQ ID NO: 22524 - DNA, 103 bp, Artificial Sequence
  Synthetic Polynucleotide
taatacgactcactatagggtgcatttaaaagattaaataaaaataagttaacagaggagaaacttaatgttatttaataacctggcggcagcgcaaaagatg

SEQ ID NO: 22525 - DNA, 103 bp, Artificial Sequence
  Synthetic Polynucleotide
taatacgactcactatagggtgatttgcatttaaaagattaaataaaaataacagaggagaatttttatgtaatcttttaacctggcggcagcgcaaaagatg

SEQ ID NO: 22526 - DNA, 103 bp, Artificial Sequence
  Synthetic Polynucleotide
taatacgactcactatagggtcttttgatttgcatttaaaagattaaataaacagaggagatatttaatgttttaaatgaacctggcggcagcgcaaaagatg

SEQ ID NO: 22527 - DNA, 103 bp, Artificial Sequence
  Synthetic Polynucleotide
taatacgactcactatagggtgtcctcttttgatttgcatttaaaagattaacagaggagaaatcttatgaatgcaaataacctggcggcagcgcaaaagatg

SEQ ID NO: 22528 - DNA, 103 bp, Artificial Sequence
  Synthetic Polynucleotide
taatacgactcactataggggctcatgtcctcttttgatttgcatttaaaaacagaggagatttaaaatgaaatcaaaaaacctggcggcagcgcaaaagatg

SEQ ID NO: 22529 - DNA, 103 bp, Artificial Sequence
  Synthetic Polynucleotide
taatacgactcactataggggggtggctcatgtcctcttttgatttgcataacagaggagaatgcaaatgaaaagaggaaacctggcggcagcgcaaaagatg

SEQ ID NO: 22530 - DNA, 103 bp, Artificial Sequence
  Synthetic Polynucleotide
taatacgactcactatagggaatgagggtggctcatgtcctcttttgattaacagaggagaaatcaaatgaggacatgaaacctggcggcagcgcaaaagatg

SEQ ID NO: 22531 - DNA, 103 bp, Artificial Sequence
  Synthetic Polynucleotide
taatacgactcactatagggaatccatcttttaaagaatattaacaaaataacagaggagaattttgatgatattctttaacctggcggcagcgcaaaagatg

SEQ ID NO: 22532 - DNA, 103 bp, Artificial Sequence
  Synthetic Polynucleotide
taatacgactcactatagggcattttttacttttgaggtccgcacaagtgaacagaggagacacttgatgggacctcaaaacctggcggcagcgcaaaagatg

SEQ ID NO: 22533 - DNA, 103 bp, Artificial Sequence
  Synthetic Polynucleotide
taatacgactcactatagggagtaaaatgagggtggctcatgtcctctttaacagaggagaaaagagatgatgagccacaacctggcggcagcgcaaaagatg

SEQ ID NO: 22534 - DNA, 103 bp, Artificial Sequence
  Synthetic Polynucleotide
taatacgactcactatagggattgaagtaaaatgagggtggctcatgtccaacagaggagaggacatatgccaccctcaaacctggcggcagcgcaaaagatg

SEQ ID NO: 22535 - DNA, 103 bp, Artificial Sequence
  Synthetic Polynucleotide
taatacgactcactatagggttcgtattgaagtaaaatgagggtggctcaaacagaggagatgagccatgctcattttaaacctggcggcagcgcaaaagatg

SEQ ID NO: 22536 - DNA, 103 bp, Artificial Sequence
  Synthetic Polynucleotide
taatacgactcactatagggattccttcgtattgaagtaaaatgagggtgaacagaggagacaccctatgtttacttcaaacctggcggcagcgcaaaagatg

SEQ ID NO: 22537 - DNA, 103 bp, Artificial Sequence
  Synthetic Polynucleotide
taatacgactcactataggggaagaattccttcgtattgaagtaaaatgaaacagaggagatcatttatgttcaatacgaacctggcggcagcgcaaaagatg

SEQ ID NO: 22538 - DNA, 103 bp, Artificial Sequence
  Synthetic Polynucleotide
taatacgactcactataggggagaagaagaattccttcgtattgaagtaaaacagaggagattacttatgtacgaaggaaacctggcggcagcgcaaaagatg

SEQ ID NO: 22539 - DNA, 103 bp, Artificial Sequence
  Synthetic Polynucleotide
taatacgactcactatagggaggctgagaagaagaattccttcgtattgaaacagaggagatcaataatgaggaattctaacctggcggcagcgcaaaagatg

SEQ ID NO: 22540 - DNA, 103 bp, Artificial Sequence
  Synthetic Polynucleotide
taatacgactcactatagggaatgtaggctgagaagaagaattccttcgtaacagaggagaacgaagatgttcttcttcaacctggcggcagcgcaaaagatg

SEQ ID NO: 22541 - DNA, 103 bp, Artificial Sequence
  Synthetic Polynucleotide
taatacgactcactatagggattaaaatgtaggctgagaagaagaattccaacagaggagaggaattatgcttctcagcaacctggcggcagcgcaaaagatg

SEQ ID NO: 22542 - DNA, 103 bp, Artificial Sequence
  Synthetic Polynucleotide
taatacgactcactatagggggtaaattaaaatgtaggctgagaagaagaaacagaggagatcttctatgcagcctacaaacctggcggcagcgcaaaagatg

SEQ ID NO: 22543 - DNA, 103 bp, Artificial Sequence
  Synthetic Polynucleotide
taatacgactcactatagggaacttcattttttacttttgaggtccgcacaacagaggagagtgcggatgtcaaaagtaaacctggcggcagcgcaaaagatg

SEQ ID NO: 22544 - DNA, 103 bp, Artificial Sequence
  Synthetic Polynucleotide
taatacgactcactatagggcacctggtaaattaaaatgtaggctgagaaaacagaggagattctcaatgtacattttaaacctggcggcagcgcaaaagatg

SEQ ID NO: 22545 - DNA, 103 bp, Artificial Sequence
  Synthetic Polynucleotide
taatacgactcactatagggtttatcacctggtaaattaaaatgtaggctaacagaggagaagcctaatgtttaatttaaacctggcggcagcgcaaaagatg

SEQ ID NO: 22546 - DNA, 103 bp, Artificial Sequence
  Synthetic Polynucleotide
taatacgactcactatagggaaaagtttatcacctggtaaattaaaatgtaacagaggagaacatttatgtttaccaggaacctggcggcagcgcaaaagatg

SEQ ID NO: 22547 - DNA, 103 bp, Artificial Sequence
  Synthetic Polynucleotide
taatacgactcactatagggttaccaaaagtttatcacctggtaaattaaaacagaggagattaattatgcaggtgataaacctggcggcagcgcaaaagatg

SEQ ID NO: 22548 - DNA, 103 bp, Artificial Sequence
  Synthetic Polynucleotide
taatacgactcactataggggtaaattaccaaaagtttatcacctggtaaaacagaggagattaccaatggataaacttaacctggcggcagcgcaaaagatg

SEQ ID NO: 22549 - DNA, 103 bp, Artificial Sequence
  Synthetic Polynucleotide
taatacgactcactatagggttaaggtaaattaccaaaagtttatcacctaacagaggagaaggtgaatgacttttggtaacctggcggcagcgcaaaagatg

SEQ ID NO: 22550 - DNA, 103 bp, Artificial Sequence
  Synthetic Polynucleotide
taatacgactcactatagggctatgttaaggtaaattaccaaaagtttataacagaggagaataaacatgtggtaatttaacctggcggcagcgcaaaagatg

SEQ ID NO: 22551 - DNA, 103 bp, Artificial Sequence
  Synthetic Polynucleotide
taatacgactcactatagggagcacctatgttaaggtaaattaccaaaagaacagaggagacttttgatgatttaccttaacctggcggcagcgcaaaagatg

SEQ ID NO: 22552 - DNA, 103 bp, Artificial Sequence
  Synthetic Polynucleotide
taatacgactcactatagggttatcagcacctatgttaaggtaaattaccaacagaggagaggtaatatgccttaacataacctggcggcagcgcaaaagatg

SEQ ID NO: 22553 - DNA, 103 bp, Artificial Sequence
  Synthetic Polynucleotide
taatacgactcactatagggtcatcttatcagcacctatgttaaggtaaaaacagaggagatttaccatgacataggtgaacctggcggcagcgcaaaagatg

SEQ ID NO: 22554 - DNA, 103 bp, Artificial Sequence
  Synthetic Polynucleotide
taatacgactcactatagggcttgcaacttcattttttacttttgaggtcaacagaggagagacctcatgagtaaaaaaaacctggcggcagcgcaaaagatg

SEQ ID NO: 22555 - DNA, 103 bp, Artificial Sequence
  Synthetic Polynucleotide
taatacgactcactatagggtccaatcatcttatcagcacctatgttaagaacagaggagacttaacatgggtgctgataacctggcggcagcgcaaaagatg

SEQ ID NO: 22556 - DNA, 103 bp, Artificial Sequence
  Synthetic Polynucleotide
taatacgactcactatagggtatcatccaatcatcttatcagcacctatgaacagaggagacataggatgtgataagataacctggcggcagcgcaaaagatg

SEQ ID NO: 22557 - DNA, 103 bp, Artificial Sequence
  Synthetic Polynucleotide
taatacgactcactatagggtgtgttatcatccaatcatcttatcagcacaacagaggagagtgctgatgagatgattgaacctggcggcagcgcaaaagatg

SEQ ID NO: 22558 - DNA, 103 bp, Artificial Sequence
  Synthetic Polynucleotide
taatacgactcactataggggtaaatgtgttatcatccaatcatcttatcaacagaggagagataagatgattggatgaaacctggcggcagcgcaaaagatg

SEQ ID NO: 22559 - DNA, 103 bp, Artificial Sequence
  Synthetic Polynucleotide
taatacgactcactatagggtctcggtaaatgtgttatcatccaatcatcaacagaggagagatgatatgatgataacaaacctggcggcagcgcaaaagatg

SEQ ID NO: 22560 - DNA, 103 bp, Artificial Sequence
  Synthetic Polynucleotide
taatacgactcactatagggttaaatctcggtaaatgtgttatcatccaaaacagaggagattggatatgaacacatttaacctggcggcagcgcaaaagatg

SEQ ID NO: 22561 - DNA, 103 bp, Artificial Sequence
  Synthetic Polynucleotide
taatacgactcactatagggtacgattaaatctcggtaaatgtgttatcaaacagaggagatgataaatgatttaccgaaacctggcggcagcgcaaaagatg

SEQ ID NO: 22562 - DNA, 103 bp, Artificial Sequence
  Synthetic Polynucleotide
taatacgactcactatagggtgagatacgattaaatctcggtaaatgtgtaacagaggagaacacatatgccgagatttaacctggcggcagcgcaaaagatg

SEQ ID NO: 22563 - DNA, 103 bp, Artificial Sequence
  Synthetic Polynucleotide
taatacgactcactatagggcttaatgagatacgattaaatctcggtaaaaacagaggagatttaccatgatttaatcgaacctggcggcagcgcaaaagatg

SEQ ID NO: 22564 - DNA, 103 bp, Artificial Sequence
  Synthetic Polynucleotide
taatacgactcactatagggtttttcttaatgagatacgattaaatctcgaacagaggagacgagatatgatcgtatctaacctggcggcagcgcaaaagatg

SEQ ID NO: 22565 - DNA, 103 bp, Artificial Sequence
  Synthetic Polynucleotide
taatacgactcactatagggtgaagcttgcaacttcattttttacttttgaacagaggagacaaaagatgaaaatgaagaacctggcggcagcgcaaaagatg

SEQ ID NO: 22566 - DNA, 103 bp, Artificial Sequence
  Synthetic Polynucleotide
taatacgactcactatagggttatctttttcttaatgagatacgattaaaaacagaggagatttaatatgatctcattaaacctggcggcagcgcaaaagatg

SEQ ID NO: 22567 - DNA, 103 bp, Artificial Sequence
  Synthetic Polynucleotide
taatacgactcactatagggtctaattatctttttcttaatgagatacgaaacagaggagatcgtatatgattaagaaaaacctggcggcagcgcaaaagatg

SEQ ID NO: 22568 - DNA, 103 bp, Artificial Sequence
  Synthetic Polynucleotide
taatacgactcactatagggagtgttctaattatctttttcttaatgagaaacagaggagatctcatatggaaaaagataacctggcggcagcgcaaaagatg

SEQ ID NO: 22569 - DNA, 103 bp, Artificial Sequence
  Synthetic Polynucleotide
taatacgactcactatagggtttccagtgttctaattatctttttcttaaaacagaggagattaagaatgagataattaaacctggcggcagcgcaaaagatg

SEQ ID NO: 22570 - DNA, 103 bp, Artificial Sequence
  Synthetic Polynucleotide
taatacgactcactatagggatcaatttccagtgttctaattatctttttaacagaggagaaaaaagatgattagaacaaacctggcggcagcgcaaaagatg

SEQ ID NO: 22571 - DNA, 103 bp, Artificial Sequence
  Synthetic Polynucleotide
taatacgactcactatagggagtttatcaatttccagtgttctaattatcaacagaggagagataatatgaacactggaaacctggcggcagcgcaaaagatg

SEQ ID NO: 22572 - DNA, 103 bp, Artificial Sequence
  Synthetic Polynucleotide
taatacgactcactatagggatagaagtttatcaatttccagtgttctaaaacagaggagattagaaatgtggaaattgaacctggcggcagcgcaaaagatg

SEQ ID NO: 22573 - DNA, 103 bp, Artificial Sequence
  Synthetic Polynucleotide
taatacgactcactatagggtcaaaatagaagtttatcaatttccagtgtaacagaggagaacactgatgattgataaaaacctggcggcagcgcaaaagatg

SEQ ID NO: 22574 - DNA, 103 bp, Artificial Sequence
  Synthetic Polynucleotide
taatacgactcactatagggattgatcaaaatagaagtttatcaatttccaacagaggagaggaaatatgtaaacttctaacctggcggcagcgcaaaagatg

SEQ ID NO: 22575 - DNA, 103 bp, Artificial Sequence
  Synthetic Polynucleotide
taatacgactcactatagggtctacattgatcaaaatagaagtttatcaaaacagaggagattgataatgttctattttaacctggcggcagcgcaaaagatg

SEQ ID NO: 22576 - DNA, 103 bp, Artificial Sequence
  Synthetic Polynucleotide
taatacgactcactatagggctgtttgaagcttgcaacttcattttttacaacagaggagagtaaaaatggaagttgcaaacctggcggcagcgcaaaagatg

SEQ ID NO: 22577 - DNA, 103 bp, Artificial Sequence
  Synthetic Polynucleotide
taatacgactcactatagggtcttttctacattgatcaaaatagaagtttaacagaggagaaaacttatgttttgatcaaacctggcggcagcgcaaaagatg

SEQ ID NO: 22578 - DNA, 103 bp, Artificial Sequence
  Synthetic Polynucleotide
taatacgactcactatagggataattcttttctacattgatcaaaatagaaacagaggagatctattatgatcaatgtaaacctggcggcagcgcaaaagatg

SEQ ID NO: 22579 - DNA, 103 bp, Artificial Sequence
  Synthetic Polynucleotide
taatacgactcactatagggtttttataattcttttctacattgatcaaaaacagaggagatttgatatgtgtagaaaaaacctggcggcagcgcaaaagatg

SEQ ID NO: 22580 - DNA, 103 bp, Artificial Sequence
  Synthetic Polynucleotide
taatacgactcactatagggtaagatttttataattcttttctacattgaaacagaggagatcaatgatgaaaagaattaacctggcggcagcgcaaaagatg

SEQ ID NO: 22581 - DNA, 103 bp, Artificial Sequence
  Synthetic Polynucleotide
taatacgactcactatagggtttactaagatttttataattcttttctacaacagaggagagtagaaatgaattataaaaacctggcggcagcgcaaaagatg

SEQ ID NO: 22582 - DNA, 103 bp, Artificial Sequence
  Synthetic Polynucleotide
taatacgactcactatagggatttatttactaagatttttataattctttaacagaggagaaaagaaatgtaaaaatctaacctggcggcagcgcaaaagatg

SEQ ID NO: 22583 - DNA, 103 bp, Artificial Sequence
  Synthetic Polynucleotide
taatacgactcactatagggcagtaatttatttactaagatttttataataacagaggagaattataatgatcttagtaaacctggcggcagcgcaaaagatg

SEQ ID NO: 22584 - DNA, 103 bp, Artificial Sequence
  Synthetic Polynucleotide
taatacgactcactatagggctttgcagtaatttatttactaagatttttaacagaggagaaaaaatatgagtaaataaaacctggcggcagcgcaaaagatg

SEQ ID NO: 22585 - DNA, 103 bp, Artificial Sequence
  Synthetic Polynucleotide
taatacgactcactatagggttttactttgcagtaatttatttactaagaaacagaggagatcttagatgataaattacaacctggcggcagcgcaaaagatg

SEQ ID NO: 22586 - DNA, 103 bp, Artificial Sequence
  Synthetic Polynucleotide
taatacgactcactatagggttcgtttttactttgcagtaatttatttacaacagaggagagtaaatatgttactgcaaaacctggcggcagcgcaaaagatg

SEQ ID NO: 22587 - DNA, 103 bp, Artificial Sequence
  Synthetic Polynucleotide
taatacgactcactatagggaatgcctgtttgaagcttgcaacttcatttaacagaggagaaaatgaatgtgcaagcttaacctggcggcagcgcaaaagatg

SEQ ID NO: 22588 - DNA, 103 bp, Artificial Sequence
  Synthetic Polynucleotide
taatacgactcactatagggtgttcttcgtttttactttgcagtaatttaaacagaggagataaattatggcaaagtaaaacctggcggcagcgcaaaagatg

SEQ ID NO: 22589 - DNA, 103 bp, Artificial Sequence
  Synthetic Polynucleotide
taatacgactcactatagggcttaatgttcttcgtttttactttgcagtaaacagaggagatactgcatggtaaaaacgaacctggcggcagcgcaaaagatg

SEQ ID NO: 22590 - DNA, 103 bp, Artificial Sequence
  Synthetic Polynucleotide
taatacgactcactataggggaacacttaatgttcttcgtttttactttgaacagaggagacaaagtatgaacgaagaaaacctggcggcagcgcaaaagatg

SEQ ID NO: 22591 - DNA, 103 bp, Artificial Sequence
  Synthetic Polynucleotide
taatacgactcactatagggataaagaacacttaatgttcttcgtttttaaacagaggagataaaaaatgagaacattaaacctggcggcagcgcaaaagatg

SEQ ID NO: 22592 - DNA, 103 bp, Artificial Sequence
  Synthetic Polynucleotide
taatacgactcactatagggttttaataaagaacacttaatgttcttcgtaacagaggagaacgaagatgattaagtgtaacctggcggcagcgcaaaagatg

SEQ ID NO: 22593 - DNA, 103 bp, Artificial Sequence
  Synthetic Polynucleotide
taatacgactcactatagggaacaattttaataaagaacacttaatgttcaacagaggagagaacatatggtgttctttaacctggcggcagcgcaaaagatg

SEQ ID NO: 22594 - DNA, 103 bp, Artificial Sequence
  Synthetic Polynucleotide
taatacgactcactatagggggatgaacaattttaataaagaacacttaaaacagaggagattaagtatgctttattaaaacctggcggcagcgcaaaagatg

SEQ ID NO: 22595 - DNA, 103 bp, Artificial Sequence
  Synthetic Polynucleotide
taatacgactcactataggggaaaaggatgaacaattttaataaagaacaaacagaggagatgttctatgttaaaattgaacctggcggcagcgcaaaagatg

SEQ ID NO: 22596 - DNA, 103 bp, Artificial Sequence
  Synthetic Polynucleotide
taatacgactcactatagggaaagcgaaaaggatgaacaattttaataaaaacagaggagatttattatgattgttcataacctggcggcagcgcaaaagatg

SEQ ID NO: 22597 - DNA, 103 bp, Artificial Sequence
  Synthetic Polynucleotide
taatacgactcactatagggaatcaaaagcgaaaaggatgaacaattttaaacagaggagataaaatatgtcatcctttaacctggcggcagcgcaaaagatg

SEQ ID NO: 22598 - DNA, 103 bp, Artificial Sequence
  Synthetic Polynucleotide
taatacgactcactatagggtactcaatgcctgtttgaagcttgcaacttaacagaggagaaagttgatggcttcaaacaacctggcggcagcgcaaaagatg

SEQ ID NO: 22599 - DNA, 103 bp, Artificial Sequence
  Synthetic Polynucleotide
taatacgactcactatagggaatataatcaaaagcgaaaaggatgaacaaaacagaggagattgttcatgcttttcgctaacctggcggcagcgcaaaagatg

SEQ ID NO: 22600 - DNA, 103 bp, Artificial Sequence
  Synthetic Polynucleotide
taatacgactcactataggggatcaaatataatcaaaagcgaaaaggatgaacagaggagacatcctatgcgcttttgaaacctggcggcagcgcaaaagatg

SEQ ID NO: 22601 - DNA, 103 bp, Artificial Sequence
  Synthetic Polynucleotide
taatacgactcactatagggtatttgatcaaatataatcaaaagcgaaaaaacagaggagattttcgatgttgattataaacctggcggcagcgcaaaagatg

SEQ ID NO: 22602 - DNA, 103 bp, Artificial Sequence
  Synthetic Polynucleotide
taatacgactcactatagggagttgtatttgatcaaatataatcaaaagcaacagaggagagcttttatgtatatttgaaacctggcggcagcgcaaaagatg

SEQ ID NO: 22603 - DNA, 103 bp, Artificial Sequence
  Synthetic Polynucleotide
taatacgactcactatagggaatgaagttgtatttgatcaaatataatcaaacagaggagatgattaatgttgatcaaaaacctggcggcagcgcaaaagatg

SEQ ID NO: 22604 - DNA, 103 bp, Artificial Sequence
  Synthetic Polynucleotide
taatacgactcactatagggtaccaaatgaagttgtatttgatcaaatataacagaggagaatatttatgcaaatacaaaacctggcggcagcgcaaaagatg

SEQ ID NO: 22605 - DNA, 103 bp, Artificial Sequence
  Synthetic Polynucleotide
taatacgactcactatagggatgaataccaaatgaagttgtatttgatcaaacagaggagatgatcaatgacaacttcaaacctggcggcagcgcaaaagatg

SEQ ID NO: 22606 - DNA, 103 bp, Artificial Sequence
  Synthetic Polynucleotide
taatacgactcactatagggttggaatgaataccaaatgaagttgtatttaacagaggagaaaatacatgttcatttggaacctggcggcagcgcaaaagatg

SEQ ID NO: 22607 - DNA, 103 bp, Artificial Sequence
  Synthetic Polynucleotide
taatacgactcactataggggaatcttggaatgaataccaaatgaagttgaacagaggagacaacttatgttggtattcaacctggcggcagcgcaaaagatg

SEQ ID NO: 22608 - DNA, 103 bp, Artificial Sequence
  Synthetic Polynucleotide
taatacgactcactatagggattctgaatcttggaatgaataccaaatgaaacagaggagatcatttatgattcattccaacctggcggcagcgcaaaagatg

SEQ ID NO: 22609 - DNA, 103 bp, Artificial Sequence
  Synthetic Polynucleotide
taatacgactcactatagggtaagttactcaatgcctgtttgaagcttgcaacagaggagagcaagcatgaaacaggcaaacctggcggcagcgcaaaagatg

SEQ ID NO: 22610 - DNA, 103 bp, Artificial Sequence
  Synthetic Polynucleotide
taatacgactcactataggggttgcattctgaatcttggaatgaataccaaacagaggagatggtatatgttccaagataacctggcggcagcgcaaaagatg

SEQ ID NO: 22611 - DNA, 103 bp, Artificial Sequence
  Synthetic Polynucleotide
taatacgactcactatagggaggctgttgcattctgaatcttggaatgaaaacagaggagattcattatgagattcagaaacctggcggcagcgcaaaagatg

SEQ ID NO: 22612 - DNA, 103 bp, Artificial Sequence
  Synthetic Polynucleotide
taatacgactcactatagggccacgaggctgttgcattctgaatcttggaaacagaggagatccaagatgcagaatgcaaacctggcggcagcgcaaaagatg

SEQ ID NO: 22613 - DNA, 103 bp, Artificial Sequence
  Synthetic Polynucleotide
taatacgactcactatagggttctcccacgaggctgttgcattctgaatcaacagaggagagattcaatgtgcaacagcaacctggcggcagcgcaaaagatg

SEQ ID NO: 22614 - DNA, 103 bp, Artificial Sequence
  Synthetic Polynucleotide
taatacgactcactatagggtcggcttctcccacgaggctgttgcattctaacagaggagaagaatgatgcagcctcgtaacctggcggcagcgcaaaagatg

SEQ ID NO: 22615 - DNA, 103 bp, Artificial Sequence
  Synthetic Polynucleotide
taatacgactcactatagggcgatttcggcttctcccacgaggctgttgcaacagaggagagcaacaatgtcgtgggagaacctggcggcagcgcaaaagatg

SEQ ID NO: 22616 - DNA, 103 bp, Artificial Sequence
  Synthetic Polynucleotide
taatacgactcactatagggggctacgatttcggcttctcccacgaggctaacagaggagaagcctcatgggagaagccaacctggcggcagcgcaaaagatg

SEQ ID NO: 22617 - DNA, 103 bp, Artificial Sequence
  Synthetic Polynucleotide
taatacgactcactatagggttggtggctacgatttcggcttctcccacgaacagaggagacgtgggatgagccgaaataacctggcggcagcgcaaaagatg

SEQ ID NO: 22618 - DNA, 103 bp, Artificial Sequence
  Synthetic Polynucleotide
taatacgactcactataggggcaacttggtggctacgatttcggcttctcaacagaggagagagaagatgaaatcgtagaacctggcggcagcgcaaaagatg

SEQ ID NO: 22619 - DNA, 103 bp, Artificial Sequence
  Synthetic Polynucleotide
taatacgactcactatagggatagtgcaacttggtggctacgatttcggcaacagaggagagccgaaatggtagccaccaacctggcggcagcgcaaaagatg

SEQ ID NO: 22620 - DNA, 103 bp, Artificial Sequence
  Synthetic Polynucleotide
taatacgactcactatagggcgagctaagttactcaatgcctgtttgaagaacagaggagacttcaaatgggcattgagaacctggcggcagcgcaaaagatg

SEQ ID NO: 22621 - DNA, 103 bp, Artificial Sequence
  Synthetic Polynucleotide
taatacgactcactatagggtgtggatagtgcaacttggtggctacgattaacagaggagaaatcgtatgcaccaagttaacctggcggcagcgcaaaagatg

SEQ ID NO: 22622 - DNA, 103 bp, Artificial Sequence
  Synthetic Polynucleotide
taatacgactcactatagggtggtatgtggatagtgcaacttggtggctaaacagaggagatagccaatgagttgcactaacctggcggcagcgcaaaagatg

SEQ ID NO: 22623 - DNA, 103 bp, Artificial Sequence
  Synthetic Polynucleotide
taatacgactcactatagggtttcatggtatgtggatagtgcaacttggtaacagaggagaaccaagatgcactatccaaacctggcggcagcgcaaaagatg

SEQ ID NO: 22624 - DNA, 103 bp, Artificial Sequence
  Synthetic Polynucleotide
taatacgactcactatagggttgattttcatggtatgtggatagtgcaacaacagaggagagttgcaatgtccacatacaacctggcggcagcgcaaaagatg

SEQ ID NO: 22625 - DNA, 103 bp, Artificial Sequence
  Synthetic Polynucleotide
taatacgactcactatagggggtaattgattttcatggtatgtggatagtaacagaggagaactatcatgataccatgaaacctggcggcagcgcaaaagatg

SEQ ID NO: 22626 - DNA, 103 bp, Artificial Sequence
  Synthetic Polynucleotide
taatacgactcactatagggtagagggtaattgattttcatggtatgtggaacagaggagaccacatatgatgaaaatcaacctggcggcagcgcaaaagatg

SEQ ID NO: 22627 - DNA, 103 bp, Artificial Sequence
  Synthetic Polynucleotide
taatacgactcactatagggaggtttagagggtaattgattttcatggtaaacagaggagataccatatgaatcaattaaacctggcggcagcgcaaaagatg

SEQ ID NO: 22628 - DNA, 103 bp, Artificial Sequence
  Synthetic Polynucleotide
taatacgactcactatagggtactgaggtttagagggtaattgattttcaaacagaggagatgaaaaatgattaccctcaacctggcggcagcgcaaaagatg

SEQ ID NO: 22629 - DNA, 103 bp, Artificial Sequence
  Synthetic Polynucleotide
taatacgactcactatagggtaatgtactgaggtttagagggtaattgataacagaggagaatcaatatgcctctaaacaacctggcggcagcgcaaaagatg

SEQ ID NO: 22630 - DNA, 103 bp, Artificial Sequence
  Synthetic Polynucleotide
taatacgactcactatagggatggttaatgtactgaggtttagagggtaaaacagaggagattacccatgaaacctcagaacctggcggcagcgcaaaagatg

SEQ ID NO: 22631 - DNA, 103 bp, Artificial Sequence
  Synthetic Polynucleotide
taatacgactcactatagggcatgacgagctaagttactcaatgcctgttaacagaggagaaacaggatgtgagtaactaacctggcggcagcgcaaaagatg

SEQ ID NO: 22632 - DNA, 103 bp, Artificial Sequence
  Synthetic Polynucleotide
taatacgactcactatagggggatgatggttaatgtactgaggtttagagaacagaggagactctaaatgtcagtacataacctggcggcagcgcaaaagatg

SEQ ID NO: 22633 - DNA, 103 bp, Artificial Sequence
  Synthetic Polynucleotide
taatacgactcactatagggcacgtggatgatggttaatgtactgaggttaacagaggagaaacctcatgacattaaccaacctggcggcagcgcaaaagatg

SEQ ID NO: 22634 - DNA, 103 bp, Artificial Sequence
  Synthetic Polynucleotide
taatacgactcactatagggtcttgcacgtggatgatggttaatgtactgaacagaggagacagtacatgaaccatcataacctggcggcagcgcaaaagatg

SEQ ID NO: 22635 - DNA, 103 bp, Artificial Sequence
  Synthetic Polynucleotide
taatacgactcactatagggattgatcttgcacgtggatgatggttaatgaacagaggagacattaaatgtcatccacgaacctggcggcagcgcaaaagatg

SEQ ID NO: 22636 - DNA, 103 bp, Artificial Sequence
  Synthetic Polynucleotide
taatacgactcactatagggaactcattgatcttgcacgtggatgatggtaacagaggagaaccatcatgcacgtgcaaaacctggcggcagcgcaaaagatg

SEQ ID NO: 22637 - DNA, 103 bp, Artificial Sequence
  Synthetic Polynucleotide
taatacgactcactatagggggttgaactcattgatcttgcacgtggatgaacagaggagacatccaatggcaagatcaaacctggcggcagcgcaaaagatg

SEQ ID NO: 22638 - DNA, 103 bp, Artificial Sequence
  Synthetic Polynucleotide
taatacgactcactatagggctacgggttgaactcattgatcttgcacgtaacagaggagaacgtgcatgatcaatgagaacctggcggcagcgcaaaagatg

SEQ ID NO: 22639 - DNA, 103 bp, Artificial Sequence
  Synthetic Polynucleotide
taatacgactcactatagggtactactacgggttgaactcattgatcttgaacagaggagacaagatatgtgagttcaaaacctggcggcagcgcaaaagatg

SEQ ID NO: 22640 - DNA, 103 bp, Artificial Sequence
  Synthetic Polynucleotide
taatacgactcactatagggttctgtactactacgggttgaactcattgaaacagaggagatcaatgatgtcaacccgtaacctggcggcagcgcaaaagatg

SEQ ID NO: 22641 - DNA, 103 bp, Artificial Sequence
  Synthetic Polynucleotide
taatacgactcactatagggctaccttctgtactactacgggttgaactcaacagaggagagagttcatgccgtagtagaacctggcggcagcgcaaaagatg

SEQ ID NO: 22642 - DNA, 103 bp, Artificial Sequence
  Synthetic Polynucleotide
taatacgactcactatagggatgtaaatccatcttttaaagaatattaacaacagaggagagttaatatgctttaaaagaacctggcggcagcgcaaaagatg

SEQ ID NO: 22643 - DNA, 103 bp, Artificial Sequence
  Synthetic Polynucleotide
taatacgactcactatagggctctccatgacgagctaagttactcaatgcaacagaggagagcattgatgaacttagctaacctggcggcagcgcaaaagatg

SEQ ID NO: 22644 - DNA, 103 bp, Artificial Sequence
  Synthetic Polynucleotide
taatacgactcactatagggtagggctaccttctgtactactacgggttgaacagaggagacaacccatggtagtacagaacctggcggcagcgcaaaagatg

SEQ ID NO: 22645 - DNA, 103 bp, Artificial Sequence
  Synthetic Polynucleotide
taatacgactcactatagggattagtagggctaccttctgtactactacgaacagaggagacgtagtatgacagaaggtaacctggcggcagcgcaaaagatg

SEQ ID NO: 22646 - DNA, 103 bp, Artificial Sequence
  Synthetic Polynucleotide
taatacgactcactataggggcatgattagtagggctaccttctgtactaaacagaggagatagtacatgaggtagcccaacctggcggcagcgcaaaagatg

SEQ ID NO: 22647 - DNA, 103 bp, Artificial Sequence
  Synthetic Polynucleotide
taatacgactcactataggggggaagcatgattagtagggctaccttctgaacagaggagacagaagatggccctactaaacctggcggcagcgcaaaagatg

SEQ ID NO: 22648 - DNA, 103 bp, Artificial Sequence
  Synthetic Polynucleotide
taatacgactcactatagggagcacgggaagcatgattagtagggctaccaacagaggagaggtagcatgactaatcataacctggcggcagcgcaaaagatg

SEQ ID NO: 22649 - DNA, 103 bp, Artificial Sequence
  Synthetic Polynucleotide
taatacgactcactatagggggtcgagcacgggaagcatgattagtagggaacagaggagaccctacatgtcatgcttcaacctggcggcagcgcaaaagatg

SEQ ID NO: 22650 - DNA, 103 bp, Artificial Sequence
  Synthetic Polynucleotide
taatacgactcactatagggaaagtggtcgagcacgggaagcatgattagaacagaggagactaatcatgcttcccgtgaacctggcggcagcgcaaaagatg

SEQ ID NO: 22651 - DNA, 103 bp, Artificial Sequence
  Synthetic Polynucleotide
taatacgactcactatagggtgttgaaagtggtcgagcacgggaagcatgaacagaggagacatgctatgcgtgctcgaaacctggcggcagcgcaaaagatg

SEQ ID NO: 22652 - DNA, 103 bp, Artificial Sequence
  Synthetic Polynucleotide
taatacgactcactatagggttaaatgttgaaagtggtcgagcacgggaaaacagaggagattcccgatgtcgaccactaacctggcggcagcgcaaaagatg

SEQ ID NO: 22653 - DNA, 103 bp, Artificial Sequence
  Synthetic Polynucleotide
taatacgactcactatagggatagattaaatgttgaaagtggtcgagcacaacagaggagagtgctcatgcactttcaaaacctggcggcagcgcaaaagatg

SEQ ID NO: 22654 - DNA, 103 bp, Artificial Sequence
  Synthetic Polynucleotide
taatacgactcactataggggcgtactctccatgacgagctaagttactcaacagaggagagagtaaatgagctcgtcaaacctggcggcagcgcaaaagatg

SEQ ID NO: 22655 - DNA, 103 bp, Artificial Sequence
  Synthetic Polynucleotide
taatacgactcactatagggtttcgatagattaaatgttgaaagtggtcgaacagaggagacgaccaatgtcaacatttaacctggcggcagcgcaaaagatg

SEQ ID NO: 22656 - DNA, 103 bp, Artificial Sequence
  Synthetic Polynucleotide
taatacgactcactatagggggaggtttcgatagattaaatgttgaaagtaacagaggagaactttcatgatttaatctaacctggcggcagcgcaaaagatg

SEQ ID NO: 22657 - DNA, 103 bp, Artificial Sequence
  Synthetic Polynucleotide
taatacgactcactatagggggggaggaggtttcgatagattaaatgttgaacagaggagacaacatatgatctatcgaaacctggcggcagcgcaaaagatg

SEQ ID NO: 22658 - DNA, 103 bp, Artificial Sequence
  Synthetic Polynucleotide
taatacgactcactatagggcggggggggaggaggtttcgatagattaaaaacagaggagatttaatatgtcgaaacctaacctggcggcagcgcaaaagatg

SEQ ID NO: 22659 - DNA, 103 bp, Artificial Sequence
  Synthetic Polynucleotide
taatacgactcactatagggtctttcggggggggaggaggtttcgatagaaacagaggagatctatcatgacctcctccaacctggcggcagcgcaaaagatg

SEQ ID NO: 22660 - DNA, 103 bp, Artificial Sequence
  Synthetic Polynucleotide
taatacgactcactatagggacatgtctttcggggggggaggaggtttcgaacagaggagacgaaacatgctcccccccaacctggcggcagcgcaaaagatg

SEQ ID NO: 22661 - DNA, 103 bp, Artificial Sequence
  Synthetic Polynucleotide
taatacgactcactatagggcctgcacatgtctttcggggggggaggaggaacagaggagacctcctatgcccccgaaaaacctggcggcagcgcaaaagatg

SEQ ID NO: 22662 - DNA, 103 bp, Artificial Sequence
  Synthetic Polynucleotide
taatacgactcactatagggatgttcctgcacatgtctttcggggggggaaacagaggagatcccccatggaaagacataacctggcggcagcgcaaaagatg

SEQ ID NO: 22663 - DNA, 103 bp, Artificial Sequence
  Synthetic Polynucleotide
taatacgactcactatagggttttcatgttcctgcacatgtctttcggggaacagaggagaccccgaatgacatgtgcaaacctggcggcagcgcaaaagatg

SEQ ID NO: 22664 - DNA, 103 bp, Artificial Sequence
  Synthetic Polynucleotide
taatacgactcactatagggcccaattttcatgttcctgcacatgtctttaacagaggagaaaagacatgtgcaggaacaacctggcggcagcgcaaaagatg

SEQ ID NO: 22665 - DNA, 103 bp, Artificial Sequence
  Synthetic Polynucleotide
taatacgactcactatagggatggtgcgtactctccatgacgagctaagtaacagaggagaacttagatggtcatggagaacctggcggcagcgcaaaagatg

SEQ ID NO: 22666 - DNA, 103 bp, Artificial Sequence
  Synthetic Polynucleotide
taatacgactcactatagggggtaacccaattttcatgttcctgcacatgaacagaggagacatgtgatggaacatgaaaacctggcggcagcgcaaaagatg

SEQ ID NO: 22667 - DNA, 103 bp, Artificial Sequence
  Synthetic Polynucleotide
taatacgactcactatagggtacagggtaacccaattttcatgttcctgcaacagaggagagcaggaatgtgaaaattgaacctggcggcagcgcaaaagatg

SEQ ID NO: 22668 - DNA, 103 bp, Artificial Sequence
  Synthetic Polynucleotide
taatacgactcactataggggtcagtacagggtaacccaattttcatgttaacagaggagaaacatgatgattgggttaaacctggcggcagcgcaaaagatg

SEQ ID NO: 22669 - DNA, 103 bp, Artificial Sequence
  Synthetic Polynucleotide
taatacgactcactataggggcggggtcagtacagggtaacccaattttcaacagaggagagaaaatatggttaccctgaacctggcggcagcgcaaaagatg

SEQ ID NO: 22670 - DNA, 103 bp, Artificial Sequence
  Synthetic Polynucleotide
taatacgactcactatagggtgcaagcggggtcagtacagggtaacccaaaacagaggagattgggtatgcctgtactgaacctggcggcagcgcaaaagatg

SEQ ID NO: 22671 - DNA, 103 bp, Artificial Sequence
  Synthetic Polynucleotide
taatacgactcactatagggcctgttgcaagcggggtcagtacagggtaaaacagaggagattacccatgactgaccccaacctggcggcagcgcaaaagatg

SEQ ID NO: 22672 - DNA, 103 bp, Artificial Sequence
  Synthetic Polynucleotide
taatacgactcactatagggtgatccctgttgcaagcggggtcagtacagaacagaggagactgtacatgccccgcttgaacctggcggcagcgcaaaagatg

SEQ ID NO: 22673 - DNA, 103 bp, Artificial Sequence
  Synthetic Polynucleotide
taatacgactcactatagggggtcatgatccctgttgcaagcggggtcagaacagaggagactgaccatgcttgcaacaaacctggcggcagcgcaaaagatg

SEQ ID NO: 22674 - DNA, 103 bp, Artificial Sequence
  Synthetic Polynucleotide
taatacgactcactatagggatcaaggtcatgatccctgttgcaagcgggaacagaggagacccgctatgaacagggataacctggcggcagcgcaaaagatg

SEQ ID NO: 22675 - DNA, 103 bp, Artificial Sequence
  Synthetic Polynucleotide
taatacgactcactatagggagattatcaaggtcatgatccctgttgcaaaacagaggagattgcaaatgggatcatgaaacctggcggcagcgcaaaagatg

SEQ ID NO: 22676 - DNA, 103 bp, Artificial Sequence
  Synthetic Polynucleotide
taatacgactcactatagggtgcaaatggtgcgtactctccatgacgagcaacagaggagagctcgtatgggagagtacaacctggcggcagcgcaaaagatg

SEQ ID NO: 22677 - DNA, 103 bp, Artificial Sequence
  Synthetic Polynucleotide
taatacgactcactatagggttgttagattatcaaggtcatgatccctgtaacagaggagaacagggatgatgaccttgaacctggcggcagcgcaaaagatg

SEQ ID NO: 22678 - DNA, 103 bp, Artificial Sequence
  Synthetic Polynucleotide
taatacgactcactatagggacgatttgttagattatcaaggtcatgatcaacagaggagagatcatatgcttgataataacctggcggcagcgcaaaagatg

SEQ ID NO: 22679 - DNA, 103 bp, Artificial Sequence
  Synthetic Polynucleotide
taatacgactcactatagggagttcacgatttgttagattatcaaggtcaaacagaggagatgacctatgtaatctaacaacctggcggcagcgcaaaagatg

SEQ ID NO: 22680 - DNA, 103 bp, Artificial Sequence
  Synthetic Polynucleotide
taatacgactcactataggggcaaaagttcacgatttgttagattatcaaaacagaggagattgataatgtaacaaatcaacctggcggcagcgcaaaagatg

SEQ ID NO: 22681 - DNA, 103 bp, Artificial Sequence
  Synthetic Polynucleotide
taatacgactcactatagggcaacagcaaaagttcacgatttgttagattaacagaggagaaatctaatgaatcgtgaaaacctggcggcagcgcaaaagatg

SEQ ID NO: 22682 - DNA, 103 bp, Artificial Sequence
  Synthetic Polynucleotide
taatacgactcactataggggccatcaacagcaaaagttcacgatttgttaacagaggagaaacaaaatgtgaacttttaacctggcggcagcgcaaaagatg

SEQ ID NO: 22683 - DNA, 103 bp, Artificial Sequence
  Synthetic Polynucleotide
taatacgactcactatagggtccgtgccatcaacagcaaaagttcacgataacagaggagaatcgtgatgttttgctgtaacctggcggcagcgcaaaagatg

SEQ ID NO: 22684 - DNA, 103 bp, Artificial Sequence
  Synthetic Polynucleotide
taatacgactcactatagggcatcttccgtgccatcaacagcaaaagttcaacagaggagagaacttatgctgttgatgaacctggcggcagcgcaaaagatg

SEQ ID NO: 22685 - DNA, 103 bp, Artificial Sequence
  Synthetic Polynucleotide
taatacgactcactataggggggagcatcttccgtgccatcaacagcaaaaacagaggagatttgctatggatggcacgaacctggcggcagcgcaaaagatg

SEQ ID NO: 22686 - DNA, 103 bp, Artificial Sequence
  Synthetic Polynucleotide
taatacgactcactatagggtattggggagcatcttccgtgccatcaacaaacagaggagatgttgaatgcacggaagaaacctggcggcagcgcaaaagatg

SEQ ID NO: 22687 - DNA, 103 bp, Artificial Sequence
  Synthetic Polynucleotide
taatacgactcactatagggacccgtgcaaatggtgcgtactctccatgaaacagaggagatcatggatggtacgcaccaacctggcggcagcgcaaaagatg

SEQ ID NO: 22688 - DNA, 103 bp, Artificial Sequence
  Synthetic Polynucleotide
taatacgactcactatagggatctgtattggggagcatcttccgtgccataacagaggagaatggcaatgaagatgctcaacctggcggcagcgcaaaagatg

SEQ ID NO: 22689 - DNA, 103 bp, Artificial Sequence
  Synthetic Polynucleotide
taatacgactcactataggggccttatctgtattggggagcatcttccgtaacagaggagaacggaaatggctccccaaaacctggcggcagcgcaaaagatg

SEQ ID NO: 22690 - DNA, 103 bp, Artificial Sequence
  Synthetic Polynucleotide
taatacgactcactatagggtgaaagccttatctgtattggggagcatctaacagaggagaagatgcatgccaatacagaacctggcggcagcgcaaaagatg

SEQ ID NO: 22691 - DNA, 103 bp, Artificial Sequence
  Synthetic Polynucleotide
taatacgactcactatagggacttttgaaagccttatctgtattggggagaacagaggagactccccatgacagataagaacctggcggcagcgcaaaagatg

SEQ ID NO: 22692 - DNA, 103 bp, Artificial Sequence
  Synthetic Polynucleotide
taatacgactcactatagggtgctgacttttgaaagccttatctgtattgaacagaggagacaatacatgtaaggctttaacctggcggcagcgcaaaagatg

SEQ ID NO: 22693 - DNA, 103 bp, Artificial Sequence
  Synthetic Polynucleotide
taatacgactcactatagggagtcctgctgacttttgaaagccttatctgaacagaggagacagataatgctttcaaaaaacctggcggcagcgcaaaagatg

SEQ ID NO: 22694 - DNA, 103 bp, Artificial Sequence
  Synthetic Polynucleotide
taatacgactcactatagggtccacagtcctgctgacttttgaaagccttaacagaggagaaaggctatgaaaagtcagaacctggcggcagcgcaaaagatg

SEQ ID NO: 22695 - DNA, 103 bp, Artificial Sequence
  Synthetic Polynucleotide
taatacgactcactatagggggcgatccacagtcctgctgacttttgaaaaacagaggagatttcaaatgtcagcaggaaacctggcggcagcgcaaaagatg

SEQ ID NO: 22696 - DNA, 103 bp, Artificial Sequence
  Synthetic Polynucleotide
taatacgactcactataggggagatggcgatccacagtcctgctgactttaacagaggagaaaagtcatgaggactgtgaacctggcggcagcgcaaaagatg

SEQ ID NO: 22697 - DNA, 103 bp, Artificial Sequence
  Synthetic Polynucleotide
taatacgactcactatagggggaaagagatggcgatccacagtcctgctgaacagaggagacagcagatgtgtggatcgaacctggcggcagcgcaaaagatg

SEQ ID NO: 22698 - DNA, 103 bp, Artificial Sequence
  Synthetic Polynucleotide
taatacgactcactatagggtcaaaacccgtgcaaatggtgcgtactctcaacagaggagagagagtatgcaccatttgaacctggcggcagcgcaaaagatg

SEQ ID NO: 22699 - DNA, 103 bp, Artificial Sequence
  Synthetic Polynucleotide
taatacgactcactatagggcctttggaaagagatggcgatccacagtccaacagaggagaggactgatgatcgccatcaacctggcggcagcgcaaaagatg

SEQ ID NO: 22700 - DNA, 103 bp, Artificial Sequence
  Synthetic Polynucleotide
taatacgactcactatagggaaagccctttggaaagagatggcgatccacaacagaggagagtggatatgcatctctttaacctggcggcagcgcaaaagatg

SEQ ID NO: 22701 - DNA, 103 bp, Artificial Sequence
  Synthetic Polynucleotide
taatacgactcactatagggctttgaaagccctttggaaagagatggcgaaacagaggagatcgccaatgctttccaaaaacctggcggcagcgcaaaagatg

SEQ ID NO: 22702 - DNA, 103 bp, Artificial Sequence
  Synthetic Polynucleotide
taatacgactcactatagggttgtcctttgaaagccctttggaaagagataacagaggagaatctctatgcaaagggctaacctggcggcagcgcaaaagatg

SEQ ID NO: 22703 - DNA, 103 bp, Artificial Sequence
  Synthetic Polynucleotide
taatacgactcactatagggcctgcttgtcctttgaaagccctttggaaaaacagaggagatttccaatgggctttcaaaacctggcggcagcgcaaaagatg

SEQ ID NO: 22704 - DNA, 103 bp, Artificial Sequence
  Synthetic Polynucleotide
taatacgactcactatagggttgttcctgcttgtcctttgaaagccctttaacagaggagaaaagggatgtcaaaggacaacctggcggcagcgcaaaagatg

SEQ ID NO: 22705 - DNA, 103 bp, Artificial Sequence
  Synthetic Polynucleotide
taatacgactcactatagggtttgcttgttcctgcttgtcctttgaaagcaacagaggagagctttcatgggacaagcaaacctggcggcagcgcaaaagatg

SEQ ID NO: 22706 - DNA, 103 bp, Artificial Sequence
  Synthetic Polynucleotide
taatacgactcactatagggcatcctttgcttgttcctgcttgtcctttgaacagaggagacaaaggatgagcaggaacaacctggcggcagcgcaaaagatg

SEQ ID NO: 22707 - DNA, 103 bp, Artificial Sequence
  Synthetic Polynucleotide
taatacgactcactatagggcagtacatcctttgcttgttcctgcttgtcaacagaggagagacaagatggaacaagcaaacctggcggcagcgcaaaagatg

SEQ ID NO: 22708 - DNA, 103 bp, Artificial Sequence
  Synthetic Polynucleotide
taatacgactcactatagggaaagtcagtacatcctttgcttgttcctgcaacagaggagagcaggaatgagcaaaggaaacctggcggcagcgcaaaagatg

SEQ ID NO: 22709 - DNA, 103 bp, Artificial Sequence
  Synthetic Polynucleotide
taatacgactcactatagggtaaattcaaaacccgtgcaaatggtgcgtaaacagaggagatacgcaatgtttgcacggaacctggcggcagcgcaaaagatg

SEQ ID NO: 22710 - DNA, 103 bp, Artificial Sequence
  Synthetic Polynucleotide
taatacgactcactatagggtttccaaagtcagtacatcctttgcttgttaacagaggagaaacaagatgaggatgtacaacctggcggcagcgcaaaagatg

SEQ ID NO: 22711 - DNA, 103 bp, Artificial Sequence
  Synthetic Polynucleotide
taatacgactcactatagggtagattttccaaagtcagtacatcctttgcaacagaggagagcaaagatggtactgactaacctggcggcagcgcaaaagatg

SEQ ID NO: 22712 - DNA, 103 bp, Artificial Sequence
  Synthetic Polynucleotide
taatacgactcactatagggtgccctagattttccaaagtcagtacatccaacagaggagaggatgtatggactttggaaacctggcggcagcgcaaaagatg

SEQ ID NO: 22713 - DNA, 103 bp, Artificial Sequence
  Synthetic Polynucleotide
taatacgactcactatagggatatgtgccctagattttccaaagtcagtaaacagaggagatactgaatgtggaaaatcaacctggcggcagcgcaaaagatg

SEQ ID NO: 22714 - DNA, 103 bp, Artificial Sequence
  Synthetic Polynucleotide
taatacgactcactatagggattcaatatgtgccctagattttccaaagtaacagaggagaactttgatgaatctagggaacctggcggcagcgcaaaagatg

SEQ ID NO: 22715 - DNA, 103 bp, Artificial Sequence
  Synthetic Polynucleotide
taatacgactcactatagggagataattcaatatgtgccctagattttccaacagaggagaggaaaaatgagggcacataacctggcggcagcgcaaaagatg

SEQ ID NO: 22716 - DNA, 103 bp, Artificial Sequence
  Synthetic Polynucleotide
taatacgactcactatagggtatgaagataattcaatatgtgccctagataacagaggagaatctagatgacatattgaaacctggcggcagcgcaaaagatg

SEQ ID NO: 22717 - DNA, 103 bp, Artificial Sequence
  Synthetic Polynucleotide
taatacgactcactatagggtgatctatgaagataattcaatatgtgcccaacagaggagagggcacatgttgaattataacctggcggcagcgcaaaagatg

SEQ ID NO: 22718 - DNA, 103 bp, Artificial Sequence
  Synthetic Polynucleotide
taatacgactcactatagggatttctgatctatgaagataattcaatatgaacagaggagacatattatgttatcttcaaacctggcggcagcgcaaaagatg

SEQ ID NO: 22719 - DNA, 103 bp, Artificial Sequence
  Synthetic Polynucleotide
taatacgactcactatagggttccgatttctgatctatgaagataattcaaacagaggagatgaattatgttcatagataacctggcggcagcgcaaaagatg

SEQ ID NO: 22720 - DNA, 103 bp, Artificial Sequence
  Synthetic Polynucleotide
taatacgactcactatagggcctgataaattcaaaacccgtgcaaatggtaacagaggagaaccattatgacgggttttaacctggcggcagcgcaaaagatg

SEQ ID NO: 22721 - DNA, 103 bp, Artificial Sequence
  Synthetic Polynucleotide
taatacgactcactatagggcaattttccgatttctgatctatgaagataaacagaggagatatcttatgagatcagaaaacctggcggcagcgcaaaagatg

SEQ ID NO: 22722 - DNA, 103 bp, Artificial Sequence
  Synthetic Polynucleotide
taatacgactcactatagggtcgtccaattttccgatttctgatctatgaaacagaggagatcatagatgagaaatcggaacctggcggcagcgcaaaagatg

SEQ ID NO: 22723 - DNA, 103 bp, Artificial Sequence
  Synthetic Polynucleotide
taatacgactcactatagggatgtctcgtccaattttccgatttctgatcaacagaggagagatcagatgtcggaaaataacctggcggcagcgcaaaagatg

SEQ ID NO: 22724 - DNA, 103 bp, Artificial Sequence
  Synthetic Polynucleotide
taatacgactcactataggggagtgatgtctcgtccaattttccgatttcaacagaggagagaaatcatgaaattggacaacctggcggcagcgcaaaagatg

SEQ ID NO: 22725 - DNA, 103 bp, Artificial Sequence
  Synthetic Polynucleotide
taatacgactcactataggggcacggagtgatgtctcgtccaattttccgaacagaggagacggaaaatgggacgagacaacctggcggcagcgcaaaagatg

SEQ ID NO: 22726 - DNA, 103 bp, Artificial Sequence
  Synthetic Polynucleotide
taatacgactcactatagggatgctgcacggagtgatgtctcgtccaattaacagaggagaaattggatgagacatcacaacctggcggcagcgcaaaagatg

SEQ ID NO: 22727 - DNA, 103 bp, Artificial Sequence
  Synthetic Polynucleotide
taatacgactcactatagggactcaatgctgcacggagtgatgtctcgtcaacagaggagagacgagatgtcactccgtaacctggcggcagcgcaaaagatg

SEQ ID NO: 22728 - DNA, 103 bp, Artificial Sequence
  Synthetic Polynucleotide
taatacgactcactataggggttaaactcaatgctgcacggagtgatgtcaacagaggagagacatcatgccgtgcagcaacctggcggcagcgcaaaagatg

SEQ ID NO: 22729 - DNA, 103 bp, Artificial Sequence
  Synthetic Polynucleotide
taatacgactcactatagggcacatgttaaactcaatgctgcacggagtgaacagaggagacactccatgcagcattgaaacctggcggcagcgcaaaagatg

SEQ ID NO: 22730 - DNA, 103 bp, Artificial Sequence
  Synthetic Polynucleotide
taatacgactcactatagggtccggcacatgttaaactcaatgctgcacgaacagaggagacgtgcaatgttgagtttaaacctggcggcagcgcaaaagatg

SEQ ID NO: 22731 - DNA, 103 bp, Artificial Sequence
  Synthetic Polynucleotide
taatacgactcactatagggtgatccctgataaattcaaaacccgtgcaaaacagaggagattgcacatgttttgaattaacctggcggcagcgcaaaagatg

SEQ ID NO: 22732 - DNA, 103 bp, Artificial Sequence
  Synthetic Polynucleotide
taatacgactcactatagggcggattccggcacatgttaaactcaatgctaacagaggagaagcattatgtttaacatgaacctggcggcagcgcaaaagatg

SEQ ID NO: 22733 - DNA, 103 bp, Artificial Sequence
  Synthetic Polynucleotide
taatacgactcactatagggtctttcggattccggcacatgttaaactcaaacagaggagatgagttatgcatgtgccgaacctggcggcagcgcaaaagatg

SEQ ID NO: 22734 - DNA, 103 bp, Artificial Sequence
  Synthetic Polynucleotide
taatacgactcactatagggatttgtctttcggattccggcacatgttaaaacagaggagattaacaatggccggaatcaacctggcggcagcgcaaaagatg

SEQ ID NO: 22735 - DNA, 103 bp, Artificial Sequence
  Synthetic Polynucleotide
taatacgactcactataggggacctatttgtctttcggattccggcacataacagaggagaatgtgcatgaatccgaaaaacctggcggcagcgcaaaagatg

SEQ ID NO: 22736 - DNA, 103 bp, Artificial Sequence
  Synthetic Polynucleotide
taatacgactcactatagggtcaaagacctatttgtctttcggattccggaacagaggagaccggaaatggaaagacaaaacctggcggcagcgcaaaagatg

SEQ ID NO: 22737 - DNA, 103 bp, Artificial Sequence
  Synthetic Polynucleotide
taatacgactcactatagggattaatcaaagacctatttgtctttcggataacagaggagaatccgaatgacaaataggaacctggcggcagcgcaaaagatg

SEQ ID NO: 22738 - DNA, 103 bp, Artificial Sequence
  Synthetic Polynucleotide
taatacgactcactatagggatagtattaatcaaagacctatttgtctttaacagaggagaaaagacatgtaggtctttaacctggcggcagcgcaaaagatg

SEQ ID NO: 22739 - DNA, 103 bp, Artificial Sequence
  Synthetic Polynucleotide
taatacgactcactatagggctgtcatagtattaatcaaagacctatttgaacagaggagacaaataatgctttgattaaacctggcggcagcgcaaaagatg

SEQ ID NO: 22740 - DNA, 103 bp, Artificial Sequence
  Synthetic Polynucleotide
taatacgactcactatagggcaattctgtcatagtattaatcaaagacctaacagaggagaaggtctatgattaatactaacctggcggcagcgcaaaagatg

SEQ ID NO: 22741 - DNA, 103 bp, Artificial Sequence
  Synthetic Polynucleotide
taatacgactcactatagggatatgcaattctgtcatagtattaatcaaaaacagaggagatttgatatgtactatgacaacctggcggcagcgcaaaagatg

SEQ ID NO: 22742 - DNA, 103 bp, Artificial Sequence
  Synthetic Polynucleotide
taatacgactcactataggggttattgatccctgataaattcaaaacccgaacagaggagacgggttatgaatttatcaaacctggcggcagcgcaaaagatg

SEQ ID NO: 22743 - DNA, 103 bp, Artificial Sequence
  Synthetic Polynucleotide
taatacgactcactatagggggttgatatgcaattctgtcatagtattaaaacagaggagattaataatgtgacagaataacctggcggcagcgcaaaagatg

SEQ ID NO: 22744 - DNA, 103 bp, Artificial Sequence
  Synthetic Polynucleotide
taatacgactcactatagggctcatggttgatatgcaattctgtcatagtaacagaggagaactatgatggaattgcataacctggcggcagcgcaaaagatg

SEQ ID NO: 22745 - DNA, 103 bp, Artificial Sequence
  Synthetic Polynucleotide
taatacgactcactatagggagattctcatggttgatatgcaattctgtcaacagaggagagacagaatggcatatcaaaacctggcggcagcgcaaaagatg

SEQ ID NO: 22746 - DNA, 103 bp, Artificial Sequence
  Synthetic Polynucleotide
taatacgactcactataggggtggaagattctcatggttgatatgcaattaacagaggagaaattgcatgtcaaccatgaacctggcggcagcgcaaaagatg

SEQ ID NO: 22747 - DNA, 103 bp, Artificial Sequence
  Synthetic Polynucleotide
taatacgactcactataggggtcctgtggaagattctcatggttgatatgaacagaggagacatatcatgcatgagaataacctggcggcagcgcaaaagatg

SEQ ID NO: 22748 - DNA, 103 bp, Artificial Sequence
  Synthetic Polynucleotide
taatacgactcactatagggttttggtcctgtggaagattctcatggttgaacagaggagacaaccaatggaatcttccaacctggcggcagcgcaaaagatg

SEQ ID NO: 22749 - DNA, 103 bp, Artificial Sequence
  Synthetic Polynucleotide
taatacgactcactatagggcaccattttggtcctgtggaagattctcataacagaggagaatgagaatgttccacaggaacctggcggcagcgcaaaagatg

SEQ ID NO: 22750 - DNA, 103 bp, Artificial Sequence
  Synthetic Polynucleotide
taatacgactcactatagggaataacaccattttggtcctgtggaagattaacagaggagaaatcttatgcaggaccaaaacctggcggcagcgcaaaagatg

SEQ ID NO: 22751 - DNA, 103 bp, Artificial Sequence
  Synthetic Polynucleotide
taatacgactcactatagggtgcttaataacaccattttggtcctgtggaaacagaggagatccacaatgccaaaatggaacctggcggcagcgcaaaagatg

SEQ ID NO: 22752 - DNA, 103 bp, Artificial Sequence
  Synthetic Polynucleotide
taatacgactcactatagggatgtctgcttaataacaccattttggtcctaacagaggagaaggaccatgatggtgttaaacctggcggcagcgcaaaagatg

SEQ ID NO: 22753 - DNA, 103 bp, Artificial Sequence
  Synthetic Polynucleotide
taatacgactcactatagggaaactatgtaaatccatcttttaaagaataaacagaggagatattctatgaaagatggaaacctggcggcagcgcaaaagatg

SEQ ID NO: 22754 - DNA, 103 bp, Artificial Sequence
  Synthetic Polynucleotide
taatacgactcactatagggtcaaggttattgatccctgataaattcaaaaacagaggagatttgaaatgatcagggataacctggcggcagcgcaaaagatg

SEQ ID NO: 22755 - DNA, 103 bp, Artificial Sequence
  Synthetic Polynucleotide
taatacgactcactatagggtgtatatgtctgcttaataacaccattttgaacagaggagacaaaatatggttattaagaacctggcggcagcgcaaaagatg

SEQ ID NO: 22756 - DNA, 103 bp, Artificial Sequence
  Synthetic Polynucleotide
taatacgactcactatagggatacctgtatatgtctgcttaataacaccaaacagaggagatggtgtatgtaagcagacaacctggcggcagcgcaaaagatg

SEQ ID NO: 22757 - DNA, 103 bp, Artificial Sequence
  Synthetic Polynucleotide
taatacgactcactataggggatgaatacctgtatatgtctgcttaataaaacagaggagattattaatgagacatataaacctggcggcagcgcaaaagatg

SEQ ID NO: 22758 - DNA, 103 bp, Artificial Sequence
  Synthetic Polynucleotide
taatacgactcactataggggtcaagatgaatacctgtatatgtctgcttaacagaggagaaagcagatgtatacaggtaacctggcggcagcgcaaaagatg

SEQ ID NO: 22759 - DNA, 103 bp, Artificial Sequence
  Synthetic Polynucleotide
taatacgactcactatagggcctttgtcaagatgaatacctgtatatgtcaacagaggagagacataatgaggtattcaaacctggcggcagcgcaaaagatg

SEQ ID NO: 22760 - DNA, 103 bp, Artificial Sequence
  Synthetic Polynucleotide
taatacgactcactataggggaccccctttgtcaagatgaatacctgtataacagaggagaatacagatgttcatcttgaacctggcggcagcgcaaaagatg

SEQ ID NO: 22761 - DNA, 103 bp, Artificial Sequence
  Synthetic Polynucleotide
taatacgactcactatagggaaattgaccccctttgtcaagatgaataccaacagaggagaggtattatgcttgacaaaaacctggcggcagcgcaaaagatg

SEQ ID NO: 22762 - DNA, 103 bp, Artificial Sequence
  Synthetic Polynucleotide
taatacgactcactataggggcttcaaattgaccccctttgtcaagatgaaacagaggagatcatctatgcaaagggggaacctggcggcagcgcaaaagatg

SEQ ID NO: 22763 - DNA, 103 bp, Artificial Sequence
  Synthetic Polynucleotide
taatacgactcactatagggaggcagcttcaaattgaccccctttgtcaaaacagaggagattgacaatgggggtcaataacctggcggcagcgcaaaagatg

SEQ ID NO: 22764 - DNA, 103 bp, Artificial Sequence
  Synthetic Polynucleotide
taatacgactcactatagggccataaggcagcttcaaattgaccccctttaacagaggagaaaagggatgcaatttgaaaacctggcggcagcgcaaaagatg

SEQ ID NO: 22765 - DNA, 103 bp, Artificial Sequence
  Synthetic Polynucleotide
taatacgactcactatagggcatgctcaaggttattgatccctgataaataacagaggagaatttatatgggatcaataaacctggcggcagcgcaaaagatg

SEQ ID NO: 22766 - DNA, 103 bp, Artificial Sequence
  Synthetic Polynucleotide
taatacgactcactatagggccctgccataaggcagcttcaaattgacccaacagaggagagggtcaatgtgaagctgcaacctggcggcagcgcaaaagatg

SEQ ID NO: 22767 - DNA, 103 bp, Artificial Sequence
  Synthetic Polynucleotide
taatacgactcactatagggcccagccctgccataaggcagcttcaaattaacagaggagaaatttgatgctgccttataacctggcggcagcgcaaaagatg

SEQ ID NO: 22768 - DNA, 103 bp, Artificial Sequence
  Synthetic Polynucleotide
taatacgactcactatagggcttgtcccagccctgccataaggcagcttcaacagaggagagaagctatgttatggcagaacctggcggcagcgcaaaagatg

SEQ ID NO: 22769 - DNA, 103 bp, Artificial Sequence
  Synthetic Polynucleotide
taatacgactcactataggggacttcttgtcccagccctgccataaggcaaacagaggagatgccttatggcagggctgaacctggcggcagcgcaaaagatg

SEQ ID NO: 22770 - DNA, 103 bp, Artificial Sequence
  Synthetic Polynucleotide
taatacgactcactatagggatattgacttcttgtcccagccctgccataaacagaggagatatggcatggctgggacaaacctggcggcagcgcaaaagatg

SEQ ID NO: 22771 - DNA, 103 bp, Artificial Sequence
  Synthetic Polynucleotide
taatacgactcactatagggcaacgatattgacttcttgtcccagccctgaacagaggagacagggcatggacaagaagaacctggcggcagcgcaaaagatg

SEQ ID NO: 22772 - DNA, 103 bp, Artificial Sequence
  Synthetic Polynucleotide
taatacgactcactatagggacaaacaacgatattgacttcttgtcccagaacagaggagactgggaatggaagtcaataacctggcggcagcgcaaaagatg

SEQ ID NO: 22773 - DNA, 103 bp, Artificial Sequence
  Synthetic Polynucleotide
taatacgactcactatagggcttgcacaaacaacgatattgacttcttgtaacagaggagaacaagaatgcaatatcgtaacctggcggcagcgcaaaagatg

SEQ ID NO: 22774 - DNA, 103 bp, Artificial Sequence
  Synthetic Polynucleotide
taatacgactcactatagggtgcagcttgcacaaacaacgatattgacttaacagaggagaaagtcaatgtcgttgtttaacctggcggcagcgcaaaagatg

SEQ ID NO: 22775 - DNA, 103 bp, Artificial Sequence
  Synthetic Polynucleotide
taatacgactcactatagggtataatgcagcttgcacaaacaacgatattaacagaggagaaatatcatggtttgtgcaaacctggcggcagcgcaaaagatg

SEQ ID NO: 22776 - DNA, 103 bp, Artificial Sequence
  Synthetic Polynucleotide
taatacgactcactataggggagcccatgctcaaggttattgatccctgaaacagaggagatcagggatgaataaccttaacctggcggcagcgcaaaagatg

SEQ ID NO: 22777 - DNA, 103 bp, Artificial Sequence
  Synthetic Polynucleotide
taatacgactcactatagggtcacatataatgcagcttgcacaaacaacgaacagaggagacgttgtatgtgcaagctgaacctggcggcagcgcaaaagatg

SEQ ID NO: 22778 - DNA, 103 bp, Artificial Sequence
  Synthetic Polynucleotide
taatacgactcactatagggattcatcacatataatgcagcttgcacaaaaacagaggagatttgtgatggctgcattaaacctggcggcagcgcaaaagatg

SEQ ID NO: 22779 - DNA, 103 bp, Artificial Sequence
  Synthetic Polynucleotide
taatacgactcactatagggatattattcatcacatataatgcagcttgcaacagaggagagcaagcatgattatatgtaacctggcggcagcgcaaaagatg

SEQ ID NO: 22780 - DNA, 103 bp, Artificial Sequence
  Synthetic Polynucleotide
taatacgactcactatagggaggggatattattcatcacatataatgcagaacagaggagactgcatatgatgtgatgaaacctggcggcagcgcaaaagatg

SEQ ID NO: 22781 - DNA, 103 bp, Artificial Sequence
  Synthetic Polynucleotide
taatacgactcactatagggttcacaggggatattattcatcacatataaaacagaggagattatatatgatgaataataacctggcggcagcgcaaaagatg

SEQ ID NO: 22782 - DNA, 103 bp, Artificial Sequence
  Synthetic Polynucleotide
taatacgactcactataggggacgattcacaggggatattattcatcacaaacagaggagatgtgatatgtaatatcccaacctggcggcagcgcaaaagatg

SEQ ID NO: 22783 - DNA, 103 bp, Artificial Sequence
  Synthetic Polynucleotide
taatacgactcactatagggtgatggacgattcacaggggatattattcaaacagaggagatgaataatgtcccctgtgaacctggcggcagcgcaaaagatg

SEQ ID NO: 22784 - DNA, 103 bp, Artificial Sequence
  Synthetic Polynucleotide
taatacgactcactatagggcacactgatggacgattcacaggggatattaacagaggagaaatatcatgtgtgaatcgaacctggcggcagcgcaaaagatg

SEQ ID NO: 22785 - DNA, 103 bp, Artificial Sequence
  Synthetic Polynucleotide
taatacgactcactataggggcctgcacactgatggacgattcacaggggaacagaggagacccctgatgatcgtccataacctggcggcagcgcaaaagatg

SEQ ID NO: 22786 - DNA, 103 bp, Artificial Sequence
  Synthetic Polynucleotide
taatacgactcactatagggatgaggcctgcacactgatggacgattcacaacagaggagagtgaatatgccatcagtgaacctggcggcagcgcaaaagatg

SEQ ID NO: 22787 - DNA, 103 bp, Artificial Sequence
  Synthetic Polynucleotide
taatacgactcactatagggggatagagcccatgctcaaggttattgatcaacagaggagagatcaaatgccttgagcaaacctggcggcagcgcaaaagatg

SEQ ID NO: 22788 - DNA, 103 bp, Artificial Sequence
  Synthetic Polynucleotide
taatacgactcactatagggatcatatgaggcctgcacactgatggacgaaacagaggagatcgtccatgagtgtgcagaacctggcggcagcgcaaaagatg

SEQ ID NO: 22789 - DNA, 103 bp, Artificial Sequence
  Synthetic Polynucleotide
taatacgactcactatagggaagtgatcatatgaggcctgcacactgatgaacagaggagacatcagatggcaggcctcaacctggcggcagcgcaaaagatg

SEQ ID NO: 22790 - DNA, 103 bp, Artificial Sequence
  Synthetic Polynucleotide
taatacgactcactataggggaataaagtgatcatatgaggcctgcacacaacagaggagagtgtgcatgcctcatatgaacctggcggcagcgcaaaagatg

SEQ ID NO: 22791 - DNA, 103 bp, Artificial Sequence
  Synthetic Polynucleotide
taatacgactcactatagggagggagaataaagtgatcatatgaggcctgaacagaggagacaggccatgtatgatcacaacctggcggcagcgcaaaagatg

SEQ ID NO: 22792 - DNA, 103 bp, Artificial Sequence
  Synthetic Polynucleotide
taatacgactcactatagggtttcgagggagaataaagtgatcatatgagaacagaggagactcataatgtcactttataacctggcggcagcgcaaaagatg

SEQ ID NO: 22793 - DNA, 103 bp, Artificial Sequence
  Synthetic Polynucleotide
taatacgactcactatagggcctgatttcgagggagaataaagtgatcataacagaggagaatgatcatgttattctccaacctggcggcagcgcaaaagatg

SEQ ID NO: 22794 - DNA, 103 bp, Artificial Sequence
  Synthetic Polynucleotide
taatacgactcactatagggttcaccctgatttcgagggagaataaagtgaacagaggagacactttatgctccctcgaaacctggcggcagcgcaaaagatg

SEQ ID NO: 22795 - DNA, 103 bp, Artificial Sequence
  Synthetic Polynucleotide
taatacgactcactatagggtgtctttcaccctgatttcgagggagaataaacagaggagatattctatgtcgaaatcaaacctggcggcagcgcaaaagatg

SEQ ID NO: 22796 - DNA, 103 bp, Artificial Sequence
  Synthetic Polynucleotide
taatacgactcactatagggatcattgtctttcaccctgatttcgagggaaacagaggagatccctcatgatcagggtgaacctggcggcagcgcaaaagatg

SEQ ID NO: 22797 - DNA, 103 bp, Artificial Sequence
  Synthetic Polynucleotide
taatacgactcactatagggtgacaatcattgtctttcaccctgatttcgaacagaggagacgaaatatgggtgaaagaaacctggcggcagcgcaaaagatg

SEQ ID NO: 22798 - DNA, 103 bp, Artificial Sequence
  Synthetic Polynucleotide
taatacgactcactataggggctgaggatagagcccatgctcaaggttataacagaggagaataaccatgagcatgggcaacctggcggcagcgcaaaagatg

SEQ ID NO: 22799 - DNA, 103 bp, Artificial Sequence
  Synthetic Polynucleotide
taatacgactcactatagggtgaaatgacaatcattgtctttcaccctgaaacagaggagatcagggatgaagacaatgaacctggcggcagcgcaaaagatg

SEQ ID NO: 22800 - DNA, 103 bp, Artificial Sequence
  Synthetic Polynucleotide
taatacgactcactataggggattttgaaatgacaatcattgtctttcacaacagaggagagtgaaaatgaatgattgtaacctggcggcagcgcaaaagatg

SEQ ID NO: 22801 - DNA, 103 bp, Artificial Sequence
  Synthetic Polynucleotide
taatacgactcactatagggtcgttgattttgaaatgacaatcattgtctaacagaggagaagacaaatgttgtcatttaacctggcggcagcgcaaaagatg

SEQ ID NO: 22802 - DNA, 103 bp, Artificial Sequence
  Synthetic Polynucleotide
taatacgactcactatagggttatatcgttgattttgaaatgacaatcataacagaggagaatgattatgatttcaaaaaacctggcggcagcgcaaaagatg

SEQ ID NO: 22803 - DNA, 103 bp, Artificial Sequence
  Synthetic Polynucleotide
taatacgactcactatagggaataattatatcgttgattttgaaatgacaaacagaggagatgtcatatgaaaatcaacaacctggcggcagcgcaaaagatg

SEQ ID NO: 22804 - DNA, 103 bp, Artificial Sequence
  Synthetic Polynucleotide
taatacgactcactatagggttaacaataattatatcgttgattttgaaaaacagaggagatttcaaatgcaacgatataacctggcggcagcgcaaaagatg

SEQ ID NO: 22805 - DNA, 103 bp, Artificial Sequence
  Synthetic Polynucleotide
taatacgactcactataggggaatgttaacaataattatatcgttgatttaacagaggagaaaatcaatgatataattaaacctggcggcagcgcaaaagatg

SEQ ID NO: 22806 - DNA, 103 bp, Artificial Sequence
  Synthetic Polynucleotide
taatacgactcactatagggaggtagaatgttaacaataattatatcgttaacagaggagaaacgatatgattattgttaacctggcggcagcgcaaaagatg

SEQ ID NO: 22807 - DNA, 103 bp, Artificial Sequence
  Synthetic Polynucleotide
taatacgactcactatagggaaccaaggtagaatgttaacaataattataaacagaggagatataatatgtgttaacataacctggcggcagcgcaaaagatg

SEQ ID NO: 22808 - DNA, 103 bp, Artificial Sequence
  Synthetic Polynucleotide
taatacgactcactatagggataagaaccaaggtagaatgttaacaataaaacagaggagattattgatgacattctacaacctggcggcagcgcaaaagatg

SEQ ID NO: 22809 - DNA, 103 bp, Artificial Sequence
  Synthetic Polynucleotide
taatacgactcactatagggtgaaagctgaggatagagcccatgctcaagaacagaggagacttgagatggggctctataacctggcggcagcgcaaaagatg

SEQ ID NO: 22810 - DNA, 103 bp, Artificial Sequence
  Synthetic Polynucleotide
taatacgactcactatagggttacaataagaaccaaggtagaatgttaacaacagaggagagttaacatgctaccttggaacctggcggcagcgcaaaagatg

SEQ ID NO: 22811 - DNA, 103 bp, Artificial Sequence
  Synthetic Polynucleotide
taatacgactcactatagggaagtcttacaataagaaccaaggtagaatgaacagaggagacattctatgttggttcttaacctggcggcagcgcaaaagatg

SEQ ID NO: 22812 - DNA, 103 bp, Artificial Sequence
  Synthetic Polynucleotide
taatacgactcactatagggtatacaagtcttacaataagaaccaaggtaaacagaggagataccttatgtcttattgtaacctggcggcagcgcaaaagatg

SEQ ID NO: 22813 - DNA, 103 bp, Artificial Sequence
  Synthetic Polynucleotide
taatacgactcactataggggagagtatacaagtcttacaataagaaccaaacagaggagatggttcatgttgtaagacaacctggcggcagcgcaaaagatg

SEQ ID NO: 22814 - DNA, 103 bp, Artificial Sequence
  Synthetic Polynucleotide
taatacgactcactataggggataggagagtatacaagtcttacaataagaacagaggagacttattatgagacttgtaaacctggcggcagcgcaaaagatg

SEQ ID NO: 22815 - DNA, 103 bp, Artificial Sequence
  Synthetic Polynucleotide
taatacgactcactatagggcagttgataggagagtatacaagtcttacaaacagaggagatgtaagatgtgtatactcaacctggcggcagcgcaaaagatg

SEQ ID NO: 22816 - DNA, 103 bp, Artificial Sequence
  Synthetic Polynucleotide
taatacgactcactatagggagtcacagttgataggagagtatacaagtcaacagaggagagacttgatgactctcctaaacctggcggcagcgcaaaagatg

SEQ ID NO: 22817 - DNA, 103 bp, Artificial Sequence
  Synthetic Polynucleotide
taatacgactcactatagggctagtagtcacagttgataggagagtatacaacagaggagagtatacatgcctatcaacaacctggcggcagcgcaaaagatg

SEQ ID NO: 22818 - DNA, 103 bp, Artificial Sequence
  Synthetic Polynucleotide
taatacgactcactatagggttgaactagtagtcacagttgataggagagaacagaggagactctccatgcaactgtgaaacctggcggcagcgcaaaagatg

SEQ ID NO: 22819 - DNA, 103 bp, Artificial Sequence
  Synthetic Polynucleotide
taatacgactcactatagggtaattttgaactagtagtcacagttgatagaacagaggagactatcaatggtgactactaacctggcggcagcgcaaaagatg

SEQ ID NO: 22820 - DNA, 103 bp, Artificial Sequence
  Synthetic Polynucleotide
taatacgactcactatagggattgctgaaagctgaggatagagcccatgcaacagaggagagcatggatgctatcctcaaacctggcggcagcgcaaaagatg

SEQ ID NO: 22821 - DNA, 103 bp, Artificial Sequence
  Synthetic Polynucleotide
taatacgactcactatagggagttttaattttgaactagtagtcacagttaacagaggagaaactgtatgtactagttcaacctggcggcagcgcaaaagatg

SEQ ID NO: 22822 - DNA, 103 bp, Artificial Sequence
  Synthetic Polynucleotide
taatacgactcactatagggttgtgagttttaattttgaactagtagtcaaacagaggagatgactaatggttcaaaataacctggcggcagcgcaaaagatg

SEQ ID NO: 22823 - DNA, 103 bp, Artificial Sequence
  Synthetic Polynucleotide
taatacgactcactatagggaatttttgtgagttttaattttgaactagtaacagaggagaactagtatgaaattaaaaaacctggcggcagcgcaaaagatg

SEQ ID NO: 22824 - DNA, 103 bp, Artificial Sequence
  Synthetic Polynucleotide
taatacgactcactataggggattgaatttttgtgagttttaattttgaaaacagaggagattcaaaatgaaaactcacaacctggcggcagcgcaaaagatg

SEQ ID NO: 22825 - DNA, 103 bp, Artificial Sequence
  Synthetic Polynucleotide
taatacgactcactatagggaatgcgattgaatttttgtgagttttaattaacagaggagaaattaaatgtcacaaaaaaacctggcggcagcgcaaaagatg

SEQ ID NO: 22826 - DNA, 103 bp, Artificial Sequence
  Synthetic Polynucleotide
taatacgactcactatagggattacaatgcgattgaatttttgtgagtttaacagaggagaaaactcatgaaaattcaaaacctggcggcagcgcaaaagatg

SEQ ID NO: 22827 - DNA, 103 bp, Artificial Sequence
  Synthetic Polynucleotide
taatacgactcactatagggaattgattacaatgcgattgaatttttgtgaacagaggagacacaaaatgtcaatcgcaaacctggcggcagcgcaaaagatg

SEQ ID NO: 22828 - DNA, 103 bp, Artificial Sequence
  Synthetic Polynucleotide
taatacgactcactatagggtaaataattgattacaatgcgattgaatttaacagaggagaaaattcatgcgcattgtaaacctggcggcagcgcaaaagatg

SEQ ID NO: 22829 - DNA, 103 bp, Artificial Sequence
  Synthetic Polynucleotide
taatacgactcactataggggatgataaataattgattacaatgcgattgaacagaggagacaatcgatgtgtaatcaaaacctggcggcagcgcaaaagatg

SEQ ID NO: 22830 - DNA, 103 bp, Artificial Sequence
  Synthetic Polynucleotide
taatacgactcactatagggcaatcgatgataaataattgattacaatgcaacagaggagagcattgatgtcaattattaacctggcggcagcgcaaaagatg

SEQ ID NO: 22831 - DNA, 103 bp, Artificial Sequence
  Synthetic Polynucleotide
taatacgactcactataggggtgcaattgctgaaagctgaggatagagccaacagaggagaggctctatgctcagctttaacctggcggcagcgcaaaagatg

SEQ ID NO: 22832 - DNA, 103 bp, Artificial Sequence
  Synthetic Polynucleotide
taatacgactcactatagggctaaacaatcgatgataaataattgattacaacagaggagagtaatcatgtatttatcaaacctggcggcagcgcaaaagatg

SEQ ID NO: 22833 - DNA, 103 bp, Artificial Sequence
  Synthetic Polynucleotide
taatacgactcactatagggtcaaactaaacaatcgatgataaataattgaacagaggagacaattaatgatcatcgataacctggcggcagcgcaaaagatg

SEQ ID NO: 22834 - DNA, 103 bp, Artificial Sequence
  Synthetic Polynucleotide
taatacgactcactatagggatccctcaaactaaacaatcgatgataaataacagaggagaatttatatgcgattgtttaacctggcggcagcgcaaaagatg

SEQ ID NO: 22835 - DNA, 103 bp, Artificial Sequence
  Synthetic Polynucleotide
taatacgactcactataggggtggaatccctcaaactaaacaatcgatgaaacagaggagatcatcgatggtttagtttaacctggcggcagcgcaaaagatg

SEQ ID NO: 22836 - DNA, 103 bp, Artificial Sequence
  Synthetic Polynucleotide
taatacgactcactatagggatgatgtggaatccctcaaactaaacaatcaacagaggagagattgtatggtttgagggaacctggcggcagcgcaaaagatg

SEQ ID NO: 22837 - DNA, 103 bp, Artificial Sequence
  Synthetic Polynucleotide
taatacgactcactatagggttaagatgatgtggaatccctcaaactaaaaacagaggagatttagtatgagggattccaacctggcggcagcgcaaaagatg

SEQ ID NO: 22838 - DNA, 103 bp, Artificial Sequence
  Synthetic Polynucleotide
taatacgactcactatagggtggatttaagatgatgtggaatccctcaaaaacagaggagatttgagatgttccacatcaacctggcggcagcgcaaaagatg

SEQ ID NO: 22839 - DNA, 103 bp, Artificial Sequence
  Synthetic Polynucleotide
taatacgactcactataggggttattggatttaagatgatgtggaatcccaacagaggagagggattatgcatcatcttaacctggcggcagcgcaaaagatg

SEQ ID NO: 22840 - DNA, 103 bp, Artificial Sequence
  Synthetic Polynucleotide
taatacgactcactatagggatcgtgttattggatttaagatgatgtggaaacagaggagatccacaatgtcttaaatcaacctggcggcagcgcaaaagatg

SEQ ID NO: 22841 - DNA, 103 bp, Artificial Sequence
  Synthetic Polynucleotide
taatacgactcactatagggacaaaatcgtgttattggatttaagatgataacagaggagaatcatcatgaatccaataaacctggcggcagcgcaaaagatg

SEQ ID NO: 22842 - DNA, 103 bp, Artificial Sequence
  Synthetic Polynucleotide
taatacgactcactataggggcccagtgcaattgctgaaagctgaggataaacagaggagatatcctatgctttcagcaaacctggcggcagcgcaaaagatg

SEQ ID NO: 22843 - DNA, 103 bp, Artificial Sequence
  Synthetic Polynucleotide
taatacgactcactatagggatcaaacaaaatcgtgttattggatttaagaacagaggagacttaaaatgaataacacgaacctggcggcagcgcaaaagatg

SEQ ID NO: 22844 - DNA, 103 bp, Artificial Sequence
  Synthetic Polynucleotide
taatacgactcactataggggaaaaatcaaacaaaatcgtgttattggataacagaggagaatccaaatgcacgattttaacctggcggcagcgcaaaagatg

SEQ ID NO: 22845 - DNA, 103 bp, Artificial Sequence
  Synthetic Polynucleotide
taatacgactcactatagggtaaaagaaaaatcaaacaaaatcgtgttataacagaggagaataacaatgttttgtttgaacctggcggcagcgcaaaagatg

SEQ ID NO: 22846 - DNA, 103 bp, Artificial Sequence
  Synthetic Polynucleotide
taatacgactcactataggggaaattaaaagaaaaatcaaacaaaatcgtaacagaggagaacgattatgtttgattttaacctggcggcagcgcaaaagatg

SEQ ID NO: 22847 - DNA, 103 bp, Artificial Sequence
  Synthetic Polynucleotide
taatacgactcactataggggtgtagaaattaaaagaaaaatcaaacaaaaacagaggagatttgttatgtttttctttaacctggcggcagcgcaaaagatg

SEQ ID NO: 22848 - DNA, 103 bp, Artificial Sequence
  Synthetic Polynucleotide
taatacgactcactatagggttgtggtgtagaaattaaaagaaaaatcaaaacagaggagattgattatgcttttaattaacctggcggcagcgcaaaagatg

SEQ ID NO: 22849 - DNA, 103 bp, Artificial Sequence
  Synthetic Polynucleotide
taatacgactcactatagggtgttgttgtggtgtagaaattaaaagaaaaaacagaggagattttctatgaatttctacaacctggcggcagcgcaaaagatg

SEQ ID NO: 22850 - DNA, 103 bp, Artificial Sequence
  Synthetic Polynucleotide
taatacgactcactatagggttgtatgttgttgtggtgtagaaattaaaaaacagaggagattttaaatgctacaccacaacctggcggcagcgcaaaagatg

SEQ ID NO: 22851 - DNA, 103 bp, Artificial Sequence
  Synthetic Polynucleotide
taatacgactcactataggggacacttgtatgttgttgtggtgtagaaataacagaggagaatttctatgccacaacaaaacctggcggcagcgcaaaagatg

SEQ ID NO: 22852 - DNA, 103 bp, Artificial Sequence
  Synthetic Polynucleotide
taatacgactcactatagggcgtcagacacttgtatgttgttgtggtgtaaacagaggagatacaccatgacaacatacaacctggcggcagcgcaaaagatg

SEQ ID NO: 22853 - DNA, 103 bp, Artificial Sequence
  Synthetic Polynucleotide
taatacgactcactataggggcaacgcccagtgcaattgctgaaagctgaaacagaggagatcagctatgagcaattgcaacctggcggcagcgcaaaagatg

SEQ ID NO: 22854 - DNA, 103 bp, Artificial Sequence
  Synthetic Polynucleotide
taatacgactcactatagggtcgttcgtcagacacttgtatgttgttgtgaacagaggagacacaacatgatacaagtgaacctggcggcagcgcaaaagatg

SEQ ID NO: 22855 - DNA, 103 bp, Artificial Sequence
  Synthetic Polynucleotide
taatacgactcactatagggacaggtcgttcgtcagacacttgtatgttgaacagaggagacaacatatgagtgtctgaaacctggcggcagcgcaaaagatg

SEQ ID NO: 22856 - DNA, 103 bp, Artificial Sequence
  Synthetic Polynucleotide
taatacgactcactataggggaaacacaggtcgttcgtcagacacttgtaaacagaggagatacaagatgctgacgaacaacctggcggcagcgcaaaagatg

SEQ ID NO: 22857 - DNA, 103 bp, Artificial Sequence
  Synthetic Polynucleotide
taatacgactcactatagggccatagaaacacaggtcgttcgtcagacacaacagaggagagtgtctatggaacgacctaacctggcggcagcgcaaaagatg

SEQ ID NO: 22858 - DNA, 103 bp, Artificial Sequence
  Synthetic Polynucleotide
taatacgactcactatagggtttttccatagaaacacaggtcgttcgtcaaacagaggagatgacgaatgacctgtgttaacctggcggcagcgcaaaagatg

SEQ ID NO: 22859 - DNA, 103 bp, Artificial Sequence
  Synthetic Polynucleotide
taatacgactcactatagggtcatgtttttccatagaaacacaggtcgttaacagaggagaaacgacatgtgtttctataacctggcggcagcgcaaaagatg

SEQ ID NO: 22860 - DNA, 103 bp, Artificial Sequence
  Synthetic Polynucleotide
taatacgactcactataggggttcttcatgtttttccatagaaacacaggaacagaggagacctgtgatgctatggaaaaacctggcggcagcgcaaaagatg

SEQ ID NO: 22861 - DNA, 103 bp, Artificial Sequence
  Synthetic Polynucleotide
taatacgactcactatagggttaatgttcttcatgtttttccatagaaacaacagaggagagtttctatggaaaaacataacctggcggcagcgcaaaagatg

SEQ ID NO: 22862 - DNA, 103 bp, Artificial Sequence
  Synthetic Polynucleotide
taatacgactcactatagggttttcttaatgttcttcatgtttttccataaacagaggagatatggaatgacatgaagaaacctggcggcagcgcaaaagatg

SEQ ID NO: 22863 - DNA, 103 bp, Artificial Sequence
  Synthetic Polynucleotide
taatacgactcactatagggatcctttttcttaatgttcttcatgtttttaacagaggagaaaaaacatgaagaacattaacctggcggcagcgcaaaagatg

SEQ ID NO: 22864 - DNA, 103 bp, Artificial Sequence
  Synthetic Polynucleotide
taatacgactcactatagggtacacaaaatcatcatctcttgtttttgtgaacagaggagacacaaaatgaagagatgaaacctggcggcagcgcaaaagatg

SEQ ID NO: 22865 - DNA, 103 bp, Artificial Sequence
  Synthetic Polynucleotide
taatacgactcactatagggctagcaaactatgtaaatccatcttttaaaaacagaggagatttaaaatgtggatttacaacctggcggcagcgcaaaagatg

SEQ ID NO: 22866 - DNA, 103 bp, Artificial Sequence
  Synthetic Polynucleotide
taatacgactcactatagggctgttgcaacgcccagtgcaattgctgaaaaacagaggagatttcagatgttgcactggaacctggcggcagcgcaaaagatg

SEQ ID NO: 22867 - DNA, 103 bp, Artificial Sequence
  Synthetic Polynucleotide
taatacgactcactatagggagaacatcctttttcttaatgttcttcatgaacagaggagacatgaaatgcattaagaaaacctggcggcagcgcaaaagatg

SEQ ID NO: 22868 - DNA, 103 bp, Artificial Sequence
  Synthetic Polynucleotide
taatacgactcactatagggatacaagaacatcctttttcttaatgttctaacagaggagaagaacaatgagaaaaaggaacctggcggcagcgcaaaagatg

SEQ ID NO: 22869 - DNA, 103 bp, Artificial Sequence
  Synthetic Polynucleotide
taatacgactcactatagggttgaaatacaagaacatcctttttcttaataacagaggagaattaagatgaaggatgttaacctggcggcagcgcaaaagatg

SEQ ID NO: 22870 - DNA, 103 bp, Artificial Sequence
  Synthetic Polynucleotide
taatacgactcactatagggcttggttgaaatacaagaacatcctttttcaacagaggagagaaaaaatgtgttcttgtaacctggcggcagcgcaaaagatg

SEQ ID NO: 22871 - DNA, 103 bp, Artificial Sequence
  Synthetic Polynucleotide
taatacgactcactatagggacaaccttggttgaaatacaagaacatcctaacagaggagaaggatgatgttgtatttcaacctggcggcagcgcaaaagatg

SEQ ID NO: 22872 - DNA, 103 bp, Artificial Sequence
  Synthetic Polynucleotide
taatacgactcactatagggtatatacaaccttggttgaaatacaagaacaacagaggagagttcttatgtttcaaccaaacctggcggcagcgcaaaagatg

SEQ ID NO: 22873 - DNA, 103 bp, Artificial Sequence
  Synthetic Polynucleotide
taatacgactcactatagggccaaatatatacaaccttggttgaaatacaaacagaggagatgtattatgaccaaggttaacctggcggcagcgcaaaagatg

SEQ ID NO: 22874 - DNA, 103 bp, Artificial Sequence
  Synthetic Polynucleotide
taatacgactcactatagggatcggccaaatatatacaaccttggttgaaaacagaggagattcaacatgggttgtataaacctggcggcagcgcaaaagatg

SEQ ID NO: 22875 - DNA, 103 bp, Artificial Sequence
  Synthetic Polynucleotide
taatacgactcactatagggaggatatcggccaaatatatacaaccttggaacagaggagaccaaggatgtatatatttaacctggcggcagcgcaaaagatg

SEQ ID NO: 22876 - DNA, 103 bp, Artificial Sequence
  Synthetic Polynucleotide
taatacgactcactatagggctccgaggatatcggccaaatatatacaacaacagaggagagttgtaatgatttggccgaacctggcggcagcgcaaaagatg

SEQ ID NO: 22877 - DNA, 103 bp, Artificial Sequence
  Synthetic Polynucleotide
taatacgactcactatagggatgtgctgttgcaacgcccagtgcaattgcaacagaggagagcaattatgctgggcgttaacctggcggcagcgcaaaagatg

SEQ ID NO: 22878 - DNA, 103 bp, Artificial Sequence
  Synthetic Polynucleotide
taatacgactcactatagggttattctccgaggatatcggccaaatatataacagaggagaatatatatggccgatatcaacctggcggcagcgcaaaagatg

SEQ ID NO: 22879 - DNA, 103 bp, Artificial Sequence
  Synthetic Polynucleotide
taatacgactcactataggggacaattattctccgaggatatcggccaaaaacagaggagatttggcatgtatcctcggaacctggcggcagcgcaaaagatg

SEQ ID NO: 22880 - DNA, 103 bp, Artificial Sequence
  Synthetic Polynucleotide
taatacgactcactatagggatattgacaattattctccgaggatatcggaacagaggagaccgataatgtcggagaataacctggcggcagcgcaaaagatg

SEQ ID NO: 22881 - DNA, 103 bp, Artificial Sequence
  Synthetic Polynucleotide
taatacgactcactataggggtcagatattgacaattattctccgaggataacagaggagaatcctcatggaataattgaacctggcggcagcgcaaaagatg

SEQ ID NO: 22882 - DNA, 103 bp, Artificial Sequence
  Synthetic Polynucleotide
taatacgactcactatagggcaattgtcagatattgacaattattctccgaacagaggagacggagaatgattgtcaataacctggcggcagcgcaaaagatg

SEQ ID NO: 22883 - DNA, 103 bp, Artificial Sequence
  Synthetic Polynucleotide
taatacgactcactatagggatgatcaattgtcagatattgacaattattaacagaggagaaataatatgcaatatctgaacctggcggcagcgcaaaagatg

SEQ ID NO: 22884 - DNA, 103 bp, Artificial Sequence
  Synthetic Polynucleotide
taatacgactcactatagggtgtgtatgatcaattgtcagatattgacaaaacagaggagattgtcaatgtctgacaataacctggcggcagcgcaaaagatg

SEQ ID NO: 22885 - DNA, 103 bp, Artificial Sequence
  Synthetic Polynucleotide
taatacgactcactatagggtggaatgtgtatgatcaattgtcagatattaacagaggagaaatatcatgcaattgatcaacctggcggcagcgcaaaagatg

SEQ ID NO: 22886 - DNA, 103 bp, Artificial Sequence
  Synthetic Polynucleotide
taatacgactcactatagggattattggaatgtgtatgatcaattgtcagaacagaggagactgacaatggatcatacaaacctggcggcagcgcaaaagatg

SEQ ID NO: 22887 - DNA, 103 bp, Artificial Sequence
  Synthetic Polynucleotide
taatacgactcactatagggaatgtattattggaatgtgtatgatcaattaacagaggagaaattgaatgtacacattcaacctggcggcagcgcaaaagatg

SEQ ID NO: 22888 - DNA, 103 bp, Artificial Sequence
  Synthetic Polynucleotide
taatacgactcactatagggctgccatgtgctgttgcaacgcccagtgcaaacagaggagatgcactatgcgttgcaacaacctggcggcagcgcaaaagatg

SEQ ID NO: 22889 - DNA, 103 bp, Artificial Sequence
  Synthetic Polynucleotide
taatacgactcactatagggtctataatgtattattggaatgtgtatgataacagaggagaatcataatgattccaataaacctggcggcagcgcaaaagatg

SEQ ID NO: 22890 - DNA, 103 bp, Artificial Sequence
  Synthetic Polynucleotide
taatacgactcactatagggaaaagtctataatgtattattggaatgtgtaacagaggagaacacatatgaataatacaaacctggcggcagcgcaaaagatg

SEQ ID NO: 22891 - DNA, 103 bp, Artificial Sequence
  Synthetic Polynucleotide
taatacgactcactatagggtgataaaaagtctataatgtattattggaaaacagaggagattccaaatgtacattataaacctggcggcagcgcaaaagatg

SEQ ID NO: 22892 - DNA, 103 bp, Artificial Sequence
  Synthetic Polynucleotide
taatacgactcactatagggatatatgataaaaagtctataatgtattataacagaggagaataataatgtatagacttaacctggcggcagcgcaaaagatg

SEQ ID NO: 22893 - DNA, 103 bp, Artificial Sequence
  Synthetic Polynucleotide
taatacgactcactataggggttctatatatgataaaaagtctataatgtaacagaggagaacattaatgactttttataacctggcggcagcgcaaaagatg

SEQ ID NO: 22894 - DNA, 103 bp, Artificial Sequence
  Synthetic Polynucleotide
taatacgactcactatagggtcccagttctatatatgataaaaagtctataacagaggagaatagacatgttatcatataacctggcggcagcgcaaaagatg

SEQ ID NO: 22895 - DNA, 103 bp, Artificial Sequence
  Synthetic Polynucleotide
taatacgactcactatagggtagaatcccagttctatatatgataaaaagaacagaggagactttttatgatatatagaaacctggcggcagcgcaaaagatg

SEQ ID NO: 22896 - DNA, 103 bp, Artificial Sequence
  Synthetic Polynucleotide
taatacgactcactatagggactattagaatcccagttctatatatgataaacagaggagatatcatatgtagaactggaacctggcggcagcgcaaaagatg

SEQ ID NO: 22897 - DNA, 103 bp, Artificial Sequence
  Synthetic Polynucleotide
taatacgactcactataggggtagaactattagaatcccagttctatataaacagaggagatatataatgctgggattcaacctggcggcagcgcaaaagatg

SEQ ID NO: 22898 - DNA, 103 bp, Artificial Sequence
  Synthetic Polynucleotide
taatacgactcactatagggaagaagtagaactattagaatcccagttctaacagaggagaagaactatgattctaataaacctggcggcagcgcaaaagatg

SEQ ID NO: 22899 - DNA, 103 bp, Artificial Sequence
  Synthetic Polynucleotide
taatacgactcactatagggatgtactgccatgtgctgttgcaacgcccaaacagaggagatgggcgatgcaacagcacaacctggcggcagcgcaaaagatg

SEQ ID NO: 22900 - DNA, 103 bp, Artificial Sequence
  Synthetic Polynucleotide
taatacgactcactataggggcactaagaagtagaactattagaatcccaaacagaggagatgggatatgaatagttctaacctggcggcagcgcaaaagatg

SEQ ID NO: 22901 - DNA, 103 bp, Artificial Sequence
  Synthetic Polynucleotide
taatacgactcactataggggtactgcactaagaagtagaactattagaaaacagaggagattctaaatgttctacttcaacctggcggcagcgcaaaagatg

SEQ ID NO: 22902 - DNA, 103 bp, Artificial Sequence
  Synthetic Polynucleotide
taatacgactcactatagggaacctgtactgcactaagaagtagaactataacagaggagaatagttatgcttcttagtaacctggcggcagcgcaaaagatg

SEQ ID NO: 22903 - DNA, 103 bp, Artificial Sequence
  Synthetic Polynucleotide
taatacgactcactataggggcaaaaacctgtactgcactaagaagtagaaacagaggagatctactatgtagtgcagtaacctggcggcagcgcaaaagatg

SEQ ID NO: 22904 - DNA, 103 bp, Artificial Sequence
  Synthetic Polynucleotide
taatacgactcactatagggtctttgcaaaaacctgtactgcactaagaaaacagaggagattcttaatgcagtacaggaacctggcggcagcgcaaaagatg

SEQ ID NO: 22905 - DNA, 103 bp, Artificial Sequence
  Synthetic Polynucleotide
taatacgactcactatagggaagtttctttgcaaaaacctgtactgcactaacagaggagaagtgcaatgcaggtttttaacctggcggcagcgcaaaagatg

SEQ ID NO: 22906 - DNA, 103 bp, Artificial Sequence
  Synthetic Polynucleotide
taatacgactcactatagggctcagaagtttctttgcaaaaacctgtactaacagaggagaagtacaatgttttgcaaaaacctggcggcagcgcaaaagatg

SEQ ID NO: 22907 - DNA, 103 bp, Artificial Sequence
  Synthetic Polynucleotide
taatacgactcactatagggccatactcagaagtttctttgcaaaaacctaacagaggagaaggtttatgcaaagaaacaacctggcggcagcgcaaaagatg

SEQ ID NO: 22908 - DNA, 103 bp, Artificial Sequence
  Synthetic Polynucleotide
taatacgactcactatagggttctgccatactcagaagtttctttgcaaaaacagaggagatttgcaatgaaacttctgaacctggcggcagcgcaaaagatg

SEQ ID NO: 22909 - DNA, 103 bp, Artificial Sequence
  Synthetic Polynucleotide
taatacgactcactataggggacagttctgccatactcagaagtttctttaacagaggagaaaagaaatgtctgagtataacctggcggcagcgcaaaagatg

SEQ ID NO: 22910 - DNA, 103 bp, Artificial Sequence
  Synthetic Polynucleotide
taatacgactcactatagggagccaatgtactgccatgtgctgttgcaacaacagaggagagttgcaatggcacatggcaacctggcggcagcgcaaaagatg

SEQ ID NO: 22911 - DNA, 103 bp, Artificial Sequence
  Synthetic Polynucleotide
taatacgactcactataggggtgttgacagttctgccatactcagaagttaacagaggagaaacttcatggtatggcagaacctggcggcagcgcaaaagatg

SEQ ID NO: 22912 - DNA, 103 bp, Artificial Sequence
  Synthetic Polynucleotide
taatacgactcactataggggtaacgtgttgacagttctgccatactcagaacagaggagactgagtatggcagaactgaacctggcggcagcgcaaaagatg

SEQ ID NO: 22913 - DNA, 103 bp, Artificial Sequence
  Synthetic Polynucleotide
taatacgactcactatagggaagttgtaacgtgttgacagttctgccataaacagaggagatatggcatgactgtcaacaacctggcggcagcgcaaaagatg

SEQ ID NO: 22914 - DNA, 103 bp, Artificial Sequence
  Synthetic Polynucleotide
taatacgactcactatagggttggtaagttgtaacgtgttgacagttctgaacagaggagacagaacatgcaacacgttaacctggcggcagcgcaaaagatg

SEQ ID NO: 22915 - DNA, 103 bp, Artificial Sequence
  Synthetic Polynucleotide
taatacgactcactatagggatttgttggtaagttgtaacgtgttgacagaacagaggagactgtcaatgcgttacaacaacctggcggcagcgcaaaagatg

SEQ ID NO: 22916 - DNA, 103 bp, Artificial Sequence
  Synthetic Polynucleotide
taatacgactcactataggggtaatatttgttggtaagttgtaacgtgttaacagaggagaaacacgatgcaacttaccaacctggcggcagcgcaaaagatg

SEQ ID NO: 22917 - DNA, 103 bp, Artificial Sequence
  Synthetic Polynucleotide
taatacgactcactatagggtctctgtaatatttgttggtaagttgtaacaacagaggagagttacaatgtaccaacaaaacctggcggcagcgcaaaagatg

SEQ ID NO: 22918 - DNA, 103 bp, Artificial Sequence
  Synthetic Polynucleotide
taatacgactcactataggggctcttctctgtaatatttgttggtaagttaacagaggagaaacttaatgacaaatattaacctggcggcagcgcaaaagatg

SEQ ID NO: 22919 - DNA, 103 bp, Artificial Sequence
  Synthetic Polynucleotide
taatacgactcactatagggtttatgctcttctctgtaatatttgttggtaacagaggagaaccaacatgtattacagaaacctggcggcagcgcaaaagatg

SEQ ID NO: 22920 - DNA, 103 bp, Artificial Sequence
  Synthetic Polynucleotide
taatacgactcactatagggcaagatttatgctcttctctgtaatatttgaacagaggagacaaataatgcagagaagaaacctggcggcagcgcaaaagatg

SEQ ID NO: 22921 - DNA, 103 bp, Artificial Sequence
  Synthetic Polynucleotide
taatacgactcactatagggacaccagccaatgtactgccatgtgctgttaacagaggagaaacagcatgtggcagtacaacctggcggcagcgcaaaagatg

SEQ ID NO: 22922 - DNA, 103 bp, Artificial Sequence
  Synthetic Polynucleotide
taatacgactcactataggggagatcaagatttatgctcttctctgtaataacagaggagaattacaatgaagagcataaacctggcggcagcgcaaaagatg

SEQ ID NO: 22923 - DNA, 103 bp, Artificial Sequence
  Synthetic Polynucleotide
taatacgactcactataggggaattgagatcaagatttatgctcttctctaacagaggagaagagaaatgcataaatctaacctggcggcagcgcaaaagatg

SEQ ID NO: 22924 - DNA, 103 bp, Artificial Sequence
  Synthetic Polynucleotide
taatacgactcactatagggcagtagaattgagatcaagatttatgctctaacagaggagaagagcaatgatcttgatcaacctggcggcagcgcaaaagatg

SEQ ID NO: 22925 - DNA, 103 bp, Artificial Sequence
  Synthetic Polynucleotide
taatacgactcactatagggccgtgcagtagaattgagatcaagatttataacagaggagaataaatatggatctcaataacctggcggcagcgcaaaagatg

SEQ ID NO: 22926 - DNA, 103 bp, Artificial Sequence
  Synthetic Polynucleotide
taatacgactcactatagggacccaccgtgcagtagaattgagatcaagaaacagaggagatcttgaatgcaattctacaacctggcggcagcgcaaaagatg

SEQ ID NO: 22927 - DNA, 103 bp, Artificial Sequence
  Synthetic Polynucleotide
taatacgactcactatagggcttttacccaccgtgcagtagaattgagataacagaggagaatctcaatgctactgcacaacctggcggcagcgcaaaagatg

SEQ ID NO: 22928 - DNA, 103 bp, Artificial Sequence
  Synthetic Polynucleotide
taatacgactcactataggggggctcttttacccaccgtgcagtagaattaacagaggagaaattctatggcacggtggaacctggcggcagcgcaaaagatg

SEQ ID NO: 22929 - DNA, 103 bp, Artificial Sequence
  Synthetic Polynucleotide
taatacgactcactatagggacactgggctcttttacccaccgtgcagtaaacagaggagatactgcatggtgggtaaaaacctggcggcagcgcaaaagatg

SEQ ID NO: 22930 - DNA, 103 bp, Artificial Sequence
  Synthetic Polynucleotide
taatacgactcactatagggccccaacactgggctcttttacccaccgtgaacagaggagacacggtatgtaaaagagcaacctggcggcagcgcaaaagatg

SEQ ID NO: 22931 - DNA, 103 bp, Artificial Sequence
  Synthetic Polynucleotide
taatacgactcactatagggccagcccccaacactgggctcttttacccaaacagaggagatgggtaatggagcccagtaacctggcggcagcgcaaaagatg

SEQ ID NO: 22932 - DNA, 103 bp, Artificial Sequence
  Synthetic Polynucleotide
taatacgactcactatagggcgttaacaccagccaatgtactgccatgtgaacagaggagacacatgatggtacattggaacctggcggcagcgcaaaagatg

SEQ ID NO: 22933 - DNA, 103 bp, Artificial Sequence
  Synthetic Polynucleotide
taatacgactcactatagggactgtccagcccccaacactgggctcttttaacagaggagaaaaagaatgcagtgttggaacctggcggcagcgcaaaagatg

SEQ ID NO: 22934 - DNA, 103 bp, Artificial Sequence
  Synthetic Polynucleotide
taatacgactcactatagggatttcactgtccagcccccaacactgggctaacagaggagaagcccaatgttgggggctaacctggcggcagcgcaaaagatg

SEQ ID NO: 22935 - DNA, 103 bp, Artificial Sequence
  Synthetic Polynucleotide
taatacgactcactatagggcccccatttcactgtccagcccccaacactaacagaggagaagtgttatgggctggacaaacctggcggcagcgcaaaagatg

SEQ ID NO: 22936 - DNA, 103 bp, Artificial Sequence
  Synthetic Polynucleotide
taatacgactcactatagggaaattcccccatttcactgtccagcccccaaacagaggagatgggggatggacagtgaaaacctggcggcagcgcaaaagatg

SEQ ID NO: 22937 - DNA, 103 bp, Artificial Sequence
  Synthetic Polynucleotide
taatacgactcactatagggagataaaattcccccatttcactgtccagcaacagaggagagctggaatgtgaaatgggaacctggcggcagcgcaaaagatg

SEQ ID NO: 22938 - DNA, 103 bp, Artificial Sequence
  Synthetic Polynucleotide
taatacgactcactataggggtgaaagataaaattcccccatttcactgtaacagaggagaacagtgatgtgggggaataacctggcggcagcgcaaaagatg

SEQ ID NO: 22939 - DNA, 103 bp, Artificial Sequence
  Synthetic Polynucleotide
taatacgactcactataggggggatgtgaaagataaaattcccccatttcaacagaggagagaaatgatggaattttataacctggcggcagcgcaaaagatg

SEQ ID NO: 22940 - DNA, 103 bp, Artificial Sequence
  Synthetic Polynucleotide
taatacgactcactatagggtatttgggatgtgaaagataaaattcccccaacagaggagagggggaatgttatctttcaacctggcggcagcgcaaaagatg

SEQ ID NO: 22941 - DNA, 103 bp, Artificial Sequence
  Synthetic Polynucleotide
taatacgactcactatagggtccggtatttgggatgtgaaagataaaattaacagaggagaaattttatgtttcacatcaacctggcggcagcgcaaaagatg

SEQ ID NO: 22942 - DNA, 103 bp, Artificial Sequence
  Synthetic Polynucleotide
taatacgactcactataggggtcattccggtatttgggatgtgaaagataaacagaggagatatcttatgcatcccaaaaacctggcggcagcgcaaaagatg

SEQ ID NO: 22943 - DNA, 103 bp, Artificial Sequence
  Synthetic Polynucleotide
taatacgactcactataggggccaacgttaacaccagccaatgtactgccaacagaggagaggcagtatgttggctggtaacctggcggcagcgcaaaagatg

SEQ ID NO: 22944 - DNA, 103 bp, Artificial Sequence
  Synthetic Polynucleotide
taatacgactcactatagggacaatgtcattccggtatttgggatgtgaaaacagaggagattcacaatgcaaataccgaacctggcggcagcgcaaaagatg

SEQ ID NO: 22945 - DNA, 103 bp, Artificial Sequence
  Synthetic Polynucleotide
taatacgactcactatagggatgcaacaatgtcattccggtatttgggataacagaggagaatcccaatgaccggaatgaacctggcggcagcgcaaaagatg

SEQ ID NO: 22946 - DNA, 103 bp, Artificial Sequence
  Synthetic Polynucleotide
taatacgactcactatagggaaatgatgcaacaatgtcattccggtatttaacagaggagaaaatacatgaatgacattaacctggcggcagcgcaaaagatg

SEQ ID NO: 22947 - DNA, 103 bp, Artificial Sequence
  Synthetic Polynucleotide
taatacgactcactatagggattttaaatgatgcaacaatgtcattccggaacagaggagaccggaaatgcattgttgcaacctggcggcagcgcaaaagatg

SEQ ID NO: 22948 - DNA, 103 bp, Artificial Sequence
  Synthetic Polynucleotide
taatacgactcactatagggattagattttaaatgatgcaacaatgtcataacagaggagaatgacaatgttgcatcataacctggcggcagcgcaaaagatg

SEQ ID NO: 22949 - DNA, 103 bp, Artificial Sequence
  Synthetic Polynucleotide
taatacgactcactatagggacaaaattagattttaaatgatgcaacaataacagaggagaattgttatgtcatttaaaaacctggcggcagcgcaaaagatg

SEQ ID NO: 22950 - DNA, 103 bp, Artificial Sequence
  Synthetic Polynucleotide
taatacgactcactataggggaacaacaaaattagattttaaatgatgcaaacagaggagatgcatcatgtaaaatctaaacctggcggcagcgcaaaagatg

SEQ ID NO: 22951 - DNA, 103 bp, Artificial Sequence
  Synthetic Polynucleotide
taatacgactcactatagggttctggaacaacaaaattagattttaaatgaacagaggagacatttaatgtctaattttaacctggcggcagcgcaaaagatg

SEQ ID NO: 22952 - DNA, 103 bp, Artificial Sequence
  Synthetic Polynucleotide
taatacgactcactatagggtgccattctggaacaacaaaattagattttaacagaggagaaaaatcatgttttgttgtaacctggcggcagcgcaaaagatg

SEQ ID NO: 22953 - DNA, 103 bp, Artificial Sequence
  Synthetic Polynucleotide
taatacgactcactatagggtttgttgccattctggaacaacaaaattagaacagaggagactaattatgttgttccagaacctggcggcagcgcaaaagatg

SEQ ID NO: 22954 - DNA, 103 bp, Artificial Sequence
  Synthetic Polynucleotide
taatacgactcactatagggtgttcgccaacgttaacaccagccaatgtaaacagaggagatacattatgtggtgttaaaacctggcggcagcgcaaaagatg

SEQ ID NO: 22955 - DNA, 103 bp, Artificial Sequence
  Synthetic Polynucleotide
taatacgactcactatagggccttgtttgttgccattctggaacaacaaaaacagaggagatttgttatgccagaatggaacctggcggcagcgcaaaagatg

SEQ ID NO: 22956 - DNA, 103 bp, Artificial Sequence
  Synthetic Polynucleotide
taatacgactcactatagggagactccttgtttgttgccattctggaacaaacagaggagatgttccatgatggcaacaaacctggcggcagcgcaaaagatg

SEQ ID NO: 22957 - DNA, 103 bp, Artificial Sequence
  Synthetic Polynucleotide
taatacgactcactatagggagaagagactccttgtttgttgccattctgaacagaggagacagaatatgaacaaacaaaacctggcggcagcgcaaaagatg

SEQ ID NO: 22958 - DNA, 103 bp, Artificial Sequence
  Synthetic Polynucleotide
taatacgactcactatagggatgggagaagagactccttgtttgttgccaaacagaggagatggcaaatgacaaggagtaacctggcggcagcgcaaaagatg

SEQ ID NO: 22959 - DNA, 103 bp, Artificial Sequence
  Synthetic Polynucleotide
taatacgactcactatagggaagagatgggagaagagactccttgtttgtaacagaggagaacaaacatggagtctcttaacctggcggcagcgcaaaagatg

SEQ ID NO: 22960 - DNA, 103 bp, Artificial Sequence
  Synthetic Polynucleotide
taatacgactcactatagggttttaaagagatgggagaagagactccttgaacagaggagacaaggaatgtcttctcccaacctggcggcagcgcaaaagatg

SEQ ID NO: 22961 - DNA, 103 bp, Artificial Sequence
  Synthetic Polynucleotide
taatacgactcactatagggtgggtttttaaagagatgggagaagagactaacagaggagaagtctcatgtcccatctcaacctggcggcagcgcaaaagatg

SEQ ID NO: 22962 - DNA, 103 bp, Artificial Sequence
  Synthetic Polynucleotide
taatacgactcactataggggattttgggtttttaaagagatgggagaagaacagaggagacttctcatgtctctttaaaacctggcggcagcgcaaaagatg

SEQ ID NO: 22963 - DNA, 103 bp, Artificial Sequence
  Synthetic Polynucleotide
taatacgactcactatagggtggttgattttgggtttttaaagagatgggaacagaggagacccatcatgttaaaaaccaacctggcggcagcgcaaaagatg

SEQ ID NO: 22964 - DNA, 103 bp, Artificial Sequence
  Synthetic Polynucleotide
taatacgactcactatagggcatgatggttgattttgggtttttaaagagaacagaggagactctttatgaacccaaaaaacctggcggcagcgcaaaagatg

SEQ ID NO: 22965 - DNA, 103 bp, Artificial Sequence
  Synthetic Polynucleotide
taatacgactcactatagggggtattgttcgccaacgttaacaccagccaaacagaggagatggctgatgttaacgttgaacctggcggcagcgcaaaagatg

SEQ ID NO: 22966 - DNA, 103 bp, Artificial Sequence
  Synthetic Polynucleotide
taatacgactcactatagggggctccatgatggttgattttgggtttttaaacagaggagataaaaaatgaaaatcaacaacctggcggcagcgcaaaagatg

SEQ ID NO: 22967 - DNA, 103 bp, Artificial Sequence
  Synthetic Polynucleotide
taatacgactcactatagggagaaaggctccatgatggttgattttgggtaacagaggagaacccaaatgcaaccatcaaacctggcggcagcgcaaaagatg

SEQ ID NO: 22968 - DNA, 103 bp, Artificial Sequence
  Synthetic Polynucleotide
taatacgactcactatagggagccaagaaaggctccatgatggttgatttaacagaggagaaaatcaatgatcatggagaacctggcggcagcgcaaaagatg

SEQ ID NO: 22969 - DNA, 103 bp, Artificial Sequence
  Synthetic Polynucleotide
taatacgactcactatagggctcaaagccaagaaaggctccatgatggttaacagaggagaaaccatatgggagcctttaacctggcggcagcgcaaaagatg

SEQ ID NO: 22970 - DNA, 103 bp, Artificial Sequence
  Synthetic Polynucleotide
taatacgactcactatagggagatcctcaaagccaagaaaggctccatgaaacagaggagatcatggatgctttcttggaacctggcggcagcgcaaaagatg

SEQ ID NO: 22971 - DNA, 103 bp, Artificial Sequence
  Synthetic Polynucleotide
taatacgactcactatagggaagtaagatcctcaaagccaagaaaggctcaacagaggagagagcctatgttggctttgaacctggcggcagcgcaaaagatg

SEQ ID NO: 22972 - DNA, 103 bp, Artificial Sequence
  Synthetic Polynucleotide
taatacgactcactatagggacgccaagtaagatcctcaaagccaagaaaaacagaggagatttcttatgtttgaggataacctggcggcagcgcaaaagatg

SEQ ID NO: 22973 - DNA, 103 bp, Artificial Sequence
  Synthetic Polynucleotide
taatacgactcactatagggaagcaacgccaagtaagatcctcaaagccaaacagaggagatggcttatgggatcttacaacctggcggcagcgcaaaagatg

SEQ ID NO: 22974 - DNA, 103 bp, Artificial Sequence
  Synthetic Polynucleotide
taatacgactcactatagggcttcaaagcaacgccaagtaagatcctcaaaacagaggagattgaggatgttacttggcaacctggcggcagcgcaaaagatg

SEQ ID NO: 22975 - DNA, 103 bp, Artificial Sequence
  Synthetic Polynucleotide
taatacgactcactatagggtgatccttcaaagcaacgccaagtaagatcaacagaggagagatcttatgtggcgttgcaacctggcggcagcgcaaaagatg

SEQ ID NO: 22976 - DNA, 103 bp, Artificial Sequence
  Synthetic Polynucleotide
taatacgactcactatagggtaattctagcaaactatgtaaatccatcttaacagaggagaaagatgatgttacatagtaacctggcggcagcgcaaaagatg

SEQ ID NO: 22977 - DNA, 103 bp, Artificial Sequence
  Synthetic Polynucleotide
taatacgactcactatagggttgttggtattgttcgccaacgttaacaccaacagaggagaggtgttatggttggcgaaaacctggcggcagcgcaaaagatg

SEQ ID NO: 22978 - DNA, 103 bp, Artificial Sequence
  Synthetic Polynucleotide
taatacgactcactatagggattcttgatccttcaaagcaacgccaagtaaacagaggagatacttgatgttgctttgaaacctggcggcagcgcaaaagatg

SEQ ID NO: 22979 - DNA, 103 bp, Artificial Sequence
  Synthetic Polynucleotide
taatacgactcactatagggctgcaattcttgatccttcaaagcaacgccaacagaggagaggcgttatgttgaaggataacctggcggcagcgcaaaagatg

SEQ ID NO: 22980 - DNA, 103 bp, Artificial Sequence
  Synthetic Polynucleotide
taatacgactcactataggggattgctgcaattcttgatccttcaaagcaaacagaggagatgctttatgggatcaagaaacctggcggcagcgcaaaagatg

SEQ ID NO: 22981 - DNA, 103 bp, Artificial Sequence
  Synthetic Polynucleotide
taatacgactcactatagggtcaatgattgctgcaattcttgatccttcaaacagaggagatgaaggatgaagaattgcaacctggcggcagcgcaaaagatg

SEQ ID NO: 22982 - DNA, 103 bp, Artificial Sequence
  Synthetic Polynucleotide
taatacgactcactatagggaggaatcaatgattgctgcaattcttgatcaacagaggagagatcaaatgttgcagcaaaacctggcggcagcgcaaaagatg

SEQ ID NO: 22983 - DNA, 103 bp, Artificial Sequence
  Synthetic Polynucleotide
taatacgactcactatagggaatccaggaatcaatgattgctgcaattctaacagaggagaagaattatggcaatcattaacctggcggcagcgcaaaagatg

SEQ ID NO: 22984 - DNA, 103 bp, Artificial Sequence
  Synthetic Polynucleotide
taatacgactcactatagggatctaaatccaggaatcaatgattgctgcaaacagaggagatgcagcatgcattgattcaacctggcggcagcgcaaaagatg

SEQ ID NO: 22985 - DNA, 103 bp, Artificial Sequence
  Synthetic Polynucleotide
taatacgactcactatagggaatggatctaaatccaggaatcaatgattgaacagaggagacaatcaatgattcctggaaacctggcggcagcgcaaaagatg

SEQ ID NO: 22986 - DNA, 103 bp, Artificial Sequence
  Synthetic Polynucleotide
taatacgactcactatagggtgcacaatggatctaaatccaggaatcaataacagaggagaattgatatgtggatttagaacctggcggcagcgcaaaagatg

SEQ ID NO: 22987 - DNA, 103 bp, Artificial Sequence
  Synthetic Polynucleotide
taatacgactcactataggggcatatgcacaatggatctaaatccaggaaaacagaggagattcctgatgttagatccaaacctggcggcagcgcaaaagatg

SEQ ID NO: 22988 - DNA, 103 bp, Artificial Sequence
  Synthetic Polynucleotide
taatacgactcactatagggcgcagttgttggtattgttcgccaacgttaaacagaggagataacgtatgcgaacaataaacctggcggcagcgcaaaagatg

SEQ ID NO: 22989 - DNA, 103 bp, Artificial Sequence
  Synthetic Polynucleotide
taatacgactcactatagggtgaaagcatatgcacaatggatctaaatccaacagaggagaggatttatgtccattgtgaacctggcggcagcgcaaaagatg

SEQ ID NO: 22990 - DNA, 103 bp, Artificial Sequence
  Synthetic Polynucleotide
taatacgactcactatagggcattctgaaagcatatgcacaatggatctaaacagaggagatagatcatgtgtgcatataacctggcggcagcgcaaaagatg

SEQ ID NO: 22991 - DNA, 103 bp, Artificial Sequence
  Synthetic Polynucleotide
taatacgactcactataggggcagccattctgaaagcatatgcacaatggaacagaggagaccattgatgatatgctttaacctggcggcagcgcaaaagatg

SEQ ID NO: 22992 - DNA, 103 bp, Artificial Sequence
  Synthetic Polynucleotide
taatacgactcactatagggtaaaagcagccattctgaaagcatatgcacaacagaggagagtgcatatgctttcagaaaacctggcggcagcgcaaaagatg

SEQ ID NO: 22993 - DNA, 103 bp, Artificial Sequence
  Synthetic Polynucleotide
taatacgactcactatagggacttctaaaagcagccattctgaaagcataaacagaggagatatgctatgagaatggctaacctggcggcagcgcaaaagatg

SEQ ID NO: 22994 - DNA, 103 bp, Artificial Sequence
  Synthetic Polynucleotide
taatacgactcactatagggacgtaacttctaaaagcagccattctgaaaaacagaggagatttcagatgggctgctttaacctggcggcagcgcaaaagatg

SEQ ID NO: 22995 - DNA, 103 bp, Artificial Sequence
  Synthetic Polynucleotide
taatacgactcactatagggagctgacgtaacttctaaaagcagccattcaacagaggagagaatggatgcttttagaaaacctggcggcagcgcaaaagatg

SEQ ID NO: 22996 - DNA, 103 bp, Artificial Sequence
  Synthetic Polynucleotide
taatacgactcactatagggtggatagctgacgtaacttctaaaagcagcaacagaggagagctgctatgagaagttacaacctggcggcagcgcaaaagatg

SEQ ID NO: 22997 - DNA, 103 bp, Artificial Sequence
  Synthetic Polynucleotide
taatacgactcactatagggtgatatggatagctgacgtaacttctaaaaaacagaggagattttagatgttacgtcagaacctggcggcagcgcaaaagatg

SEQ ID NO: 22998 - DNA, 103 bp, Artificial Sequence
  Synthetic Polynucleotide
taatacgactcactatagggaggactgatatggatagctgacgtaacttcaacagaggagagaagttatgtcagctatcaacctggcggcagcgcaaaagatg

SEQ ID NO: 22999 - DNA, 103 bp, Artificial Sequence
  Synthetic Polynucleotide
taatacgactcactatagggcttctcgcagttgttggtattgttcgccaaaacagaggagattggcgatgaataccaacaacctggcggcagcgcaaaagatg

SEQ ID NO: 23000 - DNA, 103 bp, Artificial Sequence
  Synthetic Polynucleotide
taatacgactcactatagggaggttaggactgatatggatagctgacgtaaacagaggagatacgtcatgtatccatataacctggcggcagcgcaaaagatg

SEQ ID NO: 23001 - DNA, 103 bp, Artificial Sequence
  Synthetic Polynucleotide
taatacgactcactatagggccaacaggttaggactgatatggatagctgaacagaggagacagctaatgatatcagtcaacctggcggcagcgcaaaagatg

SEQ ID NO: 23002 - DNA, 103 bp, Artificial Sequence
  Synthetic Polynucleotide
taatacgactcactataggggatccccaacaggttaggactgatatggataacagaggagaatccatatgagtcctaacaacctggcggcagcgcaaaagatg

SEQ ID NO: 23003 - DNA, 103 bp, Artificial Sequence
  Synthetic Polynucleotide
taatacgactcactatagggaaatagatccccaacaggttaggactgataaacagaggagatatcagatgtaacctgttaacctggcggcagcgcaaaagatg

SEQ ID NO: 23004 - DNA, 103 bp, Artificial Sequence
  Synthetic Polynucleotide
taatacgactcactatagggaggtcaaatagatccccaacaggttaggacaacagaggagagtcctaatgtgttggggaaacctggcggcagcgcaaaagatg

SEQ ID NO: 23005 - DNA, 103 bp, Artificial Sequence
  Synthetic Polynucleotide
taatacgactcactataggggtctgaggtcaaatagatccccaacaggttaacagaggagaaacctgatggggatctataacctggcggcagcgcaaaagatg

SEQ ID NO: 23006 - DNA, 103 bp, Artificial Sequence
  Synthetic Polynucleotide
taatacgactcactatagggaacatgtctgaggtcaaatagatccccaacaacagaggagagttgggatgctatttgacaacctggcggcagcgcaaaagatg

SEQ ID NO: 23007 - DNA, 103 bp, Artificial Sequence
  Synthetic Polynucleotide
taatacgactcactatagggttttaaacatgtctgaggtcaaatagatccaacagaggagaggatctatgtgacctcagaacctggcggcagcgcaaaagatg

SEQ ID NO: 23008 - DNA, 103 bp, Artificial Sequence
  Synthetic Polynucleotide
taatacgactcactatagggtaggattttaaacatgtctgaggtcaaataaacagaggagatatttgatgtcagacatgaacctggcggcagcgcaaaagatg

SEQ ID NO: 23009 - DNA, 103 bp, Artificial Sequence
  Synthetic Polynucleotide
taatacgactcactataggggccattaggattttaaacatgtctgaggtcaacagaggagagacctcatgcatgtttaaaacctggcggcagcgcaaaagatg

SEQ ID NO: 23010 - DNA, 103 bp, Artificial Sequence
  Synthetic Polynucleotide
taatacgactcactatagggtgctgcttctcgcagttgttggtattgttcaacagaggagagaacaaatgcaacaactgaacctggcggcagcgcaaaagatg

SEQ ID NO: 23011 - DNA, 103 bp, Artificial Sequence
  Synthetic Polynucleotide
taatacgactcactatagggcacctgccattaggattttaaacatgtctgaacagaggagacagacaatgttaaaatccaacctggcggcagcgcaaaagatg

SEQ ID NO: 23012 - DNA, 103 bp, Artificial Sequence
  Synthetic Polynucleotide
taatacgactcactatagggtttcacacctgccattaggattttaaacataacagaggagaatgtttatgatcctaatgaacctggcggcagcgcaaaagatg

SEQ ID NO: 23013 - DNA, 103 bp, Artificial Sequence
  Synthetic Polynucleotide
taatacgactcactatagggaagtttttcacacctgccattaggattttaaacagaggagataaaatatgaatggcaggaacctggcggcagcgcaaaagatg

SEQ ID NO: 23014 - DNA, 103 bp, Artificial Sequence
  Synthetic Polynucleotide
taatacgactcactatagggtgaaaaagtttttcacacctgccattaggaaacagaggagatcctaaatgcaggtgtgaaacctggcggcagcgcaaaagatg

SEQ ID NO: 23015 - DNA, 103 bp, Artificial Sequence
  Synthetic Polynucleotide
taatacgactcactatagggcttattgaaaaagtttttcacacctgccataacagaggagaatggcaatggtgaaaaacaacctggcggcagcgcaaaagatg

SEQ ID NO: 23016 - DNA, 103 bp, Artificial Sequence
  Synthetic Polynucleotide
taatacgactcactatagggaacagcttattgaaaaagtttttcacacctaacagaggagaaggtgtatgaaactttttaacctggcggcagcgcaaaagatg

SEQ ID NO: 23017 - DNA, 103 bp, Artificial Sequence
  Synthetic Polynucleotide
taatacgactcactataggggggtaaacagcttattgaaaaagtttttcaaacagaggagatgaaaaatgttttcaataaacctggcggcagcgcaaaagatg

SEQ ID NO: 23018 - DNA, 103 bp, Artificial Sequence
  Synthetic Polynucleotide
taatacgactcactatagggatggagggtaaacagcttattgaaaaagttaacagaggagaaactttatgaataagctgaacctggcggcagcgcaaaagatg

SEQ ID NO: 23019 - DNA, 103 bp, Artificial Sequence
  Synthetic Polynucleotide
taatacgactcactatagggacaacatggagggtaaacagcttattgaaaaacagaggagatttcaaatggctgtttacaacctggcggcagcgcaaaagatg

SEQ ID NO: 23020 - DNA, 103 bp, Artificial Sequence
  Synthetic Polynucleotide
taatacgactcactatagggcatttacaacatggagggtaaacagcttataacagaggagaataagcatgttaccctccaacctggcggcagcgcaaaagatg

SEQ ID NO: 23021 - DNA, 103 bp, Artificial Sequence
  Synthetic Polynucleotide
taatacgactcactatagggtcatgtgctgcttctcgcagttgttggtataacagaggagaataccaatgactgcgagaaacctggcggcagcgcaaaagatg

SEQ ID NO: 23022 - DNA, 103 bp, Artificial Sequence
  Synthetic Polynucleotide
taatacgactcactatagggatgatcatttacaacatggagggtaaacagaacagaggagactgtttatgctccatgttaacctggcggcagcgcaaaagatg

SEQ ID NO: 23023 - DNA, 103 bp, Artificial Sequence
  Synthetic Polynucleotide
taatacgactcactatagggtttccatgatcatttacaacatggagggtaaacagaggagataccctatgtgttgtaaaaacctggcggcagcgcaaaagatg

SEQ ID NO: 23024 - DNA, 103 bp, Artificial Sequence
  Synthetic Polynucleotide
taatacgactcactatagggtaggttttccatgatcatttacaacatggaaacagaggagatccatgatgtaaatgatcaacctggcggcagcgcaaaagatg

SEQ ID NO: 23025 - DNA, 103 bp, Artificial Sequence
  Synthetic Polynucleotide
taatacgactcactatagggactgctaggttttccatgatcatttacaacaacagaggagagttgtaatggatcatggaaacctggcggcagcgcaaaagatg

SEQ ID NO: 23026 - DNA, 103 bp, Artificial Sequence
  Synthetic Polynucleotide
taatacgactcactatagggtcaatactgctaggttttccatgatcatttaacagaggagaaaatgaatgtggaaaaccaacctggcggcagcgcaaaagatg

SEQ ID NO: 23027 - DNA, 103 bp, Artificial Sequence
  Synthetic Polynucleotide
taatacgactcactatagggttatttcaatactgctaggttttccatgataacagaggagaatcatgatgaacctagcaaacctggcggcagcgcaaaagatg

SEQ ID NO: 23028 - DNA, 103 bp, Artificial Sequence
  Synthetic Polynucleotide
taatacgactcactatagggtaattttatttcaatactgctaggttttccaacagaggagaggaaaaatgagcagtattaacctggcggcagcgcaaaagatg

SEQ ID NO: 23029 - DNA, 103 bp, Artificial Sequence
  Synthetic Polynucleotide
taatacgactcactatagggccggttaattttatttcaatactgctaggtaacagaggagaacctagatgtattgaaataacctggcggcagcgcaaaagatg

SEQ ID NO: 23030 - DNA, 103 bp, Artificial Sequence
  Synthetic Polynucleotide
taatacgactcactataggggttgtccggttaattttatttcaatactgcaacagaggagagcagtaatgaaataaaataacctggcggcagcgcaaaagatg

SEQ ID NO: 23031 - DNA, 103 bp, Artificial Sequence
  Synthetic Polynucleotide
taatacgactcactataggggatctgttgtccggttaattttatttcaataacagaggagaattgaaatgaaattaaccaacctggcggcagcgcaaaagatg

SEQ ID NO: 23032 - DNA, 103 bp, Artificial Sequence
  Synthetic Polynucleotide
taatacgactcactatagggctgcatcatgtgctgcttctcgcagttgttaacagaggagaaacaacatggagaagcagaacctggcggcagcgcaaaagatg

SEQ ID NO: 23033 - DNA, 103 bp, Artificial Sequence
  Synthetic Polynucleotide
taatacgactcactatagggattatgatctgttgtccggttaattttattaacagaggagaaataaaatgaaccggacaaacctggcggcagcgcaaaagatg

SEQ ID NO: 23034 - DNA, 103 bp, Artificial Sequence
  Synthetic Polynucleotide
taatacgactcactataggggagtgattatgatctgttgtccggttaattaacagaggagaaattaaatggacaacagaaacctggcggcagcgcaaaagatg

SEQ ID NO: 23035 - DNA, 103 bp, Artificial Sequence
  Synthetic Polynucleotide
taatacgactcactatagggaactcgagtgattatgatctgttgtccggtaacagaggagaaccggaatgcagatcataaacctggcggcagcgcaaaagatg

SEQ ID NO: 23036 - DNA, 103 bp, Artificial Sequence
  Synthetic Polynucleotide
taatacgactcactatagggatgttaactcgagtgattatgatctgttgtaacagaggagaacaacaatgcataatcacaacctggcggcagcgcaaaagatg

SEQ ID NO: 23037 - DNA, 103 bp, Artificial Sequence
  Synthetic Polynucleotide
taatacgactcactatagggaccccatgttaactcgagtgattatgatctaacagaggagaagatcaatgtcactcgagaacctggcggcagcgcaaaagatg

SEQ ID NO: 23038 - DNA, 103 bp, Artificial Sequence
  Synthetic Polynucleotide
taatacgactcactatagggtaagaaccccatgttaactcgagtgattataacagaggagaataatcatgcgagttaacaacctggcggcagcgcaaaagatg

SEQ ID NO: 23039 - DNA, 103 bp, Artificial Sequence
  Synthetic Polynucleotide
taatacgactcactatagggtctactaagaaccccatgttaactcgagtgaacagaggagacactcgatgtaacatgggaacctggcggcagcgcaaaagatg

SEQ ID NO: 23040 - DNA, 103 bp, Artificial Sequence
  Synthetic Polynucleotide
taatacgactcactatagggtaacttctactaagaaccccatgttaactcaacagaggagagagttaatgtggggttctaacctggcggcagcgcaaaagatg

SEQ ID NO: 23041 - DNA, 103 bp, Artificial Sequence
  Synthetic Polynucleotide
taatacgactcactatagggcctcctaacttctactaagaaccccatgttaacagaggagaaacatgatgttcttagtaaacctggcggcagcgcaaaagatg

SEQ ID NO: 23042 - DNA, 103 bp, Artificial Sequence
  Synthetic Polynucleotide
taatacgactcactatagggtcaatcctcctaacttctactaagaaccccaacagaggagaggggttatgagtagaagtaacctggcggcagcgcaaaagatg

SEQ ID NO: 23043 - DNA, 103 bp, Artificial Sequence
  Synthetic Polynucleotide
taatacgactcactatagggtacttctgcatcatgtgctgcttctcgcagaacagaggagactgcgaatggcagcacataacctggcggcagcgcaaaagatg

SEQ ID NO: 23044 - DNA, 103 bp, Artificial Sequence
  Synthetic Polynucleotide
taatacgactcactatagggcaatgtcaatcctcctaacttctactaagaaacagaggagatcttagatgaagttaggaaacctggcggcagcgcaaaagatg

SEQ ID NO: 23045 - DNA, 103 bp, Artificial Sequence
  Synthetic Polynucleotide
taatacgactcactatagggaggttcaatgtcaatcctcctaacttctacaacagaggagagtagaaatgaggaggattaacctggcggcagcgcaaaagatg

SEQ ID NO: 23046 - DNA, 103 bp, Artificial Sequence
  Synthetic Polynucleotide
taatacgactcactatagggcagcaaggttcaatgtcaatcctcctaactaacagaggagaagttagatggattgacataacctggcggcagcgcaaaagatg

SEQ ID NO: 23047 - DNA, 103 bp, Artificial Sequence
  Synthetic Polynucleotide
taatacgactcactatagggcgccgcagcaaggttcaatgtcaatcctccaacagaggagaggaggaatgacattgaacaacctggcggcagcgcaaaagatg

SEQ ID NO: 23048 - DNA, 103 bp, Artificial Sequence
  Synthetic Polynucleotide
taatacgactcactatagggagtctcgccgcagcaaggttcaatgtcaataacagaggagaattgacatggaaccttgcaacctggcggcagcgcaaaagatg

SEQ ID NO: 23049 - DNA, 103 bp, Artificial Sequence
  Synthetic Polynucleotide
taatacgactcactatagggaggacagtctcgccgcagcaaggttcaatgaacagaggagacattgaatgttgctgcggaacctggcggcagcgcaaaagatg

SEQ ID NO: 23050 - DNA, 103 bp, Artificial Sequence
  Synthetic Polynucleotide
taatacgactcactatagggctgagaggacagtctcgccgcagcaaggttaacagaggagaaaccttatggcggcgagaaacctggcggcagcgcaaaagatg

SEQ ID NO: 23051 - DNA, 103 bp, Artificial Sequence
  Synthetic Polynucleotide
taatacgactcactatagggtgattctgagaggacagtctcgccgcagcaaacagaggagatgctgcatggagactgtcaacctggcggcagcgcaaaagatg

SEQ ID NO: 23052 - DNA, 103 bp, Artificial Sequence
  Synthetic Polynucleotide
taatacgactcactatagggacaactgattctgagaggacagtctcgccgaacagaggagacggcgaatgtgtcctctcaacctggcggcagcgcaaaagatg

SEQ ID NO: 23053 - DNA, 103 bp, Artificial Sequence
  Synthetic Polynucleotide
taatacgactcactatagggcaaacacaactgattctgagaggacagtctaacagaggagaagactgatgtctcagaataacctggcggcagcgcaaaagatg

SEQ ID NO: 23054 - DNA, 103 bp, Artificial Sequence
  Synthetic Polynucleotide
taatacgactcactatagggaattttacttctgcatcatgtgctgcttctaacagaggagaagaagcatgacatgatgcaacctggcggcagcgcaaaagatg

SEQ ID NO: 23055 - DNA, 103 bp, Artificial Sequence
  Synthetic Polynucleotide
taatacgactcactatagggtagcccaaacacaactgattctgagaggacaacagaggagagtcctcatggaatcagttaacctggcggcagcgcaaaagatg

SEQ ID NO: 23056 - DNA, 103 bp, Artificial Sequence
  Synthetic Polynucleotide
taatacgactcactataggggctactagcccaaacacaactgattctgagaacagaggagactcagaatgagttgtgttaacctggcggcagcgcaaaagatg

SEQ ID NO: 23057 - DNA, 103 bp, Artificial Sequence
  Synthetic Polynucleotide
taatacgactcactatagggcttcagctactagcccaaacacaactgattaacagaggagaaatcagatgtgtttgggcaacctggcggcagcgcaaaagatg

SEQ ID NO: 23058 - DNA, 103 bp, Artificial Sequence
  Synthetic Polynucleotide
taatacgactcactataggggactgcttcagctactagcccaaacacaacaacagaggagagttgtgatggggctagtaaacctggcggcagcgcaaaagatg

SEQ ID NO: 23059 - DNA, 103 bp, Artificial Sequence
  Synthetic Polynucleotide
taatacgactcactatagggcttaggactgcttcagctactagcccaaacaacagaggagagtttggatgagtagctgaaacctggcggcagcgcaaaagatg

SEQ ID NO: 23060 - DNA, 103 bp, Artificial Sequence
  Synthetic Polynucleotide
taatacgactcactataggggttcccttaggactgcttcagctactagccaacagaggagaggctagatgctgaagcagaacctggcggcagcgcaaaagatg

SEQ ID NO: 23061 - DNA, 103 bp, Artificial Sequence
  Synthetic Polynucleotide
taatacgactcactataggggctgtgttcccttaggactgcttcagctacaacagaggagagtagctatggcagtcctaaacctggcggcagcgcaaaagatg

SEQ ID NO: 23062 - DNA, 103 bp, Artificial Sequence
  Synthetic Polynucleotide
taatacgactcactatagggatctggctgtgttcccttaggactgcttcaaacagaggagatgaagcatgcctaagggaaacctggcggcagcgcaaaagatg

SEQ ID NO: 23063 - DNA, 103 bp, Artificial Sequence
  Synthetic Polynucleotide
taatacgactcactatagggtctcaatctggctgtgttcccttaggactgaacagaggagacagtccatggggaacacaaacctggcggcagcgcaaaagatg

SEQ ID NO: 23064 - DNA, 103 bp, Artificial Sequence
  Synthetic Polynucleotide
taatacgactcactatagggacctctctcaatctggctgtgttcccttagaacagaggagactaaggatgcacagccagaacctggcggcagcgcaaaagatg

SEQ ID NO: 23065 - DNA, 103 bp, Artificial Sequence
  Synthetic Polynucleotide
taatacgactcactatagggtttgtaattttacttctgcatcatgtgctgaacagaggagacagcacatgatgcagaagaacctggcggcagcgcaaaagatg

SEQ ID NO: 23066 - DNA, 103 bp, Artificial Sequence
  Synthetic Polynucleotide
taatacgactcactatagggggttgacctctctcaatctggctgtgttccaacagaggagaggaacaatgccagattgaaacctggcggcagcgcaaaagatg

SEQ ID NO: 23067 - DNA, 103 bp, Artificial Sequence
  Synthetic Polynucleotide
taatacgactcactatagggtaagaggttgacctctctcaatctggctgtaacagaggagaacagccatgttgagagagaacctggcggcagcgcaaaagatg

SEQ ID NO: 23068 - DNA, 103 bp, Artificial Sequence
  Synthetic Polynucleotide
taatacgactcactatagggcaaattaagaggttgacctctctcaatctgaacagaggagacagattatgagaggtcaaaacctggcggcagcgcaaaagatg

SEQ ID NO: 23069 - DNA, 103 bp, Artificial Sequence
  Synthetic Polynucleotide
taatacgactcactatagggtgtgtcaaattaagaggttgacctctctcaaacagaggagatgagagatgtcaacctctaacctggcggcagcgcaaaagatg

SEQ ID NO: 23070 - DNA, 103 bp, Artificial Sequence
  Synthetic Polynucleotide
taatacgactcactatagggtgtattgtgtcaaattaagaggttgacctcaacagaggagagaggtcatgctcttaattaacctggcggcagcgcaaaagatg

SEQ ID NO: 23071 - DNA, 103 bp, Artificial Sequence
  Synthetic Polynucleotide
taatacgactcactataggggttcatgtattgtgtcaaattaagaggttgaacagaggagacaacctatgaatttgacaaacctggcggcagcgcaaaagatg

SEQ ID NO: 23072 - DNA, 103 bp, Artificial Sequence
  Synthetic Polynucleotide
taatacgactcactatagggttgctgttcatgtattgtgtcaaattaagaaacagaggagatcttaaatggacacaataaacctggcggcagcgcaaaagatg

SEQ ID NO: 23073 - DNA, 103 bp, Artificial Sequence
  Synthetic Polynucleotide
taatacgactcactatagggcaattttgctgttcatgtattgtgtcaaataacagaggagaatttgaatgaatacatgaaacctggcggcagcgcaaaagatg

SEQ ID NO: 23074 - DNA, 103 bp, Artificial Sequence
  Synthetic Polynucleotide
taatacgactcactatagggaatagcaattttgctgttcatgtattgtgtaacagaggagaacacaaatgatgaacagcaacctggcggcagcgcaaaagatg

SEQ ID NO: 23075 - DNA, 103 bp, Artificial Sequence
  Synthetic Polynucleotide
taatacgactcactataggggtctaaatagcaattttgctgttcatgtataacagaggagaatacatatgcagcaaaataacctggcggcagcgcaaaagatg

SEQ ID NO: 23076 - DNA, 103 bp, Artificial Sequence
  Synthetic Polynucleotide
taatacgactcactatagggtcgcctttgtaattttacttctgcatcatgaacagaggagacatgatatggaagtaaaaaacctggcggcagcgcaaaagatg

SEQ ID NO: 23077 - DNA, 103 bp, Artificial Sequence
  Synthetic Polynucleotide
taatacgactcactatagggaagctgtctaaatagcaattttgctgttcaaacagaggagatgaacaatgaaattgctaaacctggcggcagcgcaaaagatg

SEQ ID NO: 23078 - DNA, 103 bp, Artificial Sequence
  Synthetic Polynucleotide
taatacgactcactataggggaatcaagctgtctaaatagcaattttgctaacagaggagaagcaaaatggctatttagaacctggcggcagcgcaaaagatg

SEQ ID NO: 23079 - DNA, 103 bp, Artificial Sequence
  Synthetic Polynucleotide
taatacgactcactatagggatgccgaatcaagctgtctaaatagcaattaacagaggagaaattgcatgttagacagcaacctggcggcagcgcaaaagatg

SEQ ID NO: 23080 - DNA, 103 bp, Artificial Sequence
  Synthetic Polynucleotide
taatacgactcactatagggtttagatgccgaatcaagctgtctaaatagaacagaggagactatttatgcagcttgataacctggcggcagcgcaaaagatg

SEQ ID NO: 23081 - DNA, 103 bp, Artificial Sequence
  Synthetic Polynucleotide
taatacgactcactatagggaaagctttagatgccgaatcaagctgtctaaacagaggagatagacaatgtgattcggcaacctggcggcagcgcaaaagatg

SEQ ID NO: 23082 - DNA, 103 bp, Artificial Sequence
  Synthetic Polynucleotide
taatacgactcactataggggaattaaagctttagatgccgaatcaagctaacagaggagaagcttgatgcggcatctaaacctggcggcagcgcaaaagatg

SEQ ID NO: 23083 - DNA, 103 bp, Artificial Sequence
  Synthetic Polynucleotide
taatacgactcactatagggcagctgaattaaagctttagatgccgaatcaacagaggagagattcgatgtctaaagctaacctggcggcagcgcaaaagatg

SEQ ID NO: 23084 - DNA, 103 bp, Artificial Sequence
  Synthetic Polynucleotide
taatacgactcactatagggttatacagctgaattaaagctttagatgccaacagaggagaggcatcatgagctttaataacctggcggcagcgcaaaagatg

SEQ ID NO: 23085 - DNA, 103 bp, Artificial Sequence
  Synthetic Polynucleotide
taatacgactcactatagggtatccttatacagctgaattaaagctttagaacagaggagactaaagatgtaattcagcaacctggcggcagcgcaaaagatg

SEQ ID NO: 23086 - DNA, 103 bp, Artificial Sequence
  Synthetic Polynucleotide
taatacgactcactatagggctcaatatccttatacagctgaattaaagcaacagaggagagctttaatgcagctgtataacctggcggcagcgcaaaagatg

SEQ ID NO: 23087 - DNA, 103 bp, Artificial Sequence
  Synthetic Polynucleotide
taatacgactcactataggggtacctaattctagcaaactatgtaaatccaacagaggagaggatttatgtagtttgctaacctggcggcagcgcaaaagatg

SEQ ID NO: 23088 - DNA, 103 bp, Artificial Sequence
  Synthetic Polynucleotide
taatacgactcactatagggtcatgtcgcctttgtaattttacttctgcaaacagaggagatgcagaatgaaaattacaaacctggcggcagcgcaaaagatg

SEQ ID NO: 23089 - DNA, 103 bp, Artificial Sequence
  Synthetic Polynucleotide
taatacgactcactataggggtcttctcaatatccttatacagctgaattaacagaggagaaattcaatggtataaggaaacctggcggcagcgcaaaagatg

SEQ ID NO: 23090 - DNA, 103 bp, Artificial Sequence
  Synthetic Polynucleotide
taatacgactcactatagggccactgtcttctcaatatccttatacagctaacagaggagaagctgtatgaggatattgaacctggcggcagcgcaaaagatg

SEQ ID NO: 23091 - DNA, 103 bp, Artificial Sequence
  Synthetic Polynucleotide
taatacgactcactatagggatgatccactgtcttctcaatatccttataaacagaggagatataagatgattgagaagaacctggcggcagcgcaaaagatg

SEQ ID NO: 23092 - DNA, 103 bp, Artificial Sequence
  Synthetic Polynucleotide
taatacgactcactatagggtgattatgatccactgtcttctcaatatccaacagaggagaggatatatggaagacagtaacctggcggcagcgcaaaagatg

SEQ ID NO: 23093 - DNA, 103 bp, Artificial Sequence
  Synthetic Polynucleotide
taatacgactcactataggggcaattgattatgatccactgtcttctcaaaacagaggagattgagaatgcagtggatcaacctggcggcagcgcaaaagatg

SEQ ID NO: 23094 - DNA, 103 bp, Artificial Sequence
  Synthetic Polynucleotide
taatacgactcactatagggaaagggcaattgattatgatccactgtcttaacagaggagaaagacaatggatcataataacctggcggcagcgcaaaagatg

SEQ ID NO: 23095 - DNA, 103 bp, Artificial Sequence
  Synthetic Polynucleotide
taatacgactcactatagggattataaagggcaattgattatgatccactaacagaggagaagtggaatgtaatcaattaacctggcggcagcgcaaaagatg

SEQ ID NO: 23096 - DNA, 103 bp, Artificial Sequence
  Synthetic Polynucleotide
taatacgactcactatagggcttttattataaagggcaattgattatgataacagaggagaatcataatgaattgccctaacctggcggcagcgcaaaagatg

SEQ ID NO: 23097 - DNA, 103 bp, Artificial Sequence
  Synthetic Polynucleotide
taatacgactcactatagggtacatcttttattataaagggcaattgattaacagaggagaaatcaaatgccctttataaacctggcggcagcgcaaaagatg

SEQ ID NO: 23098 - DNA, 103 bp, Artificial Sequence
  Synthetic Polynucleotide
taatacgactcactataggggcaactacatcttttattataaagggcaataacagaggagaattgccatgtataataaaaacctggcggcagcgcaaaagatg

SEQ ID NO: 23099 - DNA, 103 bp, Artificial Sequence
  Synthetic Polynucleotide
taatacgactcactatagggggtgttcatgtcgcctttgtaattttacttaacagaggagaaagtaaatgtacaaaggcaacctggcggcagcgcaaaagatg

SEQ ID NO: 23100 - DNA, 103 bp, Artificial Sequence
  Synthetic Polynucleotide
taatacgactcactatagggttagggcaactacatcttttattataaaggaacagaggagacctttaatgtaaaagatgaacctggcggcagcgcaaaagatg

SEQ ID NO: 23101 - DNA, 103 bp, Artificial Sequence
  Synthetic Polynucleotide
taatacgactcactatagggacaaattagggcaactacatcttttattataacagaggagaataataatggatgtagttaacctggcggcagcgcaaaagatg

SEQ ID NO: 23102 - DNA, 103 bp, Artificial Sequence
  Synthetic Polynucleotide
taatacgactcactatagggtgaatacaaattagggcaactacatcttttaacagaggagaaaaagaatgagttgccctaacctggcggcagcgcaaaagatg

SEQ ID NO: 23103 - DNA, 103 bp, Artificial Sequence
  Synthetic Polynucleotide
taatacgactcactataggggttagtgaatacaaattagggcaactacataacagaggagaatgtagatgccctaatttaacctggcggcagcgcaaaagatg

SEQ ID NO: 23104 - DNA, 103 bp, Artificial Sequence
  Synthetic Polynucleotide
taatacgactcactatagggtttaggttagtgaatacaaattagggcaacaacagaggagagttgccatgatttgtattaacctggcggcagcgcaaaagatg

SEQ ID NO: 23105 - DNA, 103 bp, Artificial Sequence
  Synthetic Polynucleotide
taatacgactcactatagggattattttaggttagtgaatacaaattaggaacagaggagacctaatatgtattcactaaacctggcggcagcgcaaaagatg

SEQ ID NO: 23106 - DNA, 103 bp, Artificial Sequence
  Synthetic Polynucleotide
taatacgactcactatagggatactattattttaggttagtgaatacaaaaacagaggagatttgtaatgactaacctaaacctggcggcagcgcaaaagatg

SEQ ID NO: 23107 - DNA, 103 bp, Artificial Sequence
  Synthetic Polynucleotide
taatacgactcactatagggtgataatactattattttaggttagtgaataacagaggagaattcacatgcctaaaataaacctggcggcagcgcaaaagatg

SEQ ID NO: 23108 - DNA, 103 bp, Artificial Sequence
  Synthetic Polynucleotide
taatacgactcactatagggtagtgtgataatactattattttaggttagaacagaggagactaaccatgaataatagtaacctggcggcagcgcaaaagatg

SEQ ID NO: 23109 - DNA, 103 bp, Artificial Sequence
  Synthetic Polynucleotide
taatacgactcactatagggctatctagtgtgataatactattattttagaacagaggagactaaaaatgtagtattataacctggcggcagcgcaaaagatg

SEQ ID NO: 23110 - DNA, 103 bp, Artificial Sequence
  Synthetic Polynucleotide
taatacgactcactatagggttcctggtgttcatgtcgcctttgtaatttaacagaggagaaaattaatgaggcgacataacctggcggcagcgcaaaagatg

SEQ ID NO: 23111 - DNA, 103 bp, Artificial Sequence
  Synthetic Polynucleotide
taatacgactcactataggggatgactatctagtgtgataatactattataacagaggagaataataatgttatcacacaacctggcggcagcgcaaaagatg

SEQ ID NO: 23112 - DNA, 103 bp, Artificial Sequence
  Synthetic Polynucleotide
taatacgactcactatagggtatgtgatgactatctagtgtgataatactaacagaggagaagtattatgacactagataacctggcggcagcgcaaaagatg

SEQ ID NO: 23113 - DNA, 103 bp, Artificial Sequence
  Synthetic Polynucleotide
taatacgactcactatagggcttattatgtgatgactatctagtgtgataaacagaggagatatcacatgagatagtcaaacctggcggcagcgcaaaagatg

SEQ ID NO: 23114 - DNA, 103 bp, Artificial Sequence
  Synthetic Polynucleotide
taatacgactcactatagggaacaacttattatgtgatgactatctagtgaacagaggagacactagatggtcatcacaaacctggcggcagcgcaaaagatg

SEQ ID NO: 23115 - DNA, 103 bp, Artificial Sequence
  Synthetic Polynucleotide
taatacgactcactatagggatagaaacaacttattatgtgatgactatcaacagaggagagatagtatgcacataataaacctggcggcagcgcaaaagatg

SEQ ID NO: 23116 - DNA, 103 bp, Artificial Sequence
  Synthetic Polynucleotide
taatacgactcactatagggaattcatagaaacaacttattatgtgatgaaacagaggagatcatcaatgaataagttgaacctggcggcagcgcaaaagatg

SEQ ID NO: 23117 - DNA, 103 bp, Artificial Sequence
  Synthetic Polynucleotide
taatacgactcactatagggtgattaattcatagaaacaacttattatgtaacagaggagaacataaatggttgtttctaacctggcggcagcgcaaaagatg

SEQ ID NO: 23118 - DNA, 103 bp, Artificial Sequence
  Synthetic Polynucleotide
taatacgactcactatagggtatcatgattaattcatagaaacaacttataacagaggagaataagtatgttctatgaaaacctggcggcagcgcaaaagatg

SEQ ID NO: 23119 - DNA, 103 bp, Artificial Sequence
  Synthetic Polynucleotide
taatacgactcactatagggtatactatcatgattaattcatagaaacaaaacagaggagattgtttatgtgaattaataacctggcggcagcgcaaaagatg

SEQ ID NO: 23120 - DNA, 103 bp, Artificial Sequence
  Synthetic Polynucleotide
taatacgactcactatagggaagattatactatcatgattaattcatagaaacagaggagatctatgatgtaatcatgaaacctggcggcagcgcaaaagatg

SEQ ID NO: 23121 - DNA, 103 bp, Artificial Sequence
  Synthetic Polynucleotide
taatacgactcactatagggtgaatttcctggtgttcatgtcgcctttgtaacagaggagaacaaagatgacatgaacaaacctggcggcagcgcaaaagatg

SEQ ID NO: 23122 - DNA, 103 bp, Artificial Sequence
  Synthetic Polynucleotide
taatacgactcactatagggtctacaagattatactatcatgattaattcaacagaggagagaattaatgatgatagtaaacctggcggcagcgcaaaagatg

SEQ ID NO: 23123 - DNA, 103 bp, Artificial Sequence
  Synthetic Polynucleotide
taatacgactcactataggggtaattctacaagattatactatcatgattaacagaggagaaatcatatgagtataatcaacctggcggcagcgcaaaagatg

SEQ ID NO: 23124 - DNA, 103 bp, Artificial Sequence
  Synthetic Polynucleotide
taatacgactcactatagggccatagtaattctacaagattatactatcaaacagaggagatgatagatgaatcttgtaaacctggcggcagcgcaaaagatg

SEQ ID NO: 23125 - DNA, 103 bp, Artificial Sequence
  Synthetic Polynucleotide
taatacgactcactatagggagaacccatagtaattctacaagattatacaacagaggagagtataaatgtgtagaattaacctggcggcagcgcaaaagatg

SEQ ID NO: 23126 - DNA, 103 bp, Artificial Sequence
  Synthetic Polynucleotide
taatacgactcactatagggtatatagaacccatagtaattctacaagataacagaggagaatcttgatgaattactataacctggcggcagcgcaaaagatg

SEQ ID NO: 23127 - DNA, 103 bp, Artificial Sequence
  Synthetic Polynucleotide
taatacgactcactatagggtgccgtatatagaacccatagtaattctacaacagaggagagtagaaatgctatgggttaacctggcggcagcgcaaaagatg

SEQ ID NO: 23128 - DNA, 103 bp, Artificial Sequence
  Synthetic Polynucleotide
taatacgactcactatagggataaatgccgtatatagaacccatagtaataacagaggagaattactatgggttctataaacctggcggcagcgcaaaagatg

SEQ ID NO: 23129 - DNA, 103 bp, Artificial Sequence
  Synthetic Polynucleotide
taatacgactcactatagggccggaataaatgccgtatatagaacccataaacagaggagatatgggatgtatatacggaacctggcggcagcgcaaaagatg

SEQ ID NO: 23130 - DNA, 103 bp, Artificial Sequence
  Synthetic Polynucleotide
taatacgactcactatagggacagtccggaataaatgccgtatatagaacaacagaggagagttctaatgacggcatttaacctggcggcagcgcaaaagatg

SEQ ID NO: 23131 - DNA, 103 bp, Artificial Sequence
  Synthetic Polynucleotide
taatacgactcactatagggaggatacagtccggaataaatgccgtatataacagaggagaatatacatgatttattccaacctggcggcagcgcaaaagatg

SEQ ID NO: 23132 - DNA, 103 bp, Artificial Sequence
  Synthetic Polynucleotide
taatacgactcactatagggtggcctgaatttcctggtgttcatgtcgccaacagaggagaggcgacatgaacaccaggaacctggcggcagcgcaaaagatg

SEQ ID NO: 23133 - DNA, 103 bp, Artificial Sequence
  Synthetic Polynucleotide
taatacgactcactatagggtacaaaggatacagtccggaataaatgccgaacagaggagacggcatatgttccggactaacctggcggcagcgcaaaagatg

SEQ ID NO: 23134 - DNA, 103 bp, Artificial Sequence
  Synthetic Polynucleotide
taatacgactcactatagggttgtttacaaaggatacagtccggaataaaaacagaggagatttattatggactgtatcaacctggcggcagcgcaaaagatg

SEQ ID NO: 23135 - DNA, 103 bp, Artificial Sequence
  Synthetic Polynucleotide
taatacgactcactatagggatgcattgtttacaaaggatacagtccggaaacagaggagatccggaatgtatcctttgaacctggcggcagcgcaaaagatg

SEQ ID NO: 23136 - DNA, 103 bp, Artificial Sequence
  Synthetic Polynucleotide
taatacgactcactatagggtaagcatgcattgtttacaaaggatacagtaacagaggagaactgtaatgtttgtaaacaacctggcggcagcgcaaaagatg

SEQ ID NO: 23137 - DNA, 103 bp, Artificial Sequence
  Synthetic Polynucleotide
taatacgactcactatagggatacttaagcatgcattgtttacaaaggataacagaggagaatccttatgaaacaatgcaacctggcggcagcgcaaaagatg

SEQ ID NO: 23138 - DNA, 103 bp, Artificial Sequence
  Synthetic Polynucleotide
taatacgactcactatagggtgagaatacttaagcatgcattgtttacaaaacagaggagattgtaaatgatgcatgctaacctggcggcagcgcaaaagatg

SEQ ID NO: 23139 - DNA, 103 bp, Artificial Sequence
  Synthetic Polynucleotide
taatacgactcactatagggtgatatgagaatacttaagcatgcattgttaacagaggagaaacaatatgtgcttaagtaacctggcggcagcgcaaaagatg

SEQ ID NO: 23140 - DNA, 103 bp, Artificial Sequence
  Synthetic Polynucleotide
taatacgactcactatagggatgtatgatatgagaatacttaagcatgcaaacagaggagatgcatgatgaagtattctaacctggcggcagcgcaaaagatg

SEQ ID NO: 23141 - DNA, 103 bp, Artificial Sequence
  Synthetic Polynucleotide
taatacgactcactatagggataacatgtatgatatgagaatacttaagcaacagaggagagcttaaatgttctcatataacctggcggcagcgcaaaagatg

SEQ ID NO: 23142 - DNA, 103 bp, Artificial Sequence
  Synthetic Polynucleotide
taatacgactcactatagggcagtgataacatgtatgatatgagaatactaacagaggagaagtattatgatatcatacaacctggcggcagcgcaaaagatg

SEQ ID NO: 23143 - DNA, 103 bp, Artificial Sequence
  Synthetic Polynucleotide
taatacgactcactatagggggcgatggcctgaatttcctggtgttcatgaacagaggagacatgaaatgcaggaaattaacctggcggcagcgcaaaagatg

SEQ ID NO: 23144 - DNA, 103 bp, Artificial Sequence
  Synthetic Polynucleotide
taatacgactcactatagggtcaggcagtgataacatgtatgatatgagaaacagaggagatctcatatgatacatgttaacctggcggcagcgcaaaagatg

SEQ ID NO: 23145 - DNA, 103 bp, Artificial Sequence
  Synthetic Polynucleotide
taatacgactcactatagggcttaatcaggcagtgataacatgtatgataaacagaggagatatcatatgtgttatcacaacctggcggcagcgcaaaagatg

SEQ ID NO: 23146 - DNA, 103 bp, Artificial Sequence
  Synthetic Polynucleotide
taatacgactcactatagggtttttcttaatcaggcagtgataacatgtaaacagaggagatacatgatgtcactgcctaacctggcggcagcgcaaaagatg

SEQ ID NO: 23147 - DNA, 103 bp, Artificial Sequence
  Synthetic Polynucleotide
taatacgactcactatagggattggtttttcttaatcaggcagtgataacaacagaggagagttatcatggcctgattaaacctggcggcagcgcaaaagatg

SEQ ID NO: 23148 - DNA, 103 bp, Artificial Sequence
  Synthetic Polynucleotide
taatacgactcactatagggccatcattggtttttcttaatcaggcagtgaacagaggagacactgcatgattaagaaaaacctggcggcagcgcaaaagatg

SEQ ID NO: 23149 - DNA, 103 bp, Artificial Sequence
  Synthetic Polynucleotide
taatacgactcactatagggaatatccatcattggtttttcttaatcaggaacagaggagacctgatatggaaaaaccaaacctggcggcagcgcaaaagatg

SEQ ID NO: 23150 - DNA, 103 bp, Artificial Sequence
  Synthetic Polynucleotide
taatacgactcactatagggtgtttaatatccatcattggtttttcttaaaacagaggagattaagaatgaccaatgataacctggcggcagcgcaaaagatg

SEQ ID NO: 23151 - DNA, 103 bp, Artificial Sequence
  Synthetic Polynucleotide
taatacgactcactatagggaaggatgtttaatatccatcattggtttttaacagaggagaaaaaacatgtgatggataaacctggcggcagcgcaaaagatg

SEQ ID NO: 23152 - DNA, 103 bp, Artificial Sequence
  Synthetic Polynucleotide
taatacgactcactatagggaattgaaggatgtttaatatccatcattggaacagaggagaccaatgatggatattaaaaacctggcggcagcgcaaaagatg

SEQ ID NO: 23153 - DNA, 103 bp, Artificial Sequence
  Synthetic Polynucleotide
taatacgactcactatagggcagtcaattgaaggatgtttaatatccatcaacagaggagagatggaatgtaaacatccaacctggcggcagcgcaaaagatg

SEQ ID NO: 23154 - DNA, 103 bp, Artificial Sequence
  Synthetic Polynucleotide
taatacgactcactatagggtcctcggcgatggcctgaatttcctggtgtaacagaggagaacaccaatgaattcaggcaacctggcggcagcgcaaaagatg

SEQ ID NO: 23155 - DNA, 103 bp, Artificial Sequence
  Synthetic Polynucleotide
taatacgactcactatagggcaaaacagtcaattgaaggatgtttaatataacagaggagaatattaatgatccttcaaaacctggcggcagcgcaaaagatg

SEQ ID NO: 23156 - DNA, 103 bp, Artificial Sequence
  Synthetic Polynucleotide
taatacgactcactatagggagtctcaaaacagtcaattgaaggatgtttaacagaggagaaaacatatgtcaattgacaacctggcggcagcgcaaaagatg

SEQ ID NO: 23157 - DNA, 103 bp, Artificial Sequence
  Synthetic Polynucleotide
taatacgactcactatagggtttaaagtctcaaaacagtcaattgaaggaaacagaggagatccttcatgtgactgtttaacctggcggcagcgcaaaagatg

SEQ ID NO: 23158 - DNA, 103 bp, Artificial Sequence
  Synthetic Polynucleotide
taatacgactcactatagggaagattttaaagtctcaaaacagtcaattgaacagaggagacaattgatggttttgagaaacctggcggcagcgcaaaagatg

SEQ ID NO: 23159 - DNA, 103 bp, Artificial Sequence
  Synthetic Polynucleotide
taatacgactcactatagggcctgtaagattttaaagtctcaaaacagtcaacagaggagagactgtatggagactttaaacctggcggcagcgcaaaagatg

SEQ ID NO: 23160 - DNA, 103 bp, Artificial Sequence
  Synthetic Polynucleotide
taatacgactcactataggggacagcctgtaagattttaaagtctcaaaaaacagaggagattttgaatgtttaaaatcaacctggcggcagcgcaaaagatg

SEQ ID NO: 23161 - DNA, 103 bp, Artificial Sequence
  Synthetic Polynucleotide
taatacgactcactatagggatcaagacagcctgtaagattttaaagtctaacagaggagaagacttatgaatcttacaaacctggcggcagcgcaaaagatg

SEQ ID NO: 23162 - DNA, 103 bp, Artificial Sequence
  Synthetic Polynucleotide
taatacgactcactatagggtaaaaatcaagacagcctgtaagattttaaaacagaggagattaaaaatgtacaggctgaacctggcggcagcgcaaaagatg

SEQ ID NO: 23163 - DNA, 103 bp, Artificial Sequence
  Synthetic Polynucleotide
taatacgactcactataggggaatttaaaaatcaagacagcctgtaagataacagaggagaatcttaatggctgtcttgaacctggcggcagcgcaaaagatg

SEQ ID NO: 23164 - DNA, 103 bp, Artificial Sequence
  Synthetic Polynucleotide
taatacgactcactataggggtagagaatttaaaaatcaagacagcctgtaacagaggagaacaggcatgcttgattttaacctggcggcagcgcaaaagatg

SEQ ID NO: 23165 - DNA, 103 bp, Artificial Sequence
  Synthetic Polynucleotide
taatacgactcactatagggcgtcatcctcggcgatggcctgaatttcctaacagaggagaaggaaaatgaggccatcgaacctggcggcagcgcaaaagatg

SEQ ID NO: 23166 - DNA, 103 bp, Artificial Sequence
  Synthetic Polynucleotide
taatacgactcactatagggatcccgtagagaatttaaaaatcaagacagaacagaggagactgtctatgtttttaaataacctggcggcagcgcaaaagatg

SEQ ID NO: 23167 - DNA, 103 bp, Artificial Sequence
  Synthetic Polynucleotide
taatacgactcactataggggtataatcccgtagagaatttaaaaatcaaaacagaggagattgattatgaaattctctaacctggcggcagcgcaaaagatg

SEQ ID NO: 23168 - DNA, 103 bp, Artificial Sequence
  Synthetic Polynucleotide
taatacgactcactatagggtgactgtataatcccgtagagaatttaaaaaacagaggagattttaaatgctctacgggaacctggcggcagcgcaaaagatg

SEQ ID NO: 23169 - DNA, 103 bp, Artificial Sequence
  Synthetic Polynucleotide
taatacgactcactatagggaaaggtgactgtataatcccgtagagaattaacagaggagaaattctatgcgggattataacctggcggcagcgcaaaagatg

SEQ ID NO: 23170 - DNA, 103 bp, Artificial Sequence
  Synthetic Polynucleotide
taatacgactcactatagggatgctaaaggtgactgtataatcccgtagaaacagaggagatctacgatgttatacagtaacctggcggcagcgcaaaagatg

SEQ ID NO: 23171 - DNA, 103 bp, Artificial Sequence
  Synthetic Polynucleotide
taatacgactcactatagggaatgtatgctaaaggtgactgtataatcccaacagaggagagggattatgcagtcacctaacctggcggcagcgcaaaagatg

SEQ ID NO: 23172 - DNA, 103 bp, Artificial Sequence
  Synthetic Polynucleotide
taatacgactcactatagggggcataatgtatgctaaaggtgactgtataaacagaggagatatacaatgacctttagcaacctggcggcagcgcaaaagatg

SEQ ID NO: 23173 - DNA, 103 bp, Artificial Sequence
  Synthetic Polynucleotide
taatacgactcactatagggcgagaggcataatgtatgctaaaggtgactaacagaggagaagtcacatgtagcatacaaacctggcggcagcgcaaaagatg

SEQ ID NO: 23174 - DNA, 103 bp, Artificial Sequence
  Synthetic Polynucleotide
taatacgactcactatagggtttcgcgagaggcataatgtatgctaaaggaacagaggagacctttaatgtacattatgaacctggcggcagcgcaaaagatg

SEQ ID NO: 23175 - DNA, 103 bp, Artificial Sequence
  Synthetic Polynucleotide
taatacgactcactatagggtattatttcgcgagaggcataatgtatgctaacagaggagaagcataatgtatgcctctaacctggcggcagcgcaaaagatg

SEQ ID NO: 23176 - DNA, 103 bp, Artificial Sequence
  Synthetic Polynucleotide
taatacgactcactatagggctcttcgtcatcctcggcgatggcctgaataacagaggagaattcagatgatcgccgagaacctggcggcagcgcaaaagatg

SEQ ID NO: 23177 - DNA, 103 bp, Artificial Sequence
  Synthetic Polynucleotide
taatacgactcactatagggacttatattatttcgcgagaggcataatgtaacagaggagaacattaatgctctcgcgaaacctggcggcagcgcaaaagatg

SEQ ID NO: 23178 - DNA, 103 bp, Artificial Sequence
  Synthetic Polynucleotide
taatacgactcactataggggagtcacttatattatttcgcgagaggcataacagaggagaatgcctatggcgaaataaaacctggcggcagcgcaaaagatg

SEQ ID NO: 23179 - DNA, 103 bp, Artificial Sequence
  Synthetic Polynucleotide
taatacgactcactatagggtcatagagtcacttatattatttcgcgagaaacagaggagatctcgcatgataatataaaacctggcggcagcgcaaaagatg

SEQ ID NO: 23180 - DNA, 103 bp, Artificial Sequence
  Synthetic Polynucleotide
taatacgactcactataggggaatgtcatagagtcacttatattatttcgaacagaggagacgaaatatgataagtgacaacctggcggcagcgcaaaagatg

SEQ ID NO: 23181 - DNA, 103 bp, Artificial Sequence
  Synthetic Polynucleotide
taatacgactcactataggggctcggaatgtcatagagtcacttatattaaacagaggagataatatatgtgactctataacctggcggcagcgcaaaagatg

SEQ ID NO: 23182 - DNA, 103 bp, Artificial Sequence
  Synthetic Polynucleotide
taatacgactcactatagggacctggctcggaatgtcatagagtcacttaaacagaggagataagtgatgctatgacataacctggcggcagcgcaaaagatg

SEQ ID NO: 23183 - DNA, 103 bp, Artificial Sequence
  Synthetic Polynucleotide
taatacgactcactatagggtaaagacctggctcggaatgtcatagagtcaacagaggagagactctatgacattccgaaacctggcggcagcgcaaaagatg

SEQ ID NO: 23184 - DNA, 103 bp, Artificial Sequence
  Synthetic Polynucleotide
taatacgactcactatagggcaagataaagacctggctcggaatgtcataaacagaggagatatgacatgccgagccagaacctggcggcagcgcaaaagatg

SEQ ID NO: 23185 - DNA, 103 bp, Artificial Sequence
  Synthetic Polynucleotide
taatacgactcactatagggtaattcaagataaagacctggctcggaatgaacagaggagacattccatgccaggtcttaacctggcggcagcgcaaaagatg

SEQ ID NO: 23186 - DNA, 103 bp, Artificial Sequence
  Synthetic Polynucleotide
taatacgactcactatagggagggttaattcaagataaagacctggctcgaacagaggagacgagccatgtctttatctaacctggcggcagcgcaaaagatg

SEQ ID NO: 23187 - DNA, 103 bp, Artificial Sequence
  Synthetic Polynucleotide
taatacgactcactatagggtttctctcttcgtcatcctcggcgatggccaacagaggagaggccatatgcgaggatgaaacctggcggcagcgcaaaagatg

SEQ ID NO: 23188 - DNA, 103 bp, Artificial Sequence
  Synthetic Polynucleotide
taatacgactcactatagggaaaagagggttaattcaagataaagacctgaacagaggagacaggtcatgatcttgaataacctggcggcagcgcaaaagatg

SEQ ID NO: 23189 - DNA, 103 bp, Artificial Sequence
  Synthetic Polynucleotide
taatacgactcactatagggtaccaaaaagagggttaattcaagataaagaacagaggagactttatatggaattaaccaacctggcggcagcgcaaaagatg

SEQ ID NO: 23190 - DNA, 103 bp, Artificial Sequence
  Synthetic Polynucleotide
taatacgactcactatagggttgcataccaaaaagagggttaattcaagaaacagaggagatcttgaatgaaccctcttaacctggcggcagcgcaaaagatg

SEQ ID NO: 23191 - DNA, 103 bp, Artificial Sequence
  Synthetic Polynucleotide
taatacgactcactataggggggtgttgcataccaaaaagagggttaattaacagaggagaaattaaatgtctttttggaacctggcggcagcgcaaaagatg

SEQ ID NO: 23192 - DNA, 103 bp, Artificial Sequence
  Synthetic Polynucleotide
taatacgactcactataggggagtcgggtgttgcataccaaaaagagggtaacagaggagaaccctcatgttggtatgcaacctggcggcagcgcaaaagatg

SEQ ID NO: 23193 - DNA, 103 bp, Artificial Sequence
  Synthetic Polynucleotide
taatacgactcactatagggatattgagtcgggtgttgcataccaaaaagaacagaggagactttttatgatgcaacacaacctggcggcagcgcaaaagatg

SEQ ID NO: 23194 - DNA, 103 bp, Artificial Sequence
  Synthetic Polynucleotide
taatacgactcactatagggtctggatattgagtcgggtgttgcataccaaacagaggagatggtatatgacacccgacaacctggcggcagcgcaaaagatg

SEQ ID NO: 23195 - DNA, 103 bp, Artificial Sequence
  Synthetic Polynucleotide
taatacgactcactatagggttgcatctggatattgagtcgggtgttgcaaacagaggagatgcaacatgcgactcaataacctggcggcagcgcaaaagatg

SEQ ID NO: 23196 - DNA, 103 bp, Artificial Sequence
  Synthetic Polynucleotide
taatacgactcactatagggtaatcttgcatctggatattgagtcgggtgaacagaggagacacccgatgcaatatccaaacctggcggcagcgcaaaagatg

SEQ ID NO: 23197 - DNA, 103 bp, Artificial Sequence
  Synthetic Polynucleotide
taatacgactcactataggggaagataatcttgcatctggatattgagtcaacagaggagagactcaatgtccagatgcaacctggcggcagcgcaaaagatg

SEQ ID NO: 23198 - DNA, 103 bp, Artificial Sequence
  Synthetic Polynucleotide
taatacgactcactataggggttttgtacctaattctagcaaactatgtaaacagaggagatacataatgtgctagaataacctggcggcagcgcaaaagatg

SEQ ID NO: 23199 - DNA, 103 bp, Artificial Sequence
  Synthetic Polynucleotide
taatacgactcactatagggatatttttctctcttcgtcatcctcggcgaaacagaggagatcgccgatgatgacgaagaacctggcggcagcgcaaaagatg

SEQ ID NO: 23200 - DNA, 103 bp, Artificial Sequence
  Synthetic Polynucleotide
taatacgactcactatagggtgggagaagataatcttgcatctggatattaacagaggagaaatatcatgatgcaagataacctggcggcagcgcaaaagatg

SEQ ID NO: 23201 - DNA, 103 bp, Artificial Sequence
  Synthetic Polynucleotide
taatacgactcactatagggaattatgggagaagataatcttgcatctggaacagaggagaccagatatgagattatctaacctggcggcagcgcaaaagatg

SEQ ID NO: 23202 - DNA, 103 bp, Artificial Sequence
  Synthetic Polynucleotide
taatacgactcactatagggtctaaaattatgggagaagataatcttgcaaacagaggagatgcaagatgatcttctccaacctggcggcagcgcaaaagatg

SEQ ID NO: 23203 - DNA, 103 bp, Artificial Sequence
  Synthetic Polynucleotide
taatacgactcactatagggactgatctaaaattatgggagaagataatcaacagaggagagattatatgctcccataaaacctggcggcagcgcaaaagatg

SEQ ID NO: 23204 - DNA, 103 bp, Artificial Sequence
  Synthetic Polynucleotide
taatacgactcactatagggatcacactgatctaaaattatgggagaagaaacagaggagatcttctatgataattttaaacctggcggcagcgcaaaagatg

SEQ ID NO: 23205 - DNA, 103 bp, Artificial Sequence
  Synthetic Polynucleotide
taatacgactcactatagggaataaatcacactgatctaaaattatgggaaacagaggagatcccatatgtttagatcaaacctggcggcagcgcaaaagatg

SEQ ID NO: 23206 - DNA, 103 bp, Artificial Sequence
  Synthetic Polynucleotide
taatacgactcactatagggtggtcaataaatcacactgatctaaaattaaacagaggagataatttatgatcagtgtgaacctggcggcagcgcaaaagatg

SEQ ID NO: 23207 - DNA, 103 bp, Artificial Sequence
  Synthetic Polynucleotide
taatacgactcactatagggacttctggtcaataaatcacactgatctaaaacagaggagattagatatgtgtgatttaaacctggcggcagcgcaaaagatg

SEQ ID NO: 23208 - DNA, 103 bp, Artificial Sequence
  Synthetic Polynucleotide
taatacgactcactatagggcctagacttctggtcaataaatcacactgaaacagaggagatcagtgatgtttattgacaacctggcggcagcgcaaaagatg

SEQ ID NO: 23209 - DNA, 103 bp, Artificial Sequence
  Synthetic Polynucleotide
taatacgactcactatagggacaaccctagacttctggtcaataaatcacaacagaggagagtgattatgtgaccagaaaacctggcggcagcgcaaaagatg

SEQ ID NO: 23210 - DNA, 103 bp, Artificial Sequence
  Synthetic Polynucleotide
taatacgactcactatagggttctaatatttttctctcttcgtcatcctcaacagaggagagaggatatggaagagagaaacctggcggcagcgcaaaagatg

SEQ ID NO: 23211 - DNA, 103 bp, Artificial Sequence
  Synthetic Polynucleotide
taatacgactcactatagggactatacaaccctagacttctggtcaataaaacagaggagattattgatgagaagtctaaacctggcggcagcgcaaaagatg

SEQ ID NO: 23212 - DNA, 103 bp, Artificial Sequence
  Synthetic Polynucleotide
taatacgactcactatagggtaatgactatacaaccctagacttctggtcaacagaggagagaccagatgtctagggttaacctggcggcagcgcaaaagatg

SEQ ID NO: 23213 - DNA, 103 bp, Artificial Sequence
  Synthetic Polynucleotide
taatacgactcactataggggtgagtaatgactatacaaccctagacttcaacagaggagagaagtcatgggttgtataaacctggcggcagcgcaaaagatg

SEQ ID NO: 23214 - DNA, 103 bp, Artificial Sequence
  Synthetic Polynucleotide
taatacgactcactatagggattgtgtgagtaatgactatacaaccctagaacagaggagactagggatgtatagtcataacctggcggcagcgcaaaagatg

SEQ ID NO: 23215 - DNA, 103 bp, Artificial Sequence
  Synthetic Polynucleotide
taatacgactcactatagggtttggattgtgtgagtaatgactatacaacaacagaggagagttgtaatgtcattactcaacctggcggcagcgcaaaagatg

SEQ ID NO: 23216 - DNA, 103 bp, Artificial Sequence
  Synthetic Polynucleotide
taatacgactcactataggggtagttttggattgtgtgagtaatgactataacagaggagaatagtcatgactcacacaaacctggcggcagcgcaaaagatg

SEQ ID NO: 23217 - DNA, 103 bp, Artificial Sequence
  Synthetic Polynucleotide
taatacgactcactatagggattacgtagttttggattgtgtgagtaatgaacagaggagacattacatgcacaatccaaacctggcggcagcgcaaaagatg

SEQ ID NO: 23218 - DNA, 103 bp, Artificial Sequence
  Synthetic Polynucleotide
taatacgactcactatagggctacaattacgtagttttggattgtgtgagaacagaggagactcacaatgtccaaaactaacctggcggcagcgcaaaagatg

SEQ ID NO: 23219 - DNA, 103 bp, Artificial Sequence
  Synthetic Polynucleotide
taatacgactcactataggggaatcctacaattacgtagttttggattgtaacagaggagaacaatcatgaactacgtaaacctggcggcagcgcaaaagatg

SEQ ID NO: 23220 - DNA, 103 bp, Artificial Sequence
  Synthetic Polynucleotide
taatacgactcactataggggtatggaatcctacaattacgtagttttggaacagaggagaccaaaaatgcgtaattgtaacctggcggcagcgcaaaagatg

SEQ ID NO: 23221 - DNA, 103 bp, Artificial Sequence
  Synthetic Polynucleotide
taatacgactcactatagggaactgttctaatatttttctctcttcgtcaaacagaggagatgacgaatggagaaaaataacctggcggcagcgcaaaagatg

SEQ ID NO: 23222 - DNA, 103 bp, Artificial Sequence
  Synthetic Polynucleotide
taatacgactcactatagggatgtggtatggaatcctacaattacgtagtaacagaggagaactacgatgttgtaggataacctggcggcagcgcaaaagatg

SEQ ID NO: 23223 - DNA, 103 bp, Artificial Sequence
  Synthetic Polynucleotide
taatacgactcactataggggataaatgtggtatggaatcctacaattacaacagaggagagtaattatgggattccataacctggcggcagcgcaaaagatg

SEQ ID NO: 23224 - DNA, 103 bp, Artificial Sequence
  Synthetic Polynucleotide
taatacgactcactatagggcaagcgataaatgtggtatggaatcctacaaacagaggagatgtaggatgccataccacaacctggcggcagcgcaaaagatg

SEQ ID NO: 23225 - DNA, 103 bp, Artificial Sequence
  Synthetic Polynucleotide
taatacgactcactatagggttcctcaagcgataaatgtggtatggaatcaacagaggagagattccatgccacatttaaacctggcggcagcgcaaaagatg

SEQ ID NO: 23226 - DNA, 103 bp, Artificial Sequence
  Synthetic Polynucleotide
taatacgactcactatagggtagaattcctcaagcgataaatgtggtatgaacagaggagacataccatgtttatcgctaacctggcggcagcgcaaaagatg

SEQ ID NO: 23227 - DNA, 103 bp, Artificial Sequence
  Synthetic Polynucleotide
taatacgactcactatagggtgctgtagaattcctcaagcgataaatgtgaacagaggagacacattatgcgcttgaggaacctggcggcagcgcaaaagatg

SEQ ID NO: 23228 - DNA, 103 bp, Artificial Sequence
  Synthetic Polynucleotide
taatacgactcactatagggtttaatgctgtagaattcctcaagcgataaaacagaggagattatcgatggaggaattcaacctggcggcagcgcaaaagatg

SEQ ID NO: 23229 - DNA, 103 bp, Artificial Sequence
  Synthetic Polynucleotide
taatacgactcactatagggatgtctttaatgctgtagaattcctcaagcaacagaggagagcttgaatgattctacagaacctggcggcagcgcaaaagatg

SEQ ID NO: 23230 - DNA, 103 bp, Artificial Sequence
  Synthetic Polynucleotide
taatacgactcactatagggaagaaatgtctttaatgctgtagaattcctaacagaggagaaggaatatgacagcattaaacctggcggcagcgcaaaagatg

SEQ ID NO: 23231 - DNA, 103 bp, Artificial Sequence
  Synthetic Polynucleotide
taatacgactcactatagggttctgaagaaatgtctttaatgctgtagaaaacagaggagattctacatgattaaagacaacctggcggcagcgcaaaagatg

SEQ ID NO: 23232 - DNA, 103 bp, Artificial Sequence
  Synthetic Polynucleotide
taatacgactcactataggggatggaactgttctaatatttttctctcttaacagaggagaaagagaatgaaatattagaacctggcggcagcgcaaaagatg

SEQ ID NO: 23233 - DNA, 103 bp, Artificial Sequence
  Synthetic Polynucleotide
taatacgactcactatagggaacagttctgaagaaatgtctttaatgctgaacagaggagacagcatatgagacatttcaacctggcggcagcgcaaaagatg

SEQ ID NO: 23234 - DNA, 103 bp, Artificial Sequence
  Synthetic Polynucleotide
taatacgactcactatagggtatcgaacagttctgaagaaatgtctttaaaacagaggagattaaagatgtttcttcagaacctggcggcagcgcaaaagatg

SEQ ID NO: 23235 - DNA, 103 bp, Artificial Sequence
  Synthetic Polynucleotide
taatacgactcactataggggtgagtatcgaacagttctgaagaaatgtcaacagaggagagacattatgtcagaactgaacctggcggcagcgcaaaagatg

SEQ ID NO: 23236 - DNA, 103 bp, Artificial Sequence
  Synthetic Polynucleotide
taatacgactcactataggggaactgtgagtatcgaacagttctgaagaaaacagaggagattcttcatgactgttcgaaacctggcggcagcgcaaaagatg

SEQ ID NO: 23237 - DNA, 103 bp, Artificial Sequence
  Synthetic Polynucleotide
taatacgactcactatagggaaaaggaactgtgagtatcgaacagttctgaacagaggagacagaacatgtcgatactcaacctggcggcagcgcaaaagatg

SEQ ID NO: 23238 - DNA, 103 bp, Artificial Sequence
  Synthetic Polynucleotide
taatacgactcactataggggagtgaaaaggaactgtgagtatcgaacagaacagaggagactgttcatgactcacagtaacctggcggcagcgcaaaagatg

SEQ ID NO: 23239 - DNA, 103 bp, Artificial Sequence
  Synthetic Polynucleotide
taatacgactcactatagggaaattgagtgaaaaggaactgtgagtatcgaacagaggagacgatacatgcagttccttaacctggcggcagcgcaaaagatg

SEQ ID NO: 23240 - DNA, 103 bp, Artificial Sequence
  Synthetic Polynucleotide
taatacgactcactatagggatcccaaattgagtgaaaaggaactgtgagaacagaggagactcacaatgccttttcacaacctggcggcagcgcaaaagatg

SEQ ID NO: 23241 - DNA, 103 bp, Artificial Sequence
  Synthetic Polynucleotide
taatacgactcactatagggatgtgatcccaaattgagtgaaaaggaactaacagaggagaagttccatgtcactcaataacctggcggcagcgcaaaagatg

SEQ ID NO: 23242 - DNA, 103 bp, Artificial Sequence
  Synthetic Polynucleotide
taatacgactcactatagggttatgatgtgatcccaaattgagtgaaaagaacagaggagacttttcatgcaatttgggaacctggcggcagcgcaaaagatg

SEQ ID NO: 23243 - DNA, 103 bp, Artificial Sequence
  Synthetic Polynucleotide
taatacgactcactatagggctggagatggaactgttctaatatttttctaacagaggagaagaaaaatgttagaacagaacctggcggcagcgcaaaagatg

SEQ ID NO: 23244 - DNA, 103 bp, Artificial Sequence
  Synthetic Polynucleotide
taatacgactcactatagggtgaagttatgatgtgatcccaaattgagtgaacagaggagacactcaatgtgggatcacaacctggcggcagcgcaaaagatg

SEQ ID NO: 23245 - DNA, 103 bp, Artificial Sequence
  Synthetic Polynucleotide
taatacgactcactatagggtgaattgaagttatgatgtgatcccaaattaacagaggagaaatttgatgtcacatcataacctggcggcagcgcaaaagatg

SEQ ID NO: 23246 - DNA, 103 bp, Artificial Sequence
  Synthetic Polynucleotide
taatacgactcactatagggcgtgttgaattgaagttatgatgtgatcccaacagaggagagggatcatgtcataacttaacctggcggcagcgcaaaagatg

SEQ ID NO: 23247 - DNA, 103 bp, Artificial Sequence
  Synthetic Polynucleotide
taatacgactcactatagggtgcatcgtgttgaattgaagttatgatgtgaacagaggagacacatcatgacttcaattaacctggcggcagcgcaaaagatg

SEQ ID NO: 23248 - DNA, 103 bp, Artificial Sequence
  Synthetic Polynucleotide
taatacgactcactatagggttaattgcatcgtgttgaattgaagttatgaacagaggagacataacatgaattcaacaaacctggcggcagcgcaaaagatg

SEQ ID NO: 23249 - DNA, 103 bp, Artificial Sequence
  Synthetic Polynucleotide
taatacgactcactatagggtatgattaattgcatcgtgttgaattgaagaacagaggagacttcaaatgaacacgatgaacctggcggcagcgcaaaagatg

SEQ ID NO: 23250 - DNA, 103 bp, Artificial Sequence
  Synthetic Polynucleotide
taatacgactcactatagggattgatatgattaattgcatcgtgttgaataacagaggagaattcaaatggatgcaattaacctggcggcagcgcaaaagatg

SEQ ID NO: 23251 - DNA, 103 bp, Artificial Sequence
  Synthetic Polynucleotide
taatacgactcactatagggaaatcattgatatgattaattgcatcgtgtaacagaggagaacacgaatgaattaatcaaacctggcggcagcgcaaaagatg

SEQ ID NO: 23252 - DNA, 103 bp, Artificial Sequence
  Synthetic Polynucleotide
taatacgactcactatagggatttgaaatcattgatatgattaattgcataacagaggagaatgcaaatgatcatatcaaacctggcggcagcgcaaaagatg

SEQ ID NO: 23253 - DNA, 103 bp, Artificial Sequence
  Synthetic Polynucleotide
taatacgactcactatagggtaggtatttgaaatcattgatatgattaataacagaggagaattaatatgatcaatgataacctggcggcagcgcaaaagatg

SEQ ID NO: 23254 - DNA, 103 bp, Artificial Sequence
  Synthetic Polynucleotide
taatacgactcactataggggtcttctggagatggaactgttctaatattaacagaggagaaatattatgacagttccaaacctggcggcagcgcaaaagatg

SEQ ID NO: 23255 - DNA, 103 bp, Artificial Sequence
  Synthetic Polynucleotide
taatacgactcactatagggggtaataggtatttgaaatcattgatatgaaacagaggagatcatatatgtgatttcaaaacctggcggcagcgcaaaagatg

SEQ ID NO: 23256 - DNA, 103 bp, Artificial Sequence
  Synthetic Polynucleotide
taatacgactcactatagggctgatggtaataggtatttgaaatcattgaaacagaggagatcaatgatgtcaaataccaacctggcggcagcgcaaaagatg

SEQ ID NO: 23257 - DNA, 103 bp, Artificial Sequence
  Synthetic Polynucleotide
taatacgactcactataggggagttctgatggtaataggtatttgaaatcaacagaggagagatttcatgtacctattaaacctggcggcagcgcaaaagatg

SEQ ID NO: 23258 - DNA, 103 bp, Artificial Sequence
  Synthetic Polynucleotide
taatacgactcactatagggtttatgagttctgatggtaataggtatttgaacagaggagacaaataatgattaccatcaacctggcggcagcgcaaaagatg

SEQ ID NO: 23259 - DNA, 103 bp, Artificial Sequence
  Synthetic Polynucleotide
taatacgactcactatagggcatactttatgagttctgatggtaataggtaacagaggagaacctatatgcatcagaacaacctggcggcagcgcaaaagatg

SEQ ID NO: 23260 - DNA, 103 bp, Artificial Sequence
  Synthetic Polynucleotide
taatacgactcactatagggattagcatactttatgagttctgatggtaaaacagaggagattaccaatggaactcataaacctggcggcagcgcaaaagatg

SEQ ID NO: 23261 - DNA, 103 bp, Artificial Sequence
  Synthetic Polynucleotide
taatacgactcactatagggtcccaattagcatactttatgagttctgataacagaggagaatcagaatgcataaagtaaacctggcggcagcgcaaaagatg

SEQ ID NO: 23262 - DNA, 103 bp, Artificial Sequence
  Synthetic Polynucleotide
taatacgactcactatagggcattgtcccaattagcatactttatgagttaacagaggagaaactcaatgagtatgctaaacctggcggcagcgcaaaagatg

SEQ ID NO: 23263 - DNA, 103 bp, Artificial Sequence
  Synthetic Polynucleotide
taatacgactcactataggggaactcattgtcccaattagcatactttataacagaggagaataaagatggctaattggaacctggcggcagcgcaaaagatg

SEQ ID NO: 23264 - DNA, 103 bp, Artificial Sequence
  Synthetic Polynucleotide
taatacgactcactatagggcttaagaactcattgtcccaattagcatacaacagaggagagtatgcatgttgggacaaaacctggcggcagcgcaaaagatg

SEQ ID NO: 23265 - DNA, 103 bp, Artificial Sequence
  Synthetic Polynucleotide
taatacgactcactatagggtctcagtcttctggagatggaactgttctaaacagaggagatagaacatgtccatctccaacctggcggcagcgcaaaagatg

SEQ ID NO: 23266 - DNA, 103 bp, Artificial Sequence
  Synthetic Polynucleotide
taatacgactcactatagggatactcttaagaactcattgtcccaattagaacagaggagactaattatgacaatgagtaacctggcggcagcgcaaaagatg

SEQ ID NO: 23267 - DNA, 103 bp, Artificial Sequence
  Synthetic Polynucleotide
taatacgactcactatagggaaggaatactcttaagaactcattgtcccaaacagaggagatgggacatggagttcttaaacctggcggcagcgcaaaagatg

SEQ ID NO: 23268 - DNA, 103 bp, Artificial Sequence
  Synthetic Polynucleotide
taatacgactcactatagggttgttaaggaatactcttaagaactcattgaacagaggagacaatgaatgcttaagagtaacctggcggcagcgcaaaagatg

SEQ ID NO: 23269 - DNA, 103 bp, Artificial Sequence
  Synthetic Polynucleotide
taatacgactcactatagggagatcttgttaaggaatactcttaagaactaacagaggagaagttctatggagtattccaacctggcggcagcgcaaaagatg

SEQ ID NO: 23270 - DNA, 103 bp, Artificial Sequence
  Synthetic Polynucleotide
taatacgactcactatagggtctcaagatcttgttaaggaatactcttaaaacagaggagattaagaatgttccttaacaacctggcggcagcgcaaaagatg

SEQ ID NO: 23271 - DNA, 103 bp, Artificial Sequence
  Synthetic Polynucleotide
taatacgactcactatagggtcgagtctcaagatcttgttaaggaatactaacagaggagaagtattatgtaacaagataacctggcggcagcgcaaaagatg

SEQ ID NO: 23272 - DNA, 103 bp, Artificial Sequence
  Synthetic Polynucleotide
taatacgactcactatagggcatgatcgagtctcaagatcttgttaaggaaacagaggagatccttaatgagatcttgaaacctggcggcagcgcaaaagatg

SEQ ID NO: 23273 - DNA, 103 bp, Artificial Sequence
  Synthetic Polynucleotide
taatacgactcactatagggaaaagcatgatcgagtctcaagatcttgttaacagaggagaaacaagatgttgagactcaacctggcggcagcgcaaaagatg

SEQ ID NO: 23274 - DNA, 103 bp, Artificial Sequence
  Synthetic Polynucleotide
taatacgactcactatagggtttgtaaaagcatgatcgagtctcaagatcaacagaggagagatcttatgactcgatcaaacctggcggcagcgcaaaagatg

SEQ ID NO: 23275 - DNA, 103 bp, Artificial Sequence
  Synthetic Polynucleotide
taatacgactcactatagggcagaatttgtaaaagcatgatcgagtctcaaacagaggagatgagacatgatcatgcttaacctggcggcagcgcaaaagatg

SEQ ID NO: 23276 - DNA, 103 bp, Artificial Sequence
  Synthetic Polynucleotide
taatacgactcactatagggtgtaatctcagtcttctggagatggaactgaacagaggagacagttcatgctccagaagaacctggcggcagcgcaaaagatg

SEQ ID NO: 23277 - DNA, 103 bp, Artificial Sequence
  Synthetic Polynucleotide
taatacgactcactatagggctttgcagaatttgtaaaagcatgatcgagaacagaggagactcgatatggcttttacaaacctggcggcagcgcaaaagatg

SEQ ID NO: 23278 - DNA, 103 bp, Artificial Sequence
  Synthetic Polynucleotide
taatacgactcactatagggtgtaactttgcagaatttgtaaaagcatgaaacagaggagatcatgcatgtacaaattcaacctggcggcagcgcaaaagatg

SEQ ID NO: 23279 - DNA, 103 bp, Artificial Sequence
  Synthetic Polynucleotide
taatacgactcactatagggcacattgtaactttgcagaatttgtaaaagaacagaggagacttttaatgattctgcaaaacctggcggcagcgcaaaagatg

SEQ ID NO: 23280 - DNA, 103 bp, Artificial Sequence
  Synthetic Polynucleotide
taatacgactcactatagggatcctcacattgtaactttgcagaatttgtaacagaggagaacaaatatggcaaagttaaacctggcggcagcgcaaaagatg

SEQ ID NO: 23281 - DNA, 103 bp, Artificial Sequence
  Synthetic Polynucleotide
taatacgactcactataggggagaaatcctcacattgtaactttgcagaaaacagaggagattctgcatggttacaatgaacctggcggcagcgcaaaagatg

SEQ ID NO: 23282 - DNA, 103 bp, Artificial Sequence
  Synthetic Polynucleotide
taatacgactcactatagggtgggagagaaatcctcacattgtaactttgaacagaggagacaaagtatgaatgtgaggaacctggcggcagcgcaaaagatg

SEQ ID NO: 23283 - DNA, 103 bp, Artificial Sequence
  Synthetic Polynucleotide
taatacgactcactatagggctctttgggagagaaatcctcacattgtaaaacagaggagattacaaatggaggatttcaacctggcggcagcgcaaaagatg

SEQ ID NO: 23284 - DNA, 103 bp, Artificial Sequence
  Synthetic Polynucleotide
taatacgactcactatagggggattctctttgggagagaaatcctcacataacagaggagaatgtgaatgtttctctccaacctggcggcagcgcaaaagatg

SEQ ID NO: 23285 - DNA, 103 bp, Artificial Sequence
  Synthetic Polynucleotide
taatacgactcactatagggaataaggattctctttgggagagaaatcctaacagaggagaaggattatgctcccaaagaacctggcggcagcgcaaaagatg

SEQ ID NO: 23286 - DNA, 103 bp, Artificial Sequence
  Synthetic Polynucleotide
taatacgactcactatagggccaataataaggattctctttgggagagaaaacagaggagattctctatgaaagagaataacctggcggcagcgcaaaagatg

SEQ ID NO: 23287 - DNA, 103 bp, Artificial Sequence
  Synthetic Polynucleotide
taatacgactcactatagggctgtgtgtaatctcagtcttctggagatggaacagaggagaccatctatggaagactgaaacctggcggcagcgcaaaagatg

SEQ ID NO: 23288 - DNA, 103 bp, Artificial Sequence
  Synthetic Polynucleotide
taatacgactcactatagggatcccccaataataaggattctctttgggaaacagaggagatcccaaatggaatccttaaacctggcggcagcgcaaaagatg

SEQ ID NO: 23289 - DNA, 103 bp, Artificial Sequence
  Synthetic Polynucleotide
taatacgactcactatagggataacatcccccaataataaggattctcttaacagaggagaaagagaatgcttattattaacctggcggcagcgcaaaagatg

SEQ ID NO: 23290 - DNA, 103 bp, Artificial Sequence
  Synthetic Polynucleotide
taatacgactcactataggggagcaataacatcccccaataataaggattaacagaggagaaatcctatgtattgggggaacctggcggcagcgcaaaagatg

SEQ ID NO: 23291 - DNA, 103 bp, Artificial Sequence
  Synthetic Polynucleotide
taatacgactcactatagggtgcacgagcaataacatcccccaataataaaacagaggagattattaatgggggatgttaacctggcggcagcgcaaaagatg

SEQ ID NO: 23292 - DNA, 103 bp, Artificial Sequence
  Synthetic Polynucleotide
taatacgactcactatagggataaatgcacgagcaataacatcccccaataacagaggagaattgggatgtgttattgcaacctggcggcagcgcaaaagatg

SEQ ID NO: 23293 - DNA, 103 bp, Artificial Sequence
  Synthetic Polynucleotide
taatacgactcactatagggttgagataaatgcacgagcaataacatcccaacagaggagagggatgatgttgctcgtgaacctggcggcagcgcaaaagatg

SEQ ID NO: 23294 - DNA, 103 bp, Artificial Sequence
  Synthetic Polynucleotide
taatacgactcactataggggcaagttgagataaatgcacgagcaataacaacagaggagagttattatgcgtgcatttaacctggcggcagcgcaaaagatg

SEQ ID NO: 23295 - DNA, 103 bp, Artificial Sequence
  Synthetic Polynucleotide
taatacgactcactatagggttctggcaagttgagataaatgcacgagcaaacagaggagatgctcgatgatttatctcaacctggcggcagcgcaaaagatg

SEQ ID NO: 23296 - DNA, 103 bp, Artificial Sequence
  Synthetic Polynucleotide
taatacgactcactatagggaatccttctggcaagttgagataaatgcacaacagaggagagtgcatatgtctcaacttaacctggcggcagcgcaaaagatg

SEQ ID NO: 23297 - DNA, 103 bp, Artificial Sequence
  Synthetic Polynucleotide
taatacgactcactatagggcccttaatccttctggcaagttgagataaaaacagaggagatttatcatgacttgccagaacctggcggcagcgcaaaagatg

SEQ ID NO: 23298 - DNA, 103 bp, Artificial Sequence
  Synthetic Polynucleotide
taatacgactcactatagggtctgactgtgtgtaatctcagtcttctggaaacagaggagatccagaatgctgagattaaacctggcggcagcgcaaaagatg

SEQ ID NO: 23299 - DNA, 103 bp, Artificial Sequence
  Synthetic Polynucleotide
taatacgactcactatagggtttgtcccttaatccttctggcaagttgagaacagaggagactcaacatgccagaaggaaacctggcggcagcgcaaaagatg

SEQ ID NO: 23300 - DNA, 103 bp, Artificial Sequence
  Synthetic Polynucleotide
taatacgactcactatagggccctctttgtcccttaatccttctggcaagaacagaggagacttgccatgaggattaagaacctggcggcagcgcaaaagatg

SEQ ID NO: 23301 - DNA, 103 bp, Artificial Sequence
  Synthetic Polynucleotide
taatacgactcactatagggaaagaccctctttgtcccttaatccttctgaacagaggagacagaagatgtaagggacaaacctggcggcagcgcaaaagatg

SEQ ID NO: 23302 - DNA, 103 bp, Artificial Sequence
  Synthetic Polynucleotide
taatacgactcactatagggtccttaaagaccctctttgtcccttaatccaacagaggagaggattaatggacaaagagaacctggcggcagcgcaaaagatg

SEQ ID NO: 23303 - DNA, 103 bp, Artificial Sequence
  Synthetic Polynucleotide
taatacgactcactataggggttgctccttaaagaccctctttgtcccttaacagaggagaaagggaatgagagggtctaacctggcggcagcgcaaaagatg

SEQ ID NO: 23304 - DNA, 103 bp, Artificial Sequence
  Synthetic Polynucleotide
taatacgactcactatagggttccagttgctccttaaagaccctctttgtaacagaggagaacaaagatggtctttaagaacctggcggcagcgcaaaagatg

SEQ ID NO: 23305 - DNA, 103 bp, Artificial Sequence
  Synthetic Polynucleotide
taatacgactcactatagggtaaacttccagttgctccttaaagaccctcaacagaggagagagggtatgtaaggagcaaacctggcggcagcgcaaaagatg

SEQ ID NO: 23306 - DNA, 103 bp, Artificial Sequence
  Synthetic Polynucleotide
taatacgactcactatagggtcctataaacttccagttgctccttaaagaaacagaggagatctttaatgagcaactggaacctggcggcagcgcaaaagatg

SEQ ID NO: 23307 - DNA, 103 bp, Artificial Sequence
  Synthetic Polynucleotide
taatacgactcactatagggtcaactcctataaacttccagttgctccttaacagaggagaaaggagatgctggaagttaacctggcggcagcgcaaaagatg

SEQ ID NO: 23308 - DNA, 103 bp, Artificial Sequence
  Synthetic Polynucleotide
taatacgactcactatagggccaaatcaactcctataaacttccagttgcaacagaggagagcaactatgagtttatagaacctggcggcagcgcaaaagatg

SEQ ID NO: 23309 - DNA, 103 bp, Artificial Sequence
  Synthetic Polynucleotide
taatacgactcactatagggtgtgggttttgtacctaattctagcaaactaacagaggagaagtttgatggaattaggtaacctggcggcagcgcaaaagatg

SEQ ID NO: 23310 - DNA, 103 bp, Artificial Sequence
  Synthetic Polynucleotide
taatacgactcactatagggcaatgtctgactgtgtgtaatctcagtcttaacagaggagaaagactatgattacacacaacctggcggcagcgcaaaagatg

SEQ ID NO: 23311 - DNA, 103 bp, Artificial Sequence
  Synthetic Polynucleotide
taatacgactcactatagggtagttccaaatcaactcctataaacttccaaacagaggagatggaagatgataggagttaacctggcggcagcgcaaaagatg

SEQ ID NO: 23312 - DNA, 103 bp, Artificial Sequence
  Synthetic Polynucleotide
taatacgactcactatagggccaaatagttccaaatcaactcctataaacaacagaggagagtttatatgagttgatttaacctggcggcagcgcaaaagatg

SEQ ID NO: 23313 - DNA, 103 bp, Artificial Sequence
  Synthetic Polynucleotide
taatacgactcactatagggctattccaaatagttccaaatcaactcctaaacagaggagataggagatgatttggaacaacctggcggcagcgcaaaagatg

SEQ ID NO: 23314 - DNA, 103 bp, Artificial Sequence
  Synthetic Polynucleotide
taatacgactcactatagggatctgctattccaaatagttccaaatcaacaacagaggagagttgatatggaactatttaacctggcggcagcgcaaaagatg

SEQ ID NO: 23315 - DNA, 103 bp, Artificial Sequence
  Synthetic Polynucleotide
taatacgactcactatagggacaaaatctgctattccaaatagttccaaaaacagaggagatttggaatgatttggaataacctggcggcagcgcaaaagatg

SEQ ID NO: 23316 - DNA, 103 bp, Artificial Sequence
  Synthetic Polynucleotide
taatacgactcactatagggaaataacaaaatctgctattccaaatagttaacagaggagaaactatatggaatagcagaacctggcggcagcgcaaaagatg

SEQ ID NO: 23317 - DNA, 103 bp, Artificial Sequence
  Synthetic Polynucleotide
taatacgactcactatagggtttaaaaataacaaaatctgctattccaaaaacagaggagatttggaatggcagattttaacctggcggcagcgcaaaagatg

SEQ ID NO: 23318 - DNA, 103 bp, Artificial Sequence
  Synthetic Polynucleotide
taatacgactcactatagggggaactttaaaaataacaaaatctgctattaacagaggagaaatagcatgttttgttataacctggcggcagcgcaaaagatg

SEQ ID NO: 23319 - DNA, 103 bp, Artificial Sequence
  Synthetic Polynucleotide
taatacgactcactatagggttatcggaactttaaaaataacaaaatctgaacagaggagacagattatgttatttttaaacctggcggcagcgcaaaagatg

SEQ ID NO: 23320 - DNA, 103 bp, Artificial Sequence
  Synthetic Polynucleotide
taatacgactcactatagggtgcttttatcggaactttaaaaataacaaaaacagaggagatttgttatgtttaaagttaacctggcggcagcgcaaaagatg

SEQ ID NO: 23321 - DNA, 103 bp, Artificial Sequence
  Synthetic Polynucleotide
taatacgactcactatagggacggccaatgtctgactgtgtgtaatctcaaacagaggagatgagatatgacacagtcaaacctggcggcagcgcaaaagatg

SEQ ID NO: 23322 - DNA, 103 bp, Artificial Sequence
  Synthetic Polynucleotide
taatacgactcactatagggattattgcttttatcggaactttaaaaataaacagaggagatattttatgagttccgataacctggcggcagcgcaaaagatg

SEQ ID NO: 23323 - DNA, 103 bp, Artificial Sequence
  Synthetic Polynucleotide
taatacgactcactatagggtccgaattattgcttttatcggaactttaaaacagaggagattaaagatgcgataaaagaacctggcggcagcgcaaaagatg

SEQ ID NO: 23324 - DNA, 103 bp, Artificial Sequence
  Synthetic Polynucleotide
taatacgactcactatagggagcattccgaattattgcttttatcggaacaacagaggagagttccgatgaaagcaataaacctggcggcagcgcaaaagatg

SEQ ID NO: 23325 - DNA, 103 bp, Artificial Sequence
  Synthetic Polynucleotide
taatacgactcactatagggcttgtagcattccgaattattgcttttatcaacagaggagagataaaatgaataattcgaacctggcggcagcgcaaaagatg

SEQ ID NO: 23326 - DNA, 103 bp, Artificial Sequence
  Synthetic Polynucleotide
taatacgactcactataggggtaaacttgtagcattccgaattattgcttaacagaggagaaagcaaatgttcggaatgaacctggcggcagcgcaaaagatg

SEQ ID NO: 23327 - DNA, 103 bp, Artificial Sequence
  Synthetic Polynucleotide
taatacgactcactatagggggcctgtaaacttgtagcattccgaattataacagaggagaataattatgaatgctacaaacctggcggcagcgcaaaagatg

SEQ ID NO: 23328 - DNA, 103 bp, Artificial Sequence
  Synthetic Polynucleotide
taatacgactcactatagggtttgaggcctgtaaacttgtagcattccgaaacagaggagatcggaaatgtacaagtttaacctggcggcagcgcaaaagatg

SEQ ID NO: 23329 - DNA, 103 bp, Artificial Sequence
  Synthetic Polynucleotide
taatacgactcactatagggctggttttgaggcctgtaaacttgtagcataacagaggagaatgctaatggtttacaggaacctggcggcagcgcaaaagatg

SEQ ID NO: 23330 - DNA, 103 bp, Artificial Sequence
  Synthetic Polynucleotide
taatacgactcactatagggtaaccctggttttgaggcctgtaaacttgtaacagaggagaacaagtatgcaggcctcaaacctggcggcagcgcaaaagatg

SEQ ID NO: 23331 - DNA, 103 bp, Artificial Sequence
  Synthetic Polynucleotide
taatacgactcactataggggtctttaaccctggttttgaggcctgtaaaaacagaggagatttacaatgctcaaaaccaacctggcggcagcgcaaaagatg

SEQ ID NO: 23332 - DNA, 103 bp, Artificial Sequence
  Synthetic Polynucleotide
taatacgactcactatagggtgaggacggccaatgtctgactgtgtgtaaaacagaggagattacacatggtcagacataacctggcggcagcgcaaaagatg

SEQ ID NO: 23333 - DNA, 103 bp, Artificial Sequence
  Synthetic Polynucleotide
taatacgactcactatagggaccatgtctttaaccctggttttgaggcctaacagaggagaaggcctatgaaccagggtaacctggcggcagcgcaaaagatg

SEQ ID NO: 23334 - DNA, 103 bp, Artificial Sequence
  Synthetic Polynucleotide
taatacgactcactatagggacggtaccatgtctttaaccctggttttgaaacagaggagatcaaaaatggggttaaagaacctggcggcagcgcaaaagatg

SEQ ID NO: 23335 - DNA, 103 bp, Artificial Sequence
  Synthetic Polynucleotide
taatacgactcactatagggtgatcacggtaccatgtctttaaccctggtaacagaggagaaccaggatgaaagacatgaacctggcggcagcgcaaaagatg

SEQ ID NO: 23336 - DNA, 103 bp, Artificial Sequence
  Synthetic Polynucleotide
taatacgactcactatagggagttttgatcacggtaccatgtctttaaccaacagaggagaggttaaatgcatggtaccaacctggcggcagcgcaaaagatg

SEQ ID NO: 23337 - DNA, 103 bp, Artificial Sequence
  Synthetic Polynucleotide
taatacgactcactatagggagttaagttttgatcacggtaccatgtcttaacagaggagaaagacaatgtaccgtgataacctggcggcagcgcaaaagatg

SEQ ID NO: 23338 - DNA, 103 bp, Artificial Sequence
  Synthetic Polynucleotide
taatacgactcactatagggtaaggagttaagttttgatcacggtaccataacagaggagaatggtaatgtgatcaaaaaacctggcggcagcgcaaaagatg

SEQ ID NO: 23339 - DNA, 103 bp, Artificial Sequence
  Synthetic Polynucleotide
taatacgactcactatagggacagataaggagttaagttttgatcacggtaacagaggagaaccgtgatgaaaacttaaaacctggcggcagcgcaaaagatg

SEQ ID NO: 23340 - DNA, 103 bp, Artificial Sequence
  Synthetic Polynucleotide
taatacgactcactatagggatcacacagataaggagttaagttttgatcaacagaggagagatcaaatgttaactcctaacctggcggcagcgcaaaagatg

SEQ ID NO: 23341 - DNA, 103 bp, Artificial Sequence
  Synthetic Polynucleotide
taatacgactcactatagggtcatcatcacacagataaggagttaagtttaacagaggagaaaacttatgtccttatctaacctggcggcagcgcaaaagatg

SEQ ID NO: 23342 - DNA, 103 bp, Artificial Sequence
  Synthetic Polynucleotide
taatacgactcactatagggcaaattcatcatcacacagataaggagttaaacagaggagataactcatgatctgtgtgaacctggcggcagcgcaaaagatg

SEQ ID NO: 23343 - DNA, 103 bp, Artificial Sequence
  Synthetic Polynucleotide
taatacgactcactatagggctggctgaggacggccaatgtctgactgtgaacagaggagacacagtatgacattggccaacctggcggcagcgcaaaagatg

SEQ ID NO: 23344 - DNA, 103 bp, Artificial Sequence
  Synthetic Polynucleotide
taatacgactcactatagggtacaacaaattcatcatcacacagataaggaacagaggagaccttatatgtgtgatgataacctggcggcagcgcaaaagatg

SEQ ID NO: 23345 - DNA, 103 bp, Artificial Sequence
  Synthetic Polynucleotide
taatacgactcactatagggatgcttacaacaaattcatcatcacacagaaacagaggagatctgtgatgtgatgaattaacctggcggcagcgcaaaagatg

SEQ ID NO: 23346 - DNA, 103 bp, Artificial Sequence
  Synthetic Polynucleotide
taatacgactcactatagggtagcgatgcttacaacaaattcatcatcacaacagaggagagtgatgatgaatttgttgaacctggcggcagcgcaaaagatg

SEQ ID NO: 23347 - DNA, 103 bp, Artificial Sequence
  Synthetic Polynucleotide
taatacgactcactatagggataactagcgatgcttacaacaaattcatcaacagaggagagatgaaatggttgtaagcaacctggcggcagcgcaaaagatg

SEQ ID NO: 23348 - DNA, 103 bp, Artificial Sequence
  Synthetic Polynucleotide
taatacgactcactatagggcattcataactagcgatgcttacaacaaataacagaggagaatttgtatgaagcatcgcaacctggcggcagcgcaaaagatg

SEQ ID NO: 23349 - DNA, 103 bp, Artificial Sequence
  Synthetic Polynucleotide
taatacgactcactatagggtaaaacattcataactagcgatgcttacaaaacagaggagattgtaaatgtcgctagttaacctggcggcagcgcaaaagatg

SEQ ID NO: 23350 - DNA, 103 bp, Artificial Sequence
  Synthetic Polynucleotide
taatacgactcactatagggcatgataaaacattcataactagcgatgctaacagaggagaagcatcatgagttatgaaaacctggcggcagcgcaaaagatg

SEQ ID NO: 23351 - DNA, 103 bp, Artificial Sequence
  Synthetic Polynucleotide
taatacgactcactatagggttaatcatgataaaacattcataactagcgaacagaggagacgctagatgtgaatgtttaacctggcggcagcgcaaaagatg

SEQ ID NO: 23352 - DNA, 103 bp, Artificial Sequence
  Synthetic Polynucleotide
taatacgactcactatagggcatctttaatcatgataaaacattcataacaacagaggagagttatgatggttttatcaaacctggcggcagcgcaaaagatg

SEQ ID NO: 23353 - DNA, 103 bp, Artificial Sequence
  Synthetic Polynucleotide
taatacgactcactataggggaagacatctttaatcatgataaaacattcaacagaggagagaatgtatgatcatgattaacctggcggcagcgcaaaagatg

SEQ ID NO: 23354 - DNA, 103 bp, Artificial Sequence
  Synthetic Polynucleotide
taatacgactcactatagggcgtttctggctgaggacggccaatgtctgaaacagaggagatcagacatgggccgtcctaacctggcggcagcgcaaaagatg

SEQ ID NO: 23355 - DNA, 103 bp, Artificial Sequence
  Synthetic Polynucleotide
taatacgactcactatagggtcgatgaagacatctttaatcatgataaaaaacagaggagattttatatggattaaagaaacctggcggcagcgcaaaagatg

SEQ ID NO: 23356 - DNA, 103 bp, Artificial Sequence
  Synthetic Polynucleotide
taatacgactcactatagggacctttcgatgaagacatctttaatcatgaaacagaggagatcatgaatgaagatgtctaacctggcggcagcgcaaaagatg

SEQ ID NO: 23357 - DNA, 103 bp, Artificial Sequence
  Synthetic Polynucleotide
taatacgactcactataggggttgtacctttcgatgaagacatctttaataacagaggagaattaaaatggtcttcatcaacctggcggcagcgcaaaagatg

SEQ ID NO: 23358 - DNA, 103 bp, Artificial Sequence
  Synthetic Polynucleotide
taatacgactcactatagggcacgtgttgtacctttcgatgaagacatctaacagaggagaagatgtatgcatcgaaagaacctggcggcagcgcaaaagatg

SEQ ID NO: 23359 - DNA, 103 bp, Artificial Sequence
  Synthetic Polynucleotide
taatacgactcactatagggtctcccacgtgttgtacctttcgatgaagaaacagaggagatcttcaatgaaaggtacaaacctggcggcagcgcaaaagatg

SEQ ID NO: 23360 - DNA, 103 bp, Artificial Sequence
  Synthetic Polynucleotide
taatacgactcactatagggacagatctcccacgtgttgtacctttcgataacagaggagaatcgaaatgtacaacacgaacctggcggcagcgcaaaagatg

SEQ ID NO: 23361 - DNA, 103 bp, Artificial Sequence
  Synthetic Polynucleotide
taatacgactcactatagggcgagcacagatctcccacgtgttgtaccttaacagaggagaaaggtaatgcacgtgggaaacctggcggcagcgcaaaagatg

SEQ ID NO: 23362 - DNA, 103 bp, Artificial Sequence
  Synthetic Polynucleotide
taatacgactcactatagggaagcgcgagcacagatctcccacgtgttgtaacagaggagaacaacaatggggagatctaacctggcggcagcgcaaaagatg

SEQ ID NO: 23363 - DNA, 103 bp, Artificial Sequence
  Synthetic Polynucleotide
taatacgactcactataggggacccaagcgcgagcacagatctcccacgtaacagaggagaacgtggatgatctgtgctaacctggcggcagcgcaaaagatg

SEQ ID NO: 23364 - DNA, 103 bp, Artificial Sequence
  Synthetic Polynucleotide
taatacgactcactatagggtcttcgacccaagcgcgagcacagatctccaacagaggagaggagatatgtgctcgcgcaacctggcggcagcgcaaaagatg

SEQ ID NO: 23365 - DNA, 103 bp, Artificial Sequence
  Synthetic Polynucleotide
taatacgactcactatagggtctctcgtttctggctgaggacggccaatgaacagaggagacattggatgtcctcagccaacctggcggcagcgcaaaagatg

SEQ ID NO: 23366 - DNA, 103 bp, Artificial Sequence
  Synthetic Polynucleotide
taatacgactcactatagggcattatcttcgacccaagcgcgagcacagaaacagaggagatctgtgatggcgcttgggaacctggcggcagcgcaaaagatg

SEQ ID NO: 23367 - DNA, 103 bp, Artificial Sequence
  Synthetic Polynucleotide
taatacgactcactatagggttcttcattatcttcgacccaagcgcgagcaacagaggagagctcgcatgtgggtcgaaaacctggcggcagcgcaaaagatg

SEQ ID NO: 23368 - DNA, 103 bp, Artificial Sequence
  Synthetic Polynucleotide
taatacgactcactatagggtcagcttcttcattatcttcgacccaagcgaacagaggagacgcttgatgcgaagataaaacctggcggcagcgcaaaagatg

SEQ ID NO: 23369 - DNA, 103 bp, Artificial Sequence
  Synthetic Polynucleotide
taatacgactcactatagggggtaatcagcttcttcattatcttcgacccaacagaggagagggtcgatgataatgaagaacctggcggcagcgcaaaagatg

SEQ ID NO: 23370 - DNA, 103 bp, Artificial Sequence
  Synthetic Polynucleotide
taatacgactcactatagggaggtgggtaatcagcttcttcattatcttcaacagaggagagaagatatggaagaagctaacctggcggcagcgcaaaagatg

SEQ ID NO: 23371 - DNA, 103 bp, Artificial Sequence
  Synthetic Polynucleotide
taatacgactcactatagggccaagaggtgggtaatcagcttcttcattaaacagaggagataatgaatgagctgattaaacctggcggcagcgcaaaagatg

SEQ ID NO: 23372 - DNA, 103 bp, Artificial Sequence
  Synthetic Polynucleotide
taatacgactcactatagggatataccaagaggtgggtaatcagcttcttaacagaggagaaagaagatgattacccacaacctggcggcagcgcaaaagatg

SEQ ID NO: 23373 - DNA, 103 bp, Artificial Sequence
  Synthetic Polynucleotide
taatacgactcactatagggtcttaatataccaagaggtgggtaatcagcaacagaggagagctgatatgccacctcttaacctggcggcagcgcaaaagatg

SEQ ID NO: 23374 - DNA, 103 bp, Artificial Sequence
  Synthetic Polynucleotide
taatacgactcactatagggaaatctcttaatataccaagaggtgggtaaaacagaggagattacccatgtcttggtataacctggcggcagcgcaaaagatg

SEQ ID NO: 23375 - DNA, 103 bp, Artificial Sequence
  Synthetic Polynucleotide
taatacgactcactatagggtgtacaaatctcttaatataccaagaggtgaacagaggagacacctcatggtatattaaaacctggcggcagcgcaaaagatg

SEQ ID NO: 23376 - DNA, 103 bp, Artificial Sequence
  Synthetic Polynucleotide
taatacgactcactatagggtagtttctctcgtttctggctgaggacggcaacagaggagagccgtcatgagccagaaaaacctggcggcagcgcaaaagatg

SEQ ID NO: 23377 - DNA, 103 bp, Artificial Sequence
  Synthetic Polynucleotide
taatacgactcactatagggttgattgtacaaatctcttaatataccaagaacagaggagacttggtatgttaagagataacctggcggcagcgcaaaagatg

SEQ ID NO: 23378 - DNA, 103 bp, Artificial Sequence
  Synthetic Polynucleotide
taatacgactcactatagggtccccttgattgtacaaatctcttaatataaacagaggagatatattatgagatttgtaaacctggcggcagcgcaaaagatg

SEQ ID NO: 23379 - DNA, 103 bp, Artificial Sequence
  Synthetic Polynucleotide
taatacgactcactatagggtttggtccccttgattgtacaaatctcttaaacagaggagataagagatgtgtacaatcaacctggcggcagcgcaaaagatg

SEQ ID NO: 23380 - DNA, 103 bp, Artificial Sequence
  Synthetic Polynucleotide
taatacgactcactatagggtataatttggtccccttgattgtacaaatcaacagaggagagatttgatgaatcaagggaacctggcggcagcgcaaaagatg

SEQ ID NO: 23381 - DNA, 103 bp, Artificial Sequence
  Synthetic Polynucleotide
taatacgactcactatagggatggttataatttggtccccttgattgtacaacagaggagagtacaaatgaggggaccaaacctggcggcagcgcaaaagatg

SEQ ID NO: 23382 - DNA, 103 bp, Artificial Sequence
  Synthetic Polynucleotide
taatacgactcactataggggatacatggttataatttggtccccttgataacagaggagaatcaagatgaccaaattaaacctggcggcagcgcaaaagatg

SEQ ID NO: 23383 - DNA, 103 bp, Artificial Sequence
  Synthetic Polynucleotide
taatacgactcactatagggctctagatacatggttataatttggtccccaacagaggagaggggacatgattataaccaacctggcggcagcgcaaaagatg

SEQ ID NO: 23384 - DNA, 103 bp, Artificial Sequence
  Synthetic Polynucleotide
taatacgactcactatagggccatcctctagatacatggttataatttggaacagaggagaccaaatatgaaccatgtaaacctggcggcagcgcaaaagatg

SEQ ID NO: 23385 - DNA, 103 bp, Artificial Sequence
  Synthetic Polynucleotide
taatacgactcactatagggtgaaaccatcctctagatacatggttataaaacagaggagattataaatgtgtatctagaacctggcggcagcgcaaaagatg

SEQ ID NO: 23386 - DNA, 103 bp, Artificial Sequence
  Synthetic Polynucleotide
taatacgactcactatagggtaatttgaaaccatcctctagatacatggtaacagaggagaaccatgatgctagaggataacctggcggcagcgcaaaagatg

SEQ ID NO: 23387 - DNA, 103 bp, Artificial Sequence
  Synthetic Polynucleotide
taatacgactcactatagggcgggctagtttctctcgtttctggctgaggaacagaggagacctcagatggaaacgagaaacctggcggcagcgcaaaagatg

SEQ ID NO: 23388 - DNA, 103 bp, Artificial Sequence
  Synthetic Polynucleotide
taatacgactcactatagggtttattaatttgaaaccatcctctagatacaacagaggagagtatctatgggatggtttaacctggcggcagcgcaaaagatg

SEQ ID NO: 23389 - DNA, 103 bp, Artificial Sequence
  Synthetic Polynucleotide
taatacgactcactatagggagtgttttattaatttgaaaccatcctctaaacagaggagatagaggatggtttcaaataacctggcggcagcgcaaaagatg

SEQ ID NO: 23390 - DNA, 103 bp, Artificial Sequence
  Synthetic Polynucleotide
taatacgactcactatagggttctaagtgttttattaatttgaaaccatcaacagaggagagatggtatgaaattaataaacctggcggcagcgcaaaagatg

SEQ ID NO: 23391 - DNA, 103 bp, Artificial Sequence
  Synthetic Polynucleotide
taatacgactcactatagggaagggttctaagtgttttattaatttgaaaaacagaggagatttcaaatgaataaaacaaacctggcggcagcgcaaaagatg

SEQ ID NO: 23392 - DNA, 103 bp, Artificial Sequence
  Synthetic Polynucleotide
taatacgactcactatagggcacataagggttctaagtgttttattaattaacagaggagaaattaaatgaacacttagaacctggcggcagcgcaaaagatg

SEQ ID NO: 23393 - DNA, 103 bp, Artificial Sequence
  Synthetic Polynucleotide
taatacgactcactatagggactgacacataagggttctaagtgttttataacagaggagaataaaaatgttagaacccaacctggcggcagcgcaaaagatg

SEQ ID NO: 23394 - DNA, 103 bp, Artificial Sequence
  Synthetic Polynucleotide
taatacgactcactatagggatacaactgacacataagggttctaagtgtaacagaggagaacacttatgacccttatgaacctggcggcagcgcaaaagatg

SEQ ID NO: 23395 - DNA, 103 bp, Artificial Sequence
  Synthetic Polynucleotide
taatacgactcactatagggtttgtatacaactgacacataagggttctaaacagaggagatagaacatgtatgtgtcaaacctggcggcagcgcaaaagatg

SEQ ID NO: 23396 - DNA, 103 bp, Artificial Sequence
  Synthetic Polynucleotide
taatacgactcactataggggtacgtttgtatacaactgacacataagggaacagaggagacccttaatggtcagttgtaacctggcggcagcgcaaaagatg

SEQ ID NO: 23397 - DNA, 103 bp, Artificial Sequence
  Synthetic Polynucleotide
taatacgactcactatagggataccgtacgtttgtatacaactgacacataacagaggagaatgtgtatgttgtatacaaacctggcggcagcgcaaaagatg

SEQ ID NO: 23398 - DNA, 103 bp, Artificial Sequence
  Synthetic Polynucleotide
taatacgactcactatagggcaagacgggctagtttctctcgtttctggcaacagaggagagccagaatggagagaaacaacctggcggcagcgcaaaagatg

SEQ ID NO: 23399 - DNA, 103 bp, Artificial Sequence
  Synthetic Polynucleotide
taatacgactcactatagggtaaaaataccgtacgtttgtatacaactgaaacagaggagatcagttatgtacaaacgtaacctggcggcagcgcaaaagatg

SEQ ID NO: 23400 - DNA, 103 bp, Artificial Sequence
  Synthetic Polynucleotide
taatacgactcactatagggcggcgtaaaaataccgtacgtttgtatacaaacagaggagatgtataatgacgtacggtaacctggcggcagcgcaaaagatg

SEQ ID NO: 23401 - DNA, 103 bp, Artificial Sequence
  Synthetic Polynucleotide
taatacgactcactatagggttcctcggcgtaaaaataccgtacgtttgtaacagaggagaacaaacatgcggtattttaacctggcggcagcgcaaaagatg

SEQ ID NO: 23402 - DNA, 103 bp, Artificial Sequence
  Synthetic Polynucleotide
taatacgactcactatagggagtacttcctcggcgtaaaaataccgtacgaacagaggagacgtacgatgtttttacgcaacctggcggcagcgcaaaagatg

SEQ ID NO: 23403 - DNA, 103 bp, Artificial Sequence
  Synthetic Polynucleotide
taatacgactcactatagggaaaccagtacttcctcggcgtaaaaataccaacagaggagaggtattatgacgccgaggaacctggcggcagcgcaaaagatg

SEQ ID NO: 23404 - DNA, 103 bp, Artificial Sequence
  Synthetic Polynucleotide
taatacgactcactataggggattgaaaccagtacttcctcggcgtaaaaaacagaggagattttacatggaggaagtaaacctggcggcagcgcaaaagatg

SEQ ID NO: 23405 - DNA, 103 bp, Artificial Sequence
  Synthetic Polynucleotide
taatacgactcactatagggtctgagattgaaaccagtacttcctcggcgaacagaggagacgccgaatgagtactggtaacctggcggcagcgcaaaagatg

SEQ ID NO: 23406 - DNA, 103 bp, Artificial Sequence
  Synthetic Polynucleotide
taatacgactcactatagggaatcatctgagattgaaaccagtacttcctaacagaggagaaggaagatgtggtttcaaaacctggcggcagcgcaaaagatg

SEQ ID NO: 23407 - DNA, 103 bp, Artificial Sequence
  Synthetic Polynucleotide
taatacgactcactataggggatttaatcatctgagattgaaaccagtacaacagaggagagtactgatgtcaatctcaaacctggcggcagcgcaaaagatg

SEQ ID NO: 23408 - DNA, 103 bp, Artificial Sequence
  Synthetic Polynucleotide
taatacgactcactatagggaatatgatttaatcatctgagattgaaaccaacagaggagaggtttcatgctcagatgaaacctggcggcagcgcaaaagatg

SEQ ID NO: 23409 - DNA, 103 bp, Artificial Sequence
  Synthetic Polynucleotide
taatacgactcactatagggtgcagcaagacgggctagtttctctcgtttaacagaggagaaaacgaatgaaactagccaacctggcggcagcgcaaaagatg

SEQ ID NO: 23410 - DNA, 103 bp, Artificial Sequence
  Synthetic Polynucleotide
taatacgactcactatagggatcataatatgatttaatcatctgagattgaacagaggagacaatctatgatgattaaaaacctggcggcagcgcaaaagatg

SEQ ID NO: 23411 - DNA, 103 bp, Artificial Sequence
  Synthetic Polynucleotide
taatacgactcactatagggagttcatcataatatgatttaatcatctgaaacagaggagatcagatatgtaaatcataaacctggcggcagcgcaaaagatg

SEQ ID NO: 23412 - DNA, 103 bp, Artificial Sequence
  Synthetic Polynucleotide
taatacgactcactatagggtttgaagttcatcataatatgatttaatcaaacagaggagatgattaatgcatattatgaacctggcggcagcgcaaaagatg

SEQ ID NO: 23413 - DNA, 103 bp, Artificial Sequence
  Synthetic Polynucleotide
taatacgactcactatagggaagactttgaagttcatcataatatgatttaacagaggagaaaatcaatgtatgatgaaaacctggcggcagcgcaaaagatg

SEQ ID NO: 23414 - DNA, 103 bp, Artificial Sequence
  Synthetic Polynucleotide
taatacgactcactatagggaggttaagactttgaagttcatcataatataacagaggagaatattaatgtgaacttcaaacctggcggcagcgcaaaagatg

SEQ ID NO: 23415 - DNA, 103 bp, Artificial Sequence
  Synthetic Polynucleotide
taatacgactcactataggggttttaggttaagactttgaagttcatcataacagaggagaatgatgatgttcaaagtcaacctggcggcagcgcaaaagatg

SEQ ID NO: 23416 - DNA, 103 bp, Artificial Sequence
  Synthetic Polynucleotide
taatacgactcactatagggctgaagttttaggttaagactttgaagttcaacagaggagagaacttatgagtcttaacaacctggcggcagcgcaaaagatg

SEQ ID NO: 23417 - DNA, 103 bp, Artificial Sequence
  Synthetic Polynucleotide
taatacgactcactatagggggaatctgaagttttaggttaagactttgaaacagaggagatcaaagatgtaacctaaaaacctggcggcagcgcaaaagatg

SEQ ID NO: 23418 - DNA, 103 bp, Artificial Sequence
  Synthetic Polynucleotide
taatacgactcactatagggtatctggaatctgaagttttaggttaagacaacagaggagagtcttaatgtaaaacttcaacctggcggcagcgcaaaagatg

SEQ ID NO: 23419 - DNA, 103 bp, Artificial Sequence
  Synthetic Polynucleotide
taatacgactcactatagggcctattatctggaatctgaagttttaggttaacagaggagaaacctaatgcttcagattaacctggcggcagcgcaaaagatg

SEQ ID NO: 23420 - DNA, 103 bp, Artificial Sequence
  Synthetic Polynucleotide
taatacgactcactatagggggggctgtgggttttgtacctaattctagcaacagaggagagctagaatgaggtacaaaaacctggcggcagcgcaaaagatg

SEQ ID NO: 23421 - DNA, 103 bp, Artificial Sequence
  Synthetic Polynucleotide
taatacgactcactatagggatttctgcagcaagacgggctagtttctctaacagaggagaagagaaatgagcccgtctaacctggcggcagcgcaaaagatg

SEQ ID NO: 23422 - DNA, 103 bp, Artificial Sequence
  Synthetic Polynucleotide
taatacgactcactatagggtcagtcctattatctggaatctgaagttttaacagaggagaaaaactatggattccagaaacctggcggcagcgcaaaagatg

SEQ ID NO: 23423 - DNA, 103 bp, Artificial Sequence
  Synthetic Polynucleotide
taatacgactcactatagggcacattcagtcctattatctggaatctgaaaacagaggagattcagaatgcagataataaacctggcggcagcgcaaaagatg

SEQ ID NO: 23424 - DNA, 103 bp, Artificial Sequence
  Synthetic Polynucleotide
taatacgactcactatagggctgtgcacattcagtcctattatctggaataacagaggagaattccaatgaataggactaacctggcggcagcgcaaaagatg

SEQ ID NO: 23425 - DNA, 103 bp, Artificial Sequence
  Synthetic Polynucleotide
taatacgactcactatagggaagttctgtgcacattcagtcctattatctaacagaggagaagataaatggactgaatgaacctggcggcagcgcaaaagatg

SEQ ID NO: 23426 - DNA, 103 bp, Artificial Sequence
  Synthetic Polynucleotide
taatacgactcactatagggtaataaagttctgtgcacattcagtcctataacagaggagaataggaatgaatgtgcacaacctggcggcagcgcaaaagatg

SEQ ID NO: 23427 - DNA, 103 bp, Artificial Sequence
  Synthetic Polynucleotide
taatacgactcactatagggggttttaataaagttctgtgcacattcagtaacagaggagaactgaaatggcacagaacaacctggcggcagcgcaaaagatg

SEQ ID NO: 23428 - DNA, 103 bp, Artificial Sequence
  Synthetic Polynucleotide
taatacgactcactatagggattatggttttaataaagttctgtgcacataacagaggagaatgtgcatggaactttataacctggcggcagcgcaaaagatg

SEQ ID NO: 23429 - DNA, 103 bp, Artificial Sequence
  Synthetic Polynucleotide
taatacgactcactatagggcctgaattatggttttaataaagttctgtgaacagaggagacacagaatgttattaaaaaacctggcggcagcgcaaaagatg

SEQ ID NO: 23430 - DNA, 103 bp, Artificial Sequence
  Synthetic Polynucleotide
taatacgactcactatagggttttgcctgaattatggttttaataaagttaacagaggagaaactttatgaaaaccataaacctggcggcagcgcaaaagatg

SEQ ID NO: 23431 - DNA, 103 bp, Artificial Sequence
  Synthetic Polynucleotide
taatacgactcactataggggtcagttttgcctgaattatggttttaataaacagaggagatattaaatgcataattcaaacctggcggcagcgcaaaagatg

SEQ ID NO: 23432 - DNA, 103 bp, Artificial Sequence
  Synthetic Polynucleotide
taatacgactcactatagggtttcaatttctgcagcaagacgggctagttaacagaggagaaactagatggtcttgctgaacctggcggcagcgcaaaagatg

SEQ ID NO: 23433 - DNA, 103 bp, Artificial Sequence
  Synthetic Polynucleotide
taatacgactcactataggggaggagtcagttttgcctgaattatggtttaacagaggagaaaaccaatgttcaggcaaaacctggcggcagcgcaaaagatg

SEQ ID NO: 23434 - DNA, 103 bp, Artificial Sequence
  Synthetic Polynucleotide
taatacgactcactatagggttgttgaggagtcagttttgcctgaattataacagaggagaataattatggcaaaactgaacctggcggcagcgcaaaagatg

SEQ ID NO: 23435 - DNA, 103 bp, Artificial Sequence
  Synthetic Polynucleotide
taatacgactcactatagggcagtattgttgaggagtcagttttgcctgaaacagaggagatcaggcatgactgactccaacctggcggcagcgcaaaagatg

SEQ ID NO: 23436 - DNA, 103 bp, Artificial Sequence
  Synthetic Polynucleotide
taatacgactcactatagggattcacagtattgttgaggagtcagttttgaacagaggagacaaaacatgctcctcaacaacctggcggcagcgcaaaagatg

SEQ ID NO: 23437 - DNA, 103 bp, Artificial Sequence
  Synthetic Polynucleotide
taatacgactcactataggggaacaattcacagtattgttgaggagtcagaacagaggagactgactatgcaacaatacaacctggcggcagcgcaaaagatg

SEQ ID NO: 23438 - DNA, 103 bp, Artificial Sequence
  Synthetic Polynucleotide
taatacgactcactatagggaaagagaacaattcacagtattgttgaggaaacagaggagatcctcaatgatactgtgaaacctggcggcagcgcaaaagatg

SEQ ID NO: 23439 - DNA, 103 bp, Artificial Sequence
  Synthetic Polynucleotide
taatacgactcactatagggtttgtaaagagaacaattcacagtattgttaacagaggagaaacaatatggtgaattgtaacctggcggcagcgcaaaagatg

SEQ ID NO: 23440 - DNA, 103 bp, Artificial Sequence
  Synthetic Polynucleotide
taatacgactcactatagggatgtttttgtaaagagaacaattcacagtaaacagaggagatactgtatgttgttctctaacctggcggcagcgcaaaagatg

SEQ ID NO: 23441 - DNA, 103 bp, Artificial Sequence
  Synthetic Polynucleotide
taatacgactcactatagggccccaatgtttttgtaaagagaacaattcaaacagaggagatgaattatgctctttacaaacctggcggcagcgcaaaagatg

SEQ ID NO: 23442 - DNA, 103 bp, Artificial Sequence
  Synthetic Polynucleotide
taatacgactcactatagggggtgaccccaatgtttttgtaaagagaacaaacagaggagatgttctatgtacaaaaacaacctggcggcagcgcaaaagatg

SEQ ID NO: 23443 - DNA, 103 bp, Artificial Sequence
  Synthetic Polynucleotide
taatacgactcactataggggttgttttcaatttctgcagcaagacgggcaacagaggagagcccgtatggctgcagaaaacctggcggcagcgcaaaagatg

SEQ ID NO: 23444 - DNA, 103 bp, Artificial Sequence
  Synthetic Polynucleotide
taatacgactcactatagggaactgggtgaccccaatgtttttgtaaagaaacagaggagatctttaatgaaacattggaacctggcggcagcgcaaaagatg

SEQ ID NO: 23445 - DNA, 103 bp, Artificial Sequence
  Synthetic Polynucleotide
taatacgactcactatagggtataaaactgggtgaccccaatgtttttgtaacagaggagaacaaaaatgttggggtcaaacctggcggcagcgcaaaagatg

SEQ ID NO: 23446 - DNA, 103 bp, Artificial Sequence
  Synthetic Polynucleotide
taatacgactcactatagggcattgtataaaactgggtgaccccaatgttaacagaggagaaacattatggtcacccagaacctggcggcagcgcaaaagatg

SEQ ID NO: 23447 - DNA, 103 bp, Artificial Sequence
  Synthetic Polynucleotide
taatacgactcactatagggaacatcattgtataaaactgggtgaccccaaacagaggagatggggtatgccagttttaaacctggcggcagcgcaaaagatg

SEQ ID NO: 23448 - DNA, 103 bp, Artificial Sequence
  Synthetic Polynucleotide
taatacgactcactatagggagtgcaacatcattgtataaaactgggtgaaacagaggagatcacccatgtttatacaaaacctggcggcagcgcaaaagatg

SEQ ID NO: 23449 - DNA, 103 bp, Artificial Sequence
  Synthetic Polynucleotide
taatacgactcactatagggtgtctagtgcaacatcattgtataaaactgaacagaggagacagtttatgacaatgatgaacctggcggcagcgcaaaagatg

SEQ ID NO: 23450 - DNA, 103 bp, Artificial Sequence
  Synthetic Polynucleotide
taatacgactcactatagggcactttgtctagtgcaacatcattgtataaaacagaggagattatacatggatgttgcaaacctggcggcagcgcaaaagatg

SEQ ID NO: 23451 - DNA, 103 bp, Artificial Sequence
  Synthetic Polynucleotide
taatacgactcactatagggttcttcactttgtctagtgcaacatcattgaacagaggagacaatgaatgtgcactagaaacctggcggcagcgcaaaagatg

SEQ ID NO: 23452 - DNA, 103 bp, Artificial Sequence
  Synthetic Polynucleotide
taatacgactcactatagggcatgtttcttcactttgtctagtgcaacataacagaggagaatgttgatgtagacaaagaacctggcggcagcgcaaaagatg

SEQ ID NO: 23453 - DNA, 103 bp, Artificial Sequence
  Synthetic Polynucleotide
taatacgactcactatagggttgggcatgtttcttcactttgtctagtgcaacagaggagagcactaatgaaagtgaagaacctggcggcagcgcaaaagatg

SEQ ID NO: 23454 - DNA, 103 bp, Artificial Sequence
  Synthetic Polynucleotide
taatacgactcactataggggcaatgttgttttcaatttctgcagcaagaaacagaggagatcttgcatgagaaattgaaacctggcggcagcgcaaaagatg

SEQ ID NO: 23455 - DNA, 103 bp, Artificial Sequence
  Synthetic Polynucleotide
taatacgactcactataggggttgattgggcatgtttcttcactttgtctaacagaggagaagacaaatggaagaaacaaacctggcggcagcgcaaaagatg

SEQ ID NO: 23456 - DNA, 103 bp, Artificial Sequence
  Synthetic Polynucleotide
taatacgactcactatagggtttttgttgattgggcatgtttcttcacttaacagaggagaaagtgaatgaacatgcccaacctggcggcagcgcaaaagatg

SEQ ID NO: 23457 - DNA, 103 bp, Artificial Sequence
  Synthetic Polynucleotide
taatacgactcactatagggtaaaatttttgttgattgggcatgtttcttaacagaggagaaagaaaatggcccaatcaaacctggcggcagcgcaaaagatg

SEQ ID NO: 23458 - DNA, 103 bp, Artificial Sequence
  Synthetic Polynucleotide
taatacgactcactatagggggttttaaaatttttgttgattgggcatgtaacagaggagaacatgcatgatcaacaaaaacctggcggcagcgcaaaagatg

SEQ ID NO: 23459 - DNA, 103 bp, Artificial Sequence
  Synthetic Polynucleotide
taatacgactcactatagggccttaggttttaaaatttttgttgattgggaacagaggagacccaatatgcaaaaatttaacctggcggcagcgcaaaagatg

SEQ ID NO: 23460 - DNA, 103 bp, Artificial Sequence
  Synthetic Polynucleotide
taatacgactcactatagggcatgaccttaggttttaaaatttttgttgaaacagaggagatcaacaatgattttaaaaaacctggcggcagcgcaaaagatg

SEQ ID NO: 23461 - DNA, 103 bp, Artificial Sequence
  Synthetic Polynucleotide
taatacgactcactatagggtcaaacatgaccttaggttttaaaatttttaacagaggagaaaaaatatgaaaacctaaaacctggcggcagcgcaaaagatg

SEQ ID NO: 23462 - DNA, 103 bp, Artificial Sequence
  Synthetic Polynucleotide
taatacgactcactatagggaagtttcaaacatgaccttaggttttaaaaaacagaggagattttaaatgctaaggtcaaacctggcggcagcgcaaaagatg

SEQ ID NO: 23463 - DNA, 103 bp, Artificial Sequence
  Synthetic Polynucleotide
taatacgactcactatagggacaaaaagtttcaaacatgaccttaggtttaacagaggagaaaacctatggtcatgtttaacctggcggcagcgcaaaagatg

SEQ ID NO: 23464 - DNA, 103 bp, Artificial Sequence
  Synthetic Polynucleotide
taatacgactcactatagggaagacacaaaaagtttcaaacatgaccttaaacagaggagataaggtatggtttgaaacaacctggcggcagcgcaaaagatg

SEQ ID NO: 23465 - DNA, 103 bp, Artificial Sequence
  Synthetic Polynucleotide
taatacgactcactatagggcctctgcaatgttgttttcaatttctgcagaacagaggagactgcagatgttgaaaacaaacctggcggcagcgcaaaagatg

SEQ ID NO: 23466 - DNA, 103 bp, Artificial Sequence
  Synthetic Polynucleotide
taatacgactcactatagggacttaaagacacaaaaagtttcaaacatgaaacagaggagatcatgtatgaaactttttaacctggcggcagcgcaaaagatg

SEQ ID NO: 23467 - DNA, 103 bp, Artificial Sequence
  Synthetic Polynucleotide
taatacgactcactatagggtataaacttaaagacacaaaaagtttcaaaaacagaggagatttgaaatgttttgtgtcaacctggcggcagcgcaaaagatg

SEQ ID NO: 23468 - DNA, 103 bp, Artificial Sequence
  Synthetic Polynucleotide
taatacgactcactataggggccactataaacttaaagacacaaaaagttaacagaggagaaactttatgtgtctttaaaacctggcggcagcgcaaaagatg

SEQ ID NO: 23469 - DNA, 103 bp, Artificial Sequence
  Synthetic Polynucleotide
taatacgactcactatagggtttttgccactataaacttaaagacacaaaaacagaggagatttgtgatgttaagtttaaacctggcggcagcgcaaaagatg

SEQ ID NO: 23470 - DNA, 103 bp, Artificial Sequence
  Synthetic Polynucleotide
taatacgactcactatagggatgattttttgccactataaacttaaagacaacagaggagagtctttatgtttatagtgaacctggcggcagcgcaaaagatg

SEQ ID NO: 23471 - DNA, 103 bp, Artificial Sequence
  Synthetic Polynucleotide
taatacgactcactatagggtgataatgattttttgccactataaacttaaacagaggagataagttatgagtggcaaaaacctggcggcagcgcaaaagatg

SEQ ID NO: 23472 - DNA, 103 bp, Artificial Sequence
  Synthetic Polynucleotide
taatacgactcactataggggagagtgataatgattttttgccactataaaacagaggagattatagatgcaaaaaatcaacctggcggcagcgcaaaagatg

SEQ ID NO: 23473 - DNA, 103 bp, Artificial Sequence
  Synthetic Polynucleotide
taatacgactcactatagggtccttgagagtgataatgattttttgccacaacagaggagagtggcaatgaatcattataacctggcggcagcgcaaaagatg

SEQ ID NO: 23474 - DNA, 103 bp, Artificial Sequence
  Synthetic Polynucleotide
taatacgactcactatagggcacgatccttgagagtgataatgattttttaacagaggagaaaaaaaatgttatcactcaacctggcggcagcgcaaaagatg

SEQ ID NO: 23475 - DNA, 103 bp, Artificial Sequence
  Synthetic Polynucleotide
taatacgactcactatagggtgtaccacgatccttgagagtgataatgataacagaggagaatcattatgactctcaagaacctggcggcagcgcaaaagatg

SEQ ID NO: 23476 - DNA, 103 bp, Artificial Sequence
  Synthetic Polynucleotide
taatacgactcactatagggctgatcctctgcaatgttgttttcaatttcaacagaggagagaaattatgaacaacattaacctggcggcagcgcaaaagatg

SEQ ID NO: 23477 - DNA, 103 bp, Artificial Sequence
  Synthetic Polynucleotide
taatacgactcactatagggggttttgtaccacgatccttgagagtgataaacagaggagatatcacatgcaaggatcgaacctggcggcagcgcaaaagatg

SEQ ID NO: 23478 - DNA, 103 bp, Artificial Sequence
  Synthetic Polynucleotide
taatacgactcactatagggtgtgtggttttgtaccacgatccttgagagaacagaggagactctcaatgatcgtggtaaacctggcggcagcgcaaaagatg

SEQ ID NO: 23479 - DNA, 103 bp, Artificial Sequence
  Synthetic Polynucleotide
taatacgactcactataggggatcatgtgtggttttgtaccacgatccttaacagaggagaaaggatatgggtacaaaaaacctggcggcagcgcaaaagatg

SEQ ID NO: 23480 - DNA, 103 bp, Artificial Sequence
  Synthetic Polynucleotide
taatacgactcactatagggatgtagatcatgtgtggttttgtaccacgaaacagaggagatcgtggatgaaaaccacaaacctggcggcagcgcaaaagatg

SEQ ID NO: 23481 - DNA, 103 bp, Artificial Sequence
  Synthetic Polynucleotide
taatacgactcactataggggtcaaatgtagatcatgtgtggttttgtacaacagaggagagtacaaatgcacacatgaaacctggcggcagcgcaaaagatg

SEQ ID NO: 23482 - DNA, 103 bp, Artificial Sequence
  Synthetic Polynucleotide
taatacgactcactatagggatggggtcaaatgtagatcatgtgtggtttaacagaggagaaaaccaatgatgatctacaacctggcggcagcgcaaaagatg

SEQ ID NO: 23483 - DNA, 103 bp, Artificial Sequence
  Synthetic Polynucleotide
taatacgactcactatagggtagatatggggtcaaatgtagatcatgtgtaacagaggagaacacatatgctacatttgaacctggcggcagcgcaaaagatg

SEQ ID NO: 23484 - DNA, 103 bp, Artificial Sequence
  Synthetic Polynucleotide
taatacgactcactatagggtgccgtagatatggggtcaaatgtagatcaaacagaggagatgatctatgtttgaccccaacctggcggcagcgcaaaagatg

SEQ ID NO: 23485 - DNA, 103 bp, Artificial Sequence
  Synthetic Polynucleotide
taatacgactcactatagggtgtgctgccgtagatatggggtcaaatgtaaacagaggagatacattatgccccatatcaacctggcggcagcgcaaaagatg

SEQ ID NO: 23486 - DNA, 103 bp, Artificial Sequence
  Synthetic Polynucleotide
taatacgactcactatagggcacaatgtgctgccgtagatatggggtcaaaacagaggagattgaccatgtatctacggaacctggcggcagcgcaaaagatg

SEQ ID NO: 23487 - DNA, 103 bp, Artificial Sequence
  Synthetic Polynucleotide
taatacgactcactatagggaacccctgatcctctgcaatgttgttttcaaacagaggagatgaaaaatgcattgcagaaacctggcggcagcgcaaaagatg

SEQ ID NO: 23488 - DNA, 103 bp, Artificial Sequence
  Synthetic Polynucleotide
taatacgactcactatagggtttgacacaatgtgctgccgtagatatgggaacagaggagacccataatgacggcagcaaacctggcggcagcgcaaaagatg

SEQ ID NO: 23489 - DNA, 103 bp, Artificial Sequence
  Synthetic Polynucleotide
taatacgactcactatagggatgaatttgacacaatgtgctgccgtagataacagaggagaatctacatgagcacattgaacctggcggcagcgcaaaagatg

SEQ ID NO: 23490 - DNA, 103 bp, Artificial Sequence
  Synthetic Polynucleotide
taatacgactcactatagggtggaaatgaatttgacacaatgtgctgccgaacagaggagacggcagatgattgtgtcaaacctggcggcagcgcaaaagatg

SEQ ID NO: 23491 - DNA, 103 bp, Artificial Sequence
  Synthetic Polynucleotide
taatacgactcactatagggtgcgatggaaatgaatttgacacaatgtgcaacagaggagagcacatatggtcaaattcaacctggcggcagcgcaaaagatg

SEQ ID NO: 23492 - DNA, 103 bp, Artificial Sequence
  Synthetic Polynucleotide
taatacgactcactatagggcggcttgcgatggaaatgaatttgacacaaaacagaggagattgtgtatgattcatttcaacctggcggcagcgcaaaagatg

SEQ ID NO: 23493 - DNA, 103 bp, Artificial Sequence
  Synthetic Polynucleotide
taatacgactcactatagggaatctcggcttgcgatggaaatgaatttgaaacagaggagatcaaatatgtttccatcgaacctggcggcagcgcaaaagatg

SEQ ID NO: 23494 - DNA, 103 bp, Artificial Sequence
  Synthetic Polynucleotide
taatacgactcactatagggtgataaatctcggcttgcgatggaaatgaaaacagaggagattcattatgatcgcaagcaacctggcggcagcgcaaaagatg

SEQ ID NO: 23495 - DNA, 103 bp, Artificial Sequence
  Synthetic Polynucleotide
taatacgactcactatagggggtgctgataaatctcggcttgcgatggaaaacagaggagattccatatgaagccgagaaacctggcggcagcgcaaaagatg

SEQ ID NO: 23496 - DNA, 103 bp, Artificial Sequence
  Synthetic Polynucleotide
taatacgactcactatagggccagaggtgctgataaatctcggcttgcgaaacagaggagatcgcaaatggagatttataacctggcggcagcgcaaaagatg

SEQ ID NO: 23497 - DNA, 103 bp, Artificial Sequence
  Synthetic Polynucleotide
taatacgactcactatagggcattcccagaggtgctgataaatctcggctaacagaggagaagccgaatgttatcagcaaacctggcggcagcgcaaaagatg

SEQ ID NO: 23498 - DNA, 103 bp, Artificial Sequence
  Synthetic Polynucleotide
taatacgactcactataggggtttgaacccctgatcctctgcaatgttgtaacagaggagaacaacaatgcagaggatcaacctggcggcagcgcaaaagatg

SEQ ID NO: 23499 - DNA, 103 bp, Artificial Sequence
  Synthetic Polynucleotide
taatacgactcactatagggagtaccattcccagaggtgctgataaatctaacagaggagaagatttatgagcacctctaacctggcggcagcgcaaaagatg

SEQ ID NO: 23500 - DNA, 103 bp, Artificial Sequence
  Synthetic Polynucleotide
taatacgactcactatagggtacaaagtaccattcccagaggtgctgataaacagaggagatatcagatgctctgggaaaacctggcggcagcgcaaaagatg

SEQ ID NO: 23501 - DNA, 103 bp, Artificial Sequence
  Synthetic Polynucleotide
taatacgactcactatagggtgctctacaaagtaccattcccagaggtgcaacagaggagagcacctatgggaatggtaaacctggcggcagcgcaaaagatg

SEQ ID NO: 23502 - DNA, 103 bp, Artificial Sequence
  Synthetic Polynucleotide
taatacgactcactataggggttcatgctctacaaagtaccattcccagaaacagaggagatctgggatgggtactttgaacctggcggcagcgcaaaagatg

SEQ ID NO: 23503 - DNA, 103 bp, Artificial Sequence
  Synthetic Polynucleotide
taatacgactcactatagggaagaggttcatgctctacaaagtaccattcaacagaggagagaatggatgtttgtagagaacctggcggcagcgcaaaagatg

SEQ ID NO: 23504 - DNA, 103 bp, Artificial Sequence
  Synthetic Polynucleotide
taatacgactcactataggggaaaaaagaggttcatgctctacaaagtacaacagaggagagtacttatgagagcatgaaacctggcggcagcgcaaaagatg

SEQ ID NO: 23505 - DNA, 103 bp, Artificial Sequence
  Synthetic Polynucleotide
taatacgactcactatagggttgtagaaaaaagaggttcatgctctacaaaacagaggagattgtagatgatgaacctcaacctggcggcagcgcaaaagatg

SEQ ID NO: 23506 - DNA, 103 bp, Artificial Sequence
  Synthetic Polynucleotide
taatacgactcactatagggtatttttgtagaaaaaagaggttcatgctcaacagaggagagagcatatgcctctttttaacctggcggcagcgcaaaagatg

SEQ ID NO: 23507 - DNA, 103 bp, Artificial Sequence
  Synthetic Polynucleotide
taatacgactcactatagggcttattatttttgtagaaaaaagaggttcaaacagaggagatgaaccatgtttttctacaacctggcggcagcgcaaaagatg

SEQ ID NO: 23508 - DNA, 103 bp, Artificial Sequence
  Synthetic Polynucleotide
taatacgactcactatagggaatcacttattatttttgtagaaaaaagagaacagaggagactctttatgctacaaaaaaacctggcggcagcgcaaaagatg

SEQ ID NO: 23509 - DNA, 103 bp, Artificial Sequence
  Synthetic Polynucleotide
taatacgactcactatagggcgattgtttgaacccctgatcctctgcaataacagaggagaattgcaatggatcaggggaacctggcggcagcgcaaaagatg

SEQ ID NO: 23510 - DNA, 103 bp, Artificial Sequence
  Synthetic Polynucleotide
taatacgactcactatagggactcaaatcacttattatttttgtagaaaaaacagaggagattttctatgaaaataataaacctggcggcagcgcaaaagatg

SEQ ID NO: 23511 - DNA, 103 bp, Artificial Sequence
  Synthetic Polynucleotide
taatacgactcactatagggaaaatactcaaatcacttattatttttgtaaacagaggagatacaaaatgaataagtgaaacctggcggcagcgcaaaagatg

SEQ ID NO: 23512 - DNA, 103 bp, Artificial Sequence
  Synthetic Polynucleotide
taatacgactcactatagggttatgaaaatactcaaatcacttattatttaacagaggagaaaataaatggtgatttgaaacctggcggcagcgcaaaagatg

SEQ ID NO: 23513 - DNA, 103 bp, Artificial Sequence
  Synthetic Polynucleotide
taatacgactcactatagggatcttttatgaaaatactcaaatcacttataacagaggagaataagtatgttgagtattaacctggcggcagcgcaaaagatg

SEQ ID NO: 23514 - DNA, 103 bp, Artificial Sequence
  Synthetic Polynucleotide
taatacgactcactataggggctctatcttttatgaaaatactcaaatcaaacagaggagatgatttatgtattttcataacctggcggcagcgcaaaagatg

SEQ ID NO: 23515 - DNA, 103 bp, Artificial Sequence
  Synthetic Polynucleotide
taatacgactcactatagggcagtagctctatcttttatgaaaatactcaaacagaggagatgagtaatgtcataaaagaacctggcggcagcgcaaaagatg

SEQ ID NO: 23516 - DNA, 103 bp, Artificial Sequence
  Synthetic Polynucleotide
taatacgactcactatagggtacagcagtagctctatcttttatgaaaataacagaggagaattttcatgaaagatagaaacctggcggcagcgcaaaagatg

SEQ ID NO: 23517 - DNA, 103 bp, Artificial Sequence
  Synthetic Polynucleotide
taatacgactcactatagggcgatttacagcagtagctctatcttttatgaacagaggagacataaaatgtagagctacaacctggcggcagcgcaaaagatg

SEQ ID NO: 23518 - DNA, 103 bp, Artificial Sequence
  Synthetic Polynucleotide
taatacgactcactatagggactctcgatttacagcagtagctctatcttaacagaggagaaagataatgctactgctgaacctggcggcagcgcaaaagatg

SEQ ID NO: 23519 - DNA, 103 bp, Artificial Sequence
  Synthetic Polynucleotide
taatacgactcactatagggccaacactctcgatttacagcagtagctctaacagaggagaagagctatggctgtaaataacctggcggcagcgcaaaagatg

SEQ ID NO: 23520 - DNA, 103 bp, Artificial Sequence
  Synthetic Polynucleotide
taatacgactcactatagggttctgcgattgtttgaacccctgatcctctaacagaggagaagaggaatgggggttcaaaacctggcggcagcgcaaaagatg

SEQ ID NO: 23521 - DNA, 103 bp, Artificial Sequence
  Synthetic Polynucleotide
taatacgactcactatagggctgtcccaacactctcgatttacagcagtaaacagaggagatactgcatgaaatcgagaaacctggcggcagcgcaaaagatg

SEQ ID NO: 23522 - DNA, 103 bp, Artificial Sequence
  Synthetic Polynucleotide
taatacgactcactatagggaaacgctgtcccaacactctcgatttacagaacagaggagactgtaaatggagagtgttaacctggcggcagcgcaaaagatg

SEQ ID NO: 23523 - DNA, 103 bp, Artificial Sequence
  Synthetic Polynucleotide
taatacgactcactatagggatcaaaaacgctgtcccaacactctcgattaacagaggagaaatcgaatgtgttgggacaacctggcggcagcgcaaaagatg

SEQ ID NO: 23524 - DNA, 103 bp, Artificial Sequence
  Synthetic Polynucleotide
taatacgactcactatagggctcctatcaaaaacgctgtcccaacactctaacagaggagaagagtgatgggacagcgtaacctggcggcagcgcaaaagatg

SEQ ID NO: 23525 - DNA, 103 bp, Artificial Sequence
  Synthetic Polynucleotide
taatacgactcactataggggcacactcctatcaaaaacgctgtcccaacaacagaggagagttgggatggcgtttttgaacctggcggcagcgcaaaagatg

SEQ ID NO: 23526 - DNA, 103 bp, Artificial Sequence
  Synthetic Polynucleotide
taatacgactcactatagggtcctagcacactcctatcaaaaacgctgtcaacagaggagagacagcatgtttgataggaacctggcggcagcgcaaaagatg

SEQ ID NO: 23527 - DNA, 103 bp, Artificial Sequence
  Synthetic Polynucleotide
taatacgactcactatagggttgtatcctagcacactcctatcaaaaacgaacagaggagacgttttatgtaggagtgtaacctggcggcagcgcaaaagatg

SEQ ID NO: 23528 - DNA, 103 bp, Artificial Sequence
  Synthetic Polynucleotide
taatacgactcactatagggggggattgtatcctagcacactcctatcaaaacagaggagattgataatggtgtgctagaacctggcggcagcgcaaaagatg

SEQ ID NO: 23529 - DNA, 103 bp, Artificial Sequence
  Synthetic Polynucleotide
taatacgactcactataggggacagggggattgtatcctagcacactcctaacagaggagaaggagtatgctaggatacaacctggcggcagcgcaaaagatg

SEQ ID NO: 23530 - DNA, 103 bp, Artificial Sequence
  Synthetic Polynucleotide
taatacgactcactatagggaatctgacagggggattgtatcctagcacaaacagaggagatgtgctatgatacaatccaacctggcggcagcgcaaaagatg

SEQ ID NO: 23531 - DNA, 103 bp, Artificial Sequence
  Synthetic Polynucleotide
taatacgactcactatagggcatgaggggctgtgggttttgtacctaattaacagaggagaaattagatgcaaaacccaaacctggcggcagcgcaaaagatg

SEQ ID NO: 23532 - DNA, 103 bp, Artificial Sequence
  Synthetic Polynucleotide
taatacgactcactatagggcctgattctgcgattgtttgaacccctgataacagaggagaatcaggatgtcaaacaataacctggcggcagcgcaaaagatg

SEQ ID NO: 23533 - DNA, 103 bp, Artificial Sequence
  Synthetic Polynucleotide
taatacgactcactatagggattgaaatctgacagggggattgtatcctaaacagaggagataggatatgatccccctgaacctggcggcagcgcaaaagatg

SEQ ID NO: 23534 - DNA, 103 bp, Artificial Sequence
  Synthetic Polynucleotide
taatacgactcactatagggctttgattgaaatctgacagggggattgtaaacagaggagatacaatatgcctgtcagaaacctggcggcagcgcaaaagatg

SEQ ID NO: 23535 - DNA, 103 bp, Artificial Sequence
  Synthetic Polynucleotide
taatacgactcactatagggaccctctttgattgaaatctgacagggggaaacagaggagatcccccatgcagatttcaaacctggcggcagcgcaaaagatg

SEQ ID NO: 23536 - DNA, 103 bp, Artificial Sequence
  Synthetic Polynucleotide
taatacgactcactatagggcaggtaccctctttgattgaaatctgacagaacagaggagactgtcaatgttcaatcaaaacctggcggcagcgcaaaagatg

SEQ ID NO: 23537 - DNA, 103 bp, Artificial Sequence
  Synthetic Polynucleotide
taatacgactcactatagggttgctcaggtaccctctttgattgaaatctaacagaggagaagatttatgtcaaagaggaacctggcggcagcgcaaaagatg

SEQ ID NO: 23538 - DNA, 103 bp, Artificial Sequence
  Synthetic Polynucleotide
taatacgactcactatagggaagaattgctcaggtaccctctttgattgaaacagaggagatcaatcatggagggtaccaacctggcggcagcgcaaaagatg

SEQ ID NO: 23539 - DNA, 103 bp, Artificial Sequence
  Synthetic Polynucleotide
taatacgactcactataggggacctaagaattgctcaggtaccctctttgaacagaggagacaaagaatgtacctgagcaacctggcggcagcgcaaaagatg

SEQ ID NO: 23540 - DNA, 103 bp, Artificial Sequence
  Synthetic Polynucleotide
taatacgactcactatagggtgcttgacctaagaattgctcaggtaccctaacagaggagaagggtaatggagcaattcaacctggcggcagcgcaaaagatg

SEQ ID NO: 23541 - DNA, 103 bp, Artificial Sequence
  Synthetic Polynucleotide
taatacgactcactatagggaaatctgcttgacctaagaattgctcaggtaacagaggagaacctgaatgattcttaggaacctggcggcagcgcaaaagatg

SEQ ID NO: 23542 - DNA, 103 bp, Artificial Sequence
  Synthetic Polynucleotide
taatacgactcactatagggaagagaaatctgcttgacctaagaattgctaacagaggagaagcaatatgtaggtcaagaacctggcggcagcgcaaaagatg

SEQ ID NO: 23543 - DNA, 103 bp, Artificial Sequence
  Synthetic Polynucleotide
taatacgactcactatagggtgacacctgattctgcgattgtttgaacccaacagaggagagggttcatgcaatcgcagaacctggcggcagcgcaaaagatg

SEQ ID NO: 23544 - DNA, 103 bp, Artificial Sequence
  Synthetic Polynucleotide
taatacgactcactatagggatttaaagagaaatctgcttgacctaagaaaacagaggagattcttaatgcaagcagataacctggcggcagcgcaaaagatg

SEQ ID NO: 23545 - DNA, 103 bp, Artificial Sequence
  Synthetic Polynucleotide
taatacgactcactatagggatttgatttaaagagaaatctgcttgacctaacagaggagaaggtcaatgagatttctcaacctggcggcagcgcaaaagatg

SEQ ID NO: 23546 - DNA, 103 bp, Artificial Sequence
  Synthetic Polynucleotide
taatacgactcactatagggccaatatttgatttaaagagaaatctgcttaacagaggagaaagcagatgtctctttaaaacctggcggcagcgcaaaagatg

SEQ ID NO: 23547 - DNA, 103 bp, Artificial Sequence
  Synthetic Polynucleotide
taatacgactcactatagggaaaatccaatatttgatttaaagagaaatcaacagaggagagatttcatgttaaatcaaaacctggcggcagcgcaaaagatg

SEQ ID NO: 23548 - DNA, 103 bp, Artificial Sequence
  Synthetic Polynucleotide
taatacgactcactatagggtcagcaaaatccaatatttgatttaaagagaacagaggagactctttatgtcaaatattaacctggcggcagcgcaaaagatg

SEQ ID NO: 23549 - DNA, 103 bp, Artificial Sequence
  Synthetic Polynucleotide
taatacgactcactatagggatttctcagcaaaatccaatatttgatttaaacagaggagataaatcatgtattggattaacctggcggcagcgcaaaagatg

SEQ ID NO: 23550 - DNA, 103 bp, Artificial Sequence
  Synthetic Polynucleotide
taatacgactcactatagggctctaatttctcagcaaaatccaatatttgaacagaggagacaaataatggattttgctaacctggcggcagcgcaaaagatg

SEQ ID NO: 23551 - DNA, 103 bp, Artificial Sequence
  Synthetic Polynucleotide
taatacgactcactatagggagatactctaatttctcagcaaaatccaataacagaggagaattggaatgtgctgagaaaacctggcggcagcgcaaaagatg

SEQ ID NO: 23552 - DNA, 103 bp, Artificial Sequence
  Synthetic Polynucleotide
taatacgactcactataggggagctagatactctaatttctcagcaaaataacagaggagaattttgatgagaaattagaacctggcggcagcgcaaaagatg

SEQ ID NO: 23553 - DNA, 103 bp, Artificial Sequence
  Synthetic Polynucleotide
taatacgactcactatagggtgaaggagctagatactctaatttctcagcaacagaggagagctgagatgttagagtataacctggcggcagcgcaaaagatg

SEQ ID NO: 23554 - DNA, 103 bp, Artificial Sequence
  Synthetic Polynucleotide
taatacgactcactataggggactgtgacacctgattctgcgattgtttgaacagaggagacaaacaatggcagaatcaaacctggcggcagcgcaaaagatg

SEQ ID NO: 23555 - DNA, 103 bp, Artificial Sequence
  Synthetic Polynucleotide
taatacgactcactatagggctatatgaaggagctagatactctaatttcaacagaggagagaaattatggtatctagcaacctggcggcagcgcaaaagatg

SEQ ID NO: 23556 - DNA, 103 bp, Artificial Sequence
  Synthetic Polynucleotide
taatacgactcactatagggagtttctatatgaaggagctagatactctaaacagaggagatagagtatgtagctccttaacctggcggcagcgcaaaagatg

SEQ ID NO: 23557 - DNA, 103 bp, Artificial Sequence
  Synthetic Polynucleotide
taatacgactcactatagggggaaaagtttctatatgaaggagctagataaacagaggagatatctaatgccttcatataacctggcggcagcgcaaaagatg

SEQ ID NO: 23558 - DNA, 103 bp, Artificial Sequence
  Synthetic Polynucleotide
taatacgactcactataggggaaaaggaaaagtttctatatgaaggagctaacagaggagaagctccatgatatagaaaaacctggcggcagcgcaaaagatg

SEQ ID NO: 23559 - DNA, 103 bp, Artificial Sequence
  Synthetic Polynucleotide
taatacgactcactatagggttaatgaaaaggaaaagtttctatatgaagaacagaggagacttcatatggaaacttttaacctggcggcagcgcaaaagatg

SEQ ID NO: 23560 - DNA, 103 bp, Artificial Sequence
  Synthetic Polynucleotide
taatacgactcactatagggttcctttaatgaaaaggaaaagtttctataaacagaggagatatagaatgttttcctttaacctggcggcagcgcaaaagatg

SEQ ID NO: 23561 - DNA, 103 bp, Artificial Sequence
  Synthetic Polynucleotide
taatacgactcactatagggtctttttcctttaatgaaaaggaaaagtttaacagaggagaaaacttatgcttttcattaacctggcggcagcgcaaaagatg

SEQ ID NO: 23562 - DNA, 103 bp, Artificial Sequence
  Synthetic Polynucleotide
taatacgactcactatagggtcaattctttttcctttaatgaaaaggaaaaacagaggagatttcctatgcattaaaggaacctggcggcagcgcaaaagatg

SEQ ID NO: 23563 - DNA, 103 bp, Artificial Sequence
  Synthetic Polynucleotide
taatacgactcactatagggaatattcaattctttttcctttaatgaaaaaacagaggagattttcaatgaaggaaaaaaacctggcggcagcgcaaaagatg

SEQ ID NO: 23564 - DNA, 103 bp, Artificial Sequence
  Synthetic Polynucleotide
taatacgactcactatagggctcccaatattcaattctttttcctttaataacagaggagaattaaaatgaaaagaattaacctggcggcagcgcaaaagatg

SEQ ID NO: 23565 - DNA, 103 bp, Artificial Sequence
  Synthetic Polynucleotide
taatacgactcactatagggagaaagactgtgacacctgattctgcgattaacagaggagaaatcgcatgatcaggtgtaacctggcggcagcgcaaaagatg

SEQ ID NO: 23566 - DNA, 103 bp, Artificial Sequence
  Synthetic Polynucleotide
taatacgactcactatagggatgttctcccaatattcaattctttttcctaacagaggagaaggaaaatgaattgaataaacctggcggcagcgcaaaagatg

SEQ ID NO: 23567 - DNA, 103 bp, Artificial Sequence
  Synthetic Polynucleotide
taatacgactcactatagggcccgaatgttctcccaatattcaattctttaacagaggagaaaagaaatgaatattgggaacctggcggcagcgcaaaagatg

SEQ ID NO: 23568 - DNA, 103 bp, Artificial Sequence
  Synthetic Polynucleotide
taatacgactcactatagggaacttcccgaatgttctcccaatattcaataacagaggagaattgaaatgtgggagaacaacctggcggcagcgcaaaagatg

SEQ ID NO: 23569 - DNA, 103 bp, Artificial Sequence
  Synthetic Polynucleotide
taatacgactcactatagggagggcaacttcccgaatgttctcccaatataacagaggagaatattgatggaacattcgaacctggcggcagcgcaaaagatg

SEQ ID NO: 23570 - DNA, 103 bp, Artificial Sequence
  Synthetic Polynucleotide
taatacgactcactatagggacgatagggcaacttcccgaatgttctcccaacagaggagagggagaatgttcgggaagaacctggcggcagcgcaaaagatg

SEQ ID NO: 23571 - DNA, 103 bp, Artificial Sequence
  Synthetic Polynucleotide
taatacgactcactatagggctgacacgatagggcaacttcccgaatgttaacagaggagaaacattatggaagttgccaacctggcggcagcgcaaaagatg

SEQ ID NO: 23572 - DNA, 103 bp, Artificial Sequence
  Synthetic Polynucleotide
taatacgactcactatagggcatttctgacacgatagggcaacttcccgaaacagaggagatcgggaatgtgccctatcaacctggcggcagcgcaaaagatg

SEQ ID NO: 23573 - DNA, 103 bp, Artificial Sequence
  Synthetic Polynucleotide
taatacgactcactatagggttggacatttctgacacgatagggcaacttaacagaggagaaagttgatgtatcgtgtcaacctggcggcagcgcaaaagatg

SEQ ID NO: 23574 - DNA, 103 bp, Artificial Sequence
  Synthetic Polynucleotide
taatacgactcactatagggagtgtttggacatttctgacacgatagggcaacagaggagagccctaatgtgtcagaaaaacctggcggcagcgcaaaagatg

SEQ ID NO: 23575 - DNA, 103 bp, Artificial Sequence
  Synthetic Polynucleotide
taatacgactcactatagggctgcaagtgtttggacatttctgacacgataacagaggagaatcgtgatggaaatgtccaacctggcggcagcgcaaaagatg

SEQ ID NO: 23576 - DNA, 103 bp, Artificial Sequence
  Synthetic Polynucleotide
taatacgactcactatagggatttaagaaagactgtgacacctgattctgaacagaggagacagaatatggtgtcacagaacctggcggcagcgcaaaagatg

SEQ ID NO: 23577 - DNA, 103 bp, Artificial Sequence
  Synthetic Polynucleotide
taatacgactcactatagggggcttctgcaagtgtttggacatttctgacaacagaggagagtcagaatggtccaaacaaacctggcggcagcgcaaaagatg

SEQ ID NO: 23578 - DNA, 103 bp, Artificial Sequence
  Synthetic Polynucleotide
taatacgactcactatagggaataaggcttctgcaagtgtttggacatttaacagaggagaaaatgtatgaacacttgcaacctggcggcagcgcaaaagatg

SEQ ID NO: 23579 - DNA, 103 bp, Artificial Sequence
  Synthetic Polynucleotide
taatacgactcactatagggctgctaataaggcttctgcaagtgtttggaaacagaggagatccaaaatgttgcagaagaacctggcggcagcgcaaaagatg

SEQ ID NO: 23580 - DNA, 103 bp, Artificial Sequence
  Synthetic Polynucleotide
taatacgactcactatagggtccatctgctaataaggcttctgcaagtgtaacagaggagaacacttatggaagccttaaacctggcggcagcgcaaaagatg

SEQ ID NO: 23581 - DNA, 103 bp, Artificial Sequence
  Synthetic Polynucleotide
taatacgactcactataggggctagtccatctgctaataaggcttctgcaaacagaggagatgcagaatgcttattagcaacctggcggcagcgcaaaagatg

SEQ ID NO: 23582 - DNA, 103 bp, Artificial Sequence
  Synthetic Polynucleotide
taatacgactcactatagggccttcgctagtccatctgctaataaggcttaacagaggagaaagcctatgtagcagatgaacctggcggcagcgcaaaagatg

SEQ ID NO: 23583 - DNA, 103 bp, Artificial Sequence
  Synthetic Polynucleotide
taatacgactcactataggggaatgccttcgctagtccatctgctaataaaacagaggagattattaatggatggactaaacctggcggcagcgcaaaagatg

SEQ ID NO: 23584 - DNA, 103 bp, Artificial Sequence
  Synthetic Polynucleotide
taatacgactcactatagggctagggaatgccttcgctagtccatctgctaacagaggagaagcagaatgactagcgaaaacctggcggcagcgcaaaagatg

SEQ ID NO: 23585 - DNA, 103 bp, Artificial Sequence
  Synthetic Polynucleotide
taatacgactcactatagggtattactagggaatgccttcgctagtccataacagaggagaatggacatgcgaaggcataacctggcggcagcgcaaaagatg

SEQ ID NO: 23586 - DNA, 103 bp, Artificial Sequence
  Synthetic Polynucleotide
taatacgactcactatagggcatcatattactagggaatgccttcgctagaacagaggagactagcgatggcattccctaacctggcggcagcgcaaaagatg

SEQ ID NO: 23587 - DNA, 103 bp, Artificial Sequence
  Synthetic Polynucleotide
taatacgactcactatagggggatcatttaagaaagactgtgacacctgaaacagaggagatcaggtatgacagtctttaacctggcggcagcgcaaaagatg

SEQ ID NO: 23588 - DNA, 103 bp, Artificial Sequence
  Synthetic Polynucleotide
taatacgactcactatagggacaaccatcatattactagggaatgccttcaacagaggagagaaggcatgccctagtaaaacctggcggcagcgcaaaagatg

SEQ ID NO: 23589 - DNA, 103 bp, Artificial Sequence
  Synthetic Polynucleotide
taatacgactcactatagggcagtaacaaccatcatattactagggaatgaacagaggagacattccatggtaatatgaaacctggcggcagcgcaaaagatg

SEQ ID NO: 23590 - DNA, 103 bp, Artificial Sequence
  Synthetic Polynucleotide
taatacgactcactatagggtctctcagtaacaaccatcatattactaggaacagaggagacctagtatgatgatggttaacctggcggcagcgcaaaagatg

SEQ ID NO: 23591 - DNA, 103 bp, Artificial Sequence
  Synthetic Polynucleotide
taatacgactcactatagggtgctctctctcagtaacaaccatcatattaaacagaggagataatatatgggttgttacaacctggcggcagcgcaaaagatg

SEQ ID NO: 23592 - DNA, 103 bp, Artificial Sequence
  Synthetic Polynucleotide
taatacgactcactatagggctttctgctctctctcagtaacaaccatcaaacagaggagatgatggatgttactgagaaacctggcggcagcgcaaaagatg

SEQ ID NO: 23593 - DNA, 103 bp, Artificial Sequence
  Synthetic Polynucleotide
taatacgactcactatagggagcttctttctgctctctctcagtaacaacaacagaggagagttgttatggagagagagaacctggcggcagcgcaaaagatg

SEQ ID NO: 23594 - DNA, 103 bp, Artificial Sequence
  Synthetic Polynucleotide
taatacgactcactatagggaatagagcttctttctgctctctctcagtaaacagaggagatactgaatgagagcagaaaacctggcggcagcgcaaaagatg

SEQ ID NO: 23595 - DNA, 103 bp, Artificial Sequence
  Synthetic Polynucleotide
taatacgactcactataggggatgcaatagagcttctttctgctctctctaacagaggagaagagagatgagaaagaagaacctggcggcagcgcaaaagatg

SEQ ID NO: 23596 - DNA, 103 bp, Artificial Sequence
  Synthetic Polynucleotide
taatacgactcactatagggggcttgatgcaatagagcttctttctgctcaacagaggagagagcagatggaagctctaaacctggcggcagcgcaaaagatg

SEQ ID NO: 23597 - DNA, 103 bp, Artificial Sequence
  Synthetic Polynucleotide
taatacgactcactatagggcaagaggcttgatgcaatagagcttctttcaacagaggagagaaagaatgtctattgcaaacctggcggcagcgcaaaagatg

SEQ ID NO: 23598 - DNA, 103 bp, Artificial Sequence
  Synthetic Polynucleotide
taatacgactcactataggggtgtgggatcatttaagaaagactgtgacaaacagaggagatgtcacatgctttcttaaaacctggcggcagcgcaaaagatg

SEQ ID NO: 23599 - DNA, 103 bp, Artificial Sequence
  Synthetic Polynucleotide
taatacgactcactatagggggtgccaagaggcttgatgcaatagagcttaacagaggagaaagctcatgtgcatcaagaacctggcggcagcgcaaaagatg

SEQ ID NO: 23600 - DNA, 103 bp, Artificial Sequence
  Synthetic Polynucleotide
taatacgactcactatagggattatggtgccaagaggcttgatgcaatagaacagaggagactattgatgcaagcctctaacctggcggcagcgcaaaagatg

SEQ ID NO: 23601 - DNA, 103 bp, Artificial Sequence
  Synthetic Polynucleotide
taatacgactcactataggggctgaattatggtgccaagaggcttgatgcaacagaggagagcatcaatgctcttggcaaacctggcggcagcgcaaaagatg

SEQ ID NO: 23602 - DNA, 103 bp, Artificial Sequence
  Synthetic Polynucleotide
taatacgactcactatagggtacttgctgaattatggtgccaagaggcttaacagaggagaaagcctatgggcaccataaacctggcggcagcgcaaaagatg

SEQ ID NO: 23603 - DNA, 103 bp, Artificial Sequence
  Synthetic Polynucleotide
taatacgactcactatagggccctatacttgctgaattatggtgccaagaaacagaggagatcttggatgcataattcaaacctggcggcagcgcaaaagatg

SEQ ID NO: 23604 - DNA, 103 bp, Artificial Sequence
  Synthetic Polynucleotide
taatacgactcactatagggttctcccctatacttgctgaattatggtgcaacagaggagagcaccaatgttcagcaagaacctggcggcagcgcaaaagatg

SEQ ID NO: 23605 - DNA, 103 bp, Artificial Sequence
  Synthetic Polynucleotide
taatacgactcactatagggtggcattctcccctatacttgctgaattataacagaggagaataattatgcaagtatagaacctggcggcagcgcaaaagatg

SEQ ID NO: 23606 - DNA, 103 bp, Artificial Sequence
  Synthetic Polynucleotide
taatacgactcactatagggtactatggcattctcccctatacttgctgaaacagaggagatcagcaatgataggggagaacctggcggcagcgcaaaagatg

SEQ ID NO: 23607 - DNA, 103 bp, Artificial Sequence
  Synthetic Polynucleotide
taatacgactcactatagggcctcttactatggcattctcccctatacttaacagaggagaaagtatatgggagaatgcaacctggcggcagcgcaaaagatg

SEQ ID NO: 23608 - DNA, 103 bp, Artificial Sequence
  Synthetic Polynucleotide
taatacgactcactatagggttgcacctcttactatggcattctcccctaaacagaggagataggggatgatgccatagaacctggcggcagcgcaaaagatg

SEQ ID NO: 23609 - DNA, 103 bp, Artificial Sequence
  Synthetic Polynucleotide
taatacgactcactatagggtacaggtgtgggatcatttaagaaagactgaacagaggagacagtctatgttaaatgataacctggcggcagcgcaaaagatg

SEQ ID NO: 23610 - DNA, 103 bp, Artificial Sequence
  Synthetic Polynucleotide
taatacgactcactatagggaaaacttgcacctcttactatggcattctcaacagaggagagagaatatgatagtaagaaacctggcggcagcgcaaaagatg

SEQ ID NO: 23611 - DNA, 103 bp, Artificial Sequence
  Synthetic Polynucleotide
taatacgactcactataggggtaacaaaacttgcacctcttactatggcaaacagaggagatgccatatgaagaggtgcaacctggcggcagcgcaaaagatg

SEQ ID NO: 23612 - DNA, 103 bp, Artificial Sequence
  Synthetic Polynucleotide
taatacgactcactataggggatcagtaacaaaacttgcacctcttactaaacagaggagatagtaaatggtgcaagttaacctggcggcagcgcaaaagatg

SEQ ID NO: 23613 - DNA, 103 bp, Artificial Sequence
  Synthetic Polynucleotide
taatacgactcactatagggctcaagatcagtaacaaaacttgcacctctaacagaggagaagaggtatgagttttgttaacctggcggcagcgcaaaagatg

SEQ ID NO: 23614 - DNA, 103 bp, Artificial Sequence
  Synthetic Polynucleotide
taatacgactcactatagggtatttctcaagatcagtaacaaaacttgcaaacagaggagatgcaagatgtgttactgaaacctggcggcagcgcaaaagatg

SEQ ID NO: 23615 - DNA, 103 bp, Artificial Sequence
  Synthetic Polynucleotide
taatacgactcactataggggattgtatttctcaagatcagtaacaaaacaacagaggagagttttgatgctgatcttgaacctggcggcagcgcaaaagatg

SEQ ID NO: 23616 - DNA, 103 bp, Artificial Sequence
  Synthetic Polynucleotide
taatacgactcactatagggggcaagattgtatttctcaagatcagtaacaacagaggagagttactatgcttgagaaaaacctggcggcagcgcaaaagatg

SEQ ID NO: 23617 - DNA, 103 bp, Artificial Sequence
  Synthetic Polynucleotide
taatacgactcactatagggctaaaggcaagattgtatttctcaagatcaaacagaggagatgatctatggaaatacaaaacctggcggcagcgcaaaagatg

SEQ ID NO: 23618 - DNA, 103 bp, Artificial Sequence
  Synthetic Polynucleotide
taatacgactcactatagggcatatctaaaggcaagattgtatttctcaaaacagaggagattgagaatgacaatcttgaacctggcggcagcgcaaaagatg

SEQ ID NO: 23619 - DNA, 103 bp, Artificial Sequence
  Synthetic Polynucleotide
taatacgactcactatagggaaactcatatctaaaggcaagattgtatttaacagaggagaaaatacatgcttgcctttaacctggcggcagcgcaaaagatg

SEQ ID NO: 23620 - DNA, 103 bp, Artificial Sequence
  Synthetic Polynucleotide
taatacgactcactatagggacttctacaggtgtgggatcatttaagaaaaacagaggagatttcttatgtgatcccacaacctggcggcagcgcaaaagatg

SEQ ID NO: 23621 - DNA, 103 bp, Artificial Sequence
  Synthetic Polynucleotide
taatacgactcactatagggcgtgtaaactcatatctaaaggcaagattgaacagaggagacaatctatgctttagataaacctggcggcagcgcaaaagatg

SEQ ID NO: 23622 - DNA, 103 bp, Artificial Sequence
  Synthetic Polynucleotide
taatacgactcactatagggaatgtcgtgtaaactcatatctaaaggcaaaacagaggagattgcctatggatatgagtaacctggcggcagcgcaaaagatg

SEQ ID NO: 23623 - DNA, 103 bp, Artificial Sequence
  Synthetic Polynucleotide
taatacgactcactatagggtatgaaatgtcgtgtaaactcatatctaaaaacagaggagatttagaatggagtttacaaacctggcggcagcgcaaaagatg

SEQ ID NO: 23624 - DNA, 103 bp, Artificial Sequence
  Synthetic Polynucleotide
taatacgactcactatagggtagtctatgaaatgtcgtgtaaactcatataacagaggagaatatgaatgtacacgacaaacctggcggcagcgcaaaagatg

SEQ ID NO: 23625 - DNA, 103 bp, Artificial Sequence
  Synthetic Polynucleotide
taatacgactcactatagggtacagtagtctatgaaatgtcgtgtaaactaacagaggagaagtttaatggacatttcaaacctggcggcagcgcaaaagatg

SEQ ID NO: 23626 - DNA, 103 bp, Artificial Sequence
  Synthetic Polynucleotide
taatacgactcactatagggtcgattacagtagtctatgaaatgtcgtgtaacagaggagaacacgaatgttcatagacaacctggcggcagcgcaaaagatg

SEQ ID NO: 23627 - DNA, 103 bp, Artificial Sequence
  Synthetic Polynucleotide
taatacgactcactatagggtaacatcgattacagtagtctatgaaatgtaacagaggagaacatttatgagactactgaacctggcggcagcgcaaaagatg

SEQ ID NO: 23628 - DNA, 103 bp, Artificial Sequence
  Synthetic Polynucleotide
taatacgactcactatagggcaccgtaacatcgattacagtagtctatgaaacagaggagatcatagatgactgtaatcaacctggcggcagcgcaaaagatg

SEQ ID NO: 23629 - DNA, 103 bp, Artificial Sequence
  Synthetic Polynucleotide
taatacgactcactatagggtttaacaccgtaacatcgattacagtagtcaacagaggagagactacatgaatcgatgtaacctggcggcagcgcaaaagatg

SEQ ID NO: 23630 - DNA, 103 bp, Artificial Sequence
  Synthetic Polynucleotide
taatacgactcactatagggaaatttttaacaccgtaacatcgattacagaacagaggagactgtaaatgatgttacggaacctggcggcagcgcaaaagatg

SEQ ID NO: 23631 - DNA, 103 bp, Artificial Sequence
  Synthetic Polynucleotide
taatacgactcactatagggctgtcacttctacaggtgtgggatcatttaaacagaggagataaatgatgccacacctgaacctggcggcagcgcaaaagatg

SEQ ID NO: 23632 - DNA, 103 bp, Artificial Sequence
  Synthetic Polynucleotide
taatacgactcactatagggcgaataaatttttaacaccgtaacatcgataacagaggagaatcgatatgacggtgttaaacctggcggcagcgcaaaagatg

SEQ ID NO: 23633 - DNA, 103 bp, Artificial Sequence
  Synthetic Polynucleotide
taatacgactcactatagggccagtcgaataaatttttaacaccgtaacaaacagaggagatgttacatggttaaaaataacctggcggcagcgcaaaagatg

SEQ ID NO: 23634 - DNA, 103 bp, Artificial Sequence
  Synthetic Polynucleotide
taatacgactcactatagggtgcatccagtcgaataaatttttaacaccgaacagaggagacggtgtatgaaatttattaacctggcggcagcgcaaaagatg

SEQ ID NO: 23635 - DNA, 103 bp, Artificial Sequence
  Synthetic Polynucleotide
taatacgactcactatagggagaaatgcatccagtcgaataaatttttaaaacagaggagattaaaaatgtattcgactaacctggcggcagcgcaaaagatg

SEQ ID NO: 23636 - DNA, 103 bp, Artificial Sequence
  Synthetic Polynucleotide
taatacgactcactatagggtattaagaaatgcatccagtcgaataaattaacagaggagaaatttaatggactggatgaacctggcggcagcgcaaaagatg

SEQ ID NO: 23637 - DNA, 103 bp, Artificial Sequence
  Synthetic Polynucleotide
taatacgactcactatagggagtggtattaagaaatgcatccagtcgaataacagaggagaattcgaatggatgcatttaacctggcggcagcgcaaaagatg

SEQ ID NO: 23638 - DNA, 103 bp, Artificial Sequence
  Synthetic Polynucleotide
taatacgactcactatagggagcatagtggtattaagaaatgcatccagtaacagaggagaactggaatgatttcttaaaacctggcggcagcgcaaaagatg

SEQ ID NO: 23639 - DNA, 103 bp, Artificial Sequence
  Synthetic Polynucleotide
taatacgactcactatagggcatatagcatagtggtattaagaaatgcataacagaggagaatgcatatgttaataccaaacctggcggcagcgcaaaagatg

SEQ ID NO: 23640 - DNA, 103 bp, Artificial Sequence
  Synthetic Polynucleotide
taatacgactcactatagggacatgcatatagcatagtggtattaagaaaaacagaggagatttcttatgaccactatgaacctggcggcagcgcaaaagatg

SEQ ID NO: 23641 - DNA, 103 bp, Artificial Sequence
  Synthetic Polynucleotide
taatacgactcactatagggcactgacatgcatatagcatagtggtattaaacagaggagataatacatgtatgctataaacctggcggcagcgcaaaagatg

SEQ ID NO: 23642 - DNA, 103 bp, Artificial Sequence
  Synthetic Polynucleotide
taatacgactcactatagggacgaacatgaggggctgtgggttttgtaccaacagaggagaggtacaatgcccacagccaacctggcggcagcgcaaaagatg

SEQ ID NO: 23643 - DNA, 103 bp, Artificial Sequence
  Synthetic Polynucleotide
taatacgactcactatagggttggactgtcacttctacaggtgtgggatcaacagaggagagatcccatgcctgtagaaaacctggcggcagcgcaaaagatg

SEQ ID NO: 23644 - DNA, 103 bp, Artificial Sequence
  Synthetic Polynucleotide
taatacgactcactatagggaaagtcactgacatgcatatagcatagtggaacagaggagaccactaatgtatatgcataacctggcggcagcgcaaaagatg

SEQ ID NO: 23645 - DNA, 103 bp, Artificial Sequence
  Synthetic Polynucleotide
taatacgactcactatagggctataaaagtcactgacatgcatatagcataacagaggagaatgctaatggcatgtcagaacctggcggcagcgcaaaagatg

SEQ ID NO: 23646 - DNA, 103 bp, Artificial Sequence
  Synthetic Polynucleotide
taatacgactcactataggggagggctataaaagtcactgacatgcatataacagaggagaatatgcatgtcagtgactaacctggcggcagcgcaaaagatg

SEQ ID NO: 23647 - DNA, 103 bp, Artificial Sequence
  Synthetic Polynucleotide
taatacgactcactataggggtgaggagggctataaaagtcactgacatgaacagaggagacatgtcatggacttttataacctggcggcagcgcaaaagatg

SEQ ID NO: 23648 - DNA, 103 bp, Artificial Sequence
  Synthetic Polynucleotide
taatacgactcactatagggacgcagtgaggagggctataaaagtcactgaacagaggagacagtgaatgttatagcccaacctggcggcagcgcaaaagatg

SEQ ID NO: 23649 - DNA, 103 bp, Artificial Sequence
  Synthetic Polynucleotide
taatacgactcactatagggctgtcacgcagtgaggagggctataaaagtaacagaggagaacttttatggccctcctcaacctggcggcagcgcaaaagatg

SEQ ID NO: 23650 - DNA, 103 bp, Artificial Sequence
  Synthetic Polynucleotide
taatacgactcactatagggattttctgtcacgcagtgaggagggctataaacagaggagatatagcatgcctcactgcaacctggcggcagcgcaaaagatg

SEQ ID NO: 23651 - DNA, 103 bp, Artificial Sequence
  Synthetic Polynucleotide
taatacgactcactatagggcggttattttctgtcacgcagtgaggagggaacagaggagaccctccatgctgcgtgacaacctggcggcagcgcaaaagatg

SEQ ID NO: 23652 - DNA, 103 bp, Artificial Sequence
  Synthetic Polynucleotide
taatacgactcactatagggtatttcggttattttctgtcacgcagtgagaacagaggagactcactatgtgacagaaaaacctggcggcagcgcaaaagatg

SEQ ID NO: 23653 - DNA, 103 bp, Artificial Sequence
  Synthetic Polynucleotide
taatacgactcactatagggtgggttatttcggttattttctgtcacgcaaacagaggagatgcgtgatggaaaataacaacctggcggcagcgcaaaagatg

SEQ ID NO: 23654 - DNA, 103 bp, Artificial Sequence
  Synthetic Polynucleotide
taatacgactcactatagggctggcttggactgtcacttctacaggtgtgaacagaggagacacaccatgagaagtgacaacctggcggcagcgcaaaagatg

SEQ ID NO: 23655 - DNA, 103 bp, Artificial Sequence
  Synthetic Polynucleotide
taatacgactcactatagggtcaggtgggttatttcggttattttctgtcaacagaggagagacagaatgtaaccgaaaaacctggcggcagcgcaaaagatg

SEQ ID NO: 23656 - DNA, 103 bp, Artificial Sequence
  Synthetic Polynucleotide
taatacgactcactatagggcacaatcaggtgggttatttcggttattttaacagaggagaaaaataatggaaataaccaacctggcggcagcgcaaaagatg

SEQ ID NO: 23657 - DNA, 103 bp, Artificial Sequence
  Synthetic Polynucleotide
taatacgactcactatagggattggcacaatcaggtgggttatttcggttaacagaggagaaaccgaatgaacccacctaacctggcggcagcgcaaaagatg

SEQ ID NO: 23658 - DNA, 103 bp, Artificial Sequence
  Synthetic Polynucleotide
taatacgactcactatagggtaagcattggcacaatcaggtgggttatttaacagaggagaaaataaatgacctgattgaacctggcggcagcgcaaaagatg

SEQ ID NO: 23659 - DNA, 103 bp, Artificial Sequence
  Synthetic Polynucleotide
taatacgactcactatagggaatgataagcattggcacaatcaggtgggtaacagaggagaacccacatgattgtgccaaacctggcggcagcgcaaaagatg

SEQ ID NO: 23660 - DNA, 103 bp, Artificial Sequence
  Synthetic Polynucleotide
taatacgactcactatagggatgataatgataagcattggcacaatcaggaacagaggagacctgatatggccaatgctaacctggcggcagcgcaaaagatg

SEQ ID NO: 23661 - DNA, 103 bp, Artificial Sequence
  Synthetic Polynucleotide
taatacgactcactatagggcctaaatgataatgataagcattggcacaaaacagaggagattgtgcatgtgcttatcaaacctggcggcagcgcaaaagatg

SEQ ID NO: 23662 - DNA, 103 bp, Artificial Sequence
  Synthetic Polynucleotide
taatacgactcactatagggtacctcctaaatgataatgataagcattggaacagaggagaccaatgatgatcattatcaacctggcggcagcgcaaaagatg

SEQ ID NO: 23663 - DNA, 103 bp, Artificial Sequence
  Synthetic Polynucleotide
taatacgactcactatagggttctatacctcctaaatgataatgataagcaacagaggagagcttatatgtatcatttaaacctggcggcagcgcaaaagatg

SEQ ID NO: 23664 - DNA, 103 bp, Artificial Sequence
  Synthetic Polynucleotide
taatacgactcactatagggagtccttctatacctcctaaatgataatgaaacagaggagatcattaatgtttaggaggaacctggcggcagcgcaaaagatg

SEQ ID NO: 23665 - DNA, 103 bp, Artificial Sequence
  Synthetic Polynucleotide
taatacgactcactatagggtagacctggcttggactgtcacttctacagaacagaggagactgtagatgtgacagtccaacctggcggcagcgcaaaagatg

SEQ ID NO: 23666 - DNA, 103 bp, Artificial Sequence
  Synthetic Polynucleotide
taatacgactcactataggggttgtagtccttctatacctcctaaatgataacagaggagaatcattatggaggtatagaacctggcggcagcgcaaaagatg

SEQ ID NO: 23667 - DNA, 103 bp, Artificial Sequence
  Synthetic Polynucleotide
taatacgactcactatagggtttctgttgtagtccttctatacctcctaaaacagaggagattaggaatgatagaaggaaacctggcggcagcgcaaaagatg

SEQ ID NO: 23668 - DNA, 103 bp, Artificial Sequence
  Synthetic Polynucleotide
taatacgactcactatagggcacaatttctgttgtagtccttctatacctaacagaggagaaggtatatgaggactacaaacctggcggcagcgcaaaagatg

SEQ ID NO: 23669 - DNA, 103 bp, Artificial Sequence
  Synthetic Polynucleotide
taatacgactcactatagggatgtccacaatttctgttgtagtccttctaaacagaggagatagaagatgtacaacagaaacctggcggcagcgcaaaagatg

SEQ ID NO: 23670 - DNA, 103 bp, Artificial Sequence
  Synthetic Polynucleotide
taatacgactcactatagggtatacatgtccacaatttctgttgtagtccaacagaggagaggactaatgcagaaattgaacctggcggcagcgcaaaagatg

SEQ ID NO: 23671 - DNA, 103 bp, Artificial Sequence
  Synthetic Polynucleotide
taatacgactcactatagggcatgatatacatgtccacaatttctgttgtaacagaggagaacaacaatgattgtggacaacctggcggcagcgcaaaagatg

SEQ ID NO: 23672 - DNA, 103 bp, Artificial Sequence
  Synthetic Polynucleotide
taatacgactcactataggggagcacatgatatacatgtccacaatttctaacagaggagaagaaatatgggacatgtaaacctggcggcagcgcaaaagatg

SEQ ID NO: 23673 - DNA, 103 bp, Artificial Sequence
  Synthetic Polynucleotide
taatacgactcactataggggatttgagcacatgatatacatgtccacaaaacagaggagattgtggatgtgtatatcaaacctggcggcagcgcaaaagatg

SEQ ID NO: 23674 - DNA, 103 bp, Artificial Sequence
  Synthetic Polynucleotide
taatacgactcactatagggagcgtgatttgagcacatgatatacatgtcaacagaggagagacatgatgatcatgtgcaacctggcggcagcgcaaaagatg

SEQ ID NO: 23675 - DNA, 103 bp, Artificial Sequence
  Synthetic Polynucleotide
taatacgactcactatagggctacaagcgtgatttgagcacatgatatacaacagaggagagtatatatggtgctcaaaaacctggcggcagcgcaaaagatg

SEQ ID NO: 23676 - DNA, 103 bp, Artificial Sequence
  Synthetic Polynucleotide
taatacgactcactatagggatttatagacctggcttggactgtcacttcaacagaggagagaagtgatggtccaagccaacctggcggcagcgcaaaagatg

SEQ ID NO: 23677 - DNA, 103 bp, Artificial Sequence
  Synthetic Polynucleotide
taatacgactcactatagggcagttctacaagcgtgatttgagcacatgaaacagaggagatcatgtatgcaaatcacgaacctggcggcagcgcaaaagatg

SEQ ID NO: 23678 - DNA, 103 bp, Artificial Sequence
  Synthetic Polynucleotide
taatacgactcactataggggttttcagttctacaagcgtgatttgagcaaacagaggagatgctcaatgcacgcttgtaacctggcggcagcgcaaaagatg

SEQ ID NO: 23679 - DNA, 103 bp, Artificial Sequence
  Synthetic Polynucleotide
taatacgactcactatagggacttagttttcagttctacaagcgtgatttaacagaggagaaaatcaatgttgtagaacaacctggcggcagcgcaaaagatg

SEQ ID NO: 23680 - DNA, 103 bp, Artificial Sequence
  Synthetic Polynucleotide
taatacgactcactatagggttttaacttagttttcagttctacaagcgtaacagaggagaacgcttatggaactgaaaaacctggcggcagcgcaaaagatg

SEQ ID NO: 23681 - DNA, 103 bp, Artificial Sequence
  Synthetic Polynucleotide
taatacgactcactatagggttcaattttaacttagttttcagttctacaaacagaggagatgtagaatggaaaactaaaacctggcggcagcgcaaaagatg

SEQ ID NO: 23682 - DNA, 103 bp, Artificial Sequence
  Synthetic Polynucleotide
taatacgactcactatagggtggatttcaattttaacttagttttcagttaacagaggagaaactgaatgctaagttaaaacctggcggcagcgcaaaagatg

SEQ ID NO: 23683 - DNA, 103 bp, Artificial Sequence
  Synthetic Polynucleotide
taatacgactcactataggggacactggatttcaattttaacttagttttaacagaggagaaaaactatgttaaaattgaacctggcggcagcgcaaaagatg

SEQ ID NO: 23684 - DNA, 103 bp, Artificial Sequence
  Synthetic Polynucleotide
taatacgactcactatagggcccatgacactggatttcaattttaacttaaacagaggagataagttatgattgaaatcaacctggcggcagcgcaaaagatg

SEQ ID NO: 23685 - DNA, 103 bp, Artificial Sequence
  Synthetic Polynucleotide
taatacgactcactatagggtatcacccatgacactggatttcaattttaaacagaggagataaaatatgaatccagtgaacctggcggcagcgcaaaagatg

SEQ ID NO: 23686 - DNA, 103 bp, Artificial Sequence
  Synthetic Polynucleotide
taatacgactcactatagggttgattatcacccatgacactggatttcaaaacagaggagattgaaaatgagtgtcatgaacctggcggcagcgcaaaagatg

SEQ ID NO: 23687 - DNA, 103 bp, Artificial Sequence
  Synthetic Polynucleotide
taatacgactcactatagggggtcgatttatagacctggcttggactgtcaacagaggagagacagtatgagccaggtcaacctggcggcagcgcaaaagatg

SEQ ID NO: 23688 - DNA, 103 bp, Artificial Sequence
  Synthetic Polynucleotide
taatacgactcactatagggatacattgattatcacccatgacactggataacagaggagaatccagatgcatgggtgaaacctggcggcagcgcaaaagatg

SEQ ID NO: 23689 - DNA, 103 bp, Artificial Sequence
  Synthetic Polynucleotide
taatacgactcactatagggttgttatacattgattatcacccatgacacaacagaggagagtgtcaatggtgataatcaacctggcggcagcgcaaaagatg

SEQ ID NO: 23690 - DNA, 103 bp, Artificial Sequence
  Synthetic Polynucleotide
taatacgactcactatagggtagagttgttatacattgattatcacccataacagaggagaatgggtatgaatcaatgtaacctggcggcagcgcaaaagatg

SEQ ID NO: 23691 - DNA, 103 bp, Artificial Sequence
  Synthetic Polynucleotide
taatacgactcactatagggagacttagagttgttatacattgattatcaaacagaggagatgataaatgatgtataacaacctggcggcagcgcaaaagatg

SEQ ID NO: 23692 - DNA, 103 bp, Artificial Sequence
  Synthetic Polynucleotide
taatacgactcactatagggggaaaagacttagagttgttatacattgataacagaggagaatcaatatgtaacaactcaacctggcggcagcgcaaaagatg

SEQ ID NO: 23693 - DNA, 103 bp, Artificial Sequence
  Synthetic Polynucleotide
taatacgactcactatagggaatagggaaaagacttagagttgttatacaaacagaggagatgtataatgactctaagtaacctggcggcagcgcaaaagatg

SEQ ID NO: 23694 - DNA, 103 bp, Artificial Sequence
  Synthetic Polynucleotide
taatacgactcactataggggcatcaatagggaaaagacttagagttgttaacagaggagaaacaacatgaagtcttttaacctggcggcagcgcaaaagatg

SEQ ID NO: 23695 - DNA, 103 bp, Artificial Sequence
  Synthetic Polynucleotide
taatacgactcactatagggtgggagcatcaatagggaaaagacttagagaacagaggagactctaaatgttttccctaaacctggcggcagcgcaaaagatg

SEQ ID NO: 23696 - DNA, 103 bp, Artificial Sequence
  Synthetic Polynucleotide
taatacgactcactatagggatcattgggagcatcaatagggaaaagactaacagaggagaagtcttatgcctattgataacctggcggcagcgcaaaagatg

SEQ ID NO: 23697 - DNA, 103 bp, Artificial Sequence
  Synthetic Polynucleotide
taatacgactcactatagggtgataatcattgggagcatcaatagggaaaaacagaggagatttcccatgtgatgctccaacctggcggcagcgcaaaagatg

SEQ ID NO: 23698 - DNA, 103 bp, Artificial Sequence
  Synthetic Polynucleotide
taatacgactcactatagggctgttggtcgatttatagacctggcttggaaacagaggagatccaagatgggtctataaaacctggcggcagcgcaaaagatg

SEQ ID NO: 23699 - DNA, 103 bp, Artificial Sequence
  Synthetic Polynucleotide
taatacgactcactatagggtttcttgataatcattgggagcatcaatagaacagaggagactattgatgctcccaatgaacctggcggcagcgcaaaagatg

SEQ ID NO: 23700 - DNA, 103 bp, Artificial Sequence
  Synthetic Polynucleotide
taatacgactcactatagggctcattttcttgataatcattgggagcatcaacagaggagagatgctatgaatgattataacctggcggcagcgcaaaagatg

SEQ ID NO: 23701 - DNA, 103 bp, Artificial Sequence
  Synthetic Polynucleotide
taatacgactcactatagggtctgcctcattttcttgataatcattgggaaacagaggagatcccaaatgttatcaagaaacctggcggcagcgcaaaagatg

SEQ ID NO: 23702 - DNA, 103 bp, Artificial Sequence
  Synthetic Polynucleotide
taatacgactcactatagggttaattctgcctcattttcttgataatcataacagaggagaatgattatgaagaaaatgaacctggcggcagcgcaaaagatg

SEQ ID NO: 23703 - DNA, 103 bp, Artificial Sequence
  Synthetic Polynucleotide
taatacgactcactatagggagcatttaattctgcctcattttcttgataaacagaggagatatcaaatgaatgaggcaaacctggcggcagcgcaaaagatg

SEQ ID NO: 23704 - DNA, 103 bp, Artificial Sequence
  Synthetic Polynucleotide
taatacgactcactatagggcgtgcagcatttaattctgcctcattttctaacagaggagaagaaaaatgggcagaattaacctggcggcagcgcaaaagatg

SEQ ID NO: 23705 - DNA, 103 bp, Artificial Sequence
  Synthetic Polynucleotide
taatacgactcactatagggcaactcgtgcagcatttaattctgcctcataacagaggagaatgaggatgaattaaatgaacctggcggcagcgcaaaagatg

SEQ ID NO: 23706 - DNA, 103 bp, Artificial Sequence
  Synthetic Polynucleotide
taatacgactcactatagggaacagcaactcgtgcagcatttaattctgcaacagaggagagcagaaatgaatgctgcaaacctggcggcagcgcaaaagatg

SEQ ID NO: 23707 - DNA, 103 bp, Artificial Sequence
  Synthetic Polynucleotide
taatacgactcactatagggaattcaacagcaactcgtgcagcatttaataacagaggagaattaaaatgtgcacgagtaacctggcggcagcgcaaaagatg

SEQ ID NO: 23708 - DNA, 103 bp, Artificial Sequence
  Synthetic Polynucleotide
taatacgactcactatagggtagctaattcaacagcaactcgtgcagcataacagaggagaatgctgatggagttgctgaacctggcggcagcgcaaaagatg

SEQ ID NO: 23709 - DNA, 103 bp, Artificial Sequence
  Synthetic Polynucleotide
taatacgactcactatagggcagggctgttggtcgatttatagacctggcaacagaggagagccaggatgataaatcgaaacctggcggcagcgcaaaagatg

SEQ ID NO: 23710 - DNA, 103 bp, Artificial Sequence
  Synthetic Polynucleotide
taatacgactcactatagggagtaatagctaattcaacagcaactcgtgcaacagaggagagcacgaatggctgttgaaaacctggcggcagcgcaaaagatg

SEQ ID NO: 23711 - DNA, 103 bp, Artificial Sequence
  Synthetic Polynucleotide
taatacgactcactatagggcctgtagtaatagctaattcaacagcaactaacagaggagaagttgcatgtgaattagcaacctggcggcagcgcaaaagatg

SEQ ID NO: 23712 - DNA, 103 bp, Artificial Sequence
  Synthetic Polynucleotide
taatacgactcactatagggtatagcctgtagtaatagctaattcaacagaacagaggagactgttgatgtagctattaaacctggcggcagcgcaaaagatg

SEQ ID NO: 23713 - DNA, 103 bp, Artificial Sequence
  Synthetic Polynucleotide
taatacgactcactatagggcccactatagcctgtagtaatagctaattcaacagaggagagaattaatgattactacaaacctggcggcagcgcaaaagatg

SEQ ID NO: 23714 - DNA, 103 bp, Artificial Sequence
  Synthetic Polynucleotide
taatacgactcactatagggaatatcccactatagcctgtagtaatagctaacagaggagaagctatatgtacaggctaaacctggcggcagcgcaaaagatg

SEQ ID NO: 23715 - DNA, 103 bp, Artificial Sequence
  Synthetic Polynucleotide
taatacgactcactatagggttaagaatatcccactatagcctgtagtaaaacagaggagattactaatggctatagtgaacctggcggcagcgcaaaagatg

SEQ ID NO: 23716 - DNA, 103 bp, Artificial Sequence
  Synthetic Polynucleotide
taatacgactcactatagggaggttttaagaatatcccactatagcctgtaacagaggagaacaggcatgagtgggataaacctggcggcagcgcaaaagatg

SEQ ID NO: 23717 - DNA, 103 bp, Artificial Sequence
  Synthetic Polynucleotide
taatacgactcactatagggtcttcaggttttaagaatatcccactatagaacagaggagactatagatggatattcttaacctggcggcagcgcaaaagatg

SEQ ID NO: 23718 - DNA, 103 bp, Artificial Sequence
  Synthetic Polynucleotide
taatacgactcactatagggatgtctcttcaggttttaagaatatcccacaacagaggagagtgggaatgtcttaaaacaacctggcggcagcgcaaaagatg

SEQ ID NO: 23719 - DNA, 103 bp, Artificial Sequence
  Synthetic Polynucleotide
taatacgactcactatagggcacaaatgtctcttcaggttttaagaatataacagaggagaatattcatgaaacctgaaaacctggcggcagcgcaaaagatg

SEQ ID NO: 23720 - DNA, 103 bp, Artificial Sequence
  Synthetic Polynucleotide
taatacgactcactataggggggggcagggctgttggtcgatttatagacaacagaggagagtctatatgtcgaccaacaacctggcggcagcgcaaaagatg

SEQ ID NO: 23721 - DNA, 103 bp, Artificial Sequence
  Synthetic Polynucleotide
taatacgactcactataggggaatgcacaaatgtctcttcaggttttaagaacagaggagacttaaaatgtgaagagacaacctggcggcagcgcaaaagatg

SEQ ID NO: 23722 - DNA, 103 bp, Artificial Sequence
  Synthetic Polynucleotide
taatacgactcactatagggaccctgaatgcacaaatgtctcttcaggttaacagaggagaaacctgatgagacatttgaacctggcggcagcgcaaaagatg

SEQ ID NO: 23723 - DNA, 103 bp, Artificial Sequence
  Synthetic Polynucleotide
taatacgactcactatagggaataaaccctgaatgcacaaatgtctcttcaacagaggagagaagagatgtttgtgcataacctggcggcagcgcaaaagatg

SEQ ID NO: 23724 - DNA, 103 bp, Artificial Sequence
  Synthetic Polynucleotide
taatacgactcactatagggaagtaaataaaccctgaatgcacaaatgtcaacagaggagagacattatggcattcaggaacctggcggcagcgcaaaagatg

SEQ ID NO: 23725 - DNA, 103 bp, Artificial Sequence
  Synthetic Polynucleotide
taatacgactcactatagggtaccaaagtaaataaaccctgaatgcacaaaacagaggagattgtgcatgcagggtttaaacctggcggcagcgcaaaagatg

SEQ ID NO: 23726 - DNA, 103 bp, Artificial Sequence
  Synthetic Polynucleotide
taatacgactcactatagggctttttaccaaagtaaataaaccctgaatgaacagaggagacattcaatgtttatttacaacctggcggcagcgcaaaagatg

SEQ ID NO: 23727 - DNA, 103 bp, Artificial Sequence
  Synthetic Polynucleotide
taatacgactcactatagggtattgctttttaccaaagtaaataaaccctaacagaggagaagggttatgttactttggaacctggcggcagcgcaaaagatg

SEQ ID NO: 23728 - DNA, 103 bp, Artificial Sequence
  Synthetic Polynucleotide
taatacgactcactatagggttaggtattgctttttaccaaagtaaataaaacagaggagattatttatgttggtaaaaaacctggcggcagcgcaaaagatg

SEQ ID NO: 23729 - DNA, 103 bp, Artificial Sequence
  Synthetic Polynucleotide
taatacgactcactatagggaccatttaggtattgctttttaccaaagtaaacagaggagatactttatgaaaaagcaaaacctggcggcagcgcaaaagatg

SEQ ID NO: 23730 - DNA, 103 bp, Artificial Sequence
  Synthetic Polynucleotide
taatacgactcactatagggtgaacaccatttaggtattgctttttaccaaacagaggagatggtaaatggcaatacctaacctggcggcagcgcaaaagatg

SEQ ID NO: 23731 - DNA, 103 bp, Artificial Sequence
  Synthetic Polynucleotide
taatacgactcactatagggctggggggggcagggctgttggtcgatttaaacagaggagataaatcatgcaacagcccaacctggcggcagcgcaaaagatg

SEQ ID NO: 23732 - DNA, 103 bp, Artificial Sequence
  Synthetic Polynucleotide
taatacgactcactataggggtaattgaacaccatttaggtattgcttttaacagaggagaaaaagcatgacctaaatgaacctggcggcagcgcaaaagatg

SEQ ID NO: 23733 - DNA, 103 bp, Artificial Sequence
  Synthetic Polynucleotide
taatacgactcactatagggttgtggtaattgaacaccatttaggtattgaacagaggagacaatacatgaatggtgttaacctggcggcagcgcaaaagatg

SEQ ID NO: 23734 - DNA, 103 bp, Artificial Sequence
  Synthetic Polynucleotide
taatacgactcactatagggaatgattgtggtaattgaacaccatttaggaacagaggagacctaaaatgtgttcaattaacctggcggcagcgcaaaagatg

SEQ ID NO: 23735 - DNA, 103 bp, Artificial Sequence
  Synthetic Polynucleotide
taatacgactcactatagggtcttcaatgattgtggtaattgaacaccataacagaggagaatggtgatgaattaccacaacctggcggcagcgcaaaagatg

SEQ ID NO: 23736 - DNA, 103 bp, Artificial Sequence
  Synthetic Polynucleotide
taatacgactcactatagggcattgtcttcaatgattgtggtaattgaacaacagaggagagttcaaatgccacaatcaaacctggcggcagcgcaaaagatg

SEQ ID NO: 23737 - DNA, 103 bp, Artificial Sequence
  Synthetic Polynucleotide
taatacgactcactatagggcttgccattgtcttcaatgattgtggtaataacagaggagaattaccatgatcattgaaaacctggcggcagcgcaaaagatg

SEQ ID NO: 23738 - DNA, 103 bp, Artificial Sequence
  Synthetic Polynucleotide
taatacgactcactatagggcacaccttgccattgtcttcaatgattgtgaacagaggagacacaatatgtgaagacaaaacctggcggcagcgcaaaagatg

SEQ ID NO: 23739 - DNA, 103 bp, Artificial Sequence
  Synthetic Polynucleotide
taatacgactcactatagggaggtccacaccttgccattgtcttcaatgaaacagaggagatcattgatgacaatggcaaacctggcggcagcgcaaaagatg

SEQ ID NO: 23740 - DNA, 103 bp, Artificial Sequence
  Synthetic Polynucleotide
taatacgactcactataggggataaaggtccacaccttgccattgtcttcaacagaggagagaagacatgggcaaggtgaacctggcggcagcgcaaaagatg

SEQ ID NO: 23741 - DNA, 103 bp, Artificial Sequence
  Synthetic Polynucleotide
taatacgactcactatagggaatctgataaaggtccacaccttgccattgaacagaggagacaatggatgggtgtggacaacctggcggcagcgcaaaagatg

SEQ ID NO: 23742 - DNA, 103 bp, Artificial Sequence
  Synthetic Polynucleotide
taatacgactcactataggggtcgactggggggggcagggctgttggtcgaacagaggagacgaccaatggccctgcccaacctggcggcagcgcaaaagatg

SEQ ID NO: 23743 - DNA, 103 bp, Artificial Sequence
  Synthetic Polynucleotide
taatacgactcactatagggaatggaatctgataaaggtccacaccttgcaacagaggagagcaaggatgggacctttaaacctggcggcagcgcaaaagatg

SEQ ID NO: 23744 - DNA, 103 bp, Artificial Sequence
  Synthetic Polynucleotide
taatacgactcactatagggtcgaaaatggaatctgataaaggtccacacaacagaggagagtgtggatgtttatcagaaacctggcggcagcgcaaaagatg

SEQ ID NO: 23745 - DNA, 103 bp, Artificial Sequence
  Synthetic Polynucleotide
taatacgactcactataggggatcgtcgaaaatggaatctgataaaggtcaacagaggagagaccttatgcagattccaaacctggcggcagcgcaaaagatg

SEQ ID NO: 23746 - DNA, 103 bp, Artificial Sequence
  Synthetic Polynucleotide
taatacgactcactatagggttgaagatcgtcgaaaatggaatctgataaaacagaggagattatcaatgtccattttcaacctggcggcagcgcaaaagatg

SEQ ID NO: 23747 - DNA, 103 bp, Artificial Sequence
  Synthetic Polynucleotide
taatacgactcactataggggaaccttgaagatcgtcgaaaatggaatctaacagaggagaagattcatgtttcgacgaaacctggcggcagcgcaaaagatg

SEQ ID NO: 23748 - DNA, 103 bp, Artificial Sequence
  Synthetic Polynucleotide
taatacgactcactatagggctagtgaaccttgaagatcgtcgaaaatggaacagaggagaccatttatgacgatcttcaacctggcggcagcgcaaaagatg

SEQ ID NO: 23749 - DNA, 103 bp, Artificial Sequence
  Synthetic Polynucleotide
taatacgactcactatagggactggctagtgaaccttgaagatcgtcgaaaacagaggagattcgacatgcttcaaggtaacctggcggcagcgcaaaagatg

SEQ ID NO: 23750 - DNA, 103 bp, Artificial Sequence
  Synthetic Polynucleotide
taatacgactcactatagggccaatactggctagtgaaccttgaagatcgaacagaggagacgatctatgaggttcactaacctggcggcagcgcaaaagatg

SEQ ID NO: 23751 - DNA, 103 bp, Artificial Sequence
  Synthetic Polynucleotide
taatacgactcactatagggatgtgccaatactggctagtgaaccttgaaaacagaggagattcaagatgcactagccaaacctggcggcagcgcaaaagatg

SEQ ID NO: 23752 - DNA, 103 bp, Artificial Sequence
  Synthetic Polynucleotide
taatacgactcactatagggaaatgatgtgccaatactggctagtgaaccaacagaggagaggttcaatggccagtattaacctggcggcagcgcaaaagatg

SEQ ID NO: 23753 - DNA, 103 bp, Artificial Sequence
  Synthetic Polynucleotide
taatacgactcactatagggttattacgaacatgaggggctgtgggttttaacagaggagaaaaaccatgagcccctcaaacctggcggcagcgcaaaagatg

SEQ ID NO: 23754 - DNA, 103 bp, Artificial Sequence
  Synthetic Polynucleotide
taatacgactcactatagggttgttgtcgactggggggggcagggctgttaacagaggagaaacagcatggccccccccaacctggcggcagcgcaaaagatg

SEQ ID NO: 23755 - DNA, 103 bp, Artificial Sequence
  Synthetic Polynucleotide
taatacgactcactatagggctctcaaatgatgtgccaatactggctagtaacagaggagaactagcatgtattggcacaacctggcggcagcgcaaaagatg

SEQ ID NO: 23756 - DNA, 103 bp, Artificial Sequence
  Synthetic Polynucleotide
taatacgactcactatagggcccctctctcaaatgatgtgccaatactggaacagaggagaccagtaatggcacatcataacctggcggcagcgcaaaagatg

SEQ ID NO: 23757 - DNA, 103 bp, Artificial Sequence
  Synthetic Polynucleotide
taatacgactcactataggggcttgcccctctctcaaatgatgtgccaataacagaggagaattggcatgtcatttgagaacctggcggcagcgcaaaagatg

SEQ ID NO: 23758 - DNA, 103 bp, Artificial Sequence
  Synthetic Polynucleotide
taatacgactcactataggggtctcgcttgcccctctctcaaatgatgtgaacagaggagacacatcatgtgagagaggaacctggcggcagcgcaaaagatg

SEQ ID NO: 23759 - DNA, 103 bp, Artificial Sequence
  Synthetic Polynucleotide
taatacgactcactataggggccgtgtctcgcttgcccctctctcaaatgaacagaggagacatttgatggaggggcaaaacctggcggcagcgcaaaagatg

SEQ ID NO: 23760 - DNA, 103 bp, Artificial Sequence
  Synthetic Polynucleotide
taatacgactcactatagggaatatgccgtgtctcgcttgcccctctctcaacagaggagagagagaatggcaagcgagaacctggcggcagcgcaaaagatg

SEQ ID NO: 23761 - DNA, 103 bp, Artificial Sequence
  Synthetic Polynucleotide
taatacgactcactatagggggaaaaatatgccgtgtctcgcttgcccctaacagaggagaaggggcatgcgagacacgaacctggcggcagcgcaaaagatg

SEQ ID NO: 23762 - DNA, 103 bp, Artificial Sequence
  Synthetic Polynucleotide
taatacgactcactataggggacttggaaaaatatgccgtgtctcgcttgaacagaggagacaagcgatgcacggcataaacctggcggcagcgcaaaagatg

SEQ ID NO: 23763 - DNA, 103 bp, Artificial Sequence
  Synthetic Polynucleotide
taatacgactcactatagggccaacgacttggaaaaatatgccgtgtctcaacagaggagagagacaatgcatatttttaacctggcggcagcgcaaaagatg

SEQ ID NO: 23764 - DNA, 103 bp, Artificial Sequence
  Synthetic Polynucleotide
taatacgactcactataggggctatccaacgacttggaaaaatatgccgtaacagaggagaacggcaatgttttccaagaacctggcggcagcgcaaaagatg

SEQ ID NO: 23765 - DNA, 103 bp, Artificial Sequence
  Synthetic Polynucleotide
taatacgactcactatagggcaattttgttgtcgactggggggggcagggaacagaggagaccctgcatgccccagtcgaacctggcggcagcgcaaaagatg

SEQ ID NO: 23766 - DNA, 103 bp, Artificial Sequence
  Synthetic Polynucleotide
taatacgactcactatagggatgcagctatccaacgacttggaaaaatataacagaggagaatatttatgcaagtcgttaacctggcggcagcgcaaaagatg

SEQ ID NO: 23767 - DNA, 103 bp, Artificial Sequence
  Synthetic Polynucleotide
taatacgactcactatagggatgaaatgcagctatccaacgacttggaaaaacagaggagatttccaatgcgttggataaacctggcggcagcgcaaaagatg

SEQ ID NO: 23768 - DNA, 103 bp, Artificial Sequence
  Synthetic Polynucleotide
taatacgactcactatagggatggaatgaaatgcagctatccaacgacttaacagaggagaaagtcgatggatagctgcaacctggcggcagcgcaaaagatg

SEQ ID NO: 23769 - DNA, 103 bp, Artificial Sequence
  Synthetic Polynucleotide
taatacgactcactatagggctaacatggaatgaaatgcagctatccaacaacagaggagagttggaatgctgcatttcaacctggcggcagcgcaaaagatg

SEQ ID NO: 23770 - DNA, 103 bp, Artificial Sequence
  Synthetic Polynucleotide
taatacgactcactatagggtacggctaacatggaatgaaatgcagctataacagaggagaatagctatgtttcattccaacctggcggcagcgcaaaagatg

SEQ ID NO: 23771 - DNA, 103 bp, Artificial Sequence
  Synthetic Polynucleotide
taatacgactcactatagggaaatttacggctaacatggaatgaaatgcaaacagaggagatgcattatgttccatgttaacctggcggcagcgcaaaagatg

SEQ ID NO: 23772 - DNA, 103 bp, Artificial Sequence
  Synthetic Polynucleotide
taatacgactcactatagggttaacaaatttacggctaacatggaatgaaaacagaggagattcattatgtgttagccgaacctggcggcagcgcaaaagatg

SEQ ID NO: 23773 - DNA, 103 bp, Artificial Sequence
  Synthetic Polynucleotide
taatacgactcactatagggctgatttaacaaatttacggctaacatggaaacagaggagatccatgatggccgtaaataacctggcggcagcgcaaaagatg

SEQ ID NO: 23774 - DNA, 103 bp, Artificial Sequence
  Synthetic Polynucleotide
taatacgactcactatagggtgattctgatttaacaaatttacggctaacaacagaggagagttagcatgaaatttgttaacctggcggcagcgcaaaagatg

SEQ ID NO: 23775 - DNA, 103 bp, Artificial Sequence
  Synthetic Polynucleotide
taatacgactcactatagggcgaggtgattctgatttaacaaatttacggaacagaggagaccgtaaatgtgttaaatcaacctggcggcagcgcaaaagatg

SEQ ID NO: 23776 - DNA, 103 bp, Artificial Sequence
  Synthetic Polynucleotide
taatacgactcactatagggatgctcaattttgttgtcgactggggggggaacagaggagaccccccatggtcgacaacaacctggcggcagcgcaaaagatg

SEQ ID NO: 23777 - DNA, 103 bp, Artificial Sequence
  Synthetic Polynucleotide
taatacgactcactatagggaaatccgaggtgattctgatttaacaaattaacagaggagaaatttgatgaatcagaataacctggcggcagcgcaaaagatg

SEQ ID NO: 23778 - DNA, 103 bp, Artificial Sequence
  Synthetic Polynucleotide
taatacgactcactatagggaggggaaatccgaggtgattctgatttaacaacagaggagagttaaaatggaatcacctaacctggcggcagcgcaaaagatg

SEQ ID NO: 23779 - DNA, 103 bp, Artificial Sequence
  Synthetic Polynucleotide
taatacgactcactatagggatcctaggggaaatccgaggtgattctgataacagaggagaatcagaatgacctcggataacctggcggcagcgcaaaagatg

SEQ ID NO: 23780 - DNA, 103 bp, Artificial Sequence
  Synthetic Polynucleotide
taatacgactcactatagggactaaatcctaggggaaatccgaggtgattaacagaggagaaatcacatgggatttcccaacctggcggcagcgcaaaagatg

SEQ ID NO: 23781 - DNA, 103 bp, Artificial Sequence
  Synthetic Polynucleotide
taatacgactcactatagggtcaatactaaatcctaggggaaatccgaggaacagaggagacctcggatgtcccctaggaacctggcggcagcgcaaaagatg

SEQ ID NO: 23782 - DNA, 103 bp, Artificial Sequence
  Synthetic Polynucleotide
taatacgactcactatagggatacatcaatactaaatcctaggggaaatcaacagaggagagatttcatgtaggatttaaacctggcggcagcgcaaaagatg

SEQ ID NO: 23783 - DNA, 103 bp, Artificial Sequence
  Synthetic Polynucleotide
taatacgactcactatagggacaggatacatcaatactaaatcctaggggaacagaggagacccctaatgtttagtattaacctggcggcagcgcaaaagatg

SEQ ID NO: 23784 - DNA, 103 bp, Artificial Sequence
  Synthetic Polynucleotide
taatacgactcactatagggttaaaacaggatacatcaatactaaatcctaacagaggagaaggattatgtattgatgtaacctggcggcagcgcaaaagatg

SEQ ID NO: 23785 - DNA, 103 bp, Artificial Sequence
  Synthetic Polynucleotide
taatacgactcactataggggctttttaaaacaggatacatcaatactaaaacagaggagattagtaatgatgtatcctaacctggcggcagcgcaaaagatg

SEQ ID NO: 23786 - DNA, 103 bp, Artificial Sequence
  Synthetic Polynucleotide
taatacgactcactatagggaagaggctttttaaaacaggatacatcaataacagaggagaattgatatgtcctgttttaacctggcggcagcgcaaaagatg

SEQ ID NO: 23787 - DNA, 103 bp, Artificial Sequence
  Synthetic Polynucleotide
taatacgactcactataggggtttcatgctcaattttgttgtcgactgggaacagaggagacccagtatgcaacaaaataacctggcggcagcgcaaaagatg

SEQ ID NO: 23788 - DNA, 103 bp, Artificial Sequence
  Synthetic Polynucleotide
taatacgactcactatagggaaagtaagaggctttttaaaacaggatacaaacagaggagatgtatcatgttttaaaaaaacctggcggcagcgcaaaagatg

SEQ ID NO: 23789 - DNA, 103 bp, Artificial Sequence
  Synthetic Polynucleotide
taatacgactcactatagggccgagaaagtaagaggctttttaaaacaggaacagaggagacctgttatgaaaagcctcaacctggcggcagcgcaaaagatg

SEQ ID NO: 23790 - DNA, 103 bp, Artificial Sequence
  Synthetic Polynucleotide
taatacgactcactatagggtttctccgagaaagtaagaggctttttaaaaacagaggagatttaaaatgcctcttactaacctggcggcagcgcaaaagatg

SEQ ID NO: 23791 - DNA, 103 bp, Artificial Sequence
  Synthetic Polynucleotide
taatacgactcactatagggattaatttctccgagaaagtaagaggctttaacagaggagaaaagccatgtactttctcaacctggcggcagcgcaaaagatg

SEQ ID NO: 23792 - DNA, 103 bp, Artificial Sequence
  Synthetic Polynucleotide
taatacgactcactatagggaagcaattaatttctccgagaaagtaagagaacagaggagactcttaatgtctcggagaaacctggcggcagcgcaaaagatg

SEQ ID NO: 23793 - DNA, 103 bp, Artificial Sequence
  Synthetic Polynucleotide
taatacgactcactataggggatcaaagcaattaatttctccgagaaagtaacagaggagaactttcatggagaaattaaacctggcggcagcgcaaaagatg

SEQ ID NO: 23794 - DNA, 103 bp, Artificial Sequence
  Synthetic Polynucleotide
taatacgactcactatagggggtgtgatcaaagcaattaatttctccgagaacagaggagactcggaatgattaattgcaacctggcggcagcgcaaaagatg

SEQ ID NO: 23795 - DNA, 103 bp, Artificial Sequence
  Synthetic Polynucleotide
taatacgactcactatagggcttgaggtgtgatcaaagcaattaatttctaacagaggagaagaaatatgttgctttgaaacctggcggcagcgcaaaagatg

SEQ ID NO: 23796 - DNA, 103 bp, Artificial Sequence
  Synthetic Polynucleotide
taatacgactcactatagggtagcacttgaggtgtgatcaaagcaattaaaacagaggagattaattatgttgatcacaaacctggcggcagcgcaaaagatg

SEQ ID NO: 23797 - DNA, 103 bp, Artificial Sequence
  Synthetic Polynucleotide
taatacgactcactatagggccccctagcacttgaggtgtgatcaaagcaaacagaggagatgctttatgcacacctcaaacctggcggcagcgcaaaagatg

SEQ ID NO: 23798 - DNA, 103 bp, Artificial Sequence
  Synthetic Polynucleotide
taatacgactcactatagggcttcagtttcatgctcaattttgttgtcgaaacagaggagatcgacaatgaaattgagcaacctggcggcagcgcaaaagatg

SEQ ID NO: 23799 - DNA, 103 bp, Artificial Sequence
  Synthetic Polynucleotide
taatacgactcactatagggataatccccctagcacttgaggtgtgatcaaacagaggagatgatcaatgctcaagtgcaacctggcggcagcgcaaaagatg

SEQ ID NO: 23800 - DNA, 103 bp, Artificial Sequence
  Synthetic Polynucleotide
taatacgactcactataggggaaagataatccccctagcacttgaggtgtaacagaggagaacacctatggtgctagggaacctggcggcagcgcaaaagatg

SEQ ID NO: 23801 - DNA, 103 bp, Artificial Sequence
  Synthetic Polynucleotide
taatacgactcactatagggtttaagaaagataatccccctagcacttgaaacagaggagatcaagtatgagggggattaacctggcggcagcgcaaaagatg

SEQ ID NO: 23802 - DNA, 103 bp, Artificial Sequence
  Synthetic Polynucleotide
taatacgactcactatagggccgggtttaagaaagataatccccctagcaaacagaggagatgctagatggattatcttaacctggcggcagcgcaaaagatg

SEQ ID NO: 23803 - DNA, 103 bp, Artificial Sequence
  Synthetic Polynucleotide
taatacgactcactatagggtttctccgggtttaagaaagataatcccccaacagaggagagggggaatgtctttcttaaacctggcggcagcgcaaaagatg

SEQ ID NO: 23804 - DNA, 103 bp, Artificial Sequence
  Synthetic Polynucleotide
taatacgactcactatagggaataatttctccgggtttaagaaagataataacagaggagaattatcatgcttaaacccaacctggcggcagcgcaaaagatg

SEQ ID NO: 23805 - DNA, 103 bp, Artificial Sequence
  Synthetic Polynucleotide
taatacgactcactataggggatagaataatttctccgggtttaagaaagaacagaggagactttctatgacccggagaaacctggcggcagcgcaaaagatg

SEQ ID NO: 23806 - DNA, 103 bp, Artificial Sequence
  Synthetic Polynucleotide
taatacgactcactataggggttccgatagaataatttctccgggtttaaaacagaggagattaaacatggagaaattaaacctggcggcagcgcaaaagatg

SEQ ID NO: 23807 - DNA, 103 bp, Artificial Sequence
  Synthetic Polynucleotide
taatacgactcactatagggctgatgttccgatagaataatttctccgggaacagaggagacccggaatgattattctaaacctggcggcagcgcaaaagatg

SEQ ID NO: 23808 - DNA, 103 bp, Artificial Sequence
  Synthetic Polynucleotide
taatacgactcactataggggatcactgatgttccgatagaataatttctaacagaggagaagaaatatgtctatcggaaacctggcggcagcgcaaaagatg

SEQ ID NO: 23809 - DNA, 103 bp, Artificial Sequence
  Synthetic Polynucleotide
taatacgactcactataggggtcctcttcagtttcatgctcaattttgttaacagaggagaaacaaaatggagcatgaaaacctggcggcagcgcaaaagatg

SEQ ID NO: 23810 - DNA, 103 bp, Artificial Sequence
  Synthetic Polynucleotide
taatacgactcactatagggaagaggatcactgatgttccgatagaataaaacagaggagattattcatgcggaacatcaacctggcggcagcgcaaaagatg

SEQ ID NO: 23811 - DNA, 103 bp, Artificial Sequence
  Synthetic Polynucleotide
taatacgactcactataggggaagtaagaggatcactgatgttccgatagaacagaggagactatcgatgcatcagtgaaacctggcggcagcgcaaaagatg

SEQ ID NO: 23812 - DNA, 103 bp, Artificial Sequence
  Synthetic Polynucleotide
taatacgactcactatagggaccctgaagtaagaggatcactgatgttccaacagaggagaggaacaatggtgatcctcaacctggcggcagcgcaaaagatg

SEQ ID NO: 23813 - DNA, 103 bp, Artificial Sequence
  Synthetic Polynucleotide
taatacgactcactatagggaaataaccctgaagtaagaggatcactgataacagaggagaatcagtatgcctcttactaacctggcggcagcgcaaaagatg

SEQ ID NO: 23814 - DNA, 103 bp, Artificial Sequence
  Synthetic Polynucleotide
taatacgactcactatagggagttgaaataaccctgaagtaagaggatcaaacagaggagatgatccatgtacttcaggaacctggcggcagcgcaaaagatg

SEQ ID NO: 23815 - DNA, 103 bp, Artificial Sequence
  Synthetic Polynucleotide
taatacgactcactatagggtcctgagttgaaataaccctgaagtaagagaacagaggagactcttaatgcagggttataacctggcggcagcgcaaaagatg

SEQ ID NO: 23816 - DNA, 103 bp, Artificial Sequence
  Synthetic Polynucleotide
taatacgactcactatagggtgcattcctgagttgaaataaccctgaagtaacagaggagaacttcaatgttatttcaaaacctggcggcagcgcaaaagatg

SEQ ID NO: 23817 - DNA, 103 bp, Artificial Sequence
  Synthetic Polynucleotide
taatacgactcactatagggtctaatgcattcctgagttgaaataaccctaacagaggagaagggttatgtcaactcagaacctggcggcagcgcaaaagatg

SEQ ID NO: 23818 - DNA, 103 bp, Artificial Sequence
  Synthetic Polynucleotide
taatacgactcactatagggggaactctaatgcattcctgagttgaaataaacagaggagatatttcatgtcaggaatgaacctggcggcagcgcaaaagatg

SEQ ID NO: 23819 - DNA, 103 bp, Artificial Sequence
  Synthetic Polynucleotide
taatacgactcactatagggtctaaggaactctaatgcattcctgagttgaacagaggagacaactcatgaatgcattaaacctggcggcagcgcaaaagatg

SEQ ID NO: 23820 - DNA, 103 bp, Artificial Sequence
  Synthetic Polynucleotide
taatacgactcactataggggagctgtcctcttcagtttcatgctcaattaacagaggagaaattgaatgtgaaactgaaacctggcggcagcgcaaaagatg

SEQ ID NO: 23821 - DNA, 103 bp, Artificial Sequence
  Synthetic Polynucleotide
taatacgactcactatagggtcctttctaaggaactctaatgcattcctgaacagaggagacaggaaatgattagagttaacctggcggcagcgcaaaagatg

SEQ ID NO: 23822 - DNA, 103 bp, Artificial Sequence
  Synthetic Polynucleotide
taatacgactcactatagggactcttcctttctaaggaactctaatgcataacagaggagaatgcatatgagttccttaaacctggcggcagcgcaaaagatg

SEQ ID NO: 23823 - DNA, 103 bp, Artificial Sequence
  Synthetic Polynucleotide
taatacgactcactataggggaacaactcttcctttctaaggaactctaaaacagaggagattagagatgcttagaaagaacctggcggcagcgcaaaagatg

SEQ ID NO: 23824 - DNA, 103 bp, Artificial Sequence
  Synthetic Polynucleotide
taatacgactcactatagggatgtagaacaactcttcctttctaaggaacaacagaggagagttcctatgaaaggaagaaacctggcggcagcgcaaaagatg

SEQ ID NO: 23825 - DNA, 103 bp, Artificial Sequence
  Synthetic Polynucleotide
taatacgactcactatagggtcaagatgtagaacaactcttcctttctaaaacagaggagattagaaatgaagagttgtaacctggcggcagcgcaaaagatg

SEQ ID NO: 23826 - DNA, 103 bp, Artificial Sequence
  Synthetic Polynucleotide
taatacgactcactatagggagcaatcaagatgtagaacaactcttccttaacagaggagaaaggaaatgttgttctacaacctggcggcagcgcaaaagatg

SEQ ID NO: 23827 - DNA, 103 bp, Artificial Sequence
  Synthetic Polynucleotide
taatacgactcactatagggtttttagcaatcaagatgtagaacaactctaacagaggagaagagttatgctacatcttaacctggcggcagcgcaaaagatg

SEQ ID NO: 23828 - DNA, 103 bp, Artificial Sequence
  Synthetic Polynucleotide
taatacgactcactatagggcgggttttttagcaatcaagatgtagaacaaacagaggagatgttctatgtcttgattgaacctggcggcagcgcaaaagatg

SEQ ID NO: 23829 - DNA, 103 bp, Artificial Sequence
  Synthetic Polynucleotide
taatacgactcactatagggtaaaccgggttttttagcaatcaagatgtaaacagaggagatacatcatgattgctaaaaacctggcggcagcgcaaaagatg

SEQ ID NO: 23830 - DNA, 103 bp, Artificial Sequence
  Synthetic Polynucleotide
taatacgactcactatagggtcagctaaaccgggttttttagcaatcaagaacagaggagacttgatatgtaaaaaaccaacctggcggcagcgcaaaagatg

SEQ ID NO: 23831 - DNA, 103 bp, Artificial Sequence
  Synthetic Polynucleotide
taatacgactcactatagggatgaggagctgtcctcttcagtttcatgctaacagaggagaagcatgatgctgaagaggaacctggcggcagcgcaaaagatg

SEQ ID NO: 23832 - DNA, 103 bp, Artificial Sequence
  Synthetic Polynucleotide
taatacgactcactatagggaagcatcagctaaaccgggttttttagcaaaacagaggagattgctaatgaacccggttaacctggcggcagcgcaaaagatg

SEQ ID NO: 23833 - DNA, 103 bp, Artificial Sequence
  Synthetic Polynucleotide
taatacgactcactatagggatctgaagcatcagctaaaccgggttttttaacagaggagaaaaaaaatgggtttagctaacctggcggcagcgcaaaagatg

SEQ ID NO: 23834 - DNA, 103 bp, Artificial Sequence
  Synthetic Polynucleotide
taatacgactcactatagggacgaaatctgaagcatcagctaaaccgggtaacagaggagaacccggatgagctgatgcaacctggcggcagcgcaaaagatg

SEQ ID NO: 23835 - DNA, 103 bp, Artificial Sequence
  Synthetic Polynucleotide
taatacgactcactatagggtcataacgaaatctgaagcatcagctaaacaacagaggagagtttagatgatgcttcagaacctggcggcagcgcaaaagatg

SEQ ID NO: 23836 - DNA, 103 bp, Artificial Sequence
  Synthetic Polynucleotide
taatacgactcactatagggtggattcataacgaaatctgaagcatcagcaacagaggagagctgatatgtcagatttcaacctggcggcagcgcaaaagatg

SEQ ID NO: 23837 - DNA, 103 bp, Artificial Sequence
  Synthetic Polynucleotide
taatacgactcactatagggcctaatggattcataacgaaatctgaagcaaacagaggagatgcttcatgtttcgttataacctggcggcagcgcaaaagatg

SEQ ID NO: 23838 - DNA, 103 bp, Artificial Sequence
  Synthetic Polynucleotide
taatacgactcactatagggttaaacctaatggattcataacgaaatctgaacagaggagacagattatgttatgaatcaacctggcggcagcgcaaaagatg

SEQ ID NO: 23839 - DNA, 103 bp, Artificial Sequence
  Synthetic Polynucleotide
taatacgactcactatagggcacatttaaacctaatggattcataacgaaaacagaggagattcgttatgaatccattaaacctggcggcagcgcaaaagatg

SEQ ID NO: 23840 - DNA, 103 bp, Artificial Sequence
  Synthetic Polynucleotide
taatacgactcactatagggcctggcacatttaaacctaatggattcataaacagaggagatatgaaatgattaggtttaacctggcggcagcgcaaaagatg

SEQ ID NO: 23841 - DNA, 103 bp, Artificial Sequence
  Synthetic Polynucleotide
taatacgactcactatagggtagatcctggcacatttaaacctaatggataacagaggagaatccatatggtttaaatgaacctggcggcagcgcaaaagatg

SEQ ID NO: 23842 - DNA, 103 bp, Artificial Sequence
  Synthetic Polynucleotide
taatacgactcactatagggacttgatgaggagctgtcctcttcagtttcaacagaggagagaaactatggaggacagcaacctggcggcagcgcaaaagatg

SEQ ID NO: 23843 - DNA, 103 bp, Artificial Sequence
  Synthetic Polynucleotide
taatacgactcactatagggttccctagatcctggcacatttaaacctaaaacagaggagattaggtatgaatgtgccaaacctggcggcagcgcaaaagatg

SEQ ID NO: 23844 - DNA, 103 bp, Artificial Sequence
  Synthetic Polynucleotide
taatacgactcactatagggattatttccctagatcctggcacatttaaaaacagaggagatttaaaatggccaggatcaacctggcggcagcgcaaaagatg

SEQ ID NO: 23845 - DNA, 103 bp, Artificial Sequence
  Synthetic Polynucleotide
taatacgactcactatagggacgttattatttccctagatcctggcacataacagaggagaatgtgcatggatctagggaacctggcggcagcgcaaaagatg

SEQ ID NO: 23846 - DNA, 103 bp, Artificial Sequence
  Synthetic Polynucleotide
taatacgactcactataggggagaaacgttattatttccctagatcctggaacagaggagaccaggaatgagggaaataaacctggcggcagcgcaaaagatg

SEQ ID NO: 23847 - DNA, 103 bp, Artificial Sequence
  Synthetic Polynucleotide
taatacgactcactatagggtgcctgagaaacgttattatttccctagataacagaggagaatctagatgaataataacaacctggcggcagcgcaaaagatg

SEQ ID NO: 23848 - DNA, 103 bp, Artificial Sequence
  Synthetic Polynucleotide
taatacgactcactatagggctgtttgcctgagaaacgttattatttcccaacagaggagagggaaaatgtaacgtttcaacctggcggcagcgcaaaagatg

SEQ ID NO: 23849 - DNA, 103 bp, Artificial Sequence
  Synthetic Polynucleotide
taatacgactcactatagggacgaactgtttgcctgagaaacgttattataacagaggagaataataatgtttctcaggaacctggcggcagcgcaaaagatg

SEQ ID NO: 23850 - DNA, 103 bp, Artificial Sequence
  Synthetic Polynucleotide
taatacgactcactatagggttttcacgaactgtttgcctgagaaacgttaacagaggagaaacgttatgcaggcaaacaacctggcggcagcgcaaaagatg

SEQ ID NO: 23851 - DNA, 103 bp, Artificial Sequence
  Synthetic Polynucleotide
taatacgactcactatagggttatgttttcacgaactgtttgcctgagaaaacagaggagattctcaatgaaacagttcaacctggcggcagcgcaaaagatg

SEQ ID NO: 23852 - DNA, 103 bp, Artificial Sequence
  Synthetic Polynucleotide
taatacgactcactatagggaattgttatgttttcacgaactgtttgcctaacagaggagaaggcaaatggttcgtgaaaacctggcggcagcgcaaaagatg

SEQ ID NO: 23853 - DNA, 103 bp, Artificial Sequence
  Synthetic Polynucleotide
taatacgactcactatagggaaactacttgatgaggagctgtcctcttcaaacagaggagatgaagaatgcagctcctcaacctggcggcagcgcaaaagatg

SEQ ID NO: 23854 - DNA, 103 bp, Artificial Sequence
  Synthetic Polynucleotide
taatacgactcactataggggatgtaattgttatgttttcacgaactgttaacagaggagaaacagtatgtgaaaacataacctggcggcagcgcaaaagatg

SEQ ID NO: 23855 - DNA, 103 bp, Artificial Sequence
  Synthetic Polynucleotide
taatacgactcactatagggtttgtgatgtaattgttatgttttcacgaaaacagaggagattcgtgatgacataacaaaacctggcggcagcgcaaaagatg

SEQ ID NO: 23856 - DNA, 103 bp, Artificial Sequence
  Synthetic Polynucleotide
taatacgactcactatagggtctattttgtgatgtaattgttatgttttcaacagaggagagaaaacatgacaattacaaacctggcggcagcgcaaaagatg

SEQ ID NO: 23857 - DNA, 103 bp, Artificial Sequence
  Synthetic Polynucleotide
taatacgactcactatagggattattctattttgtgatgtaattgttatgaacagaggagacataacatgtacatcacaaacctggcggcagcgcaaaagatg

SEQ ID NO: 23858 - DNA, 103 bp, Artificial Sequence
  Synthetic Polynucleotide
taatacgactcactatagggaatttattattctattttgtgatgtaattgaacagaggagacaattaatgcacaaaataaacctggcggcagcgcaaaagatg

SEQ ID NO: 23859 - DNA, 103 bp, Artificial Sequence
  Synthetic Polynucleotide
taatacgactcactatagggaagagaatttattattctattttgtgatgtaacagaggagaacatcaatgaatagaataaacctggcggcagcgcaaaagatg

SEQ ID NO: 23860 - DNA, 103 bp, Artificial Sequence
  Synthetic Polynucleotide
taatacgactcactatagggtgaaaaagagaatttattattctattttgtaacagaggagaacaaaaatgaataataaaaacctggcggcagcgcaaaagatg

SEQ ID NO: 23861 - DNA, 103 bp, Artificial Sequence
  Synthetic Polynucleotide
taatacgactcactatagggctatgtgaaaaagagaatttattattctataacagaggagaatagaaatgtaaattctcaacctggcggcagcgcaaaagatg

SEQ ID NO: 23862 - DNA, 103 bp, Artificial Sequence
  Synthetic Polynucleotide
taatacgactcactatagggggaacctatgtgaaaaagagaatttattataacagaggagaataataatgtctctttttaacctggcggcagcgcaaaagatg

SEQ ID NO: 23863 - DNA, 103 bp, Artificial Sequence
  Synthetic Polynucleotide
taatacgactcactatagggaagtcggaacctatgtgaaaaagagaatttaacagaggagaaaattcatgttttcacataacctggcggcagcgcaaaagatg

SEQ ID NO: 23864 - DNA, 103 bp, Artificial Sequence
  Synthetic Polynucleotide
taatacgactcactatagggccttcttattacgaacatgaggggctgtggaacagaggagaccacagatgctcatgttcaacctggcggcagcgcaaaagatg

SEQ ID NO: 23865 - DNA, 103 bp, Artificial Sequence
  Synthetic Polynucleotide
taatacgactcactatagggcaacaaaactacttgatgaggagctgtcctaacagaggagaaggacaatgcctcatcaaaacctggcggcagcgcaaaagatg

SEQ ID NO: 23866 - DNA, 103 bp, Artificial Sequence
  Synthetic Polynucleotide
taatacgactcactatagggcctctaagtcggaacctatgtgaaaaagagaacagaggagactctttatgacataggttaacctggcggcagcgcaaaagatg

SEQ ID NO: 23867 - DNA, 103 bp, Artificial Sequence
  Synthetic Polynucleotide
taatacgactcactatagggttgatcctctaagtcggaacctatgtgaaaaacagaggagatttcacatgggttccgacaacctggcggcagcgcaaaagatg

SEQ ID NO: 23868 - DNA, 103 bp, Artificial Sequence
  Synthetic Polynucleotide
taatacgactcactatagggactctttgatcctctaagtcggaacctatgaacagaggagacataggatgcgacttagaaacctggcggcagcgcaaaagatg

SEQ ID NO: 23869 - DNA, 103 bp, Artificial Sequence
  Synthetic Polynucleotide
taatacgactcactatagggcacatactctttgatcctctaagtcggaacaacagaggagagttccgatgtagaggatcaacctggcggcagcgcaaaagatg

SEQ ID NO: 23870 - DNA, 103 bp, Artificial Sequence
  Synthetic Polynucleotide
taatacgactcactatagggccattcacatactctttgatcctctaagtcaacagaggagagacttaatggatcaaagaaacctggcggcagcgcaaaagatg

SEQ ID NO: 23871 - DNA, 103 bp, Artificial Sequence
  Synthetic Polynucleotide
taatacgactcactatagggaaaagccattcacatactctttgatcctctaacagaggagaagaggaatgaagagtatgaacctggcggcagcgcaaaagatg

SEQ ID NO: 23872 - DNA, 103 bp, Artificial Sequence
  Synthetic Polynucleotide
taatacgactcactatagggatgataaaagccattcacatactctttgataacagaggagaatcaaaatgtatgtgaataacctggcggcagcgcaaaagatg

SEQ ID NO: 23873 - DNA, 103 bp, Artificial Sequence
  Synthetic Polynucleotide
taatacgactcactataggggtttgatgataaaagccattcacatactctaacagaggagaagagtaatggaatggcttaacctggcggcagcgcaaaagatg

SEQ ID NO: 23874 - DNA, 103 bp, Artificial Sequence
  Synthetic Polynucleotide
taatacgactcactatagggacagggtttgatgataaaagccattcacataacagaggagaatgtgaatggcttttatcaacctggcggcagcgcaaaagatg

SEQ ID NO: 23875 - DNA, 103 bp, Artificial Sequence
  Synthetic Polynucleotide
taatacgactcactatagggtcattacagggtttgatgataaaagccattaacagaggagaaatggcatgtatcatcaaaacctggcggcagcgcaaaagatg

SEQ ID NO: 23876 - DNA, 103 bp, Artificial Sequence
  Synthetic Polynucleotide
taatacgactcactatagggcaagtcaacaaaactacttgatgaggagctaacagaggagaagctccatgtcaagtagtaacctggcggcagcgcaaaagatg

SEQ ID NO: 23877 - DNA, 103 bp, Artificial Sequence
  Synthetic Polynucleotide
taatacgactcactatagggtcggctcattacagggtttgatgataaaagaacagaggagacttttaatgtcaaaccctaacctggcggcagcgcaaaagatg

SEQ ID NO: 23878 - DNA, 103 bp, Artificial Sequence
  Synthetic Polynucleotide
taatacgactcactataggggcaaatcggctcattacagggtttgatgataacagaggagaatcatcatgccctgtaataacctggcggcagcgcaaaagatg

SEQ ID NO: 23879 - DNA, 103 bp, Artificial Sequence
  Synthetic Polynucleotide
taatacgactcactatagggcagcagcaaatcggctcattacagggtttgaacagaggagacaaaccatgtaatgagccaacctggcggcagcgcaaaagatg

SEQ ID NO: 23880 - DNA, 103 bp, Artificial Sequence
  Synthetic Polynucleotide
taatacgactcactatagggaatatcagcagcaaatcggctcattacaggaacagaggagacctgtaatgagccgatttaacctggcggcagcgcaaaagatg

SEQ ID NO: 23881 - DNA, 103 bp, Artificial Sequence
  Synthetic Polynucleotide
taatacgactcactataggggaaaaaatatcagcagcaaatcggctcattaacagaggagaaatgagatgatttgctgcaacctggcggcagcgcaaaagatg

SEQ ID NO: 23882 - DNA, 103 bp, Artificial Sequence
  Synthetic Polynucleotide
taatacgactcactatagggttcgtgaaaaaatatcagcagcaaatcggcaacagaggagagccgatatgctgctgataaacctggcggcagcgcaaaagatg

SEQ ID NO: 23883 - DNA, 103 bp, Artificial Sequence
  Synthetic Polynucleotide
taatacgactcactatagggaggtgttcgtgaaaaaatatcagcagcaaaaacagaggagatttgctatggatatttttaacctggcggcagcgcaaaagatg

SEQ ID NO: 23884 - DNA, 103 bp, Artificial Sequence
  Synthetic Polynucleotide
taatacgactcactatagggccactaggtgttcgtgaaaaaatatcagcaaacagaggagatgctgaatgtttttcacgaacctggcggcagcgcaaaagatg

SEQ ID NO: 23885 - DNA, 103 bp, Artificial Sequence
  Synthetic Polynucleotide
taatacgactcactatagggtttttccactaggtgttcgtgaaaaaatataacagaggagaatatttatgcacgaacacaacctggcggcagcgcaaaagatg

SEQ ID NO: 23886 - DNA, 103 bp, Artificial Sequence
  Synthetic Polynucleotide
taatacgactcactatagggaagtctttttccactaggtgttcgtgaaaaaacagaggagattttcaatgacacctagtaacctggcggcagcgcaaaagatg

SEQ ID NO: 23887 - DNA, 103 bp, Artificial Sequence
  Synthetic Polynucleotide
taatacgactcactatagggtcattcaagtcaacaaaactacttgatgagaacagaggagactcatcatgtagttttgtaacctggcggcagcgcaaaagatg

SEQ ID NO: 23888 - DNA, 103 bp, Artificial Sequence
  Synthetic Polynucleotide
taatacgactcactatagggacttgaagtctttttccactaggtgttcgtaacagaggagaacgaacatgtagtggaaaaacctggcggcagcgcaaaagatg

SEQ ID NO: 23889 - DNA, 103 bp, Artificial Sequence
  Synthetic Polynucleotide
taatacgactcactatagggctaaaacttgaagtctttttccactaggtgaacagaggagacacctaatggaaaaagacaacctggcggcagcgcaaaagatg

SEQ ID NO: 23890 - DNA, 103 bp, Artificial Sequence
  Synthetic Polynucleotide
taatacgactcactataggggtaacctaaaacttgaagtctttttccactaacagaggagaagtggaatgagacttcaaaacctggcggcagcgcaaaagatg

SEQ ID NO: 23891 - DNA, 103 bp, Artificial Sequence
  Synthetic Polynucleotide
taatacgactcactatagggtccaagtaacctaaaacttgaagtctttttaacagaggagaaaaaagatgtcaagttttaacctggcggcagcgcaaaagatg

SEQ ID NO: 23892 - DNA, 103 bp, Artificial Sequence
  Synthetic Polynucleotide
taatacgactcactatagggttccttccaagtaacctaaaacttgaagtcaacagaggagagacttcatgttttaggttaacctggcggcagcgcaaaagatg

SEQ ID NO: 23893 - DNA, 103 bp, Artificial Sequence
  Synthetic Polynucleotide
taatacgactcactatagggtctggttccttccaagtaacctaaaacttgaacagaggagacaagttatgggttacttgaacctggcggcagcgcaaaagatg

SEQ ID NO: 23894 - DNA, 103 bp, Artificial Sequence
  Synthetic Polynucleotide
taatacgactcactatagggaacgttctggttccttccaagtaacctaaaaacagaggagatttaggatgcttggaaggaacctggcggcagcgcaaaagatg

SEQ ID NO: 23895 - DNA, 103 bp, Artificial Sequence
  Synthetic Polynucleotide
taatacgactcactatagggctaataacgttctggttccttccaagtaacaacagaggagagttactatgaaggaaccaaacctggcggcagcgcaaaagatg

SEQ ID NO: 23896 - DNA, 103 bp, Artificial Sequence
  Synthetic Polynucleotide
taatacgactcactatagggggaagctaataacgttctggttccttccaaaacagaggagattggaaatgaccagaacgaacctggcggcagcgcaaaagatg

SEQ ID NO: 23897 - DNA, 103 bp, Artificial Sequence
  Synthetic Polynucleotide
taatacgactcactataggggtgcgggaagctaataacgttctggttcctaacagaggagaaggaacatgaacgttattaacctggcggcagcgcaaaagatg

SEQ ID NO: 23898 - DNA, 103 bp, Artificial Sequence
  Synthetic Polynucleotide
taatacgactcactatagggatggatcattcaagtcaacaaaactacttgaacagaggagacaagtaatgttgttgactaacctggcggcagcgcaaaagatg

SEQ ID NO: 23899 - DNA, 103 bp, Artificial Sequence
  Synthetic Polynucleotide
taatacgactcactatagggtgatcgtgcgggaagctaataacgttctggaacagaggagaccagaaatgtattagcttaacctggcggcagcgcaaaagatg

SEQ ID NO: 23900 - DNA, 103 bp, Artificial Sequence
  Synthetic Polynucleotide
taatacgactcactatagggtaaactgatcgtgcgggaagctaataacgtaacagaggagaacgttaatggcttcccgcaacctggcggcagcgcaaaagatg

SEQ ID NO: 23901 - DNA, 103 bp, Artificial Sequence
  Synthetic Polynucleotide
taatacgactcactataggggtggttaaactgatcgtgcgggaagctaataacagaggagaattagcatgccgcacgataacctggcggcagcgcaaaagatg

SEQ ID NO: 23902 - DNA, 103 bp, Artificial Sequence
  Synthetic Polynucleotide
taatacgactcactatagggcctcagtggttaaactgatcgtgcgggaagaacagaggagacttcccatgcgatcagttaacctggcggcagcgcaaaagatg

SEQ ID NO: 23903 - DNA, 103 bp, Artificial Sequence
  Synthetic Polynucleotide
taatacgactcactatagggtgtaccctcagtggttaaactgatcgtgcgaacagaggagacgcacgatgagtttaaccaacctggcggcagcgcaaaagatg

SEQ ID NO: 23904 - DNA, 103 bp, Artificial Sequence
  Synthetic Polynucleotide
taatacgactcactatagggaacattgtaccctcagtggttaaactgatcaacagaggagagatcagatgaaccactgaaacctggcggcagcgcaaaagatg

SEQ ID NO: 23905 - DNA, 103 bp, Artificial Sequence
  Synthetic Polynucleotide
taatacgactcactatagggtcatcaacattgtaccctcagtggttaaacaacagaggagagtttaaatgctgagggtaaacctggcggcagcgcaaaagatg

SEQ ID NO: 23906 - DNA, 103 bp, Artificial Sequence
  Synthetic Polynucleotide
taatacgactcactatagggtaatctcatcaacattgtaccctcagtggtaacagaggagaaccactatgggtacaatgaacctggcggcagcgcaaaagatg

SEQ ID NO: 23907 - DNA, 103 bp, Artificial Sequence
  Synthetic Polynucleotide
taatacgactcactatagggtctcttaatctcatcaacattgtaccctcaaacagaggagatgagggatgaatgttgataacctggcggcagcgcaaaagatg

SEQ ID NO: 23908 - DNA, 103 bp, Artificial Sequence
  Synthetic Polynucleotide
taatacgactcactatagggttaactctcttaatctcatcaacattgtacaacagaggagagtacaaatgtgatgagataacctggcggcagcgcaaaagatg

SEQ ID NO: 23909 - DNA, 103 bp, Artificial Sequence
  Synthetic Polynucleotide
taatacgactcactatagggtgcaaatggatcattcaagtcaacaaaactaacagaggagaagttttatggacttgaataacctggcggcagcgcaaaagatg

SEQ ID NO: 23910 - DNA, 103 bp, Artificial Sequence
  Synthetic Polynucleotide
taatacgactcactatagggcttagttaactctcttaatctcatcaacataacagaggagaatgttgatgagattaagaaacctggcggcagcgcaaaagatg

SEQ ID NO: 23911 - DNA, 103 bp, Artificial Sequence
  Synthetic Polynucleotide
taatacgactcactatagggcgactcttagttaactctcttaatctcatcaacagaggagagatgagatgaagagagttaacctggcggcagcgcaaaagatg

SEQ ID NO: 23912 - DNA, 103 bp, Artificial Sequence
  Synthetic Polynucleotide
taatacgactcactatagggtccatcgactcttagttaactctcttaatcaacagaggagagattaaatgagttaactaaacctggcggcagcgcaaaagatg

SEQ ID NO: 23913 - DNA, 103 bp, Artificial Sequence
  Synthetic Polynucleotide
taatacgactcactatagggactcttccatcgactcttagttaactctctaacagaggagaagagagatgactaagagtaacctggcggcagcgcaaaagatg

SEQ ID NO: 23914 - DNA, 103 bp, Artificial Sequence
  Synthetic Polynucleotide
taatacgactcactatagggaaccaactcttccatcgactcttagttaacaacagaggagagttaacatggagtcgatgaacctggcggcagcgcaaaagatg

SEQ ID NO: 23915 - DNA, 103 bp, Artificial Sequence
  Synthetic Polynucleotide
taatacgactcactatagggaagaaaaccaactcttccatcgactcttagaacagaggagactaagaatggatggaagaaacctggcggcagcgcaaaagatg

SEQ ID NO: 23916 - DNA, 103 bp, Artificial Sequence
  Synthetic Polynucleotide
taatacgactcactatagggaatgtaagaaaaccaactcttccatcgactaacagaggagaagtcgaatgaagagttggaacctggcggcagcgcaaaagatg

SEQ ID NO: 23917 - DNA, 103 bp, Artificial Sequence
  Synthetic Polynucleotide
taatacgactcactataggggcatcaatgtaagaaaaccaactcttccataacagaggagaatggaaatgttggttttcaacctggcggcagcgcaaaagatg

SEQ ID NO: 23918 - DNA, 103 bp, Artificial Sequence
  Synthetic Polynucleotide
taatacgactcactatagggctaatgcatcaatgtaagaaaaccaactctaacagaggagaagagttatgtttcttacaaacctggcggcagcgcaaaagatg

SEQ ID NO: 23919 - DNA, 103 bp, Artificial Sequence
  Synthetic Polynucleotide
taatacgactcactatagggatcatctaatgcatcaatgtaagaaaaccaaacagaggagatggtttatgtacattgataacctggcggcagcgcaaaagatg

SEQ ID NO: 23920 - DNA, 103 bp, Artificial Sequence
  Synthetic Polynucleotide
taatacgactcactatagggagcagtgcaaatggatcattcaagtcaacaaacagaggagatgttgaatggaatgatccaacctggcggcagcgcaaaagatg

SEQ ID NO: 23921 - DNA, 103 bp, Artificial Sequence
  Synthetic Polynucleotide
taatacgactcactatagggaaatcatcatctaatgcatcaatgtaagaaaacagaggagattcttaatgtgatgcattaacctggcggcagcgcaaaagatg

SEQ ID NO: 23922 - DNA, 103 bp, Artificial Sequence
  Synthetic Polynucleotide
taatacgactcactatagggcagacaaatcatcatctaatgcatcaatgtaacagaggagaacattgatgcattagatgaacctggcggcagcgcaaaagatg

SEQ ID NO: 23923 - DNA, 103 bp, Artificial Sequence
  Synthetic Polynucleotide
taatacgactcactatagggagactcagacaaatcatcatctaatgcatcaacagaggagagatgcaatggatgatgataacctggcggcagcgcaaaagatg

SEQ ID NO: 23924 - DNA, 103 bp, Artificial Sequence
  Synthetic Polynucleotide
taatacgactcactatagggtcaagagactcagacaaatcatcatctaataacagaggagaattagaatgtgatttgtcaacctggcggcagcgcaaaagatg

SEQ ID NO: 23925 - DNA, 103 bp, Artificial Sequence
  Synthetic Polynucleotide
taatacgactcactatagggacttttcaagagactcagacaaatcatcataacagaggagaatgatgatgtgtctgagtaacctggcggcagcgcaaaagatg

SEQ ID NO: 23926 - DNA, 103 bp, Artificial Sequence
  Synthetic Polynucleotide
taatacgactcactatagggtatgaacttttcaagagactcagacaaatcaacagaggagagatttgatggagtctcttaacctggcggcagcgcaaaagatg

SEQ ID NO: 23927 - DNA, 103 bp, Artificial Sequence
  Synthetic Polynucleotide
taatacgactcactataggggtgcatatgaacttttcaagagactcagacaacagaggagagtctgaatgtcttgaaaaaacctggcggcagcgcaaaagatg

SEQ ID NO: 23928 - DNA, 103 bp, Artificial Sequence
  Synthetic Polynucleotide
taatacgactcactatagggcaacagtgcatatgaacttttcaagagactaacagaggagaagtctcatgaaaagttcaaacctggcggcagcgcaaaagatg

SEQ ID NO: 23929 - DNA, 103 bp, Artificial Sequence
  Synthetic Polynucleotide
taatacgactcactatagggcacatcaacagtgcatatgaacttttcaagaacagaggagacttgaaatgttcatatgcaacctggcggcagcgcaaaagatg

SEQ ID NO: 23930 - DNA, 103 bp, Artificial Sequence
  Synthetic Polynucleotide
taatacgactcactatagggttagccacatcaacagtgcatatgaactttaacagaggagaaaagttatgatgcactgtaacctggcggcagcgcaaaagatg

SEQ ID NO: 23931 - DNA, 103 bp, Artificial Sequence
  Synthetic Polynucleotide
taatacgactcactatagggcgttcagcagtgcaaatggatcattcaagtaacagaggagaacttgaatgatccatttgaacctggcggcagcgcaaaagatg

SEQ ID NO: 23932 - DNA, 103 bp, Artificial Sequence
  Synthetic Polynucleotide
taatacgactcactatagggagaaattagccacatcaacagtgcatatgaaacagaggagatcatatatgctgttgatgaacctggcggcagcgcaaaagatg

SEQ ID NO: 23933 - DNA, 103 bp, Artificial Sequence
  Synthetic Polynucleotide
taatacgactcactatagggtctcaagaaattagccacatcaacagtgcaaacagaggagatgcactatggatgtggctaacctggcggcagcgcaaaagatg

SEQ ID NO: 23934 - DNA, 103 bp, Artificial Sequence
  Synthetic Polynucleotide
taatacgactcactatagggtatgctctcaagaaattagccacatcaacaaacagaggagatgttgaatgggctaatttaacctggcggcagcgcaaaagatg

SEQ ID NO: 23935 - DNA, 103 bp, Artificial Sequence
  Synthetic Polynucleotide
taatacgactcactatagggatgaatatgctctcaagaaattagccacataacagaggagaatgtggatgatttcttgaaacctggcggcagcgcaaaagatg

SEQ ID NO: 23936 - DNA, 103 bp, Artificial Sequence
  Synthetic Polynucleotide
taatacgactcactatagggtgaccatgaatatgctctcaagaaattagcaacagaggagagctaatatgttgagagcaaacctggcggcagcgcaaaagatg

SEQ ID NO: 23937 - DNA, 103 bp, Artificial Sequence
  Synthetic Polynucleotide
taatacgactcactatagggacatctgaccatgaatatgctctcaagaaaaacagaggagatttcttatgagcatattcaacctggcggcagcgcaaaagatg

SEQ ID NO: 23938 - DNA, 103 bp, Artificial Sequence
  Synthetic Polynucleotide
taatacgactcactatagggtcaagacatctgaccatgaatatgctctcaaacagaggagatgagagatgattcatggtaacctggcggcagcgcaaaagatg

SEQ ID NO: 23939 - DNA, 103 bp, Artificial Sequence
  Synthetic Polynucleotide
taatacgactcactatagggtcctttcaagacatctgaccatgaatatgcaacagaggagagcatatatgtggtcagataacctggcggcagcgcaaaagatg

SEQ ID NO: 23940 - DNA, 103 bp, Artificial Sequence
  Synthetic Polynucleotide
taatacgactcactatagggctttttcctttcaagacatctgaccatgaaaacagaggagattcatgatgagatgtcttaacctggcggcagcgcaaaagatg

SEQ ID NO: 23941 - DNA, 103 bp, Artificial Sequence
  Synthetic Polynucleotide
taatacgactcactatagggttaacctttttcctttcaagacatctgaccaacagaggagaggtcagatgtcttgaaagaacctggcggcagcgcaaaagatg

SEQ ID NO: 23942 - DNA, 103 bp, Artificial Sequence
  Synthetic Polynucleotide
taatacgactcactataggggtcttcgttcagcagtgcaaatggatcattaacagaggagaaatgatatgtttgcactgaacctggcggcagcgcaaaagatg

SEQ ID NO: 23943 - DNA, 103 bp, Artificial Sequence
  Synthetic Polynucleotide
taatacgactcactatagggaccaattaacctttttcctttcaagacatcaacagaggagagatgtcatgaaaggaaaaaacctggcggcagcgcaaaagatg

SEQ ID NO: 23944 - DNA, 103 bp, Artificial Sequence
  Synthetic Polynucleotide
taatacgactcactataggggtggcaccaattaacctttttcctttcaagaacagaggagacttgaaatgaaaaaggttaacctggcggcagcgcaaaagatg

SEQ ID NO: 23945 - DNA, 103 bp, Artificial Sequence
  Synthetic Polynucleotide
taatacgactcactataggggtagtgtggcaccaattaacctttttccttaacagaggagaaaggaaatgggttaattgaacctggcggcagcgcaaaagatg

SEQ ID NO: 23946 - DNA, 103 bp, Artificial Sequence
  Synthetic Polynucleotide
taatacgactcactatagggacatggtagtgtggcaccaattaaccttttaacagaggagaaaaaggatgattggtgccaacctggcggcagcgcaaaagatg

SEQ ID NO: 23947 - DNA, 103 bp, Artificial Sequence
  Synthetic Polynucleotide
taatacgactcactatagggagtaaacatggtagtgtggcaccaattaacaacagaggagagttaatatgtgccacactaacctggcggcagcgcaaaagatg

SEQ ID NO: 23948 - DNA, 103 bp, Artificial Sequence
  Synthetic Polynucleotide
taatacgactcactataggggctccagtaaacatggtagtgtggcaccaaaacagaggagattggtgatgcactaccataacctggcggcagcgcaaaagatg

SEQ ID NO: 23949 - DNA, 103 bp, Artificial Sequence
  Synthetic Polynucleotide
taatacgactcactataggggaattgctccagtaaacatggtagtgtggcaacagaggagagccacaatgccatgtttaaacctggcggcagcgcaaaagatg

SEQ ID NO: 23950 - DNA, 103 bp, Artificial Sequence
  Synthetic Polynucleotide
taatacgactcactatagggacattgaattgctccagtaaacatggtagtaacagaggagaactaccatgtttactggaaacctggcggcagcgcaaaagatg

SEQ ID NO: 23951 - DNA, 103 bp, Artificial Sequence
  Synthetic Polynucleotide
taatacgactcactatagggactttacattgaattgctccagtaaacatgaacagaggagacatgttatgtggagcaataacctggcggcagcgcaaaagatg

SEQ ID NO: 23952 - DNA, 103 bp, Artificial Sequence
  Synthetic Polynucleotide
taatacgactcactataggggacccactttacattgaattgctccagtaaaacagaggagattactgatgcaattcaataacctggcggcagcgcaaaagatg

SEQ ID NO: 23953 - DNA, 103 bp, Artificial Sequence
  Synthetic Polynucleotide
taatacgactcactatagggtcctcgtcttcgttcagcagtgcaaatggaaacagaggagatccattatgactgctgaaaacctggcggcagcgcaaaagatg

SEQ ID NO: 23954 - DNA, 103 bp, Artificial Sequence
  Synthetic Polynucleotide
taatacgactcactatagggaagttgacccactttacattgaattgctccaacagaggagaggagcaatgcaatgtaaaaacctggcggcagcgcaaaagatg

SEQ ID NO: 23955 - DNA, 103 bp, Artificial Sequence
  Synthetic Polynucleotide
taatacgactcactatagggcagacaagttgacccactttacattgaattaacagaggagaaattcaatgtaaagtgggaacctggcggcagcgcaaaagatg

SEQ ID NO: 23956 - DNA, 103 bp, Artificial Sequence
  Synthetic Polynucleotide
taatacgactcactataggggtcttcagacaagttgacccactttacattaacagaggagaaatgtaatgtgggtcaacaacctggcggcagcgcaaaagatg

SEQ ID NO: 23957 - DNA, 103 bp, Artificial Sequence
  Synthetic Polynucleotide
taatacgactcactatagggtttaagtcttcagacaagttgacccactttaacagaggagaaaagtgatgcaacttgtcaacctggcggcagcgcaaaagatg

SEQ ID NO: 23958 - DNA, 103 bp, Artificial Sequence
  Synthetic Polynucleotide
taatacgactcactataggggctcctttaagtcttcagacaagttgacccaacagaggagagggtcaatgtgtctgaagaacctggcggcagcgcaaaagatg

SEQ ID NO: 23959 - DNA, 103 bp, Artificial Sequence
  Synthetic Polynucleotide
taatacgactcactatagggaaattgctcctttaagtcttcagacaagttaacagaggagaaacttgatggaagacttaaacctggcggcagcgcaaaagatg

SEQ ID NO: 23960 - DNA, 103 bp, Artificial Sequence
  Synthetic Polynucleotide
taatacgactcactatagggagcttaaattgctcctttaagtcttcagacaacagaggagagtctgaatgcttaaaggaaacctggcggcagcgcaaaagatg

SEQ ID NO: 23961 - DNA, 103 bp, Artificial Sequence
  Synthetic Polynucleotide
taatacgactcactatagggaagatagcttaaattgctcctttaagtcttaacagaggagaaagactatgaggagcaataacctggcggcagcgcaaaagatg

SEQ ID NO: 23962 - DNA, 103 bp, Artificial Sequence
  Synthetic Polynucleotide
taatacgactcactatagggatctgaagatagcttaaattgctcctttaaaacagaggagattaaagatgcaatttaagaacctggcggcagcgcaaaagatg

SEQ ID NO: 23963 - DNA, 103 bp, Artificial Sequence
  Synthetic Polynucleotide
taatacgactcactatagggcccagatctgaagatagcttaaattgctccaacagaggagaggagcaatgtaagctatcaacctggcggcagcgcaaaagatg

SEQ ID NO: 23964 - DNA, 103 bp, Artificial Sequence
  Synthetic Polynucleotide
taatacgactcactataggggagtatcctcgtcttcgttcagcagtgcaaaacagaggagattgcacatgtgaacgaagaacctggcggcagcgcaaaagatg

SEQ ID NO: 23965 - DNA, 103 bp, Artificial Sequence
  Synthetic Polynucleotide
taatacgactcactataggggtgatcccagatctgaagatagcttaaattaacagaggagaaatttaatgtatcttcagaacctggcggcagcgcaaaagatg

SEQ ID NO: 23966 - DNA, 103 bp, Artificial Sequence
  Synthetic Polynucleotide
taatacgactcactatagggcgtaggtgatcccagatctgaagatagcttaacagaggagaaagctaatgtcagatctgaacctggcggcagcgcaaaagatg

SEQ ID NO: 23967 - DNA, 103 bp, Artificial Sequence
  Synthetic Polynucleotide
taatacgactcactatagggaaatccgtaggtgatcccagatctgaagataacagaggagaatcttcatgtctgggatcaacctggcggcagcgcaaaagatg

SEQ ID NO: 23968 - DNA, 103 bp, Artificial Sequence
  Synthetic Polynucleotide
taatacgactcactataggggcaataaatccgtaggtgatcccagatctgaacagaggagacagatcatggatcacctaaacctggcggcagcgcaaaagatg

SEQ ID NO: 23969 - DNA, 103 bp, Artificial Sequence
  Synthetic Polynucleotide
taatacgactcactataggggtactgcaataaatccgtaggtgatcccagaacagaggagactgggaatgcctacggataacctggcggcagcgcaaaagatg

SEQ ID NO: 23970 - DNA, 103 bp, Artificial Sequence
  Synthetic Polynucleotide
taatacgactcactatagggcaatcgtactgcaataaatccgtaggtgataacagaggagaatcaccatgggatttattaacctggcggcagcgcaaaagatg

SEQ ID NO: 23971 - DNA, 103 bp, Artificial Sequence
  Synthetic Polynucleotide
taatacgactcactatagggcattgcaatcgtactgcaataaatccgtagaacagaggagactacggatgtattgcagtaacctggcggcagcgcaaaagatg

SEQ ID NO: 23972 - DNA, 103 bp, Artificial Sequence
  Synthetic Polynucleotide
taatacgactcactatagggcagtccattgcaatcgtactgcaataaatcaacagaggagagatttaatgcagtacgataacctggcggcagcgcaaaagatg

SEQ ID NO: 23973 - DNA, 103 bp, Artificial Sequence
  Synthetic Polynucleotide
taatacgactcactataggggaatgcagtccattgcaatcgtactgcaataacagaggagaattgcaatgcgattgcaaaacctggcggcagcgcaaaagatg

SEQ ID NO: 23974 - DNA, 103 bp, Artificial Sequence
  Synthetic Polynucleotide
taatacgactcactatagggcctttgaatgcagtccattgcaatcgtactaacagaggagaagtacgatggcaatggacaacctggcggcagcgcaaaagatg

SEQ ID NO: 23975 - DNA, 103 bp, Artificial Sequence
  Synthetic Polynucleotide
taatacgactcactatagggtatgatacacaaaatcatcatctcttgtttaacagaggagaaaacaaatgatgatgattaacctggcggcagcgcaaaagatg

SEQ ID NO: 23976 - DNA, 103 bp, Artificial Sequence
  Synthetic Polynucleotide
taatacgactcactatagggtatcaccttcttattacgaacatgaggggcaacagaggagagcccctatggttcgtaataacctggcggcagcgcaaaagatg

SEQ ID NO: 23977 - DNA, 103 bp, Artificial Sequence
  Synthetic Polynucleotide
taatacgactcactatagggttcaagagtatcctcgtcttcgttcagcagaacagaggagactgctgatggaagacgagaacctggcggcagcgcaaaagatg

SEQ ID NO: 23978 - DNA, 103 bp, Artificial Sequence
  Synthetic Polynucleotide
taatacgactcactatagggggccccctttgaatgcagtccattgcaatcaacagaggagagattgcatgggactgcataacctggcggcagcgcaaaagatg

SEQ ID NO: 23979 - DNA, 103 bp, Artificial Sequence
  Synthetic Polynucleotide
taatacgactcactatagggttatcggccccctttgaatgcagtccattgaacagaggagacaatggatggcattcaaaaacctggcggcagcgcaaaagatg

SEQ ID NO: 23980 - DNA, 103 bp, Artificial Sequence
  Synthetic Polynucleotide
taatacgactcactatagggctgcgttatcggccccctttgaatgcagtcaacagaggagagactgcatgcaaagggggaacctggcggcagcgcaaaagatg

SEQ ID NO: 23981 - DNA, 103 bp, Artificial Sequence
  Synthetic Polynucleotide
taatacgactcactatagggtaattctgcgttatcggccccctttgaatgaacagaggagacattcaatgggggccgataacctggcggcagcgcaaaagatg

SEQ ID NO: 23982 - DNA, 103 bp, Artificial Sequence
  Synthetic Polynucleotide
taatacgactcactatagggtaatttaattctgcgttatcggccccctttaacagaggagaaaagggatgcgataacgcaacctggcggcagcgcaaaagatg

SEQ ID NO: 23983 - DNA, 103 bp, Artificial Sequence
  Synthetic Polynucleotide
taatacgactcactatagggtcacataatttaattctgcgttatcggcccaacagaggagagggccgatgacgcagaataacctggcggcagcgcaaaagatg

SEQ ID NO: 23984 - DNA, 103 bp, Artificial Sequence
  Synthetic Polynucleotide
taatacgactcactatagggacaactcacataatttaattctgcgttatcaacagaggagagataacatggaattaaataacctggcggcagcgcaaaagatg

SEQ ID NO: 23985 - DNA, 103 bp, Artificial Sequence
  Synthetic Polynucleotide
taatacgactcactatagggagggcacaactcacataatttaattctgcgaacagaggagacgcagaatgaaattatgtaacctggcggcagcgcaaaagatg

SEQ ID NO: 23986 - DNA, 103 bp, Artificial Sequence
  Synthetic Polynucleotide
taatacgactcactatagggggtcaagggcacaactcacataatttaattaacagaggagaaattaaatgatgtgagttaacctggcggcagcgcaaaagatg

SEQ ID NO: 23987 - DNA, 103 bp, Artificial Sequence
  Synthetic Polynucleotide
taatacgactcactatagggtttccggtcaagggcacaactcacataattaacagaggagaaattatatgagttgtgccaacctggcggcagcgcaaaagatg

SEQ ID NO: 23988 - DNA, 103 bp, Artificial Sequence
  Synthetic Polynucleotide
taatacgactcactatagggctattttcaagagtatcctcgtcttcgttcaacagaggagagaacgaatgcgaggatacaacctggcggcagcgcaaaagatg

SEQ ID NO: 23989 - DNA, 103 bp, Artificial Sequence
  Synthetic Polynucleotide
taatacgactcactatagggacaattttccggtcaagggcacaactcacaaacagaggagatgtgagatgtgcccttgaaacctggcggcagcgcaaaagatg

SEQ ID NO: 23990 - DNA, 103 bp, Artificial Sequence
  Synthetic Polynucleotide
taatacgactcactatagggtttgaacaattttccggtcaagggcacaacaacagaggagagttgtgatgttgaccggaaacctggcggcagcgcaaaagatg

SEQ ID NO: 23991 - DNA, 103 bp, Artificial Sequence
  Synthetic Polynucleotide
taatacgactcactatagggatgcttttgaacaattttccggtcaagggcaacagaggagagcccttatgcggaaaattaacctggcggcagcgcaaaagatg

SEQ ID NO: 23992 - DNA, 103 bp, Artificial Sequence
  Synthetic Polynucleotide
taatacgactcactataggggatggatgcttttgaacaattttccggtcaaacagaggagatgaccgatgaattgttcaaacctggcggcagcgcaaaagatg

SEQ ID NO: 23993 - DNA, 103 bp, Artificial Sequence
  Synthetic Polynucleotide
taatacgactcactatagggtgtcagatggatgcttttgaacaattttccaacagaggagaggaaaaatgttcaaaagcaacctggcggcagcgcaaaagatg

SEQ ID NO: 23994 - DNA, 103 bp, Artificial Sequence
  Synthetic Polynucleotide
taatacgactcactataggggcgattgtcagatggatgcttttgaacaataacagaggagaattgttatgaagcatccaaacctggcggcagcgcaaaagatg

SEQ ID NO: 23995 - DNA, 103 bp, Artificial Sequence
  Synthetic Polynucleotide
taatacgactcactataggggccaggcgattgtcagatggatgcttttgaaacagaggagatcaaaaatgtccatctgaaacctggcggcagcgcaaaagatg

SEQ ID NO: 23996 - DNA, 103 bp, Artificial Sequence
  Synthetic Polynucleotide
taatacgactcactatagggtccatgccaggcgattgtcagatggatgctaacagaggagaagcatcatgctgacaatcaacctggcggcagcgcaaaagatg

SEQ ID NO: 23997 - DNA, 103 bp, Artificial Sequence
  Synthetic Polynucleotide
taatacgactcactatagggtattgtccatgccaggcgattgtcagatggaacagaggagaccatctatgaatcgcctgaacctggcggcagcgcaaaagatg

SEQ ID NO: 23998 - DNA, 103 bp, Artificial Sequence
  Synthetic Polynucleotide
taatacgactcactatagggtttcctattgtccatgccaggcgattgtcaaacagaggagatgacaaatgcctggcatgaacctggcggcagcgcaaaagatg

SEQ ID NO: 23999 - DNA, 103 bp, Artificial Sequence
  Synthetic Polynucleotide
taatacgactcactatagggtgacactattttcaagagtatcctcgtcttaacagaggagaaagacgatgatactcttgaacctggcggcagcgcaaaagatg

SEQ ID NO: 24000 - DNA, 103 bp, Artificial Sequence
  Synthetic Polynucleotide
taatacgactcactatagggctcgatttcctattgtccatgccaggcgataacagaggagaatcgccatgcatggacaaaacctggcggcagcgcaaaagatg

SEQ ID NO: 24001 - DNA, 103 bp, Artificial Sequence
  Synthetic Polynucleotide
taatacgactcactatagggcggtgctcgatttcctattgtccatgccagaacagaggagactggcaatgacaataggaaacctggcggcagcgcaaaagatg

SEQ ID NO: 24002 - DNA, 103 bp, Artificial Sequence
  Synthetic Polynucleotide
taatacgactcactatagggatatacggtgctcgatttcctattgtccataacagaggagaatggacatgaggaaatcgaacctggcggcagcgcaaaagatg

SEQ ID NO: 24003 - DNA, 103 bp, Artificial Sequence
  Synthetic Polynucleotide
taatacgactcactatagggaccctatatacggtgctcgatttcctattgaacagaggagacaatagatgatcgagcacaacctggcggcagcgcaaaagatg

SEQ ID NO: 24004 - DNA, 103 bp, Artificial Sequence
  Synthetic Polynucleotide
taatacgactcactatagggtcgtgaccctatatacggtgctcgatttccaacagaggagaggaaatatggcaccgtataacctggcggcagcgcaaaagatg

SEQ ID NO: 24005 - DNA, 103 bp, Artificial Sequence
  Synthetic Polynucleotide
taatacgactcactatagggtctgttcgtgaccctatatacggtgctcgaaacagaggagatcgagcatggtatataggaacctggcggcagcgcaaaagatg

SEQ ID NO: 24006 - DNA, 103 bp, Artificial Sequence
  Synthetic Polynucleotide
taatacgactcactatagggtatcttctgttcgtgaccctatatacggtgaacagaggagacaccgtatgtagggtcacaacctggcggcagcgcaaaagatg

SEQ ID NO: 24007 - DNA, 103 bp, Artificial Sequence
  Synthetic Polynucleotide
taatacgactcactatagggaattttatcttctgttcgtgaccctatataaacagaggagatatataatgtcacgaacaaacctggcggcagcgcaaaagatg

SEQ ID NO: 24008 - DNA, 103 bp, Artificial Sequence
  Synthetic Polynucleotide
taatacgactcactatagggtaaccaattttatcttctgttcgtgaccctaacagaggagaagggtcatgaacagaagaaacctggcggcagcgcaaaagatg

SEQ ID NO: 24009 - DNA, 103 bp, Artificial Sequence
  Synthetic Polynucleotide
taatacgactcactataggggagggtaaccaattttatcttctgttcgtgaacagaggagacacgaaatgaagataaaaaacctggcggcagcgcaaaagatg

SEQ ID NO: 24010 - DNA, 103 bp, Artificial Sequence
  Synthetic Polynucleotide
taatacgactcactatagggggccatgacactattttcaagagtatcctcaacagaggagagaggatatgcttgaaaataacctggcggcagcgcaaaagatg

SEQ ID NO: 24011 - DNA, 103 bp, Artificial Sequence
  Synthetic Polynucleotide
taatacgactcactatagggtaaaggagggtaaccaattttatcttctgtaacagaggagaacagaaatgaaaattggtaacctggcggcagcgcaaaagatg

SEQ ID NO: 24012 - DNA, 103 bp, Artificial Sequence
  Synthetic Polynucleotide
taatacgactcactatagggactcttaaaggagggtaaccaattttatctaacagaggagaagataaatgtggttacccaacctggcggcagcgcaaaagatg

SEQ ID NO: 24013 - DNA, 103 bp, Artificial Sequence
  Synthetic Polynucleotide
taatacgactcactatagggagtttactcttaaaggagggtaaccaatttaacagaggagaaaattgatgaccctccttaacctggcggcagcgcaaaagatg

SEQ ID NO: 24014 - DNA, 103 bp, Artificial Sequence
  Synthetic Polynucleotide
taatacgactcactatagggtgggcagtttactcttaaaggagggtaaccaacagaggagaggttacatgcctttaagaaacctggcggcagcgcaaaagatg

SEQ ID NO: 24015 - DNA, 103 bp, Artificial Sequence
  Synthetic Polynucleotide
taatacgactcactataggggccgatgggcagtttactcttaaaggagggaacagaggagaccctccatgaagagtaaaaacctggcggcagcgcaaaagatg

SEQ ID NO: 24016 - DNA, 103 bp, Artificial Sequence
  Synthetic Polynucleotide
taatacgactcactataggggggctgccgatgggcagtttactcttaaagaacagaggagactttaaatgtaaactgccaacctggcggcagcgcaaaagatg

SEQ ID NO: 24017 - DNA, 103 bp, Artificial Sequence
  Synthetic Polynucleotide
taatacgactcactatagggtttaagggctgccgatgggcagtttactctaacagaggagaagagtaatgtgcccatcgaacctggcggcagcgcaaaagatg

SEQ ID NO: 24018 - DNA, 103 bp, Artificial Sequence
  Synthetic Polynucleotide
taatacgactcactataggggcttctttaagggctgccgatgggcagtttaacagaggagaaaactgatgatcggcagcaacctggcggcagcgcaaaagatg

SEQ ID NO: 24019 - DNA, 103 bp, Artificial Sequence
  Synthetic Polynucleotide
taatacgactcactatagggcaatagcttctttaagggctgccgatgggcaacagaggagagcccatatgcagcccttaaacctggcggcagcgcaaaagatg

SEQ ID NO: 24020 - DNA, 103 bp, Artificial Sequence
  Synthetic Polynucleotide
taatacgactcactatagggcatttcaatagcttctttaagggctgccgaaacagaggagatcggcaatgcttaaagaaaacctggcggcagcgcaaaagatg

SEQ ID NO: 24021 - DNA, 103 bp, Artificial Sequence
  Synthetic Polynucleotide
taatacgactcactatagggcttggggccatgacactattttcaagagtaaacagaggagatactctatgaaatagtgtaacctggcggcagcgcaaaagatg

SEQ ID NO: 24022 - DNA, 103 bp, Artificial Sequence
  Synthetic Polynucleotide
taatacgactcactataggggagaccatttcaatagcttctttaagggctaacagaggagaagccctatgagaagctataacctggcggcagcgcaaaagatg

SEQ ID NO: 24023 - DNA, 103 bp, Artificial Sequence
  Synthetic Polynucleotide
taatacgactcactataggggtctagagaccatttcaatagcttctttaaaacagaggagattaaagatgctattgaaaaacctggcggcagcgcaaaagatg

SEQ ID NO: 24024 - DNA, 103 bp, Artificial Sequence
  Synthetic Polynucleotide
taatacgactcactatagggcaatagtctagagaccatttcaatagcttcaacagaggagagaagctatggaaatggtcaacctggcggcagcgcaaaagatg

SEQ ID NO: 24025 - DNA, 103 bp, Artificial Sequence
  Synthetic Polynucleotide
taatacgactcactatagggacccacaatagtctagagaccatttcaataaacagaggagatattgaatgggtctctagaacctggcggcagcgcaaaagatg

SEQ ID NO: 24026 - DNA, 103 bp, Artificial Sequence
  Synthetic Polynucleotide
taatacgactcactataggggagtcacccacaatagtctagagaccatttaacagaggagaaaatggatgctagactataacctggcggcagcgcaaaagatg

SEQ ID NO: 24027 - DNA, 103 bp, Artificial Sequence
  Synthetic Polynucleotide
taatacgactcactataggggccttgagtcacccacaatagtctagagacaacagaggagagtctctatgctattgtggaacctggcggcagcgcaaaagatg

SEQ ID NO: 24028 - DNA, 103 bp, Artificial Sequence
  Synthetic Polynucleotide
taatacgactcactataggggcggtgccttgagtcacccacaatagtctaaacagaggagatagactatggtgggtgacaacctggcggcagcgcaaaagatg

SEQ ID NO: 24029 - DNA, 103 bp, Artificial Sequence
  Synthetic Polynucleotide
taatacgactcactataggggatctgcggtgccttgagtcacccacaataaacagaggagatattgtatgtgactcaagaacctggcggcagcgcaaaagatg

SEQ ID NO: 24030 - DNA, 103 bp, Artificial Sequence
  Synthetic Polynucleotide
taatacgactcactatagggttctcgatctgcggtgccttgagtcacccaaacagaggagatgggtgatgcaaggcaccaacctggcggcagcgcaaaagatg

SEQ ID NO: 24031 - DNA, 103 bp, Artificial Sequence
  Synthetic Polynucleotide
taatacgactcactatagggaatttttctcgatctgcggtgccttgagtcaacagaggagagactcaatgcaccgcagaaacctggcggcagcgcaaaagatg

SEQ ID NO: 24032 - DNA, 103 bp, Artificial Sequence
  Synthetic Polynucleotide
taatacgactcactatagggtagtgcttggggccatgacactattttcaaaacagaggagattgaaaatggtgtcatggaacctggcggcagcgcaaaagatg

SEQ ID NO: 24033 - DNA, 103 bp, Artificial Sequence
  Synthetic Polynucleotide
taatacgactcactatagggtgagcaatttttctcgatctgcggtgccttaacagaggagaaaggcaatgcagatcgagaacctggcggcagcgcaaaagatg

SEQ ID NO: 24034 - DNA, 103 bp, Artificial Sequence
  Synthetic Polynucleotide
taatacgactcactatagggaggaatgagcaatttttctcgatctgcggtaacagaggagaaccgcaatgcgagaaaaaaacctggcggcagcgcaaaagatg

SEQ ID NO: 24035 - DNA, 103 bp, Artificial Sequence
  Synthetic Polynucleotide
taatacgactcactatagggagaagaggaatgagcaatttttctcgatctaacagaggagaagatcgatgaaaattgctaacctggcggcagcgcaaaagatg

SEQ ID NO: 24036 - DNA, 103 bp, Artificial Sequence
  Synthetic Polynucleotide
taatacgactcactatagggaattgagaagaggaatgagcaatttttctcaacagaggagagagaaaatgtgctcattcaacctggcggcagcgcaaaagatg

SEQ ID NO: 24037 - DNA, 103 bp, Artificial Sequence
  Synthetic Polynucleotide
taatacgactcactatagggtcttgaattgagaagaggaatgagcaatttaacagaggagaaaattgatgattcctcttaacctggcggcagcgcaaaagatg

SEQ ID NO: 24038 - DNA, 103 bp, Artificial Sequence
  Synthetic Polynucleotide
taatacgactcactatagggttaactcttgaattgagaagaggaatgagcaacagaggagagctcatatgtcttctcaaaacctggcggcagcgcaaaagatg

SEQ ID NO: 24039 - DNA, 103 bp, Artificial Sequence
  Synthetic Polynucleotide
taatacgactcactatagggctaaattaactcttgaattgagaagaggaaaacagaggagattcctcatgtcaattcaaaacctggcggcagcgcaaaagatg

SEQ ID NO: 24040 - DNA, 103 bp, Artificial Sequence
  Synthetic Polynucleotide
taatacgactcactatagggatagtctaaattaactcttgaattgagaagaacagaggagacttctcatgtcaagagttaacctggcggcagcgcaaaagatg

SEQ ID NO: 24041 - DNA, 103 bp, Artificial Sequence
  Synthetic Polynucleotide
taatacgactcactataggggtctgatagtctaaattaactcttgaattgaacagaggagacaattcatgagttaatttaacctggcggcagcgcaaaagatg

SEQ ID NO: 24042 - DNA, 103 bp, Artificial Sequence
  Synthetic Polynucleotide
taatacgactcactataggggcactgtctgatagtctaaattaactcttgaacagaggagacaagagatgatttagactaacctggcggcagcgcaaaagatg

SEQ ID NO: 24043 - DNA, 103 bp, Artificial Sequence
  Synthetic Polynucleotide
taatacgactcactatagggcaaagtagtgcttggggccatgacactattaacagaggagaaatagtatgatggccccaaacctggcggcagcgcaaaagatg

SEQ ID NO: 24044 - DNA, 103 bp, Artificial Sequence
  Synthetic Polynucleotide
taatacgactcactataggggttgagcactgtctgatagtctaaattaacaacagaggagagttaatatggactatcagaacctggcggcagcgcaaaagatg

SEQ ID NO: 24045 - DNA, 103 bp, Artificial Sequence
  Synthetic Polynucleotide
taatacgactcactatagggaggaagttgagcactgtctgatagtctaaaaacagaggagatttagaatgtcagacagtaacctggcggcagcgcaaaagatg

SEQ ID NO: 24046 - DNA, 103 bp, Artificial Sequence
  Synthetic Polynucleotide
taatacgactcactatagggtgggcaggaagttgagcactgtctgatagtaacagaggagaactatcatgcagtgctcaaacctggcggcagcgcaaaagatg

SEQ ID NO: 24047 - DNA, 103 bp, Artificial Sequence
  Synthetic Polynucleotide
taatacgactcactataggggtgagtgggcaggaagttgagcactgtctgaacagaggagacagacaatgctcaacttcaacctggcggcagcgcaaaagatg

SEQ ID NO: 24048 - DNA, 103 bp, Artificial Sequence
  Synthetic Polynucleotide
taatacgactcactataggggagtagtgagtgggcaggaagttgagcactaacagaggagaagtgctatgcttcctgccaacctggcggcagcgcaaaagatg

SEQ ID NO: 24049 - DNA, 103 bp, Artificial Sequence
  Synthetic Polynucleotide
taatacgactcactatagggtgcctgagtagtgagtgggcaggaagttgaaacagaggagatcaactatgtgcccactcaacctggcggcagcgcaaaagatg

SEQ ID NO: 24050 - DNA, 103 bp, Artificial Sequence
  Synthetic Polynucleotide
taatacgactcactatagggtatattgcctgagtagtgagtgggcaggaaaacagaggagattcctgatgactcactacaacctggcggcagcgcaaaagatg

SEQ ID NO: 24051 - DNA, 103 bp, Artificial Sequence
  Synthetic Polynucleotide
taatacgactcactatagggtgaactatattgcctgagtagtgagtgggcaacagaggagagcccacatgctactcaggaacctggcggcagcgcaaaagatg

SEQ ID NO: 24052 - DNA, 103 bp, Artificial Sequence
  Synthetic Polynucleotide
taatacgactcactatagggatctgtgaactatattgcctgagtagtgagaacagaggagactcactatgcaggcaataaacctggcggcagcgcaaaagatg

SEQ ID NO: 24053 - DNA, 103 bp, Artificial Sequence
  Synthetic Polynucleotide
taatacgactcactatagggattgtatctgtgaactatattgcctgagtaaacagaggagatactcaatgaatatagttaacctggcggcagcgcaaaagatg

SEQ ID NO: 24054 - DNA, 103 bp, Artificial Sequence
  Synthetic Polynucleotide
taatacgactcactatagggtctctcaaagtagtgcttggggccatgacaaacagaggagatgtcatatgcccaagcacaacctggcggcagcgcaaaagatg

SEQ ID NO: 24055 - DNA, 103 bp, Artificial Sequence
  Synthetic Polynucleotide
taatacgactcactatagggtgatcattgtatctgtgaactatattgcctaacagaggagaaggcaaatgagttcacagaacctggcggcagcgcaaaagatg

SEQ ID NO: 24056 - DNA, 103 bp, Artificial Sequence
  Synthetic Polynucleotide
taatacgactcactatagggcatattgatcattgtatctgtgaactatataacagaggagaatatagatgacagatacaaacctggcggcagcgcaaaagatg

SEQ ID NO: 24057 - DNA, 103 bp, Artificial Sequence
  Synthetic Polynucleotide
taatacgactcactatagggttgtccatattgatcattgtatctgtgaacaacagaggagagttcacatgtacaatgataacctggcggcagcgcaaaagatg

SEQ ID NO: 24058 - DNA, 103 bp, Artificial Sequence
  Synthetic Polynucleotide
taatacgactcactataggggagtgttgtccatattgatcattgtatctgaacagaggagacagataatgtgatcaataaacctggcggcagcgcaaaagatg

SEQ ID NO: 24059 - DNA, 103 bp, Artificial Sequence
  Synthetic Polynucleotide
taatacgactcactatagggtaaaggagtgttgtccatattgatcattgtaacagaggagaacaatgatgaatatggacaacctggcggcagcgcaaaagatg

SEQ ID NO: 24060 - DNA, 103 bp, Artificial Sequence
  Synthetic Polynucleotide
taatacgactcactatagggtgccataaaggagtgttgtccatattgatcaacagaggagagatcaaatgggacaacacaacctggcggcagcgcaaaagatg

SEQ ID NO: 24061 - DNA, 103 bp, Artificial Sequence
  Synthetic Polynucleotide
taatacgactcactatagggctatttgccataaaggagtgttgtccatataacagaggagaatatggatgacactccttaacctggcggcagcgcaaaagatg

SEQ ID NO: 24062 - DNA, 103 bp, Artificial Sequence
  Synthetic Polynucleotide
taatacgactcactatagggtcattctatttgccataaaggagtgttgtcaacagaggagagacaacatgcctttatggaacctggcggcagcgcaaaagatg

SEQ ID NO: 24063 - DNA, 103 bp, Artificial Sequence
  Synthetic Polynucleotide
taatacgactcactatagggattgctcattctatttgccataaaggagtgaacagaggagacactccatgatggcaaataacctggcggcagcgcaaaagatg

SEQ ID NO: 24064 - DNA, 103 bp, Artificial Sequence
  Synthetic Polynucleotide
taatacgactcactataggggatgtattgctcattctatttgccataaagaacagaggagactttatatgaaatagaataacctggcggcagcgcaaaagatg

SEQ ID NO: 24065 - DNA, 103 bp, Artificial Sequence
  Synthetic Polynucleotide
taatacgactcactatagggtgggttctctcaaagtagtgcttggggccaaacagaggagatggcccatggcactacttaacctggcggcagcgcaaaagatg

SEQ ID NO: 24066 - DNA, 103 bp, Artificial Sequence
  Synthetic Polynucleotide
taatacgactcactataggggagtggatgtattgctcattctatttgccaaacagaggagatggcaaatggaatgagcaaacctggcggcagcgcaaaagatg

SEQ ID NO: 24067 - DNA, 103 bp, Artificial Sequence
  Synthetic Polynucleotide
taatacgactcactatagggtgcacgagtggatgtattgctcattctattaacagaggagaaatagaatgagcaatacaaacctggcggcagcgcaaaagatg

SEQ ID NO: 24068 - DNA, 103 bp, Artificial Sequence
  Synthetic Polynucleotide
taatacgactcactatagggatgattgcacgagtggatgtattgctcattaacagaggagaaatgagatgtacatccacaacctggcggcagcgcaaaagatg

SEQ ID NO: 24069 - DNA, 103 bp, Artificial Sequence
  Synthetic Polynucleotide
taatacgactcactatagggttgatatgattgcacgagtggatgtattgcaacagaggagagcaataatgccactcgtgaacctggcggcagcgcaaaagatg

SEQ ID NO: 24070 - DNA, 103 bp, Artificial Sequence
  Synthetic Polynucleotide
taatacgactcactataggggttagttgatatgattgcacgagtggatgtaacagaggagaacatccatgcgtgcaatcaacctggcggcagcgcaaaagatg

SEQ ID NO: 24071 - DNA, 103 bp, Artificial Sequence
  Synthetic Polynucleotide
taatacgactcactatagggagtgtgttagttgatatgattgcacgagtgaacagaggagacactcgatgaatcatatcaacctggcggcagcgcaaaagatg

SEQ ID NO: 24072 - DNA, 103 bp, Artificial Sequence
  Synthetic Polynucleotide
taatacgactcactatagggtccctagtgtgttagttgatatgattgcacaacagaggagagtgcaaatgtatcaactaaacctggcggcagcgcaaaagatg

SEQ ID NO: 24073 - DNA, 103 bp, Artificial Sequence
  Synthetic Polynucleotide
taatacgactcactatagggatatttccctagtgtgttagttgatatgataacagaggagaatcataatgactaacacaaacctggcggcagcgcaaaagatg

SEQ ID NO: 24074 - DNA, 103 bp, Artificial Sequence
  Synthetic Polynucleotide
taatacgactcactatagggccagcatatttccctagtgtgttagttgataacagaggagaatcaacatgcacactaggaacctggcggcagcgcaaaagatg

SEQ ID NO: 24075 - DNA, 103 bp, Artificial Sequence
  Synthetic Polynucleotide
taatacgactcactatagggcccctccagcatatttccctagtgtgttagaacagaggagactaacaatgtagggaaataacctggcggcagcgcaaaagatg

SEQ ID NO: 24076 - DNA, 103 bp, Artificial Sequence
  Synthetic Polynucleotide
taatacgactcactatagggttctttgggttctctcaaagtagtgcttggaacagaggagaccaagcatgactttgagaaacctggcggcagcgcaaaagatg

SEQ ID NO: 24077 - DNA, 103 bp, Artificial Sequence
  Synthetic Polynucleotide
taatacgactcactatagggttgaccccctccagcatatttccctagtgtaacagaggagaacactaatgaaatatgctaacctggcggcagcgcaaaagatg

SEQ ID NO: 24078 - DNA, 103 bp, Artificial Sequence
  Synthetic Polynucleotide
taatacgactcactataggggcagcttgaccccctccagcatatttccctaacagaggagaagggaaatgtgctggaggaacctggcggcagcgcaaaagatg

SEQ ID NO: 24079 - DNA, 103 bp, Artificial Sequence
  Synthetic Polynucleotide
taatacgactcactatagggcaacagcagcttgaccccctccagcatattaacagaggagaaatatgatggagggggtcaacctggcggcagcgcaaaagatg

SEQ ID NO: 24080 - DNA, 103 bp, Artificial Sequence
  Synthetic Polynucleotide
taatacgactcactatagggactatcaacagcagcttgaccccctccagcaacagaggagagctggaatgggtcaagctaacctggcggcagcgcaaaagatg

SEQ ID NO: 24081 - DNA, 103 bp, Artificial Sequence
  Synthetic Polynucleotide
taatacgactcactatagggatattactatcaacagcagcttgaccccctaacagaggagaagggggatgagctgctgtaacctggcggcagcgcaaaagatg

SEQ ID NO: 24082 - DNA, 103 bp, Artificial Sequence
  Synthetic Polynucleotide
taatacgactcactatagggagattatattactatcaacagcagcttgacaacagaggagagtcaagatgctgttgataaacctggcggcagcgcaaaagatg

SEQ ID NO: 24083 - DNA, 103 bp, Artificial Sequence
  Synthetic Polynucleotide
taatacgactcactatagggctggaagattatattactatcaacagcagcaacagaggagagctgctatggatagtaataacctggcggcagcgcaaaagatg

SEQ ID NO: 24084 - DNA, 103 bp, Artificial Sequence
  Synthetic Polynucleotide
taatacgactcactataggggtgttctggaagattatattactatcaacaaacagaggagatgttgaatgtaatataataacctggcggcagcgcaaaagatg

SEQ ID NO: 24085 - DNA, 103 bp, Artificial Sequence
  Synthetic Polynucleotide
taatacgactcactatagggtaatagtgttctggaagattatattactataacagaggagaatagtaatgtaatcttccaacctggcggcagcgcaaaagatg

SEQ ID NO: 24086 - DNA, 103 bp, Artificial Sequence
  Synthetic Polynucleotide
taatacgactcactatagggtaaattaatagtgttctggaagattatattaacagaggagaaatataatgttccagaacaacctggcggcagcgcaaaagatg

SEQ ID NO: 24087 - DNA, 103 bp, Artificial Sequence
  Synthetic Polynucleotide
taatacgactcactatagggaacaatatcaccttcttattacgaacatgaaacagaggagatcatgtatgtaataagaaaacctggcggcagcgcaaaagatg

SEQ ID NO: 24088 - DNA, 103 bp, Artificial Sequence
  Synthetic Polynucleotide
taatacgactcactataggggaaacttctttgggttctctcaaagtagtgaacagaggagacactacatggagagaaccaacctggcggcagcgcaaaagatg

SEQ ID NO: 24089 - DNA, 103 bp, Artificial Sequence
  Synthetic Polynucleotide
taatacgactcactatagggacacctaaattaatagtgttctggaagattaacagaggagaaatcttatggaacactataacctggcggcagcgcaaaagatg

SEQ ID NO: 24090 - DNA, 103 bp, Artificial Sequence
  Synthetic Polynucleotide
taatacgactcactatagggctgcaacacctaaattaatagtgttctggaaacagaggagatccagaatgctattaattaacctggcggcagcgcaaaagatg

SEQ ID NO: 24091 - DNA, 103 bp, Artificial Sequence
  Synthetic Polynucleotide
taatacgactcactatagggcaaaactgcaacacctaaattaatagtgttaacagaggagaaacactatgaatttaggtaacctggcggcagcgcaaaagatg

SEQ ID NO: 24092 - DNA, 103 bp, Artificial Sequence
  Synthetic Polynucleotide
taatacgactcactatagggatgtccaaaactgcaacacctaaattaataaacagaggagatattaaatgaggtgttgcaacctggcggcagcgcaaaagatg

SEQ ID NO: 24093 - DNA, 103 bp, Artificial Sequence
  Synthetic Polynucleotide
taatacgactcactatagggatgtaatgtccaaaactgcaacacctaaataacagaggagaatttagatgttgcagtttaacctggcggcagcgcaaaagatg

SEQ ID NO: 24094 - DNA, 103 bp, Artificial Sequence
  Synthetic Polynucleotide
taatacgactcactatagggagacaatgtaatgtccaaaactgcaacaccaacagaggagaggtgttatggttttggacaacctggcggcagcgcaaaagatg

SEQ ID NO: 24095 - DNA, 103 bp, Artificial Sequence
  Synthetic Polynucleotide
taatacgactcactataggggaaagagacaatgtaatgtccaaaactgcaaacagaggagatgcagtatgggacattacaacctggcggcagcgcaaaagatg

SEQ ID NO: 24096 - DNA, 103 bp, Artificial Sequence
  Synthetic Polynucleotide
taatacgactcactatagggatttagaaagagacaatgtaatgtccaaaaaacagaggagattttggatgttacattgtaacctggcggcagcgcaaaagatg

SEQ ID NO: 24097 - DNA, 103 bp, Artificial Sequence
  Synthetic Polynucleotide
taatacgactcactatagggtgacaatttagaaagagacaatgtaatgtcaacagaggagagacattatgttgtctcttaacctggcggcagcgcaaaagatg

SEQ ID NO: 24098 - DNA, 103 bp, Artificial Sequence
  Synthetic Polynucleotide
taatacgactcactataggggttgatgacaatttagaaagagacaatgtaaacagaggagatacattatgtctttctaaaacctggcggcagcgcaaaagatg

SEQ ID NO: 24099 - DNA, 103 bp, Artificial Sequence
  Synthetic Polynucleotide
taatacgactcactataggggttcggaaacttctttgggttctctcaaagaacagaggagactttgaatgaacccaaagaacctggcggcagcgcaaaagatg

SEQ ID NO: 24100 - DNA, 103 bp, Artificial Sequence
  Synthetic Polynucleotide
taatacgactcactatagggttgatgttgatgacaatttagaaagagacaaacagaggagatgtctcatgctaaattgtaacctggcggcagcgcaaaagatg

SEQ ID NO: 24101 - DNA, 103 bp, Artificial Sequence
  Synthetic Polynucleotide
taatacgactcactatagggaacatttgatgttgatgacaatttagaaagaacagaggagactttctatgttgtcatcaaacctggcggcagcgcaaaagatg

SEQ ID NO: 24102 - DNA, 103 bp, Artificial Sequence
  Synthetic Polynucleotide
taatacgactcactatagggaaagaaacatttgatgttgatgacaatttaaacagaggagataaattatgatcaacatcaacctggcggcagcgcaaaagatg

SEQ ID NO: 24103 - DNA, 103 bp, Artificial Sequence
  Synthetic Polynucleotide
taatacgactcactatagggaacggaaagaaacatttgatgttgatgacaaacagaggagatgtcatatgcatcaaatgaacctggcggcagcgcaaaagatg

SEQ ID NO: 24104 - DNA, 103 bp, Artificial Sequence
  Synthetic Polynucleotide
taatacgactcactatagggcattaaacggaaagaaacatttgatgttgaaacagaggagatcaacaatgaatgtttctaacctggcggcagcgcaaaagatg

SEQ ID NO: 24105 - DNA, 103 bp, Artificial Sequence
  Synthetic Polynucleotide
taatacgactcactatagggcttaacattaaacggaaagaaacatttgataacagaggagaatcaaaatgttctttccgaacctggcggcagcgcaaaagatg

SEQ ID NO: 24106 - DNA, 103 bp, Artificial Sequence
  Synthetic Polynucleotide
taatacgactcactatagggatttacttaacattaaacggaaagaaacataacagaggagaatgtttatgtccgtttaaaacctggcggcagcgcaaaagatg

SEQ ID NO: 24107 - DNA, 103 bp, Artificial Sequence
  Synthetic Polynucleotide
taatacgactcactataggggcaacatttacttaacattaaacggaaagaaacagaggagatctttcatgttaatgttaaacctggcggcagcgcaaaagatg

SEQ ID NO: 24108 - DNA, 103 bp, Artificial Sequence
  Synthetic Polynucleotide
taatacgactcactatagggcgtgtgcaacatttacttaacattaaacggaacagaggagaccgtttatggttaagtaaaacctggcggcagcgcaaaagatg

SEQ ID NO: 24109 - DNA, 103 bp, Artificial Sequence
  Synthetic Polynucleotide
taatacgactcactatagggcatgccgtgtgcaacatttacttaacattaaacagaggagataatgtatggtaaatgttaacctggcggcagcgcaaaagatg

SEQ ID NO: 24110 - DNA, 103 bp, Artificial Sequence
  Synthetic Polynucleotide
taatacgactcactatagggtagtggttcggaaacttctttgggttctctaacagaggagaagagaaatgaaagaagttaacctggcggcagcgcaaaagatg

SEQ ID NO: 24111 - DNA, 103 bp, Artificial Sequence
  Synthetic Polynucleotide
taatacgactcactatagggcggtacatgccgtgtgcaacatttacttaaaacagaggagattaagtatgtgttgcacaaacctggcggcagcgcaaaagatg

SEQ ID NO: 24112 - DNA, 103 bp, Artificial Sequence
  Synthetic Polynucleotide
taatacgactcactatagggtcagacggtacatgccgtgtgcaacatttaaacagaggagataaatgatgcacacggcaaacctggcggcagcgcaaaagatg

SEQ ID NO: 24113 - DNA, 103 bp, Artificial Sequence
  Synthetic Polynucleotide
taatacgactcactatagggaatactcagacggtacatgccgtgtgcaacaacagaggagagttgcaatgggcatgtacaacctggcggcagcgcaaaagatg

SEQ ID NO: 24114 - DNA, 103 bp, Artificial Sequence
  Synthetic Polynucleotide
taatacgactcactataggggaataaatactcagacggtacatgccgtgtaacagaggagaacacggatggtaccgtctaacctggcggcagcgcaaaagatg

SEQ ID NO: 24115 - DNA, 103 bp, Artificial Sequence
  Synthetic Polynucleotide
taatacgactcactatagggtcaaagaataaatactcagacggtacatgcaacagaggagagcatgtatggtctgagtaaacctggcggcagcgcaaaagatg

SEQ ID NO: 24116 - DNA, 103 bp, Artificial Sequence
  Synthetic Polynucleotide
taatacgactcactataggggtttatcaaagaataaatactcagacggtaaacagaggagataccgtatgagtatttataacctggcggcagcgcaaaagatg

SEQ ID NO: 24117 - DNA, 103 bp, Artificial Sequence
  Synthetic Polynucleotide
taatacgactcactatagggtaaaggtttatcaaagaataaatactcagaaacagaggagatctgagatgttattctttaacctggcggcagcgcaaaagatg

SEQ ID NO: 24118 - DNA, 103 bp, Artificial Sequence
  Synthetic Polynucleotide
taatacgactcactatagggacatctaaaggtttatcaaagaataaatacaacagaggagagtatttatgctttgataaaacctggcggcagcgcaaaagatg

SEQ ID NO: 24119 - DNA, 103 bp, Artificial Sequence
  Synthetic Polynucleotide
taatacgactcactatagggaatccacatctaaaggtttatcaaagaataaacagaggagatattctatgataaaccttaacctggcggcagcgcaaaagatg

SEQ ID NO: 24120 - DNA, 103 bp, Artificial Sequence
  Synthetic Polynucleotide
taatacgactcactataggggttcaaatccacatctaaaggtttatcaaaaacagaggagatttgatatgcctttagataacctggcggcagcgcaaaagatg

SEQ ID NO: 24121 - DNA, 103 bp, Artificial Sequence
  Synthetic Polynucleotide
taatacgactcactatagggtgccttagtggttcggaaacttctttgggtaacagaggagaacccaaatgagtttccgaaacctggcggcagcgcaaaagatg

SEQ ID NO: 24122 - DNA, 103 bp, Artificial Sequence
  Synthetic Polynucleotide
taatacgactcactatagggtacttgttcaaatccacatctaaaggtttaaacagaggagataaaccatgagatgtggaaacctggcggcagcgcaaaagatg

SEQ ID NO: 24123 - DNA, 103 bp, Artificial Sequence
  Synthetic Polynucleotide
taatacgactcactatagggccatgtacttgttcaaatccacatctaaagaacagaggagactttagatgtggatttgaaacctggcggcagcgcaaaagatg

SEQ ID NO: 24124 - DNA, 103 bp, Artificial Sequence
  Synthetic Polynucleotide
taatacgactcactataggggttgtccatgtacttgttcaaatccacatcaacagaggagagatgtgatgttgaacaagaacctggcggcagcgcaaaagatg

SEQ ID NO: 24125 - DNA, 103 bp, Artificial Sequence
  Synthetic Polynucleotide
taatacgactcactatagggaactcgttgtccatgtacttgttcaaatccaacagaggagaggatttatgcaagtacataacctggcggcagcgcaaaagatg

SEQ ID NO: 24126 - DNA, 103 bp, Artificial Sequence
  Synthetic Polynucleotide
taatacgactcactatagggaaactaactcgttgtccatgtacttgttcaaacagaggagatgaacaatgacatggacaaacctggcggcagcgcaaaagatg

SEQ ID NO: 24127 - DNA, 103 bp, Artificial Sequence
  Synthetic Polynucleotide
taatacgactcactatagggatcgtaaactaactcgttgtccatgtacttaacagaggagaaagtacatggacaacgagaacctggcggcagcgcaaaagatg

SEQ ID NO: 24128 - DNA, 103 bp, Artificial Sequence
  Synthetic Polynucleotide
taatacgactcactatagggtcattatcgtaaactaactcgttgtccatgaacagaggagacatggaatgcgagttagtaacctggcggcagcgcaaaagatg

SEQ ID NO: 24129 - DNA, 103 bp, Artificial Sequence
  Synthetic Polynucleotide
taatacgactcactataggggaggatcattatcgtaaactaactcgttgtaacagaggagaacaacgatgtagtttacgaacctggcggcagcgcaaaagatg

SEQ ID NO: 24130 - DNA, 103 bp, Artificial Sequence
  Synthetic Polynucleotide
taatacgactcactatagggacagagaggatcattatcgtaaactaactcaacagaggagagagttaatgtacgataataacctggcggcagcgcaaaagatg

SEQ ID NO: 24131 - DNA, 103 bp, Artificial Sequence
  Synthetic Polynucleotide
taatacgactcactatagggccactacagagaggatcattatcgtaaactaacagaggagaagtttaatgtaatgatccaacctggcggcagcgcaaaagatg

SEQ ID NO: 24132 - DNA, 103 bp, Artificial Sequence
  Synthetic Polynucleotide
taatacgactcactataggggagtttgccttagtggttcggaaacttcttaacagaggagaaagaagatgccgaaccacaacctggcggcagcgcaaaagatg

SEQ ID NO: 24133 - DNA, 103 bp, Artificial Sequence
  Synthetic Polynucleotide
taatacgactcactatagggttattccactacagagaggatcattatcgtaacagaggagaacgataatgatcctctctaacctggcggcagcgcaaaagatg

SEQ ID NO: 24134 - DNA, 103 bp, Artificial Sequence
  Synthetic Polynucleotide
taatacgactcactatagggtccctttattccactacagagaggatcattaacagaggagaaatgatatgctctgtagtaacctggcggcagcgcaaaagatg

SEQ ID NO: 24135 - DNA, 103 bp, Artificial Sequence
  Synthetic Polynucleotide
taatacgactcactatagggaatcttccctttattccactacagagaggaaacagaggagatcctctatgtagtggaataacctggcggcagcgcaaaagatg

SEQ ID NO: 24136 - DNA, 103 bp, Artificial Sequence
  Synthetic Polynucleotide
taatacgactcactatagggtacctaatcttccctttattccactacagaaacagaggagatctgtaatggaataaaggaacctggcggcagcgcaaaagatg

SEQ ID NO: 24137 - DNA, 103 bp, Artificial Sequence
  Synthetic Polynucleotide
taatacgactcactatagggtactctacctaatcttccctttattccactaacagaggagaagtggaatgaagggaagaaacctggcggcagcgcaaaagatg

SEQ ID NO: 24138 - DNA, 103 bp, Artificial Sequence
  Synthetic Polynucleotide
taatacgactcactatagggcttgatactctacctaatcttccctttattaacagaggagaaataaaatgaagattaggaacctggcggcagcgcaaaagatg

SEQ ID NO: 24139 - DNA, 103 bp, Artificial Sequence
  Synthetic Polynucleotide
taatacgactcactatagggttgatcttgatactctacctaatcttccctaacagaggagaagggaaatgtaggtagagaacctggcggcagcgcaaaagatg

SEQ ID NO: 24140 - DNA, 103 bp, Artificial Sequence
  Synthetic Polynucleotide
taatacgactcactataggggagtgttgatcttgatactctacctaatctaacagaggagaagattaatgagagtatcaaacctggcggcagcgcaaaagatg

SEQ ID NO: 24141 - DNA, 103 bp, Artificial Sequence
  Synthetic Polynucleotide
taatacgactcactatagggaatgagagtgttgatcttgatactctacctaacagaggagaaggtagatgatcaagatcaacctggcggcagcgcaaaagatg

SEQ ID NO: 24142 - DNA, 103 bp, Artificial Sequence
  Synthetic Polynucleotide
taatacgactcactataggggactcaatgagagtgttgatcttgatactcaacagaggagagagtatatggatcaacacaacctggcggcagcgcaaaagatg

SEQ ID NO: 24143 - DNA, 103 bp, Artificial Sequence
  Synthetic Polynucleotide
taatacgactcactataggggtcctgagtttgccttagtggttcggaaacaacagaggagagtttccatgccactaaggaacctggcggcagcgcaaaagatg

SEQ ID NO: 24144 - DNA, 103 bp, Artificial Sequence
  Synthetic Polynucleotide
taatacgactcactatagggatttagactcaatgagagtgttgatcttgaaacagaggagatcaagaatgacactctcaaacctggcggcagcgcaaaagatg

SEQ ID NO: 24145 - DNA, 103 bp, Artificial Sequence
  Synthetic Polynucleotide
taatacgactcactatagggcttacatttagactcaatgagagtgttgataacagaggagaatcaacatgctcattgagaacctggcggcagcgcaaaagatg

SEQ ID NO: 24146 - DNA, 103 bp, Artificial Sequence
  Synthetic Polynucleotide
taatacgactcactatagggtatcgcttacatttagactcaatgagagtgaacagaggagacactctatgtgagtctaaaacctggcggcagcgcaaaagatg

SEQ ID NO: 24147 - DNA, 103 bp, Artificial Sequence
  Synthetic Polynucleotide
taatacgactcactatagggtccaatatcgcttacatttagactcaatgaaacagaggagatcattgatgctaaatgtaaacctggcggcagcgcaaaagatg

SEQ ID NO: 24148 - DNA, 103 bp, Artificial Sequence
  Synthetic Polynucleotide
taatacgactcactatagggtaagatccaatatcgcttacatttagactcaacagaggagagagtctatgtgtaagcgaaacctggcggcagcgcaaaagatg

SEQ ID NO: 24149 - DNA, 103 bp, Artificial Sequence
  Synthetic Polynucleotide
taatacgactcactatagggagtcgtaagatccaatatcgcttacatttaaacagaggagataaatgatggcgatattgaacctggcggcagcgcaaaagatg

SEQ ID NO: 24150 - DNA, 103 bp, Artificial Sequence
  Synthetic Polynucleotide
taatacgactcactatagggcggaaagtcgtaagatccaatatcgcttacaacagaggagagtaagcatgattggatctaacctggcggcagcgcaaaagatg

SEQ ID NO: 24151 - DNA, 103 bp, Artificial Sequence
  Synthetic Polynucleotide
taatacgactcactatagggatagtcggaaagtcgtaagatccaatatcgaacagaggagacgatatatgatcttacgaaacctggcggcagcgcaaaagatg

SEQ ID NO: 24152 - DNA, 103 bp, Artificial Sequence
  Synthetic Polynucleotide
taatacgactcactatagggcagcaatagtcggaaagtcgtaagatccaaaacagaggagattggatatgacgactttcaacctggcggcagcgcaaaagatg

SEQ ID NO: 24153 - DNA, 103 bp, Artificial Sequence
  Synthetic Polynucleotide
taatacgactcactatagggccacgcagcaatagtcggaaagtcgtaagaaacagaggagatcttacatgtttccgactaacctggcggcagcgcaaaagatg

SEQ ID NO: 24154 - DNA, 103 bp, Artificial Sequence
  Synthetic Polynucleotide
taatacgactcactatagggtcaaggtcctgagtttgccttagtggttcgaacagaggagacgaaccatgaaggcaaacaacctggcggcagcgcaaaagatg

SEQ ID NO: 24155 - DNA, 103 bp, Artificial Sequence
  Synthetic Polynucleotide
taatacgactcactatagggaaagtccacgcagcaatagtcggaaagtcgaacagaggagacgacttatggactattgcaacctggcggcagcgcaaaagatg

SEQ ID NO: 24156 - DNA, 103 bp, Artificial Sequence
  Synthetic Polynucleotide
taatacgactcactatagggctcctaaagtccacgcagcaatagtcggaaaacagaggagattccgaatgttgctgcgtaacctggcggcagcgcaaaagatg

SEQ ID NO: 24157 - DNA, 103 bp, Artificial Sequence
  Synthetic Polynucleotide
taatacgactcactatagggtgtctctcctaaagtccacgcagcaatagtaacagaggagaactattatggcgtggactaacctggcggcagcgcaaaagatg

SEQ ID NO: 24158 - DNA, 103 bp, Artificial Sequence
  Synthetic Polynucleotide
taatacgactcactatagggataattgtctctcctaaagtccacgcagcaaacagaggagatgctgcatggactttaggaacctggcggcagcgcaaaagatg

SEQ ID NO: 24159 - DNA, 103 bp, Artificial Sequence
  Synthetic Polynucleotide
taatacgactcactatagggttccaataattgtctctcctaaagtccacgaacagaggagacgtggaatgtaggagagaaacctggcggcagcgcaaaagatg

SEQ ID NO: 24160 - DNA, 103 bp, Artificial Sequence
  Synthetic Polynucleotide
taatacgactcactatagggaatacttccaataattgtctctcctaaagtaacagaggagaactttaatggagacaattaacctggcggcagcgcaaaagatg

SEQ ID NO: 24161 - DNA, 103 bp, Artificial Sequence
  Synthetic Polynucleotide
taatacgactcactataggggaaaaaatacttccaataattgtctctcctaacagaggagaaggagaatgaattattggaacctggcggcagcgcaaaagatg

SEQ ID NO: 24162 - DNA, 103 bp, Artificial Sequence
  Synthetic Polynucleotide
taatacgactcactatagggcatcagaaaaaatacttccaataattgtctaacagaggagaagacaaatgttggaagtaaacctggcggcagcgcaaaagatg

SEQ ID NO: 24163 - DNA, 103 bp, Artificial Sequence
  Synthetic Polynucleotide
taatacgactcactatagggagattcatcagaaaaaatacttccaataataacagaggagaattattatgagtatttttaacctggcggcagcgcaaaagatg

SEQ ID NO: 24164 - DNA, 103 bp, Artificial Sequence
  Synthetic Polynucleotide
taatacgactcactatagggtgagaagattcatcagaaaaaatacttccaaacagaggagatggaagatgtttttctgaaacctggcggcagcgcaaaagatg

SEQ ID NO: 24165 - DNA, 103 bp, Artificial Sequence
  Synthetic Polynucleotide
taatacgactcactatagggtaatatcaaggtcctgagtttgccttagtgaacagaggagacactaaatgaaactcaggaacctggcggcagcgcaaaagatg

SEQ ID NO: 24166 - DNA, 103 bp, Artificial Sequence
  Synthetic Polynucleotide
taatacgactcactatagggtactttgagaagattcatcagaaaaaatacaacagaggagagtatttatgctgatgaataacctggcggcagcgcaaaagatg

SEQ ID NO: 24167 - DNA, 103 bp, Artificial Sequence
  Synthetic Polynucleotide
taatacgactcactataggggtctgtactttgagaagattcatcagaaaaaacagaggagattttctatggaatcttctaacctggcggcagcgcaaaagatg

SEQ ID NO: 24168 - DNA, 103 bp, Artificial Sequence
  Synthetic Polynucleotide
taatacgactcactatagggatagggtctgtactttgagaagattcatcaaacagaggagatgatgaatgttctcaaagaacctggcggcagcgcaaaagatg

SEQ ID NO: 24169 - DNA, 103 bp, Artificial Sequence
  Synthetic Polynucleotide
taatacgactcactatagggaacttatagggtctgtactttgagaagattaacagaggagaaatcttatgaaagtacagaacctggcggcagcgcaaaagatg

SEQ ID NO: 24170 - DNA, 103 bp, Artificial Sequence
  Synthetic Polynucleotide
taatacgactcactataggggcctgaacttatagggtctgtactttgagaaacagaggagatctcaaatgacagaccctaacctggcggcagcgcaaaagatg

SEQ ID NO: 24171 - DNA, 103 bp, Artificial Sequence
  Synthetic Polynucleotide
taatacgactcactataggggtacagcctgaacttatagggtctgtacttaacagaggagaaagtacatgccctataagaacctggcggcagcgcaaaagatg

SEQ ID NO: 24172 - DNA, 103 bp, Artificial Sequence
  Synthetic Polynucleotide
taatacgactcactatagggtttttgtacagcctgaacttatagggtctgaacagaggagacagaccatgtaagttcagaacctggcggcagcgcaaaagatg

SEQ ID NO: 24173 - DNA, 103 bp, Artificial Sequence
  Synthetic Polynucleotide
taatacgactcactatagggaaaagtttttgtacagcctgaacttataggaacagaggagacctataatgtcaggctgtaacctggcggcagcgcaaaagatg

SEQ ID NO: 24174 - DNA, 103 bp, Artificial Sequence
  Synthetic Polynucleotide
taatacgactcactataggggttacaaaagtttttgtacagcctgaacttaacagaggagaaagttcatgctgtacaaaaacctggcggcagcgcaaaagatg

SEQ ID NO: 24175 - DNA, 103 bp, Artificial Sequence
  Synthetic Polynucleotide
taatacgactcactatagggagtgtgttacaaaagtttttgtacagcctgaacagaggagacaggctatgcaaaaacttaacctggcggcagcgcaaaagatg

SEQ ID NO: 24176 - DNA, 103 bp, Artificial Sequence
  Synthetic Polynucleotide
taatacgactcactatagggttggctaatatcaaggtcctgagtttgcctaacagaggagaaggcaaatgcaggaccttaacctggcggcagcgcaaaagatg

SEQ ID NO: 24177 - DNA, 103 bp, Artificial Sequence
  Synthetic Polynucleotide
taatacgactcactatagggaagaaagtgtgttacaaaagtttttgtacaaacagaggagatgtacaatgacttttgtaaacctggcggcagcgcaaaagatg

SEQ ID NO: 24178 - DNA, 103 bp, Artificial Sequence
  Synthetic Polynucleotide
taatacgactcactatagggtacacaagaaagtgtgttacaaaagtttttaacagaggagaaaaaacatgtgtaacacaaacctggcggcagcgcaaaagatg

SEQ ID NO: 24179 - DNA, 103 bp, Artificial Sequence
  Synthetic Polynucleotide
taatacgactcactatagggctggatacacaagaaagtgtgttacaaaagaacagaggagacttttgatgcacactttcaacctggcggcagcgcaaaagatg

SEQ ID NO: 24180 - DNA, 103 bp, Artificial Sequence
  Synthetic Polynucleotide
taatacgactcactatagggctcaactggatacacaagaaagtgtgttacaacagaggagagtaacaatgtttcttgtgaacctggcggcagcgcaaaagatg

SEQ ID NO: 24181 - DNA, 103 bp, Artificial Sequence
  Synthetic Polynucleotide
taatacgactcactatagggatactctcaactggatacacaagaaagtgtaacagaggagaacacttatgtgtgtatccaacctggcggcagcgcaaaagatg

SEQ ID NO: 24182 - DNA, 103 bp, Artificial Sequence
  Synthetic Polynucleotide
taatacgactcactatagggaaaagatactctcaactggatacacaagaaaacagaggagattcttgatgatccagttgaacctggcggcagcgcaaaagatg

SEQ ID NO: 24183 - DNA, 103 bp, Artificial Sequence
  Synthetic Polynucleotide
taatacgactcactatagggggcataaaagatactctcaactggatacacaacagaggagagtgtatatggttgagagtaacctggcggcagcgcaaaagatg

SEQ ID NO: 24184 - DNA, 103 bp, Artificial Sequence
  Synthetic Polynucleotide
taatacgactcactatagggccaaaggcataaaagatactctcaactggaaacagaggagatccagtatggagtatcttaacctggcggcagcgcaaaagatg

SEQ ID NO: 24185 - DNA, 103 bp, Artificial Sequence
  Synthetic Polynucleotide
taatacgactcactatagggtagctccaaaggcataaaagatactctcaaaacagaggagattgagaatgtcttttatgaacctggcggcagcgcaaaagatg

SEQ ID NO: 24186 - DNA, 103 bp, Artificial Sequence
  Synthetic Polynucleotide
taatacgactcactatagggtagattagctccaaaggcataaaagatactaacagaggagaagtatcatgtatgcctttaacctggcggcagcgcaaaagatg

SEQ ID NO: 24187 - DNA, 103 bp, Artificial Sequence
  Synthetic Polynucleotide
taatacgactcactatagggttcttttggctaatatcaaggtcctgagttaacagaggagaaactcaatgccttgatataacctggcggcagcgcaaaagatg

SEQ ID NO: 24188 - DNA, 103 bp, Artificial Sequence
  Synthetic Polynucleotide
taatacgactcactatagggactattagattagctccaaaggcataaaagaacagaggagacttttaatgctttggagcaacctggcggcagcgcaaaagatg

SEQ ID NO: 24189 - DNA, 103 bp, Artificial Sequence
  Synthetic Polynucleotide
taatacgactcactatagggtttccactattagattagctccaaaggcataacagaggagaatgcctatggagctaatcaacctggcggcagcgcaaaagatg

SEQ ID NO: 24190 - DNA, 103 bp, Artificial Sequence
  Synthetic Polynucleotide
taatacgactcactatagggtaaactttccactattagattagctccaaaaacagaggagatttggaatgaatctaataaacctggcggcagcgcaaaagatg

SEQ ID NO: 24191 - DNA, 103 bp, Artificial Sequence
  Synthetic Polynucleotide
taatacgactcactatagggaaacttaaactttccactattagattagctaacagaggagaagctaaatgaatagtggaaacctggcggcagcgcaaaagatg

SEQ ID NO: 24192 - DNA, 103 bp, Artificial Sequence
  Synthetic Polynucleotide
taatacgactcactatagggtgcttaaacttaaactttccactattagataacagaggagaatctaaatgtggaaagttaacctggcggcagcgcaaaagatg

SEQ ID NO: 24193 - DNA, 103 bp, Artificial Sequence
  Synthetic Polynucleotide
taatacgactcactataggggatcctgcttaaacttaaactttccactataacagaggagaatagtgatgagtttaagtaacctggcggcagcgcaaaagatg

SEQ ID NO: 24194 - DNA, 103 bp, Artificial Sequence
  Synthetic Polynucleotide
taatacgactcactataggggaattgatcctgcttaaacttaaactttccaacagaggagaggaaagatgaagtttaagaacctggcggcagcgcaaaagatg

SEQ ID NO: 24195 - DNA, 103 bp, Artificial Sequence
  Synthetic Polynucleotide
taatacgactcactatagggtgattgaattgatcctgcttaaacttaaacaacagaggagagtttaaatgtaagcaggaaacctggcggcagcgcaaaagatg

SEQ ID NO: 24196 - DNA, 103 bp, Artificial Sequence
  Synthetic Polynucleotide
taatacgactcactataggggctcttgattgaattgatcctgcttaaactaacagaggagaagtttaatgaggatcaataacctggcggcagcgcaaaagatg

SEQ ID NO: 24197 - DNA, 103 bp, Artificial Sequence
  Synthetic Polynucleotide
taatacgactcactataggggagaggctcttgattgaattgatcctgcttaacagaggagaaagcagatgcaattcaataacctggcggcagcgcaaaagatg

SEQ ID NO: 24198 - DNA, 103 bp, Artificial Sequence
  Synthetic Polynucleotide
taatacgactcactatagggtatcaaacaatatcaccttcttattacgaaaacagaggagattcgtaatgagaaggtgaaacctggcggcagcgcaaaagatg

SEQ ID NO: 24199 - DNA, 103 bp, Artificial Sequence
  Synthetic Polynucleotide
taatacgactcactatagggcctgtttcttttggctaatatcaaggtcctaacagaggagaaggaccatgatattagccaacctggcggcagcgcaaaagatg

SEQ ID NO: 24200 - DNA, 103 bp, Artificial Sequence
  Synthetic Polynucleotide
taatacgactcactatagggaatctgagaggctcttgattgaattgatccaacagaggagaggatcaatgcaatcaagaaacctggcggcagcgcaaaagatg

SEQ ID NO: 24201 - DNA, 103 bp, Artificial Sequence
  Synthetic Polynucleotide
taatacgactcactatagggtgttaaatctgagaggctcttgattgaattaacagaggagaaattcaatgaagagcctcaacctggcggcagcgcaaaagatg

SEQ ID NO: 24202 - DNA, 103 bp, Artificial Sequence
  Synthetic Polynucleotide
taatacgactcactatagggagaaatgttaaatctgagaggctcttgattaacagaggagaaatcaaatgcctctcagaaacctggcggcagcgcaaaagatg

SEQ ID NO: 24203 - DNA, 103 bp, Artificial Sequence
  Synthetic Polynucleotide
taatacgactcactatagggatataagaaatgttaaatctgagaggctctaacagaggagaagagccatgcagatttaaaacctggcggcagcgcaaaagatg

SEQ ID NO: 24204 - DNA, 103 bp, Artificial Sequence
  Synthetic Polynucleotide
taatacgactcactatagggggatgatataagaaatgttaaatctgagagaacagaggagactctcaatgttaacatttaacctggcggcagcgcaaaagatg

SEQ ID NO: 24205 - DNA, 103 bp, Artificial Sequence
  Synthetic Polynucleotide
taatacgactcactatagggattgtggatgatataagaaatgttaaatctaacagaggagaagatttatgatttcttataacctggcggcagcgcaaaagatg

SEQ ID NO: 24206 - DNA, 103 bp, Artificial Sequence
  Synthetic Polynucleotide
taatacgactcactatagggttctgattgtggatgatataagaaatgttaaacagaggagataacatatgttatatcataacctggcggcagcgcaaaagatg

SEQ ID NO: 24207 - DNA, 103 bp, Artificial Sequence
  Synthetic Polynucleotide
taatacgactcactatagggcaaatttctgattgtggatgatataagaaaaacagaggagatttcttatgtcatccacaaacctggcggcagcgcaaaagatg

SEQ ID NO: 24208 - DNA, 103 bp, Artificial Sequence
  Synthetic Polynucleotide
taatacgactcactatagggtgtgacaaatttctgattgtggatgatataaacagaggagatatatcatgcacaatcagaacctggcggcagcgcaaaagatg

SEQ ID NO: 24209 - DNA, 103 bp, Artificial Sequence
  Synthetic Polynucleotide
taatacgactcactatagggatctgtgtgacaaatttctgattgtggatgaacagaggagacatccaatgtcagaaattaacctggcggcagcgcaaaagatg

SEQ ID NO: 24210 - DNA, 103 bp, Artificial Sequence
  Synthetic Polynucleotide
taatacgactcactatagggatttccctgtttcttttggctaatatcaagaacagaggagacttgatatgagccaaaagaacctggcggcagcgcaaaagatg

SEQ ID NO: 24211 - DNA, 103 bp, Artificial Sequence
  Synthetic Polynucleotide
taatacgactcactatagggaagtgatctgtgtgacaaatttctgattgtaacagaggagaacaatcatgaatttgtcaaacctggcggcagcgcaaaagatg

SEQ ID NO: 24212 - DNA, 103 bp, Artificial Sequence
  Synthetic Polynucleotide
taatacgactcactatagggattcgaagtgatctgtgtgacaaatttctgaacagaggagacagaaaatggtcacacagaacctggcggcagcgcaaaagatg

SEQ ID NO: 24213 - DNA, 103 bp, Artificial Sequence
  Synthetic Polynucleotide
taatacgactcactataggggaagaattcgaagtgatctgtgtgacaaataacagaggagaatttgtatgacagatcacaacctggcggcagcgcaaaagatg

SEQ ID NO: 24214 - DNA, 103 bp, Artificial Sequence
  Synthetic Polynucleotide
taatacgactcactatagggagattgaagaattcgaagtgatctgtgtgaaacagaggagatcacacatgtcacttcgaaacctggcggcagcgcaaaagatg

SEQ ID NO: 24215 - DNA, 103 bp, Artificial Sequence
  Synthetic Polynucleotide
taatacgactcactatagggaaagtagattgaagaattcgaagtgatctgaacagaggagacagatcatgtcgaattctaacctggcggcagcgcaaaagatg

SEQ ID NO: 24216 - DNA, 103 bp, Artificial Sequence
  Synthetic Polynucleotide
taatacgactcactataggggtcggaaagtagattgaagaattcgaagtgaacagaggagacacttcatgttcttcaataacctggcggcagcgcaaaagatg

SEQ ID NO: 24217 - DNA, 103 bp, Artificial Sequence
  Synthetic Polynucleotide
taatacgactcactatagggttcatgtcggaaagtagattgaagaattcgaacagaggagacgaattatgcaatctactaacctggcggcagcgcaaaagatg

SEQ ID NO: 24218 - DNA, 103 bp, Artificial Sequence
  Synthetic Polynucleotide
taatacgactcactatagggaccaattcatgtcggaaagtagattgaagaaacagaggagatcttcaatgtactttccgaacctggcggcagcgcaaaagatg

SEQ ID NO: 24219 - DNA, 103 bp, Artificial Sequence
  Synthetic Polynucleotide
taatacgactcactatagggttaataccaattcatgtcggaaagtagattaacagaggagaaatctaatgtccgacatgaacctggcggcagcgcaaaagatg

SEQ ID NO: 24220 - DNA, 103 bp, Artificial Sequence
  Synthetic Polynucleotide
taatacgactcactatagggtctagttaataccaattcatgtcggaaagtaacagaggagaactttcatgcatgaattgaacctggcggcagcgcaaaagatg

SEQ ID NO: 24221 - DNA, 103 bp, Artificial Sequence
  Synthetic Polynucleotide
taatacgactcactataggggattcatttccctgtttcttttggctaataaacagaggagatattagatgaaagaaacaaacctggcggcagcgcaaaagatg

SEQ ID NO: 24222 - DNA, 103 bp, Artificial Sequence
  Synthetic Polynucleotide
taatacgactcactataggggctagtctagttaataccaattcatgtcggaacagaggagaccgacaatgattggtattaacctggcggcagcgcaaaagatg

SEQ ID NO: 24223 - DNA, 103 bp, Artificial Sequence
  Synthetic Polynucleotide
taatacgactcactataggggatgagctagtctagttaataccaattcataacagaggagaatgaatatgtattaactaaacctggcggcagcgcaaaagatg

SEQ ID NO: 24224 - DNA, 103 bp, Artificial Sequence
  Synthetic Polynucleotide
taatacgactcactatagggtatatgatgagctagtctagttaataccaaaacagaggagattggtaatgactagactaaacctggcggcagcgcaaaagatg

SEQ ID NO: 24225 - DNA, 103 bp, Artificial Sequence
  Synthetic Polynucleotide
taatacgactcactatagggaatggtatatgatgagctagtctagttaataacagaggagaattaacatgactagctcaaacctggcggcagcgcaaaagatg

SEQ ID NO: 24226 - DNA, 103 bp, Artificial Sequence
  Synthetic Polynucleotide
taatacgactcactatagggaaatcaatggtatatgatgagctagtctagaacagaggagactagacatgctcatcataaacctggcggcagcgcaaaagatg

SEQ ID NO: 24227 - DNA, 103 bp, Artificial Sequence
  Synthetic Polynucleotide
taatacgactcactatagggtaaggaaatcaatggtatatgatgagctagaacagaggagactagctatgcatataccaaacctggcggcagcgcaaaagatg

SEQ ID NO: 24228 - DNA, 103 bp, Artificial Sequence
  Synthetic Polynucleotide
taatacgactcactatagggagcattaaggaaatcaatggtatatgatgaaacagaggagatcatcaatgaccattgataacctggcggcagcgcaaaagatg

SEQ ID NO: 24229 - DNA, 103 bp, Artificial Sequence
  Synthetic Polynucleotide
taatacgactcactatagggctcctagcattaaggaaatcaatggtatataacagaggagaatatacatgtgatttcctaacctggcggcagcgcaaaagatg

SEQ ID NO: 24230 - DNA, 103 bp, Artificial Sequence
  Synthetic Polynucleotide
taatacgactcactatagggagaacctcctagcattaaggaaatcaatggaacagaggagaccattgatgtccttaatgaacctggcggcagcgcaaaagatg

SEQ ID NO: 24231 - DNA, 103 bp, Artificial Sequence
  Synthetic Polynucleotide
taatacgactcactatagggcccgcagaacctcctagcattaaggaaatcaacagaggagagatttcatgaatgctaggaacctggcggcagcgcaaaagatg

SEQ ID NO: 24232 - DNA, 103 bp, Artificial Sequence
  Synthetic Polynucleotide
taatacgactcactatagggctgttgattcatttccctgtttcttttggcaacagaggagagccaaaatgaacagggaaaacctggcggcagcgcaaaagatg

SEQ ID NO: 24233 - DNA, 103 bp, Artificial Sequence
  Synthetic Polynucleotide
taatacgactcactatagggtctcacccgcagaacctcctagcattaaggaacagaggagaccttaaatgtaggaggttaacctggcggcagcgcaaaagatg

SEQ ID NO: 24234 - DNA, 103 bp, Artificial Sequence
  Synthetic Polynucleotide
taatacgactcactatagggacttttctcacccgcagaacctcctagcataacagaggagaatgctaatgggttctgcgaacctggcggcagcgcaaaagatg

SEQ ID NO: 24235 - DNA, 103 bp, Artificial Sequence
  Synthetic Polynucleotide
taatacgactcactataggggacgaacttttctcacccgcagaacctcctaacagaggagaaggaggatgtgcgggtgaaacctggcggcagcgcaaaagatg

SEQ ID NO: 24236 - DNA, 103 bp, Artificial Sequence
  Synthetic Polynucleotide
taatacgactcactatagggcatccgacgaacttttctcacccgcagaacaacagaggagagttctgatggtgagaaaaaacctggcggcagcgcaaaagatg

SEQ ID NO: 24237 - DNA, 103 bp, Artificial Sequence
  Synthetic Polynucleotide
taatacgactcactataggggacagcatccgacgaacttttctcacccgcaacagaggagagcgggtatgaaaagttcgaacctggcggcagcgcaaaagatg

SEQ ID NO: 24238 - DNA, 103 bp, Artificial Sequence
  Synthetic Polynucleotide
taatacgactcactatagggagtcggacagcatccgacgaacttttctcaaacagaggagatgagaaatgttcgtcggaaacctggcggcagcgcaaaagatg

SEQ ID NO: 24239 - DNA, 103 bp, Artificial Sequence
  Synthetic Polynucleotide
taatacgactcactataggggaaatagtcggacagcatccgacgaactttaacagaggagaaaagttatgcggatgctgaacctggcggcagcgcaaaagatg

SEQ ID NO: 24240 - DNA, 103 bp, Artificial Sequence
  Synthetic Polynucleotide
taatacgactcactatagggcgtaagaaatagtcggacagcatccgacgaaacagaggagatcgtcgatggctgtccgaaacctggcggcagcgcaaaagatg

SEQ ID NO: 24241 - DNA, 103 bp, Artificial Sequence
  Synthetic Polynucleotide
taatacgactcactatagggcttgccgtaagaaatagtcggacagcatccaacagaggagaggatgcatgccgactattaacctggcggcagcgcaaaagatg

SEQ ID NO: 24242 - DNA, 103 bp, Artificial Sequence
  Synthetic Polynucleotide
taatacgactcactataggggataacttgccgtaagaaatagtcggacagaacagaggagactgtccatgtatttcttaaacctggcggcagcgcaaaagatg

SEQ ID NO: 24243 - DNA, 103 bp, Artificial Sequence
  Synthetic Polynucleotide
taatacgactcactatagggtggatctgttgattcatttccctgtttcttaacagaggagaaagaaaatgggaaatgaaaacctggcggcagcgcaaaagatg

SEQ ID NO: 24244 - DNA, 103 bp, Artificial Sequence
  Synthetic Polynucleotide
taatacgactcactatagggattttgataacttgccgtaagaaatagtcgaacagaggagacgactaatgcttacggcaaacctggcggcagcgcaaaagatg

SEQ ID NO: 24245 - DNA, 103 bp, Artificial Sequence
  Synthetic Polynucleotide
taatacgactcactatagggataaaattttgataacttgccgtaagaaataacagaggagaatttctatgggcaagttaaacctggcggcagcgcaaaagatg

SEQ ID NO: 24246 - DNA, 103 bp, Artificial Sequence
  Synthetic Polynucleotide
taatacgactcactatagggtattgataaaattttgataacttgccgtaaaacagaggagattacggatggttatcaaaaacctggcggcagcgcaaaagatg

SEQ ID NO: 24247 - DNA, 103 bp, Artificial Sequence
  Synthetic Polynucleotide
taatacgactcactataggggaaattattgataaaattttgataacttgcaacagaggagagcaagtatgcaaaattttaacctggcggcagcgcaaaagatg

SEQ ID NO: 24248 - DNA, 103 bp, Artificial Sequence
  Synthetic Polynucleotide
taatacgactcactatagggcaactgaaattattgataaaattttgataaaacagaggagattatcaatgttttatcaaaacctggcggcagcgcaaaagatg

SEQ ID NO: 24249 - DNA, 103 bp, Artificial Sequence
  Synthetic Polynucleotide
taatacgactcactatagggtcaaacaactgaaattattgataaaattttaacagaggagaaaaattatgtcaataattaacctggcggcagcgcaaaagatg

SEQ ID NO: 24250 - DNA, 103 bp, Artificial Sequence
  Synthetic Polynucleotide
taatacgactcactatagggtctcatcaaacaactgaaattattgataaaaacagaggagatttatcatgaatttcagtaacctggcggcagcgcaaaagatg

SEQ ID NO: 24251 - DNA, 103 bp, Artificial Sequence
  Synthetic Polynucleotide
taatacgactcactatagggttctttctcatcaaacaactgaaattattgaacagaggagacaataaatgcagttgtttaacctggcggcagcgcaaaagatg

SEQ ID NO: 24252 - DNA, 103 bp, Artificial Sequence
  Synthetic Polynucleotide
taatacgactcactatagggattggttctttctcatcaaacaactgaaataacagaggagaatttcaatggtttgatgaaacctggcggcagcgcaaaagatg

SEQ ID NO: 24253 - DNA, 103 bp, Artificial Sequence
  Synthetic Polynucleotide
taatacgactcactatagggtggtgattggttctttctcatcaaacaactaacagaggagaagttgtatgatgagaaagaacctggcggcagcgcaaaagatg

SEQ ID NO: 24254 - DNA, 103 bp, Artificial Sequence
  Synthetic Polynucleotide
taatacgactcactatagggcttgctggatctgttgattcatttccctgtaacagaggagaacagggatgtgaatcaacaacctggcggcagcgcaaaagatg

SEQ ID NO: 24255 - DNA, 103 bp, Artificial Sequence
  Synthetic Polynucleotide
taatacgactcactatagggggtaatggtgattggttctttctcatcaaaaacagaggagatttgatatgaaagaaccaaacctggcggcagcgcaaaagatg

SEQ ID NO: 24256 - DNA, 103 bp, Artificial Sequence
  Synthetic Polynucleotide
taatacgactcactatagggaaactggtaatggtgattggttctttctcaaacagaggagatgagaaatgaccaatcacaacctggcggcagcgcaaaagatg

SEQ ID NO: 24257 - DNA, 103 bp, Artificial Sequence
  Synthetic Polynucleotide
taatacgactcactatagggaagccaaactggtaatggtgattggttcttaacagaggagaaagaacatgtcaccattaaacctggcggcagcgcaaaagatg

SEQ ID NO: 24258 - DNA, 103 bp, Artificial Sequence
  Synthetic Polynucleotide
taatacgactcactatagggaaataaagccaaactggtaatggtgattggaacagaggagaccaatcatgattaccagtaacctggcggcagcgcaaaagatg

SEQ ID NO: 24259 - DNA, 103 bp, Artificial Sequence
  Synthetic Polynucleotide
taatacgactcactatagggtagggaaataaagccaaactggtaatggtgaacagaggagacaccatatgcagtttggcaacctggcggcagcgcaaaagatg

SEQ ID NO: 24260 - DNA, 103 bp, Artificial Sequence
  Synthetic Polynucleotide
taatacgactcactatagggttcactagggaaataaagccaaactggtaaaacagaggagattaccaatgtggctttataacctggcggcagcgcaaaagatg

SEQ ID NO: 24261 - DNA, 103 bp, Artificial Sequence
  Synthetic Polynucleotide
taatacgactcactatagggtgcccttcactagggaaataaagccaaactaacagaggagaagtttgatgttatttcccaacctggcggcagcgcaaaagatg

SEQ ID NO: 24262 - DNA, 103 bp, Artificial Sequence
  Synthetic Polynucleotide
taatacgactcactataggggttgttgcccttcactagggaaataaagccaacagaggagaggctttatgtccctagtgaacctggcggcagcgcaaaagatg

SEQ ID NO: 24263 - DNA, 103 bp, Artificial Sequence
  Synthetic Polynucleotide
taatacgactcactatagggttttagttgttgcccttcactagggaaataaacagaggagatatttcatgagtgaagggaacctggcggcagcgcaaaagatg

SEQ ID NO: 24264 - DNA, 103 bp, Artificial Sequence
  Synthetic Polynucleotide
taatacgactcactatagggataggttttagttgttgcccttcactagggaacagaggagaccctagatgagggcaacaaacctggcggcagcgcaaaagatg

SEQ ID NO: 24265 - DNA, 103 bp, Artificial Sequence
  Synthetic Polynucleotide
taatacgactcactataggggttttcttgctggatctgttgattcatttcaacagaggagagaaatgatgcaacagatcaacctggcggcagcgcaaaagatg

SEQ ID NO: 24266 - DNA, 103 bp, Artificial Sequence
  Synthetic Polynucleotide
taatacgactcactatagggttaaaataggttttagttgttgcccttcacaacagaggagagtgaagatgaacaactaaaacctggcggcagcgcaaaagatg

SEQ ID NO: 24267 - DNA, 103 bp, Artificial Sequence
  Synthetic Polynucleotide
taatacgactcactatagggaatttttaaaataggttttagttgttgcccaacagaggagagggcaaatgctaaaacctaacctggcggcagcgcaaaagatg

SEQ ID NO: 24268 - DNA, 103 bp, Artificial Sequence
  Synthetic Polynucleotide
taatacgactcactatagggtgcaaaatttttaaaataggttttagttgtaacagaggagaacaactatgacctattttaacctggcggcagcgcaaaagatg

SEQ ID NO: 24269 - DNA, 103 bp, Artificial Sequence
  Synthetic Polynucleotide
taatacgactcactatagggacctttgcaaaatttttaaaataggttttaaacagaggagataaaacatgttttaaaaaaacctggcggcagcgcaaaagatg

SEQ ID NO: 24270 - DNA, 103 bp, Artificial Sequence
  Synthetic Polynucleotide
taatacgactcactatagggtgataacctttgcaaaatttttaaaataggaacagaggagacctattatgaaaattttgaacctggcggcagcgcaaaagatg

SEQ ID NO: 24271 - DNA, 103 bp, Artificial Sequence
  Synthetic Polynucleotide
taatacgactcactatagggaaacatgataacctttgcaaaatttttaaaaacagaggagatttaaaatgtttgcaaagaacctggcggcagcgcaaaagatg

SEQ ID NO: 24272 - DNA, 103 bp, Artificial Sequence
  Synthetic Polynucleotide
taatacgactcactatagggttaataaacatgataacctttgcaaaatttaacagaggagaaaatttatgaaaggttataacctggcggcagcgcaaaagatg

SEQ ID NO: 24273 - DNA, 103 bp, Artificial Sequence
  Synthetic Polynucleotide
taatacgactcactatagggagttgttaataaacatgataacctttgcaaaacagaggagattgcaaatgttatcatgtaacctggcggcagcgcaaaagatg

SEQ ID NO: 24274 - DNA, 103 bp, Artificial Sequence
  Synthetic Polynucleotide
taatacgactcactatagggtttttagttgttaataaacatgataaccttaacagaggagaaaggttatgatgtttattaacctggcggcagcgcaaaagatg

SEQ ID NO: 24275 - DNA, 103 bp, Artificial Sequence
  Synthetic Polynucleotide
taatacgactcactataggggaacctttttagttgttaataaacatgataaacagaggagatatcatatgtattaacaaaacctggcggcagcgcaaaagatg

SEQ ID NO: 24276 - DNA, 103 bp, Artificial Sequence
  Synthetic Polynucleotide
taatacgactcactataggggaattgttttcttgctggatctgttgattcaacagaggagagaatcaatggatccagcaaacctggcggcagcgcaaaagatg

SEQ ID NO: 24277 - DNA, 103 bp, Artificial Sequence
  Synthetic Polynucleotide
taatacgactcactatagggattttgaacctttttagttgttaataaacaaacagaggagatgtttaatgacaactaaaaacctggcggcagcgcaaaagatg

SEQ ID NO: 24278 - DNA, 103 bp, Artificial Sequence
  Synthetic Polynucleotide
taatacgactcactatagggctgtgattttgaacctttttagttgttaataacagaggagaattaacatgtaaaaaggtaacctggcggcagcgcaaaagatg

SEQ ID NO: 24279 - DNA, 103 bp, Artificial Sequence
  Synthetic Polynucleotide
taatacgactcactatagggcaggtctgtgattttgaacctttttagttgaacagaggagacaactaatgaggttcaaaaacctggcggcagcgcaaaagatg

SEQ ID NO: 24280 - DNA, 103 bp, Artificial Sequence
  Synthetic Polynucleotide
taatacgactcactatagggagctacaggtctgtgattttgaacctttttaacagaggagaaaaaagatgcaaaatcacaacctggcggcagcgcaaaagatg

SEQ ID NO: 24281 - DNA, 103 bp, Artificial Sequence
  Synthetic Polynucleotide
taatacgactcactataggggtatcagctacaggtctgtgattttgaaccaacagaggagaggttcaatgtcacagaccaacctggcggcagcgcaaaagatg

SEQ ID NO: 24282 - DNA, 103 bp, Artificial Sequence
  Synthetic Polynucleotide
taatacgactcactatagggaacaagtatcagctacaggtctgtgattttaacagaggagaaaaatcatggacctgtagaacctggcggcagcgcaaaagatg

SEQ ID NO: 24283 - DNA, 103 bp, Artificial Sequence
  Synthetic Polynucleotide
taatacgactcactatagggcaaaaaacaagtatcagctacaggtctgtgaacagaggagacacagaatggtagctgataacctggcggcagcgcaaaagatg

SEQ ID NO: 24284 - DNA, 103 bp, Artificial Sequence
  Synthetic Polynucleotide
taatacgactcactatagggtcagtcaaaaaacaagtatcagctacaggtaacagaggagaacctgtatgtgatacttgaacctggcggcagcgcaaaagatg

SEQ ID NO: 24285 - DNA, 103 bp, Artificial Sequence
  Synthetic Polynucleotide
taatacgactcactatagggaattatcagtcaaaaaacaagtatcagctaaacagaggagatagctgatgcttgtttttaacctggcggcagcgcaaaagatg

SEQ ID NO: 24286 - DNA, 103 bp, Artificial Sequence
  Synthetic Polynucleotide
taatacgactcactatagggccaaaaattatcagtcaaaaaacaagtatcaacagaggagagatactatgtttttgactaacctggcggcagcgcaaaagatg

SEQ ID NO: 24287 - DNA, 103 bp, Artificial Sequence
  Synthetic Polynucleotide
taatacgactcactatagggcgtaagaattgttttcttgctggatctgttaacagaggagaaacagaatgagcaagaaaaacctggcggcagcgcaaaagatg

SEQ ID NO: 24288 - DNA, 103 bp, Artificial Sequence
  Synthetic Polynucleotide
taatacgactcactatagggtagacccaaaaattatcagtcaaaaaacaaaacagaggagattgtttatggactgataaaacctggcggcagcgcaaaagatg

SEQ ID NO: 24289 - DNA, 103 bp, Artificial Sequence
  Synthetic Polynucleotide
taatacgactcactatagggttggatagacccaaaaattatcagtcaaaaaacagaggagattttgaatgataatttttaacctggcggcagcgcaaaagatg

SEQ ID NO: 24290 - DNA, 103 bp, Artificial Sequence
  Synthetic Polynucleotide
taatacgactcactatagggtttgcttggatagacccaaaaattatcagtaacagaggagaactgatatgttttgggtcaacctggcggcagcgcaaaagatg

SEQ ID NO: 24291 - DNA, 103 bp, Artificial Sequence
  Synthetic Polynucleotide
taatacgactcactataggggttgatttgcttggatagacccaaaaattaaacagaggagataatttatgggtctatccaacctggcggcagcgcaaaagatg

SEQ ID NO: 24292 - DNA, 103 bp, Artificial Sequence
  Synthetic Polynucleotide
taatacgactcactatagggttctcgttgatttgcttggatagacccaaaaacagaggagatttgggatgatccaagcaaacctggcggcagcgcaaaagatg

SEQ ID NO: 24293 - DNA, 103 bp, Artificial Sequence
  Synthetic Polynucleotide
taatacgactcactatagggattagttctcgttgatttgcttggatagacaacagaggagagtctatatgagcaaatcaaacctggcggcagcgcaaaagatg

SEQ ID NO: 24294 - DNA, 103 bp, Artificial Sequence
  Synthetic Polynucleotide
taatacgactcactatagggtaatgattagttctcgttgatttgcttggaaacagaggagatccaagatgatcaacgagaacctggcggcagcgcaaaagatg

SEQ ID NO: 24295 - DNA, 103 bp, Artificial Sequence
  Synthetic Polynucleotide
taatacgactcactatagggcataataatgattagttctcgttgatttgcaacagaggagagcaaatatgcgagaactaaacctggcggcagcgcaaaagatg

SEQ ID NO: 24296 - DNA, 103 bp, Artificial Sequence
  Synthetic Polynucleotide
taatacgactcactatagggacttgcataataatgattagttctcgttgaaacagaggagatcaacgatgactaatcataacctggcggcagcgcaaaagatg

SEQ ID NO: 24297 - DNA, 103 bp, Artificial Sequence
  Synthetic Polynucleotide
taatacgactcactatagggttaagacttgcataataatgattagttctcaacagaggagagagaacatgtcattattaaacctggcggcagcgcaaaagatg

SEQ ID NO: 24298 - DNA, 103 bp, Artificial Sequence
  Synthetic Polynucleotide
taatacgactcactataggggatatcgtaagaattgttttcttgctggataacagaggagaatccagatggaaaacaataacctggcggcagcgcaaaagatg

SEQ ID NO: 24299 - DNA, 103 bp, Artificial Sequence
  Synthetic Polynucleotide
taatacgactcactatagggaataattaagacttgcataataatgattagaacagaggagactaatcatgattatgcaaaacctggcggcagcgcaaaagatg

SEQ ID NO: 24300 - DNA, 103 bp, Artificial Sequence
  Synthetic Polynucleotide
taatacgactcactatagggtctccaataattaagacttgcataataatgaacagaggagacattatatggcaagtcttaacctggcggcagcgcaaaagatg

SEQ ID NO: 24301 - DNA, 103 bp, Artificial Sequence
  Synthetic Polynucleotide
taatacgactcactatagggttgtctctccaataattaagacttgcataaaacagaggagattatgcatgtcttaattaaacctggcggcagcgcaaaagatg

SEQ ID NO: 24302 - DNA, 103 bp, Artificial Sequence
  Synthetic Polynucleotide
taatacgactcactatagggtagctttgtctctccaataattaagacttgaacagaggagacaagtcatgattattggaaacctggcggcagcgcaaaagatg

SEQ ID NO: 24303 - DNA, 103 bp, Artificial Sequence
  Synthetic Polynucleotide
taatacgactcactatagggcttattagctttgtctctccaataattaagaacagaggagacttaatatgtggagagacaacctggcggcagcgcaaaagatg

SEQ ID NO: 24304 - DNA, 103 bp, Artificial Sequence
  Synthetic Polynucleotide
taatacgactcactatagggttaatcttattagctttgtctctccaataaaacagaggagattattgatgagacaaagcaacctggcggcagcgcaaaagatg

SEQ ID NO: 24305 - DNA, 103 bp, Artificial Sequence
  Synthetic Polynucleotide
taatacgactcactatagggtattcttaatcttattagctttgtctctccaacagaggagaggagagatgaagctaataaacctggcggcagcgcaaaagatg

SEQ ID NO: 24306 - DNA, 103 bp, Artificial Sequence
  Synthetic Polynucleotide
taatacgactcactatagggtgaagtattcttaatcttattagctttgtcaacagaggagagacaaaatgaataagattaacctggcggcagcgcaaaagatg

SEQ ID NO: 24307 - DNA, 103 bp, Artificial Sequence
  Synthetic Polynucleotide
taatacgactcactataggggaaaatgaagtattcttaatcttattagctaacagaggagaagctaaatggattaagaaaacctggcggcagcgcaaaagatg

SEQ ID NO: 24308 - DNA, 103 bp, Artificial Sequence
  Synthetic Polynucleotide
taatacgactcactatagggaatgtgaaaatgaagtattcttaatcttataacagaggagaataagaatgagaatacttaacctggcggcagcgcaaaagatg

SEQ ID NO: 24309 - DNA, 103 bp, Artificial Sequence
  Synthetic Polynucleotide
taatacgactcactataggggtttgtatcaaacaatatcaccttcttattaacagaggagaaataagatggtgatattgaacctggcggcagcgcaaaagatg

SEQ ID NO: 24310 - DNA, 103 bp, Artificial Sequence
  Synthetic Polynucleotide
taatacgactcactatagggttcttgatatcgtaagaattgttttcttgcaacagaggagagcaagaatgcaattcttaaacctggcggcagcgcaaaagatg

SEQ ID NO: 24311 - DNA, 103 bp, Artificial Sequence
  Synthetic Polynucleotide
taatacgactcactatagggtatcaaatgtgaaaatgaagtattcttaataacagaggagaattaagatgacttcatttaacctggcggcagcgcaaaagatg

SEQ ID NO: 24312 - DNA, 103 bp, Artificial Sequence
  Synthetic Polynucleotide
taatacgactcactatagggtagtttatcaaatgtgaaaatgaagtattcaacagaggagagaatacatgattttcacaaacctggcggcagcgcaaaagatg

SEQ ID NO: 24313 - DNA, 103 bp, Artificial Sequence
  Synthetic Polynucleotide
taatacgactcactatagggatgaatagtttatcaaatgtgaaaatgaagaacagaggagacttcatatgcacatttgaaacctggcggcagcgcaaaagatg

SEQ ID NO: 24314 - DNA, 103 bp, Artificial Sequence
  Synthetic Polynucleotide
taatacgactcactatagggagaaaatgaatagtttatcaaatgtgaaaaaacagaggagattttcaatgttgataaacaacctggcggcagcgcaaaagatg

SEQ ID NO: 24315 - DNA, 103 bp, Artificial Sequence
  Synthetic Polynucleotide
taatacgactcactatagggggttcagaaaatgaatagtttatcaaatgtaacagaggagaacatttatgaaactattcaacctggcggcagcgcaaaagatg

SEQ ID NO: 24316 - DNA, 103 bp, Artificial Sequence
  Synthetic Polynucleotide
taatacgactcactataggggagagggttcagaaaatgaatagtttatcaaacagaggagatgataaatgattcattttaacctggcggcagcgcaaaagatg

SEQ ID NO: 24317 - DNA, 103 bp, Artificial Sequence
  Synthetic Polynucleotide
taatacgactcactatagggatgtagagagggttcagaaaatgaatagttaacagaggagaaactatatgttttctgaaaacctggcggcagcgcaaaagatg

SEQ ID NO: 24318 - DNA, 103 bp, Artificial Sequence
  Synthetic Polynucleotide
taatacgactcactatagggctcgcatgtagagagggttcagaaaatgaaaacagaggagattcattatgtgaaccctcaacctggcggcagcgcaaaagatg

SEQ ID NO: 24319 - DNA, 103 bp, Artificial Sequence
  Synthetic Polynucleotide
taatacgactcactatagggtagagctcgcatgtagagagggttcagaaaaacagaggagatttctgatgcctctctacaacctggcggcagcgcaaaagatg

SEQ ID NO: 24320 - DNA, 103 bp, Artificial Sequence
  Synthetic Polynucleotide
taatacgactcactatagggagagatagagctcgcatgtagagagggttcaacagaggagagaacccatgctacatgcgaacctggcggcagcgcaaaagatg

SEQ ID NO: 24321 - DNA, 103 bp, Artificial Sequence
  Synthetic Polynucleotide
taatacgactcactatagggggtaattcttgatatcgtaagaattgttttaacagaggagaaaaacaatgcttacgataaacctggcggcagcgcaaaagatg

SEQ ID NO: 24322 - DNA, 103 bp, Artificial Sequence
  Synthetic Polynucleotide
taatacgactcactatagggctagaagagatagagctcgcatgtagagagaacagaggagactctctatgtgcgagctcaacctggcggcagcgcaaaagatg

SEQ ID NO: 24323 - DNA, 103 bp, Artificial Sequence
  Synthetic Polynucleotide
taatacgactcactatagggcttgactagaagagatagagctcgcatgtaaacagaggagatacatgatggctctatctaacctggcggcagcgcaaaagatg

SEQ ID NO: 24324 - DNA, 103 bp, Artificial Sequence
  Synthetic Polynucleotide
taatacgactcactatagggcacttcttgactagaagagatagagctcgcaacagaggagagcgagcatgatctcttctaacctggcggcagcgcaaaagatg

SEQ ID NO: 24325 - DNA, 103 bp, Artificial Sequence
  Synthetic Polynucleotide
taatacgactcactatagggttgaccacttcttgactagaagagatagagaacagaggagactctatatgttctagtcaaacctggcggcagcgcaaaagatg

SEQ ID NO: 24326 - DNA, 103 bp, Artificial Sequence
  Synthetic Polynucleotide
taatacgactcactatagggttaaattgaccacttcttgactagaagagaaacagaggagatctcttatggtcaagaagaacctggcggcagcgcaaaagatg

SEQ ID NO: 24327 - DNA, 103 bp, Artificial Sequence
  Synthetic Polynucleotide
taatacgactcactataggggtgttttaaattgaccacttcttgactagaaacagaggagatctagtatggaagtggtcaacctggcggcagcgcaaaagatg

SEQ ID NO: 24328 - DNA, 103 bp, Artificial Sequence
  Synthetic Polynucleotide
taatacgactcactatagggctggtgtgttttaaattgaccacttcttgaaacagaggagatcaagaatgggtcaatttaacctggcggcagcgcaaaagatg

SEQ ID NO: 24329 - DNA, 103 bp, Artificial Sequence
  Synthetic Polynucleotide
taatacgactcactatagggaacgactggtgtgttttaaattgaccacttaacagaggagaaagtggatgatttaaaacaacctggcggcagcgcaaaagatg

SEQ ID NO: 24330 - DNA, 103 bp, Artificial Sequence
  Synthetic Polynucleotide
taatacgactcactatagggatctaaacgactggtgtgttttaaattgacaacagaggagagtcaatatgaaacacaccaacctggcggcagcgcaaaagatg

SEQ ID NO: 24331 - DNA, 103 bp, Artificial Sequence
  Synthetic Polynucleotide
taatacgactcactataggggtttcatctaaacgactggtgtgttttaaaaacagaggagatttaaaatgcaccagtcgaacctggcggcagcgcaaaagatg

SEQ ID NO: 24332 - DNA, 103 bp, Artificial Sequence
  Synthetic Polynucleotide
taatacgactcactatagggcaggaggtaattcttgatatcgtaagaattaacagaggagaaattctatggatatcaagaacctggcggcagcgcaaaagatg

SEQ ID NO: 24333 - DNA, 103 bp, Artificial Sequence
  Synthetic Polynucleotide
taatacgactcactatagggtaggtgtttcatctaaacgactggtgtgttaacagaggagaaacacaatggtcgtttagaacctggcggcagcgcaaaagatg

SEQ ID NO: 24334 - DNA, 103 bp, Artificial Sequence
  Synthetic Polynucleotide
taatacgactcactatagggcatattaggtgtttcatctaaacgactggtaacagaggagaaccagtatgttagatgaaaacctggcggcagcgcaaaagatg

SEQ ID NO: 24335 - DNA, 103 bp, Artificial Sequence
  Synthetic Polynucleotide
taatacgactcactatagggtcactcatattaggtgtttcatctaaacgaaacagaggagatcgtttatgtgaaacaccaacctggcggcagcgcaaaagatg

SEQ ID NO: 24336 - DNA, 103 bp, Artificial Sequence
  Synthetic Polynucleotide
taatacgactcactatagggccctttcactcatattaggtgtttcatctaaacagaggagatagatgatgcacctaataaacctggcggcagcgcaaaagatg

SEQ ID NO: 24337 - DNA, 103 bp, Artificial Sequence
  Synthetic Polynucleotide
taatacgactcactatagggttgagccctttcactcatattaggtgtttcaacagaggagagaaacaatgaatatgagtaacctggcggcagcgcaaaagatg

SEQ ID NO: 24338 - DNA, 103 bp, Artificial Sequence
  Synthetic Polynucleotide
taatacgactcactataggggttgattgagccctttcactcatattaggtaacagaggagaacctaaatggagtgaaagaacctggcggcagcgcaaaagatg

SEQ ID NO: 24339 - DNA, 103 bp, Artificial Sequence
  Synthetic Polynucleotide
taatacgactcactataggggatttgttgattgagccctttcactcatataacagaggagaatatgaatgaaagggctcaacctggcggcagcgcaaaagatg

SEQ ID NO: 24340 - DNA, 103 bp, Artificial Sequence
  Synthetic Polynucleotide
taatacgactcactatagggctcatgatttgttgattgagccctttcactaacagaggagaagtgaaatggctcaatcaaacctggcggcagcgcaaaagatg

SEQ ID NO: 24341 - DNA, 103 bp, Artificial Sequence
  Synthetic Polynucleotide
taatacgactcactataggggttggctcatgatttgttgattgagcccttaacagaggagaaagggcatgatcaacaaaaacctggcggcagcgcaaaagatg

SEQ ID NO: 24342 - DNA, 103 bp, Artificial Sequence
  Synthetic Polynucleotide
taatacgactcactatagggaagctgttggctcatgatttgttgattgagaacagaggagactcaatatgcaaatcatgaacctggcggcagcgcaaaagatg

SEQ ID NO: 24343 - DNA, 103 bp, Artificial Sequence
  Synthetic Polynucleotide
taatacgactcactatagggttgaacaggaggtaattcttgatatcgtaaaacagaggagattacgaatgcaagaattaaacctggcggcagcgcaaaagatg

SEQ ID NO: 24344 - DNA, 103 bp, Artificial Sequence
  Synthetic Polynucleotide
taatacgactcactatagggttgtaaagctgttggctcatgatttgttgaaacagaggagatcaacaatgcatgagccaaacctggcggcagcgcaaaagatg

SEQ ID NO: 24345 - DNA, 103 bp, Artificial Sequence
  Synthetic Polynucleotide
taatacgactcactatagggacctcttgtaaagctgttggctcatgatttaacagaggagaaaatcaatggccaacagcaacctggcggcagcgcaaaagatg

SEQ ID NO: 24346 - DNA, 103 bp, Artificial Sequence
  Synthetic Polynucleotide
taatacgactcactatagggtgcacacctcttgtaaagctgttggctcataacagaggagaatgagcatgcagctttacaacctggcggcagcgcaaaagatg

SEQ ID NO: 24347 - DNA, 103 bp, Artificial Sequence
  Synthetic Polynucleotide
taatacgactcactatagggctcagtgcacacctcttgtaaagctgttggaacagaggagaccaacaatgttacaagagaacctggcggcagcgcaaaagatg

SEQ ID NO: 24348 - DNA, 103 bp, Artificial Sequence
  Synthetic Polynucleotide
taatacgactcactatagggggtatctcagtgcacacctcttgtaaagctaacagaggagaagctttatgagaggtgtgaacctggcggcagcgcaaaagatg

SEQ ID NO: 24349 - DNA, 103 bp, Artificial Sequence
  Synthetic Polynucleotide
taatacgactcactatagggagtagggtatctcagtgcacacctcttgtaaacagaggagatacaagatgtgtgcactgaacctggcggcagcgcaaaagatg

SEQ ID NO: 24350 - DNA, 103 bp, Artificial Sequence
  Synthetic Polynucleotide
taatacgactcactatagggttccgagtagggtatctcagtgcacacctcaacagaggagagaggtgatgactgagataaacctggcggcagcgcaaaagatg

SEQ ID NO: 24351 - DNA, 103 bp, Artificial Sequence
  Synthetic Polynucleotide
taatacgactcactatagggtcttgttccgagtagggtatctcagtgcacaacagaggagagtgcacatggataccctaaacctggcggcagcgcaaaagatg

SEQ ID NO: 24352 - DNA, 103 bp, Artificial Sequence
  Synthetic Polynucleotide
taatacgactcactatagggctggatcttgttccgagtagggtatctcagaacagaggagactgagaatgcctactcggaacctggcggcagcgcaaaagatg

SEQ ID NO: 24353 - DNA, 103 bp, Artificial Sequence
  Synthetic Polynucleotide
taatacgactcactatagggtttggctggatcttgttccgagtagggtataacagaggagaatacccatgtcggaacaaaacctggcggcagcgcaaaagatg

SEQ ID NO: 24354 - DNA, 103 bp, Artificial Sequence
  Synthetic Polynucleotide
taatacgactcactatagggtcttcttgaacaggaggtaattcttgatataacagaggagaatatcaatgattacctccaacctggcggcagcgcaaaagatg

SEQ ID NO: 24355 - DNA, 103 bp, Artificial Sequence
  Synthetic Polynucleotide
taatacgactcactatagggtaacttttggctggatcttgttccgagtagaacagaggagactactcatgacaagatccaacctggcggcagcgcaaaagatg

SEQ ID NO: 24356 - DNA, 103 bp, Artificial Sequence
  Synthetic Polynucleotide
taatacgactcactataggggcaaataacttttggctggatcttgttccgaacagaggagacggaacatgatccagccaaacctggcggcagcgcaaaagatg

SEQ ID NO: 24357 - DNA, 103 bp, Artificial Sequence
  Synthetic Polynucleotide
taatacgactcactatagggtaacagcaaataacttttggctggatcttgaacagaggagacaagatatggccaaaagtaacctggcggcagcgcaaaagatg

SEQ ID NO: 24358 - DNA, 103 bp, Artificial Sequence
  Synthetic Polynucleotide
taatacgactcactatagggttctctaacagcaaataacttttggctggaaacagaggagatccagcatgaagttatttaacctggcggcagcgcaaaagatg

SEQ ID NO: 24359 - DNA, 103 bp, Artificial Sequence
  Synthetic Polynucleotide
taatacgactcactatagggtagtattctctaacagcaaataacttttggaacagaggagaccaaaaatgatttgctgtaacctggcggcagcgcaaaagatg

SEQ ID NO: 24360 - DNA, 103 bp, Artificial Sequence
  Synthetic Polynucleotide
taatacgactcactataggggaatctagtattctctaacagcaaataactaacagaggagaagttatatgctgttagagaacctggcggcagcgcaaaagatg

SEQ ID NO: 24361 - DNA, 103 bp, Artificial Sequence
  Synthetic Polynucleotide
taatacgactcactatagggtccctgaatctagtattctctaacagcaaaaacagaggagatttgctatgagagaatacaacctggcggcagcgcaaaagatg

SEQ ID NO: 24362 - DNA, 103 bp, Artificial Sequence
  Synthetic Polynucleotide
taatacgactcactataggggatcatccctgaatctagtattctctaacaaacagaggagatgttagatgatactagataacctggcggcagcgcaaaagatg

SEQ ID NO: 24363 - DNA, 103 bp, Artificial Sequence
  Synthetic Polynucleotide
taatacgactcactatagggtttctgatcatccctgaatctagtattctcaacagaggagagagaatatgagattcaggaacctggcggcagcgcaaaagatg

SEQ ID NO: 24364 - DNA, 103 bp, Artificial Sequence
  Synthetic Polynucleotide
taatacgactcactatagggaatattttctgatcatccctgaatctagtaaacagaggagatactagatgcagggatgaaacctggcggcagcgcaaaagatg

SEQ ID NO: 24365 - DNA, 103 bp, Artificial Sequence
  Synthetic Polynucleotide
taatacgactcactatagggcatcgtcttcttgaacaggaggtaattcttaacagaggagaaagaatatgctcctgttcaacctggcggcagcgcaaaagatg

SEQ ID NO: 24366 - DNA, 103 bp, Artificial Sequence
  Synthetic Polynucleotide
taatacgactcactataggggtcttaatattttctgatcatccctgaatcaacagaggagagattcaatgatgatcagaaacctggcggcagcgcaaaagatg

SEQ ID NO: 24367 - DNA, 103 bp, Artificial Sequence
  Synthetic Polynucleotide
taatacgactcactatagggatcatgtcttaatattttctgatcatccctaacagaggagaagggatatgcagaaaataaacctggcggcagcgcaaaagatg

SEQ ID NO: 24368 - DNA, 103 bp, Artificial Sequence
  Synthetic Polynucleotide
taatacgactcactatagggttctgatcatgtcttaatattttctgatcaaacagaggagatgatcaatgaatattaagaacctggcggcagcgcaaaagatg

SEQ ID NO: 24369 - DNA, 103 bp, Artificial Sequence
  Synthetic Polynucleotide
taatacgactcactatagggcagctttctgatcatgtcttaatattttctaacagaggagaagaaaaatgtaagacatgaacctggcggcagcgcaaaagatg

SEQ ID NO: 24370 - DNA, 103 bp, Artificial Sequence
  Synthetic Polynucleotide
taatacgactcactatagggcctctcagctttctgatcatgtcttaatataacagaggagaatattaatgcatgatcagaacctggcggcagcgcaaaagatg

SEQ ID NO: 24371 - DNA, 103 bp, Artificial Sequence
  Synthetic Polynucleotide
taatacgactcactatagggtcacccctctcagctttctgatcatgtcttaacagaggagaaagacaatgtcagaaagcaacctggcggcagcgcaaaagatg

SEQ ID NO: 24372 - DNA, 103 bp, Artificial Sequence
  Synthetic Polynucleotide
taatacgactcactataggggaggttcacccctctcagctttctgatcataacagaggagaatgatcatgaagctgagaaacctggcggcagcgcaaaagatg

SEQ ID NO: 24373 - DNA, 103 bp, Artificial Sequence
  Synthetic Polynucleotide
taatacgactcactatagggtgaaagaggttcacccctctcagctttctgaacagaggagacagaaaatggagaggggtaacctggcggcagcgcaaaagatg

SEQ ID NO: 24374 - DNA, 103 bp, Artificial Sequence
  Synthetic Polynucleotide
taatacgactcactatagggtgcaatgaaagaggttcacccctctcagctaacagaggagaagctgaatggggtgaaccaacctggcggcagcgcaaaagatg

SEQ ID NO: 24375 - DNA, 103 bp, Artificial Sequence
  Synthetic Polynucleotide
taatacgactcactatagggacacttgcaatgaaagaggttcacccctctaacagaggagaagagggatgaacctctttaacctggcggcagcgcaaaagatg

SEQ ID NO: 24376 - DNA, 103 bp, Artificial Sequence
  Synthetic Polynucleotide
taatacgactcactatagggtgattcatcgtcttcttgaacaggaggtaaaacagaggagattacctatggttcaagaaaacctggcggcagcgcaaaagatg

SEQ ID NO: 24377 - DNA, 103 bp, Artificial Sequence
  Synthetic Polynucleotide
taatacgactcactatagggagaagacacttgcaatgaaagaggttcaccaacagaggagaggtgaaatgctttcattgaacctggcggcagcgcaaaagatg

SEQ ID NO: 24378 - DNA, 103 bp, Artificial Sequence
  Synthetic Polynucleotide
taatacgactcactatagggcccctagaagacacttgcaatgaaagaggtaacagaggagaacctctatgattgcaagtaacctggcggcagcgcaaaagatg

SEQ ID NO: 24379 - DNA, 103 bp, Artificial Sequence
  Synthetic Polynucleotide
taatacgactcactatagggggcaacccctagaagacacttgcaatgaaaaacagaggagatttcatatgaagtgtcttaacctggcggcagcgcaaaagatg

SEQ ID NO: 24380 - DNA, 103 bp, Artificial Sequence
  Synthetic Polynucleotide
taatacgactcactatagggctgcaggcaacccctagaagacacttgcaaaacagaggagattgcaaatgtcttctaggaacctggcggcagcgcaaaagatg

SEQ ID NO: 24381 - DNA, 103 bp, Artificial Sequence
  Synthetic Polynucleotide
taatacgactcactatagggagagcctgcaggcaacccctagaagacactaacagaggagaagtgtcatgtaggggttgaacctggcggcagcgcaaaagatg

SEQ ID NO: 24382 - DNA, 103 bp, Artificial Sequence
  Synthetic Polynucleotide
taatacgactcactatagggaagtaagagcctgcaggcaacccctagaagaacagaggagacttctaatggttgcctgcaacctggcggcagcgcaaaagatg

SEQ ID NO: 24383 - DNA, 103 bp, Artificial Sequence
  Synthetic Polynucleotide
taatacgactcactatagggagggcaagtaagagcctgcaggcaacccctaacagaggagaaggggtatgctgcaggctaacctggcggcagcgcaaaagatg

SEQ ID NO: 24384 - DNA, 103 bp, Artificial Sequence
  Synthetic Polynucleotide
taatacgactcactatagggtgatgagggcaagtaagagcctgcaggcaaaacagaggagattgcctatgggctcttacaacctggcggcagcgcaaaagatg

SEQ ID NO: 24385 - DNA, 103 bp, Artificial Sequence
  Synthetic Polynucleotide
taatacgactcactatagggaggggtgatgagggcaagtaagagcctgcaaacagaggagatgcaggatgttacttgccaacctggcggcagcgcaaaagatg

SEQ ID NO: 24386 - DNA, 103 bp, Artificial Sequence
  Synthetic Polynucleotide
taatacgactcactatagggtggggaggggtgatgagggcaagtaagagcaacagaggagagctcttatgtgccctcataacctggcggcagcgcaaaagatg

SEQ ID NO: 24387 - DNA, 103 bp, Artificial Sequence
  Synthetic Polynucleotide
taatacgactcactatagggtattctgattcatcgtcttcttgaacaggaaacagaggagatcctgtatgagaagacgaaacctggcggcagcgcaaaagatg

SEQ ID NO: 24388 - DNA, 103 bp, Artificial Sequence
  Synthetic Polynucleotide
taatacgactcactatagggtgagatggggaggggtgatgagggcaagtaaacagaggagatacttgatgtcatcacccaacctggcggcagcgcaaaagatg

SEQ ID NO: 24389 - DNA, 103 bp, Artificial Sequence
  Synthetic Polynucleotide
taatacgactcactatagggtggtttgagatggggaggggtgatgagggcaacagaggagagccctcatgacccctcccaacctggcggcagcgcaaaagatg

SEQ ID NO: 24390 - DNA, 103 bp, Artificial Sequence
  Synthetic Polynucleotide
taatacgactcactatagggtgtggtggtttgagatggggaggggtgatgaacagaggagacatcacatgtccccatctaacctggcggcagcgcaaaagatg

SEQ ID NO: 24391 - DNA, 103 bp, Artificial Sequence
  Synthetic Polynucleotide
taatacgactcactatagggggttctgtggtggtttgagatggggaggggaacagaggagacccctcatgatctcaaacaacctggcggcagcgcaaaagatg

SEQ ID NO: 24392 - DNA, 103 bp, Artificial Sequence
  Synthetic Polynucleotide
taatacgactcactatagggttagtggttctgtggtggtttgagatggggaacagaggagaccccatatgaaaccaccaaacctggcggcagcgcaaaagatg

SEQ ID NO: 24393 - DNA, 103 bp, Artificial Sequence
  Synthetic Polynucleotide
taatacgactcactatagggcatgcttagtggttctgtggtggtttgagaaacagaggagatctcaaatgaccacagaaaacctggcggcagcgcaaaagatg

SEQ ID NO: 24394 - DNA, 103 bp, Artificial Sequence
  Synthetic Polynucleotide
taatacgactcactatagggctaagcatgcttagtggttctgtggtggttaacagaggagaaaccacatgagaaccactaacctggcggcagcgcaaaagatg

SEQ ID NO: 24395 - DNA, 103 bp, Artificial Sequence
  Synthetic Polynucleotide
taatacgactcactatagggaattcctaagcatgcttagtggttctgtggaacagaggagaccacagatgcactaagcaaacctggcggcagcgcaaaagatg

SEQ ID NO: 24396 - DNA, 103 bp, Artificial Sequence
  Synthetic Polynucleotide
taatacgactcactataggggtcacaattcctaagcatgcttagtggttcaacagaggagagaaccaatgagcatgcttaacctggcggcagcgcaaaagatg

SEQ ID NO: 24397 - DNA, 103 bp, Artificial Sequence
  Synthetic Polynucleotide
taatacgactcactatagggatggcgtcacaattcctaagcatgcttagtaacagaggagaactaagatggcttaggaaaacctggcggcagcgcaaaagatg

SEQ ID NO: 24398 - DNA, 103 bp, Artificial Sequence
  Synthetic Polynucleotide
taatacgactcactatagggttgtgtattctgattcatcgtcttcttgaaaacagaggagattcaagatgacgatgaataacctggcggcagcgcaaaagatg

SEQ ID NO: 24399 - DNA, 103 bp, Artificial Sequence
  Synthetic Polynucleotide
taatacgactcactatagggcttttatggcgtcacaattcctaagcatgcaacagaggagagcatgcatgggaattgtgaacctggcggcagcgcaaaagatg

SEQ ID NO: 24400 - DNA, 103 bp, Artificial Sequence
  Synthetic Polynucleotide
taatacgactcactatagggggctgcttttatggcgtcacaattcctaagaacagaggagacttaggatgtgtgacgccaacctggcggcagcgcaaaagatg

SEQ ID NO: 24401 - DNA, 103 bp, Artificial Sequence
  Synthetic Polynucleotide
taatacgactcactatagggcgtaaggctgcttttatggcgtcacaattcaacagaggagagaattgatgcgccataaaaacctggcggcagcgcaaaagatg

SEQ ID NO: 24402 - DNA, 103 bp, Artificial Sequence
  Synthetic Polynucleotide
taatacgactcactatagggcagaacgtaaggctgcttttatggcgtcacaacagaggagagtgacgatgtaaaagcagaacctggcggcagcgcaaaagatg

SEQ ID NO: 24403 - DNA, 103 bp, Artificial Sequence
  Synthetic Polynucleotide
taatacgactcactatagggcgtctcagaacgtaaggctgcttttatggcaacagaggagagccataatggcagccttaaacctggcggcagcgcaaaagatg

SEQ ID NO: 24404 - DNA, 103 bp, Artificial Sequence
  Synthetic Polynucleotide
taatacgactcactatagggtcattcgtctcagaacgtaaggctgcttttaacagaggagaaaaagcatgcttacgttcaacctggcggcagcgcaaaagatg

SEQ ID NO: 24405 - DNA, 103 bp, Artificial Sequence
  Synthetic Polynucleotide
taatacgactcactatagggggggatcattcgtctcagaacgtaaggctgaacagaggagacagcctatggttctgagaaacctggcggcagcgcaaaagatg

SEQ ID NO: 24406 - DNA, 103 bp, Artificial Sequence
  Synthetic Polynucleotide
taatacgactcactatagggaagacggggatcattcgtctcagaacgtaaaacagaggagattacgtatggagacgaataacctggcggcagcgcaaaagatg

SEQ ID NO: 24407 - DNA, 103 bp, Artificial Sequence
  Synthetic Polynucleotide
taatacgactcactatagggctcataagacggggatcattcgtctcagaaaacagaggagattctgaatggaatgatccaacctggcggcagcgcaaaagatg

SEQ ID NO: 24408 - DNA, 103 bp, Artificial Sequence
  Synthetic Polynucleotide
taatacgactcactatagggtactgctcataagacggggatcattcgtctaacagaggagaagacgaatgatccccgtcaacctggcggcagcgcaaaagatg

SEQ ID NO: 24409 - DNA, 103 bp, Artificial Sequence
  Synthetic Polynucleotide
taatacgactcactatagggatcagttgtgtattctgattcatcgtcttcaacagaggagagaagacatggaatcagaaaacctggcggcagcgcaaaagatg

SEQ ID NO: 24410 - DNA, 103 bp, Artificial Sequence
  Synthetic Polynucleotide
taatacgactcactatagggaaggatactgctcataagacggggatcattaacagaggagaaatgatatgcgtcttatgaacctggcggcagcgcaaaagatg

SEQ ID NO: 24411 - DNA, 103 bp, Artificial Sequence
  Synthetic Polynucleotide
taatacgactcactatagggatatcaaggatactgctcataagacggggaaacagaggagatccccgatgtatgagcagaacctggcggcagcgcaaaagatg

SEQ ID NO: 24412 - DNA, 103 bp, Artificial Sequence
  Synthetic Polynucleotide
taatacgactcactatagggatctcatatcaaggatactgctcataagacaacagaggagagtcttaatggcagtatccaacctggcggcagcgcaaaagatg

SEQ ID NO: 24413 - DNA, 103 bp, Artificial Sequence
  Synthetic Polynucleotide
taatacgactcactatagggcaatgatctcatatcaaggatactgctcataacagaggagaatgagcatgatccttgataacctggcggcagcgcaaaagatg

SEQ ID NO: 24414 - DNA, 103 bp, Artificial Sequence
  Synthetic Polynucleotide
taatacgactcactataggggttttcaatgatctcatatcaaggatactgaacagaggagacagtatatgtgatatgagaacctggcggcagcgcaaaagatg

SEQ ID NO: 24415 - DNA, 103 bp, Artificial Sequence
  Synthetic Polynucleotide
taatacgactcactatagggtgggagttttcaatgatctcatatcaaggaaacagaggagatccttgatgtgagatcataacctggcggcagcgcaaaagatg

SEQ ID NO: 24416 - DNA, 103 bp, Artificial Sequence
  Synthetic Polynucleotide
taatacgactcactatagggtctcatgggagttttcaatgatctcatatcaacagaggagagatatgatgtcattgaaaaacctggcggcagcgcaaaagatg

SEQ ID NO: 24417 - DNA, 103 bp, Artificial Sequence
  Synthetic Polynucleotide
taatacgactcactatagggtctattctcatgggagttttcaatgatctcaacagaggagagagatcatggaaaactccaacctggcggcagcgcaaaagatg

SEQ ID NO: 24418 - DNA, 103 bp, Artificial Sequence
  Synthetic Polynucleotide
taatacgactcactataggggagattctattctcatgggagttttcaatgaacagaggagacattgaatgctcccatgaaacctggcggcagcgcaaaagatg

SEQ ID NO: 24419 - DNA, 103 bp, Artificial Sequence
  Synthetic Polynucleotide
taatacgactcactataggggtttcgagattctattctcatgggagttttaacagaggagaaaaactatgatgagaataaacctggcggcagcgcaaaagatg

SEQ ID NO: 24420 - DNA, 103 bp, Artificial Sequence
  Synthetic Polynucleotide
taatacgactcactatagggtgatggtttgtatcaaacaatatcaccttcaacagaggagagaaggtatgattgtttgaaacctggcggcagcgcaaaagatg

SEQ ID NO: 24421 - DNA, 103 bp, Artificial Sequence
  Synthetic Polynucleotide
taatacgactcactatagggtgagaatcagttgtgtattctgattcatcgaacagaggagacgatgaatgagaatacacaacctggcggcagcgcaaaagatg

SEQ ID NO: 24422 - DNA, 103 bp, Artificial Sequence
  Synthetic Polynucleotide
taatacgactcactatagggctcgtgtttcgagattctattctcatgggaaacagaggagatcccatatgaatagaatcaacctggcggcagcgcaaaagatg

SEQ ID NO: 24423 - DNA, 103 bp, Artificial Sequence
  Synthetic Polynucleotide
taatacgactcactatagggatagactcgtgtttcgagattctattctcaaacagaggagatgagaaatgaatctcgaaaacctggcggcagcgcaaaagatg

SEQ ID NO: 24424 - DNA, 103 bp, Artificial Sequence
  Synthetic Polynucleotide
taatacgactcactatagggttgcaatagactcgtgtttcgagattctataacagaggagaatagaaatgcgaaacacgaacctggcggcagcgcaaaagatg

SEQ ID NO: 24425 - DNA, 103 bp, Artificial Sequence
  Synthetic Polynucleotide
taatacgactcactataggggaaggttgcaatagactcgtgtttcgagataacagaggagaatctcgatgcacgagtctaacctggcggcagcgcaaaagatg

SEQ ID NO: 24426 - DNA, 103 bp, Artificial Sequence
  Synthetic Polynucleotide
taatacgactcactatagggactcagaaggttgcaatagactcgtgtttcaacagaggagagaaacaatggtctattgcaacctggcggcagcgcaaaagatg

SEQ ID NO: 24427 - DNA, 103 bp, Artificial Sequence
  Synthetic Polynucleotide
taatacgactcactatagggcagacactcagaaggttgcaatagactcgtaacagaggagaacgagtatgttgcaacctaacctggcggcagcgcaaaagatg

SEQ ID NO: 24428 - DNA, 103 bp, Artificial Sequence
  Synthetic Polynucleotide
taatacgactcactataggggttgacagacactcagaaggttgcaatagaaacagaggagatctattatgaccttctgaaacctggcggcagcgcaaaagatg

SEQ ID NO: 24429 - DNA, 103 bp, Artificial Sequence
  Synthetic Polynucleotide
taatacgactcactatagggtagaagttgacagacactcagaaggttgcaaacagaggagatgcaacatgctgagtgtcaacctggcggcagcgcaaaagatg

SEQ ID NO: 24430 - DNA, 103 bp, Artificial Sequence
  Synthetic Polynucleotide
taatacgactcactatagggtcccttagaagttgacagacactcagaaggaacagaggagaccttctatgtgtctgtcaaacctggcggcagcgcaaaagatg

SEQ ID NO: 24431 - DNA, 103 bp, Artificial Sequence
  Synthetic Polynucleotide
taatacgactcactataggggattttcccttagaagttgacagacactcaaacagaggagatgagtgatggtcaacttcaacctggcggcagcgcaaaagatg

SEQ ID NO: 24432 - DNA, 103 bp, Artificial Sequence
  Synthetic Polynucleotide
taatacgactcactatagggtttcctgagaatcagttgtgtattctgattaacagaggagaaatcagatgacacaactgaacctggcggcagcgcaaaagatg

SEQ ID NO: 24433 - DNA, 103 bp, Artificial Sequence
  Synthetic Polynucleotide
taatacgactcactataggggtacagattttcccttagaagttgacagacaacagaggagagtctgtatgcttctaaggaacctggcggcagcgcaaaagatg

SEQ ID NO: 24434 - DNA, 103 bp, Artificial Sequence
  Synthetic Polynucleotide
taatacgactcactatagggagacagtacagattttcccttagaagttgaaacagaggagatcaactatgaagggaaaaaacctggcggcagcgcaaaagatg

SEQ ID NO: 24435 - DNA, 103 bp, Artificial Sequence
  Synthetic Polynucleotide
taatacgactcactatagggtctctagacagtacagattttcccttagaaaacagaggagattctaaatgaaaatctgtaacctggcggcagcgcaaaagatg

SEQ ID NO: 24436 - DNA, 103 bp, Artificial Sequence
  Synthetic Polynucleotide
taatacgactcactatagggcctgttctctagacagtacagattttccctaacagaggagaagggaaatgctgtactgtaacctggcggcagcgcaaaagatg

SEQ ID NO: 24437 - DNA, 103 bp, Artificial Sequence
  Synthetic Polynucleotide
taatacgactcactatagggtgaagcctgttctctagacagtacagatttaacagaggagaaaatctatgctgtctagaaacctggcggcagcgcaaaagatg

SEQ ID NO: 24438 - DNA, 103 bp, Artificial Sequence
  Synthetic Polynucleotide
taatacgactcactatagggaggtatgaagcctgttctctagacagtacaaacagaggagatgtactatgtagagaacaaacctggcggcagcgcaaaagatg

SEQ ID NO: 24439 - DNA, 103 bp, Artificial Sequence
  Synthetic Polynucleotide
taatacgactcactatagggcatacaggtatgaagcctgttctctagacaaacagaggagatgtctaatgaacaggcttaacctggcggcagcgcaaaagatg

SEQ ID NO: 24440 - DNA, 103 bp, Artificial Sequence
  Synthetic Polynucleotide
taatacgactcactatagggatcaacatacaggtatgaagcctgttctctaacagaggagaagagaaatggcttcatacaacctggcggcagcgcaaaagatg

SEQ ID NO: 24441 - DNA, 103 bp, Artificial Sequence
  Synthetic Polynucleotide
taatacgactcactatagggctgcaatcaacatacaggtatgaagcctgtaacagaggagaacaggcatgatacctgtaaacctggcggcagcgcaaaagatg

SEQ ID NO: 24442 - DNA, 103 bp, Artificial Sequence
  Synthetic Polynucleotide
taatacgactcactatagggtattactgcaatcaacatacaggtatgaagaacagaggagacttcatatgtgtatgttgaacctggcggcagcgcaaaagatg

SEQ ID NO: 24443 - DNA, 103 bp, Artificial Sequence
  Synthetic Polynucleotide
taatacgactcactataggggtcactttcctgagaatcagttgtgtattcaacagaggagagaatacatgactgattctaacctggcggcagcgcaaaagatg

SEQ ID NO: 24444 - DNA, 103 bp, Artificial Sequence
  Synthetic Polynucleotide
taatacgactcactatagggagagatattactgcaatcaacatacaggtaaacagaggagatacctgatggttgattgcaacctggcggcagcgcaaaagatg

SEQ ID NO: 24445 - DNA, 103 bp, Artificial Sequence
  Synthetic Polynucleotide
taatacgactcactatagggatagaagagatattactgcaatcaacatacaacagaggagagtatgtatgttgcagtaaaacctggcggcagcgcaaaagatg

SEQ ID NO: 24446 - DNA, 103 bp, Artificial Sequence
  Synthetic Polynucleotide
taatacgactcactataggggagaaatagaagagatattactgcaatcaaaacagaggagattgattatggtaatatctaacctggcggcagcgcaaaagatg

SEQ ID NO: 24447 - DNA, 103 bp, Artificial Sequence
  Synthetic Polynucleotide
taatacgactcactatagggatccagagaaatagaagagatattactgcaaacagaggagatgcagtatgatctcttctaacctggcggcagcgcaaaagatg

SEQ ID NO: 24448 - DNA, 103 bp, Artificial Sequence
  Synthetic Polynucleotide
taatacgactcactatagggcctgaatccagagaaatagaagagatattaaacagaggagataatatatgttctatttcaacctggcggcagcgcaaaagatg

SEQ ID NO: 24449 - DNA, 103 bp, Artificial Sequence
  Synthetic Polynucleotide
taatacgactcactataggggaaaacctgaatccagagaaatagaagagaaacagaggagatctcttatgtttctctggaacctggcggcagcgcaaaagatg

SEQ ID NO: 24450 - DNA, 103 bp, Artificial Sequence
  Synthetic Polynucleotide
taatacgactcactatagggatttcgaaaacctgaatccagagaaatagaaacagaggagatctattatgctggattcaaacctggcggcagcgcaaaagatg

SEQ ID NO: 24451 - DNA, 103 bp, Artificial Sequence
  Synthetic Polynucleotide
taatacgactcactataggggacatatttcgaaaacctgaatccagagaaaacagaggagattctctatgttcaggtttaacctggcggcagcgcaaaagatg

SEQ ID NO: 24452 - DNA, 103 bp, Artificial Sequence
  Synthetic Polynucleotide
taatacgactcactatagggtatcagacatatttcgaaaacctgaatccaaacagaggagatggattatggttttcgaaaacctggcggcagcgcaaaagatg

SEQ ID NO: 24453 - DNA, 103 bp, Artificial Sequence
  Synthetic Polynucleotide
taatacgactcactatagggatttctatcagacatatttcgaaaacctgaaacagaggagatcaggtatgcgaaatatgaacctggcggcagcgcaaaagatg

SEQ ID NO: 24454 - DNA, 103 bp, Artificial Sequence
  Synthetic Polynucleotide
taatacgactcactatagggtgatcgtcactttcctgagaatcagttgtgaacagaggagacacaacatgttctcaggaaacctggcggcagcgcaaaagatg

SEQ ID NO: 24455 - DNA, 103 bp, Artificial Sequence
  Synthetic Polynucleotide
taatacgactcactatagggacttgatttctatcagacatatttcgaaaaaacagaggagattttcgatgtatgtctgaaacctggcggcagcgcaaaagatg

SEQ ID NO: 24456 - DNA, 103 bp, Artificial Sequence
  Synthetic Polynucleotide
taatacgactcactatagggtttggacttgatttctatcagacatatttcaacagaggagagaaataatgctgatagaaaacctggcggcagcgcaaaagatg

SEQ ID NO: 24457 - DNA, 103 bp, Artificial Sequence
  Synthetic Polynucleotide
taatacgactcactatagggtagcatttggacttgatttctatcagacataacagaggagaatgtctatgagaaatcaaaacctggcggcagcgcaaaagatg

SEQ ID NO: 24458 - DNA, 103 bp, Artificial Sequence
  Synthetic Polynucleotide
taatacgactcactatagggtttattagcatttggacttgatttctatcaaacagaggagatgatagatgtcaagtccaaacctggcggcagcgcaaaagatg

SEQ ID NO: 24459 - DNA, 103 bp, Artificial Sequence
  Synthetic Polynucleotide
taatacgactcactatagggaagtatttattagcatttggacttgatttcaacagaggagagaaatcatgtccaaatgcaacctggcggcagcgcaaaagatg

SEQ ID NO: 24460 - DNA, 103 bp, Artificial Sequence
  Synthetic Polynucleotide
taatacgactcactatagggtttgtaagtatttattagcatttggacttgaacagaggagacaagtcatgatgctaataaacctggcggcagcgcaaaagatg

SEQ ID NO: 24461 - DNA, 103 bp, Artificial Sequence
  Synthetic Polynucleotide
taatacgactcactatagggtcacgtttgtaagtatttattagcatttggaacagaggagaccaaatatgaataaatacaacctggcggcagcgcaaaagatg

SEQ ID NO: 24462 - DNA, 103 bp, Artificial Sequence
  Synthetic Polynucleotide
taatacgactcactatagggataagtcacgtttgtaagtatttattagcaaacagaggagatgctaaatgatacttacaaacctggcggcagcgcaaaagatg

SEQ ID NO: 24463 - DNA, 103 bp, Artificial Sequence
  Synthetic Polynucleotide
taatacgactcactatagggagtgtataagtcacgtttgtaagtatttataacagaggagaataaatatgtacaaacgtaacctggcggcagcgcaaaagatg

SEQ ID NO: 24464 - DNA, 103 bp, Artificial Sequence
  Synthetic Polynucleotide
taatacgactcactatagggaaacaagtgtataagtcacgtttgtaagtaaacagaggagatacttaatgacgtgacttaacctggcggcagcgcaaaagatg

SEQ ID NO: 24465 - DNA, 103 bp, Artificial Sequence
  Synthetic Polynucleotide
taatacgactcactatagggctggttgatcgtcactttcctgagaatcagaacagaggagactgattatgaggaaagtgaacctggcggcagcgcaaaagatg

SEQ ID NO: 24466 - DNA, 103 bp, Artificial Sequence
  Synthetic Polynucleotide
taatacgactcactatagggtatcaaaacaagtgtataagtcacgtttgtaacagaggagaacaaacatgacttatacaaacctggcggcagcgcaaaagatg

SEQ ID NO: 24467 - DNA, 103 bp, Artificial Sequence
  Synthetic Polynucleotide
taatacgactcactataggggttactatcaaaacaagtgtataagtcacgaacagaggagacgtgacatgtacacttgtaacctggcggcagcgcaaaagatg

SEQ ID NO: 24468 - DNA, 103 bp, Artificial Sequence
  Synthetic Polynucleotide
taatacgactcactatagggaattggttactatcaaaacaagtgtataagaacagaggagacttataatgttgttttgaaacctggcggcagcgcaaaagatg

SEQ ID NO: 24469 - DNA, 103 bp, Artificial Sequence
  Synthetic Polynucleotide
taatacgactcactatagggtgcagaattggttactatcaaaacaagtgtaacagaggagaacacttatgttgatagtaaacctggcggcagcgcaaaagatg

SEQ ID NO: 24470 - DNA, 103 bp, Artificial Sequence
  Synthetic Polynucleotide
taatacgactcactatagggaaacctgcagaattggttactatcaaaacaaacagaggagatgttttatgagtaaccaaaacctggcggcagcgcaaaagatg

SEQ ID NO: 24471 - DNA, 103 bp, Artificial Sequence
  Synthetic Polynucleotide
taatacgactcactatagggcctgtaaacctgcagaattggttactatcaaacagaggagatgatagatgccaattctgaacctggcggcagcgcaaaagatg

SEQ ID NO: 24472 - DNA, 103 bp, Artificial Sequence
  Synthetic Polynucleotide
taatacgactcactatagggcgacccctgtaaacctgcagaattggttacaacagaggagagtaaccatgtctgcaggtaacctggcggcagcgcaaaagatg

SEQ ID NO: 24473 - DNA, 103 bp, Artificial Sequence
  Synthetic Polynucleotide
taatacgactcactatagggtgaaacgacccctgtaaacctgcagaattgaacagaggagacaattcatgaggtttacaaacctggcggcagcgcaaaagatg

SEQ ID NO: 24474 - DNA, 103 bp, Artificial Sequence
  Synthetic Polynucleotide
taatacgactcactatagggattgatgaaacgacccctgtaaacctgcagaacagaggagactgcagatgtacaggggtaacctggcggcagcgcaaaagatg

SEQ ID NO: 24475 - DNA, 103 bp, Artificial Sequence
  Synthetic Polynucleotide
taatacgactcactatagggaatgcattgatgaaacgacccctgtaaaccaacagaggagaggtttaatggggtcgtttaacctggcggcagcgcaaaagatg

SEQ ID NO: 24476 - DNA, 103 bp, Artificial Sequence
  Synthetic Polynucleotide
taatacgactcactatagggagatcctggttgatcgtcactttcctgagaaacagaggagatctcagatgagtgacgataacctggcggcagcgcaaaagatg

SEQ ID NO: 24477 - DNA, 103 bp, Artificial Sequence
  Synthetic Polynucleotide
taatacgactcactatagggcttataatgcattgatgaaacgacccctgtaacagaggagaacagggatggtttcatcaaacctggcggcagcgcaaaagatg

SEQ ID NO: 24478 - DNA, 103 bp, Artificial Sequence
  Synthetic Polynucleotide
taatacgactcactatagggtaaagcttataatgcattgatgaaacgaccaacagaggagaggtcgtatgatcaatgcaaacctggcggcagcgcaaaagatg

SEQ ID NO: 24479 - DNA, 103 bp, Artificial Sequence
  Synthetic Polynucleotide
taatacgactcactataggggatcataaagcttataatgcattgatgaaaaacagaggagatttcatatgtgcattataaacctggcggcagcgcaaaagatg

SEQ ID NO: 24480 - DNA, 103 bp, Artificial Sequence
  Synthetic Polynucleotide
taatacgactcactatagggcaaaagatcataaagcttataatgcattgaaacagaggagatcaatgatgtataagcttaacctggcggcagcgcaaaagatg

SEQ ID NO: 24481 - DNA, 103 bp, Artificial Sequence
  Synthetic Polynucleotide
taatacgactcactataggggctggcaaaagatcataaagcttataatgcaacagaggagagcattaatggctttatgaaacctggcggcagcgcaaaagatg

SEQ ID NO: 24482 - DNA, 103 bp, Artificial Sequence
  Synthetic Polynucleotide
taatacgactcactatagggtgcctgctggcaaaagatcataaagcttataacagaggagaataagcatgatgatctttaacctggcggcagcgcaaaagatg

SEQ ID NO: 24483 - DNA, 103 bp, Artificial Sequence
  Synthetic Polynucleotide
taatacgactcactataggggagtttgcctgctggcaaaagatcataaagaacagaggagactttatatgcttttgccaaacctggcggcagcgcaaaagatg

SEQ ID NO: 24484 - DNA, 103 bp, Artificial Sequence
  Synthetic Polynucleotide
taatacgactcactatagggtttccgagtttgcctgctggcaaaagatcaaacagaggagatgatctatggccagcaggaacctggcggcagcgcaaaagatg

SEQ ID NO: 24485 - DNA, 103 bp, Artificial Sequence
  Synthetic Polynucleotide
taatacgactcactatagggttgcctttccgagtttgcctgctggcaaaaaacagaggagattttgcatgcaggcaaacaacctggcggcagcgcaaaagatg

SEQ ID NO: 24486 - DNA, 103 bp, Artificial Sequence
  Synthetic Polynucleotide
taatacgactcactataggggcagattgcctttccgagtttgcctgctggaacagaggagaccagcaatgaaactcggaaacctggcggcagcgcaaaagatg

SEQ ID NO: 24487 - DNA, 103 bp, Artificial Sequence
  Synthetic Polynucleotide
taatacgactcactatagggttatcagatcctggttgatcgtcactttccaacagaggagaggaaagatgcgatcaaccaacctggcggcagcgcaaaagatg

SEQ ID NO: 24488 - DNA, 103 bp, Artificial Sequence
  Synthetic Polynucleotide
taatacgactcactataggggctaggcagattgcctttccgagtttgcctaacagaggagaaggcaaatgcggaaaggcaacctggcggcagcgcaaaagatg

SEQ ID NO: 24489 - DNA, 103 bp, Artificial Sequence
  Synthetic Polynucleotide
taatacgactcactatagggcttcggctaggcagattgcctttccgagttaacagaggagaaactcgatgaggcaatctaacctggcggcagcgcaaaagatg

SEQ ID NO: 24490 - DNA, 103 bp, Artificial Sequence
  Synthetic Polynucleotide
taatacgactcactatagggttccccttcggctaggcagattgcctttccaacagaggagaggaaagatgatctgcctaaacctggcggcagcgcaaaagatg

SEQ ID NO: 24491 - DNA, 103 bp, Artificial Sequence
  Synthetic Polynucleotide
taatacgactcactatagggctcccttccccttcggctaggcagattgccaacagaggagaggcaatatgcctagccgaaacctggcggcagcgcaaaagatg

SEQ ID NO: 24492 - DNA, 103 bp, Artificial Sequence
  Synthetic Polynucleotide
taatacgactcactatagggcgccactcccttccccttcggctaggcagaaacagaggagatctgccatgccgaaggggaacctggcggcagcgcaaaagatg

SEQ ID NO: 24493 - DNA, 103 bp, Artificial Sequence
  Synthetic Polynucleotide
taatacgactcactatagggtcgagcgccactcccttccccttcggctagaacagaggagactagccatgggggaagggaacctggcggcagcgcaaaagatg

SEQ ID NO: 24494 - DNA, 103 bp, Artificial Sequence
  Synthetic Polynucleotide
taatacgactcactatagggagtagtcgagcgccactcccttccccttcgaacagaggagacgaaggatgagggagtggaacctggcggcagcgcaaaagatg

SEQ ID NO: 24495 - DNA, 103 bp, Artificial Sequence
  Synthetic Polynucleotide
taatacgactcactatagggtcaagagtagtcgagcgccactcccttcccaacagaggagagggaagatggtggcgctcaacctggcggcagcgcaaaagatg

SEQ ID NO: 24496 - DNA, 103 bp, Artificial Sequence
  Synthetic Polynucleotide
taatacgactcactatagggccacttcaagagtagtcgagcgccactcccaacagaggagagggagtatggctcgactaaacctggcggcagcgcaaaagatg

SEQ ID NO: 24497 - DNA, 103 bp, Artificial Sequence
  Synthetic Polynucleotide
taatacgactcactatagggtccttccacttcaagagtagtcgagcgccaaacagaggagatggcgcatgactactcttaacctggcggcagcgcaaaagatg

SEQ ID NO: 24498 - DNA, 103 bp, Artificial Sequence
  Synthetic Polynucleotide
taatacgactcactataggggttcattatcagatcctggttgatcgtcacaacagaggagagtgacgatgaaccaggataacctggcggcagcgcaaaagatg

SEQ ID NO: 24499 - DNA, 103 bp, Artificial Sequence
  Synthetic Polynucleotide
taatacgactcactatagggctgtctccttccacttcaagagtagtcgagaacagaggagactcgacatgtcttgaagtaacctggcggcagcgcaaaagatg

SEQ ID NO: 24500 - DNA, 103 bp, Artificial Sequence
  Synthetic Polynucleotide
taatacgactcactatagggataatctgtctccttccacttcaagagtagaacagaggagactactcatgaagtggaagaacctggcggcagcgcaaaagatg

SEQ ID NO: 24501 - DNA, 103 bp, Artificial Sequence
  Synthetic Polynucleotide
taatacgactcactatagggaataaataatctgtctccttccacttcaagaacagaggagacttgaaatggaaggagacaacctggcggcagcgcaaaagatg

SEQ ID NO: 24502 - DNA, 103 bp, Artificial Sequence
  Synthetic Polynucleotide
taatacgactcactatagggtgaagaataaataatctgtctccttccactaacagaggagaagtggaatgagacagattaacctggcggcagcgcaaaagatg

SEQ ID NO: 24503 - DNA, 103 bp, Artificial Sequence
  Synthetic Polynucleotide
taatacgactcactatagggagtattgaagaataaataatctgtctccttaacagaggagaaaggagatggattatttaaacctggcggcagcgcaaaagatg

SEQ ID NO: 24504 - DNA, 103 bp, Artificial Sequence
  Synthetic Polynucleotide
taatacgactcactataggggccaaagtattgaagaataaataatctgtcaacagaggagagacagaatgtttattcttaacctggcggcagcgcaaaagatg

SEQ ID NO: 24505 - DNA, 103 bp, Artificial Sequence
  Synthetic Polynucleotide
taatacgactcactatagggctgtggccaaagtattgaagaataaataataacagaggagaattattatgtcttcaataaacctggcggcagcgcaaaagatg

SEQ ID NO: 24506 - DNA, 103 bp, Artificial Sequence
  Synthetic Polynucleotide
taatacgactcactatagggtgaatctgtggccaaagtattgaagaataaaacagaggagattattcatgaatactttgaacctggcggcagcgcaaaagatg

SEQ ID NO: 24507 - DNA, 103 bp, Artificial Sequence
  Synthetic Polynucleotide
taatacgactcactatagggtgttgtgaatctgtggccaaagtattgaagaacagaggagacttcaaatgtttggccacaacctggcggcagcgcaaaagatg

SEQ ID NO: 24508 - DNA, 103 bp, Artificial Sequence
  Synthetic Polynucleotide
taatacgactcactatagggcttcctgttgtgaatctgtggccaaagtataacagaggagaatacttatgccacagattaacctggcggcagcgcaaaagatg

SEQ ID NO: 24509 - DNA, 103 bp, Artificial Sequence
  Synthetic Polynucleotide
taatacgactcactatagggaccttgttcattatcagatcctggttgatcaacagaggagagatcaaatgggatctgataacctggcggcagcgcaaaagatg

SEQ ID NO: 24510 - DNA, 103 bp, Artificial Sequence
  Synthetic Polynucleotide
taatacgactcactatagggttctgcttcctgttgtgaatctgtggccaaaacagaggagattggccatggattcacaaaacctggcggcagcgcaaaagatg

SEQ ID NO: 24511 - DNA, 103 bp, Artificial Sequence
  Synthetic Polynucleotide
taatacgactcactatagggaaaatttctgcttcctgttgtgaatctgtgaacagaggagacacagaatgacaacaggaaacctggcggcagcgcaaaagatg

SEQ ID NO: 24512 - DNA, 103 bp, Artificial Sequence
  Synthetic Polynucleotide
taatacgactcactatagggcactcaaaatttctgcttcctgttgtgaataacagaggagaattcacatgaggaagcagaacctggcggcagcgcaaaagatg

SEQ ID NO: 24513 - DNA, 103 bp, Artificial Sequence
  Synthetic Polynucleotide
taatacgactcactatagggtcgaccactcaaaatttctgcttcctgttgaacagaggagacaacagatggcagaaattaacctggcggcagcgcaaaagatg

SEQ ID NO: 24514 - DNA, 103 bp, Artificial Sequence
  Synthetic Polynucleotide
taatacgactcactatagggataactcgaccactcaaaatttctgcttccaacagaggagaggaagcatgaattttgagaacctggcggcagcgcaaaagatg

SEQ ID NO: 24515 - DNA, 103 bp, Artificial Sequence
  Synthetic Polynucleotide
taatacgactcactatagggttggaataactcgaccactcaaaatttctgaacagaggagacagaaaatgtgagtggtcaacctggcggcagcgcaaaagatg

SEQ ID NO: 24516 - DNA, 103 bp, Artificial Sequence
  Synthetic Polynucleotide
taatacgactcactatagggcatccttggaataactcgaccactcaaaataacagaggagaattttgatgggtcgagttaacctggcggcagcgcaaaagatg

SEQ ID NO: 24517 - DNA, 103 bp, Artificial Sequence
  Synthetic Polynucleotide
taatacgactcactatagggtacaacatccttggaataactcgaccactcaacagaggagagagtggatgagttattccaacctggcggcagcgcaaaagatg

SEQ ID NO: 24518 - DNA, 103 bp, Artificial Sequence
  Synthetic Polynucleotide
taatacgactcactatagggtgttatacaacatccttggaataactcgacaacagaggagagtcgagatgttccaaggaaacctggcggcagcgcaaaagatg

SEQ ID NO: 24519 - DNA, 103 bp, Artificial Sequence
  Synthetic Polynucleotide
taatacgactcactatagggatctatgttatacaacatccttggaataacaacagaggagagttattatgaggatgttgaacctggcggcagcgcaaaagatg

SEQ ID NO: 24520 - DNA, 103 bp, Artificial Sequence
  Synthetic Polynucleotide
taatacgactcactatagggtcaacaccttgttcattatcagatcctggtaacagaggagaaccaggatgtgataatgaaacctggcggcagcgcaaaagatg

SEQ ID NO: 24521 - DNA, 103 bp, Artificial Sequence
  Synthetic Polynucleotide
taatacgactcactatagggagcttatctatgttatacaacatccttggaaacagaggagatccaagatggttgtataaaacctggcggcagcgcaaaagatg

SEQ ID NO: 24522 - DNA, 103 bp, Artificial Sequence
  Synthetic Polynucleotide
taatacgactcactatagggcacttagcttatctatgttatacaacatccaacagaggagaggatgtatgataacatagaacctggcggcagcgcaaaagatg

SEQ ID NO: 24523 - DNA, 103 bp, Artificial Sequence
  Synthetic Polynucleotide
taatacgactcactatagggtaaaacacttagcttatctatgttatacaaaacagaggagattgtatatgatagataagaacctggcggcagcgcaaaagatg

SEQ ID NO: 24524 - DNA, 103 bp, Artificial Sequence
  Synthetic Polynucleotide
taatacgactcactatagggtcaagtaaaacacttagcttatctatgttaaacagaggagataacatatgtaagctaagaacctggcggcagcgcaaaagatg

SEQ ID NO: 24525 - DNA, 103 bp, Artificial Sequence
  Synthetic Polynucleotide
taatacgactcactatagggtggattcaagtaaaacacttagcttatctaaacagaggagatagataatgtaagtgtttaacctggcggcagcgcaaaagatg

SEQ ID NO: 24526 - DNA, 103 bp, Artificial Sequence
  Synthetic Polynucleotide
taatacgactcactatagggttttctggattcaagtaaaacacttagcttaacagaggagaaagctaatggttttacttaacctggcggcagcgcaaaagatg

SEQ ID NO: 24527 - DNA, 103 bp, Artificial Sequence
  Synthetic Polynucleotide
taatacgactcactatagggattaattttctggattcaagtaaaacacttaacagaggagaaagtgtatgacttgaatcaacctggcggcagcgcaaaagatg

SEQ ID NO: 24528 - DNA, 103 bp, Artificial Sequence
  Synthetic Polynucleotide
taatacgactcactatagggtcaagattaattttctggattcaagtaaaaaacagaggagattttacatgaatccagaaaacctggcggcagcgcaaaagatg

SEQ ID NO: 24529 - DNA, 103 bp, Artificial Sequence
  Synthetic Polynucleotide
taatacgactcactatagggattattcaagattaattttctggattcaagaacagaggagacttgaaatgagaaaattaaacctggcggcagcgcaaaagatg

SEQ ID NO: 24530 - DNA, 103 bp, Artificial Sequence
  Synthetic Polynucleotide
taatacgactcactataggggttagattattcaagattaattttctggataacagaggagaatccagatgattaatcttaacctggcggcagcgcaaaagatg

SEQ ID NO: 24531 - DNA, 103 bp, Artificial Sequence
  Synthetic Polynucleotide
taatacgactcactatagggtaacctgatggtttgtatcaaacaatatcaaacagaggagatgatatatgttgatacaaaacctggcggcagcgcaaaagatg

SEQ ID NO: 24532 - DNA, 103 bp, Artificial Sequence
  Synthetic Polynucleotide
taatacgactcactatagggggagatcaacaccttgttcattatcagatcaacagaggagagatctgatgatgaacaagaacctggcggcagcgcaaaagatg

SEQ ID NO: 24533 - DNA, 103 bp, Artificial Sequence
  Synthetic Polynucleotide
taatacgactcactataggggaatagttagattattcaagattaattttcaacagaggagagaaaatatgtcttgaataaacctggcggcagcgcaaaagatg

SEQ ID NO: 24534 - DNA, 103 bp, Artificial Sequence
  Synthetic Polynucleotide
taatacgactcactataggggatttgaatagttagattattcaagattaaaacagaggagattaatcatgaataatctaaacctggcggcagcgcaaaagatg

SEQ ID NO: 24535 - DNA, 103 bp, Artificial Sequence
  Synthetic Polynucleotide
taatacgactcactatagggtccgtgatttgaatagttagattattcaagaacagaggagacttgaaatgtctaactataacctggcggcagcgcaaaagatg

SEQ ID NO: 24536 - DNA, 103 bp, Artificial Sequence
  Synthetic Polynucleotide
taatacgactcactatagggtaatatccgtgatttgaatagttagattataacagaggagaataatcatgctattcaaaaacctggcggcagcgcaaaagatg

SEQ ID NO: 24537 - DNA, 103 bp, Artificial Sequence
  Synthetic Polynucleotide
taatacgactcactataggggtttgtaatatccgtgatttgaatagttagaacagaggagactaactatgcaaatcacgaacctggcggcagcgcaaaagatg

SEQ ID NO: 24538 - DNA, 103 bp, Artificial Sequence
  Synthetic Polynucleotide
taatacgactcactatagggagtgggtttgtaatatccgtgatttgaataaacagaggagatattcaatgcacggatataacctggcggcagcgcaaaagatg

SEQ ID NO: 24539 - DNA, 103 bp, Artificial Sequence
  Synthetic Polynucleotide
taatacgactcactataggggccatagtgggtttgtaatatccgtgatttaacagaggagaaaatcaatgatattacaaaacctggcggcagcgcaaaagatg

SEQ ID NO: 24540 - DNA, 103 bp, Artificial Sequence
  Synthetic Polynucleotide
taatacgactcactataggggtccagccatagtgggtttgtaatatccgtaacagaggagaacggatatgacaaacccaaacctggcggcagcgcaaaagatg

SEQ ID NO: 24541 - DNA, 103 bp, Artificial Sequence
  Synthetic Polynucleotide
taatacgactcactatagggacagagtccagccatagtgggtttgtaataaacagaggagatattacatgcccactatgaacctggcggcagcgcaaaagatg

SEQ ID NO: 24542 - DNA, 103 bp, Artificial Sequence
  Synthetic Polynucleotide
taatacgactcactataggggtatgacagagtccagccatagtgggtttgaacagaggagacaaaccatgtatggctggaacctggcggcagcgcaaaagatg

SEQ ID NO: 24543 - DNA, 103 bp, Artificial Sequence
  Synthetic Polynucleotide
taatacgactcactatagggtggtgggagatcaacaccttgttcattatcaacagaggagagataatatgcaaggtgttaacctggcggcagcgcaaaagatg

SEQ ID NO: 24544 - DNA, 103 bp, Artificial Sequence
  Synthetic Polynucleotide
taatacgactcactataggggtattgtatgacagagtccagccatagtggaacagaggagaccactaatgctggactctaacctggcggcagcgcaaaagatg

SEQ ID NO: 24545 - DNA, 103 bp, Artificial Sequence
  Synthetic Polynucleotide
taatacgactcactatagggggtaggtattgtatgacagagtccagccataacagaggagaatggctatgctctgtcataacctggcggcagcgcaaaagatg

SEQ ID NO: 24546 - DNA, 103 bp, Artificial Sequence
  Synthetic Polynucleotide
taatacgactcactatagggcttcaggtaggtattgtatgacagagtccaaacagaggagatggactatgtcatacaataacctggcggcagcgcaaaagatg

SEQ ID NO: 24547 - DNA, 103 bp, Artificial Sequence
  Synthetic Polynucleotide
taatacgactcactatagggactatcttcaggtaggtattgtatgacagaaacagaggagatctgtcatgcaatacctaaacctggcggcagcgcaaaagatg

SEQ ID NO: 24548 - DNA, 103 bp, Artificial Sequence
  Synthetic Polynucleotide
taatacgactcactatagggatgtcactatcttcaggtaggtattgtatgaacagaggagacatacaatgcctacctgaaacctggcggcagcgcaaaagatg

SEQ ID NO: 24549 - DNA, 103 bp, Artificial Sequence
  Synthetic Polynucleotide
taatacgactcactatagggttagaatgtcactatcttcaggtaggtattaacagaggagaaataccatgctgaagataaacctggcggcagcgcaaaagatg

SEQ ID NO: 24550 - DNA, 103 bp, Artificial Sequence
  Synthetic Polynucleotide
taatacgactcactatagggcattgttagaatgtcactatcttcaggtagaacagaggagactacctatggatagtgacaacctggcggcagcgcaaaagatg

SEQ ID NO: 24551 - DNA, 103 bp, Artificial Sequence
  Synthetic Polynucleotide
taatacgactcactataggggcatccattgttagaatgtcactatcttcaaacagaggagatgaagaatgtgacattctaacctggcggcagcgcaaaagatg

SEQ ID NO: 24552 - DNA, 103 bp, Artificial Sequence
  Synthetic Polynucleotide
taatacgactcactatagggtctctgcatccattgttagaatgtcactataacagaggagaatagtgatgttctaacaaaacctggcggcagcgcaaaagatg

SEQ ID NO: 24553 - DNA, 103 bp, Artificial Sequence
  Synthetic Polynucleotide
taatacgactcactatagggagtggtctctgcatccattgttagaatgtcaacagaggagagacattatgacaatggataacctggcggcagcgcaaaagatg

SEQ ID NO: 24554 - DNA, 103 bp, Artificial Sequence
  Synthetic Polynucleotide
taatacgactcactatagggggaggtggtgggagatcaacaccttgttcaaacagaggagatgaacaatgtgttgatctaacctggcggcagcgcaaaagatg

SEQ ID NO: 24555 - DNA, 103 bp, Artificial Sequence
  Synthetic Polynucleotide
taatacgactcactatagggtctttagtggtctctgcatccattgttagaaacagaggagatctaacatgggatgcagaaacctggcggcagcgcaaaagatg

SEQ ID NO: 24556 - DNA, 103 bp, Artificial Sequence
  Synthetic Polynucleotide
taatacgactcactatagggtctcttctttagtggtctctgcatccattgaacagaggagacaatggatgcagagaccaaacctggcggcagcgcaaaagatg

SEQ ID NO: 24557 - DNA, 103 bp, Artificial Sequence
  Synthetic Polynucleotide
taatacgactcactatagggtcttgtctcttctttagtggtctctgcatcaacagaggagagatgcaatgaccactaaaaacctggcggcagcgcaaaagatg

SEQ ID NO: 24558 - DNA, 103 bp, Artificial Sequence
  Synthetic Polynucleotide
taatacgactcactatagggtgctctcttgtctcttctttagtggtctctaacagaggagaagagacatgtaaagaagaaacctggcggcagcgcaaaagatg

SEQ ID NO: 24559 - DNA, 103 bp, Artificial Sequence
  Synthetic Polynucleotide
taatacgactcactatagggagagttgctctcttgtctcttctttagtggaacagaggagaccactaatgaagagacaaaacctggcggcagcgcaaaagatg

SEQ ID NO: 24560 - DNA, 103 bp, Artificial Sequence
  Synthetic Polynucleotide
taatacgactcactatagggtttatagagttgctctcttgtctcttctttaacagaggagaaaagaaatgacaagagagaacctggcggcagcgcaaaagatg

SEQ ID NO: 24561 - DNA, 103 bp, Artificial Sequence
  Synthetic Polynucleotide
taatacgactcactatagggatagttttatagagttgctctcttgtctctaacagaggagaagagacatgagagcaactaacctggcggcagcgcaaaagatg

SEQ ID NO: 24562 - DNA, 103 bp, Artificial Sequence
  Synthetic Polynucleotide
taatacgactcactatagggttatgatagttttatagagttgctctcttgaacagaggagacaagagatgaactctataaacctggcggcagcgcaaaagatg

SEQ ID NO: 24563 - DNA, 103 bp, Artificial Sequence
  Synthetic Polynucleotide
taatacgactcactatagggaatatttatgatagttttatagagttgctcaacagaggagagagcaaatgtataaaactaacctggcggcagcgcaaaagatg

SEQ ID NO: 24564 - DNA, 103 bp, Artificial Sequence
  Synthetic Polynucleotide
taatacgactcactataggggcccaaatatttatgatagttttatagagtaacagaggagaactctaatgaactatcataacctggcggcagcgcaaaagatg

SEQ ID NO: 24565 - DNA, 103 bp, Artificial Sequence
  Synthetic Polynucleotide
taatacgactcactatagggataatggaggtggtgggagatcaacaccttaacagaggagaaaggtgatgatctcccacaacctggcggcagcgcaaaagatg

SEQ ID NO: 24566 - DNA, 103 bp, Artificial Sequence
  Synthetic Polynucleotide
taatacgactcactatagggtacgtgcccaaatatttatgatagttttataacagaggagaataaaaatgtcataaataaacctggcggcagcgcaaaagatg

SEQ ID NO: 24567 - DNA, 103 bp, Artificial Sequence
  Synthetic Polynucleotide
taatacgactcactatagggagaagtacgtgcccaaatatttatgatagtaacagaggagaactatcatgaatatttggaacctggcggcagcgcaaaagatg

SEQ ID NO: 24568 - DNA, 103 bp, Artificial Sequence
  Synthetic Polynucleotide
taatacgactcactatagggttaggagaagtacgtgcccaaatatttatgaacagaggagacataaaatgttgggcacgaacctggcggcagcgcaaaagatg

SEQ ID NO: 24569 - DNA, 103 bp, Artificial Sequence
  Synthetic Polynucleotide
taatacgactcactatagggggatattaggagaagtacgtgcccaaatataacagaggagaatatttatgcacgtacttaacctggcggcagcgcaaaagatg

SEQ ID NO: 24570 - DNA, 103 bp, Artificial Sequence
  Synthetic Polynucleotide
taatacgactcactatagggtttagggatattaggagaagtacgtgcccaaacagaggagatgggcaatgacttctcctaacctggcggcagcgcaaaagatg

SEQ ID NO: 24571 - DNA, 103 bp, Artificial Sequence
  Synthetic Polynucleotide
taatacgactcactatagggctggttttagggatattaggagaagtacgtaacagaggagaacgtacatgtcctaatataacctggcggcagcgcaaaagatg

SEQ ID NO: 24572 - DNA, 103 bp, Artificial Sequence
  Synthetic Polynucleotide
taatacgactcactatagggtgatgctggttttagggatattaggagaagaacagaggagacttctcatgatatccctaaacctggcggcagcgcaaaagatg

SEQ ID NO: 24573 - DNA, 103 bp, Artificial Sequence
  Synthetic Polynucleotide
taatacgactcactatagggtttaatgatgctggttttagggatattaggaacagaggagacctaatatgcctaaaaccaacctggcggcagcgcaaaagatg

SEQ ID NO: 24574 - DNA, 103 bp, Artificial Sequence
  Synthetic Polynucleotide
taatacgactcactatagggaacactttaatgatgctggttttagggataaacagaggagatatcccatgaaccagcataacctggcggcagcgcaaaagatg

SEQ ID NO: 24575 - DNA, 103 bp, Artificial Sequence
  Synthetic Polynucleotide
taatacgactcactatagggataaaaacactttaatgatgctggttttagaacagaggagactaaaaatggcatcattaaacctggcggcagcgcaaaagatg

SEQ ID NO: 24576 - DNA, 103 bp, Artificial Sequence
  Synthetic Polynucleotide
taatacgactcactatagggagcatataatggaggtggtgggagatcaacaacagaggagagttgatatgccaccacctaacctggcggcagcgcaaaagatg

SEQ ID NO: 24577 - DNA, 103 bp, Artificial Sequence
  Synthetic Polynucleotide
taatacgactcactatagggatctaataaaaacactttaatgatgctggtaacagaggagaaccagcatgattaaagtgaacctggcggcagcgcaaaagatg

SEQ ID NO: 24578 - DNA, 103 bp, Artificial Sequence
  Synthetic Polynucleotide
taatacgactcactatagggccataatctaataaaaacactttaatgatgaacagaggagacatcatatgagtgtttttaacctggcggcagcgcaaaagatg

SEQ ID NO: 24579 - DNA, 103 bp, Artificial Sequence
  Synthetic Polynucleotide
taatacgactcactatagggttcccccataatctaataaaaacactttaaaacagaggagattaaagatgttttattagaacctggcggcagcgcaaaagatg

SEQ ID NO: 24580 - DNA, 103 bp, Artificial Sequence
  Synthetic Polynucleotide
taatacgactcactatagggcaaggttcccccataatctaataaaaacacaacagaggagagtgtttatgttagattataacctggcggcagcgcaaaagatg

SEQ ID NO: 24581 - DNA, 103 bp, Artificial Sequence
  Synthetic Polynucleotide
taatacgactcactatagggaagaacaaggttcccccataatctaataaaaacagaggagatttattatgttatgggggaacctggcggcagcgcaaaagatg

SEQ ID NO: 24582 - DNA, 103 bp, Artificial Sequence
  Synthetic Polynucleotide
taatacgactcactatagggtcattaagaacaaggttcccccataatctaaacagaggagatagattatgggggaacctaacctggcggcagcgcaaaagatg

SEQ ID NO: 24583 - DNA, 103 bp, Artificial Sequence
  Synthetic Polynucleotide
taatacgactcactatagggattcttcattaagaacaaggttcccccataaacagaggagatatgggatgaccttgttcaacctggcggcagcgcaaaagatg

SEQ ID NO: 24584 - DNA, 103 bp, Artificial Sequence
  Synthetic Polynucleotide
taatacgactcactatagggatagcattcttcattaagaacaaggttcccaacagaggagagggaacatggttcttaataacctggcggcagcgcaaaagatg

SEQ ID NO: 24585 - DNA, 103 bp, Artificial Sequence
  Synthetic Polynucleotide
taatacgactcactatagggattgaatagcattcttcattaagaacaaggaacagaggagaccttgtatgtaatgaagaaacctggcggcagcgcaaaagatg

SEQ ID NO: 24586 - DNA, 103 bp, Artificial Sequence
  Synthetic Polynucleotide
taatacgactcactatagggataatattgaatagcattcttcattaagaaaacagaggagattcttaatgaagaatgctaacctggcggcagcgcaaaagatg

SEQ ID NO: 24587 - DNA, 103 bp, Artificial Sequence
  Synthetic Polynucleotide
taatacgactcactatagggtcctgagcatataatggaggtggtgggagaaacagaggagatctcccatgacctccattaacctggcggcagcgcaaaagatg

SEQ ID NO: 24588 - DNA, 103 bp, Artificial Sequence
  Synthetic Polynucleotide
taatacgactcactatagggtgtccataatattgaatagcattcttcattaacagaggagaaatgaaatgtgctattcaaacctggcggcagcgcaaaagatg

SEQ ID NO: 24589 - DNA, 103 bp, Artificial Sequence
  Synthetic Polynucleotide
taatacgactcactataggggaacttgtccataatattgaatagcattctaacagaggagaagaatgatgttcaatattaacctggcggcagcgcaaaagatg

SEQ ID NO: 24590 - DNA, 103 bp, Artificial Sequence
  Synthetic Polynucleotide
taatacgactcactatagggaagttgaacttgtccataatattgaatagcaacagaggagagctattatgtattatggaaacctggcggcagcgcaaaagatg

SEQ ID NO: 24591 - DNA, 103 bp, Artificial Sequence
  Synthetic Polynucleotide
taatacgactcactatagggttcttaagttgaacttgtccataatattgaaacagaggagatcaataatgtggacaagtaacctggcggcagcgcaaaagatg

SEQ ID NO: 24592 - DNA, 103 bp, Artificial Sequence
  Synthetic Polynucleotide
taatacgactcactatagggatggtttcttaagttgaacttgtccataataacagaggagaattatgatgaagttcaacaacctggcggcagcgcaaaagatg

SEQ ID NO: 24593 - DNA, 103 bp, Artificial Sequence
  Synthetic Polynucleotide
taatacgactcactatagggactatatggtttcttaagttgaacttgtccaacagaggagaggacaaatgcaacttaagaacctggcggcagcgcaaaagatg

SEQ ID NO: 24594 - DNA, 103 bp, Artificial Sequence
  Synthetic Polynucleotide
taatacgactcactatagggtttgaactatatggtttcttaagttgaactaacagaggagaagttcaatgtaagaaaccaacctggcggcagcgcaaaagatg

SEQ ID NO: 24595 - DNA, 103 bp, Artificial Sequence
  Synthetic Polynucleotide
taatacgactcactatagggttgcatttgaactatatggtttcttaagttaacagaggagaaacttaatgaaccatataaacctggcggcagcgcaaaagatg

SEQ ID NO: 24596 - DNA, 103 bp, Artificial Sequence
  Synthetic Polynucleotide
taatacgactcactatagggattttttgcatttgaactatatggtttcttaacagaggagaaagaaaatgtatagttcaaacctggcggcagcgcaaaagatg

SEQ ID NO: 24597 - DNA, 103 bp, Artificial Sequence
  Synthetic Polynucleotide
taatacgactcactatagggtctgaattttttgcatttgaactatatggtaacagaggagaaccataatgttcaaatgcaacctggcggcagcgcaaaagatg

SEQ ID NO: 24598 - DNA, 103 bp, Artificial Sequence
  Synthetic Polynucleotide
taatacgactcactatagggtcttttcctgagcatataatggaggtggtgaacagaggagacaccacatgcattatatgaacctggcggcagcgcaaaagatg

SEQ ID NO: 24599 - DNA, 103 bp, Artificial Sequence
  Synthetic Polynucleotide
taatacgactcactatagggaccattctgaattttttgcatttgaactataacagaggagaatagttatgatgcaaaaaaacctggcggcagcgcaaaagatg

SEQ ID NO: 24600 - DNA, 103 bp, Artificial Sequence
  Synthetic Polynucleotide
taatacgactcactatagggtaagtaccattctgaattttttgcatttgaaacagaggagatcaaatatgaaaaattcaaacctggcggcagcgcaaaagatg

SEQ ID NO: 24601 - DNA, 103 bp, Artificial Sequence
  Synthetic Polynucleotide
taatacgactcactatagggcaacataagtaccattctgaattttttgcaaacagaggagatgcaaaatgttcagaatgaacctggcggcagcgcaaaagatg

SEQ ID NO: 24602 - DNA, 103 bp, Artificial Sequence
  Synthetic Polynucleotide
taatacgactcactatagggttccacaacataagtaccattctgaattttaacagaggagaaaaattatgaatggtactaacctggcggcagcgcaaaagatg

SEQ ID NO: 24603 - DNA, 103 bp, Artificial Sequence
  Synthetic Polynucleotide
taatacgactcactatagggtcgttttccacaacataagtaccattctgaaacagaggagatcagaaatgtacttatgtaacctggcggcagcgcaaaagatg

SEQ ID NO: 24604 - DNA, 103 bp, Artificial Sequence
  Synthetic Polynucleotide
taatacgactcactatagggactcttcgttttccacaacataagtaccataacagaggagaatggtaatgatgttgtggaacctggcggcagcgcaaaagatg

SEQ ID NO: 24605 - DNA, 103 bp, Artificial Sequence
  Synthetic Polynucleotide
taatacgactcactataggggttgaactcttcgttttccacaacataagtaacagaggagaacttatatggtggaaaacaacctggcggcagcgcaaaagatg

SEQ ID NO: 24606 - DNA, 103 bp, Artificial Sequence
  Synthetic Polynucleotide
taatacgactcactataggggagtcgttgaactcttcgttttccacaacaaacagaggagatgttgtatgaaacgaagaaacctggcggcagcgcaaaagatg

SEQ ID NO: 24607 - DNA, 103 bp, Artificial Sequence
  Synthetic Polynucleotide
taatacgactcactatagggactcggagtcgttgaactcttcgttttccaaacagaggagatggaaaatgaagagttcaaacctggcggcagcgcaaaagatg

SEQ ID NO: 24608 - DNA, 103 bp, Artificial Sequence
  Synthetic Polynucleotide
taatacgactcactatagggaatcaactcggagtcgttgaactcttcgttaacagaggagaaacgaaatgttcaacgacaacctggcggcagcgcaaaagatg

SEQ ID NO: 24609 - DNA, 103 bp, Artificial Sequence
  Synthetic Polynucleotide
taatacgactcactatagggctgtctcttttcctgagcatataatggaggaacagaggagacctccaatgtatgctcagaacctggcggcagcgcaaaagatg

SEQ ID NO: 24610 - DNA, 103 bp, Artificial Sequence
  Synthetic Polynucleotide
taatacgactcactatagggtggaaaatcaactcggagtcgttgaactctaacagaggagaagagttatgcgactccgaaacctggcggcagcgcaaaagatg

SEQ ID NO: 24611 - DNA, 103 bp, Artificial Sequence
  Synthetic Polynucleotide
taatacgactcactatagggtggtctggaaaatcaactcggagtcgttgaaacagaggagatcaacgatgccgagttgaaacctggcggcagcgcaaaagatg

SEQ ID NO: 24612 - DNA, 103 bp, Artificial Sequence
  Synthetic Polynucleotide
taatacgactcactatagggctacttggtctggaaaatcaactcggagtcaacagaggagagactccatgttgattttcaacctggcggcagcgcaaaagatg

SEQ ID NO: 24613 - DNA, 103 bp, Artificial Sequence
  Synthetic Polynucleotide
taatacgactcactatagggtattcctacttggtctggaaaatcaactcgaacagaggagacgagttatgtttccagacaacctggcggcagcgcaaaagatg

SEQ ID NO: 24614 - DNA, 103 bp, Artificial Sequence
  Synthetic Polynucleotide
taatacgactcactatagggaagaatattcctacttggtctggaaaatcaaacagaggagatgatttatgagaccaagtaacctggcggcagcgcaaaagatg

SEQ ID NO: 24615 - DNA, 103 bp, Artificial Sequence
  Synthetic Polynucleotide
taatacgactcactatagggagatcaagaatattcctacttggtctggaaaacagaggagattccagatgaagtaggaaaacctggcggcagcgcaaaagatg

SEQ ID NO: 24616 - DNA, 103 bp, Artificial Sequence
  Synthetic Polynucleotide
taatacgactcactatagggtttacagatcaagaatattcctacttggtcaacagaggagagaccaaatgggaatattcaacctggcggcagcgcaaaagatg

SEQ ID NO: 24617 - DNA, 103 bp, Artificial Sequence
  Synthetic Polynucleotide
taatacgactcactatagggattgctttacagatcaagaatattcctactaacagaggagaagtaggatgattcttgataacctggcggcagcgcaaaagatg

SEQ ID NO: 24618 - DNA, 103 bp, Artificial Sequence
  Synthetic Polynucleotide
taatacgactcactataggggtgacattgctttacagatcaagaatattcaacagaggagagaatatatgtgatctgtaaacctggcggcagcgcaaaagatg

SEQ ID NO: 24619 - DNA, 103 bp, Artificial Sequence
  Synthetic Polynucleotide
taatacgactcactatagggctgacgtgacattgctttacagatcaagaaaacagaggagattcttgatgtgtaaagcaaacctggcggcagcgcaaaagatg

SEQ ID NO: 24620 - DNA, 103 bp, Artificial Sequence
  Synthetic Polynucleotide
taatacgactcactatagggggatcctgtctcttttcctgagcatataataacagaggagaattataatgtcaggaaaaaacctggcggcagcgcaaaagatg

SEQ ID NO: 24621 - DNA, 103 bp, Artificial Sequence
  Synthetic Polynucleotide
taatacgactcactatagggtgcctctgacgtgacattgctttacagatcaacagaggagagatctgatgagcaatgtcaacctggcggcagcgcaaaagatg

SEQ ID NO: 24622 - DNA, 103 bp, Artificial Sequence
  Synthetic Polynucleotide
taatacgactcactatagggttgcttgcctctgacgtgacattgctttacaacagaggagagtaaagatgtgtcacgtcaacctggcggcagcgcaaaagatg

SEQ ID NO: 24623 - DNA, 103 bp, Artificial Sequence
  Synthetic Polynucleotide
taatacgactcactatagggaggaattgcttgcctctgacgtgacattgcaacagaggagagcaatgatgcgtcagaggaacctggcggcagcgcaaaagatg

SEQ ID NO: 24624 - DNA, 103 bp, Artificial Sequence
  Synthetic Polynucleotide
taatacgactcactatagggcagtaaggaattgcttgcctctgacgtgacaacagaggagagtcacgatggaggcaagcaacctggcggcagcgcaaaagatg

SEQ ID NO: 24625 - DNA, 103 bp, Artificial Sequence
  Synthetic Polynucleotide
taatacgactcactatagggttagccagtaaggaattgcttgcctctgacaacagaggagagtcagaatgaagcaattcaacctggcggcagcgcaaaagatg

SEQ ID NO: 24626 - DNA, 103 bp, Artificial Sequence
  Synthetic Polynucleotide
taatacgactcactataggggtgctttagccagtaaggaattgcttgcctaacagaggagaaggcaaatgattccttacaacctggcggcagcgcaaaagatg

SEQ ID NO: 24627 - DNA, 103 bp, Artificial Sequence
  Synthetic Polynucleotide
taatacgactcactatagggtctatgtgctttagccagtaaggaattgctaacagaggagaagcaatatgttactggctaacctggcggcagcgcaaaagatg

SEQ ID NO: 24628 - DNA, 103 bp, Artificial Sequence
  Synthetic Polynucleotide
taatacgactcactatagggtcttttctatgtgctttagccagtaaggaaaacagaggagattccttatgggctaaagcaacctggcggcagcgcaaaagatg

SEQ ID NO: 24629 - DNA, 103 bp, Artificial Sequence
  Synthetic Polynucleotide
taatacgactcactataggggtaattcttttctatgtgctttagccagtaaacagaggagatactggatgaagcacataaacctggcggcagcgcaaaagatg

SEQ ID NO: 24630 - DNA, 103 bp, Artificial Sequence
  Synthetic Polynucleotide
taatacgactcactataggggcagggtaattcttttctatgtgctttagcaacagaggagagctaaaatgcatagaaaaaacctggcggcagcgcaaaagatg

SEQ ID NO: 24631 - DNA, 103 bp, Artificial Sequence
  Synthetic Polynucleotide
taatacgactcactataggggtatgggatcctgtctcttttcctgagcataacagaggagaatgctcatgaaaagagacaacctggcggcagcgcaaaagatg

SEQ ID NO: 24632 - DNA, 103 bp, Artificial Sequence
  Synthetic Polynucleotide
taatacgactcactatagggatgaagcagggtaattcttttctatgtgctaacagaggagaagcacaatgaaaagaattaacctggcggcagcgcaaaagatg

SEQ ID NO: 24633 - DNA, 103 bp, Artificial Sequence
  Synthetic Polynucleotide
taatacgactcactataggggtgcaatgaagcagggtaattcttttctataacagaggagaatagaaatgaattaccctaacctggcggcagcgcaaaagatg

SEQ ID NO: 24634 - DNA, 103 bp, Artificial Sequence
  Synthetic Polynucleotide
taatacgactcactatagggaactcgtgcaatgaagcagggtaattctttaacagaggagaaaagaaatgccctgcttcaacctggcggcagcgcaaaagatg

SEQ ID NO: 24635 - DNA, 103 bp, Artificial Sequence
  Synthetic Polynucleotide
taatacgactcactatagggtaaagaactcgtgcaatgaagcagggtaataacagaggagaattaccatgcttcattgcaacctggcggcagcgcaaaagatg

SEQ ID NO: 24636 - DNA, 103 bp, Artificial Sequence
  Synthetic Polynucleotide
taatacgactcactatagggagttataaagaactcgtgcaatgaagcaggaacagaggagacctgctatgttgcacgagaacctggcggcagcgcaaaagatg

SEQ ID NO: 24637 - DNA, 103 bp, Artificial Sequence
  Synthetic Polynucleotide
taatacgactcactatagggcctaaagttataaagaactcgtgcaatgaaaacagaggagattcattatgcgagttcttaacctggcggcagcgcaaaagatg

SEQ ID NO: 24638 - DNA, 103 bp, Artificial Sequence
  Synthetic Polynucleotide
taatacgactcactataggggaaaacctaaagttataaagaactcgtgcaaacagaggagatgcacgatgtctttataaaacctggcggcagcgcaaaagatg

SEQ ID NO: 24639 - DNA, 103 bp, Artificial Sequence
  Synthetic Polynucleotide
taatacgactcactatagggagaaggaaaacctaaagttataaagaactcaacagaggagagagttcatgataactttaaacctggcggcagcgcaaaagatg

SEQ ID NO: 24640 - DNA, 103 bp, Artificial Sequence
  Synthetic Polynucleotide
taatacgactcactatagggtctaaagaaggaaaacctaaagttataaagaacagaggagactttatatgtttaggtttaacctggcggcagcgcaaaagatg

SEQ ID NO: 24641 - DNA, 103 bp, Artificial Sequence
  Synthetic Polynucleotide
taatacgactcactatagggatgactctaaagaaggaaaacctaaagttaaacagaggagataacttatggttttccttaacctggcggcagcgcaaaagatg

SEQ ID NO: 24642 - DNA, 103 bp, Artificial Sequence
  Synthetic Polynucleotide
taatacgactcactataggggatactaacctgatggtttgtatcaaacaaaacagaggagattgtttatgacaaaccataacctggcggcagcgcaaaagatg

SEQ ID NO: 24643 - DNA, 103 bp, Artificial Sequence
  Synthetic Polynucleotide
taatacgactcactatagggatgctgtatgggatcctgtctcttttcctgaacagaggagacaggaaatgagacaggataacctggcggcagcgcaaaagatg

SEQ ID NO: 24644 - DNA, 103 bp, Artificial Sequence
  Synthetic Polynucleotide
taatacgactcactataggggaaagatgactctaaagaaggaaaacctaaaacagaggagattaggtatgccttctttaaacctggcggcagcgcaaaagatg

SEQ ID NO: 24645 - DNA, 103 bp, Artificial Sequence
  Synthetic Polynucleotide
taatacgactcactatagggtggcagaaagatgactctaaagaaggaaaaaacagaggagattttccatgtttagagtcaacctggcggcagcgcaaaagatg

SEQ ID NO: 24646 - DNA, 103 bp, Artificial Sequence
  Synthetic Polynucleotide
taatacgactcactatagggagcgatggcagaaagatgactctaaagaagaacagaggagacttcttatgagtcatcttaacctggcggcagcgcaaaagatg

SEQ ID NO: 24647 - DNA, 103 bp, Artificial Sequence
  Synthetic Polynucleotide
taatacgactcactatagggggtgtagcgatggcagaaagatgactctaaaacagaggagattagagatgtctttctgcaacctggcggcagcgcaaaagatg

SEQ ID NO: 24648 - DNA, 103 bp, Artificial Sequence
  Synthetic Polynucleotide
taatacgactcactatagggggaatggtgtagcgatggcagaaagatgacaacagaggagagtcatcatgctgccatcgaacctggcggcagcgcaaaagatg

SEQ ID NO: 24649 - DNA, 103 bp, Artificial Sequence
  Synthetic Polynucleotide
taatacgactcactatagggtgaacggaatggtgtagcgatggcagaaagaacagaggagactttctatgatcgctacaaacctggcggcagcgcaaaagatg

SEQ ID NO: 24650 - DNA, 103 bp, Artificial Sequence
  Synthetic Polynucleotide
taatacgactcactatagggctcagtgaacggaatggtgtagcgatggcaaacagaggagatgccatatgtacaccattaacctggcggcagcgcaaaagatg

SEQ ID NO: 24651 - DNA, 103 bp, Artificial Sequence
  Synthetic Polynucleotide
taatacgactcactataggggttccctcagtgaacggaatggtgtagcgaaacagaggagatcgctaatgcattccgttaacctggcggcagcgcaaaagatg

SEQ ID NO: 24652 - DNA, 103 bp, Artificial Sequence
  Synthetic Polynucleotide
taatacgactcactataggggagccgttccctcagtgaacggaatggtgtaacagaggagaacaccaatgcgttcactgaacctggcggcagcgcaaaagatg

SEQ ID NO: 24653 - DNA, 103 bp, Artificial Sequence
  Synthetic Polynucleotide
taatacgactcactatagggaaagagagccgttccctcagtgaacggaataacagaggagaattccgatgactgagggaaacctggcggcagcgcaaaagatg

SEQ ID NO: 24654 - DNA, 103 bp, Artificial Sequence
  Synthetic Polynucleotide
taatacgactcactataggggctggatgctgtatgggatcctgtctctttaacagaggagaaaagagatgggatcccataacctggcggcagcgcaaaagatg

SEQ ID NO: 24655 - DNA, 103 bp, Artificial Sequence
  Synthetic Polynucleotide
taatacgactcactatagggttgtgaaagagagccgttccctcagtgaacaacagaggagagttcacatggggaacggcaacctggcggcagcgcaaaagatg

SEQ ID NO: 24656 - DNA, 103 bp, Artificial Sequence
  Synthetic Polynucleotide
taatacgactcactatagggggaccttgtgaaagagagccgttccctcagaacagaggagactgaggatgcggctctctaacctggcggcagcgcaaaagatg

SEQ ID NO: 24657 - DNA, 103 bp, Artificial Sequence
  Synthetic Polynucleotide
taatacgactcactatagggagactggaccttgtgaaagagagccgttccaacagaggagaggaacgatgctctttcacaacctggcggcagcgcaaaagatg

SEQ ID NO: 24658 - DNA, 103 bp, Artificial Sequence
  Synthetic Polynucleotide
taatacgactcactatagggacataagactggaccttgtgaaagagagccaacagaggagaggctctatgtcacaaggtaacctggcggcagcgcaaaagatg

SEQ ID NO: 24659 - DNA, 103 bp, Artificial Sequence
  Synthetic Polynucleotide
taatacgactcactataggggtcggacataagactggaccttgtgaaagaaacagaggagatctttcatgaggtccagtaacctggcggcagcgcaaaagatg

SEQ ID NO: 24660 - DNA, 103 bp, Artificial Sequence
  Synthetic Polynucleotide
taatacgactcactatagggaccttgtcggacataagactggaccttgtgaacagaggagacacaagatgcagtcttataacctggcggcagcgcaaaagatg

SEQ ID NO: 24661 - DNA, 103 bp, Artificial Sequence
  Synthetic Polynucleotide
taatacgactcactatagggtgtctaccttgtcggacataagactggaccaacagaggagaggtccaatgttatgtccgaacctggcggcagcgcaaaagatg

SEQ ID NO: 24662 - DNA, 103 bp, Artificial Sequence
  Synthetic Polynucleotide
taatacgactcactatagggggtgttgtctaccttgtcggacataagactaacagaggagaagtcttatgtccgacaagaacctggcggcagcgcaaaagatg

SEQ ID NO: 24663 - DNA, 103 bp, Artificial Sequence
  Synthetic Polynucleotide
taatacgactcactataggggtgtaggtgttgtctaccttgtcggacataaacagaggagatatgtcatgcaaggtagaaacctggcggcagcgcaaaagatg

SEQ ID NO: 24664 - DNA, 103 bp, Artificial Sequence
  Synthetic Polynucleotide
taatacgactcactatagggagagagtgtaggtgttgtctaccttgtcggaacagaggagaccgacaatgtagacaacaaacctggcggcagcgcaaaagatg

SEQ ID NO: 24665 - DNA, 103 bp, Artificial Sequence
  Synthetic Polynucleotide
taatacgactcactatagggtcacggctggatgctgtatgggatcctgtcaacagaggagagacaggatgccatacagcaacctggcggcagcgcaaaagatg

SEQ ID NO: 24666 - DNA, 103 bp, Artificial Sequence
  Synthetic Polynucleotide
taatacgactcactatagggacataagagagtgtaggtgttgtctaccttaacagaggagaaaggtaatgaacacctacaacctggcggcagcgcaaaagatg

SEQ ID NO: 24667 - DNA, 103 bp, Artificial Sequence
  Synthetic Polynucleotide
taatacgactcactatagggatctaacataagagagtgtaggtgttgtctaacagaggagaagacaaatgctacactctaacctggcggcagcgcaaaagatg

SEQ ID NO: 24668 - DNA, 103 bp, Artificial Sequence
  Synthetic Polynucleotide
taatacgactcactatagggtcgtaatctaacataagagagtgtaggtgtaacagaggagaacacctatgctctcttataacctggcggcagcgcaaaagatg

SEQ ID NO: 24669 - DNA, 103 bp, Artificial Sequence
  Synthetic Polynucleotide
taatacgactcactatagggtattttcgtaatctaacataagagagtgtaaacagaggagatacactatgttatgttagaacctggcggcagcgcaaaagatg

SEQ ID NO: 24670 - DNA, 103 bp, Artificial Sequence
  Synthetic Polynucleotide
taatacgactcactatagggtgaattattttcgtaatctaacataagagaaacagaggagatctcttatgttagattacaacctggcggcagcgcaaaagatg

SEQ ID NO: 24671 - DNA, 103 bp, Artificial Sequence
  Synthetic Polynucleotide
taatacgactcactatagggaggggtgaattattttcgtaatctaacataaacagaggagatatgttatgttacgaaaaaacctggcggcagcgcaaaagatg

SEQ ID NO: 24672 - DNA, 103 bp, Artificial Sequence
  Synthetic Polynucleotide
taatacgactcactatagggctaggaggggtgaattattttcgtaatctaaacagaggagatagattatgaaaataattaacctggcggcagcgcaaaagatg

SEQ ID NO: 24673 - DNA, 103 bp, Artificial Sequence
  Synthetic Polynucleotide
taatacgactcactatagggcagatctaggaggggtgaattattttcgtaaacagaggagatacgaaatgaattcacccaacctggcggcagcgcaaaagatg

SEQ ID NO: 24674 - DNA, 103 bp, Artificial Sequence
  Synthetic Polynucleotide
taatacgactcactatagggtttctcagatctaggaggggtgaattatttaacagaggagaaaataaatgacccctcctaacctggcggcagcgcaaaagatg

SEQ ID NO: 24675 - DNA, 103 bp, Artificial Sequence
  Synthetic Polynucleotide
taatacgactcactatagggagtgatttctcagatctaggaggggtgaataacagaggagaattcacatgtcctagatcaacctggcggcagcgcaaaagatg

SEQ ID NO: 24676 - DNA, 103 bp, Artificial Sequence
  Synthetic Polynucleotide
taatacgactcactatagggggagctcacggctggatgctgtatgggatcaacagaggagagatcccatgcagcatccaaacctggcggcagcgcaaaagatg

SEQ ID NO: 24677 - DNA, 103 bp, Artificial Sequence
  Synthetic Polynucleotide
taatacgactcactatagggtatgaagtgatttctcagatctaggaggggaacagaggagacccctcatggatctgagaaacctggcggcagcgcaaaagatg

SEQ ID NO: 24678 - DNA, 103 bp, Artificial Sequence
  Synthetic Polynucleotide
taatacgactcactataggggagcatatgaagtgatttctcagatctaggaacagaggagacctagaatggagaaatcaaacctggcggcagcgcaaaagatg

SEQ ID NO: 24679 - DNA, 103 bp, Artificial Sequence
  Synthetic Polynucleotide
taatacgactcactatagggtcaatgagcatatgaagtgatttctcagataacagaggagaatctgaatgatcacttcaaacctggcggcagcgcaaaagatg

SEQ ID NO: 24680 - DNA, 103 bp, Artificial Sequence
  Synthetic Polynucleotide
taatacgactcactatagggtcccctcaatgagcatatgaagtgatttctaacagaggagaagaaatatgttcatatgcaacctggcggcagcgcaaaagatg

SEQ ID NO: 24681 - DNA, 103 bp, Artificial Sequence
  Synthetic Polynucleotide
taatacgactcactatagggatctttcccctcaatgagcatatgaagtgaaacagaggagatcacttatgatgctcattaacctggcggcagcgcaaaagatg

SEQ ID NO: 24682 - DNA, 103 bp, Artificial Sequence
  Synthetic Polynucleotide
taatacgactcactatagggtggttatctttcccctcaatgagcatatgaaacagaggagatcatatatgcattgagggaacctggcggcagcgcaaaagatg

SEQ ID NO: 24683 - DNA, 103 bp, Artificial Sequence
  Synthetic Polynucleotide
taatacgactcactatagggatacttggttatctttcccctcaatgagcaaacagaggagatgctcaatgaggggaaagaacctggcggcagcgcaaaagatg

SEQ ID NO: 24684 - DNA, 103 bp, Artificial Sequence
  Synthetic Polynucleotide
taatacgactcactatagggttgtaatacttggttatctttcccctcaataacagaggagaattgagatgaaagataacaacctggcggcagcgcaaaagatg

SEQ ID NO: 24685 - DNA, 103 bp, Artificial Sequence
  Synthetic Polynucleotide
taatacgactcactatagggtgtcattgtaatacttggttatctttccccaacagaggagaggggaaatgtaaccaagtaacctggcggcagcgcaaaagatg

SEQ ID NO: 24686 - DNA, 103 bp, Artificial Sequence
  Synthetic Polynucleotide
taatacgactcactatagggcaatatgtcattgtaatacttggttatcttaacagaggagaaagataatgaagtattacaacctggcggcagcgcaaaagatg

SEQ ID NO: 24687 - DNA, 103 bp, Artificial Sequence
  Synthetic Polynucleotide
taatacgactcactatagggtcttgggagctcacggctggatgctgtatgaacagaggagacatacaatgtccagccgtaacctggcggcagcgcaaaagatg

SEQ ID NO: 24688 - DNA, 103 bp, Artificial Sequence
  Synthetic Polynucleotide
taatacgactcactatagggaatttcaatatgtcattgtaatacttggttaacagaggagaaaccaaatgttacaatgaaacctggcggcagcgcaaaagatg

SEQ ID NO: 24689 - DNA, 103 bp, Artificial Sequence
  Synthetic Polynucleotide
taatacgactcactataggggatttaatttcaatatgtcattgtaatactaacagaggagaagtattatgatgacatataacctggcggcagcgcaaaagatg

SEQ ID NO: 24690 - DNA, 103 bp, Artificial Sequence
  Synthetic Polynucleotide
taatacgactcactatagggtactagatttaatttcaatatgtcattgtaaacagaggagatacaatatgatattgaaaaacctggcggcagcgcaaaagatg

SEQ ID NO: 24691 - DNA, 103 bp, Artificial Sequence
  Synthetic Polynucleotide
taatacgactcactatagggctcactactagatttaatttcaatatgtcaaacagaggagatgacatatggaaattaaaaacctggcggcagcgcaaaagatg

SEQ ID NO: 24692 - DNA, 103 bp, Artificial Sequence
  Synthetic Polynucleotide
taatacgactcactatagggctgctctcactactagatttaatttcaataaacagaggagatattgaatgtaaatctagaacctggcggcagcgcaaaagatg

SEQ ID NO: 24693 - DNA, 103 bp, Artificial Sequence
  Synthetic Polynucleotide
taatacgactcactatagggttctactgctctcactactagatttaatttaacagaggagaaaattaatgctagtagtgaacctggcggcagcgcaaaagatg

SEQ ID NO: 24694 - DNA, 103 bp, Artificial Sequence
  Synthetic Polynucleotide
taatacgactcactatagggcctctttctactgctctcactactagatttaacagaggagaaaatctatgagtgagagcaacctggcggcagcgcaaaagatg

SEQ ID NO: 24695 - DNA, 103 bp, Artificial Sequence
  Synthetic Polynucleotide
taatacgactcactatagggttttccctctttctactgctctcactactaaacagaggagatagtagatggagcagtagaacctggcggcagcgcaaaagatg

SEQ ID NO: 24696 - DNA, 103 bp, Artificial Sequence
  Synthetic Polynucleotide
taatacgactcactatagggccaatttttccctctttctactgctctcacaacagaggagagtgagaatggtagaaagaaacctggcggcagcgcaaaagatg

SEQ ID NO: 24697 - DNA, 103 bp, Artificial Sequence
  Synthetic Polynucleotide
taatacgactcactatagggtgcgaccaatttttccctctttctactgctaacagaggagaagcagtatgaagagggaaaacctggcggcagcgcaaaagatg

SEQ ID NO: 24698 - DNA, 103 bp, Artificial Sequence
  Synthetic Polynucleotide
taatacgactcactatagggagggatcttgggagctcacggctggatgctaacagaggagaagcatcatgccgtgagctaacctggcggcagcgcaaaagatg

SEQ ID NO: 24699 - DNA, 103 bp, Artificial Sequence
  Synthetic Polynucleotide
taatacgactcactatagggcgagttgcgaccaatttttccctctttctaaacagaggagatagaaaatgggaaaaattaacctggcggcagcgcaaaagatg

SEQ ID NO: 24700 - DNA, 103 bp, Artificial Sequence
  Synthetic Polynucleotide
taatacgactcactatagggctcaacgagttgcgaccaatttttccctctaacagaggagaagagggatgaattggtcgaacctggcggcagcgcaaaagatg

SEQ ID NO: 24701 - DNA, 103 bp, Artificial Sequence
  Synthetic Polynucleotide
taatacgactcactatagggagggactcaacgagttgcgaccaatttttcaacagaggagagaaaaaatggtcgcaactaacctggcggcagcgcaaaagatg

SEQ ID NO: 24702 - DNA, 103 bp, Artificial Sequence
  Synthetic Polynucleotide
taatacgactcactatagggtaggaagggactcaacgagttgcgaccaataacagaggagaattggtatgaactcgttgaacctggcggcagcgcaaaagatg

SEQ ID NO: 24703 - DNA, 103 bp, Artificial Sequence
  Synthetic Polynucleotide
taatacgactcactatagggcatattaggaagggactcaacgagttgcgaaacagaggagatcgcaaatggttgagtccaacctggcggcagcgcaaaagatg

SEQ ID NO: 24704 - DNA, 103 bp, Artificial Sequence
  Synthetic Polynucleotide
taatacgactcactataggggagtgcatattaggaagggactcaacgagtaacagaggagaactcgtatggtcccttccaacctggcggcagcgcaaaagatg

SEQ ID NO: 24705 - DNA, 103 bp, Artificial Sequence
  Synthetic Polynucleotide
taatacgactcactatagggatactgagtgcatattaggaagggactcaaaacagaggagattgagtatgttcctaataaacctggcggcagcgcaaaagatg

SEQ ID NO: 24706 - DNA, 103 bp, Artificial Sequence
  Synthetic Polynucleotide
taatacgactcactatagggtatgcatactgagtgcatattaggaagggaaacagaggagatcccttatgaatatgcacaacctggcggcagcgcaaaagatg

SEQ ID NO: 24707 - DNA, 103 bp, Artificial Sequence
  Synthetic Polynucleotide
taatacgactcactatagggtgtgttatgcatactgagtgcatattaggaaacagaggagatcctaaatggcactcagtaacctggcggcagcgcaaaagatg

SEQ ID NO: 24708 - DNA, 103 bp, Artificial Sequence
  Synthetic Polynucleotide
taatacgactcactatagggcaacatgtgttatgcatactgagtgcatataacagaggagaatatgcatgcagtatgcaaacctggcggcagcgcaaaagatg

SEQ ID NO: 24709 - DNA, 103 bp, Artificial Sequence
  Synthetic Polynucleotide
taatacgactcactataggggccaaagggatcttgggagctcacggctggaacagaggagaccagccatgagctcccaaaacctggcggcagcgcaaaagatg

SEQ ID NO: 24710 - DNA, 103 bp, Artificial Sequence
  Synthetic Polynucleotide
taatacgactcactataggggtgatcaacatgtgttatgcatactgagtgaacagaggagacactcaatgtgcataacaaacctggcggcagcgcaaaagatg

SEQ ID NO: 24711 - DNA, 103 bp, Artificial Sequence
  Synthetic Polynucleotide
taatacgactcactatagggcattcgtgatcaacatgtgttatgcatactaacagaggagaagtatgatgaacacatgtaacctggcggcagcgcaaaagatg

SEQ ID NO: 24712 - DNA, 103 bp, Artificial Sequence
  Synthetic Polynucleotide
taatacgactcactatagggcaatacattcgtgatcaacatgtgttatgcaacagaggagagcataaatgatgttgatcaacctggcggcagcgcaaaagatg

SEQ ID NO: 24713 - DNA, 103 bp, Artificial Sequence
  Synthetic Polynucleotide
taatacgactcactatagggacagccaatacattcgtgatcaacatgtgtaacagaggagaacacatatggatcacgaaaacctggcggcagcgcaaaagatg

SEQ ID NO: 24714 - DNA, 103 bp, Artificial Sequence
  Synthetic Polynucleotide
taatacgactcactatagggctctcacagccaatacattcgtgatcaacaaacagaggagatgttgaatgcgaatgtataacctggcggcagcgcaaaagatg

SEQ ID NO: 24715 - DNA, 103 bp, Artificial Sequence
  Synthetic Polynucleotide
taatacgactcactatagggaccgtctctcacagccaatacattcgtgataacagaggagaatcacgatggtattggctaacctggcggcagcgcaaaagatg

SEQ ID NO: 24716 - DNA, 103 bp, Artificial Sequence
  Synthetic Polynucleotide
taatacgactcactatagggtaataaccgtctctcacagccaatacattcaacagaggagagaatgtatgggctgtgagaacctggcggcagcgcaaaagatg

SEQ ID NO: 24717 - DNA, 103 bp, Artificial Sequence
  Synthetic Polynucleotide
taatacgactcactatagggttaagtaataaccgtctctcacagccaataaacagaggagatattggatgtgagagacgaacctggcggcagcgcaaaagatg

SEQ ID NO: 24718 - DNA, 103 bp, Artificial Sequence
  Synthetic Polynucleotide
taatacgactcactatagggccaatttaagtaataaccgtctctcacagcaacagaggagagctgtgatggacggttataacctggcggcagcgcaaaagatg

SEQ ID NO: 24719 - DNA, 103 bp, Artificial Sequence
  Synthetic Polynucleotide
taatacgactcactatagggaaagtccaatttaagtaataaccgtctctcaacagaggagagagagaatgttattacttaacctggcggcagcgcaaaagatg

SEQ ID NO: 24720 - DNA, 103 bp, Artificial Sequence
  Synthetic Polynucleotide
taatacgactcactatagggatactgccaaagggatcttgggagctcacgaacagaggagacgtgagatgccaagatccaacctggcggcagcgcaaaagatg

SEQ ID NO: 24721 - DNA, 103 bp, Artificial Sequence
  Synthetic Polynucleotide
taatacgactcactatagggctgacaaagtccaatttaagtaataaccgtaacagaggagaacggttatgacttaaattaacctggcggcagcgcaaaagatg

SEQ ID NO: 24722 - DNA, 103 bp, Artificial Sequence
  Synthetic Polynucleotide
taatacgactcactatagggtatttctgacaaagtccaatttaagtaataaacagaggagatattacatgaattggactaacctggcggcagcgcaaaagatg

SEQ ID NO: 24723 - DNA, 103 bp, Artificial Sequence
  Synthetic Polynucleotide
taatacgactcactatagggctttgtatttctgacaaagtccaatttaagaacagaggagacttaaaatggactttgtcaacctggcggcagcgcaaaagatg

SEQ ID NO: 24724 - DNA, 103 bp, Artificial Sequence
  Synthetic Polynucleotide
taatacgactcactataggggctatctttgtatttctgacaaagtccaataacagaggagaattggaatgtgtcagaaaaacctggcggcagcgcaaaagatg

SEQ ID NO: 24725 - DNA, 103 bp, Artificial Sequence
  Synthetic Polynucleotide
taatacgactcactataggggttctgctatctttgtatttctgacaaagtaacagaggagaactttgatggaaatacaaaacctggcggcagcgcaaaagatg

SEQ ID NO: 24726 - DNA, 103 bp, Artificial Sequence
  Synthetic Polynucleotide
taatacgactcactatagggcttttgttctgctatctttgtatttctgacaacagaggagagtcagaatgacaaagataaacctggcggcagcgcaaaagatg

SEQ ID NO: 24727 - DNA, 103 bp, Artificial Sequence
  Synthetic Polynucleotide
taatacgactcactatagggagtaacttttgttctgctatctttgtatttaacagaggagaaaatacatggatagcagaaacctggcggcagcgcaaaagatg

SEQ ID NO: 24728 - DNA, 103 bp, Artificial Sequence
  Synthetic Polynucleotide
taatacgactcactatagggtattgagtaacttttgttctgctatctttgaacagaggagacaaagaatgcagaacaaaaacctggcggcagcgcaaaagatg

SEQ ID NO: 24729 - DNA, 103 bp, Artificial Sequence
  Synthetic Polynucleotide
taatacgactcactatagggtaccctattgagtaacttttgttctgctataacagaggagaatagcaatgcaaaagttaaacctggcggcagcgcaaaagatg

SEQ ID NO: 24730 - DNA, 103 bp, Artificial Sequence
  Synthetic Polynucleotide
taatacgactcactatagggccaattaccctattgagtaacttttgttctaacagaggagaagaacaatggttactcaaaacctggcggcagcgcaaaagatg

SEQ ID NO: 24731 - DNA, 103 bp, Artificial Sequence
  Synthetic Polynucleotide
taatacgactcactatagggcaccaatactgccaaagggatcttgggagcaacagaggagagctcccatgatccctttgaacctggcggcagcgcaaaagatg

SEQ ID NO: 24732 - DNA, 103 bp, Artificial Sequence
  Synthetic Polynucleotide
taatacgactcactatagggtatacccaattaccctattgagtaacttttaacagaggagaaaaagtatgtcaatagggaacctggcggcagcgcaaaagatg

SEQ ID NO: 24733 - DNA, 103 bp, Artificial Sequence
  Synthetic Polynucleotide
taatacgactcactatagggtagaatatacccaattaccctattgagtaaaacagaggagattactcatgagggtaattaacctggcggcagcgcaaaagatg

SEQ ID NO: 24734 - DNA, 103 bp, Artificial Sequence
  Synthetic Polynucleotide
taatacgactcactatagggaagaatagaatatacccaattaccctattgaacagaggagacaatagatgaattgggtaaacctggcggcagcgcaaaagatg

SEQ ID NO: 24735 - DNA, 103 bp, Artificial Sequence
  Synthetic Polynucleotide
taatacgactcactatagggaagggaagaatagaatatacccaattacccaacagaggagagggtaaatgggtatattcaacctggcggcagcgcaaaagatg

SEQ ID NO: 24736 - DNA, 103 bp, Artificial Sequence
  Synthetic Polynucleotide
taatacgactcactatagggaccaaaagggaagaatagaatatacccaataacagaggagaattgggatgattctattcaacctggcggcagcgcaaaagatg

SEQ ID NO: 24737 - DNA, 103 bp, Artificial Sequence
  Synthetic Polynucleotide
taatacgactcactataggggagaaaccaaaagggaagaatagaatatacaacagaggagagtatatatgattcttcccaacctggcggcagcgcaaaagatg

SEQ ID NO: 24738 - DNA, 103 bp, Artificial Sequence
  Synthetic Polynucleotide
taatacgactcactataggggtctggagaaaccaaaagggaagaatagaaaacagaggagattctatatgtcccttttgaacctggcggcagcgcaaaagatg

SEQ ID NO: 24739 - DNA, 103 bp, Artificial Sequence
  Synthetic Polynucleotide
taatacgactcactatagggcttgggtctggagaaaccaaaagggaagaaaacagaggagattcttcatgtttggtttcaacctggcggcagcgcaaaagatg

SEQ ID NO: 24740 - DNA, 103 bp, Artificial Sequence
  Synthetic Polynucleotide
taatacgactcactatagggagtcacttgggtctggagaaaccaaaagggaacagaggagaccctttatgtttctccagaacctggcggcagcgcaaaagatg

SEQ ID NO: 24741 - DNA, 103 bp, Artificial Sequence
  Synthetic Polynucleotide
taatacgactcactatagggtctgtagtcacttgggtctggagaaaccaaaacagaggagattggttatgccagacccaaacctggcggcagcgcaaaagatg

SEQ ID NO: 24742 - DNA, 103 bp, Artificial Sequence
  Synthetic Polynucleotide
taatacgactcactatagggtacatcaccaatactgccaaagggatcttgaacagaggagacaagatatgtttggcagtaacctggcggcagcgcaaaagatg

SEQ ID NO: 24743 - DNA, 103 bp, Artificial Sequence
  Synthetic Polynucleotide
taatacgactcactatagggatatatctgtagtcacttgggtctggagaaaacagaggagattctccatgcccaagtgaaacctggcggcagcgcaaaagatg

SEQ ID NO: 24744 - DNA, 103 bp, Artificial Sequence
  Synthetic Polynucleotide
taatacgactcactataggggaagaatatatctgtagtcacttgggtctgaacagaggagacagaccatggtgactacaaacctggcggcagcgcaaaagatg

SEQ ID NO: 24745 - DNA, 103 bp, Artificial Sequence
  Synthetic Polynucleotide
taatacgactcactatagggttattgaagaatatatctgtagtcacttggaacagaggagaccaagtatgtacagatataacctggcggcagcgcaaaagatg

SEQ ID NO: 24746 - DNA, 103 bp, Artificial Sequence
  Synthetic Polynucleotide
taatacgactcactatagggttcctttattgaagaatatatctgtagtcaaacagaggagatgactaatgatatattctaacctggcggcagcgcaaaagatg

SEQ ID NO: 24747 - DNA, 103 bp, Artificial Sequence
  Synthetic Polynucleotide
taatacgactcactatagggtgagcttcctttattgaagaatatatctgtaacagaggagaacagatatgttcttcaataacctggcggcagcgcaaaagatg

SEQ ID NO: 24748 - DNA, 103 bp, Artificial Sequence
  Synthetic Polynucleotide
taatacgactcactatagggtagactgagcttcctttattgaagaatataaacagaggagatatattatgcaataaaggaacctggcggcagcgcaaaagatg

SEQ ID NO: 24749 - DNA, 103 bp, Artificial Sequence
  Synthetic Polynucleotide
taatacgactcactatagggtgagttagactgagcttcctttattgaagaaacagaggagatcttcaatgaaggaagctaacctggcggcagcgcaaaagatg

SEQ ID NO: 24750 - DNA, 103 bp, Artificial Sequence
  Synthetic Polynucleotide
taatacgactcactatagggttctgtgagttagactgagcttcctttattaacagaggagaaataaaatgagctcagtcaacctggcggcagcgcaaaagatg

SEQ ID NO: 24751 - DNA, 103 bp, Artificial Sequence
  Synthetic Polynucleotide
taatacgactcactatagggattatttctgtgagttagactgagcttcctaacagaggagaaggaagatgagtctaactaacctggcggcagcgcaaaagatg

SEQ ID NO: 24752 - DNA, 103 bp, Artificial Sequence
  Synthetic Polynucleotide
taatacgactcactatagggagtagattatttctgtgagttagactgagcaacagaggagagctcagatgaactcacagaacctggcggcagcgcaaaagatg

SEQ ID NO: 24753 - DNA, 103 bp, Artificial Sequence
  Synthetic Polynucleotide
taatacgactcactatagggttacagatactaacctgatggtttgtatcaaacagaggagatgatacatgccatcaggtaacctggcggcagcgcaaaagatg

SEQ ID NO: 24754 - DNA, 103 bp, Artificial Sequence
  Synthetic Polynucleotide
taatacgactcactatagggccatctacatcaccaatactgccaaagggaaacagaggagatcccttatgcagtattggaacctggcggcagcgcaaaagatg

SEQ ID NO: 24755 - DNA, 103 bp, Artificial Sequence
  Synthetic Polynucleotide
taatacgactcactatagggtttgaagtagattatttctgtgagttagacaacagaggagagtctaaatgacagaaataaacctggcggcagcgcaaaagatg

SEQ ID NO: 24756 - DNA, 103 bp, Artificial Sequence
  Synthetic Polynucleotide
taatacgactcactatagggcttgttttgaagtagattatttctgtgagtaacagaggagaactcacatgaataatctaaacctggcggcagcgcaaaagatg

SEQ ID NO: 24757 - DNA, 103 bp, Artificial Sequence
  Synthetic Polynucleotide
taatacgactcactatagggtgatccttgttttgaagtagattatttctgaacagaggagacagaaaatgtctacttcaaacctggcggcagcgcaaaagatg

SEQ ID NO: 24758 - DNA, 103 bp, Artificial Sequence
  Synthetic Polynucleotide
taatacgactcactatagggatgggtgatccttgttttgaagtagattataacagaggagaataatcatgttcaaaacaaacctggcggcagcgcaaaagatg

SEQ ID NO: 24759 - DNA, 103 bp, Artificial Sequence
  Synthetic Polynucleotide
taatacgactcactatagggccaaaatgggtgatccttgttttgaagtagaacagaggagactacttatgaacaaggataacctggcggcagcgcaaaagatg

SEQ ID NO: 24760 - DNA, 103 bp, Artificial Sequence
  Synthetic Polynucleotide
taatacgactcactatagggatgttccaaaatgggtgatccttgttttgaaacagaggagatcaaaaatgggatcacccaacctggcggcagcgcaaaagatg

SEQ ID NO: 24761 - DNA, 103 bp, Artificial Sequence
  Synthetic Polynucleotide
taatacgactcactatagggatacaatgttccaaaatgggtgatccttgtaacagaggagaacaaggatgacccattttaacctggcggcagcgcaaaagatg

SEQ ID NO: 24762 - DNA, 103 bp, Artificial Sequence
  Synthetic Polynucleotide
taatacgactcactatagggttcttatacaatgttccaaaatgggtgatcaacagaggagagatcacatgttttggaacaacctggcggcagcgcaaaagatg

SEQ ID NO: 24763 - DNA, 103 bp, Artificial Sequence
  Synthetic Polynucleotide
taatacgactcactataggggcagtttcttatacaatgttccaaaatgggaacagaggagacccattatggaacattgtaacctggcggcagcgcaaaagatg

SEQ ID NO: 24764 - DNA, 103 bp, Artificial Sequence
  Synthetic Polynucleotide
taatacgactcactataggggtcttgcagtttcttatacaatgttccaaaaacagaggagatttggaatgttgtataagaacctggcggcagcgcaaaagatg

SEQ ID NO: 24765 - DNA, 103 bp, Artificial Sequence
  Synthetic Polynucleotide
taatacgactcactatagggtatcaccatctacatcaccaatactgccaaaacagaggagattggcaatgttggtgatgaacctggcggcagcgcaaaagatg

SEQ ID NO: 24766 - DNA, 103 bp, Artificial Sequence
  Synthetic Polynucleotide
taatacgactcactatagggtatttgtcttgcagtttcttatacaatgttaacagaggagaaacattatgtaagaaactaacctggcggcagcgcaaaagatg

SEQ ID NO: 24767 - DNA, 103 bp, Artificial Sequence
  Synthetic Polynucleotide
taatacgactcactatagggcttattatttgtcttgcagtttcttatacaaacagaggagatgtataatgaactgcaagaacctggcggcagcgcaaaagatg

SEQ ID NO: 24768 - DNA, 103 bp, Artificial Sequence
  Synthetic Polynucleotide
taatacgactcactatagggctttccttattatttgtcttgcagtttcttaacagaggagaaagaaaatgcaagacaaaaacctggcggcagcgcaaaagatg

SEQ ID NO: 24769 - DNA, 103 bp, Artificial Sequence
  Synthetic Polynucleotide
taatacgactcactataggggtatcctttccttattatttgtcttgcagtaacagaggagaactgcaatgcaaataataaacctggcggcagcgcaaaagatg

SEQ ID NO: 24770 - DNA, 103 bp, Artificial Sequence
  Synthetic Polynucleotide
taatacgactcactatagggcagtagtatcctttccttattatttgtcttaacagaggagaaagacaatgaataaggaaaacctggcggcagcgcaaaagatg

SEQ ID NO: 24771 - DNA, 103 bp, Artificial Sequence
  Synthetic Polynucleotide
taatacgactcactatagggttatacagtagtatcctttccttattatttaacagaggagaaaataaatgggaaaggataacctggcggcagcgcaaaagatg

SEQ ID NO: 24772 - DNA, 103 bp, Artificial Sequence
  Synthetic Polynucleotide
taatacgactcactatagggacaagttatacagtagtatcctttccttataacagaggagaataaggatgggatactacaacctggcggcagcgcaaaagatg

SEQ ID NO: 24773 - DNA, 103 bp, Artificial Sequence
  Synthetic Polynucleotide
taatacgactcactatagggatataacaagttatacagtagtatcctttcaacagaggagagaaaggatgctactgtataacctggcggcagcgcaaaagatg

SEQ ID NO: 24774 - DNA, 103 bp, Artificial Sequence
  Synthetic Polynucleotide
taatacgactcactatagggtttggatataacaagttatacagtagtatcaacagaggagagatactatggtataacttaacctggcggcagcgcaaaagatg

SEQ ID NO: 24775 - DNA, 103 bp, Artificial Sequence
  Synthetic Polynucleotide
taatacgactcactatagggatccttttggatataacaagttatacagtaaacagaggagatactgtatgacttgttataacctggcggcagcgcaaaagatg

SEQ ID NO: 24776 - DNA, 103 bp, Artificial Sequence
  Synthetic Polynucleotide
taatacgactcactatagggcaaaatatcaccatctacatcaccaatactaacagaggagaagtattatggatgtagataacctggcggcagcgcaaaagatg

SEQ ID NO: 24777 - DNA, 103 bp, Artificial Sequence
  Synthetic Polynucleotide
taatacgactcactatagggccaagatccttttggatataacaagttataaacagaggagatataacatgttatatccaaacctggcggcagcgcaaaagatg

SEQ ID NO: 24778 - DNA, 103 bp, Artificial Sequence
  Synthetic Polynucleotide
taatacgactcactatagggatgacccaagatccttttggatataacaagaacagaggagacttgttatgtccaaaaggaacctggcggcagcgcaaaagatg

SEQ ID NO: 24779 - DNA, 103 bp, Artificial Sequence
  Synthetic Polynucleotide
taatacgactcactatagggttaaaatgacccaagatccttttggatataaacagaggagatatatcatgaaggatcttaacctggcggcagcgcaaaagatg

SEQ ID NO: 24780 - DNA, 103 bp, Artificial Sequence
  Synthetic Polynucleotide
taatacgactcactatagggcatgcttaaaatgacccaagatccttttggaacagaggagaccaaaaatgtcttgggtcaacctggcggcagcgcaaaagatg

SEQ ID NO: 24781 - DNA, 103 bp, Artificial Sequence
  Synthetic Polynucleotide
taatacgactcactatagggtgcatcatgcttaaaatgacccaagatcctaacagaggagaaggatcatgggtcattttaacctggcggcagcgcaaaagatg

SEQ ID NO: 24782 - DNA, 103 bp, Artificial Sequence
  Synthetic Polynucleotide
taatacgactcactatagggttatttgcatcatgcttaaaatgacccaagaacagaggagacttgggatgttttaagcaaacctggcggcagcgcaaaagatg

SEQ ID NO: 24783 - DNA, 103 bp, Artificial Sequence
  Synthetic Polynucleotide
taatacgactcactatagggattttttatttgcatcatgcttaaaatgacaacagaggagagtcattatgagcatgatgaacctggcggcagcgcaaaagatg

SEQ ID NO: 24784 - DNA, 103 bp, Artificial Sequence
  Synthetic Polynucleotide
taatacgactcactatagggagacgattttttatttgcatcatgcttaaaaacagaggagatttaagatggatgcaaataacctggcggcagcgcaaaagatg

SEQ ID NO: 24785 - DNA, 103 bp, Artificial Sequence
  Synthetic Polynucleotide
taatacgactcactatagggtatgtagacgattttttatttgcatcatgcaacagaggagagcatgaatgaaataaaaaaacctggcggcagcgcaaaagatg

SEQ ID NO: 24786 - DNA, 103 bp, Artificial Sequence
  Synthetic Polynucleotide
taatacgactcactatagggtcggctatgtagacgattttttatttgcataacagaggagaatgcaaatgaaaaatcgtaacctggcggcagcgcaaaagatg

SEQ ID NO: 24787 - DNA, 103 bp, Artificial Sequence
  Synthetic Polynucleotide
taatacgactcactatagggggttccaaaatatcaccatctacatcaccaaacagaggagatggtgaatgagatggtgaaacctggcggcagcgcaaaagatg

SEQ ID NO: 24788 - DNA, 103 bp, Artificial Sequence
  Synthetic Polynucleotide
taatacgactcactatagggtcagttcggctatgtagacgattttttattaacagaggagaaataaaatgtcgtctacaaacctggcggcagcgcaaaagatg

SEQ ID NO: 24789 - DNA, 103 bp, Artificial Sequence
  Synthetic Polynucleotide
taatacgactcactatagggagcggtcagttcggctatgtagacgattttaacagaggagaaaaatcatgtacatagccaacctggcggcagcgcaaaagatg

SEQ ID NO: 24790 - DNA, 103 bp, Artificial Sequence
  Synthetic Polynucleotide
taatacgactcactatagggtactgagcggtcagttcggctatgtagacgaacagaggagacgtctaatgagccgaactaacctggcggcagcgcaaaagatg

SEQ ID NO: 24791 - DNA, 103 bp, Artificial Sequence
  Synthetic Polynucleotide
taatacgactcactatagggataagtactgagcggtcagttcggctatgtaacagaggagaacatagatgaactgaccgaacctggcggcagcgcaaaagatg

SEQ ID NO: 24792 - DNA, 103 bp, Artificial Sequence
  Synthetic Polynucleotide
taatacgactcactatagggtgtgaataagtactgagcggtcagttcggcaacagaggagagccgaaatgaccgctcagaacctggcggcagcgcaaaagatg

SEQ ID NO: 24793 - DNA, 103 bp, Artificial Sequence
  Synthetic Polynucleotide
taatacgactcactatagggatgattgtgaataagtactgagcggtcagtaacagaggagaactgacatgtcagtacttaacctggcggcagcgcaaaagatg

SEQ ID NO: 24794 - DNA, 103 bp, Artificial Sequence
  Synthetic Polynucleotide
taatacgactcactatagggttagcatgattgtgaataagtactgagcggaacagaggagaccgctcatgacttattcaaacctggcggcagcgcaaaagatg

SEQ ID NO: 24795 - DNA, 103 bp, Artificial Sequence
  Synthetic Polynucleotide
taatacgactcactatagggaaaagttagcatgattgtgaataagtactgaacagaggagacagtacatgttcacaatcaacctggcggcagcgcaaaagatg

SEQ ID NO: 24796 - DNA, 103 bp, Artificial Sequence
  Synthetic Polynucleotide
taatacgactcactatagggaaactaaaagttagcatgattgtgaataagaacagaggagacttattatgaatcatgctaacctggcggcagcgcaaaagatg

SEQ ID NO: 24797 - DNA, 103 bp, Artificial Sequence
  Synthetic Polynucleotide
taatacgactcactatagggattaaaaactaaaagttagcatgattgtgaaacagaggagatcacaaatgtgctaacttaacctggcggcagcgcaaaagatg

SEQ ID NO: 24798 - DNA, 103 bp, Artificial Sequence
  Synthetic Polynucleotide
taatacgactcactatagggttataggttccaaaatatcaccatctacataacagaggagaatgtagatggtgatatttaacctggcggcagcgcaaaagatg

SEQ ID NO: 24799 - DNA, 103 bp, Artificial Sequence
  Synthetic Polynucleotide
taatacgactcactataggggcacaattaaaaactaaaagttagcatgataacagaggagaatcatgatgacttttagtaacctggcggcagcgcaaaagatg

SEQ ID NO: 24800 - DNA, 103 bp, Artificial Sequence
  Synthetic Polynucleotide
taatacgactcactatagggtttttgcacaattaaaaactaaaagttagcaacagaggagagctaacatgtagtttttaaacctggcggcagcgcaaaagatg

SEQ ID NO: 24801 - DNA, 103 bp, Artificial Sequence
  Synthetic Polynucleotide
taatacgactcactatagggagtaatttttgcacaattaaaaactaaaagaacagaggagacttttaatgtttaattgtaacctggcggcagcgcaaaagatg

SEQ ID NO: 24802 - DNA, 103 bp, Artificial Sequence
  Synthetic Polynucleotide
taatacgactcactatagggttcttagtaatttttgcacaattaaaaactaacagaggagaagttttatgttgtgcaaaaacctggcggcagcgcaaaagatg

SEQ ID NO: 24803 - DNA, 103 bp, Artificial Sequence
  Synthetic Polynucleotide
taatacgactcactatagggaattattcttagtaatttttgcacaattaaaacagaggagattaattatgcaaaaattaaacctggcggcagcgcaaaagatg

SEQ ID NO: 24804 - DNA, 103 bp, Artificial Sequence
  Synthetic Polynucleotide
taatacgactcactatagggatattaattattcttagtaatttttgcacaaacagaggagatgtgcaatgattactaagaacctggcggcagcgcaaaagatg

SEQ ID NO: 24805 - DNA, 103 bp, Artificial Sequence
  Synthetic Polynucleotide
taatacgactcactatagggtatcaatattaattattcttagtaatttttaacagaggagaaaaaatatgtaagaataaaacctggcggcagcgcaaaagatg

SEQ ID NO: 24806 - DNA, 103 bp, Artificial Sequence
  Synthetic Polynucleotide
taatacgactcactatagggtttaatatcaatattaattattcttagtaaaacagaggagattactaatgataattaataacctggcggcagcgcaaaagatg

SEQ ID NO: 24807 - DNA, 103 bp, Artificial Sequence
  Synthetic Polynucleotide
taatacgactcactatagggaatgttttaatatcaatattaattattcttaacagaggagaaagaatatgtaatattgaaacctggcggcagcgcaaaagatg

SEQ ID NO: 24808 - DNA, 103 bp, Artificial Sequence
  Synthetic Polynucleotide
taatacgactcactatagggcatttaatgttttaatatcaatattaattaaacagaggagataattaatgttgatattaaacctggcggcagcgcaaaagatg

SEQ ID NO: 24809 - DNA, 103 bp, Artificial Sequence
  Synthetic Polynucleotide
taatacgactcactatagggcgatcttataggttccaaaatatcaccatcaacagaggagagatggtatgattttggaaaacctggcggcagcgcaaaagatg

SEQ ID NO: 24810 - DNA, 103 bp, Artificial Sequence
  Synthetic Polynucleotide
taatacgactcactatagggatgtccatttaatgttttaatatcaatattaacagaggagaaatattatgattaaaacaaacctggcggcagcgcaaaagatg

SEQ ID NO: 24811 - DNA, 103 bp, Artificial Sequence
  Synthetic Polynucleotide
taatacgactcactatagggctcaaatgtccatttaatgttttaatatcaaacagaggagatgatatatgaacattaaaaacctggcggcagcgcaaaagatg

SEQ ID NO: 24812 - DNA, 103 bp, Artificial Sequence
  Synthetic Polynucleotide
taatacgactcactatagggtaaaactcaaatgtccatttaatgttttaaaacagaggagattaaaaatgtaaatggacaacctggcggcagcgcaaaagatg

SEQ ID NO: 24813 - DNA, 103 bp, Artificial Sequence
  Synthetic Polynucleotide
taatacgactcactatagggaggcataaaactcaaatgtccatttaatgtaacagaggagaacattaatgggacatttgaacctggcggcagcgcaaaagatg

SEQ ID NO: 24814 - DNA, 103 bp, Artificial Sequence
  Synthetic Polynucleotide
taatacgactcactatagggattctaggcataaaactcaaatgtccatttaacagaggagaaaatggatgtttgagtttaacctggcggcagcgcaaaagatg

SEQ ID NO: 24815 - DNA, 103 bp, Artificial Sequence
  Synthetic Polynucleotide
taatacgactcactatagggatattattctaggcataaaactcaaatgtcaacagaggagagacattatggttttatgcaacctggcggcagcgcaaaagatg

SEQ ID NO: 24816 - DNA, 103 bp, Artificial Sequence
  Synthetic Polynucleotide
taatacgactcactatagggtctttatattattctaggcataaaactcaaaacagaggagattgagtatgatgcctagaaacctggcggcagcgcaaaagatg

SEQ ID NO: 24817 - DNA, 103 bp, Artificial Sequence
  Synthetic Polynucleotide
taatacgactcactatagggaaatttctttatattattctaggcataaaaaacagaggagattttatatgtagaataataacctggcggcagcgcaaaagatg

SEQ ID NO: 24818 - DNA, 103 bp, Artificial Sequence
  Synthetic Polynucleotide
taatacgactcactatagggctcttaaatttctttatattattctaggcaaacagaggagatgcctaatgtaatataaaaacctggcggcagcgcaaaagatg

SEQ ID NO: 24819 - DNA, 103 bp, Artificial Sequence
  Synthetic Polynucleotide
taatacgactcactatagggaatgtctcttaaatttctttatattattctaacagaggagaagaataatgtaaagaaataacctggcggcagcgcaaaagatg

SEQ ID NO: 24820 - DNA, 103 bp, Artificial Sequence
  Synthetic Polynucleotide
taatacgactcactataggggaaggcgatcttataggttccaaaatatcaaacagaggagatgatatatgggaacctataacctggcggcagcgcaaaagatg

SEQ ID NO: 24821 - DNA, 103 bp, Artificial Sequence
  Synthetic Polynucleotide
taatacgactcactatagggatctaaatgtctcttaaatttctttatattaacagaggagaaatataatgaaatttaagaacctggcggcagcgcaaaagatg

SEQ ID NO: 24822 - DNA, 103 bp, Artificial Sequence
  Synthetic Polynucleotide
taatacgactcactataggggatatatctaaatgtctcttaaatttctttaacagaggagaaaagaaatgtaagagacaaacctggcggcagcgcaaaagatg

SEQ ID NO: 24823 - DNA, 103 bp, Artificial Sequence
  Synthetic Polynucleotide
taatacgactcactatagggcaactgatatatctaaatgtctcttaaattaacagaggagaaatttaatggacatttagaacctggcggcagcgcaaaagatg

SEQ ID NO: 24824 - DNA, 103 bp, Artificial Sequence
  Synthetic Polynucleotide
taatacgactcactatagggcaattcaactgatatatctaaatgtctcttaacagaggagaaagagaatgttagatataaacctggcggcagcgcaaaagatg

SEQ ID NO: 24825 - DNA, 103 bp, Artificial Sequence
  Synthetic Polynucleotide
taatacgactcactatagggtaaatcaattcaactgatatatctaaatgtaacagaggagaacatttatgtatatcagtaacctggcggcagcgcaaaagatg

SEQ ID NO: 24826 - DNA, 103 bp, Artificial Sequence
  Synthetic Polynucleotide
taatacgactcactatagggtgtcataaatcaattcaactgatatatctaaacagaggagatagataatgcagttgaataacctggcggcagcgcaaaagatg

SEQ ID NO: 24827 - DNA, 103 bp, Artificial Sequence
  Synthetic Polynucleotide
taatacgactcactatagggctatgtgtcataaatcaattcaactgatataacagaggagaatatcaatggaattgattaacctggcggcagcgcaaaagatg

SEQ ID NO: 24828 - DNA, 103 bp, Artificial Sequence
  Synthetic Polynucleotide
taatacgactcactatagggatgcactatgtgtcataaatcaattcaactaacagaggagaagttgaatggatttatgaaacctggcggcagcgcaaaagatg

SEQ ID NO: 24829 - DNA, 103 bp, Artificial Sequence
  Synthetic Polynucleotide
taatacgactcactatagggtcatgatgcactatgtgtcataaatcaattaacagaggagaaattgaatgatgacacataacctggcggcagcgcaaaagatg

SEQ ID NO: 24830 - DNA, 103 bp, Artificial Sequence
  Synthetic Polynucleotide
taatacgactcactatagggtgtattcatgatgcactatgtgtcataaataacagaggagaatttatatgacatagtgcaacctggcggcagcgcaaaagatg

SEQ ID NO: 24831 - DNA, 103 bp, Artificial Sequence
  Synthetic Polynucleotide
taatacgactcactataggggtgaggaaggcgatcttataggttccaaaaaacagaggagattttggatgctataagataacctggcggcagcgcaaaagatg

SEQ ID NO: 24832 - DNA, 103 bp, Artificial Sequence
  Synthetic Polynucleotide
taatacgactcactatagggctctttgtattcatgatgcactatgtgtcaaacagaggagatgacacatggtgcatcataacctggcggcagcgcaaaagatg

SEQ ID NO: 24833 - DNA, 103 bp, Artificial Sequence
  Synthetic Polynucleotide
taatacgactcactatagggtttttctctttgtattcatgatgcactatgaacagaggagacatagtatgtcatgaataaacctggcggcagcgcaaaagatg

SEQ ID NO: 24834 - DNA, 103 bp, Artificial Sequence
  Synthetic Polynucleotide
taatacgactcactatagggaacaatttttctctttgtattcatgatgcaaacagaggagatgcatcatgaatacaaagaacctggcggcagcgcaaaagatg

SEQ ID NO: 24835 - DNA, 103 bp, Artificial Sequence
  Synthetic Polynucleotide
taatacgactcactatagggattgcaacaatttttctctttgtattcatgaacagaggagacatgaaatgaaagagaaaaacctggcggcagcgcaaaagatg

SEQ ID NO: 24836 - DNA, 103 bp, Artificial Sequence
  Synthetic Polynucleotide
taatacgactcactatagggcctgaattgcaacaatttttctctttgtataacagaggagaatacaaatggaaaaattgaacctggcggcagcgcaaaagatg

SEQ ID NO: 24837 - DNA, 103 bp, Artificial Sequence
  Synthetic Polynucleotide
taatacgactcactatagggatattcctgaattgcaacaatttttctcttaacagaggagaaagagaatgattgttgcaaacctggcggcagcgcaaaagatg

SEQ ID NO: 24838 - DNA, 103 bp, Artificial Sequence
  Synthetic Polynucleotide
taatacgactcactatagggataagatattcctgaattgcaacaatttttaacagaggagaaaaaatatgtgcaattcaaacctggcggcagcgcaaaagatg

SEQ ID NO: 24839 - DNA, 103 bp, Artificial Sequence
  Synthetic Polynucleotide
taatacgactcactatagggtttaaataagatattcctgaattgcaacaaaacagaggagattgttgatgttcaggaataacctggcggcagcgcaaaagatg

SEQ ID NO: 24840 - DNA, 103 bp, Artificial Sequence
  Synthetic Polynucleotide
taatacgactcactatagggatacatttaaataagatattcctgaattgcaacagaggagagcaattatggaatatcttaacctggcggcagcgcaaaagatg

SEQ ID NO: 24841 - DNA, 103 bp, Artificial Sequence
  Synthetic Polynucleotide
taatacgactcactatagggctctaatacatttaaataagatattcctgaaacagaggagatcaggaatgtcttatttaaacctggcggcagcgcaaaagatg

SEQ ID NO: 24842 - DNA, 103 bp, Artificial Sequence
  Synthetic Polynucleotide
taatacgactcactatagggagacggtgaggaaggcgatcttataggttcaacagaggagagaacctatgagatcgcctaacctggcggcagcgcaaaagatg

SEQ ID NO: 24843 - DNA, 103 bp, Artificial Sequence
  Synthetic Polynucleotide
taatacgactcactatagggtttctctctaatacatttaaataagatattaacagaggagaaatatcatgtttaaatgtaacctggcggcagcgcaaaagatg

SEQ ID NO: 24844 - DNA, 103 bp, Artificial Sequence
  Synthetic Polynucleotide
taatacgactcactatagggctgactttctctctaatacatttaaataagaacagaggagacttattatgatgtattagaacctggcggcagcgcaaaagatg

SEQ ID NO: 24845 - DNA, 103 bp, Artificial Sequence
  Synthetic Polynucleotide
taatacgactcactatagggataatctgactttctctctaatacatttaaaacagaggagattaaatatgttagagagaaacctggcggcagcgcaaaagatg

SEQ ID NO: 24846 - DNA, 103 bp, Artificial Sequence
  Synthetic Polynucleotide
taatacgactcactatagggtgataataatctgactttctctctaatacaaacagaggagatgtattatggagaaagtcaacctggcggcagcgcaaaagatg

SEQ ID NO: 24847 - DNA, 103 bp, Artificial Sequence
  Synthetic Polynucleotide
taatacgactcactataggggattttgataataatctgactttctctctaaacagaggagatagagaatgagtcagattaacctggcggcagcgcaaaagatg

SEQ ID NO: 24848 - DNA, 103 bp, Artificial Sequence
  Synthetic Polynucleotide
taatacgactcactatagggtgcttgattttgataataatctgactttctaacagaggagaagaaagatggattattataacctggcggcagcgcaaaagatg

SEQ ID NO: 24849 - DNA, 103 bp, Artificial Sequence
  Synthetic Polynucleotide
taatacgactcactatagggtattttgcttgattttgataataatctgacaacagaggagagtcagaatgttatcaaaaaacctggcggcagcgcaaaagatg

SEQ ID NO: 24850 - DNA, 103 bp, Artificial Sequence
  Synthetic Polynucleotide
taatacgactcactatagggtattgtattttgcttgattttgataataataacagaggagaattattatgaaaatcaagaacctggcggcagcgcaaaagatg

SEQ ID NO: 24851 - DNA, 103 bp, Artificial Sequence
  Synthetic Polynucleotide
taatacgactcactatagggaaacctattgtattttgcttgattttgataaacagaggagatatcaaatgcaagcaaaaaacctggcggcagcgcaaaagatg

SEQ ID NO: 24852 - DNA, 103 bp, Artificial Sequence
  Synthetic Polynucleotide
taatacgactcactatagggtgaaaaaacctattgtattttgcttgatttaacagaggagaaaatcaatgaaaatacaaaacctggcggcagcgcaaaagatg

SEQ ID NO: 24853 - DNA, 103 bp, Artificial Sequence
  Synthetic Polynucleotide
taatacgactcactatagggggagcagacggtgaggaaggcgatcttataaacagaggagatataagatggccttcctcaacctggcggcagcgcaaaagatg

SEQ ID NO: 24854 - DNA, 103 bp, Artificial Sequence
  Synthetic Polynucleotide
taatacgactcactatagggttctttgaaaaaacctattgtattttgcttaacagaggagaaagcaaatgacaataggtaacctggcggcagcgcaaaagatg

SEQ ID NO: 24855 - DNA, 103 bp, Artificial Sequence
  Synthetic Polynucleotide
taatacgactcactatagggacctattctttgaaaaaacctattgtatttaacagaggagaaaatacatgaggttttttaacctggcggcagcgcaaaagatg

SEQ ID NO: 24856 - DNA, 103 bp, Artificial Sequence
  Synthetic Polynucleotide
taatacgactcactatagggttaccacctattctttgaaaaaacctattgaacagaggagacaatagatgttttcaaagaacctggcggcagcgcaaaagatg

SEQ ID NO: 24857 - DNA, 103 bp, Artificial Sequence
  Synthetic Polynucleotide
taatacgactcactatagggaggctttaccacctattctttgaaaaaaccaacagaggagaggttttatgaaagaatagaacctggcggcagcgcaaaagatg

SEQ ID NO: 24858 - DNA, 103 bp, Artificial Sequence
  Synthetic Polynucleotide
taatacgactcactatagggccataaggctttaccacctattctttgaaaaacagaggagatttcaaatgataggtggtaacctggcggcagcgcaaaagatg

SEQ ID NO: 24859 - DNA, 103 bp, Artificial Sequence
  Synthetic Polynucleotide
taatacgactcactatagggaataaccataaggctttaccacctattcttaacagaggagaaagaatatgtggtaaagcaacctggcggcagcgcaaaagatg

SEQ ID NO: 24860 - DNA, 103 bp, Artificial Sequence
  Synthetic Polynucleotide
taatacgactcactatagggtaaaaaataaccataaggctttaccacctaaacagaggagataggtgatgaagccttataacctggcggcagcgcaaaagatg

SEQ ID NO: 24861 - DNA, 103 bp, Artificial Sequence
  Synthetic Polynucleotide
taatacgactcactatagggatctttaaaaaataaccataaggctttaccaacagaggagaggtaaaatgttatggttaaacctggcggcagcgcaaaagatg

SEQ ID NO: 24862 - DNA, 103 bp, Artificial Sequence
  Synthetic Polynucleotide
taatacgactcactatagggttgacatctttaaaaaataaccataaggctaacagaggagaagccttatggttatttttaacctggcggcagcgcaaaagatg

SEQ ID NO: 24863 - DNA, 103 bp, Artificial Sequence
  Synthetic Polynucleotide
taatacgactcactatagggtcacattgacatctttaaaaaataaccataaacagaggagatatggtatgtttttaaagaacctggcggcagcgcaaaagatg

SEQ ID NO: 24864 - DNA, 103 bp, Artificial Sequence
  Synthetic Polynucleotide
taatacgactcactatagggtctggttacagatactaacctgatggtttgaacagaggagacaaaccatgaggttagtaaacctggcggcagcgcaaaagatg

SEQ ID NO: 24865 - DNA, 103 bp, Artificial Sequence
  Synthetic Polynucleotide
taatacgactcactatagggcctgaggagcagacggtgaggaaggcgatcaacagaggagagatcgcatgcctcaccgtaacctggcggcagcgcaaaagatg

SEQ ID NO: 24866 - DNA, 103 bp, Artificial Sequence
  Synthetic Polynucleotide
taatacgactcactatagggaaaattcacattgacatctttaaaaaataaaacagaggagattatttatgaaagatgtcaacctggcggcagcgcaaaagatg

SEQ ID NO: 24867 - DNA, 103 bp, Artificial Sequence
  Synthetic Polynucleotide
taatacgactcactatagggtaataaaaattcacattgacatctttaaaaaacagaggagattttaaatgtgtcaatgtaacctggcggcagcgcaaaagatg

SEQ ID NO: 24868 - DNA, 103 bp, Artificial Sequence
  Synthetic Polynucleotide
taatacgactcactatagggtttcttaataaaaattcacattgacatcttaacagaggagaaagatgatgatgtgaattaacctggcggcagcgcaaaagatg

SEQ ID NO: 24869 - DNA, 103 bp, Artificial Sequence
  Synthetic Polynucleotide
taatacgactcactatagggtactttttcttaataaaaattcacattgacaacagaggagagtcaatatgaatttttataacctggcggcagcgcaaaagatg

SEQ ID NO: 24870 - DNA, 103 bp, Artificial Sequence
  Synthetic Polynucleotide
taatacgactcactatagggtgcattactttttcttaataaaaattcacaaacagaggagatgtgaaatgttattaagaaacctggcggcagcgcaaaagatg

SEQ ID NO: 24871 - DNA, 103 bp, Artificial Sequence
  Synthetic Polynucleotide
taatacgactcactatagggtttcatgcattactttttcttaataaaaataacagaggagaatttttatgaagaaaaagaacctggcggcagcgcaaaagatg

SEQ ID NO: 24872 - DNA, 103 bp, Artificial Sequence
  Synthetic Polynucleotide
taatacgactcactatagggtttaatttcatgcattactttttcttaataaacagaggagatattaaatgaaagtaatgaacctggcggcagcgcaaaagatg

SEQ ID NO: 24873 - DNA, 103 bp, Artificial Sequence
  Synthetic Polynucleotide
taatacgactcactatagggaattttttaatttcatgcattactttttctaacagaggagaagaaaaatgaatgcatgaaacctggcggcagcgcaaaagatg

SEQ ID NO: 24874 - DNA, 103 bp, Artificial Sequence
  Synthetic Polynucleotide
taatacgactcactatagggtctttaattttttaatttcatgcattacttaacagaggagaaagtaaatgatgaaattaaacctggcggcagcgcaaaagatg

SEQ ID NO: 24875 - DNA, 103 bp, Artificial Sequence
  Synthetic Polynucleotide
taatacgactcactatagggaaagttctttaattttttaatttcatgcataacagaggagaatgcatatgattaaaaaaaacctggcggcagcgcaaaagatg

SEQ ID NO: 24876 - DNA, 103 bp, Artificial Sequence
  Synthetic Polynucleotide
taatacgactcactataggggtcctcctgaggagcagacggtgaggaaggaacagaggagaccttccatgccgtctgctaacctggcggcagcgcaaaagatg

SEQ ID NO: 24877 - DNA, 103 bp, Artificial Sequence
  Synthetic Polynucleotide
taatacgactcactatagggatatcaaagttctttaattttttaatttcaaacagaggagatgaaatatgaaaattaaaaacctggcggcagcgcaaaagatg

SEQ ID NO: 24878 - DNA, 103 bp, Artificial Sequence
  Synthetic Polynucleotide
taatacgactcactatagggtacttatatcaaagttctttaattttttaaaacagaggagattaaaaatgtaaagaactaacctggcggcagcgcaaaagatg

SEQ ID NO: 24879 - DNA, 103 bp, Artificial Sequence
  Synthetic Polynucleotide
taatacgactcactatagggtgtgttacttatatcaaagttctttaatttaacagaggagaaaattaatgaactttgataacctggcggcagcgcaaaagatg

SEQ ID NO: 24880 - DNA, 103 bp, Artificial Sequence
  Synthetic Polynucleotide
taatacgactcactatagggtgttttgtgttacttatatcaaagttctttaacagaggagaaaagaaatgtgatataagaacctggcggcagcgcaaaagatg

SEQ ID NO: 24881 - DNA, 103 bp, Artificial Sequence
  Synthetic Polynucleotide
taatacgactcactatagggaagagtgttttgtgttacttatatcaaagtaacagaggagaactttgatgtaagtaacaaacctggcggcagcgcaaaagatg

SEQ ID NO: 24882 - DNA, 103 bp, Artificial Sequence
  Synthetic Polynucleotide
taatacgactcactatagggagatgaagagtgttttgtgttacttatatcaacagaggagagatataatgaacacaaaaaacctggcggcagcgcaaaagatg

SEQ ID NO: 24883 - DNA, 103 bp, Artificial Sequence
  Synthetic Polynucleotide
taatacgactcactatagggtaaaaagatgaagagtgttttgtgttacttaacagaggagaaagtaaatgaaaacactcaacctggcggcagcgcaaaagatg

SEQ ID NO: 24884 - DNA, 103 bp, Artificial Sequence
  Synthetic Polynucleotide
taatacgactcactatagggcacactaaaaagatgaagagtgttttgtgtaacagaggagaacacaaatgactcttcataacctggcggcagcgcaaaagatg

SEQ ID NO: 24885 - DNA, 103 bp, Artificial Sequence
  Synthetic Polynucleotide
taatacgactcactatagggcttgtgtcctcctgaggagcagacggtgagaacagaggagactcaccatgtgctcctcaaacctggcggcagcgcaaaagatg

SEQ ID NO: 24886 - DNA, 103 bp, Artificial Sequence
  Synthetic Polynucleotide
taatacgactcactatagggccatccttgtgtcctcctgaggagcagacgaacagaggagacgtctgatgctcaggaggaacctggcggcagcgcaaaagatg

SEQ ID NO: 24887 - DNA, 103 bp, Artificial Sequence
  Synthetic Polynucleotide
taatacgactcactatagggttctcccatccttgtgtcctcctgaggagcaacagaggagagctcctatggaggacacaaacctggcggcagcgcaaaagatg

SEQ ID NO: 24888 - DNA, 103 bp, Artificial Sequence
  Synthetic Polynucleotide
taatacgactcactatagggtaggcttctcccatccttgtgtcctcctgaaacagaggagatcaggaatgcacaaggataacctggcggcagcgcaaaagatg

SEQ ID NO: 24889 - DNA, 103 bp, Artificial Sequence
  Synthetic Polynucleotide
taatacgactcactatagggattcataggcttctcccatccttgtgtcctaacagaggagaaggacaatgggatgggagaacctggcggcagcgcaaaagatg

SEQ ID NO: 24890 - DNA, 103 bp, Artificial Sequence
  Synthetic Polynucleotide
taatacgactcactatagggtgataattcataggcttctcccatccttgtaacagaggagaacaaggatgggagaagccaacctggcggcagcgcaaaagatg

SEQ ID NO: 24891 - DNA, 103 bp, Artificial Sequence
  Synthetic Polynucleotide
taatacgactcactatagggtcaggtgataattcataggcttctcccatcaacagaggagagatgggatgagcctatgaaacctggcggcagcgcaaaagatg

SEQ ID NO: 24892 - DNA, 103 bp, Artificial Sequence
  Synthetic Polynucleotide
taatacgactcactatagggtaaaatcaggtgataattcataggcttctcaacagaggagagagaagatgatgaattataacctggcggcagcgcaaaagatg

SEQ ID NO: 24893 - DNA, 103 bp, Artificial Sequence
  Synthetic Polynucleotide
taatacgactcactatagggtattatctggttacagatactaacctgatgaacagaggagacatcagatgagtatctgtaacctggcggcagcgcaaaagatg

SEQ ID NO: 24894 - DNA, 103 bp, Artificial Sequence
  Synthetic Polynucleotide
taatacgactcactataggggcttgtaaaatcaggtgataattcataggcaacagaggagagcctatatgttatcacctaacctggcggcagcgcaaaagatg

SEQ ID NO: 24895 - DNA, 103 bp, Artificial Sequence
  Synthetic Polynucleotide
taatacgactcactatagggtcatagcttgtaaaatcaggtgataattcaaacagaggagatgaattatgacctgatttaacctggcggcagcgcaaaagatg

SEQ ID NO: 24896 - DNA, 103 bp, Artificial Sequence
  Synthetic Polynucleotide
taatacgactcactatagggtatcctcatagcttgtaaaatcaggtgataaacagaggagatatcacatgattttacaaaacctggcggcagcgcaaaagatg

SEQ ID NO: 24897 - DNA, 103 bp, Artificial Sequence
  Synthetic Polynucleotide
taatacgactcactatagggctgattatcctcatagcttgtaaaatcaggaacagaggagacctgatatgacaagctataacctggcggcagcgcaaaagatg

SEQ ID NO: 24898 - DNA, 103 bp, Artificial Sequence
  Synthetic Polynucleotide
taatacgactcactatagggttctgctgattatcctcatagcttgtaaaaaacagaggagattttacatgctatgaggaaacctggcggcagcgcaaaagatg

SEQ ID NO: 24899 - DNA, 103 bp, Artificial Sequence
  Synthetic Polynucleotide
taatacgactcactataggggccaattctgctgattatcctcatagcttgaacagaggagacaagctatgaggataatcaacctggcggcagcgcaaaagatg

SEQ ID NO: 24900 - DNA, 103 bp, Artificial Sequence
  Synthetic Polynucleotide
taatacgactcactatagggctgtggccaattctgctgattatcctcataaacagaggagatatgagatgaatcagcagaacctggcggcagcgcaaaagatg

SEQ ID NO: 24901 - DNA, 103 bp, Artificial Sequence
  Synthetic Polynucleotide
taatacgactcactatagggactctctgtggccaattctgctgattatccaacagaggagaggataaatggcagaattgaacctggcggcagcgcaaaagatg

SEQ ID NO: 24902 - DNA, 103 bp, Artificial Sequence
  Synthetic Polynucleotide
taatacgactcactatagggttaccactctctgtggccaattctgctgataacagaggagaatcagcatgattggccacaacctggcggcagcgcaaaagatg

SEQ ID NO: 24903 - DNA, 103 bp, Artificial Sequence
  Synthetic Polynucleotide
taatacgactcactatagggctttgttaccactctctgtggccaattctgaacagaggagacagaatatgccacagagaaacctggcggcagcgcaaaagatg

SEQ ID NO: 24904 - DNA, 103 bp, Artificial Sequence
  Synthetic Polynucleotide
taatacgactcactatagggatttatatgatacacaaaatcatcatctctaacagaggagaagagatatggattttgtgaacctggcggcagcgcaaaagatg

SEQ ID NO: 24905 - DNA, 103 bp, Artificial Sequence
  Synthetic Polynucleotide
taatacgactcactataggggcatctattatctggttacagatactaaccaacagaggagaggttagatgctgtaaccaaacctggcggcagcgcaaaagatg

SEQ ID NO: 24906 - DNA, 103 bp, Artificial Sequence
  Synthetic Polynucleotide
taatacgactcactatagggcctttctttgttaccactctctgtggccaaaacagaggagattggccatggagagtggtaacctggcggcagcgcaaaagatg

SEQ ID NO: 24907 - DNA, 103 bp, Artificial Sequence
  Synthetic Polynucleotide
taatacgactcactatagggtcctgcctttctttgttaccactctctgtgaacagaggagacacagaatgtggtaacaaaacctggcggcagcgcaaaagatg

SEQ ID NO: 24908 - DNA, 103 bp, Artificial Sequence
  Synthetic Polynucleotide
taatacgactcactataggggaaggtcctgcctttctttgttaccactctaacagaggagaagagtgatgacaaagaaaaacctggcggcagcgcaaaagatg

SEQ ID NO: 24909 - DNA, 103 bp, Artificial Sequence
  Synthetic Polynucleotide
taatacgactcactatagggtaaaggaaggtcctgcctttctttgttaccaacagaggagaggtaacatggaaaggcagaacctggcggcagcgcaaaagatg

SEQ ID NO: 24910 - DNA, 103 bp, Artificial Sequence
  Synthetic Polynucleotide
taatacgactcactatagggtaggataaaggaaggtcctgcctttctttgaacagaggagacaaagaatggcaggacctaacctggcggcagcgcaaaagatg

SEQ ID NO: 24911 - DNA, 103 bp, Artificial Sequence
  Synthetic Polynucleotide
taatacgactcactataggggtcattaggataaaggaaggtcctgcctttaacagaggagaaaaggcatgaccttccttaacctggcggcagcgcaaaagatg

SEQ ID NO: 24912 - DNA, 103 bp, Artificial Sequence
  Synthetic Polynucleotide
taatacgactcactatagggaaaaggtcattaggataaaggaaggtcctgaacagaggagacaggacatgcctttatccaacctggcggcagcgcaaaagatg

SEQ ID NO: 24913 - DNA, 103 bp, Artificial Sequence
  Synthetic Polynucleotide
taatacgactcactatagggtctgtaaaaggtcattaggataaaggaaggaacagaggagaccttccatgatcctaatgaacctggcggcagcgcaaaagatg

SEQ ID NO: 24914 - DNA, 103 bp, Artificial Sequence
  Synthetic Polynucleotide
taatacgactcactatagggactcgtctgtaaaaggtcattaggataaagaacagaggagactttatatgaatgaccttaacctggcggcagcgcaaaagatg

SEQ ID NO: 24915 - DNA, 103 bp, Artificial Sequence
  Synthetic Polynucleotide
taatacgactcactatagggggaggactcgtctgtaaaaggtcattaggaaacagaggagatcctaaatgccttttacaaacctggcggcagcgcaaaagatg

SEQ ID NO: 24916 - DNA, 103 bp, Artificial Sequence
  Synthetic Polynucleotide
taatacgactcactatagggttattgcatctattatctggttacagatacaacagaggagagtatctatgaccagataaaacctggcggcagcgcaaaagatg

SEQ ID NO: 24917 - DNA, 103 bp, Artificial Sequence
  Synthetic Polynucleotide
taatacgactcactatagggactctggaggactcgtctgtaaaaggtcataacagaggagaatgaccatgtacagacgaaacctggcggcagcgcaaaagatg

SEQ ID NO: 24918 - DNA, 103 bp, Artificial Sequence
  Synthetic Polynucleotide
taatacgactcactatagggtaatgactctggaggactcgtctgtaaaagaacagaggagacttttaatgacgagtcctaacctggcggcagcgcaaaagatg

SEQ ID NO: 24919 - DNA, 103 bp, Artificial Sequence
  Synthetic Polynucleotide
taatacgactcactataggggttattaatgactctggaggactcgtctgtaacagaggagaacagacatgtcctccagaaacctggcggcagcgcaaaagatg

SEQ ID NO: 24920 - DNA, 103 bp, Artificial Sequence
  Synthetic Polynucleotide
taatacgactcactataggggggctgttattaatgactctggaggactcgaacagaggagacgagtcatgcagagtcataacctggcggcagcgcaaaagatg

SEQ ID NO: 24921 - DNA, 103 bp, Artificial Sequence
  Synthetic Polynucleotide
taatacgactcactatagggaacaagggctgttattaatgactctggaggaacagaggagacctccaatgtcattaataaacctggcggcagcgcaaaagatg

SEQ ID NO: 24922 - DNA, 103 bp, Artificial Sequence
  Synthetic Polynucleotide
taatacgactcactatagggtcttcaacaagggctgttattaatgactctaacagaggagaagagtcatgaataacagcaacctggcggcagcgcaaaagatg

SEQ ID NO: 24923 - DNA, 103 bp, Artificial Sequence
  Synthetic Polynucleotide
taatacgactcactatagggggtactcttcaacaagggctgttattaatgaacagaggagacattaaatgcagcccttgaacctggcggcagcgcaaaagatg

SEQ ID NO: 24924 - DNA, 103 bp, Artificial Sequence
  Synthetic Polynucleotide
taatacgactcactataggggttttggtactcttcaacaagggctgttataacagaggagaataacaatgcttgttgaaaacctggcggcagcgcaaaagatg

SEQ ID NO: 24925 - DNA, 103 bp, Artificial Sequence
  Synthetic Polynucleotide
taatacgactcactatagggacagggttttggtactcttcaacaagggctaacagaggagaagccctatgtgaagagtaaacctggcggcagcgcaaaagatg

SEQ ID NO: 24926 - DNA, 103 bp, Artificial Sequence
  Synthetic Polynucleotide
taatacgactcactatagggctgagacagggttttggtactcttcaacaaaacagaggagattgttgatgagtaccaaaaacctggcggcagcgcaaaagatg

SEQ ID NO: 24927 - DNA, 103 bp, Artificial Sequence
  Synthetic Polynucleotide
taatacgactcactatagggtgagtttattgcatctattatctggttacaaacagaggagatgtaacatgataatagataacctggcggcagcgcaaaagatg

SEQ ID NO: 24928 - DNA, 103 bp, Artificial Sequence
  Synthetic Polynucleotide
taatacgactcactatagggttttgctgagacagggttttggtactcttcaacagaggagagaagagatgcaaaaccctaacctggcggcagcgcaaaagatg

SEQ ID NO: 24929 - DNA, 103 bp, Artificial Sequence
  Synthetic Polynucleotide
taatacgactcactatagggagctcttttgctgagacagggttttggtacaacagaggagagtaccaatgccctgtctcaacctggcggcagcgcaaaagatg

SEQ ID NO: 24930 - DNA, 103 bp, Artificial Sequence
  Synthetic Polynucleotide
taatacgactcactatagggcttgaagctcttttgctgagacagggttttaacagaggagaaaaaccatgtctcagcaaaacctggcggcagcgcaaaagatg

SEQ ID NO: 24931 - DNA, 103 bp, Artificial Sequence
  Synthetic Polynucleotide
taatacgactcactatagggatccgcttgaagctcttttgctgagacaggaacagaggagacctgtcatggcaaaagagaacctggcggcagcgcaaaagatg

SEQ ID NO: 24932 - DNA, 103 bp, Artificial Sequence
  Synthetic Polynucleotide
taatacgactcactatagggggccaatccgcttgaagctcttttgctgagaacagaggagactcagcatgagagcttcaaacctggcggcagcgcaaaagatg

SEQ ID NO: 24933 - DNA, 103 bp, Artificial Sequence
  Synthetic Polynucleotide
taatacgactcactatagggtgtcaggccaatccgcttgaagctcttttgaacagaggagacaaaagatgttcaagcggaacctggcggcagcgcaaaagatg

SEQ ID NO: 24934 - DNA, 103 bp, Artificial Sequence
  Synthetic Polynucleotide
taatacgactcactatagggtgacatgtcaggccaatccgcttgaagctcaacagaggagagagcttatggcggattggaacctggcggcagcgcaaaagatg

SEQ ID NO: 24935 - DNA, 103 bp, Artificial Sequence
  Synthetic Polynucleotide
taatacgactcactatagggtcaaatgacatgtcaggccaatccgcttgaaacagaggagatcaagcatgttggcctgaaacctggcggcagcgcaaaagatg

SEQ ID NO: 24936 - DNA, 103 bp, Artificial Sequence
  Synthetic Polynucleotide
taatacgactcactatagggtctcatcaaatgacatgtcaggccaatccgaacagaggagacggattatgctgacatgtaacctggcggcagcgcaaaagatg

SEQ ID NO: 24937 - DNA, 103 bp, Artificial Sequence
  Synthetic Polynucleotide
taatacgactcactatagggcctcctctcatcaaatgacatgtcaggccaaacagaggagatggcctatgatgtcatttaacctggcggcagcgcaaaagatg

SEQ ID NO: 24938 - DNA, 103 bp, Artificial Sequence
  Synthetic Polynucleotide
taatacgactcactatagggatccctgagtttattgcatctattatctggaacagaggagaccagatatgagatgcaataacctggcggcagcgcaaaagatg

SEQ ID NO: 24939 - DNA, 103 bp, Artificial Sequence
  Synthetic Polynucleotide
taatacgactcactatagggacatgcctcctctcatcaaatgacatgtcaaacagaggagatgacatatgatttgatgaaacctggcggcagcgcaaaagatg

SEQ ID NO: 24940 - DNA, 103 bp, Artificial Sequence
  Synthetic Polynucleotide
taatacgactcactatagggtagcaacatgcctcctctcatcaaatgacaaacagaggagatgtcatatgatgagaggaaacctggcggcagcgcaaaagatg

SEQ ID NO: 24941 - DNA, 103 bp, Artificial Sequence
  Synthetic Polynucleotide
taatacgactcactataggggttcatagcaacatgcctcctctcatcaaaaacagaggagatttgatatgaggaggcataacctggcggcagcgcaaaagatg

SEQ ID NO: 24942 - DNA, 103 bp, Artificial Sequence
  Synthetic Polynucleotide
taatacgactcactatagggtacaagttcatagcaacatgcctcctctcaaacagaggagatgagagatggcatgttgcaacctggcggcagcgcaaaagatg

SEQ ID NO: 24943 - DNA, 103 bp, Artificial Sequence
  Synthetic Polynucleotide
taatacgactcactataggggaaattacaagttcatagcaacatgcctccaacagaggagaggaggcatgttgctatgaaacctggcggcagcgcaaaagatg

SEQ ID NO: 24944 - DNA, 103 bp, Artificial Sequence
  Synthetic Polynucleotide
taatacgactcactatagggttgtcgaaattacaagttcatagcaacatgaacagaggagacatgttatgatgaacttgaacctggcggcagcgcaaaagatg

SEQ ID NO: 24945 - DNA, 103 bp, Artificial Sequence
  Synthetic Polynucleotide
taatacgactcactatagggctgtgttgtcgaaattacaagttcatagcaaacagaggagatgctatatgcttgtaattaacctggcggcagcgcaaaagatg

SEQ ID NO: 24946 - DNA, 103 bp, Artificial Sequence
  Synthetic Polynucleotide
taatacgactcactatagggtcgtgctgtgttgtcgaaattacaagttcaaacagaggagatgaactatgaatttcgacaacctggcggcagcgcaaaagatg

SEQ ID NO: 24947 - DNA, 103 bp, Artificial Sequence
  Synthetic Polynucleotide
taatacgactcactatagggagtagtcgtgctgtgttgtcgaaattacaaaacagaggagattgtaaatgcgacaacacaacctggcggcagcgcaaaagatg

SEQ ID NO: 24948 - DNA, 103 bp, Artificial Sequence
  Synthetic Polynucleotide
taatacgactcactatagggaaatgagtagtcgtgctgtgttgtcgaaataacagaggagaatttcgatgacacagcacaacctggcggcagcgcaaaagatg

SEQ ID NO: 24949 - DNA, 103 bp, Artificial Sequence
  Synthetic Polynucleotide
taatacgactcactatagggaatcgatccctgagtttattgcatctattaaacagaggagataatagatgcaataaactaacctggcggcagcgcaaaagatg

SEQ ID NO: 24950 - DNA, 103 bp, Artificial Sequence
  Synthetic Polynucleotide
taatacgactcactatagggtaaataaatgagtagtcgtgctgtgttgtcaacagaggagagacaacatggcacgactaaacctggcggcagcgcaaaagatg

SEQ ID NO: 24951 - DNA, 103 bp, Artificial Sequence
  Synthetic Polynucleotide
taatacgactcactatagggtgaagtaaataaatgagtagtcgtgctgtgaacagaggagacacagcatgactactcataacctggcggcagcgcaaaagatg

SEQ ID NO: 24952 - DNA, 103 bp, Artificial Sequence
  Synthetic Polynucleotide
taatacgactcactatagggtatattgaagtaaataaatgagtagtcgtgaacagaggagacacgacatgtcatttattaacctggcggcagcgcaaaagatg

SEQ ID NO: 24953 - DNA, 103 bp, Artificial Sequence
  Synthetic Polynucleotide
taatacgactcactatagggtaaaatatattgaagtaaataaatgagtagaacagaggagactactcatgtatttacttaacctggcggcagcgcaaaagatg

SEQ ID NO: 24954 - DNA, 103 bp, Artificial Sequence
  Synthetic Polynucleotide
taatacgactcactatagggggaggtaaaatatattgaagtaaataaatgaacagaggagacatttaatgacttcaataaacctggcggcagcgcaaaagatg

SEQ ID NO: 24955 - DNA, 103 bp, Artificial Sequence
  Synthetic Polynucleotide
taatacgactcactataggggtttcggaggtaaaatatattgaagtaaataacagaggagaatttacatgaatatatttaacctggcggcagcgcaaaagatg

SEQ ID NO: 24956 - DNA, 103 bp, Artificial Sequence
  Synthetic Polynucleotide
taatacgactcactatagggattatgtttcggaggtaaaatatattgaagaacagaggagacttcaaatgattttacctaacctggcggcagcgcaaaagatg

SEQ ID NO: 24957 - DNA, 103 bp, Artificial Sequence
  Synthetic Polynucleotide
taatacgactcactatagggtgactattatgtttcggaggtaaaatatataacagaggagaatatatatgacctccgaaaacctggcggcagcgcaaaagatg

SEQ ID NO: 24958 - DNA, 103 bp, Artificial Sequence
  Synthetic Polynucleotide
taatacgactcactatagggaaatttgactattatgtttcggaggtaaaaaacagaggagattttacatgcgaaacataaacctggcggcagcgcaaaagatg

SEQ ID NO: 24959 - DNA, 103 bp, Artificial Sequence
  Synthetic Polynucleotide
taatacgactcactatagggtaaataaatttgactattatgtttcggaggaacagaggagacctccgatgcataatagtaacctggcggcagcgcaaaagatg

SEQ ID NO: 24960 - DNA, 103 bp, Artificial Sequence
  Synthetic Polynucleotide
taatacgactcactatagggtcctaaatcgatccctgagtttattgcatcaacagaggagagatgcaatgaactcagggaacctggcggcagcgcaaaagatg

SEQ ID NO: 24961 - DNA, 103 bp, Artificial Sequence
  Synthetic Polynucleotide
taatacgactcactatagggatatttaaataaatttgactattatgtttcaacagaggagagaaacaatgtagtcaaataacctggcggcagcgcaaaagatg

SEQ ID NO: 24962 - DNA, 103 bp, Artificial Sequence
  Synthetic Polynucleotide
taatacgactcactatagggtctagatatttaaataaatttgactattataacagaggagaataataatgaaatttattaacctggcggcagcgcaaaagatg

SEQ ID NO: 24963 - DNA, 103 bp, Artificial Sequence
  Synthetic Polynucleotide
taatacgactcactatagggagtggtctagatatttaaataaatttgactaacagaggagaagtcaaatgtatttaaataacctggcggcagcgcaaaagatg

SEQ ID NO: 24964 - DNA, 103 bp, Artificial Sequence
  Synthetic Polynucleotide
taatacgactcactatagggttgaaagtggtctagatatttaaataaattaacagaggagaaatttaatgaaatatctaaacctggcggcagcgcaaaagatg

SEQ ID NO: 24965 - DNA, 103 bp, Artificial Sequence
  Synthetic Polynucleotide
taatacgactcactatagggggtatttgaaagtggtctagatatttaaataacagaggagaatttaaatgtctagaccaaacctggcggcagcgcaaaagatg

SEQ ID NO: 24966 - DNA, 103 bp, Artificial Sequence
  Synthetic Polynucleotide
taatacgactcactatagggaacaaggtatttgaaagtggtctagatattaacagaggagaaatatcatgaccactttcaacctggcggcagcgcaaaagatg

SEQ ID NO: 24967 - DNA, 103 bp, Artificial Sequence
  Synthetic Polynucleotide
taatacgactcactatagggtatataacaaggtatttgaaagtggtctagaacagaggagactagacatgtttcaaataaacctggcggcagcgcaaaagatg

SEQ ID NO: 24968 - DNA, 103 bp, Artificial Sequence
  Synthetic Polynucleotide
taatacgactcactatagggagtgatatataacaaggtatttgaaagtggaacagaggagaccacttatgaataccttgaacctggcggcagcgcaaaagatg

SEQ ID NO: 24969 - DNA, 103 bp, Artificial Sequence
  Synthetic Polynucleotide
taatacgactcactatagggataacagtgatatataacaaggtatttgaaaacagaggagattcaaaatgcttgttataaacctggcggcagcgcaaaagatg

SEQ ID NO: 24970 - DNA, 103 bp, Artificial Sequence
  Synthetic Polynucleotide
taatacgactcactatagggctcacataacagtgatatataacaaggtataacagaggagaatacctatgtatatatcaaacctggcggcagcgcaaaagatg

SEQ ID NO: 24971 - DNA, 103 bp, Artificial Sequence
  Synthetic Polynucleotide
taatacgactcactatagggagatctcctaaatcgatccctgagtttattaacagaggagaaataaaatgagggatcgaaacctggcggcagcgcaaaagatg

SEQ ID NO: 24972 - DNA, 103 bp, Artificial Sequence
  Synthetic Polynucleotide
taatacgactcactatagggaccatctcacataacagtgatatataacaaaacagaggagattgttaatgatcactgttaacctggcggcagcgcaaaagatg

SEQ ID NO: 24973 - DNA, 103 bp, Artificial Sequence
  Synthetic Polynucleotide
taatacgactcactatagggtttgcaccatctcacataacagtgatatataacagaggagaatatatatgtgttatgtgaacctggcggcagcgcaaaagatg

SEQ ID NO: 24974 - DNA, 103 bp, Artificial Sequence
  Synthetic Polynucleotide
taatacgactcactatagggtaaggtttgcaccatctcacataacagtgaaacagaggagatcactgatgtgtgagatgaacctggcggcagcgcaaaagatg

SEQ ID NO: 24975 - DNA, 103 bp, Artificial Sequence
  Synthetic Polynucleotide
taatacgactcactatagggcattctaaggtttgcaccatctcacataacaacagaggagagttatgatggatggtgcaaacctggcggcagcgcaaaagatg

SEQ ID NO: 24976 - DNA, 103 bp, Artificial Sequence
  Synthetic Polynucleotide
taatacgactcactataggggttatcattctaaggtttgcaccatctcacaacagaggagagtgagaatgtgcaaacctaacctggcggcagcgcaaaagatg

SEQ ID NO: 24977 - DNA, 103 bp, Artificial Sequence
  Synthetic Polynucleotide
taatacgactcactatagggctttggttatcattctaaggtttgcaccataacagaggagaatggtgatgaccttagaaaacctggcggcagcgcaaaagatg

SEQ ID NO: 24978 - DNA, 103 bp, Artificial Sequence
  Synthetic Polynucleotide
taatacgactcactatagggcctacctttggttatcattctaaggtttgcaacagaggagagcaaacatgagaatgataaacctggcggcagcgcaaaagatg

SEQ ID NO: 24979 - DNA, 103 bp, Artificial Sequence
  Synthetic Polynucleotide
taatacgactcactatagggcagttcctacctttggttatcattctaaggaacagaggagaccttagatggataaccaaaacctggcggcagcgcaaaagatg

SEQ ID NO: 24980 - DNA, 103 bp, Artificial Sequence
  Synthetic Polynucleotide
taatacgactcactatagggataaccagttcctacctttggttatcattcaacagaggagagaatgaatgccaaaggtaaacctggcggcagcgcaaaagatg

SEQ ID NO: 24981 - DNA, 103 bp, Artificial Sequence
  Synthetic Polynucleotide
taatacgactcactataggggtcatataaccagttcctacctttggttataacagaggagaataaccatgggtaggaacaacctggcggcagcgcaaaagatg

SEQ ID NO: 24982 - DNA, 103 bp, Artificial Sequence
  Synthetic Polynucleotide
taatacgactcactatagggccaaaagatctcctaaatcgatccctgagtaacagaggagaactcagatgtcgatttagaacctggcggcagcgcaaaagatg

SEQ ID NO: 24983 - DNA, 103 bp, Artificial Sequence
  Synthetic Polynucleotide
taatacgactcactataggggtactgtcatataaccagttcctacctttgaacagaggagacaaaggatggaactggttaacctggcggcagcgcaaaagatg

SEQ ID NO: 24984 - DNA, 103 bp, Artificial Sequence
  Synthetic Polynucleotide
taatacgactcactatagggtcgaggtactgtcatataaccagttcctacaacagaggagagtaggaatgggttatatgaacctggcggcagcgcaaaagatg

SEQ ID NO: 24985 - DNA, 103 bp, Artificial Sequence
  Synthetic Polynucleotide
taatacgactcactatagggcaccttcgaggtactgtcatataaccagttaacagaggagaaactggatgtatgacagtaacctggcggcagcgcaaaagatg

SEQ ID NO: 24986 - DNA, 103 bp, Artificial Sequence
  Synthetic Polynucleotide
taatacgactcactatagggaataacaccttcgaggtactgtcatataacaacagaggagagttataatgcagtacctcaacctggcggcagcgcaaaagatg

SEQ ID NO: 24987 - DNA, 103 bp, Artificial Sequence
  Synthetic Polynucleotide
taatacgactcactatagggcattgaataacaccttcgaggtactgtcataacagaggagaatgacaatgcctcgaaggaacctggcggcagcgcaaaagatg

SEQ ID NO: 24988 - DNA, 103 bp, Artificial Sequence
  Synthetic Polynucleotide
taatacgactcactatagggtaaaccattgaataacaccttcgaggtactaacagaggagaagtaccatgaaggtgttaaacctggcggcagcgcaaaagatg

SEQ ID NO: 24989 - DNA, 103 bp, Artificial Sequence
  Synthetic Polynucleotide
taatacgactcactatagggagatctaaaccattgaataacaccttcgagaacagaggagactcgaaatggttattcaaaacctggcggcagcgcaaaagatg

SEQ ID NO: 24990 - DNA, 103 bp, Artificial Sequence
  Synthetic Polynucleotide
taatacgactcactatagggaggagagatctaaaccattgaataacacctaacagaggagaaggtgtatgtcaatggttaacctggcggcagcgcaaaagatg

SEQ ID NO: 24991 - DNA, 103 bp, Artificial Sequence
  Synthetic Polynucleotide
taatacgactcactatagggattagaggagagatctaaaccattgaataaaacagaggagattattcatgggtttagataacctggcggcagcgcaaaagatg

SEQ ID NO: 24992 - DNA, 103 bp, Artificial Sequence
  Synthetic Polynucleotide
taatacgactcactatagggtagcaattagaggagagatctaaaccattgaacagaggagacaatggatgagatctctcaacctggcggcagcgcaaaagatg

SEQ ID NO: 24993 - DNA, 103 bp, Artificial Sequence
  Synthetic Polynucleotide
taatacgactcactataggggccttccaaaagatctcctaaatcgatcccaacagaggagagggatcatgttaggagataacctggcggcagcgcaaaagatg

SEQ ID NO: 24994 - DNA, 103 bp, Artificial Sequence
  Synthetic Polynucleotide
taatacgactcactatagggtatcgtagcaattagaggagagatctaaacaacagaggagagtttagatgtctcctctaaacctggcggcagcgcaaaagatg

SEQ ID NO: 24995 - DNA, 103 bp, Artificial Sequence
  Synthetic Polynucleotide
taatacgactcactatagggtgtattatcgtagcaattagaggagagatcaacagaggagagatctcatgtctaattgcaacctggcggcagcgcaaaagatg

SEQ ID NO: 24996 - DNA, 103 bp, Artificial Sequence
  Synthetic Polynucleotide
taatacgactcactataggggtagttgtattatcgtagcaattagaggagaacagaggagactcctcatgttgctacgaaacctggcggcagcgcaaaagatg

SEQ ID NO: 24997 - DNA, 103 bp, Artificial Sequence
  Synthetic Polynucleotide
taatacgactcactatagggggtttgtagttgtattatcgtagcaattagaacagaggagactaattatgacgataataaacctggcggcagcgcaaaagatg

SEQ ID NO: 24998 - DNA, 103 bp, Artificial Sequence
  Synthetic Polynucleotide
taatacgactcactatagggaaagaggtttgtagttgtattatcgtagcaaacagaggagatgctacatgaatacaactaacctggcggcagcgcaaaagatg

SEQ ID NO: 24999 - DNA, 103 bp, Artificial Sequence
  Synthetic Polynucleotide
taatacgactcactatagggaaggtaaagaggtttgtagttgtattatcgaacagaggagacgataaatgaactacaaaaacctggcggcagcgcaaaagatg

SEQ ID NO: 25000 - DNA, 103 bp, Artificial Sequence
  Synthetic Polynucleotide
taatacgactcactatagggtaaccaaggtaaagaggtttgtagttgtataacagaggagaatacaaatgcaaacctctaacctggcggcagcgcaaaagatg

SEQ ID NO: 25001 - DNA, 103 bp, Artificial Sequence
  Synthetic Polynucleotide
taatacgactcactatagggtattgtaaccaaggtaaagaggtttgtagtaacagaggagaactacaatgctctttaccaacctggcggcagcgcaaaagatg

SEQ ID NO: 25002 - DNA, 103 bp, Artificial Sequence
  Synthetic Polynucleotide
taatacgactcactatagggtacagtattgtaaccaaggtaaagaggtttaacagaggagaaaacctatgtaccttggtaacctggcggcagcgcaaaagatg

SEQ ID NO: 25003 - DNA, 103 bp, Artificial Sequence
  Synthetic Polynucleotide
taatacgactcactatagggtctattacagtattgtaaccaaggtaaagaaacagaggagatctttaatgtggttacaaaacctggcggcagcgcaaaagatg

SEQ ID NO: 25004 - DNA, 103 bp, Artificial Sequence
  Synthetic Polynucleotide
taatacgactcactatagggaagccgccttccaaaagatctcctaaatcgaacagaggagacgatttatgagatcttttaacctggcggcagcgcaaaagatg

SEQ ID NO: 25005 - DNA, 103 bp, Artificial Sequence
  Synthetic Polynucleotide
taatacgactcactatagggtcatatctattacagtattgtaaccaaggtaacagaggagaaccttgatgacaatactgaacctggcggcagcgcaaaagatg

SEQ ID NO: 25006 - DNA, 103 bp, Artificial Sequence
  Synthetic Polynucleotide
taatacgactcactatagggtacaatcatatctattacagtattgtaaccaacagaggagaggttacatgactgtaataaacctggcggcagcgcaaaagatg

SEQ ID NO: 25007 - DNA, 103 bp, Artificial Sequence
  Synthetic Polynucleotide
taatacgactcactatagggagaaatacaatcatatctattacagtattgaacagaggagacaatacatgaatagatataacctggcggcagcgcaaaagatg

SEQ ID NO: 25008 - DNA, 103 bp, Artificial Sequence
  Synthetic Polynucleotide
taatacgactcactatagggaagaaagaaatacaatcatatctattacagaacagaggagactgtaaatgatatgattgaacctggcggcagcgcaaaagatg

SEQ ID NO: 25009 - DNA, 103 bp, Artificial Sequence
  Synthetic Polynucleotide
taatacgactcactataggggatttaagaaagaaatacaatcatatctataacagaggagaatagatatgattgtatttaacctggcggcagcgcaaaagatg

SEQ ID NO: 25010 - DNA, 103 bp, Artificial Sequence
  Synthetic Polynucleotide
taatacgactcactatagggcagatgatttaagaaagaaatacaatcataaacagaggagatatgatatgatttctttcaacctggcggcagcgcaaaagatg

SEQ ID NO: 25011 - DNA, 103 bp, Artificial Sequence
  Synthetic Polynucleotide
taatacgactcactatagggtgaatcagatgatttaagaaagaaatacaaaacagaggagattgtatatgtttcttaaaaacctggcggcagcgcaaaagatg

SEQ ID NO: 25012 - DNA, 103 bp, Artificial Sequence
  Synthetic Polynucleotide
taatacgactcactatagggcaagttgaatcagatgatttaagaaagaaaaacagaggagatttcttatgtaaatcatcaacctggcggcagcgcaaaagatg

SEQ ID NO: 25013 - DNA, 103 bp, Artificial Sequence
  Synthetic Polynucleotide
taatacgactcactatagggtctatcaagttgaatcagatgatttaagaaaacagaggagattcttaatgcatctgattaacctggcggcagcgcaaaagatg

SEQ ID NO: 25014 - DNA, 103 bp, Artificial Sequence
  Synthetic Polynucleotide
taatacgactcactatagggttatatctatcaagttgaatcagatgatttaacagaggagaaaatcaatggattcaactaacctggcggcagcgcaaaagatg

SEQ ID NO: 25015 - DNA, 103 bp, Artificial Sequence
  Synthetic Polynucleotide
taatacgactcactatagggtctttatttatatgatacacaaaatcatcaaacagaggagatgatgaatgtgtgtatcaaacctggcggcagcgcaaaagatg

SEQ ID NO: 25016 - DNA, 103 bp, Artificial Sequence
  Synthetic Polynucleotide
taatacgactcactatagggtcaacaagccgccttccaaaagatctcctaaacagaggagataggagatgttttggaagaacctggcggcagcgcaaaagatg

SEQ ID NO: 25017 - DNA, 103 bp, Artificial Sequence
  Synthetic Polynucleotide
taatacgactcactatagggtcaagttatatctatcaagttgaatcagataacagaggagaatctgaatgaacttgataaacctggcggcagcgcaaaagatg

SEQ ID NO: 25018 - DNA, 103 bp, Artificial Sequence
  Synthetic Polynucleotide
taatacgactcactatagggctgaatcaagttatatctatcaagttgaataacagaggagaattcaaatggatagatataacctggcggcagcgcaaaagatg

SEQ ID NO: 25019 - DNA, 103 bp, Artificial Sequence
  Synthetic Polynucleotide
taatacgactcactataggggttctctgaatcaagttatatctatcaagtaacagaggagaacttgaatgatataacttaacctggcggcagcgcaaaagatg

SEQ ID NO: 25020 - DNA, 103 bp, Artificial Sequence
  Synthetic Polynucleotide
taatacgactcactatagggaaaatgttctctgaatcaagttatatctataacagaggagaatagatatgacttgattcaacctggcggcagcgcaaaagatg

SEQ ID NO: 25021 - DNA, 103 bp, Artificial Sequence
  Synthetic Polynucleotide
taatacgactcactatagggttcccaaaatgttctctgaatcaagttataaacagaggagatataacatgattcagagaaacctggcggcagcgcaaaagatg

SEQ ID NO: 25022 - DNA, 103 bp, Artificial Sequence
  Synthetic Polynucleotide
taatacgactcactatagggtgacgttcccaaaatgttctctgaatcaagaacagaggagacttgatatggagaacattaacctggcggcagcgcaaaagatg

SEQ ID NO: 25023 - DNA, 103 bp, Artificial Sequence
  Synthetic Polynucleotide
taatacgactcactataggggttaatgacgttcccaaaatgttctctgaaaacagaggagattcagaatgcattttgggaacctggcggcagcgcaaaagatg

SEQ ID NO: 25024 - DNA, 103 bp, Artificial Sequence
  Synthetic Polynucleotide
taatacgactcactatagggatttagttaatgacgttcccaaaatgttctaacagaggagaagaacaatgtgggaacgtaacctggcggcagcgcaaaagatg

SEQ ID NO: 25025 - DNA, 103 bp, Artificial Sequence
  Synthetic Polynucleotide
taatacgactcactatagggagagaatttagttaatgacgttcccaaaataacagaggagaattttgatgacgtcattaaacctggcggcagcgcaaaagatg

SEQ ID NO: 25026 - DNA, 103 bp, Artificial Sequence
  Synthetic Polynucleotide
taatacgactcactatagggcatttagagaatttagttaatgacgttcccaacagaggagagggaacatgattaactaaaacctggcggcagcgcaaaagatg

SEQ ID NO: 25027 - DNA, 103 bp, Artificial Sequence
  Synthetic Polynucleotide
taatacgactcactatagggtaatgtcaacaagccgccttccaaaagatcaacagaggagagatcttatggaaggcggcaacctggcggcagcgcaaaagatg

SEQ ID NO: 25028 - DNA, 103 bp, Artificial Sequence
  Synthetic Polynucleotide
taatacgactcactatagggtacatcatttagagaatttagttaatgacgaacagaggagacgtcatatgctaaattctaacctggcggcagcgcaaaagatg

SEQ ID NO: 25029 - DNA, 103 bp, Artificial Sequence
  Synthetic Polynucleotide
taatacgactcactatagggtacagtacatcatttagagaatttagttaaaacagaggagattaactatgttctctaaaaacctggcggcagcgcaaaagatg

SEQ ID NO: 25030 - DNA, 103 bp, Artificial Sequence
  Synthetic Polynucleotide
taatacgactcactatagggagtaatacagtacatcatttagagaatttaaacagaggagataaattatgtaaatgatgaacctggcggcagcgcaaaagatg

SEQ ID NO: 25031 - DNA, 103 bp, Artificial Sequence
  Synthetic Polynucleotide
taatacgactcactataggggaaacagtaatacagtacatcatttagagaaacagaggagatctctaatggatgtactgaacctggcggcagcgcaaaagatg

SEQ ID NO: 25032 - DNA, 103 bp, Artificial Sequence
  Synthetic Polynucleotide
taatacgactcactatagggcgggtgaaacagtaatacagtacatcatttaacagaggagaaaatgaatgactgtattaaacctggcggcagcgcaaaagatg

SEQ ID NO: 25033 - DNA, 103 bp, Artificial Sequence
  Synthetic Polynucleotide
taatacgactcactatagggttagtcgggtgaaacagtaatacagtacataacagaggagaatgtacatgattactgttaacctggcggcagcgcaaaagatg

SEQ ID NO: 25034 - DNA, 103 bp, Artificial Sequence
  Synthetic Polynucleotide
taatacgactcactatagggtataattagtcgggtgaaacagtaatacagaacagaggagactgtatatgtgtttcaccaacctggcggcagcgcaaaagatg

SEQ ID NO: 25035 - DNA, 103 bp, Artificial Sequence
  Synthetic Polynucleotide
taatacgactcactatagggtactatataattagtcgggtgaaacagtaaaacagaggagattactgatgcacccgactaacctggcggcagcgcaaaagatg

SEQ ID NO: 25036 - DNA, 103 bp, Artificial Sequence
  Synthetic Polynucleotide
taatacgactcactatagggtatgctactatataattagtcgggtgaaacaacagaggagagtttcaatggactaattaaacctggcggcagcgcaaaagatg

SEQ ID NO: 25037 - DNA, 103 bp, Artificial Sequence
  Synthetic Polynucleotide
taatacgactcactatagggattaatatgctactatataattagtcgggtaacagaggagaacccgaatgattatatagaacctggcggcagcgcaaaagatg

SEQ ID NO: 25038 - DNA, 103 bp, Artificial Sequence
  Synthetic Polynucleotide
taatacgactcactatagggacacataatgtcaacaagccgccttccaaaaacagaggagatttggaatgcggcttgttaacctggcggcagcgcaaaagatg

SEQ ID NO: 25039 - DNA, 103 bp, Artificial Sequence
  Synthetic Polynucleotide
taatacgactcactataggggatccattaatatgctactatataattagtaacagaggagaactaatatgatagtagcaaacctggcggcagcgcaaaagatg

SEQ ID NO: 25040 - DNA, 103 bp, Artificial Sequence
  Synthetic Polynucleotide
taatacgactcactatagggtaaaggatccattaatatgctactatataaaacagaggagattatatatgagcatattaaacctggcggcagcgcaaaagatg

SEQ ID NO: 25041 - DNA, 103 bp, Artificial Sequence
  Synthetic Polynucleotide
taatacgactcactatagggagaggtaaaggatccattaatatgctactaaacagaggagatagtagatgattaatggaaacctggcggcagcgcaaaagatg

SEQ ID NO: 25042 - DNA, 103 bp, Artificial Sequence
  Synthetic Polynucleotide
taatacgactcactatagggggaggagaggtaaaggatccattaatatgcaacagaggagagcatatatgtggatccttaacctggcggcagcgcaaaagatg

SEQ ID NO: 25043 - DNA, 103 bp, Artificial Sequence
  Synthetic Polynucleotide
taatacgactcactataggggcataggaggagaggtaaaggatccattaaaacagaggagattaatgatgcctttacctaacctggcggcagcgcaaaagatg

SEQ ID NO: 25044 - DNA, 103 bp, Artificial Sequence
  Synthetic Polynucleotide
taatacgactcactataggggaagagcataggaggagaggtaaaggatccaacagaggagaggatccatgacctctcctaacctggcggcagcgcaaaagatg

SEQ ID NO: 25045 - DNA, 103 bp, Artificial Sequence
  Synthetic Polynucleotide
taatacgactcactatagggtataagaagagcataggaggagaggtaaagaacagaggagactttacatgtcctcctataacctggcggcagcgcaaaagatg

SEQ ID NO: 25046 - DNA, 103 bp, Artificial Sequence
  Synthetic Polynucleotide
taatacgactcactatagggtgacttataagaagagcataggaggagaggaacagaggagacctctcatgctatgctctaacctggcggcagcgcaaaagatg

SEQ ID NO: 25047 - DNA, 103 bp, Artificial Sequence
  Synthetic Polynucleotide
taatacgactcactatagggttgagtgacttataagaagagcataggaggaacagaggagacctcctatgctcttcttaaacctggcggcagcgcaaaagatg

SEQ ID NO: 25048 - DNA, 103 bp, Artificial Sequence
  Synthetic Polynucleotide
taatacgactcactatagggaccggttgagtgacttataagaagagcataaacagaggagatatgctatgcttataagtaacctggcggcagcgcaaaagatg

SEQ ID NO: 25049 - DNA, 103 bp, Artificial Sequence
  Synthetic Polynucleotide
taatacgactcactataggggttcaacacataatgtcaacaagccgccttaacagaggagaaaggcgatgtgttgacataacctggcggcagcgcaaaagatg

SEQ ID NO: 25050 - DNA, 103 bp, Artificial Sequence
  Synthetic Polynucleotide
taatacgactcactataggggtttcaccggttgagtgacttataagaagaaacagaggagatcttctatgaagtcactcaacctggcggcagcgcaaaagatg

SEQ ID NO: 25051 - DNA, 103 bp, Artificial Sequence
  Synthetic Polynucleotide
taatacgactcactatagggtcggcgtttcaccggttgagtgacttataaaacagaggagattataaatgactcaaccgaacctggcggcagcgcaaaagatg

SEQ ID NO: 25052 - DNA, 103 bp, Artificial Sequence
  Synthetic Polynucleotide
taatacgactcactatagggcaaactcggcgtttcaccggttgagtgactaacagaggagaagtcacatgaccggtgaaaacctggcggcagcgcaaaagatg

SEQ ID NO: 25053 - DNA, 103 bp, Artificial Sequence
  Synthetic Polynucleotide
taatacgactcactataggggccaacaaactcggcgtttcaccggttgagaacagaggagactcaacatgtgaaacgccaacctggcggcagcgcaaaagatg

SEQ ID NO: 25054 - DNA, 103 bp, Artificial Sequence
  Synthetic Polynucleotide
taatacgactcactatagggtctaagccaacaaactcggcgtttcaccggaacagaggagaccggtgatgcgccgagttaacctggcggcagcgcaaaagatg

SEQ ID NO: 25055 - DNA, 103 bp, Artificial Sequence
  Synthetic Polynucleotide
taatacgactcactatagggaaaactctaagccaacaaactcggcgtttcaacagaggagagaaacgatgagtttgttgaacctggcggcagcgcaaaagatg

SEQ ID NO: 25056 - DNA, 103 bp, Artificial Sequence
  Synthetic Polynucleotide
taatacgactcactatagggacaggaaaactctaagccaacaaactcggcaacagaggagagccgagatggttggcttaaacctggcggcagcgcaaaagatg

SEQ ID NO: 25057 - DNA, 103 bp, Artificial Sequence
  Synthetic Polynucleotide
taatacgactcactataggggtaaaacaggaaaactctaagccaacaaacaacagaggagagtttgtatgcttagagttaacctggcggcagcgcaaaagatg

SEQ ID NO: 25058 - DNA, 103 bp, Artificial Sequence
  Synthetic Polynucleotide
taatacgactcactatagggattcagtaaaacaggaaaactctaagccaaaacagaggagattggctatgagttttcctaacctggcggcagcgcaaaagatg

SEQ ID NO: 25059 - DNA, 103 bp, Artificial Sequence
  Synthetic Polynucleotide
taatacgactcactatagggactacattcagtaaaacaggaaaactctaaaacagaggagattagagatgtcctgttttaacctggcggcagcgcaaaagatg

SEQ ID NO: 25060 - DNA, 103 bp, Artificial Sequence
  Synthetic Polynucleotide
taatacgactcactatagggataatgttcaacacataatgtcaacaagccaacagaggagaggcttgatgacattatgtaacctggcggcagcgcaaaagatg

SEQ ID NO: 25061 - DNA, 103 bp, Artificial Sequence
  Synthetic Polynucleotide
taatacgactcactatagggtaattactacattcagtaaaacaggaaaacaacagaggagagttttcatgttttactgaaacctggcggcagcgcaaaagatg

SEQ ID NO: 25062 - DNA, 103 bp, Artificial Sequence
  Synthetic Polynucleotide
taatacgactcactatagggatcattaattactacattcagtaaaacaggaacagaggagacctgttatgctgaatgtaaacctggcggcagcgcaaaagatg

SEQ ID NO: 25063 - DNA, 103 bp, Artificial Sequence
  Synthetic Polynucleotide
taatacgactcactatagggagtcaatcattaattactacattcagtaaaaacagaggagatttactatgtgtagtaataacctggcggcagcgcaaaagatg

SEQ ID NO: 25064 - DNA, 103 bp, Artificial Sequence
  Synthetic Polynucleotide
taatacgactcactatagggactcaagtcaatcattaattactacattcaaacagaggagatgaatgatgtaattaatgaacctggcggcagcgcaaaagatg

SEQ ID NO: 25065 - DNA, 103 bp, Artificial Sequence
  Synthetic Polynucleotide
taatacgactcactatagggtcaacactcaagtcaatcattaattactacaacagaggagagtagtaatgaatgattgaaacctggcggcagcgcaaaagatg

SEQ ID NO: 25066 - DNA, 103 bp, Artificial Sequence
  Synthetic Polynucleotide
taatacgactcactatagggttccatcaacactcaagtcaatcattaattaacagaggagaaattaaatgttgacttgaaacctggcggcagcgcaaaagatg

SEQ ID NO: 25067 - DNA, 103 bp, Artificial Sequence
  Synthetic Polynucleotide
taatacgactcactatagggcttgattccatcaacactcaagtcaatcataacagaggagaatgattatgttgagtgttaacctggcggcagcgcaaaagatg

SEQ ID NO: 25068 - DNA, 103 bp, Artificial Sequence
  Synthetic Polynucleotide
taatacgactcactatagggactatcttgattccatcaacactcaagtcaaacagaggagatgacttatgtgttgatggaacctggcggcagcgcaaaagatg

SEQ ID NO: 25069 - DNA, 103 bp, Artificial Sequence
  Synthetic Polynucleotide
taatacgactcactatagggatcgcactatcttgattccatcaacactcaaacagaggagatgagtgatgatggaatcaaacctggcggcagcgcaaaagatg

SEQ ID NO: 25070 - DNA, 103 bp, Artificial Sequence
  Synthetic Polynucleotide
taatacgactcactataggggaatcatcgcactatcttgattccatcaacaacagaggagagttgatatgatcaagataaacctggcggcagcgcaaaagatg

SEQ ID NO: 25071 - DNA, 103 bp, Artificial Sequence
  Synthetic Polynucleotide
taatacgactcactatagggttgtaataatgttcaacacataatgtcaacaacagaggagagttgacatgatgtgttgaaacctggcggcagcgcaaaagatg

SEQ ID NO: 25072 - DNA, 103 bp, Artificial Sequence
  Synthetic Polynucleotide
taatacgactcactatagggaatatgaatcatcgcactatcttgattccaaacagaggagatggaatatggatagtgcgaacctggcggcagcgcaaaagatg

SEQ ID NO: 25073 - DNA, 103 bp, Artificial Sequence
  Synthetic Polynucleotide
taatacgactcactatagggcttataatatgaatcatcgcactatcttgaaacagaggagatcaagaatgtgcgatgataacctggcggcagcgcaaaagatg

SEQ ID NO: 25074 - DNA, 103 bp, Artificial Sequence
  Synthetic Polynucleotide
taatacgactcactatagggtgtaccttataatatgaatcatcgcactataacagaggagaatagtgatgtgattcataaacctggcggcagcgcaaaagatg

SEQ ID NO: 25075 - DNA, 103 bp, Artificial Sequence
  Synthetic Polynucleotide
taatacgactcactataggggaaattgtaccttataatatgaatcatcgcaacagaggagagcgatgatgcatattataaacctggcggcagcgcaaaagatg

SEQ ID NO: 25076 - DNA, 103 bp, Artificial Sequence
  Synthetic Polynucleotide
taatacgactcactatagggaaatggaaattgtaccttataatatgaatcaacagaggagagattcaatgtataaggtaaacctggcggcagcgcaaaagatg

SEQ ID NO: 25077 - DNA, 103 bp, Artificial Sequence
  Synthetic Polynucleotide
taatacgactcactatagggaacagaaatggaaattgtaccttataatataacagaggagaatattaatgggtacaattaacctggcggcagcgcaaaagatg

SEQ ID NO: 25078 - DNA, 103 bp, Artificial Sequence
  Synthetic Polynucleotide
taatacgactcactatagggggcaaaacagaaatggaaattgtaccttataacagaggagaataaggatgaatttccataacctggcggcagcgcaaaagatg

SEQ ID NO: 25079 - DNA, 103 bp, Artificial Sequence
  Synthetic Polynucleotide
taatacgactcactatagggacattggcaaaacagaaatggaaattgtacaacagaggagagtacaaatgccatttctgaacctggcggcagcgcaaaagatg

SEQ ID NO: 25080 - DNA, 103 bp, Artificial Sequence
  Synthetic Polynucleotide
taatacgactcactatagggaggatacattggcaaaacagaaatggaaataacagaggagaatttccatgtctgttttgaacctggcggcagcgcaaaagatg

SEQ ID NO: 25081 - DNA, 103 bp, Artificial Sequence
  Synthetic Polynucleotide
taatacgactcactatagggggaagaggatacattggcaaaacagaaatgaacagaggagacatttcatgtttgccaataacctggcggcagcgcaaaagatg

SEQ ID NO: 25082 - DNA, 103 bp, Artificial Sequence
  Synthetic Polynucleotide
taatacgactcactatagggcagaattgtaataatgttcaacacataatgaacagaggagacattatatgttgaacattaacctggcggcagcgcaaaagatg

SEQ ID NO: 25083 - DNA, 103 bp, Artificial Sequence
  Synthetic Polynucleotide
taatacgactcactataggggataaggaagaggatacattggcaaaacagaacagaggagactgtttatgcaatgtatcaacctggcggcagcgcaaaagatg

SEQ ID NO: 25084 - DNA, 103 bp, Artificial Sequence
  Synthetic Polynucleotide
taatacgactcactatagggcatgtgataaggaagaggatacattggcaaaacagaggagattgccaatgtatcctcttaacctggcggcagcgcaaaagatg

SEQ ID NO: 25085 - DNA, 103 bp, Artificial Sequence
  Synthetic Polynucleotide
taatacgactcactatagggattggcatgtgataaggaagaggatacattaacagaggagaaatgtaatgtcttccttaaacctggcggcagcgcaaaagatg

SEQ ID NO: 25086 - DNA, 103 bp, Artificial Sequence
  Synthetic Polynucleotide
taatacgactcactatagggtcttgattggcatgtgataaggaagaggataacagaggagaatcctcatgcttatcacaaacctggcggcagcgcaaaagatg

SEQ ID NO: 25087 - DNA, 103 bp, Artificial Sequence
  Synthetic Polynucleotide
taatacgactcactataggggtttttcttgattggcatgtgataaggaagaacagaggagacttcctatgcacatgccaaacctggcggcagcgcaaaagatg

SEQ ID NO: 25088 - DNA, 103 bp, Artificial Sequence
  Synthetic Polynucleotide
taatacgactcactatagggtctttgtttttcttgattggcatgtgataaaacagaggagattatcaatggccaatcaaaacctggcggcagcgcaaaagatg

SEQ ID NO: 25089 - DNA, 103 bp, Artificial Sequence
  Synthetic Polynucleotide
taatacgactcactatagggtcgactctttgtttttcttgattggcatgtaacagaggagaacatgcatgtcaagaaaaaacctggcggcagcgcaaaagatg

SEQ ID NO: 25090 - DNA, 103 bp, Artificial Sequence
  Synthetic Polynucleotide
taatacgactcactatagggattcttcgactctttgtttttcttgattggaacagaggagaccaatcatgaaaaacaaaaacctggcggcagcgcaaaagatg

SEQ ID NO: 25091 - DNA, 103 bp, Artificial Sequence
  Synthetic Polynucleotide
taatacgactcactatagggttaatattcttcgactctttgtttttcttgaacagaggagacaagaaatgcaaagagtcaacctggcggcagcgcaaaagatg

SEQ ID NO: 25092 - DNA, 103 bp, Artificial Sequence
  Synthetic Polynucleotide
taatacgactcactatagggaatctttaatattcttcgactctttgttttaacagaggagaaaaacaatgagtcgaagaaacctggcggcagcgcaaaagatg

SEQ ID NO: 25093 - DNA, 103 bp, Artificial Sequence
  Synthetic Polynucleotide
taatacgactcactatagggtttgtcagaattgtaataatgttcaacacaaacagaggagatgtgttatgcattattacaacctggcggcagcgcaaaagatg

SEQ ID NO: 25094 - DNA, 103 bp, Artificial Sequence
  Synthetic Polynucleotide
taatacgactcactatagggaagagaatctttaatattcttcgactctttaacagaggagaaaagagatgaagaatattaacctggcggcagcgcaaaagatg

SEQ ID NO: 25095 - DNA, 103 bp, Artificial Sequence
  Synthetic Polynucleotide
taatacgactcactatagggtattaaagagaatctttaatattcttcgacaacagaggagagtcgaaatgtattaaagaaacctggcggcagcgcaaaagatg

SEQ ID NO: 25096 - DNA, 103 bp, Artificial Sequence
  Synthetic Polynucleotide
taatacgactcactatagggttgaatattaaagagaatctttaatattctaacagaggagaagaataatgaagattctcaacctggcggcagcgcaaaagatg

SEQ ID NO: 25097 - DNA, 103 bp, Artificial Sequence
  Synthetic Polynucleotide
taatacgactcactatagggtgtttttgaatattaaagagaatctttaataacagaggagaattaaaatgtctctttaaaacctggcggcagcgcaaaagatg

SEQ ID NO: 25098 - DNA, 103 bp, Artificial Sequence
  Synthetic Polynucleotide
taatacgactcactatagggagaactgtttttgaatattaaagagaatctaacagaggagaagattcatgttaatattcaacctggcggcagcgcaaaagatg

SEQ ID NO: 25099 - DNA, 103 bp, Artificial Sequence
  Synthetic Polynucleotide
taatacgactcactatagggaattaagaactgtttttgaatattaaagagaacagaggagactctttatgattcaaaaaaacctggcggcagcgcaaaagatg

SEQ ID NO: 25100 - DNA, 103 bp, Artificial Sequence
  Synthetic Polynucleotide
taatacgactcactatagggaaaagaattaagaactgtttttgaatattaaacagaggagataatatatgaaaacagttaacctggcggcagcgcaaaagatg

SEQ ID NO: 25101 - DNA, 103 bp, Artificial Sequence
  Synthetic Polynucleotide
taatacgactcactatagggaaaggaaaagaattaagaactgtttttgaaaacagaggagattcaaaatgagttcttaaaacctggcggcagcgcaaaagatg

SEQ ID NO: 25102 - DNA, 103 bp, Artificial Sequence
  Synthetic Polynucleotide
taatacgactcactatagggaaaggaaaggaaaagaattaagaactgtttaacagaggagaaaacagatgttaattcttaacctggcggcagcgcaaaagatg

SEQ ID NO: 25103 - DNA, 103 bp, Artificial Sequence
  Synthetic Polynucleotide
taatacgactcactatagggttaataaaggaaaggaaaagaattaagaacaacagaggagagttcttatgtcttttcctaacctggcggcagcgcaaaagatg

SEQ ID NO: 25104 - DNA, 103 bp, Artificial Sequence
  Synthetic Polynucleotide
taatacgactcactatagggttatctttgtcagaattgtaataatgttcaaacagaggagatgaacaatgttacaattcaacctggcggcagcgcaaaagatg

SEQ ID NO: 25105 - DNA, 103 bp, Artificial Sequence
  Synthetic Polynucleotide
taatacgactcactatagggttatattaataaaggaaaggaaaagaattaaacagaggagataattcatgtcctttcctaacctggcggcagcgcaaaagatg

SEQ ID NO: 25106 - DNA, 103 bp, Artificial Sequence
  Synthetic Polynucleotide
taatacgactcactatagggatatattatattaataaaggaaaggaaaagaacagaggagacttttcatgtcctttattaacctggcggcagcgcaaaagatg

SEQ ID NO: 25107 - DNA, 103 bp, Artificial Sequence
  Synthetic Polynucleotide
taatacgactcactatagggtatcgatatattatattaataaaggaaaggaacagaggagacctttcatgtattaatataacctggcggcagcgcaaaagatg

SEQ ID NO: 25108 - DNA, 103 bp, Artificial Sequence
  Synthetic Polynucleotide
taatacgactcactatagggagatttatcgatatattatattaataaaggaacagaggagacctttaatgatataatataacctggcggcagcgcaaaagatg

SEQ ID NO: 25109 - DNA, 103 bp, Artificial Sequence
  Synthetic Polynucleotide
taatacgactcactatagggttgtaagatttatcgatatattatattaataacagaggagaattaatatgatatatcgaaacctggcggcagcgcaaaagatg

SEQ ID NO: 25110 - DNA, 103 bp, Artificial Sequence
  Synthetic Polynucleotide
taatacgactcactatagggccacattgtaagatttatcgatatattataaacagaggagatataatatgtcgataaataacctggcggcagcgcaaaagatg

SEQ ID NO: 25111 - DNA, 103 bp, Artificial Sequence
  Synthetic Polynucleotide
taatacgactcactataggggagtcccacattgtaagatttatcgatataaacagaggagatatatcatgaaatcttacaacctggcggcagcgcaaaagatg

SEQ ID NO: 25112 - DNA, 103 bp, Artificial Sequence
  Synthetic Polynucleotide
taatacgactcactatagggatgacgagtcccacattgtaagatttatcgaacagaggagacgataaatgttacaatgtaacctggcggcagcgcaaaagatg

SEQ ID NO: 25113 - DNA, 103 bp, Artificial Sequence
  Synthetic Polynucleotide
taatacgactcactatagggcatgtatgacgagtcccacattgtaagattaacagaggagaaatcttatgatgtgggacaacctggcggcagcgcaaaagatg

SEQ ID NO: 25114 - DNA, 103 bp, Artificial Sequence
  Synthetic Polynucleotide
taatacgactcactatagggtgttgcatgtatgacgagtcccacattgtaaacagaggagatacaatatgggactcgtcaacctggcggcagcgcaaaagatg

SEQ ID NO: 25115 - DNA, 103 bp, Artificial Sequence
  Synthetic Polynucleotide
taatacgactcactatagggtgaatttatctttgtcagaattgtaataataacagaggagaattattatgattctgacaaacctggcggcagcgcaaaagatg

SEQ ID NO: 25116 - DNA, 103 bp, Artificial Sequence
  Synthetic Polynucleotide
taatacgactcactatagggtcacttgttgcatgtatgacgagtcccacaaacagaggagatgtgggatgcgtcatacaaacctggcggcagcgcaaaagatg

SEQ ID NO: 25117 - DNA, 103 bp, Artificial Sequence
  Synthetic Polynucleotide
taatacgactcactatagggctcactcacttgttgcatgtatgacgagtcaacagaggagagactcgatgtacatgcaaaacctggcggcagcgcaaaagatg

SEQ ID NO: 25118 - DNA, 103 bp, Artificial Sequence
  Synthetic Polynucleotide
taatacgactcactatagggagtccctcactcacttgttgcatgtatgacaacagaggagagtcataatggcaacaagtaacctggcggcagcgcaaaagatg

SEQ ID NO: 25119 - DNA, 103 bp, Artificial Sequence
  Synthetic Polynucleotide
taatacgactcactatagggtcatcagtccctcactcacttgttgcatgtaacagaggagaacatgcatgaagtgagtgaacctggcggcagcgcaaaagatg

SEQ ID NO: 25120 - DNA, 103 bp, Artificial Sequence
  Synthetic Polynucleotide
taatacgactcactatagggtccagtcatcagtccctcactcacttgttgaacagaggagacaacaaatgagtgagggaaacctggcggcagcgcaaaagatg

SEQ ID NO: 25121 - DNA, 103 bp, Artificial Sequence
  Synthetic Polynucleotide
taatacgactcactatagggacttttccagtcatcagtccctcactcactaacagaggagaagtgagatggggactgataacctggcggcagcgcaaaagatg

SEQ ID NO: 25122 - DNA, 103 bp, Artificial Sequence
  Synthetic Polynucleotide
taatacgactcactatagggttggaacttttccagtcatcagtccctcacaacagaggagagtgaggatgtgatgactgaacctggcggcagcgcaaaagatg

SEQ ID NO: 25123 - DNA, 103 bp, Artificial Sequence
  Synthetic Polynucleotide
taatacgactcactatagggatctattggaacttttccagtcatcagtccaacagaggagaggactgatgactggaaaaaacctggcggcagcgcaaaagatg

SEQ ID NO: 25124 - DNA, 103 bp, Artificial Sequence
  Synthetic Polynucleotide
taatacgactcactatagggacttgatctattggaacttttccagtcatcaacagaggagagatgacatgaaaagttccaacctggcggcagcgcaaaagatg

SEQ ID NO: 25125 - DNA, 103 bp, Artificial Sequence
  Synthetic Polynucleotide
taatacgactcactatagggcgaacacttgatctattggaacttttccagaacagaggagactggaaatgttccaatagaacctggcggcagcgcaaaagatg

SEQ ID NO: 25126 - DNA, 103 bp, Artificial Sequence
  Synthetic Polynucleotide
taatacgactcactatagggattcttctttatttatatgatacacaaaataacagaggagaattttgatgatcatataaaacctggcggcagcgcaaaagatg

SEQ ID NO: 25127 - DNA, 103 bp, Artificial Sequence
  Synthetic Polynucleotide
taatacgactcactatagggtgtattgaatttatctttgtcagaattgtaaacagaggagatacaatatggacaaagataacctggcggcagcgcaaaagatg

SEQ ID NO: 25128 - DNA, 103 bp, Artificial Sequence
  Synthetic Polynucleotide
taatacgactcactatagggagtgccgaacacttgatctattggaactttaacagaggagaaaagttatgatagatcaaaacctggcggcagcgcaaaagatg

SEQ ID NO: 25129 - DNA, 103 bp, Artificial Sequence
  Synthetic Polynucleotide
taatacgactcactatagggggattagtgccgaacacttgatctattggaaacagaggagatccaatatgtcaagtgttaacctggcggcagcgcaaaagatg

SEQ ID NO: 25130 - DNA, 103 bp, Artificial Sequence
  Synthetic Polynucleotide
taatacgactcactatagggctaagggattagtgccgaacacttgatctaaacagaggagatagatcatgtgttcggcaaacctggcggcagcgcaaaagatg

SEQ ID NO: 25131 - DNA, 103 bp, Artificial Sequence
  Synthetic Polynucleotide
taatacgactcactatagggcttttctaagggattagtgccgaacacttgaacagaggagacaagtgatgggcactaataacctggcggcagcgcaaaagatg

SEQ ID NO: 25132 - DNA, 103 bp, Artificial Sequence
  Synthetic Polynucleotide
taatacgactcactatagggtataacttttctaagggattagtgccgaacaacagaggagagttcggatgtaatcccttaacctggcggcagcgcaaaagatg

SEQ ID NO: 25133 - DNA, 103 bp, Artificial Sequence
  Synthetic Polynucleotide
taatacgactcactatagggtcttatataacttttctaagggattagtgcaacagaggagagcactaatgccttagaaaaacctggcggcagcgcaaaagatg

SEQ ID NO: 25134 - DNA, 103 bp, Artificial Sequence
  Synthetic Polynucleotide
taatacgactcactatagggtcttctcttatataacttttctaagggattaacagaggagaaatcccatggaaaagttaaacctggcggcagcgcaaaagatg

SEQ ID NO: 25135 - DNA, 103 bp, Artificial Sequence
  Synthetic Polynucleotide
taatacgactcactatagggggctttcttctcttatataacttttctaagaacagaggagacttagaatggttatataaaacctggcggcagcgcaaaagatg

SEQ ID NO: 25136 - DNA, 103 bp, Artificial Sequence
  Synthetic Polynucleotide
taatacgactcactatagggctttcggctttcttctcttatataacttttaacagaggagaaaaagtatgataagagaaaacctggcggcagcgcaaaagatg

SEQ ID NO: 25137 - DNA, 103 bp, Artificial Sequence
  Synthetic Polynucleotide
taatacgactcactatagggtgtccctttcggctttcttctcttatataaaacagaggagattatatatgagaagaaagaacctggcggcagcgcaaaagatg

SEQ ID NO: 25138 - DNA, 103 bp, Artificial Sequence
  Synthetic Polynucleotide
taatacgactcactatagggggacttgtattgaatttatctttgtcagaaaacagaggagattctgaatgagataaattaacctggcggcagcgcaaaagatg

SEQ ID NO: 25139 - DNA, 103 bp, Artificial Sequence
  Synthetic Polynucleotide
taatacgactcactatagggcccactgtccctttcggctttcttctcttaaacagaggagataagagatgaaagccgaaaacctggcggcagcgcaaaagatg

SEQ ID NO: 25140 - DNA, 103 bp, Artificial Sequence
  Synthetic Polynucleotide
taatacgactcactataggggtaatcccactgtccctttcggctttcttcaacagaggagagaagaaatgcgaaagggaaacctggcggcagcgcaaaagatg

SEQ ID NO: 25141 - DNA, 103 bp, Artificial Sequence
  Synthetic Polynucleotide
taatacgactcactatagggacattgtaatcccactgtccctttcggcttaacagaggagaaagccgatggggacagtgaacctggcggcagcgcaaaagatg

SEQ ID NO: 25142 - DNA, 103 bp, Artificial Sequence
  Synthetic Polynucleotide
taatacgactcactatagggggactacattgtaatcccactgtccctttcaacagaggagagaaaggatgagtgggattaacctggcggcagcgcaaaagatg

SEQ ID NO: 25143 - DNA, 103 bp, Artificial Sequence
  Synthetic Polynucleotide
taatacgactcactatagggagcaaggactacattgtaatcccactgtccaacagaggagaggacagatggattacaataacctggcggcagcgcaaaagatg

SEQ ID NO: 25144 - DNA, 103 bp, Artificial Sequence
  Synthetic Polynucleotide
taatacgactcactatagggtattaagcaaggactacattgtaatcccacaacagaggagagtgggaatgcaatgtagtaacctggcggcagcgcaaaagatg

SEQ ID NO: 25145 - DNA, 103 bp, Artificial Sequence
  Synthetic Polynucleotide
taatacgactcactatagggtttgatattaagcaaggactacattgtaataacagaggagaattacaatgtagtccttgaacctggcggcagcgcaaaagatg

SEQ ID NO: 25146 - DNA, 103 bp, Artificial Sequence
  Synthetic Polynucleotide
taatacgactcactatagggttgattttgatattaagcaaggactacattaacagaggagaaatgtaatgcttgcttaaaacctggcggcagcgcaaaagatg

SEQ ID NO: 25147 - DNA, 103 bp, Artificial Sequence
  Synthetic Polynucleotide
taatacgactcactatagggacttgttgattttgatattaagcaaggactaacagaggagaagtcctatgttaatatcaaacctggcggcagcgcaaaagatg

SEQ ID NO: 25148 - DNA, 103 bp, Artificial Sequence
  Synthetic Polynucleotide
taatacgactcactatagggtcagtacttgttgattttgatattaagcaaaacagaggagattgcttatgatcaaaatcaacctggcggcagcgcaaaagatg

SEQ ID NO: 25149 - DNA, 103 bp, Artificial Sequence
  Synthetic Polynucleotide
taatacgactcactatagggcaataggacttgtattgaatttatctttgtaacagaggagaacaaagatgaattcaataaacctggcggcagcgcaaaagatg

SEQ ID NO: 25150 - DNA, 103 bp, Artificial Sequence
  Synthetic Polynucleotide
taatacgactcactatagggtgtcgtcagtacttgttgattttgatattaaacagaggagataatatatgaatcaacaaaacctggcggcagcgcaaaagatg

SEQ ID NO: 25151 - DNA, 103 bp, Artificial Sequence
  Synthetic Polynucleotide
taatacgactcactatagggaacaatgtcgtcagtacttgttgattttgaaacagaggagatcaaaaatgacaagtactaacctggcggcagcgcaaaagatg

SEQ ID NO: 25152 - DNA, 103 bp, Artificial Sequence
  Synthetic Polynucleotide
taatacgactcactatagggtcccaaacaatgtcgtcagtacttgttgataacagaggagaatcaacatgtactgacgaaacctggcggcagcgcaaaagatg

SEQ ID NO: 25153 - DNA, 103 bp, Artificial Sequence
  Synthetic Polynucleotide
taatacgactcactataggggctgatcccaaacaatgtcgtcagtacttgaacagaggagacaagtaatgacgacattgaacctggcggcagcgcaaaagatg

SEQ ID NO: 25154 - DNA, 103 bp, Artificial Sequence
  Synthetic Polynucleotide
taatacgactcactataggggattagctgatcccaaacaatgtcgtcagtaacagaggagaactgacatgattgtttggaacctggcggcagcgcaaaagatg

SEQ ID NO: 25155 - DNA, 103 bp, Artificial Sequence
  Synthetic Polynucleotide
taatacgactcactatagggtttacgattagctgatcccaaacaatgtcgaacagaggagacgacatatgttgggatcaaacctggcggcagcgcaaaagatg

SEQ ID NO: 25156 - DNA, 103 bp, Artificial Sequence
  Synthetic Polynucleotide
taatacgactcactatagggttttctttacgattagctgatcccaaacaaaacagaggagattgtttatgatcagctaaaacctggcggcagcgcaaaagatg

SEQ ID NO: 25157 - DNA, 103 bp, Artificial Sequence
  Synthetic Polynucleotide
taatacgactcactatagggcaatgttttctttacgattagctgatcccaaacagaggagatgggatatgctaatcgtaaacctggcggcagcgcaaaagatg

SEQ ID NO: 25158 - DNA, 103 bp, Artificial Sequence
  Synthetic Polynucleotide
taatacgactcactatagggtcagccaatgttttctttacgattagctgaaacagaggagatcagctatgcgtaaagaaaacctggcggcagcgcaaaagatg

SEQ ID NO: 25159 - DNA, 103 bp, Artificial Sequence
  Synthetic Polynucleotide
taatacgactcactataggggcaagtcagccaatgttttctttacgattaaacagaggagataatcgatgagaaaacataacctggcggcagcgcaaaagatg

SEQ ID NO: 25160 - DNA, 103 bp, Artificial Sequence
  Synthetic Polynucleotide
taatacgactcactatagggttttgcaataggacttgtattgaatttatcaacagaggagagataaaatgaatacaagtaacctggcggcagcgcaaaagatg

SEQ ID NO: 25161 - DNA, 103 bp, Artificial Sequence
  Synthetic Polynucleotide
taatacgactcactatagggtataagcaagtcagccaatgttttctttacaacagaggagagtaaagatgacattggctaacctggcggcagcgcaaaagatg

SEQ ID NO: 25162 - DNA, 103 bp, Artificial Sequence
  Synthetic Polynucleotide
taatacgactcactatagggataggtataagcaagtcagccaatgttttcaacagaggagagaaaacatgggctgacttaacctggcggcagcgcaaaagatg

SEQ ID NO: 25163 - DNA, 103 bp, Artificial Sequence
  Synthetic Polynucleotide
taatacgactcactatagggtatttataggtataagcaagtcagccaatgaacagaggagacattggatgacttgcttaaacctggcggcagcgcaaaagatg

SEQ ID NO: 25164 - DNA, 103 bp, Artificial Sequence
  Synthetic Polynucleotide
taatacgactcactatagggttgcctatttataggtataagcaagtcagcaacagaggagagctgacatgcttatacctaacctggcggcagcgcaaaagatg

SEQ ID NO: 25165 - DNA, 103 bp, Artificial Sequence
  Synthetic Polynucleotide
taatacgactcactataggggacatttgcctatttataggtataagcaagaacagaggagacttgctatgacctataaaaacctggcggcagcgcaaaagatg

SEQ ID NO: 25166 - DNA, 103 bp, Artificial Sequence
  Synthetic Polynucleotide
taatacgactcactatagggtgtccgacatttgcctatttataggtataaaacagaggagattatacatgtaaataggcaacctggcggcagcgcaaaagatg

SEQ ID NO: 25167 - DNA, 103 bp, Artificial Sequence
  Synthetic Polynucleotide
taatacgactcactatagggttgaatgtccgacatttgcctatttataggaacagaggagacctataatgaggcaaatgaacctggcggcagcgcaaaagatg

SEQ ID NO: 25168 - DNA, 103 bp, Artificial Sequence
  Synthetic Polynucleotide
taatacgactcactataggggtgctttgaatgtccgacatttgcctatttaacagaggagaaaatagatgaatgtcggaaacctggcggcagcgcaaaagatg

SEQ ID NO: 25169 - DNA, 103 bp, Artificial Sequence
  Synthetic Polynucleotide
taatacgactcactatagggttagggtgctttgaatgtccgacatttgccaacagaggagaggcaaaatgcggacattcaacctggcggcagcgcaaaagatg

SEQ ID NO: 25170 - DNA, 103 bp, Artificial Sequence
  Synthetic Polynucleotide
taatacgactcactatagggttcgcttagggtgctttgaatgtccgacataacagaggagaatgtcgatgattcaaagcaacctggcggcagcgcaaaagatg

SEQ ID NO: 25171 - DNA, 103 bp, Artificial Sequence
  Synthetic Polynucleotide
taatacgactcactatagggagatattttgcaataggacttgtattgaataacagaggagaattcaaatgaagtcctataacctggcggcagcgcaaaagatg

SEQ ID NO: 25172 - DNA, 103 bp, Artificial Sequence
  Synthetic Polynucleotide
taatacgactcactataggggtcatttcgcttagggtgctttgaatgtccaacagaggagaggacatatgaagcaccctaacctggcggcagcgcaaaagatg

SEQ ID NO: 25173 - DNA, 103 bp, Artificial Sequence
  Synthetic Polynucleotide
taatacgactcactatagggttgttgtcatttcgcttagggtgctttgaaaacagaggagattcaaaatgccctaagcgaacctggcggcagcgcaaaagatg

SEQ ID NO: 25174 - DNA, 103 bp, Artificial Sequence
  Synthetic Polynucleotide
taatacgactcactataggggacttttgttgtcatttcgcttagggtgctaacagaggagaagcaccatgagcgaaatgaacctggcggcagcgcaaaagatg

SEQ ID NO: 25175 - DNA, 103 bp, Artificial Sequence
  Synthetic Polynucleotide
taatacgactcactatagggtcatggacttttgttgtcatttcgcttaggaacagaggagacctaagatgaatgacaacaacctggcggcagcgcaaaagatg

SEQ ID NO: 25176 - DNA, 103 bp, Artificial Sequence
  Synthetic Polynucleotide
taatacgactcactatagggcgatctcatggacttttgttgtcatttcgcaacagaggagagcgaaaatgcaacaaaagaacctggcggcagcgcaaaagatg

SEQ ID NO: 25177 - DNA, 103 bp, Artificial Sequence
  Synthetic Polynucleotide
taatacgactcactatagggacgctcgatctcatggacttttgttgtcataacagaggagaatgacaatgaaagtccataacctggcggcagcgcaaaagatg

SEQ ID NO: 25178 - DNA, 103 bp, Artificial Sequence
  Synthetic Polynucleotide
taatacgactcactatagggagttgacgctcgatctcatggacttttgttaacagaggagaaacaaaatgccatgagataacctggcggcagcgcaaaagatg

SEQ ID NO: 25179 - DNA, 103 bp, Artificial Sequence
  Synthetic Polynucleotide
taatacgactcactatagggcatgtagttgacgctcgatctcatggacttaacagaggagaaagtccatgagatcgagcaacctggcggcagcgcaaaagatg

SEQ ID NO: 25180 - DNA, 103 bp, Artificial Sequence
  Synthetic Polynucleotide
taatacgactcactataggggatatcatgtagttgacgctcgatctcatgaacagaggagacatgagatggagcgtcaaaacctggcggcagcgcaaaagatg

SEQ ID NO: 25181 - DNA, 103 bp, Artificial Sequence
  Synthetic Polynucleotide
taatacgactcactatagggggggtgatatcatgtagttgacgctcgatcaacagaggagagatcgaatgtcaactacaaacctggcggcagcgcaaaagatg

SEQ ID NO: 25182 - DNA, 103 bp, Artificial Sequence
  Synthetic Polynucleotide
taatacgactcactatagggcccgcagatattttgcaataggacttgtataacagaggagaatacaaatgctattgcaaaacctggcggcagcgcaaaagatg

SEQ ID NO: 25183 - DNA, 103 bp, Artificial Sequence
  Synthetic Polynucleotide
taatacgactcactatagggcaactggggtgatatcatgtagttgacgctaacagaggagaagcgtcatgtacatgataaacctggcggcagcgcaaaagatg

SEQ ID NO: 25184 - DNA, 103 bp, Artificial Sequence
  Synthetic Polynucleotide
taatacgactcactatagggttttacaactggggtgatatcatgtagttgaacagaggagacaactaatggatatcaccaacctggcggcagcgcaaaagatg

SEQ ID NO: 25185 - DNA, 103 bp, Artificial Sequence
  Synthetic Polynucleotide
taatacgactcactatagggcccatttttacaactggggtgatatcatgtaacagaggagaacatgaatgcaccccagtaacctggcggcagcgcaaaagatg

SEQ ID NO: 25186 - DNA, 103 bp, Artificial Sequence
  Synthetic Polynucleotide
taatacgactcactatagggtttttcccatttttacaactggggtgatataacagaggagaatatcaatgcagttgtaaaacctggcggcagcgcaaaagatg

SEQ ID NO: 25187 - DNA, 103 bp, Artificial Sequence
  Synthetic Polynucleotide
taatacgactcactatagggtagcgtttttcccatttttacaactggggtaacagaggagaaccccaatggtaaaaatgaacctggcggcagcgcaaaagatg

SEQ ID NO: 25188 - DNA, 103 bp, Artificial Sequence
  Synthetic Polynucleotide
taatacgactcactataggggcttctagcgtttttcccatttttacaactaacagaggagaagttgtatgaatgggaaaaacctggcggcagcgcaaaagatg

SEQ ID NO: 25189 - DNA, 103 bp, Artificial Sequence
  Synthetic Polynucleotide
taatacgactcactatagggaaattgcttctagcgtttttcccatttttaaacagaggagataaaaaatggaaaaacgcaacctggcggcagcgcaaaagatg

SEQ ID NO: 25190 - DNA, 103 bp, Artificial Sequence
  Synthetic Polynucleotide
taatacgactcactatagggtttggaaattgcttctagcgtttttcccataacagaggagaatgggaatgacgctagaaaacctggcggcagcgcaaaagatg

SEQ ID NO: 25191 - DNA, 103 bp, Artificial Sequence
  Synthetic Polynucleotide
taatacgactcactatagggattcctttggaaattgcttctagcgtttttaacagaggagaaaaaacatgagaagcaataacctggcggcagcgcaaaagatg

SEQ ID NO: 25192 - DNA, 103 bp, Artificial Sequence
  Synthetic Polynucleotide
taatacgactcactatagggctgacattcctttggaaattgcttctagcgaacagaggagacgctagatgcaatttccaaacctggcggcagcgcaaaagatg

SEQ ID NO: 25193 - DNA, 103 bp, Artificial Sequence
  Synthetic Polynucleotide
taatacgactcactatagggcgcgtcccgcagatattttgcaataggactaacagaggagaagtcctatggcaaaatataacctggcggcagcgcaaaagatg

SEQ ID NO: 25194 - DNA, 103 bp, Artificial Sequence
  Synthetic Polynucleotide
taatacgactcactatagggcatctctgacattcctttggaaattgcttcaacagaggagagaagcaatgtccaaaggaaacctggcggcagcgcaaaagatg

SEQ ID NO: 25195 - DNA, 103 bp, Artificial Sequence
  Synthetic Polynucleotide
taatacgactcactataggggctagcatctctgacattcctttggaaattaacagaggagaaatttcatgaggaatgtcaacctggcggcagcgcaaaagatg

SEQ ID NO: 25196 - DNA, 103 bp, Artificial Sequence
  Synthetic Polynucleotide
taatacgactcactatagggacttagctagcatctctgacattcctttggaacagaggagaccaaagatgtgtcagagaaacctggcggcagcgcaaaagatg

SEQ ID NO: 25197 - DNA, 103 bp, Artificial Sequence
  Synthetic Polynucleotide
taatacgactcactatagggatcgtacttagctagcatctctgacattccaacagaggagaggaatgatggagatgctaaacctggcggcagcgcaaaagatg

SEQ ID NO: 25198 - DNA, 103 bp, Artificial Sequence
  Synthetic Polynucleotide
taatacgactcactatagggagatgatcgtacttagctagcatctctgacaacagaggagagtcagaatggctagctaaaacctggcggcagcgcaaaagatg

SEQ ID NO: 25199 - DNA, 103 bp, Artificial Sequence
  Synthetic Polynucleotide
taatacgactcactatagggtcacgagatgatcgtacttagctagcatctaacagaggagaagatgcatgctaagtacgaacctggcggcagcgcaaaagatg

SEQ ID NO: 25200 - DNA, 103 bp, Artificial Sequence
  Synthetic Polynucleotide
taatacgactcactatagggtgaaatcacgagatgatcgtacttagctagaacagaggagactagctatgtacgatcataacctggcggcagcgcaaaagatg

SEQ ID NO: 25201 - DNA, 103 bp, Artificial Sequence
  Synthetic Polynucleotide
taatacgactcactatagggccagttgaaatcacgagatgatcgtacttaaacagaggagataagtaatgtcatctcgtaacctggcggcagcgcaaaagatg

SEQ ID NO: 25202 - DNA, 103 bp, Artificial Sequence
  Synthetic Polynucleotide
taatacgactcactatagggttcttccagttgaaatcacgagatgatcgtaacagaggagaacgatcatgtcgtgatttaacctggcggcagcgcaaaagatg

SEQ ID NO: 25203 - DNA, 103 bp, Artificial Sequence
  Synthetic Polynucleotide
taatacgactcactatagggggtggttcttccagttgaaatcacgagatgaacagaggagacatctcatgatttcaactaacctggcggcagcgcaaaagatg

SEQ ID NO: 25204 - DNA, 103 bp, Artificial Sequence
  Synthetic Polynucleotide
taatacgactcactatagggtagcccgcgtcccgcagatattttgcaataaacagaggagatattgcatgatatctgcgaacctggcggcagcgcaaaagatg

SEQ ID NO: 25205 - DNA, 103 bp, Artificial Sequence
  Synthetic Polynucleotide
taatacgactcactatagggggtgcggtggttcttccagttgaaatcacgaacagaggagacgtgatatgaactggaagaacctggcggcagcgcaaaagatg

SEQ ID NO: 25206 - DNA, 103 bp, Artificial Sequence
  Synthetic Polynucleotide
taatacgactcactatagggcagctggtgcggtggttcttccagttgaaaaacagaggagatttcaaatggaagaaccaaacctggcggcagcgcaaaagatg

SEQ ID NO: 25207 - DNA, 103 bp, Artificial Sequence
  Synthetic Polynucleotide
taatacgactcactatagggggcagcagctggtgcggtggttcttccagtaacagaggagaactggaatgaccaccgcaaacctggcggcagcgcaaaagatg

SEQ ID NO: 25208 - DNA, 103 bp, Artificial Sequence
  Synthetic Polynucleotide
taatacgactcactatagggtcaaaggcagcagctggtgcggtggttcttaacagaggagaaagaacatgcgcaccagcaacctggcggcagcgcaaaagatg

SEQ ID NO: 25209 - DNA, 103 bp, Artificial Sequence
  Synthetic Polynucleotide
taatacgactcactatagggaagcatcaaaggcagcagctggtgcggtggaacagaggagaccaccgatgcagctgctgaacctggcggcagcgcaaaagatg

SEQ ID NO: 25210 - DNA, 103 bp, Artificial Sequence
  Synthetic Polynucleotide
taatacgactcactatagggtaagtaagcatcaaaggcagcagctggtgcaacagaggagagcaccaatggctgcctttaacctggcggcagcgcaaaagatg

SEQ ID NO: 25211 - DNA, 103 bp, Artificial Sequence
  Synthetic Polynucleotide
taatacgactcactatagggtcgtttaagtaagcatcaaaggcagcagctaacagaggagaagctgcatgctttgatgcaacctggcggcagcgcaaaagatg

SEQ ID NO: 25212 - DNA, 103 bp, Artificial Sequence
  Synthetic Polynucleotide
taatacgactcactatagggcatgctcgtttaagtaagcatcaaaggcagaacagaggagactgcctatgatgcttactaacctggcggcagcgcaaaagatg

SEQ ID NO: 25213 - DNA, 103 bp, Artificial Sequence
  Synthetic Polynucleotide
taatacgactcactataggggactccatgctcgtttaagtaagcatcaaaaacagaggagatttgatatgtacttaaacaacctggcggcagcgcaaaagatg

SEQ ID NO: 25214 - DNA, 103 bp, Artificial Sequence
  Synthetic Polynucleotide
taatacgactcactatagggggggggactccatgctcgtttaagtaagcaaacagaggagatgcttaatgaaacgagcaaacctggcggcagcgcaaaagatg

SEQ ID NO: 25215 - DNA, 103 bp, Artificial Sequence
  Synthetic Polynucleotide
taatacgactcactatagggactcatagcccgcgtcccgcagatattttgaacagaggagacaaaatatgtgcgggacgaacctggcggcagcgcaaaagatg

SEQ ID NO: 25216 - DNA, 103 bp, Artificial Sequence
  Synthetic Polynucleotide
taatacgactcactataggggagggggggggactccatgctcgtttaagtaacagaggagaacttaaatgagcatggagaacctggcggcagcgcaaaagatg

SEQ ID NO: 25217 - DNA, 103 bp, Artificial Sequence
  Synthetic Polynucleotide
taatacgactcactatagggaggctgagggggggggactccatgctcgttaacagaggagaaacgagatgggagtccccaacctggcggcagcgcaaaagatg

SEQ ID NO: 25218 - DNA, 103 bp, Artificial Sequence
  Synthetic Polynucleotide
taatacgactcactatagggattgcaggctgagggggggggactccatgcaacagaggagagcatggatgcccccccccaacctggcggcagcgcaaaagatg

SEQ ID NO: 25219 - DNA, 103 bp, Artificial Sequence
  Synthetic Polynucleotide
taatacgactcactatagggtgaagattgcaggctgagggggggggactcaacagaggagagagtccatgcccctcagcaacctggcggcagcgcaaaagatg

SEQ ID NO: 25220 - DNA, 103 bp, Artificial Sequence
  Synthetic Polynucleotide
taatacgactcactatagggatctttgaagattgcaggctgaggggggggaacagaggagaccccccatgcagcctgcaaacctggcggcagcgcaaaagatg

SEQ ID NO: 25221 - DNA, 103 bp, Artificial Sequence
  Synthetic Polynucleotide
taatacgactcactatagggccaagatctttgaagattgcaggctgagggaacagaggagaccctcaatgtgcaatcttaacctggcggcagcgcaaaagatg

SEQ ID NO: 25222 - DNA, 103 bp, Artificial Sequence
  Synthetic Polynucleotide
taatacgactcactatagggcaactccaagatctttgaagattgcaggctaacagaggagaagcctgatgtcttcaaagaacctggcggcagcgcaaaagatg

SEQ ID NO: 25223 - DNA, 103 bp, Artificial Sequence
  Synthetic Polynucleotide
taatacgactcactatagggttgggcaactccaagatctttgaagattgcaacagaggagagcaatcatgaaagatcttaacctggcggcagcgcaaaagatg

SEQ ID NO: 25224 - DNA, 103 bp, Artificial Sequence
  Synthetic Polynucleotide
taatacgactcactataggggcttgttgggcaactccaagatctttgaagaacagaggagacttcaaatgtcttggagtaacctggcggcagcgcaaaagatg

SEQ ID NO: 25225 - DNA, 103 bp, Artificial Sequence
  Synthetic Polynucleotide
taatacgactcactatagggtgtaggcttgttgggcaactccaagatcttaacagaggagaaagatcatggagttgcccaacctggcggcagcgcaaaagatg

SEQ ID NO: 25226 - DNA, 103 bp, Artificial Sequence
  Synthetic Polynucleotide
taatacgactcactatagggatcaaactcatagcccgcgtcccgcagataaacagaggagatatctgatggacgcgggcaacctggcggcagcgcaaaagatg

SEQ ID NO: 25227 - DNA, 103 bp, Artificial Sequence
  Synthetic Polynucleotide
taatacgactcactatagggttgactgtaggcttgttgggcaactccaagaacagaggagacttggaatggcccaacaaaacctggcggcagcgcaaaagatg

SEQ ID NO: 25228 - DNA, 103 bp, Artificial Sequence
  Synthetic Polynucleotide
taatacgactcactataggggtcttttgactgtaggcttgttgggcaactaacagaggagaagttgcatgacaagcctaaacctggcggcagcgcaaaagatg

SEQ ID NO: 25229 - DNA, 103 bp, Artificial Sequence
  Synthetic Polynucleotide
taatacgactcactatagggccatagtcttttgactgtaggcttgttgggaacagaggagacccaacatgcctacagtcaacctggcggcagcgcaaaagatg

SEQ ID NO: 25230 - DNA, 103 bp, Artificial Sequence
  Synthetic Polynucleotide
taatacgactcactatagggtttgaccatagtcttttgactgtaggcttgaacagaggagacaagccatgagtcaaaagaacctggcggcagcgcaaaagatg

SEQ ID NO: 25231 - DNA, 103 bp, Artificial Sequence
  Synthetic Polynucleotide
taatacgactcactatagggtggtttttgaccatagtcttttgactgtagaacagaggagactacagatgaaagactataacctggcggcagcgcaaaagatg

SEQ ID NO: 25232 - DNA, 103 bp, Artificial Sequence
  Synthetic Polynucleotide
taatacgactcactatagggttgtttggtttttgaccatagtcttttgacaacagaggagagtcaaaatgctatggtcaaacctggcggcagcgcaaaagatg

SEQ ID NO: 25233 - DNA, 103 bp, Artificial Sequence
  Synthetic Polynucleotide
taatacgactcactatagggatctgttgtttggtttttgaccatagtcttaacagaggagaaagactatggtcaaaaacaacctggcggcagcgcaaaagatg

SEQ ID NO: 25234 - DNA, 103 bp, Artificial Sequence
  Synthetic Polynucleotide
taatacgactcactataggggctgcatctgttgtttggtttttgaccataaacagaggagatatggtatgaaaccaaacaacctggcggcagcgcaaaagatg

SEQ ID NO: 25235 - DNA, 103 bp, Artificial Sequence
  Synthetic Polynucleotide
taatacgactcactatagggtgtcagctgcatctgttgtttggtttttgaaacagaggagatcaaaaatgaaacaacagaacctggcggcagcgcaaaagatg

SEQ ID NO: 25236 - DNA, 103 bp, Artificial Sequence
  Synthetic Polynucleotide
taatacgactcactatagggcattttgtcagctgcatctgttgtttggttaacagaggagaaaccaaatgacagatgcaaacctggcggcagcgcaaaagatg

SEQ ID NO: 25237 - DNA, 103 bp, Artificial Sequence
  Synthetic Polynucleotide
taatacgactcactatagggttaatattcttctttatttatatgatacacaacagaggagagtgtatatgataaataaaaacctggcggcagcgcaaaagatg

SEQ ID NO: 25238 - DNA, 103 bp, Artificial Sequence
  Synthetic Polynucleotide
taatacgactcactatagggatgacatcaaactcatagcccgcgtcccgcaacagaggagagcgggaatggggctatgaaacctggcggcagcgcaaaagatg

SEQ ID NO: 25239 - DNA, 103 bp, Artificial Sequence
  Synthetic Polynucleotide
taatacgactcactatagggtttgacattttgtcagctgcatctgttgttaacagaggagaaacaacatgtgcagctgaaacctggcggcagcgcaaaagatg

SEQ ID NO: 25240 - DNA, 103 bp, Artificial Sequence
  Synthetic Polynucleotide
taatacgactcactataggggaacctttgacattttgtcagctgcatctgaacagaggagacagatgatgctgacaaaaaacctggcggcagcgcaaaagatg

SEQ ID NO: 25241 - DNA, 103 bp, Artificial Sequence
  Synthetic Polynucleotide
taatacgactcactatagggttccagaacctttgacattttgtcagctgcaacagaggagagcagctatgaaaatgtcaaacctggcggcagcgcaaaagatg

SEQ ID NO: 25242 - DNA, 103 bp, Artificial Sequence
  Synthetic Polynucleotide
taatacgactcactatagggctgagttccagaacctttgacattttgtcaaacagaggagatgacaaatggtcaaaggtaacctggcggcagcgcaaaagatg

SEQ ID NO: 25243 - DNA, 103 bp, Artificial Sequence
  Synthetic Polynucleotide
taatacgactcactatagggcttcactgagttccagaacctttgacatttaacagaggagaaaatgtatgaggttctggaacctggcggcagcgcaaaagatg

SEQ ID NO: 25244 - DNA, 103 bp, Artificial Sequence
  Synthetic Polynucleotide
taatacgactcactatagggtgtttcttcactgagttccagaacctttgaaacagaggagatcaaagatgctggaactcaacctggcggcagcgcaaaagatg

SEQ ID NO: 25245 - DNA, 103 bp, Artificial Sequence
  Synthetic Polynucleotide
taatacgactcactataggggaaaatgtttcttcactgagttccagaaccaacagaggagaggttctatgactcagtgaaacctggcggcagcgcaaaagatg

SEQ ID NO: 25246 - DNA, 103 bp, Artificial Sequence
  Synthetic Polynucleotide
taatacgactcactataggggcttggaaaatgtttcttcactgagttccaaacagaggagatggaacatggtgaagaaaaacctggcggcagcgcaaaagatg

SEQ ID NO: 25247 - DNA, 103 bp, Artificial Sequence
  Synthetic Polynucleotide
taatacgactcactataggggtttggcttggaaaatgtttcttcactgagaacagaggagactcagtatggaaacatttaacctggcggcagcgcaaaagatg

SEQ ID NO: 25248 - DNA, 103 bp, Artificial Sequence
  Synthetic Polynucleotide
taatacgactcactataggggaaaggtttggcttggaaaatgtttcttcaaacagaggagatgaagaatgattttccaaaacctggcggcagcgcaaaagatg

SEQ ID NO: 25249 - DNA, 103 bp, Artificial Sequence
  Synthetic Polynucleotide
taatacgactcactatagggtcttgatgacatcaaactcatagcccgcgtaacagaggagaacgcggatgatgagtttgaacctggcggcagcgcaaaagatg

SEQ ID NO: 25250 - DNA, 103 bp, Artificial Sequence
  Synthetic Polynucleotide
taatacgactcactatagggtagctgaaaggtttggcttggaaaatgtttaacagaggagaaaacatatgccaagccaaaacctggcggcagcgcaaaagatg

SEQ ID NO: 25251 - DNA, 103 bp, Artificial Sequence
  Synthetic Polynucleotide
taatacgactcactatagggatccttagctgaaaggtttggcttggaaaaaacagaggagattttccatgccaaaccttaacctggcggcagcgcaaaagatg

SEQ ID NO: 25252 - DNA, 103 bp, Artificial Sequence
  Synthetic Polynucleotide
taatacgactcactataggggctaaatccttagctgaaaggtttggcttgaacagaggagacaagccatgcctttcagcaacctggcggcagcgcaaaagatg

SEQ ID NO: 25253 - DNA, 103 bp, Artificial Sequence
  Synthetic Polynucleotide
taatacgactcactatagggatagagctaaatccttagctgaaaggtttgaacagaggagacaaaccatgcagctaaggaacctggcggcagcgcaaaagatg

SEQ ID NO: 25254 - DNA, 103 bp, Artificial Sequence
  Synthetic Polynucleotide
taatacgactcactatagggtaataatagagctaaatccttagctgaaagaacagaggagactttcaatgaaggatttaaacctggcggcagcgcaaaagatg

SEQ ID NO: 25255 - DNA, 103 bp, Artificial Sequence
  Synthetic Polynucleotide
taatacgactcactataggggtaaataataatagagctaaatccttagctaacagaggagaagctaaatgtttagctctaacctggcggcagcgcaaaagatg

SEQ ID NO: 25256 - DNA, 103 bp, Artificial Sequence
  Synthetic Polynucleotide
taatacgactcactataggggatgagtaaataataatagagctaaatcctaacagaggagaaggattatgctctattataacctggcggcagcgcaaaagatg

SEQ ID NO: 25257 - DNA, 103 bp, Artificial Sequence
  Synthetic Polynucleotide
taatacgactcactatagggagggagatgagtaaataataatagagctaaaacagaggagattagctatgttattatttaacctggcggcagcgcaaaagatg

SEQ ID NO: 25258 - DNA, 103 bp, Artificial Sequence
  Synthetic Polynucleotide
taatacgactcactatagggttgccagggagatgagtaaataataatagaaacagaggagatctattatgatttactcaaacctggcggcagcgcaaaagatg

SEQ ID NO: 25259 - DNA, 103 bp, Artificial Sequence
  Synthetic Polynucleotide
taatacgactcactatagggtgttgttgccagggagatgagtaaataataaacagaggagatattatatgctcatctccaacctggcggcagcgcaaaagatg

SEQ ID NO: 25260 - DNA, 103 bp, Artificial Sequence
  Synthetic Polynucleotide
taatacgactcactatagggaggattcttgatgacatcaaactcatagccaacagaggagaggctatatgtttgatgtcaacctggcggcagcgcaaaagatg

SEQ ID NO: 25261 - DNA, 103 bp, Artificial Sequence
  Synthetic Polynucleotide
taatacgactcactatagggtggagtgttgttgccagggagatgagtaaaaacagaggagatttactatgctccctggcaacctggcggcagcgcaaaagatg

SEQ ID NO: 25262 - DNA, 103 bp, Artificial Sequence
  Synthetic Polynucleotide
taatacgactcactatagggtggaatggagtgttgttgccagggagatgaaacagaggagatcatctatgtggcaacaaaacctggcggcagcgcaaaagatg

SEQ ID NO: 25263 - DNA, 103 bp, Artificial Sequence
  Synthetic Polynucleotide
taatacgactcactataggggtatgtggaatggagtgttgttgccagggaaacagaggagatccctgatgacaacactcaacctggcggcagcgcaaaagatg

SEQ ID NO: 25264 - DNA, 103 bp, Artificial Sequence
  Synthetic Polynucleotide
taatacgactcactatagggggcgagtatgtggaatggagtgttgttgccaacagaggagaggcaacatgactccattcaacctggcggcagcgcaaaagatg

SEQ ID NO: 25265 - DNA, 103 bp, Artificial Sequence
  Synthetic Polynucleotide
taatacgactcactatagggacttgggcgagtatgtggaatggagtgttgaacagaggagacaacacatgattccacataacctggcggcagcgcaaaagatg

SEQ ID NO: 25266 - DNA, 103 bp, Artificial Sequence
  Synthetic Polynucleotide
taatacgactcactatagggaaaggacttgggcgagtatgtggaatggagaacagaggagactccatatgacatactcgaacctggcggcagcgcaaaagatg

SEQ ID NO: 25267 - DNA, 103 bp, Artificial Sequence
  Synthetic Polynucleotide
taatacgactcactatagggttttgaaaggacttgggcgagtatgtggaaaacagaggagattccacatgctcgcccaaaacctggcggcagcgcaaaagatg

SEQ ID NO: 25268 - DNA, 103 bp, Artificial Sequence
  Synthetic Polynucleotide
taatacgactcactataggggcaatttttgaaaggacttgggcgagtatgaacagaggagacatactatgccaagtcctaacctggcggcagcgcaaaagatg

SEQ ID NO: 25269 - DNA, 103 bp, Artificial Sequence
  Synthetic Polynucleotide
taatacgactcactatagggtgtaagcaatttttgaaaggacttgggcgaaacagaggagatcgcccatgtcctttcaaaacctggcggcagcgcaaaagatg

SEQ ID NO: 25270 - DNA, 103 bp, Artificial Sequence
  Synthetic Polynucleotide
taatacgactcactatagggtgatttgtaagcaatttttgaaaggacttgaacagaggagacaagtcatgtcaaaaattaacctggcggcagcgcaaaagatg

SEQ ID NO: 25271 - DNA, 103 bp, Artificial Sequence
  Synthetic Polynucleotide
taatacgactcactataggggcatcaggattcttgatgacatcaaactcaaacagaggagatgagttatgtgtcatcaaaacctggcggcagcgcaaaagatg

SEQ ID NO: 25272 - DNA, 103 bp, Artificial Sequence
  Synthetic Polynucleotide
taatacgactcactatagggtttcctgatttgtaagcaatttttgaaaggaacagaggagacctttcatgaattgcttaaacctggcggcagcgcaaaagatg

SEQ ID NO: 25273 - DNA, 103 bp, Artificial Sequence
  Synthetic Polynucleotide
taatacgactcactatagggcagactttcctgatttgtaagcaatttttgaacagaggagacaaaaaatgcttacaaataacctggcggcagcgcaaaagatg

SEQ ID NO: 25274 - DNA, 103 bp, Artificial Sequence
  Synthetic Polynucleotide
taatacgactcactatagggtgctccagactttcctgatttgtaagcaataacagaggagaattgctatgaaatcaggaaacctggcggcagcgcaaaagatg

SEQ ID NO: 25275 - DNA, 103 bp, Artificial Sequence
  Synthetic Polynucleotide
taatacgactcactatagggaagaatgctccagactttcctgatttgtaaaacagaggagattacaaatgaggaaagtcaacctggcggcagcgcaaaagatg

SEQ ID NO: 25276 - DNA, 103 bp, Artificial Sequence
  Synthetic Polynucleotide
taatacgactcactatagggcatccaagaatgctccagactttcctgattaacagaggagaaatcagatgagtctggagaacctggcggcagcgcaaaagatg

SEQ ID NO: 25277 - DNA, 103 bp, Artificial Sequence
  Synthetic Polynucleotide
taatacgactcactataggggaatgcatccaagaatgctccagactttccaacagaggagaggaaagatgggagcattcaacctggcggcagcgcaaaagatg

SEQ ID NO: 25278 - DNA, 103 bp, Artificial Sequence
  Synthetic Polynucleotide
taatacgactcactatagggtgatggaatgcatccaagaatgctccagacaacagaggagagtctggatgattcttggaaacctggcggcagcgcaaaagatg

SEQ ID NO: 25279 - DNA, 103 bp, Artificial Sequence
  Synthetic Polynucleotide
taatacgactcactatagggaaatctgatggaatgcatccaagaatgctcaacagaggagagagcatatgtggatgcataacctggcggcagcgcaaaagatg

SEQ ID NO: 25280 - DNA, 103 bp, Artificial Sequence
  Synthetic Polynucleotide
taatacgactcactataggggcttaaaatctgatggaatgcatccaagaaaacagaggagattcttgatggcattccataacctggcggcagcgcaaaagatg

SEQ ID NO: 25281 - DNA, 103 bp, Artificial Sequence
  Synthetic Polynucleotide
taatacgactcactatagggccttcgcttaaaatctgatggaatgcatccaacagaggagaggatgcatgccatcagataacctggcggcagcgcaaaagatg

SEQ ID NO: 25282 - DNA, 103 bp, Artificial Sequence
  Synthetic Polynucleotide
taatacgactcactataggggagttgcatcaggattcttgatgacatcaaaacagaggagattgatgatgtcaagaatcaacctggcggcagcgcaaaagatg

SEQ ID NO: 25283 - DNA, 103 bp, Artificial Sequence
  Synthetic Polynucleotide
taatacgactcactatagggtctccccttcgcttaaaatctgatggaatgaacagaggagacattccatgagattttaaaacctggcggcagcgcaaaagatg

SEQ ID NO: 25284 - DNA, 103 bp, Artificial Sequence
  Synthetic Polynucleotide
taatacgactcactatagggagcattctccccttcgcttaaaatctgatgaacagaggagacatcagatgttaagcgaaaacctggcggcagcgcaaaagatg

SEQ ID NO: 25285 - DNA, 103 bp, Artificial Sequence
  Synthetic Polynucleotide
taatacgactcactataggggcctgagcattctccccttcgcttaaaatcaacagaggagagattttatgcgaaggggaaacctggcggcagcgcaaaagatg

SEQ ID NO: 25286 - DNA, 103 bp, Artificial Sequence
  Synthetic Polynucleotide
taatacgactcactatagggatgcagcctgagcattctccccttcgcttaaacagaggagataagcgatggggagaatgaacctggcggcagcgcaaaagatg

SEQ ID NO: 25287 - DNA, 103 bp, Artificial Sequence
  Synthetic Polynucleotide
taatacgactcactatagggggttaatgcagcctgagcattctccccttcaacagaggagagaagggatgaatgctcagaacctggcggcagcgcaaaagatg

SEQ ID NO: 25288 - DNA, 103 bp, Artificial Sequence
  Synthetic Polynucleotide
taatacgactcactatagggaatcgggttaatgcagcctgagcattctccaacagaggagaggagaaatgtcaggctgcaacctggcggcagcgcaaaagatg

SEQ ID NO: 25289 - DNA, 103 bp, Artificial Sequence
  Synthetic Polynucleotide
taatacgactcactatagggtgcttaatcgggttaatgcagcctgagcataacagaggagaatgctcatgctgcattaaaacctggcggcagcgcaaaagatg

SEQ ID NO: 25290 - DNA, 103 bp, Artificial Sequence
  Synthetic Polynucleotide
taatacgactcactatagggtgttctgcttaatcgggttaatgcagcctgaacagaggagacaggctatgttaacccgaaacctggcggcagcgcaaaagatg

SEQ ID NO: 25291 - DNA, 103 bp, Artificial Sequence
  Synthetic Polynucleotide
taatacgactcactatagggtcgaatgttctgcttaatcgggttaatgcaaacagaggagatgcattatgccgattaagaacctggcggcagcgcaaaagatg

SEQ ID NO: 25292 - DNA, 103 bp, Artificial Sequence
  Synthetic Polynucleotide
taatacgactcactatagggaagcatcgaatgttctgcttaatcgggttaaacagaggagataacccatgtaagcagaaaacctggcggcagcgcaaaagatg

SEQ ID NO: 25293 - DNA, 103 bp, Artificial Sequence
  Synthetic Polynucleotide
taatacgactcactatagggaaagcgagttgcatcaggattcttgatgacaacagaggagagtcatcatgaatcctgataacctggcggcagcgcaaaagatg

SEQ ID NO: 25294 - DNA, 103 bp, Artificial Sequence
  Synthetic Polynucleotide
taatacgactcactatagggaaggaaagcatcgaatgttctgcttaatcgaacagaggagacgattaatgagaacattcaacctggcggcagcgcaaaagatg

SEQ ID NO: 25295 - DNA, 103 bp, Artificial Sequence
  Synthetic Polynucleotide
taatacgactcactataggggctccaaggaaagcatcgaatgttctgcttaacagaggagaaagcagatgattcgatgcaacctggcggcagcgcaaaagatg

SEQ ID NO: 25296 - DNA, 103 bp, Artificial Sequence
  Synthetic Polynucleotide
taatacgactcactataggggaactgctccaaggaaagcatcgaatgttcaacagaggagagaacatatgatgctttccaacctggcggcagcgcaaaagatg

SEQ ID NO: 25297 - DNA, 103 bp, Artificial Sequence
  Synthetic Polynucleotide
taatacgactcactatagggtggaggaactgctccaaggaaagcatcgaaaacagaggagattcgatatgttccttggaaacctggcggcagcgcaaaagatg

SEQ ID NO: 25298 - DNA, 103 bp, Artificial Sequence
  Synthetic Polynucleotide
taatacgactcactatagggattactggaggaactgctccaaggaaagcaaacagaggagatgctttatgtggagcagtaacctggcggcagcgcaaaagatg

SEQ ID NO: 25299 - DNA, 103 bp, Artificial Sequence
  Synthetic Polynucleotide
taatacgactcactatagggcttttattactggaggaactgctccaaggaaacagaggagatccttgatgcagttcctcaacctggcggcagcgcaaaagatg

SEQ ID NO: 25300 - DNA, 103 bp, Artificial Sequence
  Synthetic Polynucleotide
taatacgactcactatagggtttaacttttattactggaggaactgctccaacagaggagaggagcaatgcctccagtaaacctggcggcagcgcaaaagatg

SEQ ID NO: 25301 - DNA, 103 bp, Artificial Sequence
  Synthetic Polynucleotide
taatacgactcactatagggaagtttttaacttttattactggaggaactaacagaggagaagttccatgagtaataaaaacctggcggcagcgcaaaagatg

SEQ ID NO: 25302 - DNA, 103 bp, Artificial Sequence
  Synthetic Polynucleotide
taatacgactcactatagggtttgaaagtttttaacttttattactggagaacagaggagactccagatgtaaaagttaaacctggcggcagcgcaaaagatg

SEQ ID NO: 25303 - DNA, 103 bp, Artificial Sequence
  Synthetic Polynucleotide
taatacgactcactataggggaccgtttgaaagtttttaacttttattacaacagaggagagtaataatggttaaaaacaacctggcggcagcgcaaaagatg

SEQ ID NO: 25304 - DNA, 103 bp, Artificial Sequence
  Synthetic Polynucleotide
taatacgactcactatagggtctagaaagcgagttgcatcaggattcttgaacagaggagacaagaaatgtgatgcaacaacctggcggcagcgcaaaagatg

SEQ ID NO: 25305 - DNA, 103 bp, Artificial Sequence
  Synthetic Polynucleotide
taatacgactcactatagggcgggggaccgtttgaaagtttttaacttttaacagaggagaaaaagtatgaaactttcaaacctggcggcagcgcaaaagatg

SEQ ID NO: 25306 - DNA, 103 bp, Artificial Sequence
  Synthetic Polynucleotide
taatacgactcactatagggaagggcgggggaccgtttgaaagtttttaaaacagaggagattaaaaatgttcaaacggaacctggcggcagcgcaaaagatg

SEQ ID NO: 25307 - DNA, 103 bp, Artificial Sequence
  Synthetic Polynucleotide
taatacgactcactatagggttgacaagggcgggggaccgtttgaaagttaacagaggagaaactttatgacggtccccaacctggcggcagcgcaaaagatg

SEQ ID NO: 25308 - DNA, 103 bp, Artificial Sequence
  Synthetic Polynucleotide
taatacgactcactatagggcttttttgacaagggcgggggaccgtttgaaacagaggagatcaaacatgcccccgcccaacctggcggcagcgcaaaagatg

SEQ ID NO: 25309 - DNA, 103 bp, Artificial Sequence
  Synthetic Polynucleotide
taatacgactcactatagggggaggcttttttgacaagggcgggggaccgaacagaggagacggtccatggcccttgtcaacctggcggcagcgcaaaagatg

SEQ ID NO: 25310 - DNA, 103 bp, Artificial Sequence
  Synthetic Polynucleotide
taatacgactcactatagggagctcggaggcttttttgacaagggcggggaacagaggagaccccgcatgtgtcaaaaaaacctggcggcagcgcaaaagatg

SEQ ID NO: 25311 - DNA, 103 bp, Artificial Sequence
  Synthetic Polynucleotide
taatacgactcactatagggggaacagctcggaggcttttttgacaagggaacagaggagacccttgatgaaaaagcctaacctggcggcagcgcaaaagatg

SEQ ID NO: 25312 - DNA, 103 bp, Artificial Sequence
  Synthetic Polynucleotide
taatacgactcactatagggttgggggaacagctcggaggcttttttgacaacagaggagagtcaaaatggcctccgagaacctggcggcagcgcaaaagatg

SEQ ID NO: 25313 - DNA, 103 bp, Artificial Sequence
  Synthetic Polynucleotide
taatacgactcactatagggtggatttgggggaacagctcggaggcttttaacagaggagaaaaagcatgcgagctgttaacctggcggcagcgcaaaagatg

SEQ ID NO: 25314 - DNA, 103 bp, Artificial Sequence
  Synthetic Polynucleotide
taatacgactcactatagggattgttggatttgggggaacagctcggaggaacagaggagacctccgatgtgttcccccaacctggcggcagcgcaaaagatg

SEQ ID NO: 25315 - DNA, 103 bp, Artificial Sequence
  Synthetic Polynucleotide
taatacgactcactatagggtaacctctagaaagcgagttgcatcaggataacagaggagaatcctgatgcaactcgctaacctggcggcagcgcaaaagatg

SEQ ID NO: 25316 - DNA, 103 bp, Artificial Sequence
  Synthetic Polynucleotide
taatacgactcactatagggtgtcaattgttggatttgggggaacagctcaacagaggagagagctgatgccccaaatcaacctggcggcagcgcaaaagatg

SEQ ID NO: 25317 - DNA, 103 bp, Artificial Sequence
  Synthetic Polynucleotide
taatacgactcactatagggtcccttgtcaattgttggatttgggggaacaacagaggagagttcccatgaatccaacaaacctggcggcagcgcaaaagatg

SEQ ID NO: 25318 - DNA, 103 bp, Artificial Sequence
  Synthetic Polynucleotide
taatacgactcactatagggacccatcccttgtcaattgttggatttgggaacagaggagacccaaaatgaacaattgaaacctggcggcagcgcaaaagatg

SEQ ID NO: 25319 - DNA, 103 bp, Artificial Sequence
  Synthetic Polynucleotide
taatacgactcactatagggcacagacccatcccttgtcaattgttggataacagaggagaatccaaatgttgacaaggaacctggcggcagcgcaaaagatg

SEQ ID NO: 25320 - DNA, 103 bp, Artificial Sequence
  Synthetic Polynucleotide
taatacgactcactatagggatagacacagacccatcccttgtcaattgtaacagaggagaacaattatgaagggatggaacctggcggcagcgcaaaagatg

SEQ ID NO: 25321 - DNA, 103 bp, Artificial Sequence
  Synthetic Polynucleotide
taatacgactcactataggggatgaatagacacagacccatcccttgtcaaacagaggagatgacaaatgatgggtctgaacctggcggcagcgcaaaagatg

SEQ ID NO: 25322 - DNA, 103 bp, Artificial Sequence
  Synthetic Polynucleotide
taatacgactcactataggggttcagatgaatagacacagacccatccctaacagaggagaagggatatgtctgtgtctaacctggcggcagcgcaaaagatg

SEQ ID NO: 25323 - DNA, 103 bp, Artificial Sequence
  Synthetic Polynucleotide
taatacgactcactatagggaccctgttcagatgaatagacacagacccaaacagaggagatgggtcatggtctattcaaacctggcggcagcgcaaaagatg

SEQ ID NO: 25324 - DNA, 103 bp, Artificial Sequence
  Synthetic Polynucleotide
taatacgactcactataggggtttcaccctgttcagatgaatagacacagaacagaggagactgtgtatgttcatctgaaacctggcggcagcgcaaaagatg

SEQ ID NO: 25325 - DNA, 103 bp, Artificial Sequence
  Synthetic Polynucleotide
taatacgactcactatagggcccgggtttcaccctgttcagatgaatagaaacagaggagatctattatgctgaacaggaacctggcggcagcgcaaaagatg

SEQ ID NO: 25326 - DNA, 103 bp, Artificial Sequence
  Synthetic Polynucleotide
taatacgactcactataggggggaataacctctagaaagcgagttgcatcaacagaggagagatgcaatgcgctttctaaacctggcggcagcgcaaaagatg

SEQ ID NO: 25327 - DNA, 103 bp, Artificial Sequence
  Synthetic Polynucleotide
taatacgactcactatagggaagagcccgggtttcaccctgttcagatgaaacagaggagatcatctatgcagggtgaaaacctggcggcagcgcaaaagatg

SEQ ID NO: 25328 - DNA, 103 bp, Artificial Sequence
  Synthetic Polynucleotide
taatacgactcactatagggattttaagagcccgggtttcaccctgttcaaacagaggagatgaacaatgtgaaacccgaacctggcggcagcgcaaaagatg

SEQ ID NO: 25329 - DNA, 103 bp, Artificial Sequence
  Synthetic Polynucleotide
taatacgactcactatagggattagattttaagagcccgggtttcaccctaacagaggagaagggtgatgcccgggctcaacctggcggcagcgcaaaagatg

SEQ ID NO: 25330 - DNA, 103 bp, Artificial Sequence
  Synthetic Polynucleotide
taatacgactcactatagggcaaggattagattttaagagcccgggtttcaacagaggagagaaaccatggctcttaaaaacctggcggcagcgcaaaagatg

SEQ ID NO: 25331 - DNA, 103 bp, Artificial Sequence
  Synthetic Polynucleotide
taatacgactcactatagggaatcgcaaggattagattttaagagcccggaacagaggagaccgggcatgtaaaatctaaacctggcggcagcgcaaaagatg

SEQ ID NO: 25332 - DNA, 103 bp, Artificial Sequence
  Synthetic Polynucleotide
taatacgactcactataggggaatgaatcgcaaggattagattttaagagaacagaggagactcttaatgtctaatcctaacctggcggcagcgcaaaagatg

SEQ ID NO: 25333 - DNA, 103 bp, Artificial Sequence
  Synthetic Polynucleotide
taatacgactcactatagggttcaagaatgaatcgcaaggattagattttaacagaggagaaaaatcatgtccttgcgaaacctggcggcagcgcaaaagatg

SEQ ID NO: 25334 - DNA, 103 bp, Artificial Sequence
  Synthetic Polynucleotide
taatacgactcactatagggctttgttcaagaatgaatcgcaaggattagaacagaggagactaatcatggcgattcataacctggcggcagcgcaaaagatg

SEQ ID NO: 25335 - DNA, 103 bp, Artificial Sequence
  Synthetic Polynucleotide
taatacgactcactatagggtcattctttgttcaagaatgaatcgcaaggaacagaggagaccttgcatgtcattcttgaacctggcggcagcgcaaaagatg

SEQ ID NO: 25336 - DNA, 103 bp, Artificial Sequence
  Synthetic Polynucleotide
taatacgactcactatagggaaagatcattctttgttcaagaatgaatcgaacagaggagacgattcatgcttgaacaaaacctggcggcagcgcaaaagatg

SEQ ID NO: 25337 - DNA, 103 bp, Artificial Sequence
  Synthetic Polynucleotide
taatacgactcactatagggtcattgggaataacctctagaaagcgagttaacagaggagaaactcgatgtctagaggtaacctggcggcagcgcaaaagatg

SEQ ID NO: 25338 - DNA, 103 bp, Artificial Sequence
  Synthetic Polynucleotide
taatacgactcactatagggcctagaaagatcattctttgttcaagaatgaacagaggagacattctatgacaaagaataacctggcggcagcgcaaaagatg

SEQ ID NO: 25339 - DNA, 103 bp, Artificial Sequence
  Synthetic Polynucleotide
taatacgactcactatagggattaacctagaaagatcattctttgttcaaaacagaggagattgaacatggaatgatctaacctggcggcagcgcaaaagatg

SEQ ID NO: 25340 - DNA, 103 bp, Artificial Sequence
  Synthetic Polynucleotide
taatacgactcactatagggtttgtattaacctagaaagatcattctttgaacagaggagacaaagaatgatctttctaaacctggcggcagcgcaaaagatg

SEQ ID NO: 25341 - DNA, 103 bp, Artificial Sequence
  Synthetic Polynucleotide
taatacgactcactataggggtgtttttgtattaacctagaaagatcattaacagaggagaaatgatatgtctaggttaaacctggcggcagcgcaaaagatg

SEQ ID NO: 25342 - DNA, 103 bp, Artificial Sequence
  Synthetic Polynucleotide
taatacgactcactataggggtttagtgtttttgtattaacctagaaagaaacagaggagatctttcatggttaatacaaacctggcggcagcgcaaaagatg

SEQ ID NO: 25343 - DNA, 103 bp, Artificial Sequence
  Synthetic Polynucleotide
taatacgactcactataggggaaatgtttagtgtttttgtattaacctagaacagaggagactaggtatgtacaaaaacaacctggcggcagcgcaaaagatg

SEQ ID NO: 25344 - DNA, 103 bp, Artificial Sequence
  Synthetic Polynucleotide
taatacgactcactatagggctcttgaaatgtttagtgtttttgtattaaaacagaggagattaataatgaaacactaaaacctggcggcagcgcaaaagatg

SEQ ID NO: 25345 - DNA, 103 bp, Artificial Sequence
  Synthetic Polynucleotide
taatacgactcactatagggacaaactcttgaaatgtttagtgtttttgtaacagaggagaacaaaaatgctaaacattaacctggcggcagcgcaaaagatg

SEQ ID NO: 25346 - DNA, 103 bp, Artificial Sequence
  Synthetic Polynucleotide
taatacgactcactatagggcatccacaaactcttgaaatgtttagtgttaacagaggagaaacactatgcatttcaagaacctggcggcagcgcaaaagatg

SEQ ID NO: 25347 - DNA, 103 bp, Artificial Sequence
  Synthetic Polynucleotide
taatacgactcactatagggtaaatcatccacaaactcttgaaatgtttaaacagaggagataaacaatgcaagagtttaacctggcggcagcgcaaaagatg

SEQ ID NO: 25348 - DNA, 103 bp, Artificial Sequence
  Synthetic Polynucleotide
taatacgactcactatagggcaatgttaatattcttctttatttatatgaaacagaggagatcatatatgtaaagaagaaacctggcggcagcgcaaaagatg

SEQ ID NO: 25349 - DNA, 103 bp, Artificial Sequence
  Synthetic Polynucleotide
taatacgactcactataggggaggttcattgggaataacctctagaaagcaacagaggagagctttcatgaggttattcaacctggcggcagcgcaaaagatg

SEQ ID NO: 25350 - DNA, 103 bp, Artificial Sequence
  Synthetic Polynucleotide
taatacgactcactatagggatgcttaaatcatccacaaactcttgaaataacagaggagaatttcaatggtttgtggaaacctggcggcagcgcaaaagatg

SEQ ID NO: 25351 - DNA, 103 bp, Artificial Sequence
  Synthetic Polynucleotide
taatacgactcactatagggcaaatatgcttaaatcatccacaaactcttaacagaggagaaagagtatgtggatgattaacctggcggcagcgcaaaagatg

SEQ ID NO: 25352 - DNA, 103 bp, Artificial Sequence
  Synthetic Polynucleotide
taatacgactcactatagggttacccaaatatgcttaaatcatccacaaaaacagaggagatttgtgatggatttaagcaacctggcggcagcgcaaaagatg

SEQ ID NO: 25353 - DNA, 103 bp, Artificial Sequence
  Synthetic Polynucleotide
taatacgactcactatagggtaaatttacccaaatatgcttaaatcatccaacagaggagaggatgaatgaagcatattaacctggcggcagcgcaaaagatg

SEQ ID NO: 25354 - DNA, 103 bp, Artificial Sequence
  Synthetic Polynucleotide
taatacgactcactatagggctgattaaatttacccaaatatgcttaaataacagaggagaatttaaatgtatttgggtaacctggcggcagcgcaaaagatg

SEQ ID NO: 25355 - DNA, 103 bp, Artificial Sequence
  Synthetic Polynucleotide
taatacgactcactatagggctatcctgattaaatttacccaaatatgctaacagaggagaagcataatggggtaaattaacctggcggcagcgcaaaagatg

SEQ ID NO: 25356 - DNA, 103 bp, Artificial Sequence
  Synthetic Polynucleotide
taatacgactcactatagggaactactatcctgattaaatttacccaaataacagaggagaatttggatgaatttaatcaacctggcggcagcgcaaaagatg

SEQ ID NO: 25357 - DNA, 103 bp, Artificial Sequence
  Synthetic Polynucleotide
taatacgactcactatagggatttaaactactatcctgattaaatttaccaacagaggagaggtaaaatgaatcaggataacctggcggcagcgcaaaagatg

SEQ ID NO: 25358 - DNA, 103 bp, Artificial Sequence
  Synthetic Polynucleotide
taatacgactcactatagggaacaaatttaaactactatcctgattaaataacagaggagaatttaaatgggatagtagaacctggcggcagcgcaaaagatg

SEQ ID NO: 25359 - DNA, 103 bp, Artificial Sequence
  Synthetic Polynucleotide
taatacgactcactatagggcttaaaacaaatttaaactactatcctgataacagaggagaatcaggatggtagtttaaaacctggcggcagcgcaaaagatg

SEQ ID NO: 25360 - DNA, 103 bp, Artificial Sequence
  Synthetic Polynucleotide
taatacgactcactataggggtaatgaggttcattgggaataacctctagaacagaggagactagagatgattcccaataacctggcggcagcgcaaaagatg

SEQ ID NO: 25361 - DNA, 103 bp, Artificial Sequence
  Synthetic Polynucleotide
taatacgactcactatagggtcacgcttaaaacaaatttaaactactatcaacagaggagagatagtatgttaaatttgaacctggcggcagcgcaaaagatg

SEQ ID NO: 25362 - DNA, 103 bp, Artificial Sequence
  Synthetic Polynucleotide
taatacgactcactataggggaaaatcacgcttaaaacaaatttaaactaaacagaggagatagtttatgtttgttttaaacctggcggcagcgcaaaagatg

SEQ ID NO: 25363 - DNA, 103 bp, Artificial Sequence
  Synthetic Polynucleotide
taatacgactcactatagggttaatgaaaatcacgcttaaaacaaatttaaacagaggagataaattatgtttaagcgtaacctggcggcagcgcaaaagatg

SEQ ID NO: 25364 - DNA, 103 bp, Artificial Sequence
  Synthetic Polynucleotide
taatacgactcactatagggctctcttaatgaaaatcacgcttaaaacaaaacagaggagattgtttatggcgtgatttaacctggcggcagcgcaaaagatg

SEQ ID NO: 25365 - DNA, 103 bp, Artificial Sequence
  Synthetic Polynucleotide
taatacgactcactatagggtaaccctctcttaatgaaaatcacgcttaaaacagaggagattaagcatgattttcattaacctggcggcagcgcaaaagatg

SEQ ID NO: 25366 - DNA, 103 bp, Artificial Sequence
  Synthetic Polynucleotide
taatacgactcactatagggctaattaaccctctcttaatgaaaatcacgaacagaggagacgtgatatgcattaagagaacctggcggcagcgcaaaagatg

SEQ ID NO: 25367 - DNA, 103 bp, Artificial Sequence
  Synthetic Polynucleotide
taatacgactcactatagggtataactaattaaccctctcttaatgaaaaaacagaggagattttcaatgagagagggtaacctggcggcagcgcaaaagatg

SEQ ID NO: 25368 - DNA, 103 bp, Artificial Sequence
  Synthetic Polynucleotide
taatacgactcactatagggcaatctataactaattaaccctctcttaataacagaggagaattaagatggggttaattaacctggcggcagcgcaaaagatg

SEQ ID NO: 25369 - DNA, 103 bp, Artificial Sequence
  Synthetic Polynucleotide
taatacgactcactatagggaagatcaatctataactaattaaccctctcaacagaggagagagaggatgaattagttaaacctggcggcagcgcaaaagatg

SEQ ID NO: 25370 - DNA, 103 bp, Artificial Sequence
  Synthetic Polynucleotide
taatacgactcactatagggcactaaagatcaatctataactaattaaccaacagaggagaggttaaatggttatagataacctggcggcagcgcaaaagatg

SEQ ID NO: 25371 - DNA, 103 bp, Artificial Sequence
  Synthetic Polynucleotide
taatacgactcactataggggggctgtaatgaggttcattgggaataaccaacagaggagaggttatatgcaatgaaccaacctggcggcagcgcaaaagatg

SEQ ID NO: 25372 - DNA, 103 bp, Artificial Sequence
  Synthetic Polynucleotide
taatacgactcactataggggagtacactaaagatcaatctataactaataacagaggagaattagtatgagattgatcaacctggcggcagcgcaaaagatg

SEQ ID NO: 25373 - DNA, 103 bp, Artificial Sequence
  Synthetic Polynucleotide
taatacgactcactataggggtatggagtacactaaagatcaatctataaaacagaggagattatagatggatctttagaacctggcggcagcgcaaaagatg

SEQ ID NO: 25374 - DNA, 103 bp, Artificial Sequence
  Synthetic Polynucleotide
taatacgactcactatagggtatgcgtatggagtacactaaagatcaatcaacagaggagagattgaatgttagtgtacaacctggcggcagcgcaaaagatg

SEQ ID NO: 25375 - DNA, 103 bp, Artificial Sequence
  Synthetic Polynucleotide
taatacgactcactatagggtatattatgcgtatggagtacactaaagataacagaggagaatctttatggtactccataacctggcggcagcgcaaaagatg

SEQ ID NO: 25376 - DNA, 103 bp, Artificial Sequence
  Synthetic Polynucleotide
taatacgactcactatagggttctctatattatgcgtatggagtacactaaacagaggagatagtgtatgccatacgcaaacctggcggcagcgcaaaagatg

SEQ ID NO: 25377 - DNA, 103 bp, Artificial Sequence
  Synthetic Polynucleotide
taatacgactcactatagggttaatttctctatattatgcgtatggagtaaacagaggagatactccatgcgcataataaacctggcggcagcgcaaaagatg

SEQ ID NO: 25378 - DNA, 103 bp, Artificial Sequence
  Synthetic Polynucleotide
taatacgactcactatagggtaatattaatttctctatattatgcgtatgaacagaggagacatacgatgaatatagagaacctggcggcagcgcaaaagatg

SEQ ID NO: 25379 - DNA, 103 bp, Artificial Sequence
  Synthetic Polynucleotide
taatacgactcactataggggttagtaatattaatttctctatattatgcaacagaggagagcataaatgagagaaattaacctggcggcagcgcaaaagatg

SEQ ID NO: 25380 - DNA, 103 bp, Artificial Sequence
  Synthetic Polynucleotide
taatacgactcactatagggtttttgttagtaatattaatttctctatataacagaggagaatatagatgaattaatataacctggcggcagcgcaaaagatg

SEQ ID NO: 25381 - DNA, 103 bp, Artificial Sequence
  Synthetic Polynucleotide
taatacgactcactatagggaaccctttttgttagtaatattaatttctcaacagaggagagagaaaatgatattactaaacctggcggcagcgcaaaagatg

SEQ ID NO: 25382 - DNA, 103 bp, Artificial Sequence
  Synthetic Polynucleotide
taatacgactcactatagggtcaaagggctgtaatgaggttcattgggaaaacagaggagattcccaatgaacctcattaacctggcggcagcgcaaaagatg

SEQ ID NO: 25383 - DNA, 103 bp, Artificial Sequence
  Synthetic Polynucleotide
taatacgactcactatagggtaaaaaaccctttttgttagtaatattaataacagaggagaattaatatgactaacaaaaacctggcggcagcgcaaaagatg

SEQ ID NO: 25384 - DNA, 103 bp, Artificial Sequence
  Synthetic Polynucleotide
taatacgactcactatagggccgtttaaaaaaccctttttgttagtaataaacagaggagatattacatgcaaaaagggaacctggcggcagcgcaaaagatg

SEQ ID NO: 25385 - DNA, 103 bp, Artificial Sequence
  Synthetic Polynucleotide
taatacgactcactatagggcaaatccgtttaaaaaaccctttttgttagaacagaggagactaacaatgagggtttttaacctggcggcagcgcaaaagatg

SEQ ID NO: 25386 - DNA, 103 bp, Artificial Sequence
  Synthetic Polynucleotide
taatacgactcactatagggttaatcaaatccgtttaaaaaaccctttttaacagaggagaaaaaagatgtttttaaacaacctggcggcagcgcaaaagatg

SEQ ID NO: 25387 - DNA, 103 bp, Artificial Sequence
  Synthetic Polynucleotide
taatacgactcactatagggatctattaatcaaatccgtttaaaaaacccaacagaggagagggtttatgaaacggattaacctggcggcagcgcaaaagatg

SEQ ID NO: 25388 - DNA, 103 bp, Artificial Sequence
  Synthetic Polynucleotide
taatacgactcactatagggtactgatctattaatcaaatccgtttaaaaaacagaggagattttaaatggatttgattaacctggcggcagcgcaaaagatg

SEQ ID NO: 25389 - DNA, 103 bp, Artificial Sequence
  Synthetic Polynucleotide
taatacgactcactatagggagatatactgatctattaatcaaatccgttaacagaggagaaacggaatggattaatagaacctggcggcagcgcaaaagatg

SEQ ID NO: 25390 - DNA, 103 bp, Artificial Sequence
  Synthetic Polynucleotide
taatacgactcactatagggttttgagatatactgatctattaatcaaataacagaggagaatttgaatgatagatcagaacctggcggcagcgcaaaagatg

SEQ ID NO: 25391 - DNA, 103 bp, Artificial Sequence
  Synthetic Polynucleotide
taatacgactcactatagggttggcttttgagatatactgatctattaataacagaggagaattaatatgtcagtatataacctggcggcagcgcaaaagatg

SEQ ID NO: 25392 - DNA, 103 bp, Artificial Sequence
  Synthetic Polynucleotide
taatacgactcactatagggattatttggcttttgagatatactgatctaaacagaggagatagatcatgatatctcaaaacctggcggcagcgcaaaagatg

SEQ ID NO: 25393 - DNA, 103 bp, Artificial Sequence
  Synthetic Polynucleotide
taatacgactcactatagggcaaaatcaaagggctgtaatgaggttcattaacagaggagaaatgaaatgcattacagcaacctggcggcagcgcaaaagatg

SEQ ID NO: 25394 - DNA, 103 bp, Artificial Sequence
  Synthetic Polynucleotide
taatacgactcactatagggagtcaattatttggcttttgagatatactgaacagaggagacagtatatgtcaaaagccaacctggcggcagcgcaaaagatg

SEQ ID NO: 25395 - DNA, 103 bp, Artificial Sequence
  Synthetic Polynucleotide
taatacgactcactatagggtaagaagtcaattatttggcttttgagataaacagaggagatatctcatgagccaaataaacctggcggcagcgcaaaagatg

SEQ ID NO: 25396 - DNA, 103 bp, Artificial Sequence
  Synthetic Polynucleotide
taatacgactcactatagggaagagtaagaagtcaattatttggcttttgaacagaggagacaaaagatgaataattgaaacctggcggcagcgcaaaagatg

SEQ ID NO: 25397 - DNA, 103 bp, Artificial Sequence
  Synthetic Polynucleotide
taatacgactcactatagggtcccaaagagtaagaagtcaattatttggcaacagaggagagccaaaatgttgacttctaacctggcggcagcgcaaaagatg

SEQ ID NO: 25398 - DNA, 103 bp, Artificial Sequence
  Synthetic Polynucleotide
taatacgactcactatagggtaaattcccaaagagtaagaagtcaattataacagaggagaataattatgttcttactcaacctggcggcagcgcaaaagatg

SEQ ID NO: 25399 - DNA, 103 bp, Artificial Sequence
  Synthetic Polynucleotide
taatacgactcactataggggttagtaaattcccaaagagtaagaagtcaaacagaggagatgacttatgactctttggaacctggcggcagcgcaaaagatg

SEQ ID NO: 25400 - DNA, 103 bp, Artificial Sequence
  Synthetic Polynucleotide
taatacgactcactatagggatattgttagtaaattcccaaagagtaagaaacagaggagatcttacatgttgggaattaacctggcggcagcgcaaaagatg

SEQ ID NO: 25401 - DNA, 103 bp, Artificial Sequence
  Synthetic Polynucleotide
taatacgactcactatagggttcctatattgttagtaaattcccaaagagaacagaggagactctttatgaatttactaaacctggcggcagcgcaaaagatg

SEQ ID NO: 25402 - DNA, 103 bp, Artificial Sequence
  Synthetic Polynucleotide
taatacgactcactatagggtatctttcctatattgttagtaaattcccaaacagaggagatgggaaatgactaacaataacctggcggcagcgcaaaagatg

SEQ ID NO: 25403 - DNA, 103 bp, Artificial Sequence
  Synthetic Polynucleotide
taatacgactcactatagggataaatatctttcctatattgttagtaaataacagaggagaatttacatgcaatataggaacctggcggcagcgcaaaagatg

SEQ ID NO: 25404 - DNA, 103 bp, Artificial Sequence
  Synthetic Polynucleotide
taatacgactcactatagggagagccaaaatcaaagggctgtaatgaggtaacagaggagaacctcaatgcagccctttaacctggcggcagcgcaaaagatg

SEQ ID NO: 25405 - DNA, 103 bp, Artificial Sequence
  Synthetic Polynucleotide
taatacgactcactatagggtaagaataaatatctttcctatattgttagaacagaggagactaacaatgtaggaaagaaacctggcggcagcgcaaaagatg

SEQ ID NO: 25406 - DNA, 103 bp, Artificial Sequence
  Synthetic Polynucleotide
taatacgactcactatagggttacgtaagaataaatatctttcctatattaacagaggagaaatataatgaagatatttaacctggcggcagcgcaaaagatg

SEQ ID NO: 25407 - DNA, 103 bp, Artificial Sequence
  Synthetic Polynucleotide
taatacgactcactatagggaaggattacgtaagaataaatatctttcctaacagaggagaaggaaaatgatttattctaacctggcggcagcgcaaaagatg

SEQ ID NO: 25408 - DNA, 103 bp, Artificial Sequence
  Synthetic Polynucleotide
taatacgactcactataggggggccaaggattacgtaagaataaatatctaacagaggagaagatatatgttcttacgtaacctggcggcagcgcaaaagatg

SEQ ID NO: 25409 - DNA, 103 bp, Artificial Sequence
  Synthetic Polynucleotide
taatacgactcactatagggccgttgggccaaggattacgtaagaataaaaacagaggagatttattatgacgtaatccaacctggcggcagcgcaaaagatg

SEQ ID NO: 25410 - DNA, 103 bp, Artificial Sequence
  Synthetic Polynucleotide
taatacgactcactatagggagtttccgttgggccaaggattacgtaagaaacagaggagatcttacatgatccttggcaacctggcggcagcgcaaaagatg

SEQ ID NO: 25411 - DNA, 103 bp, Artificial Sequence
  Synthetic Polynucleotide
taatacgactcactatagggaggttagtttccgttgggccaaggattacgaacagaggagacgtaatatgtggcccaacaacctggcggcagcgcaaaagatg

SEQ ID NO: 25412 - DNA, 103 bp, Artificial Sequence
  Synthetic Polynucleotide
taatacgactcactatagggcattgaggttagtttccgttgggccaaggaaacagaggagatccttgatgcaacggaaaaacctggcggcagcgcaaaagatg

SEQ ID NO: 25413 - DNA, 103 bp, Artificial Sequence
  Synthetic Polynucleotide
taatacgactcactatagggatgaccattgaggttagtttccgttgggccaacagaggagaggcccaatggaaactaacaacctggcggcagcgcaaaagatg

SEQ ID NO: 25414 - DNA, 103 bp, Artificial Sequence
  Synthetic Polynucleotide
taatacgactcactatagggattgaatgaccattgaggttagtttccgttaacagaggagaaacggaatgtaacctcaaaacctggcggcagcgcaaaagatg

SEQ ID NO: 25415 - DNA, 103 bp, Artificial Sequence
  Synthetic Polynucleotide
taatacgactcactatagggttttgagagccaaaatcaaagggctgtaataacagaggagaattacaatgctttgatttaacctggcggcagcgcaaaagatg

SEQ ID NO: 25416 - DNA, 103 bp, Artificial Sequence
  Synthetic Polynucleotide
taatacgactcactatagggagcatattgaatgaccattgaggttagtttaacagaggagaaaactaatgtcaatggtcaacctggcggcagcgcaaaagatg

SEQ ID NO: 25417 - DNA, 103 bp, Artificial Sequence
  Synthetic Polynucleotide
taatacgactcactataggggagcaagcatattgaatgaccattgaggttaacagaggagaaacctcatgggtcattcaaacctggcggcagcgcaaaagatg

SEQ ID NO: 25418 - DNA, 103 bp, Artificial Sequence
  Synthetic Polynucleotide
taatacgactcactatagggatcatgagcaagcatattgaatgaccattgaacagaggagacaatggatgttcaatatgaacctggcggcagcgcaaaagatg

SEQ ID NO: 25419 - DNA, 103 bp, Artificial Sequence
  Synthetic Polynucleotide
taatacgactcactataggggatatatcatgagcaagcatattgaatgacaacagaggagagtcattatgtatgcttgcaacctggcggcagcgcaaaagatg

SEQ ID NO: 25420 - DNA, 103 bp, Artificial Sequence
  Synthetic Polynucleotide
taatacgactcactatagggctctggatatatcatgagcaagcatattgaaacagaggagatcaataatgttgctcatgaacctggcggcagcgcaaaagatg

SEQ ID NO: 25421 - DNA, 103 bp, Artificial Sequence
  Synthetic Polynucleotide
taatacgactcactatagggaaaatctctggatatatcatgagcaagcataacagaggagaatgcttatgcatgatataaacctggcggcagcgcaaaagatg

SEQ ID NO: 25422 - DNA, 103 bp, Artificial Sequence
  Synthetic Polynucleotide
taatacgactcactatagggtataaaaaatctctggatatatcatgagcaaacagaggagatgctcaatgtatatccagaacctggcggcagcgcaaaagatg

SEQ ID NO: 25423 - DNA, 103 bp, Artificial Sequence
  Synthetic Polynucleotide
taatacgactcactataggggaacttataaaaaatctctggatatatcataacagaggagaatgataatgccagagattaacctggcggcagcgcaaaagatg

SEQ ID NO: 25424 - DNA, 103 bp, Artificial Sequence
  Synthetic Polynucleotide
taatacgactcactataggggttttgaacttataaaaaatctctggatataacagaggagaatatccatggattttttaaacctggcggcagcgcaaaagatg

SEQ ID NO: 25425 - DNA, 103 bp, Artificial Sequence
  Synthetic Polynucleotide
taatacgactcactatagggacaacgttttgaacttataaaaaatctctgaacagaggagacagagaatgtttataagtaacctggcggcagcgcaaaagatg

SEQ ID NO: 25426 - DNA, 103 bp, Artificial Sequence
  Synthetic Polynucleotide
taatacgactcactatagggtaaggttttgagagccaaaatcaaagggctaacagaggagaagccctatgattttggctaacctggcggcagcgcaaaagatg

SEQ ID NO: 25427 - DNA, 103 bp, Artificial Sequence
  Synthetic Polynucleotide
taatacgactcactatagggaatttacaacgttttgaacttataaaaaataacagaggagaatttttatgaagttcaaaaacctggcggcagcgcaaaagatg

SEQ ID NO: 25428 - DNA, 103 bp, Artificial Sequence
  Synthetic Polynucleotide
taatacgactcactatagggagtataatttacaacgttttgaacttataaaacagaggagattataaatgcaaaacgttaacctggcggcagcgcaaaagatg

SEQ ID NO: 25429 - DNA, 103 bp, Artificial Sequence
  Synthetic Polynucleotide
taatacgactcactatagggatgcaagtataatttacaacgttttgaactaacagaggagaagttcaatgcgttgtaaaaacctggcggcagcgcaaaagatg

SEQ ID NO: 25430 - DNA, 103 bp, Artificial Sequence
  Synthetic Polynucleotide
taatacgactcactatagggattttatgcaagtataatttacaacgttttaacagaggagaaaaacgatgtaaattataaacctggcggcagcgcaaaagatg

SEQ ID NO: 25431 - DNA, 103 bp, Artificial Sequence
  Synthetic Polynucleotide
taatacgactcactatagggacagtattttatgcaagtataatttacaacaacagaggagagttgtaatgtatacttgcaacctggcggcagcgcaaaagatg

SEQ ID NO: 25432 - DNA, 103 bp, Artificial Sequence
  Synthetic Polynucleotide
taatacgactcactatagggttaaaacagtattttatgcaagtataatttaacagaggagaaaattaatgttgcataaaaacctggcggcagcgcaaaagatg

SEQ ID NO: 25433 - DNA, 103 bp, Artificial Sequence
  Synthetic Polynucleotide
taatacgactcactatagggcttaattaaaacagtattttatgcaagtataacagaggagaatacttatgtaaaatactaacctggcggcagcgcaaaagatg

SEQ ID NO: 25434 - DNA, 103 bp, Artificial Sequence
  Synthetic Polynucleotide
taatacgactcactatagggtttttcttaattaaaacagtattttatgcaaacagaggagatgcataatgtactgttttaacctggcggcagcgcaaaagatg

SEQ ID NO: 25435 - DNA, 103 bp, Artificial Sequence
  Synthetic Polynucleotide
taatacgactcactatagggcatagtttttcttaattaaaacagtattttaacagaggagaaaaataatgttttaattaaacctggcggcagcgcaaaagatg

SEQ ID NO: 25436 - DNA, 103 bp, Artificial Sequence
  Synthetic Polynucleotide
taatacgactcactatagggttcttcatagtttttcttaattaaaacagtaacagaggagaactgttatgattaagaaaaacctggcggcagcgcaaaagatg

SEQ ID NO: 25437 - DNA, 103 bp, Artificial Sequence
  Synthetic Polynucleotide
taatacgactcactatagggctttctaaggttttgagagccaaaatcaaaaacagaggagatttgatatgggctctcaaaacctggcggcagcgcaaaagatg

SEQ ID NO: 25438 - DNA, 103 bp, Artificial Sequence
  Synthetic Polynucleotide
taatacgactcactatagggtaatgttcttcatagtttttcttaattaaaaacagaggagatttaatatggaaaaactaaacctggcggcagcgcaaaagatg

SEQ ID NO: 25439 - DNA, 103 bp, Artificial Sequence
  Synthetic Polynucleotide
taatacgactcactatagggccacttaatgttcttcatagtttttcttaaaacagaggagattaagaatgactatgaagaacctggcggcagcgcaaaagatg

SEQ ID NO: 25440 - DNA, 103 bp, Artificial Sequence
  Synthetic Polynucleotide
taatacgactcactatagggaaaatccacttaatgttcttcatagtttttaacagaggagaaaaaacatggaagaacataacctggcggcagcgcaaaagatg

SEQ ID NO: 25441 - DNA, 103 bp, Artificial Sequence
  Synthetic Polynucleotide
taatacgactcactatagggaaggaaaaatccacttaatgttcttcatagaacagaggagactatgaatgacattaagtaacctggcggcagcgcaaaagatg

SEQ ID NO: 25442 - DNA, 103 bp, Artificial Sequence
  Synthetic Polynucleotide
taatacgactcactatagggctaagaaggaaaaatccacttaatgttcttaacagaggagaaagaacatgaagtggattaacctggcggcagcgcaaaagatg

SEQ ID NO: 25443 - DNA, 103 bp, Artificial Sequence
  Synthetic Polynucleotide
taatacgactcactataggggaacactaagaaggaaaaatccacttaatgaacagaggagacattaaatggatttttccaacctggcggcagcgcaaaagatg

SEQ ID NO: 25444 - DNA, 103 bp, Artificial Sequence
  Synthetic Polynucleotide
taatacgactcactatagggtaaaagaacactaagaaggaaaaatccactaacagaggagaagtggaatgttccttcttaacctggcggcagcgcaaaagatg

SEQ ID NO: 25445 - DNA, 103 bp, Artificial Sequence
  Synthetic Polynucleotide
taatacgactcactatagggctttgtaaaagaacactaagaaggaaaaataacagaggagaatttttatgtcttagtgtaacctggcggcagcgcaaaagatg

SEQ ID NO: 25446 - DNA, 103 bp, Artificial Sequence
  Synthetic Polynucleotide
taatacgactcactatagggccttgctttgtaaaagaacactaagaaggaaacagaggagatccttcatggtgttctttaacctggcggcagcgcaaaagatg

SEQ ID NO: 25447 - DNA, 103 bp, Artificial Sequence
  Synthetic Polynucleotide
taatacgactcactatagggaaaaaccttgctttgtaaaagaacactaagaacagaggagacttagtatgcttttacaaaacctggcggcagcgcaaaagatg

SEQ ID NO: 25448 - DNA, 103 bp, Artificial Sequence
  Synthetic Polynucleotide
taatacgactcactatagggcagtgctttctaaggttttgagagccaaaaaacagaggagattttggatgtcaaaacctaacctggcggcagcgcaaaagatg

SEQ ID NO: 25449 - DNA, 103 bp, Artificial Sequence
  Synthetic Polynucleotide
taatacgactcactatagggaatttaaaaaccttgctttgtaaaagaacaaacagaggagatgttctatgacaaagcaaaacctggcggcagcgcaaaagatg

SEQ ID NO: 25450 - DNA, 103 bp, Artificial Sequence
  Synthetic Polynucleotide
taatacgactcactatagggacttgaatttaaaaaccttgctttgtaaaaaacagaggagattttacatggcaaggtttaacctggcggcagcgcaaaagatg

SEQ ID NO: 25451 - DNA, 103 bp, Artificial Sequence
  Synthetic Polynucleotide
taatacgactcactataggggatctacttgaatttaaaaaccttgctttgaacagaggagacaaagcatggtttttaaaaacctggcggcagcgcaaaagatg

SEQ ID NO: 25452 - DNA, 103 bp, Artificial Sequence
  Synthetic Polynucleotide
taatacgactcactataggggacttgatctacttgaatttaaaaaccttgaacagaggagacaaggtatgtaaattcaaaacctggcggcagcgcaaaagatg

SEQ ID NO: 25453 - DNA, 103 bp, Artificial Sequence
  Synthetic Polynucleotide
taatacgactcactataggggagtagacttgatctacttgaatttaaaaaaacagaggagatttttaatgtcaagtagaaacctggcggcagcgcaaaagatg

SEQ ID NO: 25454 - DNA, 103 bp, Artificial Sequence
  Synthetic Polynucleotide
taatacgactcactatagggagcaagagtagacttgatctacttgaatttaacagaggagaaaattcatgtagatcaagaacctggcggcagcgcaaaagatg

SEQ ID NO: 25455 - DNA, 103 bp, Artificial Sequence
  Synthetic Polynucleotide
taatacgactcactatagggagttcagcaagagtagacttgatctacttgaacagaggagacaagtaatgcaagtctacaacctggcggcagcgcaaaagatg

SEQ ID NO: 25456 - DNA, 103 bp, Artificial Sequence
  Synthetic Polynucleotide
taatacgactcactatagggaagtaagttcagcaagagtagacttgatctaacagaggagaagatcaatgctactcttgaacctggcggcagcgcaaaagatg

SEQ ID NO: 25457 - DNA, 103 bp, Artificial Sequence
  Synthetic Polynucleotide
taatacgactcactatagggtaaagaagtaagttcagcaagagtagacttaacagaggagaaagtctatgcttgctgaaaacctggcggcagcgcaaaagatg

SEQ ID NO: 25458 - DNA, 103 bp, Artificial Sequence
  Synthetic Polynucleotide
taatacgactcactatagggatttttaaagaagtaagttcagcaagagtaaacagaggagatactctatgtgaacttacaacctggcggcagcgcaaaagatg

SEQ ID NO: 25459 - DNA, 103 bp, Artificial Sequence
  Synthetic Polynucleotide
taatacgactcactatagggaatgtcaatgttaatattcttctttatttaaacagaggagataaataatgaagaatattaacctggcggcagcgcaaaagatg

SEQ ID NO: 25460 - DNA, 103 bp, Artificial Sequence
  Synthetic Polynucleotide
taatacgactcactatagggagattcagtgctttctaaggttttgagagcaacagaggagagctctcatgaccttagaaaacctggcggcagcgcaaaagatg

SEQ ID NO: 25461 - DNA, 103 bp, Artificial Sequence
  Synthetic Polynucleotide
taatacgactcactatagggaattaatttttaaagaagtaagttcagcaaaacagaggagattgctgatgttacttcttaacctggcggcagcgcaaaagatg

SEQ ID NO: 25462 - DNA, 103 bp, Artificial Sequence
  Synthetic Polynucleotide
taatacgactcactataggggtgtaaattaatttttaaagaagtaagttcaacagaggagagaacttatgtctttaaaaaacctggcggcagcgcaaaagatg

SEQ ID NO: 25463 - DNA, 103 bp, Artificial Sequence
  Synthetic Polynucleotide
taatacgactcactataggggtttagtgtaaattaatttttaaagaagtaaacagaggagatacttcatgaaaaattaaaacctggcggcagcgcaaaagatg

SEQ ID NO: 25464 - DNA, 103 bp, Artificial Sequence
  Synthetic Polynucleotide
taatacgactcactataggggaattgtttagtgtaaattaatttttaaagaacagaggagactttaaatgttaatttacaacctggcggcagcgcaaaagatg

SEQ ID NO: 25465 - DNA, 103 bp, Artificial Sequence
  Synthetic Polynucleotide
taatacgactcactatagggaaaacgaattgtttagtgtaaattaattttaacagaggagaaaaattatgttacactaaaacctggcggcagcgcaaaagatg

SEQ ID NO: 25466 - DNA, 103 bp, Artificial Sequence
  Synthetic Polynucleotide
taatacgactcactatagggcaacaaaaacgaattgtttagtgtaaattaaacagaggagataatttatgctaaacaataacctggcggcagcgcaaaagatg

SEQ ID NO: 25467 - DNA, 103 bp, Artificial Sequence
  Synthetic Polynucleotide
taatacgactcactatagggtccgtcaacaaaaacgaattgtttagtgtaaacagaggagatacactatgcaattcgttaacctggcggcagcgcaaaagatg

SEQ ID NO: 25468 - DNA, 103 bp, Artificial Sequence
  Synthetic Polynucleotide
taatacgactcactatagggtttgttccgtcaacaaaaacgaattgtttaaacagaggagataaacaatgcgtttttgtaacctggcggcagcgcaaaagatg

SEQ ID NO: 25469 - DNA, 103 bp, Artificial Sequence
  Synthetic Polynucleotide
taatacgactcactatagggctgaatttgttccgtcaacaaaaacgaattaacagaggagaaattcgatgttgttgacgaacctggcggcagcgcaaaagatg

SEQ ID NO: 25470 - DNA, 103 bp, Artificial Sequence
  Synthetic Polynucleotide
taatacgactcactatagggcatatctgaatttgttccgtcaacaaaaacaacagaggagagtttttatggacggaacaaacctggcggcagcgcaaaagatg

SEQ ID NO: 25471 - DNA, 103 bp, Artificial Sequence
  Synthetic Polynucleotide
taatacgactcactatagggctttgagattcagtgctttctaaggttttgaacagaggagacaaaacatgagaaagcacaacctggcggcagcgcaaaagatg

SEQ ID NO: 25472 - DNA, 103 bp, Artificial Sequence
  Synthetic Polynucleotide
taatacgactcactatagggctggccatatctgaatttgttccgtcaacaaacagaggagatgttgaatgaacaaattcaacctggcggcagcgcaaaagatg

SEQ ID NO: 25473 - DNA, 103 bp, Artificial Sequence
  Synthetic Polynucleotide
taatacgactcactatagggtggaactggccatatctgaatttgttccgtaacagaggagaacggaaatgattcagataaacctggcggcagcgcaaaagatg

SEQ ID NO: 25474 - DNA, 103 bp, Artificial Sequence
  Synthetic Polynucleotide
taatacgactcactatagggattgctggaactggccatatctgaatttgtaacagaggagaacaaatatggatatggccaacctggcggcagcgcaaaagatg

SEQ ID NO: 25475 - DNA, 103 bp, Artificial Sequence
  Synthetic Polynucleotide
taatacgactcactatagggttataattgctggaactggccatatctgaaaacagaggagattcagaatgggccagttcaacctggcggcagcgcaaaagatg

SEQ ID NO: 25476 - DNA, 103 bp, Artificial Sequence
  Synthetic Polynucleotide
taatacgactcactatagggacgtattataattgctggaactggccatataacagaggagaatatggatggttccagcaaacctggcggcagcgcaaaagatg

SEQ ID NO: 25477 - DNA, 103 bp, Artificial Sequence
  Synthetic Polynucleotide
taatacgactcactatagggcatatacgtattataattgctggaactggcaacagaggagagccagtatgagcaattataacctggcggcagcgcaaaagatg

SEQ ID NO: 25478 - DNA, 103 bp, Artificial Sequence
  Synthetic Polynucleotide
taatacgactcactatagggtattgcatatacgtattataattgctggaaaacagaggagattccagatgttataatacaacctggcggcagcgcaaaagatg

SEQ ID NO: 25479 - DNA, 103 bp, Artificial Sequence
  Synthetic Polynucleotide
taatacgactcactatagggtcaggtattgcatatacgtattataattgcaacagaggagagcaattatgatacgtataaacctggcggcagcgcaaaagatg

SEQ ID NO: 25480 - DNA, 103 bp, Artificial Sequence
  Synthetic Polynucleotide
taatacgactcactatagggagggttcaggtattgcatatacgtattataaacagaggagatataatatgtatatgcaaaacctggcggcagcgcaaaagatg

SEQ ID NO: 25481 - DNA, 103 bp, Artificial Sequence
  Synthetic Polynucleotide
taatacgactcactataggggggggagggttcaggtattgcatatacgtaaacagaggagatacgtaatggcaatacctaacctggcggcagcgcaaaagatg

SEQ ID NO: 25482 - DNA, 103 bp, Artificial Sequence
  Synthetic Polynucleotide
taatacgactcactatagggtccccctttgagattcagtgctttctaaggaacagaggagaccttagatggcactgaataacctggcggcagcgcaaaagatg

SEQ ID NO: 25483 - DNA, 103 bp, Artificial Sequence
  Synthetic Polynucleotide
taatacgactcactatagggcataagggggagggttcaggtattgcatataacagaggagaatatgcatgacctgaaccaacctggcggcagcgcaaaagatg

SEQ ID NO: 25484 - DNA, 103 bp, Artificial Sequence
  Synthetic Polynucleotide
taatacgactcactatagggatcagcataagggggagggttcaggtattgaacagaggagacaatacatgaaccctcccaacctggcggcagcgcaaaagatg

SEQ ID NO: 25485 - DNA, 103 bp, Artificial Sequence
  Synthetic Polynucleotide
taatacgactcactatagggccatgatcagcataagggggagggttcaggaacagaggagacctgaaatgtcccccttaaacctggcggcagcgcaaaagatg

SEQ ID NO: 25486 - DNA, 103 bp, Artificial Sequence
  Synthetic Polynucleotide
taatacgactcactatagggttgcaccatgatcagcataagggggagggtaacagaggagaaccctcatgcttatgctgaacctggcggcagcgcaaaagatg

SEQ ID NO: 25487 - DNA, 103 bp, Artificial Sequence
  Synthetic Polynucleotide
taatacgactcactatagggctgatttgcaccatgatcagcataagggggaacagaggagaccccctatggctgatcataacctggcggcagcgcaaaagatg

SEQ ID NO: 25488 - DNA, 103 bp, Artificial Sequence
  Synthetic Polynucleotide
taatacgactcactatagggattaactgatttgcaccatgatcagcataaaacagaggagattatgcatgtcatggtgcaacctggcggcagcgcaaaagatg

SEQ ID NO: 25489 - DNA, 103 bp, Artificial Sequence
  Synthetic Polynucleotide
taatacgactcactatagggctgggattaactgatttgcaccatgatcagaacagaggagactgatcatggtgcaaatcaacctggcggcagcgcaaaagatg

SEQ ID NO: 25490 - DNA, 103 bp, Artificial Sequence
  Synthetic Polynucleotide
taatacgactcactataggggtctgctgggattaactgatttgcaccatgaacagaggagacatggtatgaatcagttaaacctggcggcagcgcaaaagatg

SEQ ID NO: 25491 - DNA, 103 bp, Artificial Sequence
  Synthetic Polynucleotide
taatacgactcactatagggagctggtctgctgggattaactgatttgcaaacagaggagatgcaaaatggttaatcccaacctggcggcagcgcaaaagatg

SEQ ID NO: 25492 - DNA, 103 bp, Artificial Sequence
  Synthetic Polynucleotide
taatacgactcactatagggttgatagctggtctgctgggattaactgataacagaggagaatcagtatgtcccagcagaacctggcggcagcgcaaaagatg

SEQ ID NO: 25493 - DNA, 103 bp, Artificial Sequence
  Synthetic Polynucleotide
taatacgactcactatagggaatcctccccctttgagattcagtgctttcaacagaggagagaaagcatggaatctcaaaacctggcggcagcgcaaaagatg

SEQ ID NO: 25494 - DNA, 103 bp, Artificial Sequence
  Synthetic Polynucleotide
taatacgactcactatagggttgatttgatagctggtctgctgggattaaaacagaggagattaatcatggcagaccagaacctggcggcagcgcaaaagatg

SEQ ID NO: 25495 - DNA, 103 bp, Artificial Sequence
  Synthetic Polynucleotide
taatacgactcactatagggccatgttgatttgatagctggtctgctgggaacagaggagacccagcatgccagctatcaacctggcggcagcgcaaaagatg

SEQ ID NO: 25496 - DNA, 103 bp, Artificial Sequence
  Synthetic Polynucleotide
taatacgactcactatagggttataccatgttgatttgatagctggtctgaacagaggagacagaccatgtatcaaatcaacctggcggcagcgcaaaagatg

SEQ ID NO: 25497 - DNA, 103 bp, Artificial Sequence
  Synthetic Polynucleotide
taatacgactcactatagggcggagttataccatgttgatttgatagctgaacagaggagacagctaatgaatcaacataacctggcggcagcgcaaaagatg

SEQ ID NO: 25498 - DNA, 103 bp, Artificial Sequence
  Synthetic Polynucleotide
taatacgactcactatagggtaattcggagttataccatgttgatttgataacagaggagaatcaaaatgacatggtataacctggcggcagcgcaaaagatg

SEQ ID NO: 25499 - DNA, 103 bp, Artificial Sequence
  Synthetic Polynucleotide
taatacgactcactatagggccacataattcggagttataccatgttgataacagaggagaatcaacatggtataactcaacctggcggcagcgcaaaagatg

SEQ ID NO: 25500 - DNA, 103 bp, Artificial Sequence
  Synthetic Polynucleotide
taatacgactcactataggggtcgcccacataattcggagttataccatgaacagaggagacatggtatgactccgaataacctggcggcagcgcaaaagatg

SEQ ID NO: 25501 - DNA, 103 bp, Artificial Sequence
  Synthetic Polynucleotide
taatacgactcactatagggttcaagtcgcccacataattcggagttataaacagaggagatataacatggaattatgtaacctggcggcagcgcaaaagatg

SEQ ID NO: 25502 - DNA, 103 bp, Artificial Sequence
  Synthetic Polynucleotide
taatacgactcactatagggctagattcaagtcgcccacataattcggagaacagaggagactccgaatgatgtgggcgaacctggcggcagcgcaaaagatg

SEQ ID NO: 25503 - DNA, 103 bp, Artificial Sequence
  Synthetic Polynucleotide
taatacgactcactatagggatcatctagattcaagtcgcccacataattaacagaggagaaattatatgggcgacttgaacctggcggcagcgcaaaagatg

SEQ ID NO: 25504 - DNA, 103 bp, Artificial Sequence
  Synthetic Polynucleotide
taatacgactcactatagggagcccaatcctccccctttgagattcagtgaacagaggagacactgaatgtcaaaggggaacctggcggcagcgcaaaagatg

SEQ ID NO: 25505 - DNA, 103 bp, Artificial Sequence
  Synthetic Polynucleotide
taatacgactcactatagggaactgatcatctagattcaagtcgcccacaaacagaggagatgtgggatgcttgaatctaacctggcggcagcgcaaaagatg

SEQ ID NO: 25506 - DNA, 103 bp, Artificial Sequence
  Synthetic Polynucleotide
taatacgactcactatagggctttaaactgatcatctagattcaagtcgcaacagaggagagcgactatgatctagatgaacctggcggcagcgcaaaagatg

SEQ ID NO: 25507 - DNA, 103 bp, Artificial Sequence
  Synthetic Polynucleotide
taatacgactcactatagggattccctttaaactgatcatctagattcaaaacagaggagattgaatatggatgatcagaacctggcggcagcgcaaaagatg

SEQ ID NO: 25508 - DNA, 103 bp, Artificial Sequence
  Synthetic Polynucleotide
taatacgactcactatagggcaaacattccctttaaactgatcatctagaaacagaggagatctagaatgtcagtttaaaacctggcggcagcgcaaaagatg

SEQ ID NO: 25509 - DNA, 103 bp, Artificial Sequence
  Synthetic Polynucleotide
taatacgactcactatagggcgtgacaaacattccctttaaactgatcataacagaggagaatgatcatgttaaagggaaacctggcggcagcgcaaaagatg

SEQ ID NO: 25510 - DNA, 103 bp, Artificial Sequence
  Synthetic Polynucleotide
taatacgactcactataggggaaggcgtgacaaacattccctttaaactgaacagaggagacagtttatggggaatgttaacctggcggcagcgcaaaagatg

SEQ ID NO: 25511 - DNA, 103 bp, Artificial Sequence
  Synthetic Polynucleotide
taatacgactcactatagggaaagtgaaggcgtgacaaacattccctttaaacagaggagataaaggatgtgtttgtcaaacctggcggcagcgcaaaagatg

SEQ ID NO: 25512 - DNA, 103 bp, Artificial Sequence
  Synthetic Polynucleotide
taatacgactcactatagggcttccaaagtgaaggcgtgacaaacattccaacagaggagaggaatgatggtcacgcctaacctggcggcagcgcaaaagatg

SEQ ID NO: 25513 - DNA, 103 bp, Artificial Sequence
  Synthetic Polynucleotide
taatacgactcactatagggtattgcttccaaagtgaaggcgtgacaaacaacagaggagagtttgtatggccttcactaacctggcggcagcgcaaaagatg

SEQ ID NO: 25514 - DNA, 103 bp, Artificial Sequence
  Synthetic Polynucleotide
taatacgactcactatagggtcaattattgcttccaaagtgaaggcgtgaaacagaggagatcacgcatgcactttggaaacctggcggcagcgcaaaagatg

SEQ ID NO: 25515 - DNA, 103 bp, Artificial Sequence
  Synthetic Polynucleotide
taatacgactcactataggggaaagagcccaatcctccccctttgagattaacagaggagaaatctcatggggggaggaaacctggcggcagcgcaaaagatg

SEQ ID NO: 25516 - DNA, 103 bp, Artificial Sequence
  Synthetic Polynucleotide
taatacgactcactatagggatatatcaattattgcttccaaagtgaaggaacagaggagaccttcaatgtggaagcaaaacctggcggcagcgcaaaagatg

SEQ ID NO: 25517 - DNA, 103 bp, Artificial Sequence
  Synthetic Polynucleotide
taatacgactcactatagggagcagatatatcaattattgcttccaaagtaacagaggagaactttgatggcaataattaacctggcggcagcgcaaaagatg

SEQ ID NO: 25518 - DNA, 103 bp, Artificial Sequence
  Synthetic Polynucleotide
taatacgactcactatagggttataagcagatatatcaattattgcttccaacagaggagaggaagcatgaattgatataacctggcggcagcgcaaaagatg

SEQ ID NO: 25519 - DNA, 103 bp, Artificial Sequence
  Synthetic Polynucleotide
taatacgactcactataggggctcattataagcagatatatcaattattgaacagaggagacaataaatgatatatctgaacctggcggcagcgcaaaagatg

SEQ ID NO: 25520 - DNA, 103 bp, Artificial Sequence
  Synthetic Polynucleotide
taatacgactcactatagggcgtccgctcattataagcagatatatcaataacagaggagaattgatatgtctgcttataacctggcggcagcgcaaaagatg

SEQ ID NO: 25521 - DNA, 103 bp, Artificial Sequence
  Synthetic Polynucleotide
taatacgactcactatagggttgaccgtccgctcattataagcagatataaacagaggagatatatcatgttataatgaaacctggcggcagcgcaaaagatg

SEQ ID NO: 25522 - DNA, 103 bp, Artificial Sequence
  Synthetic Polynucleotide
taatacgactcactatagggctcctttgaccgtccgctcattataagcagaacagaggagactgcttatgatgagcggaaacctggcggcagcgcaaaagatg

SEQ ID NO: 25523 - DNA, 103 bp, Artificial Sequence
  Synthetic Polynucleotide
taatacgactcactatagggtgggactcctttgaccgtccgctcattataaacagaggagatataatatgcggacggtcaacctggcggcagcgcaaaagatg

SEQ ID NO: 25524 - DNA, 103 bp, Artificial Sequence
  Synthetic Polynucleotide
taatacgactcactatagggcacgctgggactcctttgaccgtccgctcaaacagaggagatgagcgatgggtcaaaggaacctggcggcagcgcaaaagatg

SEQ ID NO: 25525 - DNA, 103 bp, Artificial Sequence
  Synthetic Polynucleotide
taatacgactcactataggggcagccacgctgggactcctttgaccgtccaacagaggagaggacggatgaaggagtccaacctggcggcagcgcaaaagatg

SEQ ID NO: 25526 - DNA, 103 bp, Artificial Sequence
  Synthetic Polynucleotide
taatacgactcactatagggtgacagaaagagcccaatcctccccctttgaacagaggagacaaaggatgaggattgggaacctggcggcagcgcaaaagatg

SEQ ID NO: 25527 - DNA, 103 bp, Artificial Sequence
  Synthetic Polynucleotide
taatacgactcactatagggaagaggcagccacgctgggactcctttgacaacagaggagagtcaaaatggtcccagcgaacctggcggcagcgcaaaagatg

SEQ ID NO: 25528 - DNA, 103 bp, Artificial Sequence
  Synthetic Polynucleotide
taatacgactcactatagggatcccaagaggcagccacgctgggactcctaacagaggagaaggagtatgagcgtggctaacctggcggcagcgcaaaagatg

SEQ ID NO: 25529 - DNA, 103 bp, Artificial Sequence
  Synthetic Polynucleotide
taatacgactcactatagggtcatgatcccaagaggcagccacgctgggaaacagaggagatcccagatgggctgcctcaacctggcggcagcgcaaaagatg

SEQ ID NO: 25530 - DNA, 103 bp, Artificial Sequence
  Synthetic Polynucleotide
taatacgactcactatagggattgctcatgatcccaagaggcagccacgcaacagaggagagcgtggatgcctcttgggaacctggcggcagcgcaaaagatg

SEQ ID NO: 25531 - DNA, 103 bp, Artificial Sequence
  Synthetic Polynucleotide
taatacgactcactatagggtcaaaattgctcatgatcccaagaggcagcaacagaggagagctgccatgtgggatcataacctggcggcagcgcaaaagatg

SEQ ID NO: 25532 - DNA, 103 bp, Artificial Sequence
  Synthetic Polynucleotide
taatacgactcactatagggggtattcaaaattgctcatgatcccaagagaacagaggagactcttgatgtcatgagcaaacctggcggcagcgcaaaagatg

SEQ ID NO: 25533 - DNA, 103 bp, Artificial Sequence
  Synthetic Polynucleotide
taatacgactcactatagggtaaagggtattcaaaattgctcatgatcccaacagaggagagggatcatgagcaattttaacctggcggcagcgcaaaagatg

SEQ ID NO: 25534 - DNA, 103 bp, Artificial Sequence
  Synthetic Polynucleotide
taatacgactcactatagggtgggctaaagggtattcaaaattgctcatgaacagaggagacatgagatgttttgaataaacctggcggcagcgcaaaagatg

SEQ ID NO: 25535 - DNA, 103 bp, Artificial Sequence
  Synthetic Polynucleotide
taatacgactcactatagggcagtgtgggctaaagggtattcaaaattgcaacagaggagagcaattatgaatacccttaacctggcggcagcgcaaaagatg

SEQ ID NO: 25536 - DNA, 103 bp, Artificial Sequence
  Synthetic Polynucleotide
taatacgactcactatagggagcaacagtgtgggctaaagggtattcaaaaacagaggagatttgaaatgcctttagccaacctggcggcagcgcaaaagatg

SEQ ID NO: 25537 - DNA, 103 bp, Artificial Sequence
  Synthetic Polynucleotide
taatacgactcactatagggcaaaatgacagaaagagcccaatcctccccaacagaggagaggggagatgtgggctcttaacctggcggcagcgcaaaagatg

SEQ ID NO: 25538 - DNA, 103 bp, Artificial Sequence
  Synthetic Polynucleotide
taatacgactcactatagggaatgcagcaacagtgtgggctaaagggtataacagaggagaatacccatgagcccacacaacctggcggcagcgcaaaagatg

SEQ ID NO: 25539 - DNA, 103 bp, Artificial Sequence
  Synthetic Polynucleotide
taatacgactcactatagggtaagcaatgcagcaacagtgtgggctaaagaacagaggagactttagatgacactgttgaacctggcggcagcgcaaaagatg

SEQ ID NO: 25540 - DNA, 103 bp, Artificial Sequence
  Synthetic Polynucleotide
taatacgactcactatagggccctgtaagcaatgcagcaacagtgtgggcaacagaggagagcccacatggttgctgcaaacctggcggcagcgcaaaagatg

SEQ ID NO: 25541 - DNA, 103 bp, Artificial Sequence
  Synthetic Polynucleotide
taatacgactcactatagggtagctccctgtaagcaatgcagcaacagtgaacagaggagacactgtatgtgcattgctaacctggcggcagcgcaaaagatg

SEQ ID NO: 25542 - DNA, 103 bp, Artificial Sequence
  Synthetic Polynucleotide
taatacgactcactatagggtcgtgtagctccctgtaagcaatgcagcaaaacagaggagattgctgatgtgcttacagaacctggcggcagcgcaaaagatg

SEQ ID NO: 25543 - DNA, 103 bp, Artificial Sequence
  Synthetic Polynucleotide
taatacgactcactatagggggtaatcgtgtagctccctgtaagcaatgcaacagaggagagcattgatgacagggagcaacctggcggcagcgcaaaagatg

SEQ ID NO: 25544 - DNA, 103 bp, Artificial Sequence
  Synthetic Polynucleotide
taatacgactcactatagggaattgggtaatcgtgtagctccctgtaagcaacagaggagagcttacatggagctacacaacctggcggcagcgcaaaagatg

SEQ ID NO: 25545 - DNA, 103 bp, Artificial Sequence
  Synthetic Polynucleotide
taatacgactcactataggggcgtgaattgggtaatcgtgtagctccctgaacagaggagacagggaatgacacgattaaacctggcggcagcgcaaaagatg

SEQ ID NO: 25546 - DNA, 103 bp, Artificial Sequence
  Synthetic Polynucleotide
taatacgactcactatagggattgtgcgtgaattgggtaatcgtgtagctaacagaggagaagctacatgattacccaaaacctggcggcagcgcaaaagatg

SEQ ID NO: 25547 - DNA, 103 bp, Artificial Sequence
  Synthetic Polynucleotide
taatacgactcactatagggtgtccattgtgcgtgaattgggtaatcgtgaacagaggagacacgatatgccaattcacaacctggcggcagcgcaaaagatg

SEQ ID NO: 25548 - DNA, 103 bp, Artificial Sequence
  Synthetic Polynucleotide
taatacgactcactataggggactgcaaaatgacagaaagagcccaatccaacagaggagaggattgatgtctttctgtaacctggcggcagcgcaaaagatg

SEQ ID NO: 25549 - DNA, 103 bp, Artificial Sequence
  Synthetic Polynucleotide
taatacgactcactatagggatttttgtccattgtgcgtgaattgggtaaaacagaggagattacccatgtcacgcacaaacctggcggcagcgcaaaagatg

SEQ ID NO: 25550 - DNA, 103 bp, Artificial Sequence
  Synthetic Polynucleotide
taatacgactcactatagggaacaaatttttgtccattgtgcgtgaattgaacagaggagacaattcatgcacaatggaaacctggcggcagcgcaaaagatg

SEQ ID NO: 25551 - DNA, 103 bp, Artificial Sequence
  Synthetic Polynucleotide
taatacgactcactatagggacacgaacaaatttttgtccattgtgcgtgaacagaggagacacgcaatgtggacaaaaaacctggcggcagcgcaaaagatg

SEQ ID NO: 25552 - DNA, 103 bp, Artificial Sequence
  Synthetic Polynucleotide
taatacgactcactataggggattaacacgaacaaatttttgtccattgtaacagaggagaacaatgatgaaaaatttgaacctggcggcagcgcaaaagatg

SEQ ID NO: 25553 - DNA, 103 bp, Artificial Sequence
  Synthetic Polynucleotide
taatacgactcactatagggaagtcgattaacacgaacaaatttttgtccaacagaggagaggacaaatgtttgttcgtaacctggcggcagcgcaaaagatg

SEQ ID NO: 25554 - DNA, 103 bp, Artificial Sequence
  Synthetic Polynucleotide
taatacgactcactataggggtcccaagtcgattaacacgaacaaattttaacagaggagaaaaattatgtcgtgttaaaacctggcggcagcgcaaaagatg

SEQ ID NO: 25555 - DNA, 103 bp, Artificial Sequence
  Synthetic Polynucleotide
taatacgactcactatagggttcctgtcccaagtcgattaacacgaacaaaacagaggagattgttcatgttaatcgacaacctggcggcagcgcaaaagatg

SEQ ID NO: 25556 - DNA, 103 bp, Artificial Sequence
  Synthetic Polynucleotide
taatacgactcactatagggtgggattcctgtcccaagtcgattaacacgaacagaggagacgtgttatgcgacttgggaacctggcggcagcgcaaaagatg

SEQ ID NO: 25557 - DNA, 103 bp, Artificial Sequence
  Synthetic Polynucleotide
taatacgactcactatagggtgtgctgggattcctgtcccaagtcgattaaacagaggagataatcgatgtgggacaggaacctggcggcagcgcaaaagatg

SEQ ID NO: 25558 - DNA, 103 bp, Artificial Sequence
  Synthetic Polynucleotide
taatacgactcactataggggtggatgtgctgggattcctgtcccaagtcaacagaggagagacttgatgcaggaatccaacctggcggcagcgcaaaagatg

SEQ ID NO: 25559 - DNA, 103 bp, Artificial Sequence
  Synthetic Polynucleotide
taatacgactcactatagggaaaaagactgcaaaatgacagaaagagcccaacagaggagagggctcatgctgtcatttaacctggcggcagcgcaaaagatg

SEQ ID NO: 25560 - DNA, 103 bp, Artificial Sequence
  Synthetic Polynucleotide
taatacgactcactatagggtctgagtggatgtgctgggattcctgtcccaacagaggagagggacaatgatcccagcaaacctggcggcagcgcaaaagatg

SEQ ID NO: 25561 - DNA, 103 bp, Artificial Sequence
  Synthetic Polynucleotide
taatacgactcactatagggagcattctgagtggatgtgctgggattcctaacagaggagaaggaatatgagcacatccaacctggcggcagcgcaaaagatg

SEQ ID NO: 25562 - DNA, 103 bp, Artificial Sequence
  Synthetic Polynucleotide
taatacgactcactatagggcccgcagcattctgagtggatgtgctgggaaacagaggagatcccagatgatccactcaaacctggcggcagcgcaaaagatg

SEQ ID NO: 25563 - DNA, 103 bp, Artificial Sequence
  Synthetic Polynucleotide
taatacgactcactatagggtccttcccgcagcattctgagtggatgtgcaacagaggagagcacatatgctcagaatgaacctggcggcagcgcaaaagatg

SEQ ID NO: 25564 - DNA, 103 bp, Artificial Sequence
  Synthetic Polynucleotide
taatacgactcactatagggtggtttccttcccgcagcattctgagtggaaacagaggagatccactatgaatgctgcgaacctggcggcagcgcaaaagatg

SEQ ID NO: 25565 - DNA, 103 bp, Artificial Sequence
  Synthetic Polynucleotide
taatacgactcactatagggaagcttggtttccttcccgcagcattctgaaacagaggagatcagaaatgtgcgggaagaacctggcggcagcgcaaaagatg

SEQ ID NO: 25566 - DNA, 103 bp, Artificial Sequence
  Synthetic Polynucleotide
taatacgactcactataggggacaaaagcttggtttccttcccgcagcataacagaggagaatgctgatggaaggaaacaacctggcggcagcgcaaaagatg

SEQ ID NO: 25567 - DNA, 103 bp, Artificial Sequence
  Synthetic Polynucleotide
taatacgactcactatagggttttggacaaaagcttggtttccttcccgcaacagaggagagcgggaatgaaaccaagcaacctggcggcagcgcaaaagatg

SEQ ID NO: 25568 - DNA, 103 bp, Artificial Sequence
  Synthetic Polynucleotide
taatacgactcactatagggccatgttttggacaaaagcttggtttccttaacagaggagaaaggaaatgaagcttttgaacctggcggcagcgcaaaagatg

SEQ ID NO: 25569 - DNA, 103 bp, Artificial Sequence
  Synthetic Polynucleotide
taatacgactcactatagggaatcaccatgttttggacaaaagcttggttaacagaggagaaaccaaatgtttgtccaaaacctggcggcagcgcaaaagatg

SEQ ID NO: 25570 - DNA, 103 bp, Artificial Sequence
  Synthetic Polynucleotide
taatacgactcactatagggctagcaaggtacagttatacattagagcaaaacagaggagattgctcatgtgtataactaacctggcggcagcgcaaaagatg

SEQ ID NO: 25571 - DNA, 103 bp, Artificial Sequence
  Synthetic Polynucleotide
taatacgactcactatagggataaagggcaactacaaagatacagtgcaaaacagaggagattgcacatgatctttgtaaacctggcggcagcgcaaaagatg

SEQ ID NO: 25572 - DNA, 103 bp, Artificial Sequence
  Synthetic Polynucleotide
taatacgactcactatagggtgacacccccaatctttcagcgagaagcagaacagaggagactgcttatggctgaaagaaacctggcggcagcgcaaaagatg

SEQ ID NO: 25573 - DNA, 103 bp, Artificial Sequence
  Synthetic Polynucleotide
taatacgactcactatagggccacaggggcttcaagtaaaggtactatagaacagaggagactatagatgctttacttgaacctggcggcagcgcaaaagatg

SEQ ID NO: 25574 - DNA, 103 bp, Artificial Sequence
  Synthetic Polynucleotide
taatacgactcactatagggaggatccacaggggcttcaagtaaaggtacaacagaggagagtacctatgcttgaagccaacctggcggcagcgcaaaagatg

SEQ ID NO: 25575 - DNA, 103 bp, Artificial Sequence
  Synthetic Polynucleotide
taatacgactcactatagggcctgaaggatccacaggggcttcaagtaaaaacagaggagatttactatgagcccctgtaacctggcggcagcgcaaaagatg

SEQ ID NO: 25576 - DNA, 103 bp, Artificial Sequence
  Synthetic Polynucleotide
taatacgactcactatagggccccccctgaaggatccacaggggcttcaaaacagaggagattgaagatgctgtggatcaacctggcggcagcgcaaaagatg

SEQ ID NO: 25577 - DNA, 103 bp, Artificial Sequence
  Synthetic Polynucleotide
taatacgactcactatagggtaaatccccccctgaaggatccacaggggcaacagaggagagcccctatggatccttcaaacctggcggcagcgcaaaagatg

SEQ ID NO: 25578 - DNA, 103 bp, Artificial Sequence
  Synthetic Polynucleotide
taatacgactcactatagggttttctaaatccccccctgaaggatccacaaacagaggagatgtggaatgttcagggggaacctggcggcagcgcaaaagatg

SEQ ID NO: 25579 - DNA, 103 bp, Artificial Sequence
  Synthetic Polynucleotide
taatacgactcactatagggcaatgttttctaaatccccccctgaaggataacagaggagaatccttatgggggggattaacctggcggcagcgcaaaagatg

SEQ ID NO: 25580 - DNA, 103 bp, Artificial Sequence
  Synthetic Polynucleotide
taatacgactcactatagggctcagcaatgttttctaaatccccccctgaaacagaggagatcagggatggatttagaaaacctggcggcagcgcaaaagatg

SEQ ID NO: 25581 - DNA, 103 bp, Artificial Sequence
  Synthetic Polynucleotide
taatacgactcactataggggcaacctcagcaatgttttctaaatcccccaacagaggagagggggaatgagaaaacataacctggcggcagcgcaaaagatg

SEQ ID NO: 25582 - DNA, 103 bp, Artificial Sequence
  Synthetic Polynucleotide
taatacgactcactatagggtgggcgcaacctcagcaatgttttctaaataacagaggagaatttagatgacattgctgaacctggcggcagcgcaaaagatg

SEQ ID NO: 25583 - DNA, 103 bp, Artificial Sequence
  Synthetic Polynucleotide
taatacgactcactatagggtcaggtgacacccccaatctttcagcgagaaacagaggagatctcgcatgaagattgggaacctggcggcagcgcaaaagatg

SEQ ID NO: 25584 - DNA, 103 bp, Artificial Sequence
  Synthetic Polynucleotide
taatacgactcactataggggtgtgtgggcgcaacctcagcaatgttttcaacagaggagagaaaacatggctgaggttaacctggcggcagcgcaaaagatg

SEQ ID NO: 25585 - DNA, 103 bp, Artificial Sequence
  Synthetic Polynucleotide
taatacgactcactatagggtttgtgtgtgtgggcgcaacctcagcaatgaacagaggagacattgcatgggttgcgccaacctggcggcagcgcaaaagatg

SEQ ID NO: 25586 - DNA, 103 bp, Artificial Sequence
  Synthetic Polynucleotide
taatacgactcactatagggcaccatttgtgtgtgtgggcgcaacctcagaacagaggagactgaggatgcgcccacacaacctggcggcagcgcaaaagatg

SEQ ID NO: 25587 - DNA, 103 bp, Artificial Sequence
  Synthetic Polynucleotide
taatacgactcactatagggcaggccaccatttgtgtgtgtgggcgcaacaacagaggagagttgcgatgacacacacaaacctggcggcagcgcaaaagatg

SEQ ID NO: 25588 - DNA, 103 bp, Artificial Sequence
  Synthetic Polynucleotide
taatacgactcactataggggggtccaggccaccatttgtgtgtgtgggcaacagaggagagcccacatgcacaaatggaacctggcggcagcgcaaaagatg

SEQ ID NO: 25589 - DNA, 103 bp, Artificial Sequence
  Synthetic Polynucleotide
taatacgactcactatagggtaacagggtccaggccaccatttgtgtgtgaacagaggagacacacaatgatggtggccaacctggcggcagcgcaaaagatg

SEQ ID NO: 25590 - DNA, 103 bp, Artificial Sequence
  Synthetic Polynucleotide
taatacgactcactatagggtattataacagggtccaggccaccatttgtaacagaggagaacaaatatgggcctggacaacctggcggcagcgcaaaagatg

SEQ ID NO: 25591 - DNA, 103 bp, Artificial Sequence
  Synthetic Polynucleotide
taatacgactcactataggggcccctattataacagggtccaggccaccaaacagaggagatggtggatgggaccctgtaacctggcggcagcgcaaaagatg

SEQ ID NO: 25592 - DNA, 103 bp, Artificial Sequence
  Synthetic Polynucleotide
taatacgactcactatagggcaggagcccctattataacagggtccaggcaacagaggagagcctggatgctgttataaaacctggcggcagcgcaaaagatg

SEQ ID NO: 25593 - DNA, 103 bp, Artificial Sequence
  Synthetic Polynucleotide
taatacgactcactatagggttcatcaggagcccctattataacagggtcaacagaggagagaccctatgataatagggaacctggcggcagcgcaaaagatg

SEQ ID NO: 25594 - DNA, 103 bp, Artificial Sequence
  Synthetic Polynucleotide
taatacgactcactataggggatcttcaggtgacacccccaatctttcagaacagaggagactgaaaatgtgggggtgtaacctggcggcagcgcaaaagatg

SEQ ID NO: 25595 - DNA, 103 bp, Artificial Sequence
  Synthetic Polynucleotide
taatacgactcactataggggcttcttcatcaggagcccctattataacaaacagaggagatgttatatgaggggctccaacctggcggcagcgcaaaagatg

SEQ ID NO: 25596 - DNA, 103 bp, Artificial Sequence
  Synthetic Polynucleotide
taatacgactcactatagggctggtgcttcttcatcaggagcccctattaaacagaggagataatagatgctcctgatgaacctggcggcagcgcaaaagatg

SEQ ID NO: 25597 - DNA, 103 bp, Artificial Sequence
  Synthetic Polynucleotide
taatacgactcactatagggaatgactggtgcttcttcatcaggagccccaacagaggagaggggctatggatgaagaaaacctggcggcagcgcaaaagatg

SEQ ID NO: 25598 - DNA, 103 bp, Artificial Sequence
  Synthetic Polynucleotide
taatacgactcactatagggacctcaatgactggtgcttcttcatcaggaaacagaggagatcctgaatgagaagcaccaacctggcggcagcgcaaaagatg

SEQ ID NO: 25599 - DNA, 103 bp, Artificial Sequence
  Synthetic Polynucleotide
taatacgactcactatagggcctgaacctcaatgactggtgcttcttcataacagaggagaatgaagatgcaccagtcaaacctggcggcagcgcaaaagatg

SEQ ID NO: 25600 - DNA, 103 bp, Artificial Sequence
  Synthetic Polynucleotide
taatacgactcactatagggtccttcctgaacctcaatgactggtgcttcaacagaggagagaagcaatggtcattgagaacctggcggcagcgcaaaagatg

SEQ ID NO: 25601 - DNA, 103 bp, Artificial Sequence
  Synthetic Polynucleotide
taatacgactcactataggggccggtccttcctgaacctcaatgactggtaacagaggagaaccagtatgtgaggttcaaacctggcggcagcgcaaaagatg

SEQ ID NO: 25602 - DNA, 103 bp, Artificial Sequence
  Synthetic Polynucleotide
taatacgactcactatagggtaggcgccggtccttcctgaacctcaatgaaacagaggagatcattgatgttcaggaagaacctggcggcagcgcaaaagatg

SEQ ID NO: 25603 - DNA, 103 bp, Artificial Sequence
  Synthetic Polynucleotide
taatacgactcactatagggtggtgtaggcgccggtccttcctgaacctcaacagaggagagaggttatggaaggaccgaacctggcggcagcgcaaaagatg

SEQ ID NO: 25604 - DNA, 103 bp, Artificial Sequence
  Synthetic Polynucleotide
taatacgactcactatagggacaggtggtgtaggcgccggtccttcctgaaacagaggagatcaggaatgaccggcgccaacctggcggcagcgcaaaagatg

SEQ ID NO: 25605 - DNA, 103 bp, Artificial Sequence
  Synthetic Polynucleotide
taatacgactcactatagggtagcagatcttcaggtgacacccccaatctaacagaggagaagattgatggtgtcacctaacctggcggcagcgcaaaagatg

SEQ ID NO: 25606 - DNA, 103 bp, Artificial Sequence
  Synthetic Polynucleotide
taatacgactcactatagggtgcgaacaggtggtgtaggcgccggtccttaacagaggagaaaggacatgcgcctacacaacctggcggcagcgcaaaagatg

SEQ ID NO: 25607 - DNA, 103 bp, Artificial Sequence
  Synthetic Polynucleotide
taatacgactcactatagggacggctgcgaacaggtggtgtaggcgccggaacagaggagaccggcgatgacaccacctaacctggcggcagcgcaaaagatg

SEQ ID NO: 25608 - DNA, 103 bp, Artificial Sequence
  Synthetic Polynucleotide
taatacgactcactatagggcttgtacggctgcgaacaggtggtgtaggcaacagaggagagcctacatgacctgttcgaacctggcggcagcgcaaaagatg

SEQ ID NO: 25609 - DNA, 103 bp, Artificial Sequence
  Synthetic Polynucleotide
taatacgactcactatagggttgtacttgtacggctgcgaacaggtggtgaacagaggagacaccacatgttcgcagccaacctggcggcagcgcaaaagatg

SEQ ID NO: 25610 - DNA, 103 bp, Artificial Sequence
  Synthetic Polynucleotide
taatacgactcactataggggactgttgtacttgtacggctgcgaacaggaacagaggagacctgttatgagccgtacaaacctggcggcagcgcaaaagatg

SEQ ID NO: 25611 - DNA, 103 bp, Artificial Sequence
  Synthetic Polynucleotide
taatacgactcactatagggttatggactgttgtacttgtacggctgcgaaacagaggagatcgcagatgtacaagtacaacctggcggcagcgcaaaagatg

SEQ ID NO: 25612 - DNA, 103 bp, Artificial Sequence
  Synthetic Polynucleotide
taatacgactcactataggggattgttatggactgttgtacttgtacggcaacagaggagagccgtaatggtacaacagaacctggcggcagcgcaaaagatg

SEQ ID NO: 25613 - DNA, 103 bp, Artificial Sequence
  Synthetic Polynucleotide
taatacgactcactatagggggacggattgttatggactgttgtacttgtaacagaggagaacaagtatgacagtccataacctggcggcagcgcaaaagatg

SEQ ID NO: 25614 - DNA, 103 bp, Artificial Sequence
  Synthetic Polynucleotide
taatacgactcactatagggtgataggacggattgttatggactgttgtaaacagaggagatacaacatgccataacaaaacctggcggcagcgcaaaagatg

SEQ ID NO: 25615 - DNA, 103 bp, Artificial Sequence
  Synthetic Polynucleotide
taatacgactcactatagggtagaatgataggacggattgttatggactgaacagaggagacagtccatgacaatccgtaacctggcggcagcgcaaaagatg

SEQ ID NO: 25616 - DNA, 103 bp, Artificial Sequence
  Synthetic Polynucleotide
taatacgactcactataggggatattagcagatcttcaggtgacacccccaacagaggagagggggtatgacctgaagaaacctggcggcagcgcaaaagatg

SEQ ID NO: 25617 - DNA, 103 bp, Artificial Sequence
  Synthetic Polynucleotide
taatacgactcactatagggcactatagaatgataggacggattgttatgaacagaggagacataacatgccgtcctataacctggcggcagcgcaaaagatg

SEQ ID NO: 25618 - DNA, 103 bp, Artificial Sequence
  Synthetic Polynucleotide
taatacgactcactatagggctggccactatagaatgataggacggattgaacagaggagacaatccatgctatcattcaacctggcggcagcgcaaaagatg

SEQ ID NO: 25619 - DNA, 103 bp, Artificial Sequence
  Synthetic Polynucleotide
taatacgactcactatagggcactgctggccactatagaatgataggacgaacagaggagacgtcctatgattctatagaacctggcggcagcgcaaaagatg

SEQ ID NO: 25620 - DNA, 103 bp, Artificial Sequence
  Synthetic Polynucleotide
taatacgactcactatagggaatgtcactgctggccactatagaatgataaacagaggagatatcatatgatagtggccaacctggcggcagcgcaaaagatg

SEQ ID NO: 25621 - DNA, 103 bp, Artificial Sequence
  Synthetic Polynucleotide
taatacgactcactatagggcccggaatgtcactgctggccactatagaaaacagaggagattctatatgggccagcagaacctggcggcagcgcaaaagatg

SEQ ID NO: 25622 - DNA, 103 bp, Artificial Sequence
  Synthetic Polynucleotide
taatacgactcactatagggtttcccccggaatgtcactgctggccactaaacagaggagatagtggatggcagtgacaaacctggcggcagcgcaaaagatg

SEQ ID NO: 25623 - DNA, 103 bp, Artificial Sequence
  Synthetic Polynucleotide
taatacgactcactatagggagctgtttcccccggaatgtcactgctggcaacagaggagagccagcatggacattccgaacctggcggcagcgcaaaagatg

SEQ ID NO: 25624 - DNA, 103 bp, Artificial Sequence
  Synthetic Polynucleotide
taatacgactcactataggggaggcagctgtttcccccggaatgtcactgaacagaggagacagtgaatgtccgggggaaacctggcggcagcgcaaaagatg

SEQ ID NO: 25625 - DNA, 103 bp, Artificial Sequence
  Synthetic Polynucleotide
taatacgactcactataggggatctgaggcagctgtttcccccggaatgtaacagaggagaacattcatggggaaacagaacctggcggcagcgcaaaagatg

SEQ ID NO: 25626 - DNA, 103 bp, Artificial Sequence
  Synthetic Polynucleotide
taatacgactcactatagggaatttgatctgaggcagctgtttcccccggaacagaggagaccggggatgacagctgccaacctggcggcagcgcaaaagatg

SEQ ID NO: 25627 - DNA, 103 bp, Artificial Sequence
  Synthetic Polynucleotide
taatacgactcactatagggtacaagatattagcagatcttcaggtgacaaacagaggagatgtcacatgaagatctgcaacctggcggcagcgcaaaagatg

SEQ ID NO: 25628 - DNA, 103 bp, Artificial Sequence
  Synthetic Polynucleotide
taatacgactcactatagggataaaaatttgatctgaggcagctgtttccaacagaggagaggaaacatgtgcctcagaaacctggcggcagcgcaaaagatg

SEQ ID NO: 25629 - DNA, 103 bp, Artificial Sequence
  Synthetic Polynucleotide
taatacgactcactatagggcagtgataaaaatttgatctgaggcagctgaacagaggagacagctgatgcagatcaaaaacctggcggcagcgcaaaagatg

SEQ ID NO: 25630 - DNA, 103 bp, Artificial Sequence
  Synthetic Polynucleotide
taatacgactcactataggggccatcagtgataaaaatttgatctgaggcaacagaggagagcctcaatgcaaatttttaacctggcggcagcgcaaaagatg

SEQ ID NO: 25631 - DNA, 103 bp, Artificial Sequence
  Synthetic Polynucleotide
taatacgactcactatagggctcaagccatcagtgataaaaatttgatctaacagaggagaagatcaatgttttatcacaacctggcggcagcgcaaaagatg

SEQ ID NO: 25632 - DNA, 103 bp, Artificial Sequence
  Synthetic Polynucleotide
taatacgactcactatagggcagccctcaagccatcagtgataaaaatttaacagaggagaaaatttatgtcactgatgaacctggcggcagcgcaaaagatg

SEQ ID NO: 25633 - DNA, 103 bp, Artificial Sequence
  Synthetic Polynucleotide
taatacgactcactatagggaaactcagccctcaagccatcagtgataaaaacagaggagatttatcatggatggcttgaacctggcggcagcgcaaaagatg

SEQ ID NO: 25634 - DNA, 103 bp, Artificial Sequence
  Synthetic Polynucleotide
taatacgactcactatagggcctataaactcagccctcaagccatcagtgaacagaggagacactgaatgcttgagggcaacctggcggcagcgcaaaagatg

SEQ ID NO: 25635 - DNA, 103 bp, Artificial Sequence
  Synthetic Polynucleotide
taatacgactcactatagggagcctcctataaactcagccctcaagccataacagaggagaatggctatggggctgagtaacctggcggcagcgcaaaagatg

SEQ ID NO: 25636 - DNA, 103 bp, Artificial Sequence
  Synthetic Polynucleotide
taatacgactcactatagggccctgagcctcctataaactcagccctcaaaacagaggagattgaggatggagtttataaacctggcggcagcgcaaaagatg

SEQ ID NO: 25637 - DNA, 103 bp, Artificial Sequence
  Synthetic Polynucleotide
taatacgactcactatagggtgaaaccctgagcctcctataaactcagccaacagaggagaggctgaatgtataggaggaacctggcggcagcgcaaaagatg

SEQ ID NO: 25638 - DNA, 103 bp, Artificial Sequence
  Synthetic Polynucleotide
taatacgactcactatagggaaatctacaagatattagcagatcttcaggaacagaggagacctgaaatgctgctaataaacctggcggcagcgcaaaagatg

SEQ ID NO: 25639 - DNA, 103 bp, Artificial Sequence
  Synthetic Polynucleotide
taatacgactcactatagggcttcctgaaaccctgagcctcctataaactaacagaggagaagtttaatggaggctcagaacctggcggcagcgcaaaagatg

SEQ ID NO: 25640 - DNA, 103 bp, Artificial Sequence
  Synthetic Polynucleotide
taatacgactcactatagggcacagcttcctgaaaccctgagcctcctataacagaggagaataggaatgtcagggtttaacctggcggcagcgcaaaagatg

SEQ ID NO: 25641 - DNA, 103 bp, Artificial Sequence
  Synthetic Polynucleotide
taatacgactcactataggggggaacacagcttcctgaaaccctgagcctaacagaggagaaggctcatggtttcaggaaacctggcggcagcgcaaaagatg

SEQ ID NO: 25642 - DNA, 103 bp, Artificial Sequence
  Synthetic Polynucleotide
taatacgactcactatagggtagacgggaacacagcttcctgaaaccctgaacagaggagacagggtatgaggaagctgaacctggcggcagcgcaaaagatg

SEQ ID NO: 25643 - DNA, 103 bp, Artificial Sequence
  Synthetic Polynucleotide
taatacgactcactatagggtgatgtagacgggaacacagcttcctgaaaaacagaggagatttcagatggctgtgttcaacctggcggcagcgcaaaagatg

SEQ ID NO: 25644 - DNA, 103 bp, Artificial Sequence
  Synthetic Polynucleotide
taatacgactcactataggggggcctgatgtagacgggaacacagcttccaacagaggagaggaagcatggttcccgtcaacctggcggcagcgcaaaagatg

SEQ ID NO: 25645 - DNA, 103 bp, Artificial Sequence
  Synthetic Polynucleotide
taatacgactcactataggggataggggcctgatgtagacgggaacacagaacagaggagactgtgtatgcgtctacataacctggcggcagcgcaaaagatg

SEQ ID NO: 25646 - DNA, 103 bp, Artificial Sequence
  Synthetic Polynucleotide
taatacgactcactatagggttcctgataggggcctgatgtagacgggaaaacagaggagattcccgatgacatcaggcaacctggcggcagcgcaaaagatg

SEQ ID NO: 25647 - DNA, 103 bp, Artificial Sequence
  Synthetic Polynucleotide
taatacgactcactatagggggaatttcctgataggggcctgatgtagacaacagaggagagtctacatgaggcccctaaacctggcggcagcgcaaaagatg

SEQ ID NO: 25648 - DNA, 103 bp, Artificial Sequence
  Synthetic Polynucleotide
taatacgactcactatagggctaaaggaatttcctgataggggcctgatgaacagaggagacatcagatgcctatcaggaacctggcggcagcgcaaaagatg

SEQ ID NO: 25649 - DNA, 103 bp, Artificial Sequence
  Synthetic Polynucleotide
taatacgactcactatagggcagcaaaatctacaagatattagcagatctaacagaggagaagatctatgaatatcttgaacctggcggcagcgcaaaagatg

SEQ ID NO: 25650 - DNA, 103 bp, Artificial Sequence
  Synthetic Polynucleotide
taatacgactcactatagggtgtgtctaaaggaatttcctgataggggccaacagaggagaggccccatgcaggaaattaacctggcggcagcgcaaaagatg

SEQ ID NO: 25651 - DNA, 103 bp, Artificial Sequence
  Synthetic Polynucleotide
taatacgactcactatagggtgaaatgtgtctaaaggaatttcctgatagaacagaggagactatcaatgaattcctttaacctggcggcagcgcaaaagatg

SEQ ID NO: 25652 - DNA, 103 bp, Artificial Sequence
  Synthetic Polynucleotide
taatacgactcactatagggtatcctgaaatgtgtctaaaggaatttcctaacagaggagaaggaaaatgctttagacaaacctggcggcagcgcaaaagatg

SEQ ID NO: 25653 - DNA, 103 bp, Artificial Sequence
  Synthetic Polynucleotide
taatacgactcactatagggatcaatatcctgaaatgtgtctaaaggaataacagaggagaattcctatggacacatttaacctggcggcagcgcaaaagatg

SEQ ID NO: 25654 - DNA, 103 bp, Artificial Sequence
  Synthetic Polynucleotide
taatacgactcactataggggaaacatcaatatcctgaaatgtgtctaaaaacagaggagatttagaatgatttcaggaaacctggcggcagcgcaaaagatg

SEQ ID NO: 25655 - DNA, 103 bp, Artificial Sequence
  Synthetic Polynucleotide
taatacgactcactatagggtgtcagaaacatcaatatcctgaaatgtgtaacagaggagaacacatatgaggatattgaacctggcggcagcgcaaaagatg

SEQ ID NO: 25656 - DNA, 103 bp, Artificial Sequence
  Synthetic Polynucleotide
taatacgactcactatagggcaatgtgtcagaaacatcaatatcctgaaaaacagaggagatttcagatgattgatgttaacctggcggcagcgcaaaagatg

SEQ ID NO: 25657 - DNA, 103 bp, Artificial Sequence
  Synthetic Polynucleotide
taatacgactcactatagggatgtgcaatgtgtcagaaacatcaatatccaacagaggagaggatatatgtgtttctgaaacctggcggcagcgcaaaagatg

SEQ ID NO: 25658 - DNA, 103 bp, Artificial Sequence
  Synthetic Polynucleotide
taatacgactcactatagggcttcaatgtgcaatgtgtcagaaacatcaaaacagaggagattgatgatgctgacacataacctggcggcagcgcaaaagatg

SEQ ID NO: 25659 - DNA, 103 bp, Artificial Sequence
  Synthetic Polynucleotide
taatacgactcactataggggggctcttcaatgtgcaatgtgtcagaaacaacagaggagagtttctatgacattgcacaacctggcggcagcgcaaaagatg

SEQ ID NO: 25660 - DNA, 103 bp, Artificial Sequence
  Synthetic Polynucleotide
taatacgactcactatagggaccagcagcaaaatctacaagatattagcaaacagaggagatgctaaatgcttgtagataacctggcggcagcgcaaaagatg

SEQ ID NO: 25661 - DNA, 103 bp, Artificial Sequence
  Synthetic Polynucleotide
taatacgactcactatagggcgagggggctcttcaatgtgcaatgtgtcaaacagaggagatgacacatggcacattgaaacctggcggcagcgcaaaagatg

SEQ ID NO: 25662 - DNA, 103 bp, Artificial Sequence
  Synthetic Polynucleotide
taatacgactcactatagggttgcacgagggggctcttcaatgtgcaatgaacagaggagacattgcatgttgaagagcaacctggcggcagcgcaaaagatg

SEQ ID NO: 25663 - DNA, 103 bp, Artificial Sequence
  Synthetic Polynucleotide
taatacgactcactatagggtgtgcttgcacgagggggctcttcaatgtgaacagaggagacacattatggagccccctaacctggcggcagcgcaaaagatg

SEQ ID NO: 25664 - DNA, 103 bp, Artificial Sequence
  Synthetic Polynucleotide
taatacgactcactatagggctcggtgtgcttgcacgagggggctcttcaaacagaggagatgaagaatgccctcgtgcaacctggcggcagcgcaaaagatg

SEQ ID NO: 25665 - DNA, 103 bp, Artificial Sequence
  Synthetic Polynucleotide
taatacgactcactatagggactccctcggtgtgcttgcacgagggggctaacagaggagaagccccatggtgcaagcaaacctggcggcagcgcaaaagatg

SEQ ID NO: 25666 - DNA, 103 bp, Artificial Sequence
  Synthetic Polynucleotide
taatacgactcactatagggtacagactccctcggtgtgcttgcacgaggaacagaggagacctcgtatgagcacaccgaacctggcggcagcgcaaaagatg

SEQ ID NO: 25667 - DNA, 103 bp, Artificial Sequence
  Synthetic Polynucleotide
taatacgactcactatagggtggcctacagactccctcggtgtgcttgcaaacagaggagatgcaagatgaccgagggaaacctggcggcagcgcaaaagatg

SEQ ID NO: 25668 - DNA, 103 bp, Artificial Sequence
  Synthetic Polynucleotide
taatacgactcactataggggactttggcctacagactccctcggtgtgcaacagaggagagcacacatggggagtctgaacctggcggcagcgcaaaagatg

SEQ ID NO: 25669 - DNA, 103 bp, Artificial Sequence
  Synthetic Polynucleotide
taatacgactcactatagggattcagactttggcctacagactccctcggaacagaggagaccgaggatgtctgtaggcaacctggcggcagcgcaaaagatg

SEQ ID NO: 25670 - DNA, 103 bp, Artificial Sequence
  Synthetic Polynucleotide
taatacgactcactatagggtttctattcagactttggcctacagactccaacagaggagaggagtcatgaggccaaagaacctggcggcagcgcaaaagatg

SEQ ID NO: 25671 - DNA, 103 bp, Artificial Sequence
  Synthetic Polynucleotide
taatacgactcactatagggcataaaccagcagcaaaatctacaagatataacagaggagaatatctatgagattttgcaacctggcggcagcgcaaaagatg

SEQ ID NO: 25672 - DNA, 103 bp, Artificial Sequence
  Synthetic Polynucleotide
taatacgactcactatagggtcatatttctattcagactttggcctacagaacagaggagactgtagatgaaagtctgaaacctggcggcagcgcaaaagatg

SEQ ID NO: 25673 - DNA, 103 bp, Artificial Sequence
  Synthetic Polynucleotide
taatacgactcactatagggtcttttcatatttctattcagactttggccaacagaggagaggccaaatgctgaatagaaacctggcggcagcgcaaaagatg

SEQ ID NO: 25674 - DNA, 103 bp, Artificial Sequence
  Synthetic Polynucleotide
taatacgactcactatagggcgtagtcttttcatatttctattcagacttaacagaggagaaagtctatgtagaaatataacctggcggcagcgcaaaagatg

SEQ ID NO: 25675 - DNA, 103 bp, Artificial Sequence
  Synthetic Polynucleotide
taatacgactcactatagggcggtgcgtagtcttttcatatttctattcaaacagaggagatgaataatgatatgaaaaaacctggcggcagcgcaaaagatg

SEQ ID NO: 25676 - DNA, 103 bp, Artificial Sequence
  Synthetic Polynucleotide
taatacgactcactatagggcattgcggtgcgtagtcttttcatatttctaacagaggagaagaaatatgaaaagactaaacctggcggcagcgcaaaagatg

SEQ ID NO: 25677 - DNA, 103 bp, Artificial Sequence
  Synthetic Polynucleotide
taatacgactcactatagggccatacattgcggtgcgtagtcttttcataaacagaggagatatgaaatgactacgcacaacctggcggcagcgcaaaagatg

SEQ ID NO: 25678 - DNA, 103 bp, Artificial Sequence
  Synthetic Polynucleotide
taatacgactcactataggggcctgccatacattgcggtgcgtagtctttaacagaggagaaaagacatggcaccgcaaaacctggcggcagcgcaaaagatg

SEQ ID NO: 25679 - DNA, 103 bp, Artificial Sequence
  Synthetic Polynucleotide
taatacgactcactatagggagtacgcctgccatacattgcggtgcgtagaacagaggagactacgcatggcaatgtataacctggcggcagcgcaaaagatg

SEQ ID NO: 25680 - DNA, 103 bp, Artificial Sequence
  Synthetic Polynucleotide
taatacgactcactatagggtgctgagtacgcctgccatacattgcggtgaacagaggagacaccgcatggtatggcagaacctggcggcagcgcaaaagatg

SEQ ID NO: 25681 - DNA, 103 bp, Artificial Sequence
  Synthetic Polynucleotide
taatacgactcactataggggaacctgctgagtacgcctgccatacattgaacagaggagacaatgtatggcaggcgtaaacctggcggcagcgcaaaagatg

SEQ ID NO: 25682 - DNA, 103 bp, Artificial Sequence
  Synthetic Polynucleotide
taatacgactcactatagggtgtcaataaagggcaactacaaagatacagaacagaggagactgtatatgtgtagttgcaacctggcggcagcgcaaaagatg

SEQ ID NO: 25683 - DNA, 103 bp, Artificial Sequence
  Synthetic Polynucleotide
taatacgactcactatagggaaggtcataaaccagcagcaaaatctacaaaacagaggagattgtagatgttgctgctgaacctggcggcagcgcaaaagatg

SEQ ID NO: 25684 - DNA, 103 bp, Artificial Sequence
  Synthetic Polynucleotide
taatacgactcactatagggcacccgaacctgctgagtacgcctgccataaacagaggagatatggcatgcgtactcagaacctggcggcagcgcaaaagatg

SEQ ID NO: 25685 - DNA, 103 bp, Artificial Sequence
  Synthetic Polynucleotide
taatacgactcactatagggttttccacccgaacctgctgagtacgcctgaacagaggagacaggcgatgtcagcaggtaacctggcggcagcgcaaaagatg

SEQ ID NO: 25686 - DNA, 103 bp, Artificial Sequence
  Synthetic Polynucleotide
taatacgactcactataggggtgggttttccacccgaacctgctgagtacaacagaggagagtactcatgaggttcgggaacctggcggcagcgcaaaagatg

SEQ ID NO: 25687 - DNA, 103 bp, Artificial Sequence
  Synthetic Polynucleotide
taatacgactcactatagggaaatcgtgggttttccacccgaacctgctgaacagaggagacagcagatgcgggtggaaaacctggcggcagcgcaaaagatg

SEQ ID NO: 25688 - DNA, 103 bp, Artificial Sequence
  Synthetic Polynucleotide
taatacgactcactatagggctaagaaatcgtgggttttccacccgaaccaacagaggagaggttcgatgggaaaacccaacctggcggcagcgcaaaagatg

SEQ ID NO: 25689 - DNA, 103 bp, Artificial Sequence
  Synthetic Polynucleotide
taatacgactcactataggggggagctaagaaatcgtgggttttccacccaacagaggagagggtggatgacccacgataacctggcggcagcgcaaaagatg

SEQ ID NO: 25690 - DNA, 103 bp, Artificial Sequence
  Synthetic Polynucleotide
taatacgactcactatagggacctggggagctaagaaatcgtgggttttcaacagaggagagaaaacatgcgatttcttaacctggcggcagcgcaaaagatg

SEQ ID NO: 25691 - DNA, 103 bp, Artificial Sequence
  Synthetic Polynucleotide
taatacgactcactatagggaatctacctggggagctaagaaatcgtgggaacagaggagacccacgatgtcttagctcaacctggcggcagcgcaaaagatg

SEQ ID NO: 25692 - DNA, 103 bp, Artificial Sequence
  Synthetic Polynucleotide
taatacgactcactataggggcactaatctacctggggagctaagaaatcaacagaggagagatttcatggctccccagaacctggcggcagcgcaaaagatg

SEQ ID NO: 25693 - DNA, 103 bp, Artificial Sequence
  Synthetic Polynucleotide
taatacgactcactatagggaaactgcactaatctacctggggagctaagaacagaggagacttagcatgccaggtagaaacctggcggcagcgcaaaagatg

SEQ ID NO: 25694 - DNA, 103 bp, Artificial Sequence
  Synthetic Polynucleotide
taatacgactcactatagggcttcaaaggtcataaaccagcagcaaaatcaacagaggagagattttatggctggtttaaacctggcggcagcgcaaaagatg

SEQ ID NO: 25695 - DNA, 103 bp, Artificial Sequence
  Synthetic Polynucleotide
taatacgactcactatagggtattcaaactgcactaatctacctggggagaacagaggagactccccatgtagattagtaacctggcggcagcgcaaaagatg

SEQ ID NO: 25696 - DNA, 103 bp, Artificial Sequence
  Synthetic Polynucleotide
taatacgactcactatagggtactgtattcaaactgcactaatctacctgaacagaggagacaggtaatgtagtgcagtaacctggcggcagcgcaaaagatg

SEQ ID NO: 25697 - DNA, 103 bp, Artificial Sequence
  Synthetic Polynucleotide
taatacgactcactatagggtggattactgtattcaaactgcactaatctaacagaggagaagattaatgcagtttgaaaacctggcggcagcgcaaaagatg

SEQ ID NO: 25698 - DNA, 103 bp, Artificial Sequence
  Synthetic Polynucleotide
taatacgactcactatagggaatgctggattactgtattcaaactgcactaacagaggagaagtgcaatgtgaatacagaacctggcggcagcgcaaaagatg

SEQ ID NO: 25699 - DNA, 103 bp, Artificial Sequence
  Synthetic Polynucleotide
taatacgactcactatagggcttgaaatgctggattactgtattcaaactaacagaggagaagtttgatgacagtaatcaacctggcggcagcgcaaaagatg

SEQ ID NO: 25700 - DNA, 103 bp, Artificial Sequence
  Synthetic Polynucleotide
taatacgactcactatagggctcatcttgaaatgctggattactgtattcaacagaggagagaatacatgaatccagcaaacctggcggcagcgcaaaagatg

SEQ ID NO: 25701 - DNA, 103 bp, Artificial Sequence
  Synthetic Polynucleotide
taatacgactcactataggggtgacctcatcttgaaatgctggattactgaacagaggagacagtaaatgagcatttcaaacctggcggcagcgcaaaagatg

SEQ ID NO: 25702 - DNA, 103 bp, Artificial Sequence
  Synthetic Polynucleotide
taatacgactcactatagggctaatgtgacctcatcttgaaatgctggataacagaggagaatccagatgttcaagatgaacctggcggcagcgcaaaagatg

SEQ ID NO: 25703 - DNA, 103 bp, Artificial Sequence
  Synthetic Polynucleotide
taatacgactcactatagggaaattctaatgtgacctcatcttgaaatgcaacagaggagagcatttatggatgaggtcaacctggcggcagcgcaaaagatg

SEQ ID NO: 25704 - DNA, 103 bp, Artificial Sequence
  Synthetic Polynucleotide
taatacgactcactatagggctttcaaattctaatgtgacctcatcttgaaacagaggagatcaagaatgggtcacattaacctggcggcagcgcaaaagatg

SEQ ID NO: 25705 - DNA, 103 bp, Artificial Sequence
  Synthetic Polynucleotide
taatacgactcactatagggtaaatcttcaaaggtcataaaccagcagcaaacagaggagatgctgcatgtttatgaccaacctggcggcagcgcaaaagatg

SEQ ID NO: 25706 - DNA, 103 bp, Artificial Sequence
  Synthetic Polynucleotide
taatacgactcactatagggcatctctttcaaattctaatgtgacctcataacagaggagaatgaggatgcattagaataacctggcggcagcgcaaaagatg

SEQ ID NO: 25707 - DNA, 103 bp, Artificial Sequence
  Synthetic Polynucleotide
taatacgactcactatagggactgacatctctttcaaattctaatgtgacaacagaggagagtcacaatggaatttgaaaacctggcggcagcgcaaaagatg

SEQ ID NO: 25708 - DNA, 103 bp, Artificial Sequence
  Synthetic Polynucleotide
taatacgactcactatagggactgcactgacatctctttcaaattctaataacagaggagaattagaatgtgaaagagaaacctggcggcagcgcaaaagatg

SEQ ID NO: 25709 - DNA, 103 bp, Artificial Sequence
  Synthetic Polynucleotide
taatacgactcactatagggcctcaactgcactgacatctctttcaaattaacagaggagaaatttgatggagatgtcaaacctggcggcagcgcaaaagatg

SEQ ID NO: 25710 - DNA, 103 bp, Artificial Sequence
  Synthetic Polynucleotide
taatacgactcactatagggagcttcctcaactgcactgacatctctttcaacagaggagagaaagaatggtcagtgcaaacctggcggcagcgcaaaagatg

SEQ ID NO: 25711 - DNA, 103 bp, Artificial Sequence
  Synthetic Polynucleotide
taatacgactcactatagggtcaggagcttcctcaactgcactgacatctaacagaggagaagatgtatgtgcagttgaaacctggcggcagcgcaaaagatg

SEQ ID NO: 25712 - DNA, 103 bp, Artificial Sequence
  Synthetic Polynucleotide
taatacgactcactatagggcaaattcaggagcttcctcaactgcactgaaacagaggagatcagtgatgttgaggaagaacctggcggcagcgcaaaagatg

SEQ ID NO: 25713 - DNA, 103 bp, Artificial Sequence
  Synthetic Polynucleotide
taatacgactcactatagggaaaatcaaattcaggagcttcctcaactgcaacagaggagagcagttatggaagctcctaacctggcggcagcgcaaaagatg

SEQ ID NO: 25714 - DNA, 103 bp, Artificial Sequence
  Synthetic Polynucleotide
taatacgactcactatagggtctctaaaatcaaattcaggagcttcctcaaacagaggagatgaggaatgtcctgaattaacctggcggcagcgcaaaagatg

SEQ ID NO: 25715 - DNA, 103 bp, Artificial Sequence
  Synthetic Polynucleotide
taatacgactcactatagggctatgtctctaaaatcaaattcaggagcttaacagaggagaaagctcatgaatttgattaacctggcggcagcgcaaaagatg

SEQ ID NO: 25716 - DNA, 103 bp, Artificial Sequence
  Synthetic Polynucleotide
taatacgactcactatagggtgcattaaatcttcaaaggtcataaaccagaacagaggagactggttatggacctttgaaacctggcggcagcgcaaaagatg

SEQ ID NO: 25717 - DNA, 103 bp, Artificial Sequence
  Synthetic Polynucleotide
taatacgactcactatagggacgaactatgtctctaaaatcaaattcaggaacagaggagacctgaaatggattttagaaacctggcggcagcgcaaaagatg

SEQ ID NO: 25718 - DNA, 103 bp, Artificial Sequence
  Synthetic Polynucleotide
taatacgactcactatagggcctaaacgaactatgtctctaaaatcaaataacagaggagaatttgaatgtagagacataacctggcggcagcgcaaaagatg

SEQ ID NO: 25719 - DNA, 103 bp, Artificial Sequence
  Synthetic Polynucleotide
taatacgactcactataggggccggcctaaacgaactatgtctctaaaataacagaggagaattttaatgacatagttcaacctggcggcagcgcaaaagatg

SEQ ID NO: 25720 - DNA, 103 bp, Artificial Sequence
  Synthetic Polynucleotide
taatacgactcactatagggtctaggccggcctaaacgaactatgtctctaacagaggagaagagacatggttcgtttaaacctggcggcagcgcaaaagatg

SEQ ID NO: 25721 - DNA, 103 bp, Artificial Sequence
  Synthetic Polynucleotide
taatacgactcactataggggagtatctaggccggcctaaacgaactatgaacagaggagacatagtatgtttaggccgaacctggcggcagcgcaaaagatg

SEQ ID NO: 25722 - DNA, 103 bp, Artificial Sequence
  Synthetic Polynucleotide
taatacgactcactatagggtttcagagtatctaggccggcctaaacgaaaacagaggagattcgttatggccggcctaaacctggcggcagcgcaaaagatg

SEQ ID NO: 25723 - DNA, 103 bp, Artificial Sequence
  Synthetic Polynucleotide
taatacgactcactatagggatttgtttcagagtatctaggccggcctaaaacagaggagattaggcatgcctagatacaacctggcggcagcgcaaaagatg

SEQ ID NO: 25724 - DNA, 103 bp, Artificial Sequence
  Synthetic Polynucleotide
taatacgactcactatagggcctgtatttgtttcagagtatctaggccggaacagaggagaccggccatgatactctgaaacctggcggcagcgcaaaagatg

SEQ ID NO: 25725 - DNA, 103 bp, Artificial Sequence
  Synthetic Polynucleotide
taatacgactcactatagggcataccctgtatttgtttcagagtatctagaacagaggagactagatatgctgaaacaaaacctggcggcagcgcaaaagatg

SEQ ID NO: 25726 - DNA, 103 bp, Artificial Sequence
  Synthetic Polynucleotide
taatacgactcactatagggcctaacataccctgtatttgtttcagagtaaacagaggagatactctatgacaaatacaaacctggcggcagcgcaaaagatg

SEQ ID NO: 25727 - DNA, 103 bp, Artificial Sequence
  Synthetic Polynucleotide
taatacgactcactatagggcaaagtgcattaaatcttcaaaggtcataaaacagaggagattatgaatgttgaagattaacctggcggcagcgcaaaagatg

SEQ ID NO: 25728 - DNA, 103 bp, Artificial Sequence
  Synthetic Polynucleotide
taatacgactcactatagggctgaccctaacataccctgtatttgtttcaaacagaggagatgaaacatgtacagggtaaacctggcggcagcgcaaaagatg

SEQ ID NO: 25729 - DNA, 103 bp, Artificial Sequence
  Synthetic Polynucleotide
taatacgactcactatagggacctactgaccctaacataccctgtatttgaacagaggagacaaataatgggtatgttaaacctggcggcagcgcaaaagatg

SEQ ID NO: 25730 - DNA, 103 bp, Artificial Sequence
  Synthetic Polynucleotide
taatacgactcactatagggacccaacctactgaccctaacataccctgtaacagaggagaacagggatggttagggtcaacctggcggcagcgcaaaagatg

SEQ ID NO: 25731 - DNA, 103 bp, Artificial Sequence
  Synthetic Polynucleotide
taatacgactcactatagggctccgacccaacctactgaccctaacatacaacagaggagagtatgtatgggtcagtagaacctggcggcagcgcaaaagatg

SEQ ID NO: 25732 - DNA, 103 bp, Artificial Sequence
  Synthetic Polynucleotide
taatacgactcactatagggtacctctccgacccaacctactgaccctaaaacagaggagattagggatggtaggttggaacctggcggcagcgcaaaagatg

SEQ ID NO: 25733 - DNA, 103 bp, Artificial Sequence
  Synthetic Polynucleotide
taatacgactcactatagggaatagtacctctccgacccaacctactgacaacagaggagagtcagtatgttgggtcggaacctggcggcagcgcaaaagatg

SEQ ID NO: 25734 - DNA, 103 bp, Artificial Sequence
  Synthetic Polynucleotide
taatacgactcactataggggtcctaatagtacctctccgacccaacctaaacagaggagataggttatgtcggagaggaacctggcggcagcgcaaaagatg

SEQ ID NO: 25735 - DNA, 103 bp, Artificial Sequence
  Synthetic Polynucleotide
taatacgactcactataggggccttgtcctaatagtacctctccgacccaaacagaggagatgggtcatggaggtactaaacctggcggcagcgcaaaagatg

SEQ ID NO: 25736 - DNA, 103 bp, Artificial Sequence
  Synthetic Polynucleotide
taatacgactcactatagggtccttgccttgtcctaatagtacctctccgaacagaggagacggagaatgactattaggaacctggcggcagcgcaaaagatg

SEQ ID NO: 25737 - DNA, 103 bp, Artificial Sequence
  Synthetic Polynucleotide
taatacgactcactatagggtgtgttccttgccttgtcctaatagtacctaacagaggagaaggtacatgtaggacaagaacctggcggcagcgcaaaagatg

SEQ ID NO: 25738 - DNA, 103 bp, Artificial Sequence
  Synthetic Polynucleotide
taatacgactcactatagggccagtcaaagtgcattaaatcttcaaaggtaacagaggagaacctttatggatttaatgaacctggcggcagcgcaaaagatg

SEQ ID NO: 25739 - DNA, 103 bp, Artificial Sequence
  Synthetic Polynucleotide
taatacgactcactatagggctatttgtgttccttgccttgtcctaatagaacagaggagactattaatgcaaggcaagaacctggcggcagcgcaaaagatg

SEQ ID NO: 25740 - DNA, 103 bp, Artificial Sequence
  Synthetic Polynucleotide
taatacgactcactatagggccctcctatttgtgttccttgccttgtcctaacagaggagaaggacaatgcaaggaacaaacctggcggcagcgcaaaagatg

SEQ ID NO: 25741 - DNA, 103 bp, Artificial Sequence
  Synthetic Polynucleotide
taatacgactcactataggggctgcccctcctatttgtgttccttgccttaacagaggagaaaggcaatgaacacaaataacctggcggcagcgcaaaagatg

SEQ ID NO: 25742 - DNA, 103 bp, Artificial Sequence
  Synthetic Polynucleotide
taatacgactcactatagggaatgagctgcccctcctatttgtgttccttaacagaggagaaaggaaatgaaataggagaacctggcggcagcgcaaaagatg

SEQ ID NO: 25743 - DNA, 103 bp, Artificial Sequence
  Synthetic Polynucleotide
taatacgactcactataggggtaataatgagctgcccctcctatttgtgtaacagaggagaacacaaatgggaggggcaaacctggcggcagcgcaaaagatg

SEQ ID NO: 25744 - DNA, 103 bp, Artificial Sequence
  Synthetic Polynucleotide
taatacgactcactatagggtcagtgtaataatgagctgcccctcctattaacagaggagaaataggatgggcagctcaaacctggcggcagcgcaaaagatg

SEQ ID NO: 25745 - DNA, 103 bp, Artificial Sequence
  Synthetic Polynucleotide
taatacgactcactatagggttatatcagtgtaataatgagctgcccctcaacagaggagagaggggatgctcattattaacctggcggcagcgcaaaagatg

SEQ ID NO: 25746 - DNA, 103 bp, Artificial Sequence
  Synthetic Polynucleotide
taatacgactcactatagggagaacttatatcagtgtaataatgagctgcaacagaggagagcagctatgtattacactaacctggcggcagcgcaaaagatg

SEQ ID NO: 25747 - DNA, 103 bp, Artificial Sequence
  Synthetic Polynucleotide
taatacgactcactatagggtgaatagaacttatatcagtgtaataatgaaacagaggagatcattaatgcactgatataacctggcggcagcgcaaaagatg

SEQ ID NO: 25748 - DNA, 103 bp, Artificial Sequence
  Synthetic Polynucleotide
taatacgactcactatagggcctcatgaatagaacttatatcagtgtaataacagaggagaattacaatgatataagttaacctggcggcagcgcaaaagatg

SEQ ID NO: 25749 - DNA, 103 bp, Artificial Sequence
  Synthetic Polynucleotide
taatacgactcactatagggcctttccagtcaaagtgcattaaatcttcaaacagaggagatgaagaatgaatgcacttaacctggcggcagcgcaaaagatg

SEQ ID NO: 25750 - DNA, 103 bp, Artificial Sequence
  Synthetic Polynucleotide
taatacgactcactataggggtcaccctcatgaatagaacttatatcagtaacagaggagaactgatatgagttctattaacctggcggcagcgcaaaagatg

SEQ ID NO: 25751 - DNA, 103 bp, Artificial Sequence
  Synthetic Polynucleotide
taatacgactcactatagggatagagtcaccctcatgaatagaacttataaacagaggagatataagatgtattcatgaaacctggcggcagcgcaaaagatg

SEQ ID NO: 25752 - DNA, 103 bp, Artificial Sequence
  Synthetic Polynucleotide
taatacgactcactataggggttccatagagtcaccctcatgaatagaacaacagaggagagttctaatgatgagggtgaacctggcggcagcgcaaaagatg

SEQ ID NO: 25753 - DNA, 103 bp, Artificial Sequence
  Synthetic Polynucleotide
taatacgactcactatagggagatagttccatagagtcaccctcatgaataacagaggagaattcatatgggtgactctaacctggcggcagcgcaaaagatg

SEQ ID NO: 25754 - DNA, 103 bp, Artificial Sequence
  Synthetic Polynucleotide
taatacgactcactatagggataagagatagttccatagagtcaccctcaaacagaggagatgagggatgctctatggaaacctggcggcagcgcaaaagatg

SEQ ID NO: 25755 - DNA, 103 bp, Artificial Sequence
  Synthetic Polynucleotide
taatacgactcactatagggtaccaataagagatagttccatagagtcacaacagaggagagtgactatgtggaactataacctggcggcagcgcaaaagatg

SEQ ID NO: 25756 - DNA, 103 bp, Artificial Sequence
  Synthetic Polynucleotide
taatacgactcactatagggatgactaccaataagagatagttccatagaaacagaggagatctatgatgctatctcttaacctggcggcagcgcaaaagatg

SEQ ID NO: 25757 - DNA, 103 bp, Artificial Sequence
  Synthetic Polynucleotide
taatacgactcactatagggttattatgactaccaataagagatagttccaacagaggagaggaactatgtcttattggaacctggcggcagcgcaaaagatg

SEQ ID NO: 25758 - DNA, 103 bp, Artificial Sequence
  Synthetic Polynucleotide
taatacgactcactatagggcctcattattatgactaccaataagagataaacagaggagatatctcatgttggtagtcaacctggcggcagcgcaaaagatg

SEQ ID NO: 25759 - DNA, 103 bp, Artificial Sequence
  Synthetic Polynucleotide
taatacgactcactatagggtgtagcctcattattatgactaccaataagaacagaggagacttattatgagtcataataacctggcggcagcgcaaaagatg

SEQ ID NO: 25760 - DNA, 103 bp, Artificial Sequence
  Synthetic Polynucleotide
taatacgactcactataggggtaatcctttccagtcaaagtgcattaaataacagaggagaatttaaatgactttgactaacctggcggcagcgcaaaagatg

SEQ ID NO: 25761 - DNA, 103 bp, Artificial Sequence
  Synthetic Polynucleotide
taatacgactcactatagggaccaatgtagcctcattattatgactaccaaacagaggagatggtagatgtaataatgaaacctggcggcagcgcaaaagatg

SEQ ID NO: 25762 - DNA, 103 bp, Artificial Sequence
  Synthetic Polynucleotide
taatacgactcactatagggactggaccaatgtagcctcattattatgacaacagaggagagtcataatgatgaggctaaacctggcggcagcgcaaaagatg

SEQ ID NO: 25763 - DNA, 103 bp, Artificial Sequence
  Synthetic Polynucleotide
taatacgactcactatagggggaggactggaccaatgtagcctcattattaacagaggagaaataatatggctacattgaacctggcggcagcgcaaaagatg

SEQ ID NO: 25764 - DNA, 103 bp, Artificial Sequence
  Synthetic Polynucleotide
taatacgactcactatagggtcattggaggactggaccaatgtagcctcaaacagaggagatgaggcatgattggtccaaacctggcggcagcgcaaaagatg

SEQ ID NO: 25765 - DNA, 103 bp, Artificial Sequence
  Synthetic Polynucleotide
taatacgactcactatagggctccttcattggaggactggaccaatgtagaacagaggagactacatatgtccagtcctaacctggcggcagcgcaaaagatg

SEQ ID NO: 25766 - DNA, 103 bp, Artificial Sequence
  Synthetic Polynucleotide
taatacgactcactataggggaatactccttcattggaggactggaccaaaacagaggagattggtcatgtcctccaataacctggcggcagcgcaaaagatg

SEQ ID NO: 25767 - DNA, 103 bp, Artificial Sequence
  Synthetic Polynucleotide
taatacgactcactatagggtcaacgaatactccttcattggaggactggaacagaggagaccagtcatgcaatgaaggaacctggcggcagcgcaaaagatg

SEQ ID NO: 25768 - DNA, 103 bp, Artificial Sequence
  Synthetic Polynucleotide
taatacgactcactatagggccatgtcaacgaatactccttcattggaggaacagaggagacctccaatgaaggagtataacctggcggcagcgcaaaagatg

SEQ ID NO: 25769 - DNA, 103 bp, Artificial Sequence
  Synthetic Polynucleotide
taatacgactcactatagggttcctccatgtcaacgaatactccttcattaacagaggagaaatgaaatggtattcgttaacctggcggcagcgcaaaagatg

SEQ ID NO: 25770 - DNA, 103 bp, Artificial Sequence
  Synthetic Polynucleotide
taatacgactcactatagggtgtgcttcctccatgtcaacgaatactcctaacagaggagaaggagtatgcgttgacataacctggcggcagcgcaaaagatg

SEQ ID NO: 25771 - DNA, 103 bp, Artificial Sequence
  Synthetic Polynucleotide
taatacgactcactatagggcaattgtaatcctttccagtcaaagtgcataacagaggagaatgcacatggactggaaaaacctggcggcagcgcaaaagatg

SEQ ID NO: 25772 - DNA, 103 bp, Artificial Sequence
  Synthetic Polynucleotide
taatacgactcactatagggctccttgtgcttcctccatgtcaacgaataaacagaggagatattcgatgacatggaggaacctggcggcagcgcaaaagatg

SEQ ID NO: 25773 - DNA, 103 bp, Artificial Sequence
  Synthetic Polynucleotide
taatacgactcactatagggtacccctccttgtgcttcctccatgtcaacaacagaggagagttgacatggaggaagcaaacctggcggcagcgcaaaagatg

SEQ ID NO: 25774 - DNA, 103 bp, Artificial Sequence
  Synthetic Polynucleotide
taatacgactcactatagggtgtgctacccctccttgtgcttcctccatgaacagaggagacatggaatgagcacaaggaacctggcggcagcgcaaaagatg

SEQ ID NO: 25775 - DNA, 103 bp, Artificial Sequence
  Synthetic Polynucleotide
taatacgactcactatagggacccctgtgctacccctccttgtgcttcctaacagaggagaaggaagatgaaggaggggaacctggcggcagcgcaaaagatg

SEQ ID NO: 25776 - DNA, 103 bp, Artificial Sequence
  Synthetic Polynucleotide
taatacgactcactatagggatcatacccctgtgctacccctccttgtgcaacagaggagagcacaaatgggggtagcaaacctggcggcagcgcaaaagatg

SEQ ID NO: 25777 - DNA, 103 bp, Artificial Sequence
  Synthetic Polynucleotide
taatacgactcactatagggtcgtcatcatacccctgtgctacccctcctaacagaggagaaggaggatgagcacagggaacctggcggcagcgcaaaagatg

SEQ ID NO: 25778 - DNA, 103 bp, Artificial Sequence
  Synthetic Polynucleotide
taatacgactcactataggggctcctcgtcatcatacccctgtgctacccaacagaggagagggtagatgaggggtatgaacctggcggcagcgcaaaagatg

SEQ ID NO: 25779 - DNA, 103 bp, Artificial Sequence
  Synthetic Polynucleotide
taatacgactcactatagggtaatagctcctcgtcatcatacccctgtgcaacagaggagagcacagatgtatgatgacaacctggcggcagcgcaaaagatg

SEQ ID NO: 25780 - DNA, 103 bp, Artificial Sequence
  Synthetic Polynucleotide
taatacgactcactatagggtcatctaatagctcctcgtcatcataccccaacagaggagaggggtaatgtgacgaggaaacctggcggcagcgcaaaagatg

SEQ ID NO: 25781 - DNA, 103 bp, Artificial Sequence
  Synthetic Polynucleotide
taatacgactcactatagggctgtgtcatctaatagctcctcgtcatcataacagaggagaatgatgatgaggagctataacctggcggcagcgcaaaagatg

SEQ ID NO: 25782 - DNA, 103 bp, Artificial Sequence
  Synthetic Polynucleotide
taatacgactcactatagggcaaatcaattgtaatcctttccagtcaaagaacagaggagactttgaatggaaaggattaacctggcggcagcgcaaaagatg

SEQ ID NO: 25783 - DNA, 103 bp, Artificial Sequence
  Synthetic Polynucleotide
taatacgactcactatagggctcagctgtgtcatctaatagctcctcgtcaacagaggagagacgagatgctattagataacctggcggcagcgcaaaagatg

SEQ ID NO: 25784 - DNA, 103 bp, Artificial Sequence
  Synthetic Polynucleotide
taatacgactcactatagggaaatcctcagctgtgtcatctaatagctccaacagaggagaggagctatgagatgacacaacctggcggcagcgcaaaagatg

SEQ ID NO: 25785 - DNA, 103 bp, Artificial Sequence
  Synthetic Polynucleotide
taatacgactcactatagggtgctaaaatcctcagctgtgtcatctaataaacagaggagatattagatgacacagctgaacctggcggcagcgcaaaagatg

SEQ ID NO: 25786 - DNA, 103 bp, Artificial Sequence
  Synthetic Polynucleotide
taatacgactcactatagggtcctctgctaaaatcctcagctgtgtcatcaacagaggagagatgacatggctgaggataacctggcggcagcgcaaaagatg

SEQ ID NO: 25787 - DNA, 103 bp, Artificial Sequence
  Synthetic Polynucleotide
taatacgactcactatagggagccttcctctgctaaaatcctcagctgtgaacagaggagacacagcatgggattttagaacctggcggcagcgcaaaagatg

SEQ ID NO: 25788 - DNA, 103 bp, Artificial Sequence
  Synthetic Polynucleotide
taatacgactcactatagggcaatcagccttcctctgctaaaatcctcagaacagaggagactgaggatgttagcagagaacctggcggcagcgcaaaagatg

SEQ ID NO: 25789 - DNA, 103 bp, Artificial Sequence
  Synthetic Polynucleotide
taatacgactcactatagggtgaaacaatcagccttcctctgctaaaatcaacagaggagagattttatgagaggaaggaacctggcggcagcgcaaaagatg

SEQ ID NO: 25790 - DNA, 103 bp, Artificial Sequence
  Synthetic Polynucleotide
taatacgactcactatagggcctgttgaaacaatcagccttcctctgctaaacagaggagatagcagatgaaggctgataacctggcggcagcgcaaaagatg

SEQ ID NO: 25791 - DNA, 103 bp, Artificial Sequence
  Synthetic Polynucleotide
taatacgactcactatagggtatctcctgttgaaacaatcagccttcctcaacagaggagagaggaaatgtgattgtttaacctggcggcagcgcaaaagatg

SEQ ID NO: 25792 - DNA, 103 bp, Artificial Sequence
  Synthetic Polynucleotide
taatacgactcactatagggggtggtatctcctgttgaaacaatcagcctaacagaggagaaggctgatggtttcaacaaacctggcggcagcgcaaaagatg

SEQ ID NO: 25793 - DNA, 103 bp, Artificial Sequence
  Synthetic Polynucleotide
taatacgactcactatagggccatatgtcaataaagggcaactacaaagaaacagaggagatctttgatgttgccctttaacctggcggcagcgcaaaagatg

SEQ ID NO: 25794 - DNA, 103 bp, Artificial Sequence
  Synthetic Polynucleotide
taatacgactcactatagggttctccaaatcaattgtaatcctttccagtaacagaggagaactggaatggattacaataacctggcggcagcgcaaaagatg

SEQ ID NO: 25795 - DNA, 103 bp, Artificial Sequence
  Synthetic Polynucleotide
taatacgactcactatagggctgtaggtggtatctcctgttgaaacaatcaacagaggagagattgtatgaacaggagaaacctggcggcagcgcaaaagatg

SEQ ID NO: 25796 - DNA, 103 bp, Artificial Sequence
  Synthetic Polynucleotide
taatacgactcactatagggctatactgtaggtggtatctcctgttgaaaaacagaggagatttcaaatggagataccaaacctggcggcagcgcaaaagatg

SEQ ID NO: 25797 - DNA, 103 bp, Artificial Sequence
  Synthetic Polynucleotide
taatacgactcactatagggcctgcctatactgtaggtggtatctcctgtaacagaggagaacaggaatgaccacctacaacctggcggcagcgcaaaagatg

SEQ ID NO: 25798 - DNA, 103 bp, Artificial Sequence
  Synthetic Polynucleotide
taatacgactcactataggggagaccctgcctatactgtaggtggtatctaacagaggagaagatacatgctacagtataacctggcggcagcgcaaaagatg

SEQ ID NO: 25799 - DNA, 103 bp, Artificial Sequence
  Synthetic Polynucleotide
taatacgactcactatagggcaaatgagaccctgcctatactgtaggtggaacagaggagaccacctatggtataggcaaacctggcggcagcgcaaaagatg

SEQ ID NO: 25800 - DNA, 103 bp, Artificial Sequence
  Synthetic Polynucleotide
taatacgactcactatagggataaccaaatgagaccctgcctatactgtaaacagaggagatacagtatgggcagggtcaacctggcggcagcgcaaaagatg

SEQ ID NO: 25801 - DNA, 103 bp, Artificial Sequence
  Synthetic Polynucleotide
taatacgactcactatagggtcagcataaccaaatgagaccctgcctataaacagaggagatataggatgggtctcattaacctggcggcagcgcaaaagatg

SEQ ID NO: 25802 - DNA, 103 bp, Artificial Sequence
  Synthetic Polynucleotide
taatacgactcactatagggtgtcttcagcataaccaaatgagaccctgcaacagaggagagcagggatgcatttggttaacctggcggcagcgcaaaagatg

SEQ ID NO: 25803 - DNA, 103 bp, Artificial Sequence
  Synthetic Polynucleotide
taatacgactcactatagggagcagtgtcttcagcataaccaaatgagacaacagaggagagtctcaatgggttatgctaacctggcggcagcgcaaaagatg

SEQ ID NO: 25804 - DNA, 103 bp, Artificial Sequence
  Synthetic Polynucleotide
taatacgactcactatagggtctctagcagtgtcttcagcataaccaaataacagaggagaatttggatgtgctgaagaaacctggcggcagcgcaaaagatg

SEQ ID NO: 25805 - DNA, 103 bp, Artificial Sequence
  Synthetic Polynucleotide
taatacgactcactatagggtccgtttctccaaatcaattgtaatcctttaacagaggagaaaaggaatgcaattgattaacctggcggcagcgcaaaagatg

SEQ ID NO: 25806 - DNA, 103 bp, Artificial Sequence
  Synthetic Polynucleotide
taatacgactcactatagggcaaaatctctagcagtgtcttcagcataacaacagaggagagttatgatgaagacactgaacctggcggcagcgcaaaagatg

SEQ ID NO: 25807 - DNA, 103 bp, Artificial Sequence
  Synthetic Polynucleotide
taatacgactcactataggggcctgcaaaatctctagcagtgtcttcagcaacagaggagagctgaaatgactgctagaaacctggcggcagcgcaaaagatg

SEQ ID NO: 25808 - DNA, 103 bp, Artificial Sequence
  Synthetic Polynucleotide
taatacgactcactatagggactgtgcctgcaaaatctctagcagtgtctaacagaggagaagacacatgtagagatttaacctggcggcagcgcaaaagatg

SEQ ID NO: 25809 - DNA, 103 bp, Artificial Sequence
  Synthetic Polynucleotide
taatacgactcactatagggaaacaactgtgcctgcaaaatctctagcagaacagaggagactgctaatgattttgcagaacctggcggcagcgcaaaagatg

SEQ ID NO: 25810 - DNA, 103 bp, Artificial Sequence
  Synthetic Polynucleotide
taatacgactcactatagggtggaaaaacaactgtgcctgcaaaatctctaacagaggagaagagatatggcaggcacaaacctggcggcagcgcaaaagatg

SEQ ID NO: 25811 - DNA, 103 bp, Artificial Sequence
  Synthetic Polynucleotide
taatacgactcactatagggccatctggaaaaacaactgtgcctgcaaaaaacagaggagattttgcatgcacagttgtaacctggcggcagcgcaaaagatg

SEQ ID NO: 25812 - DNA, 103 bp, Artificial Sequence
  Synthetic Polynucleotide
taatacgactcactataggggctgtccatctggaaaaacaactgtgcctgaacagaggagacaggcaatgttgtttttcaacctggcggcagcgcaaaagatg

SEQ ID NO: 25813 - DNA, 103 bp, Artificial Sequence
  Synthetic Polynucleotide
taatacgactcactatagggagatggctgtccatctggaaaaacaactgtaacagaggagaacagttatgtttccagataacctggcggcagcgcaaaagatg

SEQ ID NO: 25814 - DNA, 103 bp, Artificial Sequence
  Synthetic Polynucleotide
taatacgactcactatagggtattcagatggctgtccatctggaaaaacaaacagaggagatgttttatgagatggacaaacctggcggcagcgcaaaagatg

SEQ ID NO: 25815 - DNA, 103 bp, Artificial Sequence
  Synthetic Polynucleotide
taatacgactcactataggggtgggtattcagatggctgtccatctggaaaacagaggagattccagatggacagccataacctggcggcagcgcaaaagatg

SEQ ID NO: 25816 - DNA, 103 bp, Artificial Sequence
  Synthetic Polynucleotide
taatacgactcactatagggacgtttccgtttctccaaatcaattgtaataacagaggagaattacaatggatttggagaacctggcggcagcgcaaaagatg

SEQ ID NO: 25817 - DNA, 103 bp, Artificial Sequence
  Synthetic Polynucleotide
taatacgactcactatagggcggctgtgggtattcagatggctgtccatcaacagaggagagatggaatgccatctgaaaacctggcggcagcgcaaaagatg

SEQ ID NO: 25818 - DNA, 103 bp, Artificial Sequence
  Synthetic Polynucleotide
taatacgactcactatagggctgcccggctgtgggtattcagatggctgtaacagaggagaacagccatgtgaatacccaacctggcggcagcgcaaaagatg

SEQ ID NO: 25819 - DNA, 103 bp, Artificial Sequence
  Synthetic Polynucleotide
taatacgactcactatagggttgggctgcccggctgtgggtattcagatgaacagaggagacatctgatgacccacagcaacctggcggcagcgcaaaagatg

SEQ ID NO: 25820 - DNA, 103 bp, Artificial Sequence
  Synthetic Polynucleotide
taatacgactcactatagggattagttgggctgcccggctgtgggtattcaacagaggagagaatacatgcagccgggcaacctggcggcagcgcaaaagatg

SEQ ID NO: 25821 - DNA, 103 bp, Artificial Sequence
  Synthetic Polynucleotide
taatacgactcactataggggtgggattagttgggctgcccggctgtgggaacagaggagacccacaatggggcagcccaacctggcggcagcgcaaaagatg

SEQ ID NO: 25822 - DNA, 103 bp, Artificial Sequence
  Synthetic Polynucleotide
taatacgactcactatagggtacttgtgggattagttgggctgcccggctaacagaggagaagccggatggcccaactaaacctggcggcagcgcaaaagatg

SEQ ID NO: 25823 - DNA, 103 bp, Artificial Sequence
  Synthetic Polynucleotide
taatacgactcactatagggtggtatacttgtgggattagttgggctgccaacagaggagaggcagcatgactaatcccaacctggcggcagcgcaaaagatg

SEQ ID NO: 25824 - DNA, 103 bp, Artificial Sequence
  Synthetic Polynucleotide
taatacgactcactatagggactgttggtatacttgtgggattagttgggaacagaggagacccaacatgtcccacaagaacctggcggcagcgcaaaagatg

SEQ ID NO: 25825 - DNA, 103 bp, Artificial Sequence
  Synthetic Polynucleotide
taatacgactcactatagggttaaaactgttggtatacttgtgggattagaacagaggagactaatcatgcaagtatacaacctggcggcagcgcaaaagatg

SEQ ID NO: 25826 - DNA, 103 bp, Artificial Sequence
  Synthetic Polynucleotide
taatacgactcactatagggattaattaaaactgttggtatacttgtgggaacagaggagacccacaatgataccaacaaacctggcggcagcgcaaaagatg

SEQ ID NO: 25827 - DNA, 103 bp, Artificial Sequence
  Synthetic Polynucleotide
taatacgactcactatagggcaaatacgtttccgtttctccaaatcaattaacagaggagaaattgaatgggagaaacgaacctggcggcagcgcaaaagatg

SEQ ID NO: 25828 - DNA, 103 bp, Artificial Sequence
  Synthetic Polynucleotide
taatacgactcactatagggtatacattaattaaaactgttggtatacttaacagaggagaaagtatatgaacagttttaacctggcggcagcgcaaaagatg

SEQ ID NO: 25829 - DNA, 103 bp, Artificial Sequence
  Synthetic Polynucleotide
taatacgactcactatagggcatcatatacattaattaaaactgttggtaaacagaggagataccaaatgttttaattaaacctggcggcagcgcaaaagatg

SEQ ID NO: 25830 - DNA, 103 bp, Artificial Sequence
  Synthetic Polynucleotide
taatacgactcactatagggtccctcatcatatacattaattaaaactgtaacagaggagaacagttatgattaatgtaaacctggcggcagcgcaaaagatg

SEQ ID NO: 25831 - DNA, 103 bp, Artificial Sequence
  Synthetic Polynucleotide
taatacgactcactatagggtctaatccctcatcatatacattaattaaaaacagaggagatttaatatgtgtatatgaaacctggcggcagcgcaaaagatg

SEQ ID NO: 25832 - DNA, 103 bp, Artificial Sequence
  Synthetic Polynucleotide
taatacgactcactatagggagaagtctaatccctcatcatatacattaaaacagaggagattaatgatgatgatgaggaacctggcggcagcgcaaaagatg

SEQ ID NO: 25833 - DNA, 103 bp, Artificial Sequence
  Synthetic Polynucleotide
taatacgactcactatagggtagcaagaagtctaatccctcatcatatacaacagaggagagtatatatggagggattaaacctggcggcagcgcaaaagatg

SEQ ID NO: 25834 - DNA, 103 bp, Artificial Sequence
  Synthetic Polynucleotide
taatacgactcactatagggggatgtagcaagaagtctaatccctcatcaaacagaggagatgatgaatgattagacttaacctggcggcagcgcaaaagatg

SEQ ID NO: 25835 - DNA, 103 bp, Artificial Sequence
  Synthetic Polynucleotide
taatacgactcactatagggtactcggatgtagcaagaagtctaatccctaacagaggagaagggatatgacttcttgcaacctggcggcagcgcaaaagatg

SEQ ID NO: 25836 - DNA, 103 bp, Artificial Sequence
  Synthetic Polynucleotide
taatacgactcactataggggaacatactcggatgtagcaagaagtctaaaacagaggagattagacatgttgctacataacctggcggcagcgcaaaagatg

SEQ ID NO: 25837 - DNA, 103 bp, Artificial Sequence
  Synthetic Polynucleotide
taatacgactcactatagggttggggaacatactcggatgtagcaagaagaacagaggagacttcttatgacatccgagaacctggcggcagcgcaaaagatg

SEQ ID NO: 25838 - DNA, 103 bp, Artificial Sequence
  Synthetic Polynucleotide
taatacgactcactatagggacagccaaatacgtttccgtttctccaaataacagaggagaatttggatgaacggaaacaacctggcggcagcgcaaaagatg

SEQ ID NO: 25839 - DNA, 103 bp, Artificial Sequence
  Synthetic Polynucleotide
taatacgactcactatagggttcgtttggggaacatactcggatgtagcaaacagaggagatgctacatgcgagtatgtaacctggcggcagcgcaaaagatg

SEQ ID NO: 25840 - DNA, 103 bp, Artificial Sequence
  Synthetic Polynucleotide
taatacgactcactatagggtcgttttcgtttggggaacatactcggatgaacagaggagacatccgatgatgttccccaacctggcggcagcgcaaaagatg

SEQ ID NO: 25841 - DNA, 103 bp, Artificial Sequence
  Synthetic Polynucleotide
taatacgactcactatagggtttcttcgttttcgtttggggaacatactcaacagaggagagagtatatgccccaaacgaacctggcggcagcgcaaaagatg

SEQ ID NO: 25842 - DNA, 103 bp, Artificial Sequence
  Synthetic Polynucleotide
taatacgactcactatagggcaagttttcttcgttttcgtttggggaacaaacagaggagatgttccatgaacgaaaacaacctggcggcagcgcaaaagatg

SEQ ID NO: 25843 - DNA, 103 bp, Artificial Sequence
  Synthetic Polynucleotide
taatacgactcactatagggaaaagcaagttttcttcgttttcgtttgggaacagaggagacccaaaatgaaacgaagaaacctggcggcagcgcaaaagatg

SEQ ID NO: 25844 - DNA, 103 bp, Artificial Sequence
  Synthetic Polynucleotide
taatacgactcactatagggcacaaaaaagcaagttttcttcgttttcgtaacagaggagaacgaaaatgaagaaaactaacctggcggcagcgcaaaagatg

SEQ ID NO: 25845 - DNA, 103 bp, Artificial Sequence
  Synthetic Polynucleotide
taatacgactcactatagggaacatcacaaaaaagcaagttttcttcgttaacagaggagaaacgaaatgaacttgcttaacctggcggcagcgcaaaagatg

SEQ ID NO: 25846 - DNA, 103 bp, Artificial Sequence
  Synthetic Polynucleotide
taatacgactcactatagggtgcaaaacatcacaaaaaagcaagttttctaacagaggagaagaaaaatggcttttttgaacctggcggcagcgcaaaagatg

SEQ ID NO: 25847 - DNA, 103 bp, Artificial Sequence
  Synthetic Polynucleotide
taatacgactcactatagggtcatctgcaaaacatcacaaaaaagcaagtaacagaggagaacttgcatgtttgtgatgaacctggcggcagcgcaaaagatg

SEQ ID NO: 25848 - DNA, 103 bp, Artificial Sequence
  Synthetic Polynucleotide
taatacgactcactatagggggaggtcatctgcaaaacatcacaaaaaagaacagaggagactttttatggatgttttgaacctggcggcagcgcaaaagatg

SEQ ID NO: 25849 - DNA, 103 bp, Artificial Sequence
  Synthetic Polynucleotide
taatacgactcactatagggctacaacagccaaatacgtttccgtttctcaacagaggagagagaaaatgaaacgtattaacctggcggcagcgcaaaagatg

SEQ ID NO: 25850 - DNA, 103 bp, Artificial Sequence
  Synthetic Polynucleotide
taatacgactcactatagggcagaaggaggtcatctgcaaaacatcacaaaacagaggagattgtgaatgtttgcagataacctggcggcagcgcaaaagatg

SEQ ID NO: 25851 - DNA, 103 bp, Artificial Sequence
  Synthetic Polynucleotide
taatacgactcactataggggcagccagaaggaggtcatctgcaaaacataacagaggagaatgtttatgagatgacctaacctggcggcagcgcaaaagatg

SEQ ID NO: 25852 - DNA, 103 bp, Artificial Sequence
  Synthetic Polynucleotide
taatacgactcactataggggctcggcagccagaaggaggtcatctgcaaaacagaggagattgcagatgacctccttcaacctggcggcagcgcaaaagatg

SEQ ID NO: 25853 - DNA, 103 bp, Artificial Sequence
  Synthetic Polynucleotide
taatacgactcactatagggcctttgctcggcagccagaaggaggtcatcaacagaggagagatgacatgcttctggctaacctggcggcagcgcaaaagatg

SEQ ID NO: 25854 - DNA, 103 bp, Artificial Sequence
  Synthetic Polynucleotide
taatacgactcactataggggctttcctttgctcggcagccagaaggaggaacagaggagacctcctatgggctgccgaaacctggcggcagcgcaaaagatg

SEQ ID NO: 25855 - DNA, 103 bp, Artificial Sequence
  Synthetic Polynucleotide
taatacgactcactataggggtacagctttcctttgctcggcagccagaaaacagaggagattctggatgccgagcaaaaacctggcggcagcgcaaaagatg

SEQ ID NO: 25856 - DNA, 103 bp, Artificial Sequence
  Synthetic Polynucleotide
taatacgactcactatagggggcaggtacagctttcctttgctcggcagcaacagaggagagctgccatgcaaaggaaaaacctggcggcagcgcaaaagatg

SEQ ID NO: 25857 - DNA, 103 bp, Artificial Sequence
  Synthetic Polynucleotide
taatacgactcactataggggcggaggcaggtacagctttcctttgctcgaacagaggagacgagcaatggaaagctgtaacctggcggcagcgcaaaagatg

SEQ ID NO: 25858 - DNA, 103 bp, Artificial Sequence
  Synthetic Polynucleotide
taatacgactcactatagggggtgggcggaggcaggtacagctttcctttaacagaggagaaaaggaatgctgtacctgaacctggcggcagcgcaaaagatg

SEQ ID NO: 25859 - DNA, 103 bp, Artificial Sequence
  Synthetic Polynucleotide
taatacgactcactatagggataggggtgggcggaggcaggtacagctttaacagaggagaaaagctatgcctgcctccaacctggcggcagcgcaaaagatg

SEQ ID NO: 25860 - DNA, 103 bp, Artificial Sequence
  Synthetic Polynucleotide
taatacgactcactatagggaccccctacaacagccaaatacgtttccgtaacagaggagaacggaaatgtatttggctaacctggcggcagcgcaaaagatg

SEQ ID NO: 25861 - DNA, 103 bp, Artificial Sequence
  Synthetic Polynucleotide
taatacgactcactatagggtagtgataggggtgggcggaggcaggtacaaacagaggagatgtaccatgctccgcccaaacctggcggcagcgcaaaagatg

SEQ ID NO: 25862 - DNA, 103 bp, Artificial Sequence
  Synthetic Polynucleotide
taatacgactcactatagggcactttagtgataggggtgggcggaggcagaacagaggagactgcctatgcccacccctaacctggcggcagcgcaaaagatg

SEQ ID NO: 25863 - DNA, 103 bp, Artificial Sequence
  Synthetic Polynucleotide
taatacgactcactatagggtgcagcactttagtgataggggtgggcggaaacagaggagatccgccatgccctatcacaacctggcggcagcgcaaaagatg

SEQ ID NO: 25864 - DNA, 103 bp, Artificial Sequence
  Synthetic Polynucleotide
taatacgactcactatagggctgtgtgcagcactttagtgataggggtggaacagaggagaccacccatgtcactaaagaacctggcggcagcgcaaaagatg

SEQ ID NO: 25865 - DNA, 103 bp, Artificial Sequence
  Synthetic Polynucleotide
taatacgactcactataggggtcatctgtgtgcagcactttagtgataggaacagaggagacctatcatgaaagtgctgaacctggcggcagcgcaaaagatg

SEQ ID NO: 25866 - DNA, 103 bp, Artificial Sequence
  Synthetic Polynucleotide
taatacgactcactatagggacaaagtcatctgtgtgcagcactttagtgaacagaggagacactaaatggctgcacacaacctggcggcagcgcaaaagatg

SEQ ID NO: 25867 - DNA, 103 bp, Artificial Sequence
  Synthetic Polynucleotide
taatacgactcactatagggtgctaacaaagtcatctgtgtgcagcacttaacagaggagaaagtgcatgacacagatgaacctggcggcagcgcaaaagatg

SEQ ID NO: 25868 - DNA, 103 bp, Artificial Sequence
  Synthetic Polynucleotide
taatacgactcactatagggggtcctgctaacaaagtcatctgtgtgcagaacagaggagactgcacatggatgactttaacctggcggcagcgcaaaagatg

SEQ ID NO: 25869 - DNA, 103 bp, Artificial Sequence
  Synthetic Polynucleotide
taatacgactcactatagggatattggtcctgctaacaaagtcatctgtgaacagaggagacacagaatgctttgttagaacctggcggcagcgcaaaagatg

SEQ ID NO: 25870 - DNA, 103 bp, Artificial Sequence
  Synthetic Polynucleotide
taatacgactcactatagggagtaaatattggtcctgctaacaaagtcataacagaggagaatgactatgttagcaggaaacctggcggcagcgcaaaagatg

SEQ ID NO: 25871 - DNA, 103 bp, Artificial Sequence
  Synthetic Polynucleotide
taatacgactcactatagggggaacaccccctacaacagccaaatacgttaacagaggagaaacgtaatgggctgttgtaacctggcggcagcgcaaaagatg

SEQ ID NO: 25872 - DNA, 103 bp, Artificial Sequence
  Synthetic Polynucleotide
taatacgactcactatagggatggtagtaaatattggtcctgctaacaaaaacagaggagatttgttatgaggaccaataacctggcggcagcgcaaaagatg

SEQ ID NO: 25873 - DNA, 103 bp, Artificial Sequence
  Synthetic Polynucleotide
taatacgactcactatagggttagcatggtagtaaatattggtcctgctaaacagaggagatagcagatgcaatatttaaacctggcggcagcgcaaaagatg

SEQ ID NO: 25874 - DNA, 103 bp, Artificial Sequence
  Synthetic Polynucleotide
taatacgactcactatagggcacttttagcatggtagtaaatattggtccaacagaggagaggaccaatgtttactaccaacctggcggcagcgcaaaagatg

SEQ ID NO: 25875 - DNA, 103 bp, Artificial Sequence
  Synthetic Polynucleotide
taatacgactcactatagggcctgtcacttttagcatggtagtaaatattaacagaggagaaatattatgtaccatgctaacctggcggcagcgcaaaagatg

SEQ ID NO: 25876 - DNA, 103 bp, Artificial Sequence
  Synthetic Polynucleotide
taatacgactcactatagggaaaagcctgtcacttttagcatggtagtaaaacagaggagattactaatgtgctaaaagaacctggcggcagcgcaaaagatg

SEQ ID NO: 25877 - DNA, 103 bp, Artificial Sequence
  Synthetic Polynucleotide
taatacgactcactatagggctgttaaaagcctgtcacttttagcatggtaacagaggagaaccatgatgaaagtgacaaacctggcggcagcgcaaaagatg

SEQ ID NO: 25878 - DNA, 103 bp, Artificial Sequence
  Synthetic Polynucleotide
taatacgactcactatagggaccaactgttaaaagcctgtcacttttagcaacagaggagagctaaaatggacaggcttaacctggcggcagcgcaaaagatg

SEQ ID NO: 25879 - DNA, 103 bp, Artificial Sequence
  Synthetic Polynucleotide
taatacgactcactatagggggattaccaactgttaaaagcctgtcacttaacagaggagaaagtgaatggcttttaacaacctggcggcagcgcaaaagatg

SEQ ID NO: 25880 - DNA, 103 bp, Artificial Sequence
  Synthetic Polynucleotide
taatacgactcactatagggaatatggattaccaactgttaaaagcctgtaacagaggagaacaggcatgtaacagttgaacctggcggcagcgcaaaagatg

SEQ ID NO: 25881 - DNA, 103 bp, Artificial Sequence
  Synthetic Polynucleotide
taatacgactcactatagggagtgtaatatggattaccaactgttaaaagaacagaggagacttttaatggttggtaataacctggcggcagcgcaaaagatg

SEQ ID NO: 25882 - DNA, 103 bp, Artificial Sequence
  Synthetic Polynucleotide
taatacgactcactatagggattctggaacaccccctacaacagccaaataacagaggagaatttggatgttgtaggggaacctggcggcagcgcaaaagatg

SEQ ID NO: 25883 - DNA, 103 bp, Artificial Sequence
  Synthetic Polynucleotide
taatacgactcactatagggttgatagtgtaatatggattaccaactgttaacagaggagaaacagtatgtaatccataaacctggcggcagcgcaaaagatg

SEQ ID NO: 25884 - DNA, 103 bp, Artificial Sequence
  Synthetic Polynucleotide
taatacgactcactataggggttgcttgatagtgtaatatggattaccaaaacagaggagattggtaatgcatattacaaacctggcggcagcgcaaaagatg

SEQ ID NO: 25885 - DNA, 103 bp, Artificial Sequence
  Synthetic Polynucleotide
taatacgactcactatagggatcatgttgcttgatagtgtaatatggattaacagaggagaaatccaatgtacactatcaacctggcggcagcgcaaaagatg

SEQ ID NO: 25886 - DNA, 103 bp, Artificial Sequence
  Synthetic Polynucleotide
taatacgactcactatagggagcttatcatgttgcttgatagtgtaatataacagaggagaatattaatgtatcaagcaaacctggcggcagcgcaaaagatg

SEQ ID NO: 25887 - DNA, 103 bp, Artificial Sequence
  Synthetic Polynucleotide
taatacgactcactatagggcaacaagcttatcatgttgcttgatagtgtaacagaggagaacactaatgagcaacatgaacctggcggcagcgcaaaagatg

SEQ ID NO: 25888 - DNA, 103 bp, Artificial Sequence
  Synthetic Polynucleotide
taatacgactcactataggggggcacaacaagcttatcatgttgcttgataacagaggagaatcaagatgcatgataagaacctggcggcagcgcaaaagatg

SEQ ID NO: 25889 - DNA, 103 bp, Artificial Sequence
  Synthetic Polynucleotide
taatacgactcactatagggaccttgggcacaacaagcttatcatgttgcaacagaggagagcaacaatgtaagcttgtaacctggcggcagcgcaaaagatg

SEQ ID NO: 25890 - DNA, 103 bp, Artificial Sequence
  Synthetic Polynucleotide
taatacgactcactatagggctgaaaccttgggcacaacaagcttatcataacagaggagaatgataatgttgttgtgcaacctggcggcagcgcaaaagatg

SEQ ID NO: 25891 - DNA, 103 bp, Artificial Sequence
  Synthetic Polynucleotide
taatacgactcactatagggatttcctgaaaccttgggcacaacaagcttaacagaggagaaagcttatggtgcccaagaacctggcggcagcgcaaaagatg

SEQ ID NO: 25892 - DNA, 103 bp, Artificial Sequence
  Synthetic Polynucleotide
taatacgactcactatagggtattgatttcctgaaaccttgggcacaacaaacagaggagatgttgtatgcaaggtttcaacctggcggcagcgcaaaagatg

SEQ ID NO: 25893 - DNA, 103 bp, Artificial Sequence
  Synthetic Polynucleotide
taatacgactcactatagggcaacaattctggaacaccccctacaacagcaacagaggagagctgttatggggggtgttaacctggcggcagcgcaaaagatg

SEQ ID NO: 25894 - DNA, 103 bp, Artificial Sequence
  Synthetic Polynucleotide
taatacgactcactatagggccctatattgatttcctgaaaccttgggcaaacagaggagatgcccaatgtttcaggaaaacctggcggcagcgcaaaagatg

SEQ ID NO: 25895 - DNA, 103 bp, Artificial Sequence
  Synthetic Polynucleotide
taatacgactcactataggggaaaaccctatattgatttcctgaaaccttaacagaggagaaaggttatgggaaatcaaaacctggcggcagcgcaaaagatg

SEQ ID NO: 25896 - DNA, 103 bp, Artificial Sequence
  Synthetic Polynucleotide
taatacgactcactatagggaccctgaaaaccctatattgatttcctgaaaacagaggagattcaggatgtcaatatagaacctggcggcagcgcaaaagatg

SEQ ID NO: 25897 - DNA, 103 bp, Artificial Sequence
  Synthetic Polynucleotide
taatacgactcactatagggatgataccctgaaaaccctatattgatttcaacagaggagagaaatcatgatagggtttaacctggcggcagcgcaaaagatg

SEQ ID NO: 25898 - DNA, 103 bp, Artificial Sequence
  Synthetic Polynucleotide
taatacgactcactatagggtggaaatgataccctgaaaaccctatattgaacagaggagacaatatatggttttcaggaacctggcggcagcgcaaaagatg

SEQ ID NO: 25899 - DNA, 103 bp, Artificial Sequence
  Synthetic Polynucleotide
taatacgactcactatagggggatctggaaatgataccctgaaaaccctaaacagaggagatagggtatgcagggtatcaacctggcggcagcgcaaaagatg

SEQ ID NO: 25900 - DNA, 103 bp, Artificial Sequence
  Synthetic Polynucleotide
taatacgactcactatagggtattgggatctggaaatgataccctgaaaaaacagaggagattttcaatgtatcatttcaacctggcggcagcgcaaaagatg

SEQ ID NO: 25901 - DNA, 103 bp, Artificial Sequence
  Synthetic Polynucleotide
taatacgactcactatagggaaatttattgggatctggaaatgataccctaacagaggagaagggtaatgtttccagataacctggcggcagcgcaaaagatg

SEQ ID NO: 25902 - DNA, 103 bp, Artificial Sequence
  Synthetic Polynucleotide
taatacgactcactatagggaatgcaaatttattgggatctggaaatgataacagaggagaatcattatgagatcccaaaacctggcggcagcgcaaaagatg

SEQ ID NO: 25903 - DNA, 103 bp, Artificial Sequence
  Synthetic Polynucleotide
taatacgactcactatagggcagccaatgcaaatttattgggatctggaaaacagaggagattccagatgccaataaataacctggcggcagcgcaaaagatg

SEQ ID NO: 25904 - DNA, 103 bp, Artificial Sequence
  Synthetic Polynucleotide
taatacgactcactatagggattcaccatatgtcaataaagggcaactacaacagaggagagtagttatgctttattgaaacctggcggcagcgcaaaagatg

SEQ ID NO: 25905 - DNA, 103 bp, Artificial Sequence
  Synthetic Polynucleotide
taatacgactcactataggggtaggcaacaattctggaacaccccctacaaacagaggagatgtaggatgtgttccagaaacctggcggcagcgcaaaagatg

SEQ ID NO: 25906 - DNA, 103 bp, Artificial Sequence
  Synthetic Polynucleotide
taatacgactcactatagggagggtcagccaatgcaaatttattgggatcaacagaggagagatcccatgaaatttgcaaacctggcggcagcgcaaaagatg

SEQ ID NO: 25907 - DNA, 103 bp, Artificial Sequence
  Synthetic Polynucleotide
taatacgactcactatagggaccttagggtcagccaatgcaaatttattgaacagaggagacaataaatgtgcattggcaacctggcggcagcgcaaaagatg

SEQ ID NO: 25908 - DNA, 103 bp, Artificial Sequence
  Synthetic Polynucleotide
taatacgactcactatagggcatacaccttagggtcagccaatgcaaattaacagaggagaaatttgatgtggctgaccaacctggcggcagcgcaaaagatg

SEQ ID NO: 25909 - DNA, 103 bp, Artificial Sequence
  Synthetic Polynucleotide
taatacgactcactatagggaggatcatacaccttagggtcagccaatgcaacagaggagagcattgatggaccctaagaacctggcggcagcgcaaaagatg

SEQ ID NO: 25910 - DNA, 103 bp, Artificial Sequence
  Synthetic Polynucleotide
taatacgactcactatagggttatcaggatcatacaccttagggtcagccaacagaggagaggctgaatgtaaggtgtaaacctggcggcagcgcaaaagatg

SEQ ID NO: 25911 - DNA, 103 bp, Artificial Sequence
  Synthetic Polynucleotide
taatacgactcactataggggttctttatcaggatcatacaccttagggtaacagaggagaaccctaatgtgtatgatcaacctggcggcagcgcaaaagatg

SEQ ID NO: 25912 - DNA, 103 bp, Artificial Sequence
  Synthetic Polynucleotide
taatacgactcactatagggaagccgttctttatcaggatcatacaccttaacagaggagaaaggtgatggatcctgataacctggcggcagcgcaaaagatg

SEQ ID NO: 25913 - DNA, 103 bp, Artificial Sequence
  Synthetic Polynucleotide
taatacgactcactatagggcacacaagccgttctttatcaggatcatacaacagaggagagtatgaatgtgataaagaaacctggcggcagcgcaaaagatg

SEQ ID NO: 25914 - DNA, 103 bp, Artificial Sequence
  Synthetic Polynucleotide
taatacgactcactatagggcaccccacacaagccgttctttatcaggataacagaggagaatcctgatgaagaacggcaacctggcggcagcgcaaaagatg

SEQ ID NO: 25915 - DNA, 103 bp, Artificial Sequence
  Synthetic Polynucleotide
taatacgactcactatagggtcgtacaccccacacaagccgttctttatcaacagaggagagataaaatgcggcttgtgaacctggcggcagcgcaaaagatg

SEQ ID NO: 25916 - DNA, 103 bp, Artificial Sequence
  Synthetic Polynucleotide
taatacgactcactatagggtcctcgtaggcaacaattctggaacaccccaacagaggagaggggtgatgcagaattgtaacctggcggcagcgcaaaagatg

SEQ ID NO: 25917 - DNA, 103 bp, Artificial Sequence
  Synthetic Polynucleotide
taatacgactcactatagggacacctcgtacaccccacacaagccgttctaacagaggagaagaacgatgtgtgtggggaacctggcggcagcgcaaaagatg

SEQ ID NO: 25918 - DNA, 103 bp, Artificial Sequence
  Synthetic Polynucleotide
taatacgactcactatagggtttcaacacctcgtacaccccacacaagccaacagaggagaggcttgatgggggtgtacaacctggcggcagcgcaaaagatg

SEQ ID NO: 25919 - DNA, 103 bp, Artificial Sequence
  Synthetic Polynucleotide
taatacgactcactatagggcctaatttcaacacctcgtacaccccacacaacagaggagagtgtggatggtacgaggtaacctggcggcagcgcaaaagatg

SEQ ID NO: 25920 - DNA, 103 bp, Artificial Sequence
  Synthetic Polynucleotide
taatacgactcactatagggcctctcctaatttcaacacctcgtacacccaacagaggagagggtgtatgaggtgttgaaacctggcggcagcgcaaaagatg

SEQ ID NO: 25921 - DNA, 103 bp, Artificial Sequence
  Synthetic Polynucleotide
taatacgactcactataggggctggcctctcctaatttcaacacctcgtaaacagaggagatacgagatgttgaaattaaacctggcggcagcgcaaaagatg

SEQ ID NO: 25922 - DNA, 103 bp, Artificial Sequence
  Synthetic Polynucleotide
taatacgactcactatagggtaaaggctggcctctcctaatttcaacaccaacagaggagaggtgttatgattaggagaaacctggcggcagcgcaaaagatg

SEQ ID NO: 25923 - DNA, 103 bp, Artificial Sequence
  Synthetic Polynucleotide
taatacgactcactatagggacgcctaaaggctggcctctcctaatttcaaacagaggagatgaaatatggagaggccaaacctggcggcagcgcaaaagatg

SEQ ID NO: 25924 - DNA, 103 bp, Artificial Sequence
  Synthetic Polynucleotide
taatacgactcactatagggtgccaacgcctaaaggctggcctctcctaaaacagaggagattaggaatggccagccttaacctggcggcagcgcaaaagatg

SEQ ID NO: 25925 - DNA, 103 bp, Artificial Sequence
  Synthetic Polynucleotide
taatacgactcactatagggtgtggtgccaacgcctaaaggctggcctctaacagaggagaagaggcatgcctttaggcaacctggcggcagcgcaaaagatg

SEQ ID NO: 25926 - DNA, 103 bp, Artificial Sequence
  Synthetic Polynucleotide
taatacgactcactatagggtggcctgtggtgccaacgcctaaaggctggaacagaggagaccagccatgaggcgttggaacctggcggcagcgcaaaagatg

SEQ ID NO: 25927 - DNA, 103 bp, Artificial Sequence
  Synthetic Polynucleotide
taatacgactcactataggggatgctcctcgtaggcaacaattctggaacaacagaggagagttccaatgttgttgcctaacctggcggcagcgcaaaagatg

SEQ ID NO: 25928 - DNA, 103 bp, Artificial Sequence
  Synthetic Polynucleotide
taatacgactcactatagggaagggtggcctgtggtgccaacgcctaaagaacagaggagactttagatgttggcaccaaacctggcggcagcgcaaaagatg

SEQ ID NO: 25929 - DNA, 103 bp, Artificial Sequence
  Synthetic Polynucleotide
taatacgactcactatagggaagaaaagggtggcctgtggtgccaacgccaacagaggagaggcgttatgaccacaggcaacctggcggcagcgcaaaagatg

SEQ ID NO: 25930 - DNA, 103 bp, Artificial Sequence
  Synthetic Polynucleotide
taatacgactcactatagggttattaagaaaagggtggcctgtggtgccaaacagaggagatggcacatgaggccacccaacctggcggcagcgcaaaagatg

SEQ ID NO: 25931 - DNA, 103 bp, Artificial Sequence
  Synthetic Polynucleotide
taatacgactcactatagggctaccttattaagaaaagggtggcctgtggaacagaggagaccacagatgacccttttcaacctggcggcagcgcaaaagatg

SEQ ID NO: 25932 - DNA, 103 bp, Artificial Sequence
  Synthetic Polynucleotide
taatacgactcactatagggatctcctaccttattaagaaaagggtggccaacagaggagaggccacatgtttcttaataacctggcggcagcgcaaaagatg

SEQ ID NO: 25933 - DNA, 103 bp, Artificial Sequence
  Synthetic Polynucleotide
taatacgactcactatagggtcagtatctcctaccttattaagaaaagggaacagaggagaccctttatgtaataaggtaacctggcggcagcgcaaaagatg

SEQ ID NO: 25934 - DNA, 103 bp, Artificial Sequence
  Synthetic Polynucleotide
taatacgactcactataggggattttcagtatctcctaccttattaagaaaacagaggagattcttaatgaggtaggagaacctggcggcagcgcaaaagatg

SEQ ID NO: 25935 - DNA, 103 bp, Artificial Sequence
  Synthetic Polynucleotide
taatacgactcactatagggtgatggattttcagtatctcctaccttattaacagaggagaaataagatgggagatactaacctggcggcagcgcaaaagatg

SEQ ID NO: 25936 - DNA, 103 bp, Artificial Sequence
  Synthetic Polynucleotide
taatacgactcactatagggaatattgatggattttcagtatctcctaccaacagaggagaggtaggatgtactgaaaaaacctggcggcagcgcaaaagatg

SEQ ID NO: 25937 - DNA, 103 bp, Artificial Sequence
  Synthetic Polynucleotide
taatacgactcactatagggtcaaaaatattgatggattttcagtatctcaacagaggagagagataatgaaaatccataacctggcggcagcgcaaaagatg

SEQ ID NO: 25938 - DNA, 103 bp, Artificial Sequence
  Synthetic Polynucleotide
taatacgactcactatagggttgttgatgctcctcgtaggcaacaattctaacagaggagaagaattatggcctacgagaacctggcggcagcgcaaaagatg

SEQ ID NO: 25939 - DNA, 103 bp, Artificial Sequence
  Synthetic Polynucleotide
taatacgactcactatagggttgtttcaaaaatattgatggattttcagtaacagaggagaactgaaatgccatcaataaacctggcggcagcgcaaaagatg

SEQ ID NO: 25940 - DNA, 103 bp, Artificial Sequence
  Synthetic Polynucleotide
taatacgactcactatagggttgccttgtttcaaaaatattgatggatttaacagaggagaaaatccatgaatatttttaacctggcggcagcgcaaaagatg

SEQ ID NO: 25941 - DNA, 103 bp, Artificial Sequence
  Synthetic Polynucleotide
taatacgactcactatagggcatctttgccttgtttcaaaaatattgatgaacagaggagacatcaaatgttttgaaacaacctggcggcagcgcaaaagatg

SEQ ID NO: 25942 - DNA, 103 bp, Artificial Sequence
  Synthetic Polynucleotide
taatacgactcactatagggcctgtcatctttgccttgtttcaaaaatataacagaggagaatatttatgaaacaaggcaacctggcggcagcgcaaaagatg

SEQ ID NO: 25943 - DNA, 103 bp, Artificial Sequence
  Synthetic Polynucleotide
taatacgactcactatagggttttgcctgtcatctttgccttgtttcaaaaacagaggagatttgaaatgaggcaaagaaacctggcggcagcgcaaaagatg

SEQ ID NO: 25944 - DNA, 103 bp, Artificial Sequence
  Synthetic Polynucleotide
taatacgactcactatagggatacattttgcctgtcatctttgccttgttaacagaggagaaacaagatgaagatgacaaacctggcggcagcgcaaaagatg

SEQ ID NO: 25945 - DNA, 103 bp, Artificial Sequence
  Synthetic Polynucleotide
taatacgactcactatagggaaaggatacattttgcctgtcatctttgccaacagaggagaggcaaaatggacaggcaaaacctggcggcagcgcaaaagatg

SEQ ID NO: 25946 - DNA, 103 bp, Artificial Sequence
  Synthetic Polynucleotide
taatacgactcactatagggggatcaaaggatacattttgcctgtcatctaacagaggagaagatgaatggcaaaatgtaacctggcggcagcgcaaaagatg

SEQ ID NO: 25947 - DNA, 103 bp, Artificial Sequence
  Synthetic Polynucleotide
taatacgactcactataggggtttaggatcaaaggatacattttgcctgtaacagaggagaacaggcatgatgtatcctaacctggcggcagcgcaaaagatg

SEQ ID NO: 25948 - DNA, 103 bp, Artificial Sequence
  Synthetic Polynucleotide
taatacgactcactatagggaatttgtttaggatcaaaggatacattttgaacagaggagacaaaatatgtcctttgataacctggcggcagcgcaaaagatg

SEQ ID NO: 25949 - DNA, 103 bp, Artificial Sequence
  Synthetic Polynucleotide
taatacgactcactatagggcaaaattgttgatgctcctcgtaggcaacaaacagaggagatgttgcatgcgaggagcaaacctggcggcagcgcaaaagatg

SEQ ID NO: 25950 - DNA, 103 bp, Artificial Sequence
  Synthetic Polynucleotide
taatacgactcactatagggagctgaatttgtttaggatcaaaggatacaaacagaggagatgtatcatgtgatcctaaaacctggcggcagcgcaaaagatg

SEQ ID NO: 25951 - DNA, 103 bp, Artificial Sequence
  Synthetic Polynucleotide
taatacgactcactatagggcaaacagctgaatttgtttaggatcaaaggaacagaggagacctttgatgctaaacaaaaacctggcggcagcgcaaaagatg

SEQ ID NO: 25952 - DNA, 103 bp, Artificial Sequence
  Synthetic Polynucleotide
taatacgactcactatagggtagcacaaacagctgaatttgtttaggatcaacagaggagagatcctatgcaaattcagaacctggcggcagcgcaaaagatg

SEQ ID NO: 25953 - DNA, 103 bp, Artificial Sequence
  Synthetic Polynucleotide
taatacgactcactatagggcaccctagcacaaacagctgaatttgtttaaacagaggagataaacaatgtcagctgttaacctggcggcagcgcaaaagatg

SEQ ID NO: 25954 - DNA, 103 bp, Artificial Sequence
  Synthetic Polynucleotide
taatacgactcactataggggtgtacaccctagcacaaacagctgaatttaacagaggagaaaattcatgtgtttgtgcaacctggcggcagcgcaaaagatg

SEQ ID NO: 25955 - DNA, 103 bp, Artificial Sequence
  Synthetic Polynucleotide
taatacgactcactatagggacaaggtgtacaccctagcacaaacagctgaacagaggagacagctgatggtgctagggaacctggcggcagcgcaaaagatg

SEQ ID NO: 25956 - DNA, 103 bp, Artificial Sequence
  Synthetic Polynucleotide
taatacgactcactatagggccctcacaaggtgtacaccctagcacaaacaacagaggagagtttgtatgagggtgtacaacctggcggcagcgcaaaagatg

SEQ ID NO: 25957 - DNA, 103 bp, Artificial Sequence
  Synthetic Polynucleotide
taatacgactcactataggggctctccctcacaaggtgtacaccctagcaaacagaggagatgctagatggtacaccttaacctggcggcagcgcaaaagatg

SEQ ID NO: 25958 - DNA, 103 bp, Artificial Sequence
  Synthetic Polynucleotide
taatacgactcactatagggccagtgctctccctcacaaggtgtacacccaacagaggagagggtgtatgccttgtgagaacctggcggcagcgcaaaagatg

SEQ ID NO: 25959 - DNA, 103 bp, Artificial Sequence
  Synthetic Polynucleotide
taatacgactcactatagggttaccccagtgctctccctcacaaggtgtaaacagaggagatacaccatgtgagggagaaacctggcggcagcgcaaaagatg

SEQ ID NO: 25960 - DNA, 103 bp, Artificial Sequence
  Synthetic Polynucleotide
taatacgactcactataggggggtacaaaattgttgatgctcctcgtaggaacagaggagacctacgatgagcatcaacaacctggcggcagcgcaaaagatg

SEQ ID NO: 25961 - DNA, 103 bp, Artificial Sequence
  Synthetic Polynucleotide
taatacgactcactatagggtagctttaccccagtgctctccctcacaagaacagaggagacttgtgatggagagcactaacctggcggcagcgcaaaagatg

SEQ ID NO: 25962 - DNA, 103 bp, Artificial Sequence
  Synthetic Polynucleotide
taatacgactcactatagggaggagtagctttaccccagtgctctccctcaacagaggagagagggaatgcactggggtaacctggcggcagcgcaaaagatg

SEQ ID NO: 25963 - DNA, 103 bp, Artificial Sequence
  Synthetic Polynucleotide
taatacgactcactatagggctgcaaggagtagctttaccccagtgctctaacagaggagaagagcaatggggtaaagcaacctggcggcagcgcaaaagatg

SEQ ID NO: 25964 - DNA, 103 bp, Artificial Sequence
  Synthetic Polynucleotide
taatacgactcactatagggcaggactgcaaggagtagctttaccccagtaacagaggagaactgggatgaagctactcaacctggcggcagcgcaaaagatg

SEQ ID NO: 25965 - DNA, 103 bp, Artificial Sequence
  Synthetic Polynucleotide
taatacgactcactatagggttccacaggactgcaaggagtagctttaccaacagaggagaggtaaaatgactccttgcaacctggcggcagcgcaaaagatg

SEQ ID NO: 25966 - DNA, 103 bp, Artificial Sequence
  Synthetic Polynucleotide
taatacgactcactatagggcctgtttccacaggactgcaaggagtagctaacagaggagaagctacatgttgcagtccaacctggcggcagcgcaaaagatg

SEQ ID NO: 25967 - DNA, 103 bp, Artificial Sequence
  Synthetic Polynucleotide
taatacgactcactatagggaatcccctgtttccacaggactgcaaggagaacagaggagactccttatggtcctgtggaacctggcggcagcgcaaaagatg

SEQ ID NO: 25968 - DNA, 103 bp, Artificial Sequence
  Synthetic Polynucleotide
taatacgactcactatagggggggcaatcccctgtttccacaggactgcaaacagaggagatgcagtatggtggaaacaaacctggcggcagcgcaaaagatg

SEQ ID NO: 25969 - DNA, 103 bp, Artificial Sequence
  Synthetic Polynucleotide
taatacgactcactatagggatgggggggcaatcccctgtttccacaggaaacagaggagatcctgtatgaacaggggaaacctggcggcagcgcaaaagatg

SEQ ID NO: 25970 - DNA, 103 bp, Artificial Sequence
  Synthetic Polynucleotide
taatacgactcactatagggattcaatgggggggcaatcccctgtttccaaacagaggagatggaaaatggggattgccaacctggcggcagcgcaaaagatg

SEQ ID NO: 25971 - DNA, 103 bp, Artificial Sequence
  Synthetic Polynucleotide
taatacgactcactatagggctcgtgggtacaaaattgttgatgctcctcaacagaggagagaggagatgcaacaatttaacctggcggcagcgcaaaagatg

SEQ ID NO: 25972 - DNA, 103 bp, Artificial Sequence
  Synthetic Polynucleotide
taatacgactcactatagggttttaattcaatgggggggcaatcccctgtaacagaggagaacagggatgtgcccccccaacctggcggcagcgcaaaagatg

SEQ ID NO: 25973 - DNA, 103 bp, Artificial Sequence
  Synthetic Polynucleotide
taatacgactcactataggggtagattttaattcaatgggggggcaatccaacagaggagaggattgatgccccattgaaacctggcggcagcgcaaaagatg

SEQ ID NO: 25974 - DNA, 103 bp, Artificial Sequence
  Synthetic Polynucleotide
taatacgactcactatagggtcaaagtagattttaattcaatgggggggcaacagaggagagcccccatgttgaattaaaacctggcggcagcgcaaaagatg

SEQ ID NO: 25975 - DNA, 103 bp, Artificial Sequence
  Synthetic Polynucleotide
taatacgactcactatagggctcaatcaaagtagattttaattcaatgggaacagaggagacccattatgttaaaatctaacctggcggcagcgcaaaagatg

SEQ ID NO: 25976 - DNA, 103 bp, Artificial Sequence
  Synthetic Polynucleotide
taatacgactcactatagggccatcctcaatcaaagtagattttaattcaaacagaggagatgaattatgatctactttaacctggcggcagcgcaaaagatg

SEQ ID NO: 25977 - DNA, 103 bp, Artificial Sequence
  Synthetic Polynucleotide
taatacgactcactatagggtatcaccatcctcaatcaaagtagattttaaacagaggagataaaatatgctttgattgaacctggcggcagcgcaaaagatg

SEQ ID NO: 25978 - DNA, 103 bp, Artificial Sequence
  Synthetic Polynucleotide
taatacgactcactatagggacacatatcaccatcctcaatcaaagtagaaacagaggagatctactatgattgaggataacctggcggcagcgcaaaagatg

SEQ ID NO: 25979 - DNA, 103 bp, Artificial Sequence
  Synthetic Polynucleotide
taatacgactcactatagggatgtcacacatatcaccatcctcaatcaaaaacagaggagatttgatatgggatggtgaaacctggcggcagcgcaaaagatg

SEQ ID NO: 25980 - DNA, 103 bp, Artificial Sequence
  Synthetic Polynucleotide
taatacgactcactatagggagccaatgtcacacatatcaccatcctcaaaacagaggagattgaggatggtgatatgtaacctggcggcagcgcaaaagatg

SEQ ID NO: 25981 - DNA, 103 bp, Artificial Sequence
  Synthetic Polynucleotide
taatacgactcactataggggccaaagccaatgtcacacatatcaccatcaacagaggagagatggtatgatgtgtgacaacctggcggcagcgcaaaagatg

SEQ ID NO: 25982 - DNA, 103 bp, Artificial Sequence
  Synthetic Polynucleotide
taatacgactcactatagggagcaactcgtgggtacaaaattgttgatgcaacagaggagagcatcaatgattttgtacaacctggcggcagcgcaaaagatg

SEQ ID NO: 25983 - DNA, 103 bp, Artificial Sequence
  Synthetic Polynucleotide
taatacgactcactatagggagacagccaaagccaatgtcacacatatcaaacagaggagatgatatatgtgacattggaacctggcggcagcgcaaaagatg

SEQ ID NO: 25984 - DNA, 103 bp, Artificial Sequence
  Synthetic Polynucleotide
taatacgactcactatagggaatcaagacagccaaagccaatgtcacacaaacagaggagatgtgtgatgttggctttgaacctggcggcagcgcaaaagatg

SEQ ID NO: 25985 - DNA, 103 bp, Artificial Sequence
  Synthetic Polynucleotide
taatacgactcactatagggtttaaaatcaagacagccaaagccaatgtcaacagaggagagacattatgtttggctgtaacctggcggcagcgcaaaagatg

SEQ ID NO: 25986 - DNA, 103 bp, Artificial Sequence
  Synthetic Polynucleotide
taatacgactcactatagggagttctttaaaatcaagacagccaaagccaaacagaggagatggcttatgctgtcttgaaacctggcggcagcgcaaaagatg

SEQ ID NO: 25987 - DNA, 103 bp, Artificial Sequence
  Synthetic Polynucleotide
taatacgactcactatagggcctgcagttctttaaaatcaagacagccaaaacagaggagattggctatgttgattttaaacctggcggcagcgcaaaagatg

SEQ ID NO: 25988 - DNA, 103 bp, Artificial Sequence
  Synthetic Polynucleotide
taatacgactcactatagggggtgacctgcagttctttaaaatcaagacaaacagaggagatgtcttatgtttaaagaaaacctggcggcagcgcaaaagatg

SEQ ID NO: 25989 - DNA, 103 bp, Artificial Sequence
  Synthetic Polynucleotide
taatacgactcactataggggatttggtgacctgcagttctttaaaatcaaacagaggagatgatttatgagaactgcaaacctggcggcagcgcaaaagatg

SEQ ID NO: 25990 - DNA, 103 bp, Artificial Sequence
  Synthetic Polynucleotide
taatacgactcactatagggcacctgatttggtgacctgcagttctttaaaacagaggagattaaagatgtgcaggtcaaacctggcggcagcgcaaaagatg

SEQ ID NO: 25991 - DNA, 103 bp, Artificial Sequence
  Synthetic Polynucleotide
taatacgactcactataggggctcacacctgatttggtgacctgcagttcaacagaggagagaactgatggtcaccaaaaacctggcggcagcgcaaaagatg

SEQ ID NO: 25992 - DNA, 103 bp, Artificial Sequence
  Synthetic Polynucleotide
taatacgactcactatagggtccaggctcacacctgatttggtgacctgcaacagaggagagcaggtatgcaaatcaggaacctggcggcagcgcaaaagatg

SEQ ID NO: 25993 - DNA, 103 bp, Artificial Sequence
  Synthetic Polynucleotide
taatacgactcactatagggcgcctagcaactcgtgggtacaaaattgttaacagaggagaaacaatatggtacccacgaacctggcggcagcgcaaaagatg

SEQ ID NO: 25994 - DNA, 103 bp, Artificial Sequence
  Synthetic Polynucleotide
taatacgactcactatagggcaatgtccaggctcacacctgatttggtgaaacagaggagatcaccaatgcaggtgtgaaacctggcggcagcgcaaaagatg

SEQ ID NO: 25995 - DNA, 103 bp, Artificial Sequence
  Synthetic Polynucleotide
taatacgactcactatagggctgcacaatgtccaggctcacacctgatttaacagaggagaaaatcaatggtgagcctgaacctggcggcagcgcaaaagatg

SEQ ID NO: 25996 - DNA, 103 bp, Artificial Sequence
  Synthetic Polynucleotide
taatacgactcactataggggtagactgcacaatgtccaggctcacacctaacagaggagaaggtgtatgcctggacataacctggcggcagcgcaaaagatg

SEQ ID NO: 25997 - DNA, 103 bp, Artificial Sequence
  Synthetic Polynucleotide
taatacgactcactatagggtgcaggtagactgcacaatgtccaggctcaaacagaggagatgagccatgacattgtgcaacctggcggcagcgcaaaagatg

SEQ ID NO: 25998 - DNA, 103 bp, Artificial Sequence
  Synthetic Polynucleotide
taatacgactcactatagggatatttgcaggtagactgcacaatgtccagaacagaggagactggacatggtgcagtctaacctggcggcagcgcaaaagatg

SEQ ID NO: 25999 - DNA, 103 bp, Artificial Sequence
  Synthetic Polynucleotide
taatacgactcactatagggtcaggatatttgcaggtagactgcacaatgaacagaggagacattgtatggtctacctgaacctggcggcagcgcaaaagatg

SEQ ID NO: 26000 - DNA, 103 bp, Artificial Sequence
  Synthetic Polynucleotide
taatacgactcactataggggaaagtcaggatatttgcaggtagactgcaaacagaggagatgcagtatgcctgcaaataacctggcggcagcgcaaaagatg

SEQ ID NO: 26001 - DNA, 103 bp, Artificial Sequence
  Synthetic Polynucleotide
taatacgactcactatagggtttaagaaagtcaggatatttgcaggtagaaacagaggagatctaccatgaaatatcctaacctggcggcagcgcaaaagatg

SEQ ID NO: 26002 - DNA, 103 bp, Artificial Sequence
  Synthetic Polynucleotide
taatacgactcactatagggcacattttaagaaagtcaggatatttgcagaacagaggagactgcaaatgtcctgacttaacctggcggcagcgcaaaagatg

SEQ ID NO: 26003 - DNA, 103 bp, Artificial Sequence
  Synthetic Polynucleotide
taatacgactcactatagggcatcacacattttaagaaagtcaggatattaacagaggagaaatatcatgactttcttaaacctggcggcagcgcaaaagatg

SEQ ID NO: 26004 - DNA, 103 bp, Artificial Sequence
  Synthetic Polynucleotide
taatacgactcactatagggatcggcgcctagcaactcgtgggtacaaaaaacagaggagattttgtatgcacgagttgaacctggcggcagcgcaaaagatg

SEQ ID NO: 26005 - DNA, 103 bp, Artificial Sequence
  Synthetic Polynucleotide
taatacgactcactatagggattgtcatcacacattttaagaaagtcaggaacagaggagacctgacatgcttaaaatgaacctggcggcagcgcaaaagatg

SEQ ID NO: 26006 - DNA, 103 bp, Artificial Sequence
  Synthetic Polynucleotide
taatacgactcactatagggccataattgtcatcacacattttaagaaagaacagaggagactttctatgaatgtgtgaaacctggcggcagcgcaaaagatg

SEQ ID NO: 26007 - DNA, 103 bp, Artificial Sequence
  Synthetic Polynucleotide
taatacgactcactatagggcatttccataattgtcatcacacattttaaaacagaggagattaaaaatggtgatgacaaacctggcggcagcgcaaaagatg

SEQ ID NO: 26008 - DNA, 103 bp, Artificial Sequence
  Synthetic Polynucleotide
taatacgactcactataggggcatgcatttccataattgtcatcacacataacagaggagaatgtgtatggacaattataacctggcggcagcgcaaaagatg

SEQ ID NO: 26009 - DNA, 103 bp, Artificial Sequence
  Synthetic Polynucleotide
taatacgactcactatagggaaaaagcatgcatttccataattgtcatcaaacagaggagatgatgaatgttatggaaaaacctggcggcagcgcaaaagatg

SEQ ID NO: 26010 - DNA, 103 bp, Artificial Sequence
  Synthetic Polynucleotide
taatacgactcactatagggcaaaaaaaaagcatgcatttccataattgtaacagaggagaacaattatggaaatgcataacctggcggcagcgcaaaagatg

SEQ ID NO: 26011 - DNA, 103 bp, Artificial Sequence
  Synthetic Polynucleotide
taatacgactcactatagggttttgcaaaaaaaaagcatgcatttccataaacagaggagatatggaatggcatgctttaacctggcggcagcgcaaaagatg

SEQ ID NO: 26012 - DNA, 103 bp, Artificial Sequence
  Synthetic Polynucleotide
taatacgactcactatagggtctcgttttgcaaaaaaaaagcatgcatttaacagaggagaaaatgcatgcttttttttaacctggcggcagcgcaaaagatg

SEQ ID NO: 26013 - DNA, 103 bp, Artificial Sequence
  Synthetic Polynucleotide
taatacgactcactataggggctgctctcgttttgcaaaaaaaaagcatgaacagaggagacatgctatgtttttgcaaaacctggcggcagcgcaaaagatg

SEQ ID NO: 26014 - DNA, 103 bp, Artificial Sequence
  Synthetic Polynucleotide
taatacgactcactatagggaaacagctgctctcgttttgcaaaaaaaaaaacagaggagattttttatggcaaaacgaaacctggcggcagcgcaaaagatg

SEQ ID NO: 26015 - DNA, 103 bp, Artificial Sequence
  Synthetic Polynucleotide
taatacgactcactataggggatacattcaccatatgtcaataaagggcaaacagaggagatgccctatgttgacatataacctggcggcagcgcaaaagatg

SEQ ID NO: 26016 - DNA, 103 bp, Artificial Sequence
  Synthetic Polynucleotide
taatacgactcactatagggatcagatcggcgcctagcaactcgtgggtaaacagaggagatacccaatggttgctaggaacctggcggcagcgcaaaagatg

SEQ ID NO: 26017 - DNA, 103 bp, Artificial Sequence
  Synthetic Polynucleotide
taatacgactcactatagggctcataaacagctgctctcgttttgcaaaaaacagaggagattttgcatgacgagagcaaacctggcggcagcgcaaaagatg

SEQ ID NO: 26018 - DNA, 103 bp, Artificial Sequence
  Synthetic Polynucleotide
taatacgactcactatagggaatgtctcataaacagctgctctcgttttgaacagaggagacaaaacatgagcagctgtaacctggcggcagcgcaaaagatg

SEQ ID NO: 26019 - DNA, 103 bp, Artificial Sequence
  Synthetic Polynucleotide
taatacgactcactatagggccaaaaatgtctcataaacagctgctctcgaacagaggagacgagagatgctgtttatgaacctggcggcagcgcaaaagatg

SEQ ID NO: 26020 - DNA, 103 bp, Artificial Sequence
  Synthetic Polynucleotide
taatacgactcactatagggcgggtccaaaaatgtctcataaacagctgcaacagaggagagcagctatgtatgagacaaacctggcggcagcgcaaaagatg

SEQ ID NO: 26021 - DNA, 103 bp, Artificial Sequence
  Synthetic Polynucleotide
taatacgactcactatagggctcctcgggtccaaaaatgtctcataaacaaacagaggagatgtttaatggacatttttaacctggcggcagcgcaaaagatg

SEQ ID NO: 26022 - DNA, 103 bp, Artificial Sequence
  Synthetic Polynucleotide
taatacgactcactatagggaacacctcctcgggtccaaaaatgtctcataacagaggagaatgagaatgttttggaccaacctggcggcagcgcaaaagatg

SEQ ID NO: 26023 - DNA, 103 bp, Artificial Sequence
  Synthetic Polynucleotide
taatacgactcactatagggcccgtaacacctcctcgggtccaaaaatgtaacagaggagaacatttatggacccgaggaacctggcggcagcgcaaaagatg

SEQ ID NO: 26024 - DNA, 103 bp, Artificial Sequence
  Synthetic Polynucleotide
taatacgactcactatagggcatcgcccgtaacacctcctcgggtccaaaaacagaggagatttggaatggaggaggtgaacctggcggcagcgcaaaagatg

SEQ ID NO: 26025 - DNA, 103 bp, Artificial Sequence
  Synthetic Polynucleotide
taatacgactcactatagggcacatcatcgcccgtaacacctcctcgggtaacagaggagaacccgaatgggtgttacgaacctggcggcagcgcaaaagatg

SEQ ID NO: 26026 - DNA, 103 bp, Artificial Sequence
  Synthetic Polynucleotide
taatacgactcactataggggtgggcacatcatcgcccgtaacacctcctaacagaggagaaggaggatgtacgggcgaaacctggcggcagcgcaaaagatg

SEQ ID NO: 26027 - DNA, 103 bp, Artificial Sequence
  Synthetic Polynucleotide
taatacgactcactatagggggtctatcagatcggcgcctagcaactcgtaacagaggagaacgagtatgtaggcgccgaacctggcggcagcgcaaaagatg

SEQ ID NO: 26028 - DNA, 103 bp, Artificial Sequence
  Synthetic Polynucleotide
taatacgactcactatagggcctcagtgggcacatcatcgcccgtaacacaacagaggagagtgttaatggcgatgatgaacctggcggcagcgcaaaagatg

SEQ ID NO: 26029 - DNA, 103 bp, Artificial Sequence
  Synthetic Polynucleotide
taatacgactcactataggggtagtcctcagtgggcacatcatcgcccgtaacagaggagaacgggcatggatgtgcccaacctggcggcagcgcaaaagatg

SEQ ID NO: 26030 - DNA, 103 bp, Artificial Sequence
  Synthetic Polynucleotide
taatacgactcactataggggtaaagtagtcctcagtgggcacatcatcgaacagaggagacgatgaatggcccactgaaacctggcggcagcgcaaaagatg

SEQ ID NO: 26031 - DNA, 103 bp, Artificial Sequence
  Synthetic Polynucleotide
taatacgactcactatagggcaggggtaaagtagtcctcagtgggcacataacagaggagaatgtgcatgctgaggactaacctggcggcagcgcaaaagatg

SEQ ID NO: 26032 - DNA, 103 bp, Artificial Sequence
  Synthetic Polynucleotide
taatacgactcactatagggtgcatcaggggtaaagtagtcctcagtgggaacagaggagacccactatggactactttaacctggcggcagcgcaaaagatg

SEQ ID NO: 26033 - DNA, 103 bp, Artificial Sequence
  Synthetic Polynucleotide
taatacgactcactatagggtctcctgcatcaggggtaaagtagtcctcaaacagaggagatgaggaatgctttaccccaacctggcggcagcgcaaaagatg

SEQ ID NO: 26034 - DNA, 103 bp, Artificial Sequence
  Synthetic Polynucleotide
taatacgactcactatagggcctcctctcctgcatcaggggtaaagtagtaacagaggagaactactatgcccctgatgaacctggcggcagcgcaaaagatg

SEQ ID NO: 26035 - DNA, 103 bp, Artificial Sequence
  Synthetic Polynucleotide
taatacgactcactatagggtctttcctcctctcctgcatcaggggtaaaaacagaggagatttaccatggatgcaggaaacctggcggcagcgcaaaagatg

SEQ ID NO: 26036 - DNA, 103 bp, Artificial Sequence
  Synthetic Polynucleotide
taatacgactcactataggggtttttctttcctcctctcctgcatcagggaacagaggagaccctgaatgaggagaggaaacctggcggcagcgcaaaagatg

SEQ ID NO: 26037 - DNA, 103 bp, Artificial Sequence
  Synthetic Polynucleotide
taatacgactcactatagggccattgtttttctttcctcctctcctgcataacagaggagaatgcagatgaggaggaaaaacctggcggcagcgcaaaagatg

SEQ ID NO: 26038 - DNA, 103 bp, Artificial Sequence
  Synthetic Polynucleotide
taatacgactcactatagggaactaggtctatcagatcggcgcctagcaaaacagaggagattgctaatggccgatctgaacctggcggcagcgcaaaagatg

SEQ ID NO: 26039 - DNA, 103 bp, Artificial Sequence
  Synthetic Polynucleotide
taatacgactcactatagggtggacccattgtttttctttcctcctctccaacagaggagaggagagatggaaagaaaaaacctggcggcagcgcaaaagatg

SEQ ID NO: 26040 - DNA, 103 bp, Artificial Sequence
  Synthetic Polynucleotide
taatacgactcactataggggctactggacccattgtttttctttcctccaacagaggagaggaggaatgaaaaacaataacctggcggcagcgcaaaagatg

SEQ ID NO: 26041 - DNA, 103 bp, Artificial Sequence
  Synthetic Polynucleotide
taatacgactcactatagggaatatgctactggacccattgtttttctttaacagaggagaaaagaaatgcaatgggtcaacctggcggcagcgcaaaagatg

SEQ ID NO: 26042 - DNA, 103 bp, Artificial Sequence
  Synthetic Polynucleotide
taatacgactcactatagggtccaaaatatgctactggacccattgttttaacagaggagaaaaacaatgggtccagtaaacctggcggcagcgcaaaagatg

SEQ ID NO: 26043 - DNA, 103 bp, Artificial Sequence
  Synthetic Polynucleotide
taatacgactcactatagggggagctccaaaatatgctactggacccattaacagaggagaaatgggatgagtagcataaacctggcggcagcgcaaaagatg

SEQ ID NO: 26044 - DNA, 103 bp, Artificial Sequence
  Synthetic Polynucleotide
taatacgactcactatagggcgctgggagctccaaaatatgctactggacaacagaggagagtccagatgcatattttgaacctggcggcagcgcaaaagatg

SEQ ID NO: 26045 - DNA, 103 bp, Artificial Sequence
  Synthetic Polynucleotide
taatacgactcactatagggagagccgctgggagctccaaaatatgctacaacagaggagagtagcaatgtttggagctaacctggcggcagcgcaaaagatg

SEQ ID NO: 26046 - DNA, 103 bp, Artificial Sequence
  Synthetic Polynucleotide
taatacgactcactatagggaccaaagagccgctgggagctccaaaatataacagaggagaatatttatgagctcccagaacctggcggcagcgcaaaagatg

SEQ ID NO: 26047 - DNA, 103 bp, Artificial Sequence
  Synthetic Polynucleotide
taatacgactcactatagggtgctgaccaaagagccgctgggagctccaaaacagaggagattggagatgccagcggctaacctggcggcagcgcaaaagatg

SEQ ID NO: 26048 - DNA, 103 bp, Artificial Sequence
  Synthetic Polynucleotide
taatacgactcactatagggatcactgctgaccaaagagccgctgggagcaacagaggagagctcccatgggctctttgaacctggcggcagcgcaaaagatg

SEQ ID NO: 26049 - DNA, 103 bp, Artificial Sequence
  Synthetic Polynucleotide
taatacgactcactatagggaccttaactaggtctatcagatcggcgcctaacagaggagaaggcgcatgtctgatagaaacctggcggcagcgcaaaagatg

SEQ ID NO: 26050 - DNA, 103 bp, Artificial Sequence
  Synthetic Polynucleotide
taatacgactcactatagggtgggaatcactgctgaccaaagagccgctgaacagaggagacagcggatgtttggtcagaacctggcggcagcgcaaaagatg

SEQ ID NO: 26051 - DNA, 103 bp, Artificial Sequence
  Synthetic Polynucleotide
taatacgactcactatagggacaattgggaatcactgctgaccaaagagcaacagaggagagctcttatgtcagcagtgaacctggcggcagcgcaaaagatg

SEQ ID NO: 26052 - DNA, 103 bp, Artificial Sequence
  Synthetic Polynucleotide
taatacgactcactataggggttaaacaattgggaatcactgctgaccaaaacagaggagattggtcatgagtgattccaacctggcggcagcgcaaaagatg

SEQ ID NO: 26053 - DNA, 103 bp, Artificial Sequence
  Synthetic Polynucleotide
taatacgactcactatagggggcctgttaaacaattgggaatcactgctgaacagaggagacagcagatgttcccaattaacctggcggcagcgcaaaagatg

SEQ ID NO: 26054 - DNA, 103 bp, Artificial Sequence
  Synthetic Polynucleotide
taatacgactcactatagggaataaggcctgttaaacaattgggaatcacaacagaggagagtgattatgaattgtttaaacctggcggcagcgcaaaagatg

SEQ ID NO: 26055 - DNA, 103 bp, Artificial Sequence
  Synthetic Polynucleotide
taatacgactcactatagggaagccaataaggcctgttaaacaattgggaaacagaggagatcccaaatgtttaacaggaacctggcggcagcgcaaaagatg

SEQ ID NO: 26056 - DNA, 103 bp, Artificial Sequence
  Synthetic Polynucleotide
taatacgactcactatagggctctgaagccaataaggcctgttaaacaataacagaggagaattgttatgcaggccttaaacctggcggcagcgcaaaagatg

SEQ ID NO: 26057 - DNA, 103 bp, Artificial Sequence
  Synthetic Polynucleotide
taatacgactcactataggggggctctctgaagccaataaggcctgttaaaacagaggagattaacaatgcttattggcaacctggcggcagcgcaaaagatg

SEQ ID NO: 26058 - DNA, 103 bp, Artificial Sequence
  Synthetic Polynucleotide
taatacgactcactatagggtccttgggctctctgaagccaataaggcctaacagaggagaaggcctatgtggcttcagaacctggcggcagcgcaaaagatg

SEQ ID NO: 26059 - DNA, 103 bp, Artificial Sequence
  Synthetic Polynucleotide
taatacgactcactatagggttctgtccttgggctctctgaagccaataaaacagaggagattattgatgtcagagagcaacctggcggcagcgcaaaagatg

SEQ ID NO: 26060 - DNA, 103 bp, Artificial Sequence
  Synthetic Polynucleotide
taatacgactcactatagggagggaaccttaactaggtctatcagatcggaacagaggagaccgatcatgtagacctagaacctggcggcagcgcaaaagatg

SEQ ID NO: 26061 - DNA, 103 bp, Artificial Sequence
  Synthetic Polynucleotide
taatacgactcactatagggcattattctgtccttgggctctctgaagccaacagaggagaggcttcatggagcccaagaacctggcggcagcgcaaaagatg

SEQ ID NO: 26062 - DNA, 103 bp, Artificial Sequence
  Synthetic Polynucleotide
taatacgactcactatagggaatgccattattctgtccttgggctctctgaacagaggagacagagaatgcaaggacagaacctggcggcagcgcaaaagatg

SEQ ID NO: 26063 - DNA, 103 bp, Artificial Sequence
  Synthetic Polynucleotide
taatacgactcactatagggcaggcaatgccattattctgtccttgggctaacagaggagaagcccaatgacagaataaaacctggcggcagcgcaaaagatg

SEQ ID NO: 26064 - DNA, 103 bp, Artificial Sequence
  Synthetic Polynucleotide
taatacgactcactatagggtattccaggcaatgccattattctgtccttaacagaggagaaaggacatgataatggcaaacctggcggcagcgcaaaagatg

SEQ ID NO: 26065 - DNA, 103 bp, Artificial Sequence
  Synthetic Polynucleotide
taatacgactcactatagggctggttattccaggcaatgccattattctgaacagaggagacagaatatgggcattgccaacctggcggcagcgcaaaagatg

SEQ ID NO: 26066 - DNA, 103 bp, Artificial Sequence
  Synthetic Polynucleotide
taatacgactcactatagggaacacctggttattccaggcaatgccattaaacagaggagataatggatgtgcctggaaaacctggcggcagcgcaaaagatg

SEQ ID NO: 26067 - DNA, 103 bp, Artificial Sequence
  Synthetic Polynucleotide
taatacgactcactatagggtcacaaacacctggttattccaggcaatgcaacagaggagagcattgatgggaataaccaacctggcggcagcgcaaaagatg

SEQ ID NO: 26068 - DNA, 103 bp, Artificial Sequence
  Synthetic Polynucleotide
taatacgactcactatagggcacggtcacaaacacctggttattccaggcaacagaggagagcctggatgaaccaggtgaacctggcggcagcgcaaaagatg

SEQ ID NO: 26069 - DNA, 103 bp, Artificial Sequence
  Synthetic Polynucleotide
taatacgactcactatagggtccaccacggtcacaaacacctggttattcaacagaggagagaataaatgggtgtttgtaacctggcggcagcgcaaaagatg

SEQ ID NO: 26070 - DNA, 103 bp, Artificial Sequence
  Synthetic Polynucleotide
taatacgactcactatagggtgttgtccaccacggtcacaaacacctggtaacagaggagaaccaggatgttgtgaccgaacctggcggcagcgcaaaagatg

SEQ ID NO: 26071 - DNA, 103 bp, Artificial Sequence
  Synthetic Polynucleotide
taatacgactcactatagggatgcaagggaaccttaactaggtctatcagaacagaggagactgataatgctagttaagaacctggcggcagcgcaaaagatg

SEQ ID NO: 26072 - DNA, 103 bp, Artificial Sequence
  Synthetic Polynucleotide
taatacgactcactatagggccgtgtgttgtccaccacggtcacaaacacaacagaggagagtgtttatgaccgtggtgaacctggcggcagcgcaaaagatg

SEQ ID NO: 26073 - DNA, 103 bp, Artificial Sequence
  Synthetic Polynucleotide
taatacgactcactataggggtgccccgtgtgttgtccaccacggtcacaaacagaggagatgtgacatgggtggacaaaacctggcggcagcgcaaaagatg

SEQ ID NO: 26074 - DNA, 103 bp, Artificial Sequence
  Synthetic Polynucleotide
taatacgactcactatagggagttagtgccccgtgtgttgtccaccacggaacagaggagaccgtggatgacaacacacaacctggcggcagcgcaaaagatg

SEQ ID NO: 26075 - DNA, 103 bp, Artificial Sequence
  Synthetic Polynucleotide
taatacgactcactatagggttgaaagttagtgccccgtgtgttgtccacaacagaggagagtggacatgacacggggcaacctggcggcagcgcaaaagatg

SEQ ID NO: 26076 - DNA, 103 bp, Artificial Sequence
  Synthetic Polynucleotide
taatacgactcactataggggaaatttgaaagttagtgccccgtgtgttgaacagaggagacaacacatggggcactaaaacctggcggcagcgcaaaagatg

SEQ ID NO: 26077 - DNA, 103 bp, Artificial Sequence
  Synthetic Polynucleotide
taatacgactcactatagggggactgaaatttgaaagttagtgccccgtgaacagaggagacacgggatgctaactttcaacctggcggcagcgcaaaagatg

SEQ ID NO: 26078 - DNA, 103 bp, Artificial Sequence
  Synthetic Polynucleotide
taatacgactcactatagggtttggggactgaaatttgaaagttagtgccaacagaggagaggcactatgtttcaaattaacctggcggcagcgcaaaagatg

SEQ ID NO: 26079 - DNA, 103 bp, Artificial Sequence
  Synthetic Polynucleotide
taatacgactcactatagggtcatctttggggactgaaatttgaaagttaaacagaggagataacttatgaatttcagtaacctggcggcagcgcaaaagatg

SEQ ID NO: 26080 - DNA, 103 bp, Artificial Sequence
  Synthetic Polynucleotide
taatacgactcactatagggcctcctcatctttggggactgaaatttgaaaacagaggagattcaaaatgcagtccccaaacctggcggcagcgcaaaagatg

SEQ ID NO: 26081 - DNA, 103 bp, Artificial Sequence
  Synthetic Polynucleotide
taatacgactcactatagggatgttcctcctcatctttggggactgaaataacagaggagaatttcaatgcccaaagataacctggcggcagcgcaaaagatg

SEQ ID NO: 26082 - DNA, 103 bp, Artificial Sequence
  Synthetic Polynucleotide
taatacgactcactatagggattaaatgcaagggaaccttaactaggtctaacagaggagaagacctatgtaaggttccaacctggcggcagcgcaaaagatg

SEQ ID NO: 26083 - DNA, 103 bp, Artificial Sequence
  Synthetic Polynucleotide
taatacgactcactataggggtttcatgttcctcctcatctttggggactaacagaggagaagtcccatgagatgaggaaacctggcggcagcgcaaaagatg

SEQ ID NO: 26084 - DNA, 103 bp, Artificial Sequence
  Synthetic Polynucleotide
taatacgactcactatagggcaaaggtttcatgttcctcctcatctttggaacagaggagaccaaagatgaggaggaacaacctggcggcagcgcaaaagatg

SEQ ID NO: 26085 - DNA, 103 bp, Artificial Sequence
  Synthetic Polynucleotide
taatacgactcactatagggggcatcaaaggtttcatgttcctcctcatcaacagaggagagatgagatggaacatgaaaacctggcggcagcgcaaaagatg

SEQ ID NO: 26086 - DNA, 103 bp, Artificial Sequence
  Synthetic Polynucleotide
taatacgactcactatagggttttgggcatcaaaggtttcatgttcctccaacagaggagaggaggaatgtgaaaccttaacctggcggcagcgcaaaagatg

SEQ ID NO: 26087 - DNA, 103 bp, Artificial Sequence
  Synthetic Polynucleotide
taatacgactcactatagggtataattttgggcatcaaaggtttcatgttaacagaggagaaacatgatgcctttgatgaacctggcggcagcgcaaaagatg

SEQ ID NO: 26088 - DNA, 103 bp, Artificial Sequence
  Synthetic Polynucleotide
taatacgactcactatagggttgtttataattttgggcatcaaaggtttcaacagaggagagaaaccatggatgcccaaaacctggcggcagcgcaaaagatg

SEQ ID NO: 26089 - DNA, 103 bp, Artificial Sequence
  Synthetic Polynucleotide
taatacgactcactatagggttatattgtttataattttgggcatcaaagaacagaggagactttgaatgccaaaattaaacctggcggcagcgcaaaagatg

SEQ ID NO: 26090 - DNA, 103 bp, Artificial Sequence
  Synthetic Polynucleotide
taatacgactcactataggggtctattatattgtttataattttgggcataacagaggagaatgcccatgattataaacaacctggcggcagcgcaaaagatg

SEQ ID NO: 26091 - DNA, 103 bp, Artificial Sequence
  Synthetic Polynucleotide
taatacgactcactatagggcacgtgtctattatattgtttataattttgaacagaggagacaaaatatgaaacaatataacctggcggcagcgcaaaagatg

SEQ ID NO: 26092 - DNA, 103 bp, Artificial Sequence
  Synthetic Polynucleotide
taatacgactcactatagggtcctccacgtgtctattatattgtttataaaacagaggagattataaatgatataatagaacctggcggcagcgcaaaagatg

SEQ ID NO: 26093 - DNA, 103 bp, Artificial Sequence
  Synthetic Polynucleotide
taatacgactcactatagggtgaatattaaatgcaagggaaccttaactaaacagaggagatagttaatgttcccttgcaacctggcggcagcgcaaaagatg

SEQ ID NO: 26094 - DNA, 103 bp, Artificial Sequence
  Synthetic Polynucleotide
taatacgactcactatagggcatactcctccacgtgtctattatattgttaacagaggagaaacaatatgatagacacgaacctggcggcagcgcaaaagatg

SEQ ID NO: 26095 - DNA, 103 bp, Artificial Sequence
  Synthetic Polynucleotide
taatacgactcactatagggtaattcatactcctccacgtgtctattataaacagaggagatataatatgcacgtggagaacctggcggcagcgcaaaagatg

SEQ ID NO: 26096 - DNA, 103 bp, Artificial Sequence
  Synthetic Polynucleotide
taatacgactcactatagggaatgctaattcatactcctccacgtgtctaaacagaggagatagacaatgggaggagtaaacctggcggcagcgcaaaagatg

SEQ ID NO: 26097 - DNA, 103 bp, Artificial Sequence
  Synthetic Polynucleotide
taatacgactcactatagggcaataaatgctaattcatactcctccacgtaacagaggagaacgtggatgagtatgaataacctggcggcagcgcaaaagatg

SEQ ID NO: 26098 - DNA, 103 bp, Artificial Sequence
  Synthetic Polynucleotide
taatacgactcactatagggctgaacaataaatgctaattcatactcctcaacagaggagagaggagatggaattagcaaacctggcggcagcgcaaaagatg

SEQ ID NO: 26099 - DNA, 103 bp, Artificial Sequence
  Synthetic Polynucleotide
taatacgactcactatagggcatagctgaacaataaatgctaattcatacaacagaggagagtatgaatgagcatttataacctggcggcagcgcaaaagatg

SEQ ID NO: 26100 - DNA, 103 bp, Artificial Sequence
  Synthetic Polynucleotide
taatacgactcactatagggctttgcatagctgaacaataaatgctaattaacagaggagaaattagatgttattgttcaacctggcggcagcgcaaaagatg

SEQ ID NO: 26101 - DNA, 103 bp, Artificial Sequence
  Synthetic Polynucleotide
taatacgactcactatagggagacactttgcatagctgaacaataaatgcaacagaggagagcatttatggttcagctaaacctggcggcagcgcaaaagatg

SEQ ID NO: 26102 - DNA, 103 bp, Artificial Sequence
  Synthetic Polynucleotide
taatacgactcactatagggtctaaagacactttgcatagctgaacaataaacagaggagatattgtatggctatgcaaaacctggcggcagcgcaaaagatg

SEQ ID NO: 26103 - DNA, 103 bp, Artificial Sequence
  Synthetic Polynucleotide
taatacgactcactatagggccggttctaaagacactttgcatagctgaaaacagaggagattcagcatggcaaagtgtaacctggcggcagcgcaaaagatg

SEQ ID NO: 26104 - DNA, 103 bp, Artificial Sequence
  Synthetic Polynucleotide
taatacgactcactatagggcctaatgaatattaaatgcaagggaaccttaacagaggagaaaggttatgttgcatttaaacctggcggcagcgcaaaagatg

SEQ ID NO: 26105 - DNA, 103 bp, Artificial Sequence
  Synthetic Polynucleotide
taatacgactcactataggggacctccggttctaaagacactttgcatagaacagaggagactatgcatggtgtctttaaacctggcggcagcgcaaaagatg

SEQ ID NO: 26106 - DNA, 103 bp, Artificial Sequence
  Synthetic Polynucleotide
taatacgactcactataggggctaggacctccggttctaaagacactttgaacagaggagacaaagtatgtttagaaccaacctggcggcagcgcaaaagatg

SEQ ID NO: 26107 - DNA, 103 bp, Artificial Sequence
  Synthetic Polynucleotide
taatacgactcactatagggggtgggctaggacctccggttctaaagacaaacagaggagatgtcttatgaaccggaggaacctggcggcagcgcaaaagatg

SEQ ID NO: 26108 - DNA, 103 bp, Artificial Sequence
  Synthetic Polynucleotide
taatacgactcactatagggattaaggtgggctaggacctccggttctaaaacagaggagattagaaatggaggtcctaaacctggcggcagcgcaaaagatg

SEQ ID NO: 26109 - DNA, 103 bp, Artificial Sequence
  Synthetic Polynucleotide
taatacgactcactatagggattgcattaaggtgggctaggacctccggtaacagaggagaaccggaatgcctagcccaaacctggcggcagcgcaaaagatg

SEQ ID NO: 26110 - DNA, 103 bp, Artificial Sequence
  Synthetic Polynucleotide
taatacgactcactatagggtattcattgcattaaggtgggctaggacctaacagaggagaaggtccatgcccaccttaaacctggcggcagcgcaaaagatg

SEQ ID NO: 26111 - DNA, 103 bp, Artificial Sequence
  Synthetic Polynucleotide
taatacgactcactatagggatctttattcattgcattaaggtgggctagaacagaggagactagccatgcttaatgcaaacctggcggcagcgcaaaagatg

SEQ ID NO: 26112 - DNA, 103 bp, Artificial Sequence
  Synthetic Polynucleotide
taatacgactcactatagggaatatatctttattcattgcattaaggtggaacagaggagaccacctatgtgcaatgaaaacctggcggcagcgcaaaagatg

SEQ ID NO: 26113 - DNA, 103 bp, Artificial Sequence
  Synthetic Polynucleotide
taatacgactcactatagggcttctaatatatctttattcattgcattaaaacagaggagattaatgatgtgaataaagaacctggcggcagcgcaaaagatg

SEQ ID NO: 26114 - DNA, 103 bp, Artificial Sequence
  Synthetic Polynucleotide
taatacgactcactatagggccagtcttctaatatatctttattcattgcaacagaggagagcaatgatgaaagatataaacctggcggcagcgcaaaagatg

SEQ ID NO: 26115 - DNA, 103 bp, Artificial Sequence
  Synthetic Polynucleotide
taatacgactcactatagggacacacctaatgaatattaaatgcaagggaaacagaggagatcccttatgtttaatattaacctggcggcagcgcaaaagatg

SEQ ID NO: 26116 - DNA, 103 bp, Artificial Sequence
  Synthetic Polynucleotide
taatacgactcactatagggagctcccagtcttctaatatatctttattcaacagaggagagaataaatgtatattagaaacctggcggcagcgcaaaagatg

SEQ ID NO: 26117 - DNA, 103 bp, Artificial Sequence
  Synthetic Polynucleotide
taatacgactcactatagggatcctagctcccagtcttctaatatatcttaacagaggagaaagataatgtagaagactaacctggcggcagcgcaaaagatg

SEQ ID NO: 26118 - DNA, 103 bp, Artificial Sequence
  Synthetic Polynucleotide
taatacgactcactatagggtataaatcctagctcccagtcttctaatataacagaggagaatattaatggactgggagaacctggcggcagcgcaaaagatg

SEQ ID NO: 26119 - DNA, 103 bp, Artificial Sequence
  Synthetic Polynucleotide
taatacgactcactatagggggggctataaatcctagctcccagtcttctaacagaggagaagaagaatgggagctaggaacctggcggcagcgcaaaagatg

SEQ ID NO: 26120 - DNA, 103 bp, Artificial Sequence
  Synthetic Polynucleotide
taatacgactcactatagggcaggtggggctataaatcctagctcccagtaacagaggagaactgggatgtaggatttaaacctggcggcagcgcaaaagatg

SEQ ID NO: 26121 - DNA, 103 bp, Artificial Sequence
  Synthetic Polynucleotide
taatacgactcactataggggctaccaggtggggctataaatcctagctcaacagaggagagagctaatgtttatagccaacctggcggcagcgcaaaagatg

SEQ ID NO: 26122 - DNA, 103 bp, Artificial Sequence
  Synthetic Polynucleotide
taatacgactcactatagggtccaggctaccaggtggggctataaatcctaacagaggagaaggattatgagccccaccaacctggcggcagcgcaaaagatg

SEQ ID NO: 26123 - DNA, 103 bp, Artificial Sequence
  Synthetic Polynucleotide
taatacgactcactatagggtatcttccaggctaccaggtggggctataaaacagaggagattatagatgcacctggtaaacctggcggcagcgcaaaagatg

SEQ ID NO: 26124 - DNA, 103 bp, Artificial Sequence
  Synthetic Polynucleotide
taatacgactcactataggggtatctatcttccaggctaccaggtggggcaacagaggagagccccaatgggtagcctgaacctggcggcagcgcaaaagatg

SEQ ID NO: 26125 - DNA, 103 bp, Artificial Sequence
  Synthetic Polynucleotide
taatacgactcactatagggaatctgtatctatcttccaggctaccaggtaacagaggagaacctggatgcctggaagaaacctggcggcagcgcaaaagatg

SEQ ID NO: 26126 - DNA, 103 bp, Artificial Sequence
  Synthetic Polynucleotide
taatacgactcactataggggtagggatacattcaccatatgtcaataaaaacagaggagatttattatgatatggtgaaacctggcggcagcgcaaaagatg

SEQ ID NO: 26127 - DNA, 103 bp, Artificial Sequence
  Synthetic Polynucleotide
taatacgactcactatagggactgcacacacctaatgaatattaaatgcaaacagaggagatgcattatgtattcattaaacctggcggcagcgcaaaagatg

SEQ ID NO: 26128 - DNA, 103 bp, Artificial Sequence
  Synthetic Polynucleotide
taatacgactcactatagggccataaatctgtatctatcttccaggctacaacagaggagagtagccatgaagatagataacctggcggcagcgcaaaagatg

SEQ ID NO: 26129 - DNA, 103 bp, Artificial Sequence
  Synthetic Polynucleotide
taatacgactcactatagggtgattccataaatctgtatctatcttccagaacagaggagactggaaatgagatacagaaacctggcggcagcgcaaaagatg

SEQ ID NO: 26130 - DNA, 103 bp, Artificial Sequence
  Synthetic Polynucleotide
taatacgactcactataggggccagtgattccataaatctgtatctatctaacagaggagaagatagatgcagatttataacctggcggcagcgcaaaagatg

SEQ ID NO: 26131 - DNA, 103 bp, Artificial Sequence
  Synthetic Polynucleotide
taatacgactcactatagggtagtagccagtgattccataaatctgtatcaacagaggagagatacaatgttatggaataacctggcggcagcgcaaaagatg

SEQ ID NO: 26132 - DNA, 103 bp, Artificial Sequence
  Synthetic Polynucleotide
taatacgactcactatagggacatctagtagccagtgattccataaatctaacagaggagaagatttatggaatcactgaacctggcggcagcgcaaaagatg

SEQ ID NO: 26133 - DNA, 103 bp, Artificial Sequence
  Synthetic Polynucleotide
taatacgactcactatagggaggggacatctagtagccagtgattccataaacagaggagatatggaatgactggctacaacctggcggcagcgcaaaagatg

SEQ ID NO: 26134 - DNA, 103 bp, Artificial Sequence
  Synthetic Polynucleotide
taatacgactcactatagggcagggaggggacatctagtagccagtgattaacagaggagaaatcacatgctactagataacctggcggcagcgcaaaagatg

SEQ ID NO: 26135 - DNA, 103 bp, Artificial Sequence
  Synthetic Polynucleotide
taatacgactcactatagggttgatcagggaggggacatctagtagccagaacagaggagactggctatgagatgtcccaacctggcggcagcgcaaaagatg

SEQ ID NO: 26136 - DNA, 103 bp, Artificial Sequence
  Synthetic Polynucleotide
taatacgactcactatagggttggtttgatcagggaggggacatctagtaaacagaggagatactagatgtcccctcccaacctggcggcagcgcaaaagatg

SEQ ID NO: 26137 - DNA, 103 bp, Artificial Sequence
  Synthetic Polynucleotide
taatacgactcactatagggtatccttggtttgatcagggaggggacatcaacagaggagagatgtcatgtccctgatcaacctggcggcagcgcaaaagatg

SEQ ID NO: 26138 - DNA, 103 bp, Artificial Sequence
  Synthetic Polynucleotide
taatacgactcactatagggcagacactgcacacacctaatgaatattaaaacagaggagattaataatgattaggtgtaacctggcggcagcgcaaaagatg

SEQ ID NO: 26139 - DNA, 103 bp, Artificial Sequence
  Synthetic Polynucleotide
taatacgactcactatagggctttttatccttggtttgatcagggaggggaacagaggagacccctcatggatcaaaccaacctggcggcagcgcaaaagatg

SEQ ID NO: 26140 - DNA, 103 bp, Artificial Sequence
  Synthetic Polynucleotide
taatacgactcactatagggggatcctttttatccttggtttgatcagggaacagaggagaccctgaatgaaccaaggaaacctggcggcagcgcaaaagatg

SEQ ID NO: 26141 - DNA, 103 bp, Artificial Sequence
  Synthetic Polynucleotide
taatacgactcactatagggcatatggatcctttttatccttggtttgataacagaggagaatcaaaatgaggataaaaaacctggcggcagcgcaaaagatg

SEQ ID NO: 26142 - DNA, 103 bp, Artificial Sequence
  Synthetic Polynucleotide
taatacgactcactatagggtttttcatatggatcctttttatccttggtaacagaggagaaccaagatgaaaaaggataacctggcggcagcgcaaaagatg

SEQ ID NO: 26143 - DNA, 103 bp, Artificial Sequence
  Synthetic Polynucleotide
taatacgactcactatagggttaagtttttcatatggatcctttttatccaacagaggagaggataaatgggatccataaacctggcggcagcgcaaaagatg

SEQ ID NO: 26144 - DNA, 103 bp, Artificial Sequence
  Synthetic Polynucleotide
taatacgactcactatagggagaagttaagtttttcatatggatccttttaacagaggagaaaaaggatgcatatgaaaaacctggcggcagcgcaaaagatg

SEQ ID NO: 26145 - DNA, 103 bp, Artificial Sequence
  Synthetic Polynucleotide
taatacgactcactatagggattccagaagttaagtttttcatatggatcaacagaggagagatccaatggaaaaacttaacctggcggcagcgcaaaagatg

SEQ ID NO: 26146 - DNA, 103 bp, Artificial Sequence
  Synthetic Polynucleotide
taatacgactcactatagggtccacattccagaagttaagtttttcatataacagaggagaatatgaatgacttaacttaacctggcggcagcgcaaaagatg

SEQ ID NO: 26147 - DNA, 103 bp, Artificial Sequence
  Synthetic Polynucleotide
taatacgactcactataggggtagatccacattccagaagttaagtttttaacagaggagaaaaaacatgacttctggaaacctggcggcagcgcaaaagatg

SEQ ID NO: 26148 - DNA, 103 bp, Artificial Sequence
  Synthetic Polynucleotide
taatacgactcactatagggttcccgtagatccacattccagaagttaagaacagaggagacttaacatgtggaatgtgaacctggcggcagcgcaaaagatg

SEQ ID NO: 26149 - DNA, 103 bp, Artificial Sequence
  Synthetic Polynucleotide
taatacgactcactatagggtgtttcagacactgcacacacctaatgaataacagaggagaattcatatggtgtgtgcaaacctggcggcagcgcaaaagatg

SEQ ID NO: 26150 - DNA, 103 bp, Artificial Sequence
  Synthetic Polynucleotide
taatacgactcactatagggaacttttcccgtagatccacattccagaagaacagaggagacttctgatgtgtggatctaacctggcggcagcgcaaaagatg

SEQ ID NO: 26151 - DNA, 103 bp, Artificial Sequence
  Synthetic Polynucleotide
taatacgactcactatagggatgaaaacttttcccgtagatccacattccaacagaggagaggaatgatgatctacgggaacctggcggcagcgcaaaagatg

SEQ ID NO: 26152 - DNA, 103 bp, Artificial Sequence
  Synthetic Polynucleotide
taatacgactcactatagggttctaatgaaaacttttcccgtagatccacaacagaggagagtggatatgcgggaaaagaacctggcggcagcgcaaaagatg

SEQ ID NO: 26153 - DNA, 103 bp, Artificial Sequence
  Synthetic Polynucleotide
taatacgactcactatagggtctaattctaatgaaaacttttcccgtagaaacagaggagatctacgatgaaagttttcaacctggcggcagcgcaaaagatg

SEQ ID NO: 26154 - DNA, 103 bp, Artificial Sequence
  Synthetic Polynucleotide
taatacgactcactatagggactgttctaattctaatgaaaacttttcccaacagaggagagggaaaatgtttcattagaacctggcggcagcgcaaaagatg

SEQ ID NO: 26155 - DNA, 103 bp, Artificial Sequence
  Synthetic Polynucleotide
taatacgactcactatagggggagtactgttctaattctaatgaaaacttaacagaggagaaagtttatgttagaattaaacctggcggcagcgcaaaagatg

SEQ ID NO: 26156 - DNA, 103 bp, Artificial Sequence
  Synthetic Polynucleotide
taatacgactcactatagggcccagggagtactgttctaattctaatgaaaacagaggagattcattatgattagaacaaacctggcggcagcgcaaaagatg

SEQ ID NO: 26157 - DNA, 103 bp, Artificial Sequence
  Synthetic Polynucleotide
taatacgactcactatagggtgcgccccagggagtactgttctaattctaaacagaggagatagaatatgaacagtactaacctggcggcagcgcaaaagatg

SEQ ID NO: 26158 - DNA, 103 bp, Artificial Sequence
  Synthetic Polynucleotide
taatacgactcactatagggaaacttgcgccccagggagtactgttctaaaacagaggagattagaaatgtactccctgaacctggcggcagcgcaaaagatg

SEQ ID NO: 26159 - DNA, 103 bp, Artificial Sequence
  Synthetic Polynucleotide
taatacgactcactatagggaatagaaacttgcgccccagggagtactgtaacagaggagaacagtaatgcctggggcgaacctggcggcagcgcaaaagatg

SEQ ID NO: 26160 - DNA, 103 bp, Artificial Sequence
  Synthetic Polynucleotide
taatacgactcactatagggacagctgtttcagacactgcacacacctaaaacagaggagattaggtatgtgcagtgtcaacctggcggcagcgcaaaagatg

SEQ ID NO: 26161 - DNA, 103 bp, Artificial Sequence
  Synthetic Polynucleotide
taatacgactcactatagggactgaaatagaaacttgcgccccagggagtaacagaggagaactcccatgggcgcaagtaacctggcggcagcgcaaaagatg

SEQ ID NO: 26162 - DNA, 103 bp, Artificial Sequence
  Synthetic Polynucleotide
taatacgactcactatagggtcctgactgaaatagaaacttgcgccccagaacagaggagactggggatgaagtttctaaacctggcggcagcgcaaaagatg

SEQ ID NO: 26163 - DNA, 103 bp, Artificial Sequence
  Synthetic Polynucleotide
taatacgactcactatagggctgagtcctgactgaaatagaaacttgcgcaacagaggagagcgcaaatgtctatttcaaacctggcggcagcgcaaaagatg

SEQ ID NO: 26164 - DNA, 103 bp, Artificial Sequence
  Synthetic Polynucleotide
taatacgactcactatagggcgttcctgagtcctgactgaaatagaaactaacagaggagaagtttcatgttcagtcagaacctggcggcagcgcaaaagatg

SEQ ID NO: 26165 - DNA, 103 bp, Artificial Sequence
  Synthetic Polynucleotide
taatacgactcactatagggagtaccgttcctgagtcctgactgaaatagaacagaggagactatttatgtcaggactcaacctggcggcagcgcaaaagatg

SEQ ID NO: 26166 - DNA, 103 bp, Artificial Sequence
  Synthetic Polynucleotide
taatacgactcactatagggcgcttagtaccgttcctgagtcctgactgaaacagaggagatcagtcatgactcaggaaaacctggcggcagcgcaaaagatg

SEQ ID NO: 26167 - DNA, 103 bp, Artificial Sequence
  Synthetic Polynucleotide
taatacgactcactatagggcgggccgcttagtaccgttcctgagtcctgaacagaggagacaggacatgggaacggtaaacctggcggcagcgcaaaagatg

SEQ ID NO: 26168 - DNA, 103 bp, Artificial Sequence
  Synthetic Polynucleotide
taatacgactcactatagggtgtggcgggccgcttagtaccgttcctgagaacagaggagactcaggatgggtactaagaacctggcggcagcgcaaaagatg

SEQ ID NO: 26169 - DNA, 103 bp, Artificial Sequence
  Synthetic Polynucleotide
taatacgactcactataggggtttttgtggcgggccgcttagtaccgttcaacagaggagagaacggatgtaagcggccaacctggcggcagcgcaaaagatg

SEQ ID NO: 26170 - DNA, 103 bp, Artificial Sequence
  Synthetic Polynucleotide
taatacgactcactatagggtgaccgtttttgtggcgggccgcttagtacaacagaggagagtactaatgggcccgccaaacctggcggcagcgcaaaagatg

SEQ ID NO: 26171 - DNA, 103 bp, Artificial Sequence
  Synthetic Polynucleotide
taatacgactcactatagggaaacgacagctgtttcagacactgcacacaaacagaggagatgtgtgatgtgtctgaaaaacctggcggcagcgcaaaagatg

SEQ ID NO: 26172 - DNA, 103 bp, Artificial Sequence
  Synthetic Polynucleotide
taatacgactcactatagggaaacctgaccgtttttgtggcgggccgcttaacagaggagaaagcggatggccacaaaaaacctggcggcagcgcaaaagatg

SEQ ID NO: 26173 - DNA, 103 bp, Artificial Sequence
  Synthetic Polynucleotide
taatacgactcactataggggtttgaaacctgaccgtttttgtggcgggcaacagaggagagcccgcatgaaaaacggtaacctggcggcagcgcaaaagatg

SEQ ID NO: 26174 - DNA, 103 bp, Artificial Sequence
  Synthetic Polynucleotide
taatacgactcactataggggtgatgtttgaaacctgaccgtttttgtggaacagaggagaccacaaatgcggtcaggtaacctggcggcagcgcaaaagatg

SEQ ID NO: 26175 - DNA, 103 bp, Artificial Sequence
  Synthetic Polynucleotide
taatacgactcactatagggacggggtgatgtttgaaacctgaccgttttaacagaggagaaaaacgatgaggtttcaaaacctggcggcagcgcaaaagatg

SEQ ID NO: 26176 - DNA, 103 bp, Artificial Sequence
  Synthetic Polynucleotide
taatacgactcactataggggcgggacggggtgatgtttgaaacctgaccaacagaggagaggtcagatgtcaaacatcaacctggcggcagcgcaaaagatg

SEQ ID NO: 26177 - DNA, 103 bp, Artificial Sequence
  Synthetic Polynucleotide
taatacgactcactataggggcttggcgggacggggtgatgtttgaaaccaacagaggagaggtttcatgcatcaccccaacctggcggcagcgcaaaagatg

SEQ ID NO: 26178 - DNA, 103 bp, Artificial Sequence
  Synthetic Polynucleotide
taatacgactcactatagggtcggcgcttggcgggacggggtgatgtttgaacagaggagacaaacaatgccccgtcccaacctggcggcagcgcaaaagatg

SEQ ID NO: 26179 - DNA, 103 bp, Artificial Sequence
  Synthetic Polynucleotide
taatacgactcactatagggtttcttcggcgcttggcgggacggggtgataacagaggagaatcaccatgtcccgccaaaacctggcggcagcgcaaaagatg

SEQ ID NO: 26180 - DNA, 103 bp, Artificial Sequence
  Synthetic Polynucleotide
taatacgactcactatagggttgcttttcttcggcgcttggcgggacgggaacagaggagacccgtcatgccaagcgccaacctggcggcagcgcaaaagatg

SEQ ID NO: 26181 - DNA, 103 bp, Artificial Sequence
  Synthetic Polynucleotide
taatacgactcactataggggctagttgcttttcttcggcgcttggcgggaacagaggagacccgccatgcgccgaagaaacctggcggcagcgcaaaagatg

SEQ ID NO: 26182 - DNA, 103 bp, Artificial Sequence
  Synthetic Polynucleotide
taatacgactcactatagggtcagcaaacgacagctgtttcagacactgcaacagaggagagcagtgatggaaacagctaacctggcggcagcgcaaaagatg

SEQ ID NO: 26183 - DNA, 103 bp, Artificial Sequence
  Synthetic Polynucleotide
taatacgactcactataggggtttttcagcaaacgacagctgtttcagacaacagaggagagtctgaatgagctgtcgtaacctggcggcagcgcaaaagatg

SEQ ID NO: 26184 - DNA, 103 bp, Artificial Sequence
  Synthetic Polynucleotide
taatacgactcactatagggatcaagtttttcagcaaacgacagctgtttaacagaggagaaaacagatgtcgtttgctaacctggcggcagcgcaaaagatg

SEQ ID NO: 26185 - DNA, 103 bp, Artificial Sequence
  Synthetic Polynucleotide
taatacgactcactatagggattatatcaagtttttcagcaaacgacagcaacagaggagagctgtcatgtgctgaaaaaacctggcggcagcgcaaaagatg

SEQ ID NO: 26186 - DNA, 103 bp, Artificial Sequence
  Synthetic Polynucleotide
taatacgactcactatagggtcgctattatatcaagtttttcagcaaacgaacagaggagacgtttgatgaaaaacttgaacctggcggcagcgcaaaagatg

SEQ ID NO: 26187 - DNA, 103 bp, Artificial Sequence
  Synthetic Polynucleotide
taatacgactcactatagggcaattgtagggatacattcaccatatgtcaaacagaggagatgacatatggtgaatgtaaacctggcggcagcgcaaaagatg

SEQ ID NO: 26188 - DNA, 103 bp, Artificial Sequence
  Synthetic Polynucleotide
taatacgactcactataggggttcctcgctattatatcaagtttttcagcaacagaggagagctgaaatgcttgatataaacctggcggcagcgcaaaagatg

SEQ ID NO: 26189 - DNA, 103 bp, Artificial Sequence
  Synthetic Polynucleotide
taatacgactcactatagggttatcgttcctcgctattatatcaagttttaacagaggagaaaaactatgtataatagcaacctggcggcagcgcaaaagatg

SEQ ID NO: 26190 - DNA, 103 bp, Artificial Sequence
  Synthetic Polynucleotide
taatacgactcactatagggaaaacttatcgttcctcgctattatatcaaaacagaggagattgataatgtagcgaggaaacctggcggcagcgcaaaagatg

SEQ ID NO: 26191 - DNA, 103 bp, Artificial Sequence
  Synthetic Polynucleotide
taatacgactcactataggggcaacaaaacttatcgttcctcgctattataacagaggagaataataatgaggaacgataacctggcggcagcgcaaaagatg

SEQ ID NO: 26192 - DNA, 103 bp, Artificial Sequence
  Synthetic Polynucleotide
taatacgactcactatagggcgaatgcaacaaaacttatcgttcctcgctaacagaggagaagcgagatgcgataagttaacctggcggcagcgcaaaagatg

SEQ ID NO: 26193 - DNA, 103 bp, Artificial Sequence
  Synthetic Polynucleotide
taatacgactcactatagggccccacgaatgcaacaaaacttatcgttccaacagaggagaggaacgatgagttttgttaacctggcggcagcgcaaaagatg

SEQ ID NO: 26194 - DNA, 103 bp, Artificial Sequence
  Synthetic Polynucleotide
taatacgactcactatagggccaggccccacgaatgcaacaaaacttatcaacagaggagagataagatgtgttgcattaacctggcggcagcgcaaaagatg

SEQ ID NO: 26195 - DNA, 103 bp, Artificial Sequence
  Synthetic Polynucleotide
taatacgactcactatagggccacgccaggccccacgaatgcaacaaaacaacagaggagagttttgatgcattcgtggaacctggcggcagcgcaaaagatg

SEQ ID NO: 26196 - DNA, 103 bp, Artificial Sequence
  Synthetic Polynucleotide
taatacgactcactatagggatcgtccacgccaggccccacgaatgcaacaacagaggagagttgcaatggtggggcctaacctggcggcagcgcaaaagatg

SEQ ID NO: 26197 - DNA, 103 bp, Artificial Sequence
  Synthetic Polynucleotide
taatacgactcactatagggcctacatcgtccacgccaggccccacgaataacagaggagaattcgtatggcctggcgtaacctggcggcagcgcaaaagatg

SEQ ID NO: 26198 - DNA, 103 bp, Artificial Sequence
  Synthetic Polynucleotide
taatacgactcactatagggttgtacaattgtagggatacattcaccataaacagaggagatatggtatgtgtatccctaacctggcggcagcgcaaaagatg

SEQ ID NO: 26199 - DNA, 103 bp, Artificial Sequence
  Synthetic Polynucleotide
taatacgactcactatagggcataccctacatcgtccacgccaggccccaaacagaggagatggggcatggcgtggacgaacctggcggcagcgcaaaagatg

SEQ ID NO: 26200 - DNA, 103 bp, Artificial Sequence
  Synthetic Polynucleotide
taatacgactcactataggggcgcacataccctacatcgtccacgccaggaacagaggagacctggcatggacgatgtaaacctggcggcagcgcaaaagatg

SEQ ID NO: 26201 - DNA, 103 bp, Artificial Sequence
  Synthetic Polynucleotide
taatacgactcactatagggtctcggcgcacataccctacatcgtccacgaacagaggagacgtggaatgtgtagggtaaacctggcggcagcgcaaaagatg

SEQ ID NO: 26202 - DNA, 103 bp, Artificial Sequence
  Synthetic Polynucleotide
taatacgactcactatagggaatcatctcggcgcacataccctacatcgtaacagaggagaacgatgatgggtatgtgcaacctggcggcagcgcaaaagatg

SEQ ID NO: 26203 - DNA, 103 bp, Artificial Sequence
  Synthetic Polynucleotide
taatacgactcactatagggtccccaatcatctcggcgcacataccctacaacagaggagagtagggatggtgcgccgaaacctggcggcagcgcaaaagatg

SEQ ID NO: 26204 - DNA, 103 bp, Artificial Sequence
  Synthetic Polynucleotide
taatacgactcactatagggcactctccccaatcatctcggcgcacatacaacagaggagagtatgtatgccgagatgaaacctggcggcagcgcaaaagatg

SEQ ID NO: 26205 - DNA, 103 bp, Artificial Sequence
  Synthetic Polynucleotide
taatacgactcactatagggagttgcactctccccaatcatctcggcgcaaacagaggagatgcgccatgatgattgggaacctggcggcagcgcaaaagatg

SEQ ID NO: 26206 - DNA, 103 bp, Artificial Sequence
  Synthetic Polynucleotide
taatacgactcactatagggtgaatagttgcactctccccaatcatctcgaacagaggagacgagatatgtggggagagaacctggcggcagcgcaaaagatg

SEQ ID NO: 26207 - DNA, 103 bp, Artificial Sequence
  Synthetic Polynucleotide
taatacgactcactatagggtgtcctgaatagttgcactctccccaatcaaacagaggagatgattgatgagagtgcaaaacctggcggcagcgcaaaagatg

SEQ ID NO: 26208 - DNA, 103 bp, Artificial Sequence
  Synthetic Polynucleotide
taatacgactcactatagggaattatgtcctgaatagttgcactctccccaacagaggagaggggagatggcaactattaacctggcggcagcgcaaaagatg

SEQ ID NO: 26209 - DNA, 103 bp, Artificial Sequence
  Synthetic Polynucleotide
taatacgactcactatagggattctttgtacaattgtagggatacattcaaacagaggagatgaatgatgccctacaataacctggcggcagcgcaaaagatg

SEQ ID NO: 26210 - DNA, 103 bp, Artificial Sequence
  Synthetic Polynucleotide
taatacgactcactatagggtggagaattatgtcctgaatagttgcactcaacagaggagagagtgcatgtattcaggaaacctggcggcagcgcaaaagatg

SEQ ID NO: 26211 - DNA, 103 bp, Artificial Sequence
  Synthetic Polynucleotide
taatacgactcactatagggtatcctggagaattatgtcctgaatagttgaacagaggagacaactaatgaggacataaaacctggcggcagcgcaaaagatg

SEQ ID NO: 26212 - DNA, 103 bp, Artificial Sequence
  Synthetic Polynucleotide
taatacgactcactataggggtcaatatcctggagaattatgtcctgaataacagaggagaattcagatgataattctcaacctggcggcagcgcaaaagatg

SEQ ID NO: 26213 - DNA, 103 bp, Artificial Sequence
  Synthetic Polynucleotide
taatacgactcactatagggatagagtcaatatcctggagaattatgtccaacagaggagaggacatatgtctccaggaaacctggcggcagcgcaaaagatg

SEQ ID NO: 26214 - DNA, 103 bp, Artificial Sequence
  Synthetic Polynucleotide
taatacgactcactatagggggtcaatagagtcaatatcctggagaattaaacagaggagataattcatgaggatattgaacctggcggcagcgcaaaagatg

SEQ ID NO: 26215 - DNA, 103 bp, Artificial Sequence
  Synthetic Polynucleotide
taatacgactcactatagggtgcaaggtcaatagagtcaatatcctggagaacagaggagactccagatgattgactctaacctggcggcagcgcaaaagatg

SEQ ID NO: 26216 - DNA, 103 bp, Artificial Sequence
  Synthetic Polynucleotide
taatacgactcactatagggtggcatgcaaggtcaatagagtcaatatccaacagaggagaggatatatgctctattgaaacctggcggcagcgcaaaagatg

SEQ ID NO: 26217 - DNA, 103 bp, Artificial Sequence
  Synthetic Polynucleotide
taatacgactcactatagggtctcgtggcatgcaaggtcaatagagtcaaaacagaggagattgactatgttgaccttgaacctggcggcagcgcaaaagatg

SEQ ID NO: 26218 - DNA, 103 bp, Artificial Sequence
  Synthetic Polynucleotide
taatacgactcactatagggcagcgtctcgtggcatgcaaggtcaatagaaacagaggagatctattatgcttgcatgcaacctggcggcagcgcaaaagatg

SEQ ID NO: 26219 - DNA, 103 bp, Artificial Sequence
  Synthetic Polynucleotide
taatacgactcactataggggatgacagcgtctcgtggcatgcaaggtcaaacagaggagatgacctatgatgccacgaaacctggcggcagcgcaaaagatg

SEQ ID NO: 26220 - DNA, 103 bp, Artificial Sequence
  Synthetic Polynucleotide
taatacgactcactatagggtacacattctttgtacaattgtagggatacaacagaggagagtatccatgcaattgtacaacctggcggcagcgcaaaagatg

SEQ ID NO: 26221 - DNA, 103 bp, Artificial Sequence
  Synthetic Polynucleotide
taatacgactcactatagggcctctgatgacagcgtctcgtggcatgcaaaacagaggagattgcatatgacgagacgcaacctggcggcagcgcaaaagatg

SEQ ID NO: 26222 - DNA, 103 bp, Artificial Sequence
  Synthetic Polynucleotide
taatacgactcactatagggctccacctctgatgacagcgtctcgtggcaaacagaggagatgccacatgacgctgtcaaacctggcggcagcgcaaaagatg

SEQ ID NO: 26223 - DNA, 103 bp, Artificial Sequence
  Synthetic Polynucleotide
taatacgactcactatagggcgctgctccacctctgatgacagcgtctcgaacagaggagacgagacatggtcatcagaaacctggcggcagcgcaaaagatg

SEQ ID NO: 26224 - DNA, 103 bp, Artificial Sequence
  Synthetic Polynucleotide
taatacgactcactataggggccgccgctgctccacctctgatgacagcgaacagaggagacgctgtatgcagaggtggaacctggcggcagcgcaaaagatg

SEQ ID NO: 26225 - DNA, 103 bp, Artificial Sequence
  Synthetic Polynucleotide
taatacgactcactatagggagtcggccgccgctgctccacctctgatgaaacagaggagatcatcaatggtggagcagaacctggcggcagcgcaaaagatg

SEQ ID NO: 26226 - DNA, 103 bp, Artificial Sequence
  Synthetic Polynucleotide
taatacgactcactatagggtatacagtcggccgccgctgctccacctctaacagaggagaagaggtatggcagcggcgaacctggcggcagcgcaaaagatg

SEQ ID NO: 26227 - DNA, 103 bp, Artificial Sequence
  Synthetic Polynucleotide
taatacgactcactatagggatggatatacagtcggccgccgctgctccaaacagaggagatggagcatgggcggccgaaacctggcggcagcgcaaaagatg

SEQ ID NO: 26228 - DNA, 103 bp, Artificial Sequence
  Synthetic Polynucleotide
taatacgactcactatagggtttatatggatatacagtcggccgccgctgaacagaggagacagcggatgccgactgtaaacctggcggcagcgcaaaagatg

SEQ ID NO: 26229 - DNA, 103 bp, Artificial Sequence
  Synthetic Polynucleotide
taatacgactcactatagggacaattttatatggatatacagtcggccgcaacagaggagagcggccatgtgtatatccaacctggcggcagcgcaaaagatg

SEQ ID NO: 26230 - DNA, 103 bp, Artificial Sequence
  Synthetic Polynucleotide
taatacgactcactataggggggtcacaattttatatggatatacagtcgaacagaggagacgactgatgatccatataaacctggcggcagcgcaaaagatg

SEQ ID NO: 26231 - DNA, 103 bp, Artificial Sequence
  Synthetic Polynucleotide
taatacgactcactatagggcccaactagcaaggtacagttatacattagaacagaggagactaatgatgaactgtaccaacctggcggcagcgcaaaagatg

SEQ ID NO: 26232 - DNA, 103 bp, Artificial Sequence
  Synthetic Polynucleotide
taatacgactcactatagggaatagtacacattctttgtacaattgtaggaacagaggagacctacaatggtacaaagaaacctggcggcagcgcaaaagatg

SEQ ID NO: 26233 - DNA, 103 bp, Artificial Sequence
  Synthetic Polynucleotide
taatacgactcactataggggcaccgggtcacaattttatatggatatacaacagaggagagtatatatgtataaaattaacctggcggcagcgcaaaagatg

SEQ ID NO: 26234 - DNA, 103 bp, Artificial Sequence
  Synthetic Polynucleotide
taatacgactcactatagggtggccgcaccgggtcacaattttatatggaaacagaggagatccataatgaattgtgacaacctggcggcagcgcaaaagatg

SEQ ID NO: 26235 - DNA, 103 bp, Artificial Sequence
  Synthetic Polynucleotide
taatacgactcactatagggcacactggccgcaccgggtcacaattttataacagaggagaataaaaatgtgacccggtaacctggcggcagcgcaaaagatg

SEQ ID NO: 26236 - DNA, 103 bp, Artificial Sequence
  Synthetic Polynucleotide
taatacgactcactatagggtgtctcacactggccgcaccgggtcacaataacagaggagaattgtgatgcggtgcggcaacctggcggcagcgcaaaagatg

SEQ ID NO: 26237 - DNA, 103 bp, Artificial Sequence
  Synthetic Polynucleotide
taatacgactcactatagggatgcttgtctcacactggccgcaccgggtcaacagaggagagacccgatgcggccagtgaacctggcggcagcgcaaaagatg

SEQ ID NO: 26238 - DNA, 103 bp, Artificial Sequence
  Synthetic Polynucleotide
taatacgactcactataggggacaaatgcttgtctcacactggccgcaccaacagaggagaggtgcgatgagtgtgagaaacctggcggcagcgcaaaagatg

SEQ ID NO: 26239 - DNA, 103 bp, Artificial Sequence
  Synthetic Polynucleotide
taatacgactcactatagggatagagacaaatgcttgtctcacactggccaacagaggagaggccagatggagacaagcaacctggcggcagcgcaaaagatg

SEQ ID NO: 26240 - DNA, 103 bp, Artificial Sequence
  Synthetic Polynucleotide
taatacgactcactatagggcccacatagagacaaatgcttgtctcacacaacagaggagagtgtgaatgaagcatttgaacctggcggcagcgcaaaagatg

SEQ ID NO: 26241 - DNA, 103 bp, Artificial Sequence
  Synthetic Polynucleotide
taatacgactcactatagggtactgcccacatagagacaaatgcttgtctaacagaggagaagacaaatgtttgtctctaacctggcggcagcgcaaaagatg

SEQ ID NO: 26242 - DNA, 103 bp, Artificial Sequence
  Synthetic Polynucleotide
taatacgactcactatagggttgagtactgcccacatagagacaaatgctaacagaggagaagcattatgctctatgtgaacctggcggcagcgcaaaagatg

SEQ ID NO: 26243 - DNA, 103 bp, Artificial Sequence
  Synthetic Polynucleotide
taatacgactcactatagggaataaaatagtacacattctttgtacaattaacagaggagaaattgtatgaagaatgtgaacctggcggcagcgcaaaagatg

SEQ ID NO: 26244 - DNA, 103 bp, Artificial Sequence
  Synthetic Polynucleotide
taatacgactcactatagggccaatttgagtactgcccacatagagacaaaacagaggagattgtctatgtgtgggcagaacctggcggcagcgcaaaagatg

SEQ ID NO: 26245 - DNA, 103 bp, Artificial Sequence
  Synthetic Polynucleotide
taatacgactcactatagggctataccaatttgagtactgcccacatagaaacagaggagatctatgatggcagtactcaacctggcggcagcgcaaaagatg

SEQ ID NO: 26246 - DNA, 103 bp, Artificial Sequence
  Synthetic Polynucleotide
taatacgactcactatagggagtgactataccaatttgagtactgcccacaacagaggagagtgggcatgactcaaattaacctggcggcagcgcaaaagatg

SEQ ID NO: 26247 - DNA, 103 bp, Artificial Sequence
  Synthetic Polynucleotide
taatacgactcactatagggtgaagagtgactataccaatttgagtactgaacagaggagacagtacatgaattggtataacctggcggcagcgcaaaagatg

SEQ ID NO: 26248 - DNA, 103 bp, Artificial Sequence
  Synthetic Polynucleotide
taatacgactcactataggggggactgaagagtgactataccaatttgagaacagaggagactcaaaatggtatagtcaaacctggcggcagcgcaaaagatg

SEQ ID NO: 26249 - DNA, 103 bp, Artificial Sequence
  Synthetic Polynucleotide
taatacgactcactatagggcagttgggactgaagagtgactataccaataacagaggagaattggtatggtcactcttaacctggcggcagcgcaaaagatg

SEQ ID NO: 26250 - DNA, 103 bp, Artificial Sequence
  Synthetic Polynucleotide
taatacgactcactatagggtcagccagttgggactgaagagtgactataaacagaggagatatagtatgtcttcagtcaacctggcggcagcgcaaaagatg

SEQ ID NO: 26251 - DNA, 103 bp, Artificial Sequence
  Synthetic Polynucleotide
taatacgactcactataggggatcttcagccagttgggactgaagagtgaaacagaggagatcactcatgagtcccaacaacctggcggcagcgcaaaagatg

SEQ ID NO: 26252 - DNA, 103 bp, Artificial Sequence
  Synthetic Polynucleotide
taatacgactcactatagggacaaagatcttcagccagttgggactgaagaacagaggagacttcagatgcaactggctaacctggcggcagcgcaaaagatg

SEQ ID NO: 26253 - DNA, 103 bp, Artificial Sequence
  Synthetic Polynucleotide
taatacgactcactatagggaggatacaaagatcttcagccagttgggacaacagaggagagtcccaatgggctgaagaaacctggcggcagcgcaaaagatg

SEQ ID NO: 26254 - DNA, 103 bp, Artificial Sequence
  Synthetic Polynucleotide
taatacgactcactatagggacattaataaaatagtacacattctttgtaaacagaggagatacaaaatgtgtgtactaaacctggcggcagcgcaaaagatg

SEQ ID NO: 26255 - DNA, 103 bp, Artificial Sequence
  Synthetic Polynucleotide
taatacgactcactatagggcgcacaggatacaaagatcttcagccagttaacagaggagaaactggatgaagatctttaacctggcggcagcgcaaaagatg

SEQ ID NO: 26256 - DNA, 103 bp, Artificial Sequence
  Synthetic Polynucleotide
taatacgactcactataggggttgccgcacaggatacaaagatcttcagcaacagaggagagctgaaatgctttgtatcaacctggcggcagcgcaaaagatg

SEQ ID NO: 26257 - DNA, 103 bp, Artificial Sequence
  Synthetic Polynucleotide
taatacgactcactatagggccgcagttgccgcacaggatacaaagatctaacagaggagaagatctatgtatcctgtgaacctggcggcagcgcaaaagatg

SEQ ID NO: 26258 - DNA, 103 bp, Artificial Sequence
  Synthetic Polynucleotide
taatacgactcactataggggcctcccgcagttgccgcacaggatacaaaaacagaggagatttgtaatgtgtgcggcaaacctggcggcagcgcaaaagatg

SEQ ID NO: 26259 - DNA, 103 bp, Artificial Sequence
  Synthetic Polynucleotide
taatacgactcactataggggttttgcctcccgcagttgccgcacaggataacagaggagaatcctgatgggcaactgcaacctggcggcagcgcaaaagatg

SEQ ID NO: 26260 - DNA, 103 bp, Artificial Sequence
  Synthetic Polynucleotide
taatacgactcactatagggggaaagttttgcctcccgcagttgccgcacaacagaggagagtgcggatgctgcgggagaacctggcggcagcgcaaaagatg

SEQ ID NO: 26261 - DNA, 103 bp, Artificial Sequence
  Synthetic Polynucleotide
taatacgactcactatagggcatttggaaagttttgcctcccgcagttgcaacagaggagagcaactatgggaggcaaaaacctggcggcagcgcaaaagatg

SEQ ID NO: 26262 - DNA, 103 bp, Artificial Sequence
  Synthetic Polynucleotide
taatacgactcactatagggccgtccatttggaaagttttgcctcccgcaaacagaggagatgcgggatgcaaaactttaacctggcggcagcgcaaaagatg

SEQ ID NO: 26263 - DNA, 103 bp, Artificial Sequence
  Synthetic Polynucleotide
taatacgactcactatagggtttttccgtccatttggaaagttttgcctcaacagaggagagaggcaatgctttccaaaaacctggcggcagcgcaaaagatg

SEQ ID NO: 26264 - DNA, 103 bp, Artificial Sequence
  Synthetic Polynucleotide
taatacgactcactatagggatgattttttccgtccatttggaaagttttaacagaggagaaaaactatgcaaatggacaacctggcggcagcgcaaaagatg

SEQ ID NO: 26265 - DNA, 103 bp, Artificial Sequence
  Synthetic Polynucleotide
taatacgactcactatagggttaaaacattaataaaatagtacacattctaacagaggagaagaatgatgactattttaaacctggcggcagcgcaaaagatg

SEQ ID NO: 26266 - DNA, 103 bp, Artificial Sequence
  Synthetic Polynucleotide
taatacgactcactatagggcctttatgattttttccgtccatttggaaaaacagaggagatttccaatgggacggaaaaacctggcggcagcgcaaaagatg

SEQ ID NO: 26267 - DNA, 103 bp, Artificial Sequence
  Synthetic Polynucleotide
taatacgactcactatagggatatacctttatgattttttccgtccatttaacagaggagaaaatggatggaaaaaatcaacctggcggcagcgcaaaagatg

SEQ ID NO: 26268 - DNA, 103 bp, Artificial Sequence
  Synthetic Polynucleotide
taatacgactcactatagggagcagatatacctttatgattttttccgtcaacagaggagagacggaatgaatcataaaaacctggcggcagcgcaaaagatg

SEQ ID NO: 26269 - DNA, 103 bp, Artificial Sequence
  Synthetic Polynucleotide
taatacgactcactatagggctacaagcagatatacctttatgattttttaacagaggagaaaaaaaatgtaaaggtataacctggcggcagcgcaaaagatg

SEQ ID NO: 26270 - DNA, 103 bp, Artificial Sequence
  Synthetic Polynucleotide
taatacgactcactatagggatgagctacaagcagatatacctttatgataacagaggagaatcataatggtatatctgaacctggcggcagcgcaaaagatg

SEQ ID NO: 26271 - DNA, 103 bp, Artificial Sequence
  Synthetic Polynucleotide
taatacgactcactatagggaatgaatgagctacaagcagatatacctttaacagaggagaaaaggtatgtctgcttgtaacctggcggcagcgcaaaagatg

SEQ ID NO: 26272 - DNA, 103 bp, Artificial Sequence
  Synthetic Polynucleotide
taatacgactcactatagggtcgtcaatgaatgagctacaagcagatataaacagaggagatatatcatgttgtagctcaacctggcggcagcgcaaaagatg

SEQ ID NO: 26273 - DNA, 103 bp, Artificial Sequence
  Synthetic Polynucleotide
taatacgactcactatagggcctcctcgtcaatgaatgagctacaagcagaacagaggagactgcttatggctcattcaaacctggcggcagcgcaaaagatg

SEQ ID NO: 26274 - DNA, 103 bp, Artificial Sequence
  Synthetic Polynucleotide
taatacgactcactatagggttcagcctcctcgtcaatgaatgagctacaaacagaggagatgtagcatgttcattgacaacctggcggcagcgcaaaagatg

SEQ ID NO: 26275 - DNA, 103 bp, Artificial Sequence
  Synthetic Polynucleotide
taatacgactcactatagggctacattcagcctcctcgtcaatgaatgagaacagaggagactcattatgtgacgaggaaacctggcggcagcgcaaaagatg

SEQ ID NO: 26276 - DNA, 103 bp, Artificial Sequence
  Synthetic Polynucleotide
taatacgactcactatagggacaatttaaaacattaataaaatagtacacaacagaggagagtgtacatgtttattaataacctggcggcagcgcaaaagatg

SEQ ID NO: 26277 - DNA, 103 bp, Artificial Sequence
  Synthetic Polynucleotide
taatacgactcactatagggtatcactacattcagcctcctcgtcaatgaaacagaggagatcattgatgaggaggctgaacctggcggcagcgcaaaagatg

SEQ ID NO: 26278 - DNA, 103 bp, Artificial Sequence
  Synthetic Polynucleotide
taatacgactcactatagggttctttatcactacattcagcctcctcgtcaacagaggagagacgagatggctgaatgtaacctggcggcagcgcaaaagatg

SEQ ID NO: 26279 - DNA, 103 bp, Artificial Sequence
  Synthetic Polynucleotide
taatacgactcactatagggctattttctttatcactacattcagcctccaacagaggagaggaggcatgatgtagtgaaacctggcggcagcgcaaaagatg

SEQ ID NO: 26280 - DNA, 103 bp, Artificial Sequence
  Synthetic Polynucleotide
taatacgactcactatagggcaatgctattttctttatcactacattcagaacagaggagactgaatatggtgataaagaacctggcggcagcgcaaaagatg

SEQ ID NO: 26281 - DNA, 103 bp, Artificial Sequence
  Synthetic Polynucleotide
taatacgactcactatagggttcatcaatgctattttctttatcactacaaacagaggagatgtagtatgaaagaaaataacctggcggcagcgcaaaagatg

SEQ ID NO: 26282 - DNA, 103 bp, Artificial Sequence
  Synthetic Polynucleotide
taatacgactcactatagggaacaattcatcaatgctattttctttatcaaacagaggagatgataaatgaaatagcataacctggcggcagcgcaaaagatg

SEQ ID NO: 26283 - DNA, 103 bp, Artificial Sequence
  Synthetic Polynucleotide
taatacgactcactatagggcatcaaacaattcatcaatgctattttcttaacagaggagaaagaaaatggcattgatgaacctggcggcagcgcaaaagatg

SEQ ID NO: 26284 - DNA, 103 bp, Artificial Sequence
  Synthetic Polynucleotide
taatacgactcactatagggatccccatcaaacaattcatcaatgctattaacagaggagaaatagcatggatgaattgaacctggcggcagcgcaaaagatg

SEQ ID NO: 26285 - DNA, 103 bp, Artificial Sequence
  Synthetic Polynucleotide
taatacgactcactatagggtcagtatccccatcaaacaattcatcaatgaacagaggagacattgaatgattgtttgaaacctggcggcagcgcaaaagatg

SEQ ID NO: 26286 - DNA, 103 bp, Artificial Sequence
  Synthetic Polynucleotide
taatacgactcactatagggcacaatcagtatccccatcaaacaattcataacagaggagaatgaatatgttgatggggaacctggcggcagcgcaaaagatg

SEQ ID NO: 26287 - DNA, 103 bp, Artificial Sequence
  Synthetic Polynucleotide
taatacgactcactatagggaaaaaacaatttaaaacattaataaaatagaacagaggagactatttatgtaatgttttaacctggcggcagcgcaaaagatg

SEQ ID NO: 26288 - DNA, 103 bp, Artificial Sequence
  Synthetic Polynucleotide
taatacgactcactatagggcccctcacaatcagtatccccatcaaacaaaacagaggagattgtttatgggggatactaacctggcggcagcgcaaaagatg

SEQ ID NO: 26289 - DNA, 103 bp, Artificial Sequence
  Synthetic Polynucleotide
taatacgactcactatagggaaaaacccctcacaatcagtatccccatcaaacagaggagatgatggatgtactgattgaacctggcggcagcgcaaaagatg

SEQ ID NO: 26290 - DNA, 103 bp, Artificial Sequence
  Synthetic Polynucleotide
taatacgactcactatagggcatctaaaaacccctcacaatcagtatcccaacagaggagagggataatgattgtgaggaacctggcggcagcgcaaaagatg

SEQ ID NO: 26291 - DNA, 103 bp, Artificial Sequence
  Synthetic Polynucleotide
taatacgactcactatagggctcctcatctaaaaacccctcacaatcagtaacagaggagaactgatatggaggggtttaacctggcggcagcgcaaaagatg

SEQ ID NO: 26292 - DNA, 103 bp, Artificial Sequence
  Synthetic Polynucleotide
taatacgactcactatagggaccggctcctcatctaaaaacccctcacaaaacagaggagattgtgaatggtttttagaaacctggcggcagcgcaaaagatg

SEQ ID NO: 26293 - DNA, 103 bp, Artificial Sequence
  Synthetic Polynucleotide
taatacgactcactataggggctcgaccggctcctcatctaaaaacccctaacagaggagaaggggtatgtagatgaggaacctggcggcagcgcaaaagatg

SEQ ID NO: 26294 - DNA, 103 bp, Artificial Sequence
  Synthetic Polynucleotide
taatacgactcactataggggccctgctcgaccggctcctcatctaaaaaaacagaggagatttttaatggaggagccgaacctggcggcagcgcaaaagatg

SEQ ID NO: 26295 - DNA, 103 bp, Artificial Sequence
  Synthetic Polynucleotide
taatacgactcactataggggagttgccctgctcgaccggctcctcatctaacagaggagaagatgaatggccggtcgaaacctggcggcagcgcaaaagatg

SEQ ID NO: 26296 - DNA, 103 bp, Artificial Sequence
  Synthetic Polynucleotide
taatacgactcactataggggcagagagttgccctgctcgaccggctcctaacagaggagaaggagcatgtcgagcaggaacctggcggcagcgcaaaagatg

SEQ ID NO: 26297 - DNA, 103 bp, Artificial Sequence
  Synthetic Polynucleotide
taatacgactcactataggggagctgcagagagttgccctgctcgaccggaacagaggagaccggtcatgcagggcaacaacctggcggcagcgcaaaagatg

SEQ ID NO: 26298 - DNA, 103 bp, Artificial Sequence
  Synthetic Polynucleotide
taatacgactcactataggggaggaaaaaaacaatttaaaacattaataaaacagaggagattattaatgttttaaattaacctggcggcagcgcaaaagatg

SEQ ID NO: 26299 - DNA, 103 bp, Artificial Sequence
  Synthetic Polynucleotide
taatacgactcactatagggttatagagctgcagagagttgccctgctcgaacagaggagacgagcaatgcaactctctaacctggcggcagcgcaaaagatg

SEQ ID NO: 26300 - DNA, 103 bp, Artificial Sequence
  Synthetic Polynucleotide
taatacgactcactataggggctgattatagagctgcagagagttgccctaacagaggagaagggcaatgctctgcagcaacctggcggcagcgcaaaagatg

SEQ ID NO: 26301 - DNA, 103 bp, Artificial Sequence
  Synthetic Polynucleotide
taatacgactcactatagggttgcagctgattatagagctgcagagagttaacagaggagaaactctatgcagctctataacctggcggcagcgcaaaagatg

SEQ ID NO: 26302 - DNA, 103 bp, Artificial Sequence
  Synthetic Polynucleotide
taatacgactcactatagggcaggcttgcagctgattatagagctgcagaaacagaggagatctgcaatgctataatcaaacctggcggcagcgcaaaagatg

SEQ ID NO: 26303 - DNA, 103 bp, Artificial Sequence
  Synthetic Polynucleotide
taatacgactcactatagggtgtcgcaggcttgcagctgattatagagctaacagaggagaagctctatgatcagctgcaacctggcggcagcgcaaaagatg

SEQ ID NO: 26304 - DNA, 103 bp, Artificial Sequence
  Synthetic Polynucleotide
taatacgactcactatagggggcgctgtcgcaggcttgcagctgattataaacagaggagatataatatgctgcaagccaacctggcggcagcgcaaaagatg

SEQ ID NO: 26305 - DNA, 103 bp, Artificial Sequence
  Synthetic Polynucleotide
taatacgactcactataggggctgcggcgctgtcgcaggcttgcagctgaaacagaggagatcagctatgagcctgcgaaacctggcggcagcgcaaaagatg

SEQ ID NO: 26306 - DNA, 103 bp, Artificial Sequence
  Synthetic Polynucleotide
taatacgactcactatagggctagtgctgcggcgctgtcgcaggcttgcaaacagaggagatgcaagatggcgacagcgaacctggcggcagcgcaaaagatg

SEQ ID NO: 26307 - DNA, 103 bp, Artificial Sequence
  Synthetic Polynucleotide
taatacgactcactatagggtgtatctagtgctgcggcgctgtcgcaggcaacagaggagagcctgcatgagcgccgcaaacctggcggcagcgcaaaagatg

SEQ ID NO: 26308 - DNA, 103 bp, Artificial Sequence
  Synthetic Polynucleotide
taatacgactcactatagggtttactgtatctagtgctgcggcgctgtcgaacagaggagacgacagatgcgcagcactaacctggcggcagcgcaaaagatg

SEQ ID NO: 26309 - DNA, 103 bp, Artificial Sequence
  Synthetic Polynucleotide
taatacgactcactatagggttaatgaggaaaaaaacaatttaaaacattaacagaggagaaatgttatgaattgttttaacctggcggcagcgcaaaagatg

SEQ ID NO: 26310 - DNA, 103 bp, Artificial Sequence
  Synthetic Polynucleotide
taatacgactcactatagggttcgttttactgtatctagtgctgcggcgcaacagaggagagcgccgatgcactagataaacctggcggcagcgcaaaagatg

SEQ ID NO: 26311 - DNA, 103 bp, Artificial Sequence
  Synthetic Polynucleotide
taatacgactcactatagggtaggtttcgttttactgtatctagtgctgcaacagaggagagcagcaatggatacagtaaacctggcggcagcgcaaaagatg

SEQ ID NO: 26312 - DNA, 103 bp, Artificial Sequence
  Synthetic Polynucleotide
taatacgactcactatagggtgcggtaggtttcgttttactgtatctagtaacagaggagaactagaatgagtaaaacgaacctggcggcagcgcaaaagatg

SEQ ID NO: 26313 - DNA, 103 bp, Artificial Sequence
  Synthetic Polynucleotide
taatacgactcactatagggttgtgtgcggtaggtttcgttttactgtataacagaggagaatacagatgaacgaaaccaacctggcggcagcgcaaaagatg

SEQ ID NO: 26314 - DNA, 103 bp, Artificial Sequence
  Synthetic Polynucleotide
taatacgactcactatagggctttgttgtgtgcggtaggtttcgttttacaacagaggagagtaaaaatgaacctaccgaacctggcggcagcgcaaaagatg

SEQ ID NO: 26315 - DNA, 103 bp, Artificial Sequence
  Synthetic Polynucleotide
taatacgactcactatagggcatctctttgttgtgtgcggtaggtttcgtaacagaggagaacgaaaatgaccgcacacaacctggcggcagcgcaaaagatg

SEQ ID NO: 26316 - DNA, 103 bp, Artificial Sequence
  Synthetic Polynucleotide
taatacgactcactataggggagcacatctctttgttgtgtgcggtaggtaacagaggagaacctacatgacacaacaaaacctggcggcagcgcaaaagatg

SEQ ID NO: 26317 - DNA, 103 bp, Artificial Sequence
  Synthetic Polynucleotide
taatacgactcactataggggcccagagcacatctctttgttgtgtgcggaacagaggagaccgcacatgacaaagagaaacctggcggcagcgcaaaagatg

SEQ ID NO: 26318 - DNA, 103 bp, Artificial Sequence
  Synthetic Polynucleotide
taatacgactcactatagggatgctgcccagagcacatctctttgttgtgaacagaggagacacaacatggagatgtgcaacctggcggcagcgcaaaagatg

SEQ ID NO: 26319 - DNA, 103 bp, Artificial Sequence
  Synthetic Polynucleotide
taatacgactcactatagggtatctatgctgcccagagcacatctctttgaacagaggagacaaagaatggtgctctggaacctggcggcagcgcaaaagatg

SEQ ID NO: 26320 - DNA, 103 bp, Artificial Sequence
  Synthetic Polynucleotide
taatacgactcactataggggcactttaatgaggaaaaaaacaatttaaaaacagaggagatttaaaatgtttttttccaacctggcggcagcgcaaaagatg

SEQ ID NO: 26321 - DNA, 103 bp, Artificial Sequence
  Synthetic Polynucleotide
taatacgactcactatagggattgatatctatgctgcccagagcacatctaacagaggagaagatgtatgctgggcagcaacctggcggcagcgcaaaagatg

SEQ ID NO: 26322 - DNA, 103 bp, Artificial Sequence
  Synthetic Polynucleotide
taatacgactcactatagggctggcattgatatctatgctgcccagagcaaacagaggagatgctctatgcagcatagaaacctggcggcagcgcaaaagatg

SEQ ID NO: 26323 - DNA, 103 bp, Artificial Sequence
  Synthetic Polynucleotide
taatacgactcactatagggtggaactggcattgatatctatgctgcccaaacagaggagatgggcaatgtagatatcaaacctggcggcagcgcaaaagatg

SEQ ID NO: 26324 - DNA, 103 bp, Artificial Sequence
  Synthetic Polynucleotide
taatacgactcactatagggctttttggaactggcattgatatctatgctaacagaggagaagcataatgatcaatgccaacctggcggcagcgcaaaagatg

SEQ ID NO: 26325 - DNA, 103 bp, Artificial Sequence
  Synthetic Polynucleotide
taatacgactcactatagggcttccctttttggaactggcattgatatctaacagaggagaagatatatgtgccagttcaacctggcggcagcgcaaaagatg

SEQ ID NO: 26326 - DNA, 103 bp, Artificial Sequence
  Synthetic Polynucleotide
taatacgactcactatagggctagtcttccctttttggaactggcattgaaacagaggagatcaatgatggttccaaaaaacctggcggcagcgcaaaagatg

SEQ ID NO: 26327 - DNA, 103 bp, Artificial Sequence
  Synthetic Polynucleotide
taatacgactcactataggggtcttctagtcttccctttttggaactggcaacagaggagagccagtatgaaaaagggaaacctggcggcagcgcaaaagatg

SEQ ID NO: 26328 - DNA, 103 bp, Artificial Sequence
  Synthetic Polynucleotide
taatacgactcactatagggccactgtcttctagtcttccctttttggaaaacagaggagattccaaatggggaagactaacctggcggcagcgcaaaagatg

SEQ ID NO: 26329 - DNA, 103 bp, Artificial Sequence
  Synthetic Polynucleotide
taatacgactcactatagggcatacccactgtcttctagtcttcccttttaacagaggagaaaaaggatggactagaagaacctggcggcagcgcaaaagatg

SEQ ID NO: 26330 - DNA, 103 bp, Artificial Sequence
  Synthetic Polynucleotide
taatacgactcactatagggagccgcatacccactgtcttctagtcttccaacagaggagaggaagaatggaagacagtaacctggcggcagcgcaaaagatg

SEQ ID NO: 26331 - DNA, 103 bp, Artificial Sequence
  Synthetic Polynucleotide
taatacgactcactatagggaataagcactttaatgaggaaaaaaacaataacagaggagaattgttatgttcctcattaacctggcggcagcgcaaaagatg

SEQ ID NO: 26332 - DNA, 103 bp, Artificial Sequence
  Synthetic Polynucleotide
taatacgactcactataggggtttcagccgcatacccactgtcttctagtaacagaggagaactagaatgcagtgggtaaacctggcggcagcgcaaaagatg

SEQ ID NO: 26333 - DNA, 103 bp, Artificial Sequence
  Synthetic Polynucleotide
taatacgactcactatagggaagaagtttcagccgcatacccactgtcttaacagaggagaaagacaatgggtatgcggaacctggcggcagcgcaaaagatg

SEQ ID NO: 26334 - DNA, 103 bp, Artificial Sequence
  Synthetic Polynucleotide
taatacgactcactatagggtgcagaagaagtttcagccgcatacccactaacagaggagaagtgggatggcggctgaaaacctggcggcagcgcaaaagatg

SEQ ID NO: 26335 - DNA, 103 bp, Artificial Sequence
  Synthetic Polynucleotide
taatacgactcactatagggacctctgcagaagaagtttcagccgcatacaacagaggagagtatgcatgtgaaacttcaacctggcggcagcgcaaaagatg

SEQ ID NO: 26336 - DNA, 103 bp, Artificial Sequence
  Synthetic Polynucleotide
taatacgactcactatagggcctccacctctgcagaagaagtttcagccgaacagaggagacggctgatgcttcttctgaacctggcggcagcgcaaaagatg

SEQ ID NO: 26337 - DNA, 103 bp, Artificial Sequence
  Synthetic Polynucleotide
taatacgactcactatagggatctacctccacctctgcagaagaagtttcaacagaggagagaaactatgtctgcagagaacctggcggcagcgcaaaagatg

SEQ ID NO: 26338 - DNA, 103 bp, Artificial Sequence
  Synthetic Polynucleotide
taatacgactcactatagggccaatatctacctccacctctgcagaagaaaacagaggagattcttcatgagaggtggaaacctggcggcagcgcaaaagatg

SEQ ID NO: 26339 - DNA, 103 bp, Artificial Sequence
  Synthetic Polynucleotide
taatacgactcactatagggagtccccaatatctacctccacctctgcagaacagaggagactgcagatgtggaggtagaacctggcggcagcgcaaaagatg

SEQ ID NO: 26340 - DNA, 103 bp, Artificial Sequence
  Synthetic Polynucleotide
taatacgactcactatagggaccgaagtccccaatatctacctccacctcaacagaggagagaggtgatggtagatattaacctggcggcagcgcaaaagatg

SEQ ID NO: 26341 - DNA, 103 bp, Artificial Sequence
  Synthetic Polynucleotide
taatacgactcactatagggggtctaccgaagtccccaatatctacctccaacagaggagaggaggtatgtattggggaaacctggcggcagcgcaaaagatg

SEQ ID NO: 26342 - DNA, 103 bp, Artificial Sequence
  Synthetic Polynucleotide
taatacgactcactatagggagtttcccaactagcaaggtacagttatacaacagaggagagtataaatgtaccttgctaacctggcggcagcgcaaaagatg

SEQ ID NO: 26343 - DNA, 103 bp, Artificial Sequence
  Synthetic Polynucleotide
taatacgactcactatagggcagtgaataagcactttaatgaggaaaaaaaacagaggagattttttatgcattaaagtaacctggcggcagcgcaaaagatg

SEQ ID NO: 26344 - DNA, 103 bp, Artificial Sequence
  Synthetic Polynucleotide
taatacgactcactatagggcgcccggtctaccgaagtccccaatatctaaacagaggagatagataatggggacttcgaacctggcggcagcgcaaaagatg

SEQ ID NO: 26345 - DNA, 103 bp, Artificial Sequence
  Synthetic Polynucleotide
taatacgactcactatagggcaccgcgcccggtctaccgaagtccccaataacagaggagaattgggatgttcggtagaaacctggcggcagcgcaaaagatg

SEQ ID NO: 26346 - DNA, 103 bp, Artificial Sequence
  Synthetic Polynucleotide
taatacgactcactataggggcccccaccgcgcccggtctaccgaagtccaacagaggagaggacttatgtagaccgggaacctggcggcagcgcaaaagatg

SEQ ID NO: 26347 - DNA, 103 bp, Artificial Sequence
  Synthetic Polynucleotide
taatacgactcactatagggacgttgcccccaccgcgcccggtctaccgaaacagaggagatcggtaatgcgggcgcggaacctggcggcagcgcaaaagatg

SEQ ID NO: 26348 - DNA, 103 bp, Artificial Sequence
  Synthetic Polynucleotide
taatacgactcactatagggtagatacgttgcccccaccgcgcccggtctaacagaggagaagaccgatggcggtggggaacctggcggcagcgcaaaagatg

SEQ ID NO: 26349 - DNA, 103 bp, Artificial Sequence
  Synthetic Polynucleotide
taatacgactcactatagggacatctagatacgttgcccccaccgcgcccaacagaggagagggcgcatggggggcaacaacctggcggcagcgcaaaagatg

SEQ ID NO: 26350 - DNA, 103 bp, Artificial Sequence
  Synthetic Polynucleotide
taatacgactcactatagggggagaacatctagatacgttgcccccaccgaacagaggagacggtggatgcaacgtatcaacctggcggcagcgcaaaagatg

SEQ ID NO: 26351 - DNA, 103 bp, Artificial Sequence
  Synthetic Polynucleotide
taatacgactcactatagggagcatggagaacatctagatacgttgccccaacagaggagaggggcaatgtatctagataacctggcggcagcgcaaaagatg

SEQ ID NO: 26352 - DNA, 103 bp, Artificial Sequence
  Synthetic Polynucleotide
taatacgactcactatagggttgtgagcatggagaacatctagatacgttaacagaggagaaacgtaatgagatgttctaacctggcggcagcgcaaaagatg

SEQ ID NO: 26353 - DNA, 103 bp, Artificial Sequence
  Synthetic Polynucleotide
taatacgactcactataggggtgcattgtgagcatggagaacatctagataacagaggagaatctagatgttctccatgaacctggcggcagcgcaaaagatg

SEQ ID NO: 26354 - DNA, 103 bp, Artificial Sequence
  Synthetic Polynucleotide
taatacgactcactatagggaactacagtgaataagcactttaatgaggaaacagaggagatcctcaatgaagtgcttaaacctggcggcagcgcaaaagatg

SEQ ID NO: 26355 - DNA, 103 bp, Artificial Sequence
  Synthetic Polynucleotide
taatacgactcactatagggcacacgtgcattgtgagcatggagaacatcaacagaggagagatgttatgcatgctcacaacctggcggcagcgcaaaagatg

SEQ ID NO: 26356 - DNA, 103 bp, Artificial Sequence
  Synthetic Polynucleotide
taatacgactcactatagggtttgccacacgtgcattgtgagcatggagaaacagaggagatctccaatgtcacaatgcaacctggcggcagcgcaaaagatg

SEQ ID NO: 26357 - DNA, 103 bp, Artificial Sequence
  Synthetic Polynucleotide
taatacgactcactatagggtcaattttgccacacgtgcattgtgagcataacagaggagaatgctcatgatgcacgtgaacctggcggcagcgcaaaagatg

SEQ ID NO: 26358 - DNA, 103 bp, Artificial Sequence
  Synthetic Polynucleotide
taatacgactcactatagggataagtcaattttgccacacgtgcattgtgaacagaggagacacaatatgcgtgtggcaaacctggcggcagcgcaaaagatg

SEQ ID NO: 26359 - DNA, 103 bp, Artificial Sequence
  Synthetic Polynucleotide
taatacgactcactatagggttaaaataagtcaattttgccacacgtgcaaacagaggagatgcacgatgggcaaaattaacctggcggcagcgcaaaagatg

SEQ ID NO: 26360 - DNA, 103 bp, Artificial Sequence
  Synthetic Polynucleotide
taatacgactcactatagggcctttttaaaataagtcaattttgccacacaacagaggagagtgtggatgaattgacttaacctggcggcagcgcaaaagatg

SEQ ID NO: 26361 - DNA, 103 bp, Artificial Sequence
  Synthetic Polynucleotide
taatacgactcactataggggaatccctttttaaaataagtcaattttgcaacagaggagagcaaaaatgacttattttaacctggcggcagcgcaaaagatg

SEQ ID NO: 26362 - DNA, 103 bp, Artificial Sequence
  Synthetic Polynucleotide
taatacgactcactatagggactgagaatccctttttaaaataagtcaataacagaggagaattgacatgttttaaaaaaacctggcggcagcgcaaaagatg

SEQ ID NO: 26363 - DNA, 103 bp, Artificial Sequence
  Synthetic Polynucleotide
taatacgactcactatagggaacccactgagaatccctttttaaaataagaacagaggagacttattatgaaaagggataacctggcggcagcgcaaaagatg

SEQ ID NO: 26364 - DNA, 103 bp, Artificial Sequence
  Synthetic Polynucleotide
taatacgactcactatagggcccaaaacccactgagaatccctttttaaaaacagaggagatttaaaatgggattctcaaacctggcggcagcgcaaaagatg

SEQ ID NO: 26365 - DNA, 103 bp, Artificial Sequence
  Synthetic Polynucleotide
taatacgactcactatagggacgccaactacagtgaataagcactttaataacagaggagaattaaaatgcttattcacaacctggcggcagcgcaaaagatg

SEQ ID NO: 26366 - DNA, 103 bp, Artificial Sequence
  Synthetic Polynucleotide
taatacgactcactatagggagctccccaaaacccactgagaatccctttaacagaggagaaaagggatgctcagtgggaacctggcggcagcgcaaaagatg

SEQ ID NO: 26367 - DNA, 103 bp, Artificial Sequence
  Synthetic Polynucleotide
taatacgactcactatagggttgttagctccccaaaacccactgagaatcaacagaggagagattctatgtgggttttgaacctggcggcagcgcaaaagatg

SEQ ID NO: 26368 - DNA, 103 bp, Artificial Sequence
  Synthetic Polynucleotide
taatacgactcactatagggtggccttgttagctccccaaaacccactgaaacagaggagatcagtgatgtttggggagaacctggcggcagcgcaaaagatg

SEQ ID NO: 26369 - DNA, 103 bp, Artificial Sequence
  Synthetic Polynucleotide
taatacgactcactatagggttgaatggccttgttagctccccaaaacccaacagaggagagggtttatgggagctaacaacctggcggcagcgcaaaagatg

SEQ ID NO: 26370 - DNA, 103 bp, Artificial Sequence
  Synthetic Polynucleotide
taatacgactcactatagggtgcttttgaatggccttgttagctccccaaaacagaggagattggggatgtaacaaggcaacctggcggcagcgcaaaagatg

SEQ ID NO: 26371 - DNA, 103 bp, Artificial Sequence
  Synthetic Polynucleotide
taatacgactcactatagggcttattgcttttgaatggccttgttagctcaacagaggagagagctaatgaggccattcaacctggcggcagcgcaaaagatg

SEQ ID NO: 26372 - DNA, 103 bp, Artificial Sequence
  Synthetic Polynucleotide
taatacgactcactatagggcatgtcttattgcttttgaatggccttgttaacagaggagaaacaagatgattcaaaagaacctggcggcagcgcaaaagatg

SEQ ID NO: 26373 - DNA, 103 bp, Artificial Sequence
  Synthetic Polynucleotide
taatacgactcactatagggggcagcatgtcttattgcttttgaatggccaacagaggagaggccatatgaaagcaataaacctggcggcagcgcaaaagatg

SEQ ID NO: 26374 - DNA, 103 bp, Artificial Sequence
  Synthetic Polynucleotide
taatacgactcactatagggtgatgggcagcatgtcttattgcttttgaaaacagaggagattcaaaatgaataagacaaacctggcggcagcgcaaaagatg

SEQ ID NO: 26375 - DNA, 103 bp, Artificial Sequence
  Synthetic Polynucleotide
taatacgactcactatagggacccatgatgggcagcatgtcttattgcttaacagaggagaaagcaaatggacatgctgaacctggcggcagcgcaaaagatg

SEQ ID NO: 26376 - DNA, 103 bp, Artificial Sequence
  Synthetic Polynucleotide
taatacgactcactatagggtacacacgccaactacagtgaataagcactaacagaggagaagtgctatgtcactgtagaacctggcggcagcgcaaaagatg

SEQ ID NO: 26377 - DNA, 103 bp, Artificial Sequence
  Synthetic Polynucleotide
taatacgactcactatagggctaacacccatgatgggcagcatgtcttataacagaggagaataagaatggctgcccataacctggcggcagcgcaaaagatg

SEQ ID NO: 26378 - DNA, 103 bp, Artificial Sequence
  Synthetic Polynucleotide
taatacgactcactatagggcacggctaacacccatgatgggcagcatgtaacagaggagaacatgcatgccatcatggaacctggcggcagcgcaaaagatg

SEQ ID NO: 26379 - DNA, 103 bp, Artificial Sequence
  Synthetic Polynucleotide
taatacgactcactatagggccgtacacggctaacacccatgatgggcagaacagaggagactgcccatgatgggtgttaacctggcggcagcgcaaaagatg

SEQ ID NO: 26380 - DNA, 103 bp, Artificial Sequence
  Synthetic Polynucleotide
taatacgactcactatagggcagctccgtacacggctaacacccatgatgaacagaggagacatcatatgtgttagccgaacctggcggcagcgcaaaagatg

SEQ ID NO: 26381 - DNA, 103 bp, Artificial Sequence
  Synthetic Polynucleotide
taatacgactcactatagggttctgcagctccgtacacggctaacacccaaacagaggagatgggtgatggccgtgtacaacctggcggcagcgcaaaagatg

SEQ ID NO: 26382 - DNA, 103 bp, Artificial Sequence
  Synthetic Polynucleotide
taatacgactcactatagggacttcttctgcagctccgtacacggctaacaacagaggagagttagcatggtacggagcaacctggcggcagcgcaaaagatg

SEQ ID NO: 26383 - DNA, 103 bp, Artificial Sequence
  Synthetic Polynucleotide
taatacgactcactatagggctaatacttcttctgcagctccgtacacggaacagaggagaccgtgtatggagctgcagaacctggcggcagcgcaaaagatg

SEQ ID NO: 26384 - DNA, 103 bp, Artificial Sequence
  Synthetic Polynucleotide
taatacgactcactataggggctttctaatacttcttctgcagctccgtaaacagaggagatacggaatggcagaagaaaacctggcggcagcgcaaaagatg

SEQ ID NO: 26385 - DNA, 103 bp, Artificial Sequence
  Synthetic Polynucleotide
taatacgactcactatagggtttgagctttctaatacttcttctgcagctaacagaggagaagctgcatgagaagtattaacctggcggcagcgcaaaagatg

SEQ ID NO: 26386 - DNA, 103 bp, Artificial Sequence
  Synthetic Polynucleotide
taatacgactcactataggggtatttttgagctttctaatacttcttctgaacagaggagacagaagatgtattagaaaaacctggcggcagcgcaaaagatg

SEQ ID NO: 26387 - DNA, 103 bp, Artificial Sequence
  Synthetic Polynucleotide
taatacgactcactatagggtaagatacacacgccaactacagtgaataaaacagaggagattattcatggtagttggcaacctggcggcagcgcaaaagatg

SEQ ID NO: 26388 - DNA, 103 bp, Artificial Sequence
  Synthetic Polynucleotide
taatacgactcactatagggtaactgtatttttgagctttctaatacttcaacagaggagagaagtaatggaaagctcaaacctggcggcagcgcaaaagatg

SEQ ID NO: 26389 - DNA, 103 bp, Artificial Sequence
  Synthetic Polynucleotide
taatacgactcactatagggtgctgtaactgtatttttgagctttctaataacagaggagaattagaatgctcaaaaataacctggcggcagcgcaaaagatg

SEQ ID NO: 26390 - DNA, 103 bp, Artificial Sequence
  Synthetic Polynucleotide
taatacgactcactatagggcatgttgctgtaactgtatttttgagctttaacagaggagaaaagctatgaaatacagtaacctggcggcagcgcaaaagatg

SEQ ID NO: 26391 - DNA, 103 bp, Artificial Sequence
  Synthetic Polynucleotide
taatacgactcactatagggatctgcatgttgctgtaactgtatttttgaaacagaggagatcaaaaatgcagttacagaacctggcggcagcgcaaaagatg

SEQ ID NO: 26392 - DNA, 103 bp, Artificial Sequence
  Synthetic Polynucleotide
taatacgactcactatagggatataatctgcatgttgctgtaactgtattaacagaggagaaatacaatgacagcaacaaacctggcggcagcgcaaaagatg

SEQ ID NO: 26393 - DNA, 103 bp, Artificial Sequence
  Synthetic Polynucleotide
taatacgactcactatagggaataaatataatctgcatgttgctgtaactaacagaggagaagttacatgaacatgcagaacctggcggcagcgcaaaagatg

SEQ ID NO: 26394 - DNA, 103 bp, Artificial Sequence
  Synthetic Polynucleotide
taatacgactcactatagggttttaaataaatataatctgcatgttgctgaacagaggagacagcaaatggcagattataacctggcggcagcgcaaaagatg

SEQ ID NO: 26395 - DNA, 103 bp, Artificial Sequence
  Synthetic Polynucleotide
taatacgactcactataggggaaacttttaaataaatataatctgcatgtaacagaggagaacatgcatgttatatttaaacctggcggcagcgcaaaagatg

SEQ ID NO: 26396 - DNA, 103 bp, Artificial Sequence
  Synthetic Polynucleotide
taatacgactcactatagggacgtagaaacttttaaataaatataatctgaacagaggagacagattatgtttatttaaaacctggcggcagcgcaaaagatg

SEQ ID NO: 26397 - DNA, 103 bp, Artificial Sequence
  Synthetic Polynucleotide
taatacgactcactatagggcggacacgtagaaacttttaaataaatataaacagaggagatatattatgttaaaagttaacctggcggcagcgcaaaagatg

SEQ ID NO: 26398 - DNA, 103 bp, Artificial Sequence
  Synthetic Polynucleotide
taatacgactcactatagggtccattaagatacacacgccaactacagtgaacagaggagacactgtatgtggcgtgtgaacctggcggcagcgcaaaagatg

SEQ ID NO: 26399 - DNA, 103 bp, Artificial Sequence
  Synthetic Polynucleotide
taatacgactcactatagggcccaacggacacgtagaaacttttaaataaaacagaggagattatttatgagtttctacaacctggcggcagcgcaaaagatg

SEQ ID NO: 26400 - DNA, 103 bp, Artificial Sequence
  Synthetic Polynucleotide
taatacgactcactatagggtaaatcccaacggacacgtagaaacttttaaacagaggagataaaagatgctacgtgtcaacctggcggcagcgcaaaagatg

SEQ ID NO: 26401 - DNA, 103 bp, Artificial Sequence
  Synthetic Polynucleotide
taatacgactcactatagggtgccataaatcccaacggacacgtagaaacaacagaggagagtttctatgtgtccgttgaacctggcggcagcgcaaaagatg

SEQ ID NO: 26402 - DNA, 103 bp, Artificial Sequence
  Synthetic Polynucleotide
taatacgactcactatagggtacagtgccataaatcccaacggacacgtaaacagaggagatacgtgatggttgggattaacctggcggcagcgcaaaagatg

SEQ ID NO: 26403 - DNA, 103 bp, Artificial Sequence
  Synthetic Polynucleotide
taatacgactcactatagggaaaggtacagtgccataaatcccaacggacaacagaggagagtccgtatggatttatggaacctggcggcagcgcaaaagatg

SEQ ID NO: 26404 - DNA, 103 bp, Artificial Sequence
  Synthetic Polynucleotide
taatacgactcactatagggatacaaaaggtacagtgccataaatcccaaaacagaggagattgggaatgatggcactgaacctggcggcagcgcaaaagatg

SEQ ID NO: 26405 - DNA, 103 bp, Artificial Sequence
  Synthetic Polynucleotide
taatacgactcactatagggttgaaatacaaaaggtacagtgccataaataacagaggagaatttatatgactgtacctaacctggcggcagcgcaaaagatg

SEQ ID NO: 26406 - DNA, 103 bp, Artificial Sequence
  Synthetic Polynucleotide
taatacgactcactatagggcagctttgaaatacaaaaggtacagtgccaaacagaggagatggcacatgaccttttgtaacctggcggcagcgcaaaagatg

SEQ ID NO: 26407 - DNA, 103 bp, Artificial Sequence
  Synthetic Polynucleotide
taatacgactcactatagggttttgcagctttgaaatacaaaaggtacagaacagaggagactgtacatgttgtatttcaacctggcggcagcgcaaaagatg

SEQ ID NO: 26408 - DNA, 103 bp, Artificial Sequence
  Synthetic Polynucleotide
taatacgactcactatagggctgctttttgcagctttgaaatacaaaaggaacagaggagaccttttatgtttcaaagcaacctggcggcagcgcaaaagatg

SEQ ID NO: 26409 - DNA, 103 bp, Artificial Sequence
  Synthetic Polynucleotide
taatacgactcactatagggcacattccattaagatacacacgccaactaaacagaggagatagttgatgtgtgtatctaacctggcggcagcgcaaaagatg

SEQ ID NO: 26410 - DNA, 103 bp, Artificial Sequence
  Synthetic Polynucleotide
taatacgactcactatagggtgtccctgctttttgcagctttgaaatacaaacagaggagatgtattatgaagctgcaaaacctggcggcagcgcaaaagatg

SEQ ID NO: 26411 - DNA, 103 bp, Artificial Sequence
  Synthetic Polynucleotide
taatacgactcactatagggaactgtgtccctgctttttgcagctttgaaaacagaggagattcaaaatggcaaaaagcaacctggcggcagcgcaaaagatg

SEQ ID NO: 26412 - DNA, 103 bp, Artificial Sequence
  Synthetic Polynucleotide
taatacgactcactatagggctcataactgtgtccctgctttttgcagctaacagaggagaagctgcatgaagcagggaaacctggcggcagcgcaaaagatg

SEQ ID NO: 26413 - DNA, 103 bp, Artificial Sequence
  Synthetic Polynucleotide
taatacgactcactatagggttaatctcataactgtgtccctgctttttgaacagaggagacaaaaaatggggacacagaacctggcggcagcgcaaaagatg

SEQ ID NO: 26414 - DNA, 103 bp, Artificial Sequence
  Synthetic Polynucleotide
taatacgactcactatagggtgtcattaatctcataactgtgtccctgctaacagaggagaagcaggatgacagttatgaacctggcggcagcgcaaaagatg

SEQ ID NO: 26415 - DNA, 103 bp, Artificial Sequence
  Synthetic Polynucleotide
taatacgactcactatagggagtcctgtcattaatctcataactgtgtccaacagaggagaggacacatgtatgagattaacctggcggcagcgcaaaagatg

SEQ ID NO: 26416 - DNA, 103 bp, Artificial Sequence
  Synthetic Polynucleotide
taatacgactcactatagggttagcagtcctgtcattaatctcataactgaacagaggagacagttaatggattaatgaaacctggcggcagcgcaaaagatg

SEQ ID NO: 26417 - DNA, 103 bp, Artificial Sequence
  Synthetic Polynucleotide
taatacgactcactatagggaacatttagcagtcctgtcattaatctcataacagaggagaatgagaatgatgacaggaaacctggcggcagcgcaaaagatg

SEQ ID NO: 26418 - DNA, 103 bp, Artificial Sequence
  Synthetic Polynucleotide
taatacgactcactatagggtcagcaacatttagcagtcctgtcattaataacagaggagaattaatatgaggactgctaacctggcggcagcgcaaaagatg

SEQ ID NO: 26419 - DNA, 103 bp, Artificial Sequence
  Synthetic Polynucleotide
taatacgactcactataggggatgctcagcaacatttagcagtcctgtcaaacagaggagatgacagatgtgctaaatgaacctggcggcagcgcaaaagatg

SEQ ID NO: 26420 - DNA, 103 bp, Artificial Sequence
  Synthetic Polynucleotide
taatacgactcactatagggcaaaccacattccattaagatacacacgccaacagaggagaggcgtgatgatcttaatgaacctggcggcagcgcaaaagatg

SEQ ID NO: 26421 - DNA, 103 bp, Artificial Sequence
  Synthetic Polynucleotide
taatacgactcactatagggtatttgatgctcagcaacatttagcagtccaacagaggagaggactgatgaatgttgctaacctggcggcagcgcaaaagatg

SEQ ID NO: 26422 - DNA, 103 bp, Artificial Sequence
  Synthetic Polynucleotide
taatacgactcactatagggctaagtatttgatgctcagcaacatttagcaacagaggagagctaaaatgtgctgagcaaacctggcggcagcgcaaaagatg

SEQ ID NO: 26423 - DNA, 103 bp, Artificial Sequence
  Synthetic Polynucleotide
taatacgactcactatagggggtcactaagtatttgatgctcagcaacataacagaggagaatgttgatgagcatcaaaaacctggcggcagcgcaaaagatg

SEQ ID NO: 26424 - DNA, 103 bp, Artificial Sequence
  Synthetic Polynucleotide
taatacgactcactatagggaggggggtcactaagtatttgatgctcagcaacagaggagagctgagatgcaaatacttaacctggcggcagcgcaaaagatg

SEQ ID NO: 26425 - DNA, 103 bp, Artificial Sequence
  Synthetic Polynucleotide
taatacgactcactatagggagcttaggggggtcactaagtatttgatgcaacagaggagagcatcaatgacttagtgaaacctggcggcagcgcaaaagatg

SEQ ID NO: 26426 - DNA, 103 bp, Artificial Sequence
  Synthetic Polynucleotide
taatacgactcactatagggtcctgagcttaggggggtcactaagtatttaacagaggagaaaatacatggtgacccccaacctggcggcagcgcaaaagatg

SEQ ID NO: 26427 - DNA, 103 bp, Artificial Sequence
  Synthetic Polynucleotide
taatacgactcactatagggcgtgctcctgagcttaggggggtcactaagaacagaggagacttagtatgccccctaagaacctggcggcagcgcaaaagatg

SEQ ID NO: 26428 - DNA, 103 bp, Artificial Sequence
  Synthetic Polynucleotide
taatacgactcactataggggctggcgtgctcctgagcttaggggggtcaaacagaggagatgacccatgtaagctcagaacctggcggcagcgcaaaagatg

SEQ ID NO: 26429 - DNA, 103 bp, Artificial Sequence
  Synthetic Polynucleotide
taatacgactcactataggggcgcagctggcgtgctcctgagcttaggggaacagaggagacccctaatgtcaggagcaaacctggcggcagcgcaaaagatg

SEQ ID NO: 26430 - DNA, 103 bp, Artificial Sequence
  Synthetic Polynucleotide
taatacgactcactataggggtacagcgcagctggcgtgctcctgagcttaacagaggagaaagctcatgagcacgccaaacctggcggcagcgcaaaagatg

SEQ ID NO: 26431 - DNA, 103 bp, Artificial Sequence
  Synthetic Polynucleotide
taatacgactcactataggggcgtgcaaaccacattccattaagatacacaacagaggagagtgtatatgaatggaatgaacctggcggcagcgcaaaagatg

SEQ ID NO: 26432 - DNA, 103 bp, Artificial Sequence
  Synthetic Polynucleotide
taatacgactcactatagggtaccagtacagcgcagctggcgtgctcctgaacagaggagacaggagatggccagctgcaacctggcggcagcgcaaaagatg

SEQ ID NO: 26433 - DNA, 103 bp, Artificial Sequence
  Synthetic Polynucleotide
taatacgactcactatagggttttgtaccagtacagcgcagctggcgtgcaacagaggagagcacgcatgctgcgctgtaacctggcggcagcgcaaaagatg

SEQ ID NO: 26434 - DNA, 103 bp, Artificial Sequence
  Synthetic Polynucleotide
taatacgactcactatagggccctgttttgtaccagtacagcgcagctggaacagaggagaccagctatgctgtactggaacctggcggcagcgcaaaagatg

SEQ ID NO: 26435 - DNA, 103 bp, Artificial Sequence
  Synthetic Polynucleotide
taatacgactcactatagggactgcccctgttttgtaccagtacagcgcaaacagaggagatgcgctatgctggtacaaaacctggcggcagcgcaaaagatg

SEQ ID NO: 26436 - DNA, 103 bp, Artificial Sequence
  Synthetic Polynucleotide
taatacgactcactatagggtgggtactgcccctgttttgtaccagtacaaacagaggagatgtactatgacaaaacagaacctggcggcagcgcaaaagatg

SEQ ID NO: 26437 - DNA, 103 bp, Artificial Sequence
  Synthetic Polynucleotide
taatacgactcactatagggggtggtgggtactgcccctgttttgtaccaaacagaggagatggtacatgacaggggcaaacctggcggcagcgcaaaagatg

SEQ ID NO: 26438 - DNA, 103 bp, Artificial Sequence
  Synthetic Polynucleotide
taatacgactcactataggggtaaaggtggtgggtactgcccctgttttgaacagaggagacaaaacatgggcagtaccaacctggcggcagcgcaaaagatg

SEQ ID NO: 26439 - DNA, 103 bp, Artificial Sequence
  Synthetic Polynucleotide
taatacgactcactatagggcatatgtaaaggtggtgggtactgcccctgaacagaggagacaggggatgtacccaccaaacctggcggcagcgcaaaagatg

SEQ ID NO: 26440 - DNA, 103 bp, Artificial Sequence
  Synthetic Polynucleotide
taatacgactcactatagggttccccatatgtaaaggtggtgggtactgcaacagaggagagcagtaatgaccacctttaacctggcggcagcgcaaaagatg

SEQ ID NO: 26441 - DNA, 103 bp, Artificial Sequence
  Synthetic Polynucleotide
taatacgactcactatagggggcaattccccatatgtaaaggtggtgggtaacagaggagaacccacatgctttacataaacctggcggcagcgcaaaagatg

SEQ ID NO: 26442 - DNA, 103 bp, Artificial Sequence
  Synthetic Polynucleotide
taatacgactcactatagggtgtgtgcgtgcaaaccacattccattaagaaacagaggagatcttaaatgaatgtggttaacctggcggcagcgcaaaagatg

SEQ ID NO: 26443 - DNA, 103 bp, Artificial Sequence
  Synthetic Polynucleotide
taatacgactcactatagggaatctggcaattccccatatgtaaaggtggaacagaggagaccacctatgcatatggggaacctggcggcagcgcaaaagatg

SEQ ID NO: 26444 - DNA, 103 bp, Artificial Sequence
  Synthetic Polynucleotide
taatacgactcactatagggtatccaatctggcaattccccatatgtaaaaacagaggagatttacaatgggggaattgaacctggcggcagcgcaaaagatg

SEQ ID NO: 26445 - DNA, 103 bp, Artificial Sequence
  Synthetic Polynucleotide
taatacgactcactatagggtgacatatccaatctggcaattccccatataacagaggagaatatggatgattgccagaaacctggcggcagcgcaaaagatg

SEQ ID NO: 26446 - DNA, 103 bp, Artificial Sequence
  Synthetic Polynucleotide
taatacgactcactatagggtttgctgacatatccaatctggcaattcccaacagaggagagggaatatgcagattggaaacctggcggcagcgcaaaagatg

SEQ ID NO: 26447 - DNA, 103 bp, Artificial Sequence
  Synthetic Polynucleotide
taatacgactcactatagggcattgtttgctgacatatccaatctggcaaaacagaggagattgccaatgtggatatgtaacctggcggcagcgcaaaagatg

SEQ ID NO: 26448 - DNA, 103 bp, Artificial Sequence
  Synthetic Polynucleotide
taatacgactcactataggggtaatcattgtttgctgacatatccaatctaacagaggagaagattgatgatgtcagcaaacctggcggcagcgcaaaagatg

SEQ ID NO: 26449 - DNA, 103 bp, Artificial Sequence
  Synthetic Polynucleotide
taatacgactcactataggggatgtgtaatcattgtttgctgacatatccaacagaggagaggatatatgagcaaacaaaacctggcggcagcgcaaaagatg

SEQ ID NO: 26450 - DNA, 103 bp, Artificial Sequence
  Synthetic Polynucleotide
taatacgactcactatagggacattgatgtgtaatcattgtttgctgacaaacagaggagatgtcagatgacaatgattaacctggcggcagcgcaaaagatg

SEQ ID NO: 26451 - DNA, 103 bp, Artificial Sequence
  Synthetic Polynucleotide
taatacgactcactatagggtccccacattgatgtgtaatcattgtttgcaacagaggagagcaaacatggattacacaaacctggcggcagcgcaaaagatg

SEQ ID NO: 26452 - DNA, 103 bp, Artificial Sequence
  Synthetic Polynucleotide
taatacgactcactatagggggacatccccacattgatgtgtaatcattgaacagaggagacaatgaatgcacatcaataacctggcggcagcgcaaaagatg

SEQ ID NO: 26453 - DNA, 103 bp, Artificial Sequence
  Synthetic Polynucleotide
taatacgactcactatagggccagtagtttcccaactagcaaggtacagtaacagaggagaactgtaatgtgctagttgaacctggcggcagcgcaaaagatg

SEQ ID NO: 26454 - DNA, 103 bp, Artificial Sequence
  Synthetic Polynucleotide
taatacgactcactatagggtagggtgtgtgcgtgcaaaccacattccataacagaggagaatggaaatgggtttgcacaacctggcggcagcgcaaaagatg

SEQ ID NO: 26455 - DNA, 103 bp, Artificial Sequence
  Synthetic Polynucleotide
taatacgactcactatagggaaactggacatccccacattgatgtgtaataacagaggagaattacaatgcaatgtgggaacctggcggcagcgcaaaagatg

SEQ ID NO: 26456 - DNA, 103 bp, Artificial Sequence
  Synthetic Polynucleotide
taatacgactcactatagggaaatcaaactggacatccccacattgatgtaacagaggagaacatcaatgtggggatgtaacctggcggcagcgcaaaagatg

SEQ ID NO: 26457 - DNA, 103 bp, Artificial Sequence
  Synthetic Polynucleotide
taatacgactcactatagggtggataaatcaaactggacatccccacattaacagaggagaaatgtgatgatgtccagtaacctggcggcagcgcaaaagatg

SEQ ID NO: 26458 - DNA, 103 bp, Artificial Sequence
  Synthetic Polynucleotide
taatacgactcactatagggcattttggataaatcaaactggacatccccaacagaggagaggggatatgcagtttgataacctggcggcagcgcaaaagatg

SEQ ID NO: 26459 - DNA, 103 bp, Artificial Sequence
  Synthetic Polynucleotide
taatacgactcactatagggtgtaccattttggataaatcaaactggacaaacagaggagatgtccaatgtgatttatcaacctggcggcagcgcaaaagatg

SEQ ID NO: 26460 - DNA, 103 bp, Artificial Sequence
  Synthetic Polynucleotide
taatacgactcactatagggcccactgtaccattttggataaatcaaactaacagaggagaagtttgatgtatccaaaaaacctggcggcagcgcaaaagatg

SEQ ID NO: 26461 - DNA, 103 bp, Artificial Sequence
  Synthetic Polynucleotide
taatacgactcactatagggataagcccactgtaccattttggataaatcaacagaggagagatttaatgaaaatggtaaacctggcggcagcgcaaaagatg

SEQ ID NO: 26462 - DNA, 103 bp, Artificial Sequence
  Synthetic Polynucleotide
taatacgactcactatagggttgtcataagcccactgtaccattttggataacagaggagaatccaaatgggtacagtgaacctggcggcagcgcaaaagatg

SEQ ID NO: 26463 - DNA, 103 bp, Artificial Sequence
  Synthetic Polynucleotide
taatacgactcactatagggaatcattgtcataagcccactgtaccatttaacagaggagaaaatggatgagtgggcttaacctggcggcagcgcaaaagatg

SEQ ID NO: 26464 - DNA, 103 bp, Artificial Sequence
  Synthetic Polynucleotide
taatacgactcactatagggcacaaaatcattgtcataagcccactgtacaacagaggagagtacagatggcttatgacaacctggcggcagcgcaaaagatg

SEQ ID NO: 26465 - DNA, 103 bp, Artificial Sequence
  Synthetic Polynucleotide
taatacgactcactatagggccttttagggtgtgtgcgtgcaaaccacataacagaggagaatgtggatggcacgcacaaacctggcggcagcgcaaaagatg

SEQ ID NO: 26466 - DNA, 103 bp, Artificial Sequence
  Synthetic Polynucleotide
taatacgactcactatagggtcgtccacaaaatcattgtcataagcccacaacagaggagagtgggcatgtgacaatgaaacctggcggcagcgcaaaagatg

SEQ ID NO: 26467 - DNA, 103 bp, Artificial Sequence
  Synthetic Polynucleotide
taatacgactcactatagggccgactcgtccacaaaatcattgtcataagaacagaggagacttatgatgatgattttgaacctggcggcagcgcaaaagatg

SEQ ID NO: 26468 - DNA, 103 bp, Artificial Sequence
  Synthetic Polynucleotide
taatacgactcactatagggtatgtccgactcgtccacaaaatcattgtcaacagaggagagacaatatgtttgtggacaacctggcggcagcgcaaaagatg

SEQ ID NO: 26469 - DNA, 103 bp, Artificial Sequence
  Synthetic Polynucleotide
taatacgactcactatagggtatgctatgtccgactcgtccacaaaatcaaacagaggagatgatttatgggacgagtcaacctggcggcagcgcaaaagatg

SEQ ID NO: 26470 - DNA, 103 bp, Artificial Sequence
  Synthetic Polynucleotide
taatacgactcactatagggagttatatgctatgtccgactcgtccacaaaacagaggagattgtggatgagtcggacaaacctggcggcagcgcaaaagatg

SEQ ID NO: 26471 - DNA, 103 bp, Artificial Sequence
  Synthetic Polynucleotide
taatacgactcactatagggggcatagttatatgctatgtccgactcgtcaacagaggagagacgagatggacatagcaaacctggcggcagcgcaaaagatg

SEQ ID NO: 26472 - DNA, 103 bp, Artificial Sequence
  Synthetic Polynucleotide
taatacgactcactatagggaatttggcatagttatatgctatgtccgacaacagaggagagtcggaatgagcatataaaacctggcggcagcgcaaaagatg

SEQ ID NO: 26473 - DNA, 103 bp, Artificial Sequence
  Synthetic Polynucleotide
taatacgactcactataggggtgccaatttggcatagttatatgctatgtaacagaggagaacatagatgataactatgaacctggcggcagcgcaaaagatg

SEQ ID NO: 26474 - DNA, 103 bp, Artificial Sequence
  Synthetic Polynucleotide
taatacgactcactatagggctctggtgccaatttggcatagttatatgcaacagaggagagcatatatgtatgccaaaaacctggcggcagcgcaaaagatg

SEQ ID NO: 26475 - DNA, 103 bp, Artificial Sequence
  Synthetic Polynucleotide
taatacgactcactatagggtcgtcctctggtgccaatttggcatagttaaacagaggagataactaatgcaaattggcaacctggcggcagcgcaaaagatg

SEQ ID NO: 26476 - DNA, 103 bp, Artificial Sequence
  Synthetic Polynucleotide
taatacgactcactatagggaaataccttttagggtgtgtgcgtgcaaacaacagaggagagtttgcatgcacacacccaacctggcggcagcgcaaaagatg

SEQ ID NO: 26477 - DNA, 103 bp, Artificial Sequence
  Synthetic Polynucleotide
taatacgactcactatagggcattttcgtcctctggtgccaatttggcataacagaggagaatgccaatgtggcaccagaacctggcggcagcgcaaaagatg

SEQ ID NO: 26478 - DNA, 103 bp, Artificial Sequence
  Synthetic Polynucleotide
taatacgactcactatagggagctgcattttcgtcctctggtgccaatttaacagaggagaaaattgatgccagaggacaacctggcggcagcgcaaaagatg

SEQ ID NO: 26479 - DNA, 103 bp, Artificial Sequence
  Synthetic Polynucleotide
taatacgactcactatagggcatgcagctgcattttcgtcctctggtgccaacagaggagaggcaccatgggacgaaaaaacctggcggcagcgcaaaagatg

SEQ ID NO: 26480 - DNA, 103 bp, Artificial Sequence
  Synthetic Polynucleotide
taatacgactcactatagggttagccatgcagctgcattttcgtcctctgaacagaggagacagaggatgaaaatgcagaacctggcggcagcgcaaaagatg

SEQ ID NO: 26481 - DNA, 103 bp, Artificial Sequence
  Synthetic Polynucleotide
taatacgactcactatagggggattttagccatgcagctgcattttcgtcaacagaggagagacgaaatggcagctgcaaacctggcggcagcgcaaaagatg

SEQ ID NO: 26482 - DNA, 103 bp, Artificial Sequence
  Synthetic Polynucleotide
taatacgactcactatagggctattggattttagccatgcagctgcatttaacagaggagaaaatgcatgtgcatggctaacctggcggcagcgcaaaagatg

SEQ ID NO: 26483 - DNA, 103 bp, Artificial Sequence
  Synthetic Polynucleotide
taatacgactcactatagggcttgactattggattttagccatgcagctgaacagaggagacagctgatgggctaaaataacctggcggcagcgcaaaagatg

SEQ ID NO: 26484 - DNA, 103 bp, Artificial Sequence
  Synthetic Polynucleotide
taatacgactcactatagggccttacttgactattggattttagccatgcaacagaggagagcatggatgaaatccaataacctggcggcagcgcaaaagatg

SEQ ID NO: 26485 - DNA, 103 bp, Artificial Sequence
  Synthetic Polynucleotide
taatacgactcactatagggacataccttacttgactattggattttagcaacagaggagagctaaaatgcaatagtcaaacctggcggcagcgcaaaagatg

SEQ ID NO: 26486 - DNA, 103 bp, Artificial Sequence
  Synthetic Polynucleotide
taatacgactcactatagggccttcacataccttacttgactattggattaacagaggagaaatccaatggtcaagtaaaacctggcggcagcgcaaaagatg

SEQ ID NO: 26487 - DNA, 103 bp, Artificial Sequence
  Synthetic Polynucleotide
taatacgactcactatagggatagtaaataccttttagggtgtgtgcgtgaacagaggagacacgcaatgaccctaaaaaacctggcggcagcgcaaaagatg

SEQ ID NO: 26488 - DNA, 103 bp, Artificial Sequence
  Synthetic Polynucleotide
taatacgactcactataggggcattccttcacataccttacttgactattaacagaggagaaatagtatggtaaggtataacctggcggcagcgcaaaagatg

SEQ ID NO: 26489 - DNA, 103 bp, Artificial Sequence
  Synthetic Polynucleotide
taatacgactcactatagggtgcgagcattccttcacataccttacttgaaacagaggagatcaagtatggtatgtgaaaacctggcggcagcgcaaaagatg

SEQ ID NO: 26490 - DNA, 103 bp, Artificial Sequence
  Synthetic Polynucleotide
taatacgactcactatagggccatctgcgagcattccttcacataccttaaacagaggagataaggtatgtgaaggaataacctggcggcagcgcaaaagatg

SEQ ID NO: 26491 - DNA, 103 bp, Artificial Sequence
  Synthetic Polynucleotide
taatacgactcactataggggcgtgccatctgcgagcattccttcacataaacagaggagatatgtgatggaatgctcgaacctggcggcagcgcaaaagatg

SEQ ID NO: 26492 - DNA, 103 bp, Artificial Sequence
  Synthetic Polynucleotide
taatacgactcactatagggtaatagcgtgccatctgcgagcattccttcaacagaggagagaaggaatgctcgcagataacctggcggcagcgcaaaagatg

SEQ ID NO: 26493 - DNA, 103 bp, Artificial Sequence
  Synthetic Polynucleotide
taatacgactcactatagggtcttgtaatagcgtgccatctgcgagcattaacagaggagaaatgctatgagatggcacaacctggcggcagcgcaaaagatg

SEQ ID NO: 26494 - DNA, 103 bp, Artificial Sequence
  Synthetic Polynucleotide
taatacgactcactatagggagccctcttgtaatagcgtgccatctgcgaaacagaggagatcgcagatggcacgctataacctggcggcagcgcaaaagatg

SEQ ID NO: 26495 - DNA, 103 bp, Artificial Sequence
  Synthetic Polynucleotide
taatacgactcactatagggttttcagccctcttgtaatagcgtgccatcaacagaggagagatggcatgctattacaaaacctggcggcagcgcaaaagatg

SEQ ID NO: 26496 - DNA, 103 bp, Artificial Sequence
  Synthetic Polynucleotide
taatacgactcactatagggctctcttttcagccctcttgtaatagcgtgaacagaggagacacgctatgacaagagggaacctggcggcagcgcaaaagatg

SEQ ID NO: 26497 - DNA, 103 bp, Artificial Sequence
  Synthetic Polynucleotide
taatacgactcactatagggcatctctctcttttcagccctcttgtaataaacagaggagatattacatgagggctgaaaacctggcggcagcgcaaaagatg

SEQ ID NO: 26498 - DNA, 103 bp, Artificial Sequence
  Synthetic Polynucleotide
taatacgactcactatagggcccgcatagtaaataccttttagggtgtgtaacagaggagaacacacatgaaaaggtataacctggcggcagcgcaaaagatg

SEQ ID NO: 26499 - DNA, 103 bp, Artificial Sequence
  Synthetic Polynucleotide
taatacgactcactatagggaacggcatctctctcttttcagccctcttgaacagaggagacaagagatgtgaaaagagaacctggcggcagcgcaaaagatg

SEQ ID NO: 26500 - DNA, 103 bp, Artificial Sequence
  Synthetic Polynucleotide
taatacgactcactatagggttgtaaacggcatctctctcttttcagcccaacagaggagagggctgatgagagagagaaacctggcggcagcgcaaaagatg

SEQ ID NO: 26501 - DNA, 103 bp, Artificial Sequence
  Synthetic Polynucleotide
taatacgactcactatagggccattttgtaaacggcatctctctcttttcaacagaggagagaaaagatggagatgccgaacctggcggcagcgcaaaagatg

SEQ ID NO: 26502 - DNA, 103 bp, Artificial Sequence
  Synthetic Polynucleotide
taatacgactcactataggggtcagccattttgtaaacggcatctctctcaacagaggagagagagaatggccgtttacaacctggcggcagcgcaaaagatg

SEQ ID NO: 26503 - DNA, 103 bp, Artificial Sequence
  Synthetic Polynucleotide
taatacgactcactatagggagcgagtcagccattttgtaaacggcatctaacagaggagaagatgcatgttacaaaataacctggcggcagcgcaaaagatg

SEQ ID NO: 26504 - DNA, 103 bp, Artificial Sequence
  Synthetic Polynucleotide
taatacgactcactatagggtatgcagcgagtcagccattttgtaaacggaacagaggagaccgtttatgaaatggctgaacctggcggcagcgcaaaagatg

SEQ ID NO: 26505 - DNA, 103 bp, Artificial Sequence
  Synthetic Polynucleotide
taatacgactcactatagggtagtctatgcagcgagtcagccattttgtaaacagaggagatacaaaatggctgactcgaacctggcggcagcgcaaaagatg

SEQ ID NO: 26506 - DNA, 103 bp, Artificial Sequence
  Synthetic Polynucleotide
taatacgactcactatagggctacatagtctatgcagcgagtcagccattaacagaggagaaatggcatgctcgctgcaaacctggcggcagcgcaaaagatg

SEQ ID NO: 26507 - DNA, 103 bp, Artificial Sequence
  Synthetic Polynucleotide
taatacgactcactatagggcccatctacatagtctatgcagcgagtcagaacagaggagactgactatgtgcatagacaacctggcggcagcgcaaaagatg

SEQ ID NO: 26508 - DNA, 103 bp, Artificial Sequence
  Synthetic Polynucleotide
taatacgactcactatagggccatccccatctacatagtctatgcagcgaaacagaggagatcgctgatgagactatgtaacctggcggcagcgcaaaagatg

SEQ ID NO: 26509 - DNA, 103 bp, Artificial Sequence
  Synthetic Polynucleotide
taatacgactcactatagggactggcccgcatagtaaataccttttagggaacagaggagaccctaaatggtatttactaacctggcggcagcgcaaaagatg

SEQ ID NO: 26510 - DNA, 103 bp, Artificial Sequence
  Synthetic Polynucleotide
taatacgactcactatagggaatccccatccccatctacatagtctatgcaacagaggagagcatagatgatgtagatgaacctggcggcagcgcaaaagatg

SEQ ID NO: 26511 - DNA, 103 bp, Artificial Sequence
  Synthetic Polynucleotide
taatacgactcactatagggcctccaatccccatccccatctacatagtcaacagaggagagactatatggatggggataacctggcggcagcgcaaaagatg

SEQ ID NO: 26512 - DNA, 103 bp, Artificial Sequence
  Synthetic Polynucleotide
taatacgactcactatagggattatcctccaatccccatccccatctacaaacagaggagatgtagaatgggatggggaaacctggcggcagcgcaaaagatg

SEQ ID NO: 26513 - DNA, 103 bp, Artificial Sequence
  Synthetic Polynucleotide
taatacgactcactatagggttacaattatcctccaatccccatccccataacagaggagaatggggatggggattggaaacctggcggcagcgcaaaagatg

SEQ ID NO: 26514 - DNA, 103 bp, Artificial Sequence
  Synthetic Polynucleotide
taatacgactcactatagggaaattttacaattatcctccaatccccatcaacagaggagagatgggatgtggaggataaacctggcggcagcgcaaaagatg

SEQ ID NO: 26515 - DNA, 103 bp, Artificial Sequence
  Synthetic Polynucleotide
taatacgactcactatagggctaagaaattttacaattatcctccaatccaacagaggagaggattgatggataattgtaacctggcggcagcgcaaaagatg

SEQ ID NO: 26516 - DNA, 103 bp, Artificial Sequence
  Synthetic Polynucleotide
taatacgactcactataggggatatctaagaaattttacaattatcctccaacagaggagaggaggaatgttgtaaaataacctggcggcagcgcaaaagatg

SEQ ID NO: 26517 - DNA, 103 bp, Artificial Sequence
  Synthetic Polynucleotide
taatacgactcactatagggatgttgatatctaagaaattttacaattataacagaggagaataattatgaaatttcttaacctggcggcagcgcaaaagatg

SEQ ID NO: 26518 - DNA, 103 bp, Artificial Sequence
  Synthetic Polynucleotide
taatacgactcactatagggtttatatgttgatatctaagaaattttacaaacagaggagatgtaaaatgtcttagataaacctggcggcagcgcaaaagatg

SEQ ID NO: 26519 - DNA, 103 bp, Artificial Sequence
  Synthetic Polynucleotide
taatacgactcactatagggcaaaatttatatgttgatatctaagaaattaacagaggagaaatttcatggatatcaacaacctggcggcagcgcaaaagatg

SEQ ID NO: 26520 - DNA, 103 bp, Artificial Sequence
  Synthetic Polynucleotide
taatacgactcactatagggtggacactggcccgcatagtaaatacctttaacagaggagaaaaggtatgtactatgcgaacctggcggcagcgcaaaagatg

SEQ ID NO: 26521 - DNA, 103 bp, Artificial Sequence
  Synthetic Polynucleotide
taatacgactcactatagggattcacaaaatttatatgttgatatctaagaacagaggagacttagaatgcaacatataaacctggcggcagcgcaaaagatg

SEQ ID NO: 26522 - DNA, 103 bp, Artificial Sequence
  Synthetic Polynucleotide
taatacgactcactatagggatgaaattcacaaaatttatatgttgatataacagaggagaatatcaatgtataaatttaacctggcggcagcgcaaaagatg

SEQ ID NO: 26523 - DNA, 103 bp, Artificial Sequence
  Synthetic Polynucleotide
taatacgactcactatagggcacacatgaaattcacaaaatttatatgttaacagaggagaaacataatgattttgtgaaacctggcggcagcgcaaaagatg

SEQ ID NO: 26524 - DNA, 103 bp, Artificial Sequence
  Synthetic Polynucleotide
taatacgactcactatagggcagtacacacatgaaattcacaaaatttataacagaggagaataaatatggtgaatttcaacctggcggcagcgcaaaagatg

SEQ ID NO: 26525 - DNA, 103 bp, Artificial Sequence
  Synthetic Polynucleotide
taatacgactcactatagggtctttcagtacacacatgaaattcacaaaaaacagaggagattttgtatgtttcatgtgaacctggcggcagcgcaaaagatg

SEQ ID NO: 26526 - DNA, 103 bp, Artificial Sequence
  Synthetic Polynucleotide
taatacgactcactatagggaaaagtctttcagtacacacatgaaattcaaacagaggagatgaattatgtgtgtgtacaacctggcggcagcgcaaaagatg

SEQ ID NO: 26527 - DNA, 103 bp, Artificial Sequence
  Synthetic Polynucleotide
taatacgactcactatagggatgaaaaaagtctttcagtacacacatgaaaacagaggagattcatgatggtactgaaaaacctggcggcagcgcaaaagatg

SEQ ID NO: 26528 - DNA, 103 bp, Artificial Sequence
  Synthetic Polynucleotide
taatacgactcactatagggctactatgaaaaaagtctttcagtacacacaacagaggagagtgtgtatggaaagacttaacctggcggcagcgcaaaagatg

SEQ ID NO: 26529 - DNA, 103 bp, Artificial Sequence
  Synthetic Polynucleotide
taatacgactcactatagggttggtctactatgaaaaaagtctttcagtaaacagaggagatactgaatgacttttttcaacctggcggcagcgcaaaagatg

SEQ ID NO: 26530 - DNA, 103 bp, Artificial Sequence
  Synthetic Polynucleotide
taatacgactcactataggggtgctttggtctactatgaaaaaagtctttaacagaggagaaaagacatgtttcatagtaacctggcggcagcgcaaaagatg

SEQ ID NO: 26531 - DNA, 103 bp, Artificial Sequence
  Synthetic Polynucleotide
taatacgactcactatagggtcttttggacactggcccgcatagtaaataaacagaggagatatttaatgtgcgggccaaacctggcggcagcgcaaaagatg

SEQ ID NO: 26532 - DNA, 103 bp, Artificial Sequence
  Synthetic Polynucleotide
taatacgactcactatagggcagttgtgctttggtctactatgaaaaaagaacagaggagactttttatgtagtagaccaacctggcggcagcgcaaaagatg

SEQ ID NO: 26533 - DNA, 103 bp, Artificial Sequence
  Synthetic Polynucleotide
taatacgactcactatagggctatgcagttgtgctttggtctactatgaaaacagaggagattcataatggaccaaagcaacctggcggcagcgcaaaagatg

SEQ ID NO: 26534 - DNA, 103 bp, Artificial Sequence
  Synthetic Polynucleotide
taatacgactcactatagggtagcactatgcagttgtgctttggtctactaacagaggagaagtagaatgaagcacaacaacctggcggcagcgcaaaagatg

SEQ ID NO: 26535 - DNA, 103 bp, Artificial Sequence
  Synthetic Polynucleotide
taatacgactcactatagggccatatagcactatgcagttgtgctttggtaacagaggagaaccaaaatgcaactgcataacctggcggcagcgcaaaagatg

SEQ ID NO: 26536 - DNA, 103 bp, Artificial Sequence
  Synthetic Polynucleotide
taatacgactcactataggggtggtccatatagcactatgcagttgtgctaacagaggagaagcacaatggcatagtgcaacctggcggcagcgcaaaagatg

SEQ ID NO: 26537 - DNA, 103 bp, Artificial Sequence
  Synthetic Polynucleotide
taatacgactcactatagggatttggtggtccatatagcactatgcagttaacagaggagaaactgcatggtgctatataacctggcggcagcgcaaaagatg

SEQ ID NO: 26538 - DNA, 103 bp, Artificial Sequence
  Synthetic Polynucleotide
taatacgactcactatagggcctgtatttggtggtccatatagcactatgaacagaggagacatagtatgatatggaccaacctggcggcagcgcaaaagatg

SEQ ID NO: 26539 - DNA, 103 bp, Artificial Sequence
  Synthetic Polynucleotide
taatacgactcactatagggatttgcctgtatttggtggtccatatagcaaacagaggagatgctatatggaccaccaaaacctggcggcagcgcaaaagatg

SEQ ID NO: 26540 - DNA, 103 bp, Artificial Sequence
  Synthetic Polynucleotide
taatacgactcactatagggcaatgatttgcctgtatttggtggtccataaacagaggagatatggaatgccaaatacaaacctggcggcagcgcaaaagatg

SEQ ID NO: 26541 - DNA, 103 bp, Artificial Sequence
  Synthetic Polynucleotide
taatacgactcactataggggcaaacaatgatttgcctgtatttggtggtaacagaggagaaccaccatgtacaggcaaaacctggcggcagcgcaaaagatg

SEQ ID NO: 26542 - DNA, 103 bp, Artificial Sequence
  Synthetic Polynucleotide
taatacgactcactataggggtttatcttttggacactggcccgcatagtaacagaggagaactatgatggccagtgtcaacctggcggcagcgcaaaagatg

SEQ ID NO: 26543 - DNA, 103 bp, Artificial Sequence
  Synthetic Polynucleotide
taatacgactcactatagggtcattgcaaacaatgatttgcctgtatttgaacagaggagacaaataatggcaaatcataacctggcggcagcgcaaaagatg

SEQ ID NO: 26544 - DNA, 103 bp, Artificial Sequence
  Synthetic Polynucleotide
taatacgactcactatagggaaggctcattgcaaacaatgatttgcctgtaacagaggagaacaggcatgtcattgtttaacctggcggcagcgcaaaagatg

SEQ ID NO: 26545 - DNA, 103 bp, Artificial Sequence
  Synthetic Polynucleotide
taatacgactcactatagggtccagaaggctcattgcaaacaatgatttgaacagaggagacaaatcatggtttgcaataacctggcggcagcgcaaaagatg

SEQ ID NO: 26546 - DNA, 103 bp, Artificial Sequence
  Synthetic Polynucleotide
taatacgactcactatagggaaaattccagaaggctcattgcaaacaatgaacagaggagacattgtatgcaatgagccaacctggcggcagcgcaaaagatg

SEQ ID NO: 26547 - DNA, 103 bp, Artificial Sequence
  Synthetic Polynucleotide
taatacgactcactatagggatgcaaaaattccagaaggctcattgcaaaaacagaggagatttgcaatgagccttctgaacctggcggcagcgcaaaagatg

SEQ ID NO: 26548 - DNA, 103 bp, Artificial Sequence
  Synthetic Polynucleotide
taatacgactcactatagggtttccatgcaaaaattccagaaggctcattaacagaggagaaatgagatgtctggaattaacctggcggcagcgcaaaagatg

SEQ ID NO: 26549 - DNA, 103 bp, Artificial Sequence
  Synthetic Polynucleotide
taatacgactcactatagggtaacctttccatgcaaaaattccagaaggcaacagaggagagccttcatgaatttttgcaacctggcggcagcgcaaaagatg

SEQ ID NO: 26550 - DNA, 103 bp, Artificial Sequence
  Synthetic Polynucleotide
taatacgactcactatagggtgaaataacctttccatgcaaaaattccagaacagaggagactggaaatgttgcatggaaacctggcggcagcgcaaaagatg

SEQ ID NO: 26551 - DNA, 103 bp, Artificial Sequence
  Synthetic Polynucleotide
taatacgactcactataggggcaaatgaaataacctttccatgcaaaaataacagaggagaatttttatgtggaaaggtaacctggcggcagcgcaaaagatg

SEQ ID NO: 26552 - DNA, 103 bp, Artificial Sequence
  Synthetic Polynucleotide
taatacgactcactatagggcattagcaaatgaaataacctttccatgcaaacagaggagatgcatgatgaggttatttaacctggcggcagcgcaaaagatg

SEQ ID NO: 26553 - DNA, 103 bp, Artificial Sequence
  Synthetic Polynucleotide
taatacgactcactataggggctaggtttatcttttggacactggcccgcaacagaggagagcgggcatgtgtccaaaaaacctggcggcagcgcaaaagatg

SEQ ID NO: 26554 - DNA, 103 bp, Artificial Sequence
  Synthetic Polynucleotide
taatacgactcactatagggtcttgcattagcaaatgaaataacctttccaacagaggagaggaaagatgatttcatttaacctggcggcagcgcaaaagatg

SEQ ID NO: 26555 - DNA, 103 bp, Artificial Sequence
  Synthetic Polynucleotide
taatacgactcactatagggtggcttcttgcattagcaaatgaaataaccaacagaggagaggttatatgatttgctaaaacctggcggcagcgcaaaagatg

SEQ ID NO: 26556 - DNA, 103 bp, Artificial Sequence
  Synthetic Polynucleotide
taatacgactcactatagggagaagtggcttcttgcattagcaaatgaaaaacagaggagatttcatatgctaatgcaaaacctggcggcagcgcaaaagatg

SEQ ID NO: 26557 - DNA, 103 bp, Artificial Sequence
  Synthetic Polynucleotide
taatacgactcactatagggcagccagaagtggcttcttgcattagcaaaaacagaggagatttgctatggcaagaagcaacctggcggcagcgcaaaagatg

SEQ ID NO: 26558 - DNA, 103 bp, Artificial Sequence
  Synthetic Polynucleotide
taatacgactcactataggggggctcagccagaagtggcttcttgcattaaacagaggagataatgcatgaagccacttaacctggcggcagcgcaaaagatg

SEQ ID NO: 26559 - DNA, 103 bp, Artificial Sequence
  Synthetic Polynucleotide
taatacgactcactatagggctagtgggctcagccagaagtggcttcttgaacagaggagacaagaaatgacttctggcaacctggcggcagcgcaaaagatg

SEQ ID NO: 26560 - DNA, 103 bp, Artificial Sequence
  Synthetic Polynucleotide
taatacgactcactataggggtctgctagtgggctcagccagaagtggctaacagaggagaagccacatgtggctgagcaacctggcggcagcgcaaaagatg

SEQ ID NO: 26561 - DNA, 103 bp, Artificial Sequence
  Synthetic Polynucleotide
taatacgactcactatagggttacagtctgctagtgggctcagccagaagaacagaggagacttctgatggagcccactaacctggcggcagcgcaaaagatg

SEQ ID NO: 26562 - DNA, 103 bp, Artificial Sequence
  Synthetic Polynucleotide
taatacgactcactatagggcaaatttacagtctgctagtgggctcagccaacagaggagaggctgaatgcactagcagaacctggcggcagcgcaaaagatg

SEQ ID NO: 26563 - DNA, 103 bp, Artificial Sequence
  Synthetic Polynucleotide
taatacgactcactataggggacagcaaatttacagtctgctagtgggctaacagaggagaagcccaatggcagactgtaacctggcggcagcgcaaaagatg

SEQ ID NO: 26564 - DNA, 103 bp, Artificial Sequence
  Synthetic Polynucleotide
taatacgactcactatagggtgcaaccagtagtttcccaactagcaaggtaacagaggagaaccttgatggttgggaaaaacctggcggcagcgcaaaagatg

SEQ ID NO: 26565 - DNA, 103 bp, Artificial Sequence
  Synthetic Polynucleotide
taatacgactcactataggggcagggctaggtttatcttttggacactggaacagaggagaccagtgatgaaaagataaaacctggcggcagcgcaaaagatg

SEQ ID NO: 26566 - DNA, 103 bp, Artificial Sequence
  Synthetic Polynucleotide
taatacgactcactatagggtctaagacagcaaatttacagtctgctagtaacagaggagaactagcatgctgtaaattaacctggcggcagcgcaaaagatg

SEQ ID NO: 26567 - DNA, 103 bp, Artificial Sequence
  Synthetic Polynucleotide
taatacgactcactatagggcatcgtctaagacagcaaatttacagtctgaacagaggagacagactatgaatttgctgaacctggcggcagcgcaaaagatg

SEQ ID NO: 26568 - DNA, 103 bp, Artificial Sequence
  Synthetic Polynucleotide
taatacgactcactatagggagtggcatcgtctaagacagcaaatttacaaacagaggagatgtaaaatggctgtcttaaacctggcggcagcgcaaaagatg

SEQ ID NO: 26569 - DNA, 103 bp, Artificial Sequence
  Synthetic Polynucleotide
taatacgactcactatagggggtacagtggcatcgtctaagacagcaaataacagaggagaatttgcatgcttagacgaaacctggcggcagcgcaaaagatg

SEQ ID NO: 26570 - DNA, 103 bp, Artificial Sequence
  Synthetic Polynucleotide
taatacgactcactatagggatgtgggtacagtggcatcgtctaagacagaacagaggagactgtctatgacgatgccaaacctggcggcagcgcaaaagatg

SEQ ID NO: 26571 - DNA, 103 bp, Artificial Sequence
  Synthetic Polynucleotide
taatacgactcactatagggattccatgtgggtacagtggcatcgtctaaaacagaggagattagacatggccactgtaaacctggcggcagcgcaaaagatg

SEQ ID NO: 26572 - DNA, 103 bp, Artificial Sequence
  Synthetic Polynucleotide
taatacgactcactatagggaagtaattccatgtgggtacagtggcatcgaacagaggagacgatgcatgtgtacccacaacctggcggcagcgcaaaagatg

SEQ ID NO: 26573 - DNA, 103 bp, Artificial Sequence
  Synthetic Polynucleotide
taatacgactcactatagggtatcaaagtaattccatgtgggtacagtggaacagaggagaccactgatgccacatggaaacctggcggcagcgcaaaagatg

SEQ ID NO: 26574 - DNA, 103 bp, Artificial Sequence
  Synthetic Polynucleotide
taatacgactcactatagggatatatatcaaagtaattccatgtgggtacaacagaggagagtacccatgtggaattacaacctggcggcagcgcaaaagatg

SEQ ID NO: 26575 - DNA, 103 bp, Artificial Sequence
  Synthetic Polynucleotide
taatacgactcactatagggctcatatatatatcaaagtaattccatgtgaacagaggagacacatgatgttactttgaaacctggcggcagcgcaaaagatg

SEQ ID NO: 26576 - DNA, 103 bp, Artificial Sequence
  Synthetic Polynucleotide
taatacgactcactatagggcctgcgcagggctaggtttatcttttggacaacagaggagagtccaaatgataaacctaaacctggcggcagcgcaaaagatg

SEQ ID NO: 26577 - DNA, 103 bp, Artificial Sequence
  Synthetic Polynucleotide
taatacgactcactatagggcatttctcatatatatatcaaagtaattccaacagaggagaggaattatgttgatatataacctggcggcagcgcaaaagatg

SEQ ID NO: 26578 - DNA, 103 bp, Artificial Sequence
  Synthetic Polynucleotide
taatacgactcactatagggaagagcatttctcatatatatatcaaagtaaacagaggagatactttatgatatatatgaacctggcggcagcgcaaaagatg

SEQ ID NO: 26579 - DNA, 103 bp, Artificial Sequence
  Synthetic Polynucleotide
taatacgactcactatagggccatcaagagcatttctcatatatatatcaaacagaggagatgatatatgtatgagaaaaacctggcggcagcgcaaaagatg

SEQ ID NO: 26580 - DNA, 103 bp, Artificial Sequence
  Synthetic Polynucleotide
taatacgactcactatagggaattaccatcaagagcatttctcatatataaacagaggagatatataatggaaatgctcaacctggcggcagcgcaaaagatg

SEQ ID NO: 26581 - DNA, 103 bp, Artificial Sequence
  Synthetic Polynucleotide
taatacgactcactatagggaacataattaccatcaagagcatttctcataacagaggagaatgagaatggctcttgataacctggcggcagcgcaaaagatg

SEQ ID NO: 26582 - DNA, 103 bp, Artificial Sequence
  Synthetic Polynucleotide
taatacgactcactatagggacacaaacataattaccatcaagagcatttaacagaggagaaaatgcatgtgatggtaaaacctggcggcagcgcaaaagatg

SEQ ID NO: 26583 - DNA, 103 bp, Artificial Sequence
  Synthetic Polynucleotide
taatacgactcactatagggtgtctacacaaacataattaccatcaagagaacagaggagactcttgatggtaattatgaacctggcggcagcgcaaaagatg

SEQ ID NO: 26584 - DNA, 103 bp, Artificial Sequence
  Synthetic Polynucleotide
taatacgactcactatagggttttgtgtctacacaaacataattaccatcaacagaggagagatggtatgtatgtttgtaacctggcggcagcgcaaaagatg

SEQ ID NO: 26585 - DNA, 103 bp, Artificial Sequence
  Synthetic Polynucleotide
taatacgactcactatagggttatgttttgtgtctacacaaacataattaaacagaggagataattaatgttgtgtagaaacctggcggcagcgcaaaagatg

SEQ ID NO: 26586 - DNA, 103 bp, Artificial Sequence
  Synthetic Polynucleotide
taatacgactcactataggggctgtttatgttttgtgtctacacaaacataacagaggagaatgtttatgtagacacaaaacctggcggcagcgcaaaagatg

SEQ ID NO: 26587 - DNA, 103 bp, Artificial Sequence
  Synthetic Polynucleotide
taatacgactcactataggggagcacctgcgcagggctaggtttatctttaacagaggagaaaagatatgcctagccctaacctggcggcagcgcaaaagatg

SEQ ID NO: 26588 - DNA, 103 bp, Artificial Sequence
  Synthetic Polynucleotide
taatacgactcactatagggcactggctgtttatgttttgtgtctacacaaacagaggagatgtgtaatgacaaaacataacctggcggcagcgcaaaagatg

SEQ ID NO: 26589 - DNA, 103 bp, Artificial Sequence
  Synthetic Polynucleotide
taatacgactcactatagggatctgcactggctgtttatgttttgtgtctaacagaggagaagacacatgacataaacaaacctggcggcagcgcaaaagatg

SEQ ID NO: 26590 - DNA, 103 bp, Artificial Sequence
  Synthetic Polynucleotide
taatacgactcactatagggtcttgatctgcactggctgtttatgttttgaacagaggagacaaaacatgaacagccagaacctggcggcagcgcaaaagatg

SEQ ID NO: 26591 - DNA, 103 bp, Artificial Sequence
  Synthetic Polynucleotide
taatacgactcactataggggggtatcttgatctgcactggctgtttatgaacagaggagacataaaatgccagtgcagaacctggcggcagcgcaaaagatg

SEQ ID NO: 26592 - DNA, 103 bp, Artificial Sequence
  Synthetic Polynucleotide
taatacgactcactatagggagtgggggtatcttgatctgcactggctgtaacagaggagaacagccatggcagatcaaaacctggcggcagcgcaaaagatg

SEQ ID NO: 26593 - DNA, 103 bp, Artificial Sequence
  Synthetic Polynucleotide
taatacgactcactatagggttagcagtgggggtatcttgatctgcactgaacagaggagacagtgcatgtcaagatacaacctggcggcagcgcaaaagatg

SEQ ID NO: 26594 - DNA, 103 bp, Artificial Sequence
  Synthetic Polynucleotide
taatacgactcactatagggtgtaattagcagtgggggtatcttgatctgaacagaggagacagatcatgatacccccaaacctggcggcagcgcaaaagatg

SEQ ID NO: 26595 - DNA, 103 bp, Artificial Sequence
  Synthetic Polynucleotide
taatacgactcactatagggttacttgtaattagcagtgggggtatcttgaacagaggagacaagatatgcccactgctaacctggcggcagcgcaaaagatg

SEQ ID NO: 26596 - DNA, 103 bp, Artificial Sequence
  Synthetic Polynucleotide
taatacgactcactatagggtatgattacttgtaattagcagtgggggtaaacagaggagataccccatgtgctaattaaacctggcggcagcgcaaaagatg

SEQ ID NO: 26597 - DNA, 103 bp, Artificial Sequence
  Synthetic Polynucleotide
taatacgactcactataggggacattatgattacttgtaattagcagtggaacagaggagaccactgatgattacaagtaacctggcggcagcgcaaaagatg

SEQ ID NO: 26598 - DNA, 103 bp, Artificial Sequence
  Synthetic Polynucleotide
taatacgactcactatagggataatgagcacctgcgcagggctaggtttaaacagaggagataaaccatgccctgcgcaaacctggcggcagcgcaaaagatg

SEQ ID NO: 26599 - DNA, 103 bp, Artificial Sequence
  Synthetic Polynucleotide
taatacgactcactataggggccaagacattatgattacttgtaattagcaacagaggagagctaatatgaagtaatcaaacctggcggcagcgcaaaagatg

SEQ ID NO: 26600 - DNA, 103 bp, Artificial Sequence
  Synthetic Polynucleotide
taatacgactcactatagggcatcagccaagacattatgattacttgtaaaacagaggagattacaaatgatcataatgaacctggcggcagcgcaaaagatg

SEQ ID NO: 26601 - DNA, 103 bp, Artificial Sequence
  Synthetic Polynucleotide
taatacgactcactatagggtttagcatcagccaagacattatgattactaacagaggagaagtaatatgaatgtcttgaacctggcggcagcgcaaaagatg

SEQ ID NO: 26602 - DNA, 103 bp, Artificial Sequence
  Synthetic Polynucleotide
taatacgactcactatagggacatatttagcatcagccaagacattatgaaacagaggagatcataaatgcttggctgaaacctggcggcagcgcaaaagatg

SEQ ID NO: 26603 - DNA, 103 bp, Artificial Sequence
  Synthetic Polynucleotide
taatacgactcactatagggaatacacatatttagcatcagccaagacataacagaggagaatgtctatgctgatgctaaacctggcggcagcgcaaaagatg

SEQ ID NO: 26604 - DNA, 103 bp, Artificial Sequence
  Synthetic Polynucleotide
taatacgactcactatagggatgcaaatacacatatttagcatcagccaaaacagaggagattggctatggctaaatataacctggcggcagcgcaaaagatg

SEQ ID NO: 26605 - DNA, 103 bp, Artificial Sequence
  Synthetic Polynucleotide
taatacgactcactatagggctgctatgcaaatacacatatttagcatcaaacagaggagatgatgcatgatatgtgtaaacctggcggcagcgcaaaagatg

SEQ ID NO: 26606 - DNA, 103 bp, Artificial Sequence
  Synthetic Polynucleotide
taatacgactcactataggggcaatctgctatgcaaatacacatatttagaacagaggagactaaatatgtgtatttgcaacctggcggcagcgcaaaagatg

SEQ ID NO: 26607 - DNA, 103 bp, Artificial Sequence
  Synthetic Polynucleotide
taatacgactcactatagggcccttgcaatctgctatgcaaatacacataaacagaggagatatgtgatgttgcatagcaacctggcggcagcgcaaaagatg

SEQ ID NO: 26608 - DNA, 103 bp, Artificial Sequence
  Synthetic Polynucleotide
taatacgactcactatagggtcaaacccttgcaatctgctatgcaaatacaacagaggagagtatttatgtagcagattaacctggcggcagcgcaaaagatg

SEQ ID NO: 26609 - DNA, 103 bp, Artificial Sequence
  Synthetic Polynucleotide
taatacgactcactatagggcttaaataatgagcacctgcgcagggctagaacagaggagactagccatgcgcaggtgcaacctggcggcagcgcaaaagatg

SEQ ID NO: 26610 - DNA, 103 bp, Artificial Sequence
  Synthetic Polynucleotide
taatacgactcactatagggggaattcaaacccttgcaatctgctatgcaaacagaggagatgcataatggattgcaagaacctggcggcagcgcaaaagatg

SEQ ID NO: 26611 - DNA, 103 bp, Artificial Sequence
  Synthetic Polynucleotide
taatacgactcactatagggatttgggaattcaaacccttgcaatctgctaacagaggagaagcagaatgcaagggtttaacctggcggcagcgcaaaagatg

SEQ ID NO: 26612 - DNA, 103 bp, Artificial Sequence
  Synthetic Polynucleotide
taatacgactcactatagggaactcatttgggaattcaaacccttgcaataacagaggagaattgcaatggtttgaattaacctggcggcagcgcaaaagatg

SEQ ID NO: 26613 - DNA, 103 bp, Artificial Sequence
  Synthetic Polynucleotide
taatacgactcactataggggtggaaactcatttgggaattcaaacccttaacagaggagaaagggtatgaattcccaaaacctggcggcagcgcaaaagatg

SEQ ID NO: 26614 - DNA, 103 bp, Artificial Sequence
  Synthetic Polynucleotide
taatacgactcactatagggagtaagtggaaactcatttgggaattcaaaaacagaggagatttgaaatgccaaatgagaacctggcggcagcgcaaaagatg

SEQ ID NO: 26615 - DNA, 103 bp, Artificial Sequence
  Synthetic Polynucleotide
taatacgactcactatagggttatcagtaagtggaaactcatttgggaataacagaggagaattcccatgtgagtttccaacctggcggcagcgcaaaagatg

SEQ ID NO: 26616 - DNA, 103 bp, Artificial Sequence
  Synthetic Polynucleotide
taatacgactcactatagggatccattatcagtaagtggaaactcatttgaacagaggagacaaatgatgttccacttaaacctggcggcagcgcaaaagatg

SEQ ID NO: 26617 - DNA, 103 bp, Artificial Sequence
  Synthetic Polynucleotide
taatacgactcactatagggaggatatccattatcagtaagtggaaactcaacagaggagagagtttatgcttactgataacctggcggcagcgcaaaagatg

SEQ ID NO: 26618 - DNA, 103 bp, Artificial Sequence
  Synthetic Polynucleotide
taatacgactcactatagggaatgcaggatatccattatcagtaagtggaaacagaggagatccactatgtgataatggaacctggcggcagcgcaaaagatg

SEQ ID NO: 26619 - DNA, 103 bp, Artificial Sequence
  Synthetic Polynucleotide
taatacgactcactataggggctgaaatgcaggatatccattatcagtaaaacagaggagattactgatgatggatatcaacctggcggcagcgcaaaagatg

SEQ ID NO: 26620 - DNA, 103 bp, Artificial Sequence
  Synthetic Polynucleotide
taatacgactcactataggggccagcttaaataatgagcacctgcgcaggaacagaggagacctgcgatggtgctcattaacctggcggcagcgcaaaagatg

SEQ ID NO: 26621 - DNA, 103 bp, Artificial Sequence
  Synthetic Polynucleotide
taatacgactcactatagggagtaagctgaaatgcaggatatccattatcaacagaggagagataatatgtatcctgcaaacctggcggcagcgcaaaagatg

SEQ ID NO: 26622 - DNA, 103 bp, Artificial Sequence
  Synthetic Polynucleotide
taatacgactcactatagggtgtgaagtaagctgaaatgcaggatatccaaacagaggagatggataatgtgcatttcaaacctggcggcagcgcaaaagatg

SEQ ID NO: 26623 - DNA, 103 bp, Artificial Sequence
  Synthetic Polynucleotide
taatacgactcactatagggaattttgtgaagtaagctgaaatgcaggataacagaggagaatcctgatgttcagcttaaacctggcggcagcgcaaaagatg

SEQ ID NO: 26624 - DNA, 103 bp, Artificial Sequence
  Synthetic Polynucleotide
taatacgactcactatagggtttccaattttgtgaagtaagctgaaatgcaacagaggagagcatttatgcttacttcaaacctggcggcagcgcaaaagatg

SEQ ID NO: 26625 - DNA, 103 bp, Artificial Sequence
  Synthetic Polynucleotide
taatacgactcactatagggaaagctttccaattttgtgaagtaagctgaaacagaggagatcagctatgttcacaaaaaacctggcggcagcgcaaaagatg

SEQ ID NO: 26626 - DNA, 103 bp, Artificial Sequence
  Synthetic Polynucleotide
taatacgactcactatagggcaaagaaagctttccaattttgtgaagtaaaacagaggagattacttatgaaaattggaaacctggcggcagcgcaaaagatg

SEQ ID NO: 26627 - DNA, 103 bp, Artificial Sequence
  Synthetic Polynucleotide
taatacgactcactatagggtttcacaaagaaagctttccaattttgtgaaacagaggagatcacaaatgtggaaagctaacctggcggcagcgcaaaagatg

SEQ ID NO: 26628 - DNA, 103 bp, Artificial Sequence
  Synthetic Polynucleotide
taatacgactcactatagggctaaatttcacaaagaaagctttccaatttaacagaggagaaaattgatgagctttcttaacctggcggcagcgcaaaagatg

SEQ ID NO: 26629 - DNA, 103 bp, Artificial Sequence
  Synthetic Polynucleotide
taatacgactcactataggggacttctaaatttcacaaagaaagctttccaacagaggagaggaaagatgtctttgtgaaacctggcggcagcgcaaaagatg

SEQ ID NO: 26630 - DNA, 103 bp, Artificial Sequence
  Synthetic Polynucleotide
taatacgactcactatagggtaactgacttctaaatttcacaaagaaagcaacagaggagagctttcatggtgaaatttaacctggcggcagcgcaaaagatg

SEQ ID NO: 26631 - DNA, 103 bp, Artificial Sequence
  Synthetic Polynucleotide
taatacgactcactatagggttctggccagcttaaataatgagcacctgcaacagaggagagcaggtatgcattatttaaacctggcggcagcgcaaaagatg

SEQ ID NO: 26632 - DNA, 103 bp, Artificial Sequence
  Synthetic Polynucleotide
taatacgactcactatagggagatctaactgacttctaaatttcacaaagaacagaggagactttgtatgatttagaagaacctggcggcagcgcaaaagatg

SEQ ID NO: 26633 - DNA, 103 bp, Artificial Sequence
  Synthetic Polynucleotide
taatacgactcactatagggcagggagatctaactgacttctaaatttcaaacagaggagatgaaatatggaagtcagtaacctggcggcagcgcaaaagatg

SEQ ID NO: 26634 - DNA, 103 bp, Artificial Sequence
  Synthetic Polynucleotide
taatacgactcactatagggtagatcagggagatctaactgacttctaaaaacagaggagatttagaatgcagttagataacctggcggcagcgcaaaagatg

SEQ ID NO: 26635 - DNA, 103 bp, Artificial Sequence
  Synthetic Polynucleotide
taatacgactcactatagggtcttctagatcagggagatctaactgacttaacagaggagaaagtcaatgagatctcccaacctggcggcagcgcaaaagatg

SEQ ID NO: 26636 - DNA, 103 bp, Artificial Sequence
  Synthetic Polynucleotide
taatacgactcactatagggtgctgtcttctagatcagggagatctaactaacagaggagaagttagatgtccctgatcaacctggcggcagcgcaaaagatg

SEQ ID NO: 26637 - DNA, 103 bp, Artificial Sequence
  Synthetic Polynucleotide
taatacgactcactatagggctcactgctgtcttctagatcagggagatcaacagaggagagatctcatggatctagaaaacctggcggcagcgcaaaagatg

SEQ ID NO: 26638 - DNA, 103 bp, Artificial Sequence
  Synthetic Polynucleotide
taatacgactcactatagggccatcctcactgctgtcttctagatcagggaacagaggagaccctgaatgagaagacagaacctggcggcagcgcaaaagatg

SEQ ID NO: 26639 - DNA, 103 bp, Artificial Sequence
  Synthetic Polynucleotide
taatacgactcactatagggtgtcgccatcctcactgctgtcttctagataacagaggagaatctagatgacagcagtgaacctggcggcagcgcaaaagatg

SEQ ID NO: 26640 - DNA, 103 bp, Artificial Sequence
  Synthetic Polynucleotide
taatacgactcactatagggttcaatgtcgccatcctcactgctgtcttcaacagaggagagaagacatgagtgaggataacctggcggcagcgcaaaagatg

SEQ ID NO: 26641 - DNA, 103 bp, Artificial Sequence
  Synthetic Polynucleotide
taatacgactcactatagggggtcgttcaatgtcgccatcctcactgctgaacagaggagacagcagatgggatggcgaaacctggcggcagcgcaaaagatg

SEQ ID NO: 26642 - DNA, 103 bp, Artificial Sequence
  Synthetic Polynucleotide
taatacgactcactataggggtggcttctggccagcttaaataatgagcaaacagaggagatgctcaatgtttaagctgaacctggcggcagcgcaaaagatg

SEQ ID NO: 26643 - DNA, 103 bp, Artificial Sequence
  Synthetic Polynucleotide
taatacgactcactataggggaaacggtcgttcaatgtcgccatcctcacaacagaggagagtgaggatggcgacattgaacctggcggcagcgcaaaagatg

SEQ ID NO: 26644 - DNA, 103 bp, Artificial Sequence
  Synthetic Polynucleotide
taatacgactcactataggggcatcgaaacggtcgttcaatgtcgccatcaacagaggagagatggcatgattgaacgaaacctggcggcagcgcaaaagatg

SEQ ID NO: 26645 - DNA, 103 bp, Artificial Sequence
  Synthetic Polynucleotide
taatacgactcactataggggcaacgcatcgaaacggtcgttcaatgtcgaacagaggagacgacatatgacgaccgttaacctggcggcagcgcaaaagatg

SEQ ID NO: 26646 - DNA, 103 bp, Artificial Sequence
  Synthetic Polynucleotide
taatacgactcactatagggttgttgcaacgcatcgaaacggtcgttcaaaacagaggagattgaacatgcgtttcgataacctggcggcagcgcaaaagatg

SEQ ID NO: 26647 - DNA, 103 bp, Artificial Sequence
  Synthetic Polynucleotide
taatacgactcactatagggtggctttgttgcaacgcatcgaaacggtcgaacagaggagacgaccgatgcgatgcgttaacctggcggcagcgcaaaagatg

SEQ ID NO: 26648 - DNA, 103 bp, Artificial Sequence
  Synthetic Polynucleotide
taatacgactcactatagggccagctggctttgttgcaacgcatcgaaacaacagaggagagtttcgatgcgttgcaacaacctggcggcagcgcaaaagatg

SEQ ID NO: 26649 - DNA, 103 bp, Artificial Sequence
  Synthetic Polynucleotide
taatacgactcactatagggaatgtccagctggctttgttgcaacgcatcaacagaggagagatgcgatgcaacaaagcaacctggcggcagcgcaaaagatg

SEQ ID NO: 26650 - DNA, 103 bp, Artificial Sequence
  Synthetic Polynucleotide
taatacgactcactatagggtcaataatgtccagctggctttgttgcaacaacagaggagagttgcaatgaagccagctaacctggcggcagcgcaaaagatg

SEQ ID NO: 26651 - DNA, 103 bp, Artificial Sequence
  Synthetic Polynucleotide
taatacgactcactatagggctgcttcaataatgtccagctggctttgttaacagaggagaaacaaaatgagctggacaaacctggcggcagcgcaaaagatg

SEQ ID NO: 26652 - DNA, 103 bp, Artificial Sequence
  Synthetic Polynucleotide
taatacgactcactatagggcggttctgcttcaataatgtccagctggctaacagaggagaagccagatggacattattaacctggcggcagcgcaaaagatg

SEQ ID NO: 26653 - DNA, 103 bp, Artificial Sequence
  Synthetic Polynucleotide
taatacgactcactataggggccaagtggcttctggccagcttaaataataacagaggagaattattatggctggccagaacctggcggcagcgcaaaagatg

SEQ ID NO: 26654 - DNA, 103 bp, Artificial Sequence
  Synthetic Polynucleotide
taatacgactcactataggggtccccggttctgcttcaataatgtccagcaacagaggagagctggaatgtattgaagcaacctggcggcagcgcaaaagatg

SEQ ID NO: 26655 - DNA, 103 bp, Artificial Sequence
  Synthetic Polynucleotide
taatacgactcactatagggctagtgtccccggttctgcttcaataatgtaacagaggagaacattaatgaagcagaacaacctggcggcagcgcaaaagatg

SEQ ID NO: 26656 - DNA, 103 bp, Artificial Sequence
  Synthetic Polynucleotide
taatacgactcactatagggatcctctagtgtccccggttctgcttcaataacagaggagaattgaaatggaaccggggaacctggcggcagcgcaaaagatg

SEQ ID NO: 26657 - DNA, 103 bp, Artificial Sequence
  Synthetic Polynucleotide
taatacgactcactatagggatttgatcctctagtgtccccggttctgctaacagaggagaagcagaatgggggacactaacctggcggcagcgcaaaagatg

SEQ ID NO: 26658 - DNA, 103 bp, Artificial Sequence
  Synthetic Polynucleotide
taatacgactcactatagggaaaatatttgatcctctagtgtccccggttaacagaggagaaaccggatgcactagaggaacctggcggcagcgcaaaagatg

SEQ ID NO: 26659 - DNA, 103 bp, Artificial Sequence
  Synthetic Polynucleotide
taatacgactcactatagggccagtaaaatatttgatcctctagtgtcccaacagaggagagggacaatggaggatcaaaacctggcggcagcgcaaaagatg

SEQ ID NO: 26660 - DNA, 103 bp, Artificial Sequence
  Synthetic Polynucleotide
taatacgactcactatagggaagtcccagtaaaatatttgatcctctagtaacagaggagaactagaatgtcaaatattaacctggcggcagcgcaaaagatg

SEQ ID NO: 26661 - DNA, 103 bp, Artificial Sequence
  Synthetic Polynucleotide
taatacgactcactatagggtaagcaagtcccagtaaaatatttgatcctaacagaggagaaggatcatgtattttactaacctggcggcagcgcaaaagatg

SEQ ID NO: 26662 - DNA, 103 bp, Artificial Sequence
  Synthetic Polynucleotide
taatacgactcactatagggttgtctaagcaagtcccagtaaaatatttgaacagaggagacaaataatgtactgggacaacctggcggcagcgcaaaagatg

SEQ ID NO: 26663 - DNA, 103 bp, Artificial Sequence
  Synthetic Polynucleotide
taatacgactcactatagggcgctcttgtctaagcaagtcccagtaaaataacagaggagaattttaatgggacttgctaacctggcggcagcgcaaaagatg

SEQ ID NO: 26664 - DNA, 103 bp, Artificial Sequence
  Synthetic Polynucleotide
taatacgactcactatagggtccatgccaagtggcttctggccagcttaaaacagaggagattaagcatgccagaagccaacctggcggcagcgcaaaagatg

SEQ ID NO: 26665 - DNA, 103 bp, Artificial Sequence
  Synthetic Polynucleotide
taatacgactcactatagggatacacgctcttgtctaagcaagtcccagtaacagaggagaactgggatgtgcttagacaacctggcggcagcgcaaaagatg

SEQ ID NO: 26666 - DNA, 103 bp, Artificial Sequence
  Synthetic Polynucleotide
taatacgactcactatagggctgcaatacacgctcttgtctaagcaagtcaacagaggagagacttgatgagacaagagaacctggcggcagcgcaaaagatg

SEQ ID NO: 26667 - DNA, 103 bp, Artificial Sequence
  Synthetic Polynucleotide
taatacgactcactatagggtaatactgcaatacacgctcttgtctaagcaacagaggagagcttagatgagagcgtgtaacctggcggcagcgcaaaagatg

SEQ ID NO: 26668 - DNA, 103 bp, Artificial Sequence
  Synthetic Polynucleotide
taatacgactcactatagggtcgcataatactgcaatacacgctcttgtcaacagaggagagacaagatggtgtattgcaacctggcggcagcgcaaaagatg

SEQ ID NO: 26669 - DNA, 103 bp, Artificial Sequence
  Synthetic Polynucleotide
taatacgactcactatagggctttctcgcataatactgcaatacacgctcaacagaggagagagcgtatgttgcagtataacctggcggcagcgcaaaagatg

SEQ ID NO: 26670 - DNA, 103 bp, Artificial Sequence
  Synthetic Polynucleotide
taatacgactcactatagggcctttctttctcgcataatactgcaatacaaacagaggagatgtattatggtattatgcaacctggcggcagcgcaaaagatg

SEQ ID NO: 26671 - DNA, 103 bp, Artificial Sequence
  Synthetic Polynucleotide
taatacgactcactatagggtatatcctttctttctcgcataatactgcaaacagaggagatgcagtatgatgcgagaaaacctggcggcagcgcaaaagatg

SEQ ID NO: 26672 - DNA, 103 bp, Artificial Sequence
  Synthetic Polynucleotide
taatacgactcactatagggccttttatatcctttctttctcgcataataaacagaggagatattatatgagaaagaaaaacctggcggcagcgcaaaagatg

SEQ ID NO: 26673 - DNA, 103 bp, Artificial Sequence
  Synthetic Polynucleotide
taatacgactcactatagggcccagccttttatatcctttctttctcgcaaacagaggagatgcgagatggaaaggataaacctggcggcagcgcaaaagatg

SEQ ID NO: 26674 - DNA, 103 bp, Artificial Sequence
  Synthetic Polynucleotide
taatacgactcactataggggcattcccagccttttatatcctttctttcaacagaggagagaaagaatggatataaaaaacctggcggcagcgcaaaagatg

SEQ ID NO: 26675 - DNA, 103 bp, Artificial Sequence
  Synthetic Polynucleotide
taatacgactcactatagggtacagtgcaaccagtagtttcccaactagcaacagaggagagctagtatggaaactactaacctggcggcagcgcaaaagatg

SEQ ID NO: 26676 - DNA, 103 bp, Artificial Sequence
  Synthetic Polynucleotide
taatacgactcactatagggttctttccatgccaagtggcttctggccagaacagaggagactggccatgagccacttgaacctggcggcagcgcaaaagatg

SEQ ID NO: 26677 - DNA, 103 bp, Artificial Sequence
  Synthetic Polynucleotide
taatacgactcactatagggaggtagcattcccagccttttatatcctttaacagaggagaaaaggaatgaaaaggctgaacctggcggcagcgcaaaagatg

SEQ ID NO: 26678 - DNA, 103 bp, Artificial Sequence
  Synthetic Polynucleotide
taatacgactcactatagggggcaaaggtagcattcccagccttttatataacagaggagaatataaatggctgggaataacctggcggcagcgcaaaagatg

SEQ ID NO: 26679 - DNA, 103 bp, Artificial Sequence
  Synthetic Polynucleotide
taatacgactcactatagggaggtgggcaaaggtagcattcccagcctttaacagaggagaaaaggcatggaatgctacaacctggcggcagcgcaaaagatg

SEQ ID NO: 26680 - DNA, 103 bp, Artificial Sequence
  Synthetic Polynucleotide
taatacgactcactatagggctgcaaggtgggcaaaggtagcattcccagaacagaggagactgggaatgctacctttgaacctggcggcagcgcaaaagatg

SEQ ID NO: 26681 - DNA, 103 bp, Artificial Sequence
  Synthetic Polynucleotide
taatacgactcactataggggatatctgcaaggtgggcaaaggtagcattaacagaggagaaatgctatgtttgcccacaacctggcggcagcgcaaaagatg

SEQ ID NO: 26682 - DNA, 103 bp, Artificial Sequence
  Synthetic Polynucleotide
taatacgactcactatagggcctcagatatctgcaaggtgggcaaaggtaaacagaggagataccttatgccaccttgcaacctggcggcagcgcaaaagatg

SEQ ID NO: 26683 - DNA, 103 bp, Artificial Sequence
  Synthetic Polynucleotide
taatacgactcactatagggtgctgcctcagatatctgcaaggtgggcaaaacagaggagattgcccatgttgcagataaacctggcggcagcgcaaaagatg

SEQ ID NO: 26684 - DNA, 103 bp, Artificial Sequence
  Synthetic Polynucleotide
taatacgactcactatagggttagctgctgcctcagatatctgcaaggtgaacagaggagacaccttatggatatctgaaacctggcggcagcgcaaaagatg

SEQ ID NO: 26685 - DNA, 103 bp, Artificial Sequence
  Synthetic Polynucleotide
taatacgactcactatagggcctctttagctgctgcctcagatatctgcaaacagaggagatgcagaatgctgaggcagaacctggcggcagcgcaaaagatg

SEQ ID NO: 26686 - DNA, 103 bp, Artificial Sequence
  Synthetic Polynucleotide
taatacgactcactatagggtatagcctctttagctgctgcctcagatataacagaggagaatatctatggcagcagctaacctggcggcagcgcaaaagatg

SEQ ID NO: 26687 - DNA, 103 bp, Artificial Sequence
  Synthetic Polynucleotide
taatacgactcactatagggagttgttctttccatgccaagtggcttctgaacagaggagacagaagatgcttggcatgaacctggcggcagcgcaaaagatg

SEQ ID NO: 26688 - DNA, 103 bp, Artificial Sequence
  Synthetic Polynucleotide
taatacgactcactatagggattgctatagcctctttagctgctgcctcaaacagaggagatgaggcatgagctaaagaaacctggcggcagcgcaaaagatg

SEQ ID NO: 26689 - DNA, 103 bp, Artificial Sequence
  Synthetic Polynucleotide
taatacgactcactatagggatgtcattgctatagcctctttagctgctgaacagaggagacagcagatgaagaggctaaacctggcggcagcgcaaaagatg

SEQ ID NO: 26690 - DNA, 103 bp, Artificial Sequence
  Synthetic Polynucleotide
taatacgactcactataggggtgtaatgtcattgctatagcctctttagcaacagaggagagctaaaatggctatagcaaacctggcggcagcgcaaaagatg

SEQ ID NO: 26691 - DNA, 103 bp, Artificial Sequence
  Synthetic Polynucleotide
taatacgactcactataggggacaggtgtaatgtcattgctatagcctctaacagaggagaagaggcatgagcaatgacaacctggcggcagcgcaaaagatg

SEQ ID NO: 26692 - DNA, 103 bp, Artificial Sequence
  Synthetic Polynucleotide
taatacgactcactatagggaacttgacaggtgtaatgtcattgctatagaacagaggagactatagatgtgacattacaacctggcggcagcgcaaaagatg

SEQ ID NO: 26693 - DNA, 103 bp, Artificial Sequence
  Synthetic Polynucleotide
taatacgactcactatagggtttcaaacttgacaggtgtaatgtcattgcaacagaggagagcaatgatgttacacctgaacctggcggcagcgcaaaagatg

SEQ ID NO: 26694 - DNA, 103 bp, Artificial Sequence
  Synthetic Polynucleotide
taatacgactcactataggggattctttcaaacttgacaggtgtaatgtcaacagaggagagacattatgcctgtcaagaacctggcggcagcgcaaaagatg

SEQ ID NO: 26695 - DNA, 103 bp, Artificial Sequence
  Synthetic Polynucleotide
taatacgactcactatagggacgatgattctttcaaacttgacaggtgtaaacagaggagatacaccatgcaagtttgaaacctggcggcagcgcaaaagatg

SEQ ID NO: 26696 - DNA, 103 bp, Artificial Sequence
  Synthetic Polynucleotide
taatacgactcactatagggtgcatacgatgattctttcaaacttgacagaacagaggagactgtcaatgttgaaagaaaacctggcggcagcgcaaaagatg

SEQ ID NO: 26697 - DNA, 103 bp, Artificial Sequence
  Synthetic Polynucleotide
taatacgactcactatagggtcatttgcatacgatgattctttcaaacttaacagaggagaaagtttatgagaatcatcaacctggcggcagcgcaaaagatg

SEQ ID NO: 26698 - DNA, 103 bp, Artificial Sequence
  Synthetic Polynucleotide
taatacgactcactatagggcaagcagttgttctttccatgccaagtggcaacagaggagagccactatgcatggaaagaacctggcggcagcgcaaaagatg

SEQ ID NO: 26699 - DNA, 103 bp, Artificial Sequence
  Synthetic Polynucleotide
taatacgactcactatagggatctttcatttgcatacgatgattctttcaaacagaggagatgaaagatgcatcgtatgaacctggcggcagcgcaaaagatg

SEQ ID NO: 26700 - DNA, 103 bp, Artificial Sequence
  Synthetic Polynucleotide
taatacgactcactatagggagtccatctttcatttgcatacgatgattcaacagaggagagaatcaatgtatgcaaataacctggcggcagcgcaaaagatg

SEQ ID NO: 26701 - DNA, 103 bp, Artificial Sequence
  Synthetic Polynucleotide
taatacgactcactatagggtgcaaagtccatctttcatttgcatacgataacagaggagaatcgtaatgaaatgaaagaacctggcggcagcgcaaaagatg

SEQ ID NO: 26702 - DNA, 103 bp, Artificial Sequence
  Synthetic Polynucleotide
taatacgactcactatagggtgtcttgcaaagtccatctttcatttgcataacagaggagaatgcaaatgaaagatggaaacctggcggcagcgcaaaagatg

SEQ ID NO: 26703 - DNA, 103 bp, Artificial Sequence
  Synthetic Polynucleotide
taatacgactcactatagggactagtgtcttgcaaagtccatctttcattaacagaggagaaatgaaatgtggactttgaacctggcggcagcgcaaaagatg

SEQ ID NO: 26704 - DNA, 103 bp, Artificial Sequence
  Synthetic Polynucleotide
taatacgactcactatagggacaatactagtgtcttgcaaagtccatcttaacagaggagaaagatgatgtttgcaagaaacctggcggcagcgcaaaagatg

SEQ ID NO: 26705 - DNA, 103 bp, Artificial Sequence
  Synthetic Polynucleotide
taatacgactcactatagggaggttacaatactagtgtcttgcaaagtccaacagaggagaggacttatgaagacactaaacctggcggcagcgcaaaagatg

SEQ ID NO: 26706 - DNA, 103 bp, Artificial Sequence
  Synthetic Polynucleotide
taatacgactcactatagggttcaaaggttacaatactagtgtcttgcaaaacagaggagattgcaaatgactagtattaacctggcggcagcgcaaaagatg

SEQ ID NO: 26707 - DNA, 103 bp, Artificial Sequence
  Synthetic Polynucleotide
taatacgactcactatagggggactttcaaaggttacaatactagtgtctaacagaggagaagacacatgtattgtaacaacctggcggcagcgcaaaagatg

SEQ ID NO: 26708 - DNA, 103 bp, Artificial Sequence
  Synthetic Polynucleotide
taatacgactcactataggggggggggactttcaaaggttacaatactagaacagaggagactagtaatgtaacctttgaacctggcggcagcgcaaaagatg

SEQ ID NO: 26709 - DNA, 103 bp, Artificial Sequence
  Synthetic Polynucleotide
taatacgactcactatagggcaatccaagcagttgttctttccatgccaaaacagaggagattggcaatgaaagaacaaaacctggcggcagcgcaaaagatg

SEQ ID NO: 26710 - DNA, 103 bp, Artificial Sequence
  Synthetic Polynucleotide
taatacgactcactatagggaaattgggggggactttcaaaggttacaataacagaggagaattgtaatgtttgaaagtaacctggcggcagcgcaaaagatg

SEQ ID NO: 26711 - DNA, 103 bp, Artificial Sequence
  Synthetic Polynucleotide
taatacgactcactatagggaaggtaaattgggggggactttcaaaggttaacagaggagaaaccttatgaagtcccccaacctggcggcagcgcaaaagatg

SEQ ID NO: 26712 - DNA, 103 bp, Artificial Sequence
  Synthetic Polynucleotide
taatacgactcactatagggttttaaaggtaaattgggggggactttcaaaacagaggagattgaaaatgccccccaataacctggcggcagcgcaaaagatg

SEQ ID NO: 26713 - DNA, 103 bp, Artificial Sequence
  Synthetic Polynucleotide
taatacgactcactatagggtccttttttaaaggtaaattgggggggactaacagaggagaagtcccatgcaatttaccaacctggcggcagcgcaaaagatg

SEQ ID NO: 26714 - DNA, 103 bp, Artificial Sequence
  Synthetic Polynucleotide
taatacgactcactatagggacaggtccttttttaaaggtaaattgggggaacagaggagacccccaatgtacctttaaaacctggcggcagcgcaaaagatg

SEQ ID NO: 26715 - DNA, 103 bp, Artificial Sequence
  Synthetic Polynucleotide
taatacgactcactatagggcagcaacaggtccttttttaaaggtaaattaacagaggagaaatttaatgttaaaaaagaacctggcggcagcgcaaaagatg

SEQ ID NO: 26716 - DNA, 103 bp, Artificial Sequence
  Synthetic Polynucleotide
taatacgactcactatagggtttaacagcaacaggtccttttttaaaggtaacagaggagaacctttatgaaaggacctaacctggcggcagcgcaaaagatg

SEQ ID NO: 26717 - DNA, 103 bp, Artificial Sequence
  Synthetic Polynucleotide
taatacgactcactataggggacaatttaacagcaacaggtccttttttaaacagaggagataaaaaatgacctgttgcaacctggcggcagcgcaaaagatg

SEQ ID NO: 26718 - DNA, 103 bp, Artificial Sequence
  Synthetic Polynucleotide
taatacgactcactatagggcaaatgacaatttaacagcaacaggtccttaacagaggagaaaggacatgttgctgttaaacctggcggcagcgcaaaagatg

SEQ ID NO: 26719 - DNA, 103 bp, Artificial Sequence
  Synthetic Polynucleotide
taatacgactcactatagggaccatcaaatgacaatttaacagcaacaggaacagaggagacctgttatggttaaattgaacctggcggcagcgcaaaagatg

SEQ ID NO: 26720 - DNA, 103 bp, Artificial Sequence
  Synthetic Polynucleotide
taatacgactcactatagggaaaagcaatccaagcagttgttctttccataacagaggagaatggaaatgacaactgctaacctggcggcagcgcaaaagatg

SEQ ID NO: 26721 - DNA, 103 bp, Artificial Sequence
  Synthetic Polynucleotide
taatacgactcactatagggggattaccatcaaatgacaatttaacagcaaacagaggagatgctgtatgattgtcattaacctggcggcagcgcaaaagatg

SEQ ID NO: 26722 - DNA, 103 bp, Artificial Sequence
  Synthetic Polynucleotide
taatacgactcactatagggtgtctggattaccatcaaatgacaatttaaaacagaggagattaaatatgcatttgatgaacctggcggcagcgcaaaagatg

SEQ ID NO: 26723 - DNA, 103 bp, Artificial Sequence
  Synthetic Polynucleotide
taatacgactcactatagggtgcattgtctggattaccatcaaatgacaaaacagaggagattgtcaatggatggtaataacctggcggcagcgcaaaagatg

SEQ ID NO: 26724 - DNA, 103 bp, Artificial Sequence
  Synthetic Polynucleotide
taatacgactcactatagggctgactgcattgtctggattaccatcaaataacagaggagaatttgaatgtaatccagaaacctggcggcagcgcaaaagatg

SEQ ID NO: 26725 - DNA, 103 bp, Artificial Sequence
  Synthetic Polynucleotide
taatacgactcactatagggtgtgcctgactgcattgtctggattaccataacagaggagaatggtaatgcagacaatgaacctggcggcagcgcaaaagatg

SEQ ID NO: 26726 - DNA, 103 bp, Artificial Sequence
  Synthetic Polynucleotide
taatacgactcactatagggcaatgtgtgcctgactgcattgtctggattaacagaggagaaatccaatgaatgcagtcaacctggcggcagcgcaaaagatg

SEQ ID NO: 26727 - DNA, 103 bp, Artificial Sequence
  Synthetic Polynucleotide
taatacgactcactatagggctccacaatgtgtgcctgactgcattgtctaacagaggagaagacaaatgagtcaggcaaacctggcggcagcgcaaaagatg

SEQ ID NO: 26728 - DNA, 103 bp, Artificial Sequence
  Synthetic Polynucleotide
taatacgactcactatagggtatctctccacaatgtgtgcctgactgcataacagaggagaatgcagatgggcacacataacctggcggcagcgcaaaagatg

SEQ ID NO: 26729 - DNA, 103 bp, Artificial Sequence
  Synthetic Polynucleotide
taatacgactcactatagggatatatatctctccacaatgtgtgcctgacaacagaggagagtcaggatgacattgtggaacctggcggcagcgcaaaagatg

SEQ ID NO: 26730 - DNA, 103 bp, Artificial Sequence
  Synthetic Polynucleotide
taatacgactcactatagggaagtaatatatatctctccacaatgtgtgcaacagaggagagcacacatggtggagagaaacctggcggcagcgcaaaagatg

SEQ ID NO: 26731 - DNA, 103 bp, Artificial Sequence
  Synthetic Polynucleotide
taatacgactcactatagggcttcaaaaagcaatccaagcagttgttcttaacagaggagaaagaacatgtgcttggataacctggcggcagcgcaaaagatg

SEQ ID NO: 26732 - DNA, 103 bp, Artificial Sequence
  Synthetic Polynucleotide
taatacgactcactatagggcatctaagtaatatatatctctccacaatgaacagaggagacattgtatggagatatataacctggcggcagcgcaaaagatg

SEQ ID NO: 26733 - DNA, 103 bp, Artificial Sequence
  Synthetic Polynucleotide
taatacgactcactatagggatcatcatctaagtaatatatatctctccaaacagaggagatggagaatgatatattacaacctggcggcagcgcaaaagatg

SEQ ID NO: 26734 - DNA, 103 bp, Artificial Sequence
  Synthetic Polynucleotide
taatacgactcactatagggtgatcatcatcatctaagtaatatatatctaacagaggagaagatatatgttacttagaaacctggcggcagcgcaaaagatg

SEQ ID NO: 26735 - DNA, 103 bp, Artificial Sequence
  Synthetic Polynucleotide
taatacgactcactatagggtccattgatcatcatcatctaagtaatataaacagaggagatatattatgtagatgatgaacctggcggcagcgcaaaagatg

SEQ ID NO: 26736 - DNA, 103 bp, Artificial Sequence
  Synthetic Polynucleotide
taatacgactcactatagggctttctccattgatcatcatcatctaagtaaacagaggagatacttaatggatgatgataacctggcggcagcgcaaaagatg

SEQ ID NO: 26737 - DNA, 103 bp, Artificial Sequence
  Synthetic Polynucleotide
taatacgactcactatagggtatgtctttctccattgatcatcatcatctaacagaggagaagatgaatgtgatcaatgaacctggcggcagcgcaaaagatg

SEQ ID NO: 26738 - DNA, 103 bp, Artificial Sequence
  Synthetic Polynucleotide
taatacgactcactatagggctgaatatgtctttctccattgatcatcataacagaggagaatgatgatgaatggagaaaacctggcggcagcgcaaaagatg

SEQ ID NO: 26739 - DNA, 103 bp, Artificial Sequence
  Synthetic Polynucleotide
taatacgactcactatagggaacatctgaatatgtctttctccattgatcaacagaggagagatcaaatgagaaagacaaacctggcggcagcgcaaaagatg

SEQ ID NO: 26740 - DNA, 103 bp, Artificial Sequence
  Synthetic Polynucleotide
taatacgactcactataggggagtcaacatctgaatatgtctttctccataacagaggagaatggagatggacatattcaacctggcggcagcgcaaaagatg

SEQ ID NO: 26741 - DNA, 103 bp, Artificial Sequence
  Synthetic Polynucleotide
taatacgactcactatagggccctggagtcaacatctgaatatgtctttcaacagaggagagaaagaatgattcagatgaacctggcggcagcgcaaaagatg

SEQ ID NO: 26742 - DNA, 103 bp, Artificial Sequence
  Synthetic Polynucleotide
taatacgactcactatagggcttaccttcaaaaagcaatccaagcagttgaacagaggagacaactgatgggattgcttaacctggcggcagcgcaaaagatg

SEQ ID NO: 26743 - DNA, 103 bp, Artificial Sequence
  Synthetic Polynucleotide
taatacgactcactatagggtatccccctggagtcaacatctgaatatgtaacagaggagaacatatatggatgttgacaacctggcggcagcgcaaaagatg

SEQ ID NO: 26744 - DNA, 103 bp, Artificial Sequence
  Synthetic Polynucleotide
taatacgactcactatagggtaatatatccccctggagtcaacatctgaaaacagaggagattcagaatgtgactccagaacctggcggcagcgcaaaagatg

SEQ ID NO: 26745 - DNA, 103 bp, Artificial Sequence
  Synthetic Polynucleotide
taatacgactcactatagggaccaataatatatccccctggagtcaacataacagaggagaatgttgatgccagggggaaacctggcggcagcgcaaaagatg

SEQ ID NO: 26746 - DNA, 103 bp, Artificial Sequence
  Synthetic Polynucleotide
taatacgactcactatagggcccagaccaataatatatccccctggagtcaacagaggagagactccatggggatatataacctggcggcagcgcaaaagatg

SEQ ID NO: 26747 - DNA, 103 bp, Artificial Sequence
  Synthetic Polynucleotide
taatacgactcactataggggagtccccagaccaataatatatccccctgaacagaggagacaggggatgatattattgaacctggcggcagcgcaaaagatg

SEQ ID NO: 26748 - DNA, 103 bp, Artificial Sequence
  Synthetic Polynucleotide
taatacgactcactatagggccttagagtccccagaccaataatatatccaacagaggagaggatatatgattggtctgaacctggcggcagcgcaaaagatg

SEQ ID NO: 26749 - DNA, 103 bp, Artificial Sequence
  Synthetic Polynucleotide
taatacgactcactatagggatataccttagagtccccagaccaataataaacagaggagatattatatgtctggggacaacctggcggcagcgcaaaagatg

SEQ ID NO: 26750 - DNA, 103 bp, Artificial Sequence
  Synthetic Polynucleotide
taatacgactcactatagggacataatataccttagagtccccagaccaaaacagaggagattggtcatgggactctaaaacctggcggcagcgcaaaagatg

SEQ ID NO: 26751 - DNA, 103 bp, Artificial Sequence
  Synthetic Polynucleotide
taatacgactcactatagggattccacataatataccttagagtccccagaacagaggagactggggatgctaaggtataacctggcggcagcgcaaaagatg

SEQ ID NO: 26752 - DNA, 103 bp, Artificial Sequence
  Synthetic Polynucleotide
taatacgactcactatagggcttgaattccacataatataccttagagtcaacagaggagagactctatggtatattataacctggcggcagcgcaaaagatg

SEQ ID NO: 26753 - DNA, 103 bp, Artificial Sequence
  Synthetic Polynucleotide
taatacgactcactatagggtaactcttaccttcaaaaagcaatccaagcaacagaggagagcttggatggctttttgaaacctggcggcagcgcaaaagatg

SEQ ID NO: 26754 - DNA, 103 bp, Artificial Sequence
  Synthetic Polynucleotide
taatacgactcactatagggtcatccttgaattccacataatataccttaaacagaggagataaggtatgttatgtggaaacctggcggcagcgcaaaagatg

SEQ ID NO: 26755 - DNA, 103 bp, Artificial Sequence
  Synthetic Polynucleotide
taatacgactcactatagggtagcatcatccttgaattccacataatataaacagaggagatatattatgtggaattcaaacctggcggcagcgcaaaagatg

SEQ ID NO: 26756 - DNA, 103 bp, Artificial Sequence
  Synthetic Polynucleotide
taatacgactcactatagggcaggctagcatcatccttgaattccacataaacagaggagatatgtgatgttcaaggataacctggcggcagcgcaaaagatg

SEQ ID NO: 26757 - DNA, 103 bp, Artificial Sequence
  Synthetic Polynucleotide
taatacgactcactataggggaatacaggctagcatcatccttgaattccaacagaggagaggaattatgggatgatgcaacctggcggcagcgcaaaagatg

SEQ ID NO: 26758 - DNA, 103 bp, Artificial Sequence
  Synthetic Polynucleotide
taatacgactcactatagggttaaagaatacaggctagcatcatccttgaaacagaggagatcaaggatgatgctagccaacctggcggcagcgcaaaagatg

SEQ ID NO: 26759 - DNA, 103 bp, Artificial Sequence
  Synthetic Polynucleotide
taatacgactcactatagggcccagttaaagaatacaggctagcatcatcaacagaggagagatgatatgagcctgtataacctggcggcagcgcaaaagatg

SEQ ID NO: 26760 - DNA, 103 bp, Artificial Sequence
  Synthetic Polynucleotide
taatacgactcactatagggcattgcccagttaaagaatacaggctagcaaacagaggagatgctagatggtattctttaacctggcggcagcgcaaaagatg

SEQ ID NO: 26761 - DNA, 103 bp, Artificial Sequence
  Synthetic Polynucleotide
taatacgactcactatagggcctcccattgcccagttaaagaatacaggcaacagaggagagcctgtatgctttaactgaacctggcggcagcgcaaaagatg

SEQ ID NO: 26762 - DNA, 103 bp, Artificial Sequence
  Synthetic Polynucleotide
taatacgactcactatagggcgtcacctcccattgcccagttaaagaataaacagaggagatattctatgactgggcaaaacctggcggcagcgcaaaagatg

SEQ ID NO: 26763 - DNA, 103 bp, Artificial Sequence
  Synthetic Polynucleotide
taatacgactcactatagggttgtacgtcacctcccattgcccagttaaaaacagaggagatttaacatggcaatgggaaacctggcggcagcgcaaaagatg

SEQ ID NO: 26764 - DNA, 103 bp, Artificial Sequence
  Synthetic Polynucleotide
taatacgactcactatagggaactataactcttaccttcaaaaagcaatcaacagaggagagattgcatgttgaaggtaaacctggcggcagcgcaaaagatg

SEQ ID NO: 26765 - DNA, 103 bp, Artificial Sequence
  Synthetic Polynucleotide
taatacgactcactatagggttttgttgtacgtcacctcccattgcccagaacagaggagactgggcatggggaggtgaaacctggcggcagcgcaaaagatg

SEQ ID NO: 26766 - DNA, 103 bp, Artificial Sequence
  Synthetic Polynucleotide
taatacgactcactatagggggtttttttgttgtacgtcacctcccattgaacagaggagacaatggatggtgacgtacaacctggcggcagcgcaaaagatg

SEQ ID NO: 26767 - DNA, 103 bp, Artificial Sequence
  Synthetic Polynucleotide
taatacgactcactataggggaaaaggtttttttgttgtacgtcacctccaacagaggagaggaggtatggtacaacaaaacctggcggcagcgcaaaagatg

SEQ ID NO: 26768 - DNA, 103 bp, Artificial Sequence
  Synthetic Polynucleotide
taatacgactcactatagggatgaagaaaaggtttttttgttgtacgtcaaacagaggagatgacgtatgacaaaaaaaaacctggcggcagcgcaaaagatg

SEQ ID NO: 26769 - DNA, 103 bp, Artificial Sequence
  Synthetic Polynucleotide
taatacgactcactatagggaatagatgaagaaaaggtttttttgttgtaaacagaggagatacaacatgaaaacctttaacctggcggcagcgcaaaagatg

SEQ ID NO: 26770 - DNA, 103 bp, Artificial Sequence
  Synthetic Polynucleotide
taatacgactcactataggggtggcaatagatgaagaaaaggtttttttgaacagaggagacaaaaaatgcttttcttcaacctggcggcagcgcaaaagatg

SEQ ID NO: 26771 - DNA, 103 bp, Artificial Sequence
  Synthetic Polynucleotide
taatacgactcactatagggagctagtggcaatagatgaagaaaaggtttaacagaggagaaaacctatgcttcatctaaacctggcggcagcgcaaaagatg

SEQ ID NO: 26772 - DNA, 103 bp, Artificial Sequence
  Synthetic Polynucleotide
taatacgactcactatagggggtggagctagtggcaatagatgaagaaaaaacagaggagattttctatgtctattgccaacctggcggcagcgcaaaagatg

SEQ ID NO: 26773 - DNA, 103 bp, Artificial Sequence
  Synthetic Polynucleotide
taatacgactcactatagggtcgttggtggagctagtggcaatagatgaaaacagaggagattcatcatgtgccactagaacctggcggcagcgcaaaagatg

SEQ ID NO: 26774 - DNA, 103 bp, Artificial Sequence
  Synthetic Polynucleotide
taatacgactcactatagggcctcttcgttggtggagctagtggcaatagaacagaggagactattgatgctagctccaaacctggcggcagcgcaaaagatg

SEQ ID NO: 26775 - DNA, 103 bp, Artificial Sequence
  Synthetic Polynucleotide
taatacgactcactatagggttaacaactataactcttaccttcaaaaagaacagaggagactttttatgggtaagagtaacctggcggcagcgcaaaagatg

SEQ ID NO: 26776 - DNA, 103 bp, Artificial Sequence
  Synthetic Polynucleotide
taatacgactcactatagggcccgtcctcttcgttggtggagctagtggcaacagaggagagccactatgtccaccaacaacctggcggcagcgcaaaagatg

SEQ ID NO: 26777 - DNA, 103 bp, Artificial Sequence
  Synthetic Polynucleotide
taatacgactcactatagggactggcccgtcctcttcgttggtggagctaaacagaggagatagctcatgcaacgaagaaacctggcggcagcgcaaaagatg

SEQ ID NO: 26778 - DNA, 103 bp, Artificial Sequence
  Synthetic Polynucleotide
taatacgactcactatagggtggggactggcccgtcctcttcgttggtggaacagaggagaccaccaatgaagaggacgaacctggcggcagcgcaaaagatg

SEQ ID NO: 26779 - DNA, 103 bp, Artificial Sequence
  Synthetic Polynucleotide
taatacgactcactatagggggatatggggactggcccgtcctcttcgttaacagaggagaaacgaaatggacgggccaaacctggcggcagcgcaaaagatg

SEQ ID NO: 26780 - DNA, 103 bp, Artificial Sequence
  Synthetic Polynucleotide
taatacgactcactatagggtctgaggatatggggactggcccgtcctctaacagaggagaagaggaatggccagtcccaacctggcggcagcgcaaaagatg

SEQ ID NO: 26781 - DNA, 103 bp, Artificial Sequence
  Synthetic Polynucleotide
taatacgactcactatagggcttcgtctgaggatatggggactggcccgtaacagaggagaacgggcatgtccccatataacctggcggcagcgcaaaagatg

SEQ ID NO: 26782 - DNA, 103 bp, Artificial Sequence
  Synthetic Polynucleotide
taatacgactcactatagggcccctcttcgtctgaggatatggggactggaacagaggagaccagtcatgatatcctcaaacctggcggcagcgcaaaagatg

SEQ ID NO: 26783 - DNA, 103 bp, Artificial Sequence
  Synthetic Polynucleotide
taatacgactcactatagggtctgtcccctcttcgtctgaggatatggggaacagaggagaccccatatgctcagacgaaacctggcggcagcgcaaaagatg

SEQ ID NO: 26784 - DNA, 103 bp, Artificial Sequence
  Synthetic Polynucleotide
taatacgactcactataggggcccgtctgtcccctcttcgtctgaggataaacagaggagatatcctatgacgaagaggaacctggcggcagcgcaaaagatg

SEQ ID NO: 26785 - DNA, 103 bp, Artificial Sequence
  Synthetic Polynucleotide
taatacgactcactatagggcccgtgcccgtctgtcccctcttcgtctgaaacagaggagatcagacatggaggggacaaacctggcggcagcgcaaaagatg

SEQ ID NO: 26786 - DNA, 103 bp, Artificial Sequence
  Synthetic Polynucleotide
taatacgactcactatagggaaagatacagtgcaaccagtagtttcccaaaacagaggagattgggaatgtactggttgaacctggcggcagcgcaaaagatg

SEQ ID NO: 26787 - DNA, 103 bp, Artificial Sequence
  Synthetic Polynucleotide
taatacgactcactatagggtgttgttaacaactataactcttaccttcaaacagaggagatgaaggatggagttatagaacctggcggcagcgcaaaagatg

SEQ ID NO: 26788 - DNA, 103 bp, Artificial Sequence
  Synthetic Polynucleotide
taatacgactcactatagggtcttgcccgtgcccgtctgtcccctcttcgaacagaggagacgaagaatggacagacggaacctggcggcagcgcaaaagatg

SEQ ID NO: 26789 - DNA, 103 bp, Artificial Sequence
  Synthetic Polynucleotide
taatacgactcactatagggcgtgctcttgcccgtgcccgtctgtcccctaacagaggagaaggggaatgacgggcacgaacctggcggcagcgcaaaagatg

SEQ ID NO: 26790 - DNA, 103 bp, Artificial Sequence
  Synthetic Polynucleotide
taatacgactcactatagggtctttcgtgctcttgcccgtgcccgtctgtaacagaggagaacagacatgcacgggcaaaacctggcggcagcgcaaaagatg

SEQ ID NO: 26791 - DNA, 103 bp, Artificial Sequence
  Synthetic Polynucleotide
taatacgactcactatagggggggatctttcgtgctcttgcccgtgcccgaacagaggagacgggcaatggcaagagcaaacctggcggcagcgcaaaagatg

SEQ ID NO: 26792 - DNA, 103 bp, Artificial Sequence
  Synthetic Polynucleotide
taatacgactcactatagggtgttgggggatctttcgtgctcttgcccgtaacagaggagaacgggcatgagcacgaaaaacctggcggcagcgcaaaagatg

SEQ ID NO: 26793 - DNA, 103 bp, Artificial Sequence
  Synthetic Polynucleotide
taatacgactcactatagggtgatctgttgggggatctttcgtgctcttgaacagaggagacaagagatggaaagatccaacctggcggcagcgcaaaagatg

SEQ ID NO: 26794 - DNA, 103 bp, Artificial Sequence
  Synthetic Polynucleotide
taatacgactcactataggggtgtctgatctgttgggggatctttcgtgcaacagaggagagcacgaatgatcccccaaaacctggcggcagcgcaaaagatg

SEQ ID NO: 26795 - DNA, 103 bp, Artificial Sequence
  Synthetic Polynucleotide
taatacgactcactatagggcttcggtgtctgatctgttgggggatctttaacagaggagaaaagatatgccaacagataacctggcggcagcgcaaaagatg

SEQ ID NO: 26796 - DNA, 103 bp, Artificial Sequence
  Synthetic Polynucleotide
taatacgactcactatagggtccttcttcggtgtctgatctgttgggggaaacagaggagatcccccatgagatcagacaacctggcggcagcgcaaaagatg

SEQ ID NO: 26797 - DNA, 103 bp, Artificial Sequence
  Synthetic Polynucleotide
taatacgactcactatagggtcttctccttcttcggtgtctgatctgttgaacagaggagacaacagatgagacaccgaaacctggcggcagcgcaaaagatg

SEQ ID NO: 26798 - DNA, 103 bp, Artificial Sequence
  Synthetic Polynucleotide
taatacgactcactatagggtagattgttgttaacaactataactcttacaacagaggagagtaagaatgatagttgttaacctggcggcagcgcaaaagatg

SEQ ID NO: 26799 - DNA, 103 bp, Artificial Sequence
  Synthetic Polynucleotide
taatacgactcactatagggcggtttcttctccttcttcggtgtctgatcaacagaggagagatcagatgccgaagaagaacctggcggcagcgcaaaagatg

SEQ ID NO: 26800 - DNA, 103 bp, Artificial Sequence
  Synthetic Polynucleotide
taatacgactcactatagggtcctccggtttcttctccttcttcggtgtcaacagaggagagacaccatggaaggagaaaacctggcggcagcgcaaaagatg

SEQ ID NO: 26801 - DNA, 103 bp, Artificial Sequence
  Synthetic Polynucleotide
taatacgactcactataggggcttctcctccggtttcttctccttcttcgaacagaggagacgaagaatgagaagaaacaacctggcggcagcgcaaaagatg

SEQ ID NO: 26802 - DNA, 103 bp, Artificial Sequence
  Synthetic Polynucleotide
taatacgactcactatagggcggaggcttctcctccggtttcttctccttaacagaggagaaaggagatgaaaccggagaacctggcggcagcgcaaaagatg

SEQ ID NO: 26803 - DNA, 103 bp, Artificial Sequence
  Synthetic Polynucleotide
taatacgactcactatagggtttctcggaggcttctcctccggtttcttcaacagaggagagaagaaatgggaggagaaaacctggcggcagcgcaaaagatg

SEQ ID NO: 26804 - DNA, 103 bp, Artificial Sequence
  Synthetic Polynucleotide
taatacgactcactataggggatgctttctcggaggcttctcctccggttaacagaggagaaaccggatgagaagcctcaacctggcggcagcgcaaaagatg

SEQ ID NO: 26805 - DNA, 103 bp, Artificial Sequence
  Synthetic Polynucleotide
taatacgactcactatagggatatggatgctttctcggaggcttctcctcaacagaggagagaggagatgcctccgagaaacctggcggcagcgcaaaagatg

SEQ ID NO: 26806 - DNA, 103 bp, Artificial Sequence
  Synthetic Polynucleotide
taatacgactcactatagggcccagatatggatgctttctcggaggcttcaacagaggagagaagccatggagaaagcaaacctggcggcagcgcaaaagatg

SEQ ID NO: 26807 - DNA, 103 bp, Artificial Sequence
  Synthetic Polynucleotide
taatacgactcactatagggacagacccagatatggatgctttctcggagaacagaggagactccgaatgagcatccataacctggcggcagcgcaaaagatg

SEQ ID NO: 26808 - DNA, 103 bp, Artificial Sequence
  Synthetic Polynucleotide
taatacgactcactatagggtccgtacagacccagatatggatgctttctaacagaggagaagaaagatgccatatctgaacctggcggcagcgcaaaagatg

SEQ ID NO: 26809 - DNA, 103 bp, Artificial Sequence
  Synthetic Polynucleotide
taatacgactcactataggggtaagtagattgttgttaacaactataactaacagaggagaagttatatgtgttaacaaaacctggcggcagcgcaaaagatg

SEQ ID NO: 26810 - DNA, 103 bp, Artificial Sequence
  Synthetic Polynucleotide
taatacgactcactataggggatgctccgtacagacccagatatggatgcaacagaggagagcatccatgtctgggtctaacctggcggcagcgcaaaagatg

SEQ ID NO: 26811 - DNA, 103 bp, Artificial Sequence
  Synthetic Polynucleotide
taatacgactcactataggggtcctgatgctccgtacagacccagatatgaacagaggagacatatcatggtctgtacgaacctggcggcagcgcaaaagatg

SEQ ID NO: 26812 - DNA, 103 bp, Artificial Sequence
  Synthetic Polynucleotide
taatacgactcactataggggcgcggtcctgatgctccgtacagacccagaacagaggagactgggtatgtacggagcaaacctggcggcagcgcaaaagatg

SEQ ID NO: 26813 - DNA, 103 bp, Artificial Sequence
  Synthetic Polynucleotide
taatacgactcactatagggcgatcgcgcggtcctgatgctccgtacagaaacagaggagatctgtaatgagcatcaggaacctggcggcagcgcaaaagatg

SEQ ID NO: 26814 - DNA, 103 bp, Artificial Sequence
  Synthetic Polynucleotide
taatacgactcactatagggtttggcgatcgcgcggtcctgatgctccgtaacagaggagaacggagatgcaggaccgcaacctggcggcagcgcaaaagatg

SEQ ID NO: 26815 - DNA, 103 bp, Artificial Sequence
  Synthetic Polynucleotide
taatacgactcactataggggggcctttggcgatcgcgcggtcctgatgcaacagaggagagcatcaatgccgcgcgataacctggcggcagcgcaaaagatg

SEQ ID NO: 26816 - DNA, 103 bp, Artificial Sequence
  Synthetic Polynucleotide
taatacgactcactatagggggagtgggcctttggcgatcgcgcggtcctaacagaggagaaggaccatgcgatcgccaaacctggcggcagcgcaaaagatg

SEQ ID NO: 26817 - DNA, 103 bp, Artificial Sequence
  Synthetic Polynucleotide
taatacgactcactataggggggttggagtgggcctttggcgatcgcgcgaacagaggagacgcgcgatggccaaaggcaacctggcggcagcgcaaaagatg

SEQ ID NO: 26818 - DNA, 103 bp, Artificial Sequence
  Synthetic Polynucleotide
taatacgactcactatagggatctcgggttggagtgggcctttggcgatcaacagaggagagatcgcatgaggcccactaacctggcggcagcgcaaaagatg

SEQ ID NO: 26819 - DNA, 103 bp, Artificial Sequence
  Synthetic Polynucleotide
taatacgactcactatagggttttgatctcgggttggagtgggcctttggaacagaggagaccaaagatgcactccaacaacctggcggcagcgcaaaagatg

SEQ ID NO: 26820 - DNA, 103 bp, Artificial Sequence
  Synthetic Polynucleotide
taatacgactcactatagggaaccagtaagtagattgttgttaacaactaaacagaggagatagttgatgacaacaatcaacctggcggcagcgcaaaagatg

SEQ ID NO: 26821 - DNA, 103 bp, Artificial Sequence
  Synthetic Polynucleotide
taatacgactcactatagggctggattttgatctcgggttggagtgggccaacagaggagaggcccaatgcaacccgagaacctggcggcagcgcaaaagatg

SEQ ID NO: 26822 - DNA, 103 bp, Artificial Sequence
  Synthetic Polynucleotide
taatacgactcactatagggtagatctggattttgatctcgggttggagtaacagaggagaactccaatgcgagatcaaaacctggcggcagcgcaaaagatg

SEQ ID NO: 26823 - DNA, 103 bp, Artificial Sequence
  Synthetic Polynucleotide
taatacgactcactatagggtgatctagatctggattttgatctcgggttaacagaggagaaacccgatgtcaaaatccaacctggcggcagcgcaaaagatg

SEQ ID NO: 26824 - DNA, 103 bp, Artificial Sequence
  Synthetic Polynucleotide
taatacgactcactataggggatcttgatctagatctggattttgatctcaacagaggagagagatcatgatccagatcaacctggcggcagcgcaaaagatg

SEQ ID NO: 26825 - DNA, 103 bp, Artificial Sequence
  Synthetic Polynucleotide
taatacgactcactatagggatctggatcttgatctagatctggattttgaacagaggagacaaaatatggatctagataacctggcggcagcgcaaaagatg

SEQ ID NO: 26826 - DNA, 103 bp, Artificial Sequence
  Synthetic Polynucleotide
taatacgactcactatagggtcgtgatctggatcttgatctagatctggaaacagaggagatccagaatgagatcaagaaacctggcggcagcgcaaaagatg

SEQ ID NO: 26827 - DNA, 103 bp, Artificial Sequence
  Synthetic Polynucleotide
taatacgactcactatagggctggatcgtgatctggatcttgatctagataacagaggagaatctagatgaagatccagaacctggcggcagcgcaaaagatg

SEQ ID NO: 26828 - DNA, 103 bp, Artificial Sequence
  Synthetic Polynucleotide
taatacgactcactatagggttgtgctggatcgtgatctggatcttgatcaacagaggagagatcaaatgccagatcacaacctggcggcagcgcaaaagatg

SEQ ID NO: 26829 - DNA, 103 bp, Artificial Sequence
  Synthetic Polynucleotide
taatacgactcactatagggcccccttgtgctggatcgtgatctggatctaacagaggagaagatccatgtcacgatccaacctggcggcagcgcaaaagatg

SEQ ID NO: 26830 - DNA, 103 bp, Artificial Sequence
  Synthetic Polynucleotide
taatacgactcactataggggtccacccccttgtgctggatcgtgatctgaacagaggagacagatcatgatccagcacaacctggcggcagcgcaaaagatg

SEQ ID NO: 26831 - DNA, 103 bp, Artificial Sequence
  Synthetic Polynucleotide
taatacgactcactataggggttaaaaccagtaagtagattgttgttaacaacagaggagagttaacatgaatctacttaacctggcggcagcgcaaaagatg

SEQ ID NO: 26832 - DNA, 103 bp, Artificial Sequence
  Synthetic Polynucleotide
taatacgactcactatagggcccgtgtccacccccttgtgctggatcgtgaacagaggagacacgatatggcacaagggaacctggcggcagcgcaaaagatg

SEQ ID NO: 26833 - DNA, 103 bp, Artificial Sequence
  Synthetic Polynucleotide
taatacgactcactatagggtcttgcccgtgtccacccccttgtgctggaaacagaggagatccagcatgagggggtggaacctggcggcagcgcaaaagatg

SEQ ID NO: 26834 - DNA, 103 bp, Artificial Sequence
  Synthetic Polynucleotide
taatacgactcactataggggtctgtcttgcccgtgtccacccccttgtgaacagaggagacacaagatggtggacacgaacctggcggcagcgcaaaagatg

SEQ ID NO: 26835 - DNA, 103 bp, Artificial Sequence
  Synthetic Polynucleotide
taatacgactcactatagggatgaggtctgtcttgcccgtgtccacccccaacagaggagagggggtatgcacgggcaaaacctggcggcagcgcaaaagatg

SEQ ID NO: 26836 - DNA, 103 bp, Artificial Sequence
  Synthetic Polynucleotide
taatacgactcactatagggggatgatgaggtctgtcttgcccgtgtccaaacagaggagatggacaatggcaagacagaacctggcggcagcgcaaaagatg

SEQ ID NO: 26837 - DNA, 103 bp, Artificial Sequence
  Synthetic Polynucleotide
taatacgactcactataggggatccggatgatgaggtctgtcttgcccgtaacagaggagaacgggcatgacagacctcaacctggcggcagcgcaaaagatg

SEQ ID NO: 26838 - DNA, 103 bp, Artificial Sequence
  Synthetic Polynucleotide
taatacgactcactatagggatcgagatccggatgatgaggtctgtcttgaacagaggagacaagacatgcctcatcataacctggcggcagcgcaaaagatg

SEQ ID NO: 26839 - DNA, 103 bp, Artificial Sequence
  Synthetic Polynucleotide
taatacgactcactatagggtcgtgatcgagatccggatgatgaggtctgaacagaggagacagaccatgtcatccggaaacctggcggcagcgcaaaagatg

SEQ ID NO: 26840 - DNA, 103 bp, Artificial Sequence
  Synthetic Polynucleotide
taatacgactcactatagggcgggatcgtgatcgagatccggatgatgagaacagaggagactcatcatgcggatctcgaacctggcggcagcgcaaaagatg

SEQ ID NO: 26841 - DNA, 103 bp, Artificial Sequence
  Synthetic Polynucleotide
taatacgactcactatagggctgatcgggatcgtgatcgagatccggatgaacagaggagacatccgatgctcgatcacaacctggcggcagcgcaaaagatg

SEQ ID NO: 26842 - DNA, 103 bp, Artificial Sequence
  Synthetic Polynucleotide
taatacgactcactatagggtacgtgttaaaaccagtaagtagattgttgaacagaggagacaacaaatgacttactggaacctggcggcagcgcaaaagatg

SEQ ID NO: 26843 - DNA, 103 bp, Artificial Sequence
  Synthetic Polynucleotide
taatacgactcactatagggggatcctgatcgggatcgtgatcgagatccaacagaggagaggatctatgtcacgatccaacctggcggcagcgcaaaagatg

SEQ ID NO: 26844 - DNA, 103 bp, Artificial Sequence
  Synthetic Polynucleotide
taatacgactcactataggggttctggatcctgatcgggatcgtgatcgaaacagaggagatcgatcatgatcccgatcaacctggcggcagcgcaaaagatg

SEQ ID NO: 26845 - DNA, 103 bp, Artificial Sequence
  Synthetic Polynucleotide
taatacgactcactatagggctcttgttctggatcctgatcgggatcgtgaacagaggagacacgatatggatcaggataacctggcggcagcgcaaaagatg

SEQ ID NO: 26846 - DNA, 103 bp, Artificial Sequence
  Synthetic Polynucleotide
taatacgactcactatagggccgggctcttgttctggatcctgatcgggaaacagaggagatcccgaatgggatccagaaacctggcggcagcgcaaaagatg

SEQ ID NO: 26847 - DNA, 103 bp, Artificial Sequence
  Synthetic Polynucleotide
taatacgactcactatagggcaggaccgggctcttgttctggatcctgataacagaggagaatcaggatgcagaacaagaacctggcggcagcgcaaaagatg

SEQ ID NO: 26848 - DNA, 103 bp, Artificial Sequence
  Synthetic Polynucleotide
taatacgactcactatagggttctccaggaccgggctcttgttctggatcaacagaggagagatccaatgcaagagcccaacctggcggcagcgcaaaagatg

SEQ ID NO: 26849 - DNA, 103 bp, Artificial Sequence
  Synthetic Polynucleotide
taatacgactcactatagggggatcttctccaggaccgggctcttgttctaacagaggagaagaacaatggcccggtccaacctggcggcagcgcaaaagatg

SEQ ID NO: 26850 - DNA, 103 bp, Artificial Sequence
  Synthetic Polynucleotide
taatacgactcactatagggcctggggatcttctccaggaccgggctcttaacagaggagaaagagcatggtcctggagaacctggcggcagcgcaaaagatg

SEQ ID NO: 26851 - DNA, 103 bp, Artificial Sequence
  Synthetic Polynucleotide
taatacgactcactatagggtatgtcctggggatcttctccaggaccgggaacagaggagacccggtatgggagaagataacctggcggcagcgcaaaagatg

SEQ ID NO: 26852 - DNA, 103 bp, Artificial Sequence
  Synthetic Polynucleotide
taatacgactcactatagggtcctctatgtcctggggatcttctccaggaaacagaggagatcctggatgagatccccaaacctggcggcagcgcaaaagatg

SEQ ID NO: 26853 - DNA, 103 bp, Artificial Sequence
  Synthetic Polynucleotide
taatacgactcactatagggcttagtacgtgttaaaaccagtaagtagataacagaggagaatctacatgctggttttaaacctggcggcagcgcaaaagatg

SEQ ID NO: 26854 - DNA, 103 bp, Artificial Sequence
  Synthetic Polynucleotide
taatacgactcactatagggcctcgtcctctatgtcctggggatcttctcaacagaggagagagaagatgcccaggacaaacctggcggcagcgcaaaagatg

SEQ ID NO: 26855 - DNA, 103 bp, Artificial Sequence
  Synthetic Polynucleotide
taatacgactcactatagggctcgtcctcgtcctctatgtcctggggatcaacagaggagagatcccatggacatagagaacctggcggcagcgcaaaagatg

SEQ ID NO: 26856 - DNA, 103 bp, Artificial Sequence
  Synthetic Polynucleotide
taatacgactcactatagggtcgtcctcgtcctcgtcctctatgtcctggaacagaggagaccaggaatgagaggacgaaacctggcggcagcgcaaaagatg

SEQ ID NO: 26857 - DNA, 103 bp, Artificial Sequence
  Synthetic Polynucleotide
taatacgactcactataggggggggtcgtcctcgtcctcgtcctctatgtaacagaggagaacatagatgacgaggacgaacctggcggcagcgcaaaagatg

SEQ ID NO: 26858 - DNA, 103 bp, Artificial Sequence
  Synthetic Polynucleotide
taatacgactcactatagggatcctgggggtcgtcctcgtcctcgtcctcaacagaggagagaggacatggacgaggacaacctggcggcagcgcaaaagatg

SEQ ID NO: 26859 - DNA, 103 bp, Artificial Sequence
  Synthetic Polynucleotide
taatacgactcactatagggtcctgatcctgggggtcgtcctcgtcctcgaacagaggagacgaggaatgggacgacccaacctggcggcagcgcaaaagatg

SEQ ID NO: 26860 - DNA, 103 bp, Artificial Sequence
  Synthetic Polynucleotide
taatacgactcactatagggcgccgtcctgatcctgggggtcgtcctcgtaacagaggagaacgaggatgacccccaggaacctggcggcagcgcaaaagatg

SEQ ID NO: 26861 - DNA, 103 bp, Artificial Sequence
  Synthetic Polynucleotide
taatacgactcactatagggcctgtcgccgtcctgatcctgggggtcgtcaacagaggagagacgacatgcaggatcagaacctggcggcagcgcaaaagatg

SEQ ID NO: 26862 - DNA, 103 bp, Artificial Sequence
  Synthetic Polynucleotide
taatacgactcactatagggtcccccctgtcgccgtcctgatcctgggggaacagaggagacccccaatgtcaggacggaacctggcggcagcgcaaaagatg

SEQ ID NO: 26863 - DNA, 103 bp, Artificial Sequence
  Synthetic Polynucleotide
taatacgactcactatagggcctgctcccccctgtcgccgtcctgatcctaacagaggagaaggatcatgacggcgacaaacctggcggcagcgcaaaagatg

SEQ ID NO: 26864 - DNA, 103 bp, Artificial Sequence
  Synthetic Polynucleotide
taatacgactcactatagggatctacttagtacgtgttaaaaccagtaagaacagaggagacttactatgtttaacacgaacctggcggcagcgcaaaagatg

SEQ ID NO: 26865 - DNA, 103 bp, Artificial Sequence
  Synthetic Polynucleotide
taatacgactcactatagggtggatcctgctcccccctgtcgccgtcctgaacagaggagacaggacatggacagggggaacctggcggcagcgcaaaagatg

SEQ ID NO: 26866 - DNA, 103 bp, Artificial Sequence
  Synthetic Polynucleotide
taatacgactcactataggggggtctggatcctgctcccccctgtcgccgaacagaggagacggcgaatggggggagcaaacctggcggcagcgcaaaagatg

SEQ ID NO: 26867 - DNA, 103 bp, Artificial Sequence
  Synthetic Polynucleotide
taatacgactcactataggggctccgggtctggatcctgctcccccctgtaacagaggagaacagggatgagcaggatcaacctggcggcagcgcaaaagatg

SEQ ID NO: 26868 - DNA, 103 bp, Artificial Sequence
  Synthetic Polynucleotide
taatacgactcactatagggatcctgctccgggtctggatcctgctccccaacagaggagaggggagatggatccagacaacctggcggcagcgcaaaagatg

SEQ ID NO: 26869 - DNA, 103 bp, Artificial Sequence
  Synthetic Polynucleotide
taatacgactcactatagggtccggatcctgctccgggtctggatcctgcaacagaggagagcaggaatgagacccggaaacctggcggcagcgcaaaagatg

SEQ ID NO: 26870 - DNA, 103 bp, Artificial Sequence
  Synthetic Polynucleotide
taatacgactcactatagggccggctccggatcctgctccgggtctggataacagaggagaatccagatgcggagcaggaacctggcggcagcgcaaaagatg

SEQ ID NO: 26871 - DNA, 103 bp, Artificial Sequence
  Synthetic Polynucleotide
taatacgactcactataggggtcctccggctccggatcctgctccgggtcaacagaggagagacccgatgcaggatccgaacctggcggcagcgcaaaagatg

SEQ ID NO: 26872 - DNA, 103 bp, Artificial Sequence
  Synthetic Polynucleotide
taatacgactcactatagggtggtcgtcctccggctccggatcctgctccaacagaggagaggagcaatgtccggagccaacctggcggcagcgcaaaagatg

SEQ ID NO: 26873 - DNA, 103 bp, Artificial Sequence
  Synthetic Polynucleotide
taatacgactcactatagggagccctggtcgtcctccggctccggatcctaacagaggagaaggatcatgagccggaggaacctggcggcagcgcaaaagatg

SEQ ID NO: 26874 - DNA, 103 bp, Artificial Sequence
  Synthetic Polynucleotide
taatacgactcactatagggaccgtagccctggtcgtcctccggctccggaacagaggagaccggagatggaggacgacaacctggcggcagcgcaaaagatg

SEQ ID NO: 26875 - DNA, 103 bp, Artificial Sequence
  Synthetic Polynucleotide
taatacgactcactatagggacagcatctacttagtacgtgttaaaaccaaacagaggagatggtttatgcacgtactaaacctggcggcagcgcaaaagatg

SEQ ID NO: 26876 - DNA, 103 bp, Artificial Sequence
  Synthetic Polynucleotide
taatacgactcactatagggccttgaccgtagccctggtcgtcctccggcaacagaggagagccggaatgcgaccagggaacctggcggcagcgcaaaagatg

SEQ ID NO: 26877 - DNA, 103 bp, Artificial Sequence
  Synthetic Polynucleotide
taatacgactcactatagggcgggaccttgaccgtagccctggtcgtcctaacagaggagaaggacgatgagggctacgaacctggcggcagcgcaaaagatg

SEQ ID NO: 26878 - DNA, 103 bp, Artificial Sequence
  Synthetic Polynucleotide
taatacgactcactatagggtgtctcgggaccttgaccgtagccctggtcaacagaggagagaccagatgtacggtcaaaacctggcggcagcgcaaaagatg

SEQ ID NO: 26879 - DNA, 103 bp, Artificial Sequence
  Synthetic Polynucleotide
taatacgactcactatagggtcttgtgtctcgggaccttgaccgtagcccaacagaggagagggctaatgtcaaggtccaacctggcggcagcgcaaaagatg

SEQ ID NO: 26880 - DNA, 103 bp, Artificial Sequence
  Synthetic Polynucleotide
taatacgactcactatagggcctgctcttgtgtctcgggaccttgaccgtaacagaggagaacggtcatggtcccgagaaacctggcggcagcgcaaaagatg

SEQ ID NO: 26881 - DNA, 103 bp, Artificial Sequence
  Synthetic Polynucleotide
taatacgactcactatagggctgatcctgctcttgtgtctcgggaccttgaacagaggagacaaggtatggagacacaaaacctggcggcagcgcaaaagatg

SEQ ID NO: 26882 - DNA, 103 bp, Artificial Sequence
  Synthetic Polynucleotide
taatacgactcactatagggtagccctgatcctgctcttgtgtctcgggaaacagaggagatcccgaatgacaagagcaaacctggcggcagcgcaaaagatg

SEQ ID NO: 26883 - DNA, 103 bp, Artificial Sequence
  Synthetic Polynucleotide
taatacgactcactatagggtttggtagccctgatcctgctcttgtgtctaacagaggagaagacacatgagcaggatcaacctggcggcagcgcaaaagatg

SEQ ID NO: 26884 - DNA, 103 bp, Artificial Sequence
  Synthetic Polynucleotide
taatacgactcactataggggcctgtttggtagccctgatcctgctcttgaacagaggagacaagagatggatcagggcaacctggcggcagcgcaaaagatg

SEQ ID NO: 26885 - DNA, 103 bp, Artificial Sequence
  Synthetic Polynucleotide
taatacgactcactatagggtgagggcctgtttggtagccctgatcctgcaacagaggagagcaggaatggggctaccaaacctggcggcagcgcaaaagatg

SEQ ID NO: 26886 - DNA, 103 bp, Artificial Sequence
  Synthetic Polynucleotide
taatacgactcactataggggaaaaacagcatctacttagtacgtgttaaaacagaggagattaacaatgactaagtagaacctggcggcagcgcaaaagatg

SEQ ID NO: 26887 - DNA, 103 bp, Artificial Sequence
  Synthetic Polynucleotide
taatacgactcactatagggcttgctgagggcctgtttggtagccctgataacagaggagaatcaggatgaccaaacagaacctggcggcagcgcaaaagatg

SEQ ID NO: 26888 - DNA, 103 bp, Artificial Sequence
  Synthetic Polynucleotide
taatacgactcactataggggcgggcttgctgagggcctgtttggtagccaacagaggagaggctacatgacaggccctaacctggcggcagcgcaaaagatg

SEQ ID NO: 26889 - DNA, 103 bp, Artificial Sequence
  Synthetic Polynucleotide
taatacgactcactatagggtgcccgcgggcttgctgagggcctgtttggaacagaggagaccaaacatgccctcagcaaacctggcggcagcgcaaaagatg

SEQ ID NO: 26890 - DNA, 103 bp, Artificial Sequence
  Synthetic Polynucleotide
taatacgactcactatagggggctctgcccgcgggcttgctgagggcctgaacagaggagacaggccatgagcaagcccaacctggcggcagcgcaaaagatg

SEQ ID NO: 26891 - DNA, 103 bp, Artificial Sequence
  Synthetic Polynucleotide
taatacgactcactataggggtacaggctctgcccgcgggcttgctgaggaacagaggagacctcagatggcccgcgggaacctggcggcagcgcaaaagatg

SEQ ID NO: 26892 - DNA, 103 bp, Artificial Sequence
  Synthetic Polynucleotide
taatacgactcactatagggcacccgtacaggctctgcccgcgggcttgcaacagaggagagcaagcatgcgggcagagaacctggcggcagcgcaaaagatg

SEQ ID NO: 26893 - DNA, 103 bp, Artificial Sequence
  Synthetic Polynucleotide
taatacgactcactatagggtccagcacccgtacaggctctgcccgcgggaacagaggagacccgcgatgagagcctgtaacctggcggcagcgcaaaagatg

SEQ ID NO: 26894 - DNA, 103 bp, Artificial Sequence
  Synthetic Polynucleotide
taatacgactcactatagggaaccttccagcacccgtacaggctctgcccaacagaggagagggcagatgctgtacgggaacctggcggcagcgcaaaagatg

SEQ ID NO: 26895 - DNA, 103 bp, Artificial Sequence
  Synthetic Polynucleotide
taatacgactcactatagggaatggaaccttccagcacccgtacaggctcaacagaggagagagcctatgcgggtgctgaacctggcggcagcgcaaaagatg

SEQ ID NO: 26896 - DNA, 103 bp, Artificial Sequence
  Synthetic Polynucleotide
taatacgactcactatagggctgggaatggaaccttccagcacccgtacaaacagaggagatgtacgatggctggaaggaacctggcggcagcgcaaaagatg

SEQ ID NO: 26897 - DNA, 103 bp, Artificial Sequence
  Synthetic Polynucleotide
taatacgactcactatagggactacaaagatacagtgcaaccagtagtttaacagaggagaaaactaatggttgcactgaacctggcggcagcgcaaaagatg

SEQ ID NO: 26898 - DNA, 103 bp, Artificial Sequence
  Synthetic Polynucleotide
taatacgactcactatagggtggcagaaaaacagcatctacttagtacgtaacagaggagaacgtacatggtagatgctaacctggcggcagcgcaaaagatg

SEQ ID NO: 26899 - DNA, 103 bp, Artificial Sequence
  Synthetic Polynucleotide
taatacgactcactatagggacggcctgggaatggaaccttccagcacccaacagaggagagggtgcatgaaggttccaaacctggcggcagcgcaaaagatg

SEQ ID NO: 26900 - DNA, 103 bp, Artificial Sequence
  Synthetic Polynucleotide
taatacgactcactatagggcgaggacggcctgggaatggaaccttccagaacagaggagactggaaatgtccattcccaacctggcggcagcgcaaaagatg

SEQ ID NO: 26901 - DNA, 103 bp, Artificial Sequence
  Synthetic Polynucleotide
taatacgactcactatagggccatacgaggacggcctgggaatggaacctaacagaggagaaggttcatgtcccaggccaacctggcggcagcgcaaaagatg

SEQ ID NO: 26902 - DNA, 103 bp, Artificial Sequence
  Synthetic Polynucleotide
taatacgactcactataggggtagcccatacgaggacggcctgggaatggaacagaggagaccattcatgggccgtcctaacctggcggcagcgcaaaagatg

SEQ ID NO: 26903 - DNA, 103 bp, Artificial Sequence
  Synthetic Polynucleotide
taatacgactcactatagggtccccgtagcccatacgaggacggcctgggaacagaggagacccaggatgtcctcgtataacctggcggcagcgcaaaagatg

SEQ ID NO: 26904 - DNA, 103 bp, Artificial Sequence
  Synthetic Polynucleotide
taatacgactcactatagggccagatccccgtagcccatacgaggacggcaacagaggagagccgtcatggtatgggctaacctggcggcagcgcaaaagatg

SEQ ID NO: 26905 - DNA, 103 bp, Artificial Sequence
  Synthetic Polynucleotide
taatacgactcactatagggcgcccccagatccccgtagcccatacgaggaacagaggagacctcgtatgggctacgggaacctggcggcagcgcaaaagatg

SEQ ID NO: 26906 - DNA, 103 bp, Artificial Sequence
  Synthetic Polynucleotide
taatacgactcactatagggggtctcgcccccagatccccgtagcccataaacagaggagatatgggatgcggggatctaacctggcggcagcgcaaaagatg

SEQ ID NO: 26907 - DNA, 103 bp, Artificial Sequence
  Synthetic Polynucleotide
taatacgactcactataggggcttcggtctcgcccccagatccccgtagcaacagaggagagctacgatgatctgggggaacctggcggcagcgcaaaagatg

SEQ ID NO: 26908 - DNA, 103 bp, Artificial Sequence
  Synthetic Polynucleotide
taatacgactcactatagggttggcgcttcggtctcgcccccagatccccaacagaggagaggggatatgggggcgagaaacctggcggcagcgcaaaagatg

SEQ ID NO: 26909 - DNA, 103 bp, Artificial Sequence
  Synthetic Polynucleotide
taatacgactcactatagggctatttggcagaaaaacagcatctacttagaacagaggagactaagtatgtgctgttttaacctggcggcagcgcaaaagatg

SEQ ID NO: 26910 - DNA, 103 bp, Artificial Sequence
  Synthetic Polynucleotide
taatacgactcactataggggtcggttggcgcttcggtctcgcccccagaaacagaggagatctgggatggagaccgaaaacctggcggcagcgcaaaagatg

SEQ ID NO: 26911 - DNA, 103 bp, Artificial Sequence
  Synthetic Polynucleotide
taatacgactcactataggggaggtgtcggttggcgcttcggtctcgcccaacagaggagagggcgaatgcgaagcgccaacctggcggcagcgcaaaagatg

SEQ ID NO: 26912 - DNA, 103 bp, Artificial Sequence
  Synthetic Polynucleotide
taatacgactcactatagggaagatgaggtgtcggttggcgcttcggtctaacagaggagaagaccgatgcgccaaccgaacctggcggcagcgcaaaagatg

SEQ ID NO: 26913 - DNA, 103 bp, Artificial Sequence
  Synthetic Polynucleotide
taatacgactcactatagggtaccaaagatgaggtgtcggttggcgcttcaacagaggagagaagcgatgaccgacaccaacctggcggcagcgcaaaagatg

SEQ ID NO: 26914 - DNA, 103 bp, Artificial Sequence
  Synthetic Polynucleotide
taatacgactcactatagggggggataccaaagatgaggtgtcggttggcaacagaggagagccaacatgcacctcatcaacctggcggcagcgcaaaagatg

SEQ ID NO: 26915 - DNA, 103 bp, Artificial Sequence
  Synthetic Polynucleotide
taatacgactcactataggggggggggggataccaaagatgaggtgtcggaacagaggagaccgacaatgcatctttggaacctggcggcagcgcaaaagatg

SEQ ID NO: 26916 - DNA, 103 bp, Artificial Sequence
  Synthetic Polynucleotide
taatacgactcactataggggaggtgggggggggataccaaagatgaggtaacagaggagaacctcaatgttggtatccaacctggcggcagcgcaaaagatg

SEQ ID NO: 26917 - DNA, 103 bp, Artificial Sequence
  Synthetic Polynucleotide
taatacgactcactataggggggctgaggtgggggggggataccaaagataacagaggagaatctttatgatcccccccaacctggcggcagcgcaaaagatg

SEQ ID NO: 26918 - DNA, 103 bp, Artificial Sequence
  Synthetic Polynucleotide
taatacgactcactatagggaccaggggctgaggtgggggggggataccaaacagaggagatggtatatgccccccaccaacctggcggcagcgcaaaagatg

SEQ ID NO: 26919 - DNA, 103 bp, Artificial Sequence
  Synthetic Polynucleotide
taatacgactcactatagggtctgaaccaggggctgaggtgggggggggaaacagaggagatcccccatgcacctcagcaacctggcggcagcgcaaaagatg

SEQ ID NO: 26920 - DNA, 103 bp, Artificial Sequence
  Synthetic Polynucleotide
taatacgactcactatagggactatctatttggcagaaaaacagcatctaaacagaggagatagatgatgtttttctgcaacctggcggcagcgcaaaagatg

SEQ ID NO: 26921 - DNA, 103 bp, Artificial Sequence
  Synthetic Polynucleotide
taatacgactcactataggggggtctctgaaccaggggctgaggtgggggaacagaggagacccccaatgcagcccctgaacctggcggcagcgcaaaagatg

SEQ ID NO: 26922 - DNA, 103 bp, Artificial Sequence
  Synthetic Polynucleotide
taatacgactcactataggggtggggggtctctgaaccaggggctgaggtaacagaggagaacctcaatgcctggttcaaacctggcggcagcgcaaaagatg

SEQ ID NO: 26923 - DNA, 103 bp, Artificial Sequence
  Synthetic Polynucleotide
taatacgactcactatagggcgctcgtggggggtctctgaaccaggggctaacagaggagaagccccatgttcagagacaacctggcggcagcgcaaaagatg

SEQ ID NO: 26924 - DNA, 103 bp, Artificial Sequence
  Synthetic Polynucleotide
taatacgactcactatagggcccggcgctcgtggggggtctctgaaccagaacagaggagactggttatgagaccccccaacctggcggcagcgcaaaagatg

SEQ ID NO: 26925 - DNA, 103 bp, Artificial Sequence
  Synthetic Polynucleotide
taatacgactcactataggggccgacccggcgctcgtggggggtctctgaaacagaggagatcagagatgccccacgagaacctggcggcagcgcaaaagatg

SEQ ID NO: 26926 - DNA, 103 bp, Artificial Sequence
  Synthetic Polynucleotide
taatacgactcactatagggaggcggccgacccggcgctcgtggggggtcaacagaggagagaccccatgcgagcgccgaacctggcggcagcgcaaaagatg

SEQ ID NO: 26927 - DNA, 103 bp, Artificial Sequence
  Synthetic Polynucleotide
taatacgactcactatagggccagaaggcggccgacccggcgctcgtgggaacagaggagacccacgatggccgggtcgaacctggcggcagcgcaaaagatg

SEQ ID NO: 26928 - DNA, 103 bp, Artificial Sequence
  Synthetic Polynucleotide
taatacgactcactataggggccttccagaaggcggccgacccggcgctcaacagaggagagagcgcatggtcggccgcaacctggcggcagcgcaaaagatg

SEQ ID NO: 26929 - DNA, 103 bp, Artificial Sequence
  Synthetic Polynucleotide
taatacgactcactatagggtcgatgccttccagaaggcggccgacccggaacagaggagaccgggtatgccgccttctaacctggcggcagcgcaaaagatg

SEQ ID NO: 26930 - DNA, 103 bp, Artificial Sequence
  Synthetic Polynucleotide
taatacgactcactatagggggtcttcgatgccttccagaaggcggccgaaacagaggagatcggccatgttctggaagaacctggcggcagcgcaaaagatg

SEQ ID NO: 26931 - DNA, 103 bp, Artificial Sequence
  Synthetic Polynucleotide
taatacgactcactatagggttataactatctatttggcagaaaaacagcaacagaggagagctgttatgctgccaaataacctggcggcagcgcaaaagatg

SEQ ID NO: 26932 - DNA, 103 bp, Artificial Sequence
  Synthetic Polynucleotide
taatacgactcactataggggagcaggtcttcgatgccttccagaaggcgaacagaggagacgccttatggaaggcatcaacctggcggcagcgcaaaagatg

SEQ ID NO: 26933 - DNA, 103 bp, Artificial Sequence
  Synthetic Polynucleotide
taatacgactcactatagggcgttggagcaggtcttcgatgccttccagaaacagaggagatctggaatgcatcgaagaaacctggcggcagcgcaaaagatg

SEQ ID NO: 26934 - DNA, 103 bp, Artificial Sequence
  Synthetic Polynucleotide
taatacgactcactatagggtcaggcgttggagcaggtcttcgatgccttaacagaggagaaaggcaatgaagacctgcaacctggcggcagcgcaaaagatg

SEQ ID NO: 26935 - DNA, 103 bp, Artificial Sequence
  Synthetic Polynucleotide
taatacgactcactatagggttctctcaggcgttggagcaggtcttcgataacagaggagaatcgaaatgctgctccaaaacctggcggcagcgcaaaagatg

SEQ ID NO: 26936 - DNA, 103 bp, Artificial Sequence
  Synthetic Polynucleotide
taatacgactcactatagggagttcttctctcaggcgttggagcaggtctaacagaggagaagacctatgccaacgcctaacctggcggcagcgcaaaagatg

SEQ ID NO: 26937 - DNA, 103 bp, Artificial Sequence
  Synthetic Polynucleotide
taatacgactcactataggggatgtagttcttctctcaggcgttggagcaaacagaggagatgctccatggcctgagagaacctggcggcagcgcaaaagatg

SEQ ID NO: 26938 - DNA, 103 bp, Artificial Sequence
  Synthetic Polynucleotide
taatacgactcactatagggatggtgatgtagttcttctctcaggcgttgaacagaggagacaacgcatgagagaagaaaacctggcggcagcgcaaaagatg

SEQ ID NO: 26939 - DNA, 103 bp, Artificial Sequence
  Synthetic Polynucleotide
taatacgactcactatagggtgccaatggtgatgtagttcttctctcaggaacagaggagacctgagatgagaactacaaacctggcggcagcgcaaaagatg

SEQ ID NO: 26940 - DNA, 103 bp, Artificial Sequence
  Synthetic Polynucleotide
taatacgactcactatagggcttcttgccaatggtgatgtagttcttctcaacagaggagagagaagatgtacatcaccaacctggcggcagcgcaaaagatg

SEQ ID NO: 26941 - DNA, 103 bp, Artificial Sequence
  Synthetic Polynucleotide
taatacgactcactatagggtttttcttcttgccaatggtgatgtagttcaacagaggagagaactaatgcaccattggaacctggcggcagcgcaaaagatg

SEQ ID NO: 26942 - DNA, 103 bp, Artificial Sequence
  Synthetic Polynucleotide
taatacgactcactatagggtcgttttataactatctatttggcagaaaaaacagaggagattttctatgaaatagataaacctggcggcagcgcaaaagatg

SEQ ID NO: 26943 - DNA, 103 bp, Artificial Sequence
  Synthetic Polynucleotide
taatacgactcactatagggcgtcctttttcttcttgccaatggtgatgtaacagaggagaacatcaatgttggcaagaaacctggcggcagcgcaaaagatg

SEQ ID NO: 26944 - DNA, 103 bp, Artificial Sequence
  Synthetic Polynucleotide
taatacgactcactataggggaccccgtcctttttcttcttgccaatggtaacagaggagaaccattatgaagaagaaaaacctggcggcagcgcaaaagatg

SEQ ID NO: 26945 - DNA, 103 bp, Artificial Sequence
  Synthetic Polynucleotide
taatacgactcactatagggatctggaccccgtcctttttcttcttgccaaacagaggagatggcaaatggaaaaaggaaacctggcggcagcgcaaaagatg

SEQ ID NO: 26946 - DNA, 103 bp, Artificial Sequence
  Synthetic Polynucleotide
taatacgactcactatagggagtggatctggaccccgtcctttttcttctaacagaggagaagaagaatgaggacggggaacctggcggcagcgcaaaagatg

SEQ ID NO: 26947 - DNA, 103 bp, Artificial Sequence
  Synthetic Polynucleotide
taatacgactcactatagggctttcagtggatctggaccccgtcctttttaacagaggagaaaaaagatgggggtccagaacctggcggcagcgcaaaagatg

SEQ ID NO: 26948 - DNA, 103 bp, Artificial Sequence
  Synthetic Polynucleotide
taatacgactcactataggggtagtctttcagtggatctggaccccgtccaacagaggagaggacggatgccagatccaaacctggcggcagcgcaaaagatg

SEQ ID NO: 26949 - DNA, 103 bp, Artificial Sequence
  Synthetic Polynucleotide
taatacgactcactatagggggaatgtagtctttcagtggatctggacccaacagaggagagggtccatgtccactgaaaacctggcggcagcgcaaaagatg

SEQ ID NO: 26950 - DNA, 103 bp, Artificial Sequence
  Synthetic Polynucleotide
taatacgactcactatagggggggtggaatgtagtctttcagtggatctgaacagaggagacagatcatgtgaaagactaacctggcggcagcgcaaaagatg

SEQ ID NO: 26951 - DNA, 103 bp, Artificial Sequence
  Synthetic Polynucleotide
taatacgactcactatagggacgtgggggtggaatgtagtctttcagtggaacagaggagaccactgatggactacattaacctggcggcagcgcaaaagatg

SEQ ID NO: 26952 - DNA, 103 bp, Artificial Sequence
  Synthetic Polynucleotide
taatacgactcactatagggcgcggacgtgggggtggaatgtagtctttcaacagaggagagaaagaatgcattccaccaacctggcggcagcgcaaaagatg

SEQ ID NO: 26953 - DNA, 103 bp, Artificial Sequence
  Synthetic Polynucleotide
taatacgactcactatagggatgtttcgttttataactatctatttggcaaacagaggagatgccaaatggatagttataacctggcggcagcgcaaaagatg

SEQ ID NO: 26954 - DNA, 103 bp, Artificial Sequence
  Synthetic Polynucleotide
taatacgactcactatagggttcttcgcggacgtgggggtggaatgtagtaacagaggagaactacaatgcacccccacaacctggcggcagcgcaaaagatg

SEQ ID NO: 26955 - DNA, 103 bp, Artificial Sequence
  Synthetic Polynucleotide
taatacgactcactatagggggtccttcttcgcggacgtgggggtggaataacagaggagaattccaatgccacgtccgaacctggcggcagcgcaaaagatg

SEQ ID NO: 26956 - DNA, 103 bp, Artificial Sequence
  Synthetic Polynucleotide
taatacgactcactatagggaggagggtccttcttcgcggacgtgggggtaacagaggagaacccccatgtccgcgaagaacctggcggcagcgcaaaagatg

SEQ ID NO: 26957 - DNA, 103 bp, Artificial Sequence
  Synthetic Polynucleotide
taatacgactcactatagggattacaggagggtccttcttcgcggacgtgaacagaggagacacgtcatggaagaaggaaacctggcggcagcgcaaaagatg

SEQ ID NO: 26958 - DNA, 103 bp, Artificial Sequence
  Synthetic Polynucleotide
taatacgactcactatagggctatgattacaggagggtccttcttcgcggaacagaggagaccgcgaatgaggaccctcaacctggcggcagcgcaaaagatg

SEQ ID NO: 26959 - DNA, 103 bp, Artificial Sequence
  Synthetic Polynucleotide
taatacgactcactatagggccgcactatgattacaggagggtccttcttaacagaggagaaagaagatgcctcctgtaaacctggcggcagcgcaaaagatg

SEQ ID NO: 26960 - DNA, 103 bp, Artificial Sequence
  Synthetic Polynucleotide
taatacgactcactatagggaggccccgcactatgattacaggagggtccaacagaggagaggacccatgtgtaatcataacctggcggcagcgcaaaagatg

SEQ ID NO: 26961 - DNA, 103 bp, Artificial Sequence
  Synthetic Polynucleotide
taatacgactcactatagggtgggcaggccccgcactatgattacaggagaacagaggagactcctgatgtcatagtgcaacctggcggcagcgcaaaagatg

SEQ ID NO: 26962 - DNA, 103 bp, Artificial Sequence
  Synthetic Polynucleotide
taatacgactcactatagggctggttgggcaggccccgcactatgattacaacagaggagagtaatcatggtgcggggcaacctggcggcagcgcaaaagatg

SEQ ID NO: 26963 - DNA, 103 bp, Artificial Sequence
  Synthetic Polynucleotide
taatacgactcactatagggttcagctggttgggcaggccccgcactatgaacagaggagacatagtatggggcctgccaacctggcggcagcgcaaaagatg

SEQ ID NO: 26964 - DNA, 103 bp, Artificial Sequence
  Synthetic Polynucleotide
taatacgactcactataggggggctatgtttcgttttataactatctattaacagaggagaaatagaatgttataaaacaacctggcggcagcgcaaaagatg

SEQ ID NO: 26965 - DNA, 103 bp, Artificial Sequence
  Synthetic Polynucleotide
taatacgactcactatagggacgtcttcagctggttgggcaggccccgcaaacagaggagatgcgggatgtgcccaaccaacctggcggcagcgcaaaagatg

SEQ ID NO: 26966 - DNA, 103 bp, Artificial Sequence
  Synthetic Polynucleotide
taatacgactcactatagggcctccacgtcttcagctggttgggcaggccaacagaggagaggcctgatgaaccagctgaacctggcggcagcgcaaaagatg

SEQ ID NO: 26967 - DNA, 103 bp, Artificial Sequence
  Synthetic Polynucleotide
taatacgactcactatagggcgatacctccacgtcttcagctggttgggcaacagaggagagcccaaatggctgaagacaacctggcggcagcgcaaaagatg

SEQ ID NO: 26968 - DNA, 103 bp, Artificial Sequence
  Synthetic Polynucleotide
taatacgactcactataggggtagccgatacctccacgtcttcagctggtaacagaggagaaccagcatgagacgtggaaacctggcggcagcgcaaaagatg

SEQ ID NO: 26969 - DNA, 103 bp, Artificial Sequence
  Synthetic Polynucleotide
taatacgactcactataggggttgtgtagccgatacctccacgtcttcagaacagaggagactgaagatgtggaggtataacctggcggcagcgcaaaagatg

SEQ ID NO: 26970 - DNA, 103 bp, Artificial Sequence
  Synthetic Polynucleotide
taatacgactcactatagggctcctgttgtgtagccgatacctccacgtcaacagaggagagacgtgatggtatcggctaacctggcggcagcgcaaaagatg

SEQ ID NO: 26971 - DNA, 103 bp, Artificial Sequence
  Synthetic Polynucleotide
taatacgactcactatagggtctttctcctgttgtgtagccgatacctccaacagaggagaggaggtatgggctacacaaacctggcggcagcgcaaaagatg

SEQ ID NO: 26972 - DNA, 103 bp, Artificial Sequence
  Synthetic Polynucleotide
taatacgactcactatagggcagtttctttctcctgttgtgtagccgataaacagaggagatatcggatgcacaacaggaacctggcggcagcgcaaaagatg

SEQ ID NO: 26973 - DNA, 103 bp, Artificial Sequence
  Synthetic Polynucleotide
taatacgactcactatagggaaaggcagtttctttctcctgttgtgtagcaacagaggagagctacaatgcaggagaaaaacctggcggcagcgcaaaagatg

SEQ ID NO: 26974 - DNA, 103 bp, Artificial Sequence
  Synthetic Polynucleotide
taatacgactcactatagggaaagaaaaggcagtttctttctcctgttgtaacagaggagaacaacaatggaaagaaacaacctggcggcagcgcaaaagatg

SEQ ID NO: 26975 - DNA, 103 bp, Artificial Sequence
  Synthetic Polynucleotide
taatacgactcactatagggaccctgggctatgtttcgttttataactataacagaggagaatagttatgaaacgaaacaacctggcggcagcgcaaaagatg

SEQ ID NO: 26976 - DNA, 103 bp, Artificial Sequence
  Synthetic Polynucleotide
taatacgactcactatagggaagataaagaaaaggcagtttctttctcctaacagaggagaaggagaatgaaactgcctaacctggcggcagcgcaaaagatg

SEQ ID NO: 26977 - DNA, 103 bp, Artificial Sequence
  Synthetic Polynucleotide
taatacgactcactataggggtgctaagataaagaaaaggcagtttctttaacagaggagaaaagaaatggccttttctaacctggcggcagcgcaaaagatg

SEQ ID NO: 26978 - DNA, 103 bp, Artificial Sequence
  Synthetic Polynucleotide
taatacgactcactatagggaagtagtgctaagataaagaaaaggcagttaacagaggagaaactgcatgttctttatcaacctggcggcagcgcaaaagatg

SEQ ID NO: 26979 - DNA, 103 bp, Artificial Sequence
  Synthetic Polynucleotide
taatacgactcactatagggtgaaaaagtagtgctaagataaagaaaaggaacagaggagaccttttatgtatcttagcaacctggcggcagcgcaaaagatg

SEQ ID NO: 26980 - DNA, 103 bp, Artificial Sequence
  Synthetic Polynucleotide
taatacgactcactatagggacccatgaaaaagtagtgctaagataaagaaacagaggagatctttaatgtagcactacaacctggcggcagcgcaaaagatg

SEQ ID NO: 26981 - DNA, 103 bp, Artificial Sequence
  Synthetic Polynucleotide
taatacgactcactataggggggtcacccatgaaaaagtagtgctaagataacagaggagaatcttaatgctactttttaacctggcggcagcgcaaaagatg

SEQ ID NO: 26982 - DNA, 103 bp, Artificial Sequence
  Synthetic Polynucleotide
taatacgactcactatagggtttacgggtcacccatgaaaaagtagtgctaacagaggagaagcactatgttttcatggaacctggcggcagcgcaaaagatg

SEQ ID NO: 26983 - DNA, 103 bp, Artificial Sequence
  Synthetic Polynucleotide
taatacgactcactatagggccccctttacgggtcacccatgaaaaagtaaacagaggagatactttatgatgggtgacaacctggcggcagcgcaaaagatg

SEQ ID NO: 26984 - DNA, 103 bp, Artificial Sequence
  Synthetic Polynucleotide
taatacgactcactatagggtgtccccccctttacgggtcacccatgaaaaacagaggagatttcatatgtgacccgtaaacctggcggcagcgcaaaagatg

SEQ ID NO: 26985 - DNA, 103 bp, Artificial Sequence
  Synthetic Polynucleotide
taatacgactcactatagggtagcctgtccccccctttacgggtcacccaaacagaggagatgggtgatgcgtaaagggaacctggcggcagcgcaaaagatg

SEQ ID NO: 26986 - DNA, 103 bp, Artificial Sequence
  Synthetic Polynucleotide
taatacgactcactatagggtacccaccctgggctatgtttcgttttataaacagaggagatataaaatgaaacatagcaacctggcggcagcgcaaaagatg

SEQ ID NO: 26987 - DNA, 103 bp, Artificial Sequence
  Synthetic Polynucleotide
taatacgactcactataggggatgatagcctgtccccccctttacgggtcaacagaggagagacccgatgagggggggaaacctggcggcagcgcaaaagatg

SEQ ID NO: 26988 - DNA, 103 bp, Artificial Sequence
  Synthetic Polynucleotide
taatacgactcactataggggtgtggatgatagcctgtccccccctttacaacagaggagagtaaagatggggacaggcaacctggcggcagcgcaaaagatg

SEQ ID NO: 26989 - DNA, 103 bp, Artificial Sequence
  Synthetic Polynucleotide
taatacgactcactatagggcatgcgtgtggatgatagcctgtcccccccaacagaggagaggggggatgaggctatcaaacctggcggcagcgcaaaagatg

SEQ ID NO: 26990 - DNA, 103 bp, Artificial Sequence
  Synthetic Polynucleotide
taatacgactcactatagggacgagcatgcgtgtggatgatagcctgtccaacagaggagaggacagatgatcatccacaacctggcggcagcgcaaaagatg

SEQ ID NO: 26991 - DNA, 103 bp, Artificial Sequence
  Synthetic Polynucleotide
taatacgactcactatagggatgccacgagcatgcgtgtggatgatagccaacagaggagaggctatatgccacacgcaaacctggcggcagcgcaaaagatg

SEQ ID NO: 26992 - DNA, 103 bp, Artificial Sequence
  Synthetic Polynucleotide
taatacgactcactatagggagcaaatgccacgagcatgcgtgtggatgaaacagaggagatcatccatgcgcatgctcaacctggcggcagcgcaaaagatg

SEQ ID NO: 26993 - DNA, 103 bp, Artificial Sequence
  Synthetic Polynucleotide
taatacgactcactatagggtaactagcaaatgccacgagcatgcgtgtgaacagaggagacacacgatggctcgtggcaacctggcggcagcgcaaaagatg

SEQ ID NO: 26994 - DNA, 103 bp, Artificial Sequence
  Synthetic Polynucleotide
taatacgactcactatagggcactgtaactagcaaatgccacgagcatgcaacagaggagagcatgcatgtggcatttgaacctggcggcagcgcaaaagatg

SEQ ID NO: 26995 - DNA, 103 bp, Artificial Sequence
  Synthetic Polynucleotide
taatacgactcactatagggcctatcactgtaactagcaaatgccacgagaacagaggagactcgtgatgtttgctagtaacctggcggcagcgcaaaagatg

SEQ ID NO: 26996 - DNA, 103 bp, Artificial Sequence
  Synthetic Polynucleotide
taatacgactcactatagggtagctcctatcactgtaactagcaaatgccaacagaggagaggcattatgtagttacagaacctggcggcagcgcaaaagatg

SEQ ID NO: 26997 - DNA, 103 bp, Artificial Sequence
  Synthetic Polynucleotide
taatacgactcactatagggattattacccaccctgggctatgtttcgttaacagaggagaaacgaaatgtagcccaggaacctggcggcagcgcaaaagatg

SEQ ID NO: 26998 - DNA, 103 bp, Artificial Sequence
  Synthetic Polynucleotide
taatacgactcactatagggggaagtagctcctatcactgtaactagcaaaacagaggagattgctaatgacagtgataaacctggcggcagcgcaaaagatg

SEQ ID NO: 26999 - DNA, 103 bp, Artificial Sequence
  Synthetic Polynucleotide
taatacgactcactatagggtcttaggaagtagctcctatcactgtaactaacagaggagaagttacatggataggagcaacctggcggcagcgcaaaagatg

SEQ ID NO: 27000 - DNA, 103 bp, Artificial Sequence
  Synthetic Polynucleotide
taatacgactcactatagggacatgtcttaggaagtagctcctatcactgaacagaggagacagtgaatggagctacttaacctggcggcagcgcaaaagatg

SEQ ID NO: 27001 - DNA, 103 bp, Artificial Sequence
  Synthetic Polynucleotide
taatacgactcactatagggatactacatgtcttaggaagtagctcctataacagaggagaataggaatgacttcctaaaacctggcggcagcgcaaaagatg

SEQ ID NO: 27002 - DNA, 103 bp, Artificial Sequence
  Synthetic Polynucleotide
taatacgactcactataggggggaaatactacatgtcttaggaagtagctaacagaggagaagctacatgctaagacataacctggcggcagcgcaaaagatg

SEQ ID NO: 27003 - DNA, 103 bp, Artificial Sequence
  Synthetic Polynucleotide
taatacgactcactatagggccagggggaaatactacatgtcttaggaagaacagaggagacttcctatgacatgtagtaacctggcggcagcgcaaaagatg

SEQ ID NO: 27004 - DNA, 103 bp, Artificial Sequence
  Synthetic Polynucleotide
taatacgactcactatagggtaactccagggggaaatactacatgtcttaaacagaggagataagacatgtagtatttcaacctggcggcagcgcaaaagatg

SEQ ID NO: 27005 - DNA, 103 bp, Artificial Sequence
  Synthetic Polynucleotide
taatacgactcactatagggaaatgtaactccagggggaaatactacatgaacagaggagacatgtaatgtttccccctaacctggcggcagcgcaaaagatg

SEQ ID NO: 27006 - DNA, 103 bp, Artificial Sequence
  Synthetic Polynucleotide
taatacgactcactatagggaggctaaatgtaactccagggggaaatactaacagaggagaagtattatgccctggagtaacctggcggcagcgcaaaagatg

SEQ ID NO: 27007 - DNA, 103 bp, Artificial Sequence
  Synthetic Polynucleotide
taatacgactcactatagggagccaaggctaaatgtaactccagggggaaaacagaggagattccccatggagttacataacctggcggcagcgcaaaagatg

SEQ ID NO: 27008 - DNA, 103 bp, Artificial Sequence
  Synthetic Polynucleotide
taatacgactcactataggggggcaactacaaagatacagtgcaaccagtaacagaggagaactggtatgactgtatctaacctggcggcagcgcaaaagatg

SEQ ID NO: 27009 - DNA, 103 bp, Artificial Sequence
  Synthetic Polynucleotide
taatacgactcactatagggtagacattattacccaccctgggctatgttaacagaggagaaacataatgcagggtgggaacctggcggcagcgcaaaagatg

SEQ ID NO: 27010 - DNA, 103 bp, Artificial Sequence
  Synthetic Polynucleotide
taatacgactcactatagggaaagtagccaaggctaaatgtaactccaggaacagaggagacctggaatgacatttagcaacctggcggcagcgcaaaagatg

SEQ ID NO: 27011 - DNA, 103 bp, Artificial Sequence
  Synthetic Polynucleotide
taatacgactcactatagggccataaaagtagccaaggctaaatgtaactaacagaggagaagttacatgtagccttggaacctggcggcagcgcaaaagatg

SEQ ID NO: 27012 - DNA, 103 bp, Artificial Sequence
  Synthetic Polynucleotide
taatacgactcactatagggacaatccataaaagtagccaaggctaaatgaacagaggagacatttaatgttggctactaacctggcggcagcgcaaaagatg

SEQ ID NO: 27013 - DNA, 103 bp, Artificial Sequence
  Synthetic Polynucleotide
taatacgactcactatagggcccttacaatccataaaagtagccaaggctaacagaggagaagccttatgtacttttataacctggcggcagcgcaaaagatg

SEQ ID NO: 27014 - DNA, 103 bp, Artificial Sequence
  Synthetic Polynucleotide
taatacgactcactatagggatcaacccttacaatccataaaagtagccaaacagaggagatggctaatgttatggattaacctggcggcagcgcaaaagatg

SEQ ID NO: 27015 - DNA, 103 bp, Artificial Sequence
  Synthetic Polynucleotide
taatacgactcactatagggtacccatcaacccttacaatccataaaagtaacagaggagaacttttatggattgtaagaacctggcggcagcgcaaaagatg

SEQ ID NO: 27016 - DNA, 103 bp, Artificial Sequence
  Synthetic Polynucleotide
taatacgactcactatagggacaaatacccatcaacccttacaatccataaacagaggagatatggaatgtaagggttgaacctggcggcagcgcaaaagatg

SEQ ID NO: 27017 - DNA, 103 bp, Artificial Sequence
  Synthetic Polynucleotide
taatacgactcactatagggacaagacaaatacccatcaacccttacaataacagaggagaattgtaatggttgatgggaacctggcggcagcgcaaaagatg

SEQ ID NO: 27018 - DNA, 103 bp, Artificial Sequence
  Synthetic Polynucleotide
taatacgactcactatagggacaaaacaagacaaatacccatcaacccttaacagaggagaaagggtatgtgggtatttaacctggcggcagcgcaaaagatg

SEQ ID NO: 27019 - DNA, 103 bp, Artificial Sequence
  Synthetic Polynucleotide
taatacgactcactatagggaacatacaaaacaagacaaatacccatcaaaacagaggagattgatgatgatttgtcttaacctggcggcagcgcaaaagatg

SEQ ID NO: 27020 - DNA, 103 bp, Artificial Sequence
  Synthetic Polynucleotide
taatacgactcactataggggtagatagacattattacccaccctgggctaacagaggagaagcccaatgtgggtaataaacctggcggcagcgcaaaagatg

SEQ ID NO: 27021 - DNA, 103 bp, Artificial Sequence
  Synthetic Polynucleotide
taatacgactcactatagggcaaagaacatacaaaacaagacaaatacccaacagaggagagggtatatgtcttgttttaacctggcggcagcgcaaaagatg

SEQ ID NO: 27022 - DNA, 103 bp, Artificial Sequence
  Synthetic Polynucleotide
taatacgactcactatagggatttacaaagaacatacaaaacaagacaaaaacagaggagatttgtcatgttttgtatgaacctggcggcagcgcaaaagatg

SEQ ID NO: 27023 - DNA, 103 bp, Artificial Sequence
  Synthetic Polynucleotide
taatacgactcactatagggccaatatttacaaagaacatacaaaacaagaacagaggagacttgttatgtatgttcttaacctggcggcagcgcaaaagatg

SEQ ID NO: 27024 - DNA, 103 bp, Artificial Sequence
  Synthetic Polynucleotide
taatacgactcactatagggcactcccaatatttacaaagaacatacaaaaacagaggagatttgtaatgtctttgtaaaacctggcggcagcgcaaaagatg

SEQ ID NO: 27025 - DNA, 103 bp, Artificial Sequence
  Synthetic Polynucleotide
taatacgactcactatagggtaacccactcccaatatttacaaagaacataacagaggagaatgttcatggtaaatattaacctggcggcagcgcaaaagatg

SEQ ID NO: 27026 - DNA, 103 bp, Artificial Sequence
  Synthetic Polynucleotide
taatacgactcactatagggaagtttaacccactcccaatatttacaaagaacagaggagactttgtatgtattgggagaacctggcggcagcgcaaaagatg

SEQ ID NO: 27027 - DNA, 103 bp, Artificial Sequence
  Synthetic Polynucleotide
taatacgactcactatagggatagcaagtttaacccactcccaatatttaaacagaggagataaataatgggagtgggtaacctggcggcagcgcaaaagatg

SEQ ID NO: 27028 - DNA, 103 bp, Artificial Sequence
  Synthetic Polynucleotide
taatacgactcactatagggatagaatagcaagtttaacccactcccaataacagaggagaattgggatggggttaaacaacctggcggcagcgcaaaagatg

SEQ ID NO: 27029 - DNA, 103 bp, Artificial Sequence
  Synthetic Polynucleotide
taatacgactcactatagggtaaatatagaatagcaagtttaacccactcaacagaggagagagtggatgaaacttgctaacctggcggcagcgcaaaagatg

SEQ ID NO: 27030 - DNA, 103 bp, Artificial Sequence
  Synthetic Polynucleotide
taatacgactcactatagggccaggtaaatatagaatagcaagtttaaccaacagaggagaggttaaatgtgctattctaacctggcggcagcgcaaaagatg

SEQ ID NO: 27031 - DNA, 103 bp, Artificial Sequence
  Synthetic Polynucleotide
taatacgactcactatagggggattgtagatagacattattacccaccctaacagaggagaagggtgatgaataatgtcaacctggcggcagcgcaaaagatg

SEQ ID NO: 27032 - DNA, 103 bp, Artificial Sequence
  Synthetic Polynucleotide
taatacgactcactatagggaaatcccaggtaaatatagaatagcaagttaacagaggagaaacttgatgttctatattaacctggcggcagcgcaaaagatg

SEQ ID NO: 27033 - DNA, 103 bp, Artificial Sequence
  Synthetic Polynucleotide
taatacgactcactatagggtaaaaaaatcccaggtaaatatagaatagcaacagaggagagctattatgtatttacctaacctggcggcagcgcaaaagatg

SEQ ID NO: 27034 - DNA, 103 bp, Artificial Sequence
  Synthetic Polynucleotide
taatacgactcactatagggactagtaaaaaaatcccaggtaaatatagaaacagaggagatctataatgacctgggataacctggcggcagcgcaaaagatg

SEQ ID NO: 27035 - DNA, 103 bp, Artificial Sequence
  Synthetic Polynucleotide
taatacgactcactatagggataaaactagtaaaaaaatcccaggtaaataacagaggagaatttacatgggattttttaacctggcggcagcgcaaaagatg

SEQ ID NO: 27036 - DNA, 103 bp, Artificial Sequence
  Synthetic Polynucleotide
taatacgactcactatagggaaacaataaaactagtaaaaaaatcccaggaacagaggagacctgggatgtttttactaaacctggcggcagcgcaaaagatg

SEQ ID NO: 27037 - DNA, 103 bp, Artificial Sequence
  Synthetic Polynucleotide
taatacgactcactatagggcaatgaaacaataaaactagtaaaaaaatcaacagaggagagattttatgactagttttaacctggcggcagcgcaaaagatg

SEQ ID NO: 27038 - DNA, 103 bp, Artificial Sequence
  Synthetic Polynucleotide
taatacgactcactatagggtacagcaatgaaacaataaaactagtaaaaaacagaggagattttacatgttttattgtaacctggcggcagcgcaaaagatg

SEQ ID NO: 27039 - DNA, 103 bp, Artificial Sequence
  Synthetic Polynucleotide
taatacgactcactatagggattattacagcaatgaaacaataaaactagaacagaggagactagttatgttgtttcataacctggcggcagcgcaaaagatg

SEQ ID NO: 27040 - DNA, 103 bp, Artificial Sequence
  Synthetic Polynucleotide
taatacgactcactataggggcaccattattacagcaatgaaacaataaaaacagaggagatttattatgtcattgctgaacctggcggcagcgcaaaagatg

SEQ ID NO: 27041 - DNA, 103 bp, Artificial Sequence
  Synthetic Polynucleotide
taatacgactcactatagggagcccgcaccattattacagcaatgaaacaaacagaggagatgtttcatggctgtaataaacctggcggcagcgcaaaagatg

SEQ ID NO: 27042 - DNA, 103 bp, Artificial Sequence
  Synthetic Polynucleotide
taatacgactcactatagggagtgcggattgtagatagacattattacccaacagaggagagggtaaatgtgtctatctaacctggcggcagcgcaaaagatg

SEQ ID NO: 27043 - DNA, 103 bp, Artificial Sequence
  Synthetic Polynucleotide
taatacgactcactatagggctagcagcccgcaccattattacagcaatgaacagaggagacattgcatgaataatggtaacctggcggcagcgcaaaagatg

SEQ ID NO: 27044 - DNA, 103 bp, Artificial Sequence
  Synthetic Polynucleotide
taatacgactcactatagggtccgcctagcagcccgcaccattattacagaacagaggagactgtaaatgtggtgcgggaacctggcggcagcgcaaaagatg

SEQ ID NO: 27045 - DNA, 103 bp, Artificial Sequence
  Synthetic Polynucleotide
taatacgactcactatagggccgcttccgcctagcagcccgcaccattataacagaggagaataatgatgcgggctgctaacctggcggcagcgcaaaagatg

SEQ ID NO: 27046 - DNA, 103 bp, Artificial Sequence
  Synthetic Polynucleotide
taatacgactcactataggggaagcccgcttccgcctagcagcccgcaccaacagaggagaggtgcgatgtgctaggcgaacctggcggcagcgcaaaagatg

SEQ ID NO: 27047 - DNA, 103 bp, Artificial Sequence
  Synthetic Polynucleotide
taatacgactcactatagggcttcagaagcccgcttccgcctagcagcccaacagaggagagggctgatgggcggaagcaacctggcggcagcgcaaaagatg

SEQ ID NO: 27048 - DNA, 103 bp, Artificial Sequence
  Synthetic Polynucleotide
taatacgactcactatagggatcatcttcagaagcccgcttccgcctagcaacagaggagagctaggatgaagcgggctaacctggcggcagcgcaaaagatg

SEQ ID NO: 27049 - DNA, 103 bp, Artificial Sequence
  Synthetic Polynucleotide
taatacgactcactatagggtacaaatcatcttcagaagcccgcttccgcaacagaggagagcggaaatgggcttctgaaacctggcggcagcgcaaaagatg

SEQ ID NO: 27050 - DNA, 103 bp, Artificial Sequence
  Synthetic Polynucleotide
taatacgactcactatagggtccgatacaaatcatcttcagaagcccgctaacagaggagaagcgggatgctgaagatgaacctggcggcagcgcaaaagatg

SEQ ID NO: 27051 - DNA, 103 bp, Artificial Sequence
  Synthetic Polynucleotide
taatacgactcactataggggcagttccgatacaaatcatcttcagaagcaacagaggagagcttctatggatgatttgaacctggcggcagcgcaaaagatg

SEQ ID NO: 27052 - DNA, 103 bp, Artificial Sequence
  Synthetic Polynucleotide
taatacgactcactatagggaaccggcagttccgatacaaatcatcttcaaacagaggagatgaagaatgtttgtatcgaacctggcggcagcgcaaaagatg

SEQ ID NO: 27053 - DNA, 103 bp, Artificial Sequence
  Synthetic Polynucleotide
taatacgactcactatagggtacggagtgcggattgtagatagacattataacagaggagaataatgatgatctacaataacctggcggcagcgcaaaagatg

SEQ ID NO: 27054 - DNA, 103 bp, Artificial Sequence
  Synthetic Polynucleotide
taatacgactcactatagggctcccaaccggcagttccgatacaaatcataacagaggagaatgattatgatcggaactaacctggcggcagcgcaaaagatg

SEQ ID NO: 27055 - DNA, 103 bp, Artificial Sequence
  Synthetic Polynucleotide
taatacgactcactatagggatcgcctcccaaccggcagttccgatacaaaacagaggagattgtatatgaactgccggaacctggcggcagcgcaaaagatg

SEQ ID NO: 27056 - DNA, 103 bp, Artificial Sequence
  Synthetic Polynucleotide
taatacgactcactatagggggacaatcgcctcccaaccggcagttccgaaacagaggagatcggaaatgccggttgggaacctggcggcagcgcaaaagatg

SEQ ID NO: 27057 - DNA, 103 bp, Artificial Sequence
  Synthetic Polynucleotide
taatacgactcactatagggcaacaggacaatcgcctcccaaccggcagtaacagaggagaactgccatgtgggaggcgaacctggcggcagcgcaaaagatg

SEQ ID NO: 27058 - DNA, 103 bp, Artificial Sequence
  Synthetic Polynucleotide
taatacgactcactatagggaatgtcaacaggacaatcgcctcccaaccgaacagaggagacggttgatgggcgattgtaacctggcggcagcgcaaaagatg

SEQ ID NO: 27059 - DNA, 103 bp, Artificial Sequence
  Synthetic Polynucleotide
taatacgactcactatagggtttttaatgtcaacaggacaatcgcctcccaacagaggagagggaggatgttgtcctgtaacctggcggcagcgcaaaagatg

SEQ ID NO: 27060 - DNA, 103 bp, Artificial Sequence
  Synthetic Polynucleotide
taatacgactcactatagggatttatttttaatgtcaacaggacaatcgcaacagaggagagcgattatgctgttgacaaacctggcggcagcgcaaaagatg

SEQ ID NO: 27061 - DNA, 103 bp, Artificial Sequence
  Synthetic Polynucleotide
taatacgactcactatagggttcatatttatttttaatgtcaacaggacaaacagaggagatgtcctatggacattaaaaacctggcggcagcgcaaaagatg

SEQ ID NO: 27062 - DNA, 103 bp, Artificial Sequence
  Synthetic Polynucleotide
taatacgactcactatagggttttgttcatatttatttttaatgtcaacaaacagaggagatgttgaatgtaaaaataaaacctggcggcagcgcaaaagatg

SEQ ID NO: 27063 - DNA, 103 bp, Artificial Sequence
  Synthetic Polynucleotide
taatacgactcactatagggaggtgttttgttcatatttatttttaatgtaacagaggagaacattaatgataaatatgaacctggcggcagcgcaaaagatg

SEQ ID NO: 27064 - DNA, 103 bp, Artificial Sequence
  Synthetic Polynucleotide
taatacgactcactatagggagcagtacggagtgcggattgtagatagacaacagaggagagtctatatgcaatccgcaaacctggcggcagcgcaaaagatg

SEQ ID NO: 27065 - DNA, 103 bp, Artificial Sequence
  Synthetic Polynucleotide
taatacgactcactatagggagccaaggtgttttgttcatatttatttttaacagaggagaaaaaatatgtatgaacaaaacctggcggcagcgcaaaagatg

SEQ ID NO: 27066 - DNA, 103 bp, Artificial Sequence
  Synthetic Polynucleotide
taatacgactcactatagggttatcagccaaggtgttttgttcatatttaaacagaggagataaataatgacaaaacacaacctggcggcagcgcaaaagatg

SEQ ID NO: 27067 - DNA, 103 bp, Artificial Sequence
  Synthetic Polynucleotide
taatacgactcactatagggaaatattatcagccaaggtgttttgttcataacagaggagaatgaacatgacaccttggaacctggcggcagcgcaaaagatg

SEQ ID NO: 27068 - DNA, 103 bp, Artificial Sequence
  Synthetic Polynucleotide
taatacgactcactatagggctttaaaatattatcagccaaggtgttttgaacagaggagacaaaacatgttggctgataacctggcggcagcgcaaaagatg

SEQ ID NO: 27069 - DNA, 103 bp, Artificial Sequence
  Synthetic Polynucleotide
taatacgactcactatagggacccactttaaaatattatcagccaaggtgaacagaggagacaccttatgtgataatataacctggcggcagcgcaaaagatg

SEQ ID NO: 27070 - DNA, 103 bp, Artificial Sequence
  Synthetic Polynucleotide
taatacgactcactatagggtgctgacccactttaaaatattatcagccaaacagaggagatggctgatgatattttaaaacctggcggcagcgcaaaagatg

SEQ ID NO: 27071 - DNA, 103 bp, Artificial Sequence
  Synthetic Polynucleotide
taatacgactcactataggggaaattgctgacccactttaaaatattatcaacagaggagagataatatgttaaagtggaacctggcggcagcgcaaaagatg

SEQ ID NO: 27072 - DNA, 103 bp, Artificial Sequence
  Synthetic Polynucleotide
taatacgactcactatagggcacaggaaattgctgacccactttaaaataaacagaggagatattttatggtgggtcagaacctggcggcagcgcaaaagatg

SEQ ID NO: 27073 - DNA, 103 bp, Artificial Sequence
  Synthetic Polynucleotide
taatacgactcactatagggcaaaccacaggaaattgctgacccactttaaacagaggagataaagtatgtcagcaattaacctggcggcagcgcaaaagatg

SEQ ID NO: 27074 - DNA, 103 bp, Artificial Sequence
  Synthetic Polynucleotide
taatacgactcactatagggtgtgccaaaccacaggaaattgctgacccaaacagaggagatgggtcatgaatttcctgaacctggcggcagcgcaaaagatg

SEQ ID NO: 27075 - DNA, 103 bp, Artificial Sequence
  Synthetic Polynucleotide
taatacgactcactatagggcgagaagcagtacggagtgcggattgtagaaacagaggagatctacaatgcgcactccgaacctggcggcagcgcaaaagatg

SEQ ID NO: 27076 - DNA, 103 bp, Artificial Sequence
  Synthetic Polynucleotide
taatacgactcactatagggcctaatgtgccaaaccacaggaaattgctgaacagaggagacagcaaatgcctgtggttaacctggcggcagcgcaaaagatg

SEQ ID NO: 27077 - DNA, 103 bp, Artificial Sequence
  Synthetic Polynucleotide
taatacgactcactatagggcaatccctaatgtgccaaaccacaggaaataacagaggagaatttccatgggtttggcaaacctggcggcagcgcaaaagatg

SEQ ID NO: 27078 - DNA, 103 bp, Artificial Sequence
  Synthetic Polynucleotide
taatacgactcactatagggagttccaatccctaatgtgccaaaccacagaacagaggagactgtggatgggcacattaaacctggcggcagcgcaaaagatg

SEQ ID NO: 27079 - DNA, 103 bp, Artificial Sequence
  Synthetic Polynucleotide
taatacgactcactatagggtttccagttccaatccctaatgtgccaaacaacagaggagagtttggatgattagggataacctggcggcagcgcaaaagatg

SEQ ID NO: 27080 - DNA, 103 bp, Artificial Sequence
  Synthetic Polynucleotide
taatacgactcactatagggtaccttttccagttccaatccctaatgtgcaacagaggagagcacatatgggattggaaaacctggcggcagcgcaaaagatg

SEQ ID NO: 27081 - DNA, 103 bp, Artificial Sequence
  Synthetic Polynucleotide
taatacgactcactatagggtcctgtaccttttccagttccaatccctaaaacagaggagattagggatgggaactggaaacctggcggcagcgcaaaagatg

SEQ ID NO: 27082 - DNA, 103 bp, Artificial Sequence
  Synthetic Polynucleotide
taatacgactcactataggggaccctcctgtaccttttccagttccaatcaacagaggagagattggatgtggaaaaggaacctggcggcagcgcaaaagatg

SEQ ID NO: 27083 - DNA, 103 bp, Artificial Sequence
  Synthetic Polynucleotide
taatacgactcactatagggcagtagaccctcctgtaccttttccagttcaacagaggagagaactgatgaaggtacagaacctggcggcagcgcaaaagatg

SEQ ID NO: 27084 - DNA, 103 bp, Artificial Sequence
  Synthetic Polynucleotide
taatacgactcactataggggtacccagtagaccctcctgtaccttttccaacagaggagaggaaaaatgacaggagggaacctggcggcagcgcaaaagatg

SEQ ID NO: 27085 - DNA, 103 bp, Artificial Sequence
  Synthetic Polynucleotide
taatacgactcactatagggctagtgtacccagtagaccctcctgtacctaacagaggagaaggtacatgagggtctacaacctggcggcagcgcaaaagatg

SEQ ID NO: 27086 - DNA, 103 bp, Artificial Sequence
  Synthetic Polynucleotide
taatacgactcactatagggttcagcgagaagcagtacggagtgcggattaacagaggagaaatccgatgtccgtactgaacctggcggcagcgcaaaagatg

SEQ ID NO: 27087 - DNA, 103 bp, Artificial Sequence
  Synthetic Polynucleotide
taatacgactcactatagggctagcctagtgtacccagtagaccctcctgaacagaggagacaggagatgctactgggtaacctggcggcagcgcaaaagatg

SEQ ID NO: 27088 - DNA, 103 bp, Artificial Sequence
  Synthetic Polynucleotide
taatacgactcactatagggaccccctagcctagtgtacccagtagacccaacagaggagagggtctatggggtacactaacctggcggcagcgcaaaagatg

SEQ ID NO: 27089 - DNA, 103 bp, Artificial Sequence
  Synthetic Polynucleotide
taatacgactcactatagggcccgcaccccctagcctagtgtacccagtaaacagaggagatactggatgcactaggctaacctggcggcagcgcaaaagatg

SEQ ID NO: 27090 - DNA, 103 bp, Artificial Sequence
  Synthetic Polynucleotide
taatacgactcactatagggcaggccccgcaccccctagcctagtgtaccaacagaggagaggtacaatgggctaggggaacctggcggcagcgcaaaagatg

SEQ ID NO: 27091 - DNA, 103 bp, Artificial Sequence
  Synthetic Polynucleotide
taatacgactcactataggggaccccaggccccgcaccccctagcctagtaacagaggagaactaggatggggggtgcgaacctggcggcagcgcaaaagatg

SEQ ID NO: 27092 - DNA, 103 bp, Artificial Sequence
  Synthetic Polynucleotide
taatacgactcactatagggtgtctgaccccaggccccgcaccccctagcaacagaggagagctaggatgtgcggggccaacctggcggcagcgcaaaagatg

SEQ ID NO: 27093 - DNA, 103 bp, Artificial Sequence
  Synthetic Polynucleotide
taatacgactcactatagggtgccttgtctgaccccaggccccgcaccccaacagaggagaggggtgatgggcctggggaacctggcggcagcgcaaaagatg

SEQ ID NO: 27094 - DNA, 103 bp, Artificial Sequence
  Synthetic Polynucleotide
taatacgactcactatagggtgggatgccttgtctgaccccaggccccgcaacagaggagagcggggatgggggtcagaaacctggcggcagcgcaaaagatg

SEQ ID NO: 27095 - DNA, 103 bp, Artificial Sequence
  Synthetic Polynucleotide
taatacgactcactatagggattgttgggatgccttgtctgaccccaggcaacagaggagagcctggatgcagacaaggaacctggcggcagcgcaaaagatg

SEQ ID NO: 27096 - DNA, 103 bp, Artificial Sequence
  Synthetic Polynucleotide
taatacgactcactataggggtgtgattgttgggatgccttgtctgacccaacagaggagagggtcaatgaaggcatccaacctggcggcagcgcaaaagatg

SEQ ID NO: 27097 - DNA, 103 bp, Artificial Sequence
  Synthetic Polynucleotide
taatacgactcactatagggaatctttcagcgagaagcagtacggagtgcaacagaggagagcactcatgactgcttctaacctggcggcagcgcaaaagatg

SEQ ID NO: 27098 - DNA, 103 bp, Artificial Sequence
  Synthetic Polynucleotide
taatacgactcactatagggaggccgtgtgattgttgggatgccttgtctaacagaggagaagacaaatgatcccaacaaacctggcggcagcgcaaaagatg

SEQ ID NO: 27099 - DNA, 103 bp, Artificial Sequence
  Synthetic Polynucleotide
taatacgactcactatagggatgttaggccgtgtgattgttgggatgcctaacagaggagaaggcatatgaacaatcacaacctggcggcagcgcaaaagatg

SEQ ID NO: 27100 - DNA, 103 bp, Artificial Sequence
  Synthetic Polynucleotide
taatacgactcactatagggcaataatgttaggccgtgtgattgttgggaaacagaggagatcccaaatgtcacacggcaacctggcggcagcgcaaaagatg

SEQ ID NO: 27101 - DNA, 103 bp, Artificial Sequence
  Synthetic Polynucleotide
taatacgactcactatagggatctacaataatgttaggccgtgtgattgtaacagaggagaacaatcatgcggcctaacaacctggcggcagcgcaaaagatg

SEQ ID NO: 27102 - DNA, 103 bp, Artificial Sequence
  Synthetic Polynucleotide
taatacgactcactatagggacagcatctacaataatgttaggccgtgtgaacagaggagacacacgatgtaacattataacctggcggcagcgcaaaagatg

SEQ ID NO: 27103 - DNA, 103 bp, Artificial Sequence
  Synthetic Polynucleotide
taatacgactcactatagggggcccacagcatctacaataatgttaggccaacagaggagaggcctaatgttattgtagaacctggcggcagcgcaaaagatg

SEQ ID NO: 27104 - DNA, 103 bp, Artificial Sequence
  Synthetic Polynucleotide
taatacgactcactatagggtgcagggcccacagcatctacaataatgttaacagaggagaaacattatggtagatgctaacctggcggcagcgcaaaagatg

SEQ ID NO: 27105 - DNA, 103 bp, Artificial Sequence
  Synthetic Polynucleotide
taatacgactcactatagggccttctgcagggcccacagcatctacaataaacagaggagatattgtatgtgctgtgggaacctggcggcagcgcaaaagatg

SEQ ID NO: 27106 - DNA, 103 bp, Artificial Sequence
  Synthetic Polynucleotide
taatacgactcactataggggtattccttctgcagggcccacagcatctaaacagaggagatagatgatgtgggccctgaacctggcggcagcgcaaaagatg

SEQ ID NO: 27107 - DNA, 103 bp, Artificial Sequence
  Synthetic Polynucleotide
taatacgactcactatagggaatgggtattccttctgcagggcccacagcaacagaggagagctgtgatgcctgcagaaaacctggcggcagcgcaaaagatg

SEQ ID NO: 27108 - DNA, 103 bp, Artificial Sequence
  Synthetic Polynucleotide
taatacgactcactatagggcccccaatctttcagcgagaagcagtacggaacagaggagaccgtacatgttctcgctgaacctggcggcagcgcaaaagatg

SEQ ID NO: 27109 - DNA, 103 bp, Artificial Sequence
  Synthetic Polynucleotide
taatacgactcactatagggacatcaatgggtattccttctgcagggcccaacagaggagagggcccatgagaaggaataacctggcggcagcgcaaaagatg

SEQ ID NO: 27110 - DNA, 103 bp, Artificial Sequence
  Synthetic Polynucleotide
taatacgactcactatagggccacaacatcaatgggtattccttctgcagaacagaggagactgcagatggaatacccaaacctggcggcagcgcaaaagatg

SEQ ID NO: 27111 - DNA, 103 bp, Artificial Sequence
  Synthetic Polynucleotide
taatacgactcactatagggagggtccacaacatcaatgggtattccttcaacagaggagagaaggaatgcccattgataacctggcggcagcgcaaaagatg

SEQ ID NO: 27112 - DNA, 103 bp, Artificial Sequence
  Synthetic Polynucleotide
taatacgactcactatagggctactagggtccacaacatcaatgggtattaacagaggagaaataccatgtgatgttgtaacctggcggcagcgcaaaagatg

SEQ ID NO: 27113 - DNA, 103 bp, Artificial Sequence
  Synthetic Polynucleotide
taatacgactcactatagggcagagctactagggtccacaacatcaatggaacagaggagaccattgatgttgtggaccaacctggcggcagcgcaaaagatg

SEQ ID NO: 27114 - DNA, 103 bp, Artificial Sequence
  Synthetic Polynucleotide
taatacgactcactatagggtatagcagagctactagggtccacaacatcaacagaggagagatgttatggaccctagtaacctggcggcagcgcaaaagatg

SEQ ID NO: 27115 - DNA, 103 bp, Artificial Sequence
  Synthetic Polynucleotide
taatacgactcactatagggggtactatagcagagctactagggtccacaaacagaggagatgtggaatgtagtagctcaacctggcggcagcgcaaaagatg

SEQ ID NO: 27116 - DNA, 103 bp, Artificial Sequence
  Synthetic Polynucleotide
taatacgactcactataggggtaaaggtactatagcagagctactagggtaacagaggagaaccctaatggctctgctaaacctggcggcagcgcaaaagatg

SEQ ID NO: 27117 - DNA, 103 bp, Artificial Sequence
  Synthetic Polynucleotide
taatacgactcactatagggttcaagtaaaggtactatagcagagctactaacagaggagaagtagcatggctatagtaaacctggcggcagcgcaaaagatg

SEQ ID NO: 27118 - DNA, 103 bp, Artificial Sequence
  Synthetic Polynucleotide
taatacgactcactatagggggggcttcaagtaaaggtactatagcagagaacagaggagactctgcatgagtacctttaacctggcggcagcgcaaaagatg

SEQ ID NO: 27119 - DNA, 103 bp, Artificial Sequence
  Synthetic Polynucleotide
taatacgactcactatagggggggtgggtacaaccccagagctgttttaaaacagaggagattaaaaatgctctggggtaacctggcggcagcgcaaaagatg

SEQ ID NO: 27120 - DNA, 103 bp, Artificial Sequence
  Synthetic Polynucleotide
taatacgactcactatagggcaagggtaccgcaataccggagtactagccaacagaggagaggctagatgtccggtattaacctggcggcagcgcaaaagatg

SEQ ID NO: 27121 - DNA, 103 bp, Artificial Sequence
  Synthetic Polynucleotide
taatacgactcactatagggacttgcgcgttacgacaggccaatcactggaacagaggagaccagtgatgggcctgtcgaacctggcggcagcgcaaaagatg

SEQ ID NO: 27122 - DNA, 103 bp, Artificial Sequence
  Synthetic Polynucleotide
taatacgactcactatagggtatctaactctggaagatttgtccattaataacagaggagaattaatatgcaaatcttcaacctggcggcagcgcaaaagatg

SEQ ID NO: 27123 - DNA, 103 bp, Artificial Sequence
  Synthetic Polynucleotide
taatacgactcactatagggtactgtatctaactctggaagatttgtccaaacagaggagatggacaatgcttccagagaacctggcggcagcgcaaaagatg

SEQ ID NO: 27124 - DNA, 103 bp, Artificial Sequence
  Synthetic Polynucleotide
taatacgactcactataggggtcaatactgtatctaactctggaagatttaacagaggagaaaatctatgagagttagaaacctggcggcagcgcaaaagatg

SEQ ID NO: 27125 - DNA, 103 bp, Artificial Sequence
  Synthetic Polynucleotide
taatacgactcactatagggatctggtcaatactgtatctaactctggaaaacagaggagattccagatgtagatacagaacctggcggcagcgcaaaagatg

SEQ ID NO: 27126 - DNA, 103 bp, Artificial Sequence
  Synthetic Polynucleotide
taatacgactcactatagggtagtgatctggtcaatactgtatctaactcaacagaggagagagttaatgacagtattgaacctggcggcagcgcaaaagatg

SEQ ID NO: 27127 - DNA, 103 bp, Artificial Sequence
  Synthetic Polynucleotide
taatacgactcactatagggcattgtagtgatctggtcaatactgtatctaacagaggagaagatacatgattgaccagaacctggcggcagcgcaaaagatg

SEQ ID NO: 27128 - DNA, 103 bp, Artificial Sequence
  Synthetic Polynucleotide
taatacgactcactatagggataatcattgtagtgatctggtcaatactgaacagaggagacagtatatgccagatcacaacctggcggcagcgcaaaagatg

SEQ ID NO: 27129 - DNA, 103 bp, Artificial Sequence
  Synthetic Polynucleotide
taatacgactcactatagggcattgataatcattgtagtgatctggtcaaaacagaggagattgaccatgtcactacaaaacctggcggcagcgcaaaagatg

SEQ ID NO: 27130 - DNA, 103 bp, Artificial Sequence
  Synthetic Polynucleotide
taatacgactcactatagggtctctcattgataatcattgtagtgatctgaacagaggagacagatcatgacaatgattaacctggcggcagcgcaaaagatg

SEQ ID NO: 27131 - DNA, 103 bp, Artificial Sequence
  Synthetic Polynucleotide
taatacgactcactatagggctgtttctctcattgataatcattgtagtgaacagaggagacactacatggattatcaaaacctggcggcagcgcaaaagatg

SEQ ID NO: 27132 - DNA, 103 bp, Artificial Sequence
  Synthetic Polynucleotide
taatacgactcactatagggcacggacttgcgcgttacgacaggccaatcaacagaggagagattggatggtcgtaacgaacctggcggcagcgcaaaagatg

SEQ ID NO: 27133 - DNA, 103 bp, Artificial Sequence
  Synthetic Polynucleotide
taatacgactcactatagggatcttctgtttctctcattgataatcattgaacagaggagacaatgaatgtcaatgagaaacctggcggcagcgcaaaagatg

SEQ ID NO: 27134 - DNA, 103 bp, Artificial Sequence
  Synthetic Polynucleotide
taatacgactcactataggggttggatcttctgtttctctcattgataataacagaggagaattatcatggagagaaacaacctggcggcagcgcaaaagatg

SEQ ID NO: 27135 - DNA, 103 bp, Artificial Sequence
  Synthetic Polynucleotide
taatacgactcactatagggccaatgttggatcttctgtttctctcattgaacagaggagacaatgaatgaaacagaagaacctggcggcagcgcaaaagatg

SEQ ID NO: 27136 - DNA, 103 bp, Artificial Sequence
  Synthetic Polynucleotide
taatacgactcactatagggaattgccaatgttggatcttctgtttctctaacagaggagaagagaaatggaagatccaaacctggcggcagcgcaaaagatg

SEQ ID NO: 27137 - DNA, 103 bp, Artificial Sequence
  Synthetic Polynucleotide
taatacgactcactatagggcatacaattgccaatgttggatcttctgttaacagaggagaaacagaatgtccaacattaacctggcggcagcgcaaaagatg

SEQ ID NO: 27138 - DNA, 103 bp, Artificial Sequence
  Synthetic Polynucleotide
taatacgactcactataggggcctccatacaattgccaatgttggatcttaacagaggagaaagatcatgcattggcaaaacctggcggcagcgcaaaagatg

SEQ ID NO: 27139 - DNA, 103 bp, Artificial Sequence
  Synthetic Polynucleotide
taatacgactcactatagggacaaagcctccatacaattgccaatgttggaacagaggagaccaacaatggcaattgtaaacctggcggcagcgcaaaagatg

SEQ ID NO: 27140 - DNA, 103 bp, Artificial Sequence
  Synthetic Polynucleotide
taatacgactcactatagggttgaaacaaagcctccatacaattgccaataacagaggagaattggcatgtgtatggagaacctggcggcagcgcaaaagatg

SEQ ID NO: 27141 - DNA, 103 bp, Artificial Sequence
  Synthetic Polynucleotide
taatacgactcactatagggggtccttgaaacaaagcctccatacaattgaacagaggagacaattgatgggaggctttaacctggcggcagcgcaaaagatg

SEQ ID NO: 27142 - DNA, 103 bp, Artificial Sequence
  Synthetic Polynucleotide
taatacgactcactatagggggagtggtccttgaaacaaagcctccatacaacagaggagagtatggatgctttgtttcaacctggcggcagcgcaaaagatg

SEQ ID NO: 27143 - DNA, 103 bp, Artificial Sequence
  Synthetic Polynucleotide
taatacgactcactatagggtccgccacggacttgcgcgttacgacaggcaacagaggagagcctgtatgaacgcgcaaaacctggcggcagcgcaaaagatg

SEQ ID NO: 27144 - DNA, 103 bp, Artificial Sequence
  Synthetic Polynucleotide
taatacgactcactatagggatactggagtggtccttgaaacaaagcctcaacagaggagagaggctatgtttcaaggaaacctggcggcagcgcaaaagatg

SEQ ID NO: 27145 - DNA, 103 bp, Artificial Sequence
  Synthetic Polynucleotide
taatacgactcactatagggtctttatactggagtggtccttgaaacaaaaacagaggagatttgttatgaggaccactaacctggcggcagcgcaaaagatg

SEQ ID NO: 27146 - DNA, 103 bp, Artificial Sequence
  Synthetic Polynucleotide
taatacgactcactatagggtcaagtctttatactggagtggtccttgaaaacagaggagattcaagatgcactccagtaacctggcggcagcgcaaaagatg

SEQ ID NO: 27147 - DNA, 103 bp, Artificial Sequence
  Synthetic Polynucleotide
taatacgactcactatagggaattttcaagtctttatactggagtggtccaacagaggagaggaccaatgcagtataaaaacctggcggcagcgcaaaagatg

SEQ ID NO: 27148 - DNA, 103 bp, Artificial Sequence
  Synthetic Polynucleotide
taatacgactcactatagggatgtcaattttcaagtctttatactggagtaacagaggagaactccaatgtaaagacttaacctggcggcagcgcaaaagatg

SEQ ID NO: 27149 - DNA, 103 bp, Artificial Sequence
  Synthetic Polynucleotide
taatacgactcactatagggtcttgatgtcaattttcaagtctttatactaacagaggagaagtataatgacttgaaaaaacctggcggcagcgcaaaagatg

SEQ ID NO: 27150 - DNA, 103 bp, Artificial Sequence
  Synthetic Polynucleotide
taatacgactcactatagggactcgtcttgatgtcaattttcaagtctttaacagaggagaaaagacatgaaaattgacaacctggcggcagcgcaaaagatg

SEQ ID NO: 27151 - DNA, 103 bp, Artificial Sequence
  Synthetic Polynucleotide
taatacgactcactataggggggggactcgtcttgatgtcaattttcaagaacagaggagacttgaaatgtgacatcaaaacctggcggcagcgcaaaagatg

SEQ ID NO: 27152 - DNA, 103 bp, Artificial Sequence
  Synthetic Polynucleotide
taatacgactcactatagggcaggagggggactcgtcttgatgtcaatttaacagaggagaaaattgatgtcaagacgaaacctggcggcagcgcaaaagatg

SEQ ID NO: 27153 - DNA, 103 bp, Artificial Sequence
  Synthetic Polynucleotide
taatacgactcactatagggacattcaggagggggactcgtcttgatgtcaacagaggagagacatcatgacgagtcccaacctggcggcagcgcaaaagatg

SEQ ID NO: 27154 - DNA, 103 bp, Artificial Sequence
  Synthetic Polynucleotide
taatacgactcactatagggtcggttccgccacggacttgcgcgttacgaaacagaggagatcgtaaatggcaagtccgaacctggcggcagcgcaaaagatg

SEQ ID NO: 27155 - DNA, 103 bp, Artificial Sequence
  Synthetic Polynucleotide
taatacgactcactatagggttgatacattcaggagggggactcgtcttgaacagaggagacaagacatgtccccctccaacctggcggcagcgcaaaagatg

SEQ ID NO: 27156 - DNA, 103 bp, Artificial Sequence
  Synthetic Polynucleotide
taatacgactcactatagggagtcattgatacattcaggagggggactcgaacagaggagacgagtcatgctcctgaataacctggcggcagcgcaaaagatg

SEQ ID NO: 27157 - DNA, 103 bp, Artificial Sequence
  Synthetic Polynucleotide
taatacgactcactataggggagcaagtcattgatacattcaggagggggaacagaggagaccccctatggaatgtatcaacctggcggcagcgcaaaagatg

SEQ ID NO: 27158 - DNA, 103 bp, Artificial Sequence
  Synthetic Polynucleotide
taatacgactcactataggggcttggagcaagtcattgatacattcaggaaacagaggagatcctgaatgtatcaatgaaacctggcggcagcgcaaaagatg

SEQ ID NO: 27159 - DNA, 103 bp, Artificial Sequence
  Synthetic Polynucleotide
taatacgactcactatagggcaactgcttggagcaagtcattgatacattaacagaggagaaatgtaatgatgacttgcaacctggcggcagcgcaaaagatg

SEQ ID NO: 27160 - DNA, 103 bp, Artificial Sequence
  Synthetic Polynucleotide
taatacgactcactatagggggagtcaactgcttggagcaagtcattgataacagaggagaatcaatatgttgctccaaaacctggcggcagcgcaaaagatg

SEQ ID NO: 27161 - DNA, 103 bp, Artificial Sequence
  Synthetic Polynucleotide
taatacgactcactatagggtcctgggagtcaactgcttggagcaagtcaaacagaggagatgacttatgccaagcagtaacctggcggcagcgcaaaagatg

SEQ ID NO: 27162 - DNA, 103 bp, Artificial Sequence
  Synthetic Polynucleotide
taatacgactcactatagggtcacctcctgggagtcaactgcttggagcaaacagaggagatgctccatgcagttgactaacctggcggcagcgcaaaagatg

SEQ ID NO: 27163 - DNA, 103 bp, Artificial Sequence
  Synthetic Polynucleotide
taatacgactcactatagggatctctcacctcctgggagtcaactgcttgaacagaggagacaagcaatggactcccagaacctggcggcagcgcaaaagatg

SEQ ID NO: 27164 - DNA, 103 bp, Artificial Sequence
  Synthetic Polynucleotide
taatacgactcactatagggcagtaatctctcacctcctgggagtcaactaacagaggagaagttgaatgccaggaggtaacctggcggcagcgcaaaagatg

SEQ ID NO: 27165 - DNA, 103 bp, Artificial Sequence
  Synthetic Polynucleotide
taatacgactcactatagggagtagtcggttccgccacggacttgcgcgtaacagaggagaacgcgcatgtccgtggcgaacctggcggcagcgcaaaagatg

SEQ ID NO: 27166 - DNA, 103 bp, Artificial Sequence
  Synthetic Polynucleotide
taatacgactcactatagggtctcacagtaatctctcacctcctgggagtaacagaggagaactcccatgaggtgagagaacctggcggcagcgcaaaagatg

SEQ ID NO: 27167 - DNA, 103 bp, Artificial Sequence
  Synthetic Polynucleotide
taatacgactcactatagggcttcttctcacagtaatctctcacctcctgaacagaggagacaggagatgagagattacaacctggcggcagcgcaaaagatg

SEQ ID NO: 27168 - DNA, 103 bp, Artificial Sequence
  Synthetic Polynucleotide
taatacgactcactatagggcaacccttcttctcacagtaatctctcaccaacagaggagaggtgagatgttactgtgaaacctggcggcagcgcaaaagatg

SEQ ID NO: 27169 - DNA, 103 bp, Artificial Sequence
  Synthetic Polynucleotide
taatacgactcactatagggctatccaacccttcttctcacagtaatctcaacagaggagagagattatggtgagaagaaacctggcggcagcgcaaaagatg

SEQ ID NO: 27170 - DNA, 103 bp, Artificial Sequence
  Synthetic Polynucleotide
taatacgactcactataggggttgactatccaacccttcttctcacagtaaacagaggagatactgtatgaagaagggtaacctggcggcagcgcaaaagatg

SEQ ID NO: 27171 - DNA, 103 bp, Artificial Sequence
  Synthetic Polynucleotide
taatacgactcactataggggtgatgttgactatccaacccttcttctcaaacagaggagatgagaaatggggttggataacctggcggcagcgcaaaagatg

SEQ ID NO: 27172 - DNA, 103 bp, Artificial Sequence
  Synthetic Polynucleotide
taatacgactcactatagggggctggtgatgttgactatccaacccttctaacagaggagaagaaggatgggatagtcaaacctggcggcagcgcaaaagatg

SEQ ID NO: 27173 - DNA, 103 bp, Artificial Sequence
  Synthetic Polynucleotide
taatacgactcactatagggaacctggctggtgatgttgactatccaaccaacagaggagaggttggatggtcaacatcaacctggcggcagcgcaaaagatg

SEQ ID NO: 27174 - DNA, 103 bp, Artificial Sequence
  Synthetic Polynucleotide
taatacgactcactataggggtttgaacctggctggtgatgttgactatcaacagaggagagatagtatgcatcaccagaacctggcggcagcgcaaaagatg

SEQ ID NO: 27175 - DNA, 103 bp, Artificial Sequence
  Synthetic Polynucleotide
taatacgactcactatagggtttctgtttgaacctggctggtgatgttgaaacagaggagatcaacaatgccagccaggaacctggcggcagcgcaaaagatg

SEQ ID NO: 27176 - DNA, 103 bp, Artificial Sequence
  Synthetic Polynucleotide
taatacgactcactatagggcccaaagtagtcggttccgccacggacttgaacagaggagacaagtcatgggcggaaccaacctggcggcagcgcaaaagatg

SEQ ID NO: 27177 - DNA, 103 bp, Artificial Sequence
  Synthetic Polynucleotide
taatacgactcactataggggttcctttctgtttgaacctggctggtgataacagaggagaatcaccatgcaggttcaaaacctggcggcagcgcaaaagatg

SEQ ID NO: 27178 - DNA, 103 bp, Artificial Sequence
  Synthetic Polynucleotide
taatacgactcactatagggttgatgttcctttctgtttgaacctggctgaacagaggagacagccaatgtcaaacagaaacctggcggcagcgcaaaagatg

SEQ ID NO: 27179 - DNA, 103 bp, Artificial Sequence
  Synthetic Polynucleotide
taatacgactcactatagggccctgttgatgttcctttctgtttgaacctaacagaggagaaggttcatgcagaaaggaaacctggcggcagcgcaaaagatg

SEQ ID NO: 27180 - DNA, 103 bp, Artificial Sequence
  Synthetic Polynucleotide
taatacgactcactatagggcattgccctgttgatgttcctttctgtttgaacagaggagacaaacaatgaggaacatcaacctggcggcagcgcaaaagatg

SEQ ID NO: 27181 - DNA, 103 bp, Artificial Sequence
  Synthetic Polynucleotide
taatacgactcactatagggattgtcattgccctgttgatgttcctttctaacagaggagaagaaagatgcatcaacagaacctggcggcagcgcaaaagatg

SEQ ID NO: 27182 - DNA, 103 bp, Artificial Sequence
  Synthetic Polynucleotide
taatacgactcactataggggtagaattgtcattgccctgttgatgttccaacagaggagaggaacaatgacagggcaaaacctggcggcagcgcaaaagatg

SEQ ID NO: 27183 - DNA, 103 bp, Artificial Sequence
  Synthetic Polynucleotide
taatacgactcactatagggcgcttgtagaattgtcattgccctgttgataacagaggagaatcaacatggcaatgacaaacctggcggcagcgcaaaagatg

SEQ ID NO: 27184 - DNA, 103 bp, Artificial Sequence
  Synthetic Polynucleotide
taatacgactcactataggggtcaccgcttgtagaattgtcattgccctgaacagaggagacagggcatggacaattctaacctggcggcagcgcaaaagatg

SEQ ID NO: 27185 - DNA, 103 bp, Artificial Sequence
  Synthetic Polynucleotide
taatacgactcactatagggaggttgtcaccgcttgtagaattgtcattgaacagaggagacaatgaatgttctacaagaacctggcggcagcgcaaaagatg

SEQ ID NO: 27186 - DNA, 103 bp, Artificial Sequence
  Synthetic Polynucleotide
taatacgactcactatagggggcgaaggttgtcaccgcttgtagaattgtaacagaggagaacaattatgcaagcggtgaacctggcggcagcgcaaaagatg

SEQ ID NO: 27187 - DNA, 103 bp, Artificial Sequence
  Synthetic Polynucleotide
taatacgactcactatagggggacacccaaagtagtcggttccgccacggaacagaggagaccgtggatgaaccgactaaacctggcggcagcgcaaaagatg

SEQ ID NO: 27188 - DNA, 103 bp, Artificial Sequence
  Synthetic Polynucleotide
taatacgactcactatagggactgcggcgaaggttgtcaccgcttgtagaaacagaggagatctacaatgggtgacaacaacctggcggcagcgcaaaagatg

SEQ ID NO: 27189 - DNA, 103 bp, Artificial Sequence
  Synthetic Polynucleotide
taatacgactcactatagggcagccactgcggcgaaggttgtcaccgcttaacagaggagaaagcggatgcaaccttcgaacctggcggcagcgcaaaagatg

SEQ ID NO: 27190 - DNA, 103 bp, Artificial Sequence
  Synthetic Polynucleotide
taatacgactcactatagggaactccagccactgcggcgaaggttgtcacaacagaggagagtgacaatgttcgccgcaaacctggcggcagcgcaaaagatg

SEQ ID NO: 27191 - DNA, 103 bp, Artificial Sequence
  Synthetic Polynucleotide
taatacgactcactatagggtagacaactccagccactgcggcgaaggttaacagaggagaaaccttatgcgcagtggcaacctggcggcagcgcaaaagatg

SEQ ID NO: 27192 - DNA, 103 bp, Artificial Sequence
  Synthetic Polynucleotide
taatacgactcactatagggtgacatagacaactccagccactgcggcgaaacagaggagatcgccgatgtggctggagaacctggcggcagcgcaaaagatg

SEQ ID NO: 27193 - DNA, 103 bp, Artificial Sequence
  Synthetic Polynucleotide
taatacgactcactatagggatacatgacatagacaactccagccactgcaacagaggagagcagtgatgggagttgtcaacctggcggcagcgcaaaagatg

SEQ ID NO: 27194 - DNA, 103 bp, Artificial Sequence
  Synthetic Polynucleotide
taatacgactcactatagggagtttatacatgacatagacaactccagccaacagaggagaggctggatgtgtctatgtaacctggcggcagcgcaaaagatg

SEQ ID NO: 27195 - DNA, 103 bp, Artificial Sequence
  Synthetic Polynucleotide
taatacgactcactatagggcaaacagtttatacatgacatagacaactcaacagaggagagagttgatgatgtcatgtaacctggcggcagcgcaaaagatg

SEQ ID NO: 27196 - DNA, 103 bp, Artificial Sequence
  Synthetic Polynucleotide
taatacgactcactatagggtccagcaaacagtttatacatgacatagacaacagaggagagtctatatgatgtataaaaacctggcggcagcgcaaaagatg

SEQ ID NO: 27197 - DNA, 103 bp, Artificial Sequence
  Synthetic Polynucleotide
taatacgactcactatagggtggtgtccagcaaacagtttatacatgacaaacagaggagatgtcatatgtaaactgttaacctggcggcagcgcaaaagatg

SEQ ID NO: 27198 - DNA, 103 bp, Artificial Sequence
  Synthetic Polynucleotide
taatacgactcactatagggaacacggacacccaaagtagtcggttccgcaacagaggagagcggaaatgactactttgaacctggcggcagcgcaaaagatg

SEQ ID NO: 27199 - DNA, 103 bp, Artificial Sequence
  Synthetic Polynucleotide
taatacgactcactatagggctccctggtgtccagcaaacagtttatacaaacagaggagatgtataatgtgtttgctgaacctggcggcagcgcaaaagatg

SEQ ID NO: 27200 - DNA, 103 bp, Artificial Sequence
  Synthetic Polynucleotide
taatacgactcactataggggtatgctccctggtgtccagcaaacagtttaacagaggagaaaactgatggctggacacaacctggcggcagcgcaaaagatg

SEQ ID NO: 27201 - DNA, 103 bp, Artificial Sequence
  Synthetic Polynucleotide
taatacgactcactatagggccagtgtatgctccctggtgtccagcaaacaacagaggagagtttgcatgacaccagggaacctggcggcagcgcaaaagatg

SEQ ID NO: 27202 - DNA, 103 bp, Artificial Sequence
  Synthetic Polynucleotide
taatacgactcactataggggtaaaccagtgtatgctccctggtgtccagaacagaggagactggacatgagggagcataacctggcggcagcgcaaaagatg

SEQ ID NO: 27203 - DNA, 103 bp, Artificial Sequence
  Synthetic Polynucleotide
taatacgactcactataggggtttggtaaaccagtgtatgctccctggtgaacagaggagacaccagatggcatacactaacctggcggcagcgcaaaagatg

SEQ ID NO: 27204 - DNA, 103 bp, Artificial Sequence
  Synthetic Polynucleotide
taatacgactcactatagggtttttgtttggtaaaccagtgtatgctcccaacagaggagagggagcatgcactggtttaacctggcggcagcgcaaaagatg

SEQ ID NO: 27205 - DNA, 103 bp, Artificial Sequence
  Synthetic Polynucleotide
taatacgactcactatagggtgggttttttgtttggtaaaccagtgtatgaacagaggagacatacaatggtttaccaaaacctggcggcagcgcaaaagatg

SEQ ID NO: 27206 - DNA, 103 bp, Artificial Sequence
  Synthetic Polynucleotide
taatacgactcactatagggcacgttgggttttttgtttggtaaaccagtaacagaggagaactggtatgccaaacaaaaacctggcggcagcgcaaaagatg

SEQ ID NO: 27207 - DNA, 103 bp, Artificial Sequence
  Synthetic Polynucleotide
taatacgactcactataggggtgggcacgttgggttttttgtttggtaaaaacagaggagatttaccatgcaaaaaaccaacctggcggcagcgcaaaagatg

SEQ ID NO: 27208 - DNA, 103 bp, Artificial Sequence
  Synthetic Polynucleotide
taatacgactcactataggggaatggtgggcacgttgggttttttgtttgaacagaggagacaaacaatgaacccaacgaacctggcggcagcgcaaaagatg

SEQ ID NO: 27209 - DNA, 103 bp, Artificial Sequence
  Synthetic Polynucleotide
taatacgactcactatagggaaggaaacacggacacccaaagtagtcggtaacagaggagaaccgacatgtttgggtgtaacctggcggcagcgcaaaagatg

SEQ ID NO: 27210 - DNA, 103 bp, Artificial Sequence
  Synthetic Polynucleotide
taatacgactcactatagggtgtccgaatggtgggcacgttgggttttttaacagaggagaaaaaaaatgaacgtgcccaacctggcggcagcgcaaaagatg

SEQ ID NO: 27211 - DNA, 103 bp, Artificial Sequence
  Synthetic Polynucleotide
taatacgactcactatagggtttgctgtccgaatggtgggcacgttgggtaacagaggagaacccaaatggcccaccataacctggcggcagcgcaaaagatg

SEQ ID NO: 27212 - DNA, 103 bp, Artificial Sequence
  Synthetic Polynucleotide
taatacgactcactataggggtacctttgctgtccgaatggtgggcacgtaacagaggagaacgtgcatgccattcggaaacctggcggcagcgcaaaagatg

SEQ ID NO: 27213 - DNA, 103 bp, Artificial Sequence
  Synthetic Polynucleotide
taatacgactcactatagggtccttgtacctttgctgtccgaatggtgggaacagaggagacccaccatgcggacagcaaacctggcggcagcgcaaaagatg

SEQ ID NO: 27214 - DNA, 103 bp, Artificial Sequence
  Synthetic Polynucleotide
taatacgactcactatagggcctggtccttgtacctttgctgtccgaatgaacagaggagacattcgatgagcaaaggtaacctggcggcagcgcaaaagatg

SEQ ID NO: 27215 - DNA, 103 bp, Artificial Sequence
  Synthetic Polynucleotide
taatacgactcactatagggcgaaccctggtccttgtacctttgctgtccaacagaggagaggacagatgaggtacaagaacctggcggcagcgcaaaagatg

SEQ ID NO: 27216 - DNA, 103 bp, Artificial Sequence
  Synthetic Polynucleotide
taatacgactcactataggggtaatcgaaccctggtccttgtacctttgcaacagaggagagcaaagatgcaaggaccaaacctggcggcagcgcaaaagatg

SEQ ID NO: 27217 - DNA, 103 bp, Artificial Sequence
  Synthetic Polynucleotide
taatacgactcactatagggactgcgtaatcgaaccctggtccttgtaccaacagaggagaggtacaatgaccagggttaacctggcggcagcgcaaaagatg

SEQ ID NO: 27218 - DNA, 103 bp, Artificial Sequence
  Synthetic Polynucleotide
taatacgactcactatagggtagccactgcgtaatcgaaccctggtccttaacagaggagaaaggacatgggttcgattaacctggcggcagcgcaaaagatg

SEQ ID NO: 27219 - DNA, 103 bp, Artificial Sequence
  Synthetic Polynucleotide
taatacgactcactatagggagccatagccactgcgtaatcgaaccctggaacagaggagaccagggatggattacgcaaacctggcggcagcgcaaaagatg

SEQ ID NO: 27220 - DNA, 103 bp, Artificial Sequence
  Synthetic Polynucleotide
taatacgactcactatagggaataaaaggaaacacggacacccaaagtagaacagaggagactacttatggtgtccgtgaacctggcggcagcgcaaaagatg

SEQ ID NO: 27221 - DNA, 103 bp, Artificial Sequence
  Synthetic Polynucleotide
taatacgactcactatagggcttttagccatagccactgcgtaatcgaacaacagaggagagttcgaatgcgcagtggcaacctggcggcagcgcaaaagatg

SEQ ID NO: 27222 - DNA, 103 bp, Artificial Sequence
  Synthetic Polynucleotide
taatacgactcactatagggtgtttcttttagccatagccactgcgtaataacagaggagaattacgatgtggctatggaacctggcggcagcgcaaaagatg

SEQ ID NO: 27223 - DNA, 103 bp, Artificial Sequence
  Synthetic Polynucleotide
taatacgactcactatagggaacaatgtttcttttagccatagccactgcaacagaggagagcagtgatgatggctaaaaacctggcggcagcgcaaaagatg

SEQ ID NO: 27224 - DNA, 103 bp, Artificial Sequence
  Synthetic Polynucleotide
taatacgactcactataggggctgtaacaatgtttcttttagccatagccaacagaggagaggctatatgtaaaagaaaaacctggcggcagcgcaaaagatg

SEQ ID NO: 27225 - DNA, 103 bp, Artificial Sequence
  Synthetic Polynucleotide
taatacgactcactatagggtagttgctgtaacaatgtttcttttagccaaacagaggagatggctaatggaaacattgaacctggcggcagcgcaaaagatg

SEQ ID NO: 27226 - DNA, 103 bp, Artificial Sequence
  Synthetic Polynucleotide
taatacgactcactataggggctagtagttgctgtaacaatgtttcttttaacagaggagaaaaagaatgattgttacaaacctggcggcagcgcaaaagatg

SEQ ID NO: 27227 - DNA, 103 bp, Artificial Sequence
  Synthetic Polynucleotide
taatacgactcactatagggcccttgctagtagttgctgtaacaatgtttaacagaggagaaaacatatgtacagcaacaacctggcggcagcgcaaaagatg

SEQ ID NO: 27228 - DNA, 103 bp, Artificial Sequence
  Synthetic Polynucleotide
taatacgactcactatagggactctcccttgctagtagttgctgtaacaaaacagaggagattgttaatgcaactactaaacctggcggcagcgcaaaagatg

SEQ ID NO: 27229 - DNA, 103 bp, Artificial Sequence
  Synthetic Polynucleotide
taatacgactcactatagggagtgaactctcccttgctagtagttgctgtaacagaggagaacagcaatgactagcaagaacctggcggcagcgcaaaagatg

SEQ ID NO: 27230 - DNA, 103 bp, Artificial Sequence
  Synthetic Polynucleotide
taatacgactcactatagggaacatagtgaactctcccttgctagtagttaacagaggagaaactacatgcaagggagaaacctggcggcagcgcaaaagatg

SEQ ID NO: 27231 - DNA, 103 bp, Artificial Sequence
  Synthetic Polynucleotide
taatacgactcactataggggcgtacaagggtaccgcaataccggagtacaacagaggagagtactcatgtattgcggtaacctggcggcagcgcaaaagatg

SEQ ID NO: 27232 - DNA, 103 bp, Artificial Sequence
  Synthetic Polynucleotide
taatacgactcactatagggaataaaataaaaggaaacacggacacccaaaacagaggagattgggtatgcgtgtttccaacctggcggcagcgcaaaagatg

SEQ ID NO: 27233 - DNA, 103 bp, Artificial Sequence
  Synthetic Polynucleotide
taatacgactcactatagggctcctaacatagtgaactctcccttgctagaacagaggagactagcaatggagagttcaaacctggcggcagcgcaaaagatg

SEQ ID NO: 27234 - DNA, 103 bp, Artificial Sequence
  Synthetic Polynucleotide
taatacgactcactataggggtggactcctaacatagtgaactctcccttaacagaggagaaagggaatgttcactatgaacctggcggcagcgcaaaagatg

SEQ ID NO: 27235 - DNA, 103 bp, Artificial Sequence
  Synthetic Polynucleotide
taatacgactcactatagggttgtcgtggactcctaacatagtgaactctaacagaggagaagagttatgtatgttaggaacctggcggcagcgcaaaagatg

SEQ ID NO: 27236 - DNA, 103 bp, Artificial Sequence
  Synthetic Polynucleotide
taatacgactcactatagggccacgttgtcgtggactcctaacatagtgaaacagaggagatcactaatgtaggagtccaacctggcggcagcgcaaaagatg

SEQ ID NO: 27237 - DNA, 103 bp, Artificial Sequence
  Synthetic Polynucleotide
taatacgactcactatagggaatagccacgttgtcgtggactcctaacataacagaggagaatgttaatggtccacgacaacctggcggcagcgcaaaagatg

SEQ ID NO: 27238 - DNA, 103 bp, Artificial Sequence
  Synthetic Polynucleotide
taatacgactcactatagggggtaaaatagccacgttgtcgtggactcctaacagaggagaaggagtatgcgacaacgtaacctggcggcagcgcaaaagatg

SEQ ID NO: 27239 - DNA, 103 bp, Artificial Sequence
  Synthetic Polynucleotide
taatacgactcactataggggggttggtaaaatagccacgttgtcgtggaaacagaggagatccacgatgacgtggctaaacctggcggcagcgcaaaagatg

SEQ ID NO: 27240 - DNA, 103 bp, Artificial Sequence
  Synthetic Polynucleotide
taatacgactcactatagggagcgtgggttggtaaaatagccacgttgtcaacagaggagagacaacatggctattttaaacctggcggcagcgcaaaagatg

SEQ ID NO: 27241 - DNA, 103 bp, Artificial Sequence
  Synthetic Polynucleotide
taatacgactcactatagggggtgaagcgtgggttggtaaaatagccacgaacagaggagacgtggcatgtttaccaacaacctggcggcagcgcaaaagatg

SEQ ID NO: 27242 - DNA, 103 bp, Artificial Sequence
  Synthetic Polynucleotide
taatacgactcactatagggcaccaggtgaagcgtgggttggtaaaatagaacagaggagactatttatgcaacccacgaacctggcggcagcgcaaaagatg

SEQ ID NO: 27243 - DNA, 103 bp, Artificial Sequence
  Synthetic Polynucleotide
taatacgactcactataggggccacaataaaataaaaggaaacacggacaaacagaggagatgtccgatgttccttttaaacctggcggcagcgcaaaagatg

SEQ ID NO: 27244 - DNA, 103 bp, Artificial Sequence
  Synthetic Polynucleotide
taatacgactcactataggggctttcaccaggtgaagcgtgggttggtaaaacagaggagattaccaatgcacgcttcaaacctggcggcagcgcaaaagatg

SEQ ID NO: 27245 - DNA, 103 bp, Artificial Sequence
  Synthetic Polynucleotide
taatacgactcactatagggacaatgctttcaccaggtgaagcgtgggttaacagaggagaaacccaatgttcacctggaacctggcggcagcgcaaaagatg

SEQ ID NO: 27246 - DNA, 103 bp, Artificial Sequence
  Synthetic Polynucleotide
taatacgactcactatagggcgatcacaatgctttcaccaggtgaagcgtaacagaggagaacgcttatgctggtgaaaaacctggcggcagcgcaaaagatg

SEQ ID NO: 27247 - DNA, 103 bp, Artificial Sequence
  Synthetic Polynucleotide
taatacgactcactataggggccatcgatcacaatgctttcaccaggtgaaacagaggagatcacctatggaaagcattaacctggcggcagcgcaaaagatg

SEQ ID NO: 27248 - DNA, 103 bp, Artificial Sequence
  Synthetic Polynucleotide
taatacgactcactatagggtctttgccatcgatcacaatgctttcaccaaacagaggagatggtgaatgcattgtgataacctggcggcagcgcaaaagatg

SEQ ID NO: 27249 - DNA, 103 bp, Artificial Sequence
  Synthetic Polynucleotide
taatacgactcactatagggccacttctttgccatcgatcacaatgctttaacagaggagaaaagcaatgtgatcgatgaacctggcggcagcgcaaaagatg

SEQ ID NO: 27250 - DNA, 103 bp, Artificial Sequence
  Synthetic Polynucleotide
taatacgactcactataggggatctccacttctttgccatcgatcacaataacagaggagaattgtgatggatggcaaaaacctggcggcagcgcaaaagatg

SEQ ID NO: 27251 - DNA, 103 bp, Artificial Sequence
  Synthetic Polynucleotide
taatacgactcactatagggtccaagatctccacttctttgccatcgatcaacagaggagagatcgaatgcaaagaagtaacctggcggcagcgcaaaagatg

SEQ ID NO: 27252 - DNA, 103 bp, Artificial Sequence
  Synthetic Polynucleotide
taatacgactcactatagggtggcatccaagatctccacttctttgccataacagaggagaatggcaatgaagtggagaaacctggcggcagcgcaaaagatg

SEQ ID NO: 27253 - DNA, 103 bp, Artificial Sequence
  Synthetic Polynucleotide
taatacgactcactatagggcgctttggcatccaagatctccacttctttaacagaggagaaaagaaatggagatcttgaacctggcggcagcgcaaaagatg

SEQ ID NO: 27254 - DNA, 103 bp, Artificial Sequence
  Synthetic Polynucleotide
taatacgactcactatagggaagcagccacaataaaataaaaggaaacacaacagaggagagtgtttatgtttattttaaacctggcggcagcgcaaaagatg

SEQ ID NO: 27255 - DNA, 103 bp, Artificial Sequence
  Synthetic Polynucleotide
taatacgactcactatagggtcgagcgctttggcatccaagatctccactaacagaggagaagtggaatgcttggatgcaacctggcggcagcgcaaaagatg

SEQ ID NO: 27256 - DNA, 103 bp, Artificial Sequence
  Synthetic Polynucleotide
taatacgactcactataggggatcttcgagcgctttggcatccaagatctaacagaggagaagatctatgatgccaaagaacctggcggcagcgcaaaagatg

SEQ ID NO: 27257 - DNA, 103 bp, Artificial Sequence
  Synthetic Polynucleotide
taatacgactcactatagggtgcttgatcttcgagcgctttggcatccaaaacagaggagattggatatgaaagcgctcaacctggcggcagcgcaaaagatg

SEQ ID NO: 27258 - DNA, 103 bp, Artificial Sequence
  Synthetic Polynucleotide
taatacgactcactataggggttcctgcttgatcttcgagcgctttggcaaacagaggagatgccaaatggctcgaagaaacctggcggcagcgcaaaagatg

SEQ ID NO: 27259 - DNA, 103 bp, Artificial Sequence
  Synthetic Polynucleotide
taatacgactcactataggggattggttcctgcttgatcttcgagcgcttaacagaggagaaagcgcatgaagatcaagaacctggcggcagcgcaaaagatg

SEQ ID NO: 27260 - DNA, 103 bp, Artificial Sequence
  Synthetic Polynucleotide
taatacgactcactatagggttcaagattggttcctgcttgatcttcgagaacagaggagactcgaaatgcaagcaggaaacctggcggcagcgcaaaagatg

SEQ ID NO: 27261 - DNA, 103 bp, Artificial Sequence
  Synthetic Polynucleotide
taatacgactcactataggggtgatttcaagattggttcctgcttgatctaacagaggagaagatcaatgaggaaccaaaacctggcggcagcgcaaaagatg

SEQ ID NO: 27262 - DNA, 103 bp, Artificial Sequence
  Synthetic Polynucleotide
taatacgactcactatagggttatagtgatttcaagattggttcctgcttaacagaggagaaagcagatgccaatcttgaacctggcggcagcgcaaaagatg

SEQ ID NO: 27263 - DNA, 103 bp, Artificial Sequence
  Synthetic Polynucleotide
taatacgactcactatagggagtgattatagtgatttcaagattggttccaacagaggagaggaaccatgcttgaaatcaacctggcggcagcgcaaaagatg

SEQ ID NO: 27264 - DNA, 103 bp, Artificial Sequence
  Synthetic Polynucleotide
taatacgactcactatagggtttagagtgattatagtgatttcaagattgaacagaggagacaatctatgaatcactataacctggcggcagcgcaaaagatg

SEQ ID NO: 27265 - DNA, 103 bp, Artificial Sequence
  Synthetic Polynucleotide
taatacgactcactatagggaccataagcagccacaataaaataaaaggaaacagaggagatcctttatgtttattgtgaacctggcggcagcgcaaaagatg

SEQ ID NO: 27266 - DNA, 103 bp, Artificial Sequence
  Synthetic Polynucleotide
taatacgactcactatagggttctctttagagtgattatagtgatttcaaaacagaggagattgaaaatgctataatcaaacctggcggcagcgcaaaagatg

SEQ ID NO: 27267 - DNA, 103 bp, Artificial Sequence
  Synthetic Polynucleotide
taatacgactcactatagggttcatttctctttagagtgattatagtgataacagaggagaatcactatgatcactctaaacctggcggcagcgcaaaagatg

SEQ ID NO: 27268 - DNA, 103 bp, Artificial Sequence
  Synthetic Polynucleotide
taatacgactcactatagggaacttttcatttctctttagagtgattataaacagaggagatataatatgtctaaagagaacctggcggcagcgcaaaagatg

SEQ ID NO: 27269 - DNA, 103 bp, Artificial Sequence
  Synthetic Polynucleotide
taatacgactcactatagggctctgaacttttcatttctctttagagtgaaacagaggagatcactcatgagagaaatgaacctggcggcagcgcaaaagatg

SEQ ID NO: 27270 - DNA, 103 bp, Artificial Sequence
  Synthetic Polynucleotide
taatacgactcactatagggaatgtctctgaacttttcatttctctttagaacagaggagactaaagatgaatgaaaagaacctggcggcagcgcaaaagatg

SEQ ID NO: 27271 - DNA, 103 bp, Artificial Sequence
  Synthetic Polynucleotide
taatacgactcactatagggggtctaatgtctctgaacttttcatttctcaacagaggagagagaaaatgaaagttcagaacctggcggcagcgcaaaagatg

SEQ ID NO: 27272 - DNA, 103 bp, Artificial Sequence
  Synthetic Polynucleotide
taatacgactcactatagggtatgtggtctaatgtctctgaacttttcataacagaggagaatgaaaatgtcagagacaaacctggcggcagcgcaaaagatg

SEQ ID NO: 27273 - DNA, 103 bp, Artificial Sequence
  Synthetic Polynucleotide
taatacgactcactatagggaggtatatgtggtctaatgtctctgaacttaacagaggagaaagttcatggacattagaaacctggcggcagcgcaaaagatg

SEQ ID NO: 27274 - DNA, 103 bp, Artificial Sequence
  Synthetic Polynucleotide
taatacgactcactatagggtgagtaggtatatgtggtctaatgtctctgaacagaggagacagagaatgtagaccacaaacctggcggcagcgcaaaagatg

SEQ ID NO: 27275 - DNA, 103 bp, Artificial Sequence
  Synthetic Polynucleotide
taatacgactcactatagggtgatttgagtaggtatatgtggtctaatgtaacagaggagaacattaatgcacatatacaacctggcggcagcgcaaaagatg

SEQ ID NO: 27276 - DNA, 103 bp, Artificial Sequence
  Synthetic Polynucleotide
taatacgactcactatagggttgtcaccataagcagccacaataaaataaaacagaggagattatttatgtgtggctgcaacctggcggcagcgcaaaagatg

SEQ ID NO: 27277 - DNA, 103 bp, Artificial Sequence
  Synthetic Polynucleotide
taatacgactcactatagggctcagtgatttgagtaggtatatgtggtctaacagaggagaagaccaatgatacctactaacctggcggcagcgcaaaagatg

SEQ ID NO: 27278 - DNA, 103 bp, Artificial Sequence
  Synthetic Polynucleotide
taatacgactcactatagggtttgtctcagtgatttgagtaggtatatgtaacagaggagaacatatatgtactcaaataacctggcggcagcgcaaaagatg

SEQ ID NO: 27279 - DNA, 103 bp, Artificial Sequence
  Synthetic Polynucleotide
taatacgactcactatagggcatcatttgtctcagtgatttgagtaggtaaacagaggagatacctaatgaaatcactgaacctggcggcagcgcaaaagatg

SEQ ID NO: 27280 - DNA, 103 bp, Artificial Sequence
  Synthetic Polynucleotide
taatacgactcactataggggactccatcatttgtctcagtgatttgagtaacagaggagaactcaaatgactgagacaaacctggcggcagcgcaaaagatg

SEQ ID NO: 27281 - DNA, 103 bp, Artificial Sequence
  Synthetic Polynucleotide
taatacgactcactatagggatcaagactccatcatttgtctcagtgattaacagaggagaaatcacatggacaaatgaaacctggcggcagcgcaaaagatg

SEQ ID NO: 27282 - DNA, 103 bp, Artificial Sequence
  Synthetic Polynucleotide
taatacgactcactatagggtcacgatcaagactccatcatttgtctcagaacagaggagactgagaatgatgatggagaacctggcggcagcgcaaaagatg

SEQ ID NO: 27283 - DNA, 103 bp, Artificial Sequence
  Synthetic Polynucleotide
taatacgactcactatagggagtgttcacgatcaagactccatcatttgtaacagaggagaacaaatatgggagtcttgaacctggcggcagcgcaaaagatg

SEQ ID NO: 27284 - DNA, 103 bp, Artificial Sequence
  Synthetic Polynucleotide
taatacgactcactatagggttgctagtgttcacgatcaagactccatcaaacagaggagatgatggatgcttgatcgtaacctggcggcagcgcaaaagatg

SEQ ID NO: 27285 - DNA, 103 bp, Artificial Sequence
  Synthetic Polynucleotide
taatacgactcactatagggggtacttgctagtgttcacgatcaagactcaacagaggagagagtctatgtcgtgaacaaacctggcggcagcgcaaaagatg

SEQ ID NO: 27286 - DNA, 103 bp, Artificial Sequence
  Synthetic Polynucleotide
taatacgactcactatagggattggggtacttgctagtgttcacgatcaaaacagaggagattgatcatgaacactagcaacctggcggcagcgcaaaagatg

SEQ ID NO: 27287 - DNA, 103 bp, Artificial Sequence
  Synthetic Polynucleotide
taatacgactcactatagggtgtgattgtcaccataagcagccacaataaaacagaggagattattgatgctgcttatgaacctggcggcagcgcaaaagatg

SEQ ID NO: 27288 - DNA, 103 bp, Artificial Sequence
  Synthetic Polynucleotide
taatacgactcactatagggtacatattggggtacttgctagtgttcacgaacagaggagacgtgaaatgtagcaagtaaacctggcggcagcgcaaaagatg

SEQ ID NO: 27289 - DNA, 103 bp, Artificial Sequence
  Synthetic Polynucleotide
taatacgactcactataggggaacatacatattggggtacttgctagtgtaacagaggagaacactaatgagtaccccaaacctggcggcagcgcaaaagatg

SEQ ID NO: 27290 - DNA, 103 bp, Artificial Sequence
  Synthetic Polynucleotide
taatacgactcactataggggacaggaacatacatattggggtacttgctaacagaggagaagcaagatgcccaatatgaacctggcggcagcgcaaaagatg

SEQ ID NO: 27291 - DNA, 103 bp, Artificial Sequence
  Synthetic Polynucleotide
taatacgactcactataggggcaccgacaggaacatacatattggggtacaacagaggagagtacccatgtatgtatgtaacctggcggcagcgcaaaagatg

SEQ ID NO: 27292 - DNA, 103 bp, Artificial Sequence
  Synthetic Polynucleotide
taatacgactcactatagggtcacagcaccgacaggaacatacatattggaacagaggagaccaataatgatgttcctgaacctggcggcagcgcaaaagatg

SEQ ID NO: 27293 - DNA, 103 bp, Artificial Sequence
  Synthetic Polynucleotide
taatacgactcactatagggttcagtcacagcaccgacaggaacatacataacagaggagaatgtatatgcctgtcggtaacctggcggcagcgcaaaagatg

SEQ ID NO: 27294 - DNA, 103 bp, Artificial Sequence
  Synthetic Polynucleotide
taatacgactcactatagggccctgttcagtcacagcaccgacaggaacaaacagaggagatgttccatgcggtgctgtaacctggcggcagcgcaaaagatg

SEQ ID NO: 27295 - DNA, 103 bp, Artificial Sequence
  Synthetic Polynucleotide
taatacgactcactataggggatatccctgttcagtcacagcaccgacagaacagaggagactgtcgatgctgtgactgaacctggcggcagcgcaaaagatg

SEQ ID NO: 27296 - DNA, 103 bp, Artificial Sequence
  Synthetic Polynucleotide
taatacgactcactatagggatttagatatccctgttcagtcacagcaccaacagaggagaggtgctatgactgaacagaacctggcggcagcgcaaaagatg

SEQ ID NO: 27297 - DNA, 103 bp, Artificial Sequence
  Synthetic Polynucleotide
taatacgactcactatagggccgagatttagatatccctgttcagtcacaaacagaggagatgtgacatgacagggataaacctggcggcagcgcaaaagatg

SEQ ID NO: 27298 - DNA, 103 bp, Artificial Sequence
  Synthetic Polynucleotide
taatacgactcactatagggcaatctgtgattgtcaccataagcagccacaacagaggagagtggctatgtatggtgacaacctggcggcagcgcaaaagatg

SEQ ID NO: 27299 - DNA, 103 bp, Artificial Sequence
  Synthetic Polynucleotide
taatacgactcactataggggcccaccgagatttagatatccctgttcagaacagaggagactgaacatggatatctaaaacctggcggcagcgcaaaagatg

SEQ ID NO: 27300 - DNA, 103 bp, Artificial Sequence
  Synthetic Polynucleotide
taatacgactcactatagggttggcgcccaccgagatttagatatccctgaacagaggagacagggaatgctaaatctcaacctggcggcagcgcaaaagatg

SEQ ID NO: 27301 - DNA, 103 bp, Artificial Sequence
  Synthetic Polynucleotide
taatacgactcactataggggcagtttggcgcccaccgagatttagatataacagaggagaatatctatgtctcggtggaacctggcggcagcgcaaaagatg

SEQ ID NO: 27302 - DNA, 103 bp, Artificial Sequence
  Synthetic Polynucleotide
taatacgactcactatagggtacgagcagtttggcgcccaccgagatttaaacagaggagataaatcatggtgggcgccaacctggcggcagcgcaaaagatg

SEQ ID NO: 27303 - DNA, 103 bp, Artificial Sequence
  Synthetic Polynucleotide
taatacgactcactatagggtagagtacgagcagtttggcgcccaccgagaacagaggagactcggtatgcgccaaactaacctggcggcagcgcaaaagatg

SEQ ID NO: 27304 - DNA, 103 bp, Artificial Sequence
  Synthetic Polynucleotide
taatacgactcactatagggtacattagagtacgagcagtttggcgcccaaacagaggagatgggcgatgaactgctcgaacctggcggcagcgcaaaagatg

SEQ ID NO: 27305 - DNA, 103 bp, Artificial Sequence
  Synthetic Polynucleotide
taatacgactcactatagggagttgtacattagagtacgagcagtttggcaacagaggagagccaaaatgctcgtactcaacctggcggcagcgcaaaagatg

SEQ ID NO: 27306 - DNA, 103 bp, Artificial Sequence
  Synthetic Polynucleotide
taatacgactcactatagggtggaaagttgtacattagagtacgagcagtaacagaggagaactgctatgactctaatgaacctggcggcagcgcaaaagatg

SEQ ID NO: 27307 - DNA, 103 bp, Artificial Sequence
  Synthetic Polynucleotide
taatacgactcactatagggctggttggaaagttgtacattagagtacgaaacagaggagatcgtacatgaatgtacaaaacctggcggcagcgcaaaagatg

SEQ ID NO: 27308 - DNA, 103 bp, Artificial Sequence
  Synthetic Polynucleotide
taatacgactcactatagggctgctctggttggaaagttgtacattagagaacagaggagactctaaatgacaactttcaacctggcggcagcgcaaaagatg

SEQ ID NO: 27309 - DNA, 103 bp, Artificial Sequence
  Synthetic Polynucleotide
taatacgactcactataggggataacaatctgtgattgtcaccataagcaaacagaggagatgcttaatgtgacaatcaaacctggcggcagcgcaaaagatg

SEQ ID NO: 27310 - DNA, 103 bp, Artificial Sequence
  Synthetic Polynucleotide
taatacgactcactatagggctgtcctgctctggttggaaagttgtacataacagaggagaatgtacatgtttccaaccaacctggcggcagcgcaaaagatg

SEQ ID NO: 27311 - DNA, 103 bp, Artificial Sequence
  Synthetic Polynucleotide
taatacgactcactatagggccacactgtcctgctctggttggaaagttgaacagaggagacaacttatgaaccagagcaacctggcggcagcgcaaaagatg

SEQ ID NO: 27312 - DNA, 103 bp, Artificial Sequence
  Synthetic Polynucleotide
taatacgactcactatagggctccaccacactgtcctgctctggttggaaaacagaggagattccaaatggagcaggacaacctggcggcagcgcaaaagatg

SEQ ID NO: 27313 - DNA, 103 bp, Artificial Sequence
  Synthetic Polynucleotide
taatacgactcactataggggatgactccaccacactgtcctgctctggtaacagaggagaaccagaatgggacagtgtaacctggcggcagcgcaaaagatg

SEQ ID NO: 27314 - DNA, 103 bp, Artificial Sequence
  Synthetic Polynucleotide
taatacgactcactatagggcatgtgatgactccaccacactgtcctgctaacagaggagaagcaggatggtgtggtggaacctggcggcagcgcaaaagatg

SEQ ID NO: 27315 - DNA, 103 bp, Artificial Sequence
  Synthetic Polynucleotide
taatacgactcactatagggcagtacatgtgatgactccaccacactgtcaacagaggagagacagtatggtggagtcaaacctggcggcagcgcaaaagatg

SEQ ID NO: 27316 - DNA, 103 bp, Artificial Sequence
  Synthetic Polynucleotide
taatacgactcactatagggtttcccagtacatgtgatgactccaccacaaacagaggagatgtggtatggtcatcacaaacctggcggcagcgcaaaagatg

SEQ ID NO: 27317 - DNA, 103 bp, Artificial Sequence
  Synthetic Polynucleotide
taatacgactcactatagggatgactttcccagtacatgtgatgactccaaacagaggagatggagtatgcacatgtacaacctggcggcagcgcaaaagatg

SEQ ID NO: 27318 - DNA, 103 bp, Artificial Sequence
  Synthetic Polynucleotide
taatacgactcactatagggtcccgatgactttcccagtacatgtgatgaaacagaggagatcatcaatggtactgggaaacctggcggcagcgcaaaagatg

SEQ ID NO: 27319 - DNA, 103 bp, Artificial Sequence
  Synthetic Polynucleotide
taatacgactcactatagggatgcatcccgatgactttcccagtacatgtaacagaggagaacatgtatggggaaagtcaacctggcggcagcgcaaaagatg

SEQ ID NO: 27320 - DNA, 103 bp, Artificial Sequence
  Synthetic Polynucleotide
taatacgactcactatagggtttatgataacaatctgtgattgtcaccataacagaggagaatggtgatgatcacagataacctggcggcagcgcaaaagatg

SEQ ID NO: 27321 - DNA, 103 bp, Artificial Sequence
  Synthetic Polynucleotide
taatacgactcactatagggccaacatgcatcccgatgactttcccagtaaacagaggagatactggatgagtcatcggaacctggcggcagcgcaaaagatg

SEQ ID NO: 27322 - DNA, 103 bp, Artificial Sequence
  Synthetic Polynucleotide
taatacgactcactatagggtcccaccaacatgcatcccgatgactttccaacagaggagaggaaagatgtcgggatgcaacctggcggcagcgcaaaagatg

SEQ ID NO: 27323 - DNA, 103 bp, Artificial Sequence
  Synthetic Polynucleotide
taatacgactcactatagggaccgttcccaccaacatgcatcccgatgacaacagaggagagtcatcatgatgcatgttaacctggcggcagcgcaaaagatg

SEQ ID NO: 27324 - DNA, 103 bp, Artificial Sequence
  Synthetic Polynucleotide
taatacgactcactatagggtgtgaaccgttcccaccaacatgcatcccgaacagaggagacgggatatgtgttggtggaacctggcggcagcgcaaaagatg

SEQ ID NO: 27325 - DNA, 103 bp, Artificial Sequence
  Synthetic Polynucleotide
taatacgactcactatagggacccgtgtgaaccgttcccaccaacatgcaaacagaggagatgcatgatggtgggaacgaacctggcggcagcgcaaaagatg

SEQ ID NO: 27326 - DNA, 103 bp, Artificial Sequence
  Synthetic Polynucleotide
taatacgactcactatagggtgcaaacccgtgtgaaccgttcccaccaacaacagaggagagttggtatgaacggttcaaacctggcggcagcgcaaaagatg

SEQ ID NO: 27327 - DNA, 103 bp, Artificial Sequence
  Synthetic Polynucleotide
taatacgactcactataggggccgctgcaaacccgtgtgaaccgttcccaaacagaggagatgggaaatgttcacacggaacctggcggcagcgcaaaagatg

SEQ ID NO: 27328 - DNA, 103 bp, Artificial Sequence
  Synthetic Polynucleotide
taatacgactcactatagggtcagggccgctgcaaacccgtgtgaaccgtaacagaggagaacggttatgacgggtttgaacctggcggcagcgcaaaagatg

SEQ ID NO: 27329 - DNA, 103 bp, Artificial Sequence
  Synthetic Polynucleotide
taatacgactcactatagggtcgcttcagggccgctgcaaacccgtgtgaaacagaggagatcacacatgtttgcagcgaacctggcggcagcgcaaaagatg

SEQ ID NO: 27330 - DNA, 103 bp, Artificial Sequence
  Synthetic Polynucleotide
taatacgactcactatagggtatgatcgcttcagggccgctgcaaacccgaacagaggagacgggttatgagcggccctaacctggcggcagcgcaaaagatg

SEQ ID NO: 27331 - DNA, 103 bp, Artificial Sequence
  Synthetic Polynucleotide
taatacgactcactatagggttcgctttatgataacaatctgtgattgtcaacagaggagagacaatatgagattgttaaacctggcggcagcgcaaaagatg

SEQ ID NO: 27332 - DNA, 103 bp, Artificial Sequence
  Synthetic Polynucleotide
taatacgactcactatagggtgaagtatgatcgcttcagggccgctgcaaaacagaggagattgcagatgccctgaagcaacctggcggcagcgcaaaagatg

SEQ ID NO: 27333 - DNA, 103 bp, Artificial Sequence
  Synthetic Polynucleotide
taatacgactcactatagggctgagtgaagtatgatcgcttcagggccgcaacagaggagagcggccatgaagcgatcaaacctggcggcagcgcaaaagatg

SEQ ID NO: 27334 - DNA, 103 bp, Artificial Sequence
  Synthetic Polynucleotide
taatacgactcactatagggtgactctgagtgaagtatgatcgcttcaggaacagaggagacctgaaatgatcatacttaacctggcggcagcgcaaaagatg

SEQ ID NO: 27335 - DNA, 103 bp, Artificial Sequence
  Synthetic Polynucleotide
taatacgactcactatagggcaccttgactctgagtgaagtatgatcgctaacagaggagaagcgatatgacttcactcaacctggcggcagcgcaaaagatg

SEQ ID NO: 27336 - DNA, 103 bp, Artificial Sequence
  Synthetic Polynucleotide
taatacgactcactataggggatttcaccttgactctgagtgaagtatgaaacagaggagatcatacatgactcagagtaacctggcggcagcgcaaaagatg

SEQ ID NO: 27337 - DNA, 103 bp, Artificial Sequence
  Synthetic Polynucleotide
taatacgactcactatagggcactggatttcaccttgactctgagtgaagaacagaggagacttcacatggagtcaaggaacctggcggcagcgcaaaagatg

SEQ ID NO: 27338 - DNA, 103 bp, Artificial Sequence
  Synthetic Polynucleotide
taatacgactcactatagggtcatccactggatttcaccttgactctgagaacagaggagactcagaatgaaggtgaaaaacctggcggcagcgcaaaagatg

SEQ ID NO: 27339 - DNA, 103 bp, Artificial Sequence
  Synthetic Polynucleotide
taatacgactcactatagggaggtctcatccactggatttcaccttgactaacagaggagaagtcaaatggaaatccagaacctggcggcagcgcaaaagatg

SEQ ID NO: 27340 - DNA, 103 bp, Artificial Sequence
  Synthetic Polynucleotide
taatacgactcactatagggttcgaaggtctcatccactggatttcacctaacagaggagaaggtgaatgccagtggataacctggcggcagcgcaaaagatg

SEQ ID NO: 27341 - DNA, 103 bp, Artificial Sequence
  Synthetic Polynucleotide
taatacgactcactatagggcttccttcgaaggtctcatccactggatttaacagaggagaaaatccatgggatgagacaacctggcggcagcgcaaaagatg

SEQ ID NO: 27342 - DNA, 103 bp, Artificial Sequence
  Synthetic Polynucleotide
taatacgactcactatagggaacaggcgtacaagggtaccgcaataccggaacagaggagaccggtaatgcggtaccctaacctggcggcagcgcaaaagatg

SEQ ID NO: 27343 - DNA, 103 bp, Artificial Sequence
  Synthetic Polynucleotide
taatacgactcactatagggtccaattcgctttatgataacaatctgtgaaacagaggagatcacagatggttatcataaacctggcggcagcgcaaaagatg

SEQ ID NO: 27344 - DNA, 103 bp, Artificial Sequence
  Synthetic Polynucleotide
taatacgactcactatagggtcccacttccttcgaaggtctcatccactgaacagaggagacagtggatgagaccttcgaacctggcggcagcgcaaaagatg

SEQ ID NO: 27345 - DNA, 103 bp, Artificial Sequence
  Synthetic Polynucleotide
taatacgactcactatagggggatatcccacttccttcgaaggtctcatcaacagaggagagatgagatgttcgaaggaaacctggcggcagcgcaaaagatg

SEQ ID NO: 27346 - DNA, 103 bp, Artificial Sequence
  Synthetic Polynucleotide
taatacgactcactatagggtgattggatatcccacttccttcgaaggtcaacagaggagagaccttatgaggaagtggaacctggcggcagcgcaaaagatg

SEQ ID NO: 27347 - DNA, 103 bp, Artificial Sequence
  Synthetic Polynucleotide
taatacgactcactatagggatttatgattggatatcccacttccttcgaaacagaggagatcgaagatggtgggatataacctggcggcagcgcaaaagatg

SEQ ID NO: 27348 - DNA, 103 bp, Artificial Sequence
  Synthetic Polynucleotide
taatacgactcactatagggggggcatttatgattggatatcccacttccaacagaggagaggaagtatgatatccaataacctggcggcagcgcaaaagatg

SEQ ID NO: 27349 - DNA, 103 bp, Artificial Sequence
  Synthetic Polynucleotide
taatacgactcactatagggtggacggggcatttatgattggatatcccaaacagaggagatgggatatgcaatcataaaacctggcggcagcgcaaaagatg

SEQ ID NO: 27350 - DNA, 103 bp, Artificial Sequence
  Synthetic Polynucleotide
taatacgactcactatagggggttttggacggggcatttatgattggataaacagaggagatatccaatgataaatgccaacctggcggcagcgcaaaagatg

SEQ ID NO: 27351 - DNA, 103 bp, Artificial Sequence
  Synthetic Polynucleotide
taatacgactcactatagggagcttggttttggacggggcatttatgattaacagaggagaaatcatatgtgccccgtcaacctggcggcagcgcaaaagatg

SEQ ID NO: 27352 - DNA, 103 bp, Artificial Sequence
  Synthetic Polynucleotide
taatacgactcactataggggttcaagcttggttttggacggggcatttaaacagaggagataaatgatgcgtccaaaaaacctggcggcagcgcaaaagatg

SEQ ID NO: 27353 - DNA, 103 bp, Artificial Sequence
  Synthetic Polynucleotide
taatacgactcactatagggactgggttcaagcttggttttggacggggcaacagaggagagccccgatgaaaaccaagaacctggcggcagcgcaaaagatg

SEQ ID NO: 27354 - DNA, 103 bp, Artificial Sequence
  Synthetic Polynucleotide
taatacgactcactataggggccaatccaattcgctttatgataacaatcaacagaggagagattgtatgcataaagcgaacctggcggcagcgcaaaagatg

SEQ ID NO: 27355 - DNA, 103 bp, Artificial Sequence
  Synthetic Polynucleotide
taatacgactcactatagggaaagcactgggttcaagcttggttttggacaacagaggagagtccaaatgcaagcttgaaacctggcggcagcgcaaaagatg

SEQ ID NO: 27356 - DNA, 103 bp, Artificial Sequence
  Synthetic Polynucleotide
taatacgactcactatagggagtggaaagcactgggttcaagcttggtttaacagaggagaaaaccaatgttgaacccaaacctggcggcagcgcaaaagatg

SEQ ID NO: 27357 - DNA, 103 bp, Artificial Sequence
  Synthetic Polynucleotide
taatacgactcactatagggcacatagtggaaagcactgggttcaagcttaacagaggagaaagcttatgcccagtgctaacctggcggcagcgcaaaagatg

SEQ ID NO: 27358 - DNA, 103 bp, Artificial Sequence
  Synthetic Polynucleotide
taatacgactcactatagggtcaaacacatagtggaaagcactgggttcaaacagaggagatgaaccatgtgctttccaaacctggcggcagcgcaaaagatg

SEQ ID NO: 27359 - DNA, 103 bp, Artificial Sequence
  Synthetic Polynucleotide
taatacgactcactatagggccccttcaaacacatagtggaaagcactggaacagaggagaccagtgatgtccactatgaacctggcggcagcgcaaaagatg

SEQ ID NO: 27360 - DNA, 103 bp, Artificial Sequence
  Synthetic Polynucleotide
taatacgactcactatagggcttcaccccttcaaacacatagtggaaagcaacagaggagagctttcatgtatgtgtttaacctggcggcagcgcaaaagatg

SEQ ID NO: 27361 - DNA, 103 bp, Artificial Sequence
  Synthetic Polynucleotide
taatacgactcactatagggggttccttcaccccttcaaacacatagtggaacagaggagaccactaatggtttgaaggaacctggcggcagcgcaaaagatg

SEQ ID NO: 27362 - DNA, 103 bp, Artificial Sequence
  Synthetic Polynucleotide
taatacgactcactatagggctgctggttccttcaccccttcaaacacataacagaggagaatgtgtatgaaggggtgaaacctggcggcagcgcaaaagatg

SEQ ID NO: 27363 - DNA, 103 bp, Artificial Sequence
  Synthetic Polynucleotide
taatacgactcactataggggaggactgctggttccttcaccccttcaaaaacagaggagatttgaaatggtgaaggaaaacctggcggcagcgcaaaagatg

SEQ ID NO: 27364 - DNA, 103 bp, Artificial Sequence
  Synthetic Polynucleotide
taatacgactcactatagggttagtgaggactgctggttccttcacccctaacagaggagaaggggtatgggaaccagcaacctggcggcagcgcaaaagatg

SEQ ID NO: 27365 - DNA, 103 bp, Artificial Sequence
  Synthetic Polynucleotide
taatacgactcactatagggggatggccaatccaattcgctttatgataaaacagaggagattatcaatgagcgaattgaacctggcggcagcgcaaaagatg

SEQ ID NO: 27366 - DNA, 103 bp, Artificial Sequence
  Synthetic Polynucleotide
taatacgactcactatagggcgtttttagtgaggactgctggttccttcaaacagaggagatgaaggatgcagcagtccaacctggcggcagcgcaaaagatg

SEQ ID NO: 27367 - DNA, 103 bp, Artificial Sequence
  Synthetic Polynucleotide
taatacgactcactataggggggatcgtttttagtgaggactgctggttcaacagaggagagaaccaatggtcctcactaacctggcggcagcgcaaaagatg

SEQ ID NO: 27368 - DNA, 103 bp, Artificial Sequence
  Synthetic Polynucleotide
taatacgactcactatagggagcctgggatcgtttttagtgaggactgctaacagaggagaagcagtatgcactaaaaaaacctggcggcagcgcaaaagatg

SEQ ID NO: 27369 - DNA, 103 bp, Artificial Sequence
  Synthetic Polynucleotide
taatacgactcactatagggtcttaagcctgggatcgtttttagtgaggaaacagaggagatcctcaatgaaaacgatcaacctggcggcagcgcaaaagatg

SEQ ID NO: 27370 - DNA, 103 bp, Artificial Sequence
  Synthetic Polynucleotide
taatacgactcactataggggtctgtcttaagcctgggatcgtttttagtaacagaggagaactaaaatggatcccaggaacctggcggcagcgcaaaagatg

SEQ ID NO: 27371 - DNA, 103 bp, Artificial Sequence
  Synthetic Polynucleotide
taatacgactcactatagggtcaaagtctgtcttaagcctgggatcgtttaacagaggagaaaacgaatgcaggcttaaaacctggcggcagcgcaaaagatg

SEQ ID NO: 27372 - DNA, 103 bp, Artificial Sequence
  Synthetic Polynucleotide
taatacgactcactatagggcctcctcaaagtctgtcttaagcctgggataacagaggagaatcccaatgttaagacagaacctggcggcagcgcaaaagatg

SEQ ID NO: 27373 - DNA, 103 bp, Artificial Sequence
  Synthetic Polynucleotide
taatacgactcactatagggaattgcctcctcaaagtctgtcttaagcctaacagaggagaaggcttatgacagactttaacctggcggcagcgcaaaagatg

SEQ ID NO: 27374 - DNA, 103 bp, Artificial Sequence
  Synthetic Polynucleotide
taatacgactcactataggggagaaaattgcctcctcaaagtctgtcttaaacagaggagataagacatgctttgaggaaacctggcggcagcgcaaaagatg

SEQ ID NO: 27375 - DNA, 103 bp, Artificial Sequence
  Synthetic Polynucleotide
taatacgactcactatagggacttggagaaaattgcctcctcaaagtctgaacagaggagacagactatgaggaggcaaaacctggcggcagcgcaaaagatg

SEQ ID NO: 27376 - DNA, 103 bp, Artificial Sequence
  Synthetic Polynucleotide
taatacgactcactatagggtcaccggatggccaatccaattcgctttataacagaggagaataaagatgattggattgaacctggcggcagcgcaaaagatg

SEQ ID NO: 27377 - DNA, 103 bp, Artificial Sequence
  Synthetic Polynucleotide
taatacgactcactatagggcacgtacttggagaaaattgcctcctcaaaaacagaggagatttgagatggcaattttcaacctggcggcagcgcaaaagatg

SEQ ID NO: 27378 - DNA, 103 bp, Artificial Sequence
  Synthetic Polynucleotide
taatacgactcactatagggttacccacgtacttggagaaaattgcctccaacagaggagaggaggcatgtttctccaaaacctggcggcagcgcaaaagatg

SEQ ID NO: 27379 - DNA, 103 bp, Artificial Sequence
  Synthetic Polynucleotide
taatacgactcactatagggttttgttacccacgtacttggagaaaattgaacagaggagacaatttatgccaagtacgaacctggcggcagcgcaaaagatg

SEQ ID NO: 27380 - DNA, 103 bp, Artificial Sequence
  Synthetic Polynucleotide
taatacgactcactatagggagtaattttgttacccacgtacttggagaaaacagaggagattctccatgtacgtgggtaacctggcggcagcgcaaaagatg

SEQ ID NO: 27381 - DNA, 103 bp, Artificial Sequence
  Synthetic Polynucleotide
taatacgactcactatagggacttcagtaattttgttacccacgtacttgaacagaggagacaagtaatggggtaacaaaacctggcggcagcgcaaaagatg

SEQ ID NO: 27382 - DNA, 103 bp, Artificial Sequence
  Synthetic Polynucleotide
taatacgactcactatagggcatccacttcagtaattttgttacccacgtaacagaggagaacgtggatgacaaaattaaacctggcggcagcgcaaaagatg

SEQ ID NO: 27383 - DNA, 103 bp, Artificial Sequence
  Synthetic Polynucleotide
taatacgactcactataggggtactcatccacttcagtaattttgttaccaacagaggagaggtaacatgattactgaaaacctggcggcagcgcaaaagatg

SEQ ID NO: 27384 - DNA, 103 bp, Artificial Sequence
  Synthetic Polynucleotide
taatacgactcactatagggttcatgtactcatccacttcagtaattttgaacagaggagacaaaatatgtgaagtggaaacctggcggcagcgcaaaagatg

SEQ ID NO: 27385 - DNA, 103 bp, Artificial Sequence
  Synthetic Polynucleotide
taatacgactcactatagggcctctttcatgtactcatccacttcagtaaaacagaggagattactgatgtggatgagtaacctggcggcagcgcaaaagatg

SEQ ID NO: 27386 - DNA, 103 bp, Artificial Sequence
  Synthetic Polynucleotide
taatacgactcactatagggtactgcctctttcatgtactcatccacttcaacagaggagagaagtgatggagtacatgaacctggcggcagcgcaaaagatg

SEQ ID NO: 27387 - DNA, 103 bp, Artificial Sequence
  Synthetic Polynucleotide
taatacgactcactatagggcactttcaccggatggccaatccaattcgcaacagaggagagcgaatatgattggccataacctggcggcagcgcaaaagatg

SEQ ID NO: 27388 - DNA, 103 bp, Artificial Sequence
  Synthetic Polynucleotide
taatacgactcactatagggtggtctactgcctctttcatgtactcatccaacagaggagaggatgaatgcatgaaagaaacctggcggcagcgcaaaagatg

SEQ ID NO: 27389 - DNA, 103 bp, Artificial Sequence
  Synthetic Polynucleotide
taatacgactcactatagggcatagtggtctactgcctctttcatgtactaacagaggagaagtacaatgaagaggcagaacctggcggcagcgcaaaagatg

SEQ ID NO: 27390 - DNA, 103 bp, Artificial Sequence
  Synthetic Polynucleotide
taatacgactcactataggggccagcatagtggtctactgcctctttcataacagaggagaatgaaaatggcagtagacaacctggcggcagcgcaaaagatg

SEQ ID NO: 27391 - DNA, 103 bp, Artificial Sequence
  Synthetic Polynucleotide
taatacgactcactatagggagctggccagcatagtggtctactgcctctaacagaggagaagaggcatgagaccactaaacctggcggcagcgcaaaagatg

SEQ ID NO: 27392 - DNA, 103 bp, Artificial Sequence
  Synthetic Polynucleotide
taatacgactcactatagggacatgagctggccagcatagtggtctactgaacagaggagacagtagatgactatgctgaacctggcggcagcgcaaaagatg

SEQ ID NO: 27393 - DNA, 103 bp, Artificial Sequence
  Synthetic Polynucleotide
taatacgactcactatagggtagtgacatgagctggccagcatagtggtcaacagaggagagaccacatggctggccagaacctggcggcagcgcaaaagatg

SEQ ID NO: 27394 - DNA, 103 bp, Artificial Sequence
  Synthetic Polynucleotide
taatacgactcactatagggatgtctagtgacatgagctggccagcatagaacagaggagactatgcatgccagctcataacctggcggcagcgcaaaagatg

SEQ ID NO: 27395 - DNA, 103 bp, Artificial Sequence
  Synthetic Polynucleotide
taatacgactcactatagggtgttgatgtctagtgacatgagctggccagaacagaggagactggccatgtcatgtcacaacctggcggcagcgcaaaagatg

SEQ ID NO: 27396 - DNA, 103 bp, Artificial Sequence
  Synthetic Polynucleotide
taatacgactcactatagggttctgtgttgatgtctagtgacatgagctgaacagaggagacagctcatgtcactagacaacctggcggcagcgcaaaagatg

SEQ ID NO: 27397 - DNA, 103 bp, Artificial Sequence
  Synthetic Polynucleotide
taatacgactcactatagggatttgttctgtgttgatgtctagtgacatgaacagaggagacatgtcatgagacatcaaaacctggcggcagcgcaaaagatg

SEQ ID NO: 27398 - DNA, 103 bp, Artificial Sequence
  Synthetic Polynucleotide
taatacgactcactatagggagtctcactttcaccggatggccaatccaaaacagaggagattggatatgccatccggtaacctggcggcagcgcaaaagatg

SEQ ID NO: 27399 - DNA, 103 bp, Artificial Sequence
  Synthetic Polynucleotide
taatacgactcactatagggagcacatttgttctgtgttgatgtctagtgaacagaggagacactagatgtcaacacagaacctggcggcagcgcaaaagatg

SEQ ID NO: 27400 - DNA, 103 bp, Artificial Sequence
  Synthetic Polynucleotide
taatacgactcactatagggctccaagcacatttgttctgtgttgatgtcaacagaggagagacatcatgacagaacaaaacctggcggcagcgcaaaagatg

SEQ ID NO: 27401 - DNA, 103 bp, Artificial Sequence
  Synthetic Polynucleotide
taatacgactcactataggggcatcctccaagcacatttgttctgtgttgaacagaggagacaacacatgacaaatgtgaacctggcggcagcgcaaaagatg

SEQ ID NO: 27402 - DNA, 103 bp, Artificial Sequence
  Synthetic Polynucleotide
taatacgactcactatagggacatggcatcctccaagcacatttgttctgaacagaggagacagaacatgtgtgcttggaacctggcggcagcgcaaaagatg

SEQ ID NO: 27403 - DNA, 103 bp, Artificial Sequence
  Synthetic Polynucleotide
taatacgactcactataggggccatacatggcatcctccaagcacatttgaacagaggagacaaatgatgttggaggataacctggcggcagcgcaaaagatg

SEQ ID NO: 27404 - DNA, 103 bp, Artificial Sequence
  Synthetic Polynucleotide
taatacgactcactatagggtcagtgccatacatggcatcctccaagcacaacagaggagagtgcttatgggatgccataacctggcggcagcgcaaaagatg

SEQ ID NO: 27405 - DNA, 103 bp, Artificial Sequence
  Synthetic Polynucleotide
taatacgactcactataggggaccatcagtgccatacatggcatcctccaaacagaggagatggaggatgccatgtatgaacctggcggcagcgcaaaagatg

SEQ ID NO: 27406 - DNA, 103 bp, Artificial Sequence
  Synthetic Polynucleotide
taatacgactcactatagggttctagaccatcagtgccatacatggcatcaacagaggagagatgccatgtatggcactaacctggcggcagcgcaaaagatg

SEQ ID NO: 27407 - DNA, 103 bp, Artificial Sequence
  Synthetic Polynucleotide
taatacgactcactatagggagtgcttctagaccatcagtgccatacatgaacagaggagacatgtaatgcactgatggaacctggcggcagcgcaaaagatg

SEQ ID NO: 27408 - DNA, 103 bp, Artificial Sequence
  Synthetic Polynucleotide
taatacgactcactatagggaatcaagtgcttctagaccatcagtgccataacagaggagaatggcaatgatggtctagaacctggcggcagcgcaaaagatg

SEQ ID NO: 27409 - DNA, 103 bp, Artificial Sequence
  Synthetic Polynucleotide
taatacgactcactatagggtaatgagtctcactttcaccggatggccaaaacagaggagattggccatgcggtgaaagaacctggcggcagcgcaaaagatg

SEQ ID NO: 27410 - DNA, 103 bp, Artificial Sequence
  Synthetic Polynucleotide
taatacgactcactatagggggacaaatcaagtgcttctagaccatcagtaacagaggagaactgatatgctagaagcaaacctggcggcagcgcaaaagatg

SEQ ID NO: 27411 - DNA, 103 bp, Artificial Sequence
  Synthetic Polynucleotide
taatacgactcactatagggctggtggacaaatcaagtgcttctagaccaaacagaggagatggtctatgagcacttgaaacctggcggcagcgcaaaagatg

SEQ ID NO: 27412 - DNA, 103 bp, Artificial Sequence
  Synthetic Polynucleotide
taatacgactcactatagggcagcactggtggacaaatcaagtgcttctaaacagaggagatagaagatgttgatttgtaacctggcggcagcgcaaaagatg

SEQ ID NO: 27413 - DNA, 103 bp, Artificial Sequence
  Synthetic Polynucleotide
taatacgactcactataggggtagccagcactggtggacaaatcaagtgcaacagaggagagcacttatgttgtccaccaacctggcggcagcgcaaaagatg

SEQ ID NO: 27414 - DNA, 103 bp, Artificial Sequence
  Synthetic Polynucleotide
taatacgactcactatagggtaagggtagccagcactggtggacaaatcaaacagaggagatgatttatgcaccagtgcaacctggcggcagcgcaaaagatg

SEQ ID NO: 27415 - DNA, 103 bp, Artificial Sequence
  Synthetic Polynucleotide
taatacgactcactatagggctacataagggtagccagcactggtggacaaacagaggagatgtccaatggtgctggctaacctggcggcagcgcaaaagatg

SEQ ID NO: 27416 - DNA, 103 bp, Artificial Sequence
  Synthetic Polynucleotide
taatacgactcactatagggcattgctacataagggtagccagcactggtaacagaggagaaccagtatgggctaccctaacctggcggcagcgcaaaagatg

SEQ ID NO: 27417 - DNA, 103 bp, Artificial Sequence
  Synthetic Polynucleotide
taatacgactcactatagggtttcccattgctacataagggtagccagcaaacagaggagatgctggatgcccttatgtaacctggcggcagcgcaaaagatg

SEQ ID NO: 27418 - DNA, 103 bp, Artificial Sequence
  Synthetic Polynucleotide
taatacgactcactatagggtcttctttcccattgctacataagggtagcaacagaggagagctaccatgatgtagcaaaacctggcggcagcgcaaaagatg

SEQ ID NO: 27419 - DNA, 103 bp, Artificial Sequence
  Synthetic Polynucleotide
taatacgactcactatagggtctcttcttctttcccattgctacataaggaacagaggagaccttatatggcaatgggaaacctggcggcagcgcaaaagatg

SEQ ID NO: 27420 - DNA, 103 bp, Artificial Sequence
  Synthetic Polynucleotide
taatacgactcactatagggatagataatgagtctcactttcaccggatgaacagaggagacatccgatgaaagtgagaaacctggcggcagcgcaaaagatg

SEQ ID NO: 27421 - DNA, 103 bp, Artificial Sequence
  Synthetic Polynucleotide
taatacgactcactatagggatgtctctcttcttctttcccattgctacaaacagaggagatgtagcatggggaaagaaaacctggcggcagcgcaaaagatg

SEQ ID NO: 27422 - DNA, 103 bp, Artificial Sequence
  Synthetic Polynucleotide
taatacgactcactatagggtcaagatgtctctcttcttctttcccattgaacagaggagacaatggatgagaagaagaaacctggcggcagcgcaaaagatg

SEQ ID NO: 27423 - DNA, 103 bp, Artificial Sequence
  Synthetic Polynucleotide
taatacgactcactatagggtttgttcaagatgtctctcttcttctttccaacagaggagaggaaagatgaagagagacaacctggcggcagcgcaaaagatg

SEQ ID NO: 27424 - DNA, 103 bp, Artificial Sequence
  Synthetic Polynucleotide
taatacgactcactataggggtttgtttgttcaagatgtctctcttcttcaacagaggagagaagaaatgagacatcttaacctggcggcagcgcaaaagatg

SEQ ID NO: 27425 - DNA, 103 bp, Artificial Sequence
  Synthetic Polynucleotide
taatacgactcactatagggctctggtttgtttgttcaagatgtctctctaacagaggagaagagagatgtcttgaacaaacctggcggcagcgcaaaagatg

SEQ ID NO: 27426 - DNA, 103 bp, Artificial Sequence
  Synthetic Polynucleotide
taatacgactcactatagggagtgtctctggtttgtttgttcaagatgtcaacagaggagagacatcatgaacaaacaaaacctggcggcagcgcaaaagatg

SEQ ID NO: 27427 - DNA, 103 bp, Artificial Sequence
  Synthetic Polynucleotide
taatacgactcactatagggtccttagtgtctctggtttgtttgttcaagaacagaggagacttgaaatgacaaaccagaacctggcggcagcgcaaaagatg

SEQ ID NO: 27428 - DNA, 103 bp, Artificial Sequence
  Synthetic Polynucleotide
taatacgactcactataggggcatttccttagtgtctctggtttgtttgtaacagaggagaacaaacatgccagagacaaacctggcggcagcgcaaaagatg

SEQ ID NO: 27429 - DNA, 103 bp, Artificial Sequence
  Synthetic Polynucleotide
taatacgactcactatagggtttttgcatttccttagtgtctctggtttgaacagaggagacaaaccatggacactaagaacctggcggcagcgcaaaagatg

SEQ ID NO: 27430 - DNA, 103 bp, Artificial Sequence
  Synthetic Polynucleotide
taatacgactcactatagggagcagtttttgcatttccttagtgtctctgaacagaggagacagagaatgtaaggaaataacctggcggcagcgcaaaagatg

SEQ ID NO: 27431 - DNA, 103 bp, Artificial Sequence
  Synthetic Polynucleotide
taatacgactcactatagggaacagatagataatgagtctcactttcaccaacagaggagaggtgaaatggagactcataacctggcggcagcgcaaaagatg

SEQ ID NO: 27432 - DNA, 103 bp, Artificial Sequence
  Synthetic Polynucleotide
taatacgactcactatagggtgtcgagcagtttttgcatttccttagtgtaacagaggagaacactaatgaaatgcaaaaacctggcggcagcgcaaaagatg

SEQ ID NO: 27433 - DNA, 103 bp, Artificial Sequence
  Synthetic Polynucleotide
taatacgactcactatagggatatgtgtcgagcagtttttgcatttccttaacagaggagaaaggaaatgcaaaaactgaacctggcggcagcgcaaaagatg

SEQ ID NO: 27434 - DNA, 103 bp, Artificial Sequence
  Synthetic Polynucleotide
taatacgactcactatagggattccatatgtgtcgagcagtttttgcattaacagaggagaaatgcaatgactgctcgaaacctggcggcagcgcaaaagatg

SEQ ID NO: 27435 - DNA, 103 bp, Artificial Sequence
  Synthetic Polynucleotide
taatacgactcactatagggggttgattccatatgtgtcgagcagtttttaacagaggagaaaaaacatgtcgacacataacctggcggcagcgcaaaagatg

SEQ ID NO: 27436 - DNA, 103 bp, Artificial Sequence
  Synthetic Polynucleotide
taatacgactcactatagggtgggaggttgattccatatgtgtcgagcagaacagaggagactgctcatgacatatggaaacctggcggcagcgcaaaagatg

SEQ ID NO: 27437 - DNA, 103 bp, Artificial Sequence
  Synthetic Polynucleotide
taatacgactcactatagggaccagtgggaggttgattccatatgtgtcgaacagaggagacgacacatgtggaatcaaaacctggcggcagcgcaaaagatg

SEQ ID NO: 27438 - DNA, 103 bp, Artificial Sequence
  Synthetic Polynucleotide
taatacgactcactatagggaagtcaccagtgggaggttgattccatatgaacagaggagacatatgatgtcaacctccaacctggcggcagcgcaaaagatg

SEQ ID NO: 27439 - DNA, 103 bp, Artificial Sequence
  Synthetic Polynucleotide
taatacgactcactatagggtacataagtcaccagtgggaggttgattccaacagaggagaggaatcatgctcccactgaacctggcggcagcgcaaaagatg

SEQ ID NO: 27440 - DNA, 103 bp, Artificial Sequence
  Synthetic Polynucleotide
taatacgactcactatagggtcctttacataagtcaccagtgggaggttgaacagaggagacaacctatgactggtgacaacctggcggcagcgcaaaagatg

SEQ ID NO: 27441 - DNA, 103 bp, Artificial Sequence
  Synthetic Polynucleotide
taatacgactcactataggggttcatcctttacataagtcaccagtgggaaacagaggagatcccacatgtgacttatgaacctggcggcagcgcaaaagatg

SEQ ID NO: 27442 - DNA, 103 bp, Artificial Sequence
  Synthetic Polynucleotide
taatacgactcactatagggcagcaaacagatagataatgagtctcacttaacagaggagaaagtgaatgtcattatctaacctggcggcagcgcaaaagatg

SEQ ID NO: 27443 - DNA, 103 bp, Artificial Sequence
  Synthetic Polynucleotide
taatacgactcactatagggtctaagttcatcctttacataagtcaccagaacagaggagactggtgatgtatgtaaagaacctggcggcagcgcaaaagatg

SEQ ID NO: 27444 - DNA, 103 bp, Artificial Sequence
  Synthetic Polynucleotide
taatacgactcactatagggttggatctaagttcatcctttacataagtcaacagaggagagacttaatgaaaggatgaaacctggcggcagcgcaaaagatg

SEQ ID NO: 27445 - DNA, 103 bp, Artificial Sequence
  Synthetic Polynucleotide
taatacgactcactatagggttgttttggatctaagttcatcctttacataacagaggagaatgtaaatgatgaacttaaacctggcggcagcgcaaaagatg

SEQ ID NO: 27446 - DNA, 103 bp, Artificial Sequence
  Synthetic Polynucleotide
taatacgactcactatagggaacctttgttttggatctaagttcatccttaacagaggagaaaggatatgcttagatccaacctggcggcagcgcaaaagatg

SEQ ID NO: 27447 - DNA, 103 bp, Artificial Sequence
  Synthetic Polynucleotide
taatacgactcactatagggtgctcaacctttgttttggatctaagttcaaacagaggagatgaactatgatccaaaacaacctggcggcagcgcaaaagatg

SEQ ID NO: 27448 - DNA, 103 bp, Artificial Sequence
  Synthetic Polynucleotide
taatacgactcactatagggtcccctgctcaacctttgttttggatctaaaacagaggagattagatatgaaacaaaggaacctggcggcagcgcaaaagatg

SEQ ID NO: 27449 - DNA, 103 bp, Artificial Sequence
  Synthetic Polynucleotide
taatacgactcactatagggggatttcccctgctcaacctttgttttggaaacagaggagatccaaaatgaaggttgagaacctggcggcagcgcaaaagatg

SEQ ID NO: 27450 - DNA, 103 bp, Artificial Sequence
  Synthetic Polynucleotide
taatacgactcactatagggaatctggatttcccctgctcaacctttgttaacagaggagaaacaaaatgtgagcagggaacctggcggcagcgcaaaagatg

SEQ ID NO: 27451 - DNA, 103 bp, Artificial Sequence
  Synthetic Polynucleotide
taatacgactcactatagggcaattaatctggatttcccctgctcaacctaacagaggagaaggttgatgaggggaaataacctggcggcagcgcaaaagatg

SEQ ID NO: 27452 - DNA, 103 bp, Artificial Sequence
  Synthetic Polynucleotide
taatacgactcactatagggagcttcaattaatctggatttcccctgctcaacagaggagagagcagatgaaatccagaaacctggcggcagcgcaaaagatg

SEQ ID NO: 27453 - DNA, 103 bp, Artificial Sequence
  Synthetic Polynucleotide
taatacgactcactatagggtataaaacaggcgtacaagggtaccgcaataacagaggagaattgcgatgcccttgtacaacctggcggcagcgcaaaagatg

SEQ ID NO: 27454 - DNA, 103 bp, Artificial Sequence
  Synthetic Polynucleotide
taatacgactcactatagggggatccagcaaacagatagataatgagtctaacagaggagaagactcatgatctatctgaacctggcggcagcgcaaaagatg

SEQ ID NO: 27455 - DNA, 103 bp, Artificial Sequence
  Synthetic Polynucleotide
taatacgactcactatagggctagaagcttcaattaatctggatttccccaacagaggagaggggaaatgcagattaataacctggcggcagcgcaaaagatg

SEQ ID NO: 27456 - DNA, 103 bp, Artificial Sequence
  Synthetic Polynucleotide
taatacgactcactatagggtcaaactagaagcttcaattaatctggattaacagaggagaaatccaatgtaattgaagaacctggcggcagcgcaaaagatg

SEQ ID NO: 27457 - DNA, 103 bp, Artificial Sequence
  Synthetic Polynucleotide
taatacgactcactataggggtcattcaaactagaagcttcaattaatctaacagaggagaagattaatggaagcttctaacctggcggcagcgcaaaagatg

SEQ ID NO: 27458 - DNA, 103 bp, Artificial Sequence
  Synthetic Polynucleotide
taatacgactcactatagggactgagtcattcaaactagaagcttcaattaacagaggagaaattgaatgttctagtttaacctggcggcagcgcaaaagatg

SEQ ID NO: 27459 - DNA, 103 bp, Artificial Sequence
  Synthetic Polynucleotide
taatacgactcactatagggttgccactgagtcattcaaactagaagcttaacagaggagaaagcttatggtttgaatgaacctggcggcagcgcaaaagatg

SEQ ID NO: 27460 - DNA, 103 bp, Artificial Sequence
  Synthetic Polynucleotide
taatacgactcactatagggtctcattgccactgagtcattcaaactagaaacagaggagatctagtatgaatgactcaaacctggcggcagcgcaaaagatg

SEQ ID NO: 27461 - DNA, 103 bp, Artificial Sequence
  Synthetic Polynucleotide
taatacgactcactataggggccattctcattgccactgagtcattcaaaaacagaggagatttgaaatgctcagtggcaacctggcggcagcgcaaaagatg

SEQ ID NO: 27462 - DNA, 103 bp, Artificial Sequence
  Synthetic Polynucleotide
taatacgactcactatagggcaaaagccattctcattgccactgagtcataacagaggagaatgactatgtggcaatgaaacctggcggcagcgcaaaagatg

SEQ ID NO: 27463 - DNA, 103 bp, Artificial Sequence
  Synthetic Polynucleotide
taatacgactcactataggggttcccaaaagccattctcattgccactgaaacagaggagatcagtgatgatgagaatgaacctggcggcagcgcaaaagatg

SEQ ID NO: 27464 - DNA, 103 bp, Artificial Sequence
  Synthetic Polynucleotide
taatacgactcactatagggtataggttcccaaaagccattctcattgccaacagaggagaggcaatatgaatggctttaacctggcggcagcgcaaaagatg

SEQ ID NO: 27465 - DNA, 103 bp, Artificial Sequence
  Synthetic Polynucleotide
taatacgactcactatagggggagcggatccagcaaacagatagataatgaacagaggagacattatatgtctgtttgcaacctggcggcagcgcaaaagatg

SEQ ID NO: 27466 - DNA, 103 bp, Artificial Sequence
  Synthetic Polynucleotide
taatacgactcactatagggcagcatataggttcccaaaagccattctcaaacagaggagatgagaaatgcttttgggaaacctggcggcagcgcaaaagatg

SEQ ID NO: 27467 - DNA, 103 bp, Artificial Sequence
  Synthetic Polynucleotide
taatacgactcactatagggaaaagcagcatataggttcccaaaagccataacagaggagaatggctatggggaacctaaacctggcggcagcgcaaaagatg

SEQ ID NO: 27468 - DNA, 103 bp, Artificial Sequence
  Synthetic Polynucleotide
taatacgactcactatagggttgtgaaaagcagcatataggttcccaaaaaacagaggagattttggatgcctatatgcaacctggcggcagcgcaaaagatg

SEQ ID NO: 27469 - DNA, 103 bp, Artificial Sequence
  Synthetic Polynucleotide
taatacgactcactatagggggtttttgtgaaaagcagcatataggttccaacagaggagaggaaccatgatgctgcttaacctggcggcagcgcaaaagatg

SEQ ID NO: 27470 - DNA, 103 bp, Artificial Sequence
  Synthetic Polynucleotide
taatacgactcactatagggtcctgggtttttgtgaaaagcagcatatagaacagaggagactatatatggcttttcacaacctggcggcagcgcaaaagatg

SEQ ID NO: 27471 - DNA, 103 bp, Artificial Sequence
  Synthetic Polynucleotide
taatacgactcactatagggatcactcctgggtttttgtgaaaagcagcaaacagaggagatgctgcatgtcacaaaaaaacctggcggcagcgcaaaagatg

SEQ ID NO: 27472 - DNA, 103 bp, Artificial Sequence
  Synthetic Polynucleotide
taatacgactcactatagggctgttatcactcctgggtttttgtgaaaagaacagaggagacttttcatgaaaacccagaacctggcggcagcgcaaaagatg

SEQ ID NO: 27473 - DNA, 103 bp, Artificial Sequence
  Synthetic Polynucleotide
taatacgactcactatagggtgaacctgttatcactcctgggtttttgtgaacagaggagacacaaaatgccaggagtgaacctggcggcagcgcaaaagatg

SEQ ID NO: 27474 - DNA, 103 bp, Artificial Sequence
  Synthetic Polynucleotide
taatacgactcactatagggactgctgaacctgttatcactcctgggtttaacagaggagaaaacccatgagtgataacaacctggcggcagcgcaaaagatg

SEQ ID NO: 27475 - DNA, 103 bp, Artificial Sequence
  Synthetic Polynucleotide
taatacgactcactatagggaccccactgctgaacctgttatcactcctgaacagaggagacaggagatgtaacaggttaacctggcggcagcgcaaaagatg

SEQ ID NO: 27476 - DNA, 103 bp, Artificial Sequence
  Synthetic Polynucleotide
taatacgactcactatagggtcaatggagcggatccagcaaacagatagaaacagaggagatctatcatgttgctggataacctggcggcagcgcaaaagatg

SEQ ID NO: 27477 - DNA, 103 bp, Artificial Sequence
  Synthetic Polynucleotide
taatacgactcactatagggatcgcaccccactgctgaacctgttatcacaacagaggagagtgataatgggttcagcaaacctggcggcagcgcaaaagatg

SEQ ID NO: 27478 - DNA, 103 bp, Artificial Sequence
  Synthetic Polynucleotide
taatacgactcactatagggtctggatcgcaccccactgctgaacctgttaacagaggagaaacaggatgagcagtgggaacctggcggcagcgcaaaagatg

SEQ ID NO: 27479 - DNA, 103 bp, Artificial Sequence
  Synthetic Polynucleotide
taatacgactcactatagggacaaatctggatcgcaccccactgctgaacaacagaggagagttcagatgtggggtgcgaacctggcggcagcgcaaaagatg

SEQ ID NO: 27480 - DNA, 103 bp, Artificial Sequence
  Synthetic Polynucleotide
taatacgactcactatagggccaaaacaaatctggatcgcaccccactgcaacagaggagagcagtgatgtgcgatccaaacctggcggcagcgcaaaagatg

SEQ ID NO: 27481 - DNA, 103 bp, Artificial Sequence
  Synthetic Polynucleotide
taatacgactcactatagggttgctccaaaacaaatctggatcgcaccccaacagaggagaggggtgatgtccagatttaacctggcggcagcgcaaaagatg

SEQ ID NO: 27482 - DNA, 103 bp, Artificial Sequence
  Synthetic Polynucleotide
taatacgactcactataggggaattttgctccaaaacaaatctggatcgcaacagaggagagcgatcatgatttgttttaacctggcggcagcgcaaaagatg

SEQ ID NO: 27483 - DNA, 103 bp, Artificial Sequence
  Synthetic Polynucleotide
taatacgactcactatagggtaccggaattttgctccaaaacaaatctggaacagaggagaccagatatgttttggagcaacctggcggcagcgcaaaagatg

SEQ ID NO: 27484 - DNA, 103 bp, Artificial Sequence
  Synthetic Polynucleotide
taatacgactcactatagggatcaataccggaattttgctccaaaacaaaaacagaggagatttgttatggagcaaaataacctggcggcagcgcaaaagatg

SEQ ID NO: 27485 - DNA, 103 bp, Artificial Sequence
  Synthetic Polynucleotide
taatacgactcactatagggcttccatcaataccggaattttgctccaaaaacagaggagatttggaatgaaattccggaacctggcggcagcgcaaaagatg

SEQ ID NO: 27486 - DNA, 103 bp, Artificial Sequence
  Synthetic Polynucleotide
taatacgactcactatagggcttctcttccatcaataccggaattttgctaacagaggagaagcaaaatgccggtattgaacctggcggcagcgcaaaagatg

SEQ ID NO: 27487 - DNA, 103 bp, Artificial Sequence
  Synthetic Polynucleotide
taatacgactcactatagggcacactcaatggagcggatccagcaaacagaacagaggagactgtttatgggatccgctaacctggcggcagcgcaaaagatg

SEQ ID NO: 27488 - DNA, 103 bp, Artificial Sequence
  Synthetic Polynucleotide
taatacgactcactatagggaacagcttctcttccatcaataccggaattaacagaggagaaattccatgattgatggaaacctggcggcagcgcaaaagatg

SEQ ID NO: 27489 - DNA, 103 bp, Artificial Sequence
  Synthetic Polynucleotide
taatacgactcactatagggaagcaaacagcttctcttccatcaataccgaacagaggagacggtatatgtggaagagaaacctggcggcagcgcaaaagatg

SEQ ID NO: 27490 - DNA, 103 bp, Artificial Sequence
  Synthetic Polynucleotide
taatacgactcactataggggtcaaaagcaaacagcttctcttccatcaaaacagaggagattgatgatggagaagctgaacctggcggcagcgcaaaagatg

SEQ ID NO: 27491 - DNA, 103 bp, Artificial Sequence
  Synthetic Polynucleotide
taatacgactcactataggggtgtagtcaaaagcaaacagcttctcttccaacagaggagaggaagaatggctgtttgcaacctggcggcagcgcaaaagatg

SEQ ID NO: 27492 - DNA, 103 bp, Artificial Sequence
  Synthetic Polynucleotide
taatacgactcactatagggaccctgtgtagtcaaaagcaaacagcttctaacagaggagaagaagcatgttgcttttgaacctggcggcagcgcaaaagatg

SEQ ID NO: 27493 - DNA, 103 bp, Artificial Sequence
  Synthetic Polynucleotide
taatacgactcactatagggatcataccctgtgtagtcaaaagcaaacagaacagaggagactgtttatgtttgactacaacctggcggcagcgcaaaagatg

SEQ ID NO: 27494 - DNA, 103 bp, Artificial Sequence
  Synthetic Polynucleotide
taatacgactcactataggggatgcatcataccctgtgtagtcaaaagcaaacagaggagatgctttatgctacacaggaacctggcggcagcgcaaaagatg

SEQ ID NO: 27495 - DNA, 103 bp, Artificial Sequence
  Synthetic Polynucleotide
taatacgactcactatagggtgagagatgcatcataccctgtgtagtcaaaacagaggagattgactatgcagggtatgaacctggcggcagcgcaaaagatg

SEQ ID NO: 27496 - DNA, 103 bp, Artificial Sequence
  Synthetic Polynucleotide
taatacgactcactatagggagggctgagagatgcatcataccctgtgtaaacagaggagatacacaatgtatgatgcaaacctggcggcagcgcaaaagatg

SEQ ID NO: 27497 - DNA, 103 bp, Artificial Sequence
  Synthetic Polynucleotide
taatacgactcactatagggcaagcagggctgagagatgcatcataccctaacagaggagaagggtaatgtgcatctctaacctggcggcagcgcaaaagatg

SEQ ID NO: 27498 - DNA, 103 bp, Artificial Sequence
  Synthetic Polynucleotide
taatacgactcactataggggtaaacacactcaatggagcggatccagcaaacagaggagatgctggatgcgctccattaacctggcggcagcgcaaaagatg

SEQ ID NO: 27499 - DNA, 103 bp, Artificial Sequence
  Synthetic Polynucleotide
taatacgactcactatagggcgaaccaagcagggctgagagatgcatcataacagaggagaatgatgatgctctcagccaacctggcggcagcgcaaaagatg

SEQ ID NO: 27500 - DNA, 103 bp, Artificial Sequence
  Synthetic Polynucleotide
taatacgactcactatagggtgcctcgaaccaagcagggctgagagatgcaacagaggagagcatctatgagccctgctaacctggcggcagcgcaaaagatg

SEQ ID NO: 27501 - DNA, 103 bp, Artificial Sequence
  Synthetic Polynucleotide
taatacgactcactatagggtttagtgcctcgaaccaagcagggctgagaaacagaggagatctcagatgtgcttggttaacctggcggcagcgcaaaagatg

SEQ ID NO: 27502 - DNA, 103 bp, Artificial Sequence
  Synthetic Polynucleotide
taatacgactcactatagggccatctttagtgcctcgaaccaagcagggcaacagaggagagccctgatgggttcgaggaacctggcggcagcgcaaaagatg

SEQ ID NO: 27503 - DNA, 103 bp, Artificial Sequence
  Synthetic Polynucleotide
taatacgactcactatagggaagcaccatctttagtgcctcgaaccaagcaacagaggagagcttggatggaggcactaaacctggcggcagcgcaaaagatg

SEQ ID NO: 27504 - DNA, 103 bp, Artificial Sequence
  Synthetic Polynucleotide
taatacgactcactatagggttctcaagcaccatctttagtgcctcgaacaacagaggagagttcgaatgactaaagataacctggcggcagcgcaaaagatg

SEQ ID NO: 27505 - DNA, 103 bp, Artificial Sequence
  Synthetic Polynucleotide
taatacgactcactatagggcgattttctcaagcaccatctttagtgcctaacagaggagaaggcacatgagatggtgcaacctggcggcagcgcaaaagatg

SEQ ID NO: 27506 - DNA, 103 bp, Artificial Sequence
  Synthetic Polynucleotide
taatacgactcactataggggaatccgattttctcaagcaccatctttagaacagaggagactaaagatggtgcttgagaacctggcggcagcgcaaaagatg

SEQ ID NO: 27507 - DNA, 103 bp, Artificial Sequence
  Synthetic Polynucleotide
taatacgactcactatagggtctccgaatccgattttctcaagcaccatcaacagaggagagatggtatgtgagaaaataacctggcggcagcgcaaaagatg

SEQ ID NO: 27508 - DNA, 103 bp, Artificial Sequence
  Synthetic Polynucleotide
taatacgactcactatagggctctgtctccgaatccgattttctcaagcaaacagaggagatgcttgatgaaatcggataacctggcggcagcgcaaaagatg

SEQ ID NO: 27509 - DNA, 103 bp, Artificial Sequence
  Synthetic Polynucleotide
taatacgactcactatagggttagagtaaacacactcaatggagcggatcaacagaggagagatccgatgcattgagtgaacctggcggcagcgcaaaagatg

SEQ ID NO: 27510 - DNA, 103 bp, Artificial Sequence
  Synthetic Polynucleotide
taatacgactcactataggggtcaactctgtctccgaatccgattttctcaacagaggagagagaaaatgggattcggaaacctggcggcagcgcaaaagatg

SEQ ID NO: 27511 - DNA, 103 bp, Artificial Sequence
  Synthetic Polynucleotide
taatacgactcactatagggatgtagtcaactctgtctccgaatccgattaacagaggagaaatcggatgcggagacagaacctggcggcagcgcaaaagatg

SEQ ID NO: 27512 - DNA, 103 bp, Artificial Sequence
  Synthetic Polynucleotide
taatacgactcactatagggagtcgatgtagtcaactctgtctccgaatcaacagaggagagattcgatgacagagttgaacctggcggcagcgcaaaagatg

SEQ ID NO: 27513 - DNA, 103 bp, Artificial Sequence
  Synthetic Polynucleotide
taatacgactcactatagggtaggtagtcgatgtagtcaactctgtctccaacagaggagaggagacatggttgactacaacctggcggcagcgcaaaagatg

SEQ ID NO: 27514 - DNA, 103 bp, Artificial Sequence
  Synthetic Polynucleotide
taatacgactcactatagggtggtttaggtagtcgatgtagtcaactctgaacagaggagacagagtatgctacatcgaaacctggcggcagcgcaaaagatg

SEQ ID NO: 27515 - DNA, 103 bp, Artificial Sequence
  Synthetic Polynucleotide
taatacgactcactataggggtgagtggtttaggtagtcgatgtagtcaaaacagaggagattgactatgtcgactaccaacctggcggcagcgcaaaagatg

SEQ ID NO: 27516 - DNA, 103 bp, Artificial Sequence
  Synthetic Polynucleotide
taatacgactcactataggggtggtgtgagtggtttaggtagtcgatgtaaacagaggagatacatcatgtacctaaacaacctggcggcagcgcaaaagatg

SEQ ID NO: 27517 - DNA, 103 bp, Artificial Sequence
  Synthetic Polynucleotide
taatacgactcactatagggtacaggtggtgtgagtggtttaggtagtcgaacagaggagacgactaatgaaaccactcaacctggcggcagcgcaaaagatg

SEQ ID NO: 27518 - DNA, 103 bp, Artificial Sequence
  Synthetic Polynucleotide
taatacgactcactatagggtcttgtacaggtggtgtgagtggtttaggtaacagaggagaacctaaatgactcacaccaacctggcggcagcgcaaaagatg

SEQ ID NO: 27519 - DNA, 103 bp, Artificial Sequence
  Synthetic Polynucleotide
taatacgactcactatagggtttattcttgtacaggtggtgtgagtggttaacagaggagaaaccacatgcaccacctgaacctggcggcagcgcaaaagatg

SEQ ID NO: 27520 - DNA, 103 bp, Artificial Sequence
  Synthetic Polynucleotide
taatacgactcactatagggtgtacttagagtaaacacactcaatggagcaacagaggagagctccaatgagtgtgtttaacctggcggcagcgcaaaagatg

SEQ ID NO: 27521 - DNA, 103 bp, Artificial Sequence
  Synthetic Polynucleotide
taatacgactcactatagggtatgttttattcttgtacaggtggtgtgagaacagaggagactcacaatgcctgtacaaaacctggcggcagcgcaaaagatg

SEQ ID NO: 27522 - DNA, 103 bp, Artificial Sequence
  Synthetic Polynucleotide
taatacgactcactatagggcacagtatgttttattcttgtacaggtggtaacagaggagaaccaccatgacaagaataaacctggcggcagcgcaaaagatg

SEQ ID NO: 27523 - DNA, 103 bp, Artificial Sequence
  Synthetic Polynucleotide
taatacgactcactatagggcttgacacagtatgttttattcttgtacagaacagaggagactgtacatgaataaaacaaacctggcggcagcgcaaaagatg

SEQ ID NO: 27524 - DNA, 103 bp, Artificial Sequence
  Synthetic Polynucleotide
taatacgactcactatagggccgcccttgacacagtatgttttattcttgaacagaggagacaagaaatgaacatactgaacctggcggcagcgcaaaagatg

SEQ ID NO: 27525 - DNA, 103 bp, Artificial Sequence
  Synthetic Polynucleotide
taatacgactcactataggggcataccgcccttgacacagtatgttttataacagaggagaataaaaatgactgtgtcaaacctggcggcagcgcaaaagatg

SEQ ID NO: 27526 - DNA, 103 bp, Artificial Sequence
  Synthetic Polynucleotide
taatacgactcactatagggagatggcataccgcccttgacacagtatgtaacagaggagaacatacatggtcaagggcaacctggcggcagcgcaaaagatg

SEQ ID NO: 27527 - DNA, 103 bp, Artificial Sequence
  Synthetic Polynucleotide
taatacgactcactatagggcagccagatggcataccgcccttgacacagaacagaggagactgtgtatggggcggtataacctggcggcagcgcaaaagatg

SEQ ID NO: 27528 - DNA, 103 bp, Artificial Sequence
  Synthetic Polynucleotide
taatacgactcactatagggctgagcagccagatggcataccgcccttgaaacagaggagatcaaggatggtatgccataacctggcggcagcgcaaaagatg

SEQ ID NO: 27529 - DNA, 103 bp, Artificial Sequence
  Synthetic Polynucleotide
taatacgactcactatagggagtgcctgagcagccagatggcataccgccaacagaggagaggcggtatgccatctggcaacctggcggcagcgcaaaagatg

SEQ ID NO: 27530 - DNA, 103 bp, Artificial Sequence
  Synthetic Polynucleotide
taatacgactcactatagggattgaagtgcctgagcagccagatggcataaacagaggagatatgccatgtggctgctcaacctggcggcagcgcaaaagatg

SEQ ID NO: 27531 - DNA, 103 bp, Artificial Sequence
  Synthetic Polynucleotide
taatacgactcactataggggaaattgtacttagagtaaacacactcaataacagaggagaattgagatggtttactctaacctggcggcagcgcaaaagatg

SEQ ID NO: 27532 - DNA, 103 bp, Artificial Sequence
  Synthetic Polynucleotide
taatacgactcactatagggtaaaaattgaagtgcctgagcagccagatgaacagaggagacatctgatggctcaggcaaacctggcggcagcgcaaaagatg

SEQ ID NO: 27533 - DNA, 103 bp, Artificial Sequence
  Synthetic Polynucleotide
taatacgactcactatagggtgagttaaaaattgaagtgcctgagcagccaacagaggagaggctgcatgggcacttcaaacctggcggcagcgcaaaagatg

SEQ ID NO: 27534 - DNA, 103 bp, Artificial Sequence
  Synthetic Polynucleotide
taatacgactcactatagggatcattgagttaaaaattgaagtgcctgagaacagaggagactcaggatgttcaattttaacctggcggcagcgcaaaagatg

SEQ ID NO: 27535 - DNA, 103 bp, Artificial Sequence
  Synthetic Polynucleotide
taatacgactcactatagggtgttaatcattgagttaaaaattgaagtgcaacagaggagagcacttatgtttttaactaacctggcggcagcgcaaaagatg

SEQ ID NO: 27536 - DNA, 103 bp, Artificial Sequence
  Synthetic Polynucleotide
taatacgactcactatagggcaagttgttaatcattgagttaaaaattgaaacagaggagatcaattatgaactcaatgaacctggcggcagcgcaaaagatg

SEQ ID NO: 27537 - DNA, 103 bp, Artificial Sequence
  Synthetic Polynucleotide
taatacgactcactatagggataatcaagttgttaatcattgagttaaaaaacagaggagattttaaatgaatgattaaaacctggcggcagcgcaaaagatg

SEQ ID NO: 27538 - DNA, 103 bp, Artificial Sequence
  Synthetic Polynucleotide
taatacgactcactatagggtcctgataatcaagttgttaatcattgagtaacagaggagaactcaaatgttaacaactaacctggcggcagcgcaaaagatg

SEQ ID NO: 27539 - DNA, 103 bp, Artificial Sequence
  Synthetic Polynucleotide
taatacgactcactataggggagtgtcctgataatcaagttgttaatcataacagaggagaatgattatgaacttgattaacctggcggcagcgcaaaagatg

SEQ ID NO: 27540 - DNA, 103 bp, Artificial Sequence
  Synthetic Polynucleotide
taatacgactcactatagggagtaagagtgtcctgataatcaagttgttaaacagaggagataacaaatggattatcagaacctggcggcagcgcaaaagatg

SEQ ID NO: 27541 - DNA, 103 bp, Artificial Sequence
  Synthetic Polynucleotide
taatacgactcactatagggttttcagtaagagtgtcctgataatcaagtaacagaggagaacttgaatgtcaggacacaacctggcggcagcgcaaaagatg

SEQ ID NO: 27542 - DNA, 103 bp, Artificial Sequence
  Synthetic Polynucleotide
taatacgactcactatagggctgttgaaattgtacttagagtaaacacacaacagaggagagtgtgtatgctctaagtaaacctggcggcagcgcaaaagatg

SEQ ID NO: 27543 - DNA, 103 bp, Artificial Sequence
  Synthetic Polynucleotide
taatacgactcactataggggtaggttttcagtaagagtgtcctgataataacagaggagaattatcatgacactcttaaacctggcggcagcgcaaaagatg

SEQ ID NO: 27544 - DNA, 103 bp, Artificial Sequence
  Synthetic Polynucleotide
taatacgactcactatagggcccttgtaggttttcagtaagagtgtcctgaacagaggagacaggacatgcttactgaaaacctggcggcagcgcaaaagatg

SEQ ID NO: 27545 - DNA, 103 bp, Artificial Sequence
  Synthetic Polynucleotide
taatacgactcactatagggctatgcccttgtaggttttcagtaagagtgaacagaggagacactctatgtgaaaacctaacctggcggcagcgcaaaagatg

SEQ ID NO: 27546 - DNA, 103 bp, Artificial Sequence
  Synthetic Polynucleotide
taatacgactcactatagggtaaatctatgcccttgtaggttttcagtaaaacagaggagattactgatgacctacaagaacctggcggcagcgcaaaagatg

SEQ ID NO: 27547 - DNA, 103 bp, Artificial Sequence
  Synthetic Polynucleotide
taatacgactcactatagggtggtctaaatctatgcccttgtaggttttcaacagaggagagaaaacatgcaagggcataacctggcggcagcgcaaaagatg

SEQ ID NO: 27548 - DNA, 103 bp, Artificial Sequence
  Synthetic Polynucleotide
taatacgactcactatagggttaggtggtctaaatctatgcccttgtaggaacagaggagacctacaatggcatagattaacctggcggcagcgcaaaagatg

SEQ ID NO: 27549 - DNA, 103 bp, Artificial Sequence
  Synthetic Polynucleotide
taatacgactcactatagggcatttttaggtggtctaaatctatgcccttaacagaggagaaagggcatggatttagacaacctggcggcagcgcaaaagatg

SEQ ID NO: 27550 - DNA, 103 bp, Artificial Sequence
  Synthetic Polynucleotide
taatacgactcactataggggcaatcatttttaggtggtctaaatctatgaacagaggagacatagaatgagaccacctaacctggcggcagcgcaaaagatg

SEQ ID NO: 27551 - DNA, 103 bp, Artificial Sequence
  Synthetic Polynucleotide
taatacgactcactatagggcataggcaatcatttttaggtggtctaaataacagaggagaatttagatgacctaaaaaaacctggcggcagcgcaaaagatg

SEQ ID NO: 27552 - DNA, 103 bp, Artificial Sequence
  Synthetic Polynucleotide
taatacgactcactatagggatcaccataggcaatcatttttaggtggtcaacagaggagagaccacatgaaaatgattaacctggcggcagcgcaaaagatg

SEQ ID NO: 27553 - DNA, 103 bp, Artificial Sequence
  Synthetic Polynucleotide
taatacgactcactatagggaataactgttgaaattgtacttagagtaaaaacagaggagatttactatgagtacaattaacctggcggcagcgcaaaagatg

SEQ ID NO: 27554 - DNA, 103 bp, Artificial Sequence
  Synthetic Polynucleotide
taatacgactcactatagggacatcatcaccataggcaatcatttttaggaacagaggagacctaaaatggattgcctaaacctggcggcagcgcaaaagatg

SEQ ID NO: 27555 - DNA, 103 bp, Artificial Sequence
  Synthetic Polynucleotide
taatacgactcactatagggcaattacatcatcaccataggcaatcatttaacagaggagaaaatgaatgcctatggtgaacctggcggcagcgcaaaagatg

SEQ ID NO: 27556 - DNA, 103 bp, Artificial Sequence
  Synthetic Polynucleotide
taatacgactcactatagggggaagcaattacatcatcaccataggcaataacagaggagaattgccatgggtgatgataacctggcggcagcgcaaaagatg

SEQ ID NO: 27557 - DNA, 103 bp, Artificial Sequence
  Synthetic Polynucleotide
taatacgactcactataggggggtaggaagcaattacatcatcaccatagaacagaggagactatggatgtgatgtaataacctggcggcagcgcaaaagatg

SEQ ID NO: 27558 - DNA, 103 bp, Artificial Sequence
  Synthetic Polynucleotide
taatacgactcactatagggcatgggggtaggaagcaattacatcatcacaacagaggagagtgatgatgtaattgcttaacctggcggcagcgcaaaagatg

SEQ ID NO: 27559 - DNA, 103 bp, Artificial Sequence
  Synthetic Polynucleotide
taatacgactcactatagggaacttcatgggggtaggaagcaattacatcaacagaggagagatgtaatggcttcctacaacctggcggcagcgcaaaagatg

SEQ ID NO: 27560 - DNA, 103 bp, Artificial Sequence
  Synthetic Polynucleotide
taatacgactcactataggggcgtcaacttcatgggggtaggaagcaattaacagaggagaaattgcatgctacccccaaacctggcggcagcgcaaaagatg

SEQ ID NO: 27561 - DNA, 103 bp, Artificial Sequence
  Synthetic Polynucleotide
taatacgactcactataggggactagcgtcaacttcatgggggtaggaagaacagaggagacttcctatgcccatgaagaacctggcggcagcgcaaaagatg

SEQ ID NO: 27562 - DNA, 103 bp, Artificial Sequence
  Synthetic Polynucleotide
taatacgactcactatagggtaggagactagcgtcaacttcatgggggtaaacagaggagataccccatggaagttgacaacctggcggcagcgcaaaagatg

SEQ ID NO: 27563 - DNA, 103 bp, Artificial Sequence
  Synthetic Polynucleotide
taatacgactcactatagggtgggctaggagactagcgtcaacttcatggaacagaggagaccatgaatgtgacgctagaacctggcggcagcgcaaaagatg

SEQ ID NO: 27564 - DNA, 103 bp, Artificial Sequence
  Synthetic Polynucleotide
taatacgactcactataggggggagtataaaacaggcgtacaagggtaccaacagaggagaggtaccatggtacgcctgaacctggcggcagcgcaaaagatg

SEQ ID NO: 27565 - DNA, 103 bp, Artificial Sequence
  Synthetic Polynucleotide
taatacgactcactatagggattgaaataactgttgaaattgtacttagaaacagaggagatctaagatgaatttcaacaacctggcggcagcgcaaaagatg

SEQ ID NO: 27566 - DNA, 103 bp, Artificial Sequence
  Synthetic Polynucleotide
taatacgactcactatagggctgattgggctaggagactagcgtcaacttaacagaggagaaagttgatgctagtctccaacctggcggcagcgcaaaagatg

SEQ ID NO: 27567 - DNA, 103 bp, Artificial Sequence
  Synthetic Polynucleotide
taatacgactcactatagggttttcctgattgggctaggagactagcgtcaacagaggagagacgctatgctcctagccaacctggcggcagcgcaaaagatg

SEQ ID NO: 27568 - DNA, 103 bp, Artificial Sequence
  Synthetic Polynucleotide
taatacgactcactatagggtagtcttttcctgattgggctaggagactaaacagaggagatagtctatgagcccaatcaacctggcggcagcgcaaaagatg

SEQ ID NO: 27569 - DNA, 103 bp, Artificial Sequence
  Synthetic Polynucleotide
taatacgactcactataggggtccatagtcttttcctgattgggctaggaaacagaggagatcctagatgaatcaggaaaacctggcggcagcgcaaaagatg

SEQ ID NO: 27570 - DNA, 103 bp, Artificial Sequence
  Synthetic Polynucleotide
taatacgactcactatagggagttagtccatagtcttttcctgattgggcaacagaggagagcccaaatgggaaaagacaacctggcggcagcgcaaaagatg

SEQ ID NO: 27571 - DNA, 103 bp, Artificial Sequence
  Synthetic Polynucleotide
taatacgactcactataggggtcatagttagtccatagtcttttcctgataacagaggagaatcaggatgagactatggaacctggcggcagcgcaaaagatg

SEQ ID NO: 27572 - DNA, 103 bp, Artificial Sequence
  Synthetic Polynucleotide
taatacgactcactatagggctggagtcatagttagtccatagtcttttcaacagaggagagaaaagatgatggactaaaacctggcggcagcgcaaaagatg

SEQ ID NO: 27573 - DNA, 103 bp, Artificial Sequence
  Synthetic Polynucleotide
taatacgactcactataggggtcagctggagtcatagttagtccatagtcaacagaggagagactatatgctaactatgaacctggcggcagcgcaaaagatg

SEQ ID NO: 27574 - DNA, 103 bp, Artificial Sequence
  Synthetic Polynucleotide
taatacgactcactataggggatttgtcagctggagtcatagttagtccaaacagaggagatggactatgtatgactccaacctggcggcagcgcaaaagatg

SEQ ID NO: 27575 - DNA, 103 bp, Artificial Sequence
  Synthetic Polynucleotide
taatacgactcactatagggtagctgatttgtcagctggagtcatagttaaacagaggagataactaatgctccagctgaacctggcggcagcgcaaaagatg

SEQ ID NO: 27576 - DNA, 103 bp, Artificial Sequence
  Synthetic Polynucleotide
taatacgactcactataggggtctgattgaaataactgttgaaattgtacaacagaggagagtacaaatgcaacagttaaacctggcggcagcgcaaaagatg

SEQ ID NO: 27577 - DNA, 103 bp, Artificial Sequence
  Synthetic Polynucleotide
taatacgactcactatagggaaatgtagctgatttgtcagctggagtcataacagaggagaatgactatggctgacaaaaacctggcggcagcgcaaaagatg

SEQ ID NO: 27578 - DNA, 103 bp, Artificial Sequence
  Synthetic Polynucleotide
taatacgactcactataggggtttcaaatgtagctgatttgtcagctggaaacagaggagatccagcatgcaaatcagcaacctggcggcagcgcaaaagatg

SEQ ID NO: 27579 - DNA, 103 bp, Artificial Sequence
  Synthetic Polynucleotide
taatacgactcactatagggtgactgtttcaaatgtagctgatttgtcagaacagaggagactgacaatgcagctacataacctggcggcagcgcaaaagatg

SEQ ID NO: 27580 - DNA, 103 bp, Artificial Sequence
  Synthetic Polynucleotide
taatacgactcactatagggccatgtgactgtttcaaatgtagctgatttaacagaggagaaaatcaatgacatttgaaaacctggcggcagcgcaaaagatg

SEQ ID NO: 27581 - DNA, 103 bp, Artificial Sequence
  Synthetic Polynucleotide
taatacgactcactatagggttctcccatgtgactgtttcaaatgtagctaacagaggagaagctacatgtgaaacagtaacctggcggcagcgcaaaagatg

SEQ ID NO: 27582 - DNA, 103 bp, Artificial Sequence
  Synthetic Polynucleotide
taatacgactcactatagggttacattctcccatgtgactgtttcaaatgaacagaggagacatttgatgcagtcacataacctggcggcagcgcaaaagatg

SEQ ID NO: 27583 - DNA, 103 bp, Artificial Sequence
  Synthetic Polynucleotide
taatacgactcactataggggaatgttacattctcccatgtgactgtttcaacagaggagagaaacaatgacatgggagaacctggcggcagcgcaaaagatg

SEQ ID NO: 27584 - DNA, 103 bp, Artificial Sequence
  Synthetic Polynucleotide
taatacgactcactatagggttcaagaatgttacattctcccatgtgactaacagaggagaagtcacatgggagaatgtaacctggcggcagcgcaaaagatg

SEQ ID NO: 27585 - DNA, 103 bp, Artificial Sequence
  Synthetic Polynucleotide
taatacgactcactatagggatctcttcaagaatgttacattctcccatgaacagaggagacatgggatgatgtaacataacctggcggcagcgcaaaagatg

SEQ ID NO: 27586 - DNA, 103 bp, Artificial Sequence
  Synthetic Polynucleotide
taatacgactcactataggggaagaatctcttcaagaatgttacattctcaacagaggagagagaatatgacattcttgaacctggcggcagcgcaaaagatg

SEQ ID NO: 27587 - DNA, 103 bp, Artificial Sequence
  Synthetic Polynucleotide
taatacgactcactatagggcaattgtctgattgaaataactgttgaaataacagaggagaatttcaatggttatttcaaacctggcggcagcgcaaaagatg

SEQ ID NO: 27588 - DNA, 103 bp, Artificial Sequence
  Synthetic Polynucleotide
taatacgactcactataggggccctgaagaatctcttcaagaatgttacaaacagaggagatgtaacatgcttgaagagaacctggcggcagcgcaaaagatg

SEQ ID NO: 27589 - DNA, 103 bp, Artificial Sequence
  Synthetic Polynucleotide
taatacgactcactatagggcgtctgccctgaagaatctcttcaagaatgaacagaggagacattctatgagagattctaacctggcggcagcgcaaaagatg

SEQ ID NO: 27590 - DNA, 103 bp, Artificial Sequence
  Synthetic Polynucleotide
taatacgactcactatagggtttctcgtctgccctgaagaatctcttcaaaacagaggagattgaagatgttcttcaggaacctggcggcagcgcaaaagatg

SEQ ID NO: 27591 - DNA, 103 bp, Artificial Sequence
  Synthetic Polynucleotide
taatacgactcactataggggggtatttctcgtctgccctgaagaatctcaacagaggagagagattatgcagggcagaaacctggcggcagcgcaaaagatg

SEQ ID NO: 27592 - DNA, 103 bp, Artificial Sequence
  Synthetic Polynucleotide
taatacgactcactataggggaaatgggtatttctcgtctgccctgaagaaacagaggagatcttcaatgcagacgagaaacctggcggcagcgcaaaagatg

SEQ ID NO: 27593 - DNA, 103 bp, Artificial Sequence
  Synthetic Polynucleotide
taatacgactcactatagggaataagaaatgggtatttctcgtctgccctaacagaggagaagggcaatggagaaatacaacctggcggcagcgcaaaagatg

SEQ ID NO: 27594 - DNA, 103 bp, Artificial Sequence
  Synthetic Polynucleotide
taatacgactcactatagggggatgaataagaaatgggtatttctcgtctaacagaggagaagacgaatgatacccattaacctggcggcagcgcaaaagatg

SEQ ID NO: 27595 - DNA, 103 bp, Artificial Sequence
  Synthetic Polynucleotide
taatacgactcactatagggttactggatgaataagaaatgggtatttctaacagaggagaagaaatatgcatttcttaaacctggcggcagcgcaaaagatg

SEQ ID NO: 27596 - DNA, 103 bp, Artificial Sequence
  Synthetic Polynucleotide
taatacgactcactatagggtggcattactggatgaataagaaatgggtaaacagaggagatacccaatgcttattcataacctggcggcagcgcaaaagatg

SEQ ID NO: 27597 - DNA, 103 bp, Artificial Sequence
  Synthetic Polynucleotide
taatacgactcactatagggttcattggcattactggatgaataagaaataacagaggagaatttctatgtcatccagtaacctggcggcagcgcaaaagatg

SEQ ID NO: 27598 - DNA, 103 bp, Artificial Sequence
  Synthetic Polynucleotide
taatacgactcactatagggtgatacaattgtctgattgaaataactgttaacagaggagaaacagtatgttcaatcagaacctggcggcagcgcaaaagatg

SEQ ID NO: 27599 - DNA, 103 bp, Artificial Sequence
  Synthetic Polynucleotide
taatacgactcactatagggtttccttcattggcattactggatgaataaaacagaggagattattcatgcagtaatgcaacctggcggcagcgcaaaagatg

SEQ ID NO: 27600 - DNA, 103 bp, Artificial Sequence
  Synthetic Polynucleotide
taatacgactcactatagggatgaatttccttcattggcattactggatgaacagaggagacatccaatgatgccaatgaacctggcggcagcgcaaaagatg

SEQ ID NO: 27601 - DNA, 103 bp, Artificial Sequence
  Synthetic Polynucleotide
taatacgactcactataggggattcatgaatttccttcattggcattactaacagaggagaagtaatatgaatgaaggaaacctggcggcagcgcaaaagatg

SEQ ID NO: 27602 - DNA, 103 bp, Artificial Sequence
  Synthetic Polynucleotide
taatacgactcactatagggtaattgattcatgaatttccttcattggcaaacagaggagatgccaaatgaggaaattcaacctggcggcagcgcaaaagatg

SEQ ID NO: 27603 - DNA, 103 bp, Artificial Sequence
  Synthetic Polynucleotide
taatacgactcactatagggccatctaattgattcatgaatttccttcataacagaggagaatgaagatgattcatgaaaacctggcggcagcgcaaaagatg

SEQ ID NO: 27604 - DNA, 103 bp, Artificial Sequence
  Synthetic Polynucleotide
taatacgactcactatagggttagtccatctaattgattcatgaatttccaacagaggagaggaaatatgtgaatcaataacctggcggcagcgcaaaagatg

SEQ ID NO: 27605 - DNA, 103 bp, Artificial Sequence
  Synthetic Polynucleotide
taatacgactcactataggggatctttagtccatctaattgattcatgaaaacagaggagattcatgatgcaattagataacctggcggcagcgcaaaagatg

SEQ ID NO: 27606 - DNA, 103 bp, Artificial Sequence
  Synthetic Polynucleotide
taatacgactcactatagggcctaggatctttagtccatctaattgattcaacagaggagagaatcaatgagatggactaacctggcggcagcgcaaaagatg

SEQ ID NO: 27607 - DNA, 103 bp, Artificial Sequence
  Synthetic Polynucleotide
taatacgactcactataggggtgttcctaggatctttagtccatctaattaacagaggagaaattagatggactaaagaaacctggcggcagcgcaaaagatg

SEQ ID NO: 27608 - DNA, 103 bp, Artificial Sequence
  Synthetic Polynucleotide
taatacgactcactatagggcctgagtgttcctaggatctttagtccatcaacagaggagagatggaatgaagatcctaaacctggcggcagcgcaaaagatg

SEQ ID NO: 27609 - DNA, 103 bp, Artificial Sequence
  Synthetic Polynucleotide
taatacgactcactatagggcattatgatacaattgtctgattgaaataaaacagaggagattatttatgtcagacaataacctggcggcagcgcaaaagatg

SEQ ID NO: 27610 - DNA, 103 bp, Artificial Sequence
  Synthetic Polynucleotide
taatacgactcactataggggtgatcctgagtgttcctaggatctttagtaacagaggagaactaaaatgcctaggaacaacctggcggcagcgcaaaagatg

SEQ ID NO: 27611 - DNA, 103 bp, Artificial Sequence
  Synthetic Polynucleotide
taatacgactcactatagggcgaacgtgatcctgagtgttcctaggatctaacagaggagaagatccatggaacactcaaacctggcggcagcgcaaaagatg

SEQ ID NO: 27612 - DNA, 103 bp, Artificial Sequence
  Synthetic Polynucleotide
taatacgactcactataggggagagcgaacgtgatcctgagtgttcctagaacagaggagactaggaatgctcaggatcaacctggcggcagcgcaaaagatg

SEQ ID NO: 27613 - DNA, 103 bp, Artificial Sequence
  Synthetic Polynucleotide
taatacgactcactataggggcacagagagcgaacgtgatcctgagtgttaacagaggagaaacactatggatcacgttaacctggcggcagcgcaaaagatg

SEQ ID NO: 27614 - DNA, 103 bp, Artificial Sequence
  Synthetic Polynucleotide
taatacgactcactatagggaaaaggcacagagagcgaacgtgatcctgaaacagaggagatcaggaatgcgttcgctcaacctggcggcagcgcaaaagatg

SEQ ID NO: 27615 - DNA, 103 bp, Artificial Sequence
  Synthetic Polynucleotide
taatacgactcactatagggaagctaaaaggcacagagagcgaacgtgataacagaggagaatcacgatggctctctgtaacctggcggcagcgcaaaagatg

SEQ ID NO: 27616 - DNA, 103 bp, Artificial Sequence
  Synthetic Polynucleotide
taatacgactcactataggggtgccaagctaaaaggcacagagagcgaacaacagaggagagttcgcatgctgtgccttaacctggcggcagcgcaaaagatg

SEQ ID NO: 27617 - DNA, 103 bp, Artificial Sequence
  Synthetic Polynucleotide
taatacgactcactatagggccattgtgccaagctaaaaggcacagagagaacagaggagactctctatgccttttagcaacctggcggcagcgcaaaagatg

SEQ ID NO: 27618 - DNA, 103 bp, Artificial Sequence
  Synthetic Polynucleotide
taatacgactcactatagggcttcgccattgtgccaagctaaaaggcacaaacagaggagatgtgccatgtagcttggcaacctggcggcagcgcaaaagatg

SEQ ID NO: 27619 - DNA, 103 bp, Artificial Sequence
  Synthetic Polynucleotide
taatacgactcactatagggttcttcttcgccattgtgccaagctaaaagaacagaggagacttttaatgtggcacaataacctggcggcagcgcaaaagatg

SEQ ID NO: 27620 - DNA, 103 bp, Artificial Sequence
  Synthetic Polynucleotide
taatacgactcactataggggcacccattatgatacaattgtctgattgaaacagaggagatcaatcatgcaattgtataacctggcggcagcgcaaaagatg

SEQ ID NO: 27621 - DNA, 103 bp, Artificial Sequence
  Synthetic Polynucleotide
taatacgactcactatagggttatattcttcttcgccattgtgccaagctaacagaggagaagcttgatgcaatggcgaaacctggcggcagcgcaaaagatg

SEQ ID NO: 27622 - DNA, 103 bp, Artificial Sequence
  Synthetic Polynucleotide
taatacgactcactatagggatttgttatattcttcttcgccattgtgccaacagaggagaggcacaatggcgaagaagaacctggcggcagcgcaaaagatg

SEQ ID NO: 27623 - DNA, 103 bp, Artificial Sequence
  Synthetic Polynucleotide
taatacgactcactatagggtaggaatttgttatattcttcttcgccattaacagaggagaaatggcatggaagaatataacctggcggcagcgcaaaagatg

SEQ ID NO: 27624 - DNA, 103 bp, Artificial Sequence
  Synthetic Polynucleotide
taatacgactcactatagggttagctaggaatttgttatattcttcttcgaacagaggagacgaagaatgatataacaaaacctggcggcagcgcaaaagatg

SEQ ID NO: 27625 - DNA, 103 bp, Artificial Sequence
  Synthetic Polynucleotide
taatacgactcactatagggtgattttagctaggaatttgttatattcttaacagaggagaaagaatatgacaaattccaacctggcggcagcgcaaaagatg

SEQ ID NO: 27626 - DNA, 103 bp, Artificial Sequence
  Synthetic Polynucleotide
taatacgactcactatagggactcctgattttagctaggaatttgttataaacagaggagatataacatgttcctagctaacctggcggcagcgcaaaagatg

SEQ ID NO: 27627 - DNA, 103 bp, Artificial Sequence
  Synthetic Polynucleotide
taatacgactcactatagggggcacactcctgattttagctaggaatttgaacagaggagacaaattatgagctaaaataacctggcggcagcgcaaaagatg

SEQ ID NO: 27628 - DNA, 103 bp, Artificial Sequence
  Synthetic Polynucleotide
taatacgactcactatagggcaattggcacactcctgattttagctaggaaacagaggagatcctagatgaaatcaggaaacctggcggcagcgcaaaagatg

SEQ ID NO: 27629 - DNA, 103 bp, Artificial Sequence
  Synthetic Polynucleotide
taatacgactcactatagggtcttccaattggcacactcctgattttagcaacagaggagagctaaaatgaggagtgtgaacctggcggcagcgcaaaagatg

SEQ ID NO: 27630 - DNA, 103 bp, Artificial Sequence
  Synthetic Polynucleotide
taatacgactcactatagggaaagctcttccaattggcacactcctgattaacagaggagaaatcagatgtgtgccaataacctggcggcagcgcaaaagatg

SEQ ID NO: 27631 - DNA, 103 bp, Artificial Sequence
  Synthetic Polynucleotide
taatacgactcactatagggcctgagcacccattatgatacaattgtctgaacagaggagacagacaatggtatcataaaacctggcggcagcgcaaaagatg

SEQ ID NO: 27632 - DNA, 103 bp, Artificial Sequence
  Synthetic Polynucleotide
taatacgactcactataggggcaataaagctcttccaattggcacactccaacagaggagaggagtgatgcaattggaaaacctggcggcagcgcaaaagatg

SEQ ID NO: 27633 - DNA, 103 bp, Artificial Sequence
  Synthetic Polynucleotide
taatacgactcactatagggtgggagcaataaagctcttccaattggcacaacagaggagagtgccaatgggaagagctaacctggcggcagcgcaaaagatg

SEQ ID NO: 27634 - DNA, 103 bp, Artificial Sequence
  Synthetic Polynucleotide
taatacgactcactatagggtactctgggagcaataaagctcttccaattaacagaggagaaattggatgagctttattaacctggcggcagcgcaaaagatg

SEQ ID NO: 27635 - DNA, 103 bp, Artificial Sequence
  Synthetic Polynucleotide
taatacgactcactatagggttgagtactctgggagcaataaagctcttcaacagaggagagaagagatgtattgctccaacctggcggcagcgcaaaagatg

SEQ ID NO: 27636 - DNA, 103 bp, Artificial Sequence
  Synthetic Polynucleotide
taatacgactcactatagggcaatgttgagtactctgggagcaataaagcaacagaggagagctttaatgctcccagagaacctggcggcagcgcaaaagatg

SEQ ID NO: 27637 - DNA, 103 bp, Artificial Sequence
  Synthetic Polynucleotide
taatacgactcactatagggcggtacaatgttgagtactctgggagcaataacagaggagaattgctatgagagtactcaacctggcggcagcgcaaaagatg

SEQ ID NO: 27638 - DNA, 103 bp, Artificial Sequence
  Synthetic Polynucleotide
taatacgactcactatagggaacggcggtacaatgttgagtactctgggaaacagaggagatcccagatgactcaacataacctggcggcagcgcaaaagatg

SEQ ID NO: 27639 - DNA, 103 bp, Artificial Sequence
  Synthetic Polynucleotide
taatacgactcactatagggaagccaacggcggtacaatgttgagtactcaacagaggagagagtacatgacattgtacaacctggcggcagcgcaaaagatg

SEQ ID NO: 27640 - DNA, 103 bp, Artificial Sequence
  Synthetic Polynucleotide
taatacgactcactataggggagtcaagccaacggcggtacaatgttgagaacagaggagactcaacatggtaccgccgaacctggcggcagcgcaaaagatg

SEQ ID NO: 27641 - DNA, 103 bp, Artificial Sequence
  Synthetic Polynucleotide
taatacgactcactatagggaaaatgagtcaagccaacggcggtacaatgaacagaggagacattgtatggccgttggcaacctggcggcagcgcaaaagatg

SEQ ID NO: 27642 - DNA, 103 bp, Artificial Sequence
  Synthetic Polynucleotide
taatacgactcactatagggtgaaacctgagcacccattatgatacaattaacagaggagaaattgtatgataatgggtaacctggcggcagcgcaaaagatg

SEQ ID NO: 27643 - DNA, 103 bp, Artificial Sequence
  Synthetic Polynucleotide
taatacgactcactatagggttactaaaatgagtcaagccaacggcggtaaacagaggagataccgcatgtggcttgacaacctggcggcagcgcaaaagatg

SEQ ID NO: 27644 - DNA, 103 bp, Artificial Sequence
  Synthetic Polynucleotide
taatacgactcactatagggtagggttactaaaatgagtcaagccaacggaacagaggagaccgttgatgtgactcattaacctggcggcagcgcaaaagatg

SEQ ID NO: 27645 - DNA, 103 bp, Artificial Sequence
  Synthetic Polynucleotide
taatacgactcactatagggtgaggtagggttactaaaatgagtcaagccaacagaggagaggcttgatgcattttagtaacctggcggcagcgcaaaagatg

SEQ ID NO: 27646 - DNA, 103 bp, Artificial Sequence
  Synthetic Polynucleotide
taatacgactcactatagggtcgactgaggtagggttactaaaatgagtcaacagaggagagactcaatgtagtaacccaacctggcggcagcgcaaaagatg

SEQ ID NO: 27647 - DNA, 103 bp, Artificial Sequence
  Synthetic Polynucleotide
taatacgactcactatagggccaattcgactgaggtagggttactaaaataacagaggagaattttaatgaccctacctaacctggcggcagcgcaaaagatg

SEQ ID NO: 27648 - DNA, 103 bp, Artificial Sequence
  Synthetic Polynucleotide
taatacgactcactatagggccaatccaattcgactgaggtagggttactaacagaggagaagtaacatgacctcagtcaacctggcggcagcgcaaaagatg

SEQ ID NO: 27649 - DNA, 103 bp, Artificial Sequence
  Synthetic Polynucleotide
taatacgactcactatagggatgacccaatccaattcgactgaggtagggaacagaggagaccctacatgagtcgaattaacctggcggcagcgcaaaagatg

SEQ ID NO: 27650 - DNA, 103 bp, Artificial Sequence
  Synthetic Polynucleotide
taatacgactcactatagggacagtatgacccaatccaattcgactgaggaacagaggagacctcagatgaattggattaacctggcggcagcgcaaaagatg

SEQ ID NO: 27651 - DNA, 103 bp, Artificial Sequence
  Synthetic Polynucleotide
taatacgactcactatagggctacaacagtatgacccaatccaattcgacaacagaggagagtcgaaatggattgggtcaacctggcggcagcgcaaaagatg

SEQ ID NO: 27652 - DNA, 103 bp, Artificial Sequence
  Synthetic Polynucleotide
taatacgactcactatagggtacccctacaacagtatgacccaatccaataacagaggagaattggaatgggtcatactaacctggcggcagcgcaaaagatg

SEQ ID NO: 27653 - DNA, 103 bp, Artificial Sequence
  Synthetic Polynucleotide
taatacgactcactatagggtgtgatgaaacctgagcacccattatgataaacagaggagatatcatatggggtgctcaaacctggcggcagcgcaaaagatg

SEQ ID NO: 27654 - DNA, 103 bp, Artificial Sequence
  Synthetic Polynucleotide
taatacgactcactatagggaaatttacccctacaacagtatgacccaataacagaggagaattgggatgtactgttgtaacctggcggcagcgcaaaagatg

SEQ ID NO: 27655 - DNA, 103 bp, Artificial Sequence
  Synthetic Polynucleotide
taatacgactcactatagggaagaaaaatttacccctacaacagtatgacaacagaggagagtcataatgttgtaggggaacctggcggcagcgcaaaagatg

SEQ ID NO: 27656 - DNA, 103 bp, Artificial Sequence
  Synthetic Polynucleotide
taatacgactcactatagggaattaaagaaaaatttacccctacaacagtaacagaggagaactgttatgggggtaaataacctggcggcagcgcaaaagatg

SEQ ID NO: 27657 - DNA, 103 bp, Artificial Sequence
  Synthetic Polynucleotide
taatacgactcactatagggctccgaattaaagaaaaatttacccctacaaacagaggagatgtaggatgaaatttttcaacctggcggcagcgcaaaagatg

SEQ ID NO: 27658 - DNA, 103 bp, Artificial Sequence
  Synthetic Polynucleotide
taatacgactcactatagggctttctgtgatgaaacctgagcacccattaaacagaggagataatggatgctcaggtttaacctggcggcagcgcaaaagatg

SEQ ID NO: 27659 - DNA, 103 bp, Artificial Sequence
  Synthetic Polynucleotide
taatacgactcactataggggggaagggagtataaaacaggcgtacaaggaacagaggagaccttgtatgcctgttttaaacctggcggcagcgcaaaagatg

SEQ ID NO: 27660 - DNA, 103 bp, Artificial Sequence
  Synthetic Polynucleotide
taatacgactcactataggggcccactttctgtgatgaaacctgagcaccaacagaggagaggtgctatggtttcatcaaacctggcggcagcgcaaaagatg

SEQ ID NO: 27661 - DNA, 103 bp, Artificial Sequence
  Synthetic Polynucleotide
taatacgactcactatagggtgtgcgcccactttctgtgatgaaacctgaaacagaggagatcaggtatgatcacagaaaacctggcggcagcgcaaaagatg

SEQ ID NO: 27662 - DNA, 103 bp, Artificial Sequence
  Synthetic Polynucleotide
taatacgactcactatagggtttcatgtgcgcccactttctgtgatgaaaaacagaggagatttcatatgagaaagtggaacctggcggcagcgcaaaagatg

SEQ ID NO: 27663 - DNA, 103 bp, Artificial Sequence
  Synthetic Polynucleotide
taatacgactcactatagggtgagttttcatgtgcgcccactttctgtgaaacagaggagatcacagatggtgggcgcaaacctggcggcagcgcaaaagatg

SEQ ID NO: 27664 - DNA, 103 bp, Artificial Sequence
  Synthetic Polynucleotide
taatacgactcactatagggctatttgagttttcatgtgcgcccactttcaacagaggagagaaagtatgcgcacatgaaacctggcggcagcgcaaaagatg

SEQ ID NO: 27665 - DNA, 103 bp, Artificial Sequence
  Synthetic Polynucleotide
taatacgactcactatagggacgctctatttgagttttcatgtgcgcccaaacagaggagatgggcgatgatgaaaactaacctggcggcagcgcaaaagatg

SEQ ID NO: 27666 - DNA, 103 bp, Artificial Sequence
  Synthetic Polynucleotide
taatacgactcactatagggaccatacgctctatttgagttttcatgtgcaacagaggagagcacatatgaactcaaataacctggcggcagcgcaaaagatg

SEQ ID NO: 27667 - DNA, 103 bp, Artificial Sequence
  Synthetic Polynucleotide
taatacgactcactataggggaaccaccatacgctctatttgagttttcaaacagaggagatgaaaaatgaaatagagcaacctggcggcagcgcaaaagatg

SEQ ID NO: 27668 - DNA, 103 bp, Artificial Sequence
  Synthetic Polynucleotide
taatacgactcactatagggtggtagaaccaccatacgctctatttgagtaacagaggagaactcaaatggagcgtatgaacctggcggcagcgcaaaagatg

SEQ ID NO: 27669 - DNA, 103 bp, Artificial Sequence
  Synthetic Polynucleotide
taatacgactcactatagggattaatggtagaaccaccatacgctctattaacagaggagaaatagaatgtatggtggtaacctggcggcagcgcaaaagatg

SEQ ID NO: 27670 - DNA, 103 bp, Artificial Sequence
  Synthetic Polynucleotide
taatacgactcactataggggttacgggaagggagtataaaacaggcgtaaacagaggagatacgccatgtttatactcaacctggcggcagcgcaaaagatg

SEQ ID NO: 27671 - DNA, 103 bp, Artificial Sequence
  Synthetic Polynucleotide
taatacgactcactataggggtgtaattaatggtagaaccaccatacgctaacagaggagaagcgtaatgtggttctacaacctggcggcagcgcaaaagatg

SEQ ID NO: 27672 - DNA, 103 bp, Artificial Sequence
  Synthetic Polynucleotide
taatacgactcactatagggtggtggtgtaattaatggtagaaccaccataacagaggagaatggtgatgctaccattaaacctggcggcagcgcaaaagatg

SEQ ID NO: 27673 - DNA, 103 bp, Artificial Sequence
  Synthetic Polynucleotide
taatacgactcactatagggattaatggtggtgtaattaatggtagaaccaacagaggagaggttctatgattaattacaacctggcggcagcgcaaaagatg

SEQ ID NO: 27674 - DNA, 103 bp, Artificial Sequence
  Synthetic Polynucleotide
taatacgactcactatagggtaataattaatggtggtgtaattaatggtaaacagaggagataccatatgttacaccacaacctggcggcagcgcaaaagatg

SEQ ID NO: 27675 - DNA, 103 bp, Artificial Sequence
  Synthetic Polynucleotide
taatacgactcactatagggctctataataattaatggtggtgtaattaaaacagaggagattaattatgccaccattaaacctggcggcagcgcaaaagatg

SEQ ID NO: 27676 - DNA, 103 bp, Artificial Sequence
  Synthetic Polynucleotide
taatacgactcactatagggtgaatctctataataattaatggtggtgtaaacagaggagatacaccatgattaattataacctggcggcagcgcaaaagatg

SEQ ID NO: 27677 - DNA, 103 bp, Artificial Sequence
  Synthetic Polynucleotide
taatacgactcactatagggctagctgaatctctataataattaatggtgaacagaggagacaccatatgttattatagaacctggcggcagcgcaaaagatg

SEQ ID NO: 27678 - DNA, 103 bp, Artificial Sequence
  Synthetic Polynucleotide
taatacgactcactatagggcgttactagctgaatctctataataattaaaacagaggagattaattatgatagagattaacctggcggcagcgcaaaagatg

SEQ ID NO: 27679 - DNA, 103 bp, Artificial Sequence
  Synthetic Polynucleotide
taatacgactcactatagggagccgcgttactagctgaatctctataataaacagaggagatattatatggattcagctaacctggcggcagcgcaaaagatg

SEQ ID NO: 27680 - DNA, 103 bp, Artificial Sequence
  Synthetic Polynucleotide
taatacgactcactatagggttcgaagccgcgttactagctgaatctctaaacagaggagatagagaatgagctagtaaaacctggcggcagcgcaaaagatg

SEQ ID NO: 27681 - DNA, 103 bp, Artificial Sequence
  Synthetic Polynucleotide
taatacgactcactatagggtctaagttacgggaagggagtataaaacagaacagaggagactgtttatgactcccttcaacctggcggcagcgcaaaagatg

SEQ ID NO: 27682 - DNA, 103 bp, Artificial Sequence
  Synthetic Polynucleotide
taatacgactcactatagggcctgtttcgaagccgcgttactagctgaataacagaggagaattcagatggtaacgcggaacctggcggcagcgcaaaagatg

SEQ ID NO: 27683 - DNA, 103 bp, Artificial Sequence
  Synthetic Polynucleotide
taatacgactcactataggggaagtcctgtttcgaagccgcgttactagcaacagaggagagctagtatggcggcttcgaacctggcggcagcgcaaaagatg

SEQ ID NO: 27684 - DNA, 103 bp, Artificial Sequence
  Synthetic Polynucleotide
taatacgactcactatagggtgagagaagtcctgtttcgaagccgcgttaaacagaggagataacgcatgttcgaaacaaacctggcggcagcgcaaaagatg

SEQ ID NO: 27685 - DNA, 103 bp, Artificial Sequence
  Synthetic Polynucleotide
taatacgactcactatagggggtcttgagagaagtcctgtttcgaagccgaacagaggagacggcttatgaacaggactaacctggcggcagcgcaaaagatg

SEQ ID NO: 27686 - DNA, 103 bp, Artificial Sequence
  Synthetic Polynucleotide
taatacgactcactatagggggaagggtcttgagagaagtcctgtttcgaaacagaggagatcgaaaatggacttctctaacctggcggcagcgcaaaagatg

SEQ ID NO: 27687 - DNA, 103 bp, Artificial Sequence
  Synthetic Polynucleotide
taatacgactcactatagggaacttggaagggtcttgagagaagtcctgtaacagaggagaacaggaatgctctcaagaaacctggcggcagcgcaaaagatg

SEQ ID NO: 27688 - DNA, 103 bp, Artificial Sequence
  Synthetic Polynucleotide
taatacgactcactatagggcggtgaacttggaagggtcttgagagaagtaacagaggagaacttctatgaagacccttaacctggcggcagcgcaaaagatg

SEQ ID NO: 27689 - DNA, 103 bp, Artificial Sequence
  Synthetic Polynucleotide
taatacgactcactataggggggctcggtgaacttggaagggtcttgagaaacagaggagatctcaaatgccttccaagaacctggcggcagcgcaaaagatg

SEQ ID NO: 27690 - DNA, 103 bp, Artificial Sequence
  Synthetic Polynucleotide
taatacgactcactatagggttgatgggctcggtgaacttggaagggtctaacagaggagaagacccatgcaagttcacaacctggcggcagcgcaaaagatg

SEQ ID NO: 27691 - DNA, 103 bp, Artificial Sequence
  Synthetic Polynucleotide
taatacgactcactatagggcatccttgatgggctcggtgaacttggaagaacagaggagacttccaatgtcaccgagcaacctggcggcagcgcaaaagatg

SEQ ID NO: 27692 - DNA, 103 bp, Artificial Sequence
  Synthetic Polynucleotide
taatacgactcactataggggtgcgtctaagttacgggaagggagtataaaacagaggagattatacatgcttcccgtaaacctggcggcagcgcaaaagatg

SEQ ID NO: 27693 - DNA, 103 bp, Artificial Sequence
  Synthetic Polynucleotide
taatacgactcactatagggcaggacatccttgatgggctcggtgaacttaacagaggagaaagttcatggagcccatcaacctggcggcagcgcaaaagatg

SEQ ID NO: 27694 - DNA, 103 bp, Artificial Sequence
  Synthetic Polynucleotide
taatacgactcactatagggtttatcaggacatccttgatgggctcggtgaacagaggagacaccgaatgcatcaaggaaacctggcggcagcgcaaaagatg

SEQ ID NO: 27695 - DNA, 103 bp, Artificial Sequence
  Synthetic Polynucleotide
taatacgactcactatagggctgtttttatcaggacatccttgatgggctaacagaggagaagcccaatgaggatgtccaacctggcggcagcgcaaaagatg

SEQ ID NO: 27696 - DNA, 103 bp, Artificial Sequence
  Synthetic Polynucleotide
taatacgactcactatagggtggggctgtttttatcaggacatccttgataacagaggagaatcaagatggtcctgataaacctggcggcagcgcaaaagatg

SEQ ID NO: 27697 - DNA, 103 bp, Artificial Sequence
  Synthetic Polynucleotide
taatacgactcactatagggagcattggggctgtttttatcaggacatccaacagaggagaggatgtatggataaaaacaacctggcggcagcgcaaaagatg

SEQ ID NO: 27698 - DNA, 103 bp, Artificial Sequence
  Synthetic Polynucleotide
taatacgactcactatagggagtttagcattggggctgtttttatcaggaaacagaggagatcctgaatgaaacagcccaacctggcggcagcgcaaaagatg

SEQ ID NO: 27699 - DNA, 103 bp, Artificial Sequence
  Synthetic Polynucleotide
taatacgactcactatagggtggcgagtttagcattggggctgtttttataacagaggagaataaaaatggccccaatgaacctggcggcagcgcaaaagatg

SEQ ID NO: 27700 - DNA, 103 bp, Artificial Sequence
  Synthetic Polynucleotide
taatacgactcactatagggatgtttggcgagtttagcattggggctgttaacagaggagaaacagcatgaatgctaaaaacctggcggcagcgcaaaagatg

SEQ ID NO: 27701 - DNA, 103 bp, Artificial Sequence
  Synthetic Polynucleotide
taatacgactcactatagggcctctatgtttggcgagtttagcattggggaacagaggagaccccaaatgtaaactcgcaacctggcggcagcgcaaaagatg

SEQ ID NO: 27702 - DNA, 103 bp, Artificial Sequence
  Synthetic Polynucleotide
taatacgactcactataggggcaagcctctatgtttggcgagtttagcataacagaggagaatgctaatgtcgccaaacaacctggcggcagcgcaaaagatg

SEQ ID NO: 27703 - DNA, 103 bp, Artificial Sequence
  Synthetic Polynucleotide
taatacgactcactataggggttttgtgcgtctaagttacgggaagggagaacagaggagactccctatgcgtaacttaaacctggcggcagcgcaaaagatg

SEQ ID NO: 27704 - DNA, 103 bp, Artificial Sequence
  Synthetic Polynucleotide
taatacgactcactatagggtacccgcaagcctctatgtttggcgagtttaacagaggagaaaactcatgaaacatagaaacctggcggcagcgcaaaagatg

SEQ ID NO: 27705 - DNA, 103 bp, Artificial Sequence
  Synthetic Polynucleotide
taatacgactcactatagggcgctatacccgcaagcctctatgtttggcgaacagaggagacgccaaatgtagaggcttaacctggcggcagcgcaaaagatg

SEQ ID NO: 27706 - DNA, 103 bp, Artificial Sequence
  Synthetic Polynucleotide
taatacgactcactatagggtctatcgctatacccgcaagcctctatgttaacagaggagaaacataatggcttgcgggaacctggcggcagcgcaaaagatg

SEQ ID NO: 27707 - DNA, 103 bp, Artificial Sequence
  Synthetic Polynucleotide
taatacgactcactatagggagtactctatcgctatacccgcaagcctctaacagaggagaagaggcatgcgggtatagaacctggcggcagcgcaaaagatg

SEQ ID NO: 27708 - DNA, 103 bp, Artificial Sequence
  Synthetic Polynucleotide
taatacgactcactatagggattgcagtactctatcgctatacccgcaagaacagaggagacttgcgatgatagcgataaacctggcggcagcgcaaaagatg

SEQ ID NO: 27709 - DNA, 103 bp, Artificial Sequence
  Synthetic Polynucleotide
taatacgactcactatagggtgttaattgcagtactctatcgctatacccaacagaggagagggtatatggatagagtaaacctggcggcagcgcaaaagatg

SEQ ID NO: 27710 - DNA, 103 bp, Artificial Sequence
  Synthetic Polynucleotide
taatacgactcactatagggcccagtgttaattgcagtactctatcgctaaacagaggagatagcgaatgagtactgcaaacctggcggcagcgcaaaagatg

SEQ ID NO: 27711 - DNA, 103 bp, Artificial Sequence
  Synthetic Polynucleotide
taatacgactcactatagggagtttcccagtgttaattgcagtactctataacagaggagaatagagatgtgcaattaaaacctggcggcagcgcaaaagatg

SEQ ID NO: 27712 - DNA, 103 bp, Artificial Sequence
  Synthetic Polynucleotide
taatacgactcactatagggagtggagtttcccagtgttaattgcagtacaacagaggagagtactgatgttaacactgaacctggcggcagcgcaaaagatg

SEQ ID NO: 27713 - DNA, 103 bp, Artificial Sequence
  Synthetic Polynucleotide
taatacgactcactataggggttatagtggagtttcccagtgttaattgcaacagaggagagcaattatgactgggaaaaacctggcggcagcgcaaaagatg

SEQ ID NO: 27714 - DNA, 103 bp, Artificial Sequence
  Synthetic Polynucleotide
taatacgactcactatagggcctctggggtgggtacaaccccagagctgtaacagaggagaacagctatggggttgtacaacctggcggcagcgcaaaagatg

SEQ ID NO: 27715 - DNA, 103 bp, Artificial Sequence
  Synthetic Polynucleotide
taatacgactcactatagggacttggttttgtgcgtctaagttacgggaaaacagaggagattcccgatgcttagacgcaacctggcggcagcgcaaaagatg

SEQ ID NO: 27716 - DNA, 103 bp, Artificial Sequence
  Synthetic Polynucleotide
taatacgactcactataggggtgtggttatagtggagtttcccagtgttaaacagaggagataacacatggaaactccaaacctggcggcagcgcaaaagatg

SEQ ID NO: 27717 - DNA, 103 bp, Artificial Sequence
  Synthetic Polynucleotide
taatacgactcactatagggctcctgtgtggttatagtggagtttcccagaacagaggagactgggaatgtccactataaacctggcggcagcgcaaaagatg

SEQ ID NO: 27718 - DNA, 103 bp, Artificial Sequence
  Synthetic Polynucleotide
taatacgactcactataggggccgcctcctgtgtggttatagtggagtttaacagaggagaaaactcatgtataaccacaacctggcggcagcgcaaaagatg

SEQ ID NO: 27719 - DNA, 103 bp, Artificial Sequence
  Synthetic Polynucleotide
taatacgactcactatagggaattagccgcctcctgtgtggttatagtggaacagaggagaccactaatgccacacaggaacctggcggcagcgcaaaagatg

SEQ ID NO: 27720 - DNA, 103 bp, Artificial Sequence
  Synthetic Polynucleotide
taatacgactcactatagggtactgaattagccgcctcctgtgtggttataacagaggagaataaccatgcaggaggcgaacctggcggcagcgcaaaagatg

SEQ ID NO: 27721 - DNA, 103 bp, Artificial Sequence
  Synthetic Polynucleotide
taatacgactcactataggggcgactactgaattagccgcctcctgtgtgaacagaggagacacacaatgggcggctaaaacctggcggcagcgcaaaagatg

SEQ ID NO: 27722 - DNA, 103 bp, Artificial Sequence
  Synthetic Polynucleotide
taatacgactcactatagggcataagcgactactgaattagccgcctcctaacagaggagaaggaggatgctaattcagaacctggcggcagcgcaaaagatg

SEQ ID NO: 27723 - DNA, 103 bp, Artificial Sequence
  Synthetic Polynucleotide
taatacgactcactatagggacgcccataagcgactactgaattagccgcaacagaggagagcggctatgtcagtagtcaacctggcggcagcgcaaaagatg

SEQ ID NO: 27724 - DNA, 103 bp, Artificial Sequence
  Synthetic Polynucleotide
taatacgactcactatagggggccaacgcccataagcgactactgaattaaacagaggagataattcatgagtcgcttaaacctggcggcagcgcaaaagatg

SEQ ID NO: 27725 - DNA, 103 bp, Artificial Sequence
  Synthetic Polynucleotide
taatacgactcactatagggattcaggccaacgcccataagcgactactgaacagaggagacagtagatgcttatgggcaacctggcggcagcgcaaaagatg

SEQ ID NO: 27726 - DNA, 103 bp, Artificial Sequence
  Synthetic Polynucleotide
taatacgactcactatagggattgaacttggttttgtgcgtctaagttacaacagaggagagtaactatgacgcacaaaaacctggcggcagcgcaaaagatg

SEQ ID NO: 27727 - DNA, 103 bp, Artificial Sequence
  Synthetic Polynucleotide
taatacgactcactatagggcagatattcaggccaacgcccataagcgacaacagaggagagtcgctatggggcgttggaacctggcggcagcgcaaaagatg

SEQ ID NO: 27728 - DNA, 103 bp, Artificial Sequence
  Synthetic Polynucleotide
taatacgactcactatagggtccctcagatattcaggccaacgcccataaaacagaggagattatggatgttggcctgaaacctggcggcagcgcaaaagatg

SEQ ID NO: 27729 - DNA, 103 bp, Artificial Sequence
  Synthetic Polynucleotide
taatacgactcactatagggcgctgtccctcagatattcaggccaacgccaacagaggagaggcgttatgctgaatatcaacctggcggcagcgcaaaagatg

SEQ ID NO: 27730 - DNA, 103 bp, Artificial Sequence
  Synthetic Polynucleotide
taatacgactcactatagggggcttcgctgtccctcagatattcaggccaaacagaggagatggcctatgtatctgaggaacctggcggcagcgcaaaagatg

SEQ ID NO: 27731 - DNA, 103 bp, Artificial Sequence
  Synthetic Polynucleotide
taatacgactcactatagggggattggcttcgctgtccctcagatattcaaacagaggagatgaataatggagggacagaacctggcggcagcgcaaaagatg

SEQ ID NO: 27732 - DNA, 103 bp, Artificial Sequence
  Synthetic Polynucleotide
taatacgactcactatagggccactggattggcttcgctgtccctcagataacagaggagaatctgaatgacagcgaagaacctggcggcagcgcaaaagatg

SEQ ID NO: 27733 - DNA, 103 bp, Artificial Sequence
  Synthetic Polynucleotide
taatacgactcactatagggctggtccactggattggcttcgctgtccctaacagaggagaagggacatggaagccaataacctggcggcagcgcaaaagatg

SEQ ID NO: 27734 - DNA, 103 bp, Artificial Sequence
  Synthetic Polynucleotide
taatacgactcactataggggtcggctggtccactggattggcttcgctgaacagaggagacagcgaatgcaatccagtaacctggcggcagcgcaaaagatg

SEQ ID NO: 27735 - DNA, 103 bp, Artificial Sequence
  Synthetic Polynucleotide
taatacgactcactataggggttctgtcggctggtccactggattggcttaacagaggagaaagccaatgcagtggaccaacctggcggcagcgcaaaagatg

SEQ ID NO: 27736 - DNA, 103 bp, Artificial Sequence
  Synthetic Polynucleotide
taatacgactcactataggggtctggttctgtcggctggtccactggattaacagaggagaaatccaatggaccagccgaacctggcggcagcgcaaaagatg

SEQ ID NO: 27737 - DNA, 103 bp, Artificial Sequence
  Synthetic Polynucleotide
taatacgactcactatagggcttctattgaacttggttttgtgcgtctaaaacagaggagattagacatgcaaaaccaaaacctggcggcagcgcaaaagatg

SEQ ID NO: 27738 - DNA, 103 bp, Artificial Sequence
  Synthetic Polynucleotide
taatacgactcactataggggcgacgtctggttctgtcggctggtccactaacagaggagaagtggaatggccgacagaaacctggcggcagcgcaaaagatg

SEQ ID NO: 27739 - DNA, 103 bp, Artificial Sequence
  Synthetic Polynucleotide
taatacgactcactatagggatgcagcgacgtctggttctgtcggctggtaacagaggagaaccagcatgcagaaccagaacctggcggcagcgcaaaagatg

SEQ ID NO: 27740 - DNA, 103 bp, Artificial Sequence
  Synthetic Polynucleotide
taatacgactcactatagggcctgcatgcagcgacgtctggttctgtcggaacagaggagaccgacaatgccagacgtcaacctggcggcagcgcaaaagatg

SEQ ID NO: 27741 - DNA, 103 bp, Artificial Sequence
  Synthetic Polynucleotide
taatacgactcactatagggtaaaacctgcatgcagcgacgtctggttctaacagaggagaagaaccatgcgtcgctgcaacctggcggcagcgcaaaagatg

SEQ ID NO: 27742 - DNA, 103 bp, Artificial Sequence
  Synthetic Polynucleotide
taatacgactcactataggggcgtataaaacctgcatgcagcgacgtctgaacagaggagacagacgatgctgcatgcaaacctggcggcagcgcaaaagatg

SEQ ID NO: 27743 - DNA, 103 bp, Artificial Sequence
  Synthetic Polynucleotide
taatacgactcactataggggtctagcgtataaaacctgcatgcagcgacaacagaggagagtcgctatgtgcaggtttaacctggcggcagcgcaaaagatg

SEQ ID NO: 27744 - DNA, 103 bp, Artificial Sequence
  Synthetic Polynucleotide
taatacgactcactatagggacggtgtctagcgtataaaacctgcatgcaaacagaggagatgcatgatggttttatacaacctggcggcagcgcaaaagatg

SEQ ID NO: 27745 - DNA, 103 bp, Artificial Sequence
  Synthetic Polynucleotide
taatacgactcactatagggaagacacggtgtctagcgtataaaacctgcaacagaggagagcaggtatgatacgctagaacctggcggcagcgcaaaagatg

SEQ ID NO: 27746 - DNA, 103 bp, Artificial Sequence
  Synthetic Polynucleotide
taatacgactcactatagggcgtccaagacacggtgtctagcgtataaaaaacagaggagattttatatgctagacaccaacctggcggcagcgcaaaagatg

SEQ ID NO: 27747 - DNA, 103 bp, Artificial Sequence
  Synthetic Polynucleotide
taatacgactcactatagggtctttcgtccaagacacggtgtctagcgtaaacagaggagatacgctatgcaccgtgtcaacctggcggcagcgcaaaagatg

SEQ ID NO: 27748 - DNA, 103 bp, Artificial Sequence
  Synthetic Polynucleotide
taatacgactcactatagggacccccttctattgaacttggttttgtgcgaacagaggagacgcacaatgccaagttcaaacctggcggcagcgcaaaagatg

SEQ ID NO: 27749 - DNA, 103 bp, Artificial Sequence
  Synthetic Polynucleotide
taatacgactcactataggggcgactctttcgtccaagacacggtgtctaaacagaggagatagacaatgtgtcttggaaacctggcggcagcgcaaaagatg

SEQ ID NO: 27750 - DNA, 103 bp, Artificial Sequence
  Synthetic Polynucleotide
taatacgactcactatagggccctcgcgactctttcgtccaagacacggtaacagaggagaaccgtgatgtggacgaaaaacctggcggcagcgcaaaagatg

SEQ ID NO: 27751 - DNA, 103 bp, Artificial Sequence
  Synthetic Polynucleotide
taatacgactcactatagggcaccaccctcgcgactctttcgtccaagacaacagaggagagtcttgatggaaagagtcaacctggcggcagcgcaaaagatg

SEQ ID NO: 27752 - DNA, 103 bp, Artificial Sequence
  Synthetic Polynucleotide
taatacgactcactatagggtccaccaccaccctcgcgactctttcgtccaacagaggagaggacgaatgagtcgcgagaacctggcggcagcgcaaaagatg

SEQ ID NO: 27753 - DNA, 103 bp, Artificial Sequence
  Synthetic Polynucleotide
taatacgactcactatagggcaacttccaccaccaccctcgcgactctttaacagaggagaaaagagatgcgagggtggaacctggcggcagcgcaaaagatg

SEQ ID NO: 27754 - DNA, 103 bp, Artificial Sequence
  Synthetic Polynucleotide
taatacgactcactatagggtcaggcaacttccaccaccaccctcgcgacaacagaggagagtcgcgatggtggtggtgaacctggcggcagcgcaaaagatg

SEQ ID NO: 27755 - DNA, 103 bp, Artificial Sequence
  Synthetic Polynucleotide
taatacgactcactataggggtgcatcaggcaacttccaccaccaccctcaacagaggagagagggtatgggtggaagtaacctggcggcagcgcaaaagatg

SEQ ID NO: 27756 - DNA, 103 bp, Artificial Sequence
  Synthetic Polynucleotide
taatacgactcactatagggcctcagtgcatcaggcaacttccaccaccaaacagaggagatggtggatgaagttgcctaacctggcggcagcgcaaaagatg

SEQ ID NO: 27757 - DNA, 103 bp, Artificial Sequence
  Synthetic Polynucleotide
taatacgactcactatagggatgtccctcagtgcatcaggcaacttccacaacagaggagagtggaaatggcctgatgcaacctggcggcagcgcaaaagatg

SEQ ID NO: 27758 - DNA, 103 bp, Artificial Sequence
  Synthetic Polynucleotide
taatacgactcactataggggtcccatgtccctcagtgcatcaggcaactaacagaggagaagttgcatgatgcactgaaacctggcggcagcgcaaaagatg

SEQ ID NO: 27759 - DNA, 103 bp, Artificial Sequence
  Synthetic Polynucleotide
taatacgactcactatagggtttgtacccccttctattgaacttggttttaacagaggagaaaaaccatgttcaatagaaacctggcggcagcgcaaaagatg

SEQ ID NO: 27760 - DNA, 103 bp, Artificial Sequence
  Synthetic Polynucleotide
taatacgactcactatagggaaagagtcccatgtccctcagtgcatcaggaacagaggagacctgatatgctgagggacaacctggcggcagcgcaaaagatg

SEQ ID NO: 27761 - DNA, 103 bp, Artificial Sequence
  Synthetic Polynucleotide
taatacgactcactatagggtgcccaaagagtcccatgtccctcagtgcaaacagaggagatgcactatgggacatgggaacctggcggcagcgcaaaagatg

SEQ ID NO: 27762 - DNA, 103 bp, Artificial Sequence
  Synthetic Polynucleotide
taatacgactcactatagggtattttgcccaaagagtcccatgtccctcaaacagaggagatgagggatgtgggactctaacctggcggcagcgcaaaagatg

SEQ ID NO: 27763 - DNA, 103 bp, Artificial Sequence
  Synthetic Polynucleotide
taatacgactcactataggggtacatattttgcccaaagagtcccatgtcaacagaggagagacatgatgctctttgggaacctggcggcagcgcaaaagatg

SEQ ID NO: 27764 - DNA, 103 bp, Artificial Sequence
  Synthetic Polynucleotide
taatacgactcactatagggtggtagtacatattttgcccaaagagtcccaacagaggagagggactatgtgggcaaaaaacctggcggcagcgcaaaagatg

SEQ ID NO: 27765 - DNA, 103 bp, Artificial Sequence
  Synthetic Polynucleotide
taatacgactcactatagggggtagtggtagtacatattttgcccaaagaaacagaggagatctttgatgaaaatatgtaacctggcggcagcgcaaaagatg

SEQ ID NO: 27766 - DNA, 103 bp, Artificial Sequence
  Synthetic Polynucleotide
taatacgactcactatagggacctaggtagtggtagtacatattttgcccaacagaggagagggcaaatgatgtactacaacctggcggcagcgcaaaagatg

SEQ ID NO: 27767 - DNA, 103 bp, Artificial Sequence
  Synthetic Polynucleotide
taatacgactcactataggggacctacctaggtagtggtagtacatatttaacagaggagaaaatatatgctaccactaaacctggcggcagcgcaaaagatg

SEQ ID NO: 27768 - DNA, 103 bp, Artificial Sequence
  Synthetic Polynucleotide
taatacgactcactatagggacccggacctacctaggtagtggtagtacaaacagaggagatgtactatgactacctagaacctggcggcagcgcaaaagatg

SEQ ID NO: 27769 - DNA, 103 bp, Artificial Sequence
  Synthetic Polynucleotide
taatacgactcactatagggggtgtacccggacctacctaggtagtggtaaacagaggagataccacatgctaggtaggaacctggcggcagcgcaaaagatg

SEQ ID NO: 27770 - DNA, 103 bp, Artificial Sequence
  Synthetic Polynucleotide
taatacgactcactatagggactggtttgtacccccttctattgaacttgaacagaggagacaagttatgtagaaggggaacctggcggcagcgcaaaagatg

SEQ ID NO: 27771 - DNA, 103 bp, Artificial Sequence
  Synthetic Polynucleotide
taatacgactcactatagggtgcacggtgtacccggacctacctaggtagaacagaggagactacctatgtaggtccggaacctggcggcagcgcaaaagatg

SEQ ID NO: 27772 - DNA, 103 bp, Artificial Sequence
  Synthetic Polynucleotide
taatacgactcactataggggtacatgcacggtgtacccggacctacctaaacagaggagataggtaatgccgggtacaaacctggcggcagcgcaaaagatg

SEQ ID NO: 27773 - DNA, 103 bp, Artificial Sequence
  Synthetic Polynucleotide
taatacgactcactatagggacactgtacatgcacggtgtacccggacctaacagaggagaaggtccatgtacaccgtgaacctggcggcagcgcaaaagatg

SEQ ID NO: 27774 - DNA, 103 bp, Artificial Sequence
  Synthetic Polynucleotide
taatacgactcactataggggcgttacactgtacatgcacggtgtacccgaacagaggagacgggtaatgcgtgcatgtaacctggcggcagcgcaaaagatg

SEQ ID NO: 27775 - DNA, 103 bp, Artificial Sequence
  Synthetic Polynucleotide
taatacgactcactatagggtggaggcgttacactgtacatgcacggtgtaacagaggagaacaccgatgatgtacagtaacctggcggcagcgcaaaagatg

SEQ ID NO: 27776 - DNA, 103 bp, Artificial Sequence
  Synthetic Polynucleotide
taatacgactcactataggggaatttggaggcgttacactgtacatgcacaacagaggagagtgcatatgcagtgtaacaacctggcggcagcgcaaaagatg

SEQ ID NO: 27777 - DNA, 103 bp, Artificial Sequence
  Synthetic Polynucleotide
taatacgactcactatagggtggtggaatttggaggcgttacactgtacaaacagaggagatgtacaatgtaacgcctcaacctggcggcagcgcaaaagatg

SEQ ID NO: 27778 - DNA, 103 bp, Artificial Sequence
  Synthetic Polynucleotide
taatacgactcactatagggccccctggtggaatttggaggcgttacactaacagaggagaagtgtaatgcctccaaataacctggcggcagcgcaaaagatg

SEQ ID NO: 27779 - DNA, 103 bp, Artificial Sequence
  Synthetic Polynucleotide
taatacgactcactatagggtagtgccccctggtggaatttggaggcgttaacagaggagaaacgccatgaaattccacaacctggcggcagcgcaaaagatg

SEQ ID NO: 27780 - DNA, 103 bp, Artificial Sequence
  Synthetic Polynucleotide
taatacgactcactatagggacccctagtgccccctggtggaatttggagaacagaggagactccaaatgccaccagggaacctggcggcagcgcaaaagatg

SEQ ID NO: 27781 - DNA, 103 bp, Artificial Sequence
  Synthetic Polynucleotide
taatacgactcactataggggtggtactggtttgtacccccttctattgaaacagaggagatcaataatggggggtacaaacctggcggcagcgcaaaagatg

SEQ ID NO: 27782 - DNA, 103 bp, Artificial Sequence
  Synthetic Polynucleotide
taatacgactcactatagggcgaatacccctagtgccccctggtggaattaacagaggagaaattccatgagggggcacaacctggcggcagcgcaaaagatg

SEQ ID NO: 27783 - DNA, 103 bp, Artificial Sequence
  Synthetic Polynucleotide
taatacgactcactatagggtacggcgaatacccctagtgccccctggtgaacagaggagacaccagatggcactagggaacctggcggcagcgcaaaagatg

SEQ ID NO: 27784 - DNA, 103 bp, Artificial Sequence
  Synthetic Polynucleotide
taatacgactcactatagggtctggtacggcgaatacccctagtgcccccaacagaggagagggggcatgaggggtattaacctggcggcagcgcaaaagatg

SEQ ID NO: 27785 - DNA, 103 bp, Artificial Sequence
  Synthetic Polynucleotide
taatacgactcactatagggacatctctggtacggcgaatacccctagtgaacagaggagacactagatgtattcgccgaacctggcggcagcgcaaaagatg

SEQ ID NO: 27786 - DNA, 103 bp, Artificial Sequence
  Synthetic Polynucleotide
taatacgactcactatagggcagacacatctctggtacggcgaataccccaacagaggagaggggtaatggccgtaccaaacctggcggcagcgcaaaagatg

SEQ ID NO: 27787 - DNA, 103 bp, Artificial Sequence
  Synthetic Polynucleotide
taatacgactcactatagggccggccagacacatctctggtacggcgaataacagaggagaattcgcatgaccagagataacctggcggcagcgcaaaagatg

SEQ ID NO: 27788 - DNA, 103 bp, Artificial Sequence
  Synthetic Polynucleotide
taatacgactcactatagggtatccccggccagacacatctctggtacggaacagaggagaccgtacatgagatgtgtcaacctggcggcagcgcaaaagatg

SEQ ID NO: 27789 - DNA, 103 bp, Artificial Sequence
  Synthetic Polynucleotide
taatacgactcactataggggttgctatccccggccagacacatctctggaacagaggagaccagagatgtgtctggccaacctggcggcagcgcaaaagatg

SEQ ID NO: 27790 - DNA, 103 bp, Artificial Sequence
  Synthetic Polynucleotide
taatacgactcactataggggtggtgttgctatccccggccagacacatcaacagaggagagatgtgatgggccggggaaacctggcggcagcgcaaaagatg

SEQ ID NO: 27791 - DNA, 103 bp, Artificial Sequence
  Synthetic Polynucleotide
taatacgactcactatagggtggtagtggtgttgctatccccggccagacaacagaggagagtctggatggggatagcaaacctggcggcagcgcaaaagatg

SEQ ID NO: 27792 - DNA, 103 bp, Artificial Sequence
  Synthetic Polynucleotide
taatacgactcactatagggtcgtggtggtactggtttgtacccccttctaacagaggagaagaaggatgtacaaaccaaacctggcggcagcgcaaaagatg

SEQ ID NO: 27793 - DNA, 103 bp, Artificial Sequence
  Synthetic Polynucleotide
taatacgactcactataggggtgcatggtagtggtgttgctatccccggcaacagaggagagccgggatgagcaacaccaacctggcggcagcgcaaaagatg

SEQ ID NO: 27794 - DNA, 103 bp, Artificial Sequence
  Synthetic Polynucleotide
taatacgactcactatagggctggtgtgcatggtagtggtgttgctatccaacagaggagaggatagatgcaccactacaacctggcggcagcgcaaaagatg

SEQ ID NO: 27795 - DNA, 103 bp, Artificial Sequence
  Synthetic Polynucleotide
taatacgactcactataggggatagctggtgtgcatggtagtggtgttgcaacagaggagagcaacaatgctaccatgcaacctggcggcagcgcaaaagatg

SEQ ID NO: 27796 - DNA, 103 bp, Artificial Sequence
  Synthetic Polynucleotide
taatacgactcactatagggattttgatagctggtgtgcatggtagtggtaacagaggagaaccactatgatgcacaccaacctggcggcagcgcaaaagatg

SEQ ID NO: 27797 - DNA, 103 bp, Artificial Sequence
  Synthetic Polynucleotide
taatacgactcactatagggttggcattttgatagctggtgtgcatggtaaacagaggagataccatatgcaccagctaaacctggcggcagcgcaaaagatg

SEQ ID NO: 27798 - DNA, 103 bp, Artificial Sequence
  Synthetic Polynucleotide
taatacgactcactatagggcaggattggcattttgatagctggtgtgcaaacagaggagatgcacaatggctatcaaaaacctggcggcagcgcaaaagatg

SEQ ID NO: 27799 - DNA, 103 bp, Artificial Sequence
  Synthetic Polynucleotide
taatacgactcactatagggctcgccaggattggcattttgatagctggtaacagaggagaaccagcatgcaaaatgccaacctggcggcagcgcaaaagatg

SEQ ID NO: 27800 - DNA, 103 bp, Artificial Sequence
  Synthetic Polynucleotide
taatacgactcactatagggcctttctcgccaggattggcattttgatagaacagaggagactatcaatgtgccaatccaacctggcggcagcgcaaaagatg

SEQ ID NO: 27801 - DNA, 103 bp, Artificial Sequence
  Synthetic Polynucleotide
taatacgactcactatagggtgcctcctttctcgccaggattggcattttaacagaggagaaaaatgatgatcctggcgaacctggcggcagcgcaaaagatg

SEQ ID NO: 27802 - DNA, 103 bp, Artificial Sequence
  Synthetic Polynucleotide
taatacgactcactataggggaaagtgcctcctttctcgccaggattggcaacagaggagagccaatatgggcgagaaaaacctggcggcagcgcaaaagatg

SEQ ID NO: 27803 - DNA, 103 bp, Artificial Sequence
  Synthetic Polynucleotide
taatacgactcactatagggcttgttcgtggtggtactggtttgtaccccaacagaggagaggggtaatgaccagtaccaacctggcggcagcgcaaaagatg

SEQ ID NO: 27804 - DNA, 103 bp, Artificial Sequence
  Synthetic Polynucleotide
taatacgactcactatagggcccgtgaaagtgcctcctttctcgccaggaaacagaggagatcctggatggaaaggaggaacctggcggcagcgcaaaagatg

SEQ ID NO: 27805 - DNA, 103 bp, Artificial Sequence
  Synthetic Polynucleotide
taatacgactcactatagggacgtacccgtgaaagtgcctcctttctcgcaacagaggagagcgagaatggaggcacttaacctggcggcagcgcaaaagatg

SEQ ID NO: 27806 - DNA, 103 bp, Artificial Sequence
  Synthetic Polynucleotide
taatacgactcactatagggagtgaacgtacccgtgaaagtgcctcctttaacagaggagaaaaggaatgactttcacgaacctggcggcagcgcaaaagatg

SEQ ID NO: 27807 - DNA, 103 bp, Artificial Sequence
  Synthetic Polynucleotide
taatacgactcactatagggtcaggagtgaacgtacccgtgaaagtgcctaacagaggagaaggcacatgcacgggtacaacctggcggcagcgcaaaagatg

SEQ ID NO: 27808 - DNA, 103 bp, Artificial Sequence
  Synthetic Polynucleotide
taatacgactcactatagggtgttgtcaggagtgaacgtacccgtgaaagaacagaggagactttcaatggtacgttcaaacctggcggcagcgcaaaagatg

SEQ ID NO: 27809 - DNA, 103 bp, Artificial Sequence
  Synthetic Polynucleotide
taatacgactcactatagggctggttgttgtcaggagtgaacgtacccgtaacagaggagaacgggtatgttcactcctaacctggcggcagcgcaaaagatg

SEQ ID NO: 27810 - DNA, 103 bp, Artificial Sequence
  Synthetic Polynucleotide
taatacgactcactataggggatgtctggttgttgtcaggagtgaacgtaaacagaggagatacgttatgtcctgacaaaacctggcggcagcgcaaaagatg

SEQ ID NO: 27811 - DNA, 103 bp, Artificial Sequence
  Synthetic Polynucleotide
taatacgactcactatagggcaggtgatgtctggttgttgtcaggagtgaaacagaggagatcactcatgacaacaaccaacctggcggcagcgcaaaagatg

SEQ ID NO: 27812 - DNA, 103 bp, Artificial Sequence
  Synthetic Polynucleotide
taatacgactcactataggggcgggcaggtgatgtctggttgttgtcaggaacagaggagacctgacatgaaccagacaaacctggcggcagcgcaaaagatg

SEQ ID NO: 27813 - DNA, 103 bp, Artificial Sequence
  Synthetic Polynucleotide
taatacgactcactatagggaacctgcgggcaggtgatgtctggttgttgaacagaggagacaacaaatggacatcaccaacctggcggcagcgcaaaagatg

SEQ ID NO: 27814 - DNA, 103 bp, Artificial Sequence
  Synthetic Polynucleotide
taatacgactcactatagggaagtgcttgttcgtggtggtactggtttgtaacagaggagaacaaacatgtaccaccacaacctggcggcagcgcaaaagatg

SEQ ID NO: 27815 - DNA, 103 bp, Artificial Sequence
  Synthetic Polynucleotide
taatacgactcactatagggggcagaacctgcgggcaggtgatgtctggtaacagaggagaaccagaatgcacctgcccaacctggcggcagcgcaaaagatg

SEQ ID NO: 27816 - DNA, 103 bp, Artificial Sequence
  Synthetic Polynucleotide
taatacgactcactatagggcaccgggcagaacctgcgggcaggtgatgtaacagaggagaacatcaatggcccgcaggaacctggcggcagcgcaaaagatg

SEQ ID NO: 27817 - DNA, 103 bp, Artificial Sequence
  Synthetic Polynucleotide
taatacgactcactatagggtaatccaccgggcagaacctgcgggcaggtaacagaggagaacctgcatgcaggttctgaacctggcggcagcgcaaaagatg

SEQ ID NO: 27818 - DNA, 103 bp, Artificial Sequence
  Synthetic Polynucleotide
taatacgactcactatagggggaggtaatccaccgggcagaacctgcgggaacagaggagacccgcaatgtctgcccggaacctggcggcagcgcaaaagatg

SEQ ID NO: 27819 - DNA, 103 bp, Artificial Sequence
  Synthetic Polynucleotide
taatacgactcactatagggtccaaggaggtaatccaccgggcagaacctaacagaggagaaggttcatgccggtggataacctggcggcagcgcaaaagatg

SEQ ID NO: 27820 - DNA, 103 bp, Artificial Sequence
  Synthetic Polynucleotide
taatacgactcactatagggccatttccaaggaggtaatccaccgggcagaacagaggagactgcccatgggattacctaacctggcggcagcgcaaaagatg

SEQ ID NO: 27821 - DNA, 103 bp, Artificial Sequence
  Synthetic Polynucleotide
taatacgactcactatagggacgtgccatttccaaggaggtaatccaccgaacagaggagacggtggatgacctccttgaacctggcggcagcgcaaaagatg

SEQ ID NO: 27822 - DNA, 103 bp, Artificial Sequence
  Synthetic Polynucleotide
taatacgactcactatagggcaacaacgtgccatttccaaggaggtaatcaacagaggagagattacatgcttggaaataacctggcggcagcgcaaaagatg

SEQ ID NO: 27823 - DNA, 103 bp, Artificial Sequence
  Synthetic Polynucleotide
taatacgactcactatagggttccccaacaacgtgccatttccaaggaggaacagaggagacctcctatgaaatggcacaacctggcggcagcgcaaaagatg

SEQ ID NO: 27824 - DNA, 103 bp, Artificial Sequence
  Synthetic Polynucleotide
taatacgactcactatagggaggcattccccaacaacgtgccatttccaaaacagaggagattggaaatggcacgttgtaacctggcggcagcgcaaaagatg

SEQ ID NO: 27825 - DNA, 103 bp, Artificial Sequence
  Synthetic Polynucleotide
taatacgactcactataggggtgggcctctggggtgggtacaaccccagaaacagaggagatctgggatggtacccaccaacctggcggcagcgcaaaagatg

SEQ ID NO: 27826 - DNA, 103 bp, Artificial Sequence
  Synthetic Polynucleotide
taatacgactcactatagggaacagaagtgcttgttcgtggtggtactggaacagaggagaccagtaatgccacgaacaaacctggcggcagcgcaaaagatg

SEQ ID NO: 27827 - DNA, 103 bp, Artificial Sequence
  Synthetic Polynucleotide
taatacgactcactatagggcacaaaggcattccccaacaacgtgccattaacagaggagaaatggcatgttgttggggaacctggcggcagcgcaaaagatg

SEQ ID NO: 27828 - DNA, 103 bp, Artificial Sequence
  Synthetic Polynucleotide
taatacgactcactataggggggaacacaaaggcattccccaacaacgtgaacagaggagacacgttatgggggaatgcaacctggcggcagcgcaaaagatg

SEQ ID NO: 27829 - DNA, 103 bp, Artificial Sequence
  Synthetic Polynucleotide
taatacgactcactatagggggtgcgggaacacaaaggcattccccaacaaacagaggagatgttggatgatgcctttgaacctggcggcagcgcaaaagatg

SEQ ID NO: 27830 - DNA, 103 bp, Artificial Sequence
  Synthetic Polynucleotide
taatacgactcactatagggtatctggtgcgggaacacaaaggcattcccaacagaggagagggaatatgtttgtgttcaacctggcggcagcgcaaaagatg

SEQ ID NO: 27831 - DNA, 103 bp, Artificial Sequence
  Synthetic Polynucleotide
taatacgactcactatagggtttattatctggtgcgggaacacaaaggcaaacagaggagatgccttatggttcccgcaaacctggcggcagcgcaaaagatg

SEQ ID NO: 27832 - DNA, 103 bp, Artificial Sequence
  Synthetic Polynucleotide
taatacgactcactataggggtaggtttattatctggtgcgggaacacaaaacagaggagattgtgtatgcgcaccagaaacctggcggcagcgcaaaagatg

SEQ ID NO: 27833 - DNA, 103 bp, Artificial Sequence
  Synthetic Polynucleotide
taatacgactcactatagggggtccgtaggtttattatctggtgcgggaaaacagaggagattcccgatgcagataataaacctggcggcagcgcaaaagatg

SEQ ID NO: 27834 - DNA, 103 bp, Artificial Sequence
  Synthetic Polynucleotide
taatacgactcactatagggttgttggtccgtaggtttattatctggtgcaacagaggagagcaccaatgaataaacctaacctggcggcagcgcaaaagatg

SEQ ID NO: 27835 - DNA, 103 bp, Artificial Sequence
  Synthetic Polynucleotide
taatacgactcactatagggcacagttgttggtccgtaggtttattatctaacagaggagaagataaatgacctacggaaacctggcggcagcgcaaaagatg

SEQ ID NO: 27836 - DNA, 103 bp, Artificial Sequence
  Synthetic Polynucleotide
taatacgactcactatagggtgtagcacagttgttggtccgtaggtttataacagaggagaataaacatgcggaccaacaacctggcggcagcgcaaaagatg

SEQ ID NO: 27837 - DNA, 103 bp, Artificial Sequence
  Synthetic Polynucleotide
taatacgactcactatagggggggaaacagaagtgcttgttcgtggtggtaacagaggagaaccaccatgaacaagcacaacctggcggcagcgcaaaagatg

SEQ ID NO: 27838 - DNA, 103 bp, Artificial Sequence
  Synthetic Polynucleotide
taatacgactcactatagggaccagtgtagcacagttgttggtccgtaggaacagaggagacctacgatgcaacaactgaacctggcggcagcgcaaaagatg

SEQ ID NO: 27839 - DNA, 103 bp, Artificial Sequence
  Synthetic Polynucleotide
taatacgactcactatagggggagtaccagtgtagcacagttgttggtccaacagaggagaggaccaatgactgtgctaaacctggcggcagcgcaaaagatg

SEQ ID NO: 27840 - DNA, 103 bp, Artificial Sequence
  Synthetic Polynucleotide
taatacgactcactataggggtaagggagtaccagtgtagcacagttgttaacagaggagaaacaacatggctacactgaacctggcggcagcgcaaaagatg

SEQ ID NO: 27841 - DNA, 103 bp, Artificial Sequence
  Synthetic Polynucleotide
taatacgactcactatagggttcacgtaagggagtaccagtgtagcacagaacagaggagactgtgcatgactggtactaacctggcggcagcgcaaaagatg

SEQ ID NO: 27842 - DNA, 103 bp, Artificial Sequence
  Synthetic Polynucleotide
taatacgactcactataggggggagttcacgtaagggagtaccagtgtagaacagaggagactacacatgtactcccttaacctggcggcagcgcaaaagatg

SEQ ID NO: 27843 - DNA, 103 bp, Artificial Sequence
  Synthetic Polynucleotide
taatacgactcactatagggcgagagggagttcacgtaagggagtaccagaacagaggagactggtaatgccttacgtgaacctggcggcagcgcaaaagatg

SEQ ID NO: 27844 - DNA, 103 bp, Artificial Sequence
  Synthetic Polynucleotide
taatacgactcactatagggtctatcgagagggagttcacgtaagggagtaacagaggagaactcccatgcgtgaactcaacctggcggcagcgcaaaagatg

SEQ ID NO: 27845 - DNA, 103 bp, Artificial Sequence
  Synthetic Polynucleotide
taatacgactcactatagggtactatctatcgagagggagttcacgtaagaacagaggagacttacgatgactccctctaacctggcggcagcgcaaaagatg

SEQ ID NO: 27846 - DNA, 103 bp, Artificial Sequence
  Synthetic Polynucleotide
taatacgactcactatagggtaccatactatctatcgagagggagttcacaacagaggagagtgaacatgctctcgataaacctggcggcagcgcaaaagatg

SEQ ID NO: 27847 - DNA, 103 bp, Artificial Sequence
  Synthetic Polynucleotide
taatacgactcactatagggtgctttaccatactatctatcgagagggagaacagaggagactccctatggatagatagaacctggcggcagcgcaaaagatg

SEQ ID NO: 27848 - DNA, 103 bp, Artificial Sequence
  Synthetic Polynucleotide
taatacgactcactatagggtcaccggggaaacagaagtgcttgttcgtgaacagaggagacacgaaatggcacttctgaacctggcggcagcgcaaaagatg

SEQ ID NO: 27849 - DNA, 103 bp, Artificial Sequence
  Synthetic Polynucleotide
taatacgactcactatagggtattgtgctttaccatactatctatcgagaaacagaggagatctcgaatgatagtatggaacctggcggcagcgcaaaagatg

SEQ ID NO: 27850 - DNA, 103 bp, Artificial Sequence
  Synthetic Polynucleotide
taatacgactcactatagggccaattattgtgctttaccatactatctataacagaggagaatagatatgatggtaaagaacctggcggcagcgcaaaagatg

SEQ ID NO: 27851 - DNA, 103 bp, Artificial Sequence
  Synthetic Polynucleotide
taatacgactcactatagggattccccaattattgtgctttaccatactaaacagaggagatagtatatgaaagcacaaaacctggcggcagcgcaaaagatg

SEQ ID NO: 27852 - DNA, 103 bp, Artificial Sequence
  Synthetic Polynucleotide
taatacgactcactatagggttgcaattccccaattattgtgctttaccaaacagaggagatggtaaatgacaataattaacctggcggcagcgcaaaagatg

SEQ ID NO: 27853 - DNA, 103 bp, Artificial Sequence
  Synthetic Polynucleotide
taatacgactcactatagggtaatattgcaattccccaattattgtgcttaacagaggagaaagcacatgaattggggaaacctggcggcagcgcaaaagatg

SEQ ID NO: 27854 - DNA, 103 bp, Artificial Sequence
  Synthetic Polynucleotide
taatacgactcactatagggaatggtaatattgcaattccccaattattgaacagaggagacaataaatggggaattgcaacctggcggcagcgcaaaagatg

SEQ ID NO: 27855 - DNA, 103 bp, Artificial Sequence
  Synthetic Polynucleotide
taatacgactcactataggggggccaatggtaatattgcaattccccaataacagaggagaattgggatgttgcaatataacctggcggcagcgcaaaagatg

SEQ ID NO: 27856 - DNA, 103 bp, Artificial Sequence
  Synthetic Polynucleotide
taatacgactcactatagggtaatggggccaatggtaatattgcaattccaacagaggagaggaattatgatattaccaaacctggcggcagcgcaaaagatg

SEQ ID NO: 27857 - DNA, 103 bp, Artificial Sequence
  Synthetic Polynucleotide
taatacgactcactatagggaaatttaatggggccaatggtaatattgcaaacagaggagatgcaatatgaccattggcaacctggcggcagcgcaaaagatg

SEQ ID NO: 27858 - DNA, 103 bp, Artificial Sequence
  Synthetic Polynucleotide
taatacgactcactatagggtagcaaaatttaatggggccaatggtaataaacagaggagatattacatgtggccccataacctggcggcagcgcaaaagatg

SEQ ID NO: 27859 - DNA, 103 bp, Artificial Sequence
  Synthetic Polynucleotide
taatacgactcactatagggcgacatcaccggggaaacagaagtgcttgtaacagaggagaacaagcatgtctgtttccaacctggcggcagcgcaaaagatg

SEQ ID NO: 27860 - DNA, 103 bp, Artificial Sequence
  Synthetic Polynucleotide
taatacgactcactatagggctcactagcaaaatttaatggggccaatggaacagaggagaccattgatgccattaaataacctggcggcagcgcaaaagatg

SEQ ID NO: 27861 - DNA, 103 bp, Artificial Sequence
  Synthetic Polynucleotide
taatacgactcactataggggaggactcactagcaaaatttaatggggccaacagaggagaggccccatgaaattttgcaacctggcggcagcgcaaaagatg

SEQ ID NO: 27862 - DNA, 103 bp, Artificial Sequence
  Synthetic Polynucleotide
taatacgactcactatagggctggggaggactcactagcaaaatttaatgaacagaggagacattaaatgttgctagtgaacctggcggcagcgcaaaagatg

SEQ ID NO: 27863 - DNA, 103 bp, Artificial Sequence
  Synthetic Polynucleotide
taatacgactcactatagggaatctctggggaggactcactagcaaaattaacagaggagaaattttatgagtgagtccaacctggcggcagcgcaaaagatg

SEQ ID NO: 27864 - DNA, 103 bp, Artificial Sequence
  Synthetic Polynucleotide
taatacgactcactatagggattggaatctctggggaggactcactagcaaacagaggagatgctagatggtcctccccaacctggcggcagcgcaaaagatg

SEQ ID NO: 27865 - DNA, 103 bp, Artificial Sequence
  Synthetic Polynucleotide
taatacgactcactatagggaggtgattggaatctctggggaggactcacaacagaggagagtgagtatgccccagagaaacctggcggcagcgcaaaagatg

SEQ ID NO: 27866 - DNA, 103 bp, Artificial Sequence
  Synthetic Polynucleotide
taatacgactcactatagggggtcaaggtgattggaatctctggggaggaaacagaggagatcctccatggagattccaaacctggcggcagcgcaaaagatg

SEQ ID NO: 27867 - DNA, 103 bp, Artificial Sequence
  Synthetic Polynucleotide
taatacgactcactataggggctatggtcaaggtgattggaatctctgggaacagaggagacccagaatgtccaatcacaacctggcggcagcgcaaaagatg

SEQ ID NO: 27868 - DNA, 103 bp, Artificial Sequence
  Synthetic Polynucleotide
taatacgactcactatagggtaggggctatggtcaaggtgattggaatctaacagaggagaagattcatgtcaccttgaaacctggcggcagcgcaaaagatg

SEQ ID NO: 27869 - DNA, 103 bp, Artificial Sequence
  Synthetic Polynucleotide
taatacgactcactataggggcacataggggctatggtcaaggtgattggaacagaggagaccaatcatgttgaccataaacctggcggcagcgcaaaagatg

SEQ ID NO: 27870 - DNA, 103 bp, Artificial Sequence
  Synthetic Polynucleotide
taatacgactcactatagggctatacgacatcaccggggaaacagaagtgaacagaggagacacttcatgttccccggtaacctggcggcagcgcaaaagatg

SEQ ID NO: 27871 - DNA, 103 bp, Artificial Sequence
  Synthetic Polynucleotide
taatacgactcactatagggtcacagcacataggggctatggtcaaggtgaacagaggagacaccttatgcatagccccaacctggcggcagcgcaaaagatg

SEQ ID NO: 27872 - DNA, 103 bp, Artificial Sequence
  Synthetic Polynucleotide
taatacgactcactatagggtgaactcacagcacataggggctatggtcaaacagaggagatgaccaatgcccctatgtaacctggcggcagcgcaaaagatg

SEQ ID NO: 27873 - DNA, 103 bp, Artificial Sequence
  Synthetic Polynucleotide
taatacgactcactatagggtccattgaactcacagcacataggggctataacagaggagaatagccatgatgtgctgtaacctggcggcagcgcaaaagatg

SEQ ID NO: 27874 - DNA, 103 bp, Artificial Sequence
  Synthetic Polynucleotide
taatacgactcactatagggcttaatccattgaactcacagcacatagggaacagaggagaccctatatgctgtgagttaacctggcggcagcgcaaaagatg

SEQ ID NO: 27875 - DNA, 103 bp, Artificial Sequence
  Synthetic Polynucleotide
taatacgactcactatagggtgtttcttaatccattgaactcacagcacaaacagaggagatgtgctatgagttcaatgaacctggcggcagcgcaaaagatg

SEQ ID NO: 27876 - DNA, 103 bp, Artificial Sequence
  Synthetic Polynucleotide
taatacgactcactatagggggtgatgtttcttaatccattgaactcacaaacagaggagatgtgagatgaatggattaaacctggcggcagcgcaaaagatg

SEQ ID NO: 27877 - DNA, 103 bp, Artificial Sequence
  Synthetic Polynucleotide
taatacgactcactatagggggcagggtgatgtttcttaatccattgaacaacagaggagagttcaaatgattaagaaaaacctggcggcagcgcaaaagatg

SEQ ID NO: 27878 - DNA, 103 bp, Artificial Sequence
  Synthetic Polynucleotide
taatacgactcactatagggagcgtggcagggtgatgtttcttaatccataacagaggagaatggatatggaaacatcaaacctggcggcagcgcaaaagatg

SEQ ID NO: 27879 - DNA, 103 bp, Artificial Sequence
  Synthetic Polynucleotide
taatacgactcactatagggctgtaagcgtggcagggtgatgtttcttaaaacagaggagattaagaatgatcaccctgaacctggcggcagcgcaaaagatg

SEQ ID NO: 27880 - DNA, 103 bp, Artificial Sequence
  Synthetic Polynucleotide
taatacgactcactatagggaggccctgtaagcgtggcagggtgatgtttaacagaggagaaaacatatgcctgccacgaacctggcggcagcgcaaaagatg

SEQ ID NO: 27881 - DNA, 103 bp, Artificial Sequence
  Synthetic Polynucleotide
taatacgactcactataggggcagtctatacgacatcaccggggaaacagaacagaggagactgtttatgcggtgatgtaacctggcggcagcgcaaaagatg

SEQ ID NO: 27882 - DNA, 103 bp, Artificial Sequence
  Synthetic Polynucleotide
taatacgactcactatagggccggcaggccctgtaagcgtggcagggtgaaacagaggagatcacccatgcacgcttacaacctggcggcagcgcaaaagatg

SEQ ID NO: 27883 - DNA, 103 bp, Artificial Sequence
  Synthetic Polynucleotide
taatacgactcactatagggcatgaccggcaggccctgtaagcgtggcagaacagaggagactgccaatgttacagggcaacctggcggcagcgcaaaagatg

SEQ ID NO: 27884 - DNA, 103 bp, Artificial Sequence
  Synthetic Polynucleotide
taatacgactcactataggggtgttcatgaccggcaggccctgtaagcgtaacagaggagaacgcttatggggcctgccaacctggcggcagcgcaaaagatg

SEQ ID NO: 27885 - DNA, 103 bp, Artificial Sequence
  Synthetic Polynucleotide
taatacgactcactatagggcaggggtgttcatgaccggcaggccctgtaaacagaggagatacaggatgtgccggtcaaacctggcggcagcgcaaaagatg

SEQ ID NO: 27886 - DNA, 103 bp, Artificial Sequence
  Synthetic Polynucleotide
taatacgactcactataggggctaccaggggtgttcatgaccggcaggccaacagaggagaggcctgatggtcatgaacaacctggcggcagcgcaaaagatg

SEQ ID NO: 27887 - DNA, 103 bp, Artificial Sequence
  Synthetic Polynucleotide
taatacgactcactatagggtgattgctaccaggggtgttcatgaccggcaacagaggagagccggtatggaacaccccaacctggcggcagcgcaaaagatg

SEQ ID NO: 27888 - DNA, 103 bp, Artificial Sequence
  Synthetic Polynucleotide
taatacgactcactataggggatattgattgctaccaggggtgttcatgaaacagaggagatcatgaatgcccctggtaaacctggcggcagcgcaaaagatg

SEQ ID NO: 27889 - DNA, 103 bp, Artificial Sequence
  Synthetic Polynucleotide
taatacgactcactatagggagtaagatattgattgctaccaggggtgttaacagaggagaaacaccatgggtagcaataacctggcggcagcgcaaaagatg

SEQ ID NO: 27890 - DNA, 103 bp, Artificial Sequence
  Synthetic Polynucleotide
taatacgactcactatagggtctgcagtaagatattgattgctaccagggaacagaggagaccctggatgcaatcaataaacctggcggcagcgcaaaagatg

SEQ ID NO: 27891 - DNA, 103 bp, Artificial Sequence
  Synthetic Polynucleotide
taatacgactcactatagggagttgtctgcagtaagatattgattgctacaacagaggagagtagcaatgaatatcttaaacctggcggcagcgcaaaagatg

SEQ ID NO: 27892 - DNA, 103 bp, Artificial Sequence
  Synthetic Polynucleotide
taatacgactcactatagggcgcaagcagtctatacgacatcaccggggaaacagaggagatccccgatgatgtcgtataacctggcggcagcgcaaaagatg

SEQ ID NO: 27893 - DNA, 103 bp, Artificial Sequence
  Synthetic Polynucleotide
taatacgactcactatagggctggaagttgtctgcagtaagatattgattaacagaggagaaatcaaatgcttactgcaaacctggcggcagcgcaaaagatg

SEQ ID NO: 27894 - DNA, 103 bp, Artificial Sequence
  Synthetic Polynucleotide
taatacgactcactatagggggtgactggaagttgtctgcagtaagatataacagaggagaatatctatgtgcagacaaaacctggcggcagcgcaaaagatg

SEQ ID NO: 27895 - DNA, 103 bp, Artificial Sequence
  Synthetic Polynucleotide
taatacgactcactatagggcacacggtgactggaagttgtctgcagtaaaacagaggagattactgatgacaacttccaacctggcggcagcgcaaaagatg

SEQ ID NO: 27896 - DNA, 103 bp, Artificial Sequence
  Synthetic Polynucleotide
taatacgactcactatagggcagcgcacacggtgactggaagttgtctgcaacagaggagagcagacatgttccagtcaaacctggcggcagcgcaaaagatg

SEQ ID NO: 27897 - DNA, 103 bp, Artificial Sequence
  Synthetic Polynucleotide
taatacgactcactatagggtcaggcagcgcacacggtgactggaagttgaacagaggagacaacttatggtcaccgtgaacctggcggcagcgcaaaagatg

SEQ ID NO: 27898 - DNA, 103 bp, Artificial Sequence
  Synthetic Polynucleotide
taatacgactcactatagggcaaattcaggcagcgcacacggtgactggaaacagaggagatccagtatgcgtgtgcgcaacctggcggcagcgcaaaagatg

SEQ ID NO: 27899 - DNA, 103 bp, Artificial Sequence
  Synthetic Polynucleotide
taatacgactcactatagggcacatcaaattcaggcagcgcacacggtgaaacagaggagatcaccgatggcgctgcctaacctggcggcagcgcaaaagatg

SEQ ID NO: 27900 - DNA, 103 bp, Artificial Sequence
  Synthetic Polynucleotide
taatacgactcactatagggggggtcacatcaaattcaggcagcgcacacaacagaggagagtgtgcatggcctgaattaacctggcggcagcgcaaaagatg

SEQ ID NO: 27901 - DNA, 103 bp, Artificial Sequence
  Synthetic Polynucleotide
taatacgactcactatagggtaggtggggtcacatcaaattcaggcagcgaacagaggagacgctgcatgaatttgatgaacctggcggcagcgcaaaagatg

SEQ ID NO: 27902 - DNA, 103 bp, Artificial Sequence
  Synthetic Polynucleotide
taatacgactcactataggggtcaataggtggggtcacatcaaattcaggaacagaggagacctgaaatggatgtgaccaacctggcggcagcgcaaaagatg

SEQ ID NO: 27903 - DNA, 103 bp, Artificial Sequence
  Synthetic Polynucleotide
taatacgactcactatagggaaccacgcaagcagtctatacgacatcaccaacagaggagaggtgatatggtatagactaacctggcggcagcgcaaaagatg

SEQ ID NO: 27904 - DNA, 103 bp, Artificial Sequence
  Synthetic Polynucleotide
taatacgactcactatagggggtatgtcaataggtggggtcacatcaaataacagaggagaatttgaatggaccccaccaacctggcggcagcgcaaaagatg

SEQ ID NO: 27905 - DNA, 103 bp, Artificial Sequence
  Synthetic Polynucleotide
taatacgactcactatagggcaccgggtatgtcaataggtggggtcacataacagaggagaatgtgaatgcacctattgaacctggcggcagcgcaaaagatg

SEQ ID NO: 27906 - DNA, 103 bp, Artificial Sequence
  Synthetic Polynucleotide
taatacgactcactatagggtacttcaccgggtatgtcaataggtggggtaacagaggagaaccccaatgattgacataaacctggcggcagcgcaaaagatg

SEQ ID NO: 27907 - DNA, 103 bp, Artificial Sequence
  Synthetic Polynucleotide
taatacgactcactatagggttctttacttcaccgggtatgtcaataggtaacagaggagaacctatatgcatacccggaacctggcggcagcgcaaaagatg

SEQ ID NO: 27908 - DNA, 103 bp, Artificial Sequence
  Synthetic Polynucleotide
taatacgactcactatagggtcatgttctttacttcaccgggtatgtcaaaacagaggagattgacaatgccggtgaagaacctggcggcagcgcaaaagatg

SEQ ID NO: 27909 - DNA, 103 bp, Artificial Sequence
  Synthetic Polynucleotide
taatacgactcactatagggttccatcatgttctttacttcaccgggtataacagaggagaatacccatggaagtaaagaacctggcggcagcgcaaaagatg

SEQ ID NO: 27910 - DNA, 103 bp, Artificial Sequence
  Synthetic Polynucleotide
taatacgactcactataggggccaattccatcatgttctttacttcaccgaacagaggagacggtgaatgaaagaacataacctggcggcagcgcaaaagatg

SEQ ID NO: 27911 - DNA, 103 bp, Artificial Sequence
  Synthetic Polynucleotide
taatacgactcactatagggtttctgccaattccatcatgttctttacttaacagaggagaaagtaaatgacatgatggaacctggcggcagcgcaaaagatg

SEQ ID NO: 27912 - DNA, 103 bp, Artificial Sequence
  Synthetic Polynucleotide
taatacgactcactataggggtcgatttctgccaattccatcatgttcttaacagaggagaaagaacatgatggaattgaacctggcggcagcgcaaaagatg

SEQ ID NO: 27913 - DNA, 103 bp, Artificial Sequence
  Synthetic Polynucleotide
taatacgactcactatagggatggtgtcgatttctgccaattccatcatgaacagaggagacatgatatgattggcagaaacctggcggcagcgcaaaagatg

SEQ ID NO: 27914 - DNA, 103 bp, Artificial Sequence
  Synthetic Polynucleotide
taatacgactcactatagggctttcaaccacgcaagcagtctatacgacaaacagaggagatgtcgtatggactgcttgaacctggcggcagcgcaaaagatg

SEQ ID NO: 27915 - DNA, 103 bp, Artificial Sequence
  Synthetic Polynucleotide
taatacgactcactataggggaatcatggtgtcgatttctgccaattccaaacagaggagatggaatatgcagaaatcgaacctggcggcagcgcaaaagatg

SEQ ID NO: 27916 - DNA, 103 bp, Artificial Sequence
  Synthetic Polynucleotide
taatacgactcactatagggaaagggaatcatggtgtcgatttctgccaaaacagaggagattggcaatgatcgacaccaacctggcggcagcgcaaaagatg

SEQ ID NO: 27917 - DNA, 103 bp, Artificial Sequence
  Synthetic Polynucleotide
taatacgactcactatagggaagtcaaagggaatcatggtgtcgatttctaacagaggagaagaaatatgcaccatgataacctggcggcagcgcaaaagatg

SEQ ID NO: 27918 - DNA, 103 bp, Artificial Sequence
  Synthetic Polynucleotide
taatacgactcactatagggcacttaagtcaaagggaatcatggtgtcgaaacagaggagatcgacaatgtgattccctaacctggcggcagcgcaaaagatg

SEQ ID NO: 27919 - DNA, 103 bp, Artificial Sequence
  Synthetic Polynucleotide
taatacgactcactatagggtgtggcacttaagtcaaagggaatcatggtaacagaggagaaccatgatgccctttgacaacctggcggcagcgcaaaagatg

SEQ ID NO: 27920 - DNA, 103 bp, Artificial Sequence
  Synthetic Polynucleotide
taatacgactcactatagggttttttgtggcacttaagtcaaagggaatcaacagaggagagattccatgtgacttaagaacctggcggcagcgcaaaagatg

SEQ ID NO: 27921 - DNA, 103 bp, Artificial Sequence
  Synthetic Polynucleotide
taatacgactcactatagggtgttcttttttgtggcacttaagtcaaaggaacagaggagacctttgatgtaagtgccaaacctggcggcagcgcaaaagatg

SEQ ID NO: 27922 - DNA, 103 bp, Artificial Sequence
  Synthetic Polynucleotide
taatacgactcactatagggcatggtgttcttttttgtggcacttaagtcaacagaggagagacttaatggccacaaaaaacctggcggcagcgcaaaagatg

SEQ ID NO: 27923 - DNA, 103 bp, Artificial Sequence
  Synthetic Polynucleotide
taatacgactcactatagggatttccatggtgttcttttttgtggcacttaacagaggagaaagtgcatgaaaaaagaaaacctggcggcagcgcaaaagatg

SEQ ID NO: 27924 - DNA, 103 bp, Artificial Sequence
  Synthetic Polynucleotide
taatacgactcactatagggtatacatttccatggtgttcttttttgtggaacagaggagaccacaaatgagaacaccaaacctggcggcagcgcaaaagatg

SEQ ID NO: 27925 - DNA, 103 bp, Artificial Sequence
  Synthetic Polynucleotide
taatacgactcactatagggcgtcgctttcaaccacgcaagcagtctataaacagaggagatatagaatgcttgcgtggaacctggcggcagcgcaaaagatg

SEQ ID NO: 27926 - DNA, 103 bp, Artificial Sequence
  Synthetic Polynucleotide
taatacgactcactatagggaaccctatacatttccatggtgttctttttaacagaggagaaaaaagatgaccatggaaaacctggcggcagcgcaaaagatg

SEQ ID NO: 27927 - DNA, 103 bp, Artificial Sequence
  Synthetic Polynucleotide
taatacgactcactatagggaaccgaaccctatacatttccatggtgttcaacagaggagagaacacatgggaaatgtaaacctggcggcagcgcaaaagatg

SEQ ID NO: 27928 - DNA, 103 bp, Artificial Sequence
  Synthetic Polynucleotide
taatacgactcactatagggcacttaaccgaaccctatacatttccatggaacagaggagaccatggatgtgtatagggaacctggcggcagcgcaaaagatg

SEQ ID NO: 27929 - DNA, 103 bp, Artificial Sequence
  Synthetic Polynucleotide
taatacgactcactatagggtttgtcacttaaccgaaccctatacatttcaacagaggagagaaatgatgagggttcggaacctggcggcagcgcaaaagatg

SEQ ID NO: 27930 - DNA, 103 bp, Artificial Sequence
  Synthetic Polynucleotide
taatacgactcactatagggtgtggtttgtcacttaaccgaaccctatacaacagaggagagtatagatgtcggttaagaacctggcggcagcgcaaaagatg

SEQ ID NO: 27931 - DNA, 103 bp, Artificial Sequence
  Synthetic Polynucleotide
taatacgactcactatagggctgtatgtggtttgtcacttaaccgaacccaacagaggagagggttcatgtaagtgacaaacctggcggcagcgcaaaagatg

SEQ ID NO: 27932 - DNA, 103 bp, Artificial Sequence
  Synthetic Polynucleotide
taatacgactcactatagggatcgtctgtatgtggtttgtcacttaaccgaacagaggagacggttaatggacaaaccaaacctggcggcagcgcaaaagatg

SEQ ID NO: 27933 - DNA, 103 bp, Artificial Sequence
  Synthetic Polynucleotide
taatacgactcactatagggatgggatcgtctgtatgtggtttgtcacttaacagaggagaaagtgaatgaccacatacaacctggcggcagcgcaaaagatg

SEQ ID NO: 27934 - DNA, 103 bp, Artificial Sequence
  Synthetic Polynucleotide
taatacgactcactatagggagagtatgggatcgtctgtatgtggtttgtaacagaggagaacaaacatgatacagacgaacctggcggcagcgcaaaagatg

SEQ ID NO: 27935 - DNA, 103 bp, Artificial Sequence
  Synthetic Polynucleotide
taatacgactcactatagggcaggcagagtatgggatcgtctgtatgtggaacagaggagaccacatatggacgatcccaacctggcggcagcgcaaaagatg

SEQ ID NO: 27936 - DNA, 103 bp, Artificial Sequence
  Synthetic Polynucleotide
taatacgactcactataggggccacgtgggcctctggggtgggtacaaccaacagaggagaggttgtatgcaccccagaaacctggcggcagcgcaaaagatg

SEQ ID NO: 27937 - DNA, 103 bp, Artificial Sequence
  Synthetic Polynucleotide
taatacgactcactatagggggatccgtcgctttcaaccacgcaagcagtaacagaggagaactgctatggtggttgaaaacctggcggcagcgcaaaagatg

SEQ ID NO: 27938 - DNA, 103 bp, Artificial Sequence
  Synthetic Polynucleotide
taatacgactcactatagggagtgacaggcagagtatgggatcgtctgtaaacagaggagatacagaatgtcccatactaacctggcggcagcgcaaaagatg

SEQ ID NO: 27939 - DNA, 103 bp, Artificial Sequence
  Synthetic Polynucleotide
taatacgactcactataggggagagagtgacaggcagagtatgggatcgtaacagaggagaacgatcatgtactctgccaacctggcggcagcgcaaaagatg

SEQ ID NO: 27940 - DNA, 103 bp, Artificial Sequence
  Synthetic Polynucleotide
taatacgactcactatagggagctggagagagtgacaggcagagtatgggaacagaggagacccataatgtgcctgtcaaacctggcggcagcgcaaaagatg

SEQ ID NO: 27941 - DNA, 103 bp, Artificial Sequence
  Synthetic Polynucleotide
taatacgactcactatagggtctgaagctggagagagtgacaggcagagtaacagaggagaactctgatggtcactctcaacctggcggcagcgcaaaagatg

SEQ ID NO: 27942 - DNA, 103 bp, Artificial Sequence
  Synthetic Polynucleotide
taatacgactcactatagggtaggatctgaagctggagagagtgacaggcaacagaggagagcctgtatgtctctccagaacctggcggcagcgcaaaagatg

SEQ ID NO: 27943 - DNA, 103 bp, Artificial Sequence
  Synthetic Polynucleotide
taatacgactcactatagggcaacctaggatctgaagctggagagagtgaaacagaggagatcactcatgccagcttcaaacctggcggcagcgcaaaagatg

SEQ ID NO: 27944 - DNA, 103 bp, Artificial Sequence
  Synthetic Polynucleotide
taatacgactcactatagggtgtgacaacctaggatctgaagctggagagaacagaggagactctccatgttcagatccaacctggcggcagcgcaaaagatg

SEQ ID NO: 27945 - DNA, 103 bp, Artificial Sequence
  Synthetic Polynucleotide
taatacgactcactatagggtagtatgtgacaacctaggatctgaagctgaacagaggagacagcttatgatcctaggtaacctggcggcagcgcaaaagatg

SEQ ID NO: 27946 - DNA, 103 bp, Artificial Sequence
  Synthetic Polynucleotide
taatacgactcactatagggaagcatagtatgtgacaacctaggatctgaaacagaggagatcagatatgaggttgtcaaacctggcggcagcgcaaaagatg

SEQ ID NO: 27947 - DNA, 103 bp, Artificial Sequence
  Synthetic Polynucleotide
taatacgactcactatagggtctccaagcatagtatgtgacaacctaggaaacagaggagatcctagatggtcacatacaacctggcggcagcgcaaaagatg

SEQ ID NO: 27948 - DNA, 103 bp, Artificial Sequence
  Synthetic Polynucleotide
taatacgactcactatagggataacggatccgtcgctttcaaccacgcaaaacagaggagattgcgtatgtgaaagcgaaacctggcggcagcgcaaaagatg

SEQ ID NO: 27949 - DNA, 103 bp, Artificial Sequence
  Synthetic Polynucleotide
taatacgactcactatagggggatttctccaagcatagtatgtgacaaccaacagaggagaggttgtatgatactatgcaacctggcggcagcgcaaaagatg

SEQ ID NO: 27950 - DNA, 103 bp, Artificial Sequence
  Synthetic Polynucleotide
taatacgactcactatagggatttaggatttctccaagcatagtatgtgaaacagaggagatcacatatgatgcttggaaacctggcggcagcgcaaaagatg

SEQ ID NO: 27951 - DNA, 103 bp, Artificial Sequence
  Synthetic Polynucleotide
taatacgactcactatagggtagtaatttaggatttctccaagcatagtaaacagaggagatactatatgtggagaaataacctggcggcagcgcaaaagatg

SEQ ID NO: 27952 - DNA, 103 bp, Artificial Sequence
  Synthetic Polynucleotide
taatacgactcactataggggtgtgtagtaatttaggatttctccaagcaaacagaggagatgcttgatgaaatcctaaaacctggcggcagcgcaaaagatg

SEQ ID NO: 27953 - DNA, 103 bp, Artificial Sequence
  Synthetic Polynucleotide
taatacgactcactatagggccagtgtgtgtagtaatttaggatttctccaacagaggagaggagaaatgctaaattacaacctggcggcagcgcaaaagatg

SEQ ID NO: 27954 - DNA, 103 bp, Artificial Sequence
  Synthetic Polynucleotide
taatacgactcactatagggcctgcccagtgtgtgtagtaatttaggattaacagaggagaaatcctatgttactacacaacctggcggcagcgcaaaagatg

SEQ ID NO: 27955 - DNA, 103 bp, Artificial Sequence
  Synthetic Polynucleotide
taatacgactcactataggggggatcctgcccagtgtgtgtagtaatttaaacagaggagataaattatgacacacactaacctggcggcagcgcaaaagatg

SEQ ID NO: 27956 - DNA, 103 bp, Artificial Sequence
  Synthetic Polynucleotide
taatacgactcactatagggcttcagggatcctgcccagtgtgtgtagtaaacagaggagatactacatgcactgggcaaacctggcggcagcgcaaaagatg

SEQ ID NO: 27957 - DNA, 103 bp, Artificial Sequence
  Synthetic Polynucleotide
taatacgactcactataggggtgaacttcagggatcctgcccagtgtgtgaacagaggagacacacaatgggcaggatcaacctggcggcagcgcaaaagatg

SEQ ID NO: 27958 - DNA, 103 bp, Artificial Sequence
  Synthetic Polynucleotide
taatacgactcactataggggaaacgtgaacttcagggatcctgcccagtaacagaggagaactgggatggatccctgaaacctggcggcagcgcaaaagatg

SEQ ID NO: 27959 - DNA, 103 bp, Artificial Sequence
  Synthetic Polynucleotide
taatacgactcactatagggagcggataacggatccgtcgctttcaaccaaacagaggagatggttgatggcgacggataacctggcggcagcgcaaaagatg

SEQ ID NO: 27960 - DNA, 103 bp, Artificial Sequence
  Synthetic Polynucleotide
taatacgactcactataggggaacagaaacgtgaacttcagggatcctgcaacagaggagagcaggaatgctgaagttcaacctggcggcagcgcaaaagatg

SEQ ID NO: 27961 - DNA, 103 bp, Artificial Sequence
  Synthetic Polynucleotide
taatacgactcactatagggccacagaacagaaacgtgaacttcagggataacagaggagaatccctatggttcacgttaacctggcggcagcgcaaaagatg

SEQ ID NO: 27962 - DNA, 103 bp, Artificial Sequence
  Synthetic Polynucleotide
taatacgactcactatagggtgaatccacagaacagaaacgtgaacttcaaacagaggagatgaagtatgcgtttctgtaacctggcggcagcgcaaaagatg

SEQ ID NO: 27963 - DNA, 103 bp, Artificial Sequence
  Synthetic Polynucleotide
taatacgactcactatagggcatcatgaatccacagaacagaaacgtgaaaacagaggagattcacgatgctgttctgtaacctggcggcagcgcaaaagatg

SEQ ID NO: 27964 - DNA, 103 bp, Artificial Sequence
  Synthetic Polynucleotide
taatacgactcactataggggttgccatcatgaatccacagaacagaaacaacagaggagagtttctatgctgtggattaacctggcggcagcgcaaaagatg

SEQ ID NO: 27965 - DNA, 103 bp, Artificial Sequence
  Synthetic Polynucleotide
taatacgactcactatagggtgccagttgccatcatgaatccacagaacaaacagaggagatgttctatggattcatgaaacctggcggcagcgcaaaagatg

SEQ ID NO: 27966 - DNA, 103 bp, Artificial Sequence
  Synthetic Polynucleotide
taatacgactcactatagggcagtttgccagttgccatcatgaatccacaaacagaggagatgtggaatgatgatggcaaacctggcggcagcgcaaaagatg

SEQ ID NO: 27967 - DNA, 103 bp, Artificial Sequence
  Synthetic Polynucleotide
taatacgactcactatagggaccaacagtttgccagttgccatcatgaataacagaggagaattcatatgggcaactggaacctggcggcagcgcaaaagatg

SEQ ID NO: 27968 - DNA, 103 bp, Artificial Sequence
  Synthetic Polynucleotide
taatacgactcactatagggatgacaccaacagtttgccagttgccatcaaacagaggagatgatggatgctggcaaacaacctggcggcagcgcaaaagatg

SEQ ID NO: 27969 - DNA, 103 bp, Artificial Sequence
  Synthetic Polynucleotide
taatacgactcactatagggcgcgtatgacaccaacagtttgccagttgcaacagaggagagcaactatgaaactgttgaacctggcggcagcgcaaaagatg

SEQ ID NO: 27970 - DNA, 103 bp, Artificial Sequence
  Synthetic Polynucleotide
taatacgactcactatagggacataagcggataacggatccgtcgctttcaacagaggagagaaagcatgggatccgttaacctggcggcagcgcaaaagatg

SEQ ID NO: 27971 - DNA, 103 bp, Artificial Sequence
  Synthetic Polynucleotide
taatacgactcactatagggggaggcgcgtatgacaccaacagtttgccaaacagaggagatggcaaatggttggtgtcaacctggcggcagcgcaaaagatg

SEQ ID NO: 27972 - DNA, 103 bp, Artificial Sequence
  Synthetic Polynucleotide
taatacgactcactatagggctccaggaggcgcgtatgacaccaacagttaacagaggagaaactgtatgtgtcatacgaacctggcggcagcgcaaaagatg

SEQ ID NO: 27973 - DNA, 103 bp, Artificial Sequence
  Synthetic Polynucleotide
taatacgactcactataggggtcggctccaggaggcgcgtatgacaccaaaacagaggagattggtgatgtacgcgcctaacctggcggcagcgcaaaagatg

SEQ ID NO: 27974 - DNA, 103 bp, Artificial Sequence
  Synthetic Polynucleotide
taatacgactcactatagggggtgggtcggctccaggaggcgcgtatgacaacagaggagagtcataatggcctcctggaacctggcggcagcgcaaaagatg

SEQ ID NO: 27975 - DNA, 103 bp, Artificial Sequence
  Synthetic Polynucleotide
taatacgactcactatagggtctttggtgggtcggctccaggaggcgcgtaacagaggagaacgcgcatgctggagccgaacctggcggcagcgcaaaagatg

SEQ ID NO: 27976 - DNA, 103 bp, Artificial Sequence
  Synthetic Polynucleotide
taatacgactcactatagggacgcttctttggtgggtcggctccaggaggaacagaggagacctcctatggccgacccaaacctggcggcagcgcaaaagatg

SEQ ID NO: 27977 - DNA, 103 bp, Artificial Sequence
  Synthetic Polynucleotide
taatacgactcactatagggtccttacgcttctttggtgggtcggctccaaacagaggagatggagcatgcccaccaaaaacctggcggcagcgcaaaagatg

SEQ ID NO: 27978 - DNA, 103 bp, Artificial Sequence
  Synthetic Polynucleotide
taatacgactcactatagggtcgcctccttacgcttctttggtgggtcggaacagaggagaccgaccatgcaaagaagcaacctggcggcagcgcaaaagatg

SEQ ID NO: 27979 - DNA, 103 bp, Artificial Sequence
  Synthetic Polynucleotide
taatacgactcactatagggcaacatcgcctccttacgcttctttggtggaacagaggagaccaccaatgaagcgtaagaacctggcggcagcgcaaaagatg

SEQ ID NO: 27980 - DNA, 103 bp, Artificial Sequence
  Synthetic Polynucleotide
taatacgactcactataggggttcccaacatcgcctccttacgcttctttaacagaggagaaaagaaatgtaaggaggcaacctggcggcagcgcaaaagatg

SEQ ID NO: 27981 - DNA, 103 bp, Artificial Sequence
  Synthetic Polynucleotide
taatacgactcactataggggaagtacataagcggataacggatccgtcgaacagaggagacgacggatgcgttatccgaacctggcggcagcgcaaaagatg

SEQ ID NO: 27982 - DNA, 103 bp, Artificial Sequence
  Synthetic Polynucleotide
taatacgactcactatagggcatgtgttcccaacatcgcctccttacgctaacagaggagaagcgtaatgaggcgatgtaacctggcggcagcgcaaaagatg

SEQ ID NO: 27983 - DNA, 103 bp, Artificial Sequence
  Synthetic Polynucleotide
taatacgactcactataggggatcacatgtgttcccaacatcgcctccttaacagaggagaaaggagatgatgttgggaaacctggcggcagcgcaaaagatg

SEQ ID NO: 27984 - DNA, 103 bp, Artificial Sequence
  Synthetic Polynucleotide
taatacgactcactatagggtcccagatcacatgtgttcccaacatcgccaacagaggagaggcgatatggggaacacaaacctggcggcagcgcaaaagatg

SEQ ID NO: 27985 - DNA, 103 bp, Artificial Sequence
  Synthetic Polynucleotide
taatacgactcactatagggctatgtcccagatcacatgtgttcccaacaaacagaggagatgttggatgcacatgtgaaacctggcggcagcgcaaaagatg

SEQ ID NO: 27986 - DNA, 103 bp, Artificial Sequence
  Synthetic Polynucleotide
taatacgactcactatagggcagtcctatgtcccagatcacatgtgttccaacagaggagaggaacaatggtgatctggaacctggcggcagcgcaaaagatg

SEQ ID NO: 27987 - DNA, 103 bp, Artificial Sequence
  Synthetic Polynucleotide
taatacgactcactataggggactgcagtcctatgtcccagatcacatgtaacagaggagaacatgtatgctgggacataacctggcggcagcgcaaaagatg

SEQ ID NO: 27988 - DNA, 103 bp, Artificial Sequence
  Synthetic Polynucleotide
taatacgactcactatagggatgaggactgcagtcctatgtcccagatcaaacagaggagatgatctatgacataggacaacctggcggcagcgcaaaagatg

SEQ ID NO: 27989 - DNA, 103 bp, Artificial Sequence
  Synthetic Polynucleotide
taatacgactcactatagggagtacatgaggactgcagtcctatgtcccaaacagaggagatgggacatgggactgcagaacctggcggcagcgcaaaagatg

SEQ ID NO: 27990 - DNA, 103 bp, Artificial Sequence
  Synthetic Polynucleotide
taatacgactcactatagggaccatagtacatgaggactgcagtcctatgaacagaggagacataggatggcagtcctcaacctggcggcagcgcaaaagatg

SEQ ID NO: 27991 - DNA, 103 bp, Artificial Sequence
  Synthetic Polynucleotide
taatacgactcactataggggcactaccatagtacatgaggactgcagtcaacagaggagagactgcatgcctcatgtaaacctggcggcagcgcaaaagatg

SEQ ID NO: 27992 - DNA, 103 bp, Artificial Sequence
  Synthetic Polynucleotide
taatacgactcactatagggttctcgaagtacataagcggataacggatcaacagaggagagatccgatgtccgcttataacctggcggcagcgcaaaagatg

SEQ ID NO: 27993 - DNA, 103 bp, Artificial Sequence
  Synthetic Polynucleotide
taatacgactcactatagggccatggcactaccatagtacatgaggactgaacagaggagacagtccatgtgtactatgaacctggcggcagcgcaaaagatg

SEQ ID NO: 27994 - DNA, 103 bp, Artificial Sequence
  Synthetic Polynucleotide
taatacgactcactatagggctaatccatggcactaccatagtacatgagaacagaggagactcatgatgtatggtagtaacctggcggcagcgcaaaagatg

SEQ ID NO: 27995 - DNA, 103 bp, Artificial Sequence
  Synthetic Polynucleotide
taatacgactcactatagggtgttgctaatccatggcactaccatagtacaacagaggagagtactaatgtagtgccataacctggcggcagcgcaaaagatg

SEQ ID NO: 27996 - DNA, 103 bp, Artificial Sequence
  Synthetic Polynucleotide
taatacgactcactatagggcgtggtgttgctaatccatggcactaccataacagaggagaatggtaatgccatggattaacctggcggcagcgcaaaagatg

SEQ ID NO: 27997 - DNA, 103 bp, Artificial Sequence
  Synthetic Polynucleotide
taatacgactcactatagggcgatacgtggtgttgctaatccatggcactaacagaggagaagtgccatggattagcaaaacctggcggcagcgcaaaagatg

SEQ ID NO: 27998 - DNA, 103 bp, Artificial Sequence
  Synthetic Polynucleotide
taatacgactcactatagggtttgccgatacgtggtgttgctaatccatgaacagaggagacatggaatggcaacaccaaacctggcggcagcgcaaaagatg

SEQ ID NO: 27999 - DNA, 103 bp, Artificial Sequence
  Synthetic Polynucleotide
taatacgactcactatagggtatggtttgccgatacgtggtgttgctaataacagaggagaattagcatgaccacgtataacctggcggcagcgcaaaagatg

SEQ ID NO: 28000 - DNA, 103 bp, Artificial Sequence
  Synthetic Polynucleotide
taatacgactcactatagggtcatctatggtttgccgatacgtggtgttgaacagaggagacaacacatggtatcggcaaacctggcggcagcgcaaaagatg

SEQ ID NO: 28001 - DNA, 103 bp, Artificial Sequence
  Synthetic Polynucleotide
taatacgactcactatagggaactatcatctatggtttgccgatacgtggaacagaggagaccacgtatgggcaaaccaaacctggcggcagcgcaaaagatg

SEQ ID NO: 28002 - DNA, 103 bp, Artificial Sequence
  Synthetic Polynucleotide
taatacgactcactatagggggtgaaactatcatctatggtttgccgataaacagaggagatatcggatgaccatagataacctggcggcagcgcaaaagatg

SEQ ID NO: 28003 - DNA, 103 bp, Artificial Sequence
  Synthetic Polynucleotide
taatacgactcactatagggtgggcttctcgaagtacataagcggataacaacagaggagagttatcatgttatgtactaacctggcggcagcgcaaaagatg

SEQ ID NO: 28004 - DNA, 103 bp, Artificial Sequence
  Synthetic Polynucleotide
taatacgactcactatagggccttcggtgaaactatcatctatggtttgcaacagaggagagcaaacatgagatgatagaacctggcggcagcgcaaaagatg

SEQ ID NO: 28005 - DNA, 103 bp, Artificial Sequence
  Synthetic Polynucleotide
taatacgactcactatagggatccgccttcggtgaaactatcatctatggaacagaggagaccatagatgatagtttcaaacctggcggcagcgcaaaagatg

SEQ ID NO: 28006 - DNA, 103 bp, Artificial Sequence
  Synthetic Polynucleotide
taatacgactcactataggggatgtatccgccttcggtgaaactatcatcaacagaggagagatgatatgttcaccgaaaacctggcggcagcgcaaaagatg

SEQ ID NO: 28007 - DNA, 103 bp, Artificial Sequence
  Synthetic Polynucleotide
taatacgactcactatagggacgctgatgtatccgccttcggtgaaactaaacagaggagatagtttatgcgaaggcggaacctggcggcagcgcaaaagatg

SEQ ID NO: 28008 - DNA, 103 bp, Artificial Sequence
  Synthetic Polynucleotide
taatacgactcactatagggagaagacgctgatgtatccgccttcggtgaaacagaggagatcaccgatggcggatacaaacctggcggcagcgcaaaagatg

SEQ ID NO: 28009 - DNA, 103 bp, Artificial Sequence
  Synthetic Polynucleotide
taatacgactcactatagggttggtagaagacgctgatgtatccgccttcaacagaggagagaaggcatgtacatcagcaacctggcggcagcgcaaaagatg

SEQ ID NO: 28010 - DNA, 103 bp, Artificial Sequence
  Synthetic Polynucleotide
taatacgactcactatagggctagtttggtagaagacgctgatgtatccgaacagaggagacggataatgcagcgtcttaacctggcggcagcgcaaaagatg

SEQ ID NO: 28011 - DNA, 103 bp, Artificial Sequence
  Synthetic Polynucleotide
taatacgactcactatagggctattctagtttggtagaagacgctgatgtaacagaggagaacatcaatgtcttctaccaacctggcggcagcgcaaaagatg

SEQ ID NO: 28012 - DNA, 103 bp, Artificial Sequence
  Synthetic Polynucleotide
taatacgactcactataggggacgactattctagtttggtagaagacgctaacagaggagaagcgtcatgtaccaaactaacctggcggcagcgcaaaagatg

SEQ ID NO: 28013 - DNA, 103 bp, Artificial Sequence
  Synthetic Polynucleotide
taatacgactcactatagggagagggacgactattctagtttggtagaagaacagaggagacttctaatgaactagaataacctggcggcagcgcaaaagatg

SEQ ID NO: 28014 - DNA, 103 bp, Artificial Sequence
  Synthetic Polynucleotide
taatacgactcactatagggggtactgggcttctcgaagtacataagcggaacagaggagaccgcttatgtacttcgagaacctggcggcagcgcaaaagatg

SEQ ID NO: 28015 - DNA, 103 bp, Artificial Sequence
  Synthetic Polynucleotide
taatacgactcactatagggtcgaaagagggacgactattctagtttggtaacagaggagaaccaaaatggaatagtcgaacctggcggcagcgcaaaagatg

SEQ ID NO: 28016 - DNA, 103 bp, Artificial Sequence
  Synthetic Polynucleotide
taatacgactcactataggggggtgtcgaaagagggacgactattctagtaacagaggagaactagaatggtcgtccctaacctggcggcagcgcaaaagatg

SEQ ID NO: 28017 - DNA, 103 bp, Artificial Sequence
  Synthetic Polynucleotide
taatacgactcactatagggtctctgggtgtcgaaagagggacgactattaacagaggagaaatagtatgccctctttcaacctggcggcagcgcaaaagatg

SEQ ID NO: 28018 - DNA, 103 bp, Artificial Sequence
  Synthetic Polynucleotide
taatacgactcactatagggccatctctctgggtgtcgaaagagggacgaaacagaggagatcgtccatgtttcgacacaacctggcggcagcgcaaaagatg

SEQ ID NO: 28019 - DNA, 103 bp, Artificial Sequence
  Synthetic Polynucleotide
taatacgactcactataggggatgtccatctctctgggtgtcgaaagaggaacagaggagacctcttatgacacccagaaacctggcggcagcgcaaaagatg

SEQ ID NO: 28020 - DNA, 103 bp, Artificial Sequence
  Synthetic Polynucleotide
taatacgactcactatagggccaaggatgtccatctctctgggtgtcgaaaacagaggagattcgacatgcagagagataacctggcggcagcgcaaaagatg

SEQ ID NO: 28021 - DNA, 103 bp, Artificial Sequence
  Synthetic Polynucleotide
taatacgactcactatagggcaaaaccaaggatgtccatctctctgggtgaacagaggagacacccaatgagatggacaaacctggcggcagcgcaaaagatg

SEQ ID NO: 28022 - DNA, 103 bp, Artificial Sequence
  Synthetic Polynucleotide
taatacgactcactatagggtgacacaaaaccaaggatgtccatctctctaacagaggagaagagagatggacatccttaacctggcggcagcgcaaaagatg

SEQ ID NO: 28023 - DNA, 103 bp, Artificial Sequence
  Synthetic Polynucleotide
taatacgactcactatagggcacgctgacacaaaaccaaggatgtccatcaacagaggagagatggaatgccttggtttaacctggcggcagcgcaaaagatg

SEQ ID NO: 28024 - DNA, 103 bp, Artificial Sequence
  Synthetic Polynucleotide
taatacgactcactatagggcattacacgctgacacaaaaccaaggatgtaacagaggagaacatccatggttttgtgtaacctggcggcagcgcaaaagatg

SEQ ID NO: 28025 - DNA, 103 bp, Artificial Sequence
  Synthetic Polynucleotide
taatacgactcactataggggaggtggtactgggcttctcgaagtacataaacagaggagatatgtaatgcgagaagccaacctggcggcagcgcaaaagatg

SEQ ID NO: 28026 - DNA, 103 bp, Artificial Sequence
  Synthetic Polynucleotide
taatacgactcactataggggaagtcattacacgctgacacaaaaccaagaacagaggagacttggtatggtgtcagcgaacctggcggcagcgcaaaagatg

SEQ ID NO: 28027 - DNA, 103 bp, Artificial Sequence
  Synthetic Polynucleotide
taatacgactcactatagggacgctgaagtcattacacgctgacacaaaaaacagaggagattttgtatgagcgtgtaaaacctggcggcagcgcaaaagatg

SEQ ID NO: 28028 - DNA, 103 bp, Artificial Sequence
  Synthetic Polynucleotide
taatacgactcactatagggagcgcacgctgaagtcattacacgctgacaaacagaggagatgtcagatggtaatgactaacctggcggcagcgcaaaagatg

SEQ ID NO: 28029 - DNA, 103 bp, Artificial Sequence
  Synthetic Polynucleotide
taatacgactcactatagggcaacaagcgcacgctgaagtcattacacgcaacagaggagagcgtgtatggacttcagcaacctggcggcagcgcaaaagatg

SEQ ID NO: 28030 - DNA, 103 bp, Artificial Sequence
  Synthetic Polynucleotide
taatacgactcactatagggtctcgcaacaagcgcacgctgaagtcattaaacagaggagataatgaatgcagcgtgcgaacctggcggcagcgcaaaagatg

SEQ ID NO: 28031 - DNA, 103 bp, Artificial Sequence
  Synthetic Polynucleotide
taatacgactcactatagggtggtatctcgcaacaagcgcacgctgaagtaacagaggagaacttcaatgtgcgcttgtaacctggcggcagcgcaaaagatg

SEQ ID NO: 28032 - DNA, 103 bp, Artificial Sequence
  Synthetic Polynucleotide
taatacgactcactatagggatgtgtggtatctcgcaacaagcgcacgctaacagaggagaagcgtgatgttgttgcgaaacctggcggcagcgcaaaagatg

SEQ ID NO: 28033 - DNA, 103 bp, Artificial Sequence
  Synthetic Polynucleotide
taatacgactcactatagggtctatatgtgtggtatctcgcaacaagcgcaacagaggagagcgcttatggcgagatacaacctggcggcagcgcaaaagatg

SEQ ID NO: 28034 - DNA, 103 bp, Artificial Sequence
  Synthetic Polynucleotide
taatacgactcactatagggtttgctctatatgtgtggtatctcgcaacaaacagaggagatgttgcatgataccacacaacctggcggcagcgcaaaagatg

SEQ ID NO: 28035 - DNA, 103 bp, Artificial Sequence
  Synthetic Polynucleotide
taatacgactcactatagggcgctttttgctctatatgtgtggtatctcgaacagaggagacgagatatgacacatataaacctggcggcagcgcaaaagatg

SEQ ID NO: 28036 - DNA, 103 bp, Artificial Sequence
  Synthetic Polynucleotide
taatacgactcactatagggattccgaggtggtactgggcttctcgaagtaacagaggagaacttcgatgagcccagtaaacctggcggcagcgcaaaagatg

SEQ ID NO: 28037 - DNA, 103 bp, Artificial Sequence
  Synthetic Polynucleotide
taatacgactcactataggggctagcgctttttgctctatatgtgtggtaaacagaggagataccacatgtatagagcaaacctggcggcagcgcaaaagatg

SEQ ID NO: 28038 - DNA, 103 bp, Artificial Sequence
  Synthetic Polynucleotide
taatacgactcactatagggcctgtgctagcgctttttgctctatatgtgaacagaggagacacataatgagcaaaaagaacctggcggcagcgcaaaagatg

SEQ ID NO: 28039 - DNA, 103 bp, Artificial Sequence
  Synthetic Polynucleotide
taatacgactcactatagggtaacccctgtgctagcgctttttgctctataacagaggagaatagagatgaaagcgctaaacctggcggcagcgcaaaagatg

SEQ ID NO: 28040 - DNA, 103 bp, Artificial Sequence
  Synthetic Polynucleotide
taatacgactcactatagggtgacctaacccctgtgctagcgctttttgcaacagaggagagcaaaaatggctagcacaaacctggcggcagcgcaaaagatg

SEQ ID NO: 28041 - DNA, 103 bp, Artificial Sequence
  Synthetic Polynucleotide
taatacgactcactataggggcatctgacctaacccctgtgctagcgcttaacagaggagaaagcgcatgcacaggggtaacctggcggcagcgcaaaagatg

SEQ ID NO: 28042 - DNA, 103 bp, Artificial Sequence
  Synthetic Polynucleotide
taatacgactcactatagggttcaagcatctgacctaacccctgtgctagaacagaggagactagcaatggggttaggtaacctggcggcagcgcaaaagatg

SEQ ID NO: 28043 - DNA, 103 bp, Artificial Sequence
  Synthetic Polynucleotide
taatacgactcactatagggatgctttcaagcatctgacctaacccctgtaacagaggagaacagggatgaggtcagataacctggcggcagcgcaaaagatg

SEQ ID NO: 28044 - DNA, 103 bp, Artificial Sequence
  Synthetic Polynucleotide
taatacgactcactatagggcaatcatgctttcaagcatctgacctaaccaacagaggagaggttagatgagatgcttgaacctggcggcagcgcaaaagatg

SEQ ID NO: 28045 - DNA, 103 bp, Artificial Sequence
  Synthetic Polynucleotide
taatacgactcactataggggttgtcaatcatgctttcaagcatctgaccaacagaggagaggtcagatgcttgaaagcaacctggcggcagcgcaaaagatg

SEQ ID NO: 28046 - DNA, 103 bp, Artificial Sequence
  Synthetic Polynucleotide
taatacgactcactatagggactgtgttgtcaatcatgctttcaagcatcaacagaggagagatgctatgaagcatgataacctggcggcagcgcaaaagatg

SEQ ID NO: 28047 - DNA, 103 bp, Artificial Sequence
  Synthetic Polynucleotide
taatacgactcactatagggtagccgccacgtgggcctctggggtgggtaaacagaggagatacccaatgcagaggcccaacctggcggcagcgcaaaagatg

SEQ ID NO: 28048 - DNA, 103 bp, Artificial Sequence
  Synthetic Polynucleotide
taatacgactcactatagggcgaagattccgaggtggtactgggcttctcaacagaggagagagaagatgagtaccaccaacctggcggcagcgcaaaagatg

SEQ ID NO: 28049 - DNA, 103 bp, Artificial Sequence
  Synthetic Polynucleotide
taatacgactcactatagggcacggactgtgttgtcaatcatgctttcaaaacagaggagattgaaaatgtgattgacaaacctggcggcagcgcaaaagatg

SEQ ID NO: 28050 - DNA, 103 bp, Artificial Sequence
  Synthetic Polynucleotide
taatacgactcactatagggcgtttcacggactgtgttgtcaatcatgctaacagaggagaagcatgatggacaacacaaacctggcggcagcgcaaaagatg

SEQ ID NO: 28051 - DNA, 103 bp, Artificial Sequence
  Synthetic Polynucleotide
taatacgactcactatagggcccaccgtttcacggactgtgttgtcaatcaacagaggagagattgaatgcacagtccgaacctggcggcagcgcaaaagatg

SEQ ID NO: 28052 - DNA, 103 bp, Artificial Sequence
  Synthetic Polynucleotide
taatacgactcactatagggccgcccccaccgtttcacggactgtgttgtaacagaggagaacaacaatgtccgtgaaaaacctggcggcagcgcaaaagatg

SEQ ID NO: 28053 - DNA, 103 bp, Artificial Sequence
  Synthetic Polynucleotide
taatacgactcactatagggtgttgccgcccccaccgtttcacggactgtaacagaggagaacagtcatggaaacggtgaacctggcggcagcgcaaaagatg

SEQ ID NO: 28054 - DNA, 103 bp, Artificial Sequence
  Synthetic Polynucleotide
taatacgactcactatagggctagatgttgccgcccccaccgtttcacggaacagaggagaccgtgaatgggtgggggcaacctggcggcagcgcaaaagatg

SEQ ID NO: 28055 - DNA, 103 bp, Artificial Sequence
  Synthetic Polynucleotide
taatacgactcactatagggcgtctctagatgttgccgcccccaccgtttaacagaggagaaaacggatggggcggcaaaacctggcggcagcgcaaaagatg

SEQ ID NO: 28056 - DNA, 103 bp, Artificial Sequence
  Synthetic Polynucleotide
taatacgactcactataggggagagcgtctctagatgttgccgcccccacaacagaggagagtggggatggcaacatctaacctggcggcagcgcaaaagatg

SEQ ID NO: 28057 - DNA, 103 bp, Artificial Sequence
  Synthetic Polynucleotide
taatacgactcactatagggtttgggagagcgtctctagatgttgccgccaacagaggagaggcggcatgatctagagaaacctggcggcagcgcaaaagatg

SEQ ID NO: 28058 - DNA, 103 bp, Artificial Sequence
  Synthetic Polynucleotide
taatacgactcactatagggcagtgtttgggagagcgtctctagatgttgaacagaggagacaacatatggagacgctcaacctggcggcagcgcaaaagatg

SEQ ID NO: 28059 - DNA, 103 bp, Artificial Sequence
  Synthetic Polynucleotide
taatacgactcactatagggcgcatcgaagattccgaggtggtactgggcaacagaggagagcccagatgcacctcggaaacctggcggcagcgcaaaagatg

SEQ ID NO: 28060 - DNA, 103 bp, Artificial Sequence
  Synthetic Polynucleotide
taatacgactcactatagggggcttcagtgtttgggagagcgtctctagaaacagaggagatctagaatggctctcccaaacctggcggcagcgcaaaagatg

SEQ ID NO: 28061 - DNA, 103 bp, Artificial Sequence
  Synthetic Polynucleotide
taatacgactcactatagggccactggcttcagtgtttgggagagcgtctaacagaggagaagacgcatgcccaaacacaacctggcggcagcgcaaaagatg

SEQ ID NO: 28062 - DNA, 103 bp, Artificial Sequence
  Synthetic Polynucleotide
taatacgactcactatagggttggtccactggcttcagtgtttgggagagaacagaggagactctccatgacactgaagaacctggcggcagcgcaaaagatg

SEQ ID NO: 28063 - DNA, 103 bp, Artificial Sequence
  Synthetic Polynucleotide
taatacgactcactataggggtgtgttggtccactggcttcagtgtttggaacagaggagaccaaacatggaagccagtaacctggcggcagcgcaaaagatg

SEQ ID NO: 28064 - DNA, 103 bp, Artificial Sequence
  Synthetic Polynucleotide
taatacgactcactatagggttggagtgtgttggtccactggcttcagtgaacagaggagacactgaatgcagtggaccaacctggcggcagcgcaaaagatg

SEQ ID NO: 28065 - DNA, 103 bp, Artificial Sequence
  Synthetic Polynucleotide
taatacgactcactatagggtttccttggagtgtgttggtccactggcttaacagaggagaaagccaatggaccaacacaacctggcggcagcgcaaaagatg

SEQ ID NO: 28066 - DNA, 103 bp, Artificial Sequence
  Synthetic Polynucleotide
taatacgactcactatagggcggaatttccttggagtgtgttggtccactaacagaggagaagtggaatgacacactccaacctggcggcagcgcaaaagatg

SEQ ID NO: 28067 - DNA, 103 bp, Artificial Sequence
  Synthetic Polynucleotide
taatacgactcactatagggagtgccggaatttccttggagtgtgttggtaacagaggagaaccaacatgctccaaggaaacctggcggcagcgcaaaagatg

SEQ ID NO: 28068 - DNA, 103 bp, Artificial Sequence
  Synthetic Polynucleotide
taatacgactcactatagggcggtgagtgccggaatttccttggagtgtgaacagaggagacacactatgaggaaattcaacctggcggcagcgcaaaagatg

SEQ ID NO: 28069 - DNA, 103 bp, Artificial Sequence
  Synthetic Polynucleotide
taatacgactcactatagggcactgcggtgagtgccggaatttccttggaaacagaggagatccaagatgattccggcaaacctggcggcagcgcaaaagatg

SEQ ID NO: 28070 - DNA, 103 bp, Artificial Sequence
  Synthetic Polynucleotide
taatacgactcactatagggcgcaacgcatcgaagattccgaggtggtacaacagaggagagtaccaatgcggaatcttaacctggcggcagcgcaaaagatg

SEQ ID NO: 28071 - DNA, 103 bp, Artificial Sequence
  Synthetic Polynucleotide
taatacgactcactataggggtttccactgcggtgagtgccggaatttccaacagaggagaggaaatatgggcactcacaacctggcggcagcgcaaaagatg

SEQ ID NO: 28072 - DNA, 103 bp, Artificial Sequence
  Synthetic Polynucleotide
taatacgactcactatagggccccagtttccactgcggtgagtgccggaaaacagaggagattccggatgtcaccgcagaacctggcggcagcgcaaaagatg

SEQ ID NO: 28073 - DNA, 103 bp, Artificial Sequence
  Synthetic Polynucleotide
taatacgactcactatagggtgtggccccagtttccactgcggtgagtgcaacagaggagagcactcatggcagtggaaaacctggcggcagcgcaaaagatg

SEQ ID NO: 28074 - DNA, 103 bp, Artificial Sequence
  Synthetic Polynucleotide
taatacgactcactatagggggatttgtggccccagtttccactgcggtgaacagaggagacaccgcatgggaaactggaacctggcggcagcgcaaaagatg

SEQ ID NO: 28075 - DNA, 103 bp, Artificial Sequence
  Synthetic Polynucleotide
taatacgactcactatagggctagtggatttgtggccccagtttccactgaacagaggagacagtggatgctggggccaaacctggcggcagcgcaaaagatg

SEQ ID NO: 28076 - DNA, 103 bp, Artificial Sequence
  Synthetic Polynucleotide
taatacgactcactatagggagggactagtggatttgtggccccagtttcaacagaggagagaaactatggccacaaataacctggcggcagcgcaaaagatg

SEQ ID NO: 28077 - DNA, 103 bp, Artificial Sequence
  Synthetic Polynucleotide
taatacgactcactatagggtcagaagggactagtggatttgtggccccaaacagaggagatggggcatgaaatccactaacctggcggcagcgcaaaagatg

SEQ ID NO: 28078 - DNA, 103 bp, Artificial Sequence
  Synthetic Polynucleotide
taatacgactcactatagggctgtatcagaagggactagtggatttgtggaacagaggagaccacaaatgcactagtccaacctggcggcagcgcaaaagatg

SEQ ID NO: 28079 - DNA, 103 bp, Artificial Sequence
  Synthetic Polynucleotide
taatacgactcactatagggttgcactgtatcagaagggactagtggattaacagaggagaaatccaatggtcccttctaacctggcggcagcgcaaaagatg

SEQ ID NO: 28080 - DNA, 103 bp, Artificial Sequence
  Synthetic Polynucleotide
taatacgactcactatagggctggtttgcactgtatcagaagggactagtaacagaggagaactagtatgttctgatacaacctggcggcagcgcaaaagatg

SEQ ID NO: 28081 - DNA, 103 bp, Artificial Sequence
  Synthetic Polynucleotide
taatacgactcactatagggctgagcgcaacgcatcgaagattccgaggtaacagaggagaacctcgatgtcttcgatgaacctggcggcagcgcaaaagatg

SEQ ID NO: 28082 - DNA, 103 bp, Artificial Sequence
  Synthetic Polynucleotide
taatacgactcactatagggcatgtctggtttgcactgtatcagaagggaaacagaggagatcccttatgatacagtgcaacctggcggcagcgcaaaagatg

SEQ ID NO: 28083 - DNA, 103 bp, Artificial Sequence
  Synthetic Polynucleotide
taatacgactcactatagggtacaacatgtctggtttgcactgtatcagaaacagaggagatctgatatggtgcaaaccaacctggcggcagcgcaaaagatg

SEQ ID NO: 28084 - DNA, 103 bp, Artificial Sequence
  Synthetic Polynucleotide
taatacgactcactatagggtgttgtacaacatgtctggtttgcactgtaaacagaggagatacagtatgaaccagacaaacctggcggcagcgcaaaagatg

SEQ ID NO: 28085 - DNA, 103 bp, Artificial Sequence
  Synthetic Polynucleotide
taatacgactcactatagggacctatgttgtacaacatgtctggtttgcaaacagaggagatgcaaaatggacatgttgaacctggcggcagcgcaaaagatg

SEQ ID NO: 28086 - DNA, 103 bp, Artificial Sequence
  Synthetic Polynucleotide
taatacgactcactatagggccttgacctatgttgtacaacatgtctggtaacagaggagaaccagaatggttgtacaaaacctggcggcagcgcaaaagatg

SEQ ID NO: 28087 - DNA, 103 bp, Artificial Sequence
  Synthetic Polynucleotide
taatacgactcactatagggtctgaccttgacctatgttgtacaacatgtaacagaggagaacatgtatgacaacatagaacctggcggcagcgcaaaagatg

SEQ ID NO: 28088 - DNA, 103 bp, Artificial Sequence
  Synthetic Polynucleotide
taatacgactcactatagggtagactctgaccttgacctatgttgtacaaaacagaggagattgtacatgataggtcaaaacctggcggcagcgcaaaagatg

SEQ ID NO: 28089 - DNA, 103 bp, Artificial Sequence
  Synthetic Polynucleotide
taatacgactcactatagggtatgctagactctgaccttgacctatgttgaacagaggagacaacatatgtcaaggtcaaacctggcggcagcgcaaaagatg

SEQ ID NO: 28090 - DNA, 103 bp, Artificial Sequence
  Synthetic Polynucleotide
taatacgactcactataggggactctatgctagactctgaccttgacctaaacagaggagataggtcatggtcagagtcaacctggcggcagcgcaaaagatg

SEQ ID NO: 28091 - DNA, 103 bp, Artificial Sequence
  Synthetic Polynucleotide
taatacgactcactatagggagaaagactctatgctagactctgaccttgaacagaggagacaaggtatgagtctagcaaacctggcggcagcgcaaaagatg

SEQ ID NO: 28092 - DNA, 103 bp, Artificial Sequence
  Synthetic Polynucleotide
taatacgactcactataggggagtgctgagcgcaacgcatcgaagattccaacagaggagaggaatcatggatgcgttgaacctggcggcagcgcaaaagatg

SEQ ID NO: 28093 - DNA, 103 bp, Artificial Sequence
  Synthetic Polynucleotide
taatacgactcactatagggcgcgaagaaagactctatgctagactctgaaacagaggagatcagagatgagcatagagaacctggcggcagcgcaaaagatg

SEQ ID NO: 28094 - DNA, 103 bp, Artificial Sequence
  Synthetic Polynucleotide
taatacgactcactatagggccccgcgcgaagaaagactctatgctagacaacagaggagagtctagatgagagtctttaacctggcggcagcgcaaaagatg

SEQ ID NO: 28095 - DNA, 103 bp, Artificial Sequence
  Synthetic Polynucleotide
taatacgactcactatagggatgcaccccgcgcgaagaaagactctatgcaacagaggagagcatagatgctttcttcgaacctggcggcagcgcaaaagatg

SEQ ID NO: 28096 - DNA, 103 bp, Artificial Sequence
  Synthetic Polynucleotide
taatacgactcactatagggcacgcatgcaccccgcgcgaagaaagactcaacagaggagagagtctatgttcgcgcggaacctggcggcagcgcaaaagatg

SEQ ID NO: 28097 - DNA, 103 bp, Artificial Sequence
  Synthetic Polynucleotide
taatacgactcactatagggatggtcacgcatgcaccccgcgcgaagaaaaacagaggagatttcttatggcggggtgcaacctggcggcagcgcaaaagatg

SEQ ID NO: 28098 - DNA, 103 bp, Artificial Sequence
  Synthetic Polynucleotide
taatacgactcactatagggtcataatggtcacgcatgcaccccgcgcgaaacagaggagatcgcgcatggtgcatgcgaacctggcggcagcgcaaaagatg

SEQ ID NO: 28099 - DNA, 103 bp, Artificial Sequence
  Synthetic Polynucleotide
taatacgactcactatagggcacggtcataatggtcacgcatgcaccccgaacagaggagacggggtatgtgcgtgaccaacctggcggcagcgcaaaagatg

SEQ ID NO: 28100 - DNA, 103 bp, Artificial Sequence
  Synthetic Polynucleotide
taatacgactcactatagggttatccacggtcataatggtcacgcatgcaaacagaggagatgcatgatggaccattataacctggcggcagcgcaaaagatg

SEQ ID NO: 28101 - DNA, 103 bp, Artificial Sequence
  Synthetic Polynucleotide
taatacgactcactatagggctgggttatccacggtcataatggtcacgcaacagaggagagcgtgaatgttatgaccgaacctggcggcagcgcaaaagatg

SEQ ID NO: 28102 - DNA, 103 bp, Artificial Sequence
  Synthetic Polynucleotide
taatacgactcactatagggggaagctgggttatccacggtcataatggtaacagaggagaaccattatgaccgtggataacctggcggcagcgcaaaagatg

SEQ ID NO: 28103 - DNA, 103 bp, Artificial Sequence
  Synthetic Polynucleotide
taatacgactcactataggggggttgagtgctgagcgcaacgcatcgaagaacagaggagacttcgaatggttgcgctcaacctggcggcagcgcaaaagatg

SEQ ID NO: 28104 - DNA, 103 bp, Artificial Sequence
  Synthetic Polynucleotide
taatacgactcactataggggtggtggaagctgggttatccacggtcataaacagaggagatatgacatgggataacccaacctggcggcagcgcaaaagatg

SEQ ID NO: 28105 - DNA, 103 bp, Artificial Sequence
  Synthetic Polynucleotide
taatacgactcactatagggtattcgtggtggaagctgggttatccacggaacagaggagaccgtggatgacccagcttaacctggcggcagcgcaaaagatg

SEQ ID NO: 28106 - DNA, 103 bp, Artificial Sequence
  Synthetic Polynucleotide
taatacgactcactatagggatccttattcgtggtggaagctgggttatcaacagaggagagataacatggcttccaccaacctggcggcagcgcaaaagatg

SEQ ID NO: 28107 - DNA, 103 bp, Artificial Sequence
  Synthetic Polynucleotide
taatacgactcactatagggagcttatccttattcgtggtggaagctgggaacagaggagacccagcatgcaccacgaaaacctggcggcagcgcaaaagatg

SEQ ID NO: 28108 - DNA, 103 bp, Artificial Sequence
  Synthetic Polynucleotide
taatacgactcactatagggcaaatagcttatccttattcgtggtggaagaacagaggagacttccaatgcgaataaggaacctggcggcagcgcaaaagatg

SEQ ID NO: 28109 - DNA, 103 bp, Artificial Sequence
  Synthetic Polynucleotide
taatacgactcactatagggcactgcaaatagcttatccttattcgtggtaacagaggagaaccacgatgaaggataagaacctggcggcagcgcaaaagatg

SEQ ID NO: 28110 - DNA, 103 bp, Artificial Sequence
  Synthetic Polynucleotide
taatacgactcactatagggttccacactgcaaatagcttatccttattcaacagaggagagaataaatgtaagctattaacctggcggcagcgcaaaagatg

SEQ ID NO: 28111 - DNA, 103 bp, Artificial Sequence
  Synthetic Polynucleotide
taatacgactcactatagggtgatcttccacactgcaaatagcttatcctaacagaggagaaggataatgtatttgcagaacctggcggcagcgcaaaagatg

SEQ ID NO: 28112 - DNA, 103 bp, Artificial Sequence
  Synthetic Polynucleotide
taatacgactcactatagggataagtgatcttccacactgcaaatagcttaacagaggagaaagctaatggcagtgtggaacctggcggcagcgcaaaagatg

SEQ ID NO: 28113 - DNA, 103 bp, Artificial Sequence
  Synthetic Polynucleotide
taatacgactcactatagggtctttataagtgatcttccacactgcaaataacagaggagaatttgcatggtggaagataacctggcggcagcgcaaaagatg

SEQ ID NO: 28114 - DNA, 103 bp, Artificial Sequence
  Synthetic Polynucleotide
taatacgactcactatagggctctggggttgagtgctgagcgcaacgcataacagaggagaatgcgtatggctcagcacaacctggcggcagcgcaaaagatg

SEQ ID NO: 28115 - DNA, 103 bp, Artificial Sequence
  Synthetic Polynucleotide
taatacgactcactatagggcagtatctttataagtgatcttccacactgaacagaggagacagtgtatgagatcacttaacctggcggcagcgcaaaagatg

SEQ ID NO: 28116 - DNA, 103 bp, Artificial Sequence
  Synthetic Polynucleotide
taatacgactcactatagggctggacagtatctttataagtgatcttccaaacagaggagatggaagatgacttataaaaacctggcggcagcgcaaaagatg

SEQ ID NO: 28117 - DNA, 103 bp, Artificial Sequence
  Synthetic Polynucleotide
taatacgactcactatagggcgtaactggacagtatctttataagtgatcaacagaggagagatcacatgtaaagatacaacctggcggcagcgcaaaagatg

SEQ ID NO: 28118 - DNA, 103 bp, Artificial Sequence
  Synthetic Polynucleotide
taatacgactcactatagggtcctccgtaactggacagtatctttataagaacagaggagacttataatgatactgtccaacctggcggcagcgcaaaagatg

SEQ ID NO: 28119 - DNA, 103 bp, Artificial Sequence
  Synthetic Polynucleotide
taatacgactcactatagggcaatttcctccgtaactggacagtatctttaacagaggagaaaagatatggtccagttaaacctggcggcagcgcaaaagatg

SEQ ID NO: 28120 - DNA, 103 bp, Artificial Sequence
  Synthetic Polynucleotide
taatacgactcactatagggaactccaatttcctccgtaactggacagtaaacagaggagatactgtatggttacggagaacctggcggcagcgcaaaagatg

SEQ ID NO: 28121 - DNA, 103 bp, Artificial Sequence
  Synthetic Polynucleotide
taatacgactcactatagggtgaagaactccaatttcctccgtaactggaaacagaggagatccagtatgggaggaaataacctggcggcagcgcaaaagatg

SEQ ID NO: 28122 - DNA, 103 bp, Artificial Sequence
  Synthetic Polynucleotide
taatacgactcactatagggataggtgaagaactccaatttcctccgtaaaacagaggagattacggatgaaattggagaacctggcggcagcgcaaaagatg

SEQ ID NO: 28123 - DNA, 103 bp, Artificial Sequence
  Synthetic Polynucleotide
taatacgactcactatagggctagaataggtgaagaactccaatttcctcaacagaggagagaggaaatgggagttcttaacctggcggcagcgcaaaagatg

SEQ ID NO: 28124 - DNA, 103 bp, Artificial Sequence
  Synthetic Polynucleotide
taatacgactcactatagggcaaatctagaataggtgaagaactccaattaacagaggagaaattggatgtcttcacctaacctggcggcagcgcaaaagatg

SEQ ID NO: 28125 - DNA, 103 bp, Artificial Sequence
  Synthetic Polynucleotide
taatacgactcactatagggctacactctggggttgagtgctgagcgcaaaacagaggagattgcgcatggcactcaacaacctggcggcagcgcaaaagatg

SEQ ID NO: 28126 - DNA, 103 bp, Artificial Sequence
  Synthetic Polynucleotide
taatacgactcactatagggcatatcaaatctagaataggtgaagaactcaacagaggagagagttcatgacctattctaacctggcggcagcgcaaaagatg

SEQ ID NO: 28127 - DNA, 103 bp, Artificial Sequence
  Synthetic Polynucleotide
taatacgactcactatagggagttccatatcaaatctagaataggtgaagaacagaggagacttcacatgttctagattaacctggcggcagcgcaaaagatg

SEQ ID NO: 28128 - DNA, 103 bp, Artificial Sequence
  Synthetic Polynucleotide
taatacgactcactatagggaggtaagttccatatcaaatctagaataggaacagaggagacctattatggatttgataaacctggcggcagcgcaaaagatg

SEQ ID NO: 28129 - DNA, 103 bp, Artificial Sequence
  Synthetic Polynucleotide
taatacgactcactatagggcacaaaggtaagttccatatcaaatctagaaacagaggagatctagaatggatatggaaaacctggcggcagcgcaaaagatg

SEQ ID NO: 28130 - DNA, 103 bp, Artificial Sequence
  Synthetic Polynucleotide
taatacgactcactataggggtaaccacaaaggtaagttccatatcaaataacagaggagaatttgaatgggaacttacaacctggcggcagcgcaaaagatg

SEQ ID NO: 28131 - DNA, 103 bp, Artificial Sequence
  Synthetic Polynucleotide
taatacgactcactatagggttgcagtaaccacaaaggtaagttccatataacagaggagaatatggatgttacctttgaacctggcggcagcgcaaaagatg

SEQ ID NO: 28132 - DNA, 103 bp, Artificial Sequence
  Synthetic Polynucleotide
taatacgactcactataggggaaatttgcagtaaccacaaaggtaagttcaacagaggagagaacttatgtttgtggttaacctggcggcagcgcaaaagatg

SEQ ID NO: 28133 - DNA, 103 bp, Artificial Sequence
  Synthetic Polynucleotide
taatacgactcactatagggtcagtgaaatttgcagtaaccacaaaggtaaacagaggagataccttatgggttactgcaacctggcggcagcgcaaaagatg

SEQ ID NO: 28134 - DNA, 103 bp, Artificial Sequence
  Synthetic Polynucleotide
taatacgactcactatagggtagtctcagtgaaatttgcagtaaccacaaaacagaggagattgtggatgctgcaaattaacctggcggcagcgcaaaagatg

SEQ ID NO: 28135 - DNA, 103 bp, Artificial Sequence
  Synthetic Polynucleotide
taatacgactcactatagggattgttagtctcagtgaaatttgcagtaacaacagaggagagttactatgaatttcactaacctggcggcagcgcaaaagatg

SEQ ID NO: 28136 - DNA, 103 bp, Artificial Sequence
  Synthetic Polynucleotide
taatacgactcactatagggctaagctacactctggggttgagtgctgagaacagaggagactcagcatgcaaccccagaacctggcggcagcgcaaaagatg

SEQ ID NO: 28137 - DNA, 103 bp, Artificial Sequence
  Synthetic Polynucleotide
taatacgactcactatagggtgcccattgttagtctcagtgaaatttgcaaacagaggagatgcaaaatgcactgagacaacctggcggcagcgcaaaagatg

SEQ ID NO: 28138 - DNA, 103 bp, Artificial Sequence
  Synthetic Polynucleotide
taatacgactcactatagggaggcatgcccattgttagtctcagtgaaataacagaggagaatttcaatgagactaacaaacctggcggcagcgcaaaagatg

SEQ ID NO: 28139 - DNA, 103 bp, Artificial Sequence
  Synthetic Polynucleotide
taatacgactcactatagggatttaaggcatgcccattgttagtctcagtaacagaggagaactgagatgaacaatgggaacctggcggcagcgcaaaagatg

SEQ ID NO: 28140 - DNA, 103 bp, Artificial Sequence
  Synthetic Polynucleotide
taatacgactcactatagggacttgatttaaggcatgcccattgttagtcaacagaggagagactaaatgtgggcatgcaacctggcggcagcgcaaaagatg

SEQ ID NO: 28141 - DNA, 103 bp, Artificial Sequence
  Synthetic Polynucleotide
taatacgactcactatagggggtacacttgatttaaggcatgcccattgtaacagaggagaacaatgatgatgccttaaaacctggcggcagcgcaaaagatg

SEQ ID NO: 28142 - DNA, 103 bp, Artificial Sequence
  Synthetic Polynucleotide
taatacgactcactatagggaatttggtacacttgatttaaggcatgcccaacagaggagagggcatatgttaaatcaaaacctggcggcagcgcaaaagatg

SEQ ID NO: 28143 - DNA, 103 bp, Artificial Sequence
  Synthetic Polynucleotide
taatacgactcactatagggtacataatttggtacacttgatttaaggcaaacagaggagatgccttatgtcaagtgtaaacctggcggcagcgcaaaagatg

SEQ ID NO: 28144 - DNA, 103 bp, Artificial Sequence
  Synthetic Polynucleotide
taatacgactcactataggggtacgtacataatttggtacacttgatttaaacagaggagataaatcatgtgtaccaaaaacctggcggcagcgcaaaagatg

SEQ ID NO: 28145 - DNA, 103 bp, Artificial Sequence
  Synthetic Polynucleotide
taatacgactcactatagggtggtggtacgtacataatttggtacacttgaacagaggagacaagtgatgcaaattatgaacctggcggcagcgcaaaagatg

SEQ ID NO: 28146 - DNA, 103 bp, Artificial Sequence
  Synthetic Polynucleotide
taatacgactcactataggggcgcctggtggtacgtacataatttggtacaacagaggagagtaccaatgtatgtacgtaacctggcggcagcgcaaaagatg

SEQ ID NO: 28147 - DNA, 103 bp, Artificial Sequence
  Synthetic Polynucleotide
taatacgactcactatagggtcagcctaagctacactctggggttgagtgaacagaggagacactcaatgccagagtgtaacctggcggcagcgcaaaagatg

SEQ ID NO: 28148 - DNA, 103 bp, Artificial Sequence
  Synthetic Polynucleotide
taatacgactcactatagggctggagcgcctggtggtacgtacataatttaacagaggagaaaattaatgacgtaccacaacctggcggcagcgcaaaagatg

SEQ ID NO: 28149 - DNA, 103 bp, Artificial Sequence
  Synthetic Polynucleotide
taatacgactcactataggggggcactggagcgcctggtggtacgtacataacagaggagaatgtacatgccaccaggcaacctggcggcagcgcaaaagatg

SEQ ID NO: 28150 - DNA, 103 bp, Artificial Sequence
  Synthetic Polynucleotide
taatacgactcactatagggttctcgggcactggagcgcctggtggtacgaacagaggagacgtaccatgaggcgctccaacctggcggcagcgcaaaagatg

SEQ ID NO: 28151 - DNA, 103 bp, Artificial Sequence
  Synthetic Polynucleotide
taatacgactcactatagggcccatttctcgggcactggagcgcctggtgaacagaggagacaccagatgctccagtgcaacctggcggcagcgcaaaagatg

SEQ ID NO: 28152 - DNA, 103 bp, Artificial Sequence
  Synthetic Polynucleotide
taatacgactcactataggggtcgtcccatttctcgggcactggagcgccaacagaggagaggcgctatggtgcccgagaacctggcggcagcgcaaaagatg

SEQ ID NO: 28153 - DNA, 103 bp, Artificial Sequence
  Synthetic Polynucleotide
taatacgactcactataggggtgtagtcgtcccatttctcgggcactggaaacagaggagatccagtatgcgagaaatgaacctggcggcagcgcaaaagatg

SEQ ID NO: 28154 - DNA, 103 bp, Artificial Sequence
  Synthetic Polynucleotide
taatacgactcactataggggccatgtgtagtcgtcccatttctcgggcaaacagaggagatgcccgatgaatgggacgaacctggcggcagcgcaaaagatg

SEQ ID NO: 28155 - DNA, 103 bp, Artificial Sequence
  Synthetic Polynucleotide
taatacgactcactatagggggtttgccatgtgtagtcgtcccatttctcaacagaggagagagaaaatggacgactacaacctggcggcagcgcaaaagatg

SEQ ID NO: 28156 - DNA, 103 bp, Artificial Sequence
  Synthetic Polynucleotide
taatacgactcactataggggatgaggtttgccatgtgtagtcgtcccataacagaggagaatgggaatgctacacatgaacctggcggcagcgcaaaagatg

SEQ ID NO: 28157 - DNA, 103 bp, Artificial Sequence
  Synthetic Polynucleotide
taatacgactcactataggggatttgatgaggtttgccatgtgtagtcgtaacagaggagaacgactatgcatggcaaaaacctggcggcagcgcaaaagatg

SEQ ID NO: 28158 - DNA, 103 bp, Artificial Sequence
  Synthetic Polynucleotide
taatacgactcactatagggagtactagccgccacgtgggcctctggggtaacagaggagaaccccaatggcccacgtgaacctggcggcagcgcaaaagatg

SEQ ID NO: 28159 - DNA, 103 bp, Artificial Sequence
  Synthetic Polynucleotide
taatacgactcactatagggactcatcagcctaagctacactctggggttaacagaggagaaaccccatggtgtagcttaacctggcggcagcgcaaaagatg

SEQ ID NO: 28160 - DNA, 103 bp, Artificial Sequence
  Synthetic Polynucleotide
taatacgactcactatagggtgatggatttgatgaggtttgccatgtgtaaacagaggagatacacaatgcaaacctcaaacctggcggcagcgcaaaagatg

SEQ ID NO: 28161 - DNA, 103 bp, Artificial Sequence
  Synthetic Polynucleotide
taatacgactcactatagggaagattgatggatttgatgaggtttgccataacagaggagaatggcaatgctcatcaaaaacctggcggcagcgcaaaagatg

SEQ ID NO: 28162 - DNA, 103 bp, Artificial Sequence
  Synthetic Polynucleotide
taatacgactcactatagggtgtaaaagattgatggatttgatgaggtttaacagaggagaaaacctatgcaaatccataacctggcggcagcgcaaaagatg

SEQ ID NO: 28163 - DNA, 103 bp, Artificial Sequence
  Synthetic Polynucleotide
taatacgactcactataggggtaggtgtaaaagattgatggatttgatgaaacagaggagatcatcaatgccatcaatcaacctggcggcagcgcaaaagatg

SEQ ID NO: 28164 - DNA, 103 bp, Artificial Sequence
  Synthetic Polynucleotide
taatacgactcactataggggttccgtaggtgtaaaagattgatggatttaacagaggagaaaatccatgaatcttttaaacctggcggcagcgcaaaagatg

SEQ ID NO: 28165 - DNA, 103 bp, Artificial Sequence
  Synthetic Polynucleotide
taatacgactcactataggggagctgttccgtaggtgtaaaagattgatgaacagaggagacatcaaatgtttacacctaacctggcggcagcgcaaaagatg

SEQ ID NO: 28166 - DNA, 103 bp, Artificial Sequence
  Synthetic Polynucleotide
taatacgactcactatagggggctggagctgttccgtaggtgtaaaagataacagaggagaatctttatgacctacggaaacctggcggcagcgcaaaagatg

SEQ ID NO: 28167 - DNA, 103 bp, Artificial Sequence
  Synthetic Polynucleotide
taatacgactcactatagggatccgggctggagctgttccgtaggtgtaaaacagaggagattacacatgcggaacagcaacctggcggcagcgcaaaagatg

SEQ ID NO: 28168 - DNA, 103 bp, Artificial Sequence
  Synthetic Polynucleotide
taatacgactcactatagggccgagatccgggctggagctgttccgtaggaacagaggagacctacgatgcagctccagaacctggcggcagcgcaaaagatg

SEQ ID NO: 28169 - DNA, 103 bp, Artificial Sequence
  Synthetic Polynucleotide
taatacgactcactatagggcggtaccgagatccgggctggagctgttccaacagaggagaggaacaatgccagcccggaacctggcggcagcgcaaaagatg

SEQ ID NO: 28170 - DNA, 103 bp, Artificial Sequence
  Synthetic Polynucleotide
taatacgactcactatagggtccagactcatcagcctaagctacactctgaacagaggagacagagtatggcttaggctaacctggcggcagcgcaaaagatg

SEQ ID NO: 28171 - DNA, 103 bp, Artificial Sequence
  Synthetic Polynucleotide
taatacgactcactatagggacatacggtaccgagatccgggctggagctaacagaggagaagctccatgccggatctcaacctggcggcagcgcaaaagatg

SEQ ID NO: 28172 - DNA, 103 bp, Artificial Sequence
  Synthetic Polynucleotide
taatacgactcactatagggtaccaacatacggtaccgagatccgggctgaacagaggagacagcccatgtctcggtacaacctggcggcagcgcaaaagatg

SEQ ID NO: 28173 - DNA, 103 bp, Artificial Sequence
  Synthetic Polynucleotide
taatacgactcactatagggcgaaataccaacatacggtaccgagatccgaacagaggagacggatcatggtaccgtataacctggcggcagcgcaaaagatg

SEQ ID NO: 28174 - DNA, 103 bp, Artificial Sequence
  Synthetic Polynucleotide
taatacgactcactataggggcgttcgaaataccaacatacggtaccgagaacagaggagactcggtatggtatgttggaacctggcggcagcgcaaaagatg

SEQ ID NO: 28175 - DNA, 103 bp, Artificial Sequence
  Synthetic Polynucleotide
taatacgactcactatagggaataggcgttcgaaataccaacatacggtaaacagaggagataccgtatgttggtatttaacctggcggcagcgcaaaagatg

SEQ ID NO: 28176 - DNA, 103 bp, Artificial Sequence
  Synthetic Polynucleotide
taatacgactcactataggggtgtgaataggcgttcgaaataccaacataaacagaggagatatgttatgatttcgaacaacctggcggcagcgcaaaagatg

SEQ ID NO: 28177 - DNA, 103 bp, Artificial Sequence
  Synthetic Polynucleotide
taatacgactcactatagggtaaaagtgtgaataggcgttcgaaataccaaacagaggagatggtatatggaacgcctaaacctggcggcagcgcaaaagatg

SEQ ID NO: 28178 - DNA, 103 bp, Artificial Sequence
  Synthetic Polynucleotide
taatacgactcactatagggcgtcgtaaaagtgtgaataggcgttcgaaaaacagaggagatttcgaatgcctattcacaacctggcggcagcgcaaaagatg

SEQ ID NO: 28179 - DNA, 103 bp, Artificial Sequence
  Synthetic Polynucleotide
taatacgactcactatagggaaaaccgtcgtaaaagtgtgaataggcgttaacagaggagaaacgccatgtcacactttaacctggcggcagcgcaaaagatg

SEQ ID NO: 28180 - DNA, 103 bp, Artificial Sequence
  Synthetic Polynucleotide
taatacgactcactatagggttggaaaaaccgtcgtaaaagtgtgaatagaacagaggagactattcatgcttttacgaaacctggcggcagcgcaaaagatg

SEQ ID NO: 28181 - DNA, 103 bp, Artificial Sequence
  Synthetic Polynucleotide
taatacgactcactatagggggatgtccagactcatcagcctaagctacaaacagaggagatgtagcatgggctgatgaaacctggcggcagcgcaaaagatg

SEQ ID NO: 28182 - DNA, 103 bp, Artificial Sequence
  Synthetic Polynucleotide
taatacgactcactataggggtactttggaaaaaccgtcgtaaaagtgtgaacagaggagacacactatgacgacggttaacctggcggcagcgcaaaagatg

SEQ ID NO: 28183 - DNA, 103 bp, Artificial Sequence
  Synthetic Polynucleotide
taatacgactcactatagggcagtggtactttggaaaaaccgtcgtaaaaaacagaggagattttacatgggtttttccaacctggcggcagcgcaaaagatg

SEQ ID NO: 28184 - DNA, 103 bp, Artificial Sequence
  Synthetic Polynucleotide
taatacgactcactatagggtccttcagtggtactttggaaaaaccgtcgaacagaggagacgacggatgttccaaagtaacctggcggcagcgcaaaagatg

SEQ ID NO: 28185 - DNA, 103 bp, Artificial Sequence
  Synthetic Polynucleotide
taatacgactcactatagggactggtccttcagtggtactttggaaaaacaacagaggagagtttttatgaagtaccacaacctggcggcagcgcaaaagatg

SEQ ID NO: 28186 - DNA, 103 bp, Artificial Sequence
  Synthetic Polynucleotide
taatacgactcactatagggtgccgactggtccttcagtggtactttggaaacagaggagatccaaaatgccactgaagaacctggcggcagcgcaaaagatg

SEQ ID NO: 28187 - DNA, 103 bp, Artificial Sequence
  Synthetic Polynucleotide
taatacgactcactatagggagtgctgccgactggtccttcagtggtactaacagaggagaagtaccatggaaggaccaaacctggcggcagcgcaaaagatg

SEQ ID NO: 28188 - DNA, 103 bp, Artificial Sequence
  Synthetic Polynucleotide
taatacgactcactatagggcacctagtgctgccgactggtccttcagtgaacagaggagacactgaatgaccagtcggaacctggcggcagcgcaaaagatg

SEQ ID NO: 28189 - DNA, 103 bp, Artificial Sequence
  Synthetic Polynucleotide
taatacgactcactatagggggagtcacctagtgctgccgactggtccttaacagaggagaaaggacatgtcggcagcaaacctggcggcagcgcaaaagatg

SEQ ID NO: 28190 - DNA, 103 bp, Artificial Sequence
  Synthetic Polynucleotide
taatacgactcactatagggtaaagggagtcacctagtgctgccgactggaacagaggagaccagtcatgagcactaggaacctggcggcagcgcaaaagatg

SEQ ID NO: 28191 - DNA, 103 bp, Artificial Sequence
  Synthetic Polynucleotide
taatacgactcactatagggcaccataaagggagtcacctagtgctgccgaacagaggagacggcagatgtaggtgactaacctggcggcagcgcaaaagatg

SEQ ID NO: 28192 - DNA, 103 bp, Artificial Sequence
  Synthetic Polynucleotide
taatacgactcactataggggtgagggatgtccagactcatcagcctaagaacagaggagacttaggatgatgagtctgaacctggcggcagcgcaaaagatg

SEQ ID NO: 28193 - DNA, 103 bp, Artificial Sequence
  Synthetic Polynucleotide
taatacgactcactatagggtgctgcaccataaagggagtcacctagtgcaacagaggagagcactaatggactcccttaacctggcggcagcgcaaaagatg

SEQ ID NO: 28194 - DNA, 103 bp, Artificial Sequence
  Synthetic Polynucleotide
taatacgactcactatagggagagatgctgcaccataaagggagtcacctaacagaggagaaggtgaatgcctttatggaacctggcggcagcgcaaaagatg

SEQ ID NO: 28195 - DNA, 103 bp, Artificial Sequence
  Synthetic Polynucleotide
taatacgactcactatagggcatttagagatgctgcaccataaagggagtaacagaggagaactcccatgatggtgcagaacctggcggcagcgcaaaagatg

SEQ ID NO: 28196 - DNA, 103 bp, Artificial Sequence
  Synthetic Polynucleotide
taatacgactcactataggggaagtcatttagagatgctgcaccataaagaacagaggagactttatatggcagcatctaacctggcggcagcgcaaaagatg

SEQ ID NO: 28197 - DNA, 103 bp, Artificial Sequence
  Synthetic Polynucleotide
taatacgactcactatagggataccgaagtcatttagagatgctgcaccaaacagaggagatggtgcatgatctctaaaaacctggcggcagcgcaaaagatg

SEQ ID NO: 28198 - DNA, 103 bp, Artificial Sequence
  Synthetic Polynucleotide
taatacgactcactatagggccaaaataccgaagtcatttagagatgctgaacagaggagacagcatatgtaaatgactaacctggcggcagcgcaaaagatg

SEQ ID NO: 28199 - DNA, 103 bp, Artificial Sequence
  Synthetic Polynucleotide
taatacgactcactatagggaacagccaaaataccgaagtcatttagagaaacagaggagatctctaatggacttcggtaacctggcggcagcgcaaaagatg

SEQ ID NO: 28200 - DNA, 103 bp, Artificial Sequence
  Synthetic Polynucleotide
taatacgactcactatagggactctaacagccaaaataccgaagtcatttaacagaggagaaaatgaatgcggtattttaacctggcggcagcgcaaaagatg

SEQ ID NO: 28201 - DNA, 103 bp, Artificial Sequence
  Synthetic Polynucleotide
taatacgactcactatagggtgactactctaacagccaaaataccgaagtaacagaggagaacttcgatgttttggctgaacctggcggcagcgcaaaagatg

SEQ ID NO: 28202 - DNA, 103 bp, Artificial Sequence
  Synthetic Polynucleotide
taatacgactcactatagggatcattgactactctaacagccaaaataccaacagaggagaggtattatggctgttagaaacctggcggcagcgcaaaagatg

SEQ ID NO: 28203 - DNA, 103 bp, Artificial Sequence
  Synthetic Polynucleotide
taatacgactcactatagggcaccggtgagggatgtccagactcatcagcaacagaggagagctgatatgtctggacataacctggcggcagcgcaaaagatg

SEQ ID NO: 28204 - DNA, 103 bp, Artificial Sequence
  Synthetic Polynucleotide
taatacgactcactatagggttgtgatcattgactactctaacagccaaaaacagaggagatttggcatgtagagtagtaacctggcggcagcgcaaaagatg

SEQ ID NO: 28205 - DNA, 103 bp, Artificial Sequence
  Synthetic Polynucleotide
taatacgactcactatagggtcgggttgtgatcattgactactctaacagaacagaggagactgttaatgtagtcaatgaacctggcggcagcgcaaaagatg

SEQ ID NO: 28206 - DNA, 103 bp, Artificial Sequence
  Synthetic Polynucleotide
taatacgactcactatagggcttggtcgggttgtgatcattgactactctaacagaggagaagagtaatgaatgatcacaacctggcggcagcgcaaaagatg

SEQ ID NO: 28207 - DNA, 103 bp, Artificial Sequence
  Synthetic Polynucleotide
taatacgactcactataggggtgaccttggtcgggttgtgatcattgactaacagaggagaagtcaaatgtcacaacccaacctggcggcagcgcaaaagatg

SEQ ID NO: 28208 - DNA, 103 bp, Artificial Sequence
  Synthetic Polynucleotide
taatacgactcactatagggtggaggtgaccttggtcgggttgtgatcataacagaggagaatgatcatgacccgaccaaacctggcggcagcgcaaaagatg

SEQ ID NO: 28209 - DNA, 103 bp, Artificial Sequence
  Synthetic Polynucleotide
taatacgactcactataggggattttggaggtgaccttggtcgggttgtgaacagaggagacacaacatgaccaaggtcaacctggcggcagcgcaaaagatg

SEQ ID NO: 28210 - DNA, 103 bp, Artificial Sequence
  Synthetic Polynucleotide
taatacgactcactatagggactctgattttggaggtgaccttggtcgggaacagaggagacccgacatgggtcacctcaacctggcggcagcgcaaaagatg

SEQ ID NO: 28211 - DNA, 103 bp, Artificial Sequence
  Synthetic Polynucleotide
taatacgactcactataggggatacactctgattttggaggtgaccttggaacagaggagaccaaggatgcctccaaaaaacctggcggcagcgcaaaagatg

SEQ ID NO: 28212 - DNA, 103 bp, Artificial Sequence
  Synthetic Polynucleotide
taatacgactcactatagggttttagatacactctgattttggaggtgacaacagaggagagtcaccatgaaaatcagaaacctggcggcagcgcaaaagatg

SEQ ID NO: 28213 - DNA, 103 bp, Artificial Sequence
  Synthetic Polynucleotide
taatacgactcactatagggttgggttttagatacactctgattttggagaacagaggagactccaaatgcagagtgtaaacctggcggcagcgcaaaagatg

SEQ ID NO: 28214 - DNA, 103 bp, Artificial Sequence
  Synthetic Polynucleotide
taatacgactcactatagggaccgtcaccggtgagggatgtccagactcaaacagaggagatgagtcatgacatccctcaacctggcggcagcgcaaaagatg

SEQ ID NO: 28215 - DNA, 103 bp, Artificial Sequence
  Synthetic Polynucleotide
taatacgactcactatagggtgtgtttgggttttagatacactctgatttaacagaggagaaaatcaatgtgtatctaaaacctggcggcagcgcaaaagatg

SEQ ID NO: 28216 - DNA, 103 bp, Artificial Sequence
  Synthetic Polynucleotide
taatacgactcactatagggtctgatgtgtttgggttttagatacactctaacagaggagaagagtgatgctaaaacccaacctggcggcagcgcaaaagatg

SEQ ID NO: 28217 - DNA, 103 bp, Artificial Sequence
  Synthetic Polynucleotide
taatacgactcactatagggcagactctgatgtgtttgggttttagatacaacagaggagagtatctatgacccaaacaaacctggcggcagcgcaaaagatg

SEQ ID NO: 28218 - DNA, 103 bp, Artificial Sequence
  Synthetic Polynucleotide
taatacgactcactatagggggcaccagactctgatgtgtttgggttttaaacagaggagataaaacatgaacacatcaaacctggcggcagcgcaaaagatg

SEQ ID NO: 28219 - DNA, 103 bp, Artificial Sequence
  Synthetic Polynucleotide
taatacgactcactatagggacgcgggcaccagactctgatgtgtttgggaacagaggagacccaaaatgatcagagtcaacctggcggcagcgcaaaagatg

SEQ ID NO: 28220 - DNA, 103 bp, Artificial Sequence
  Synthetic Polynucleotide
taatacgactcactatagggggtggacgcgggcaccagactctgatgtgtaacagaggagaacacatatgagtctggtgaacctggcggcagcgcaaaagatg

SEQ ID NO: 28221 - DNA, 103 bp, Artificial Sequence
  Synthetic Polynucleotide
taatacgactcactatagggccctcggtggacgcgggcaccagactctgaaacagaggagatcagagatgggtgcccgcaacctggcggcagcgcaaaagatg

SEQ ID NO: 28222 - DNA, 103 bp, Artificial Sequence
  Synthetic Polynucleotide
taatacgactcactatagggcactgccctcggtggacgcgggcaccagacaacagaggagagtctggatgccgcgtccaaacctggcggcagcgcaaaagatg

SEQ ID NO: 28223 - DNA, 103 bp, Artificial Sequence
  Synthetic Polynucleotide
taatacgactcactatagggtacgccactgccctcggtggacgcgggcacaacagaggagagtgcccatgtccaccgagaacctggcggcagcgcaaaagatg

SEQ ID NO: 28224 - DNA, 103 bp, Artificial Sequence
  Synthetic Polynucleotide
taatacgactcactatagggcgtagtacgccactgccctcggtggacgcgaacagaggagacgcgtcatgcgagggcagaacctggcggcagcgcaaaagatg

SEQ ID NO: 28225 - DNA, 103 bp, Artificial Sequence
  Synthetic Polynucleotide
taatacgactcactatagggggaccaccgtcaccggtgagggatgtccagaacagaggagactggacatgcctcaccggaacctggcggcagcgcaaaagatg

SEQ ID NO: 28226 - DNA, 103 bp, Artificial Sequence
  Synthetic Polynucleotide
taatacgactcactatagggagggccgtagtacgccactgccctcggtggaacagaggagaccaccgatggcagtggcgaacctggcggcagcgcaaaagatg

SEQ ID NO: 28227 - DNA, 103 bp, Artificial Sequence
  Synthetic Polynucleotide
taatacgactcactatagggactccagggccgtagtacgccactgccctcaacagaggagagagggcatgggcgtactaaacctggcggcagcgcaaaagatg

SEQ ID NO: 28228 - DNA, 103 bp, Artificial Sequence
  Synthetic Polynucleotide
taatacgactcactatagggaatccactccagggccgtagtacgccactgaacagaggagacagtggatgactacggccaacctggcggcagcgcaaaagatg

SEQ ID NO: 28229 - DNA, 103 bp, Artificial Sequence
  Synthetic Polynucleotide
taatacgactcactatagggcttgtaatccactccagggccgtagtacgcaacagaggagagcgtacatgggccctggaaacctggcggcagcgcaaaagatg

SEQ ID NO: 28230 - DNA, 103 bp, Artificial Sequence
  Synthetic Polynucleotide
taatacgactcactatagggccatccttgtaatccactccagggccgtagaacagaggagactacggatgtggagtggaaacctggcggcagcgcaaaagatg

SEQ ID NO: 28231 - DNA, 103 bp, Artificial Sequence
  Synthetic Polynucleotide
taatacgactcactataggggcgtaccatccttgtaatccactccagggcaacagaggagagccctgatgtggattacaaacctggcggcagcgcaaaagatg

SEQ ID NO: 28232 - DNA, 103 bp, Artificial Sequence
  Synthetic Polynucleotide
taatacgactcactatagggtgtaagcgtaccatccttgtaatccactccaacagaggagaggagtgatgtacaaggataacctggcggcagcgcaaaagatg

SEQ ID NO: 28233 - DNA, 103 bp, Artificial Sequence
  Synthetic Polynucleotide
taatacgactcactatagggaggggtgtaagcgtaccatccttgtaatccaacagaggagaggattaatgggatggtacaacctggcggcagcgcaaaagatg

SEQ ID NO: 28234 - DNA, 103 bp, Artificial Sequence
  Synthetic Polynucleotide
taatacgactcactatagggtggagaggggtgtaagcgtaccatccttgtaacagaggagaacaaggatggtacgcttaaacctggcggcagcgcaaaagatg

SEQ ID NO: 28235 - DNA, 103 bp, Artificial Sequence
  Synthetic Polynucleotide
taatacgactcactatagggcttggtggagaggggtgtaagcgtaccatcaacagaggagagatggtatgcttacacccaacctggcggcagcgcaaaagatg

SEQ ID NO: 28236 - DNA, 103 bp, Artificial Sequence
  Synthetic Polynucleotide
taatacgactcactatagggagcctggaccaccgtcaccggtgagggatgaacagaggagacatcccatgccggtgacgaacctggcggcagcgcaaaagatg

SEQ ID NO: 28237 - DNA, 103 bp, Artificial Sequence
  Synthetic Polynucleotide
taatacgactcactatagggagatccttggtggagaggggtgtaagcgtaaacagaggagatacgctatgacccctctcaacctggcggcagcgcaaaagatg

SEQ ID NO: 28238 - DNA, 103 bp, Artificial Sequence
  Synthetic Polynucleotide
taatacgactcactatagggtggtcagatccttggtggagaggggtgtaaaacagaggagattacacatgtctccaccaaacctggcggcagcgcaaaagatg

SEQ ID NO: 28239 - DNA, 103 bp, Artificial Sequence
  Synthetic Polynucleotide
taatacgactcactatagggatatgtggtcagatccttggtggagaggggaacagaggagacccctcatgaccaaggataacctggcggcagcgcaaaagatg

SEQ ID NO: 28240 - DNA, 103 bp, Artificial Sequence
  Synthetic Polynucleotide
taatacgactcactatagggaatccatatgtggtcagatccttggtggagaacagaggagactccacatgggatctgacaacctggcggcagcgcaaaagatg

SEQ ID NO: 28241 - DNA, 103 bp, Artificial Sequence
  Synthetic Polynucleotide
taatacgactcactataggggtccgaatccatatgtggtcagatccttggaacagaggagaccaaggatgtgaccacataacctggcggcagcgcaaaagatg

SEQ ID NO: 28242 - DNA, 103 bp, Artificial Sequence
  Synthetic Polynucleotide
taatacgactcactatagggttggtgtccgaatccatatgtggtcagatcaacagaggagagatctgatgacatatggaaacctggcggcagcgcaaaagatg

SEQ ID NO: 28243 - DNA, 103 bp, Artificial Sequence
  Synthetic Polynucleotide
taatacgactcactatagggttgttttggtgtccgaatccatatgtggtcaacagaggagagaccacatgtggattcggaacctggcggcagcgcaaaagatg

SEQ ID NO: 28244 - DNA, 103 bp, Artificial Sequence
  Synthetic Polynucleotide
taatacgactcactatagggccgctttgttttggtgtccgaatccatatgaacagaggagacatatgatgtcggacaccaacctggcggcagcgcaaaagatg

SEQ ID NO: 28245 - DNA, 103 bp, Artificial Sequence
  Synthetic Polynucleotide
taatacgactcactataggggtacaccgctttgttttggtgtccgaatccaacagaggagaggattcatgcaccaaaacaacctggcggcagcgcaaaagatg

SEQ ID NO: 28246 - DNA, 103 bp, Artificial Sequence
  Synthetic Polynucleotide
taatacgactcactataggggcagtgtacaccgctttgttttggtgtccgaacagaggagacggacaatgaaacaaagcaacctggcggcagcgcaaaagatg

SEQ ID NO: 28247 - DNA, 103 bp, Artificial Sequence
  Synthetic Polynucleotide
taatacgactcactatagggaacgcagcctggaccaccgtcaccggtgagaacagaggagactcaccatggacggtggtaacctggcggcagcgcaaaagatg

SEQ ID NO: 28248 - DNA, 103 bp, Artificial Sequence
  Synthetic Polynucleotide
taatacgactcactatagggaacctgcagtgtacaccgctttgttttggtaacagaggagaaccaaaatgaagcggtgtaacctggcggcagcgcaaaagatg

SEQ ID NO: 28249 - DNA, 103 bp, Artificial Sequence
  Synthetic Polynucleotide
taatacgactcactatagggtttgtaacctgcagtgtacaccgctttgttaacagaggagaaacaaaatggtgtacactaacctggcggcagcgcaaaagatg

SEQ ID NO: 28250 - DNA, 103 bp, Artificial Sequence
  Synthetic Polynucleotide
taatacgactcactatagggcaaattttgtaacctgcagtgtacaccgctaacagaggagaagcggtatgcactgcaggaacctggcggcagcgcaaaagatg

SEQ ID NO: 28251 - DNA, 103 bp, Artificial Sequence
  Synthetic Polynucleotide
taatacgactcactatagggagttgcaaattttgtaacctgcagtgtacaaacagaggagatgtacaatgcaggttacaaacctggcggcagcgcaaaagatg

SEQ ID NO: 28252 - DNA, 103 bp, Artificial Sequence
  Synthetic Polynucleotide
taatacgactcactataggggtggtagttgcaaattttgtaacctgcagtaacagaggagaactgcaatgtacaaaattaacctggcggcagcgcaaaagatg

SEQ ID NO: 28253 - DNA, 103 bp, Artificial Sequence
  Synthetic Polynucleotide
taatacgactcactataggggccaagtggtagttgcaaattttgtaacctaacagaggagaaggttaatgaatttgcaaaacctggcggcagcgcaaaagatg

SEQ ID NO: 28254 - DNA, 103 bp, Artificial Sequence
  Synthetic Polynucleotide
taatacgactcactataggggagtggccaagtggtagttgcaaattttgtaacagaggagaacaaaaatggcaactaccaacctggcggcagcgcaaaagatg

SEQ ID NO: 28255 - DNA, 103 bp, Artificial Sequence
  Synthetic Polynucleotide
taatacgactcactatagggatcctgagtggccaagtggtagttgcaaataacagaggagaatttgcatgtaccacttgaacctggcggcagcgcaaaagatg

SEQ ID NO: 28256 - DNA, 103 bp, Artificial Sequence
  Synthetic Polynucleotide
taatacgactcactatagggaaatcatcctgagtggccaagtggtagttgaacagaggagacaactaatgcttggccacaacctggcggcagcgcaaaagatg

SEQ ID NO: 28257 - DNA, 103 bp, Artificial Sequence
  Synthetic Polynucleotide
taatacgactcactatagggtttgcaaatcatcctgagtggccaagtggtaacagaggagaaccactatgccactcaggaacctggcggcagcgcaaaagatg

SEQ ID NO: 28258 - DNA, 103 bp, Artificial Sequence
  Synthetic Polynucleotide
taatacgactcactatagggccgccaacgcagcctggaccaccgtcaccgaacagaggagacggtgaatgtggtccaggaacctggcggcagcgcaaaagatg

SEQ ID NO: 28259 - DNA, 103 bp, Artificial Sequence
  Synthetic Polynucleotide
taatacgactcactatagggtgcgttttgcaaatcatcctgagtggccaaaacagaggagattggccatgcaggatgataacctggcggcagcgcaaaagatg

SEQ ID NO: 28260 - DNA, 103 bp, Artificial Sequence
  Synthetic Polynucleotide
taatacgactcactatagggttcactgcgttttgcaaatcatcctgagtgaacagaggagacactcaatgtgatttgcaaacctggcggcagcgcaaaagatg

SEQ ID NO: 28261 - DNA, 103 bp, Artificial Sequence
  Synthetic Polynucleotide
taatacgactcactatagggtgacgttcactgcgttttgcaaatcatcctaacagaggagaaggatgatgtgcaaaacgaacctggcggcagcgcaaaagatg

SEQ ID NO: 28262 - DNA, 103 bp, Artificial Sequence
  Synthetic Polynucleotide
taatacgactcactatagggccacatgacgttcactgcgttttgcaaatcaacagaggagagatttgatgaacgcagtgaacctggcggcagcgcaaaagatg

SEQ ID NO: 28263 - DNA, 103 bp, Artificial Sequence
  Synthetic Polynucleotide
taatacgactcactatagggctactccacatgacgttcactgcgttttgcaacagaggagagcaaaaatgagtgaacgtaacctggcggcagcgcaaaagatg

SEQ ID NO: 28264 - DNA, 103 bp, Artificial Sequence
  Synthetic Polynucleotide
taatacgactcactatagggggtctctactccacatgacgttcactgcgtaacagaggagaacgcagatgacgtcatgtaacctggcggcagcgcaaaagatg

SEQ ID NO: 28265 - DNA, 103 bp, Artificial Sequence
  Synthetic Polynucleotide
taatacgactcactatagggtaagaggtctctactccacatgacgttcacaacagaggagagtgaacatgatgtggagtaacctggcggcagcgcaaaagatg

SEQ ID NO: 28266 - DNA, 103 bp, Artificial Sequence
  Synthetic Polynucleotide
taatacgactcactataggggtgactaagaggtctctactccacatgacgaacagaggagacgtcatatggagtagagaaacctggcggcagcgcaaaagatg

SEQ ID NO: 28267 - DNA, 103 bp, Artificial Sequence
  Synthetic Polynucleotide
taatacgactcactatagggattctgtgactaagaggtctctactccacaaacagaggagatgtggaatggagacctctaacctggcggcagcgcaaaagatg

SEQ ID NO: 28268 - DNA, 103 bp, Artificial Sequence
  Synthetic Polynucleotide
taatacgactcactatagggtcttgattctgtgactaagaggtctctactaacagaggagaagtagaatgctcttagtcaacctggcggcagcgcaaaagatg

SEQ ID NO: 28269 - DNA, 103 bp, Artificial Sequence
  Synthetic Polynucleotide
taatacgactcactatagggaccggagtactagccgccacgtgggcctctaacagaggagaagaggcatgcgtggcggcaacctggcggcagcgcaaaagatg

SEQ ID NO: 28270 - DNA, 103 bp, Artificial Sequence
  Synthetic Polynucleotide
taatacgactcactataggggtaggccgccaacgcagcctggaccaccgtaacagaggagaacggtgatgcaggctgcgaacctggcggcagcgcaaaagatg

SEQ ID NO: 28271 - DNA, 103 bp, Artificial Sequence
  Synthetic Polynucleotide
taatacgactcactatagggtgggctcttgattctgtgactaagaggtctaacagaggagaagacctatgagtcacagaaacctggcggcagcgcaaaagatg

SEQ ID NO: 28272 - DNA, 103 bp, Artificial Sequence
  Synthetic Polynucleotide
taatacgactcactatagggtgccctgggctcttgattctgtgactaagaaacagaggagatcttagatgcagaatcaaaacctggcggcagcgcaaaagatg

SEQ ID NO: 28273 - DNA, 103 bp, Artificial Sequence
  Synthetic Polynucleotide
taatacgactcactatagggatcggtgccctgggctcttgattctgtgacaacagaggagagtcacaatgtcaagagccaacctggcggcagcgcaaaagatg

SEQ ID NO: 28274 - DNA, 103 bp, Artificial Sequence
  Synthetic Polynucleotide
taatacgactcactatagggattgaatcggtgccctgggctcttgattctaacagaggagaagaatcatgagcccagggaacctggcggcagcgcaaaagatg

SEQ ID NO: 28275 - DNA, 103 bp, Artificial Sequence
  Synthetic Polynucleotide
taatacgactcactatagggttgcgattgaatcggtgccctgggctcttgaacagaggagacaagagatgagggcaccgaacctggcggcagcgcaaaagatg

SEQ ID NO: 28276 - DNA, 103 bp, Artificial Sequence
  Synthetic Polynucleotide
taatacgactcactataggggcaccttgcgattgaatcggtgccctgggcaacagaggagagcccagatgaccgattcaaacctggcggcagcgcaaaagatg

SEQ ID NO: 28277 - DNA, 103 bp, Artificial Sequence
  Synthetic Polynucleotide
taatacgactcactatagggcaattgcaccttgcgattgaatcggtgcccaacagaggagagggcacatgttcaatcgcaacctggcggcagcgcaaaagatg

SEQ ID NO: 28278 - DNA, 103 bp, Artificial Sequence
  Synthetic Polynucleotide
taatacgactcactatagggcgttgcaattgcaccttgcgattgaatcggaacagaggagaccgattatgtcgcaaggtaacctggcggcagcgcaaaagatg

SEQ ID NO: 28279 - DNA, 103 bp, Artificial Sequence
  Synthetic Polynucleotide
taatacgactcactatagggccctgcgttgcaattgcaccttgcgattgaaacagaggagatcaatcatgaggtgcaataacctggcggcagcgcaaaagatg

SEQ ID NO: 28280 - DNA, 103 bp, Artificial Sequence
  Synthetic Polynucleotide
taatacgactcactatagggtacacccctgcgttgcaattgcaccttgcgaacagaggagacgcaagatgcaattgcaaaacctggcggcagcgcaaaagatg

SEQ ID NO: 28281 - DNA, 103 bp, Artificial Sequence
  Synthetic Polynucleotide
taatacgactcactatagggcataggtaggccgccaacgcagcctggaccaacagaggagaggtccaatgtgcgttggcaacctggcggcagcgcaaaagatg

SEQ ID NO: 28282 - DNA, 103 bp, Artificial Sequence
  Synthetic Polynucleotide
taatacgactcactatagggagtagtacacccctgcgttgcaattgcaccaacagaggagaggtgcaatggcaacgcagaacctggcggcagcgcaaaagatg

SEQ ID NO: 28283 - DNA, 103 bp, Artificial Sequence
  Synthetic Polynucleotide
taatacgactcactatagggctcgcagtagtacacccctgcgttgcaattaacagaggagaaattgcatggcaggggtgaacctggcggcagcgcaaaagatg

SEQ ID NO: 28284 - DNA, 103 bp, Artificial Sequence
  Synthetic Polynucleotide
taatacgactcactatagggctagactcgcagtagtacacccctgcgttgaacagaggagacaacgcatgggtgtactaaacctggcggcagcgcaaaagatg

SEQ ID NO: 28285 - DNA, 103 bp, Artificial Sequence
  Synthetic Polynucleotide
taatacgactcactatagggtccttctagactcgcagtagtacacccctgaacagaggagacaggggatgactactgcgaacctggcggcagcgcaaaagatg

SEQ ID NO: 28286 - DNA, 103 bp, Artificial Sequence
  Synthetic Polynucleotide
taatacgactcactataggggtatttccttctagactcgcagtagtacacaacagaggagagtgtacatgtgcgagtctaacctggcggcagcgcaaaagatg

SEQ ID NO: 28287 - DNA, 103 bp, Artificial Sequence
  Synthetic Polynucleotide
taatacgactcactataggggggtagtatttccttctagactcgcagtagaacagaggagactactgatggtctagaagaacctggcggcagcgcaaaagatg

SEQ ID NO: 28288 - DNA, 103 bp, Artificial Sequence
  Synthetic Polynucleotide
taatacgactcactatagggatactgggtagtatttccttctagactcgcaacagaggagagcgagtatggaaggaaataacctggcggcagcgcaaaagatg

SEQ ID NO: 28289 - DNA, 103 bp, Artificial Sequence
  Synthetic Polynucleotide
taatacgactcactataggggaaggatactgggtagtatttccttctagaaacagaggagatctagaatgaaatactacaacctggcggcagcgcaaaagatg

SEQ ID NO: 28290 - DNA, 103 bp, Artificial Sequence
  Synthetic Polynucleotide
taatacgactcactatagggccaacgaaggatactgggtagtatttccttaacagaggagaaaggaaatgctacccagtaacctggcggcagcgcaaaagatg

SEQ ID NO: 28291 - DNA, 103 bp, Artificial Sequence
  Synthetic Polynucleotide
taatacgactcactatagggttgggccaacgaaggatactgggtagtattaacagaggagaaatactatgcagtatcctaacctggcggcagcgcaaaagatg

SEQ ID NO: 28292 - DNA, 103 bp, Artificial Sequence
  Synthetic Polynucleotide
taatacgactcactatagggttagccataggtaggccgccaacgcagcctaacagaggagaaggctgatgtggcggcctaacctggcggcagcgcaaaagatg

SEQ ID NO: 28293 - DNA, 103 bp, Artificial Sequence
  Synthetic Polynucleotide
taatacgactcactataggggaacgttgggccaacgaaggatactgggtaaacagaggagatacccaatgtccttcgttaacctggcggcagcgcaaaagatg

SEQ ID NO: 28294 - DNA, 103 bp, Artificial Sequence
  Synthetic Polynucleotide
taatacgactcactatagggtactggaacgttgggccaacgaaggatactaacagaggagaagtatcatgcgttggcccaacctggcggcagcgcaaaagatg

SEQ ID NO: 28295 - DNA, 103 bp, Artificial Sequence
  Synthetic Polynucleotide
taatacgactcactatagggccatgtactggaacgttgggccaacgaaggaacagaggagaccttcgatggcccaacgtaacctggcggcagcgcaaaagatg

SEQ ID NO: 28296 - DNA, 103 bp, Artificial Sequence
  Synthetic Polynucleotide
taatacgactcactatagggagcctccatgtactggaacgttgggccaacaacagaggagagttggcatgacgttccagaacctggcggcagcgcaaaagatg

SEQ ID NO: 28297 - DNA, 103 bp, Artificial Sequence
  Synthetic Polynucleotide
taatacgactcactatagggttattagcctccatgtactggaacgttgggaacagaggagacccaacatgccagtacataacctggcggcagcgcaaaagatg

SEQ ID NO: 28298 - DNA, 103 bp, Artificial Sequence
  Synthetic Polynucleotide
taatacgactcactatagggaatagttattagcctccatgtactggaacgaacagaggagacgttccatgacatggaggaacctggcggcagcgcaaaagatg

SEQ ID NO: 28299 - DNA, 103 bp, Artificial Sequence
  Synthetic Polynucleotide
taatacgactcactatagggtgggtaatagttattagcctccatgtactgaacagaggagacagtacatggaggctaataacctggcggcagcgcaaaagatg

SEQ ID NO: 28300 - DNA, 103 bp, Artificial Sequence
  Synthetic Polynucleotide
taatacgactcactatagggctagctgggtaatagttattagcctccatgaacagaggagacatggaatgtaataactaaacctggcggcagcgcaaaagatg

SEQ ID NO: 28301 - DNA, 103 bp, Artificial Sequence
  Synthetic Polynucleotide
taatacgactcactatagggggtacctagctgggtaatagttattagcctaacagaggagaaggctaatgactattaccaacctggcggcagcgcaaaagatg

SEQ ID NO: 28302 - DNA, 103 bp, Artificial Sequence
  Synthetic Polynucleotide
taatacgactcactatagggggactggtacctagctgggtaatagttattaacagaggagaaataacatgtacccagctaacctggcggcagcgcaaaagatg

SEQ ID NO: 28303 - DNA, 103 bp, Artificial Sequence
  Synthetic Polynucleotide
taatacgactcactatagggtggcgttagccataggtaggccgccaacgcaacagaggagagcgttgatggcctacctaaacctggcggcagcgcaaaagatg

SEQ ID NO: 28304 - DNA, 103 bp, Artificial Sequence
  Synthetic Polynucleotide
taatacgactcactatagggatatgggactggtacctagctgggtaatagaacagaggagactattaatgagctaggtaaacctggcggcagcgcaaaagatg

SEQ ID NO: 28305 - DNA, 103 bp, Artificial Sequence
  Synthetic Polynucleotide
taatacgactcactatagggtgagcatatgggactggtacctagctgggtaacagaggagaacccagatgggtaccagtaacctggcggcagcgcaaaagatg

SEQ ID NO: 28306 - DNA, 103 bp, Artificial Sequence
  Synthetic Polynucleotide
taatacgactcactataggggccaatgagcatatgggactggtacctagcaacagaggagagctaggatgcagtcccataacctggcggcagcgcaaaagatg

SEQ ID NO: 28307 - DNA, 103 bp, Artificial Sequence
  Synthetic Polynucleotide
taatacgactcactatagggccatggccaatgagcatatgggactggtacaacagaggagagtaccaatgccatatgctaacctggcggcagcgcaaaagatg

SEQ ID NO: 28308 - DNA, 103 bp, Artificial Sequence
  Synthetic Polynucleotide
taatacgactcactatagggcgaatccatggccaatgagcatatgggactaacagaggagaagtcccatgtgctcattgaacctggcggcagcgcaaaagatg

SEQ ID NO: 28309 - DNA, 103 bp, Artificial Sequence
  Synthetic Polynucleotide
taatacgactcactatagggagatgcgaatccatggccaatgagcatatgaacagaggagacatatgatgattggccataacctggcggcagcgcaaaagatg

SEQ ID NO: 28310 - DNA, 103 bp, Artificial Sequence
  Synthetic Polynucleotide
taatacgactcactatagggcctggagatgcgaatccatggccaatgagcaacagaggagagctcatatgccatggattaacctggcggcagcgcaaaagatg

SEQ ID NO: 28311 - DNA, 103 bp, Artificial Sequence
  Synthetic Polynucleotide
taatacgactcactatagggaatcccctggagatgcgaatccatggccaaaacagaggagattggccatggattcgcataacctggcggcagcgcaaaagatg

SEQ ID NO: 28312 - DNA, 103 bp, Artificial Sequence
  Synthetic Polynucleotide
taatacgactcactatagggaccacaatcccctggagatgcgaatccatgaacagaggagacatggaatggcatctccaaacctggcggcagcgcaaaagatg

SEQ ID NO: 28313 - DNA, 103 bp, Artificial Sequence
  Synthetic Polynucleotide
taatacgactcactatagggatgccaccacaatcccctggagatgcgaataacagaggagaattcgcatgtccaggggaaacctggcggcagcgcaaaagatg

SEQ ID NO: 28314 - DNA, 103 bp, Artificial Sequence
  Synthetic Polynucleotide
taatacgactcactatagggtcccatggcgttagccataggtaggccgccaacagaggagaggcggcatgcctatggctaacctggcggcagcgcaaaagatg

SEQ ID NO: 28315 - DNA, 103 bp, Artificial Sequence
  Synthetic Polynucleotide
taatacgactcactatagggtgagtatgccaccacaatcccctggagatgaacagaggagacatctcatggggattgtgaacctggcggcagcgcaaaagatg

SEQ ID NO: 28316 - DNA, 103 bp, Artificial Sequence
  Synthetic Polynucleotide
taatacgactcactatagggacatctgagtatgccaccacaatcccctggaacagaggagaccagggatgtgtggtggcaacctggcggcagcgcaaaagatg

SEQ ID NO: 28317 - DNA, 103 bp, Artificial Sequence
  Synthetic Polynucleotide
taatacgactcactatagggtggtgacatctgagtatgccaccacaatccaacagaggagaggattgatgtggcatactaacctggcggcagcgcaaaagatg

SEQ ID NO: 28318 - DNA, 103 bp, Artificial Sequence
  Synthetic Polynucleotide
taatacgactcactatagggccccgtggtgacatctgagtatgccaccacaacagaggagagtggtgatgtactcagataacctggcggcagcgcaaaagatg

SEQ ID NO: 28319 - DNA, 103 bp, Artificial Sequence
  Synthetic Polynucleotide
taatacgactcactatagggtatcaccccgtggtgacatctgagtatgccaacagaggagaggcataatgagatgtcacaacctggcggcagcgcaaaagatg

SEQ ID NO: 28320 - DNA, 103 bp, Artificial Sequence
  Synthetic Polynucleotide
taatacgactcactatagggatccctatcaccccgtggtgacatctgagtaacagaggagaactcagatgtcaccacggaacctggcggcagcgcaaaagatg

SEQ ID NO: 28321 - DNA, 103 bp, Artificial Sequence
  Synthetic Polynucleotide
taatacgactcactatagggtaatgatccctatcaccccgtggtgacatcaacagaggagagatgtcatgacggggtgaaacctggcggcagcgcaaaagatg

SEQ ID NO: 28322 - DNA, 103 bp, Artificial Sequence
  Synthetic Polynucleotide
taatacgactcactatagggagcagtaatgatccctatcaccccgtggtgaacagaggagacaccacatggtgatagggaacctggcggcagcgcaaaagatg

SEQ ID NO: 28323 - DNA, 103 bp, Artificial Sequence
  Synthetic Polynucleotide
taatacgactcactatagggccaccagcagtaatgatccctatcaccccgaacagaggagacggggtatgagggatcataacctggcggcagcgcaaaagatg

SEQ ID NO: 28324 - DNA, 103 bp, Artificial Sequence
  Synthetic Polynucleotide
taatacgactcactatagggcttcgccaccagcagtaatgatccctatcaaacagaggagatgatagatgtcattactgaacctggcggcagcgcaaaagatg

SEQ ID NO: 28325 - DNA, 103 bp, Artificial Sequence
  Synthetic Polynucleotide
taatacgactcactatagggtagcgtcccatggcgttagccataggtaggaacagaggagacctaccatgggctaacgcaacctggcggcagcgcaaaagatg

SEQ ID NO: 28326 - DNA, 103 bp, Artificial Sequence
  Synthetic Polynucleotide
taatacgactcactatagggcaacccttcgccaccagcagtaatgatcccaacagaggagagggatcatgactgctggtaacctggcggcagcgcaaaagatg

SEQ ID NO: 28327 - DNA, 103 bp, Artificial Sequence
  Synthetic Polynucleotide
taatacgactcactataggggcaaccaacccttcgccaccagcagtaatgaacagaggagacattacatgtggtggcgaaacctggcggcagcgcaaaagatg

SEQ ID NO: 28328 - DNA, 103 bp, Artificial Sequence
  Synthetic Polynucleotide
taatacgactcactatagggaaaatgcaaccaacccttcgccaccagcagaacagaggagactgctgatggcgaagggtaacctggcggcagcgcaaaagatg

SEQ ID NO: 28329 - DNA, 103 bp, Artificial Sequence
  Synthetic Polynucleotide
taatacgactcactataggggtctgaaaatgcaaccaacccttcgccaccaacagaggagaggtggcatggggttggttaacctggcggcagcgcaaaagatg

SEQ ID NO: 28330 - DNA, 103 bp, Artificial Sequence
  Synthetic Polynucleotide
taatacgactcactatagggctaatgtctgaaaatgcaaccaacccttcgaacagaggagacgaaggatgggttgcattaacctggcggcagcgcaaaagatg

SEQ ID NO: 28331 - DNA, 103 bp, Artificial Sequence
  Synthetic Polynucleotide
taatacgactcactatagggagtctctaatgtctgaaaatgcaaccaaccaacagaggagaggttggatgcattttcagaacctggcggcagcgcaaaagatg

SEQ ID NO: 28332 - DNA, 103 bp, Artificial Sequence
  Synthetic Polynucleotide
taatacgactcactatagggatacaagtctctaatgtctgaaaatgcaacaacagaggagagttgcaatgtcagacattaacctggcggcagcgcaaaagatg

SEQ ID NO: 28333 - DNA, 103 bp, Artificial Sequence
  Synthetic Polynucleotide
taatacgactcactatagggtaggcatacaagtctctaatgtctgaaaataacagaggagaattttcatgcattagagaaacctggcggcagcgcaaaagatg

SEQ ID NO: 28334 - DNA, 103 bp, Artificial Sequence
  Synthetic Polynucleotide
taatacgactcactatagggcttcgtaggcatacaagtctctaatgtctgaacagaggagacagacaatggagacttgtaacctggcggcagcgcaaaagatg

SEQ ID NO: 28335 - DNA, 103 bp, Artificial Sequence
  Synthetic Polynucleotide
taatacgactcactatagggttcttcttcgtaggcatacaagtctctaataacagaggagaattagaatgttgtatgccaacctggcggcagcgcaaaagatg

SEQ ID NO: 28336 - DNA, 103 bp, Artificial Sequence
  Synthetic Polynucleotide
taatacgactcactatagggacaactagcgtcccatggcgttagccatagaacagaggagactatggatgacgccatggaacctggcggcagcgcaaaagatg

SEQ ID NO: 28337 - DNA, 103 bp, Artificial Sequence
  Synthetic Polynucleotide
taatacgactcactatagggatggcttcttcttcgtaggcatacaagtctaacagaggagaagacttatgtgcctacgaaacctggcggcagcgcaaaagatg

SEQ ID NO: 28338 - DNA, 103 bp, Artificial Sequence
  Synthetic Polynucleotide
taatacgactcactataggggttccatggcttcttcttcgtaggcatacaaacagaggagatgtatgatgacgaagaagaacctggcggcagcgcaaaagatg

SEQ ID NO: 28339 - DNA, 103 bp, Artificial Sequence
  Synthetic Polynucleotide
taatacgactcactataggggccttgttccatggcttcttcttcgtaggcaacagaggagagcctacatggaagaagccaacctggcggcagcgcaaaagatg

SEQ ID NO: 28340 - DNA, 103 bp, Artificial Sequence
  Synthetic Polynucleotide
taatacgactcactataggggtgatgccttgttccatggcttcttcttcgaacagaggagacgaagaatgagccatggaaacctggcggcagcgcaaaagatg

SEQ ID NO: 28341 - DNA, 103 bp, Artificial Sequence
  Synthetic Polynucleotide
taatacgactcactatagggaattggtgatgccttgttccatggcttcttaacagaggagaaagaagatgtggaacaagaacctggcggcagcgcaaaagatg

SEQ ID NO: 28342 - DNA, 103 bp, Artificial Sequence
  Synthetic Polynucleotide
taatacgactcactatagggtatgtaattggtgatgccttgttccatggcaacagaggagagccatgatgcaaggcatcaacctggcggcagcgcaaaagatg

SEQ ID NO: 28343 - DNA, 103 bp, Artificial Sequence
  Synthetic Polynucleotide
taatacgactcactataggggactctatgtaattggtgatgccttgttccaacagaggagaggaacaatgcatcaccaaaacctggcggcagcgcaaaagatg

SEQ ID NO: 28344 - DNA, 103 bp, Artificial Sequence
  Synthetic Polynucleotide
taatacgactcactatagggcaagtgactctatgtaattggtgatgccttaacagaggagaaaggcaatgccaattacaaacctggcggcagcgcaaaagatg

SEQ ID NO: 28345 - DNA, 103 bp, Artificial Sequence
  Synthetic Polynucleotide
taatacgactcactatagggggccccaagtgactctatgtaattggtgataacagaggagaatcaccatgtacatagagaacctggcggcagcgcaaaagatg

SEQ ID NO: 28346 - DNA, 103 bp, Artificial Sequence
  Synthetic Polynucleotide
taatacgactcactatagggaatgcggccccaagtgactctatgtaattgaacagaggagacaattaatgagagtcactaacctggcggcagcgcaaaagatg

SEQ ID NO: 28347 - DNA, 103 bp, Artificial Sequence
  Synthetic Polynucleotide
taatacgactcactatagggtgttcacaactagcgtcccatggcgttagcaacagaggagagctaacatgatgggacgcaacctggcggcagcgcaaaagatg

SEQ ID NO: 28348 - DNA, 103 bp, Artificial Sequence
  Synthetic Polynucleotide
taatacgactcactatagggttccaaatgcggccccaagtgactctatgtaacagaggagaacatagatgcacttggggaacctggcggcagcgcaaaagatg

SEQ ID NO: 28349 - DNA, 103 bp, Artificial Sequence
  Synthetic Polynucleotide
taatacgactcactatagggtccacttccaaatgcggccccaagtgactcaacagaggagagagtcaatgggggccgcaaacctggcggcagcgcaaaagatg

SEQ ID NO: 28350 - DNA, 103 bp, Artificial Sequence
  Synthetic Polynucleotide
taatacgactcactataggggtaaatccacttccaaatgcggccccaagtaacagaggagaacttggatgcgcatttggaacctggcggcagcgcaaaagatg

SEQ ID NO: 28351 - DNA, 103 bp, Artificial Sequence
  Synthetic Polynucleotide
taatacgactcactataggggctgagtaaatccacttccaaatgcggcccaacagaggagagggccgatgttggaagtgaacctggcggcagcgcaaaagatg

SEQ ID NO: 28352 - DNA, 103 bp, Artificial Sequence
  Synthetic Polynucleotide
taatacgactcactatagggaatctgctgagtaaatccacttccaaatgcaacagaggagagcatttatgagtggatttaacctggcggcagcgcaaaagatg

SEQ ID NO: 28353 - DNA, 103 bp, Artificial Sequence
  Synthetic Polynucleotide
taatacgactcactatagggtcgctaatctgctgagtaaatccacttccaaacagaggagatggaagatgatttactcaaacctggcggcagcgcaaaagatg

SEQ ID NO: 28354 - DNA, 103 bp, Artificial Sequence
  Synthetic Polynucleotide
taatacgactcactatagggttttgtcgctaatctgctgagtaaatccacaacagaggagagtggatatgctcagcagaaacctggcggcagcgcaaaagatg

SEQ ID NO: 28355 - DNA, 103 bp, Artificial Sequence
  Synthetic Polynucleotide
taatacgactcactatagggtgttattttgtcgctaatctgctgagtaaaaacagaggagatttactatgcagattagcaacctggcggcagcgcaaaagatg

SEQ ID NO: 28356 - DNA, 103 bp, Artificial Sequence
  Synthetic Polynucleotide
taatacgactcactatagggaactctgttattttgtcgctaatctgctgaaacagaggagatcagcaatgtagcgacaaaacctggcggcagcgcaaaagatg

SEQ ID NO: 28357 - DNA, 103 bp, Artificial Sequence
  Synthetic Polynucleotide
taatacgactcactatagggtggtcaactctgttattttgtcgctaatctaacagaggagaagattaatgacaaaataaaacctggcggcagcgcaaaagatg

SEQ ID NO: 28358 - DNA, 103 bp, Artificial Sequence
  Synthetic Polynucleotide
taatacgactcactatagggcaccttgttcacaactagcgtcccatggcgaacagaggagacgccatatgacgctagttaacctggcggcagcgcaaaagatg

SEQ ID NO: 28359 - DNA, 103 bp, Artificial Sequence
  Synthetic Polynucleotide
taatacgactcactatagggcatattggtcaactctgttattttgtcgctaacagaggagaagcgacatgataacagagaacctggcggcagcgcaaaagatg

SEQ ID NO: 28360 - DNA, 103 bp, Artificial Sequence
  Synthetic Polynucleotide
taatacgactcactataggggtcaccatattggtcaactctgttattttgaacagaggagacaaaatatgagagttgacaacctggcggcagcgcaaaagatg

SEQ ID NO: 28361 - DNA, 103 bp, Artificial Sequence
  Synthetic Polynucleotide
taatacgactcactatagggtactggtcaccatattggtcaactctgttaaacagaggagataacagatgtgaccaataaacctggcggcagcgcaaaagatg

SEQ ID NO: 28362 - DNA, 103 bp, Artificial Sequence
  Synthetic Polynucleotide
taatacgactcactataggggatggtactggtcaccatattggtcaactcaacagaggagagagttgatgaatatggtgaacctggcggcagcgcaaaagatg

SEQ ID NO: 28363 - DNA, 103 bp, Artificial Sequence
  Synthetic Polynucleotide
taatacgactcactatagggtcagtgatggtactggtcaccatattggtcaacagaggagagaccaaatgggtgaccagaacctggcggcagcgcaaaagatg

SEQ ID NO: 28364 - DNA, 103 bp, Artificial Sequence
  Synthetic Polynucleotide
taatacgactcactataggggcttttcagtgatggtactggtcaccatataacagaggagaatatggatgccagtaccaaacctggcggcagcgcaaaagatg

SEQ ID NO: 28365 - DNA, 103 bp, Artificial Sequence
  Synthetic Polynucleotide
taatacgactcactatagggaagtagcttttcagtgatggtactggtcacaacagaggagagtgaccatgaccatcactaacctggcggcagcgcaaaagatg

SEQ ID NO: 28366 - DNA, 103 bp, Artificial Sequence
  Synthetic Polynucleotide
taatacgactcactatagggttcttaagtagcttttcagtgatggtactgaacagaggagacagtacatgcactgaaaaaacctggcggcagcgcaaaagatg

SEQ ID NO: 28367 - DNA, 103 bp, Artificial Sequence
  Synthetic Polynucleotide
taatacgactcactatagggtcaagttcttaagtagcttttcagtgatggaacagaggagaccatcaatgaaaagctacaacctggcggcagcgcaaaagatg

SEQ ID NO: 28368 - DNA, 103 bp, Artificial Sequence
  Synthetic Polynucleotide
taatacgactcactatagggcttgatcaagttcttaagtagcttttcagtaacagaggagaactgaaatgctacttaagaacctggcggcagcgcaaaagatg

SEQ ID NO: 28369 - DNA, 103 bp, Artificial Sequence
  Synthetic Polynucleotide
taatacgactcactatagggcttcacaccttgttcacaactagcgtcccaaacagaggagatgggacatgagttgtgaaaacctggcggcagcgcaaaagatg

SEQ ID NO: 28370 - DNA, 103 bp, Artificial Sequence
  Synthetic Polynucleotide
taatacgactcactatagggatgatcttgatcaagttcttaagtagctttaacagaggagaaaagctatgtaagaacttaacctggcggcagcgcaaaagatg

SEQ ID NO: 28371 - DNA, 103 bp, Artificial Sequence
  Synthetic Polynucleotide
taatacgactcactatagggaggatatgatcttgatcaagttcttaagtaaacagaggagatacttaatgacttgatcaaacctggcggcagcgcaaaagatg

SEQ ID NO: 28372 - DNA, 103 bp, Artificial Sequence
  Synthetic Polynucleotide
taatacgactcactatagggtagtgaggatatgatcttgatcaagttcttaacagaggagaaagaacatgatcaagatcaacctggcggcagcgcaaaagatg

SEQ ID NO: 28373 - DNA, 103 bp, Artificial Sequence
  Synthetic Polynucleotide
taatacgactcactatagggataactagtgaggatatgatcttgatcaagaacagaggagacttgatatggatcatatcaacctggcggcagcgcaaaagatg

SEQ ID NO: 28374 - DNA, 103 bp, Artificial Sequence
  Synthetic Polynucleotide
taatacgactcactatagggttataataactagtgaggatatgatcttgaaacagaggagatcaagaatgtatcctcacaacctggcggcagcgcaaaagatg

SEQ ID NO: 28375 - DNA, 103 bp, Artificial Sequence
  Synthetic Polynucleotide
taatacgactcactatagggcctagttataataactagtgaggatatgataacagaggagaatcataatgtcactagttaacctggcggcagcgcaaaagatg

SEQ ID NO: 28376 - DNA, 103 bp, Artificial Sequence
  Synthetic Polynucleotide
taatacgactcactatagggtagttcctagttataataactagtgaggataacagaggagaatcctcatgagttattataacctggcggcagcgcaaaagatg

SEQ ID NO: 28377 - DNA, 103 bp, Artificial Sequence
  Synthetic Polynucleotide
taatacgactcactatagggcttcatagttcctagttataataactagtgaacagaggagacactagatgttataactaaacctggcggcagcgcaaaagatg

SEQ ID NO: 28378 - DNA, 103 bp, Artificial Sequence
  Synthetic Polynucleotide
taatacgactcactatagggggtgtcttcatagttcctagttataataacaacagaggagagttattatgactaggaacaacctggcggcagcgcaaaagatg

SEQ ID NO: 28379 - DNA, 103 bp, Artificial Sequence
  Synthetic Polynucleotide
taatacgactcactataggggttgtggtgtcttcatagttcctagttataaacagaggagatataacatggaactatgaaacctggcggcagcgcaaaagatg

SEQ ID NO: 28380 - DNA, 103 bp, Artificial Sequence
  Synthetic Polynucleotide
taatacgactcactataggggcaataccggagtactagccgccacgtgggaacagaggagacccacgatgcggctagtaaacctggcggcagcgcaaaagatg

SEQ ID NO: 28381 - DNA, 103 bp, Artificial Sequence
  Synthetic Polynucleotide
taatacgactcactatagggaggctcttcacaccttgttcacaactagcgaacagaggagacgctagatgtgaacaaggaacctggcggcagcgcaaaagatg

SEQ ID NO: 28382 - DNA, 103 bp, Artificial Sequence
  Synthetic Polynucleotide
taatacgactcactataggggcactgttgtggtgtcttcatagttcctagaacagaggagactaggaatgatgaagacaaacctggcggcagcgcaaaagatg

SEQ ID NO: 28383 - DNA, 103 bp, Artificial Sequence
  Synthetic Polynucleotide
taatacgactcactatagggagcgagcactgttgtggtgtcttcatagttaacagaggagaaactatatggacaccacaaacctggcggcagcgcaaaagatg

SEQ ID NO: 28384 - DNA, 103 bp, Artificial Sequence
  Synthetic Polynucleotide
taatacgactcactatagggagggtagcgagcactgttgtggtgtcttcaaacagaggagatgaagaatgcacaacagtaacctggcggcagcgcaaaagatg

SEQ ID NO: 28385 - DNA, 103 bp, Artificial Sequence
  Synthetic Polynucleotide
taatacgactcactataggggggccagggtagcgagcactgttgtggtgtaacagaggagaacaccaatgcagtgctcgaacctggcggcagcgcaaaagatg

SEQ ID NO: 28386 - DNA, 103 bp, Artificial Sequence
  Synthetic Polynucleotide
taatacgactcactatagggaagaagggccagggtagcgagcactgttgtaacagaggagaacaacaatgctcgctaccaacctggcggcagcgcaaaagatg

SEQ ID NO: 28387 - DNA, 103 bp, Artificial Sequence
  Synthetic Polynucleotide
taatacgactcactatagggcacccaagaagggccagggtagcgagcactaacagaggagaagtgctatgtaccctggcaacctggcggcagcgcaaaagatg

SEQ ID NO: 28388 - DNA, 103 bp, Artificial Sequence
  Synthetic Polynucleotide
taatacgactcactatagggcatcacacccaagaagggccagggtagcgaaacagaggagatcgctaatgtggcccttcaacctggcggcagcgcaaaagatg

SEQ ID NO: 28389 - DNA, 103 bp, Artificial Sequence
  Synthetic Polynucleotide
taatacgactcactatagggtgaagcatcacacccaagaagggccagggtaacagaggagaaccctgatgcttcttgggaacctggcggcagcgcaaaagatg

SEQ ID NO: 28390 - DNA, 103 bp, Artificial Sequence
  Synthetic Polynucleotide
taatacgactcactatagggcatggtgaagcatcacacccaagaagggccaacagaggagaggccctatgtgggtgtgaaacctggcggcagcgcaaaagatg

SEQ ID NO: 28391 - DNA, 103 bp, Artificial Sequence
  Synthetic Polynucleotide
taatacgactcactatagggactgccatggtgaagcatcacacccaagaaaacagaggagattcttgatggtgatgcttaacctggcggcagcgcaaaagatg

SEQ ID NO: 28392 - DNA, 103 bp, Artificial Sequence
  Synthetic Polynucleotide
taatacgactcactatagggtcaataggctcttcacaccttgttcacaacaacagaggagagttgtgatgaaggtgtgaaacctggcggcagcgcaaaagatg

SEQ ID NO: 28393 - DNA, 103 bp, Artificial Sequence
  Synthetic Polynucleotide
taatacgactcactatagggaagccactgccatggtgaagcatcacacccaacagaggagagggtgtatggcttcaccaaacctggcggcagcgcaaaagatg

SEQ ID NO: 28394 - DNA, 103 bp, Artificial Sequence
  Synthetic Polynucleotide
taatacgactcactatagggtttctaagccactgccatggtgaagcatcaaacagaggagatgatgcatgaccatggcaaacctggcggcagcgcaaaagatg

SEQ ID NO: 28395 - DNA, 103 bp, Artificial Sequence
  Synthetic Polynucleotide
taatacgactcactatagggctttctttctaagccactgccatggtgaagaacagaggagacttcacatgggcagtggcaacctggcggcagcgcaaaagatg

SEQ ID NO: 28396 - DNA, 103 bp, Artificial Sequence
  Synthetic Polynucleotide
taatacgactcactataggggcatgctttctttctaagccactgccatggaacagaggagaccatggatgtggcttagaaacctggcggcagcgcaaaagatg

SEQ ID NO: 28397 - DNA, 103 bp, Artificial Sequence
  Synthetic Polynucleotide
taatacgactcactatagggacatcgcatgctttctttctaagccactgcaacagaggagagcagtgatgtagaaagaaaacctggcggcagcgcaaaagatg

SEQ ID NO: 28398 - DNA, 103 bp, Artificial Sequence
  Synthetic Polynucleotide
taatacgactcactatagggccagaacatcgcatgctttctttctaagccaacagaggagaggcttaatgagaaagcataacctggcggcagcgcaaaagatg

SEQ ID NO: 28399 - DNA, 103 bp, Artificial Sequence
  Synthetic Polynucleotide
taatacgactcactatagggtatctccagaacatcgcatgctttctttctaacagaggagaagaaagatggcatgcgataacctggcggcagcgcaaaagatg

SEQ ID NO: 28400 - DNA, 103 bp, Artificial Sequence
  Synthetic Polynucleotide
taatacgactcactatagggtaaggtatctccagaacatcgcatgctttcaacagaggagagaaagcatgcgatgttctaacctggcggcagcgcaaaagatg

SEQ ID NO: 28401 - DNA, 103 bp, Artificial Sequence
  Synthetic Polynucleotide
taatacgactcactatagggtgacataaggtatctccagaacatcgcatgaacagaggagacatgcgatgttctggagaaacctggcggcagcgcaaaagatg

SEQ ID NO: 28402 - DNA, 103 bp, Artificial Sequence
  Synthetic Polynucleotide
taatacgactcactatagggcttgatgacataaggtatctccagaacatcaacagaggagagatgttatggagatacctaacctggcggcagcgcaaaagatg

SEQ ID NO: 28403 - DNA, 103 bp, Artificial Sequence
  Synthetic Polynucleotide
taatacgactcactataggggtagctcaataggctcttcacaccttgttcaacagaggagagaacaaatggtgaagagcaacctggcggcagcgcaaaagatg

SEQ ID NO: 28404 - DNA, 103 bp, Artificial Sequence
  Synthetic Polynucleotide
taatacgactcactatagggccttgcttgatgacataaggtatctccagaaacagaggagatctggaatgaccttatgtaacctggcggcagcgcaaaagatg

SEQ ID NO: 28405 - DNA, 103 bp, Artificial Sequence
  Synthetic Polynucleotide
taatacgactcactatagggtgtcaccttgcttgatgacataaggtatctaacagaggagaagatacatgatgtcatcaaacctggcggcagcgcaaaagatg

SEQ ID NO: 28406 - DNA, 103 bp, Artificial Sequence
  Synthetic Polynucleotide
taatacgactcactatagggccaactgtcaccttgcttgatgacataaggaacagaggagaccttatatgatcaagcaaaacctggcggcagcgcaaaagatg

SEQ ID NO: 28407 - DNA, 103 bp, Artificial Sequence
  Synthetic Polynucleotide
taatacgactcactatagggttcaaccaactgtcaccttgcttgatgacaaacagaggagatgtcatatggcaaggtgaaacctggcggcagcgcaaaagatg

SEQ ID NO: 28408 - DNA, 103 bp, Artificial Sequence
  Synthetic Polynucleotide
taatacgactcactatagggacttcttcaaccaactgtcaccttgcttgaaacagaggagatcaagcatggtgacagttaacctggcggcagcgcaaaagatg

SEQ ID NO: 28409 - DNA, 103 bp, Artificial Sequence
  Synthetic Polynucleotide
taatacgactcactatagggagtaaacttcttcaaccaactgtcaccttgaacagaggagacaaggtatgagttggttgaacctggcggcagcgcaaaagatg

SEQ ID NO: 28410 - DNA, 103 bp, Artificial Sequence
  Synthetic Polynucleotide
taatacgactcactataggggcttcagtaaacttcttcaaccaactgtcaaacagaggagatgacagatggttgaagaaaacctggcggcagcgcaaaagatg

SEQ ID NO: 28411 - DNA, 103 bp, Artificial Sequence
  Synthetic Polynucleotide
taatacgactcactatagggtgcatgcttcagtaaacttcttcaaccaacaacagaggagagttggtatgagaagtttaaacctggcggcagcgcaaaagatg

SEQ ID NO: 28412 - DNA, 103 bp, Artificial Sequence
  Synthetic Polynucleotide
taatacgactcactatagggtgcgttgcatgcttcagtaaacttcttcaaaacagaggagattgaagatgtttactgaaaacctggcggcagcgcaaaagatg

SEQ ID NO: 28413 - DNA, 103 bp, Artificial Sequence
  Synthetic Polynucleotide
taatacgactcactatagggttagctgcgttgcatgcttcagtaaacttcaacagaggagagaagttatgtgaagcatgaacctggcggcagcgcaaaagatg

SEQ ID NO: 28414 - DNA, 103 bp, Artificial Sequence
  Synthetic Polynucleotide
taatacgactcactatagggcttatgtagctcaataggctcttcacacctaacagaggagaaggtgtatggagcctattaacctggcggcagcgcaaaagatg

SEQ ID NO: 28415 - DNA, 103 bp, Artificial Sequence
  Synthetic Polynucleotide
taatacgactcactataggggtcccttagctgcgttgcatgcttcagtaaaacagaggagattactgatgcatgcaacgaacctggcggcagcgcaaaagatg

SEQ ID NO: 28416 - DNA, 103 bp, Artificial Sequence
  Synthetic Polynucleotide
taatacgactcactatagggctccagtcccttagctgcgttgcatgcttcaacagaggagagaagcaatgaacgcagctaacctggcggcagcgcaaaagatg

SEQ ID NO: 28417 - DNA, 103 bp, Artificial Sequence
  Synthetic Polynucleotide
taatacgactcactatagggacccactccagtcccttagctgcgttgcataacagaggagaatgcaaatgagctaagggaacctggcggcagcgcaaaagatg

SEQ ID NO: 28418 - DNA, 103 bp, Artificial Sequence
  Synthetic Polynucleotide
taatacgactcactatagggttgacacccactccagtcccttagctgcgtaacagaggagaacgcagatgagggactggaacctggcggcagcgcaaaagatg

SEQ ID NO: 28419 - DNA, 103 bp, Artificial Sequence
  Synthetic Polynucleotide
taatacgactcactatagggtttgtttgacacccactccagtcccttagcaacagaggagagctaagatgctggagtggaacctggcggcagcgcaaaagatg

SEQ ID NO: 28420 - DNA, 103 bp, Artificial Sequence
  Synthetic Polynucleotide
taatacgactcactataggggagattttgtttgacacccactccagtcccaacagaggagagggactatggtgggtgtcaacctggcggcagcgcaaaagatg

SEQ ID NO: 28421 - DNA, 103 bp, Artificial Sequence
  Synthetic Polynucleotide
taatacgactcactatagggattttgagattttgtttgacacccactccaaacagaggagatggagtatgtgtcaaacaaacctggcggcagcgcaaaagatg

SEQ ID NO: 28422 - DNA, 103 bp, Artificial Sequence
  Synthetic Polynucleotide
taatacgactcactatagggaatgaattttgagattttgtttgacacccaaacagaggagatgggtgatgaacaaaatcaacctggcggcagcgcaaaagatg

SEQ ID NO: 28423 - DNA, 103 bp, Artificial Sequence
  Synthetic Polynucleotide
taatacgactcactatagggcaatcaatgaattttgagattttgtttgacaacagaggagagtcaaaatgaatctcaaaaacctggcggcagcgcaaaagatg

SEQ ID NO: 28424 - DNA, 103 bp, Artificial Sequence
  Synthetic Polynucleotide
taatacgactcactatagggtgagccaatcaatgaattttgagattttgtaacagaggagaacaaaaatgcaaaattcaaacctggcggcagcgcaaaagatg

SEQ ID NO: 28425 - DNA, 103 bp, Artificial Sequence
  Synthetic Polynucleotide
taatacgactcactatagggggattcttatgtagctcaataggctcttcaaacagaggagatgaagaatgtattgagctaacctggcggcagcgcaaaagatg

SEQ ID NO: 28426 - DNA, 103 bp, Artificial Sequence
  Synthetic Polynucleotide
taatacgactcactatagggctccttgagccaatcaatgaattttgagataacagaggagaatctcaatgttcattgataacctggcggcagcgcaaaagatg

SEQ ID NO: 28427 - DNA, 103 bp, Artificial Sequence
  Synthetic Polynucleotide
taatacgactcactatagggattttctccttgagccaatcaatgaattttaacagaggagaaaaattatgtgattggctaacctggcggcagcgcaaaagatg

SEQ ID NO: 28428 - DNA, 103 bp, Artificial Sequence
  Synthetic Polynucleotide
taatacgactcactatagggggataattttctccttgagccaatcaatgaaacagaggagatcattgatgggctcaaggaacctggcggcagcgcaaaagatg

SEQ ID NO: 28429 - DNA, 103 bp, Artificial Sequence
  Synthetic Polynucleotide
taatacgactcactatagggttgtgggataattttctccttgagccaatcaacagaggagagattggatgaaggagaaaaacctggcggcagcgcaaaagatg

SEQ ID NO: 28430 - DNA, 103 bp, Artificial Sequence
  Synthetic Polynucleotide
taatacgactcactatagggctagcttgtgggataattttctccttgagcaacagaggagagctcaaatggaaaattataacctggcggcagcgcaaaagatg

SEQ ID NO: 28431 - DNA, 103 bp, Artificial Sequence
  Synthetic Polynucleotide
taatacgactcactatagggtatctctagcttgtgggataattttctcctaacagaggagaaggagaatgttatcccacaacctggcggcagcgcaaaagatg

SEQ ID NO: 28432 - DNA, 103 bp, Artificial Sequence
  Synthetic Polynucleotide
taatacgactcactatagggcaacttatctctagcttgtgggataattttaacagaggagaaaaattatgccacaagctaacctggcggcagcgcaaaagatg

SEQ ID NO: 28433 - DNA, 103 bp, Artificial Sequence
  Synthetic Polynucleotide
taatacgactcactatagggaattccaacttatctctagcttgtgggataaacagaggagatatcccatgagctagagaaacctggcggcagcgcaaaagatg

SEQ ID NO: 28434 - DNA, 103 bp, Artificial Sequence
  Synthetic Polynucleotide
taatacgactcactatagggttacaaattccaacttatctctagcttgtgaacagaggagacacaagatggagataagtaacctggcggcagcgcaaaagatg

SEQ ID NO: 28435 - DNA, 103 bp, Artificial Sequence
  Synthetic Polynucleotide
taatacgactcactatagggttttgttacaaattccaacttatctctagcaacagaggagagctagaatgaagttggaaaacctggcggcagcgcaaaagatg

SEQ ID NO: 28436 - DNA, 103 bp, Artificial Sequence
  Synthetic Polynucleotide
taatacgactcactatagggccggaggattcttatgtagctcaataggctaacagaggagaagcctaatgagctacataaacctggcggcagcgcaaaagatg

SEQ ID NO: 28437 - DNA, 103 bp, Artificial Sequence
  Synthetic Polynucleotide
taatacgactcactatagggctaagttttgttacaaattccaacttatctaacagaggagaagataaatgggaatttgtaacctggcggcagcgcaaaagatg

SEQ ID NO: 28438 - DNA, 103 bp, Artificial Sequence
  Synthetic Polynucleotide
taatacgactcactataggggttgtctaagttttgttacaaattccaactaacagaggagaagttggatgttgtaacaaaacctggcggcagcgcaaaagatg

SEQ ID NO: 28439 - DNA, 103 bp, Artificial Sequence
  Synthetic Polynucleotide
taatacgactcactatagggttctagttgtctaagttttgttacaaattcaacagaggagagaatttatgacaaaacttaacctggcggcagcgcaaaagatg

SEQ ID NO: 28440 - DNA, 103 bp, Artificial Sequence
  Synthetic Polynucleotide
taatacgactcactatagggagcatttctagttgtctaagttttgttacaaacagaggagatgtaacatgacttagacaaacctggcggcagcgcaaaagatg

SEQ ID NO: 28441 - DNA, 103 bp, Artificial Sequence
  Synthetic Polynucleotide
taatacgactcactatagggtttccagcatttctagttgtctaagttttgaacagaggagacaaaacatggacaactagaacctggcggcagcgcaaaagatg

SEQ ID NO: 28442 - DNA, 103 bp, Artificial Sequence
  Synthetic Polynucleotide
taatacgactcactatagggttggttttccagcatttctagttgtctaagaacagaggagacttagaatgctagaaatgaacctggcggcagcgcaaaagatg

SEQ ID NO: 28443 - DNA, 103 bp, Artificial Sequence
  Synthetic Polynucleotide
taatacgactcactataggggagatttggttttccagcatttctagttgtaacagaggagaacaactatgaatgctggaaacctggcggcagcgcaaaagatg

SEQ ID NO: 28444 - DNA, 103 bp, Artificial Sequence
  Synthetic Polynucleotide
taatacgactcactatagggtagttgagatttggttttccagcatttctaaacagaggagatagaaaatgtggaaaaccaacctggcggcagcgcaaaagatg

SEQ ID NO: 28445 - DNA, 103 bp, Artificial Sequence
  Synthetic Polynucleotide
taatacgactcactataggggtgtatagttgagatttggttttccagcataacagaggagaatgctgatgaaccaaatcaacctggcggcagcgcaaaagatg

SEQ ID NO: 28446 - DNA, 103 bp, Artificial Sequence
  Synthetic Polynucleotide
taatacgactcactataggggattggtgtatagttgagatttggttttccaacagaggagaggaaaaatgaatctcaacaacctggcggcagcgcaaaagatg

SEQ ID NO: 28447 - DNA, 103 bp, Artificial Sequence
  Synthetic Polynucleotide
taatacgactcactatagggaggggccggaggattcttatgtagctcaataacagaggagaattgagatgcataagaataacctggcggcagcgcaaaagatg

SEQ ID NO: 28448 - DNA, 103 bp, Artificial Sequence
  Synthetic Polynucleotide
taatacgactcactatagggggcatgattggtgtatagttgagatttggtaacagaggagaaccaaaatgcaactatacaacctggcggcagcgcaaaagatg

SEQ ID NO: 28449 - DNA, 103 bp, Artificial Sequence
  Synthetic Polynucleotide
taatacgactcactatagggactagggcatgattggtgtatagttgagataacagaggagaatctcaatgatacaccaaaacctggcggcagcgcaaaagatg

SEQ ID NO: 28450 - DNA, 103 bp, Artificial Sequence
  Synthetic Polynucleotide
taatacgactcactatagggtcctgactagggcatgattggtgtatagttaacagaggagaaactatatgccaatcatgaacctggcggcagcgcaaaagatg

SEQ ID NO: 28451 - DNA, 103 bp, Artificial Sequence
  Synthetic Polynucleotide
taatacgactcactatagggggtgttcctgactagggcatgattggtgtaaacagaggagatacaccatgcatgccctaaacctggcggcagcgcaaaagatg

SEQ ID NO: 28452 - DNA, 103 bp, Artificial Sequence
  Synthetic Polynucleotide
taatacgactcactatagggttcctggtgttcctgactagggcatgattgaacagaggagacaatcaatgcctagtcagaacctggcggcagcgcaaaagatg

SEQ ID NO: 28453 - DNA, 103 bp, Artificial Sequence
  Synthetic Polynucleotide
taatacgactcactatagggagaatttcctggtgttcctgactagggcataacagaggagaatgcccatgtcaggaacaaacctggcggcagcgcaaaagatg

SEQ ID NO: 28454 - DNA, 103 bp, Artificial Sequence
  Synthetic Polynucleotide
taatacgactcactatagggtgaatagaatttcctggtgttcctgactagaacagaggagactagtcatgaacaccaggaacctggcggcagcgcaaaagatg

SEQ ID NO: 28455 - DNA, 103 bp, Artificial Sequence
  Synthetic Polynucleotide
taatacgactcactatagggattattgaatagaatttcctggtgttcctgaacagaggagacaggaaatgcaggaaattaacctggcggcagcgcaaaagatg

SEQ ID NO: 28456 - DNA, 103 bp, Artificial Sequence
  Synthetic Polynucleotide
taatacgactcactatagggctgacattattgaatagaatttcctggtgtaacagaggagaacaccaatgaattctattaacctggcggcagcgcaaaagatg

SEQ ID NO: 28457 - DNA, 103 bp, Artificial Sequence
  Synthetic Polynucleotide
taatacgactcactatagggaccatctgacattattgaatagaatttcctaacagaggagaaggaaaatgtattcaataaacctggcggcagcgcaaaagatg

SEQ ID NO: 28458 - DNA, 103 bp, Artificial Sequence
  Synthetic Polynucleotide
taatacgactcactatagggcattcaggggccggaggattcttatgtagcaacagaggagagctacaatggaatcctccaacctggcggcagcgcaaaagatg

SEQ ID NO: 28459 - DNA, 103 bp, Artificial Sequence
  Synthetic Polynucleotide
taatacgactcactatagggggataaccatctgacattattgaatagaataacagaggagaattctaatgaataatgtcaacctggcggcagcgcaaaagatg

SEQ ID NO: 28460 - DNA, 103 bp, Artificial Sequence
  Synthetic Polynucleotide
taatacgactcactatagggtggatggataaccatctgacattattgaataacagaggagaattcaaatgtgtcagatgaacctggcggcagcgcaaaagatg

SEQ ID NO: 28461 - DNA, 103 bp, Artificial Sequence
  Synthetic Polynucleotide
taatacgactcactatagggtagactggatggataaccatctgacattataacagaggagaataatgatggatggttataacctggcggcagcgcaaaagatg

SEQ ID NO: 28462 - DNA, 103 bp, Artificial Sequence
  Synthetic Polynucleotide
taatacgactcactatagggcctcttagactggatggataaccatctgacaacagaggagagtcagaatgttatccatcaacctggcggcagcgcaaaagatg

SEQ ID NO: 28463 - DNA, 103 bp, Artificial Sequence
  Synthetic Polynucleotide
taatacgactcactataggggcaaacctcttagactggatggataaccataacagaggagaatggttatgcatccagtcaacctggcggcagcgcaaaagatg

SEQ ID NO: 28464 - DNA, 103 bp, Artificial Sequence
  Synthetic Polynucleotide
taatacgactcactataggggaggggcaaacctcttagactggatggataaacagaggagatatccaatgagtctaagaaacctggcggcagcgcaaaagatg

SEQ ID NO: 28465 - DNA, 103 bp, Artificial Sequence
  Synthetic Polynucleotide
taatacgactcactataggggtaaagaggggcaaacctcttagactggataacagaggagaatccagatgaagaggtttaacctggcggcagcgcaaaagatg

SEQ ID NO: 28466 - DNA, 103 bp, Artificial Sequence
  Synthetic Polynucleotide
taatacgactcactatagggactgcgtaaagaggggcaaacctcttagacaacagaggagagtctaaatggtttgccccaacctggcggcagcgcaaaagatg

SEQ ID NO: 28467 - DNA, 103 bp, Artificial Sequence
  Synthetic Polynucleotide
taatacgactcactatagggcttccactgcgtaaagaggggcaaacctctaacagaggagaagaggtatgcccctctttaacctggcggcagcgcaaaagatg

SEQ ID NO: 28468 - DNA, 103 bp, Artificial Sequence
  Synthetic Polynucleotide
taatacgactcactatagggtttggcttccactgcgtaaagaggggcaaaaacagaggagatttgccatgctttacgcaaacctggcggcagcgcaaaagatg

SEQ ID NO: 28469 - DNA, 103 bp, Artificial Sequence
  Synthetic Polynucleotide
taatacgactcactatagggagccgcattcaggggccggaggattcttataacagaggagaataagaatgctccggcccaacctggcggcagcgcaaaagatg

SEQ ID NO: 28470 - DNA, 103 bp, Artificial Sequence
  Synthetic Polynucleotide
taatacgactcactatagggattcttttggcttccactgcgtaaagagggaacagaggagaccctctatgcgcagtggaaacctggcggcagcgcaaaagatg

SEQ ID NO: 28471 - DNA, 103 bp, Artificial Sequence
  Synthetic Polynucleotide
taatacgactcactatagggtctgtattcttttggcttccactgcgtaaaaacagaggagatttacgatgtggaagccaaacctggcggcagcgcaaaagatg

SEQ ID NO: 28472 - DNA, 103 bp, Artificial Sequence
  Synthetic Polynucleotide
taatacgactcactatagggtagtttctgtattcttttggcttccactgcaacagaggagagcagtgatggccaaaagaaacctggcggcagcgcaaaagatg

SEQ ID NO: 28473 - DNA, 103 bp, Artificial Sequence
  Synthetic Polynucleotide
taatacgactcactatagggtgctctagtttctgtattcttttggcttccaacagaggagaggaagcatgaagaatacaaacctggcggcagcgcaaaagatg

SEQ ID NO: 28474 - DNA, 103 bp, Artificial Sequence
  Synthetic Polynucleotide
taatacgactcactatagggtagtatgctctagtttctgtattcttttggaacagaggagaccaaaaatgtacagaaacaacctggcggcagcgcaaaagatg

SEQ ID NO: 28475 - DNA, 103 bp, Artificial Sequence
  Synthetic Polynucleotide
taatacgactcactataggggttaatagtatgctctagtttctgtattctaacagaggagaagaataatgaaactagagaacctggcggcagcgcaaaagatg

SEQ ID NO: 28476 - DNA, 103 bp, Artificial Sequence
  Synthetic Polynucleotide
taatacgactcactatagggtagttgttaatagtatgctctagtttctgtaacagaggagaacagaaatgagagcatacaacctggcggcagcgcaaaagatg

SEQ ID NO: 28477 - DNA, 103 bp, Artificial Sequence
  Synthetic Polynucleotide
taatacgactcactataggggtatgtagttgttaatagtatgctctagttaacagaggagaaactagatgatactattaaacctggcggcagcgcaaaagatg

SEQ ID NO: 28478 - DNA, 103 bp, Artificial Sequence
  Synthetic Polynucleotide
taatacgactcactataggggaactgtatgtagttgttaatagtatgctcaacagaggagagagcatatgattaacaacaacctggcggcagcgcaaaagatg

SEQ ID NO: 28479 - DNA, 103 bp, Artificial Sequence
  Synthetic Polynucleotide
taatacgactcactatagggctcttgaactgtatgtagttgttaatagtaaacagaggagatactatatgcaactacataacctggcggcagcgcaaaagatg

SEQ ID NO: 28480 - DNA, 103 bp, Artificial Sequence
  Synthetic Polynucleotide
taatacgactcactatagggggattagccgcattcaggggccggaggattaacagaggagaaatcctatggcccctgaaaacctggcggcagcgcaaaagatg

SEQ ID NO: 28481 - DNA, 103 bp, Artificial Sequence
  Synthetic Polynucleotide
taatacgactcactataggggtttgctcttgaactgtatgtagttgttaaaacagaggagattaacaatgacatacagtaacctggcggcagcgcaaaagatg

SEQ ID NO: 28482 - DNA, 103 bp, Artificial Sequence
  Synthetic Polynucleotide
taatacgactcactatagggacggtgtttgctcttgaactgtatgtagttaacagaggagaaactacatgcagttcaagaacctggcggcagcgcaaaagatg

SEQ ID NO: 28483 - DNA, 103 bp, Artificial Sequence
  Synthetic Polynucleotide
taatacgactcactatagggtcaatacggtgtttgctcttgaactgtatgaacagaggagacatacaatgcaagagcaaaacctggcggcagcgcaaaagatg

SEQ ID NO: 28484 - DNA, 103 bp, Artificial Sequence
  Synthetic Polynucleotide
taatacgactcactatagggctggttcaatacggtgtttgctcttgaactaacagaggagaagttcaatggcaaacaccaacctggcggcagcgcaaaagatg

SEQ ID NO: 28485 - DNA, 103 bp, Artificial Sequence
  Synthetic Polynucleotide
taatacgactcactatagggacatactggttcaatacggtgtttgctcttaacagaggagaaagagcatgcaccgtattaacctggcggcagcgcaaaagatg

SEQ ID NO: 28486 - DNA, 103 bp, Artificial Sequence
  Synthetic Polynucleotide
taatacgactcactatagggagcaaacatactggttcaatacggtgtttgaacagaggagacaaacaatgtattgaaccaacctggcggcagcgcaaaagatg

SEQ ID NO: 28487 - DNA, 103 bp, Artificial Sequence
  Synthetic Polynucleotide
taatacgactcactataggggtactagcaaacatactggttcaatacggtaacagaggagaaccgtaatgaaccagtataacctggcggcagcgcaaaagatg

SEQ ID NO: 28488 - DNA, 103 bp, Artificial Sequence
  Synthetic Polynucleotide
taatacgactcactataggggccatgtactagcaaacatactggttcaataacagaggagaattgaaatggtatgtttgaacctggcggcagcgcaaaagatg

SEQ ID NO: 28489 - DNA, 103 bp, Artificial Sequence
  Synthetic Polynucleotide
taatacgactcactataggggggctgccatgtactagcaaacatactggtaacagaggagaaccagtatgtttgctagtaacctggcggcagcgcaaaagatg

SEQ ID NO: 28490 - DNA, 103 bp, Artificial Sequence
  Synthetic Polynucleotide
taatacgactcactatagggttccggggctgccatgtactagcaaacataaacagaggagatatgttatgtagtacatgaacctggcggcagcgcaaaagatg

SEQ ID NO: 28491 - DNA, 103 bp, Artificial Sequence
  Synthetic Polynucleotide
taatacgactcactataggggtaccgcaataccggagtactagccgccacaacagaggagagtggcgatgagtactccgaacctggcggcagcgcaaaagatg

SEQ ID NO: 28492 - DNA, 103 bp, Artificial Sequence
  Synthetic Polynucleotide
taatacgactcactatagggggttgggattagccgcattcaggggccggaaacagaggagatccggcatgtgaatgcggaacctggcggcagcgcaaaagatg

SEQ ID NO: 28493 - DNA, 103 bp, Artificial Sequence
  Synthetic Polynucleotide
taatacgactcactatagggacctgttccggggctgccatgtactagcaaaacagaggagattgctaatgcatggcagcaacctggcggcagcgcaaaagatg

SEQ ID NO: 28494 - DNA, 103 bp, Artificial Sequence
  Synthetic Polynucleotide
taatacgactcactataggggatttacctgttccggggctgccatgtactaacagaggagaagtacaatgcagccccggaacctggcggcagcgcaaaagatg

SEQ ID NO: 28495 - DNA, 103 bp, Artificial Sequence
  Synthetic Polynucleotide
taatacgactcactatagggctacagatttacctgttccggggctgccataacagaggagaatggcaatgccggaacagaacctggcggcagcgcaaaagatg

SEQ ID NO: 28496 - DNA, 103 bp, Artificial Sequence
  Synthetic Polynucleotide
taatacgactcactatagggggttgctacagatttacctgttccggggctaacagaggagaagccccatgacaggtaaaaacctggcggcagcgcaaaagatg

SEQ ID NO: 28497 - DNA, 103 bp, Artificial Sequence
  Synthetic Polynucleotide
taatacgactcactatagggaggttggttgctacagatttacctgttccgaacagaggagacggaacatgtaaatctgtaacctggcggcagcgcaaaagatg

SEQ ID NO: 28498 - DNA, 103 bp, Artificial Sequence
  Synthetic Polynucleotide
taatacgactcactatagggcaatcaggttggttgctacagatttacctgaacagaggagacaggtaatgctgtagcaaaacctggcggcagcgcaaaagatg

SEQ ID NO: 28499 - DNA, 103 bp, Artificial Sequence
  Synthetic Polynucleotide
taatacgactcactatagggtctagcaatcaggttggttgctacagatttaacagaggagaaaatctatggcaaccaacaacctggcggcagcgcaaaagatg

SEQ ID NO: 28500 - DNA, 103 bp, Artificial Sequence
  Synthetic Polynucleotide
taatacgactcactatagggatggctctagcaatcaggttggttgctacaaacagaggagatgtagcatgcaacctgataacctggcggcagcgcaaaagatg

SEQ ID NO: 28501 - DNA, 103 bp, Artificial Sequence
  Synthetic Polynucleotide
taatacgactcactatagggcagctatggctctagcaatcaggttggttgaacagaggagacaaccaatgtgattgctaaacctggcggcagcgcaaaagatg

SEQ ID NO: 28502 - DNA, 103 bp, Artificial Sequence
  Synthetic Polynucleotide
taatacgactcactatagggtctttcagctatggctctagcaatcaggttaacagaggagaaacctgatggctagagccaacctggcggcagcgcaaaagatg

SEQ ID NO: 28503 - DNA, 103 bp, Artificial Sequence
  Synthetic Polynucleotide
taatacgactcactatagggtccgaggttgggattagccgcattcaggggaacagaggagacccctgatggcggctaataacctggcggcagcgcaaaagatg

SEQ ID NO: 28504 - DNA, 103 bp, Artificial Sequence
  Synthetic Polynucleotide
taatacgactcactatagggttttctctttcagctatggctctagcaatcaacagaggagagattgcatgagccatagcaacctggcggcagcgcaaaagatg

SEQ ID NO: 28505 - DNA, 103 bp, Artificial Sequence
  Synthetic Polynucleotide
taatacgactcactatagggacgtgttttctctttcagctatggctctagaacagaggagactagagatgtagctgaaaaacctggcggcagcgcaaaagatg

SEQ ID NO: 28506 - DNA, 103 bp, Artificial Sequence
  Synthetic Polynucleotide
taatacgactcactatagggcgtggacgtgttttctctttcagctatggcaacagaggagagccataatggaaagagaaaacctggcggcagcgcaaaagatg

SEQ ID NO: 28507 - DNA, 103 bp, Artificial Sequence
  Synthetic Polynucleotide
taatacgactcactataggggagtacgtggacgtgttttctctttcagctaacagaggagaagctgaatgagaaaacacaacctggcggcagcgcaaaagatg

SEQ ID NO: 28508 - DNA, 103 bp, Artificial Sequence
  Synthetic Polynucleotide
taatacgactcactataggggtagcgagtacgtggacgtgttttctctttaacagaggagaaaagagatgacacgtccaaacctggcggcagcgcaaaagatg

SEQ ID NO: 28509 - DNA, 103 bp, Artificial Sequence
  Synthetic Polynucleotide
taatacgactcactatagggcgggggtagcgagtacgtggacgtgttttcaacagaggagagaaaacatgtccacgtacaacctggcggcagcgcaaaagatg

SEQ ID NO: 28510 - DNA, 103 bp, Artificial Sequence
  Synthetic Polynucleotide
taatacgactcactatagggggatccgggggtagcgagtacgtggacgtgaacagaggagacacgtcatggtactcgctaacctggcggcagcgcaaaagatg

SEQ ID NO: 28511 - DNA, 103 bp, Artificial Sequence
  Synthetic Polynucleotide
taatacgactcactataggggtgatggatccgggggtagcgagtacgtggaacagaggagaccacgtatgcgctaccccaacctggcggcagcgcaaaagatg

SEQ ID NO: 28512 - DNA, 103 bp, Artificial Sequence
  Synthetic Polynucleotide
taatacgactcactataggggaagtgtgatggatccgggggtagcgagtaaacagaggagatactcgatgcccccggataacctggcggcagcgcaaaagatg

SEQ ID NO: 28513 - DNA, 103 bp, Artificial Sequence
  Synthetic Polynucleotide
taatacgactcactatagggccgtcgaagtgtgatggatccgggggtagcaacagaggagagctaccatgggatccatcaacctggcggcagcgcaaaagatg

SEQ ID NO: 28514 - DNA, 103 bp, Artificial Sequence
  Synthetic Polynucleotide
taatacgactcactatagggcctgctccgaggttgggattagccgcattcaacagaggagagaatgcatgtaatcccaaaacctggcggcagcgcaaaagatg

SEQ ID NO: 28515 - DNA, 103 bp, Artificial Sequence
  Synthetic Polynucleotide
taatacgactcactatagggtgtatccgtcgaagtgtgatggatccggggaacagaggagaccccggatgcatcacactaacctggcggcagcgcaaaagatg

SEQ ID NO: 28516 - DNA, 103 bp, Artificial Sequence
  Synthetic Polynucleotide
taatacgactcactatagggttgtttgtatccgtcgaagtgtgatggatcaacagaggagagatccaatgcacttcgacaacctggcggcagcgcaaaagatg

SEQ ID NO: 28517 - DNA, 103 bp, Artificial Sequence
  Synthetic Polynucleotide
taatacgactcactatagggccctgttgtttgtatccgtcgaagtgtgataacagaggagaatcacaatgcgacggataaacctggcggcagcgcaaaagatg

SEQ ID NO: 28518 - DNA, 103 bp, Artificial Sequence
  Synthetic Polynucleotide
taatacgactcactatagggccactccctgttgtttgtatccgtcgaagtaacagaggagaacttcgatggatacaaacaacctggcggcagcgcaaaagatg

SEQ ID NO: 28519 - DNA, 103 bp, Artificial Sequence
  Synthetic Polynucleotide
taatacgactcactatagggaatcaccactccctgttgtttgtatccgtcaacagaggagagacggaatgaaacaacagaacctggcggcagcgcaaaagatg

SEQ ID NO: 28520 - DNA, 103 bp, Artificial Sequence
  Synthetic Polynucleotide
taatacgactcactatagggtccataatcaccactccctgttgtttgtataacagaggagaatacaaatgacagggagtaacctggcggcagcgcaaaagatg

SEQ ID NO: 28521 - DNA, 103 bp, Artificial Sequence
  Synthetic Polynucleotide
taatacgactcactatagggggtcgtccataatcaccactccctgttgttaacagaggagaaacaacatggagtggtgaaacctggcggcagcgcaaaagatg

SEQ ID NO: 28522 - DNA, 103 bp, Artificial Sequence
  Synthetic Polynucleotide
taatacgactcactatagggattcaggtcgtccataatcaccactccctgaacagaggagacagggaatggtgattatgaacctggcggcagcgcaaaagatg

SEQ ID NO: 28523 - DNA, 103 bp, Artificial Sequence
  Synthetic Polynucleotide
taatacgactcactatagggttttgattcaggtcgtccataatcaccactaacagaggagaagtggtatgtatggacgaaacctggcggcagcgcaaaagatg

SEQ ID NO: 28524 - DNA, 103 bp, Artificial Sequence
  Synthetic Polynucleotide
taatacgactcactatagggctgggttttgattcaggtcgtccataatcaaacagaggagatgattaatgacgacctgaaacctggcggcagcgcaaaagatg

SEQ ID NO: 28525 - DNA, 103 bp, Artificial Sequence
  Synthetic Polynucleotide
taatacgactcactataggggaccacctgctccgaggttgggattagccgaacagaggagacggctaatgccaacctcgaacctggcggcagcgcaaaagatg

SEQ ID NO: 28526 - DNA, 103 bp, Artificial Sequence
  Synthetic Polynucleotide
taatacgactcactatagggaccatctgggttttgattcaggtcgtccataacagaggagaatggacatgctgaatcaaaacctggcggcagcgcaaaagatg

SEQ ID NO: 28527 - DNA, 103 bp, Artificial Sequence
  Synthetic Polynucleotide
taatacgactcactatagggtccgcaccatctgggttttgattcaggtcgaacagaggagacgacctatgtcaaaacccaacctggcggcagcgcaaaagatg

SEQ ID NO: 28528 - DNA, 103 bp, Artificial Sequence
  Synthetic Polynucleotide
taatacgactcactatagggtcatgtccgcaccatctgggttttgattcaaacagaggagatgaatcatgacccagatgaacctggcggcagcgcaaaagatg

SEQ ID NO: 28529 - DNA, 103 bp, Artificial Sequence
  Synthetic Polynucleotide
taatacgactcactatagggcagcttcatgtccgcaccatctgggttttgaacagaggagacaaaacatggatggtgcgaacctggcggcagcgcaaaagatg

SEQ ID NO: 28530 - DNA, 103 bp, Artificial Sequence
  Synthetic Polynucleotide
taatacgactcactatagggcagaacagcttcatgtccgcaccatctgggaacagaggagacccagaatgtgcggacataacctggcggcagcgcaaaagatg

SEQ ID NO: 28531 - DNA, 103 bp, Artificial Sequence
  Synthetic Polynucleotide
taatacgactcactatagggtctgacagaacagcttcatgtccgcaccataacagaggagaatggtgatgacatgaagcaacctggcggcagcgcaaaagatg

SEQ ID NO: 28532 - DNA, 103 bp, Artificial Sequence
  Synthetic Polynucleotide
taatacgactcactatagggtaccatctgacagaacagcttcatgtccgcaacagaggagagcggacatgaagctgttcaacctggcggcagcgcaaaagatg

SEQ ID NO: 28533 - DNA, 103 bp, Artificial Sequence
  Synthetic Polynucleotide
taatacgactcactataggggttgataccatctgacagaacagcttcatgaacagaggagacatgaaatggttctgtcaaacctggcggcagcgcaaaagatg

SEQ ID NO: 28534 - DNA, 103 bp, Artificial Sequence
  Synthetic Polynucleotide
taatacgactcactatagggccactgttgataccatctgacagaacagctaacagaggagaagctgtatggtcagatggaacctggcggcagcgcaaaagatg

SEQ ID NO: 28535 - DNA, 103 bp, Artificial Sequence
  Synthetic Polynucleotide
taatacgactcactatagggaaactccactgttgataccatctgacagaaaacagaggagattctgtatgatggtatcaaacctggcggcagcgcaaaagatg

SEQ ID NO: 28536 - DNA, 103 bp, Artificial Sequence
  Synthetic Polynucleotide
taatacgactcactatagggtttgtgaccacctgctccgaggttgggattaacagaggagaaatcccatgctcggagcaaacctggcggcagcgcaaaagatg

SEQ ID NO: 28537 - DNA, 103 bp, Artificial Sequence
  Synthetic Polynucleotide
taatacgactcactatagggggtataaactccactgttgataccatctgaaacagaggagatcagatatgatcaacagtaacctggcggcagcgcaaaagatg

SEQ ID NO: 28538 - DNA, 103 bp, Artificial Sequence
  Synthetic Polynucleotide
taatacgactcactatagggtgggtggtataaactccactgttgataccaaacagaggagatggtatatgcagtggagtaacctggcggcagcgcaaaagatg

SEQ ID NO: 28539 - DNA, 103 bp, Artificial Sequence
  Synthetic Polynucleotide
taatacgactcactatagggtgccatgggtggtataaactccactgttgaaacagaggagatcaacaatggagtttataaacctggcggcagcgcaaaagatg

SEQ ID NO: 28540 - DNA, 103 bp, Artificial Sequence
  Synthetic Polynucleotide
taatacgactcactatagggagggatgccatgggtggtataaactccactaacagaggagaagtggaatgtataccaccaacctggcggcagcgcaaaagatg

SEQ ID NO: 28541 - DNA, 103 bp, Artificial Sequence
  Synthetic Polynucleotide
taatacgactcactatagggcctccagggatgccatgggtggtataaactaacagaggagaagtttaatgcacccatggaacctggcggcagcgcaaaagatg

SEQ ID NO: 28542 - DNA, 103 bp, Artificial Sequence
  Synthetic Polynucleotide
taatacgactcactatagggtttctcctccagggatgccatgggtggtataacagaggagaataccaatgatggcatccaacctggcggcagcgcaaaagatg

SEQ ID NO: 28543 - DNA, 103 bp, Artificial Sequence
  Synthetic Polynucleotide
taatacgactcactatagggattcctttctcctccagggatgccatgggtaacagaggagaacccatatgatccctggaaacctggcggcagcgcaaaagatg

SEQ ID NO: 28544 - DNA, 103 bp, Artificial Sequence
  Synthetic Polynucleotide
taatacgactcactatagggacaggattcctttctcctccagggatgccaaacagaggagatggcatatgtggaggagaaacctggcggcagcgcaaaagatg

SEQ ID NO: 28545 - DNA, 103 bp, Artificial Sequence
  Synthetic Polynucleotide
taatacgactcactatagggagtaaacaggattcctttctcctccagggaaacagaggagatccctgatggagaaaggaaacctggcggcagcgcaaaagatg

SEQ ID NO: 28546 - DNA, 103 bp, Artificial Sequence
  Synthetic Polynucleotide
taatacgactcactatagggtttgaagtaaacaggattcctttctcctccaacagaggagaggaggaatgaggaatcctaacctggcggcagcgcaaaagatg

SEQ ID NO: 28547 - DNA, 103 bp, Artificial Sequence
  Synthetic Polynucleotide
taatacgactcactatagggactggtttgtgaccacctgctccgaggttgaacagaggagacaacctatgagcaggtggaacctggcggcagcgcaaaagatg

SEQ ID NO: 28548 - DNA, 103 bp, Artificial Sequence
  Synthetic Polynucleotide
taatacgactcactatagggcgtaatttgaagtaaacaggattcctttctaacagaggagaagaaagatgtcctgtttaaacctggcggcagcgcaaaagatg

SEQ ID NO: 28549 - DNA, 103 bp, Artificial Sequence
  Synthetic Polynucleotide
taatacgactcactatagggtagaacgtaatttgaagtaaacaggattccaacagaggagaggaatcatgtttacttcaaacctggcggcagcgcaaaagatg

SEQ ID NO: 28550 - DNA, 103 bp, Artificial Sequence
  Synthetic Polynucleotide
taatacgactcactataggggatgctagaacgtaatttgaagtaaacaggaacagaggagacctgttatgttcaaattaaacctggcggcagcgcaaaagatg

SEQ ID NO: 28551 - DNA, 103 bp, Artificial Sequence
  Synthetic Polynucleotide
taatacgactcactatagggttgtggatgctagaacgtaatttgaagtaaaacagaggagattacttatgattacgttcaacctggcggcagcgcaaaagatg

SEQ ID NO: 28552 - DNA, 103 bp, Artificial Sequence
  Synthetic Polynucleotide
taatacgactcactatagggtgagtttgtggatgctagaacgtaatttgaaacagaggagatcaaatatggttctagcaaacctggcggcagcgcaaaagatg

SEQ ID NO: 28553 - DNA, 103 bp, Artificial Sequence
  Synthetic Polynucleotide
taatacgactcactatagggctgcttgagtttgtggatgctagaacgtaaaacagaggagattacgtatgagcatccacaacctggcggcagcgcaaaagatg

SEQ ID NO: 28554 - DNA, 103 bp, Artificial Sequence
  Synthetic Polynucleotide
taatacgactcactatagggaaattctgcttgagtttgtggatgctagaaaacagaggagattctagatgccacaaactaacctggcggcagcgcaaaagatg

SEQ ID NO: 28555 - DNA, 103 bp, Artificial Sequence
  Synthetic Polynucleotide
taatacgactcactataggggggggaaattctgcttgagtttgtggatgcaacagaggagagcatccatgaactcaagcaacctggcggcagcgcaaaagatg

SEQ ID NO: 28556 - DNA, 103 bp, Artificial Sequence
  Synthetic Polynucleotide
taatacgactcactataggggtggggggggaaattctgcttgagtttgtgaacagaggagacacaaaatgaagcagaataacctggcggcagcgcaaaagatg

SEQ ID NO: 28557 - DNA, 103 bp, Artificial Sequence
  Synthetic Polynucleotide
taatacgactcactatagggccacagtggggggggaaattctgcttgagtaacagaggagaactcaaatggaatttcccaacctggcggcagcgcaaaagatg

SEQ ID NO: 28558 - DNA, 103 bp, Artificial Sequence
  Synthetic Polynucleotide
taatacgactcactatagggcaatcactggtttgtgaccacctgctccgaaacagaggagatcggagatggtggtcacaaacctggcggcagcgcaaaagatg

SEQ ID NO: 28559 - DNA, 103 bp, Artificial Sequence
  Synthetic Polynucleotide
taatacgactcactataggggtgtgccacagtggggggggaaattctgctaacagaggagaagcagaatgtccccccccaacctggcggcagcgcaaaagatg

SEQ ID NO: 28560 - DNA, 103 bp, Artificial Sequence
  Synthetic Polynucleotide
taatacgactcactatagggtcactgtgtgccacagtggggggggaaattaacagaggagaaatttcatgccccactgtaacctggcggcagcgcaaaagatg

SEQ ID NO: 28561 - DNA, 103 bp, Artificial Sequence
  Synthetic Polynucleotide
taatacgactcactatagggatgcatcactgtgtgccacagtggggggggaacagaggagaccccccatgctgtggcacaacctggcggcagcgcaaaagatg

SEQ ID NO: 28562 - DNA, 103 bp, Artificial Sequence
  Synthetic Polynucleotide
taatacgactcactatagggggctaatgcatcactgtgtgccacagtgggaacagaggagacccactatggcacacagtaacctggcggcagcgcaaaagatg

SEQ ID NO: 28563 - DNA, 103 bp, Artificial Sequence
  Synthetic Polynucleotide
taatacgactcactatagggcgcctggctaatgcatcactgtgtgccacaaacagaggagatgtggcatgcagtgatgcaacctggcggcagcgcaaaagatg

SEQ ID NO: 28564 - DNA, 103 bp, Artificial Sequence
  Synthetic Polynucleotide
taatacgactcactatagggcaaagcgcctggctaatgcatcactgtgtgaacagaggagacacacaatgatgcattagaacctggcggcagcgcaaaagatg

SEQ ID NO: 28565 - DNA, 103 bp, Artificial Sequence
  Synthetic Polynucleotide
taatacgactcactataggggaacgcaaagcgcctggctaatgcatcactaacagaggagaagtgatatgttagccaggaacctggcggcagcgcaaaagatg

SEQ ID NO: 28566 - DNA, 103 bp, Artificial Sequence
  Synthetic Polynucleotide
taatacgactcactatagggatgtcgaacgcaaagcgcctggctaatgcaaacagaggagatgcattatgcaggcgcttaacctggcggcagcgcaaaagatg

SEQ ID NO: 28567 - DNA, 103 bp, Artificial Sequence
  Synthetic Polynucleotide
taatacgactcactatagggtgtccatgtcgaacgcaaagcgcctggctaaacagaggagatagccaatggctttgcgtaacctggcggcagcgcaaaagatg

SEQ ID NO: 28568 - DNA, 103 bp, Artificial Sequence
  Synthetic Polynucleotide
taatacgactcactatagggctgaatgtccatgtcgaacgcaaagcgcctaacagaggagaaggcgcatggcgttcgacaacctggcggcagcgcaaaagatg

SEQ ID NO: 28569 - DNA, 103 bp, Artificial Sequence
  Synthetic Polynucleotide
taatacgactcactatagggcaggccaatcactggtttgtgaccacctgcaacagaggagagcaggtatgcacaaaccaaacctggcggcagcgcaaaagatg

SEQ ID NO: 28570 - DNA, 103 bp, Artificial Sequence
  Synthetic Polynucleotide
taatacgactcactatagggatgacctgaatgtccatgtcgaacgcaaagaacagaggagactttgcatgcgacatggaaacctggcggcagcgcaaaagatg

SEQ ID NO: 28571 - DNA, 103 bp, Artificial Sequence
  Synthetic Polynucleotide
taatacgactcactatagggcattcatgacctgaatgtccatgtcgaacgaacagaggagacgttcgatgtggacattcaacctggcggcagcgcaaaagatg

SEQ ID NO: 28572 - DNA, 103 bp, Artificial Sequence
  Synthetic Polynucleotide
taatacgactcactatagggatactcattcatgacctgaatgtccatgtcaacagaggagagacatgatgattcaggtcaacctggcggcagcgcaaaagatg

SEQ ID NO: 28573 - DNA, 103 bp, Artificial Sequence
  Synthetic Polynucleotide
taatacgactcactatagggctagaatactcattcatgacctgaatgtccaacagaggagaggacatatgggtcatgaaaacctggcggcagcgcaaaagatg

SEQ ID NO: 28574 - DNA, 103 bp, Artificial Sequence
  Synthetic Polynucleotide
taatacgactcactatagggcatctctagaatactcattcatgacctgaaaacagaggagattcaggatgtgaatgagtaacctggcggcagcgcaaaagatg

SEQ ID NO: 28575 - DNA, 103 bp, Artificial Sequence
  Synthetic Polynucleotide
taatacgactcactatagggtttcccatctctagaatactcattcatgacaacagaggagagtcatgatggagtattctaacctggcggcagcgcaaaagatg

SEQ ID NO: 28576 - DNA, 103 bp, Artificial Sequence
  Synthetic Polynucleotide
taatacgactcactatagggttcaatttcccatctctagaatactcattcaacagaggagagaatgaatgttctagagaaacctggcggcagcgcaaaagatg

SEQ ID NO: 28577 - DNA, 103 bp, Artificial Sequence
  Synthetic Polynucleotide
taatacgactcactatagggccatgttcaatttcccatctctagaatactaacagaggagaagtattatggagatgggaaacctggcggcagcgcaaaagatg

SEQ ID NO: 28578 - DNA, 103 bp, Artificial Sequence
  Synthetic Polynucleotide
taatacgactcactatagggcatggccatgttcaatttcccatctctagaaacagaggagatctagaatggggaaattgaacctggcggcagcgcaaaagatg

SEQ ID NO: 28579 - DNA, 103 bp, Artificial Sequence
  Synthetic Polynucleotide
taatacgactcactataggggtagccatggccatgttcaatttcccatctaacagaggagaagatggatgattgaacataacctggcggcagcgcaaaagatg

SEQ ID NO: 28580 - DNA, 103 bp, Artificial Sequence
  Synthetic Polynucleotide
taatacgactcactatagggtacgacaggccaatcactggtttgtgaccaaacagaggagatggtcaatgaccagtgataacctggcggcagcgcaaaagatg

SEQ ID NO: 28581 - DNA, 103 bp, Artificial Sequence
  Synthetic Polynucleotide
taatacgactcactatagggtttcagtagccatggccatgttcaatttccaacagaggagaggaaatatgacatggccaaacctggcggcagcgcaaaagatg

SEQ ID NO: 28582 - DNA, 103 bp, Artificial Sequence
  Synthetic Polynucleotide
taatacgactcactatagggacacatttcagtagccatggccatgttcaaaacagaggagattgaacatggccatggctaacctggcggcagcgcaaaagatg

SEQ ID NO: 28583 - DNA, 103 bp, Artificial Sequence
  Synthetic Polynucleotide
taatacgactcactatagggttcttacacatttcagtagccatggccatgaacagaggagacatggcatgggctactgaaacctggcggcagcgcaaaagatg

SEQ ID NO: 28584 - DNA, 103 bp, Artificial Sequence
  Synthetic Polynucleotide
taatacgactcactataggggacagttcttacacatttcagtagccatggaacagaggagaccatggatgctgaaatgtaacctggcggcagcgcaaaagatg

SEQ ID NO: 28585 - DNA, 103 bp, Artificial Sequence
  Synthetic Polynucleotide
taatacgactcactatagggttggtgacagttcttacacatttcagtagcaacagaggagagctactatgatgtgtaagaacctggcggcagcgcaaaagatg

SEQ ID NO: 28586 - DNA, 103 bp, Artificial Sequence
  Synthetic Polynucleotide
taatacgactcactataggggctggttggtgacagttcttacacatttcaaacagaggagatgaaatatgtaagaactgaacctggcggcagcgcaaaagatg

SEQ ID NO: 28587 - DNA, 103 bp, Artificial Sequence
  Synthetic Polynucleotide
taatacgactcactatagggagtttgctggttggtgacagttcttacacaaacagaggagatgtgtaatgactgtcaccaacctggcggcagcgcaaaagatg

SEQ ID NO: 28588 - DNA, 103 bp, Artificial Sequence
  Synthetic Polynucleotide
taatacgactcactatagggcttaaagtttgctggttggtgacagttcttaacagaggagaaagaacatgcaccaaccaaacctggcggcagcgcaaaagatg

SEQ ID NO: 28589 - DNA, 103 bp, Artificial Sequence
  Synthetic Polynucleotide
taatacgactcactatagggcatctcttaaagtttgctggttggtgacagaacagaggagactgtcaatgaccagcaaaaacctggcggcagcgcaaaagatg

SEQ ID NO: 28590 - DNA, 103 bp, Artificial Sequence
  Synthetic Polynucleotide
taatacgactcactataggggacagcatctcttaaagtttgctggttggtaacagaggagaaccaacatgcaaactttaaacctggcggcagcgcaaaagatg

SEQ ID NO: 28591 - DNA, 103 bp, Artificial Sequence
  Synthetic Polynucleotide
taatacgactcactatagggcgcgttacgacaggccaatcactggtttgtaacagaggagaacaaacatgtgattggccaacctggcggcagcgcaaaagatg

SEQ ID NO: 28592 - DNA, 103 bp, Artificial Sequence
  Synthetic Polynucleotide
taatacgactcactatagggtaaaggacagcatctcttaaagtttgctggaacagaggagaccagcaatgtttaagagaaacctggcggcagcgcaaaagatg

SEQ ID NO: 28593 - DNA, 103 bp, Artificial Sequence
  Synthetic Polynucleotide
taatacgactcactatagggcacactaaaggacagcatctcttaaagtttaacagaggagaaaacttatggagatgctgaacctggcggcagcgcaaaagatg

SEQ ID NO: 28594 - DNA, 103 bp, Artificial Sequence
  Synthetic Polynucleotide
taatacgactcactatagggtaccacacactaaaggacagcatctcttaaaacagaggagattaagaatggctgtccttaacctggcggcagcgcaaaagatg

SEQ ID NO: 28595 - DNA, 103 bp, Artificial Sequence
  Synthetic Polynucleotide
taatacgactcactatagggtgccttaccacacactaaaggacagcatctaacagaggagaagatgcatgcctttagtgaacctggcggcagcgcaaaagatg

SEQ ID NO: 28596 - DNA, 103 bp, Artificial Sequence
  Synthetic Polynucleotide
taatacgactcactatagggtgaattgccttaccacacactaaaggacagaacagaggagactgtccatgagtgtgtggaacctggcggcagcgcaaaagatg

SEQ ID NO: 28597 - DNA, 103 bp, Artificial Sequence
  Synthetic Polynucleotide
taatacgactcactatagggttaattgaattgccttaccacacactaaagaacagaggagactttagatggtggtaaggaacctggcggcagcgcaaaagatg

SEQ ID NO: 28598 - DNA, 103 bp, Artificial Sequence
  Synthetic Polynucleotide
taatacgactcactataggggtccattaattgaattgccttaccacacacaacagaggagagtgtgtatgaaggcaattaacctggcggcagcgcaaaagatg

SEQ ID NO: 28599 - DNA, 103 bp, Artificial Sequence
  Synthetic Polynucleotide
taatacgactcactataggggatttgtccattaattgaattgccttaccaaacagaggagatggtaaatgaattcaattaacctggcggcagcgcaaaagatg

SEQ ID NO: 28600 - DNA, 103 bp, Artificial Sequence
  Synthetic Polynucleotide
taatacgactcactatagggtggaagatttgtccattaattgaattgcctaacagaggagaaggcaaatgaattaatggaacctggcggcagcgcaaaagatg

SEQ ID NO: 28601 - DNA, 103 bp, Artificial Sequence
  Synthetic Polynucleotide
taatacgactcactatagggaactctggaagatttgtccattaattgaataacagaggagaattcaaatgatggacaaaaacctggcggcagcgcaaaagatg

SEQ ID NO: 28602 - DNA, 103 bp, Artificial Sequence
  Synthetic Polynucleotide
taatacgactcactatagggtctgtcttctggtttttagctgttaagcgtaacagaggagaacgcttatgagctaaaaaaacctggcggcagcgcaaaagatg

SEQ ID NO: 28603 - DNA, 103 bp, Artificial Sequence
  Synthetic Polynucleotide
taatacgactcactatagggtccattgtagaagtgttactttttcttttcaacagaggagagaaaagatgaagtaacacaacctggcggcagcgcaaaagatg

SEQ ID NO: 28604 - DNA, 103 bp, Artificial Sequence
  Synthetic Polynucleotide
taatacgactcactatagggttacttaacctatacaagcacaacagaaggaacagaggagaccttctatggtgcttgtaaacctggcggcagcgcaaaagatg

SEQ ID NO: 28605 - DNA, 103 bp, Artificial Sequence
  Synthetic Polynucleotide
taatacgactcactataggggataagaagcgatgctctctagggtgaaggaacagaggagaccttcaatgtagagagcaaacctggcggcagcgcaaaagatg

SEQ ID NO: 28606 - DNA, 103 bp, Artificial Sequence
  Synthetic Polynucleotide
taatacgactcactataggggttcggataagaagcgatgctctctagggtaacagaggagaaccctaatgagcatcgctaacctggcggcagcgcaaaagatg

SEQ ID NO: 28607 - DNA, 103 bp, Artificial Sequence
  Synthetic Polynucleotide
taatacgactcactataggggggaggttcggataagaagcgatgctctctaacagaggagaagagagatgcgcttcttaaacctggcggcagcgcaaaagatg

SEQ ID NO: 28608 - DNA, 103 bp, Artificial Sequence
  Synthetic Polynucleotide
taatacgactcactataggggaagagggaggttcggataagaagcgatgcaacagaggagagcatcgatgcttatccgaaacctggcggcagcgcaaaagatg

SEQ ID NO: 28609 - DNA, 103 bp, Artificial Sequence
  Synthetic Polynucleotide
taatacgactcactatagggatcatgaagagggaggttcggataagaagcaacagaggagagcttctatgccgaacctcaacctggcggcagcgcaaaagatg

SEQ ID NO: 28610 - DNA, 103 bp, Artificial Sequence
  Synthetic Polynucleotide
taatacgactcactatagggctagcatcatgaagagggaggttcggataaaacagaggagattatccatgcctccctctaacctggcggcagcgcaaaagatg

SEQ ID NO: 28611 - DNA, 103 bp, Artificial Sequence
  Synthetic Polynucleotide
taatacgactcactatagggttcatctagcatcatgaagagggaggttcgaacagaggagacgaaccatgctcttcatgaacctggcggcagcgcaaaagatg

SEQ ID NO: 28612 - DNA, 103 bp, Artificial Sequence
  Synthetic Polynucleotide
taatacgactcactataggggtgtgttcatctagcatcatgaagagggagaacagaggagactccctatgcatgatgctaacctggcggcagcgcaaaagatg

SEQ ID NO: 28613 - DNA, 103 bp, Artificial Sequence
  Synthetic Polynucleotide
taatacgactcactatagggacagagtgtgttcatctagcatcatgaagaaacagaggagatcttcaatgtgctagatgaacctggcggcagcgcaaaagatg

SEQ ID NO: 28614 - DNA, 103 bp, Artificial Sequence
  Synthetic Polynucleotide
taatacgactcactatagggtaaatacagagtgtgttcatctagcatcataacagaggagaatgatgatggatgaacacaacctggcggcagcgcaaaagatg

SEQ ID NO: 28615 - DNA, 103 bp, Artificial Sequence
  Synthetic Polynucleotide
taatacgactcactatagggctattttacttaacctatacaagcacaacaaacagaggagatgttgtatgtgtataggtaacctggcggcagcgcaaaagatg

SEQ ID NO: 28616 - DNA, 103 bp, Artificial Sequence
  Synthetic Polynucleotide
taatacgactcactatagggaagaataaatacagagtgtgttcatctagcaacagaggagagctagaatgacacactctaacctggcggcagcgcaaaagatg

SEQ ID NO: 28617 - DNA, 103 bp, Artificial Sequence
  Synthetic Polynucleotide
taatacgactcactataggggaatcaagaataaatacagagtgtgttcataacagaggagaatgaacatgctctgtattaacctggcggcagcgcaaaagatg

SEQ ID NO: 28618 - DNA, 103 bp, Artificial Sequence
  Synthetic Polynucleotide
taatacgactcactataggggagtagaatcaagaataaatacagagtgtgaacagaggagacacactatgtatttattcaacctggcggcagcgcaaaagatg

SEQ ID NO: 28619 - DNA, 103 bp, Artificial Sequence
  Synthetic Polynucleotide
taatacgactcactatagggttcatgagtagaatcaagaataaatacagaaacagaggagatctgtaatgattcttgataacctggcggcagcgcaaaagatg

SEQ ID NO: 28620 - DNA, 103 bp, Artificial Sequence
  Synthetic Polynucleotide
taatacgactcactatagggtgaagttcatgagtagaatcaagaataaataacagaggagaatttatatgtgattctacaacctggcggcagcgcaaaagatg

SEQ ID NO: 28621 - DNA, 103 bp, Artificial Sequence
  Synthetic Polynucleotide
taatacgactcactatagggtgatttgaagttcatgagtagaatcaagaaaacagaggagattcttgatgctactcatgaacctggcggcagcgcaaaagatg

SEQ ID NO: 28622 - DNA, 103 bp, Artificial Sequence
  Synthetic Polynucleotide
taatacgactcactatagggatacatgatttgaagttcatgagtagaatcaacagaggagagattctatgcatgaacttaacctggcggcagcgcaaaagatg

SEQ ID NO: 28623 - DNA, 103 bp, Artificial Sequence
  Synthetic Polynucleotide
taatacgactcactatagggcagagatacatgatttgaagttcatgagtaaacagaggagatactcaatgacttcaaataacctggcggcagcgcaaaagatg

SEQ ID NO: 28624 - DNA, 103 bp, Artificial Sequence
  Synthetic Polynucleotide
taatacgactcactatagggggaaacagagatacatgatttgaagttcataacagaggagaatgaacatgaaatcatgtaacctggcggcagcgcaaaagatg

SEQ ID NO: 28625 - DNA, 103 bp, Artificial Sequence
  Synthetic Polynucleotide
taatacgactcactataggggagagggaaacagagatacatgatttgaagaacagaggagacttcaaatgatgtatctcaacctggcggcagcgcaaaagatg

SEQ ID NO: 28626 - DNA, 103 bp, Artificial Sequence
  Synthetic Polynucleotide
taatacgactcactatagggacccactattttacttaacctatacaagcaaacagaggagatgcttgatgaggttaagtaacctggcggcagcgcaaaagatg

SEQ ID NO: 28627 - DNA, 103 bp, Artificial Sequence
  Synthetic Polynucleotide
taatacgactcactatagggtagcagagagggaaacagagatacatgattaacagaggagaaatcatatgtctctgtttaacctggcggcagcgcaaaagatg

SEQ ID NO: 28628 - DNA, 103 bp, Artificial Sequence
  Synthetic Polynucleotide
taatacgactcactatagggagatatagcagagagggaaacagagatacaaacagaggagatgtatcatggtttccctcaacctggcggcagcgcaaaagatg

SEQ ID NO: 28629 - DNA, 103 bp, Artificial Sequence
  Synthetic Polynucleotide
taatacgactcactatagggcttatagatatagcagagagggaaacagagaacagaggagactctgtatgcctctctgcaacctggcggcagcgcaaaagatg

SEQ ID NO: 28630 - DNA, 103 bp, Artificial Sequence
  Synthetic Polynucleotide
taatacgactcactatagggagatacttatagatatagcagagagggaaaaacagaggagatttcccatgctgctatataacctggcggcagcgcaaaagatg

SEQ ID NO: 28631 - DNA, 103 bp, Artificial Sequence
  Synthetic Polynucleotide
taatacgactcactatagggttagtagatacttatagatatagcagagagaacagaggagactctctatgatatctataaacctggcggcagcgcaaaagatg

SEQ ID NO: 28632 - DNA, 103 bp, Artificial Sequence
  Synthetic Polynucleotide
taatacgactcactatagggaaaacttagtagatacttatagatatagcaaacagaggagatgctatatgtataagtataacctggcggcagcgcaaaagatg

SEQ ID NO: 28633 - DNA, 103 bp, Artificial Sequence
  Synthetic Polynucleotide
taatacgactcactatagggatgataaaacttagtagatacttatagataaacagaggagatatctaatggtatctactaacctggcggcagcgcaaaagatg

SEQ ID NO: 28634 - DNA, 103 bp, Artificial Sequence
  Synthetic Polynucleotide
taatacgactcactatagggatatgatgataaaacttagtagatacttataacagaggagaataagtatgtactaagttaacctggcggcagcgcaaaagatg

SEQ ID NO: 28635 - DNA, 103 bp, Artificial Sequence
  Synthetic Polynucleotide
taatacgactcactatagggagaagatatgatgataaaacttagtagataaacagaggagatatctaatgagttttatcaacctggcggcagcgcaaaagatg

SEQ ID NO: 28636 - DNA, 103 bp, Artificial Sequence
  Synthetic Polynucleotide
taatacgactcactatagggccgcaagaagatatgatgataaaacttagtaacagaggagaactaagatgtatcatcataacctggcggcagcgcaaaagatg

SEQ ID NO: 28637 - DNA, 103 bp, Artificial Sequence
  Synthetic Polynucleotide
taatacgactcactatagggttttgacccactattttacttaacctatacaacagaggagagtatagatgaagtaaaataacctggcggcagcgcaaaagatg

SEQ ID NO: 28638 - DNA, 103 bp, Artificial Sequence
  Synthetic Polynucleotide
taatacgactcactataggggattaccgcaagaagatatgatgataaaacaacagaggagagttttaatgtcatatcttaacctggcggcagcgcaaaagatg

SEQ ID NO: 28639 - DNA, 103 bp, Artificial Sequence
  Synthetic Polynucleotide
taatacgactcactatagggaccctgattaccgcaagaagatatgatgataacagaggagaatcatcatgtcttcttgcaacctggcggcagcgcaaaagatg

SEQ ID NO: 28640 - DNA, 103 bp, Artificial Sequence
  Synthetic Polynucleotide
taatacgactcactataggggatttaccctgattaccgcaagaagatatgaacagaggagacatatcatgttgcggtaaaacctggcggcagcgcaaaagatg

SEQ ID NO: 28641 - DNA, 103 bp, Artificial Sequence
  Synthetic Polynucleotide
taatacgactcactatagggttagagatttaccctgattaccgcaagaagaacagaggagacttcttatggtaatcaggaacctggcggcagcgcaaaagatg

SEQ ID NO: 28642 - DNA, 103 bp, Artificial Sequence
  Synthetic Polynucleotide
taatacgactcactatagggctcttttagagatttaccctgattaccgcaaacagaggagatgcggtatgcagggtaaaaacctggcggcagcgcaaaagatg

SEQ ID NO: 28643 - DNA, 103 bp, Artificial Sequence
  Synthetic Polynucleotide
taatacgactcactatagggaagttctcttttagagatttaccctgattaaacagaggagataatcaatgtaaatctctaacctggcggcagcgcaaaagatg

SEQ ID NO: 28644 - DNA, 103 bp, Artificial Sequence
  Synthetic Polynucleotide
taatacgactcactatagggttcataagttctcttttagagatttaccctaacagaggagaagggtaatgctctaaaagaacctggcggcagcgcaaaagatg

SEQ ID NO: 28645 - DNA, 103 bp, Artificial Sequence
  Synthetic Polynucleotide
taatacgactcactatagggagcagttcataagttctcttttagagatttaacagaggagaaaatctatgaaagagaacaacctggcggcagcgcaaaagatg

SEQ ID NO: 28646 - DNA, 103 bp, Artificial Sequence
  Synthetic Polynucleotide
taatacgactcactataggggttgcagcagttcataagttctcttttagaaacagaggagatctaaaatggaacttatgaacctggcggcagcgcaaaagatg

SEQ ID NO: 28647 - DNA, 103 bp, Artificial Sequence
  Synthetic Polynucleotide
taatacgactcactatagggagatagttgcagcagttcataagttctcttaacagaggagaaagagaatgtatgaactgaacctggcggcagcgcaaaagatg

SEQ ID NO: 28648 - DNA, 103 bp, Artificial Sequence
  Synthetic Polynucleotide
taatacgactcactatagggctgtgttttgacccactattttacttaaccaacagaggagaggttaaatgaaatagtggaacctggcggcagcgcaaaagatg

SEQ ID NO: 28649 - DNA, 103 bp, Artificial Sequence
  Synthetic Polynucleotide
taatacgactcactataggggagttagatagttgcagcagttcataagttaacagaggagaaacttaatgactgctgcaaacctggcggcagcgcaaaagatg

SEQ ID NO: 28650 - DNA, 103 bp, Artificial Sequence
  Synthetic Polynucleotide
taatacgactcactatagggaacatgagttagatagttgcagcagttcataacagaggagaatgaacatgtgcaactataacctggcggcagcgcaaaagatg

SEQ ID NO: 28651 - DNA, 103 bp, Artificial Sequence
  Synthetic Polynucleotide
taatacgactcactataggggttacaacatgagttagatagttgcagcagaacagaggagactgctgatgctatctaacaacctggcggcagcgcaaaagatg

SEQ ID NO: 28652 - DNA, 103 bp, Artificial Sequence
  Synthetic Polynucleotide
taatacgactcactatagggttcatgttacaacatgagttagatagttgcaacagaggagagcaactatgtaactcatgaacctggcggcagcgcaaaagatg

SEQ ID NO: 28653 - DNA, 103 bp, Artificial Sequence
  Synthetic Polynucleotide
taatacgactcactataggggtgttttcatgttacaacatgagttagataaacagaggagatatctaatgcatgttgtaaacctggcggcagcgcaaaagatg

SEQ ID NO: 28654 - DNA, 103 bp, Artificial Sequence
  Synthetic Polynucleotide
taatacgactcactatagggatgtagtgttttcatgttacaacatgagttaacagaggagaaactcaatgtgtaacatgaacctggcggcagcgcaaaagatg

SEQ ID NO: 28655 - DNA, 103 bp, Artificial Sequence
  Synthetic Polynucleotide
taatacgactcactatagggatttaatgtagtgttttcatgttacaacataacagaggagaatgttgatgcatgaaaacaacctggcggcagcgcaaaagatg

SEQ ID NO: 28656 - DNA, 103 bp, Artificial Sequence
  Synthetic Polynucleotide
taatacgactcactatagggcccatatttaatgtagtgttttcatgttacaacagaggagagtaacaatgaaacactacaacctggcggcagcgcaaaagatg

SEQ ID NO: 28657 - DNA, 103 bp, Artificial Sequence
  Synthetic Polynucleotide
taatacgactcactatagggaccagcccatatttaatgtagtgttttcataacagaggagaatgaaaatgctacattaaaacctggcggcagcgcaaaagatg

SEQ ID NO: 28658 - DNA, 103 bp, Artificial Sequence
  Synthetic Polynucleotide
taatacgactcactatagggaaaaaaccagcccatatttaatgtagtgttaacagaggagaaacactatgttaaatatgaacctggcggcagcgcaaaagatg

SEQ ID NO: 28659 - DNA, 103 bp, Artificial Sequence
  Synthetic Polynucleotide
taatacgactcactatagggatttgctgtgttttgacccactattttactaacagaggagaagtaaaatggtgggtcaaaacctggcggcagcgcaaaagatg

SEQ ID NO: 28660 - DNA, 103 bp, Artificial Sequence
  Synthetic Polynucleotide
taatacgactcactataggggcagtaaaaaaccagcccatatttaatgtaaacagaggagatacattatgtatgggctgaacctggcggcagcgcaaaagatg

SEQ ID NO: 28661 - DNA, 103 bp, Artificial Sequence
  Synthetic Polynucleotide
taatacgactcactataggggatttgcagtaaaaaaccagcccatatttaaacagaggagataaataatggctggttttaacctggcggcagcgcaaaagatg

SEQ ID NO: 28662 - DNA, 103 bp, Artificial Sequence
  Synthetic Polynucleotide
taatacgactcactatagggtaaatgatttgcagtaaaaaaccagcccataacagaggagaatgggcatgttttttactaacctggcggcagcgcaaaagatg

SEQ ID NO: 28663 - DNA, 103 bp, Artificial Sequence
  Synthetic Polynucleotide
taatacgactcactatagggtctcttaaatgatttgcagtaaaaaaccagaacagaggagactggttatgtactgcaaaaacctggcggcagcgcaaaagatg

SEQ ID NO: 28664 - DNA, 103 bp, Artificial Sequence
  Synthetic Polynucleotide
taatacgactcactatagggacaagtctcttaaatgatttgcagtaaaaaaacagaggagatttttaatgcaaatcattaacctggcggcagcgcaaaagatg

SEQ ID NO: 28665 - DNA, 103 bp, Artificial Sequence
  Synthetic Polynucleotide
taatacgactcactatagggtggagacaagtctcttaaatgatttgcagtaacagaggagaactgcaatgcatttaagaaacctggcggcagcgcaaaagatg

SEQ ID NO: 28666 - DNA, 103 bp, Artificial Sequence
  Synthetic Polynucleotide
taatacgactcactatagggatttctggagacaagtctcttaaatgatttaacagaggagaaaatcaatgaagagacttaacctggcggcagcgcaaaagatg

SEQ ID NO: 28667 - DNA, 103 bp, Artificial Sequence
  Synthetic Polynucleotide
taatacgactcactatagggtagaaatttctggagacaagtctcttaaataacagaggagaatttaaatgacttgtctcaacctggcggcagcgcaaaagatg

SEQ ID NO: 28668 - DNA, 103 bp, Artificial Sequence
  Synthetic Polynucleotide
taatacgactcactatagggtgttatagaaatttctggagacaagtctctaacagaggagaagagacatgtctccagaaaacctggcggcagcgcaaaagatg

SEQ ID NO: 28669 - DNA, 103 bp, Artificial Sequence
  Synthetic Polynucleotide
taatacgactcactatagggactgatgttatagaaatttctggagacaagaacagaggagacttgtcatgagaaatttcaacctggcggcagcgcaaaagatg

SEQ ID NO: 28670 - DNA, 103 bp, Artificial Sequence
  Synthetic Polynucleotide
taatacgactcactatagggttgtaatttgctgtgttttgacccactattaacagaggagaaatagtatgtcaaaacacaacctggcggcagcgcaaaagatg

SEQ ID NO: 28671 - DNA, 103 bp, Artificial Sequence
  Synthetic Polynucleotide
taatacgactcactatagggttttcactgatgttatagaaatttctggagaacagaggagactccagatgtttctataaaacctggcggcagcgcaaaagatg

SEQ ID NO: 28672 - DNA, 103 bp, Artificial Sequence
  Synthetic Polynucleotide
taatacgactcactatagggtgtttttttcactgatgttatagaaatttcaacagaggagagaaattatgataacatcaaacctggcggcagcgcaaaagatg

SEQ ID NO: 28673 - DNA, 103 bp, Artificial Sequence
  Synthetic Polynucleotide
taatacgactcactatagggtctgctgtttttttcactgatgttatagaaaacagaggagattctatatgatcagtgaaaacctggcggcagcgcaaaagatg

SEQ ID NO: 28674 - DNA, 103 bp, Artificial Sequence
  Synthetic Polynucleotide
taatacgactcactatagggcttcttctgctgtttttttcactgatgttaaacagaggagataacatatgtgaaaaaaaaacctggcggcagcgcaaaagatg

SEQ ID NO: 28675 - DNA, 103 bp, Artificial Sequence
  Synthetic Polynucleotide
taatacgactcactatagggttggtcttcttctgctgtttttttcactgaaacagaggagatcagtgatgaaaacagcaaacctggcggcagcgcaaaagatg

SEQ ID NO: 28676 - DNA, 103 bp, Artificial Sequence
  Synthetic Polynucleotide
taatacgactcactatagggaatcattggtcttcttctgctgtttttttcaacagaggagagaaaaaatgagcagaagaaacctggcggcagcgcaaaagatg

SEQ ID NO: 28677 - DNA, 103 bp, Artificial Sequence
  Synthetic Polynucleotide
taatacgactcactatagggcatgaaatcattggtcttcttctgctgtttaacagaggagaaaacagatgaagaagaccaacctggcggcagcgcaaaagatg

SEQ ID NO: 28678 - DNA, 103 bp, Artificial Sequence
  Synthetic Polynucleotide
taatacgactcactatagggctgttcatgaaatcattggtcttcttctgcaacagaggagagcagaaatggaccaatgaaacctggcggcagcgcaaaagatg

SEQ ID NO: 28679 - DNA, 103 bp, Artificial Sequence
  Synthetic Polynucleotide
taatacgactcactatagggactttctgttcatgaaatcattggtcttctaacagaggagaagaagaatgatgatttcaaacctggcggcagcgcaaaagatg

SEQ ID NO: 28680 - DNA, 103 bp, Artificial Sequence
  Synthetic Polynucleotide
taatacgactcactataggggttgaactttctgttcatgaaatcattggtaacagaggagaaccaatatgttcatgaacaacctggcggcagcgcaaaagatg

SEQ ID NO: 28681 - DNA, 103 bp, Artificial Sequence
  Synthetic Polynucleotide
taatacgactcactatagggtagttttgtaatttgctgtgttttgacccaaacagaggagatgggtcatgacacagcaaaacctggcggcagcgcaaaagatg

SEQ ID NO: 28682 - DNA, 103 bp, Artificial Sequence
  Synthetic Polynucleotide
taatacgactcactataggggtgatgttgaactttctgttcatgaaatcaaacagaggagatgatttatggaacagaaaaacctggcggcagcgcaaaagatg

SEQ ID NO: 28683 - DNA, 103 bp, Artificial Sequence
  Synthetic Polynucleotide
taatacgactcactatagggagggagtgatgttgaactttctgttcatgaaacagaggagatcatgaatggaaagttcaaacctggcggcagcgcaaaagatg

SEQ ID NO: 28684 - DNA, 103 bp, Artificial Sequence
  Synthetic Polynucleotide
taatacgactcactataggggtgagagggagtgatgttgaactttctgttaacagaggagaaacagaatgttcaacatcaacctggcggcagcgcaaaagatg

SEQ ID NO: 28685 - DNA, 103 bp, Artificial Sequence
  Synthetic Polynucleotide
taatacgactcactatagggagtttgtgagagggagtgatgttgaactttaacagaggagaaaagttatgcatcactccaacctggcggcagcgcaaaagatg

SEQ ID NO: 28686 - DNA, 103 bp, Artificial Sequence
  Synthetic Polynucleotide
taatacgactcactataggggatctagtttgtgagagggagtgatgttgaaacagaggagatcaacaatgctccctctcaacctggcggcagcgcaaaagatg

SEQ ID NO: 28687 - DNA, 103 bp, Artificial Sequence
  Synthetic Polynucleotide
taatacgactcactatagggtccatgatctagtttgtgagagggagtgataacagaggagaatcactatgtctcacaaaaacctggcggcagcgcaaaagatg

SEQ ID NO: 28688 - DNA, 103 bp, Artificial Sequence
  Synthetic Polynucleotide
taatacgactcactatagggaccagtccatgatctagtttgtgagagggaaacagaggagatccctcatgcaaactagaaacctggcggcagcgcaaaagatg

SEQ ID NO: 28689 - DNA, 103 bp, Artificial Sequence
  Synthetic Polynucleotide
taatacgactcactatagggctctgaccagtccatgatctagtttgtgagaacagaggagactcacaatgtagatcatgaacctggcggcagcgcaaaagatg

SEQ ID NO: 28690 - DNA, 103 bp, Artificial Sequence
  Synthetic Polynucleotide
taatacgactcactatagggatcacctctgaccagtccatgatctagtttaacagaggagaaaactaatgcatggactgaacctggcggcagcgcaaaagatg

SEQ ID NO: 28691 - DNA, 103 bp, Artificial Sequence
  Synthetic Polynucleotide
taatacgactcactatagggcatctatcacctctgaccagtccatgatctaacagaggagaagatcaatgactggtcagaacctggcggcagcgcaaaagatg

SEQ ID NO: 28692 - DNA, 103 bp, Artificial Sequence
  Synthetic Polynucleotide
taatacgactcactatagggaacattagttttgtaatttgctgtgttttgaacagaggagacaaaacatggcaaattacaacctggcggcagcgcaaaagatg

SEQ ID NO: 28693 - DNA, 103 bp, Artificial Sequence
  Synthetic Polynucleotide
taatacgactcactatagggcgggtcatctatcacctctgaccagtccataacagaggagaatggacatgtcagaggtgaacctggcggcagcgcaaaagatg

SEQ ID NO: 28694 - DNA, 103 bp, Artificial Sequence
  Synthetic Polynucleotide
taatacgactcactatagggtcttccgggtcatctatcacctctgaccagaacagaggagactggtcatgggtgatagaaacctggcggcagcgcaaaagatg

SEQ ID NO: 28695 - DNA, 103 bp, Artificial Sequence
  Synthetic Polynucleotide
taatacgactcactatagggatggatcttccgggtcatctatcacctctgaacagaggagacagaggatgtagatgaccaacctggcggcagcgcaaaagatg

SEQ ID NO: 28696 - DNA, 103 bp, Artificial Sequence
  Synthetic Polynucleotide
taatacgactcactatagggactgaatggatcttccgggtcatctatcacaacagaggagagtgataatggacccggaaaacctggcggcagcgcaaaagatg

SEQ ID NO: 28697 - DNA, 103 bp, Artificial Sequence
  Synthetic Polynucleotide
taatacgactcactatagggtccaaactgaatggatcttccgggtcatctaacagaggagaagatgaatgggaagatccaacctggcggcagcgcaaaagatg

SEQ ID NO: 28698 - DNA, 103 bp, Artificial Sequence
  Synthetic Polynucleotide
taatacgactcactatagggcttcatccaaactgaatggatcttccgggtaacagaggagaacccggatgatccattcaaacctggcggcagcgcaaaagatg

SEQ ID NO: 28699 - DNA, 103 bp, Artificial Sequence
  Synthetic Polynucleotide
taatacgactcactatagggagattcttcatccaaactgaatggatcttcaacagaggagagaagatatgttcagtttgaacctggcggcagcgcaaaagatg

SEQ ID NO: 28700 - DNA, 103 bp, Artificial Sequence
  Synthetic Polynucleotide
taatacgactcactataggggaacaagattcttcatccaaactgaatggaaacagaggagatccattatgtttggatgaaacctggcggcagcgcaaaagatg

SEQ ID NO: 28701 - DNA, 103 bp, Artificial Sequence
  Synthetic Polynucleotide
taatacgactcactatagggcaacagaacaagattcttcatccaaactgaaacagaggagatcagttatgatgaagaataacctggcggcagcgcaaaagatg

SEQ ID NO: 28702 - DNA, 103 bp, Artificial Sequence
  Synthetic Polynucleotide
taatacgactcactataggggacatcaacagaacaagattcttcatccaaaacagaggagattggatatggaatcttgtaacctggcggcagcgcaaaagatg

SEQ ID NO: 28703 - DNA, 103 bp, Artificial Sequence
  Synthetic Polynucleotide
taatacgactcactatagggtctgcaacattagttttgtaatttgctgtgaacagaggagacacagcatgttacaaaacaacctggcggcagcgcaaaagatg

SEQ ID NO: 28704 - DNA, 103 bp, Artificial Sequence
  Synthetic Polynucleotide
taatacgactcactatagggggagggacatcaacagaacaagattcttcaaacagaggagatgaagaatgttgttctgtaacctggcggcagcgcaaaagatg

SEQ ID NO: 28705 - DNA, 103 bp, Artificial Sequence
  Synthetic Polynucleotide
taatacgactcactatagggtgtttggagggacatcaacagaacaagattaacagaggagaaatcttatgctgttgatgaacctggcggcagcgcaaaagatg

SEQ ID NO: 28706 - DNA, 103 bp, Artificial Sequence
  Synthetic Polynucleotide
taatacgactcactataggggagaatgtttggagggacatcaacagaacaaacagaggagatgttctatggatgtccctaacctggcggcagcgcaaaagatg

SEQ ID NO: 28707 - DNA, 103 bp, Artificial Sequence
  Synthetic Polynucleotide
taatacgactcactataggggttctgagaatgtttggagggacatcaacaaacagaggagatgttgaatgccctccaaaaacctggcggcagcgcaaaagatg

SEQ ID NO: 28708 - DNA, 103 bp, Artificial Sequence
  Synthetic Polynucleotide
taatacgactcactatagggcggaagttctgagaatgtttggagggacataacagaggagaatgtccatgcaaacattcaacctggcggcagcgcaaaagatg

SEQ ID NO: 28709 - DNA, 103 bp, Artificial Sequence
  Synthetic Polynucleotide
taatacgactcactatagggatagtcggaagttctgagaatgtttggaggaacagaggagacctccaatgattctcagaaacctggcggcagcgcaaaagatg

SEQ ID NO: 28710 - DNA, 103 bp, Artificial Sequence
  Synthetic Polynucleotide
taatacgactcactatagggaaattatagtcggaagttctgagaatgtttaacagaggagaaaacatatgcagaacttcaacctggcggcagcgcaaaagatg

SEQ ID NO: 28711 - DNA, 103 bp, Artificial Sequence
  Synthetic Polynucleotide
taatacgactcactatagggagtttaaattatagtcggaagttctgagaaaacagaggagattctcaatgcttccgactaacctggcggcagcgcaaaagatg

SEQ ID NO: 28712 - DNA, 103 bp, Artificial Sequence
  Synthetic Polynucleotide
taatacgactcactataggggggggagtttaaattatagtcggaagttctaacagaggagaagaactatggactataataacctggcggcagcgcaaaagatg

SEQ ID NO: 28713 - DNA, 103 bp, Artificial Sequence
  Synthetic Polynucleotide
taatacgactcactatagggaacaggggggagtttaaattatagtcggaaaacagaggagattccgaatgtaatttaaaaacctggcggcagcgcaaaagatg

SEQ ID NO: 28714 - DNA, 103 bp, Artificial Sequence
  Synthetic Polynucleotide
taatacgactcactatagggcaggatccattgtagaagtgttactttttcaacagaggagagaaaaaatgacacttctaaacctggcggcagcgcaaaagatg

SEQ ID NO: 28715 - DNA, 103 bp, Artificial Sequence
  Synthetic Polynucleotide
taatacgactcactatagggtccggtctgcaacattagttttgtaatttgaacagaggagacaaattatgaaactaatgaacctggcggcagcgcaaaagatg

SEQ ID NO: 28716 - DNA, 103 bp, Artificial Sequence
  Synthetic Polynucleotide
taatacgactcactatagggcctctaacaggggggagtttaaattatagtaacagaggagaactataatgtaaactcccaacctggcggcagcgcaaaagatg

SEQ ID NO: 28717 - DNA, 103 bp, Artificial Sequence
  Synthetic Polynucleotide
taatacgactcactatagggttggtcctctaacaggggggagtttaaattaacagaggagaaatttaatgtcccccctgaacctggcggcagcgcaaaagatg

SEQ ID NO: 28718 - DNA, 103 bp, Artificial Sequence
  Synthetic Polynucleotide
taatacgactcactatagggaaactttggtcctctaacaggggggagtttaacagaggagaaaactcatgcctgttagaaacctggcggcagcgcaaaagatg

SEQ ID NO: 28719 - DNA, 103 bp, Artificial Sequence
  Synthetic Polynucleotide
taatacgactcactatagggtcagcaaactttggtcctctaacaggggggaacagaggagaccccccatgtagaggaccaacctggcggcagcgcaaaagatg

SEQ ID NO: 28720 - DNA, 103 bp, Artificial Sequence
  Synthetic Polynucleotide
taatacgactcactatagggaatcatcagcaaactttggtcctctaacagaacagaggagactgttaatggaccaaagtaacctggcggcagcgcaaaagatg

SEQ ID NO: 28721 - DNA, 103 bp, Artificial Sequence
  Synthetic Polynucleotide
taatacgactcactatagggcactcaatcatcagcaaactttggtcctctaacagaggagaagaggaatgaagtttgctaacctggcggcagcgcaaaagatg

SEQ ID NO: 28722 - DNA, 103 bp, Artificial Sequence
  Synthetic Polynucleotide
taatacgactcactatagggttaaccactcaatcatcagcaaactttggtaacagaggagaaccaaaatgtgctgatgaaacctggcggcagcgcaaaagatg

SEQ ID NO: 28723 - DNA, 103 bp, Artificial Sequence
  Synthetic Polynucleotide
taatacgactcactatagggagtttttaaccactcaatcatcagcaaactaacagaggagaagtttgatgatgattgagaacctggcggcagcgcaaaagatg

SEQ ID NO: 28724 - DNA, 103 bp, Artificial Sequence
  Synthetic Polynucleotide
taatacgactcactatagggttggcagtttttaaccactcaatcatcagcaacagaggagagctgatatgtgagtggttaacctggcggcagcgcaaaagatg

SEQ ID NO: 28725 - DNA, 103 bp, Artificial Sequence
  Synthetic Polynucleotide
taatacgactcactataggggtttgttggcagtttttaaccactcaatcaaacagaggagatgattgatgggttaaaaaaacctggcggcagcgcaaaagatg

SEQ ID NO: 28726 - DNA, 103 bp, Artificial Sequence
  Synthetic Polynucleotide
taatacgactcactatagggttccatccggtctgcaacattagttttgtaaacagaggagatacaaaatgaatgttgcaaacctggcggcagcgcaaaagatg

SEQ ID NO: 28727 - DNA, 103 bp, Artificial Sequence
  Synthetic Polynucleotide
taatacgactcactatagggagatggtttgttggcagtttttaaccactcaacagaggagagagtggatgaaaactgccaacctggcggcagcgcaaaagatg

SEQ ID NO: 28728 - DNA, 103 bp, Artificial Sequence
  Synthetic Polynucleotide
taatacgactcactatagggagcctagatggtttgttggcagtttttaacaacagaggagagttaaaatgtgccaacaaaacctggcggcagcgcaaaagatg

SEQ ID NO: 28729 - DNA, 103 bp, Artificial Sequence
  Synthetic Polynucleotide
taatacgactcactataggggtctgagcctagatggtttgttggcagtttaacagaggagaaaactgatgacaaaccataacctggcggcagcgcaaaagatg

SEQ ID NO: 28730 - DNA, 103 bp, Artificial Sequence
  Synthetic Polynucleotide
taatacgactcactatagggagagtgtctgagcctagatggtttgttggcaacagaggagagccaacatgccatctaggaacctggcggcagcgcaaaagatg

SEQ ID NO: 28731 - DNA, 103 bp, Artificial Sequence
  Synthetic Polynucleotide
taatacgactcactatagggccttcagagtgtctgagcctagatggtttgaacagaggagacaaaccatgtaggctcagaacctggcggcagcgcaaaagatg

SEQ ID NO: 28732 - DNA, 103 bp, Artificial Sequence
  Synthetic Polynucleotide
taatacgactcactataggggtaacccttcagagtgtctgagcctagatgaacagaggagacatctaatgtcagacactaacctggcggcagcgcaaaagatg

SEQ ID NO: 28733 - DNA, 103 bp, Artificial Sequence
  Synthetic Polynucleotide
taatacgactcactatagggtctcagtaacccttcagagtgtctgagcctaacagaggagaaggctcatgcactctgaaaacctggcggcagcgcaaaagatg

SEQ ID NO: 28734 - DNA, 103 bp, Artificial Sequence
  Synthetic Polynucleotide
taatacgactcactatagggtaagatctcagtaacccttcagagtgtctgaacagaggagacagacaatgtgaagggttaacctggcggcagcgcaaaagatg

SEQ ID NO: 28735 - DNA, 103 bp, Artificial Sequence
  Synthetic Polynucleotide
taatacgactcactatagggttttgtaagatctcagtaacccttcagagtaacagaggagaactctgatgggttactgaaacctggcggcagcgcaaaagatg

SEQ ID NO: 28736 - DNA, 103 bp, Artificial Sequence
  Synthetic Polynucleotide
taatacgactcactatagggtagagttttgtaagatctcagtaacccttcaacagaggagagaagggatgctgagatctaacctggcggcagcgcaaaagatg

SEQ ID NO: 28737 - DNA, 103 bp, Artificial Sequence
  Synthetic Polynucleotide
taatacgactcactatagggatttgttccatccggtctgcaacattagttaacagaggagaaactaaatgtgcagaccgaacctggcggcagcgcaaaagatg

SEQ ID NO: 28738 - DNA, 103 bp, Artificial Sequence
  Synthetic Polynucleotide
taatacgactcactatagggtcttttagagttttgtaagatctcagtaacaacagaggagagttactatgatcttacaaaacctggcggcagcgcaaaagatg

SEQ ID NO: 28739 - DNA, 103 bp, Artificial Sequence
  Synthetic Polynucleotide
taatacgactcactatagggggcaatcttttagagttttgtaagatctcaaacagaggagatgagatatgacaaaactcaacctggcggcagcgcaaaagatg

SEQ ID NO: 28740 - DNA, 103 bp, Artificial Sequence
  Synthetic Polynucleotide
taatacgactcactatagggcttgaggcaatcttttagagttttgtaagaaacagaggagatcttacatgactctaaaaaacctggcggcagcgcaaaagatg

SEQ ID NO: 28741 - DNA, 103 bp, Artificial Sequence
  Synthetic Polynucleotide
taatacgactcactatagggattttcttgaggcaatcttttagagttttgaacagaggagacaaaacatgaaaagattgaacctggcggcagcgcaaaagatg

SEQ ID NO: 28742 - DNA, 103 bp, Artificial Sequence
  Synthetic Polynucleotide
taatacgactcactatagggaatctattttcttgaggcaatcttttagagaacagaggagactctaaatgattgcctcaaacctggcggcagcgcaaaagatg

SEQ ID NO: 28743 - DNA, 103 bp, Artificial Sequence
  Synthetic Polynucleotide
taatacgactcactataggggtccaaatctattttcttgaggcaatctttaacagaggagaaaagatatgctcaagaaaaacctggcggcagcgcaaaagatg

SEQ ID NO: 28744 - DNA, 103 bp, Artificial Sequence
  Synthetic Polynucleotide
taatacgactcactatagggaaggagtccaaatctattttcttgaggcaaaacagaggagattgcctatggaaaatagaaacctggcggcagcgcaaaagatg

SEQ ID NO: 28745 - DNA, 103 bp, Artificial Sequence
  Synthetic Polynucleotide
taatacgactcactatagggatctcaaggagtccaaatctattttcttgaaacagaggagatcaagaatgtagatttggaacctggcggcagcgcaaaagatg

SEQ ID NO: 28746 - DNA, 103 bp, Artificial Sequence
  Synthetic Polynucleotide
taatacgactcactatagggtccatatctcaaggagtccaaatctattttaacagaggagaaaaataatgttggactccaacctggcggcagcgcaaaagatg

SEQ ID NO: 28747 - DNA, 103 bp, Artificial Sequence
  Synthetic Polynucleotide
taatacgactcactatagggtgacctccatatctcaaggagtccaaatctaacagaggagaagatttatgctccttgagaacctggcggcagcgcaaaagatg

SEQ ID NO: 28748 - DNA, 103 bp, Artificial Sequence
  Synthetic Polynucleotide
taatacgactcactatagggcaaaaatttgttccatccggtctgcaacataacagaggagaatgttgatgaccggatggaacctggcggcagcgcaaaagatg

SEQ ID NO: 28749 - DNA, 103 bp, Artificial Sequence
  Synthetic Polynucleotide
taatacgactcactatagggctccttgacctccatatctcaaggagtccaaacagaggagatggactatgtgagatatgaacctggcggcagcgcaaaagatg

SEQ ID NO: 28750 - DNA, 103 bp, Artificial Sequence
  Synthetic Polynucleotide
taatacgactcactatagggtttagctccttgacctccatatctcaaggaaacagaggagatccttgatgtatggaggtaacctggcggcagcgcaaaagatg

SEQ ID NO: 28751 - DNA, 103 bp, Artificial Sequence
  Synthetic Polynucleotide
taatacgactcactataggggctaatttagctccttgacctccatatctcaacagaggagagagataatgaggtcaaggaacctggcggcagcgcaaaagatg

SEQ ID NO: 28752 - DNA, 103 bp, Artificial Sequence
  Synthetic Polynucleotide
taatacgactcactatagggtaaaagctaatttagctccttgacctccataacagaggagaatggagatgaaggagctaaacctggcggcagcgcaaaagatg

SEQ ID NO: 28753 - DNA, 103 bp, Artificial Sequence
  Synthetic Polynucleotide
taatacgactcactatagggtctcttaaaagctaatttagctccttgaccaacagaggagaggtcaaatggctaaattaaacctggcggcagcgcaaaagatg

SEQ ID NO: 28754 - DNA, 103 bp, Artificial Sequence
  Synthetic Polynucleotide
taatacgactcactatagggacccatctcttaaaagctaatttagctcctaacagaggagaaggagcatgattagctttaacctggcggcagcgcaaaagatg

SEQ ID NO: 28755 - DNA, 103 bp, Artificial Sequence
  Synthetic Polynucleotide
taatacgactcactataggggcgtgacccatctcttaaaagctaatttagaacagaggagactaaatatgcttttaagaaacctggcggcagcgcaaaagatg

SEQ ID NO: 28756 - DNA, 103 bp, Artificial Sequence
  Synthetic Polynucleotide
taatacgactcactataggggttgtgcgtgacccatctcttaaaagctaaaacagaggagattagctatgaagagatggaacctggcggcagcgcaaaagatg

SEQ ID NO: 28757 - DNA, 103 bp, Artificial Sequence
  Synthetic Polynucleotide
taatacgactcactatagggacatagttgtgcgtgacccatctcttaaaaaacagaggagattttaaatgatgggtcacaacctggcggcagcgcaaaagatg

SEQ ID NO: 28758 - DNA, 103 bp, Artificial Sequence
  Synthetic Polynucleotide
taatacgactcactatagggactctacatagttgtgcgtgacccatctctaacagaggagaagagatatgtcacgcacaaacctggcggcagcgcaaaagatg

SEQ ID NO: 28759 - DNA, 103 bp, Artificial Sequence
  Synthetic Polynucleotide
taatacgactcactatagggagtttcaaaaatttgttccatccggtctgcaacagaggagagcagacatgatggaacaaaacctggcggcagcgcaaaagatg

SEQ ID NO: 28760 - DNA, 103 bp, Artificial Sequence
  Synthetic Polynucleotide
taatacgactcactatagggagtagactctacatagttgtgcgtgacccaaacagaggagatgggtcatgcacaactataacctggcggcagcgcaaaagatg

SEQ ID NO: 28761 - DNA, 103 bp, Artificial Sequence
  Synthetic Polynucleotide
taatacgactcactatagggtttcgagtagactctacatagttgtgcgtgaacagaggagacacgcaatgctatgtagaaacctggcggcagcgcaaaagatg

SEQ ID NO: 28762 - DNA, 103 bp, Artificial Sequence
  Synthetic Polynucleotide
taatacgactcactatagggtcctgtttcgagtagactctacatagttgtaacagaggagaacaactatgtagagtctaaacctggcggcagcgcaaaagatg

SEQ ID NO: 28763 - DNA, 103 bp, Artificial Sequence
  Synthetic Polynucleotide
taatacgactcactatagggcatcttcctgtttcgagtagactctacataaacagaggagatatgtaatgtctactcgaaacctggcggcagcgcaaaagatg

SEQ ID NO: 28764 - DNA, 103 bp, Artificial Sequence
  Synthetic Polynucleotide
taatacgactcactatagggataaacatcttcctgtttcgagtagactctaacagaggagaagagtcatgtcgaaacagaacctggcggcagcgcaaaagatg

SEQ ID NO: 28765 - DNA, 103 bp, Artificial Sequence
  Synthetic Polynucleotide
taatacgactcactataggggatccataaacatcttcctgtttcgagtagaacagaggagactactcatgacaggaagaaacctggcggcagcgcaaaagatg

SEQ ID NO: 28766 - DNA, 103 bp, Artificial Sequence
  Synthetic Polynucleotide
taatacgactcactatagggtctaagatccataaacatcttcctgtttcgaacagaggagacgaaacatgaagatgtttaacctggcggcagcgcaaaagatg

SEQ ID NO: 28767 - DNA, 103 bp, Artificial Sequence
  Synthetic Polynucleotide
taatacgactcactatagggaactctctaagatccataaacatcttcctgaacagaggagacaggaaatggtttatggaaacctggcggcagcgcaaaagatg

SEQ ID NO: 28768 - DNA, 103 bp, Artificial Sequence
  Synthetic Polynucleotide
taatacgactcactataggggataaaactctctaagatccataaacatctaacagaggagaagatgtatgtggatcttaaacctggcggcagcgcaaaagatg

SEQ ID NO: 28769 - DNA, 103 bp, Artificial Sequence
  Synthetic Polynucleotide
taatacgactcactatagggtttctgataaaactctctaagatccataaaaacagaggagatttatgatgcttagagagaacctggcggcagcgcaaaagatg

SEQ ID NO: 28770 - DNA, 103 bp, Artificial Sequence
  Synthetic Polynucleotide
taatacgactcactatagggggtgcagtttcaaaaatttgttccatccggaacagaggagaccggatatgacaaattttaacctggcggcagcgcaaaagatg

SEQ ID NO: 28771 - DNA, 103 bp, Artificial Sequence
  Synthetic Polynucleotide
taatacgactcactatagggtccagtttctgataaaactctctaagatccaacagaggagaggatctatgagagttttaaacctggcggcagcgcaaaagatg

SEQ ID NO: 28772 - DNA, 103 bp, Artificial Sequence
  Synthetic Polynucleotide
taatacgactcactatagggtaggctccagtttctgataaaactctctaaaacagaggagattagagatgtttatcagaaacctggcggcagcgcaaaagatg

SEQ ID NO: 28773 - DNA, 103 bp, Artificial Sequence
  Synthetic Polynucleotide
taatacgactcactatagggttctataggctccagtttctgataaaactcaacagaggagagagtttatgcagaaactgaacctggcggcagcgcaaaagatg

SEQ ID NO: 28774 - DNA, 103 bp, Artificial Sequence
  Synthetic Polynucleotide
taatacgactcactatagggatagtttctataggctccagtttctgataaaacagaggagattatcaatgactggagccaacctggcggcagcgcaaaagatg

SEQ ID NO: 28775 - DNA, 103 bp, Artificial Sequence
  Synthetic Polynucleotide
taatacgactcactatagggtcgtaatagtttctataggctccagtttctaacagaggagaagaaacatgagcctatagaacctggcggcagcgcaaaagatg

SEQ ID NO: 28776 - DNA, 103 bp, Artificial Sequence
  Synthetic Polynucleotide
taatacgactcactatagggtctattcgtaatagtttctataggctccagaacagaggagactggagatgatagaaactaacctggcggcagcgcaaaagatg

SEQ ID NO: 28777 - DNA, 103 bp, Artificial Sequence
  Synthetic Polynucleotide
taatacgactcactatagggagaaatctattcgtaatagtttctataggcaacagaggagagcctatatgaactattacaacctggcggcagcgcaaaagatg

SEQ ID NO: 28778 - DNA, 103 bp, Artificial Sequence
  Synthetic Polynucleotide
taatacgactcactatagggtctctagaaatctattcgtaatagtttctaaacagaggagatagaaaatgttacgaataaacctggcggcagcgcaaaagatg

SEQ ID NO: 28779 - DNA, 103 bp, Artificial Sequence
  Synthetic Polynucleotide
taatacgactcactatagggtctcctctctagaaatctattcgtaatagtaacagaggagaactattatgaatagatttaacctggcggcagcgcaaaagatg

SEQ ID NO: 28780 - DNA, 103 bp, Artificial Sequence
  Synthetic Polynucleotide
taatacgactcactatagggaaacctctcctctctagaaatctattcgtaaacagaggagatacgaaatgatttctagaaacctggcggcagcgcaaaagatg

SEQ ID NO: 28781 - DNA, 103 bp, Artificial Sequence
  Synthetic Polynucleotide
taatacgactcactatagggcaaatggtgcagtttcaaaaatttgttccaaacagaggagatggaacatgtttttgaaaaacctggcggcagcgcaaaagatg

SEQ ID NO: 28782 - DNA, 103 bp, Artificial Sequence
  Synthetic Polynucleotide
taatacgactcactatagggactgcaaacctctcctctctagaaatctataacagaggagaatagatatgtagagaggaaacctggcggcagcgcaaaagatg

SEQ ID NO: 28783 - DNA, 103 bp, Artificial Sequence
  Synthetic Polynucleotide
taatacgactcactatagggaggacactgcaaacctctcctctctagaaaaacagaggagatttctaatgaggagaggtaacctggcggcagcgcaaaagatg

SEQ ID NO: 28784 - DNA, 103 bp, Artificial Sequence
  Synthetic Polynucleotide
taatacgactcactatagggaaagaaggacactgcaaacctctcctctctaacagaggagaagagagatgaggtttgcaaacctggcggcagcgcaaaagatg

SEQ ID NO: 28785 - DNA, 103 bp, Artificial Sequence
  Synthetic Polynucleotide
taatacgactcactatagggtccctaaagaaggacactgcaaacctctccaacagaggagaggagagatgtgcagtgtcaacctggcggcagcgcaaaagatg

SEQ ID NO: 28786 - DNA, 103 bp, Artificial Sequence
  Synthetic Polynucleotide
taatacgactcactatagggtagtatccctaaagaaggacactgcaaaccaacagaggagaggtttgatgtgtccttctaacctggcggcagcgcaaaagatg

SEQ ID NO: 28787 - DNA, 103 bp, Artificial Sequence
  Synthetic Polynucleotide
taatacgactcactatagggctttctagtatccctaaagaaggacactgcaacagaggagagcagtgatgttctttaggaacctggcggcagcgcaaaagatg

SEQ ID NO: 28788 - DNA, 103 bp, Artificial Sequence
  Synthetic Polynucleotide
taatacgactcactatagggtgaagctttctagtatccctaaagaaggacaacagaggagagtccttatgtagggatacaacctggcggcagcgcaaaagatg

SEQ ID NO: 28789 - DNA, 103 bp, Artificial Sequence
  Synthetic Polynucleotide
taatacgactcactatagggagtcttgaagctttctagtatccctaaagaaacagaggagatctttaatgatactagaaaacctggcggcagcgcaaaagatg

SEQ ID NO: 28790 - DNA, 103 bp, Artificial Sequence
  Synthetic Polynucleotide
taatacgactcactatagggcttaaagtcttgaagctttctagtatccctaacagaggagaagggatatgagaaagcttaacctggcggcagcgcaaaagatg

SEQ ID NO: 28791 - DNA, 103 bp, Artificial Sequence
  Synthetic Polynucleotide
taatacgactcactatagggcagggcttaaagtcttgaagctttctagtaaacagaggagatactagatggcttcaagaaacctggcggcagcgcaaaagatg

SEQ ID NO: 28792 - DNA, 103 bp, Artificial Sequence
  Synthetic Polynucleotide
taatacgactcactatagggcttcacaaatggtgcagtttcaaaaatttgaacagaggagacaaattatggaaactgcaaacctggcggcagcgcaaaagatg

SEQ ID NO: 28793 - DNA, 103 bp, Artificial Sequence
  Synthetic Polynucleotide
taatacgactcactatagggtgagtcagggcttaaagtcttgaagctttcaacagaggagagaaagcatgaagactttaaacctggcggcagcgcaaaagatg

SEQ ID NO: 28794 - DNA, 103 bp, Artificial Sequence
  Synthetic Polynucleotide
taatacgactcactatagggagagctgagtcagggcttaaagtcttgaagaacagaggagacttcaaatgtttaagcccaacctggcggcagcgcaaaagatg

SEQ ID NO: 28795 - DNA, 103 bp, Artificial Sequence
  Synthetic Polynucleotide
taatacgactcactatagggttccgagagctgagtcagggcttaaagtctaacagaggagaagacttatggccctgactaacctggcggcagcgcaaaagatg

SEQ ID NO: 28796 - DNA, 103 bp, Artificial Sequence
  Synthetic Polynucleotide
taatacgactcactatagggatatcttccgagagctgagtcagggcttaaaacagaggagattaagcatggactcagctaacctggcggcagcgcaaaagatg

SEQ ID NO: 28797 - DNA, 103 bp, Artificial Sequence
  Synthetic Polynucleotide
taatacgactcactatagggacgaaatatcttccgagagctgagtcagggaacagaggagaccctgaatgagctctcggaacctggcggcagcgcaaaagatg

SEQ ID NO: 28798 - DNA, 103 bp, Artificial Sequence
  Synthetic Polynucleotide
taatacgactcactatagggcattgacgaaatatcttccgagagctgagtaacagaggagaactcagatgtcggaagataacctggcggcagcgcaaaagatg

SEQ ID NO: 28799 - DNA, 103 bp, Artificial Sequence
  Synthetic Polynucleotide
taatacgactcactatagggataaacattgacgaaatatcttccgagagcaacagaggagagctctcatgagatatttcaacctggcggcagcgcaaaagatg

SEQ ID NO: 28800 - DNA, 103 bp, Artificial Sequence
  Synthetic Polynucleotide
taatacgactcactataggggatgcataaacattgacgaaatatcttccgaacagaggagacggaagatgtttcgtcaaaacctggcggcagcgcaaaagatg

SEQ ID NO: 28801 - DNA, 103 bp, Artificial Sequence
  Synthetic Polynucleotide
taatacgactcactataggggataagatgcataaacattgacgaaatatcaacagaggagagatattatgtcaatgtttaacctggcggcagcgcaaaagatg

SEQ ID NO: 28802 - DNA, 103 bp, Artificial Sequence
  Synthetic Polynucleotide
taatacgactcactataggggacaagataagatgcataaacattgacgaaaacagaggagattcgtcatggtttatgcaaacctggcggcagcgcaaaagatg

SEQ ID NO: 28803 - DNA, 103 bp, Artificial Sequence
  Synthetic Polynucleotide
taatacgactcactatagggataatcttcacaaatggtgcagtttcaaaaaacagaggagattttgaatgtgcaccattaacctggcggcagcgcaaaagatg

SEQ ID NO: 28804 - DNA, 103 bp, Artificial Sequence
  Synthetic Polynucleotide
taatacgactcactatagggtgaaagacaagataagatgcataaacattgaacagaggagacaatgtatgtgcatcttaaacctggcggcagcgcaaaagatg

SEQ ID NO: 28805 - DNA, 103 bp, Artificial Sequence
  Synthetic Polynucleotide
taatacgactcactatagggtaacatgaaagacaagataagatgcataaaaacagaggagatttatgatgcttatcttgaacctggcggcagcgcaaaagatg

SEQ ID NO: 28806 - DNA, 103 bp, Artificial Sequence
  Synthetic Polynucleotide
taatacgactcactatagggcattataacatgaaagacaagataagatgcaacagaggagagcatctatgcttgtctttaacctggcggcagcgcaaaagatg

SEQ ID NO: 28807 - DNA, 103 bp, Artificial Sequence
  Synthetic Polynucleotide
taatacgactcactatagggtagagcattataacatgaaagacaagataaaacagaggagattatctatgctttcatgtaacctggcggcagcgcaaaagatg

SEQ ID NO: 28808 - DNA, 103 bp, Artificial Sequence
  Synthetic Polynucleotide
taatacgactcactatagggtcatatagagcattataacatgaaagacaaaacagaggagattgtctatgatgttataaaacctggcggcagcgcaaaagatg

SEQ ID NO: 28809 - DNA, 103 bp, Artificial Sequence
  Synthetic Polynucleotide
taatacgactcactatagggagagttcatatagagcattataacatgaaaaacagaggagatttcatatgataatgctcaacctggcggcagcgcaaaagatg

SEQ ID NO: 28810 - DNA, 103 bp, Artificial Sequence
  Synthetic Polynucleotide
taatacgactcactatagggtctagagagttcatatagagcattataacaaacagaggagatgttatatggctctatataacctggcggcagcgcaaaagatg

SEQ ID NO: 28811 - DNA, 103 bp, Artificial Sequence
  Synthetic Polynucleotide
taatacgactcactatagggcccaatctagagagttcatatagagcattaaacagaggagataatgcatgatatgaactaacctggcggcagcgcaaaagatg

SEQ ID NO: 28812 - DNA, 103 bp, Artificial Sequence
  Synthetic Polynucleotide
taatacgactcactatagggttcatcccaatctagagagttcatatagagaacagaggagactctatatgaactctctaaacctggcggcagcgcaaaagatg

SEQ ID NO: 28813 - DNA, 103 bp, Artificial Sequence
  Synthetic Polynucleotide
taatacgactcactatagggttttcttcatcccaatctagagagttcataaacagaggagatatgaaatgtctagattgaacctggcggcagcgcaaaagatg

SEQ ID NO: 28814 - DNA, 103 bp, Artificial Sequence
  Synthetic Polynucleotide
taatacgactcactataggggctctataatcttcacaaatggtgcagtttaacagaggagaaaactgatgcatttgtgaaacctggcggcagcgcaaaagatg

SEQ ID NO: 28815 - DNA, 103 bp, Artificial Sequence
  Synthetic Polynucleotide
taatacgactcactatagggtggctttttcttcatcccaatctagagagtaacagaggagaactctcatgattgggatgaacctggcggcagcgcaaaagatg

SEQ ID NO: 28816 - DNA, 103 bp, Artificial Sequence
  Synthetic Polynucleotide
taatacgactcactataggggataatggctttttcttcatcccaatctagaacagaggagactagatatggatgaagaaaacctggcggcagcgcaaaagatg

SEQ ID NO: 28817 - DNA, 103 bp, Artificial Sequence
  Synthetic Polynucleotide
taatacgactcactatagggaaggcgataatggctttttcttcatcccaaaacagaggagattgggaatgagaaaaagcaacctggcggcagcgcaaaagatg

SEQ ID NO: 28818 - DNA, 103 bp, Artificial Sequence
  Synthetic Polynucleotide
taatacgactcactatagggtccataaggcgataatggctttttcttcataacagaggagaatgaagatgaagccattaaacctggcggcagcgcaaaagatg

SEQ ID NO: 28819 - DNA, 103 bp, Artificial Sequence
  Synthetic Polynucleotide
taatacgactcactatagggggacctccataaggcgataatggctttttcaacagaggagagaaaaaatgattatcgccaacctggcggcagcgcaaaagatg

SEQ ID NO: 28820 - DNA, 103 bp, Artificial Sequence
  Synthetic Polynucleotide
taatacgactcactatagggaagaaggacctccataaggcgataatggctaacagaggagaagccatatgcgccttatgaacctggcggcagcgcaaaagatg

SEQ ID NO: 28821 - DNA, 103 bp, Artificial Sequence
  Synthetic Polynucleotide
taatacgactcactatagggaatccaagaaggacctccataaggcgataaaacagaggagattatcgatgtatggaggtaacctggcggcagcgcaaaagatg

SEQ ID NO: 28822 - DNA, 103 bp, Artificial Sequence
  Synthetic Polynucleotide
taatacgactcactataggggttataatccaagaaggacctccataaggcaacagaggagagccttaatgaggtccttcaacctggcggcagcgcaaaagatg

SEQ ID NO: 28823 - DNA, 103 bp, Artificial Sequence
  Synthetic Polynucleotide
taatacgactcactatagggctggagttataatccaagaaggacctccataacagaggagaatggagatgcttcttggaaacctggcggcagcgcaaaagatg

SEQ ID NO: 28824 - DNA, 103 bp, Artificial Sequence
  Synthetic Polynucleotide
taatacgactcactatagggtggtcctggagttataatccaagaaggaccaacagaggagaggtcctatgtggattataaacctggcggcagcgcaaaagatg

SEQ ID NO: 28825 - DNA, 103 bp, Artificial Sequence
  Synthetic Polynucleotide
taatacgactcactatagggttgttcaggatccattgtagaagtgttactaacagaggagaagtaacatgtctacaatgaacctggcggcagcgcaaaagatg

SEQ ID NO: 28826 - DNA, 103 bp, Artificial Sequence
  Synthetic Polynucleotide
taatacgactcactataggggtgatgctctataatcttcacaaatggtgcaacagaggagagcaccaatggtgaagattaacctggcggcagcgcaaaagatg

SEQ ID NO: 28827 - DNA, 103 bp, Artificial Sequence
  Synthetic Polynucleotide
taatacgactcactatagggagagttggtcctggagttataatccaagaaaacagaggagattcttgatgtataactccaacctggcggcagcgcaaaagatg

SEQ ID NO: 28828 - DNA, 103 bp, Artificial Sequence
  Synthetic Polynucleotide
taatacgactcactataggggacacagagttggtcctggagttataatccaacagaggagaggattaatgctccaggacaacctggcggcagcgcaaaagatg

SEQ ID NO: 28829 - DNA, 103 bp, Artificial Sequence
  Synthetic Polynucleotide
taatacgactcactatagggttactgacacagagttggtcctggagttataacagaggagaataactatgggaccaactaacctggcggcagcgcaaaagatg

SEQ ID NO: 28830 - DNA, 103 bp, Artificial Sequence
  Synthetic Polynucleotide
taatacgactcactataggggtcttttactgacacagagttggtcctggaaacagaggagatccaggatgaactctgtgaacctggcggcagcgcaaaagatg

SEQ ID NO: 28831 - DNA, 103 bp, Artificial Sequence
  Synthetic Polynucleotide
taatacgactcactatagggagcaagtcttttactgacacagagttggtcaacagaggagagaccaaatgtgtgtcagtaacctggcggcagcgcaaaagatg

SEQ ID NO: 28832 - DNA, 103 bp, Artificial Sequence
  Synthetic Polynucleotide
taatacgactcactatagggcccacagcaagtcttttactgacacagagtaacagaggagaactctgatgcagtaaaagaacctggcggcagcgcaaaagatg

SEQ ID NO: 28833 - DNA, 103 bp, Artificial Sequence
  Synthetic Polynucleotide
taatacgactcactatagggcctcccccacagcaagtcttttactgacacaacagaggagagtgtcaatgaaagacttgaacctggcggcagcgcaaaagatg

SEQ ID NO: 28834 - DNA, 103 bp, Artificial Sequence
  Synthetic Polynucleotide
taatacgactcactatagggaccatcctcccccacagcaagtcttttactaacagaggagaagtaaaatgcttgctgtgaacctggcggcagcgcaaaagatg

SEQ ID NO: 28835 - DNA, 103 bp, Artificial Sequence
  Synthetic Polynucleotide
taatacgactcactatagggtgaccaccatcctcccccacagcaagtcttaacagaggagaaagactatgtgtgggggaaacctggcggcagcgcaaaagatg

SEQ ID NO: 28836 - DNA, 103 bp, Artificial Sequence
  Synthetic Polynucleotide
taatacgactcactatagggtttagtgaccaccatcctcccccacagcaaaacagaggagattgctgatggggaggatgaacctggcggcagcgcaaaagatg

SEQ ID NO: 28837 - DNA, 103 bp, Artificial Sequence
  Synthetic Polynucleotide
taatacgactcactatagggaaggtgtgatgctctataatcttcacaaataacagaggagaatttgtatggattatagaaacctggcggcagcgcaaaagatg

SEQ ID NO: 28838 - DNA, 103 bp, Artificial Sequence
  Synthetic Polynucleotide
taatacgactcactatagggtattctttagtgaccaccatcctcccccacaacagaggagagtggggatggatggtggtaacctggcggcagcgcaaaagatg

SEQ ID NO: 28839 - DNA, 103 bp, Artificial Sequence
  Synthetic Polynucleotide
taatacgactcactataggggaacgtattctttagtgaccaccatcctccaacagaggagaggaggaatgtggtcactaaacctggcggcagcgcaaaagatg

SEQ ID NO: 28840 - DNA, 103 bp, Artificial Sequence
  Synthetic Polynucleotide
taatacgactcactatagggcatcagaacgtattctttagtgaccaccataacagaggagaatggtgatgactaaagaaaacctggcggcagcgcaaaagatg

SEQ ID NO: 28841 - DNA, 103 bp, Artificial Sequence
  Synthetic Polynucleotide
taatacgactcactatagggtctagcatcagaacgtattctttagtgaccaacagaggagaggtcacatgagaatacgtaacctggcggcagcgcaaaagatg

SEQ ID NO: 28842 - DNA, 103 bp, Artificial Sequence
  Synthetic Polynucleotide
taatacgactcactatagggtgatatctagcatcagaacgtattctttagaacagaggagactaaagatgacgttctgaaacctggcggcagcgcaaaagatg

SEQ ID NO: 28843 - DNA, 103 bp, Artificial Sequence
  Synthetic Polynucleotide
taatacgactcactataggggcagctgatatctagcatcagaacgtattcaacagaggagagaatacatgctgatgctaaacctggcggcagcgcaaaagatg

SEQ ID NO: 28844 - DNA, 103 bp, Artificial Sequence
  Synthetic Polynucleotide
taatacgactcactatagggaacaagcagctgatatctagcatcagaacgaacagaggagacgttctatggctagatataacctggcggcagcgcaaaagatg

SEQ ID NO: 28845 - DNA, 103 bp, Artificial Sequence
  Synthetic Polynucleotide
taatacgactcactatagggtatcaaacaagcagctgatatctagcatcaaacagaggagatgatgcatgatatcagctaacctggcggcagcgcaaaagatg

SEQ ID NO: 28846 - DNA, 103 bp, Artificial Sequence
  Synthetic Polynucleotide
taatacgactcactatagggattcctatcaaacaagcagctgatatctagaacagaggagactagatatgagctgcttgaacctggcggcagcgcaaaagatg

SEQ ID NO: 28847 - DNA, 103 bp, Artificial Sequence
  Synthetic Polynucleotide
taatacgactcactatagggatgaaattcctatcaaacaagcagctgataaacagaggagatatcagatgcttgtttgaaacctggcggcagcgcaaaagatg

SEQ ID NO: 28848 - DNA, 103 bp, Artificial Sequence
  Synthetic Polynucleotide
taatacgactcactatagggtcatcaaggtgtgatgctctataatcttcaaacagaggagatgaagaatgtagagcatcaacctggcggcagcgcaaaagatg

SEQ ID NO: 28849 - DNA, 103 bp, Artificial Sequence
  Synthetic Polynucleotide
taatacgactcactatagggtgagcatgaaattcctatcaaacaagcagcaacagaggagagctgctatgttgataggaaacctggcggcagcgcaaaagatg

SEQ ID NO: 28850 - DNA, 103 bp, Artificial Sequence
  Synthetic Polynucleotide
taatacgactcactatagggcaacatgagcatgaaattcctatcaaacaaaacagaggagattgtttatgaggaatttcaacctggcggcagcgcaaaagatg

SEQ ID NO: 28851 - DNA, 103 bp, Artificial Sequence
  Synthetic Polynucleotide
taatacgactcactatagggtctttcaacatgagcatgaaattcctatcaaacagaggagatgatagatgtttcatgctaacctggcggcagcgcaaaagatg

SEQ ID NO: 28852 - DNA, 103 bp, Artificial Sequence
  Synthetic Polynucleotide
taatacgactcactatagggaagtatctttcaacatgagcatgaaattccaacagaggagaggaattatgtgctcatgtaacctggcggcagcgcaaaagatg

SEQ ID NO: 28853 - DNA, 103 bp, Artificial Sequence
  Synthetic Polynucleotide
taatacgactcactatagggtaaaaaagtatctttcaacatgagcatgaaaacagaggagattcatgatgatgttgaaaaacctggcggcagcgcaaaagatg

SEQ ID NO: 28854 - DNA, 103 bp, Artificial Sequence
  Synthetic Polynucleotide
taatacgactcactatagggctggataaaaaagtatctttcaacatgagcaacagaggagagctcatatggaaagatacaacctggcggcagcgcaaaagatg

SEQ ID NO: 28855 - DNA, 103 bp, Artificial Sequence
  Synthetic Polynucleotide
taatacgactcactatagggtgaatctggataaaaaagtatctttcaacaaacagaggagatgttgaatgatactttttaacctggcggcagcgcaaaagatg

SEQ ID NO: 28856 - DNA, 103 bp, Artificial Sequence
  Synthetic Polynucleotide
taatacgactcactatagggagagttgaatctggataaaaaagtatctttaacagaggagaaaagatatgtttttatccaacctggcggcagcgcaaaagatg

SEQ ID NO: 28857 - DNA, 103 bp, Artificial Sequence
  Synthetic Polynucleotide
taatacgactcactataggggacaaagagttgaatctggataaaaaagtaaacagaggagatactttatgatccagattaacctggcggcagcgcaaaagatg

SEQ ID NO: 28858 - DNA, 103 bp, Artificial Sequence
  Synthetic Polynucleotide
taatacgactcactatagggatattgacaaagagttgaatctggataaaaaacagaggagattttatatggattcaactaacctggcggcagcgcaaaagatg

SEQ ID NO: 28859 - DNA, 103 bp, Artificial Sequence
  Synthetic Polynucleotide
taatacgactcactatagggagtagtcatcaaggtgtgatgctctataataacagaggagaattataatgcatcacaccaacctggcggcagcgcaaaagatg

SEQ ID NO: 28860 - DNA, 103 bp, Artificial Sequence
  Synthetic Polynucleotide
taatacgactcactatagggcaataatattgacaaagagttgaatctggaaacagaggagatccagaatgaactctttgaacctggcggcagcgcaaaagatg

SEQ ID NO: 28861 - DNA, 103 bp, Artificial Sequence
  Synthetic Polynucleotide
taatacgactcactatagggggagacaataatattgacaaagagttgaataacagaggagaattcaaatgtttgtcaataacctggcggcagcgcaaaagatg

SEQ ID NO: 28862 - DNA, 103 bp, Artificial Sequence
  Synthetic Polynucleotide
taatacgactcactatagggccggaggagacaataatattgacaaagagtaacagaggagaactcttatgcaatattataacctggcggcagcgcaaaagatg

SEQ ID NO: 28863 - DNA, 103 bp, Artificial Sequence
  Synthetic Polynucleotide
taatacgactcactatagggagaatccggaggagacaataatattgacaaaacagaggagattgtcaatgttattgtctaacctggcggcagcgcaaaagatg

SEQ ID NO: 28864 - DNA, 103 bp, Artificial Sequence
  Synthetic Polynucleotide
taatacgactcactatagggtaaagagaatccggaggagacaataatattaacagaggagaaatattatggtctcctccaacctggcggcagcgcaaaagatg

SEQ ID NO: 28865 - DNA, 103 bp, Artificial Sequence
  Synthetic Polynucleotide
taatacgactcactatagggctgagtaaagagaatccggaggagacaataaacagaggagatattgtatgctccggattaacctggcggcagcgcaaaagatg

SEQ ID NO: 28866 - DNA, 103 bp, Artificial Sequence
  Synthetic Polynucleotide
taatacgactcactataggggtctgctgagtaaagagaatccggaggagaaacagaggagatctcctatggattctcttaacctggcggcagcgcaaaagatg

SEQ ID NO: 28867 - DNA, 103 bp, Artificial Sequence
  Synthetic Polynucleotide
taatacgactcactataggggagaagtctgctgagtaaagagaatccggaaacagaggagatccggaatgtctttactcaacctggcggcagcgcaaaagatg

SEQ ID NO: 28868 - DNA, 103 bp, Artificial Sequence
  Synthetic Polynucleotide
taatacgactcactatagggactcagagaagtctgctgagtaaagagaataacagaggagaattctcatgactcagcagaacctggcggcagcgcaaaagatg

SEQ ID NO: 28869 - DNA, 103 bp, Artificial Sequence
  Synthetic Polynucleotide
taatacgactcactatagggcaaggactcagagaagtctgctgagtaaagaacagaggagactttacatggcagacttcaacctggcggcagcgcaaaagatg

SEQ ID NO: 28870 - DNA, 103 bp, Artificial Sequence
  Synthetic Polynucleotide
taatacgactcactatagggttgtgagtagtcatcaaggtgtgatgctctaacagaggagaagagcaatgcaccttgataacctggcggcagcgcaaaagatg

SEQ ID NO: 28871 - DNA, 103 bp, Artificial Sequence
  Synthetic Polynucleotide
taatacgactcactatagggtcacacaaggactcagagaagtctgctgagaacagaggagactcagcatgcttctctgaaacctggcggcagcgcaaaagatg

SEQ ID NO: 28872 - DNA, 103 bp, Artificial Sequence
  Synthetic Polynucleotide
taatacgactcactatagggacaagtcacacaaggactcagagaagtctgaacagaggagacagactatgctgagtcctaacctggcggcagcgcaaaagatg

SEQ ID NO: 28873 - DNA, 103 bp, Artificial Sequence
  Synthetic Polynucleotide
taatacgactcactatagggattatacaagtcacacaaggactcagagaaaacagaggagattctctatgtccttgtgtaacctggcggcagcgcaaaagatg

SEQ ID NO: 28874 - DNA, 103 bp, Artificial Sequence
  Synthetic Polynucleotide
taatacgactcactatagggcccacattatacaagtcacacaaggactcaaacagaggagatgagtcatggtgtgacttaacctggcggcagcgcaaaagatg

SEQ ID NO: 28875 - DNA, 103 bp, Artificial Sequence
  Synthetic Polynucleotide
taatacgactcactatagggtgtctcccacattatacaagtcacacaaggaacagaggagaccttgtatgacttgtataaacctggcggcagcgcaaaagatg

SEQ ID NO: 28876 - DNA, 103 bp, Artificial Sequence
  Synthetic Polynucleotide
taatacgactcactataggggatgttgtctcccacattatacaagtcacaaacagaggagatgtgacatgtataatgtgaacctggcggcagcgcaaaagatg

SEQ ID NO: 28877 - DNA, 103 bp, Artificial Sequence
  Synthetic Polynucleotide
taatacgactcactataggggctatgatgttgtctcccacattatacaagaacagaggagacttgtaatgtgtgggagaaacctggcggcagcgcaaaagatg

SEQ ID NO: 28878 - DNA, 103 bp, Artificial Sequence
  Synthetic Polynucleotide
taatacgactcactatagggattctgctatgatgttgtctcccacattataacagaggagaataatgatggagacaacaaacctggcggcagcgcaaaagatg

SEQ ID NO: 28879 - DNA, 103 bp, Artificial Sequence
  Synthetic Polynucleotide
taatacgactcactatagggcccacattctgctatgatgttgtctcccacaacagaggagagtgggaatgaacatcataaacctggcggcagcgcaaaagatg

SEQ ID NO: 28880 - DNA, 103 bp, Artificial Sequence
  Synthetic Polynucleotide
taatacgactcactataggggcgttcccacattctgctatgatgttgtctaacagaggagaagacaaatgcatagcagaaacctggcggcagcgcaaaagatg

SEQ ID NO: 28881 - DNA, 103 bp, Artificial Sequence
  Synthetic Polynucleotide
taatacgactcactatagggacatcttgtgagtagtcatcaaggtgtgataacagaggagaatcacaatgtgatgactaaacctggcggcagcgcaaaagatg

SEQ ID NO: 28882 - DNA, 103 bp, Artificial Sequence
  Synthetic Polynucleotide
taatacgactcactatagggaaccagcgttcccacattctgctatgatgtaacagaggagaacatcaatgcagaatgtgaacctggcggcagcgcaaaagatg

SEQ ID NO: 28883 - DNA, 103 bp, Artificial Sequence
  Synthetic Polynucleotide
taatacgactcactatagggatcataaccagcgttcccacattctgctataacagaggagaatagcaatgtgtgggaacaacctggcggcagcgcaaaagatg

SEQ ID NO: 28884 - DNA, 103 bp, Artificial Sequence
  Synthetic Polynucleotide
taatacgactcactatagggatgatatcataaccagcgttcccacattctaacagaggagaagaatgatggaacgctggaacctggcggcagcgcaaaagatg

SEQ ID NO: 28885 - DNA, 103 bp, Artificial Sequence
  Synthetic Polynucleotide
taatacgactcactatagggtttttatgatatcataaccagcgttcccacaacagaggagagtgggaatgctggttatgaacctggcggcagcgcaaaagatg

SEQ ID NO: 28886 - DNA, 103 bp, Artificial Sequence
  Synthetic Polynucleotide
taatacgactcactatagggaagcatttttatgatatcataaccagcgttaacagaggagaaacgctatgtatgatatcaacctggcggcagcgcaaaagatg

SEQ ID NO: 28887 - DNA, 103 bp, Artificial Sequence
  Synthetic Polynucleotide
taatacgactcactatagggggttcaagcatttttatgatatcataaccaaacagaggagatggttaatgtatcataaaaacctggcggcagcgcaaaagatg

SEQ ID NO: 28888 - DNA, 103 bp, Artificial Sequence
  Synthetic Polynucleotide
taatacgactcactatagggcaaacggttcaagcatttttatgatatcataacagaggagaatgataatgtaaaaatgcaacctggcggcagcgcaaaagatg

SEQ ID NO: 28889 - DNA, 103 bp, Artificial Sequence
  Synthetic Polynucleotide
taatacgactcactataggggactacaaacggttcaagcatttttatgataacagaggagaatcataatgatgcttgaaaacctggcggcagcgcaaaagatg

SEQ ID NO: 28890 - DNA, 103 bp, Artificial Sequence
  Synthetic Polynucleotide
taatacgactcactatagggttgttgactacaaacggttcaagcatttttaacagaggagaaaaaatatgtgaaccgttaacctggcggcagcgcaaaagatg

SEQ ID NO: 28891 - DNA, 103 bp, Artificial Sequence
  Synthetic Polynucleotide
taatacgactcactatagggcaagtttgttgactacaaacggttcaagcaaacagaggagatgcttgatgcgtttgtagaacctggcggcagcgcaaaagatg

SEQ ID NO: 28892 - DNA, 103 bp, Artificial Sequence
  Synthetic Polynucleotide
taatacgactcactatagggtgcacacatcttgtgagtagtcatcaaggtaacagaggagaaccttgatgactactcacaacctggcggcagcgcaaaagatg

SEQ ID NO: 28893 - DNA, 103 bp, Artificial Sequence
  Synthetic Polynucleotide
taatacgactcactatagggtttcacaagtttgttgactacaaacggttcaacagaggagagaaccgatggtagtcaacaacctggcggcagcgcaaaagatg

SEQ ID NO: 28894 - DNA, 103 bp, Artificial Sequence
  Synthetic Polynucleotide
taatacgactcactataggggcacttttcacaagtttgttgactacaaacaacagaggagagtttgtatgcaacaaactaacctggcggcagcgcaaaagatg

SEQ ID NO: 28895 - DNA, 103 bp, Artificial Sequence
  Synthetic Polynucleotide
taatacgactcactatagggcttcagcacttttcacaagtttgttgactaaacagaggagatagtcaatgaacttgtgaaacctggcggcagcgcaaaagatg

SEQ ID NO: 28896 - DNA, 103 bp, Artificial Sequence
  Synthetic Polynucleotide
taatacgactcactatagggaaattcttcagcacttttcacaagtttgttaacagaggagaaacaaaatggtgaaaagtaacctggcggcagcgcaaaagatg

SEQ ID NO: 28897 - DNA, 103 bp, Artificial Sequence
  Synthetic Polynucleotide
taatacgactcactataggggggcgaaattcttcagcacttttcacaagtaacagaggagaacttgtatgaagtgctgaaacctggcggcagcgcaaaagatg

SEQ ID NO: 28898 - DNA, 103 bp, Artificial Sequence
  Synthetic Polynucleotide
taatacgactcactatagggtcattgggcgaaattcttcagcacttttcaaacagaggagatgaaaaatgctgaagaataacctggcggcagcgcaaaagatg

SEQ ID NO: 28899 - DNA, 103 bp, Artificial Sequence
  Synthetic Polynucleotide
taatacgactcactatagggtggaatcattgggcgaaattcttcagcactaacagaggagaagtgctatggaatttcgcaacctggcggcagcgcaaaagatg

SEQ ID NO: 28900 - DNA, 103 bp, Artificial Sequence
  Synthetic Polynucleotide
taatacgactcactatagggaattttggaatcattgggcgaaattcttcaaacagaggagatgaagaatgtcgcccaataacctggcggcagcgcaaaagatg

SEQ ID NO: 28901 - DNA, 103 bp, Artificial Sequence
  Synthetic Polynucleotide
taatacgactcactatagggctcccaattttggaatcattgggcgaaattaacagaggagaaatttcatgcaatgattcaacctggcggcagcgcaaaagatg

SEQ ID NO: 28902 - DNA, 103 bp, Artificial Sequence
  Synthetic Polynucleotide
taatacgactcactatagggaaaatctcccaattttggaatcattgggcgaacagaggagacgcccaatgattccaaaaaacctggcggcagcgcaaaagatg

SEQ ID NO: 28903 - DNA, 103 bp, Artificial Sequence
  Synthetic Polynucleotide
taatacgactcactatagggcaatttgcacacatcttgtgagtagtcatcaacagaggagagatgacatgtcacaagataacctggcggcagcgcaaaagatg

SEQ ID NO: 28904 - DNA, 103 bp, Artificial Sequence
  Synthetic Polynucleotide
taatacgactcactatagggtcgggaaaatctcccaattttggaatcattaacagaggagaaatgatatgaaaattgggaacctggcggcagcgcaaaagatg

SEQ ID NO: 28905 - DNA, 103 bp, Artificial Sequence
  Synthetic Polynucleotide
taatacgactcactatagggtgaattcgggaaaatctcccaattttggaaaacagaggagattccaaatgtgggagattaacctggcggcagcgcaaaagatg

SEQ ID NO: 28906 - DNA, 103 bp, Artificial Sequence
  Synthetic Polynucleotide
taatacgactcactatagggtttaatgaattcgggaaaatctcccaatttaacagaggagaaaattgatggattttcccaacctggcggcagcgcaaaagatg

SEQ ID NO: 28907 - DNA, 103 bp, Artificial Sequence
  Synthetic Polynucleotide
taatacgactcactatagggttgtctttaatgaattcgggaaaatctcccaacagaggagagggagaatgtcccgaattaacctggcggcagcgcaaaagatg

SEQ ID NO: 28908 - DNA, 103 bp, Artificial Sequence
  Synthetic Polynucleotide
taatacgactcactataggggagtcttgtctttaatgaattcgggaaaataacagaggagaattttcatgaattcattaaacctggcggcagcgcaaaagatg

SEQ ID NO: 28909 - DNA, 103 bp, Artificial Sequence
  Synthetic Polynucleotide
taatacgactcactatagggctgctgagtcttgtctttaatgaattcgggaacagaggagacccgaaatgattaaagacaacctggcggcagcgcaaaagatg

SEQ ID NO: 28910 - DNA, 103 bp, Artificial Sequence
  Synthetic Polynucleotide
taatacgactcactatagggatcaactgctgagtcttgtctttaatgaataacagaggagaattcatatgagacaagacaacctggcggcagcgcaaaagatg

SEQ ID NO: 28911 - DNA, 103 bp, Artificial Sequence
  Synthetic Polynucleotide
taatacgactcactatagggtgccaatcaactgctgagtcttgtctttaaaacagaggagattaaagatgagactcagcaacctggcggcagcgcaaaagatg

SEQ ID NO: 28912 - DNA, 103 bp, Artificial Sequence
  Synthetic Polynucleotide
taatacgactcactatagggaaaggtgccaatcaactgctgagtcttgtcaacagaggagagacaagatgcagcagttgaacctggcggcagcgcaaaagatg

SEQ ID NO: 28913 - DNA, 103 bp, Artificial Sequence
  Synthetic Polynucleotide
taatacgactcactatagggggaccaaaggtgccaatcaactgctgagtcaacagaggagagactcaatggttgattggaacctggcggcagcgcaaaagatg

SEQ ID NO: 28914 - DNA, 103 bp, Artificial Sequence
  Synthetic Polynucleotide
taatacgactcactatagggtactccaatttgcacacatcttgtgagtagaacagaggagactactcatgagatgtgtgaacctggcggcagcgcaaaagatg

SEQ ID NO: 28915 - DNA, 103 bp, Artificial Sequence
  Synthetic Polynucleotide
taatacgactcactatagggccacaggaccaaaggtgccaatcaactgctaacagaggagaagcagtatgttggcacctaacctggcggcagcgcaaaagatg

SEQ ID NO: 28916 - DNA, 103 bp, Artificial Sequence
  Synthetic Polynucleotide
taatacgactcactatagggattggccacaggaccaaaggtgccaatcaaaacagaggagattgattatgacctttggtaacctggcggcagcgcaaaagatg

SEQ ID NO: 28917 - DNA, 103 bp, Artificial Sequence
  Synthetic Polynucleotide
taatacgactcactatagggaagaaattggccacaggaccaaaggtgccaaacagaggagatggcacatgtggtcctgtaacctggcggcagcgcaaaagatg

SEQ ID NO: 28918 - DNA, 103 bp, Artificial Sequence
  Synthetic Polynucleotide
taatacgactcactatagggaaaaaaagaaattggccacaggaccaaaggaacagaggagacctttgatgctgtggccaaacctggcggcagcgcaaaagatg

SEQ ID NO: 28919 - DNA, 103 bp, Artificial Sequence
  Synthetic Polynucleotide
taatacgactcactatagggttttgaaaaaaagaaattggccacaggaccaacagaggagaggtcctatggccaatttcaacctggcggcagcgcaaaagatg

SEQ ID NO: 28920 - DNA, 103 bp, Artificial Sequence
  Synthetic Polynucleotide
taatacgactcactatagggtccaattttgaaaaaaagaaattggccacaaacagaggagatgtggcatgtttctttttaacctggcggcagcgcaaaagatg

SEQ ID NO: 28921 - DNA, 103 bp, Artificial Sequence
  Synthetic Polynucleotide
taatacgactcactatagggattgctccaattttgaaaaaaagaaattggaacagaggagaccaattatgttttttcaaaacctggcggcagcgcaaaagatg

SEQ ID NO: 28922 - DNA, 103 bp, Artificial Sequence
  Synthetic Polynucleotide
taatacgactcactatagggattgtattgctccaattttgaaaaaaagaaaacagaggagattctttatgtcaaaattgaacctggcggcagcgcaaaagatg

SEQ ID NO: 28923 - DNA, 103 bp, Artificial Sequence
  Synthetic Polynucleotide
taatacgactcactatagggatgttattgtattgctccaattttgaaaaaaacagaggagatttttcatgattggagcaaacctggcggcagcgcaaaagatg

SEQ ID NO: 28924 - DNA, 103 bp, Artificial Sequence
  Synthetic Polynucleotide
taatacgactcactatagggcatggatgttattgtattgctccaattttgaacagaggagacaaaatatgagcaatacaaacctggcggcagcgcaaaagatg

SEQ ID NO: 28925 - DNA, 103 bp, Artificial Sequence
  Synthetic Polynucleotide
taatacgactcactataggggattgtactccaatttgcacacatcttgtgaacagaggagacacaagatgtgtgcaaataacctggcggcagcgcaaaagatg

SEQ ID NO: 28926 - DNA, 103 bp, Artificial Sequence
  Synthetic Polynucleotide
taatacgactcactatagggcaaatcatggatgttattgtattgctccaaaacagaggagattggagatgtacaataacaacctggcggcagcgcaaaagatg

SEQ ID NO: 28927 - DNA, 103 bp, Artificial Sequence
  Synthetic Polynucleotide
taatacgactcactatagggaaaaccaaatcatggatgttattgtattgcaacagaggagagcaataatgtaacatccaaacctggcggcagcgcaaaagatg

SEQ ID NO: 28928 - DNA, 103 bp, Artificial Sequence
  Synthetic Polynucleotide
taatacgactcactatagggacacaaaaaccaaatcatggatgttattgtaacagaggagaacaataatgtccatgattaacctggcggcagcgcaaaagatg

SEQ ID NO: 28929 - DNA, 103 bp, Artificial Sequence
  Synthetic Polynucleotide
taatacgactcactatagggtccgtacacaaaaaccaaatcatggatgttaacagaggagaaacatcatggatttggttaacctggcggcagcgcaaaagatg

SEQ ID NO: 28930 - DNA, 103 bp, Artificial Sequence
  Synthetic Polynucleotide
taatacgactcactatagggtaacatccgtacacaaaaaccaaatcatggaacagaggagaccatgaatgggtttttgtaacctggcggcagcgcaaaagatg

SEQ ID NO: 28931 - DNA, 103 bp, Artificial Sequence
  Synthetic Polynucleotide
taatacgactcactataggggtctgtaacatccgtacacaaaaaccaaataacagaggagaatttggatgttgtgtacgaacctggcggcagcgcaaaagatg

SEQ ID NO: 28932 - DNA, 103 bp, Artificial Sequence
  Synthetic Polynucleotide
taatacgactcactatagggccagtgtctgtaacatccgtacacaaaaacaacagaggagagtttttatgtacggatgtaacctggcggcagcgcaaaagatg

SEQ ID NO: 28933 - DNA, 103 bp, Artificial Sequence
  Synthetic Polynucleotide
taatacgactcactatagggtgaccccagtgtctgtaacatccgtacacaaacagaggagatgtgtaatgatgttacagaacctggcggcagcgcaaaagatg

SEQ ID NO: 28934 - DNA, 103 bp, Artificial Sequence
  Synthetic Polynucleotide
taatacgactcactataggggggggtgaccccagtgtctgtaacatccgtaacagaggagaacggatatgacagacactaacctggcggcagcgcaaaagatg

SEQ ID NO: 28935 - DNA, 103 bp, Artificial Sequence
  Synthetic Polynucleotide
taatacgactcactatagggaatatgggggtgaccccagtgtctgtaacaaacagaggagatgttacatgcactggggtaacctggcggcagcgcaaaagatg

SEQ ID NO: 28936 - DNA, 103 bp, Artificial Sequence
  Synthetic Polynucleotide
taatacgactcactatagggactacttgttcaggatccattgtagaagtgaacagaggagacacttcatgaatggatccaacctggcggcagcgcaaaagatg

SEQ ID NO: 28937 - DNA, 103 bp, Artificial Sequence
  Synthetic Polynucleotide
taatacgactcactatagggttagggattgtactccaatttgcacacatcaacagaggagagatgtgatgaaattggagaacctggcggcagcgcaaaagatg

SEQ ID NO: 28938 - DNA, 103 bp, Artificial Sequence
  Synthetic Polynucleotide
taatacgactcactatagggtaatcaatatgggggtgaccccagtgtctgaacagaggagacagacaatggggtcacccaacctggcggcagcgcaaaagatg

SEQ ID NO: 28939 - DNA, 103 bp, Artificial Sequence
  Synthetic Polynucleotide
taatacgactcactatagggttctgtaatcaatatgggggtgaccccagtaacagaggagaactgggatgacccccataaacctggcggcagcgcaaaagatg

SEQ ID NO: 28940 - DNA, 103 bp, Artificial Sequence
  Synthetic Polynucleotide
taatacgactcactatagggcccctttctgtaatcaatatgggggtgaccaacagaggagaggtcacatgcatattgataacctggcggcagcgcaaaagatg

SEQ ID NO: 28941 - DNA, 103 bp, Artificial Sequence
  Synthetic Polynucleotide
taatacgactcactataggggacaacccctttctgtaatcaatatgggggaacagaggagacccccaatgtgattacagaacctggcggcagcgcaaaagatg

SEQ ID NO: 28942 - DNA, 103 bp, Artificial Sequence
  Synthetic Polynucleotide
taatacgactcactatagggattttgacaacccctttctgtaatcaatataacagaggagaatattgatgacagaaaggaacctggcggcagcgcaaaagatg

SEQ ID NO: 28943 - DNA, 103 bp, Artificial Sequence
  Synthetic Polynucleotide
taatacgactcactatagggatacaattttgacaacccctttctgtaatcaacagaggagagattacatgaaggggttgaacctggcggcagcgcaaaagatg

SEQ ID NO: 28944 - DNA, 103 bp, Artificial Sequence
  Synthetic Polynucleotide
taatacgactcactatagggtgatcatacaattttgacaacccctttctgaacagaggagacagaaaatggttgtcaaaaacctggcggcagcgcaaaagatg

SEQ ID NO: 28945 - DNA, 103 bp, Artificial Sequence
  Synthetic Polynucleotide
taatacgactcactatagggggacttgatcatacaattttgacaacccctaacagaggagaaggggtatgcaaaattgtaacctggcggcagcgcaaaagatg

SEQ ID NO: 28946 - DNA, 103 bp, Artificial Sequence
  Synthetic Polynucleotide
taatacgactcactatagggcatatggacttgatcatacaattttgacaaaacagaggagattgtcaatgttgtatgataacctggcggcagcgcaaaagatg

SEQ ID NO: 28947 - DNA, 103 bp, Artificial Sequence
  Synthetic Polynucleotide
taatacgactcactatagggtttttcatatggacttgatcatacaattttaacagaggagaaaaattatgtgatcaagtaacctggcggcagcgcaaaagatg

SEQ ID NO: 28948 - DNA, 103 bp, Artificial Sequence
  Synthetic Polynucleotide
taatacgactcactatagggtgaaattagggattgtactccaatttgcacaacagaggagagtgcaaatgggagtacaaaacctggcggcagcgcaaaagatg

SEQ ID NO: 28949 - DNA, 103 bp, Artificial Sequence
  Synthetic Polynucleotide
taatacgactcactatagggttgactttttcatatggacttgatcatacaaacagaggagatgtatgatgaagtccataaacctggcggcagcgcaaaagatg

SEQ ID NO: 28950 - DNA, 103 bp, Artificial Sequence
  Synthetic Polynucleotide
taatacgactcactataggggtctattgactttttcatatggacttgatcaacagaggagagatcaaatgcatatgaaaaacctggcggcagcgcaaaagatg

SEQ ID NO: 28951 - DNA, 103 bp, Artificial Sequence
  Synthetic Polynucleotide
taatacgactcactatagggctggagtctattgactttttcatatggactaacagaggagaagtccaatggaaaaagtcaacctggcggcagcgcaaaagatg

SEQ ID NO: 28952 - DNA, 103 bp, Artificial Sequence
  Synthetic Polynucleotide
taatacgactcactataggggatacctggagtctattgactttttcatataacagaggagaatatgaatgagtcaatagaacctggcggcagcgcaaaagatg

SEQ ID NO: 28953 - DNA, 103 bp, Artificial Sequence
  Synthetic Polynucleotide
taatacgactcactatagggttcttgatacctggagtctattgactttttaacagaggagaaaaaagatgatagactccaacctggcggcagcgcaaaagatg

SEQ ID NO: 28954 - DNA, 103 bp, Artificial Sequence
  Synthetic Polynucleotide
taatacgactcactatagggagactttcttgatacctggagtctattgacaacagaggagagtcaatatgctccaggtaaacctggcggcagcgcaaaagatg

SEQ ID NO: 28955 - DNA, 103 bp, Artificial Sequence
  Synthetic Polynucleotide
taatacgactcactatagggtcgctagactttcttgatacctggagtctaaacagaggagatagactatgggtatcaagaacctggcggcagcgcaaaagatg

SEQ ID NO: 28956 - DNA, 103 bp, Artificial Sequence
  Synthetic Polynucleotide
taatacgactcactataggggtcactcgctagactttcttgatacctggaaacagaggagatccaggatgcaagaaagtaacctggcggcagcgcaaaagatg

SEQ ID NO: 28957 - DNA, 103 bp, Artificial Sequence
  Synthetic Polynucleotide
taatacgactcactataggggctaggtcactcgctagactttcttgatacaacagaggagagtatcaatgaagtctagcaacctggcggcagcgcaaaagatg

SEQ ID NO: 28958 - DNA, 103 bp, Artificial Sequence
  Synthetic Polynucleotide
taatacgactcactatagggtcttggctaggtcactcgctagactttcttaacagaggagaaagaaaatgtagcgagtgaacctggcggcagcgcaaaagatg

SEQ ID NO: 28959 - DNA, 103 bp, Artificial Sequence
  Synthetic Polynucleotide
taatacgactcactataggggaatctgaaattagggattgtactccaattaacagaggagaaattggatgacaatccctaacctggcggcagcgcaaaagatg

SEQ ID NO: 28960 - DNA, 103 bp, Artificial Sequence
  Synthetic Polynucleotide
taatacgactcactatagggaatcttcttggctaggtcactcgctagactaacagaggagaagtctaatgagtgacctaaacctggcggcagcgcaaaagatg

SEQ ID NO: 28961 - DNA, 103 bp, Artificial Sequence
  Synthetic Polynucleotide
taatacgactcactatagggctcaaaatcttcttggctaggtcactcgctaacagaggagaagcgagatgcctagccaaaacctggcggcagcgcaaaagatg

SEQ ID NO: 28962 - DNA, 103 bp, Artificial Sequence
  Synthetic Polynucleotide
taatacgactcactatagggcccacctcaaaatcttcttggctaggtcacaacagaggagagtgaccatgccaagaagaaacctggcggcagcgcaaaagatg

SEQ ID NO: 28963 - DNA, 103 bp, Artificial Sequence
  Synthetic Polynucleotide
taatacgactcactatagggaaatccccacctcaaaatcttcttggctagaacagaggagactagccatgaagattttgaacctggcggcagcgcaaaagatg

SEQ ID NO: 28964 - DNA, 103 bp, Artificial Sequence
  Synthetic Polynucleotide
taatacgactcactatagggttgtcaaatccccacctcaaaatcttcttgaacagaggagacaagaaatgtttgaggtgaacctggcggcagcgcaaaagatg

SEQ ID NO: 28965 - DNA, 103 bp, Artificial Sequence
  Synthetic Polynucleotide
taatacgactcactatagggagtatttgtcaaatccccacctcaaaatctaacagaggagaagatttatgggtggggataacctggcggcagcgcaaaagatg

SEQ ID NO: 28966 - DNA, 103 bp, Artificial Sequence
  Synthetic Polynucleotide
taatacgactcactatagggtttagagtatttgtcaaatccccacctcaaaacagaggagattgaggatgggatttgacaacctggcggcagcgcaaaagatg

SEQ ID NO: 28967 - DNA, 103 bp, Artificial Sequence
  Synthetic Polynucleotide
taatacgactcactatagggtaccatttagagtatttgtcaaatccccacaacagaggagagtggggatgtgacaaataaacctggcggcagcgcaaaagatg

SEQ ID NO: 28968 - DNA, 103 bp, Artificial Sequence
  Synthetic Polynucleotide
taatacgactcactatagggcaacgtaccatttagagtatttgtcaaatcaacagaggagagatttgatgaatactctaaacctggcggcagcgcaaaagatg

SEQ ID NO: 28969 - DNA, 103 bp, Artificial Sequence
  Synthetic Polynucleotide
taatacgactcactatagggaacatcaacgtaccatttagagtatttgtcaacagaggagagacaaaatgtctaaatggaacctggcggcagcgcaaaagatg

SEQ ID NO: 28970 - DNA, 103 bp, Artificial Sequence
  Synthetic Polynucleotide
taatacgactcactataggggctaagaatctgaaattagggattgtactcaacagaggagagagtacatgccctaatttaacctggcggcagcgcaaaagatg

SEQ ID NO: 28971 - DNA, 103 bp, Artificial Sequence
  Synthetic Polynucleotide
taatacgactcactatagggtttttaacatcaacgtaccatttagagtataacagaggagaatactcatgatggtacgtaacctggcggcagcgcaaaagatg

SEQ ID NO: 28972 - DNA, 103 bp, Artificial Sequence
  Synthetic Polynucleotide
taatacgactcactatagggggacctttttaacatcaacgtaccatttagaacagaggagactaaatatgacgttgatgaacctggcggcagcgcaaaagatg

SEQ ID NO: 28973 - DNA, 103 bp, Artificial Sequence
  Synthetic Polynucleotide
taatacgactcactatagggtaaggggacctttttaacatcaacgtaccaaacagaggagatggtacatggatgttaaaaacctggcggcagcgcaaaagatg

SEQ ID NO: 28974 - DNA, 103 bp, Artificial Sequence
  Synthetic Polynucleotide
taatacgactcactatagggtgatgtaaggggacctttttaacatcaacgaacagaggagacgttgaatgtaaaaaggtaacctggcggcagcgcaaaagatg

SEQ ID NO: 28975 - DNA, 103 bp, Artificial Sequence
  Synthetic Polynucleotide
taatacgactcactataggggaggatgatgtaaggggacctttttaacataacagaggagaatgttaatgaggtcccctaacctggcggcagcgcaaaagatg

SEQ ID NO: 28976 - DNA, 103 bp, Artificial Sequence
  Synthetic Polynucleotide
taatacgactcactatagggtctaagaggatgatgtaaggggacctttttaacagaggagaaaaaagatgcccttacataacctggcggcagcgcaaaagatg

SEQ ID NO: 28977 - DNA, 103 bp, Artificial Sequence
  Synthetic Polynucleotide
taatacgactcactatagggtaagatctaagaggatgatgtaaggggaccaacagaggagaggtcccatgacatcatccaacctggcggcagcgcaaaagatg

SEQ ID NO: 28978 - DNA, 103 bp, Artificial Sequence
  Synthetic Polynucleotide
taatacgactcactatagggatatataagatctaagaggatgatgtaaggaacagaggagaccttacatgatcctcttaaacctggcggcagcgcaaaagatg

SEQ ID NO: 28979 - DNA, 103 bp, Artificial Sequence
  Synthetic Polynucleotide
taatacgactcactatagggagtcaatatataagatctaagaggatgatgaacagaggagacatcatatgcttagatctaacctggcggcagcgcaaaagatg

SEQ ID NO: 28980 - DNA, 103 bp, Artificial Sequence
  Synthetic Polynucleotide
taatacgactcactataggggtctgagtcaatatataagatctaagaggaaacagaggagatcctctatgatcttatataacctggcggcagcgcaaaagatg

SEQ ID NO: 28981 - DNA, 103 bp, Artificial Sequence
  Synthetic Polynucleotide
taatacgactcactatagggtcccagctaagaatctgaaattagggattgaacagaggagacaatccatgatttcagataacctggcggcagcgcaaaagatg

SEQ ID NO: 28982 - DNA, 103 bp, Artificial Sequence
  Synthetic Polynucleotide
taatacgactcactataggggccatgtctgagtcaatatataagatctaaaacagaggagattagatatgatatattgaaacctggcggcagcgcaaaagatg

SEQ ID NO: 28983 - DNA, 103 bp, Artificial Sequence
  Synthetic Polynucleotide
taatacgactcactatagggtggaggccatgtctgagtcaatatataagaaacagaggagatcttatatgttgactcagaacctggcggcagcgcaaaagatg

SEQ ID NO: 28984 - DNA, 103 bp, Artificial Sequence
  Synthetic Polynucleotide
taatacgactcactatagggtgttttggaggccatgtctgagtcaatataaacagaggagatatattatgtcagacatgaacctggcggcagcgcaaaagatg

SEQ ID NO: 28985 - DNA, 103 bp, Artificial Sequence
  Synthetic Polynucleotide
taatacgactcactatagggctatatgttttggaggccatgtctgagtcaaacagaggagatgactcatgcatggcctcaacctggcggcagcgcaaaagatg

SEQ ID NO: 28986 - DNA, 103 bp, Artificial Sequence
  Synthetic Polynucleotide
taatacgactcactatagggatctgctatatgttttggaggccatgtctgaacagaggagacagacaatgcctccaaaaaacctggcggcagcgcaaaagatg

SEQ ID NO: 28987 - DNA, 103 bp, Artificial Sequence
  Synthetic Polynucleotide
taatacgactcactatagggatcatatctgctatatgttttggaggccataacagaggagaatggccatgaaaacatataacctggcggcagcgcaaaagatg

SEQ ID NO: 28988 - DNA, 103 bp, Artificial Sequence
  Synthetic Polynucleotide
taatacgactcactatagggtccctatcatatctgctatatgttttggagaacagaggagactccaaatgatatagcagaacctggcggcagcgcaaaagatg

SEQ ID NO: 28989 - DNA, 103 bp, Artificial Sequence
  Synthetic Polynucleotide
taatacgactcactatagggagtgttccctatcatatctgctatatgtttaacagaggagaaaacatatggcagatatgaacctggcggcagcgcaaaagatg

SEQ ID NO: 28990 - DNA, 103 bp, Artificial Sequence
  Synthetic Polynucleotide
taatacgactcactatagggtgccaagtgttccctatcatatctgctataaacagaggagatatagcatgtatgataggaacctggcggcagcgcaaaagatg

SEQ ID NO: 28991 - DNA, 103 bp, Artificial Sequence
  Synthetic Polynucleotide
taatacgactcactataggggttcatgccaagtgttccctatcatatctgaacagaggagacagataatgtagggaacaaacctggcggcagcgcaaaagatg

SEQ ID NO: 28992 - DNA, 103 bp, Artificial Sequence
  Synthetic Polynucleotide
taatacgactcactataggggtaagtcccagctaagaatctgaaattaggaacagaggagacctaatatgagattcttaaacctggcggcagcgcaaaagatg

SEQ ID NO: 28993 - DNA, 103 bp, Artificial Sequence
  Synthetic Polynucleotide
taatacgactcactataggggggcagttcatgccaagtgttccctatcataacagaggagaatgataatgaacacttggaacctggcggcagcgcaaaagatg

SEQ ID NO: 28994 - DNA, 103 bp, Artificial Sequence
  Synthetic Polynucleotide
taatacgactcactataggggttatgggcagttcatgccaagtgttccctaacagaggagaagggaaatgttggcatgaaacctggcggcagcgcaaaagatg

SEQ ID NO: 28995 - DNA, 103 bp, Artificial Sequence
  Synthetic Polynucleotide
taatacgactcactataggggttgagttatgggcagttcatgccaagtgtaacagaggagaacacttatgatgaactgcaacctggcggcagcgcaaaagatg

SEQ ID NO: 28996 - DNA, 103 bp, Artificial Sequence
  Synthetic Polynucleotide
taatacgactcactatagggaaacagttgagttatgggcagttcatgccaaacagaggagatggcatatgctgcccataaacctggcggcagcgcaaaagatg

SEQ ID NO: 28997 - DNA, 103 bp, Artificial Sequence
  Synthetic Polynucleotide
taatacgactcactatagggatgtcaaacagttgagttatgggcagttcaaacagaggagatgaactatgcataactcaaacctggcggcagcgcaaaagatg

SEQ ID NO: 28998 - DNA, 103 bp, Artificial Sequence
  Synthetic Polynucleotide
taatacgactcactatagggctgggatgtcaaacagttgagttatgggcaaacagaggagatgcccaatgctcaactgtaacctggcggcagcgcaaaagatg

SEQ ID NO: 28999 - DNA, 103 bp, Artificial Sequence
  Synthetic Polynucleotide
taatacgactcactatagggagactctgggatgtcaaacagttgagttataacagaggagaataactatgctgtttgacaacctggcggcagcgcaaaagatg

SEQ ID NO: 29000 - DNA, 103 bp, Artificial Sequence
  Synthetic Polynucleotide
taatacgactcactatagggtccatagactctgggatgtcaaacagttgaaacagaggagatcaactatgtgacatcccaacctggcggcagcgcaaaagatg

SEQ ID NO: 29001 - DNA, 103 bp, Artificial Sequence
  Synthetic Polynucleotide
taatacgactcactatagggatgggtccatagactctgggatgtcaaacaaacagaggagatgtttgatgtcccagagtaacctggcggcagcgcaaaagatg

SEQ ID NO: 29002 - DNA, 103 bp, Artificial Sequence
  Synthetic Polynucleotide
taatacgactcactatagggctctgatgggtccatagactctgggatgtcaacagaggagagacatcatggagtctatgaacctggcggcagcgcaaaagatg

SEQ ID NO: 29003 - DNA, 103 bp, Artificial Sequence
  Synthetic Polynucleotide
taatacgactcactatagggatatcgtaagtcccagctaagaatctgaaaaacagaggagatttcagatgcttagctggaacctggcggcagcgcaaaagatg

SEQ ID NO: 29004 - DNA, 103 bp, Artificial Sequence
  Synthetic Polynucleotide
taatacgactcactatagggaatatctctgatgggtccatagactctgggaacagaggagacccagaatgtatggacccaacctggcggcagcgcaaaagatg

SEQ ID NO: 29005 - DNA, 103 bp, Artificial Sequence
  Synthetic Polynucleotide
taatacgactcactatagggcatccaatatctctgatgggtccatagactaacagaggagaagtctaatgacccatcagaacctggcggcagcgcaaaagatg

SEQ ID NO: 29006 - DNA, 103 bp, Artificial Sequence
  Synthetic Polynucleotide
taatacgactcactatagggtttgtcatccaatatctctgatgggtccataacagaggagaatggacatgtcagagataaacctggcggcagcgcaaaagatg

SEQ ID NO: 29007 - DNA, 103 bp, Artificial Sequence
  Synthetic Polynucleotide
taatacgactcactatagggtgtgatttgtcatccaatatctctgatgggaacagaggagacccatcatggatattggaaacctggcggcagcgcaaaagatg

SEQ ID NO: 29008 - DNA, 103 bp, Artificial Sequence
  Synthetic Polynucleotide
taatacgactcactatagggatgagtgtgatttgtcatccaatatctctgaacagaggagacagagaatgtggatgacaaacctggcggcagcgcaaaagatg

SEQ ID NO: 29009 - DNA, 103 bp, Artificial Sequence
  Synthetic Polynucleotide
taatacgactcactatagggcgtaaatgagtgtgatttgtcatccaatataacagaggagaatattgatggacaaatcaaacctggcggcagcgcaaaagatg

SEQ ID NO: 29010 - DNA, 103 bp, Artificial Sequence
  Synthetic Polynucleotide
taatacgactcactatagggcttctcgtaaatgagtgtgatttgtcatccaacagaggagaggatgaatgatcacactcaacctggcggcagcgcaaaagatg

SEQ ID NO: 29011 - DNA, 103 bp, Artificial Sequence
  Synthetic Polynucleotide
taatacgactcactataggggtttgcttctcgtaaatgagtgtgatttgtaacagaggagaacaaatatgactcatttaaacctggcggcagcgcaaaagatg

SEQ ID NO: 29012 - DNA, 103 bp, Artificial Sequence
  Synthetic Polynucleotide
taatacgactcactatagggtatcagtttgcttctcgtaaatgagtgtgaaacagaggagatcacacatgtttacgagaaacctggcggcagcgcaaaagatg

SEQ ID NO: 29013 - DNA, 103 bp, Artificial Sequence
  Synthetic Polynucleotide
taatacgactcactatagggcatgctatcagtttgcttctcgtaaatgagaacagaggagactcattatggagaagcaaaacctggcggcagcgcaaaagatg

SEQ ID NO: 29014 - DNA, 103 bp, Artificial Sequence
  Synthetic Polynucleotide
taatacgactcactatagggaaaacatatcgtaagtcccagctaagaatcaacagaggagagattctatgctgggacttaacctggcggcagcgcaaaagatg

SEQ ID NO: 29015 - DNA, 103 bp, Artificial Sequence
  Synthetic Polynucleotide
taatacgactcactatagggtcaaccatgctatcagtttgcttctcgtaaaacagaggagattacgaatggcaaactgaaacctggcggcagcgcaaaagatg

SEQ ID NO: 29016 - DNA, 103 bp, Artificial Sequence
  Synthetic Polynucleotide
taatacgactcactatagggctcactcaaccatgctatcagtttgcttctaacagaggagaagaagcatgctgatagcaaacctggcggcagcgcaaaagatg

SEQ ID NO: 29017 - DNA, 103 bp, Artificial Sequence
  Synthetic Polynucleotide
taatacgactcactatagggcttccctcactcaaccatgctatcagtttgaacagaggagacaaactatgagcatggttaacctggcggcagcgcaaaagatg

SEQ ID NO: 29018 - DNA, 103 bp, Artificial Sequence
  Synthetic Polynucleotide
taatacgactcactatagggctcctcttccctcactcaaccatgctatcaaacagaggagatgatagatgggttgagtgaacctggcggcagcgcaaaagatg

SEQ ID NO: 29019 - DNA, 103 bp, Artificial Sequence
  Synthetic Polynucleotide
taatacgactcactatagggtggtcctcctcttccctcactcaaccatgcaacagaggagagcatggatgagtgagggaaacctggcggcagcgcaaaagatg

SEQ ID NO: 29020 - DNA, 103 bp, Artificial Sequence
  Synthetic Polynucleotide
taatacgactcactatagggggaactggtcctcctcttccctcactcaacaacagaggagagttgagatggggaagaggaacctggcggcagcgcaaaagatg

SEQ ID NO: 29021 - DNA, 103 bp, Artificial Sequence
  Synthetic Polynucleotide
taatacgactcactatagggcacttggaactggtcctcctcttccctcacaacagaggagagtgaggatggaggaggacaacctggcggcagcgcaaaagatg

SEQ ID NO: 29022 - DNA, 103 bp, Artificial Sequence
  Synthetic Polynucleotide
taatacgactcactatagggcttttcacttggaactggtcctcctcttccaacagaggagaggaagaatgggaccagttaacctggcggcagcgcaaaagatg

SEQ ID NO: 29023 - DNA, 103 bp, Artificial Sequence
  Synthetic Polynucleotide
taatacgactcactatagggatcaccttttcacttggaactggtcctcctaacagaggagaaggaggatgagttccaagaacctggcggcagcgcaaaagatg

SEQ ID NO: 29024 - DNA, 103 bp, Artificial Sequence
  Synthetic Polynucleotide
taatacgactcactatagggttatgatcaccttttcacttggaactggtcaacagaggagagaccagatgcaagtgaaaaacctggcggcagcgcaaaagatg

SEQ ID NO: 29025 - DNA, 103 bp, Artificial Sequence
  Synthetic Polynucleotide
taatacgactcactatagggagagaaaaacatatcgtaagtcccagctaaaacagaggagattagctatgacttacgataacctggcggcagcgcaaaagatg

SEQ ID NO: 29026 - DNA, 103 bp, Artificial Sequence
  Synthetic Polynucleotide
taatacgactcactatagggagcagttatgatcaccttttcacttggaacaacagaggagagttccaatggaaaaggtgaacctggcggcagcgcaaaagatg

SEQ ID NO: 29027 - DNA, 103 bp, Artificial Sequence
  Synthetic Polynucleotide
taatacgactcactataggggacagagcagttatgatcaccttttcacttaacagaggagaaagtgaatgggtgatcataacctggcggcagcgcaaaagatg

SEQ ID NO: 29028 - DNA, 103 bp, Artificial Sequence
  Synthetic Polynucleotide
taatacgactcactatagggtctgagacagagcagttatgatcaccttttaacagaggagaaaaaggatgtcataactgaacctggcggcagcgcaaaagatg

SEQ ID NO: 29029 - DNA, 103 bp, Artificial Sequence
  Synthetic Polynucleotide
taatacgactcactatagggagggttctgagacagagcagttatgatcacaacagaggagagtgatcatgactgctctgaacctggcggcagcgcaaaagatg

SEQ ID NO: 29030 - DNA, 103 bp, Artificial Sequence
  Synthetic Polynucleotide
taatacgactcactatagggttcacagggttctgagacagagcagttatgaacagaggagacataacatgtctgtctcaaacctggcggcagcgcaaaagatg

SEQ ID NO: 29031 - DNA, 103 bp, Artificial Sequence
  Synthetic Polynucleotide
taatacgactcactatagggttggattcacagggttctgagacagagcagaacagaggagactgctcatgctcagaaccaacctggcggcagcgcaaaagatg

SEQ ID NO: 29032 - DNA, 103 bp, Artificial Sequence
  Synthetic Polynucleotide
taatacgactcactatagggctctcttggattcacagggttctgagacagaacagaggagactgtctatgaaccctgtgaacctggcggcagcgcaaaagatg

SEQ ID NO: 29033 - DNA, 103 bp, Artificial Sequence
  Synthetic Polynucleotide
taatacgactcactatagggaagaactctcttggattcacagggttctgaaacagaggagatcagaaatgtgtgaatccaacctggcggcagcgcaaaagatg

SEQ ID NO: 29034 - DNA, 103 bp, Artificial Sequence
  Synthetic Polynucleotide
taatacgactcactatagggtctttaagaactctcttggattcacagggtaacagaggagaaccctgatgatccaagagaacctggcggcagcgcaaaagatg

SEQ ID NO: 29035 - DNA, 103 bp, Artificial Sequence
  Synthetic Polynucleotide
taatacgactcactatagggaattctctttaagaactctcttggattcacaacagaggagagtgaatatgagagagttcaacctggcggcagcgcaaaagatg

SEQ ID NO: 29036 - DNA, 103 bp, Artificial Sequence
  Synthetic Polynucleotide
taatacgactcactatagggatcctagagaaaaacatatcgtaagtcccaaacagaggagatgggacatgcgatatgttaacctggcggcagcgcaaaagatg

SEQ ID NO: 29037 - DNA, 103 bp, Artificial Sequence
  Synthetic Polynucleotide
taatacgactcactatagggtcatcaattctctttaagaactctcttggaaacagaggagatccaagatggttcttaaaaacctggcggcagcgcaaaagatg

SEQ ID NO: 29038 - DNA, 103 bp, Artificial Sequence
  Synthetic Polynucleotide
taatacgactcactatagggcatgatcatcaattctctttaagaactctcaacagaggagagagagtatgtaaagagaaaacctggcggcagcgcaaaagatg

SEQ ID NO: 29039 - DNA, 103 bp, Artificial Sequence
  Synthetic Polynucleotide
taatacgactcactatagggtaatccatgatcatcaattctctttaagaaaacagaggagattcttaatgagaattgataacctggcggcagcgcaaaagatg

SEQ ID NO: 29040 - DNA, 103 bp, Artificial Sequence
  Synthetic Polynucleotide
taatacgactcactataggggggtctaatccatgatcatcaattctctttaacagaggagaaaagagatgtgatgatcaaacctggcggcagcgcaaaagatg

SEQ ID NO: 29041 - DNA, 103 bp, Artificial Sequence
  Synthetic Polynucleotide
taatacgactcactatagggcatcagggtctaatccatgatcatcaattcaacagaggagagaattgatgatcatggataacctggcggcagcgcaaaagatg

SEQ ID NO: 29042 - DNA, 103 bp, Artificial Sequence
  Synthetic Polynucleotide
taatacgactcactatagggcaaatcatcagggtctaatccatgatcatcaacagaggagagatgatatgggattagacaacctggcggcagcgcaaaagatg

SEQ ID NO: 29043 - DNA, 103 bp, Artificial Sequence
  Synthetic Polynucleotide
taatacgactcactatagggattatcaaatcatcagggtctaatccatgaaacagaggagatcatggatgagaccctgaaacctggcggcagcgcaaaagatg

SEQ ID NO: 29044 - DNA, 103 bp, Artificial Sequence
  Synthetic Polynucleotide
taatacgactcactatagggaacctattatcaaatcatcagggtctaatcaacagaggagagattagatgctgatgattaacctggcggcagcgcaaaagatg

SEQ ID NO: 29045 - DNA, 103 bp, Artificial Sequence
  Synthetic Polynucleotide
taatacgactcactatagggtttcaaacctattatcaaatcatcagggtcaacagaggagagaccctatggatttgataaacctggcggcagcgcaaaagatg

SEQ ID NO: 29046 - DNA, 103 bp, Artificial Sequence
  Synthetic Polynucleotide
taatacgactcactatagggttgggtttcaaacctattatcaaatcatcaaacagaggagatgatgaatggataataggaacctggcggcagcgcaaaagatg

SEQ ID NO: 29047 - DNA, 103 bp, Artificial Sequence
  Synthetic Polynucleotide
taatacgactcactatagggtgaaaactacttgttcaggatccattgtagaacagaggagactacaaatgatcctgaacaacctggcggcagcgcaaaagatg

SEQ ID NO: 29048 - DNA, 103 bp, Artificial Sequence
  Synthetic Polynucleotide
taatacgactcactataggggatctatcctagagaaaaacatatcgtaagaacagaggagacttacgatgtgtttttctaacctggcggcagcgcaaaagatg

SEQ ID NO: 29049 - DNA, 103 bp, Artificial Sequence
  Synthetic Polynucleotide
taatacgactcactatagggtttccttgggtttcaaacctattatcaaataacagaggagaatttgaatgtaggtttgaaacctggcggcagcgcaaaagatg

SEQ ID NO: 29050 - DNA, 103 bp, Artificial Sequence
  Synthetic Polynucleotide
taatacgactcactatagggttctctttccttgggtttcaaacctattataacagaggagaataataatgttgaaacccaacctggcggcagcgcaaaagatg

SEQ ID NO: 29051 - DNA, 103 bp, Artificial Sequence
  Synthetic Polynucleotide
taatacgactcactatagggtttaattctctttccttgggtttcaaacctaacagaggagaaggtttatgacccaaggaaacctggcggcagcgcaaaagatg

SEQ ID NO: 29052 - DNA, 103 bp, Artificial Sequence
  Synthetic Polynucleotide
taatacgactcactatagggcaatctttaattctctttccttgggtttcaaacagaggagatgaaacatgaggaaagagaacctggcggcagcgcaaaagatg

SEQ ID NO: 29053 - DNA, 103 bp, Artificial Sequence
  Synthetic Polynucleotide
taatacgactcactataggggccttcaatctttaattctctttccttgggaacagaggagacccaagatgagagaattaaacctggcggcagcgcaaaagatg

SEQ ID NO: 29054 - DNA, 103 bp, Artificial Sequence
  Synthetic Polynucleotide
taatacgactcactatagggaatctgccttcaatctttaattctctttccaacagaggagaggaaagatgattaaagataacctggcggcagcgcaaaagatg

SEQ ID NO: 29055 - DNA, 103 bp, Artificial Sequence
  Synthetic Polynucleotide
taatacgactcactatagggcaaaaaatctgccttcaatctttaattctcaacagaggagagagaatatgagattgaagaacctggcggcagcgcaaaagatg

SEQ ID NO: 29056 - DNA, 103 bp, Artificial Sequence
  Synthetic Polynucleotide
taatacgactcactatagggcaaagcaaaaaatctgccttcaatctttaaaacagaggagattaaagatggaaggcagaaacctggcggcagcgcaaaagatg

SEQ ID NO: 29057 - DNA, 103 bp, Artificial Sequence
  Synthetic Polynucleotide
taatacgactcactataggggacatcaaagcaaaaaatctgccttcaatcaacagaggagagattgaatgcagatttttaacctggcggcagcgcaaaagatg

SEQ ID NO: 29058 - DNA, 103 bp, Artificial Sequence
  Synthetic Polynucleotide
taatacgactcactatagggtccatgacatcaaagcaaaaaatctgccttaacagaggagaaaggcaatgtttttgcttaacctggcggcagcgcaaaagatg

SEQ ID NO: 29059 - DNA, 103 bp, Artificial Sequence
  Synthetic Polynucleotide
taatacgactcactataggggagatgatctatcctagagaaaaacatatcaacagaggagagatatgatgttctctaggaacctggcggcagcgcaaaagatg

SEQ ID NO: 29060 - DNA, 103 bp, Artificial Sequence
  Synthetic Polynucleotide
taatacgactcactatagggtaaattccatgacatcaaagcaaaaaatctaacagaggagaagatttatggctttgatgaacctggcggcagcgcaaaagatg

SEQ ID NO: 29061 - DNA, 103 bp, Artificial Sequence
  Synthetic Polynucleotide
taatacgactcactatagggagccttaaattccatgacatcaaagcaaaaaacagaggagattttgcatggatgtcatgaacctggcggcagcgcaaaagatg

SEQ ID NO: 29062 - DNA, 103 bp, Artificial Sequence
  Synthetic Polynucleotide
taatacgactcactatagggagtaaagccttaaattccatgacatcaaagaacagaggagactttgaatgcatggaattaacctggcggcagcgcaaaagatg

SEQ ID NO: 29063 - DNA, 103 bp, Artificial Sequence
  Synthetic Polynucleotide
taatacgactcactataggggacaaagtaaagccttaaattccatgacataacagaggagaatgtcaatgaatttaaggaacctggcggcagcgcaaaagatg

SEQ ID NO: 29064 - DNA, 103 bp, Artificial Sequence
  Synthetic Polynucleotide
taatacgactcactataggggttatgacaaagtaaagccttaaattccataacagaggagaatggaaatgaaggctttaaacctggcggcagcgcaaaagatg

SEQ ID NO: 29065 - DNA, 103 bp, Artificial Sequence
  Synthetic Polynucleotide
taatacgactcactatagggtctctgttatgacaaagtaaagccttaaataacagaggagaatttaaatgtttactttgaacctggcggcagcgcaaaagatg

SEQ ID NO: 29066 - DNA, 103 bp, Artificial Sequence
  Synthetic Polynucleotide
taatacgactcactatagggcaacttctctgttatgacaaagtaaagcctaacagaggagaaggcttatgtttgtcataaacctggcggcagcgcaaaagatg

SEQ ID NO: 29067 - DNA, 103 bp, Artificial Sequence
  Synthetic Polynucleotide
taatacgactcactataggggccaacaacttctctgttatgacaaagtaaaacagaggagattacttatgcataacagaaacctggcggcagcgcaaaagatg

SEQ ID NO: 29068 - DNA, 103 bp, Artificial Sequence
  Synthetic Polynucleotide
taatacgactcactataggggattagccaacaacttctctgttatgacaaaacagaggagattgtcaatgcagagaagtaacctggcggcagcgcaaaagatg

SEQ ID NO: 29069 - DNA, 103 bp, Artificial Sequence
  Synthetic Polynucleotide
taatacgactcactataggggatatgattagccaacaacttctctgttataacagaggagaataacaatgaagttgttgaacctggcggcagcgcaaaagatg

SEQ ID NO: 29070 - DNA, 103 bp, Artificial Sequence
  Synthetic Polynucleotide
taatacgactcactatagggccatagagatgatctatcctagagaaaaacaacagaggagagtttttatgtaggatagaaacctggcggcagcgcaaaagatg

SEQ ID NO: 29071 - DNA, 103 bp, Artificial Sequence
  Synthetic Polynucleotide
taatacgactcactatagggggtatgatatgattagccaacaacttctctaacagaggagaagagaaatggttggctaaaacctggcggcagcgcaaaagatg

SEQ ID NO: 29072 - DNA, 103 bp, Artificial Sequence
  Synthetic Polynucleotide
taatacgactcactatagggaaagtggtatgatatgattagccaacaactaacagaggagaagttgtatgctaatcataaacctggcggcagcgcaaaagatg

SEQ ID NO: 29073 - DNA, 103 bp, Artificial Sequence
  Synthetic Polynucleotide
taatacgactcactataggggtcaaaaagtggtatgatatgattagccaaaacagaggagattggctatgcatatcataaacctggcggcagcgcaaaagatg

SEQ ID NO: 29074 - DNA, 103 bp, Artificial Sequence
  Synthetic Polynucleotide
taatacgactcactatagggagagagtcaaaaagtggtatgatatgattaaacagaggagataatcaatgcataccactaacctggcggcagcgcaaaagatg

SEQ ID NO: 29075 - DNA, 103 bp, Artificial Sequence
  Synthetic Polynucleotide
taatacgactcactatagggtagtgagagagtcaaaaagtggtatgatataacagaggagaatatcaatgcactttttgaacctggcggcagcgcaaaagatg

SEQ ID NO: 29076 - DNA, 103 bp, Artificial Sequence
  Synthetic Polynucleotide
taatacgactcactatagggtgtcatagtgagagagtcaaaaagtggtataacagaggagaataccaatgtttgactctaacctggcggcagcgcaaaagatg

SEQ ID NO: 29077 - DNA, 103 bp, Artificial Sequence
  Synthetic Polynucleotide
taatacgactcactatagggttgtctgtcatagtgagagagtcaaaaagtaacagaggagaacttttatgctctctcacaacctggcggcagcgcaaaagatg

SEQ ID NO: 29078 - DNA, 103 bp, Artificial Sequence
  Synthetic Polynucleotide
taatacgactcactatagggtcaaattgtctgtcatagtgagagagtcaaaacagaggagattgactatgtcactatgaaacctggcggcagcgcaaaagatg

SEQ ID NO: 29079 - DNA, 103 bp, Artificial Sequence
  Synthetic Polynucleotide
taatacgactcactatagggtttgttcaaattgtctgtcatagtgagagaaacagaggagatctctcatgatgacagacaacctggcggcagcgcaaaagatg

SEQ ID NO: 29080 - DNA, 103 bp, Artificial Sequence
  Synthetic Polynucleotide
taatacgactcactatagggaagactttgttcaaattgtctgtcatagtgaacagaggagacactatatgagacaatttaacctggcggcagcgcaaaagatg

SEQ ID NO: 29081 - DNA, 103 bp, Artificial Sequence
  Synthetic Polynucleotide
taatacgactcactatagggtagctccatagagatgatctatcctagagaaacagaggagatctctaatgtagatcatcaacctggcggcagcgcaaaagatg

SEQ ID NO: 29082 - DNA, 103 bp, Artificial Sequence
  Synthetic Polynucleotide
taatacgactcactatagggtcttaaagactttgttcaaattgtctgtcaaacagaggagatgacagatgatttgaacaaacctggcggcagcgcaaaagatg

SEQ ID NO: 29083 - DNA, 103 bp, Artificial Sequence
  Synthetic Polynucleotide
taatacgactcactatagggtaacttcttaaagactttgttcaaattgtcaacagaggagagacaatatgaacaaagtcaacctggcggcagcgcaaaagatg

SEQ ID NO: 29084 - DNA, 103 bp, Artificial Sequence
  Synthetic Polynucleotide
taatacgactcactatagggtctattaacttcttaaagactttgttcaaaaacagaggagatttgaaatgagtctttaaaacctggcggcagcgcaaaagatg

SEQ ID NO: 29085 - DNA, 103 bp, Artificial Sequence
  Synthetic Polynucleotide
taatacgactcactatagggctctgtctattaacttcttaaagactttgtaacagaggagaacaaagatgttaagaagtaacctggcggcagcgcaaaagatg

SEQ ID NO: 29086 - DNA, 103 bp, Artificial Sequence
  Synthetic Polynucleotide
taatacgactcactatagggtgtcactctgtctattaacttcttaaagacaacagaggagagtctttatgaagttaataaacctggcggcagcgcaaaagatg

SEQ ID NO: 29087 - DNA, 103 bp, Artificial Sequence
  Synthetic Polynucleotide
taatacgactcactatagggtgacctgtcactctgtctattaacttcttaaacagaggagataagaaatgaatagacagaacctggcggcagcgcaaaagatg

SEQ ID NO: 29088 - DNA, 103 bp, Artificial Sequence
  Synthetic Polynucleotide
taatacgactcactataggggtccttgacctgtcactctgtctattaactaacagaggagaagttaaatgacagagtgaaacctggcggcagcgcaaaagatg

SEQ ID NO: 29089 - DNA, 103 bp, Artificial Sequence
  Synthetic Polynucleotide
taatacgactcactatagggggtgagtccttgacctgtcactctgtctataacagaggagaatagacatggtgacaggtaacctggcggcagcgcaaaagatg

SEQ ID NO: 29090 - DNA, 103 bp, Artificial Sequence
  Synthetic Polynucleotide
taatacgactcactatagggtagtcggtgagtccttgacctgtcactctgaacagaggagacagagtatgaggtcaaggaacctggcggcagcgcaaaagatg

SEQ ID NO: 29091 - DNA, 103 bp, Artificial Sequence
  Synthetic Polynucleotide
taatacgactcactatagggtagagtagtcggtgagtccttgacctgtcaaacagaggagatgacagatgaaggactcaaacctggcggcagcgcaaaagatg

SEQ ID NO: 29092 - DNA, 103 bp, Artificial Sequence
  Synthetic Polynucleotide
taatacgactcactatagggtctgatagctccatagagatgatctatcctaacagaggagaaggataatgcatctctataacctggcggcagcgcaaaagatg

SEQ ID NO: 29093 - DNA, 103 bp, Artificial Sequence
  Synthetic Polynucleotide
taatacgactcactatagggcactctagagtagtcggtgagtccttgaccaacagaggagaggtcaaatgctcaccgacaacctggcggcagcgcaaaagatg

SEQ ID NO: 29094 - DNA, 103 bp, Artificial Sequence
  Synthetic Polynucleotide
taatacgactcactatagggtaggtcactctagagtagtcggtgagtcctaacagaggagaaggactatgcgactactcaacctggcggcagcgcaaaagatg

SEQ ID NO: 29095 - DNA, 103 bp, Artificial Sequence
  Synthetic Polynucleotide
taatacgactcactatagggaagcataggtcactctagagtagtcggtgaaacagaggagatcaccgatgactctagagaacctggcggcagcgcaaaagatg

SEQ ID NO: 29096 - DNA, 103 bp, Artificial Sequence
  Synthetic Polynucleotide
taatacgactcactatagggatgaaaagcataggtcactctagagtagtcaacagaggagagactacatgagagtgaccaacctggcggcagcgcaaaagatg

SEQ ID NO: 29097 - DNA, 103 bp, Artificial Sequence
  Synthetic Polynucleotide
taatacgactcactatagggtccaaatgaaaagcataggtcactctagagaacagaggagactctagatggacctatgcaacctggcggcagcgcaaaagatg

SEQ ID NO: 29098 - DNA, 103 bp, Artificial Sequence
  Synthetic Polynucleotide
taatacgactcactatagggcgtagtccaaatgaaaagcataggtcactcaacagaggagagagtgaatgatgcttttcaacctggcggcagcgcaaaagatg

SEQ ID NO: 29099 - DNA, 103 bp, Artificial Sequence
  Synthetic Polynucleotide
taatacgactcactatagggcttctcgtagtccaaatgaaaagcataggtaacagaggagaacctatatgtttcatttgaacctggcggcagcgcaaaagatg

SEQ ID NO: 29100 - DNA, 103 bp, Artificial Sequence
  Synthetic Polynucleotide
taatacgactcactatagggttccacttctcgtagtccaaatgaaaagcaaacagaggagatgctttatgtttggactaaacctggcggcagcgcaaaagatg

SEQ ID NO: 29101 - DNA, 103 bp, Artificial Sequence
  Synthetic Polynucleotide
taatacgactcactataggggattgttccacttctcgtagtccaaatgaaaacagaggagattcattatgactacgagaaacctggcggcagcgcaaaagatg

SEQ ID NO: 29102 - DNA, 103 bp, Artificial Sequence
  Synthetic Polynucleotide
taatacgactcactatagggttgatgattgttccacttctcgtagtccaaaacagaggagattggacatggagaagtggaacctggcggcagcgcaaaagatg

SEQ ID NO: 29103 - DNA, 103 bp, Artificial Sequence
  Synthetic Polynucleotide
taatacgactcactatagggcctactctgatagctccatagagatgatctaacagaggagaagatcaatgctatggagcaacctggcggcagcgcaaaagatg

SEQ ID NO: 29104 - DNA, 103 bp, Artificial Sequence
  Synthetic Polynucleotide
taatacgactcactatagggattctttgatgattgttccacttctcgtagaacagaggagactacgaatggtggaacaaaacctggcggcagcgcaaaagatg

SEQ ID NO: 29105 - DNA, 103 bp, Artificial Sequence
  Synthetic Polynucleotide
taatacgactcactatagggactccattctttgatgattgttccacttctaacagaggagaagaagtatgacaatcatcaacctggcggcagcgcaaaagatg

SEQ ID NO: 29106 - DNA, 103 bp, Artificial Sequence
  Synthetic Polynucleotide
taatacgactcactatagggtgttgactccattctttgatgattgttccaaacagaggagatggaacatgcatcaaagaaacctggcggcagcgcaaaagatg

SEQ ID NO: 29107 - DNA, 103 bp, Artificial Sequence
  Synthetic Polynucleotide
taatacgactcactatagggtgctctgttgactccattctttgatgattgaacagaggagacaatcaatgaagaatggaaacctggcggcagcgcaaaagatg

SEQ ID NO: 29108 - DNA, 103 bp, Artificial Sequence
  Synthetic Polynucleotide
taatacgactcactatagggaaacatgctctgttgactccattctttgataacagaggagaatcaaaatgtggagtcaaaacctggcggcagcgcaaaagatg

SEQ ID NO: 29109 - DNA, 103 bp, Artificial Sequence
  Synthetic Polynucleotide
taatacgactcactatagggctggaaaacatgctctgttgactccattctaacagaggagaagaatgatgtcaacagagaacctggcggcagcgcaaaagatg

SEQ ID NO: 29110 - DNA, 103 bp, Artificial Sequence
  Synthetic Polynucleotide
taatacgactcactatagggaaaacctggaaaacatgctctgttgactccaacagaggagaggagtcatgagagcatgtaacctggcggcagcgcaaaagatg

SEQ ID NO: 29111 - DNA, 103 bp, Artificial Sequence
  Synthetic Polynucleotide
taatacgactcactatagggtgtctaaaacctggaaaacatgctctgttgaacagaggagacaacagatgatgttttccaacctggcggcagcgcaaaagatg

SEQ ID NO: 29112 - DNA, 103 bp, Artificial Sequence
  Synthetic Polynucleotide
taatacgactcactataggggactttgtctaaaacctggaaaacatgctcaacagaggagagagcatatgttccaggttaacctggcggcagcgcaaaagatg

SEQ ID NO: 29113 - DNA, 103 bp, Artificial Sequence
  Synthetic Polynucleotide
taatacgactcactatagggccgaagactttgtctaaaacctggaaaacaaacagaggagatgttttatgggttttagaaacctggcggcagcgcaaaagatg

SEQ ID NO: 29114 - DNA, 103 bp, Artificial Sequence
  Synthetic Polynucleotide
taatacgactcactatagggcggttcctactctgatagctccatagagataacagaggagaatctctatggagctatcaaacctggcggcagcgcaaaagatg

SEQ ID NO: 29115 - DNA, 103 bp, Artificial Sequence
  Synthetic Polynucleotide
taatacgactcactatagggttaggccgaagactttgtctaaaacctggaaacagaggagatccaggatgtagacaaagaacctggcggcagcgcaaaagatg

SEQ ID NO: 29116 - DNA, 103 bp, Artificial Sequence
  Synthetic Polynucleotide
taatacgactcactatagggtttttttaggccgaagactttgtctaaaacaacagaggagagttttaatgaaagtcttcaacctggcggcagcgcaaaagatg

SEQ ID NO: 29117 - DNA, 103 bp, Artificial Sequence
  Synthetic Polynucleotide
taatacgactcactatagggaagactttttttaggccgaagactttgtctaacagaggagaagacaaatgcttcggcctaacctggcggcagcgcaaaagatg

SEQ ID NO: 29118 - DNA, 103 bp, Artificial Sequence
  Synthetic Polynucleotide
taatacgactcactataggggagagaagactttttttaggccgaagacttaacagaggagaaagtctatggcctaaaaaaacctggcggcagcgcaaaagatg

SEQ ID NO: 29119 - DNA, 103 bp, Artificial Sequence
  Synthetic Polynucleotide
taatacgactcactatagggcgttcgagagaagactttttttaggccgaaaacagaggagattcggcatgaaaaaagtcaacctggcggcagcgcaaaagatg

SEQ ID NO: 29120 - DNA, 103 bp, Artificial Sequence
  Synthetic Polynucleotide
taatacgactcactatagggtcatgcgttcgagagaagactttttttaggaacagaggagacctaaaatgagtcttctcaacctggcggcagcgcaaaagatg

SEQ ID NO: 29121 - DNA, 103 bp, Artificial Sequence
  Synthetic Polynucleotide
taatacgactcactatagggaaaactcatgcgttcgagagaagactttttaacagaggagaaaaaagatgtctctcgaaaacctggcggcagcgcaaaagatg

SEQ ID NO: 29122 - DNA, 103 bp, Artificial Sequence
  Synthetic Polynucleotide
taatacgactcactatagggttgaaaaaactcatgcgttcgagagaagacaacagaggagagtcttcatgcgaacgcataacctggcggcagcgcaaaagatg

SEQ ID NO: 29123 - DNA, 103 bp, Artificial Sequence
  Synthetic Polynucleotide
taatacgactcactataggggatttttgaaaaaactcatgcgttcgagagaacagaggagactctcgatggcatgagttaacctggcggcagcgcaaaagatg

SEQ ID NO: 29124 - DNA, 103 bp, Artificial Sequence
  Synthetic Polynucleotide
taatacgactcactatagggtccacgatttttgaaaaaactcatgcgttcaacagaggagagaacgcatgagttttttcaacctggcggcagcgcaaaagatg

SEQ ID NO: 29125 - DNA, 103 bp, Artificial Sequence
  Synthetic Polynucleotide
taatacgactcactatagggtacaacggttcctactctgatagctccataaacagaggagatatggaatgatcagagtaaacctggcggcagcgcaaaagatg

SEQ ID NO: 29126 - DNA, 103 bp, Artificial Sequence
  Synthetic Polynucleotide
taatacgactcactataggggtagatccacgatttttgaaaaaactcatgaacagaggagacatgagatgtttcaaaaaaacctggcggcagcgcaaaagatg

SEQ ID NO: 29127 - DNA, 103 bp, Artificial Sequence
  Synthetic Polynucleotide
taatacgactcactataggggagtagtagatccacgatttttgaaaaaacaacagaggagagtttttatgaaaatcgtgaacctggcggcagcgcaaaagatg

SEQ ID NO: 29128 - DNA, 103 bp, Artificial Sequence
  Synthetic Polynucleotide
taatacgactcactatagggtttcagagtagtagatccacgatttttgaaaacagaggagattcaaaatgcgtggatctaacctggcggcagcgcaaaagatg

SEQ ID NO: 29129 - DNA, 103 bp, Artificial Sequence
  Synthetic Polynucleotide
taatacgactcactatagggagatctttcagagtagtagatccacgatttaacagaggagaaaatcgatgatctactacaacctggcggcagcgcaaaagatg

SEQ ID NO: 29130 - DNA, 103 bp, Artificial Sequence
  Synthetic Polynucleotide
taatacgactcactatagggagatcagatctttcagagtagtagatccacaacagaggagagtggatatgctactctgaaacctggcggcagcgcaaaagatg

SEQ ID NO: 29131 - DNA, 103 bp, Artificial Sequence
  Synthetic Polynucleotide
taatacgactcactatagggctatcagatcagatctttcagagtagtagaaacagaggagatctactatgctgaaagataacctggcggcagcgcaaaagatg

SEQ ID NO: 29132 - DNA, 103 bp, Artificial Sequence
  Synthetic Polynucleotide
taatacgactcactatagggtatgcctatcagatcagatctttcagagtaaacagaggagatactctatgagatctgataacctggcggcagcgcaaaagatg

SEQ ID NO: 29133 - DNA, 103 bp, Artificial Sequence
  Synthetic Polynucleotide
taatacgactcactatagggccccatatgcctatcagatcagatctttcaaacagaggagatgaaagatgtgatctgataacctggcggcagcgcaaaagatg

SEQ ID NO: 29134 - DNA, 103 bp, Artificial Sequence
  Synthetic Polynucleotide
taatacgactcactatagggtgttcccccatatgcctatcagatcagatcaacagaggagagatctgatgtgataggcaaacctggcggcagcgcaaaagatg

SEQ ID NO: 29135 - DNA, 103 bp, Artificial Sequence
  Synthetic Polynucleotide
taatacgactcactatagggtattttgttcccccatatgcctatcagatcaacagaggagagatctgatgggcatatggaacctggcggcagcgcaaaagatg

SEQ ID NO: 29136 - DNA, 103 bp, Artificial Sequence
  Synthetic Polynucleotide
taatacgactcactataggggctgttacaacggttcctactctgatagctaacagaggagaagctatatgagtaggaacaacctggcggcagcgcaaaagatg

SEQ ID NO: 29137 - DNA, 103 bp, Artificial Sequence
  Synthetic Polynucleotide
taatacgactcactatagggcaacatattttgttcccccatatgcctatcaacagaggagagataggatgatgggggaaaacctggcggcagcgcaaaagatg

SEQ ID NO: 29138 - DNA, 103 bp, Artificial Sequence
  Synthetic Polynucleotide
taatacgactcactatagggctaagcaacatattttgttcccccatatgcaacagaggagagcatatatgggaacaaaaaacctggcggcagcgcaaaagatg

SEQ ID NO: 29139 - DNA, 103 bp, Artificial Sequence
  Synthetic Polynucleotide
taatacgactcactatagggcatgtctaagcaacatattttgttcccccaaacagaggagatgggggatgaaaatatgtaacctggcggcagcgcaaaagatg

SEQ ID NO: 29140 - DNA, 103 bp, Artificial Sequence
  Synthetic Polynucleotide
taatacgactcactatagggtcgctcatgtctaagcaacatattttgttcaacagaggagagaacaaatgatgttgcttaacctggcggcagcgcaaaagatg

SEQ ID NO: 29141 - DNA, 103 bp, Artificial Sequence
  Synthetic Polynucleotide
taatacgactcactatagggggccttcgctcatgtctaagcaacatatttaacagaggagaaaatatatggcttagacaaacctggcggcagcgcaaaagatg

SEQ ID NO: 29142 - DNA, 103 bp, Artificial Sequence
  Synthetic Polynucleotide
taatacgactcactatagggggtggggccttcgctcatgtctaagcaacaaacagaggagatgttgcatggacatgagcaacctggcggcagcgcaaaagatg

SEQ ID NO: 29143 - DNA, 103 bp, Artificial Sequence
  Synthetic Polynucleotide
taatacgactcactatagggcaacaggtggggccttcgctcatgtctaagaacagaggagacttagaatggagcgaaggaacctggcggcagcgcaaaagatg

SEQ ID NO: 29144 - DNA, 103 bp, Artificial Sequence
  Synthetic Polynucleotide
taatacgactcactatagggcgtcccaacaggtggggccttcgctcatgtaacagaggagaacatgaatgaaggccccaaacctggcggcagcgcaaaagatg

SEQ ID NO: 29145 - DNA, 103 bp, Artificial Sequence
  Synthetic Polynucleotide
taatacgactcactatagggttgtccgtcccaacaggtggggccttcgctaacagaggagaagcgaaatgcccacctgtaacctggcggcagcgcaaaagatg

SEQ ID NO: 29146 - DNA, 103 bp, Artificial Sequence
  Synthetic Polynucleotide
taatacgactcactatagggccatcttgtccgtcccaacaggtggggcctaacagaggagaaggcccatgctgttgggaaacctggcggcagcgcaaaagatg

SEQ ID NO: 29147 - DNA, 103 bp, Artificial Sequence
  Synthetic Polynucleotide
taatacgactcactatagggcgtaagctgttacaacggttcctactctgaaacagaggagatcagagatggaaccgttgaacctggcggcagcgcaaaagatg

SEQ ID NO: 29148 - DNA, 103 bp, Artificial Sequence
  Synthetic Polynucleotide
taatacgactcactatagggggcctccatcttgtccgtcccaacaggtggaacagaggagaccacctatggggacggacaacctggcggcagcgcaaaagatg

SEQ ID NO: 29149 - DNA, 103 bp, Artificial Sequence
  Synthetic Polynucleotide
taatacgactcactatagggctcaaggcctccatcttgtccgtcccaacaaacagaggagatgttggatgggacaagataacctggcggcagcgcaaaagatg

SEQ ID NO: 29150 - DNA, 103 bp, Artificial Sequence
  Synthetic Polynucleotide
taatacgactcactatagggaaaccctcaaggcctccatcttgtccgtccaacagaggagaggacggatgagatggaggaacctggcggcagcgcaaaagatg

SEQ ID NO: 29151 - DNA, 103 bp, Artificial Sequence
  Synthetic Polynucleotide
taatacgactcactataggggtctcaaaccctcaaggcctccatcttgtcaacagaggagagacaagatggaggccttgaacctggcggcagcgcaaaagatg

SEQ ID NO: 29152 - DNA, 103 bp, Artificial Sequence
  Synthetic Polynucleotide
taatacgactcactatagggcttttgtctcaaaccctcaaggcctccatcaacagaggagagatggaatgcttgagggtaacctggcggcagcgcaaaagatg

SEQ ID NO: 29153 - DNA, 103 bp, Artificial Sequence
  Synthetic Polynucleotide
taatacgactcactatagggcatcccttttgtctcaaaccctcaaggcctaacagaggagaaggcctatggggtttgagaacctggcggcagcgcaaaagatg

SEQ ID NO: 29154 - DNA, 103 bp, Artificial Sequence
  Synthetic Polynucleotide
taatacgactcactataggggactccatcccttttgtctcaaaccctcaaaacagaggagattgaggatgtgagacaaaaacctggcggcagcgcaaaagatg

SEQ ID NO: 29155 - DNA, 103 bp, Artificial Sequence
  Synthetic Polynucleotide
taatacgactcactatagggcacgagactccatcccttttgtctcaaaccaacagaggagaggtttgatgcaaaagggaaacctggcggcagcgcaaaagatg

SEQ ID NO: 29156 - DNA, 103 bp, Artificial Sequence
  Synthetic Polynucleotide
taatacgactcactatagggagactcacgagactccatcccttttgtctcaacagaggagagagacaatggggatggagaacctggcggcagcgcaaaagatg

SEQ ID NO: 29157 - DNA, 103 bp, Artificial Sequence
  Synthetic Polynucleotide
taatacgactcactatagggtcaagagactcacgagactccatcccttttaacagaggagaaaaaggatgggagtctcgaacctggcggcagcgcaaaagatg

SEQ ID NO: 29158 - DNA, 103 bp, Artificial Sequence
  Synthetic Polynucleotide
taatacgactcactatagggagacttgaaaactacttgttcaggatccataacagaggagaatggatatggaacaagtaaacctggcggcagcgcaaaagatg

SEQ ID NO: 29159 - DNA, 103 bp, Artificial Sequence
  Synthetic Polynucleotide
taatacgactcactatagggatcttcgtaagctgttacaacggttcctacaacagaggagagtaggaatggttgtaacaaacctggcggcagcgcaaaagatg

SEQ ID NO: 29160 - DNA, 103 bp, Artificial Sequence
  Synthetic Polynucleotide
taatacgactcactatagggtatcatcaagagactcacgagactccatccaacagaggagaggatggatgctcgtgagtaacctggcggcagcgcaaaagatg

SEQ ID NO: 29161 - DNA, 103 bp, Artificial Sequence
  Synthetic Polynucleotide
taatacgactcactatagggcgatctatcatcaagagactcacgagactcaacagaggagagagtctatggagtctcttaacctggcggcagcgcaaaagatg

SEQ ID NO: 29162 - DNA, 103 bp, Artificial Sequence
  Synthetic Polynucleotide
taatacgactcactatagggattcacgatctatcatcaagagactcacgaaacagaggagatcgtgaatgtcttgatgaaacctggcggcagcgcaaaagatg

SEQ ID NO: 29163 - DNA, 103 bp, Artificial Sequence
  Synthetic Polynucleotide
taatacgactcactatagggttgagattcacgatctatcatcaagagactaacagaggagaagtctcatgatgatagataacctggcggcagcgcaaaagatg

SEQ ID NO: 29164 - DNA, 103 bp, Artificial Sequence
  Synthetic Polynucleotide
taatacgactcactatagggcttatttgagattcacgatctatcatcaagaacagaggagacttgatatgagatcgtgaaacctggcggcagcgcaaaagatg

SEQ ID NO: 29165 - DNA, 103 bp, Artificial Sequence
  Synthetic Polynucleotide
taatacgactcactatagggtattccttatttgagattcacgatctatcaaacagaggagatgatagatggtgaatctcaacctggcggcagcgcaaaagatg

SEQ ID NO: 29166 - DNA, 103 bp, Artificial Sequence
  Synthetic Polynucleotide
taatacgactcactatagggtcttgtattccttatttgagattcacgatcaacagaggagagatcgtatgtctcaaataaacctggcggcagcgcaaaagatg

SEQ ID NO: 29167 - DNA, 103 bp, Artificial Sequence
  Synthetic Polynucleotide
taatacgactcactatagggttggttcttgtattccttatttgagattcaaacagaggagatgaatcatgaataaggaaaacctggcggcagcgcaaaagatg

SEQ ID NO: 29168 - DNA, 103 bp, Artificial Sequence
  Synthetic Polynucleotide
taatacgactcactataggggaatcttggttcttgtattccttatttgagaacagaggagactcaaaatgggaatacaaaacctggcggcagcgcaaaagatg

SEQ ID NO: 29169 - DNA, 103 bp, Artificial Sequence
  Synthetic Polynucleotide
taatacgactcactatagggagctagaatcttggttcttgtattccttataacagaggagaataaggatgacaagaaccaacctggcggcagcgcaaaagatg

SEQ ID NO: 29170 - DNA, 103 bp, Artificial Sequence
  Synthetic Polynucleotide
taatacgactcactataggggtgcaatcttcgtaagctgttacaacggttaacagaggagaaaccgtatgaacagcttaaacctggcggcagcgcaaaagatg

SEQ ID NO: 29171 - DNA, 103 bp, Artificial Sequence
  Synthetic Polynucleotide
taatacgactcactatagggccttgagctagaatcttggttcttgtattcaacagaggagagaatacatgaaccaagataacctggcggcagcgcaaaagatg

SEQ ID NO: 29172 - DNA, 103 bp, Artificial Sequence
  Synthetic Polynucleotide
taatacgactcactatagggtgtctccttgagctagaatcttggttcttgaacagaggagacaagaaatgagattctagaacctggcggcagcgcaaaagatg

SEQ ID NO: 29173 - DNA, 103 bp, Artificial Sequence
  Synthetic Polynucleotide
taatacgactcactatagggctggttgtctccttgagctagaatcttggtaacagaggagaaccaagatgctagctcaaaacctggcggcagcgcaaaagatg

SEQ ID NO: 29174 - DNA, 103 bp, Artificial Sequence
  Synthetic Polynucleotide
taatacgactcactatagggaagacctggttgtctccttgagctagaatcaacagaggagagattctatgtcaaggagaaacctggcggcagcgcaaaagatg

SEQ ID NO: 29175 - DNA, 103 bp, Artificial Sequence
  Synthetic Polynucleotide
taatacgactcactataggggacataagacctggttgtctccttgagctaaacagaggagatagctcatggagacaaccaacctggcggcagcgcaaaagatg

SEQ ID NO: 29176 - DNA, 103 bp, Artificial Sequence
  Synthetic Polynucleotide
taatacgactcactatagggagttggacataagacctggttgtctccttgaacagaggagacaaggaatgaaccaggtcaacctggcggcagcgcaaaagatg

SEQ ID NO: 29177 - DNA, 103 bp, Artificial Sequence
  Synthetic Polynucleotide
taatacgactcactatagggacataagttggacataagacctggttgtctaacagaggagaagacaaatgggtcttatgaacctggcggcagcgcaaaagatg

SEQ ID NO: 29178 - DNA, 103 bp, Artificial Sequence
  Synthetic Polynucleotide
taatacgactcactatagggacaccacataagttggacataagacctggtaacagaggagaaccaggatgtatgtccaaaacctggcggcagcgcaaaagatg

SEQ ID NO: 29179 - DNA, 103 bp, Artificial Sequence
  Synthetic Polynucleotide
taatacgactcactatagggttgtgacaccacataagttggacataagacaacagaggagagtcttaatgccaacttataacctggcggcagcgcaaaagatg

SEQ ID NO: 29180 - DNA, 103 bp, Artificial Sequence
  Synthetic Polynucleotide
taatacgactcactatagggaacccttgtgacaccacataagttggacataacagaggagaatgtccatgttatgtggtaacctggcggcagcgcaaaagatg

SEQ ID NO: 29181 - DNA, 103 bp, Artificial Sequence
  Synthetic Polynucleotide
taatacgactcactatagggatccggtgcaatcttcgtaagctgttacaaaacagaggagattgtaaatgcttacgaagaacctggcggcagcgcaaaagatg

SEQ ID NO: 29182 - DNA, 103 bp, Artificial Sequence
  Synthetic Polynucleotide
taatacgactcactatagggcattcaacccttgtgacaccacataagttgaacagaggagacaacttatgtggtgtcacaacctggcggcagcgcaaaagatg

SEQ ID NO: 29183 - DNA, 103 bp, Artificial Sequence
  Synthetic Polynucleotide
taatacgactcactataggggtcctcattcaacccttgtgacaccacataaacagaggagatatgtgatgtcacaagggaacctggcggcagcgcaaaagatg

SEQ ID NO: 29184 - DNA, 103 bp, Artificial Sequence
  Synthetic Polynucleotide
taatacgactcactatagggagaccgtcctcattcaacccttgtgacaccaacagaggagaggtgtcatgagggttgaaaacctggcggcagcgcaaaagatg

SEQ ID NO: 29185 - DNA, 103 bp, Artificial Sequence
  Synthetic Polynucleotide
taatacgactcactatagggattttagaccgtcctcattcaacccttgtgaacagaggagacacaagatgtgaatgaggaacctggcggcagcgcaaaagatg

SEQ ID NO: 29186 - DNA, 103 bp, Artificial Sequence
  Synthetic Polynucleotide
taatacgactcactatagggctcatattttagaccgtcctcattcaacccaacagaggagagggttgatggaggacggtaacctggcggcagcgcaaaagatg

SEQ ID NO: 29187 - DNA, 103 bp, Artificial Sequence
  Synthetic Polynucleotide
taatacgactcactatagggtccaactcatattttagaccgtcctcattcaacagaggagagaatgaatgcggtctaaaaacctggcggcagcgcaaaagatg

SEQ ID NO: 29188 - DNA, 103 bp, Artificial Sequence
  Synthetic Polynucleotide
taatacgactcactatagggtgttctccaactcatattttagaccgtcctaacagaggagaaggacgatgtaaaatatgaacctggcggcagcgcaaaagatg

SEQ ID NO: 29189 - DNA, 103 bp, Artificial Sequence
  Synthetic Polynucleotide
taatacgactcactatagggagatatgttctccaactcatattttagaccaacagaggagaggtctaatgtatgagttgaacctggcggcagcgcaaaagatg

SEQ ID NO: 29190 - DNA, 103 bp, Artificial Sequence
  Synthetic Polynucleotide
taatacgactcactatagggtttctagatatgttctccaactcatattttaacagaggagaaaaataatggttggagaaaacctggcggcagcgcaaaagatg

SEQ ID NO: 29191 - DNA, 103 bp, Artificial Sequence
  Synthetic Polynucleotide
taatacgactcactatagggaggcatttctagatatgttctccaactcataacagaggagaatgagtatgagaacatataacctggcggcagcgcaaaagatg

SEQ ID NO: 29192 - DNA, 103 bp, Artificial Sequence
  Synthetic Polynucleotide
taatacgactcactatagggaaccaatccggtgcaatcttcgtaagctgtaacagaggagaacagctatggaagattgcaacctggcggcagcgcaaaagatg

SEQ ID NO: 29193 - DNA, 103 bp, Artificial Sequence
  Synthetic Polynucleotide
taatacgactcactatagggggacaaggcatttctagatatgttctccaaaacagaggagattggagatgatatctagaaacctggcggcagcgcaaaagatg

SEQ ID NO: 29194 - DNA, 103 bp, Artificial Sequence
  Synthetic Polynucleotide
taatacgactcactatagggtaaatggacaaggcatttctagatatgttcaacagaggagagaacatatgtagaaatgcaacctggcggcagcgcaaaagatg

SEQ ID NO: 29195 - DNA, 103 bp, Artificial Sequence
  Synthetic Polynucleotide
taatacgactcactatagggctctataaatggacaaggcatttctagataaacagaggagatatctaatgatgccttgtaacctggcggcagcgcaaaagatg

SEQ ID NO: 29196 - DNA, 103 bp, Artificial Sequence
  Synthetic Polynucleotide
taatacgactcactatagggtattgctctataaatggacaaggcatttctaacagaggagaagaaatatgttgtccattaacctggcggcagcgcaaaagatg

SEQ ID NO: 29197 - DNA, 103 bp, Artificial Sequence
  Synthetic Polynucleotide
taatacgactcactatagggtcctctattgctctataaatggacaaggcaaacagaggagatgccttatgcatttatagaacctggcggcagcgcaaaagatg

SEQ ID NO: 29198 - DNA, 103 bp, Artificial Sequence
  Synthetic Polynucleotide
taatacgactcactatagggctccctcctctattgctctataaatggacaaacagaggagatgtccaatgatagagcaaaacctggcggcagcgcaaaagatg

SEQ ID NO: 29199 - DNA, 103 bp, Artificial Sequence
  Synthetic Polynucleotide
taatacgactcactatagggccttgctccctcctctattgctctataaataacagaggagaatttatatggcaatagagaacctggcggcagcgcaaaagatg

SEQ ID NO: 29200 - DNA, 103 bp, Artificial Sequence
  Synthetic Polynucleotide
taatacgactcactatagggaacttccttgctccctcctctattgctctaaacagaggagatagagcatgagaggagggaacctggcggcagcgcaaaagatg

SEQ ID NO: 29201 - DNA, 103 bp, Artificial Sequence
  Synthetic Polynucleotide
taatacgactcactatagggggcctaacttccttgctccctcctctattgaacagaggagacaatagatgagggagcaaaacctggcggcagcgcaaaagatg

SEQ ID NO: 29202 - DNA, 103 bp, Artificial Sequence
  Synthetic Polynucleotide
taatacgactcactataggggataaggcctaacttccttgctccctcctcaacagaggagagaggagatggcaaggaagaacctggcggcagcgcaaaagatg

SEQ ID NO: 29203 - DNA, 103 bp, Artificial Sequence
  Synthetic Polynucleotide
taatacgactcactatagggaaagaaaccaatccggtgcaatcttcgtaaaacagaggagattacgaatgttgcaccggaacctggcggcagcgcaaaagatg

SEQ ID NO: 29204 - DNA, 103 bp, Artificial Sequence
  Synthetic Polynucleotide
taatacgactcactatagggttaatgataaggcctaacttccttgctcccaacagaggagagggagcatggaagttaggaacctggcggcagcgcaaaagatg

SEQ ID NO: 29205 - DNA, 103 bp, Artificial Sequence
  Synthetic Polynucleotide
taatacgactcactatagggcttttttaatgataaggcctaacttccttgaacagaggagacaaggaatgtaggccttaaacctggcggcagcgcaaaagatg

SEQ ID NO: 29206 - DNA, 103 bp, Artificial Sequence
  Synthetic Polynucleotide
taatacgactcactatagggctcctcttttttaatgataaggcctaacttaacagaggagaaagttaatgcttatcattaacctggcggcagcgcaaaagatg

SEQ ID NO: 29207 - DNA, 103 bp, Artificial Sequence
  Synthetic Polynucleotide
taatacgactcactatagggatagtctcctcttttttaatgataaggcctaacagaggagaaggcctatgcattaaaaaaacctggcggcagcgcaaaagatg

SEQ ID NO: 29208 - DNA, 103 bp, Artificial Sequence
  Synthetic Polynucleotide
taatacgactcactatagggtacacatagtctcctcttttttaatgataaaacagaggagattatcaatgaaaaagaggaacctggcggcagcgcaaaagatg

SEQ ID NO: 29209 - DNA, 103 bp, Artificial Sequence
  Synthetic Polynucleotide
taatacgactcactatagggataactacacatagtctcctcttttttaataacagaggagaattaaaatggaggagactaacctggcggcagcgcaaaagatg

SEQ ID NO: 29210 - DNA, 103 bp, Artificial Sequence
  Synthetic Polynucleotide
taatacgactcactatagggaaatcataactacacatagtctcctcttttaacagaggagaaaaagaatggactatgtgaacctggcggcagcgcaaaagatg

SEQ ID NO: 29211 - DNA, 103 bp, Artificial Sequence
  Synthetic Polynucleotide
taatacgactcactatagggttagaaaatcataactacacatagtctcctaacagaggagaaggagaatgtgtgtagttaacctggcggcagcgcaaaagatg

SEQ ID NO: 29212 - DNA, 103 bp, Artificial Sequence
  Synthetic Polynucleotide
taatacgactcactataggggtatattagaaaatcataactacacatagtaacagaggagaactatgatgagttatgataacctggcggcagcgcaaaagatg

SEQ ID NO: 29213 - DNA, 103 bp, Artificial Sequence
  Synthetic Polynucleotide
taatacgactcactatagggttcccgtatattagaaaatcataactacacaacagaggagagtgtagatgtgattttctaacctggcggcagcgcaaaagatg

SEQ ID NO: 29214 - DNA, 103 bp, Artificial Sequence
  Synthetic Polynucleotide
taatacgactcactatagggctgtgaaagaaaccaatccggtgcaatcttaacagaggagaaagattatgccggattggaacctggcggcagcgcaaaagatg

SEQ ID NO: 29215 - DNA, 103 bp, Artificial Sequence
  Synthetic Polynucleotide
taatacgactcactataggggtgtcttcccgtatattagaaaatcataacaacagaggagagttatgatgttctaatataacctggcggcagcgcaaaagatg

SEQ ID NO: 29216 - DNA, 103 bp, Artificial Sequence
  Synthetic Polynucleotide
taatacgactcactatagggtaaaggtgtcttcccgtatattagaaaatcaacagaggagagattttatgatatacgggaacctggcggcagcgcaaaagatg

SEQ ID NO: 29217 - DNA, 103 bp, Artificial Sequence
  Synthetic Polynucleotide
taatacgactcactatagggctgtataaaggtgtcttcccgtatattagaaacagaggagatctaatatgcgggaagacaacctggcggcagcgcaaaagatg

SEQ ID NO: 29218 - DNA, 103 bp, Artificial Sequence
  Synthetic Polynucleotide
taatacgactcactatagggtgcctctgtataaaggtgtcttcccgtataaacagaggagatatacgatgagacaccttaacctggcggcagcgcaaaagatg

SEQ ID NO: 29219 - DNA, 103 bp, Artificial Sequence
  Synthetic Polynucleotide
taatacgactcactatagggtatattgcctctgtataaaggtgtcttcccaacagaggagagggaagatgcctttatacaacctggcggcagcgcaaaagatg

SEQ ID NO: 29220 - DNA, 103 bp, Artificial Sequence
  Synthetic Polynucleotide
taatacgactcactatagggaccaatatattgcctctgtataaaggtgtcaacagaggagagacaccatgatacagaggaacctggcggcagcgcaaaagatg

SEQ ID NO: 29221 - DNA, 103 bp, Artificial Sequence
  Synthetic Polynucleotide
taatacgactcactatagggcaggaaccaatatattgcctctgtataaagaacagaggagactttatatggaggcaataaacctggcggcagcgcaaaagatg

SEQ ID NO: 29222 - DNA, 103 bp, Artificial Sequence
  Synthetic Polynucleotide
taatacgactcactatagggagattcaggaaccaatatattgcctctgtaaacagaggagatacagaatgaatatattgaacctggcggcagcgcaaaagatg

SEQ ID NO: 29223 - DNA, 103 bp, Artificial Sequence
  Synthetic Polynucleotide
taatacgactcactatagggctcttagattcaggaaccaatatattgcctaacagaggagaaggcaaatgattggttccaacctggcggcagcgcaaaagatg

SEQ ID NO: 29224 - DNA, 103 bp, Artificial Sequence
  Synthetic Polynucleotide
taatacgactcactatagggcccatctcttagattcaggaaccaatatataacagaggagaatatatatgttcctgaataacctggcggcagcgcaaaagatg

SEQ ID NO: 29225 - DNA, 103 bp, Artificial Sequence
  Synthetic Polynucleotide
taatacgactcactatagggaaatcctgtgaaagaaaccaatccggtgcaaacagaggagatgcaccatgttggtttctaacctggcggcagcgcaaaagatg

SEQ ID NO: 29226 - DNA, 103 bp, Artificial Sequence
  Synthetic Polynucleotide
taatacgactcactatagggtcttgcccatctcttagattcaggaaccaaaacagaggagattggttatggaatctaagaacctggcggcagcgcaaaagatg

SEQ ID NO: 29227 - DNA, 103 bp, Artificial Sequence
  Synthetic Polynucleotide
taatacgactcactataggggacactcttgcccatctcttagattcaggaaacagaggagatcctgaatgtaagagatgaacctggcggcagcgcaaaagatg

SEQ ID NO: 29228 - DNA, 103 bp, Artificial Sequence
  Synthetic Polynucleotide
taatacgactcactatagggtgcaagacactcttgcccatctcttagattaacagaggagaaatctaatggatgggcaaaacctggcggcagcgcaaaagatg

SEQ ID NO: 29229 - DNA, 103 bp, Artificial Sequence
  Synthetic Polynucleotide
taatacgactcactatagggtgatatgcaagacactcttgcccatctcttaacagaggagaaagagaatggcaagagtgaacctggcggcagcgcaaaagatg

SEQ ID NO: 29230 - DNA, 103 bp, Artificial Sequence
  Synthetic Polynucleotide
taatacgactcactatagggtcgtttgatatgcaagacactcttgcccataacagaggagaatgggcatgagtgtcttgaacctggcggcagcgcaaaagatg

SEQ ID NO: 29231 - DNA, 103 bp, Artificial Sequence
  Synthetic Polynucleotide
taatacgactcactatagggtttgatcgtttgatatgcaagacactcttgaacagaggagacaagagatgcttgcatataacctggcggcagcgcaaaagatg

SEQ ID NO: 29232 - DNA, 103 bp, Artificial Sequence
  Synthetic Polynucleotide
taatacgactcactatagggaatgatttgatcgtttgatatgcaagacacaacagaggagagtgtctatgatatcaaacaacctggcggcagcgcaaaagatg

SEQ ID NO: 29233 - DNA, 103 bp, Artificial Sequence
  Synthetic Polynucleotide
taatacgactcactatagggagactaatgatttgatcgtttgatatgcaaaacagaggagattgcatatgaaacgatcaaacctggcggcagcgcaaaagatg

SEQ ID NO: 29234 - DNA, 103 bp, Artificial Sequence
  Synthetic Polynucleotide
taatacgactcactatagggtagcaagactaatgatttgatcgtttgataaacagaggagatatcaaatgatcaaatcaaacctggcggcagcgcaaaagatg

SEQ ID NO: 29235 - DNA, 103 bp, Artificial Sequence
  Synthetic Polynucleotide
taatacgactcactataggggatgttagcaagactaatgatttgatcgttaacagaggagaaacgatatgatcattagtaacctggcggcagcgcaaaagatg

SEQ ID NO: 29236 - DNA, 103 bp, Artificial Sequence
  Synthetic Polynucleotide
taatacgactcactatagggttaagaaatcctgtgaaagaaaccaatccgaacagaggagacggattatgttctttcacaacctggcggcagcgcaaaagatg

SEQ ID NO: 29237 - DNA, 103 bp, Artificial Sequence
  Synthetic Polynucleotide
taatacgactcactataggggacatgatgttagcaagactaatgatttgaaacagaggagatcaaatatgtagtcttgcaacctggcggcagcgcaaaagatg

SEQ ID NO: 29238 - DNA, 103 bp, Artificial Sequence
  Synthetic Polynucleotide
taatacgactcactatagggctgtagacatgatgttagcaagactaatgaaacagaggagatcattaatgttgctaacaaacctggcggcagcgcaaaagatg

SEQ ID NO: 29239 - DNA, 103 bp, Artificial Sequence
  Synthetic Polynucleotide
taatacgactcactatagggagatactgtagacatgatgttagcaagactaacagaggagaagtcttatgaacatcatgaacctggcggcagcgcaaaagatg

SEQ ID NO: 29240 - DNA, 103 bp, Artificial Sequence
  Synthetic Polynucleotide
taatacgactcactatagggttggtagatactgtagacatgatgttagcaaacagaggagatgctaaatgcatgtctacaacctggcggcagcgcaaaagatg

SEQ ID NO: 29241 - DNA, 103 bp, Artificial Sequence
  Synthetic Polynucleotide
taatacgactcactatagggaagcattggtagatactgtagacatgatgtaacagaggagaacatcaatgctacagtataacctggcggcagcgcaaaagatg

SEQ ID NO: 29242 - DNA, 103 bp, Artificial Sequence
  Synthetic Polynucleotide
taatacgactcactatagggtgttaaagcattggtagatactgtagacataacagaggagaatgtctatggtatctaccaacctggcggcagcgcaaaagatg

SEQ ID NO: 29243 - DNA, 103 bp, Artificial Sequence
  Synthetic Polynucleotide
taatacgactcactataggggcgactgttaaagcattggtagatactgtaaacagaggagatacagtatgtaccaatgcaacctggcggcagcgcaaaagatg

SEQ ID NO: 29244 - DNA, 103 bp, Artificial Sequence
  Synthetic Polynucleotide
taatacgactcactataggggctgggcgactgttaaagcattggtagataaacagaggagatatctaatgatgctttaaaacctggcggcagcgcaaaagatg

SEQ ID NO: 29245 - DNA, 103 bp, Artificial Sequence
  Synthetic Polynucleotide
taatacgactcactatagggagaatgctgggcgactgttaaagcattggtaacagaggagaaccaatatgttaacagtcaacctggcggcagcgcaaaagatg

SEQ ID NO: 29246 - DNA, 103 bp, Artificial Sequence
  Synthetic Polynucleotide
taatacgactcactataggggattgagaatgctgggcgactgttaaagcaaacagaggagatgctttatgagtcgcccaaacctggcggcagcgcaaaagatg

SEQ ID NO: 29247 - DNA, 103 bp, Artificial Sequence
  Synthetic Polynucleotide
taatacgactcactatagggtctgcttaagaaatcctgtgaaagaaaccaaacagaggagatggtttatgtcacaggataacctggcggcagcgcaaaagatg

SEQ ID NO: 29248 - DNA, 103 bp, Artificial Sequence
  Synthetic Polynucleotide
taatacgactcactatagggccagagattgagaatgctgggcgactgttaaacagaggagataacagatgcccagcattaacctggcggcagcgcaaaagatg

SEQ ID NO: 29249 - DNA, 103 bp, Artificial Sequence
  Synthetic Polynucleotide
taatacgactcactatagggttttaccagagattgagaatgctgggcgacaacagaggagagtcgccatgcattctcaaaacctggcggcagcgcaaaagatg

SEQ ID NO: 29250 - DNA, 103 bp, Artificial Sequence
  Synthetic Polynucleotide
taatacgactcactatagggataggttttaccagagattgagaatgctggaacagaggagaccagcaatgtcaatctctaacctggcggcagcgcaaaagatg

SEQ ID NO: 29251 - DNA, 103 bp, Artificial Sequence
  Synthetic Polynucleotide
taatacgactcactatagggctcttataggttttaccagagattgagaataacagaggagaattctcatgctctggtaaaacctggcggcagcgcaaaagatg

SEQ ID NO: 29252 - DNA, 103 bp, Artificial Sequence
  Synthetic Polynucleotide
taatacgactcactatagggaaagtctcttataggttttaccagagattgaacagaggagacaatctatggtaaaacctaacctggcggcagcgcaaaagatg

SEQ ID NO: 29253 - DNA, 103 bp, Artificial Sequence
  Synthetic Polynucleotide
taatacgactcactatagggataagaaagtctcttataggttttaccagaaacagaggagatctggtatgacctataagaacctggcggcagcgcaaaagatg

SEQ ID NO: 29254 - DNA, 103 bp, Artificial Sequence
  Synthetic Polynucleotide
taatacgactcactatagggacatcataagaaagtctcttataggttttaaacagaggagataaaacatgtaagagactaacctggcggcagcgcaaaagatg

SEQ ID NO: 29255 - DNA, 103 bp, Artificial Sequence
  Synthetic Polynucleotide
taatacgactcactatagggaacggacatcataagaaagtctcttataggaacagaggagacctataatggactttcttaacctggcggcagcgcaaaagatg

SEQ ID NO: 29256 - DNA, 103 bp, Artificial Sequence
  Synthetic Polynucleotide
taatacgactcactataggggcctgaacggacatcataagaaagtctcttaacagaggagaaagagaatgtcttatgataacctggcggcagcgcaaaagatg

SEQ ID NO: 29257 - DNA, 103 bp, Artificial Sequence
  Synthetic Polynucleotide
taatacgactcactatagggagactgcctgaacggacatcataagaaagtaacagaggagaactttcatgtgatgtccgaacctggcggcagcgcaaaagatg

SEQ ID NO: 29258 - DNA, 103 bp, Artificial Sequence
  Synthetic Polynucleotide
taatacgactcactatagggatttatctgcttaagaaatcctgtgaaagaaacagaggagatctttcatgggatttcttaacctggcggcagcgcaaaagatg

SEQ ID NO: 29259 - DNA, 103 bp, Artificial Sequence
  Synthetic Polynucleotide
taatacgactcactatagggatgatagactgcctgaacggacatcataagaacagaggagacttatgatgtccgttcagaacctggcggcagcgcaaaagatg

SEQ ID NO: 29260 - DNA, 103 bp, Artificial Sequence
  Synthetic Polynucleotide
taatacgactcactatagggaagtaatgatagactgcctgaacggacatcaacagaggagagatgtcatgtcaggcagtaacctggcggcagcgcaaaagatg

SEQ ID NO: 29261 - DNA, 103 bp, Artificial Sequence
  Synthetic Polynucleotide
taatacgactcactatagggacagaaagtaatgatagactgcctgaacggaacagaggagaccgttcatgcagtctatcaacctggcggcagcgcaaaagatg

SEQ ID NO: 29262 - DNA, 103 bp, Artificial Sequence
  Synthetic Polynucleotide
taatacgactcactatagggactgaacagaaagtaatgatagactgcctgaacagaggagacaggcaatgtatcattacaacctggcggcagcgcaaaagatg

SEQ ID NO: 29263 - DNA, 103 bp, Artificial Sequence
  Synthetic Polynucleotide
taatacgactcactatagggataggactgaacagaaagtaatgatagactaacagaggagaagtctaatgttactttctaacctggcggcagcgcaaaagatg

SEQ ID NO: 29264 - DNA, 103 bp, Artificial Sequence
  Synthetic Polynucleotide
taatacgactcactatagggtgagaataggactgaacagaaagtaatgataacagaggagaatcattatgttctgttcaaacctggcggcagcgcaaaagatg

SEQ ID NO: 29265 - DNA, 103 bp, Artificial Sequence
  Synthetic Polynucleotide
taatacgactcactatagggactcttgagaataggactgaacagaaagtaaacagaggagatactttatgttcagtcctaacctggcggcagcgcaaaagatg

SEQ ID NO: 29266 - DNA, 103 bp, Artificial Sequence
  Synthetic Polynucleotide
taatacgactcactatagggactcgactcttgagaataggactgaacagaaacagaggagatctgttatgtcctattctaacctggcggcagcgcaaaagatg

SEQ ID NO: 29267 - DNA, 103 bp, Artificial Sequence
  Synthetic Polynucleotide
taatacgactcactatagggagtgaactcgactcttgagaataggactgaaacagaggagatcagtcatgttctcaagaaacctggcggcagcgcaaaagatg

SEQ ID NO: 29268 - DNA, 103 bp, Artificial Sequence
  Synthetic Polynucleotide
taatacgactcactataggggatgcagtgaactcgactcttgagaataggaacagaggagacctattatgaagagtcgaaacctggcggcagcgcaaaagatg

SEQ ID NO: 29269 - DNA, 103 bp, Artificial Sequence
  Synthetic Polynucleotide
taatacgactcactatagggttccgagacttgaaaactacttgttcaggaaacagaggagatcctgaatgagtagttttaacctggcggcagcgcaaaagatg

SEQ ID NO: 29270 - DNA, 103 bp, Artificial Sequence
  Synthetic Polynucleotide
taatacgactcactataggggtaagatttatctgcttaagaaatcctgtgaacagaggagacacaggatgtcttaagcaaacctggcggcagcgcaaaagatg

SEQ ID NO: 29271 - DNA, 103 bp, Artificial Sequence
  Synthetic Polynucleotide
taatacgactcactatagggttcaagatgcagtgaactcgactcttgagaaacagaggagatctcaaatgtcgagttcaaacctggcggcagcgcaaaagatg

SEQ ID NO: 29272 - DNA, 103 bp, Artificial Sequence
  Synthetic Polynucleotide
taatacgactcactatagggatagattcaagatgcagtgaactcgactctaacagaggagaagagtcatgttcactgcaaacctggcggcagcgcaaaagatg

SEQ ID NO: 29273 - DNA, 103 bp, Artificial Sequence
  Synthetic Polynucleotide
taatacgactcactatagggatgagatagattcaagatgcagtgaactcgaacagaggagacgagttatgtgcatcttgaacctggcggcagcgcaaaagatg

SEQ ID NO: 29274 - DNA, 103 bp, Artificial Sequence
  Synthetic Polynucleotide
taatacgactcactatagggctctcatgagatagattcaagatgcagtgaaacagaggagatcactgatgcttgaatctaacctggcggcagcgcaaaagatg

SEQ ID NO: 29275 - DNA, 103 bp, Artificial Sequence
  Synthetic Polynucleotide
taatacgactcactatagggacaacctctcatgagatagattcaagatgcaacagaggagagcatctatgatctatctcaacctggcggcagcgcaaaagatg

SEQ ID NO: 29276 - DNA, 103 bp, Artificial Sequence
  Synthetic Polynucleotide
taatacgactcactatagggaagtaacaacctctcatgagatagattcaaaacagaggagattgaatatgtctcatgagaacctggcggcagcgcaaaagatg

SEQ ID NO: 29277 - DNA, 103 bp, Artificial Sequence
  Synthetic Polynucleotide
taatacgactcactatagggatggcaagtaacaacctctcatgagatagaaacagaggagatctatcatgtgagaggttaacctggcggcagcgcaaaagatg

SEQ ID NO: 29278 - DNA, 103 bp, Artificial Sequence
  Synthetic Polynucleotide
taatacgactcactatagggtggacatggcaagtaacaacctctcatgagaacagaggagactcatgatgggttgttacaacctggcggcagcgcaaaagatg

SEQ ID NO: 29279 - DNA, 103 bp, Artificial Sequence
  Synthetic Polynucleotide
taatacgactcactataggggattctggacatggcaagtaacaacctctcaacagaggagagagaggatgttacttgccaacctggcggcagcgcaaaagatg

SEQ ID NO: 29280 - DNA, 103 bp, Artificial Sequence
  Synthetic Polynucleotide
taatacgactcactatagggaatatgattctggacatggcaagtaacaacaacagaggagagttgttatgtgccatgtcaacctggcggcagcgcaaaagatg

SEQ ID NO: 29281 - DNA, 103 bp, Artificial Sequence
  Synthetic Polynucleotide
taatacgactcactatagggctgcagtaagatttatctgcttaagaaatcaacagaggagagatttcatgagcagataaaacctggcggcagcgcaaaagatg

SEQ ID NO: 29282 - DNA, 103 bp, Artificial Sequence
  Synthetic Polynucleotide
taatacgactcactatagggcaagaaatatgattctggacatggcaagtaaacagaggagatacttgatgtgtccagaaaacctggcggcagcgcaaaagatg

SEQ ID NO: 29283 - DNA, 103 bp, Artificial Sequence
  Synthetic Polynucleotide
taatacgactcactatagggaggatcaagaaatatgattctggacatggcaacagaggagagccatgatgagaatcataaacctggcggcagcgcaaaagatg

SEQ ID NO: 29284 - DNA, 103 bp, Artificial Sequence
  Synthetic Polynucleotide
taatacgactcactatagggaatgaaggatcaagaaatatgattctggacaacagaggagagtccagatgcatatttctaacctggcggcagcgcaaaagatg

SEQ ID NO: 29285 - DNA, 103 bp, Artificial Sequence
  Synthetic Polynucleotide
taatacgactcactatagggctcctaatgaaggatcaagaaatatgattcaacagaggagagaatcaatgttcttgatcaacctggcggcagcgcaaaagatg

SEQ ID NO: 29286 - DNA, 103 bp, Artificial Sequence
  Synthetic Polynucleotide
taatacgactcactatagggaacccctcctaatgaaggatcaagaaatataacagaggagaatatttatggatccttcaaacctggcggcagcgcaaaagatg

SEQ ID NO: 29287 - DNA, 103 bp, Artificial Sequence
  Synthetic Polynucleotide
taatacgactcactatagggccagaaacccctcctaatgaaggatcaagaaacagaggagatcttgaatgttcattaggaacctggcggcagcgcaaaagatg

SEQ ID NO: 29288 - DNA, 103 bp, Artificial Sequence
  Synthetic Polynucleotide
taatacgactcactatagggacattccagaaacccctcctaatgaaggataacagaggagaatccttatgtaggaggggaacctggcggcagcgcaaaagatg

SEQ ID NO: 29289 - DNA, 103 bp, Artificial Sequence
  Synthetic Polynucleotide
taatacgactcactatagggtaaagacattccagaaacccctcctaatgaaacagaggagatcattaatgggggtttctaacctggcggcagcgcaaaagatg

SEQ ID NO: 29290 - DNA, 103 bp, Artificial Sequence
  Synthetic Polynucleotide
taatacgactcactatagggcttcctaaagacattccagaaacccctcctaacagaggagaaggaggatgttctggaataacctggcggcagcgcaaaagatg

SEQ ID NO: 29291 - DNA, 103 bp, Artificial Sequence
  Synthetic Polynucleotide
taatacgactcactataggggaaaccttcctaaagacattccagaaacccaacagaggagagggtttatggaatgtcttaacctggcggcagcgcaaaagatg

SEQ ID NO: 29292 - DNA, 103 bp, Artificial Sequence
  Synthetic Polynucleotide
taatacgactcactatagggttctcctgcagtaagatttatctgcttaagaacagaggagacttaagatgataaatcttaacctggcggcagcgcaaaagatg

SEQ ID NO: 29293 - DNA, 103 bp, Artificial Sequence
  Synthetic Polynucleotide
taatacgactcactataggggatatgaaaccttcctaaagacattccagaaacagaggagatctggaatgtctttaggaaacctggcggcagcgcaaaagatg

SEQ ID NO: 29294 - DNA, 103 bp, Artificial Sequence
  Synthetic Polynucleotide
taatacgactcactatagggtgtctgatatgaaaccttcctaaagacattaacagaggagaaatgtcatgaggaaggttaacctggcggcagcgcaaaagatg

SEQ ID NO: 29295 - DNA, 103 bp, Artificial Sequence
  Synthetic Polynucleotide
taatacgactcactatagggagaattgtctgatatgaaaccttcctaaagaacagaggagactttagatgggtttcataaacctggcggcagcgcaaaagatg

SEQ ID NO: 29296 - DNA, 103 bp, Artificial Sequence
  Synthetic Polynucleotide
taatacgactcactataggggtcagagaattgtctgatatgaaaccttccaacagaggagaggaaggatgcatatcagaaacctggcggcagcgcaaaagatg

SEQ ID NO: 29297 - DNA, 103 bp, Artificial Sequence
  Synthetic Polynucleotide
taatacgactcactatagggaccgggtcagagaattgtctgatatgaaacaacagaggagagtttcaatgcagacaattaacctggcggcagcgcaaaagatg

SEQ ID NO: 29298 - DNA, 103 bp, Artificial Sequence
  Synthetic Polynucleotide
taatacgactcactatagggcagtcaccgggtcagagaattgtctgatataacagaggagaatatcaatgaattctctgaacctggcggcagcgcaaaagatg

SEQ ID NO: 29299 - DNA, 103 bp, Artificial Sequence
  Synthetic Polynucleotide
taatacgactcactatagggaccttcagtcaccgggtcagagaattgtctaacagaggagaagacaaatgtctgacccgaacctggcggcagcgcaaaagatg

SEQ ID NO: 29300 - DNA, 103 bp, Artificial Sequence
  Synthetic Polynucleotide
taatacgactcactataggggataaaccttcagtcaccgggtcagagaataacagaggagaattctcatgcccggtgacaacctggcggcagcgcaaaagatg

SEQ ID NO: 29301 - DNA, 103 bp, Artificial Sequence
  Synthetic Polynucleotide
taatacgactcactatagggaaaaagataaaccttcagtcaccgggtcagaacagaggagactgaccatgtgactgaagaacctggcggcagcgcaaaagatg

SEQ ID NO: 29302 - DNA, 103 bp, Artificial Sequence
  Synthetic Polynucleotide
taatacgactcactatagggtttccaaaaagataaaccttcagtcaccggaacagaggagaccggtgatggaaggtttaaacctggcggcagcgcaaaagatg

SEQ ID NO: 29303 - DNA, 103 bp, Artificial Sequence
  Synthetic Polynucleotide
taatacgactcactatagggatagcttctcctgcagtaagatttatctgcaacagaggagagcagatatgtcttactgcaacctggcggcagcgcaaaagatg

SEQ ID NO: 29304 - DNA, 103 bp, Artificial Sequence
  Synthetic Polynucleotide
taatacgactcactatagggatctctttccaaaaagataaaccttcagtcaacagaggagagactgaatgtttatctttaacctggcggcagcgcaaaagatg

SEQ ID NO: 29305 - DNA, 103 bp, Artificial Sequence
  Synthetic Polynucleotide
taatacgactcactatagggcccatatctctttccaaaaagataaaccttaacagaggagaaaggttatgctttttggaaacctggcggcagcgcaaaagatg

SEQ ID NO: 29306 - DNA, 103 bp, Artificial Sequence
  Synthetic Polynucleotide
taatacgactcactataggggcactcccatatctctttccaaaaagataaaacagaggagattatctatgtggaaagagaacctggcggcagcgcaaaagatg

SEQ ID NO: 29307 - DNA, 103 bp, Artificial Sequence
  Synthetic Polynucleotide
taatacgactcactataggggatgagcactcccatatctctttccaaaaaaacagaggagatttttgatgagagatatgaacctggcggcagcgcaaaagatg

SEQ ID NO: 29308 - DNA, 103 bp, Artificial Sequence
  Synthetic Polynucleotide
taatacgactcactatagggcttcagatgagcactcccatatctctttccaacagaggagaggaaagatgtatgggagtaacctggcggcagcgcaaaagatg

SEQ ID NO: 29309 - DNA, 103 bp, Artificial Sequence
  Synthetic Polynucleotide
taatacgactcactatagggccactcttcagatgagcactcccatatctcaacagaggagagagataatggagtgctcaaacctggcggcagcgcaaaagatg

SEQ ID NO: 29310 - DNA, 103 bp, Artificial Sequence
  Synthetic Polynucleotide
taatacgactcactatagggagtatccactcttcagatgagcactcccataacagaggagaatgggaatgctcatctgaaacctggcggcagcgcaaaagatg

SEQ ID NO: 29311 - DNA, 103 bp, Artificial Sequence
  Synthetic Polynucleotide
taatacgactcactataggggagaaagtatccactcttcagatgagcactaacagaggagaagtgctatgctgaagagtaacctggcggcagcgcaaaagatg

SEQ ID NO: 29312 - DNA, 103 bp, Artificial Sequence
  Synthetic Polynucleotide
taatacgactcactatagggacaaagagaaagtatccactcttcagatgaaacagaggagatcatctatggagtggataaacctggcggcagcgcaaaagatg

SEQ ID NO: 29313 - DNA, 103 bp, Artificial Sequence
  Synthetic Polynucleotide
taatacgactcactatagggtcttgacaaagagaaagtatccactcttcaaacagaggagatgaagaatggatactttcaacctggcggcagcgcaaaagatg

SEQ ID NO: 29314 - DNA, 103 bp, Artificial Sequence
  Synthetic Polynucleotide
taatacgactcactatagggacagcatagcttctcctgcagtaagatttaaacagaggagataaatcatgctgcaggagaacctggcggcagcgcaaaagatg

SEQ ID NO: 29315 - DNA, 103 bp, Artificial Sequence
  Synthetic Polynucleotide
taatacgactcactatagggcagcctcttgacaaagagaaagtatccactaacagaggagaagtggaatgtttctctttaacctggcggcagcgcaaaagatg

SEQ ID NO: 29316 - DNA, 103 bp, Artificial Sequence
  Synthetic Polynucleotide
taatacgactcactataggggtttccagcctcttgacaaagagaaagtataacagaggagaatacttatgctttgtcaaaacctggcggcagcgcaaaagatg

SEQ ID NO: 29317 - DNA, 103 bp, Artificial Sequence
  Synthetic Polynucleotide
taatacgactcactatagggtctgggtttccagcctcttgacaaagagaaaacagaggagattctctatgtcaagaggcaacctggcggcagcgcaaaagatg

SEQ ID NO: 29318 - DNA, 103 bp, Artificial Sequence
  Synthetic Polynucleotide
taatacgactcactatagggctatatctgggtttccagcctcttgacaaaaacagaggagatttgtcatgaggctggaaaacctggcggcagcgcaaaagatg

SEQ ID NO: 29319 - DNA, 103 bp, Artificial Sequence
  Synthetic Polynucleotide
taatacgactcactatagggttctcctatatctgggtttccagcctcttgaacagaggagacaagagatgggaaacccaaacctggcggcagcgcaaaagatg

SEQ ID NO: 29320 - DNA, 103 bp, Artificial Sequence
  Synthetic Polynucleotide
taatacgactcactataggggtcctttctcctatatctgggtttccagccaacagaggagaggctggatgcccagatataacctggcggcagcgcaaaagatg

SEQ ID NO: 29321 - DNA, 103 bp, Artificial Sequence
  Synthetic Polynucleotide
taatacgactcactatagggccagtgtcctttctcctatatctgggtttcaacagaggagagaaaccatgatataggagaacctggcggcagcgcaaaagatg

SEQ ID NO: 29322 - DNA, 103 bp, Artificial Sequence
  Synthetic Polynucleotide
taatacgactcactatagggactttccagtgtcctttctcctatatctggaacagaggagaccagatatgggagaaaggaacctggcggcagcgcaaaagatg

SEQ ID NO: 29323 - DNA, 103 bp, Artificial Sequence
  Synthetic Polynucleotide
taatacgactcactataggggtaaaactttccagtgtcctttctcctataaacagaggagatataggatgaaggacactaacctggcggcagcgcaaaagatg

SEQ ID NO: 29324 - DNA, 103 bp, Artificial Sequence
  Synthetic Polynucleotide
taatacgactcactatagggaccttgtaaaactttccagtgtcctttctcaacagaggagagagaaaatgcactggaaaaacctggcggcagcgcaaaagatg

SEQ ID NO: 29325 - DNA, 103 bp, Artificial Sequence
  Synthetic Polynucleotide
taatacgactcactatagggaaagtacagcatagcttctcctgcagtaagaacagaggagacttactatgggagaagctaacctggcggcagcgcaaaagatg

SEQ ID NO: 29326 - DNA, 103 bp, Artificial Sequence
  Synthetic Polynucleotide
taatacgactcactatagggtaacaaccttgtaaaactttccagtgtcctaacagaggagaaggacaatggaaagttttaacctggcggcagcgcaaaagatg

SEQ ID NO: 29327 - DNA, 103 bp, Artificial Sequence
  Synthetic Polynucleotide
taatacgactcactatagggtcctctaacaaccttgtaaaactttccagtaacagaggagaactggaatgttttacaagaacctggcggcagcgcaaaagatg

SEQ ID NO: 29328 - DNA, 103 bp, Artificial Sequence
  Synthetic Polynucleotide
taatacgactcactatagggtaggatcctctaacaaccttgtaaaactttaacagaggagaaaagttatgcaaggttgtaacctggcggcagcgcaaaagatg

SEQ ID NO: 29329 - DNA, 103 bp, Artificial Sequence
  Synthetic Polynucleotide
taatacgactcactatagggggtggtaggatcctctaacaaccttgtaaaaacagaggagatttacaatgttgttagagaacctggcggcagcgcaaaagatg

SEQ ID NO: 29330 - DNA, 103 bp, Artificial Sequence
  Synthetic Polynucleotide
taatacgactcactatagggttcagggtggtaggatcctctaacaaccttaacagaggagaaaggttatgagaggatccaacctggcggcagcgcaaaagatg

SEQ ID NO: 29331 - DNA, 103 bp, Artificial Sequence
  Synthetic Polynucleotide
taatacgactcactatagggtaatattcagggtggtaggatcctctaacaaacagaggagatgttagatgatcctaccaaacctggcggcagcgcaaaagatg

SEQ ID NO: 29332 - DNA, 103 bp, Artificial Sequence
  Synthetic Polynucleotide
taatacgactcactatagggccctctaatattcagggtggtaggatcctcaacagaggagagaggatatgaccaccctgaacctggcggcagcgcaaaagatg

SEQ ID NO: 29333 - DNA, 103 bp, Artificial Sequence
  Synthetic Polynucleotide
taatacgactcactataggggccccccctctaatattcagggtggtaggaaacagaggagatcctacatgcctgaatataacctggcggcagcgcaaaagatg

SEQ ID NO: 29334 - DNA, 103 bp, Artificial Sequence
  Synthetic Polynucleotide
taatacgactcactataggggactggccccccctctaatattcagggtggaacagaggagaccacccatgatattagagaacctggcggcagcgcaaaagatg

SEQ ID NO: 29335 - DNA, 103 bp, Artificial Sequence
  Synthetic Polynucleotide
taatacgactcactatagggagtaggactggccccccctctaatattcagaacagaggagactgaatatgagaggggggaacctggcggcagcgcaaaagatg

SEQ ID NO: 29336 - DNA, 103 bp, Artificial Sequence
  Synthetic Polynucleotide
taatacgactcactatagggtggaaaaagtacagcatagcttctcctgcaaacagaggagatgcaggatgagctatgctaacctggcggcagcgcaaaagatg

SEQ ID NO: 29337 - DNA, 103 bp, Artificial Sequence
  Synthetic Polynucleotide
taatacgactcactatagggagaatagtaggactggccccccctctaataaacagaggagatattagatggggggccagaacctggcggcagcgcaaaagatg

SEQ ID NO: 29338 - DNA, 103 bp, Artificial Sequence
  Synthetic Polynucleotide
taatacgactcactatagggttaggagaatagtaggactggccccccctcaacagaggagagaggggatgccagtcctaaacctggcggcagcgcaaaagatg

SEQ ID NO: 29339 - DNA, 103 bp, Artificial Sequence
  Synthetic Polynucleotide
taatacgactcactatagggttcctttaggagaatagtaggactggccccaacagaggagaggggccatgcctactattaacctggcggcagcgcaaaagatg

SEQ ID NO: 29340 - DNA, 103 bp, Artificial Sequence
  Synthetic Polynucleotide
taatacgactcactatagggatggcttcctttaggagaatagtaggactgaacagaggagacagtccatgtattctcctaacctggcggcagcgcaaaagatg

SEQ ID NO: 29341 - DNA, 103 bp, Artificial Sequence
  Synthetic Polynucleotide
taatacgactcactataggggtcttatggcttcctttaggagaatagtagaacagaggagactactaatgtcctaaaggaacctggcggcagcgcaaaagatg

SEQ ID NO: 29342 - DNA, 103 bp, Artificial Sequence
  Synthetic Polynucleotide
taatacgactcactatagggggcctgtcttatggcttcctttaggagaataacagaggagaattctcatgaaggaagccaacctggcggcagcgcaaaagatg

SEQ ID NO: 29343 - DNA, 103 bp, Artificial Sequence
  Synthetic Polynucleotide
taatacgactcactatagggtaaagggcctgtcttatggcttcctttaggaacagaggagacctaaaatgagccataagaacctggcggcagcgcaaaagatg

SEQ ID NO: 29344 - DNA, 103 bp, Artificial Sequence
  Synthetic Polynucleotide
taatacgactcactatagggcatcataaagggcctgtcttatggcttcctaacagaggagaaggaagatgtaagacaggaacctggcggcagcgcaaaagatg

SEQ ID NO: 29345 - DNA, 103 bp, Artificial Sequence
  Synthetic Polynucleotide
taatacgactcactataggggacttcatcataaagggcctgtcttatggcaacagaggagagccataatgcaggcccttaacctggcggcagcgcaaaagatg

SEQ ID NO: 29346 - DNA, 103 bp, Artificial Sequence
  Synthetic Polynucleotide
taatacgactcactatagggttgtcgacttcatcataaagggcctgtcttaacagaggagaaagacaatgcctttatgaaacctggcggcagcgcaaaagatg

SEQ ID NO: 29347 - DNA, 103 bp, Artificial Sequence
  Synthetic Polynucleotide
taatacgactcactatagggtcttgtggaaaaagtacagcatagcttctcaacagaggagagagaagatgtgctgtactaacctggcggcagcgcaaaagatg

SEQ ID NO: 29348 - DNA, 103 bp, Artificial Sequence
  Synthetic Polynucleotide
taatacgactcactatagggagactttgtcgacttcatcataaagggcctaacagaggagaaggcccatgatgatgaagaacctggcggcagcgcaaaagatg

SEQ ID NO: 29349 - DNA, 103 bp, Artificial Sequence
  Synthetic Polynucleotide
taatacgactcactataggggtttgagactttgtcgacttcatcataaagaacagaggagactttatatggaagtcgacaacctggcggcagcgcaaaagatg

SEQ ID NO: 29350 - DNA, 103 bp, Artificial Sequence
  Synthetic Polynucleotide
taatacgactcactatagggtcagagtttgagactttgtcgacttcatcaaacagaggagatgatgaatgcgacaaagtaacctggcggcagcgcaaaagatg

SEQ ID NO: 29351 - DNA, 103 bp, Artificial Sequence
  Synthetic Polynucleotide
taatacgactcactatagggtgaactcagagtttgagactttgtcgacttaacagaggagaaagtcgatgaagtctcaaaacctggcggcagcgcaaaagatg

SEQ ID NO: 29352 - DNA, 103 bp, Artificial Sequence
  Synthetic Polynucleotide
taatacgactcactatagggttctctgaactcagagtttgagactttgtcaacagaggagagacaaaatgtcaaactctaacctggcggcagcgcaaaagatg

SEQ ID NO: 29353 - DNA, 103 bp, Artificial Sequence
  Synthetic Polynucleotide
taatacgactcactatagggatagcttctctgaactcagagtttgagactaacagaggagaagtctcatgctctgagttaacctggcggcagcgcaaaagatg

SEQ ID NO: 29354 - DNA, 103 bp, Artificial Sequence
  Synthetic Polynucleotide
taatacgactcactatagggatattatagcttctctgaactcagagtttgaacagaggagacaaactatgagttcagagaacctggcggcagcgcaaaagatg

SEQ ID NO: 29355 - DNA, 103 bp, Artificial Sequence
  Synthetic Polynucleotide
taatacgactcactatagggggacaatattatagcttctctgaactcagaaacagaggagatctgagatgagagaagctaacctggcggcagcgcaaaagatg

SEQ ID NO: 29356 - DNA, 103 bp, Artificial Sequence
  Synthetic Polynucleotide
taatacgactcactataggggtcttggacaatattatagcttctctgaacaacagaggagagttcagatgagctataataacctggcggcagcgcaaaagatg

SEQ ID NO: 29357 - DNA, 103 bp, Artificial Sequence
  Synthetic Polynucleotide
taatacgactcactatagggtatgtgtcttggacaatattatagcttctcaacagaggagagagaagatgtaatattgtaacctggcggcagcgcaaaagatg

SEQ ID NO: 29358 - DNA, 103 bp, Artificial Sequence
  Synthetic Polynucleotide
taatacgactcactataggggaagttcttgtggaaaaagtacagcatagcaacagaggagagctatgatgtactttttcaacctggcggcagcgcaaaagatg

SEQ ID NO: 29359 - DNA, 103 bp, Artificial Sequence
  Synthetic Polynucleotide
taatacgactcactataggggtctctatgtgtcttggacaatattatagcaacagaggagagctataatgttgtccaagaacctggcggcagcgcaaaagatg

SEQ ID NO: 29360 - DNA, 103 bp, Artificial Sequence
  Synthetic Polynucleotide
taatacgactcactatagggaagttgtctctatgtgtcttggacaatattaacagaggagaaatattatgcaagacacaaacctggcggcagcgcaaaagatg

SEQ ID NO: 29361 - DNA, 103 bp, Artificial Sequence
  Synthetic Polynucleotide
taatacgactcactatagggaaacaaagttgtctctatgtgtcttggacaaacagaggagatgtccaatgcacatagagaacctggcggcagcgcaaaagatg

SEQ ID NO: 29362 - DNA, 103 bp, Artificial Sequence
  Synthetic Polynucleotide
taatacgactcactataggggtacaaaacaaagttgtctctatgtgtcttaacagaggagaaagacaatgagagacaacaacctggcggcagcgcaaaagatg

SEQ ID NO: 29363 - DNA, 103 bp, Artificial Sequence
  Synthetic Polynucleotide
taatacgactcactatagggctcaagtacaaaacaaagttgtctctatgtaacagaggagaacatagatgcaactttgtaacctggcggcagcgcaaaagatg

SEQ ID NO: 29364 - DNA, 103 bp, Artificial Sequence
  Synthetic Polynucleotide
taatacgactcactatagggtcgatctcaagtacaaaacaaagttgtctcaacagaggagagagacaatgttgttttgtaacctggcggcagcgcaaaagatg

SEQ ID NO: 29365 - DNA, 103 bp, Artificial Sequence
  Synthetic Polynucleotide
taatacgactcactatagggctcaatcgatctcaagtacaaaacaaagttaacagaggagaaactttatgttgtacttgaacctggcggcagcgcaaaagatg

SEQ ID NO: 29366 - DNA, 103 bp, Artificial Sequence
  Synthetic Polynucleotide
taatacgactcactatagggaggggctcaatcgatctcaagtacaaaacaaacagaggagatgttttatgcttgagatcaacctggcggcagcgcaaaagatg

SEQ ID NO: 29367 - DNA, 103 bp, Artificial Sequence
  Synthetic Polynucleotide
taatacgactcactataggggaaaaaggggctcaatcgatctcaagtacaaacagaggagatgtactatggatcgattgaacctggcggcagcgcaaaagatg

SEQ ID NO: 29368 - DNA, 103 bp, Artificial Sequence
  Synthetic Polynucleotide
taatacgactcactatagggcctaggaaaaaggggctcaatcgatctcaaaacagaggagattgagaatgattgagcccaacctggcggcagcgcaaaagatg

SEQ ID NO: 29369 - DNA, 103 bp, Artificial Sequence
  Synthetic Polynucleotide
taatacgactcactatagggtcctcgaagttcttgtggaaaaagtacagcaacagaggagagctgtaatgtttccacaaaacctggcggcagcgcaaaagatg

SEQ ID NO: 29370 - DNA, 103 bp, Artificial Sequence
  Synthetic Polynucleotide
taatacgactcactatagggaagaacctaggaaaaaggggctcaatcgataacagaggagaatcgatatggccccttttaacctggcggcagcgcaaaagatg

SEQ ID NO: 29371 - DNA, 103 bp, Artificial Sequence
  Synthetic Polynucleotide
taatacgactcactatagggcactcaagaacctaggaaaaaggggctcaaaacagaggagattgagcatgtttttcctaaacctggcggcagcgcaaaagatg

SEQ ID NO: 29372 - DNA, 103 bp, Artificial Sequence
  Synthetic Polynucleotide
taatacgactcactataggggagttcactcaagaacctaggaaaaaggggaacagaggagaccccttatgcctaggttcaacctggcggcagcgcaaaagatg

SEQ ID NO: 29373 - DNA, 103 bp, Artificial Sequence
  Synthetic Polynucleotide
taatacgactcactatagggctgaagagttcactcaagaacctaggaaaaaacagaggagattttccatggttcttgagaacctggcggcagcgcaaaagatg

SEQ ID NO: 29374 - DNA, 103 bp, Artificial Sequence
  Synthetic Polynucleotide
taatacgactcactatagggatgagctgaagagttcactcaagaacctagaacagaggagactaggtatgtgagtgaacaacctggcggcagcgcaaaagatg

SEQ ID NO: 29375 - DNA, 103 bp, Artificial Sequence
  Synthetic Polynucleotide
taatacgactcactataggggaaagatgagctgaagagttcactcaagaaaacagaggagattcttgatggaactcttcaacctggcggcagcgcaaaagatg

SEQ ID NO: 29376 - DNA, 103 bp, Artificial Sequence
  Synthetic Polynucleotide
taatacgactcactatagggccaaggaaagatgagctgaagagttcactcaacagaggagagagtgaatgcttcagctcaacctggcggcagcgcaaaagatg

SEQ ID NO: 29377 - DNA, 103 bp, Artificial Sequence
  Synthetic Polynucleotide
taatacgactcactataggggtattccaaggaaagatgagctgaagagttaacagaggagaaactctatggctcatcttaacctggcggcagcgcaaaagatg

SEQ ID NO: 29378 - DNA, 103 bp, Artificial Sequence
  Synthetic Polynucleotide
taatacgactcactatagggttcaggtattccaaggaaagatgagctgaaaacagaggagattcagcatgtctttccttaacctggcggcagcgcaaaagatg

SEQ ID NO: 29379 - DNA, 103 bp, Artificial Sequence
  Synthetic Polynucleotide
taatacgactcactatagggatagattcaggtattccaaggaaagatgagaacagaggagactcatcatgccttggaataacctggcggcagcgcaaaagatg

SEQ ID NO: 29380 - DNA, 103 bp, Artificial Sequence
  Synthetic Polynucleotide
taatacgactcactatagggtttccttccgagacttgaaaactacttgttaacagaggagaaacaagatgttttcaagtaacctggcggcagcgcaaaagatg

SEQ ID NO: 29381 - DNA, 103 bp, Artificial Sequence
  Synthetic Polynucleotide
taatacgactcactatagggactcttcctcgaagttcttgtggaaaaagtaacagaggagaacttttatgacaagaactaacctggcggcagcgcaaaagatg

SEQ ID NO: 29382 - DNA, 103 bp, Artificial Sequence
  Synthetic Polynucleotide
taatacgactcactatagggcgatgatagattcaggtattccaaggaaagaacagaggagactttccatggaatacctgaacctggcggcagcgcaaaagatg

SEQ ID NO: 29383 - DNA, 103 bp, Artificial Sequence
  Synthetic Polynucleotide
taatacgactcactataggggagtccgatgatagattcaggtattccaagaacagaggagacttggaatgcctgaatctaacctggcggcagcgcaaaagatg

SEQ ID NO: 29384 - DNA, 103 bp, Artificial Sequence
  Synthetic Polynucleotide
taatacgactcactatagggtgaatgagtccgatgatagattcaggtattaacagaggagaaataccatgatctatcataacctggcggcagcgcaaaagatg

SEQ ID NO: 29385 - DNA, 103 bp, Artificial Sequence
  Synthetic Polynucleotide
taatacgactcactatagggaattctgaatgagtccgatgatagattcagaacagaggagactgaatatgtcatcggacaacctggcggcagcgcaaaagatg

SEQ ID NO: 29386 - DNA, 103 bp, Artificial Sequence
  Synthetic Polynucleotide
taatacgactcactatagggcctagaattctgaatgagtccgatgatagaaacagaggagatctatcatgggactcattaacctggcggcagcgcaaaagatg

SEQ ID NO: 29387 - DNA, 103 bp, Artificial Sequence
  Synthetic Polynucleotide
taatacgactcactatagggatggtcctagaattctgaatgagtccgatgaacagaggagacatcggatgcattcagaaaacctggcggcagcgcaaaagatg

SEQ ID NO: 29388 - DNA, 103 bp, Artificial Sequence
  Synthetic Polynucleotide
taatacgactcactatagggtacgaatggtcctagaattctgaatgagtcaacagaggagagactcaatgagaattctaaacctggcggcagcgcaaaagatg

SEQ ID NO: 29389 - DNA, 103 bp, Artificial Sequence
  Synthetic Polynucleotide
taatacgactcactatagggctgtctacgaatggtcctagaattctgaataacagaggagaattcagatgtctaggaccaacctggcggcagcgcaaaagatg

SEQ ID NO: 29390 - DNA, 103 bp, Artificial Sequence
  Synthetic Polynucleotide
taatacgactcactatagggctgaactgtctacgaatggtcctagaattcaacagaggagagaattcatggaccattcgaacctggcggcagcgcaaaagatg

SEQ ID NO: 29391 - DNA, 103 bp, Artificial Sequence
  Synthetic Polynucleotide
taatacgactcactatagggtctttctgaactgtctacgaatggtcctagaacagaggagactaggaatgttcgtagacaacctggcggcagcgcaaaagatg

SEQ ID NO: 29392 - DNA, 103 bp, Artificial Sequence
  Synthetic Polynucleotide
taatacgactcactatagggcttaaactcttcctcgaagttcttgtggaaaacagaggagattccacatgaacttcgagaacctggcggcagcgcaaaagatg

SEQ ID NO: 29393 - DNA, 103 bp, Artificial Sequence
  Synthetic Polynucleotide
taatacgactcactatagggcaagctctttctgaactgtctacgaatggtaacagaggagaaccattatgagacagttcaacctggcggcagcgcaaaagatg

SEQ ID NO: 29394 - DNA, 103 bp, Artificial Sequence
  Synthetic Polynucleotide
taatacgactcactatagggcgagacaagctctttctgaactgtctacgaaacagaggagatcgtagatggttcagaaaaacctggcggcagcgcaaaagatg

SEQ ID NO: 29395 - DNA, 103 bp, Artificial Sequence
  Synthetic Polynucleotide
taatacgactcactataggggcgtacgagacaagctctttctgaactgtcaacagaggagagacagtatggaaagagctaacctggcggcagcgcaaaagatg

SEQ ID NO: 29396 - DNA, 103 bp, Artificial Sequence
  Synthetic Polynucleotide
taatacgactcactatagggttccagcgtacgagacaagctctttctgaaaacagaggagattcagaatgagcttgtctaacctggcggcagcgcaaaagatg

SEQ ID NO: 29397 - DNA, 103 bp, Artificial Sequence
  Synthetic Polynucleotide
taatacgactcactataggggatttttccagcgtacgagacaagctctttaacagaggagaaaagagatggtctcgtacaacctggcggcagcgcaaaagatg

SEQ ID NO: 29398 - DNA, 103 bp, Artificial Sequence
  Synthetic Polynucleotide
taatacgactcactatagggaaaaggatttttccagcgtacgagacaagcaacagaggagagcttgtatggtacgctggaacctggcggcagcgcaaaagatg

SEQ ID NO: 29399 - DNA, 103 bp, Artificial Sequence
  Synthetic Polynucleotide
taatacgactcactatagggcttgtaaaaggatttttccagcgtacgagaaacagaggagatctcgtatgctggaaaaaaacctggcggcagcgcaaaagatg

SEQ ID NO: 29400 - DNA, 103 bp, Artificial Sequence
  Synthetic Polynucleotide
taatacgactcactatagggtcagacttgtaaaaggatttttccagcgtaaacagaggagatacgctatgaaaatccttaacctggcggcagcgcaaaagatg

SEQ ID NO: 29401 - DNA, 103 bp, Artificial Sequence
  Synthetic Polynucleotide
taatacgactcactatagggtcaattcagacttgtaaaaggatttttccaaacagaggagatggaaaatgccttttacaaacctggcggcagcgcaaaagatg

SEQ ID NO: 29402 - DNA, 103 bp, Artificial Sequence
  Synthetic Polynucleotide
taatacgactcactatagggaccactcaattcagacttgtaaaaggatttaacagaggagaaaatccatgtacaagtctaacctggcggcagcgcaaaagatg

SEQ ID NO: 29403 - DNA, 103 bp, Artificial Sequence
  Synthetic Polynucleotide
taatacgactcactatagggattctcttaaactcttcctcgaagttcttgaacagaggagacaagaaatgcgaggaagaaacctggcggcagcgcaaaagatg

SEQ ID NO: 29404 - DNA, 103 bp, Artificial Sequence
  Synthetic Polynucleotide
taatacgactcactatagggtcaagaccactcaattcagacttgtaaaagaacagaggagacttttaatggtctgaattaacctggcggcagcgcaaaagatg

SEQ ID NO: 29405 - DNA, 103 bp, Artificial Sequence
  Synthetic Polynucleotide
taatacgactcactatagggtcttttcaagaccactcaattcagacttgtaacagaggagaacaagtatgaattgagtgaacctggcggcagcgcaaaagatg

SEQ ID NO: 29406 - DNA, 103 bp, Artificial Sequence
  Synthetic Polynucleotide
taatacgactcactatagggagccatcttttcaagaccactcaattcagaaacagaggagatctgaaatgagtggtcttaacctggcggcagcgcaaaagatg

SEQ ID NO: 29407 - DNA, 103 bp, Artificial Sequence
  Synthetic Polynucleotide
taatacgactcactatagggatttgagccatcttttcaagaccactcaataacagaggagaattgagatgtcttgaaaaaacctggcggcagcgcaaaagatg

SEQ ID NO: 29408 - DNA, 103 bp, Artificial Sequence
  Synthetic Polynucleotide
taatacgactcactataggggccccatttgagccatcttttcaagaccacaacagaggagagtggtcatgaaaagatggaacctggcggcagcgcaaaagatg

SEQ ID NO: 29409 - DNA, 103 bp, Artificial Sequence
  Synthetic Polynucleotide
taatacgactcactatagggtctctgccccatttgagccatcttttcaagaacagaggagacttgaaatgatggctcaaaacctggcggcagcgcaaaagatg

SEQ ID NO: 29410 - DNA, 103 bp, Artificial Sequence
  Synthetic Polynucleotide
taatacgactcactatagggccgactctctgccccatttgagccatctttaacagaggagaaaagatatgtcaaatgggaacctggcggcagcgcaaaagatg

SEQ ID NO: 29411 - DNA, 103 bp, Artificial Sequence
  Synthetic Polynucleotide
taatacgactcactatagggcagtcccgactctctgccccatttgagccaaacagaggagatggctcatgtggggcagaaacctggcggcagcgcaaaagatg

SEQ ID NO: 29412 - DNA, 103 bp, Artificial Sequence
  Synthetic Polynucleotide
taatacgactcactatagggccagacagtcccgactctctgccccatttgaacagaggagacaaatgatgcagagagtcaacctggcggcagcgcaaaagatg

SEQ ID NO: 29413 - DNA, 103 bp, Artificial Sequence
  Synthetic Polynucleotide
taatacgactcactatagggcatttccagacagtcccgactctctgccccaacagaggagaggggcaatgagtcgggacaacctggcggcagcgcaaaagatg

SEQ ID NO: 29414 - DNA, 103 bp, Artificial Sequence
  Synthetic Polynucleotide
taatacgactcactatagggtgaacattctcttaaactcttcctcgaagtaacagaggagaacttcgatgaagagtttaaacctggcggcagcgcaaaagatg

SEQ ID NO: 29415 - DNA, 103 bp, Artificial Sequence
  Synthetic Polynucleotide
taatacgactcactatagggcagaacatttccagacagtcccgactctctaacagaggagaagagagatgggactgtctaacctggcggcagcgcaaaagatg

SEQ ID NO: 29416 - DNA, 103 bp, Artificial Sequence
  Synthetic Polynucleotide
taatacgactcactatagggttcagcagaacatttccagacagtcccgacaacagaggagagtcgggatggtctggaaaaacctggcggcagcgcaaaagatg

SEQ ID NO: 29417 - DNA, 103 bp, Artificial Sequence
  Synthetic Polynucleotide
taatacgactcactataggggccctttcagcagaacatttccagacagtcaacagaggagagactgtatggaaatgttcaacctggcggcagcgcaaaagatg

SEQ ID NO: 29418 - DNA, 103 bp, Artificial Sequence
  Synthetic Polynucleotide
taatacgactcactatagggtatctgccctttcagcagaacatttccagaaacagaggagatctggaatggttctgctgaacctggcggcagcgcaaaagatg

SEQ ID NO: 29419 - DNA, 103 bp, Artificial Sequence
  Synthetic Polynucleotide
taatacgactcactatagggaagcctatctgccctttcagcagaacatttaacagaggagaaaatgtatggctgaaaggaacctggcggcagcgcaaaagatg

SEQ ID NO: 29420 - DNA, 103 bp, Artificial Sequence
  Synthetic Polynucleotide
taatacgactcactatagggtctctaagcctatctgccctttcagcagaaaacagaggagattctgcatgaagggcagaaacctggcggcagcgcaaaagatg

SEQ ID NO: 29421 - DNA, 103 bp, Artificial Sequence
  Synthetic Polynucleotide
taatacgactcactatagggatatctctctaagcctatctgccctttcagaacagaggagactgaaaatgcagataggcaacctggcggcagcgcaaaagatg

SEQ ID NO: 29422 - DNA, 103 bp, Artificial Sequence
  Synthetic Polynucleotide
taatacgactcactatagggccaagatatctctctaagcctatctgccctaacagaggagaagggcaatgaggcttagaaacctggcggcagcgcaaaagatg

SEQ ID NO: 29423 - DNA, 103 bp, Artificial Sequence
  Synthetic Polynucleotide
taatacgactcactatagggcttccccaagatatctctctaagcctatctaacagaggagaagatagatgtagagagataacctggcggcagcgcaaaagatg

SEQ ID NO: 29424 - DNA, 103 bp, Artificial Sequence
  Synthetic Polynucleotide
taatacgactcactatagggctttccttccccaagatatctctctaagccaacagaggagaggcttaatgagatatcttaacctggcggcagcgcaaaagatg

SEQ ID NO: 29425 - DNA, 103 bp, Artificial Sequence
  Synthetic Polynucleotide
taatacgactcactatagggaggcttgaacattctcttaaactcttcctcaacagaggagagaggaaatgtttaagagaaacctggcggcagcgcaaaagatg

SEQ ID NO: 29426 - DNA, 103 bp, Artificial Sequence
  Synthetic Polynucleotide
taatacgactcactatagggtaccactttccttccccaagatatctctctaacagaggagaagagagatgtcttggggaaacctggcggcagcgcaaaagatg

SEQ ID NO: 29427 - DNA, 103 bp, Artificial Sequence
  Synthetic Polynucleotide
taatacgactcactataggggtccctaccactttccttccccaagatatcaacagaggagagatatcatggggaaggaaaacctggcggcagcgcaaaagatg

SEQ ID NO: 29428 - DNA, 103 bp, Artificial Sequence
  Synthetic Polynucleotide
taatacgactcactatagggctgtagtccctaccactttccttccccaagaacagaggagacttgggatgggaaagtggaacctggcggcagcgcaaaagatg

SEQ ID NO: 29429 - DNA, 103 bp, Artificial Sequence
  Synthetic Polynucleotide
taatacgactcactatagggcggaactgtagtccctaccactttccttccaacagaggagaggaaggatggtggtagggaacctggcggcagcgcaaaagatg

SEQ ID NO: 29430 - DNA, 103 bp, Artificial Sequence
  Synthetic Polynucleotide
taatacgactcactatagggggatgcggaactgtagtccctaccactttcaacagaggagagaaagtatgagggactacaacctggcggcagcgcaaaagatg

SEQ ID NO: 29431 - DNA, 103 bp, Artificial Sequence
  Synthetic Polynucleotide
taatacgactcactatagggctgaaggatgcggaactgtagtccctaccaaacagaggagatggtagatgctacagttcaacctggcggcagcgcaaaagatg

SEQ ID NO: 29432 - DNA, 103 bp, Artificial Sequence
  Synthetic Polynucleotide
taatacgactcactatagggcagctctgaaggatgcggaactgtagtcccaacagaggagagggactatggttccgcataacctggcggcagcgcaaaagatg

SEQ ID NO: 29433 - DNA, 103 bp, Artificial Sequence
  Synthetic Polynucleotide
taatacgactcactatagggcttaacagctctgaaggatgcggaactgtaaacagaggagatacagtatggcatccttcaacctggcggcagcgcaaaagatg

SEQ ID NO: 29434 - DNA, 103 bp, Artificial Sequence
  Synthetic Polynucleotide
taatacgactcactatagggtcaaacttaacagctctgaaggatgcggaaaacagaggagattccgcatgcttcagagcaacctggcggcagcgcaaaagatg

SEQ ID NO: 29435 - DNA, 103 bp, Artificial Sequence
  Synthetic Polynucleotide
taatacgactcactataggggggggtcaaacttaacagctctgaaggatgaacagaggagacatcctatggagctgttaaacctggcggcagcgcaaaagatg

SEQ ID NO: 29436 - DNA, 103 bp, Artificial Sequence
  Synthetic Polynucleotide
taatacgactcactatagggtgaccaggcttgaacattctcttaaactctaacagaggagaagagttatggagaatgttaacctggcggcagcgcaaaagatg

SEQ ID NO: 29437 - DNA, 103 bp, Artificial Sequence
  Synthetic Polynucleotide
taatacgactcactataggggatctgggggtcaaacttaacagctctgaaaacagaggagattcagaatggttaagtttaacctggcggcagcgcaaaagatg

SEQ ID NO: 29438 - DNA, 103 bp, Artificial Sequence
  Synthetic Polynucleotide
taatacgactcactatagggtggaagatctgggggtcaaacttaacagctaacagaggagaagctgtatggtttgacccaacctggcggcagcgcaaaagatg

SEQ ID NO: 29439 - DNA, 103 bp, Artificial Sequence
  Synthetic Polynucleotide
taatacgactcactatagggacttatggaagatctgggggtcaaacttaaaacagaggagattaagtatgacccccagaaacctggcggcagcgcaaaagatg

SEQ ID NO: 29440 - DNA, 103 bp, Artificial Sequence
  Synthetic Polynucleotide
taatacgactcactatagggccacaacttatggaagatctgggggtcaaaaacagaggagatttgacatgcagatcttcaacctggcggcagcgcaaaagatg

SEQ ID NO: 29441 - DNA, 103 bp, Artificial Sequence
  Synthetic Polynucleotide
taatacgactcactatagggtacatccacaacttatggaagatctgggggaacagaggagacccccaatgcttccataaaacctggcggcagcgcaaaagatg

SEQ ID NO: 29442 - DNA, 103 bp, Artificial Sequence
  Synthetic Polynucleotide
taatacgactcactataggggattctacatccacaacttatggaagatctaacagaggagaagatctatgataagttgtaacctggcggcagcgcaaaagatg

SEQ ID NO: 29443 - DNA, 103 bp, Artificial Sequence
  Synthetic Polynucleotide
taatacgactcactatagggtcctggattctacatccacaacttatggaaaacagaggagattccatatgttgtggatgaacctggcggcagcgcaaaagatg

SEQ ID NO: 29444 - DNA, 103 bp, Artificial Sequence
  Synthetic Polynucleotide
taatacgactcactatagggggacatcctggattctacatccacaacttaaacagaggagataagttatggatgtagaaaacctggcggcagcgcaaaagatg

SEQ ID NO: 29445 - DNA, 103 bp, Artificial Sequence
  Synthetic Polynucleotide
taatacgactcactatagggtttctggacatcctggattctacatccacaaacagaggagatgtggaatgagaatccagaacctggcggcagcgcaaaagatg

SEQ ID NO: 29446 - DNA, 103 bp, Artificial Sequence
  Synthetic Polynucleotide
taatacgactcactatagggctaggtttctggacatcctggattctacataacagaggagaatgtagatgccaggatgtaacctggcggcagcgcaaaagatg

SEQ ID NO: 29447 - DNA, 103 bp, Artificial Sequence
  Synthetic Polynucleotide
taatacgactcactatagggtttcttgaccaggcttgaacattctcttaaaacagaggagattaagaatgtgttcaagcaacctggcggcagcgcaaaagatg

SEQ ID NO: 29448 - DNA, 103 bp, Artificial Sequence
  Synthetic Polynucleotide
taatacgactcactatagggagactctaggtttctggacatcctggattcaacagaggagagaatccatgatgtccagaaacctggcggcagcgcaaaagatg

SEQ ID NO: 29449 - DNA, 103 bp, Artificial Sequence
  Synthetic Polynucleotide
taatacgactcactatagggcactgagactctaggtttctggacatcctgaacagaggagacaggatatgcagaaacctaacctggcggcagcgcaaaagatg

SEQ ID NO: 29450 - DNA, 103 bp, Artificial Sequence
  Synthetic Polynucleotide
taatacgactcactatagggacggacactgagactctaggtttctggacaaacagaggagatgtccaatgacctagagtaacctggcggcagcgcaaaagatg

SEQ ID NO: 29451 - DNA, 103 bp, Artificial Sequence
  Synthetic Polynucleotide
taatacgactcactataggggaagaacggacactgagactctaggtttctaacagaggagaagaaacatggagtctcagaacctggcggcagcgcaaaagatg

SEQ ID NO: 29452 - DNA, 103 bp, Artificial Sequence
  Synthetic Polynucleotide
taatacgactcactatagggggaaggaagaacggacactgagactctaggaacagaggagacctagaatgtcagtgtccaacctggcggcagcgcaaaagatg

SEQ ID NO: 29453 - DNA, 103 bp, Artificial Sequence
  Synthetic Polynucleotide
taatacgactcactatagggtcaaaggaaggaagaacggacactgagactaacagaggagaagtctcatggtccgttctaacctggcggcagcgcaaaagatg

SEQ ID NO: 29454 - DNA, 103 bp, Artificial Sequence
  Synthetic Polynucleotide
taatacgactcactataggggattgtcaaaggaaggaagaacggacactgaacagaggagacagtgtatgttcttccttaacctggcggcagcgcaaaagatg

SEQ ID NO: 29455 - DNA, 103 bp, Artificial Sequence
  Synthetic Polynucleotide
taatacgactcactatagggaaaacgattgtcaaaggaaggaagaacggaaacagaggagatccgttatgccttcctttaacctggcggcagcgcaaaagatg

SEQ ID NO: 29456 - DNA, 103 bp, Artificial Sequence
  Synthetic Polynucleotide
taatacgactcactataggggatacaaaacgattgtcaaaggaaggaagaaacagaggagatcttccatgctttgacaaaacctggcggcagcgcaaaagatg

SEQ ID NO: 29457 - DNA, 103 bp, Artificial Sequence
  Synthetic Polynucleotide
taatacgactcactatagggctctagatacaaaacgattgtcaaaggaagaacagaggagacttcctatgacaatcgttaacctggcggcagcgcaaaagatg

SEQ ID NO: 29458 - DNA, 103 bp, Artificial Sequence
  Synthetic Polynucleotide
taatacgactcactatagggagccgtttcttgaccaggcttgaacattctaacagaggagaagaatgatgaagcctggtaacctggcggcagcgcaaaagatg

SEQ ID NO: 29459 - DNA, 103 bp, Artificial Sequence
  Synthetic Polynucleotide
taatacgactcactatagggaggccctctagatacaaaacgattgtcaaaaacagaggagatttgacatgcgttttgtaaacctggcggcagcgcaaaagatg

SEQ ID NO: 29460 - DNA, 103 bp, Artificial Sequence
  Synthetic Polynucleotide
taatacgactcactatagggttgagaggccctctagatacaaaacgattgaacagaggagacaatcgatgtgtatctagaacctggcggcagcgcaaaagatg

SEQ ID NO: 29461 - DNA, 103 bp, Artificial Sequence
  Synthetic Polynucleotide
taatacgactcactatagggatcctttgagaggccctctagatacaaaacaacagaggagagttttgatgctagagggcaacctggcggcagcgcaaaagatg

SEQ ID NO: 29462 - DNA, 103 bp, Artificial Sequence
  Synthetic Polynucleotide
taatacgactcactatagggcaaatatcctttgagaggccctctagatacaacagaggagagtatctatggggcctctcaacctggcggcagcgcaaaagatg

SEQ ID NO: 29463 - DNA, 103 bp, Artificial Sequence
  Synthetic Polynucleotide
taatacgactcactataggggatcccaaatatcctttgagaggccctctaaacagaggagatagaggatgtctcaaaggaacctggcggcagcgcaaaagatg

SEQ ID NO: 29464 - DNA, 103 bp, Artificial Sequence
  Synthetic Polynucleotide
taatacgactcactatagggttgaagatcccaaatatcctttgagaggccaacagaggagaggcctcatgaaggatattaacctggcggcagcgcaaaagatg

SEQ ID NO: 29465 - DNA, 103 bp, Artificial Sequence
  Synthetic Polynucleotide
taatacgactcactatagggagatgttgaagatcccaaatatcctttgagaacagaggagactcaaaatgtatttgggaaacctggcggcagcgcaaaagatg

SEQ ID NO: 29466 - DNA, 103 bp, Artificial Sequence
  Synthetic Polynucleotide
taatacgactcactataggggacacagatgttgaagatcccaaatatcctaacagaggagaaggataatggggatcttcaacctggcggcagcgcaaaagatg

SEQ ID NO: 29467 - DNA, 103 bp, Artificial Sequence
  Synthetic Polynucleotide
taatacgactcactataggggagtcgacacagatgttgaagatcccaaataacagaggagaatttggatgcttcaacataacctggcggcagcgcaaaagatg

SEQ ID NO: 29468 - DNA, 103 bp, Artificial Sequence
  Synthetic Polynucleotide
taatacgactcactatagggtagctgagtcgacacagatgttgaagatccaacagaggagaggatctatgacatctgtgaacctggcggcagcgcaaaagatg

SEQ ID NO: 29469 - DNA, 103 bp, Artificial Sequence
  Synthetic Polynucleotide
taatacgactcactatagggggggtagccgtttcttgaccaggcttgaacaacagaggagagttcaaatgtggtcaagaaacctggcggcagcgcaaaagatg

SEQ ID NO: 29470 - DNA, 103 bp, Artificial Sequence
  Synthetic Polynucleotide
taatacgactcactatagggtgaaatagctgagtcgacacagatgttgaaaacagaggagattcaacatgtgtgtcgacaacctggcggcagcgcaaaagatg

SEQ ID NO: 29471 - DNA, 103 bp, Artificial Sequence
  Synthetic Polynucleotide
taatacgactcactatagggaagcatgaaatagctgagtcgacacagatgaacagaggagacatctgatgcgactcagcaacctggcggcagcgcaaaagatg

SEQ ID NO: 29472 - DNA, 103 bp, Artificial Sequence
  Synthetic Polynucleotide
taatacgactcactatagggctcccaagcatgaaatagctgagtcgacacaacagaggagagtgtcgatgcagctatttaacctggcggcagcgcaaaagatg

SEQ ID NO: 29473 - DNA, 103 bp, Artificial Sequence
  Synthetic Polynucleotide
taatacgactcactatagggaccttctcccaagcatgaaatagctgagtcaacagaggagagactcaatgatttcatgcaacctggcggcagcgcaaaagatg

SEQ ID NO: 29474 - DNA, 103 bp, Artificial Sequence
  Synthetic Polynucleotide
taatacgactcactatagggtagtcaccttctcccaagcatgaaatagctaacagaggagaagctatatgatgcttgggaacctggcggcagcgcaaaagatg

SEQ ID NO: 29475 - DNA, 103 bp, Artificial Sequence
  Synthetic Polynucleotide
taatacgactcactatagggtacattagtcaccttctcccaagcatgaaaaacagaggagatttcatatgtgggagaagaacctggcggcagcgcaaaagatg

SEQ ID NO: 29476 - DNA, 103 bp, Artificial Sequence
  Synthetic Polynucleotide
taatacgactcactatagggacatgtacattagtcaccttctcccaagcaaacagaggagatgcttgatggaaggtgacaacctggcggcagcgcaaaagatg

SEQ ID NO: 29477 - DNA, 103 bp, Artificial Sequence
  Synthetic Polynucleotide
taatacgactcactatagggtcactacatgtacattagtcaccttctcccaacagaggagagggagaatgtgactaatgaacctggcggcagcgcaaaagatg

SEQ ID NO: 29478 - DNA, 103 bp, Artificial Sequence
  Synthetic Polynucleotide
taatacgactcactatagggtcttctcactacatgtacattagtcaccttaacagaggagaaaggtgatgaatgtacataacctggcggcagcgcaaaagatg

SEQ ID NO: 29479 - DNA, 103 bp, Artificial Sequence
  Synthetic Polynucleotide
taatacgactcactatagggagcgctcttctcactacatgtacattagtcaacagaggagagactaaatgacatgtagtaacctggcggcagcgcaaaagatg

SEQ ID NO: 29480 - DNA, 103 bp, Artificial Sequence
  Synthetic Polynucleotide
taatacgactcactatagggagtgaggggtagccgtttcttgaccaggctaacagaggagaagcctgatgaagaaacggaacctggcggcagcgcaaaagatg

SEQ ID NO: 29481 - DNA, 103 bp, Artificial Sequence
  Synthetic Polynucleotide
taatacgactcactatagggacgatagcgctcttctcactacatgtacataacagaggagaatgtacatgtagtgagaaaacctggcggcagcgcaaaagatg

SEQ ID NO: 29482 - DNA, 103 bp, Artificial Sequence
  Synthetic Polynucleotide
taatacgactcactatagggtttcaacgatagcgctcttctcactacatgaacagaggagacatgtaatgagaagagcgaacctggcggcagcgcaaaagatg

SEQ ID NO: 29483 - DNA, 103 bp, Artificial Sequence
  Synthetic Polynucleotide
taatacgactcactataggggattctttcaacgatagcgctcttctcactaacagaggagaagtgagatgagcgctatcaacctggcggcagcgcaaaagatg

SEQ ID NO: 29484 - DNA, 103 bp, Artificial Sequence
  Synthetic Polynucleotide
taatacgactcactatagggtgatagattctttcaacgatagcgctcttcaacagaggagagaagagatgtatcgttgaaacctggcggcagcgcaaaagatg

SEQ ID NO: 29485 - DNA, 103 bp, Artificial Sequence
  Synthetic Polynucleotide
taatacgactcactatagggccaattgatagattctttcaacgatagcgcaacagaggagagcgctaatgttgaaagaaaacctggcggcagcgcaaaagatg

SEQ ID NO: 29486 - DNA, 103 bp, Artificial Sequence
  Synthetic Polynucleotide
taatacgactcactatagggatgaaccaattgatagattctttcaacgataacagaggagaatcgttatgagaatctataacctggcggcagcgcaaaagatg

SEQ ID NO: 29487 - DNA, 103 bp, Artificial Sequence
  Synthetic Polynucleotide
taatacgactcactatagggtttctatgaaccaattgatagattctttcaaacagaggagatgaaagatgctatcaattaacctggcggcagcgcaaaagatg

SEQ ID NO: 29488 - DNA, 103 bp, Artificial Sequence
  Synthetic Polynucleotide
taatacgactcactatagggatccctttctatgaaccaattgatagattcaacagaggagagaatctatgaattggttcaacctggcggcagcgcaaaagatg

SEQ ID NO: 29489 - DNA, 103 bp, Artificial Sequence
  Synthetic Polynucleotide
taatacgactcactatagggtttgaatccctttctatgaaccaattgataaacagaggagatatcaaatggttcatagaaacctggcggcagcgcaaaagatg

SEQ ID NO: 29490 - DNA, 103 bp, Artificial Sequence
  Synthetic Polynucleotide
taatacgactcactatagggccaagtttgaatccctttctatgaaccaataacagaggagaattggtatgtagaaagggaacctggcggcagcgcaaaagatg

SEQ ID NO: 29491 - DNA, 103 bp, Artificial Sequence
  Synthetic Polynucleotide
taatacgactcactataggggacaatttccttccgagacttgaaaactacaacagaggagagtagttatgaagtctcggaacctggcggcagcgcaaaagatg

SEQ ID NO: 29492 - DNA, 103 bp, Artificial Sequence
  Synthetic Polynucleotide
taatacgactcactataggggtaggagtgaggggtagccgtttcttgaccaacagaggagaggtcaaatgacggctaccaacctggcggcagcgcaaaagatg

SEQ ID NO: 29493 - DNA, 103 bp, Artificial Sequence
  Synthetic Polynucleotide
taatacgactcactatagggttttgccaagtttgaatccctttctatgaaaacagaggagattcataatgagggattcaaacctggcggcagcgcaaaagatg

SEQ ID NO: 29494 - DNA, 103 bp, Artificial Sequence
  Synthetic Polynucleotide
taatacgactcactatagggatagtttttgccaagtttgaatccctttctaacagaggagaagaaagatgttcaaacttaacctggcggcagcgcaaaagatg

SEQ ID NO: 29495 - DNA, 103 bp, Artificial Sequence
  Synthetic Polynucleotide
taatacgactcactatagggttattatagtttttgccaagtttgaatcccaacagaggagagggattatgacttggcaaaacctggcggcagcgcaaaagatg

SEQ ID NO: 29496 - DNA, 103 bp, Artificial Sequence
  Synthetic Polynucleotide
taatacgactcactataggggttccttattatagtttttgccaagtttgaaacagaggagatcaaacatggcaaaaactaacctggcggcagcgcaaaagatg

SEQ ID NO: 29497 - DNA, 103 bp, Artificial Sequence
  Synthetic Polynucleotide
taatacgactcactatagggtttatgttccttattatagtttttgccaagaacagaggagacttggcatgaactataataacctggcggcagcgcaaaagatg

SEQ ID NO: 29498 - DNA, 103 bp, Artificial Sequence
  Synthetic Polynucleotide
taatacgactcactatagggaggactttatgttccttattatagtttttgaacagaggagacaaaaaatgtaataaggaaacctggcggcagcgcaaaagatg

SEQ ID NO: 29499 - DNA, 103 bp, Artificial Sequence
  Synthetic Polynucleotide
taatacgactcactatagggtgtcaaggactttatgttccttattatagtaacagaggagaactataatgaggaacataaacctggcggcagcgcaaaagatg

SEQ ID NO: 29500 - DNA, 103 bp, Artificial Sequence
  Synthetic Polynucleotide
taatacgactcactatagggggccctgtcaaggactttatgttccttattaacagaggagaaataagatgcataaagtcaacctggcggcagcgcaaaagatg

SEQ ID NO: 29501 - DNA, 103 bp, Artificial Sequence
  Synthetic Polynucleotide
taatacgactcactatagggactctggccctgtcaaggactttatgttccaacagaggagaggaacaatgagtccttgaaacctggcggcagcgcaaaagatg

SEQ ID NO: 29502 - DNA, 103 bp, Artificial Sequence
  Synthetic Polynucleotide
taatacgactcactatagggctcaaactctggccctgtcaaggactttataacagaggagaataaagatgttgacagggaacctggcggcagcgcaaaagatg

SEQ ID NO: 29503 - DNA, 103 bp, Artificial Sequence
  Synthetic Polynucleotide
taatacgactcactatagggacgaagtaggagtgaggggtagccgtttctaacagaggagaagaaacatgtacccctcaaacctggcggcagcgcaaaagatg

SEQ ID NO: 29504 - DNA, 103 bp, Artificial Sequence
  Synthetic Polynucleotide
taatacgactcactatagggtctatctcaaactctggccctgtcaaggacaacagaggagagtccttatgagggccagaaacctggcggcagcgcaaaagatg

SEQ ID NO: 29505 - DNA, 103 bp, Artificial Sequence
  Synthetic Polynucleotide
taatacgactcactatagggtctcatctatctcaaactctggccctgtcaaacagaggagatgacagatgcagagtttgaacctggcggcagcgcaaaagatg

SEQ ID NO: 29506 - DNA, 103 bp, Artificial Sequence
  Synthetic Polynucleotide
taatacgactcactataggggggaatctcatctatctcaaactctggcccaacagaggagagggccaatgtttgagataaacctggcggcagcgcaaaagatg

SEQ ID NO: 29507 - DNA, 103 bp, Artificial Sequence
  Synthetic Polynucleotide
taatacgactcactatagggaacaagggaatctcatctatctcaaactctaacagaggagaagagttatggatagatgaaacctggcggcagcgcaaaagatg

SEQ ID NO: 29508 - DNA, 103 bp, Artificial Sequence
  Synthetic Polynucleotide
taatacgactcactatagggttttgaacaagggaatctcatctatctcaaaacagaggagattgagaatgatgagattcaacctggcggcagcgcaaaagatg

SEQ ID NO: 29509 - DNA, 103 bp, Artificial Sequence
  Synthetic Polynucleotide
taatacgactcactatagggtgttcttttgaacaagggaatctcatctataacagaggagaatagatatgattcccttgaacctggcggcagcgcaaaagatg

SEQ ID NO: 29510 - DNA, 103 bp, Artificial Sequence
  Synthetic Polynucleotide
taatacgactcactataggggaccctgttcttttgaacaagggaatctcaaacagaggagatgagatatgcttgttcaaaacctggcggcagcgcaaaagatg

SEQ ID NO: 29511 - DNA, 103 bp, Artificial Sequence
  Synthetic Polynucleotide
taatacgactcactataggggggcagaccctgttcttttgaacaagggaaaacagaggagattccctatgtcaaaagaaaacctggcggcagcgcaaaagatg

SEQ ID NO: 29512 - DNA, 103 bp, Artificial Sequence
  Synthetic Polynucleotide
taatacgactcactatagggatggagggcagaccctgttcttttgaacaaaacagaggagattgttcatgagaacagggaacctggcggcagcgcaaaagatg

SEQ ID NO: 29513 - DNA, 103 bp, Artificial Sequence
  Synthetic Polynucleotide
taatacgactcactatagggaatcgatggagggcagaccctgttcttttgaacagaggagacaaaagatgagggtctgcaacctggcggcagcgcaaaagatg

SEQ ID NO: 29514 - DNA, 103 bp, Artificial Sequence
  Synthetic Polynucleotide
taatacgactcactatagggaatgcacgaagtaggagtgaggggtagccgaacagaggagacggctaatgctcactcctaacctggcggcagcgcaaaagatg

SEQ ID NO: 29515 - DNA, 103 bp, Artificial Sequence
  Synthetic Polynucleotide
taatacgactcactatagggatttgaatcgatggagggcagaccctgttcaacagaggagagaacagatgctgccctccaacctggcggcagcgcaaaagatg

SEQ ID NO: 29516 - DNA, 103 bp, Artificial Sequence
  Synthetic Polynucleotide
taatacgactcactatagggggaagatttgaatcgatggagggcagacccaacagaggagagggtctatgctccatcgaaacctggcggcagcgcaaaagatg

SEQ ID NO: 29517 - DNA, 103 bp, Artificial Sequence
  Synthetic Polynucleotide
taatacgactcactatagggtatctggaagatttgaatcgatggagggcaaacagaggagatgccctatgtcgattcaaaacctggcggcagcgcaaaagatg

SEQ ID NO: 29518 - DNA, 103 bp, Artificial Sequence
  Synthetic Polynucleotide
taatacgactcactatagggcgctgtatctggaagatttgaatcgatggaaacagaggagatccatcatgtcaaatcttaacctggcggcagcgcaaaagatg

SEQ ID NO: 29519 - DNA, 103 bp, Artificial Sequence
  Synthetic Polynucleotide
taatacgactcactatagggtccttcgctgtatctggaagatttgaatcgaacagaggagacgattcatgtcttccagaaacctggcggcagcgcaaaagatg

SEQ ID NO: 29520 - DNA, 103 bp, Artificial Sequence
  Synthetic Polynucleotide
taatacgactcactatagggtaacctccttcgctgtatctggaagatttgaacagaggagacaaatcatgcagatacagaacctggcggcagcgcaaaagatg

SEQ ID NO: 29521 - DNA, 103 bp, Artificial Sequence
  Synthetic Polynucleotide
taatacgactcactatagggaagagtaacctccttcgctgtatctggaagaacagaggagacttccaatgacagcgaagaacctggcggcagcgcaaaagatg

SEQ ID NO: 29522 - DNA, 103 bp, Artificial Sequence
  Synthetic Polynucleotide
taatacgactcactatagggcactgaagagtaacctccttcgctgtatctaacagaggagaagatacatggaaggaggtaacctggcggcagcgcaaaagatg

SEQ ID NO: 29523 - DNA, 103 bp, Artificial Sequence
  Synthetic Polynucleotide
taatacgactcactatagggggacacactgaagagtaacctccttcgctgaacagaggagacagcgaatgaggttactcaacctggcggcagcgcaaaagatg

SEQ ID NO: 29524 - DNA, 103 bp, Artificial Sequence
  Synthetic Polynucleotide
taatacgactcactatagggaattgggacacactgaagagtaacctccttaacagaggagaaaggagatgactcttcagaacctggcggcagcgcaaaagatg

SEQ ID NO: 29525 - DNA, 103 bp, Artificial Sequence
  Synthetic Polynucleotide
taatacgactcactatagggcctgaaatgcacgaagtaggagtgaggggtaacagaggagaacccctatgtcctacttcaacctggcggcagcgcaaaagatg

SEQ ID NO: 29526 - DNA, 103 bp, Artificial Sequence
  Synthetic Polynucleotide
taatacgactcactatagggcaacaaattgggacacactgaagagtaaccaacagaggagaggttacatgtcagtgtgtaacctggcggcagcgcaaaagatg

SEQ ID NO: 29527 - DNA, 103 bp, Artificial Sequence
  Synthetic Polynucleotide
taatacgactcactatagggtgagacaacaaattgggacacactgaagagaacagaggagactcttcatggtgtcccaaaacctggcggcagcgcaaaagatg

SEQ ID NO: 29528 - DNA, 103 bp, Artificial Sequence
  Synthetic Polynucleotide
taatacgactcactatagggagatatgagacaacaaattgggacacactgaacagaggagacagtgtatgccaatttgtaacctggcggcagcgcaaaagatg

SEQ ID NO: 29529 - DNA, 103 bp, Artificial Sequence
  Synthetic Polynucleotide
taatacgactcactataggggactgagatatgagacaacaaattgggacaaacagaggagatgtcccatgttgttgtctaacctggcggcagcgcaaaagatg

SEQ ID NO: 29530 - DNA, 103 bp, Artificial Sequence
  Synthetic Polynucleotide
taatacgactcactataggggtactgactgagatatgagacaacaaattgaacagaggagacaatttatggtctcatataacctggcggcagcgcaaaagatg

SEQ ID NO: 29531 - DNA, 103 bp, Artificial Sequence
  Synthetic Polynucleotide
taatacgactcactatagggtatctgtactgactgagatatgagacaacaaacagaggagatgttgtatgatatctcagaacctggcggcagcgcaaaagatg

SEQ ID NO: 29532 - DNA, 103 bp, Artificial Sequence
  Synthetic Polynucleotide
taatacgactcactatagggcatggtatctgtactgactgagatatgagaaacagaggagatctcatatgtcagtcagtaacctggcggcagcgcaaaagatg

SEQ ID NO: 29533 - DNA, 103 bp, Artificial Sequence
  Synthetic Polynucleotide
taatacgactcactatagggtcagacatggtatctgtactgactgagataaacagaggagatatctcatgcagtacagaaacctggcggcagcgcaaaagatg

SEQ ID NO: 29534 - DNA, 103 bp, Artificial Sequence
  Synthetic Polynucleotide
taatacgactcactatagggtcagctcagacatggtatctgtactgactgaacagaggagacagtcaatgcagataccaaacctggcggcagcgcaaaagatg

SEQ ID NO: 29535 - DNA, 103 bp, Artificial Sequence
  Synthetic Polynucleotide
taatacgactcactatagggatgtgtcagctcagacatggtatctgtactaacagaggagaagtacaatgaccatgtctaacctggcggcagcgcaaaagatg

SEQ ID NO: 29536 - DNA, 103 bp, Artificial Sequence
  Synthetic Polynucleotide
taatacgactcactatagggaaagacctgaaatgcacgaagtaggagtgaaacagaggagatcactcatgcttcgtgcaaacctggcggcagcgcaaaagatg

SEQ ID NO: 29537 - DNA, 103 bp, Artificial Sequence
  Synthetic Polynucleotide
taatacgactcactatagggccatcatgtgtcagctcagacatggtatctaacagaggagaagatacatggtctgagctaacctggcggcagcgcaaaagatg

SEQ ID NO: 29538 - DNA, 103 bp, Artificial Sequence
  Synthetic Polynucleotide
taatacgactcactatagggtccttccatcatgtgtcagctcagacatggaacagaggagaccatgtatgagctgacacaacctggcggcagcgcaaaagatg

SEQ ID NO: 29539 - DNA, 103 bp, Artificial Sequence
  Synthetic Polynucleotide
taatacgactcactataggggaaattccttccatcatgtgtcagctcagaaacagaggagatctgagatgacacatgataacctggcggcagcgcaaaagatg

SEQ ID NO: 29540 - DNA, 103 bp, Artificial Sequence
  Synthetic Polynucleotide
taatacgactcactatagggaagtcgaaattccttccatcatgtgtcagcaacagaggagagctgacatgtgatggaagaacctggcggcagcgcaaaagatg

SEQ ID NO: 29541 - DNA, 103 bp, Artificial Sequence
  Synthetic Polynucleotide
taatacgactcactatagggacatgaagtcgaaattccttccatcatgtgaacagaggagacacatgatggaaggaattaacctggcggcagcgcaaaagatg

SEQ ID NO: 29542 - DNA, 103 bp, Artificial Sequence
  Synthetic Polynucleotide
taatacgactcactatagggttggaacatgaagtcgaaattccttccatcaacagaggagagatggaatgaatttcgacaacctggcggcagcgcaaaagatg

SEQ ID NO: 29543 - DNA, 103 bp, Artificial Sequence
  Synthetic Polynucleotide
taatacgactcactatagggaacggttggaacatgaagtcgaaattccttaacagaggagaaaggaaatgcgacttcataacctggcggcagcgcaaaagatg

SEQ ID NO: 29544 - DNA, 103 bp, Artificial Sequence
  Synthetic Polynucleotide
taatacgactcactatagggacatcaacggttggaacatgaagtcgaaataacagaggagaatttcgatgtcatgttccaacctggcggcagcgcaaaagatg

SEQ ID NO: 29545 - DNA, 103 bp, Artificial Sequence
  Synthetic Polynucleotide
taatacgactcactatagggatacaacatcaacggttggaacatgaagtcaacagaggagagacttcatgttccaaccgaacctggcggcagcgcaaaagatg

SEQ ID NO: 29546 - DNA, 103 bp, Artificial Sequence
  Synthetic Polynucleotide
taatacgactcactatagggtgagaatacaacatcaacggttggaacatgaacagaggagacatgttatgaccgttgataacctggcggcagcgcaaaagatg

SEQ ID NO: 29547 - DNA, 103 bp, Artificial Sequence
  Synthetic Polynucleotide
taatacgactcactataggggtcctaaagacctgaaatgcacgaagtaggaacagaggagacctactatgtgcatttcaaacctggcggcagcgcaaaagatg

SEQ ID NO: 29548 - DNA, 103 bp, Artificial Sequence
  Synthetic Polynucleotide
taatacgactcactatagggatgtctgagaatacaacatcaacggttggaaacagaggagatccaacatgtgatgttgtaacctggcggcagcgcaaaagatg

SEQ ID NO: 29549 - DNA, 103 bp, Artificial Sequence
  Synthetic Polynucleotide
taatacgactcactatagggagtccatgtctgagaatacaacatcaacggaacagaggagaccgttgatgttgtattctaacctggcggcagcgcaaaagatg

SEQ ID NO: 29550 - DNA, 103 bp, Artificial Sequence
  Synthetic Polynucleotide
taatacgactcactatagggtctgcagtccatgtctgagaatacaacatcaacagaggagagatgttatgttctcagacaacctggcggcagcgcaaaagatg

SEQ ID NO: 29551 - DNA, 103 bp, Artificial Sequence
  Synthetic Polynucleotide
taatacgactcactatagggcaagctctgcagtccatgtctgagaatacaaacagaggagatgtattatgagacatggaaacctggcggcagcgcaaaagatg

SEQ ID NO: 29552 - DNA, 103 bp, Artificial Sequence
  Synthetic Polynucleotide
taatacgactcactatagggttgaacaagctctgcagtccatgtctgagaaacagaggagatctcagatgtggactgcaaacctggcggcagcgcaaaagatg

SEQ ID NO: 29553 - DNA, 103 bp, Artificial Sequence
  Synthetic Polynucleotide
taatacgactcactatagggtttctttgaacaagctctgcagtccatgtcaacagaggagagacatgatgtgcagagctaacctggcggcagcgcaaaagatg

SEQ ID NO: 29554 - DNA, 103 bp, Artificial Sequence
  Synthetic Polynucleotide
taatacgactcactatagggtcagatttctttgaacaagctctgcagtccaacagaggagaggactgatgagcttgttcaacctggcggcagcgcaaaagatg

SEQ ID NO: 29555 - DNA, 103 bp, Artificial Sequence
  Synthetic Polynucleotide
taatacgactcactatagggaagcttcagatttctttgaacaagctctgcaacagaggagagcagagatggttcaaagaaacctggcggcagcgcaaaagatg

SEQ ID NO: 29556 - DNA, 103 bp, Artificial Sequence
  Synthetic Polynucleotide
taatacgactcactatagggtctcgaagcttcagatttctttgaacaagcaacagaggagagcttgtatgaagaaatctaacctggcggcagcgcaaaagatg

SEQ ID NO: 29557 - DNA, 103 bp, Artificial Sequence
  Synthetic Polynucleotide
taatacgactcactatagggtagagtctcgaagcttcagatttctttgaaaacagaggagattcaaaatgatctgaagcaacctggcggcagcgcaaaagatg

SEQ ID NO: 29558 - DNA, 103 bp, Artificial Sequence
  Synthetic Polynucleotide
taatacgactcactatagggactcagtcctaaagacctgaaatgcacgaaaacagaggagattcgtgatgttcaggtctaacctggcggcagcgcaaaagatg

SEQ ID NO: 29559 - DNA, 103 bp, Artificial Sequence
  Synthetic Polynucleotide
taatacgactcactataggggtatgtagagtctcgaagcttcagatttctaacagaggagaagaaatatgaagcttcgaaacctggcggcagcgcaaaagatg

SEQ ID NO: 29560 - DNA, 103 bp, Artificial Sequence
  Synthetic Polynucleotide
taatacgactcactatagggcagtggtatgtagagtctcgaagcttcagaaacagaggagatctgaaatgtcgagactcaacctggcggcagcgcaaaagatg

SEQ ID NO: 29561 - DNA, 103 bp, Artificial Sequence
  Synthetic Polynucleotide
taatacgactcactataggggatgccagtggtatgtagagtctcgaagctaacagaggagaagcttcatgactctacataacctggcggcagcgcaaaagatg

SEQ ID NO: 29562 - DNA, 103 bp, Artificial Sequence
  Synthetic Polynucleotide
taatacgactcactatagggtctgagatgccagtggtatgtagagtctcgaacagaggagacgagacatgacataccacaacctggcggcagcgcaaaagatg

SEQ ID NO: 29563 - DNA, 103 bp, Artificial Sequence
  Synthetic Polynucleotide
taatacgactcactatagggttacatctgagatgccagtggtatgtagagaacagaggagactctacatgccactggcaaacctggcggcagcgcaaaagatg

SEQ ID NO: 29564 - DNA, 103 bp, Artificial Sequence
  Synthetic Polynucleotide
taatacgactcactatagggaatctttacatctgagatgccagtggtatgaacagaggagacataccatgggcatctcaaacctggcggcagcgcaaaagatg

SEQ ID NO: 29565 - DNA, 103 bp, Artificial Sequence
  Synthetic Polynucleotide
taatacgactcactatagggcacacaatctttacatctgagatgccagtgaacagaggagacactggatgctcagatgtaacctggcggcagcgcaaaagatg

SEQ ID NO: 29566 - DNA, 103 bp, Artificial Sequence
  Synthetic Polynucleotide
taatacgactcactatagggggtctcacacaatctttacatctgagatgcaacagaggagagcatctatgatgtaaagaaacctggcggcagcgcaaaagatg

SEQ ID NO: 29567 - DNA, 103 bp, Artificial Sequence
  Synthetic Polynucleotide
taatacgactcactatagggcaattggtctcacacaatctttacatctgaaacagaggagatcagatatgaagattgtgaacctggcggcagcgcaaaagatg

SEQ ID NO: 29568 - DNA, 103 bp, Artificial Sequence
  Synthetic Polynucleotide
taatacgactcactatagggatcgtcaattggtctcacacaatctttacaaacagaggagatgtaaaatgtgtgtgagaaacctggcggcagcgcaaaagatg

SEQ ID NO: 29569 - DNA, 103 bp, Artificial Sequence
  Synthetic Polynucleotide
taatacgactcactatagggttcccactcagtcctaaagacctgaaatgcaacagaggagagcatttatggtctttaggaacctggcggcagcgcaaaagatg

SEQ ID NO: 29570 - DNA, 103 bp, Artificial Sequence
  Synthetic Polynucleotide
taatacgactcactatagggaccacatcgtcaattggtctcacacaatctaacagaggagaagattgatggagaccaataacctggcggcagcgcaaaagatg

SEQ ID NO: 29571 - DNA, 103 bp, Artificial Sequence
  Synthetic Polynucleotide
taatacgactcactatagggctagcaccacatcgtcaattggtctcacacaacagaggagagtgtgaatgcaattgacgaacctggcggcagcgcaaaagatg

SEQ ID NO: 29572 - DNA, 103 bp, Artificial Sequence
  Synthetic Polynucleotide
taatacgactcactatagggacattctagcaccacatcgtcaattggtctaacagaggagaagaccaatggacgatgtgaacctggcggcagcgcaaaagatg

SEQ ID NO: 29573 - DNA, 103 bp, Artificial Sequence
  Synthetic Polynucleotide
taatacgactcactatagggtttggacattctagcaccacatcgtcaattaacagaggagaaattgaatgtgtggtgctaacctggcggcagcgcaaaagatg

SEQ ID NO: 29574 - DNA, 103 bp, Artificial Sequence
  Synthetic Polynucleotide
taatacgactcactatagggagatctttggacattctagcaccacatcgtaacagaggagaacgatgatgtgctagaataacctggcggcagcgcaaaagatg

SEQ ID NO: 29575 - DNA, 103 bp, Artificial Sequence
  Synthetic Polynucleotide
taatacgactcactatagggttcaaagatctttggacattctagcaccacaacagaggagagtggtgatggaatgtccaaacctggcggcagcgcaaaagatg

SEQ ID NO: 29576 - DNA, 103 bp, Artificial Sequence
  Synthetic Polynucleotide
taatacgactcactataggggggaattcaaagatctttggacattctagcaacagaggagagctagaatgtccaaagataacctggcggcagcgcaaaagatg

SEQ ID NO: 29577 - DNA, 103 bp, Artificial Sequence
  Synthetic Polynucleotide
taatacgactcactatagggtatctgggaattcaaagatctttggacattaacagaggagaaatgtcatgagatctttgaacctggcggcagcgcaaaagatg

SEQ ID NO: 29578 - DNA, 103 bp, Artificial Sequence
  Synthetic Polynucleotide
taatacgactcactatagggtgaaatatctgggaattcaaagatctttggaacagaggagaccaaagatgtttgaattcaacctggcggcagcgcaaaagatg

SEQ ID NO: 29579 - DNA, 103 bp, Artificial Sequence
  Synthetic Polynucleotide
taatacgactcactatagggcgggttgaaatatctgggaattcaaagatcaacagaggagagatcttatgattcccagaaacctggcggcagcgcaaaagatg

SEQ ID NO: 29580 - DNA, 103 bp, Artificial Sequence
  Synthetic Polynucleotide
taatacgactcactataggggagatttcccactcagtcctaaagacctgaaacagaggagatcaggtatgtaggactgaaacctggcggcagcgcaaaagatg

SEQ ID NO: 29581 - DNA, 103 bp, Artificial Sequence
  Synthetic Polynucleotide
taatacgactcactatagggaaattcgggttgaaatatctgggaattcaaaacagaggagattgaatatgcagatatttaacctggcggcagcgcaaaagatg

SEQ ID NO: 29582 - DNA, 103 bp, Artificial Sequence
  Synthetic Polynucleotide
taatacgactcactatagggcctagaaattcgggttgaaatatctgggaaaacagaggagattcccaatgatttcaaccaacctggcggcagcgcaaaagatg

SEQ ID NO: 29583 - DNA, 103 bp, Artificial Sequence
  Synthetic Polynucleotide
taatacgactcactatagggaccatcctagaaattcgggttgaaatatctaacagaggagaagatatatgaacccgaataacctggcggcagcgcaaaagatg

SEQ ID NO: 29584 - DNA, 103 bp, Artificial Sequence
  Synthetic Polynucleotide
taatacgactcactatagggcggataccatcctagaaattcgggttgaaaaacagaggagatttcaaatggaatttctaaacctggcggcagcgcaaaagatg

SEQ ID NO: 29585 - DNA, 103 bp, Artificial Sequence
  Synthetic Polynucleotide
taatacgactcactatagggggcgccggataccatcctagaaattcgggtaacagaggagaacccgaatgtctaggatgaacctggcggcagcgcaaaagatg

SEQ ID NO: 29586 - DNA, 103 bp, Artificial Sequence
  Synthetic Polynucleotide
taatacgactcactatagggggcacggcgccggataccatcctagaaattaacagaggagaaatttcatggatggtatcaacctggcggcagcgcaaaagatg

SEQ ID NO: 29587 - DNA, 103 bp, Artificial Sequence
  Synthetic Polynucleotide
taatacgactcactatagggattctggcacggcgccggataccatcctagaacagaggagactaggaatgtatccggcgaacctggcggcagcgcaaaagatg

SEQ ID NO: 29588 - DNA, 103 bp, Artificial Sequence
  Synthetic Polynucleotide
taatacgactcactatagggcttgaattctggcacggcgccggataccataacagaggagaatggtaatgggcgccgtgaacctggcggcagcgcaaaagatg

SEQ ID NO: 29589 - DNA, 103 bp, Artificial Sequence
  Synthetic Polynucleotide
taatacgactcactatagggaatttcttgaattctggcacggcgccggataacagaggagaatccggatgcgtgccagaaacctggcggcagcgcaaaagatg

SEQ ID NO: 29590 - DNA, 103 bp, Artificial Sequence
  Synthetic Polynucleotide
taatacgactcactatagggctggtaatttcttgaattctggcacggcgcaacagaggagagcgccgatgcagaattcaaacctggcggcagcgcaaaagatg

SEQ ID NO: 29591 - DNA, 103 bp, Artificial Sequence
  Synthetic Polynucleotide
taatacgactcactataggggtaaggagatttcccactcagtcctaaagaaacagaggagatctttaatgctgagtgggaacctggcggcagcgcaaaagatg

SEQ ID NO: 29592 - DNA, 103 bp, Artificial Sequence
  Synthetic Polynucleotide
taatacgactcactatagggaacctctggtaatttcttgaattctggcacaacagaggagagtgccaatgttcaagaaaaacctggcggcagcgcaaaagatg

SEQ ID NO: 29593 - DNA, 103 bp, Artificial Sequence
  Synthetic Polynucleotide
taatacgactcactatagggaaactaacctctggtaatttcttgaattctaacagaggagaagaattatggaaattaccaacctggcggcagcgcaaaagatg

SEQ ID NO: 29594 - DNA, 103 bp, Artificial Sequence
  Synthetic Polynucleotide
taatacgactcactataggggcttcaaactaacctctggtaatttcttgaaacagaggagatcaagaatgtaccagaggaacctggcggcagcgcaaaagatg

SEQ ID NO: 29595 - DNA, 103 bp, Artificial Sequence
  Synthetic Polynucleotide
taatacgactcactataggggccctgcttcaaactaacctctggtaatttaacagaggagaaaattaatggaggttagtaacctggcggcagcgcaaaagatg

SEQ ID NO: 29596 - DNA, 103 bp, Artificial Sequence
  Synthetic Polynucleotide
taatacgactcactatagggagattgccctgcttcaaactaacctctggtaacagaggagaaccagaatgtagtttgaaaacctggcggcagcgcaaaagatg

SEQ ID NO: 29597 - DNA, 103 bp, Artificial Sequence
  Synthetic Polynucleotide
taatacgactcactatagggtgctgagattgccctgcttcaaactaacctaacagaggagaaggttaatgtgaagcaggaacctggcggcagcgcaaaagatg

SEQ ID NO: 29598 - DNA, 103 bp, Artificial Sequence
  Synthetic Polynucleotide
taatacgactcactatagggcatcatgctgagattgccctgcttcaaactaacagaggagaagtttgatgcagggcaataacctggcggcagcgcaaaagatg

SEQ ID NO: 29599 - DNA, 103 bp, Artificial Sequence
  Synthetic Polynucleotide
taatacgactcactatagggttgctcatcatgctgagattgccctgcttcaacagaggagagaagcaatgcaatctcagaacctggcggcagcgcaaaagatg

SEQ ID NO: 29600 - DNA, 103 bp, Artificial Sequence
  Synthetic Polynucleotide
taatacgactcactatagggcttcattgctcatcatgctgagattgccctaacagaggagaagggcaatgtcagcatgaaacctggcggcagcgcaaaagatg

SEQ ID NO: 29601 - DNA, 103 bp, Artificial Sequence
  Synthetic Polynucleotide
taatacgactcactatagggtttgtcttcattgctcatcatgctgagattaacagaggagaaatctcatgatgatgagcaacctggcggcagcgcaaaagatg

SEQ ID NO: 29602 - DNA, 103 bp, Artificial Sequence
  Synthetic Polynucleotide
taatacgactcactatagggaacacgacaatttccttccgagacttgaaaaacagaggagatttcaaatgtcggaaggaaacctggcggcagcgcaaaagatg

SEQ ID NO: 29603 - DNA, 103 bp, Artificial Sequence
  Synthetic Polynucleotide
taatacgactcactataggggatgagtaaggagatttcccactcagtcctaacagaggagaaggactatgtgggaaatcaacctggcggcagcgcaaaagatg

SEQ ID NO: 29604 - DNA, 103 bp, Artificial Sequence
  Synthetic Polynucleotide
taatacgactcactatagggaatgatttgtcttcattgctcatcatgctgaacagaggagacagcatatggagcaatgaaacctggcggcagcgcaaaagatg

SEQ ID NO: 29605 - DNA, 103 bp, Artificial Sequence
  Synthetic Polynucleotide
taatacgactcactatagggtatggaatgatttgtcttcattgctcatcaaacagaggagatgatgaatgatgaagacaaacctggcggcagcgcaaaagatg

SEQ ID NO: 29606 - DNA, 103 bp, Artificial Sequence
  Synthetic Polynucleotide
taatacgactcactatagggcccaatatggaatgatttgtcttcattgctaacagaggagaagcaatatggacaaatcaaacctggcggcagcgcaaaagatg

SEQ ID NO: 29607 - DNA, 103 bp, Artificial Sequence
  Synthetic Polynucleotide
taatacgactcactataggggctgtcccaatatggaatgatttgtcttcaaacagaggagatgaagaatgatcattccaaacctggcggcagcgcaaaagatg

SEQ ID NO: 29608 - DNA, 103 bp, Artificial Sequence
  Synthetic Polynucleotide
taatacgactcactatagggcttgagctgtcccaatatggaatgatttgtaacagaggagaacaaatatgtccatattgaacctggcggcagcgcaaaagatg

SEQ ID NO: 29609 - DNA, 103 bp, Artificial Sequence
  Synthetic Polynucleotide
taatacgactcactatagggcaatccttgagctgtcccaatatggaatgaaacagaggagatcattcatgattgggacaaacctggcggcagcgcaaaagatg

SEQ ID NO: 29610 - DNA, 103 bp, Artificial Sequence
  Synthetic Polynucleotide
taatacgactcactatagggtataacaatccttgagctgtcccaatatggaacagaggagaccatatatggacagctcaaacctggcggcagcgcaaaagatg

SEQ ID NO: 29611 - DNA, 103 bp, Artificial Sequence
  Synthetic Polynucleotide
taatacgactcactatagggtagagtataacaatccttgagctgtcccaaaacagaggagattgggaatgctcaaggataacctggcggcagcgcaaaagatg

SEQ ID NO: 29612 - DNA, 103 bp, Artificial Sequence
  Synthetic Polynucleotide
taatacgactcactatagggaagaatagagtataacaatccttgagctgtaacagaggagaacagctatgggattgttaaacctggcggcagcgcaaaagatg

SEQ ID NO: 29613 - DNA, 103 bp, Artificial Sequence
  Synthetic Polynucleotide
taatacgactcactataggggccacaagaatagagtataacaatccttgaaacagaggagatcaaggatggttatactcaacctggcggcagcgcaaaagatg

SEQ ID NO: 29614 - DNA, 103 bp, Artificial Sequence
  Synthetic Polynucleotide
taatacgactcactatagggcattagatgagtaaggagatttcccactcaaacagaggagatgagtgatgaatctccttaacctggcggcagcgcaaaagatg

SEQ ID NO: 29615 - DNA, 103 bp, Artificial Sequence
  Synthetic Polynucleotide
taatacgactcactataggggaatagccacaagaatagagtataacaatcaacagaggagagattgtatgactctattcaacctggcggcagcgcaaaagatg

SEQ ID NO: 29616 - DNA, 103 bp, Artificial Sequence
  Synthetic Polynucleotide
taatacgactcactataggggtcatgaatagccacaagaatagagtataaaacagaggagattatacatgattcttgtgaacctggcggcagcgcaaaagatg

SEQ ID NO: 29617 - DNA, 103 bp, Artificial Sequence
  Synthetic Polynucleotide
taatacgactcactatagggcctgggtcatgaatagccacaagaatagagaacagaggagactctatatgtgtggctataacctggcggcagcgcaaaagatg

SEQ ID NO: 29618 - DNA, 103 bp, Artificial Sequence
  Synthetic Polynucleotide
taatacgactcactatagggtatatcctgggtcatgaatagccacaagaaaacagaggagattcttgatgctattcatgaacctggcggcagcgcaaaagatg

SEQ ID NO: 29619 - DNA, 103 bp, Artificial Sequence
  Synthetic Polynucleotide
taatacgactcactataggggtcattatatcctgggtcatgaatagccacaacagaggagagtggctatgcatgacccaaacctggcggcagcgcaaaagatg

SEQ ID NO: 29620 - DNA, 103 bp, Artificial Sequence
  Synthetic Polynucleotide
taatacgactcactataggggagtggtcattatatcctgggtcatgaataaacagaggagatattcaatgcccaggataaacctggcggcagcgcaaaagatg

SEQ ID NO: 29621 - DNA, 103 bp, Artificial Sequence
  Synthetic Polynucleotide
taatacgactcactatagggaaatagagtggtcattatatcctgggtcataacagaggagaatgaccatggatataatgaacctggcggcagcgcaaaagatg

SEQ ID NO: 29622 - DNA, 103 bp, Artificial Sequence
  Synthetic Polynucleotide
taatacgactcactataggggggaaaaatagagtggtcattatatcctggaacagaggagaccaggaatgaatgaccacaacctggcggcagcgcaaaagatg

SEQ ID NO: 29623 - DNA, 103 bp, Artificial Sequence
  Synthetic Polynucleotide
taatacgactcactatagggttcacgggaaaaatagagtggtcattatataacagaggagaatataaatgccactctataacctggcggcagcgcaaaagatg

SEQ ID NO: 29624 - DNA, 103 bp, Artificial Sequence
  Synthetic Polynucleotide
taatacgactcactatagggatatattcacgggaaaaatagagtggtcataacagaggagaatgaccatgctatttttcaacctggcggcagcgcaaaagatg

SEQ ID NO: 29625 - DNA, 103 bp, Artificial Sequence
  Synthetic Polynucleotide
taatacgactcactatagggaaccgcattagatgagtaaggagatttcccaacagaggagagggaaaatgccttactcaaacctggcggcagcgcaaaagatg

SEQ ID NO: 29626 - DNA, 103 bp, Artificial Sequence
  Synthetic Polynucleotide
taatacgactcactatagggagagtatatattcacgggaaaaatagagtgaacagaggagacactctatgtttcccgtgaacctggcggcagcgcaaaagatg

SEQ ID NO: 29627 - DNA, 103 bp, Artificial Sequence
  Synthetic Polynucleotide
taatacgactcactatagggagtcgagagtatatattcacgggaaaaataaacagaggagatattttatgcgtgaatataacctggcggcagcgcaaaagatg

SEQ ID NO: 29628 - DNA, 103 bp, Artificial Sequence
  Synthetic Polynucleotide
taatacgactcactataggggggatagtcgagagtatatattcacgggaaaacagaggagattcccgatgatatatactaacctggcggcagcgcaaaagatg

SEQ ID NO: 29629 - DNA, 103 bp, Artificial Sequence
  Synthetic Polynucleotide
taatacgactcactatagggtcttggggatagtcgagagtatatattcacaacagaggagagtgaatatgtactctcgaaacctggcggcagcgcaaaagatg

SEQ ID NO: 29630 - DNA, 103 bp, Artificial Sequence
  Synthetic Polynucleotide
taatacgactcactatagggtatcctcttggggatagtcgagagtatataaacagaggagatatataatgtcgactatcaacctggcggcagcgcaaaagatg

SEQ ID NO: 29631 - DNA, 103 bp, Artificial Sequence
  Synthetic Polynucleotide
taatacgactcactatagggtcaaatatcctcttggggatagtcgagagtaacagaggagaactctcatgtatccccaaaacctggcggcagcgcaaaagatg

SEQ ID NO: 29632 - DNA, 103 bp, Artificial Sequence
  Synthetic Polynucleotide
taatacgactcactatagggtcccctcaaatatcctcttggggatagtcgaacagaggagacgactaatgccaagaggaaacctggcggcagcgcaaaagatg

SEQ ID NO: 29633 - DNA, 103 bp, Artificial Sequence
  Synthetic Polynucleotide
taatacgactcactataggggccaatcccctcaaatatcctcttggggataacagaggagaatccccatgaggatatttaacctggcggcagcgcaaaagatg

SEQ ID NO: 29634 - DNA, 103 bp, Artificial Sequence
  Synthetic Polynucleotide
taatacgactcactatagggctctagccaatcccctcaaatatcctcttgaacagaggagacaagagatgatttgagggaacctggcggcagcgcaaaagatg

SEQ ID NO: 29635 - DNA, 103 bp, Artificial Sequence
  Synthetic Polynucleotide
taatacgactcactatagggaatgcctctagccaatcccctcaaatatccaacagaggagaggatatatgaggggattgaacctggcggcagcgcaaaagatg

SEQ ID NO: 29636 - DNA, 103 bp, Artificial Sequence
  Synthetic Polynucleotide
taatacgactcactatagggtgaccaaccgcattagatgagtaaggagataacagaggagaatctccatgctcatctaaaacctggcggcagcgcaaaagatg

SEQ ID NO: 29637 - DNA, 103 bp, Artificial Sequence
  Synthetic Polynucleotide
taatacgactcactatagggatcagaatgcctctagccaatcccctcaaaaacagaggagatttgagatgattggctagaacctggcggcagcgcaaaagatg

SEQ ID NO: 29638 - DNA, 103 bp, Artificial Sequence
  Synthetic Polynucleotide
taatacgactcactatagggaccctatcagaatgcctctagccaatccccaacagaggagaggggatatgctagaggcaaacctggcggcagcgcaaaagatg

SEQ ID NO: 29639 - DNA, 103 bp, Artificial Sequence
  Synthetic Polynucleotide
taatacgactcactatagggggatgaccctatcagaatgcctctagccaaaacagaggagattggctatgggcattctgaacctggcggcagcgcaaaagatg

SEQ ID NO: 29640 - DNA, 103 bp, Artificial Sequence
  Synthetic Polynucleotide
taatacgactcactatagggcagatggatgaccctatcagaatgcctctaaacagaggagatagaggatgtctgataggaacctggcggcagcgcaaaagatg

SEQ ID NO: 29641 - DNA, 103 bp, Artificial Sequence
  Synthetic Polynucleotide
taatacgactcactatagggagaagcagatggatgaccctatcagaatgcaacagaggagagcattcatgtagggtcataacctggcggcagcgcaaaagatg

SEQ ID NO: 29642 - DNA, 103 bp, Artificial Sequence
  Synthetic Polynucleotide
taatacgactcactatagggagttaagaagcagatggatgaccctatcagaacagaggagactgataatgtcatccatcaacctggcggcagcgcaaaagatg

SEQ ID NO: 29643 - DNA, 103 bp, Artificial Sequence
  Synthetic Polynucleotide
taatacgactcactatagggattctagttaagaagcagatggatgaccctaacagaggagaagggtcatgcatctgcttaacctggcggcagcgcaaaagatg

SEQ ID NO: 29644 - DNA, 103 bp, Artificial Sequence
  Synthetic Polynucleotide
taatacgactcactatagggtggtcattctagttaagaagcagatggatgaacagaggagacatccaatggcttcttaaaacctggcggcagcgcaaaagatg

SEQ ID NO: 29645 - DNA, 103 bp, Artificial Sequence
  Synthetic Polynucleotide
taatacgactcactatagggaatcttggtcattctagttaagaagcagataacagaggagaatctgcatgttaactagaaacctggcggcagcgcaaaagatg

SEQ ID NO: 29646 - DNA, 103 bp, Artificial Sequence
  Synthetic Polynucleotide
taatacgactcactatagggacattaatcttggtcattctagttaagaagaacagaggagacttcttatgtagaatgacaacctggcggcagcgcaaaagatg

SEQ ID NO: 29647 - DNA, 103 bp, Artificial Sequence
  Synthetic Polynucleotide
taatacgactcactatagggacatgtgaccaaccgcattagatgagtaagaacagaggagacttactatgctaatgcggaacctggcggcagcgcaaaagatg

SEQ ID NO: 29648 - DNA, 103 bp, Artificial Sequence
  Synthetic Polynucleotide
taatacgactcactataggggattcacattaatcttggtcattctagttaaacagaggagataactaatgtgaccaagaaacctggcggcagcgcaaaagatg

SEQ ID NO: 29649 - DNA, 103 bp, Artificial Sequence
  Synthetic Polynucleotide
taatacgactcactatagggaggacgattcacattaatcttggtcattctaacagaggagaagaatgatgaagattaataacctggcggcagcgcaaaagatg

SEQ ID NO: 29650 - DNA, 103 bp, Artificial Sequence
  Synthetic Polynucleotide
taatacgactcactatagggtctaaaggacgattcacattaatcttggtcaacagaggagagaccaaatgtaatgtgaaaacctggcggcagcgcaaaagatg

SEQ ID NO: 29651 - DNA, 103 bp, Artificial Sequence
  Synthetic Polynucleotide
taatacgactcactatagggtcaactctaaaggacgattcacattaatctaacagaggagaagattaatgtgaatcgtcaacctggcggcagcgcaaaagatg

SEQ ID NO: 29652 - DNA, 103 bp, Artificial Sequence
  Synthetic Polynucleotide
taatacgactcactatagggggacatcaactctaaaggacgattcacattaacagaggagaaatgtgatgcgtcctttaaacctggcggcagcgcaaaagatg

SEQ ID NO: 29653 - DNA, 103 bp, Artificial Sequence
  Synthetic Polynucleotide
taatacgactcactatagggactccggacatcaactctaaaggacgattcaacagaggagagaatcgatgtttagagttaacctggcggcagcgcaaaagatg

SEQ ID NO: 29654 - DNA, 103 bp, Artificial Sequence
  Synthetic Polynucleotide
taatacgactcactatagggagatcactccggacatcaactctaaaggacaacagaggagagtccttatgagttgatgtaacctggcggcagcgcaaaagatg

SEQ ID NO: 29655 - DNA, 103 bp, Artificial Sequence
  Synthetic Polynucleotide
taatacgactcactataggggtaagagatcactccggacatcaactctaaaacagaggagattagagatgatgtccggaaacctggcggcagcgcaaaagatg

SEQ ID NO: 29656 - DNA, 103 bp, Artificial Sequence
  Synthetic Polynucleotide
taatacgactcactatagggaatatgtaagagatcactccggacatcaacaacagaggagagttgatatgcggagtgataacctggcggcagcgcaaaagatg

SEQ ID NO: 29657 - DNA, 103 bp, Artificial Sequence
  Synthetic Polynucleotide
taatacgactcactatagggtaagtaatatgtaagagatcactccggacaaacagaggagatgtccgatgtgatctcttaacctggcggcagcgcaaaagatg

SEQ ID NO: 29658 - DNA, 103 bp, Artificial Sequence
  Synthetic Polynucleotide
taatacgactcactataggggttaaacatgtgaccaaccgcattagatgaaacagaggagatcatctatggcggttggtaacctggcggcagcgcaaaagatg

SEQ ID NO: 29659 - DNA, 103 bp, Artificial Sequence
  Synthetic Polynucleotide
taatacgactcactatagggcagtctaagtaatatgtaagagatcactccaacagaggagaggagtgatgtcttacataaacctggcggcagcgcaaaagatg

SEQ ID NO: 29660 - DNA, 103 bp, Artificial Sequence
  Synthetic Polynucleotide
taatacgactcactataggggaatccagtctaagtaatatgtaagagatcaacagaggagagatctcatgcatattactaacctggcggcagcgcaaaagatg

SEQ ID NO: 29661 - DNA, 103 bp, Artificial Sequence
  Synthetic Polynucleotide
taatacgactcactataggggatgggaatccagtctaagtaatatgtaagaacagaggagacttacaatgtacttagacaacctggcggcagcgcaaaagatg

SEQ ID NO: 29662 - DNA, 103 bp, Artificial Sequence
  Synthetic Polynucleotide
taatacgactcactataggggcttggatgggaatccagtctaagtaatataacagaggagaatattaatgagactggataacctggcggcagcgcaaaagatg

SEQ ID NO: 29663 - DNA, 103 bp, Artificial Sequence
  Synthetic Polynucleotide
taatacgactcactatagggtataagcttggatgggaatccagtctaagtaacagaggagaacttagatgggattcccaaacctggcggcagcgcaaaagatg

SEQ ID NO: 29664 - DNA, 103 bp, Artificial Sequence
  Synthetic Polynucleotide
taatacgactcactatagggtaacatataagcttggatgggaatccagtcaacagaggagagactggatgcccatccaaaacctggcggcagcgcaaaagatg

SEQ ID NO: 29665 - DNA, 103 bp, Artificial Sequence
  Synthetic Polynucleotide
taatacgactcactatagggcaacataacatataagcttggatgggaatcaacagaggagagattccatgccaagcttaaacctggcggcagcgcaaaagatg

SEQ ID NO: 29666 - DNA, 103 bp, Artificial Sequence
  Synthetic Polynucleotide
taatacgactcactatagggtctctcaacataacatataagcttggatggaacagaggagaccatccatgcttatatgtaacctggcggcagcgcaaaagatg

SEQ ID NO: 29667 - DNA, 103 bp, Artificial Sequence
  Synthetic Polynucleotide
taatacgactcactataggggaggctctctcaacataacatataagcttgaacagaggagacaagctatgatgttatgtaacctggcggcagcgcaaaagatg

SEQ ID NO: 29668 - DNA, 103 bp, Artificial Sequence
  Synthetic Polynucleotide
taatacgactcactatagggtataagaggctctctcaacataacatataaaacagaggagattatatatgatgttgagaaacctggcggcagcgcaaaagatg

SEQ ID NO: 29669 - DNA, 103 bp, Artificial Sequence
  Synthetic Polynucleotide
taatacgactcactatagggatcaagttaaacatgtgaccaaccgcattaaacagaggagataatgcatgtggtcacataacctggcggcagcgcaaaagatg

SEQ ID NO: 29670 - DNA, 103 bp, Artificial Sequence
  Synthetic Polynucleotide
taatacgactcactataggggatcttataagaggctctctcaacataacaaacagaggagatgttatatggagagagccaacctggcggcagcgcaaaagatg

SEQ ID NO: 29671 - DNA, 103 bp, Artificial Sequence
  Synthetic Polynucleotide
taatacgactcactatagggtctctgatcttataagaggctctctcaacaaacagaggagatgttgaatgagcctcttaaacctggcggcagcgcaaaagatg

SEQ ID NO: 29672 - DNA, 103 bp, Artificial Sequence
  Synthetic Polynucleotide
taatacgactcactataggggaatatctctgatcttataagaggctctctaacagaggagaagagagatgcttataagaaacctggcggcagcgcaaaagatg

SEQ ID NO: 29673 - DNA, 103 bp, Artificial Sequence
  Synthetic Polynucleotide
taatacgactcactatagggatagagaatatctctgatcttataagaggcaacagaggagagcctctatgaagatcagaaacctggcggcagcgcaaaagatg

SEQ ID NO: 29674 - DNA, 103 bp, Artificial Sequence
  Synthetic Polynucleotide
taatacgactcactataggggagggatagagaatatctctgatcttataaaacagaggagattataaatgcagagatataacctggcggcagcgcaaaagatg

SEQ ID NO: 29675 - DNA, 103 bp, Artificial Sequence
  Synthetic Polynucleotide
taatacgactcactatagggcttctgagggatagagaatatctctgatctaacagaggagaagatcaatgatattctctaacctggcggcagcgcaaaagatg

SEQ ID NO: 29676 - DNA, 103 bp, Artificial Sequence
  Synthetic Polynucleotide
taatacgactcactatagggggaaccttctgagggatagagaatatctctaacagaggagaagagatatgctctatcccaacctggcggcagcgcaaaagatg

SEQ ID NO: 29677 - DNA, 103 bp, Artificial Sequence
  Synthetic Polynucleotide
taatacgactcactatagggctgcaggaaccttctgagggatagagaataaacagaggagatattctatgtccctcagaaacctggcggcagcgcaaaagatg

SEQ ID NO: 29678 - DNA, 103 bp, Artificial Sequence
  Synthetic Polynucleotide
taatacgactcactataggggtaagctgcaggaaccttctgagggatagaaacagaggagatctatcatgcagaaggttaacctggcggcagcgcaaaagatg

SEQ ID NO: 29679 - DNA, 103 bp, Artificial Sequence
  Synthetic Polynucleotide
taatacgactcactataggggtagggtaagctgcaggaaccttctgagggaacagaggagaccctcaatgggttcctgcaacctggcggcagcgcaaaagatg

SEQ ID NO: 29680 - DNA, 103 bp, Artificial Sequence
  Synthetic Polynucleotide
taatacgactcactatagggaatgtatcaagttaaacatgtgaccaaccgaacagaggagacggttgatgacatgtttaaacctggcggcagcgcaaaagatg

SEQ ID NO: 29681 - DNA, 103 bp, Artificial Sequence
  Synthetic Polynucleotide
taatacgactcactatagggttgttgtagggtaagctgcaggaaccttctaacagaggagaagaaggatgctgcagcttaacctggcggcagcgcaaaagatg

SEQ ID NO: 29682 - DNA, 103 bp, Artificial Sequence
  Synthetic Polynucleotide
taatacgactcactatagggtctcattgttgtagggtaagctgcaggaacaacagaggagagttcctatggcttaccctaacctggcggcagcgcaaaagatg

SEQ ID NO: 29683 - DNA, 103 bp, Artificial Sequence
  Synthetic Polynucleotide
taatacgactcactatagggccttctctcattgttgtagggtaagctgcaaacagaggagatgcagcatgccctacaacaacctggcggcagcgcaaaagatg

SEQ ID NO: 29684 - DNA, 103 bp, Artificial Sequence
  Synthetic Polynucleotide
taatacgactcactataggggattgccttctctcattgttgtagggtaagaacagaggagacttaccatgcaacaatgaaacctggcggcagcgcaaaagatg

SEQ ID NO: 29685 - DNA, 103 bp, Artificial Sequence
  Synthetic Polynucleotide
taatacgactcactatagggtgcccgattgccttctctcattgttgtaggaacagaggagacctacaatgatgagagaaaacctggcggcagcgcaaaagatg

SEQ ID NO: 29686 - DNA, 103 bp, Artificial Sequence
  Synthetic Polynucleotide
taatacgactcactatagggaagactgcccgattgccttctctcattgttaacagaggagaaacaatatgagaaggcaaaacctggcggcagcgcaaaagatg

SEQ ID NO: 29687 - DNA, 103 bp, Artificial Sequence
  Synthetic Polynucleotide
taatacgactcactataggggacttaagactgcccgattgccttctctcaaacagaggagatgagagatggcaatcgggaacctggcggcagcgcaaaagatg

SEQ ID NO: 29688 - DNA, 103 bp, Artificial Sequence
  Synthetic Polynucleotide
taatacgactcactatagggcaagtgacttaagactgcccgattgccttcaacagaggagagaaggcatgcgggcagtcaacctggcggcagcgcaaaagatg

SEQ ID NO: 29689 - DNA, 103 bp, Artificial Sequence
  Synthetic Polynucleotide
taatacgactcactatagggtattgcaagtgacttaagactgcccgattgaacagaggagacaatcgatgagtcttaagaacctggcggcagcgcaaaagatg

SEQ ID NO: 29690 - DNA, 103 bp, Artificial Sequence
  Synthetic Polynucleotide
taatacgactcactatagggacgtatattgcaagtgacttaagactgcccaacagaggagagggcagatgtaagtcactaacctggcggcagcgcaaaagatg

SEQ ID NO: 29691 - DNA, 103 bp, Artificial Sequence
  Synthetic Polynucleotide
taatacgactcactatagggcacaaaatgtatcaagttaaacatgtgaccaacagaggagaggtcacatgtttaacttgaacctggcggcagcgcaaaagatg

SEQ ID NO: 29692 - DNA, 103 bp, Artificial Sequence
  Synthetic Polynucleotide
taatacgactcactatagggtcttaacgtatattgcaagtgacttaagacaacagaggagagtcttaatgcacttgcaaaacctggcggcagcgcaaaagatg

SEQ ID NO: 29693 - DNA, 103 bp, Artificial Sequence
  Synthetic Polynucleotide
taatacgactcactatagggtcatatcttaacgtatattgcaagtgacttaacagaggagaaagtcaatggcaatatacaacctggcggcagcgcaaaagatg

SEQ ID NO: 29694 - DNA, 103 bp, Artificial Sequence
  Synthetic Polynucleotide
taatacgactcactatagggctttatcatatcttaacgtatattgcaagtaacagaggagaacttgcatgatacgttaaaacctggcggcagcgcaaaagatg

SEQ ID NO: 29695 - DNA, 103 bp, Artificial Sequence
  Synthetic Polynucleotide
taatacgactcactatagggactgtctttatcatatcttaacgtatattgaacagaggagacaatatatgttaagatataacctggcggcagcgcaaaagatg

SEQ ID NO: 29696 - DNA, 103 bp, Artificial Sequence
  Synthetic Polynucleotide
taatacgactcactatagggaccaaactgtctttatcatatcttaacgtaaacagaggagatacgttatgatatgataaaacctggcggcagcgcaaaagatg

SEQ ID NO: 29697 - DNA, 103 bp, Artificial Sequence
  Synthetic Polynucleotide
taatacgactcactatagggcatcaaccaaactgtctttatcatatcttaaacagaggagataagatatgataaagacaaacctggcggcagcgcaaaagatg

SEQ ID NO: 29698 - DNA, 103 bp, Artificial Sequence
  Synthetic Polynucleotide
taatacgactcactatagggagagccatcaaccaaactgtctttatcataaacagaggagatatgatatggacagtttgaacctggcggcagcgcaaaagatg

SEQ ID NO: 29699 - DNA, 103 bp, Artificial Sequence
  Synthetic Polynucleotide
taatacgactcactataggggatccagagccatcaaccaaactgtctttaaacagaggagataaagaatgtttggttgaaacctggcggcagcgcaaaagatg

SEQ ID NO: 29700 - DNA, 103 bp, Artificial Sequence
  Synthetic Polynucleotide
taatacgactcactatagggagtttgatccagagccatcaaccaaactgtaacagaggagaacagttatgttgatggctaacctggcggcagcgcaaaagatg

SEQ ID NO: 29701 - DNA, 103 bp, Artificial Sequence
  Synthetic Polynucleotide
taatacgactcactatagggcaaccagtttgatccagagccatcaaccaaaacagaggagattggttatgggctctggaaacctggcggcagcgcaaaagatg

SEQ ID NO: 29702 - DNA, 103 bp, Artificial Sequence
  Synthetic Polynucleotide
taatacgactcactatagggcaccccacaaaatgtatcaagttaaacatgaacagaggagacatgttatgcttgatacaaacctggcggcagcgcaaaagatg

SEQ ID NO: 29703 - DNA, 103 bp, Artificial Sequence
  Synthetic Polynucleotide
taatacgactcactatagggacccacaaccagtttgatccagagccatcaaacagaggagatgatggatgtggatcaaaaacctggcggcagcgcaaaagatg

SEQ ID NO: 29704 - DNA, 103 bp, Artificial Sequence
  Synthetic Polynucleotide
taatacgactcactatagggaaaacacccacaaccagtttgatccagagcaacagaggagagctctgatgcaaactggtaacctggcggcagcgcaaaagatg

SEQ ID NO: 29705 - DNA, 103 bp, Artificial Sequence
  Synthetic Polynucleotide
taatacgactcactataggggtcagaaaacacccacaaccagtttgatccaacagaggagaggatcaatgtggttgtggaacctggcggcagcgcaaaagatg

SEQ ID NO: 29706 - DNA, 103 bp, Artificial Sequence
  Synthetic Polynucleotide
taatacgactcactatagggctaaagtcagaaaacacccacaaccagtttaacagaggagaaaactgatggtgggtgttaacctggcggcagcgcaaaagatg

SEQ ID NO: 29707 - DNA, 103 bp, Artificial Sequence
  Synthetic Polynucleotide
taatacgactcactatagggaacttctaaagtcagaaaacacccacaaccaacagaggagaggttgtatgtgttttctgaacctggcggcagcgcaaaagatg

SEQ ID NO: 29708 - DNA, 103 bp, Artificial Sequence
  Synthetic Polynucleotide
taatacgactcactatagggcttagaacttctaaagtcagaaaacacccaaacagaggagatgggtgatgtctgactttaacctggcggcagcgcaaaagatg

SEQ ID NO: 29709 - DNA, 103 bp, Artificial Sequence
  Synthetic Polynucleotide
taatacgactcactataggggtcatcttagaacttctaaagtcagaaaacaacagaggagagttttcatgctttagaagaacctggcggcagcgcaaaagatg

SEQ ID NO: 29710 - DNA, 103 bp, Artificial Sequence
  Synthetic Polynucleotide
taatacgactcactatagggggtatgtcatcttagaacttctaaagtcagaacagaggagactgactatggaagttctaaacctggcggcagcgcaaaagatg

SEQ ID NO: 29711 - DNA, 103 bp, Artificial Sequence
  Synthetic Polynucleotide
taatacgactcactatagggtgtcaggtatgtcatcttagaacttctaaaaacagaggagatttagaatgtctaagatgaacctggcggcagcgcaaaagatg

SEQ ID NO: 29712 - DNA, 103 bp, Artificial Sequence
  Synthetic Polynucleotide
taatacgactcactatagggatcaatgtcaggtatgtcatcttagaacttaacagaggagaaagttcatggatgacataaacctggcggcagcgcaaaagatg

SEQ ID NO: 29713 - DNA, 103 bp, Artificial Sequence
  Synthetic Polynucleotide
taatacgactcactatagggccttctctgtcttctggtttttagctgttaaacagaggagataacagatgaaaaccagaaacctggcggcagcgcaaaagatg

SEQ ID NO: 29714 - DNA, 103 bp, Artificial Sequence
  Synthetic Polynucleotide
taatacgactcactataggggtctcaacacgacaatttccttccgagactaacagaggagaagtctcatgaggaaattgaacctggcggcagcgcaaaagatg

SEQ ID NO: 29715 - DNA, 103 bp, Artificial Sequence
  Synthetic Polynucleotide
taatacgactcactatagggtgtagcaccccacaaaatgtatcaagttaaaacagaggagattaactatgtacattttgaacctggcggcagcgcaaaagatg

SEQ ID NO: 29716 - DNA, 103 bp, Artificial Sequence
  Synthetic Polynucleotide
taatacgactcactatagggatgtgatcaatgtcaggtatgtcatcttagaacagaggagactaagaatgcatacctgaaacctggcggcagcgcaaaagatg

SEQ ID NO: 29717 - DNA, 103 bp, Artificial Sequence
  Synthetic Polynucleotide
taatacgactcactatagggctgatatgtgatcaatgtcaggtatgtcataacagaggagaatgacaatgctgacattgaacctggcggcagcgcaaaagatg

SEQ ID NO: 29718 - DNA, 103 bp, Artificial Sequence
  Synthetic Polynucleotide
taatacgactcactatagggtgagtctgatatgtgatcaatgtcaggtataacagaggagaatacctatgattgatcacaacctggcggcagcgcaaaagatg

SEQ ID NO: 29719 - DNA, 103 bp, Artificial Sequence
  Synthetic Polynucleotide
taatacgactcactatagggacagatgagtctgatatgtgatcaatgtcaaacagaggagatgacatatgtcacatatcaacctggcggcagcgcaaaagatg

SEQ ID NO: 29720 - DNA, 103 bp, Artificial Sequence
  Synthetic Polynucleotide
taatacgactcactatagggcaataacagatgagtctgatatgtgatcaaaacagaggagattgatcatgtatcagactaacctggcggcagcgcaaaagatg

SEQ ID NO: 29721 - DNA, 103 bp, Artificial Sequence
  Synthetic Polynucleotide
taatacgactcactatagggttttgcaataacagatgagtctgatatgtgaacagaggagacacataatggactcatctaacctggcggcagcgcaaaagatg

SEQ ID NO: 29722 - DNA, 103 bp, Artificial Sequence
  Synthetic Polynucleotide
taatacgactcactatagggctaccttttgcaataacagatgagtctgataacagaggagaatcagaatgatctgttataacctggcggcagcgcaaaagatg

SEQ ID NO: 29723 - DNA, 103 bp, Artificial Sequence
  Synthetic Polynucleotide
taatacgactcactatagggctttcctaccttttgcaataacagatgagtaacagaggagaactcatatgttattgcaaaacctggcggcagcgcaaaagatg

SEQ ID NO: 29724 - DNA, 103 bp, Artificial Sequence
  Synthetic Polynucleotide
taatacgactcactatagggaggttctttcctaccttttgcaataacagaaacagaggagatctgttatggcaaaaggtaacctggcggcagcgcaaaagatg

SEQ ID NO: 29725 - DNA, 103 bp, Artificial Sequence
  Synthetic Polynucleotide
taatacgactcactatagggtagacaggttctttcctaccttttgcaataaacagaggagatattgcatgaggtaggaaaacctggcggcagcgcaaaagatg

SEQ ID NO: 29726 - DNA, 103 bp, Artificial Sequence
  Synthetic Polynucleotide
taatacgactcactatagggacccatgtagcaccccacaaaatgtatcaaaacagaggagattgataatgtttgtggggaacctggcggcagcgcaaaagatg

SEQ ID NO: 29727 - DNA, 103 bp, Artificial Sequence
  Synthetic Polynucleotide
taatacgactcactatagggtttcttagacaggttctttcctaccttttgaacagaggagacaaaagatgggaaagaacaacctggcggcagcgcaaaagatg

SEQ ID NO: 29728 - DNA, 103 bp, Artificial Sequence
  Synthetic Polynucleotide
taatacgactcactatagggttcattttcttagacaggttctttcctaccaacagaggagaggtaggatggaacctgtcaacctggcggcagcgcaaaagatg

SEQ ID NO: 29729 - DNA, 103 bp, Artificial Sequence
  Synthetic Polynucleotide
taatacgactcactatagggcagatttcattttcttagacaggttctttcaacagaggagagaaagaatgtgtctaagaaacctggcggcagcgcaaaagatg

SEQ ID NO: 29730 - DNA, 103 bp, Artificial Sequence
  Synthetic Polynucleotide
taatacgactcactataggggagatcagatttcattttcttagacaggttaacagaggagaaacctgatgaagaaaatgaacctggcggcagcgcaaaagatg

SEQ ID NO: 29731 - DNA, 103 bp, Artificial Sequence
  Synthetic Polynucleotide
taatacgactcactatagggtgtctgagatcagatttcattttcttagacaacagaggagagtctaaatgaatgaaatcaacctggcggcagcgcaaaagatg

SEQ ID NO: 29732 - DNA, 103 bp, Artificial Sequence
  Synthetic Polynucleotide
taatacgactcactatagggtaagctgtctgagatcagatttcattttctaacagaggagaagaaaaatgaatctgatcaacctggcggcagcgcaaaagatg

SEQ ID NO: 29733 - DNA, 103 bp, Artificial Sequence
  Synthetic Polynucleotide
taatacgactcactatagggagagctaagctgtctgagatcagatttcataacagaggagaatgaaaatggatctcagaaacctggcggcagcgcaaaagatg

SEQ ID NO: 29734 - DNA, 103 bp, Artificial Sequence
  Synthetic Polynucleotide
taatacgactcactatagggatgagagagctaagctgtctgagatcagataacagaggagaatctgaatgcagacagctaacctggcggcagcgcaaaagatg

SEQ ID NO: 29735 - DNA, 103 bp, Artificial Sequence
  Synthetic Polynucleotide
taatacgactcactataggggtctcatgagagagctaagctgtctgagataacagaggagaatctcaatgagcttagctaacctggcggcagcgcaaaagatg

SEQ ID NO: 29736 - DNA, 103 bp, Artificial Sequence
  Synthetic Polynucleotide
taatacgactcactatagggtacttgtctcatgagagagctaagctgtctaacagaggagaagacagatgagctctctcaacctggcggcagcgcaaaagatg

SEQ ID NO: 29737 - DNA, 103 bp, Artificial Sequence
  Synthetic Polynucleotide
taatacgactcactatagggatctgacccatgtagcaccccacaaaatgtaacagaggagaacatttatgggggtgctaaacctggcggcagcgcaaaagatg

SEQ ID NO: 29738 - DNA, 103 bp, Artificial Sequence
  Synthetic Polynucleotide
taatacgactcactatagggcccagtacttgtctcatgagagagctaagcaacagaggagagcttagatgtctcatgagaacctggcggcagcgcaaaagatg

SEQ ID NO: 29739 - DNA, 103 bp, Artificial Sequence
  Synthetic Polynucleotide
taatacgactcactatagggggcctcccagtacttgtctcatgagagagcaacagaggagagctctcatgtgagacaagaacctggcggcagcgcaaaagatg

SEQ ID NO: 29740 - DNA, 103 bp, Artificial Sequence
  Synthetic Polynucleotide
taatacgactcactatagggtgactggcctcccagtacttgtctcatgagaacagaggagactcatgatgcaagtactgaacctggcggcagcgcaaaagatg

SEQ ID NO: 29741 - DNA, 103 bp, Artificial Sequence
  Synthetic Polynucleotide
taatacgactcactatagggatatctgactggcctcccagtacttgtctcaacagaggagagagacaatgactgggaggaacctggcggcagcgcaaaagatg

SEQ ID NO: 29742 - DNA, 103 bp, Artificial Sequence
  Synthetic Polynucleotide
taatacgactcactatagggttgacatatctgactggcctcccagtacttaacagaggagaaagtacatggaggccagtaacctggcggcagcgcaaaagatg

SEQ ID NO: 29743 - DNA, 103 bp, Artificial Sequence
  Synthetic Polynucleotide
taatacgactcactatagggtttcattgacatatctgactggcctcccagaacagaggagactgggaatgcagtcagataacctggcggcagcgcaaaagatg

SEQ ID NO: 29744 - DNA, 103 bp, Artificial Sequence
  Synthetic Polynucleotide
taatacgactcactatagggacatctttcattgacatatctgactggcctaacagaggagaaggccaatgagatatgtcaacctggcggcagcgcaaaagatg

SEQ ID NO: 29745 - DNA, 103 bp, Artificial Sequence
  Synthetic Polynucleotide
taatacgactcactatagggtgtccacatctttcattgacatatctgactaacagaggagaagtcagatgtgtcaatgaaacctggcggcagcgcaaaagatg

SEQ ID NO: 29746 - DNA, 103 bp, Artificial Sequence
  Synthetic Polynucleotide
taatacgactcactatagggatcaatgtccacatctttcattgacatatcaacagaggagagatatgatgatgaaagataacctggcggcagcgcaaaagatg

SEQ ID NO: 29747 - DNA, 103 bp, Artificial Sequence
  Synthetic Polynucleotide
taatacgactcactatagggctttgatcaatgtccacatctttcattgacaacagaggagagtcaatatgagatgtggaaacctggcggcagcgcaaaagatg

SEQ ID NO: 29748 - DNA, 103 bp, Artificial Sequence
  Synthetic Polynucleotide
taatacgactcactatagggatctgatctgacccatgtagcaccccacaaaacagaggagattgtggatggctacatggaacctggcggcagcgcaaaagatg

SEQ ID NO: 29749 - DNA, 103 bp, Artificial Sequence
  Synthetic Polynucleotide
taatacgactcactatagggtgactctttgatcaatgtccacatctttcaaacagaggagatgaaagatgtggacattgaacctggcggcagcgcaaaagatg

SEQ ID NO: 29750 - DNA, 103 bp, Artificial Sequence
  Synthetic Polynucleotide
taatacgactcactatagggacatatgactctttgatcaatgtccacatcaacagaggagagatgtgatgattgatcaaaacctggcggcagcgcaaaagatg

SEQ ID NO: 29751 - DNA, 103 bp, Artificial Sequence
  Synthetic Polynucleotide
taatacgactcactataggggcatcacatatgactctttgatcaatgtccaacagaggagaggacatatgtcaaagagtaacctggcggcagcgcaaaagatg

SEQ ID NO: 29752 - DNA, 103 bp, Artificial Sequence
  Synthetic Polynucleotide
taatacgactcactatagggggatagcatcacatatgactctttgatcaaaacagaggagattgatcatggagtcatataacctggcggcagcgcaaaagatg

SEQ ID NO: 29753 - DNA, 103 bp, Artificial Sequence
  Synthetic Polynucleotide
taatacgactcactatagggtctgtggatagcatcacatatgactctttgaacagaggagacaaagaatgatatgtgataacctggcggcagcgcaaaagatg

SEQ ID NO: 29754 - DNA, 103 bp, Artificial Sequence
  Synthetic Polynucleotide
taatacgactcactatagggttcactctgtggatagcatcacatatgactaacagaggagaagtcatatgtgatgctataacctggcggcagcgcaaaagatg

SEQ ID NO: 29755 - DNA, 103 bp, Artificial Sequence
  Synthetic Polynucleotide
taatacgactcactatagggtccatttcactctgtggatagcatcacataaacagaggagatatgtgatgctatccacaaacctggcggcagcgcaaaagatg

SEQ ID NO: 29756 - DNA, 103 bp, Artificial Sequence
  Synthetic Polynucleotide
taatacgactcactatagggatcgatccatttcactctgtggatagcatcaacagaggagagatgctatgcacagagtgaacctggcggcagcgcaaaagatg

SEQ ID NO: 29757 - DNA, 103 bp, Artificial Sequence
  Synthetic Polynucleotide
taatacgactcactatagggtcttgatcgatccatttcactctgtggataaacagaggagatatccaatgagtgaaatgaacctggcggcagcgcaaaagatg

SEQ ID NO: 29758 - DNA, 103 bp, Artificial Sequence
  Synthetic Polynucleotide
taatacgactcactatagggtgacttcttgatcgatccatttcactctgtaacagaggagaacagagatgaatggatcgaacctggcggcagcgcaaaagatg

SEQ ID NO: 29759 - DNA, 103 bp, Artificial Sequence
  Synthetic Polynucleotide
taatacgactcactatagggtagagatctgatctgacccatgtagcacccaacagaggagagggtgcatgatgggtcagaacctggcggcagcgcaaaagatg

SEQ ID NO: 29760 - DNA, 103 bp, Artificial Sequence
  Synthetic Polynucleotide
taatacgactcactatagggatgtctgacttcttgatcgatccatttcacaacagaggagagtgaaaatgatcgatcaaaacctggcggcagcgcaaaagatg

SEQ ID NO: 29761 - DNA, 103 bp, Artificial Sequence
  Synthetic Polynucleotide
taatacgactcactataggggctgcatgtctgacttcttgatcgatccataacagaggagaatggatatgtcaagaagtaacctggcggcagcgcaaaagatg

SEQ ID NO: 29762 - DNA, 103 bp, Artificial Sequence
  Synthetic Polynucleotide
taatacgactcactatagggctttggctgcatgtctgacttcttgatcgaaacagaggagatcgatcatgaagtcagacaacctggcggcagcgcaaaagatg

SEQ ID NO: 29763 - DNA, 103 bp, Artificial Sequence
  Synthetic Polynucleotide
taatacgactcactatagggcagttctttggctgcatgtctgacttcttgaacagaggagacaagaaatgagacatgcaaacctggcggcagcgcaaaagatg

SEQ ID NO: 29764 - DNA, 103 bp, Artificial Sequence
  Synthetic Polynucleotide
taatacgactcactatagggctatgcagttctttggctgcatgtctgactaacagaggagaagtcagatgtgcagccaaaacctggcggcagcgcaaaagatg

SEQ ID NO: 29765 - DNA, 103 bp, Artificial Sequence
  Synthetic Polynucleotide
taatacgactcactatagggcagatctatgcagttctttggctgcatgtcaacagaggagagacatgatgccaaagaacaacctggcggcagcgcaaaagatg

SEQ ID NO: 29766 - DNA, 103 bp, Artificial Sequence
  Synthetic Polynucleotide
taatacgactcactataggggtcttcagatctatgcagttctttggctgcaacagaggagagcagccatggaactgcataacctggcggcagcgcaaaagatg

SEQ ID NO: 29767 - DNA, 103 bp, Artificial Sequence
  Synthetic Polynucleotide
taatacgactcactatagggggcgagtcttcagatctatgcagttctttgaacagaggagacaaagaatggcatagatcaacctggcggcagcgcaaaagatg

SEQ ID NO: 29768 - DNA, 103 bp, Artificial Sequence
  Synthetic Polynucleotide
taatacgactcactatagggatgatggcgagtcttcagatctatgcagttaacagaggagaaactgcatggatctgaagaacctggcggcagcgcaaaagatg

SEQ ID NO: 29769 - DNA, 103 bp, Artificial Sequence
  Synthetic Polynucleotide
taatacgactcactataggggactgatgatggcgagtcttcagatctatgaacagaggagacatagaatggaagactcgaacctggcggcagcgcaaaagatg

SEQ ID NO: 29770 - DNA, 103 bp, Artificial Sequence
  Synthetic Polynucleotide
taatacgactcactataggggcatttagagatctgatctgacccatgtagaacagaggagactacatatgtcagatcagaacctggcggcagcgcaaaagatg

SEQ ID NO: 29771 - DNA, 103 bp, Artificial Sequence
  Synthetic Polynucleotide
taatacgactcactatagggctgaagactgatgatggcgagtcttcagataacagaggagaatctgaatgctcgccatcaacctggcggcagcgcaaaagatg

SEQ ID NO: 29772 - DNA, 103 bp, Artificial Sequence
  Synthetic Polynucleotide
taatacgactcactatagggatctcctgaagactgatgatggcgagtcttaacagaggagaaagactatgcatcatcagaacctggcggcagcgcaaaagatg

SEQ ID NO: 29773 - DNA, 103 bp, Artificial Sequence
  Synthetic Polynucleotide
taatacgactcactatagggactagatctcctgaagactgatgatggcgaaacagaggagatcgccaatgtcagtcttcaacctggcggcagcgcaaaagatg

SEQ ID NO: 29774 - DNA, 103 bp, Artificial Sequence
  Synthetic Polynucleotide
taatacgactcactataggggattgactagatctcctgaagactgatgataacagaggagaatcatcatgcttcaggagaacctggcggcagcgcaaaagatg

SEQ ID NO: 29775 - DNA, 103 bp, Artificial Sequence
  Synthetic Polynucleotide
taatacgactcactatagggattcagattgactagatctcctgaagactgaacagaggagacagtctatgggagatctaaacctggcggcagcgcaaaagatg

SEQ ID NO: 29776 - DNA, 103 bp, Artificial Sequence
  Synthetic Polynucleotide
taatacgactcactatagggaacccattcagattgactagatctcctgaaaacagaggagattcaggatgtctagtcaaaacctggcggcagcgcaaaagatg

SEQ ID NO: 29777 - DNA, 103 bp, Artificial Sequence
  Synthetic Polynucleotide
taatacgactcactataggggaacaaacccattcagattgactagatctcaacagaggagagagatcatgtcaatctgaaacctggcggcagcgcaaaagatg

SEQ ID NO: 29778 - DNA, 103 bp, Artificial Sequence
  Synthetic Polynucleotide
taatacgactcactataggggagaagaacaaacccattcagattgactagaacagaggagactagtcatgctgaatgggaacctggcggcagcgcaaaagatg

SEQ ID NO: 29779 - DNA, 103 bp, Artificial Sequence
  Synthetic Polynucleotide
taatacgactcactatagggctgttgagaagaacaaacccattcagattgaacagaggagacaatctatgtgggtttgtaacctggcggcagcgcaaaagatg

SEQ ID NO: 29780 - DNA, 103 bp, Artificial Sequence
  Synthetic Polynucleotide
taatacgactcactataggggctaactgttgagaagaacaaacccattcaaacagaggagatgaatgatgttgttcttcaacctggcggcagcgcaaaagatg

SEQ ID NO: 29781 - DNA, 103 bp, Artificial Sequence
  Synthetic Polynucleotide
taatacgactcactatagggcagttgcatttagagatctgatctgacccaaacagaggagatgggtcatgtcagatctcaacctggcggcagcgcaaaagatg

SEQ ID NO: 29782 - DNA, 103 bp, Artificial Sequence
  Synthetic Polynucleotide
taatacgactcactatagggtgatggctaactgttgagaagaacaaacccaacagaggagagggtttatgcttctcaacaacctggcggcagcgcaaaagatg

SEQ ID NO: 29783 - DNA, 103 bp, Artificial Sequence
  Synthetic Polynucleotide
taatacgactcactatagggagtcgtgatggctaactgttgagaagaacaaacagaggagatgttctatgcaacagttaaacctggcggcagcgcaaaagatg

SEQ ID NO: 29784 - DNA, 103 bp, Artificial Sequence
  Synthetic Polynucleotide
taatacgactcactataggggcagaagtcgtgatggctaactgttgagaaaacagaggagattctcaatggttagccataacctggcggcagcgcaaaagatg

SEQ ID NO: 29785 - DNA, 103 bp, Artificial Sequence
  Synthetic Polynucleotide
taatacgactcactatagggggttggcagaagtcgtgatggctaactgttaacagaggagaaacagtatgccatcacgaaacctggcggcagcgcaaaagatg

SEQ ID NO: 29786 - DNA, 103 bp, Artificial Sequence
  Synthetic Polynucleotide
taatacgactcactatagggagaggggttggcagaagtcgtgatggctaaaacagaggagattagccatgacgacttctaacctggcggcagcgcaaaagatg

SEQ ID NO: 29787 - DNA, 103 bp, Artificial Sequence
  Synthetic Polynucleotide
taatacgactcactatagggggatgagaggggttggcagaagtcgtgatgaacagaggagacatcacatgttctgccaaaacctggcggcagcgcaaaagatg

SEQ ID NO: 29788 - DNA, 103 bp, Artificial Sequence
  Synthetic Polynucleotide
taatacgactcactataggggagacggatgagaggggttggcagaagtcgaacagaggagacgacttatgccaacccctaacctggcggcagcgcaaaagatg

SEQ ID NO: 29789 - DNA, 103 bp, Artificial Sequence
  Synthetic Polynucleotide
taatacgactcactatagggtatgggagacggatgagaggggttggcagaaacagaggagatctgccatgccctctcataacctggcggcagcgcaaaagatg

SEQ ID NO: 29790 - DNA, 103 bp, Artificial Sequence
  Synthetic Polynucleotide
taatacgactcactatagggacatctatgggagacggatgagaggggttgaacagaggagacaacccatgtcatccgtcaacctggcggcagcgcaaaagatg

SEQ ID NO: 29791 - DNA, 103 bp, Artificial Sequence
  Synthetic Polynucleotide
taatacgactcactatagggccttgacatctatgggagacggatgagaggaacagaggagacctctcatgcgtctcccaaacctggcggcagcgcaaaagatg

SEQ ID NO: 29792 - DNA, 103 bp, Artificial Sequence
  Synthetic Polynucleotide
taatacgactcactatagggaatgacagttgcatttagagatctgatctgaacagaggagacagatcatgtctctaaataacctggcggcagcgcaaaagatg

SEQ ID NO: 29793 - DNA, 103 bp, Artificial Sequence
  Synthetic Polynucleotide
taatacgactcactataggggattgccttgacatctatgggagacggatgaacagaggagacatccgatgcccatagataacctggcggcagcgcaaaagatg

SEQ ID NO: 29794 - DNA, 103 bp, Artificial Sequence
  Synthetic Polynucleotide
taatacgactcactatagggttgctgattgccttgacatctatgggagacaacagaggagagtctccatgagatgtcaaaacctggcggcagcgcaaaagatg

SEQ ID NO: 29795 - DNA, 103 bp, Artificial Sequence
  Synthetic Polynucleotide
taatacgactcactatagggactttttgctgattgccttgacatctatggaacagaggagaccatagatgtcaaggcaaaacctggcggcagcgcaaaagatg

SEQ ID NO: 29796 - DNA, 103 bp, Artificial Sequence
  Synthetic Polynucleotide
taatacgactcactatagggttgtaactttttgctgattgccttgacatcaacagaggagagatgtcatggcaatcagcaacctggcggcagcgcaaaagatg

SEQ ID NO: 29797 - DNA, 103 bp, Artificial Sequence
  Synthetic Polynucleotide
taatacgactcactatagggggattttgtaactttttgctgattgccttgaacagaggagacaaggcatgcagcaaaaaaacctggcggcagcgcaaaagatg

SEQ ID NO: 29798 - DNA, 103 bp, Artificial Sequence
  Synthetic Polynucleotide
taatacgactcactatagggtcagaggattttgtaactttttgctgattgaacagaggagacaatcaatgaaaagttacaacctggcggcagcgcaaaagatg

SEQ ID NO: 29799 - DNA, 103 bp, Artificial Sequence
  Synthetic Polynucleotide
taatacgactcactatagggagatatcagaggattttgtaactttttgctaacagaggagaagcaaaatgttacaaaataacctggcggcagcgcaaaagatg

SEQ ID NO: 29800 - DNA, 103 bp, Artificial Sequence
  Synthetic Polynucleotide
taatacgactcactatagggagtccagatatcagaggattttgtaactttaacagaggagaaaagttatgaaatcctctaacctggcggcagcgcaaaagatg

SEQ ID NO: 29801 - DNA, 103 bp, Artificial Sequence
  Synthetic Polynucleotide
taatacgactcactatagggccctcagtccagatatcagaggattttgtaaacagaggagatacaaaatgctctgatataacctggcggcagcgcaaaagatg

SEQ ID NO: 29802 - DNA, 103 bp, Artificial Sequence
  Synthetic Polynucleotide
taatacgactcactatagggcactaccctcagtccagatatcagaggattaacagaggagaaatcctatgatatctggaaacctggcggcagcgcaaaagatg

SEQ ID NO: 29803 - DNA, 103 bp, Artificial Sequence
  Synthetic Polynucleotide
taatacgactcactataggggtctgaatgacagttgcatttagagatctgaacagaggagacagatcatgaaatgcaacaacctggcggcagcgcaaaagatg

SEQ ID NO: 29804 - DNA, 103 bp, Artificial Sequence
  Synthetic Polynucleotide
taatacgactcactatagggcactgcactaccctcagtccagatatcagaaacagaggagatctgatatgtggactgagaacctggcggcagcgcaaaagatg

SEQ ID NO: 29805 - DNA, 103 bp, Artificial Sequence
  Synthetic Polynucleotide
taatacgactcactatagggtagcccactgcactaccctcagtccagataaacagaggagatatctgatgtgagggtagaacctggcggcagcgcaaaagatg

SEQ ID NO: 29806 - DNA, 103 bp, Artificial Sequence
  Synthetic Polynucleotide
taatacgactcactatagggtcctgtagcccactgcactaccctcagtccaacagaggagaggactgatggtagtgcagaacctggcggcagcgcaaaagatg

SEQ ID NO: 29807 - DNA, 103 bp, Artificial Sequence
  Synthetic Polynucleotide
taatacgactcactatagggtgtgctcctgtagcccactgcactaccctcaacagaggagagagggtatggcagtgggcaacctggcggcagcgcaaaagatg

SEQ ID NO: 29808 - DNA, 103 bp, Artificial Sequence
  Synthetic Polynucleotide
taatacgactcactatagggtataatgtgctcctgtagcccactgcactaaacagaggagatagtgcatggggctacagaacctggcggcagcgcaaaagatg

SEQ ID NO: 29809 - DNA, 103 bp, Artificial Sequence
  Synthetic Polynucleotide
taatacgactcactatagggtattttataatgtgctcctgtagcccactgaacagaggagacagtggatgacaggagcaaacctggcggcagcgcaaaagatg

SEQ ID NO: 29810 - DNA, 103 bp, Artificial Sequence
  Synthetic Polynucleotide
taatacgactcactatagggggctttattttataatgtgctcctgtagccaacagaggagaggctacatgagcacattaaacctggcggcagcgcaaaagatg

SEQ ID NO: 29811 - DNA, 103 bp, Artificial Sequence
  Synthetic Polynucleotide
taatacgactcactataggggtataggctttattttataatgtgctcctgaacagaggagacaggagatgattataaaaaacctggcggcagcgcaaaagatg

SEQ ID NO: 29812 - DNA, 103 bp, Artificial Sequence
  Synthetic Polynucleotide
taatacgactcactatagggattcagtataggctttattttataatgtgcaacagaggagagcacatatgaaaataaagaacctggcggcagcgcaaaagatg

SEQ ID NO: 29813 - DNA, 103 bp, Artificial Sequence
  Synthetic Polynucleotide
taatacgactcactatagggaaagaattcagtataggctttattttataaaacagaggagattataaatgaaagcctataacctggcggcagcgcaaaagatg

SEQ ID NO: 29814 - DNA, 103 bp, Artificial Sequence
  Synthetic Polynucleotide
taatacgactcactatagggcacatgtctgaatgacagttgcatttagagaacagaggagactctaaatgcaactgtcaaacctggcggcagcgcaaaagatg

SEQ ID NO: 29815 - DNA, 103 bp, Artificial Sequence
  Synthetic Polynucleotide
taatacgactcactatagggattgcaaagaattcagtataggctttatttaacagaggagaaaataaatgctatactgaaacctggcggcagcgcaaaagatg

SEQ ID NO: 29816 - DNA, 103 bp, Artificial Sequence
  Synthetic Polynucleotide
taatacgactcactatagggttcaaattgcaaagaattcagtataggcttaacagaggagaaagcctatgctgaattctaacctggcggcagcgcaaaagatg

SEQ ID NO: 29817 - DNA, 103 bp, Artificial Sequence
  Synthetic Polynucleotide
taatacgactcactatagggtttggttcaaattgcaaagaattcagtataaacagaggagatatactatgttctttgcaaacctggcggcagcgcaaaagatg

SEQ ID NO: 29818 - DNA, 103 bp, Artificial Sequence
  Synthetic Polynucleotide
taatacgactcactatagggaaagctttggttcaaattgcaaagaattcaaacagaggagatgaattatgtgcaatttgaacctggcggcagcgcaaaagatg

SEQ ID NO: 29819 - DNA, 103 bp, Artificial Sequence
  Synthetic Polynucleotide
taatacgactcactatagggcaaacaaagctttggttcaaattgcaaagaaacagaggagatctttgatgtttgaaccaaacctggcggcagcgcaaaagatg

SEQ ID NO: 29820 - DNA, 103 bp, Artificial Sequence
  Synthetic Polynucleotide
taatacgactcactatagggaccaccaaacaaagctttggttcaaattgcaacagaggagagcaattatgaccaaagctaacctggcggcagcgcaaaagatg

SEQ ID NO: 29821 - DNA, 103 bp, Artificial Sequence
  Synthetic Polynucleotide
taatacgactcactatagggctccgaccaccaaacaaagctttggttcaaaacagaggagattgaacatgagctttgttaacctggcggcagcgcaaaagatg

SEQ ID NO: 29822 - DNA, 103 bp, Artificial Sequence
  Synthetic Polynucleotide
taatacgactcactatagggcccatctccgaccaccaaacaaagctttggaacagaggagaccaaagatgtgtttggtgaacctggcggcagcgcaaaagatg

SEQ ID NO: 29823 - DNA, 103 bp, Artificial Sequence
  Synthetic Polynucleotide
taatacgactcactatagggcctgacccatctccgaccaccaaacaaagcaacagaggagagctttgatgggtggtcggaacctggcggcagcgcaaaagatg

SEQ ID NO: 29824 - DNA, 103 bp, Artificial Sequence
  Synthetic Polynucleotide
taatacgactcactatagggttcctcctgacccatctccgaccaccaaacaacagaggagagtttggatgtcggagatgaacctggcggcagcgcaaaagatg

SEQ ID NO: 29825 - DNA, 103 bp, Artificial Sequence
  Synthetic Polynucleotide
taatacgactcactatagggctctggtctcaacacgacaatttccttccgaacagaggagacggaagatgattgtcgtgaacctggcggcagcgcaaaagatg

SEQ ID NO: 29826 - DNA, 103 bp, Artificial Sequence
  Synthetic Polynucleotide
taatacgactcactatagggaggtgcacatgtctgaatgacagttgcattaacagaggagaaatgcaatggtcattcagaacctggcggcagcgcaaaagatg

SEQ ID NO: 29827 - DNA, 103 bp, Artificial Sequence
  Synthetic Polynucleotide
taatacgactcactatagggagatattcctcctgacccatctccgaccacaacagaggagagtggtcatggatgggtcaaacctggcggcagcgcaaaagatg

SEQ ID NO: 29828 - DNA, 103 bp, Artificial Sequence
  Synthetic Polynucleotide
taatacgactcactatagggcatctagatattcctcctgacccatctccgaacagaggagacggagaatggtcaggaggaacctggcggcagcgcaaaagatg

SEQ ID NO: 29829 - DNA, 103 bp, Artificial Sequence
  Synthetic Polynucleotide
taatacgactcactatagggaaatacatctagatattcctcctgacccataacagaggagaatgggtatggaggaatataacctggcggcagcgcaaaagatg

SEQ ID NO: 29830 - DNA, 103 bp, Artificial Sequence
  Synthetic Polynucleotide
taatacgactcactatagggttgtaaaatacatctagatattcctcctgaaacagaggagatcaggaatgatatctagaaacctggcggcagcgcaaaagatg

SEQ ID NO: 29831 - DNA, 103 bp, Artificial Sequence
  Synthetic Polynucleotide
taatacgactcactatagggaaaaattgtaaaatacatctagatattcctaacagaggagaaggaatatgtagatgtataacctggcggcagcgcaaaagatg

SEQ ID NO: 29832 - DNA, 103 bp, Artificial Sequence
  Synthetic Polynucleotide
taatacgactcactatagggcggggaaaaattgtaaaatacatctagataaacagaggagatatctaatggtattttacaacctggcggcagcgcaaaagatg

SEQ ID NO: 29833 - DNA, 103 bp, Artificial Sequence
  Synthetic Polynucleotide
taatacgactcactatagggggttccggggaaaaattgtaaaatacatctaacagaggagaagatgtatgttacaatttaacctggcggcagcgcaaaagatg

SEQ ID NO: 29834 - DNA, 103 bp, Artificial Sequence
  Synthetic Polynucleotide
taatacgactcactatagggagcttggttccggggaaaaattgtaaaataaacagaggagatattttatgatttttcccaacctggcggcagcgcaaaagatg

SEQ ID NO: 29835 - DNA, 103 bp, Artificial Sequence
  Synthetic Polynucleotide
taatacgactcactatagggagacaagcttggttccggggaaaaattgtaaacagaggagatacaatatgtccccggaaaacctggcggcagcgcaaaagatg

SEQ ID NO: 29836 - DNA, 103 bp, Artificial Sequence
  Synthetic Polynucleotide
taatacgactcactataggggttaaagacaagcttggttccggggaaaaaaacagaggagatttttcatgggaaccaagaacctggcggcagcgcaaaagatg

SEQ ID NO: 29837 - DNA, 103 bp, Artificial Sequence
  Synthetic Polynucleotide
taatacgactcactatagggtcatgaggtgcacatgtctgaatgacagttaacagaggagaaactgtatgtcagacatgaacctggcggcagcgcaaaagatg

SEQ ID NO: 29838 - DNA, 103 bp, Artificial Sequence
  Synthetic Polynucleotide
taatacgactcactatagggaggctgttaaagacaagcttggttccggggaacagaggagaccccggatgcaagcttgtaacctggcggcagcgcaaaagatg

SEQ ID NO: 29839 - DNA, 103 bp, Artificial Sequence
  Synthetic Polynucleotide
taatacgactcactatagggggagaaggctgttaaagacaagcttggttcaacagaggagagaaccaatgttgtctttaaacctggcggcagcgcaaaagatg

SEQ ID NO: 29840 - DNA, 103 bp, Artificial Sequence
  Synthetic Polynucleotide
taatacgactcactatagggtagctggagaaggctgttaaagacaagcttaacagaggagaaagcttatgtttaacagcaacctggcggcagcgcaaaagatg

SEQ ID NO: 29841 - DNA, 103 bp, Artificial Sequence
  Synthetic Polynucleotide
taatacgactcactatagggtcgtttagctggagaaggctgttaaagacaaacagaggagatgtcttatgcagccttctaacctggcggcagcgcaaaagatg

SEQ ID NO: 29842 - DNA, 103 bp, Artificial Sequence
  Synthetic Polynucleotide
taatacgactcactatagggtcatgtcgtttagctggagaaggctgttaaaacagaggagattaacaatgttctccagcaacctggcggcagcgcaaaagatg

SEQ ID NO: 29843 - DNA, 103 bp, Artificial Sequence
  Synthetic Polynucleotide
taatacgactcactatagggagccatcatgtcgtttagctggagaaggctaacagaggagaagccttatgcagctaaacaacctggcggcagcgcaaaagatg

SEQ ID NO: 29844 - DNA, 103 bp, Artificial Sequence
  Synthetic Polynucleotide
taatacgactcactatagggccagaagccatcatgtcgtttagctggagaaacagaggagatctccaatgaaacgacataacctggcggcagcgcaaaagatg

SEQ ID NO: 29845 - DNA, 103 bp, Artificial Sequence
  Synthetic Polynucleotide
taatacgactcactataggggtgtcccagaagccatcatgtcgtttagctaacagaggagaagctaaatgacatgatggaacctggcggcagcgcaaaagatg

SEQ ID NO: 29846 - DNA, 103 bp, Artificial Sequence
  Synthetic Polynucleotide
taatacgactcactatagggaggatgtgtcccagaagccatcatgtcgttaacagaggagaaacgacatgatggcttctaacctggcggcagcgcaaaagatg

SEQ ID NO: 29847 - DNA, 103 bp, Artificial Sequence
  Synthetic Polynucleotide
taatacgactcactatagggggcaaaggatgtgtcccagaagccatcatgaacagaggagacatgatatgttctgggacaacctggcggcagcgcaaaagatg

SEQ ID NO: 29848 - DNA, 103 bp, Artificial Sequence
  Synthetic Polynucleotide
taatacgactcactatagggacatttcatgaggtgcacatgtctgaatgaaacagaggagatcattcatgcatgtgcacaacctggcggcagcgcaaaagatg

SEQ ID NO: 29849 - DNA, 103 bp, Artificial Sequence
  Synthetic Polynucleotide
taatacgactcactatagggagggaggcaaaggatgtgtcccagaagccaaacagaggagatggcttatgggacacatcaacctggcggcagcgcaaaagatg

SEQ ID NO: 29850 - DNA, 103 bp, Artificial Sequence
  Synthetic Polynucleotide
taatacgactcactatagggagcagagggaggcaaaggatgtgtcccagaaacagaggagatctgggatgcatcctttgaacctggcggcagcgcaaaagatg

SEQ ID NO: 29851 - DNA, 103 bp, Artificial Sequence
  Synthetic Polynucleotide
taatacgactcactataggggataaagcagagggaggcaaaggatgtgtcaacagaggagagacacaatgtttgcctccaacctggcggcagcgcaaaagatg

SEQ ID NO: 29852 - DNA, 103 bp, Artificial Sequence
  Synthetic Polynucleotide
taatacgactcactatagggcatgggataaagcagagggaggcaaaggataacagaggagaatccttatgctccctctgaacctggcggcagcgcaaaagatg

SEQ ID NO: 29853 - DNA, 103 bp, Artificial Sequence
  Synthetic Polynucleotide
taatacgactcactatagggtcctccatgggataaagcagagggaggcaaaacagaggagattgcctatgtctgctttaaacctggcggcagcgcaaaagatg

SEQ ID NO: 29854 - DNA, 103 bp, Artificial Sequence
  Synthetic Polynucleotide
taatacgactcactatagggctctttcctccatgggataaagcagagggaaacagaggagatccctcatgtttatcccaaacctggcggcagcgcaaaagatg

SEQ ID NO: 29855 - DNA, 103 bp, Artificial Sequence
  Synthetic Polynucleotide
taatacgactcactatagggtaaggctctttcctccatgggataaagcagaacagaggagactgcttatgcccatggagaacctggcggcagcgcaaaagatg

SEQ ID NO: 29856 - DNA, 103 bp, Artificial Sequence
  Synthetic Polynucleotide
taatacgactcactatagggatctgtaaggctctttcctccatgggataaaacagaggagattatccatgggaggaaagaacctggcggcagcgcaaaagatg

SEQ ID NO: 29857 - DNA, 103 bp, Artificial Sequence
  Synthetic Polynucleotide
taatacgactcactatagggactctatctgtaaggctctttcctccatggaacagaggagaccatggatgaaagagcctaacctggcggcagcgcaaaagatg

SEQ ID NO: 29858 - DNA, 103 bp, Artificial Sequence
  Synthetic Polynucleotide
taatacgactcactatagggcaacaactctatctgtaaggctctttcctcaacagaggagagaggaaatggccttacagaacctggcggcagcgcaaaagatg

SEQ ID NO: 29859 - DNA, 103 bp, Artificial Sequence
  Synthetic Polynucleotide
taatacgactcactatagggaaccgacatttcatgaggtgcacatgtctgaacagaggagacagacaatggcacctcataacctggcggcagcgcaaaagatg

SEQ ID NO: 29860 - DNA, 103 bp, Artificial Sequence
  Synthetic Polynucleotide
taatacgactcactataggggaaatcaacaactctatctgtaaggctcttaacagaggagaaagagcatgacagatagaaacctggcggcagcgcaaaagatg

SEQ ID NO: 29861 - DNA, 103 bp, Artificial Sequence
  Synthetic Polynucleotide
taatacgactcactatagggagttcgaaatcaacaactctatctgtaaggaacagaggagaccttacatgtagagttgtaacctggcggcagcgcaaaagatg

SEQ ID NO: 29862 - DNA, 103 bp, Artificial Sequence
  Synthetic Polynucleotide
taatacgactcactatagggagatgagttcgaaatcaacaactctatctgaacagaggagacagataatgttgttgattaacctggcggcagcgcaaaagatg

SEQ ID NO: 29863 - DNA, 103 bp, Artificial Sequence
  Synthetic Polynucleotide
taatacgactcactatagggctcccagatgagttcgaaatcaacaactctaacagaggagaagagttatggatttcgaaaacctggcggcagcgcaaaagatg

SEQ ID NO: 29864 - DNA, 103 bp, Artificial Sequence
  Synthetic Polynucleotide
taatacgactcactatagggggcttctcccagatgagttcgaaatcaacaaacagaggagatgttgaatgcgaactcataacctggcggcagcgcaaaagatg

SEQ ID NO: 29865 - DNA, 103 bp, Artificial Sequence
  Synthetic Polynucleotide
taatacgactcactatagggcagacggcttctcccagatgagttcgaaataacagaggagaatttcgatgtcatctgggaacctggcggcagcgcaaaagatg

SEQ ID NO: 29866 - DNA, 103 bp, Artificial Sequence
  Synthetic Polynucleotide
taatacgactcactataggggagatcagacggcttctcccagatgagttcaacagaggagagaactcatgtgggagaagaacctggcggcagcgcaaaagatg

SEQ ID NO: 29867 - DNA, 103 bp, Artificial Sequence
  Synthetic Polynucleotide
taatacgactcactatagggtttctgagatcagacggcttctcccagatgaacagaggagacatctgatggaagccgtcaacctggcggcagcgcaaaagatg

SEQ ID NO: 29868 - DNA, 103 bp, Artificial Sequence
  Synthetic Polynucleotide
taatacgactcactatagggctgagtttctgagatcagacggcttctcccaacagaggagagggagaatgcgtctgatcaacctggcggcagcgcaaaagatg

SEQ ID NO: 29869 - DNA, 103 bp, Artificial Sequence
  Synthetic Polynucleotide
taatacgactcactatagggggtcactgagtttctgagatcagacggcttaacagaggagaaagccgatggatctcagaaacctggcggcagcgcaaaagatg

SEQ ID NO: 29870 - DNA, 103 bp, Artificial Sequence
  Synthetic Polynucleotide
taatacgactcactatagggcccaaaaccgacatttcatgaggtgcacataacagaggagaatgtgcatgtcatgaaataacctggcggcagcgcaaaagatg

SEQ ID NO: 29871 - DNA, 103 bp, Artificial Sequence
  Synthetic Polynucleotide
taatacgactcactatagggttccaggtcactgagtttctgagatcagacaacagaggagagtctgaatgcagaaactcaacctggcggcagcgcaaaagatg

SEQ ID NO: 29872 - DNA, 103 bp, Artificial Sequence
  Synthetic Polynucleotide
taatacgactcactatagggagtaattccaggtcactgagtttctgagataacagaggagaatctcaatgactcagtgaaacctggcggcagcgcaaaagatg

SEQ ID NO: 29873 - DNA, 103 bp, Artificial Sequence
  Synthetic Polynucleotide
taatacgactcactatagggtctgaagtaattccaggtcactgagtttctaacagaggagaagaaacatggtgacctggaacctggcggcagcgcaaaagatg

SEQ ID NO: 29874 - DNA, 103 bp, Artificial Sequence
  Synthetic Polynucleotide
taatacgactcactatagggacatctctgaagtaattccaggtcactgagaacagaggagactcagtatgctggaattaaacctggcggcagcgcaaaagatg

SEQ ID NO: 29875 - DNA, 103 bp, Artificial Sequence
  Synthetic Polynucleotide
taatacgactcactatagggtctggacatctctgaagtaattccaggtcaaacagaggagatgacctatgattacttcaaacctggcggcagcgcaaaagatg

SEQ ID NO: 29876 - DNA, 103 bp, Artificial Sequence
  Synthetic Polynucleotide
taatacgactcactatagggatctctctggacatctctgaagtaattccaaacagaggagatggaatatgttcagagataacctggcggcagcgcaaaagatg

SEQ ID NO: 29877 - DNA, 103 bp, Artificial Sequence
  Synthetic Polynucleotide
taatacgactcactataggggacagatctctctggacatctctgaagtaaaacagaggagattacttatgagatgtccaaacctggcggcagcgcaaaagatg

SEQ ID NO: 29878 - DNA, 103 bp, Artificial Sequence
  Synthetic Polynucleotide
taatacgactcactatagggtcgtagacagatctctctggacatctctgaaacagaggagatcagagatgtccagagagaacctggcggcagcgcaaaagatg

SEQ ID NO: 29879 - DNA, 103 bp, Artificial Sequence
  Synthetic Polynucleotide
taatacgactcactataggggaaattcgtagacagatctctctggacatcaacagaggagagatgtcatgagagatctgaacctggcggcagcgcaaaagatg

SEQ ID NO: 29880 - DNA, 103 bp, Artificial Sequence
  Synthetic Polynucleotide
taatacgactcactatagggaagtcgaaattcgtagacagatctctctggaacagaggagaccagagatgtctgtctacaacctggcggcagcgcaaaagatg

SEQ ID NO: 29881 - DNA, 103 bp, Artificial Sequence
  Synthetic Polynucleotide
taatacgactcactatagggaacctcccaaaaccgacatttcatgaggtgaacagaggagacacctcatgaaatgtcggaacctggcggcagcgcaaaagatg

SEQ ID NO: 29882 - DNA, 103 bp, Artificial Sequence
  Synthetic Polynucleotide
taatacgactcactatagggcaatcaagtcgaaattcgtagacagatctcaacagaggagagagatcatgctacgaattaacctggcggcagcgcaaaagatg

SEQ ID NO: 29883 - DNA, 103 bp, Artificial Sequence
  Synthetic Polynucleotide
taatacgactcactatagggacatacaatcaagtcgaaattcgtagacagaacagaggagactgtctatgaatttcgacaacctggcggcagcgcaaaagatg

SEQ ID NO: 29884 - DNA, 103 bp, Artificial Sequence
  Synthetic Polynucleotide
taatacgactcactataggggcatcacatacaatcaagtcgaaattcgtaaacagaggagatacgaaatgcgacttgataacctggcggcagcgcaaaagatg

SEQ ID NO: 29885 - DNA, 103 bp, Artificial Sequence
  Synthetic Polynucleotide
taatacgactcactatagggcctctgcatcacatacaatcaagtcgaaataacagaggagaatttcgatgtgattgtataacctggcggcagcgcaaaagatg

SEQ ID NO: 29886 - DNA, 103 bp, Artificial Sequence
  Synthetic Polynucleotide
taatacgactcactatagggagtgacctctgcatcacatacaatcaagtcaacagaggagagacttgatggtatgtgataacctggcggcagcgcaaaagatg

SEQ ID NO: 29887 - DNA, 103 bp, Artificial Sequence
  Synthetic Polynucleotide
taatacgactcactatagggatgtcagtgacctctgcatcacatacaatcaacagaggagagattgtatgtgatgcagaaacctggcggcagcgcaaaagatg

SEQ ID NO: 29888 - DNA, 103 bp, Artificial Sequence
  Synthetic Polynucleotide
taatacgactcactatagggatgatatgtcagtgacctctgcatcacataaacagaggagatatgtgatgcagaggtcaaacctggcggcagcgcaaaagatg

SEQ ID NO: 29889 - DNA, 103 bp, Artificial Sequence
  Synthetic Polynucleotide
taatacgactcactatagggcatggatgatatgtcagtgacctctgcatcaacagaggagagatgcaatggtcactgacaacctggcggcagcgcaaaagatg

SEQ ID NO: 29890 - DNA, 103 bp, Artificial Sequence
  Synthetic Polynucleotide
taatacgactcactatagggctgttcatggatgatatgtcagtgacctctaacagaggagaagaggtatgtgacatatcaacctggcggcagcgcaaaagatg

SEQ ID NO: 29891 - DNA, 103 bp, Artificial Sequence
  Synthetic Polynucleotide
taatacgactcactatagggctattctgttcatggatgatatgtcagtgaaacagaggagatcactgatgtatcatccaaacctggcggcagcgcaaaagatg

SEQ ID NO: 29892 - DNA, 103 bp, Artificial Sequence
  Synthetic Polynucleotide
taatacgactcactatagggtaagtaacctcccaaaaccgacatttcatgaacagaggagacatgaaatgtcggttttgaacctggcggcagcgcaaaagatg

SEQ ID NO: 29893 - DNA, 103 bp, Artificial Sequence
  Synthetic Polynucleotide
taatacgactcactatagggaaaggctattctgttcatggatgatatgtcaacagaggagagacataatgtccatgaacaacctggcggcagcgcaaaagatg

SEQ ID NO: 29894 - DNA, 103 bp, Artificial Sequence
  Synthetic Polynucleotide
taatacgactcactatagggaggagaaaggctattctgttcatggatgataacagaggagaatcatcatggaacagaataacctggcggcagcgcaaaagatg

SEQ ID NO: 29895 - DNA, 103 bp, Artificial Sequence
  Synthetic Polynucleotide
taatacgactcactatagggttgaaaggagaaaggctattctgttcatggaacagaggagaccatgaatggaatagcctaacctggcggcagcgcaaaagatg

SEQ ID NO: 29896 - DNA, 103 bp, Artificial Sequence
  Synthetic Polynucleotide
taatacgactcactatagggaaaatttgaaaggagaaaggctattctgttaacagaggagaaacagaatggcctttctcaacctggcggcagcgcaaaagatg

SEQ ID NO: 29897 - DNA, 103 bp, Artificial Sequence
  Synthetic Polynucleotide
taatacgactcactatagggagtataaaatttgaaaggagaaaggctattaacagaggagaaatagcatgtctcctttcaacctggcggcagcgcaaaagatg

SEQ ID NO: 29898 - DNA, 103 bp, Artificial Sequence
  Synthetic Polynucleotide
taatacgactcactatagggtagacagtataaaatttgaaaggagaaaggaacagaggagacctttcatgtttcaaattaacctggcggcagcgcaaaagatg

SEQ ID NO: 29899 - DNA, 103 bp, Artificial Sequence
  Synthetic Polynucleotide
taatacgactcactatagggttttatagacagtataaaatttgaaaggagaacagaggagactccttatgaattttataaacctggcggcagcgcaaaagatg

SEQ ID NO: 29900 - DNA, 103 bp, Artificial Sequence
  Synthetic Polynucleotide
taatacgactcactataggggggctttttatagacagtataaaatttgaaaacagaggagattcaaaatgtatactgtcaacctggcggcagcgcaaaagatg

SEQ ID NO: 29901 - DNA, 103 bp, Artificial Sequence
  Synthetic Polynucleotide
taatacgactcactatagggtcaaagggctttttatagacagtataaaataacagaggagaattttaatgtgtctataaaacctggcggcagcgcaaaagatg

SEQ ID NO: 29902 - DNA, 103 bp, Artificial Sequence
  Synthetic Polynucleotide
taatacgactcactatagggcagggtcaaagggctttttatagacagtataacagaggagaatactgatgataaaaagcaacctggcggcagcgcaaaagatg

SEQ ID NO: 29903 - DNA, 103 bp, Artificial Sequence
  Synthetic Polynucleotide
taatacgactcactatagggtctcctaagtaacctcccaaaaccgacattaacagaggagaaatgtcatgtttgggaggaacctggcggcagcgcaaaagatg

SEQ ID NO: 29904 - DNA, 103 bp, Artificial Sequence
  Synthetic Polynucleotide
taatacgactcactatagggaatatcagggtcaaagggctttttatagacaacagaggagagtctatatgaagccctttaacctggcggcagcgcaaaagatg

SEQ ID NO: 29905 - DNA, 103 bp, Artificial Sequence
  Synthetic Polynucleotide
taatacgactcactatagggatttaaatatcagggtcaaagggctttttaaacagaggagataaaaaatgctttgacccaacctggcggcagcgcaaaagatg

SEQ ID NO: 29906 - DNA, 103 bp, Artificial Sequence
  Synthetic Polynucleotide
taatacgactcactatagggataggatttaaatatcagggtcaaagggctaacagaggagaagccctatgaccctgataaacctggcggcagcgcaaaagatg

SEQ ID NO: 29907 - DNA, 103 bp, Artificial Sequence
  Synthetic Polynucleotide
taatacgactcactataggggttccataggatttaaatatcagggtcaaaaacagaggagatttgacatggatatttaaaacctggcggcagcgcaaaagatg

SEQ ID NO: 29908 - DNA, 103 bp, Artificial Sequence
  Synthetic Polynucleotide
taatacgactcactatagggacatagttccataggatttaaatatcagggaacagaggagaccctgaatgttaaatcctaacctggcggcagcgcaaaagatg

SEQ ID NO: 29909 - DNA, 103 bp, Artificial Sequence
  Synthetic Polynucleotide
taatacgactcactatagggtactaacatagttccataggatttaaatataacagaggagaatatttatgtcctatggaaacctggcggcagcgcaaaagatg

SEQ ID NO: 29910 - DNA, 103 bp, Artificial Sequence
  Synthetic Polynucleotide
taatacgactcactataggggggtttactaacatagttccataggatttaaacagaggagataaatcatgtggaactataacctggcggcagcgcaaaagatg

SEQ ID NO: 29911 - DNA, 103 bp, Artificial Sequence
  Synthetic Polynucleotide
taatacgactcactatagggaatctgggtttactaacatagttccataggaacagaggagacctatgatgctatgttagaacctggcggcagcgcaaaagatg

SEQ ID NO: 29912 - DNA, 103 bp, Artificial Sequence
  Synthetic Polynucleotide
taatacgactcactatagggtttataatctgggtttactaacatagttccaacagaggagaggaactatgttagtaaacaacctggcggcagcgcaaaagatg

SEQ ID NO: 29913 - DNA, 103 bp, Artificial Sequence
  Synthetic Polynucleotide
taatacgactcactatagggagtgctttataatctgggtttactaacataaacagaggagatatgttatgaaacccagaaacctggcggcagcgcaaaagatg

SEQ ID NO: 29914 - DNA, 103 bp, Artificial Sequence
  Synthetic Polynucleotide
taatacgactcactatagggattcctctcctaagtaacctcccaaaaccgaacagaggagacggtttatggaggttactaacctggcggcagcgcaaaagatg

SEQ ID NO: 29915 - DNA, 103 bp, Artificial Sequence
  Synthetic Polynucleotide
taatacgactcactatagggaattgagtgctttataatctgggtttactaaacagaggagatagtaaatgcagattataaacctggcggcagcgcaaaagatg

SEQ ID NO: 29916 - DNA, 103 bp, Artificial Sequence
  Synthetic Polynucleotide
taatacgactcactatagggaagataattgagtgctttataatctgggttaacagaggagaaacccaatgtataaagcaaacctggcggcagcgcaaaagatg

SEQ ID NO: 29917 - DNA, 103 bp, Artificial Sequence
  Synthetic Polynucleotide
taatacgactcactatagggtgagaaagataattgagtgctttataatctaacagaggagaagattaatgagcactcaaaacctggcggcagcgcaaaagatg

SEQ ID NO: 29918 - DNA, 103 bp, Artificial Sequence
  Synthetic Polynucleotide
taatacgactcactatagggatacctgagaaagataattgagtgctttataacagaggagaataaagatgtcaattatcaacctggcggcagcgcaaaagatg

SEQ ID NO: 29919 - DNA, 103 bp, Artificial Sequence
  Synthetic Polynucleotide
taatacgactcactatagggaggaaatacctgagaaagataattgagtgcaacagaggagagcactcatgtatctttctaacctggcggcagcgcaaaagatg

SEQ ID NO: 29920 - DNA, 103 bp, Artificial Sequence
  Synthetic Polynucleotide
taatacgactcactatagggatgttaggaaatacctgagaaagataattgaacagaggagacaattaatgttctcaggtaacctggcggcagcgcaaaagatg

SEQ ID NO: 29921 - DNA, 103 bp, Artificial Sequence
  Synthetic Polynucleotide
taatacgactcactatagggcactcatgttaggaaatacctgagaaagataacagaggagaatctttatgaggtatttcaacctggcggcagcgcaaaagatg

SEQ ID NO: 29922 - DNA, 103 bp, Artificial Sequence
  Synthetic Polynucleotide
taatacgactcactatagggcactccactcatgttaggaaatacctgagaaacagaggagatctcagatgtttcctaacaacctggcggcagcgcaaaagatg

SEQ ID NO: 29923 - DNA, 103 bp, Artificial Sequence
  Synthetic Polynucleotide
taatacgactcactataggggtgatcactccactcatgttaggaaataccaacagaggagaggtattatgtaacatgagaacctggcggcagcgcaaaagatg

SEQ ID NO: 29924 - DNA, 103 bp, Artificial Sequence
  Synthetic Polynucleotide
taatacgactcactatagggtttgtgtgatcactccactcatgttaggaaaacagaggagattcctaatgtgagtggagaacctggcggcagcgcaaaagatg

SEQ ID NO: 29925 - DNA, 103 bp, Artificial Sequence
  Synthetic Polynucleotide
taatacgactcactatagggaaagaattcctctcctaagtaacctcccaaaacagaggagattgggaatgtacttaggaaacctggcggcagcgcaaaagatg

SEQ ID NO: 29926 - DNA, 103 bp, Artificial Sequence
  Synthetic Polynucleotide
taatacgactcactatagggcgttgtttgtgtgatcactccactcatgttaacagaggagaaacatgatgggagtgatcaacctggcggcagcgcaaaagatg

SEQ ID NO: 29927 - DNA, 103 bp, Artificial Sequence
  Synthetic Polynucleotide
taatacgactcactataggggaagacgttgtttgtgtgatcactccactcaacagaggagagagtggatggatcacacaaacctggcggcagcgcaaaagatg

SEQ ID NO: 29928 - DNA, 103 bp, Artificial Sequence
  Synthetic Polynucleotide
taatacgactcactatagggagaaagaagacgttgtttgtgtgatcactcaacagaggagagagtgaatgcacaaacaaaacctggcggcagcgcaaaagatg

SEQ ID NO: 29929 - DNA, 103 bp, Artificial Sequence
  Synthetic Polynucleotide
taatacgactcactatagggtgaggagaaagaagacgttgtttgtgtgataacagaggagaatcacaatgacaacgtctaacctggcggcagcgcaaaagatg

SEQ ID NO: 29930 - DNA, 103 bp, Artificial Sequence
  Synthetic Polynucleotide
taatacgactcactatagggagttctgaggagaaagaagacgttgtttgtaacagaggagaacaaacatggtcttctttaacctggcggcagcgcaaaagatg

SEQ ID NO: 29931 - DNA, 103 bp, Artificial Sequence
  Synthetic Polynucleotide
taatacgactcactatagggaatagagttctgaggagaaagaagacgttgaacagaggagacaacgtatgctttctcctaacctggcggcagcgcaaaagatg

SEQ ID NO: 29932 - DNA, 103 bp, Artificial Sequence
  Synthetic Polynucleotide
taatacgactcactatagggaagcaaatagagttctgaggagaaagaagaaacagaggagatcttctatgtcctcagaaaacctggcggcagcgcaaaagatg

SEQ ID NO: 29933 - DNA, 103 bp, Artificial Sequence
  Synthetic Polynucleotide
taatacgactcactataggggcacaaagcaaatagagttctgaggagaaaaacagaggagatttctcatgagaactctaaacctggcggcagcgcaaaagatg

SEQ ID NO: 29934 - DNA, 103 bp, Artificial Sequence
  Synthetic Polynucleotide
taatacgactcactatagggattttgcacaaagcaaatagagttctgaggaacagaggagacctcagatgtctatttgcaacctggcggcagcgcaaaagatg

SEQ ID NO: 29935 - DNA, 103 bp, Artificial Sequence
  Synthetic Polynucleotide
taatacgactcactatagggtcctgattttgcacaaagcaaatagagttcaacagaggagagaactcatgttgctttgtaacctggcggcagcgcaaaagatg

SEQ ID NO: 29936 - DNA, 103 bp, Artificial Sequence
  Synthetic Polynucleotide
taatacgactcactatagggatcacctctggtctcaacacgacaatttccaacagaggagaggaaatatgcgtgttgagaacctggcggcagcgcaaaagatg

SEQ ID NO: 29937 - DNA, 103 bp, Artificial Sequence
  Synthetic Polynucleotide
taatacgactcactatagggttcccaaagaattcctctcctaagtaacctaacagaggagaaggttaatgaggagaggaaacctggcggcagcgcaaaagatg

SEQ ID NO: 29938 - DNA, 103 bp, Artificial Sequence
  Synthetic Polynucleotide
taatacgactcactatagggaaatctcctgattttgcacaaagcaaatagaacagaggagactatttatgttgtgcaaaaacctggcggcagcgcaaaagatg

SEQ ID NO: 29939 - DNA, 103 bp, Artificial Sequence
  Synthetic Polynucleotide
taatacgactcactatagggtgtaaaaatctcctgattttgcacaaagcaaacagaggagatgctttatgcaaaatcagaacctggcggcagcgcaaaagatg

SEQ ID NO: 29940 - DNA, 103 bp, Artificial Sequence
  Synthetic Polynucleotide
taatacgactcactatagggttctttgtaaaaatctcctgattttgcacaaacagaggagatgtgcaatgtcaggagataacctggcggcagcgcaaaagatg

SEQ ID NO: 29941 - DNA, 103 bp, Artificial Sequence
  Synthetic Polynucleotide
taatacgactcactatagggtctgtttctttgtaaaaatctcctgattttaacagaggagaaaaatcatgagatttttaaacctggcggcagcgcaaaagatg

SEQ ID NO: 29942 - DNA, 103 bp, Artificial Sequence
  Synthetic Polynucleotide
taatacgactcactatagggtatattctgtttctttgtaaaaatctcctgaacagaggagacaggagatgtttacaaagaacctggcggcagcgcaaaagatg

SEQ ID NO: 29943 - DNA, 103 bp, Artificial Sequence
  Synthetic Polynucleotide
taatacgactcactatagggagtgatatattctgtttctttgtaaaaatcaacagaggagagattttatgaaagaaacaaacctggcggcagcgcaaaagatg

SEQ ID NO: 29944 - DNA, 103 bp, Artificial Sequence
  Synthetic Polynucleotide
taatacgactcactataggggaggcagtgatatattctgtttctttgtaaaacagaggagattacaaatgaacagaataaacctggcggcagcgcaaaagatg

SEQ ID NO: 29945 - DNA, 103 bp, Artificial Sequence
  Synthetic Polynucleotide
taatacgactcactatagggtggatgaggcagtgatatattctgtttcttaacagaggagaaagaaaatgaatatatcaaacctggcggcagcgcaaaagatg

SEQ ID NO: 29946 - DNA, 103 bp, Artificial Sequence
  Synthetic Polynucleotide
taatacgactcactatagggtctgatggatgaggcagtgatatattctgtaacagaggagaacagaaatgatcactgccaacctggcggcagcgcaaaagatg

SEQ ID NO: 29947 - DNA, 103 bp, Artificial Sequence
  Synthetic Polynucleotide
taatacgactcactatagggagctctctgatggatgaggcagtgatatataacagaggagaatatatatgtgcctcatcaacctggcggcagcgcaaaagatg

SEQ ID NO: 29948 - DNA, 103 bp, Artificial Sequence
  Synthetic Polynucleotide
taatacgactcactatagggttcctttcccaaagaattcctctcctaagtaacagaggagaacttagatgaggaattctaacctggcggcagcgcaaaagatg

SEQ ID NO: 29949 - DNA, 103 bp, Artificial Sequence
  Synthetic Polynucleotide
taatacgactcactataggggacttagctctctgatggatgaggcagtgaaacagaggagatcactgatgcatccatcaaacctggcggcagcgcaaaagatg

SEQ ID NO: 29950 - DNA, 103 bp, Artificial Sequence
  Synthetic Polynucleotide
taatacgactcactatagggaacaagacttagctctctgatggatgaggcaacagaggagagcctcaatgatcagagagaacctggcggcagcgcaaaagatg

SEQ ID NO: 29951 - DNA, 103 bp, Artificial Sequence
  Synthetic Polynucleotide
taatacgactcactatagggaataaaacaagacttagctctctgatggataacagaggagaatccatatgagagctaagaacctggcggcagcgcaaaagatg

SEQ ID NO: 29952 - DNA, 103 bp, Artificial Sequence
  Synthetic Polynucleotide
taatacgactcactatagggaattgaataaaacaagacttagctctctgaaacagaggagatcagagatgtaagtcttgaacctggcggcagcgcaaaagatg

SEQ ID NO: 29953 - DNA, 103 bp, Artificial Sequence
  Synthetic Polynucleotide
taatacgactcactatagggtctacaattgaataaaacaagacttagctcaacagaggagagagctaatgcttgttttaaacctggcggcagcgcaaaagatg

SEQ ID NO: 29954 - DNA, 103 bp, Artificial Sequence
  Synthetic Polynucleotide
taatacgactcactatagggggacttctacaattgaataaaacaagacttaacagaggagaaagtctatgtttattcaaaacctggcggcagcgcaaaagatg

SEQ ID NO: 29955 - DNA, 103 bp, Artificial Sequence
  Synthetic Polynucleotide
taatacgactcactatagggttttcggacttctacaattgaataaaacaaaacagaggagattgtttatgtcaattgtaaacctggcggcagcgcaaaagatg

SEQ ID NO: 29956 - DNA, 103 bp, Artificial Sequence
  Synthetic Polynucleotide
taatacgactcactatagggttcacttttcggacttctacaattgaataaaacagaggagattattcatgtgtagaagtaacctggcggcagcgcaaaagatg

SEQ ID NO: 29957 - DNA, 103 bp, Artificial Sequence
  Synthetic Polynucleotide
taatacgactcactataggggtcatttcacttttcggacttctacaattgaacagaggagacaattgatgaagtccgaaaacctggcggcagcgcaaaagatg

SEQ ID NO: 29958 - DNA, 103 bp, Artificial Sequence
  Synthetic Polynucleotide
taatacgactcactatagggctcttgtcatttcacttttcggacttctacaacagaggagagtagaaatgcgaaaagtgaacctggcggcagcgcaaaagatg

SEQ ID NO: 29959 - DNA, 103 bp, Artificial Sequence
  Synthetic Polynucleotide
taatacgactcactataggggaatgttcctttcccaaagaattcctctccaacagaggagaggagagatgttctttgggaacctggcggcagcgcaaaagatg

SEQ ID NO: 29960 - DNA, 103 bp, Artificial Sequence
  Synthetic Polynucleotide
taatacgactcactatagggtctggctcttgtcatttcacttttcggactaacagaggagaagtccgatgagtgaaatgaacctggcggcagcgcaaaagatg

SEQ ID NO: 29961 - DNA, 103 bp, Artificial Sequence
  Synthetic Polynucleotide
taatacgactcactatagggagtgatctggctcttgtcatttcacttttcaacagaggagagaaaagatgaatgacaagaacctggcggcagcgcaaaagatg

SEQ ID NO: 29962 - DNA, 103 bp, Artificial Sequence
  Synthetic Polynucleotide
taatacgactcactatagggagttcagtgatctggctcttgtcatttcacaacagaggagagtgaaaatgcaagagccaaacctggcggcagcgcaaaagatg

SEQ ID NO: 29963 - DNA, 103 bp, Artificial Sequence
  Synthetic Polynucleotide
taatacgactcactatagggtttgtagttcagtgatctggctcttgtcataacagaggagaatgacaatggccagatcaaacctggcggcagcgcaaaagatg

SEQ ID NO: 29964 - DNA, 103 bp, Artificial Sequence
  Synthetic Polynucleotide
taatacgactcactatagggaggtctttgtagttcagtgatctggctcttaacagaggagaaagagcatgatcactgaaaacctggcggcagcgcaaaagatg

SEQ ID NO: 29965 - DNA, 103 bp, Artificial Sequence
  Synthetic Polynucleotide
taatacgactcactatagggttataaggtctttgtagttcagtgatctggaacagaggagaccagatatgtgaactacaaacctggcggcagcgcaaaagatg

SEQ ID NO: 29966 - DNA, 103 bp, Artificial Sequence
  Synthetic Polynucleotide
taatacgactcactataggggcccattataaggtctttgtagttcagtgaaacagaggagatcactgatgtacaaagacaacctggcggcagcgcaaaagatg

SEQ ID NO: 29967 - DNA, 103 bp, Artificial Sequence
  Synthetic Polynucleotide
taatacgactcactatagggggaaagcccattataaggtctttgtagttcaacagaggagagaactaatgagaccttataacctggcggcagcgcaaaagatg

SEQ ID NO: 29968 - DNA, 103 bp, Artificial Sequence
  Synthetic Polynucleotide
taatacgactcactatagggcaggaggaaagcccattataaggtctttgtaacagaggagaacaaagatgttataatggaacctggcggcagcgcaaaagatg

SEQ ID NO: 29969 - DNA, 103 bp, Artificial Sequence
  Synthetic Polynucleotide
taatacgactcactatagggtatttcaggaggaaagcccattataaggtcaacagaggagagaccttatgatgggctttaacctggcggcagcgcaaaagatg

SEQ ID NO: 29970 - DNA, 103 bp, Artificial Sequence
  Synthetic Polynucleotide
taatacgactcactatagggctctcgaatgttcctttcccaaagaattccaacagaggagaggaattatgtgggaaaggaacctggcggcagcgcaaaagatg

SEQ ID NO: 29971 - DNA, 103 bp, Artificial Sequence
  Synthetic Polynucleotide
taatacgactcactataggggagattatttcaggaggaaagcccattataaacagaggagatataatatgctttcctccaacctggcggcagcgcaaaagatg

SEQ ID NO: 29972 - DNA, 103 bp, Artificial Sequence
  Synthetic Polynucleotide
taatacgactcactatagggggttagagattatttcaggaggaaagcccaaacagaggagatgggctatgctcctgaaaaacctggcggcagcgcaaaagatg

SEQ ID NO: 29973 - DNA, 103 bp, Artificial Sequence
  Synthetic Polynucleotide
taatacgactcactataggggaaagggttagagattatttcaggaggaaaaacagaggagatttcctatggaaataatcaacctggcggcagcgcaaaagatg

SEQ ID NO: 29974 - DNA, 103 bp, Artificial Sequence
  Synthetic Polynucleotide
taatacgactcactatagggtcattgaaagggttagagattatttcaggaaacagaggagatcctgaatgaatctctaaaacctggcggcagcgcaaaagatg

SEQ ID NO: 29975 - DNA, 103 bp, Artificial Sequence
  Synthetic Polynucleotide
taatacgactcactatagggtcatttcattgaaagggttagagattatttaacagaggagaaaataaatgctaacccttaacctggcggcagcgcaaaagatg

SEQ ID NO: 29976 - DNA, 103 bp, Artificial Sequence
  Synthetic Polynucleotide
taatacgactcactatagggtatgatcatttcattgaaagggttagagataacagaggagaatctctatgcctttcaataacctggcggcagcgcaaaagatg

SEQ ID NO: 29977 - DNA, 103 bp, Artificial Sequence
  Synthetic Polynucleotide
taatacgactcactatagggagagttatgatcatttcattgaaagggttaaacagaggagataacccatgcaatgaaataacctggcggcagcgcaaaagatg

SEQ ID NO: 29978 - DNA, 103 bp, Artificial Sequence
  Synthetic Polynucleotide
taatacgactcactatagggctattagagttatgatcatttcattgaaagaacagaggagactttcaatgaaatgatcaaacctggcggcagcgcaaaagatg

SEQ ID NO: 29979 - DNA, 103 bp, Artificial Sequence
  Synthetic Polynucleotide
taatacgactcactataggggctgtctattagagttatgatcatttcattaacagaggagaaatgaaatgatcataactaacctggcggcagcgcaaaagatg

SEQ ID NO: 29980 - DNA, 103 bp, Artificial Sequence
  Synthetic Polynucleotide
taatacgactcactatagggacctcgctgtctattagagttatgatcattaacagaggagaaatgatatgaactctaataacctggcggcagcgcaaaagatg

SEQ ID NO: 29981 - DNA, 103 bp, Artificial Sequence
  Synthetic Polynucleotide
taatacgactcactatagggatcttctctcgaatgttcctttcccaaagaaacagaggagatctttgatgaaggaacataacctggcggcagcgcaaaagatg

SEQ ID NO: 29982 - DNA, 103 bp, Artificial Sequence
  Synthetic Polynucleotide
taatacgactcactatagggactccacctcgctgtctattagagttatgaaacagaggagatcataaatgtaatagacaaacctggcggcagcgcaaaagatg

SEQ ID NO: 29983 - DNA, 103 bp, Artificial Sequence
  Synthetic Polynucleotide
taatacgactcactatagggaaaggactccacctcgctgtctattagagtaacagaggagaactctaatggacagcgagaacctggcggcagcgcaaaagatg

SEQ ID NO: 29984 - DNA, 103 bp, Artificial Sequence
  Synthetic Polynucleotide
taatacgactcactatagggaccaaaaaggactccacctcgctgtctattaacagaggagaaatagaatgcgaggtggaaacctggcggcagcgcaaaagatg

SEQ ID NO: 29985 - DNA, 103 bp, Artificial Sequence
  Synthetic Polynucleotide
taatacgactcactatagggtgtgaaccaaaaaggactccacctcgctgtaacagaggagaacagcgatgtggagtcctaacctggcggcagcgcaaaagatg

SEQ ID NO: 29986 - DNA, 103 bp, Artificial Sequence
  Synthetic Polynucleotide
taatacgactcactatagggcatcttgtgaaccaaaaaggactccacctcaacagaggagagaggtgatgtcctttttgaacctggcggcagcgcaaaagatg

SEQ ID NO: 29987 - DNA, 103 bp, Artificial Sequence
  Synthetic Polynucleotide
taatacgactcactatagggtctaccatcttgtgaaccaaaaaggactccaacagaggagaggagtcatgtttggttcaaacctggcggcagcgcaaaagatg

SEQ ID NO: 29988 - DNA, 103 bp, Artificial Sequence
  Synthetic Polynucleotide
taatacgactcactatagggagtcatctaccatcttgtgaaccaaaaaggaacagaggagaccttttatgttcacaagaaacctggcggcagcgcaaaagatg

SEQ ID NO: 29989 - DNA, 103 bp, Artificial Sequence
  Synthetic Polynucleotide
taatacgactcactatagggttctaagtcatctaccatcttgtgaaccaaaacagaggagattggttatgaagatggtaaacctggcggcagcgcaaaagatg

SEQ ID NO: 29990 - DNA, 103 bp, Artificial Sequence
  Synthetic Polynucleotide
taatacgactcactataggggtcagttctaagtcatctaccatcttgtgaaacagaggagatcacaaatgggtagatgaaacctggcggcagcgcaaaagatg

SEQ ID NO: 29991 - DNA, 103 bp, Artificial Sequence
  Synthetic Polynucleotide
taatacgactcactatagggctcgagtcagttctaagtcatctaccatctaacagaggagaagatggatgatgacttagaacctggcggcagcgcaaaagatg

SEQ ID NO: 29992 - DNA, 103 bp, Artificial Sequence
  Synthetic Polynucleotide
taatacgactcactatagggaaagaatcttctctcgaatgttcctttcccaacagaggagagggaaaatgacattcgagaacctggcggcagcgcaaaagatg

SEQ ID NO: 29993 - DNA, 103 bp, Artificial Sequence
  Synthetic Polynucleotide
taatacgactcactatagggacttcctcgagtcagttctaagtcatctacaacagaggagagtagatatgttagaactgaacctggcggcagcgcaaaagatg

SEQ ID NO: 29994 - DNA, 103 bp, Artificial Sequence
  Synthetic Polynucleotide
taatacgactcactatagggtgtagacttcctcgagtcagttctaagtcaaacagaggagatgacttatgactgactcgaacctggcggcagcgcaaaagatg

SEQ ID NO: 29995 - DNA, 103 bp, Artificial Sequence
  Synthetic Polynucleotide
taatacgactcactatagggacctttgtagacttcctcgagtcagttctaaacagaggagatagaacatgctcgaggaaaacctggcggcagcgcaaaagatg

SEQ ID NO: 29996 - DNA, 103 bp, Artificial Sequence
  Synthetic Polynucleotide
taatacgactcactatagggagctaacctttgtagacttcctcgagtcagaacagaggagactgactatgggaagtctaaacctggcggcagcgcaaaagatg

SEQ ID NO: 29997 - DNA, 103 bp, Artificial Sequence
  Synthetic Polynucleotide
taatacgactcactatagggattctagctaacctttgtagacttcctcgaaacagaggagatcgaggatgtctacaaagaacctggcggcagcgcaaaagatg

SEQ ID NO: 29998 - DNA, 103 bp, Artificial Sequence
  Synthetic Polynucleotide
taatacgactcactatagggctaagattctagctaacctttgtagacttcaacagaggagagaagtcatgaaaggttagaacctggcggcagcgcaaaagatg

SEQ ID NO: 29999 - DNA, 103 bp, Artificial Sequence
  Synthetic Polynucleotide
taatacgactcactatagggaatggctaagattctagctaacctttgtagaacagaggagactacaaatgttagctagaaacctggcggcagcgcaaaagatg

SEQ ID NO: 30000 - DNA, 103 bp, Artificial Sequence
  Synthetic Polynucleotide
taatacgactcactatagggactacaatggctaagattctagctaaccttaacagaggagaaaggttatgtagaatcttaacctggcggcagcgcaaaagatg

SEQ ID NO: 30001 - DNA, 103 bp, Artificial Sequence
  Synthetic Polynucleotide
taatacgactcactatagggatactactacaatggctaagattctagctaaacagaggagatagctaatgtcttagccaaacctggcggcagcgcaaaagatg

SEQ ID NO: 30002 - DNA, 103 bp, Artificial Sequence
  Synthetic Polynucleotide
taatacgactcactatagggtgagtatactactacaatggctaagattctaacagaggagaagaatcatggccattgtaaacctggcggcagcgcaaaagatg

SEQ ID NO: 30003 - DNA, 103 bp, Artificial Sequence
  Synthetic Polynucleotide
taatacgactcactatagggtttctaaagaatcttctctcgaatgttcctaacagaggagaaggaacatgcgagagaagaacctggcggcagcgcaaaagatg

SEQ ID NO: 30004 - DNA, 103 bp, Artificial Sequence
  Synthetic Polynucleotide
taatacgactcactatagggctatttgagtatactactacaatggctaagaacagaggagacttagcatgtgtagtagtaacctggcggcagcgcaaaagatg

SEQ ID NO: 30005 - DNA, 103 bp, Artificial Sequence
  Synthetic Polynucleotide
taatacgactcactatagggagactctatttgagtatactactacaatggaacagaggagaccattgatgtagtatactaacctggcggcagcgcaaaagatg

SEQ ID NO: 30006 - DNA, 103 bp, Artificial Sequence
  Synthetic Polynucleotide
taatacgactcactatagggattaaagactctatttgagtatactactacaacagaggagagtagtaatgtactcaaataacctggcggcagcgcaaaagatg

SEQ ID NO: 30007 - DNA, 103 bp, Artificial Sequence
  Synthetic Polynucleotide
taatacgactcactataggggacacattaaagactctatttgagtatactaacagaggagaagtataatgaaatagagtaacctggcggcagcgcaaaagatg

SEQ ID NO: 30008 - DNA, 103 bp, Artificial Sequence
  Synthetic Polynucleotide
taatacgactcactataggggcttggacacattaaagactctatttgagtaacagaggagaactcaaatggagtctttaaacctggcggcagcgcaaaagatg

SEQ ID NO: 30009 - DNA, 103 bp, Artificial Sequence
  Synthetic Polynucleotide
taatacgactcactatagggcagaggcttggacacattaaagactctattaacagaggagaaatagaatgtttaatgtgaacctggcggcagcgcaaaagatg

SEQ ID NO: 30010 - DNA, 103 bp, Artificial Sequence
  Synthetic Polynucleotide
taatacgactcactatagggcctgtcagaggcttggacacattaaagactaacagaggagaagtcttatgtgtgtccaaaacctggcggcagcgcaaaagatg

SEQ ID NO: 30011 - DNA, 103 bp, Artificial Sequence
  Synthetic Polynucleotide
taatacgactcactatagggtttggcctgtcagaggcttggacacattaaaacagaggagattaatgatgccaagcctcaacctggcggcagcgcaaaagatg

SEQ ID NO: 30012 - DNA, 103 bp, Artificial Sequence
  Synthetic Polynucleotide
taatacgactcactataggggaacttttggcctgtcagaggcttggacacaacagaggagagtgtccatgcctctgacaaacctggcggcagcgcaaaagatg

SEQ ID NO: 30013 - DNA, 103 bp, Artificial Sequence
  Synthetic Polynucleotide
taatacgactcactataggggggatgaacttttggcctgtcagaggcttgaacagaggagacaagccatggacaggccaaacctggcggcagcgcaaaagatg

SEQ ID NO: 30014 - DNA, 103 bp, Artificial Sequence
  Synthetic Polynucleotide
taatacgactcactatagggcaatgtttctaaagaatcttctctcgaatgaacagaggagacattcgatggaagattctaacctggcggcagcgcaaaagatg

SEQ ID NO: 30015 - DNA, 103 bp, Artificial Sequence
  Synthetic Polynucleotide
taatacgactcactatagggaaggagggatgaacttttggcctgtcagagaacagaggagactctgaatggccaaaagtaacctggcggcagcgcaaaagatg

SEQ ID NO: 30016 - DNA, 103 bp, Artificial Sequence
  Synthetic Polynucleotide
taatacgactcactatagggatctgaaggagggatgaacttttggcctgtaacagaggagaacaggcatgaagttcatcaacctggcggcagcgcaaaagatg

SEQ ID NO: 30017 - DNA, 103 bp, Artificial Sequence
  Synthetic Polynucleotide
taatacgactcactatagggttaggatctgaaggagggatgaacttttggaacagaggagaccaaaaatgcatccctccaacctggcggcagcgcaaaagatg

SEQ ID NO: 30018 - DNA, 103 bp, Artificial Sequence
  Synthetic Polynucleotide
taatacgactcactatagggacaacttaggatctgaaggagggatgaactaacagaggagaagttcaatgctccttcagaacctggcggcagcgcaaaagatg

SEQ ID NO: 30019 - DNA, 103 bp, Artificial Sequence
  Synthetic Polynucleotide
taatacgactcactatagggccttaacaacttaggatctgaaggagggataacagaggagaatccctatgtcagatcctaacctggcggcagcgcaaaagatg

SEQ ID NO: 30020 - DNA, 103 bp, Artificial Sequence
  Synthetic Polynucleotide
taatacgactcactatagggaaatgccttaacaacttaggatctgaaggaaacagaggagatccttcatgtcctaagttaacctggcggcagcgcaaaagatg

SEQ ID NO: 30021 - DNA, 103 bp, Artificial Sequence
  Synthetic Polynucleotide
taatacgactcactatagggtgttgaaatgccttaacaacttaggatctgaacagaggagacagatcatgagttgttaaaacctggcggcagcgcaaaagatg

SEQ ID NO: 30022 - DNA, 103 bp, Artificial Sequence
  Synthetic Polynucleotide
taatacgactcactatagggacagatgttgaaatgccttaacaacttaggaacagaggagacctaagatgttaaggcataacctggcggcagcgcaaaagatg

SEQ ID NO: 30023 - DNA, 103 bp, Artificial Sequence
  Synthetic Polynucleotide
taatacgactcactatagggcttgcacagatgttgaaatgccttaacaacaacagaggagagttgttatggcatttcaaaacctggcggcagcgcaaaagatg

SEQ ID NO: 30024 - DNA, 103 bp, Artificial Sequence
  Synthetic Polynucleotide
taatacgactcactatagggatgtacttgcacagatgttgaaatgccttaaacagaggagataaggcatgtcaacatctaacctggcggcagcgcaaaagatg

SEQ ID NO: 30025 - DNA, 103 bp, Artificial Sequence
  Synthetic Polynucleotide
taatacgactcactatagggttcttcaatgtttctaaagaatcttctctcaacagaggagagagagaatgttctttagaaacctggcggcagcgcaaaagatg

SEQ ID NO: 30026 - DNA, 103 bp, Artificial Sequence
  Synthetic Polynucleotide
taatacgactcactataggggagaaatgtacttgcacagatgttgaaatgaacagaggagacatttcatgatctgtgcaaacctggcggcagcgcaaaagatg

SEQ ID NO: 30027 - DNA, 103 bp, Artificial Sequence
  Synthetic Polynucleotide
taatacgactcactatagggaaaaagagaaatgtacttgcacagatgttgaacagaggagacaacatatgtgcaagtacaacctggcggcagcgcaaaagatg

SEQ ID NO: 30028 - DNA, 103 bp, Artificial Sequence
  Synthetic Polynucleotide
taatacgactcactatagggagtttaaaaagagaaatgtacttgcacagaaacagaggagatctgtgatggtacatttcaacctggcggcagcgcaaaagatg

SEQ ID NO: 30029 - DNA, 103 bp, Artificial Sequence
  Synthetic Polynucleotide
taatacgactcactatagggcaaggagtttaaaaagagaaatgtacttgcaacagaggagagcaagtatgtttctctttaacctggcggcagcgcaaaagatg

SEQ ID NO: 30030 - DNA, 103 bp, Artificial Sequence
  Synthetic Polynucleotide
taatacgactcactatagggcctatcaaggagtttaaaaagagaaatgtaaacagaggagatacattatgctttttaaaaacctggcggcagcgcaaaagatg

SEQ ID NO: 30031 - DNA, 103 bp, Artificial Sequence
  Synthetic Polynucleotide
taatacgactcactatagggtgtctcctatcaaggagtttaaaaagagaaaacagaggagattctctatgtaaactcctaacctggcggcagcgcaaaagatg

SEQ ID NO: 30032 - DNA, 103 bp, Artificial Sequence
  Synthetic Polynucleotide
taatacgactcactatagggttcaatgtctcctatcaaggagtttaaaaaaacagaggagatttttaatgtccttgataaacctggcggcagcgcaaaagatg

SEQ ID NO: 30033 - DNA, 103 bp, Artificial Sequence
  Synthetic Polynucleotide
taatacgactcactatagggaagccttcaatgtctcctatcaaggagtttaacagaggagaaaactcatggataggagaaacctggcggcagcgcaaaagatg

SEQ ID NO: 30034 - DNA, 103 bp, Artificial Sequence
  Synthetic Polynucleotide
taatacgactcactatagggtggagaagccttcaatgtctcctatcaaggaacagaggagaccttgaatggagacattgaacctggcggcagcgcaaaagatg

SEQ ID NO: 30035 - DNA, 103 bp, Artificial Sequence
  Synthetic Polynucleotide
taatacgactcactatagggtagtctggagaagccttcaatgtctcctataacagaggagaataggaatgattgaaggcaacctggcggcagcgcaaaagatg

SEQ ID NO: 30036 - DNA, 103 bp, Artificial Sequence
  Synthetic Polynucleotide
taatacgactcactatagggttcatttcttcaatgtttctaaagaatcttaacagaggagaaagattatgtagaaacataacctggcggcagcgcaaaagatg

SEQ ID NO: 30037 - DNA, 103 bp, Artificial Sequence
  Synthetic Polynucleotide
taatacgactcactatagggaagtgtagtctggagaagccttcaatgtctaacagaggagaagacatatgaggcttctcaacctggcggcagcgcaaaagatg

SEQ ID NO: 30038 - DNA, 103 bp, Artificial Sequence
  Synthetic Polynucleotide
taatacgactcactatagggaaaggaagtgtagtctggagaagccttcaaaacagaggagattgaagatgtctccagacaacctggcggcagcgcaaaagatg

SEQ ID NO: 30039 - DNA, 103 bp, Artificial Sequence
  Synthetic Polynucleotide
taatacgactcactataggggttataaaggaagtgtagtctggagaagccaacagaggagaggcttcatgagactacacaacctggcggcagcgcaaaagatg

SEQ ID NO: 30040 - DNA, 103 bp, Artificial Sequence
  Synthetic Polynucleotide
taatacgactcactatagggttttcgttataaaggaagtgtagtctggagaacagaggagactccagatgacacttcctaacctggcggcagcgcaaaagatg

SEQ ID NO: 30041 - DNA, 103 bp, Artificial Sequence
  Synthetic Polynucleotide
taatacgactcactatagggatatcttttcgttataaaggaagtgtagtcaacagaggagagactacatgtcctttataaacctggcggcagcgcaaaagatg

SEQ ID NO: 30042 - DNA, 103 bp, Artificial Sequence
  Synthetic Polynucleotide
taatacgactcactatagggatatgatatcttttcgttataaaggaagtgaacagaggagacacttcatgtataacgaaaacctggcggcagcgcaaaagatg

SEQ ID NO: 30043 - DNA, 103 bp, Artificial Sequence
  Synthetic Polynucleotide
taatacgactcactatagggaagtaatatgatatcttttcgttataaaggaacagaggagacctttaatgcgaaaagataacctggcggcagcgcaaaagatg

SEQ ID NO: 30044 - DNA, 103 bp, Artificial Sequence
  Synthetic Polynucleotide
taatacgactcactatagggtcttaaagtaatatgatatcttttcgttataacagaggagaataacgatgagatatcataacctggcggcagcgcaaaagatg

SEQ ID NO: 30045 - DNA, 103 bp, Artificial Sequence
  Synthetic Polynucleotide
taatacgactcactatagggttgtttcttaaagtaatatgatatcttttcaacagaggagagaaaagatgtcatattacaacctggcggcagcgcaaaagatg

SEQ ID NO: 30046 - DNA, 103 bp, Artificial Sequence
  Synthetic Polynucleotide
taatacgactcactatagggtgagtttgtttcttaaagtaatatgatatcaacagaggagagatatcatgttactttaaaacctggcggcagcgcaaaagatg

SEQ ID NO: 30047 - DNA, 103 bp, Artificial Sequence
  Synthetic Polynucleotide
taatacgactcactatagggccgatatcacctctggtctcaacacgacaaaacagaggagattgtcgatgtgagaccagaacctggcggcagcgcaaaagatg

SEQ ID NO: 30048 - DNA, 103 bp, Artificial Sequence
  Synthetic Polynucleotide
taatacgactcactatagggaggttttcatttcttcaatgtttctaaagaaacagaggagatctttaatgacattgaagaacctggcggcagcgcaaaagatg

SEQ ID NO: 30049 - DNA, 103 bp, Artificial Sequence
  Synthetic Polynucleotide
taatacgactcactatagggctttatgagtttgtttcttaaagtaatatgaacagaggagacatattatgttaagaaacaacctggcggcagcgcaaaagatg

SEQ ID NO: 30050 - DNA, 103 bp, Artificial Sequence
  Synthetic Polynucleotide
taatacgactcactatagggcttgcctttatgagtttgtttcttaaagtaaacagaggagatactttatgaaacaaactaacctggcggcagcgcaaaagatg

SEQ ID NO: 30051 - DNA, 103 bp, Artificial Sequence
  Synthetic Polynucleotide
taatacgactcactatagggtagaccttgcctttatgagtttgtttcttaaacagaggagataagaaatgaactcataaaacctggcggcagcgcaaaagatg

SEQ ID NO: 30052 - DNA, 103 bp, Artificial Sequence
  Synthetic Polynucleotide
taatacgactcactatagggccagatagaccttgcctttatgagtttgttaacagaggagaaacaaaatgataaaggcaaacctggcggcagcgcaaaagatg

SEQ ID NO: 30053 - DNA, 103 bp, Artificial Sequence
  Synthetic Polynucleotide
taatacgactcactatagggccaaaccagatagaccttgcctttatgagtaacagaggagaactcatatgggcaaggtcaacctggcggcagcgcaaaagatg

SEQ ID NO: 30054 - DNA, 103 bp, Artificial Sequence
  Synthetic Polynucleotide
taatacgactcactatagggcagctccaaaccagatagaccttgcctttaaacagaggagataaaggatgggtctatctaacctggcggcagcgcaaaagatg

SEQ ID NO: 30055 - DNA, 103 bp, Artificial Sequence
  Synthetic Polynucleotide
taatacgactcactatagggtcgaccagctccaaaccagatagaccttgcaacagaggagagcaaggatgatctggtttaacctggcggcagcgcaaaagatg

SEQ ID NO: 30056 - DNA, 103 bp, Artificial Sequence
  Synthetic Polynucleotide
taatacgactcactatagggttcgttcgaccagctccaaaccagatagacaacagaggagagtctatatggtttggagcaacctggcggcagcgcaaaagatg

SEQ ID NO: 30057 - DNA, 103 bp, Artificial Sequence
  Synthetic Polynucleotide
taatacgactcactatagggggactttcgttcgaccagctccaaaccagaaacagaggagatctggtatggagctggtcaacctggcggcagcgcaaaagatg

SEQ ID NO: 30058 - DNA, 103 bp, Artificial Sequence
  Synthetic Polynucleotide
taatacgactcactatagggatgttggactttcgttcgaccagctccaaaaacagaggagatttggaatgggtcgaacgaacctggcggcagcgcaaaagatg

SEQ ID NO: 30059 - DNA, 103 bp, Artificial Sequence
  Synthetic Polynucleotide
taatacgactcactatagggttcataggttttcatttcttcaatgtttctaacagaggagaagaaacatggaagaaatgaacctggcggcagcgcaaaagatg

SEQ ID NO: 30060 - DNA, 103 bp, Artificial Sequence
  Synthetic Polynucleotide
taatacgactcactatagggtttacatgttggactttcgttcgaccagctaacagaggagaagctggatgaacgaaagtaacctggcggcagcgcaaaagatg

SEQ ID NO: 30061 - DNA, 103 bp, Artificial Sequence
  Synthetic Polynucleotide
taatacgactcactatagggacttgtttacatgttggactttcgttcgacaacagaggagagtcgaaatgaagtccaacaacctggcggcagcgcaaaagatg

SEQ ID NO: 30062 - DNA, 103 bp, Artificial Sequence
  Synthetic Polynucleotide
taatacgactcactatagggatgcaacttgtttacatgttggactttcgtaacagaggagaacgaaaatgcaacatgtaaacctggcggcagcgcaaaagatg

SEQ ID NO: 30063 - DNA, 103 bp, Artificial Sequence
  Synthetic Polynucleotide
taatacgactcactataggggttgcatgcaacttgtttacatgttggactaacagaggagaagtccaatgtgtaaacaaaacctggcggcagcgcaaaagatg

SEQ ID NO: 30064 - DNA, 103 bp, Artificial Sequence
  Synthetic Polynucleotide
taatacgactcactatagggatggagttgcatgcaacttgtttacatgttaacagaggagaaacatgatgacaagttgcaacctggcggcagcgcaaaagatg

SEQ ID NO: 30065 - DNA, 103 bp, Artificial Sequence
  Synthetic Polynucleotide
taatacgactcactatagggttagcatggagttgcatgcaacttgtttacaacagaggagagtaaacatgttgcatgcaaacctggcggcagcgcaaaagatg

SEQ ID NO: 30066 - DNA, 103 bp, Artificial Sequence
  Synthetic Polynucleotide
taatacgactcactatagggaaggcttagcatggagttgcatgcaacttgaacagaggagacaagttatgtgcaactccaacctggcggcagcgcaaaagatg

SEQ ID NO: 30067 - DNA, 103 bp, Artificial Sequence
  Synthetic Polynucleotide
taatacgactcactataggggaagaaaggcttagcatggagttgcatgcaaacagaggagatgcatgatgctccatgctaacctggcggcagcgcaaaagatg

SEQ ID NO: 30068 - DNA, 103 bp, Artificial Sequence
  Synthetic Polynucleotide
taatacgactcactatagggagtgggaagaaaggcttagcatggagttgcaacagaggagagcaactatgtgctaagccaacctggcggcagcgcaaaagatg

SEQ ID NO: 30069 - DNA, 103 bp, Artificial Sequence
  Synthetic Polynucleotide
taatacgactcactataggggatccagtgggaagaaaggcttagcatggaaacagaggagatccatgatgagcctttctaacctggcggcagcgcaaaagatg

SEQ ID NO: 30070 - DNA, 103 bp, Artificial Sequence
  Synthetic Polynucleotide
taatacgactcactatagggaactcttcataggttttcatttcttcaatgaacagaggagacattgaatgaatgaaaacaacctggcggcagcgcaaaagatg

SEQ ID NO: 30071 - DNA, 103 bp, Artificial Sequence
  Synthetic Polynucleotide
taatacgactcactatagggattctgatccagtgggaagaaaggcttagcaacagaggagagctaagatgttcttcccaaacctggcggcagcgcaaaagatg

SEQ ID NO: 30072 - DNA, 103 bp, Artificial Sequence
  Synthetic Polynucleotide
taatacgactcactatagggaaatcattctgatccagtgggaagaaaggcaacagaggagagcctttatgcccactggaaacctggcggcagcgcaaaagatg

SEQ ID NO: 30073 - DNA, 103 bp, Artificial Sequence
  Synthetic Polynucleotide
taatacgactcactatagggtttgtaaatcattctgatccagtgggaagaaacagaggagatcttccatgtggatcagaaacctggcggcagcgcaaaagatg

SEQ ID NO: 30074 - DNA, 103 bp, Artificial Sequence
  Synthetic Polynucleotide
taatacgactcactatagggatcactttgtaaatcattctgatccagtggaacagaggagaccactgatgcagaatgataacctggcggcagcgcaaaagatg

SEQ ID NO: 30075 - DNA, 103 bp, Artificial Sequence
  Synthetic Polynucleotide
taatacgactcactatagggctctaatcactttgtaaatcattctgatccaacagaggagaggatcaatgtgatttacaaacctggcggcagcgcaaaagatg

SEQ ID NO: 30076 - DNA, 103 bp, Artificial Sequence
  Synthetic Polynucleotide
taatacgactcactatagggtgttactctaatcactttgtaaatcattctaacagaggagaagaatgatgtacaaagtgaacctggcggcagcgcaaaagatg

SEQ ID NO: 30077 - DNA, 103 bp, Artificial Sequence
  Synthetic Polynucleotide
taatacgactcactatagggattcttgttactctaatcactttgtaaatcaacagaggagagatttaatgagtgattagaacctggcggcagcgcaaaagatg

SEQ ID NO: 30078 - DNA, 103 bp, Artificial Sequence
  Synthetic Polynucleotide
taatacgactcactatagggcatttattcttgttactctaatcactttgtaacagaggagaacaaagatgttagagtaaaacctggcggcagcgcaaaagatg

SEQ ID NO: 30079 - DNA, 103 bp, Artificial Sequence
  Synthetic Polynucleotide
taatacgactcactatagggtctctcatttattcttgttactctaatcacaacagaggagagtgattatggtaacaagaaacctggcggcagcgcaaaagatg

SEQ ID NO: 30080 - DNA, 103 bp, Artificial Sequence
  Synthetic Polynucleotide
taatacgactcactatagggcttcctctctcatttattcttgttactctaaacagaggagatagagtatgaagaataaaaacctggcggcagcgcaaaagatg

SEQ ID NO: 30081 - DNA, 103 bp, Artificial Sequence
  Synthetic Polynucleotide
taatacgactcactatagggcttctaactcttcataggttttcatttcttaacagaggagaaagaaaatgaaacctatgaacctggcggcagcgcaaaagatg

SEQ ID NO: 30082 - DNA, 103 bp, Artificial Sequence
  Synthetic Polynucleotide
taatacgactcactatagggttttgcttcctctctcatttattcttgttaaacagaggagataacaaatgtaaatgagaaacctggcggcagcgcaaaagatg

SEQ ID NO: 30083 - DNA, 103 bp, Artificial Sequence
  Synthetic Polynucleotide
taatacgactcactatagggtaggattttgcttcctctctcatttattctaacagaggagaagaataatggagagaggaaacctggcggcagcgcaaaagatg

SEQ ID NO: 30084 - DNA, 103 bp, Artificial Sequence
  Synthetic Polynucleotide
taatacgactcactatagggtcatctaggattttgcttcctctctcatttaacagaggagaaaatgaatgaggaagcaaaacctggcggcagcgcaaaagatg

SEQ ID NO: 30085 - DNA, 103 bp, Artificial Sequence
  Synthetic Polynucleotide
taatacgactcactatagggtcatctcatctaggattttgcttcctctctaacagaggagaagagagatggcaaaatccaacctggcggcagcgcaaaagatg

SEQ ID NO: 30086 - DNA, 103 bp, Artificial Sequence
  Synthetic Polynucleotide
taatacgactcactatagggagttgtcatctcatctaggattttgcttccaacagaggagaggaagcatgatcctagataacctggcggcagcgcaaaagatg

SEQ ID NO: 30087 - DNA, 103 bp, Artificial Sequence
  Synthetic Polynucleotide
taatacgactcactatagggaatggagttgtcatctcatctaggattttgaacagaggagacaaaatatgagatgagataacctggcggcagcgcaaaagatg

SEQ ID NO: 30088 - DNA, 103 bp, Artificial Sequence
  Synthetic Polynucleotide
taatacgactcactatagggttctcaatggagttgtcatctcatctaggaaacagaggagatcctagatgagatgacaaaacctggcggcagcgcaaaagatg

SEQ ID NO: 30089 - DNA, 103 bp, Artificial Sequence
  Synthetic Polynucleotide
taatacgactcactataggggtatgttctcaatggagttgtcatctcatcaacagaggagagatgagatgacaactccaaacctggcggcagcgcaaaagatg

SEQ ID NO: 30090 - DNA, 103 bp, Artificial Sequence
  Synthetic Polynucleotide
taatacgactcactatagggctattgtatgttctcaatggagttgtcatcaacagaggagagatgacatgtccattgagaacctggcggcagcgcaaaagatg

SEQ ID NO: 30091 - DNA, 103 bp, Artificial Sequence
  Synthetic Polynucleotide
taatacgactcactatagggaccatctattgtatgttctcaatggagttgaacagaggagacaactcatgtgagaacataacctggcggcagcgcaaaagatg

SEQ ID NO: 30092 - DNA, 103 bp, Artificial Sequence
  Synthetic Polynucleotide
taatacgactcactatagggtctttcttctaactcttcataggttttcataacagaggagaatgaaaatgtatgaagagaacctggcggcagcgcaaaagatg

SEQ ID NO: 30093 - DNA, 103 bp, Artificial Sequence
  Synthetic Polynucleotide
taatacgactcactatagggttttaaccatctattgtatgttctcaatggaacagaggagaccattgatgacatacaataacctggcggcagcgcaaaagatg

SEQ ID NO: 30094 - DNA, 103 bp, Artificial Sequence
  Synthetic Polynucleotide
taatacgactcactatagggtgaatttttaaccatctattgtatgttctcaacagaggagagagaacatgcaatagatgaacctggcggcagcgcaaaagatg

SEQ ID NO: 30095 - DNA, 103 bp, Artificial Sequence
  Synthetic Polynucleotide
taatacgactcactatagggtgtcttgaatttttaaccatctattgtatgaacagaggagacatacaatggatggttaaaacctggcggcagcgcaaaagatg

SEQ ID NO: 30096 - DNA, 103 bp, Artificial Sequence
  Synthetic Polynucleotide
taatacgactcactatagggtctgatgtcttgaatttttaaccatctattaacagaggagaaatagaatgttaaaaattaacctggcggcagcgcaaaagatg

SEQ ID NO: 30097 - DNA, 103 bp, Artificial Sequence
  Synthetic Polynucleotide
taatacgactcactatagggctgtgtctgatgtcttgaatttttaaccataacagaggagaatggttatgaattcaagaaacctggcggcagcgcaaaagatg

SEQ ID NO: 30098 - DNA, 103 bp, Artificial Sequence
  Synthetic Polynucleotide
taatacgactcactatagggacgtcctgtgtctgatgtcttgaatttttaaacagaggagataaaaaatgaagacatcaaacctggcggcagcgcaaaagatg

SEQ ID NO: 30099 - DNA, 103 bp, Artificial Sequence
  Synthetic Polynucleotide
taatacgactcactatagggaagtgacgtcctgtgtctgatgtcttgaataacagaggagaattcaaatgatcagacacaacctggcggcagcgcaaaagatg

SEQ ID NO: 30100 - DNA, 103 bp, Artificial Sequence
  Synthetic Polynucleotide
taatacgactcactatagggtccaaaagtgacgtcctgtgtctgatgtctaacagaggagaagacatatgacacaggacaacctggcggcagcgcaaaagatg

SEQ ID NO: 30101 - DNA, 103 bp, Artificial Sequence
  Synthetic Polynucleotide
taatacgactcactatagggagtattccaaaagtgacgtcctgtgtctgaaacagaggagatcagacatgggacgtcacaacctggcggcagcgcaaaagatg

SEQ ID NO: 30102 - DNA, 103 bp, Artificial Sequence
  Synthetic Polynucleotide
taatacgactcactatagggagaccagtattccaaaagtgacgtcctgtgaacagaggagacacaggatgtcacttttgaacctggcggcagcgcaaaagatg

SEQ ID NO: 30103 - DNA, 103 bp, Artificial Sequence
  Synthetic Polynucleotide
taatacgactcactatagggactcgtctttcttctaactcttcataggttaacagaggagaaacctaatgagagttagaaacctggcggcagcgcaaaagatg

SEQ ID NO: 30104 - DNA, 103 bp, Artificial Sequence
  Synthetic Polynucleotide
taatacgactcactatagggtaattagaccagtattccaaaagtgacgtcaacagaggagagacgtcatgtttggaataaacctggcggcagcgcaaaagatg

SEQ ID NO: 30105 - DNA, 103 bp, Artificial Sequence
  Synthetic Polynucleotide
taatacgactcactatagggtcccttaattagaccagtattccaaaagtgaacagaggagacactttatgaatactggtaacctggcggcagcgcaaaagatg

SEQ ID NO: 30106 - DNA, 103 bp, Artificial Sequence
  Synthetic Polynucleotide
taatacgactcactatagggtcggctcccttaattagaccagtattccaaaacagaggagattggaaatgtggtctaataacctggcggcagcgcaaaagatg

SEQ ID NO: 30107 - DNA, 103 bp, Artificial Sequence
  Synthetic Polynucleotide
taatacgactcactatagggtagactcggctcccttaattagaccagtataacagaggagaatactgatgtaattaaggaacctggcggcagcgcaaaagatg

SEQ ID NO: 30108 - DNA, 103 bp, Artificial Sequence
  Synthetic Polynucleotide
taatacgactcactatagggccaattagactcggctcccttaattagaccaacagaggagaggtctaatgaagggagccaacctggcggcagcgcaaaagatg

SEQ ID NO: 30109 - DNA, 103 bp, Artificial Sequence
  Synthetic Polynucleotide
taatacgactcactatagggctggtccaattagactcggctcccttaattaacagaggagaaattaaatgagccgagtcaacctggcggcagcgcaaaagatg

SEQ ID NO: 30110 - DNA, 103 bp, Artificial Sequence
  Synthetic Polynucleotide
taatacgactcactatagggttcggctggtccaattagactcggctccctaacagaggagaagggagatgagtctaattaacctggcggcagcgcaaaagatg

SEQ ID NO: 30111 - DNA, 103 bp, Artificial Sequence
  Synthetic Polynucleotide
taatacgactcactatagggtgaccttcggctggtccaattagactcggcaacagaggagagccgagatgaattggaccaacctggcggcagcgcaaaagatg

SEQ ID NO: 30112 - DNA, 103 bp, Artificial Sequence
  Synthetic Polynucleotide
taatacgactcactatagggttgactgaccttcggctggtccaattagacaacagaggagagtctaaatggaccagccgaacctggcggcagcgcaaaagatg

SEQ ID NO: 30113 - DNA, 103 bp, Artificial Sequence
  Synthetic Polynucleotide
taatacgactcactatagggaaacgttgactgaccttcggctggtccaataacagaggagaattggaatggccgaaggtaacctggcggcagcgcaaaagatg

SEQ ID NO: 30114 - DNA, 103 bp, Artificial Sequence
  Synthetic Polynucleotide
taatacgactcactatagggcctcgactcgtctttcttctaactcttcataacagaggagaatgaagatgtagaagaaaaacctggcggcagcgcaaaagatg

SEQ ID NO: 30115 - DNA, 103 bp, Artificial Sequence
  Synthetic Polynucleotide
taatacgactcactatagggcacagaaacgttgactgaccttcggctggtaacagaggagaaccagcatgaggtcagtcaacctggcggcagcgcaaaagatg

SEQ ID NO: 30116 - DNA, 103 bp, Artificial Sequence
  Synthetic Polynucleotide
taatacgactcactatagggtttttcacagaaacgttgactgaccttcggaacagaggagaccgaagatgagtcaacgtaacctggcggcagcgcaaaagatg

SEQ ID NO: 30117 - DNA, 103 bp, Artificial Sequence
  Synthetic Polynucleotide
taatacgactcactatagggatgtttttttcacagaaacgttgactgaccaacagaggagaggtcagatgacgtttctgaacctggcggcagcgcaaaagatg

SEQ ID NO: 30118 - DNA, 103 bp, Artificial Sequence
  Synthetic Polynucleotide
taatacgactcactatagggattaaatgtttttttcacagaaacgttgacaacagaggagagtcaacatgtctgtgaaaaacctggcggcagcgcaaaagatg

SEQ ID NO: 30119 - DNA, 103 bp, Artificial Sequence
  Synthetic Polynucleotide
taatacgactcactatagggaaagaattaaatgtttttttcacagaaacgaacagaggagacgtttcatggaaaaaaacaacctggcggcagcgcaaaagatg

SEQ ID NO: 30120 - DNA, 103 bp, Artificial Sequence
  Synthetic Polynucleotide
taatacgactcactatagggtgttgaaagaattaaatgtttttttcacagaacagaggagactgtgaatgaaacatttaaacctggcggcagcgcaaaagatg

SEQ ID NO: 30121 - DNA, 103 bp, Artificial Sequence
  Synthetic Polynucleotide
taatacgactcactatagggaccgttgttgaaagaattaaatgtttttttaacagaggagaaaaaaaatgtttaattctaacctggcggcagcgcaaaagatg

SEQ ID NO: 30122 - DNA, 103 bp, Artificial Sequence
  Synthetic Polynucleotide
taatacgactcactatagggaacagaccgttgttgaaagaattaaatgttaacagaggagaaacattatgttctttcaaaacctggcggcagcgcaaaagatg

SEQ ID NO: 30123 - DNA, 103 bp, Artificial Sequence
  Synthetic Polynucleotide
taatacgactcactataggggcgataacagaccgttgttgaaagaattaaaacagaggagattaattatgtcaacaacgaacctggcggcagcgcaaaagatg

SEQ ID NO: 30124 - DNA, 103 bp, Artificial Sequence
  Synthetic Polynucleotide
taatacgactcactatagggaaaaggcgataacagaccgttgttgaaagaaacagaggagatctttcatgaacggtctgaacctggcggcagcgcaaaagatg

SEQ ID NO: 30125 - DNA, 103 bp, Artificial Sequence
  Synthetic Polynucleotide
taatacgactcactatagggcgctgcctcgactcgtctttcttctaactcaacagaggagagagttaatggaaagacgaaacctggcggcagcgcaaaagatg

SEQ ID NO: 30126 - DNA, 103 bp, Artificial Sequence
  Synthetic Polynucleotide
taatacgactcactatagggagagaaaaaggcgataacagaccgttgttgaacagaggagacaacaaatgtctgttatcaacctggcggcagcgcaaaagatg

SEQ ID NO: 30127 - DNA, 103 bp, Artificial Sequence
  Synthetic Polynucleotide
taatacgactcactatagggaaaatagagaaaaaggcgataacagaccgtaacagaggagaacggtcatgtatcgccttaacctggcggcagcgcaaaagatg

SEQ ID NO: 30128 - DNA, 103 bp, Artificial Sequence
  Synthetic Polynucleotide
taatacgactcactatagggaataaaaaatagagaaaaaggcgataacagaacagaggagactgttaatgcctttttctaacctggcggcagcgcaaaagatg

SEQ ID NO: 30129 - DNA, 103 bp, Artificial Sequence
  Synthetic Polynucleotide
taatacgactcactatagggaaaacaataaaaaatagagaaaaaggcgataacagaggagaatcgccatgttctctattaacctggcggcagcgcaaaagatg

SEQ ID NO: 30130 - DNA, 103 bp, Artificial Sequence
  Synthetic Polynucleotide
taatacgactcactatagggacaaaaaaacaataaaaaatagagaaaaagaacagaggagactttttatgtattttttaaacctggcggcagcgcaaaagatg

SEQ ID NO: 30131 - DNA, 103 bp, Artificial Sequence
  Synthetic Polynucleotide
taatacgactcactataggggcttaacaaaaaaacaataaaaaatagagaaacagaggagatctctaatgtttattgttaacctggcggcagcgcaaaagatg

SEQ ID NO: 30132 - DNA, 103 bp, Artificial Sequence
  Synthetic Polynucleotide
taatacgactcactatagggtctagcgctgcctcgactcgtctttcttctaacagaggagaagaagaatgacgagtcgaaacctggcggcagcgcaaaagatg

SEQ ID NO: 30133 - DNA, 103 bp, Artificial Sequence
  Synthetic Polynucleotide
taatacgactcactatagggcgtcttctagcgctgcctcgactcgtctttaacagaggagaaaagacatgtcgaggcagaacctggcggcagcgcaaaagatg

SEQ ID NO: 30134 - DNA, 103 bp, Artificial Sequence
  Synthetic Polynucleotide
taatacgactcactatagggctgatccgatatcacctctggtctcaacacaacagaggagagtgttgatgccagaggtgaacctggcggcagcgcaaaagatg

SEQ ID NO: 30135 - DNA, 103 bp, Artificial Sequence
  Synthetic Polynucleotide
taatacgactcactataggggccgtcgtcttctagcgctgcctcgactcgaacagaggagacgagtcatggcagcgctaaacctggcggcagcgcaaaagatg

SEQ ID NO: 30136 - DNA, 103 bp, Artificial Sequence
  Synthetic Polynucleotide
taatacgactcactatagggacagtgccgtcgtcttctagcgctgcctcgaacagaggagacgaggcatggctagaagaaacctggcggcagcgcaaaagatg

SEQ ID NO: 30137 - DNA, 103 bp, Artificial Sequence
  Synthetic Polynucleotide
taatacgactcactatagggaatcaacagtgccgtcgtcttctagcgctgaacagaggagacagcgcatgaagacgacgaacctggcggcagcgcaaaagatg

SEQ ID NO: 30138 - DNA, 103 bp, Artificial Sequence
  Synthetic Polynucleotide
taatacgactcactatagggcccagaatcaacagtgccgtcgtcttctagaacagaggagactagaaatggacggcactaacctggcggcagcgcaaaagatg

SEQ ID NO: 30139 - DNA, 103 bp, Artificial Sequence
  Synthetic Polynucleotide
taatacgactcactatagggtcttccccagaatcaacagtgccgtcgtctaacagaggagaagacgaatgcactgttgaaacctggcggcagcgcaaaagatg

SEQ ID NO: 30140 - DNA, 103 bp, Artificial Sequence
  Synthetic Polynucleotide
taatacgactcactatagggcgtcttcttccccagaatcaacagtgccgtaacagaggagaacggcaatgttgattctgaacctggcggcagcgcaaaagatg

SEQ ID NO: 30141 - DNA, 103 bp, Artificial Sequence
  Synthetic Polynucleotide
taatacgactcactatagggccaatcgtcttcttccccagaatcaacagtaacagaggagaactgttatgtctggggaaaacctggcggcagcgcaaaagatg

SEQ ID NO: 30142 - DNA, 103 bp, Artificial Sequence
  Synthetic Polynucleotide
taatacgactcactatagggcctgtccaatcgtcttcttccccagaatcaaacagaggagatgattcatgggaagaagaaacctggcggcagcgcaaaagatg

SEQ ID NO: 30143 - DNA, 103 bp, Artificial Sequence
  Synthetic Polynucleotide
taatacgactcactatagggactcccctgtccaatcgtcttcttccccagaacagaggagactggggatgaagacgattaacctggcggcagcgcaaaagatg

SEQ ID NO: 30144 - DNA, 103 bp, Artificial Sequence
  Synthetic Polynucleotide
taatacgactcactatagggtctagactcccctgtccaatcgtcttcttcaacagaggagagaagaaatggattggacaaacctggcggcagcgcaaaagatg

SEQ ID NO: 30145 - DNA, 103 bp, Artificial Sequence
  Synthetic Polynucleotide
taatacgactcactatagggtcatactgatccgatatcacctctggtctcaacagaggagagagaccatgggtgatatcaacctggcggcagcgcaaaagatg

SEQ ID NO: 30146 - DNA, 103 bp, Artificial Sequence
  Synthetic Polynucleotide
taatacgactcactatagggggggatctagactcccctgtccaatcgtctaacagaggagaagacgaatggacaggggaaacctggcggcagcgcaaaagatg

SEQ ID NO: 30147 - DNA, 103 bp, Artificial Sequence
  Synthetic Polynucleotide
taatacgactcactatagggcctctggggatctagactcccctgtccaataacagaggagaattggaatggggagtctaaacctggcggcagcgcaaaagatg

SEQ ID NO: 30148 - DNA, 103 bp, Artificial Sequence
  Synthetic Polynucleotide
taatacgactcactatagggcaccgcctctggggatctagactcccctgtaacagaggagaacagggatgtctagatccaacctggcggcagcgcaaaagatg

SEQ ID NO: 30149 - DNA, 103 bp, Artificial Sequence
  Synthetic Polynucleotide
taatacgactcactatagggttaaacaccgcctctggggatctagactccaacagaggagaggagtcatgatccccagaaacctggcggcagcgcaaaagatg

SEQ ID NO: 30150 - DNA, 103 bp, Artificial Sequence
  Synthetic Polynucleotide
taatacgactcactatagggtgcgattaaacaccgcctctggggatctagaacagaggagactagatatgcagaggcggaacctggcggcagcgcaaaagatg

SEQ ID NO: 30151 - DNA, 103 bp, Artificial Sequence
  Synthetic Polynucleotide
taatacgactcactatagggcatgatgcgattaaacaccgcctctggggaaacagaggagatccccaatggcggtgtttaacctggcggcagcgcaaaagatg

SEQ ID NO: 30152 - DNA, 103 bp, Artificial Sequence
  Synthetic Polynucleotide
taatacgactcactatagggtttaccatgatgcgattaaacaccgcctctaacagaggagaagaggcatggtttaatcgaacctggcggcagcgcaaaagatg

SEQ ID NO: 30153 - DNA, 103 bp, Artificial Sequence
  Synthetic Polynucleotide
taatacgactcactatagggctttgtttaccatgatgcgattaaacaccgaacagaggagacggtgtatgatcgcatcaaacctggcggcagcgcaaaagatg

SEQ ID NO: 30154 - DNA, 103 bp, Artificial Sequence
  Synthetic Polynucleotide
taatacgactcactatagggtcttcctttgtttaccatgatgcgattaaaaacagaggagatttaatatgatcatggtaaacctggcggcagcgcaaaagatg

SEQ ID NO: 30155 - DNA, 103 bp, Artificial Sequence
  Synthetic Polynucleotide
taatacgactcactatagggcgcaatcttcctttgtttaccatgatgcgaaacagaggagatcgcatatgggtaaacaaaacctggcggcagcgcaaaagatg

SEQ ID NO: 30156 - DNA, 103 bp, Artificial Sequence
  Synthetic Polynucleotide
taatacgactcactatagggtgtattcatactgatccgatatcacctctgaacagaggagacagaggatgtatcggatcaacctggcggcagcgcaaaagatg

SEQ ID NO: 30157 - DNA, 103 bp, Artificial Sequence
  Synthetic Polynucleotide
taatacgactcactataggggaggacgcaatcttcctttgtttaccatgaaacagaggagatcatggatgacaaaggaaaacctggcggcagcgcaaaagatg

SEQ ID NO: 30158 - DNA, 103 bp, Artificial Sequence
  Synthetic Polynucleotide
taatacgactcactataggggtgatgaggacgcaatcttcctttgtttacaacagaggagagtaaacatgggaagattgaacctggcggcagcgcaaaagatg

SEQ ID NO: 30159 - DNA, 103 bp, Artificial Sequence
  Synthetic Polynucleotide
taatacgactcactatagggttgatgtgatgaggacgcaatcttcctttgaacagaggagacaaaggatgattgcgtccaacctggcggcagcgcaaaagatg

SEQ ID NO: 30160 - DNA, 103 bp, Artificial Sequence
  Synthetic Polynucleotide
taatacgactcactatagggacctcttgatgtgatgaggacgcaatcttcaacagaggagagaagatatggtcctcatcaacctggcggcagcgcaaaagatg

SEQ ID NO: 30161 - DNA, 103 bp, Artificial Sequence
  Synthetic Polynucleotide
taatacgactcactatagggtctaaacctcttgatgtgatgaggacgcaaaacagaggagattgcgtatgcatcacatcaacctggcggcagcgcaaaagatg

SEQ ID NO: 30162 - DNA, 103 bp, Artificial Sequence
  Synthetic Polynucleotide
taatacgactcactatagggacgtttctaaacctcttgatgtgatgaggaaacagaggagatcctcaatgcatcaagagaacctggcggcagcgcaaaagatg

SEQ ID NO: 30163 - DNA, 103 bp, Artificial Sequence
  Synthetic Polynucleotide
taatacgactcactatagggcactgacgtttctaaacctcttgatgtgataacagaggagaatcacaatgagaggtttaaacctggcggcagcgcaaaagatg

SEQ ID NO: 30164 - DNA, 103 bp, Artificial Sequence
  Synthetic Polynucleotide
taatacgactcactatagggatttgcactgacgtttctaaacctcttgataacagaggagaatcaagatgtttagaaacaacctggcggcagcgcaaaagatg

SEQ ID NO: 30165 - DNA, 103 bp, Artificial Sequence
  Synthetic Polynucleotide
taatacgactcactatagggtgatgatttgcactgacgtttctaaacctcaacagaggagagaggttatgaaacgtcagaacctggcggcagcgcaaaagatg

SEQ ID NO: 30166 - DNA, 103 bp, Artificial Sequence
  Synthetic Polynucleotide
taatacgactcactatagggttgcctgatgatttgcactgacgtttctaaaacagaggagattagaaatgtcagtgcaaaacctggcggcagcgcaaaagatg

SEQ ID NO: 30167 - DNA, 103 bp, Artificial Sequence
  Synthetic Polynucleotide
taatacgactcactataggggtatttgtattcatactgatccgatatcacaacagaggagagtgataatggatcagtataacctggcggcagcgcaaaagatg

SEQ ID NO: 30168 - DNA, 103 bp, Artificial Sequence
  Synthetic Polynucleotide
taatacgactcactatagggcggtcttgcctgatgatttgcactgacgttaacagaggagaaacgtcatggcaaatcataacctggcggcagcgcaaaagatg

SEQ ID NO: 30169 - DNA, 103 bp, Artificial Sequence
  Synthetic Polynucleotide
taatacgactcactataggggaattcggtcttgcctgatgatttgcactgaacagaggagacagtgcatgtcatcaggcaacctggcggcagcgcaaaagatg

SEQ ID NO: 30170 - DNA, 103 bp, Artificial Sequence
  Synthetic Polynucleotide
taatacgactcactatagggcaaaagaattcggtcttgcctgatgatttgaacagaggagacaaatcatgaggcaagacaacctggcggcagcgcaaaagatg

SEQ ID NO: 30171 - DNA, 103 bp, Artificial Sequence
  Synthetic Polynucleotide
taatacgactcactatagggttctgcaaaagaattcggtcttgcctgatgaacagaggagacatcagatgagaccgaataacctggcggcagcgcaaaagatg

SEQ ID NO: 30172 - DNA, 103 bp, Artificial Sequence
  Synthetic Polynucleotide
taatacgactcactatagggaggaattctgcaaaagaattcggtcttgccaacagaggagaggcaagatggaattctttaacctggcggcagcgcaaaagatg

SEQ ID NO: 30173 - DNA, 103 bp, Artificial Sequence
  Synthetic Polynucleotide
taatacgactcactatagggtagaaaggaattctgcaaaagaattcggtcaacagaggagagaccgaatgcttttgcagaacctggcggcagcgcaaaagatg

SEQ ID NO: 30174 - DNA, 103 bp, Artificial Sequence
  Synthetic Polynucleotide
taatacgactcactatagggtactttagaaaggaattctgcaaaagaattaacagaggagaaattctatggcagaattcaacctggcggcagcgcaaaagatg

SEQ ID NO: 30175 - DNA, 103 bp, Artificial Sequence
  Synthetic Polynucleotide
taatacgactcactataggggaatatactttagaaaggaattctgcaaaaaacagaggagattttgcatgattcctttcaacctggcggcagcgcaaaagatg

SEQ ID NO: 30176 - DNA, 103 bp, Artificial Sequence
  Synthetic Polynucleotide
taatacgactcactatagggtatcagaatatactttagaaaggaattctgaacagaggagacagaatatgtttctaaagaacctggcggcagcgcaaaagatg

SEQ ID NO: 30177 - DNA, 103 bp, Artificial Sequence
  Synthetic Polynucleotide
taatacgactcactatagggtgatgtatcagaatatactttagaaaggaaaacagaggagattccttatgaaagtatataacctggcggcagcgcaaaagatg

SEQ ID NO: 30178 - DNA, 103 bp, Artificial Sequence
  Synthetic Polynucleotide
taatacgactcactataggggcagggtatttgtattcatactgatccgataacagaggagaatcggaatggtatgaataaacctggcggcagcgcaaaagatg

SEQ ID NO: 30179 - DNA, 103 bp, Artificial Sequence
  Synthetic Polynucleotide
taatacgactcactatagggtctcatgatgtatcagaatatactttagaaaacagaggagattctaaatgatattctgaaacctggcggcagcgcaaaagatg

SEQ ID NO: 30180 - DNA, 103 bp, Artificial Sequence
  Synthetic Polynucleotide
taatacgactcactatagggtctgatctcatgatgtatcagaatatacttaacagaggagaaagtatatgctgatacataacctggcggcagcgcaaaagatg

SEQ ID NO: 30181 - DNA, 103 bp, Artificial Sequence
  Synthetic Polynucleotide
taatacgactcactatagggtctcatctgatctcatgatgtatcagaataaacagaggagatattctatgacatcatgaaacctggcggcagcgcaaaagatg

SEQ ID NO: 30182 - DNA, 103 bp, Artificial Sequence
  Synthetic Polynucleotide
taatacgactcactataggggctcttctcatctgatctcatgatgtatcaaacagaggagatgatacatgatgagatcaaacctggcggcagcgcaaaagatg

SEQ ID NO: 30183 - DNA, 103 bp, Artificial Sequence
  Synthetic Polynucleotide
taatacgactcactatagggaaagagctcttctcatctgatctcatgatgaacagaggagacatcatatgatcagatgaaacctggcggcagcgcaaaagatg

SEQ ID NO: 30184 - DNA, 103 bp, Artificial Sequence
  Synthetic Polynucleotide
taatacgactcactatagggttcaaaaagagctcttctcatctgatctcaaacagaggagatgagatatgatgagaagaaacctggcggcagcgcaaaagatg

SEQ ID NO: 30185 - DNA, 103 bp, Artificial Sequence
  Synthetic Polynucleotide
taatacgactcactatagggtttttttcaaaaagagctcttctcatctgaaacagaggagatcagatatgaagagctctaacctggcggcagcgcaaaagatg

SEQ ID NO: 30186 - DNA, 103 bp, Artificial Sequence
  Synthetic Polynucleotide
taatacgactcactatagggtgatgtttttttcaaaaagagctcttctcaaacagaggagatgagaaatgctctttttgaacctggcggcagcgcaaaagatg

SEQ ID NO: 30187 - DNA, 103 bp, Artificial Sequence
  Synthetic Polynucleotide
taatacgactcactatagggagtgttgatgtttttttcaaaaagagctctaacagaggagaagagctatgtttgaaaaaaacctggcggcagcgcaaaagatg

SEQ ID NO: 30188 - DNA, 103 bp, Artificial Sequence
  Synthetic Polynucleotide
taatacgactcactatagggggagaagtgttgatgtttttttcaaaaagaaacagaggagatcttttatgaaaaaacataacctggcggcagcgcaaaagatg

SEQ ID NO: 30189 - DNA, 103 bp, Artificial Sequence
  Synthetic Polynucleotide
taatacgactcactatagggctatcgcagggtatttgtattcatactgataacagaggagaatcagtatgaatacaaataacctggcggcagcgcaaaagatg

SEQ ID NO: 30190 - DNA, 103 bp, Artificial Sequence
  Synthetic Polynucleotide
taatacgactcactataggggaagtggagaagtgttgatgtttttttcaaaacagaggagattgaaaatgacatcaacaaacctggcggcagcgcaaaagatg

SEQ ID NO: 30191 - DNA, 103 bp, Artificial Sequence
  Synthetic Polynucleotide
taatacgactcactatagggtaggtgaagtggagaagtgttgatgtttttaacagaggagaaaaaacatgaacacttctaacctggcggcagcgcaaaagatg

SEQ ID NO: 30192 - DNA, 103 bp, Artificial Sequence
  Synthetic Polynucleotide
taatacgactcactataggggatgctaggtgaagtggagaagtgttgatgaacagaggagacatcaaatgttctccactaacctggcggcagcgcaaaagatg

SEQ ID NO: 30193 - DNA, 103 bp, Artificial Sequence
  Synthetic Polynucleotide
taatacgactcactatagggtgatggatgctaggtgaagtggagaagtgtaacagaggagaacacttatgcacttcaccaacctggcggcagcgcaaaagatg

SEQ ID NO: 30194 - DNA, 103 bp, Artificial Sequence
  Synthetic Polynucleotide
taatacgactcactataggggctcatgatggatgctaggtgaagtggagaaacagaggagatctccaatgcacctagcaaacctggcggcagcgcaaaagatg

SEQ ID NO: 30195 - DNA, 103 bp, Artificial Sequence
  Synthetic Polynucleotide
taatacgactcactatagggttcttgctcatgatggatgctaggtgaagtaacagaggagaacttcaatgagcatccataacctggcggcagcgcaaaagatg

SEQ ID NO: 30196 - DNA, 103 bp, Artificial Sequence
  Synthetic Polynucleotide
taatacgactcactatagggtaaggttcttgctcatgatggatgctaggtaacagaggagaacctagatgccatcatgaaacctggcggcagcgcaaaagatg

SEQ ID NO: 30197 - DNA, 103 bp, Artificial Sequence
  Synthetic Polynucleotide
taatacgactcactatagggtcttataaggttcttgctcatgatggatgcaacagaggagagcatccatgatgagcaagaacctggcggcagcgcaaaagatg

SEQ ID NO: 30198 - DNA, 103 bp, Artificial Sequence
  Synthetic Polynucleotide
taatacgactcactatagggctcggtcttataaggttcttgctcatgatgaacagaggagacatcatatgcaagaacctaacctggcggcagcgcaaaagatg

SEQ ID NO: 30199 - DNA, 103 bp, Artificial Sequence
  Synthetic Polynucleotide
taatacgactcactatagggtgtcactcggtcttataaggttcttgctcaaacagaggagatgagcaatgaccttataaaacctggcggcagcgcaaaagatg

SEQ ID NO: 30200 - DNA, 103 bp, Artificial Sequence
  Synthetic Polynucleotide
taatacgactcactatagggcgattccttctctgtcttctggtttttagcaacagaggagagctaaaatgcagaagacaaacctggcggcagcgcaaaagatg

SEQ ID NO: 30201 - DNA, 103 bp, Artificial Sequence
  Synthetic Polynucleotide
taatacgactcactataggggttctctatcgcagggtatttgtattcataaacagaggagatatgaaatgaaataccctaacctggcggcagcgcaaaagatg

SEQ ID NO: 30202 - DNA, 103 bp, Artificial Sequence
  Synthetic Polynucleotide
taatacgactcactatagggcctgatgtcactcggtcttataaggttcttaacagaggagaaagaacatgataagaccgaacctggcggcagcgcaaaagatg

SEQ ID NO: 30203 - DNA, 103 bp, Artificial Sequence
  Synthetic Polynucleotide
taatacgactcactatagggccggccctgatgtcactcggtcttataaggaacagaggagaccttatatgaccgagtgaaacctggcggcagcgcaaaagatg

SEQ ID NO: 30204 - DNA, 103 bp, Artificial Sequence
  Synthetic Polynucleotide
taatacgactcactataggggcagcccggccctgatgtcactcggtcttaaacagaggagataagacatggtgacatcaaacctggcggcagcgcaaaagatg

SEQ ID NO: 30205 - DNA, 103 bp, Artificial Sequence
  Synthetic Polynucleotide
taatacgactcactatagggatcctgcagcccggccctgatgtcactcggaacagaggagaccgagtatgatcagggccaacctggcggcagcgcaaaagatg

SEQ ID NO: 30206 - DNA, 103 bp, Artificial Sequence
  Synthetic Polynucleotide
taatacgactcactatagggtctatatcctgcagcccggccctgatgtcaaacagaggagatgacatatgggccgggctaacctggcggcagcgcaaaagatg

SEQ ID NO: 30207 - DNA, 103 bp, Artificial Sequence
  Synthetic Polynucleotide
taatacgactcactatagggccatctctatatcctgcagcccggccctgaaacagaggagatcagggatgggctgcaggaacctggcggcagcgcaaaagatg

SEQ ID NO: 30208 - DNA, 103 bp, Artificial Sequence
  Synthetic Polynucleotide
taatacgactcactatagggctccgccatctctatatcctgcagcccggcaacagaggagagccgggatgcaggatataaacctggcggcagcgcaaaagatg

SEQ ID NO: 30209 - DNA, 103 bp, Artificial Sequence
  Synthetic Polynucleotide
taatacgactcactataggggtatcctccgccatctctatatcctgcagcaacagaggagagctgcaatgtatagagataacctggcggcagcgcaaaagatg

SEQ ID NO: 30210 - DNA, 103 bp, Artificial Sequence
  Synthetic Polynucleotide
taatacgactcactatagggtgactgtatcctccgccatctctatatcctaacagaggagaaggataatgagatggcggaacctggcggcagcgcaaaagatg

SEQ ID NO: 30211 - DNA, 103 bp, Artificial Sequence
  Synthetic Polynucleotide
taatacgactcactatagggcaagttgactgtatcctccgccatctctataacagaggagaatagagatggcggaggataacctggcggcagcgcaaaagatg

SEQ ID NO: 30212 - DNA, 103 bp, Artificial Sequence
  Synthetic Polynucleotide
taatacgactcactatagggtctttgttctctatcgcagggtatttgtataacagaggagaatacaaatgccctgcgataacctggcggcagcgcaaaagatg

SEQ ID NO: 30213 - DNA, 103 bp, Artificial Sequence
  Synthetic Polynucleotide
taatacgactcactatagggtaaaccaagttgactgtatcctccgccatcaacagaggagagatggcatgggatacagtaacctggcggcagcgcaaaagatg

SEQ ID NO: 30214 - DNA, 103 bp, Artificial Sequence
  Synthetic Polynucleotide
taatacgactcactatagggtttgataaaccaagttgactgtatcctccgaacagaggagacggaggatgcagtcaactaacctggcggcagcgcaaaagatg

SEQ ID NO: 30215 - DNA, 103 bp, Artificial Sequence
  Synthetic Polynucleotide
taatacgactcactatagggcaggttttgataaaccaagttgactgtatcaacagaggagagatacaatgaacttggttaacctggcggcagcgcaaaagatg

SEQ ID NO: 30216 - DNA, 103 bp, Artificial Sequence
  Synthetic Polynucleotide
taatacgactcactatagggctcatcaggttttgataaaccaagttgactaacagaggagaagtcaaatgggtttatcaaacctggcggcagcgcaaaagatg

SEQ ID NO: 30217 - DNA, 103 bp, Artificial Sequence
  Synthetic Polynucleotide
taatacgactcactataggggatcactcatcaggttttgataaaccaagtaacagaggagaacttggatgatcaaaaccaacctggcggcagcgcaaaagatg

SEQ ID NO: 30218 - DNA, 103 bp, Artificial Sequence
  Synthetic Polynucleotide
taatacgactcactatagggggcttgatcactcatcaggttttgataaacaacagaggagagtttatatgaacctgatgaacctggcggcagcgcaaaagatg

SEQ ID NO: 30219 - DNA, 103 bp, Artificial Sequence
  Synthetic Polynucleotide
taatacgactcactatagggaaatgggcttgatcactcatcaggttttgaaacagaggagatcaaaaatggatgagtgaaacctggcggcagcgcaaaagatg

SEQ ID NO: 30220 - DNA, 103 bp, Artificial Sequence
  Synthetic Polynucleotide
taatacgactcactatagggctcttaaatgggcttgatcactcatcaggtaacagaggagaacctgaatggtgatcaagaacctggcggcagcgcaaaagatg

SEQ ID NO: 30221 - DNA, 103 bp, Artificial Sequence
  Synthetic Polynucleotide
taatacgactcactataggggtcctctcttaaatgggcttgatcactcataacagaggagaatgagtatgcaagcccataacctggcggcagcgcaaaagatg

SEQ ID NO: 30222 - DNA, 103 bp, Artificial Sequence
  Synthetic Polynucleotide
taatacgactcactatagggatagggtcctctcttaaatgggcttgatcaaacagaggagatgatcaatgccatttaagaacctggcggcagcgcaaaagatg

SEQ ID NO: 30223 - DNA, 103 bp, Artificial Sequence
  Synthetic Polynucleotide
taatacgactcactataggggcttctctttgttctctatcgcagggtattaacagaggagaaataccatgcgatagagaaacctggcggcagcgcaaaagatg

SEQ ID NO: 30224 - DNA, 103 bp, Artificial Sequence
  Synthetic Polynucleotide
taatacgactcactatagggtgtctatagggtcctctcttaaatgggcttaacagaggagaaagcccatgtaagagaggaacctggcggcagcgcaaaagatg

SEQ ID NO: 30225 - DNA, 103 bp, Artificial Sequence
  Synthetic Polynucleotide
taatacgactcactatagggcttgatgtctatagggtcctctcttaaatgaacagaggagacatttaatggaggaccctaacctggcggcagcgcaaaagatg

SEQ ID NO: 30226 - DNA, 103 bp, Artificial Sequence
  Synthetic Polynucleotide
taatacgactcactatagggagagtcttgatgtctatagggtcctctcttaacagaggagaaagagaatgccctatagaaacctggcggcagcgcaaaagatg

SEQ ID NO: 30227 - DNA, 103 bp, Artificial Sequence
  Synthetic Polynucleotide
taatacgactcactatagggcgggaagagtcttgatgtctatagggtcctaacagaggagaaggaccatgtagacatcaaacctggcggcagcgcaaaagatg

SEQ ID NO: 30228 - DNA, 103 bp, Artificial Sequence
  Synthetic Polynucleotide
taatacgactcactatagggatgttcgggaagagtcttgatgtctataggaacagaggagacctataatgatcaagactaacctggcggcagcgcaaaagatg

SEQ ID NO: 30229 - DNA, 103 bp, Artificial Sequence
  Synthetic Polynucleotide
taatacgactcactatagggtgaaaatgttcgggaagagtcttgatgtctaacagaggagaagacatatggactcttccaacctggcggcagcgcaaaagatg

SEQ ID NO: 30230 - DNA, 103 bp, Artificial Sequence
  Synthetic Polynucleotide
taatacgactcactatagggttccttgaaaatgttcgggaagagtcttgaaacagaggagatcaagaatgttcccgaacaacctggcggcagcgcaaaagatg

SEQ ID NO: 30231 - DNA, 103 bp, Artificial Sequence
  Synthetic Polynucleotide
taatacgactcactatagggtgaaattccttgaaaatgttcgggaagagtaacagaggagaactcttatggaacattttaacctggcggcagcgcaaaagatg

SEQ ID NO: 30232 - DNA, 103 bp, Artificial Sequence
  Synthetic Polynucleotide
taatacgactcactatagggttcaatgaaattccttgaaaatgttcgggaaacagaggagatcccgaatgttttcaaggaacctggcggcagcgcaaaagatg

SEQ ID NO: 30233 - DNA, 103 bp, Artificial Sequence
  Synthetic Polynucleotide
taatacgactcactatagggttcccttcaatgaaattccttgaaaatgttaacagaggagaaacattatgaaggaatttaacctggcggcagcgcaaaagatg

SEQ ID NO: 30234 - DNA, 103 bp, Artificial Sequence
  Synthetic Polynucleotide
taatacgactcactatagggtgtaggcttctctttgttctctatcgcaggaacagaggagacctgcgatggagaacaaaaacctggcggcagcgcaaaagatg

SEQ ID NO: 30235 - DNA, 103 bp, Artificial Sequence
  Synthetic Polynucleotide
taatacgactcactatagggctcatttcccttcaatgaaattccttgaaaaacagaggagatttcaaatgatttcattgaacctggcggcagcgcaaaagatg

SEQ ID NO: 30236 - DNA, 103 bp, Artificial Sequence
  Synthetic Polynucleotide
taatacgactcactatagggttcccctcatttcccttcaatgaaattcctaacagaggagaaggaatatgattgaagggaacctggcggcagcgcaaaagatg

SEQ ID NO: 30237 - DNA, 103 bp, Artificial Sequence
  Synthetic Polynucleotide
taatacgactcactatagggctgtattcccctcatttcccttcaatgaaaaacagaggagatttcatatgagggaaatgaacctggcggcagcgcaaaagatg

SEQ ID NO: 30238 - DNA, 103 bp, Artificial Sequence
  Synthetic Polynucleotide
taatacgactcactatagggatcagctgtattcccctcatttcccttcaaaacagaggagattgaagatgaatgaggggaacctggcggcagcgcaaaagatg

SEQ ID NO: 30239 - DNA, 103 bp, Artificial Sequence
  Synthetic Polynucleotide
taatacgactcactatagggtggcgatcagctgtattcccctcatttcccaacagaggagagggaaaatgggggaatacaacctggcggcagcgcaaaagatg

SEQ ID NO: 30240 - DNA, 103 bp, Artificial Sequence
  Synthetic Polynucleotide
taatacgactcactatagggcttcctggcgatcagctgtattcccctcataacagaggagaatgaggatgatacagctgaacctggcggcagcgcaaaagatg

SEQ ID NO: 30241 - DNA, 103 bp, Artificial Sequence
  Synthetic Polynucleotide
taatacgactcactatagggttcttcttcctggcgatcagctgtattcccaacagaggagagggaatatggctgatcgcaacctggcggcagcgcaaaagatg

SEQ ID NO: 30242 - DNA, 103 bp, Artificial Sequence
  Synthetic Polynucleotide
taatacgactcactatagggtactcttcttcttcctggcgatcagctgtaaacagaggagatacagcatgtcgccaggaaacctggcggcagcgcaaaagatg

SEQ ID NO: 30243 - DNA, 103 bp, Artificial Sequence
  Synthetic Polynucleotide
taatacgactcactatagggcctcatactcttcttcttcctggcgatcagaacagaggagactgatcatgaggaagaagaacctggcggcagcgcaaaagatg

SEQ ID NO: 30244 - DNA, 103 bp, Artificial Sequence
  Synthetic Polynucleotide
taatacgactcactatagggatcatcctcatactcttcttcttcctggcgaacagaggagacgccagatggaagaagagaacctggcggcagcgcaaaagatg

SEQ ID NO: 30245 - DNA, 103 bp, Artificial Sequence
  Synthetic Polynucleotide
taatacgactcactataggggttattgtaggcttctctttgttctctatcaacagaggagagatagaatgcaaagagaaaacctggcggcagcgcaaaagatg

SEQ ID NO: 30246 - DNA, 103 bp, Artificial Sequence
  Synthetic Polynucleotide
taatacgactcactatagggtctgtatcatcctcatactcttcttcttccaacagaggagaggaagaatgagagtatgaaacctggcggcagcgcaaaagatg

SEQ ID NO: 30247 - DNA, 103 bp, Artificial Sequence
  Synthetic Polynucleotide
taatacgactcactatagggctgactctgtatcatcctcatactcttcttaacagaggagaaagaagatgatgaggatgaacctggcggcagcgcaaaagatg

SEQ ID NO: 30248 - DNA, 103 bp, Artificial Sequence
  Synthetic Polynucleotide
taatacgactcactataggggtcctctgactctgtatcatcctcatactcaacagaggagagagtatatggatgatacaaacctggcggcagcgcaaaagatg

SEQ ID NO: 30249 - DNA, 103 bp, Artificial Sequence
  Synthetic Polynucleotide
taatacgactcactatagggtcaatgtcctctgactctgtatcatcctcaaacagaggagatgaggaatgtacagagtcaacctggcggcagcgcaaaagatg

SEQ ID NO: 30250 - DNA, 103 bp, Artificial Sequence
  Synthetic Polynucleotide
taatacgactcactatagggtggggtcaatgtcctctgactctgtatcataacagaggagaatgataatgagtcagaggaacctggcggcagcgcaaaagatg

SEQ ID NO: 30251 - DNA, 103 bp, Artificial Sequence
  Synthetic Polynucleotide
taatacgactcactatagggttccatggggtcaatgtcctctgactctgtaacagaggagaacagagatggaggacattaacctggcggcagcgcaaaagatg

SEQ ID NO: 30252 - DNA, 103 bp, Artificial Sequence
  Synthetic Polynucleotide
taatacgactcactatagggagctcttccatggggtcaatgtcctctgacaacagaggagagtcagaatgcattgacccaacctggcggcagcgcaaaagatg

SEQ ID NO: 30253 - DNA, 103 bp, Artificial Sequence
  Synthetic Polynucleotide
taatacgactcactatagggcttgaagctcttccatggggtcaatgtcctaacagaggagaaggacaatgaccccatggaacctggcggcagcgcaaaagatg

SEQ ID NO: 30254 - DNA, 103 bp, Artificial Sequence
  Synthetic Polynucleotide
taatacgactcactataggggaaatcttgaagctcttccatggggtcaataacagaggagaattgacatgatggaagagaacctggcggcagcgcaaaagatg

SEQ ID NO: 30255 - DNA, 103 bp, Artificial Sequence
  Synthetic Polynucleotide
taatacgactcactatagggtctaggaaatcttgaagctcttccatggggaacagaggagaccccatatgagagcttcaaacctggcggcagcgcaaaagatg

SEQ ID NO: 30256 - DNA, 103 bp, Artificial Sequence
  Synthetic Polynucleotide
taatacgactcactataggggtagagttattgtaggcttctctttgttctaacagaggagaagaacaatgagaagcctaaacctggcggcagcgcaaaagatg

SEQ ID NO: 30257 - DNA, 103 bp, Artificial Sequence
  Synthetic Polynucleotide
taatacgactcactatagggaatcatctaggaaatcttgaagctcttccaaacagaggagatggaagatgttcaagattaacctggcggcagcgcaaaagatg

SEQ ID NO: 30258 - DNA, 103 bp, Artificial Sequence
  Synthetic Polynucleotide
taatacgactcactatagggtcccaaatcatctaggaaatcttgaagctcaacagaggagagagcttatggatttcctaaacctggcggcagcgcaaaagatg

SEQ ID NO: 30259 - DNA, 103 bp, Artificial Sequence
  Synthetic Polynucleotide
taatacgactcactatagggtgagatcccaaatcatctaggaaatcttgaaacagaggagatcaagaatgcctagatgaaacctggcggcagcgcaaaagatg

SEQ ID NO: 30260 - DNA, 103 bp, Artificial Sequence
  Synthetic Polynucleotide
taatacgactcactatagggagatctgagatcccaaatcatctaggaaataacagaggagaatttccatgatgatttggaacctggcggcagcgcaaaagatg

SEQ ID NO: 30261 - DNA, 103 bp, Artificial Sequence
  Synthetic Polynucleotide
taatacgactcactatagggggacaagatctgagatcccaaatcatctagaacagaggagactagatatgttgggatctaacctggcggcagcgcaaaagatg

SEQ ID NO: 30262 - DNA, 103 bp, Artificial Sequence
  Synthetic Polynucleotide
taatacgactcactatagggaatctggacaagatctgagatcccaaatcaaacagaggagatgatttatgatctcagataacctggcggcagcgcaaaagatg

SEQ ID NO: 30263 - DNA, 103 bp, Artificial Sequence
  Synthetic Polynucleotide
taatacgactcactatagggtctttaatctggacaagatctgagatcccaaacagaggagatgggatatgagatcttgtaacctggcggcagcgcaaaagatg

SEQ ID NO: 30264 - DNA, 103 bp, Artificial Sequence
  Synthetic Polynucleotide
taatacgactcactatagggtcccttctttaatctggacaagatctgagaaacagaggagatctcagatgttgtccagaaacctggcggcagcgcaaaagatg

SEQ ID NO: 30265 - DNA, 103 bp, Artificial Sequence
  Synthetic Polynucleotide
taatacgactcactatagggttatctcccttctttaatctggacaagatcaacagaggagagatcttatgcagattaaaaacctggcggcagcgcaaaagatg

SEQ ID NO: 30266 - DNA, 103 bp, Artificial Sequence
  Synthetic Polynucleotide
taatacgactcactatagggtgattttatctcccttctttaatctggacaaacagaggagatgtccaatgtaaagaaggaacctggcggcagcgcaaaagatg

SEQ ID NO: 30267 - DNA, 103 bp, Artificial Sequence
  Synthetic Polynucleotide
taatacgactcactatagggtttttgtagagttattgtaggcttctctttaacagaggagaaaagagatgcctacaataaacctggcggcagcgcaaaagatg

SEQ ID NO: 30268 - DNA, 103 bp, Artificial Sequence
  Synthetic Polynucleotide
taatacgactcactatagggtttcttgattttatctcccttctttaatctaacagaggagaagattaatgaagggagataacctggcggcagcgcaaaagatg

SEQ ID NO: 30269 - DNA, 103 bp, Artificial Sequence
  Synthetic Polynucleotide
taatacgactcactatagggcatattttcttgattttatctcccttctttaacagaggagaaaagaaatgagataaaataacctggcggcagcgcaaaagatg

SEQ ID NO: 30270 - DNA, 103 bp, Artificial Sequence
  Synthetic Polynucleotide
taatacgactcactatagggctggccatattttcttgattttatctccctaacagaggagaagggagatgaaatcaagaaacctggcggcagcgcaaaagatg

SEQ ID NO: 30271 - DNA, 103 bp, Artificial Sequence
  Synthetic Polynucleotide
taatacgactcactatagggggcccctggccatattttcttgattttatcaacagaggagagataaaatgaagaaaataaacctggcggcagcgcaaaagatg

SEQ ID NO: 30272 - DNA, 103 bp, Artificial Sequence
  Synthetic Polynucleotide
taatacgactcactatagggagagaggcccctggccatattttcttgattaacagaggagaaatcaaatgaatatggccaacctggcggcagcgcaaaagatg

SEQ ID NO: 30273 - DNA, 103 bp, Artificial Sequence
  Synthetic Polynucleotide
taatacgactcactatagggtggacagagaggcccctggccatattttctaacagaggagaagaaaaatgggccaggggaacctggcggcagcgcaaaagatg

SEQ ID NO: 30274 - DNA, 103 bp, Artificial Sequence
  Synthetic Polynucleotide
taatacgactcactatagggctgtatggacagagaggcccctggccatataacagaggagaatatggatgggggcctctaacctggcggcagcgcaaaagatg

SEQ ID NO: 30275 - DNA, 103 bp, Artificial Sequence
  Synthetic Polynucleotide
taatacgactcactatagggaaattctgtatggacagagaggcccctggcaacagaggagagccaggatgctctctgtcaacctggcggcagcgcaaaagatg

SEQ ID NO: 30276 - DNA, 103 bp, Artificial Sequence
  Synthetic Polynucleotide
taatacgactcactatagggtaacaaaattctgtatggacagagaggcccaacagaggagagggcctatgtgtccatacaacctggcggcagcgcaaaagatg

SEQ ID NO: 30277 - DNA, 103 bp, Artificial Sequence
  Synthetic Polynucleotide
taatacgactcactatagggtgttttaacaaaattctgtatggacagagaaacagaggagatctctgatgatacagaataacctggcggcagcgcaaaagatg

SEQ ID NO: 30278 - DNA, 103 bp, Artificial Sequence
  Synthetic Polynucleotide
taatacgactcactatagggggggctttttgtagagttattgtaggcttcaacagaggagagaagccatgaataactctaacctggcggcagcgcaaaagatg

SEQ ID NO: 30279 - DNA, 103 bp, Artificial Sequence
  Synthetic Polynucleotide
taatacgactcactatagggaattttgttttaacaaaattctgtatggacaacagaggagagtccatatggaattttgtaacctggcggcagcgcaaaagatg

SEQ ID NO: 30280 - DNA, 103 bp, Artificial Sequence
  Synthetic Polynucleotide
taatacgactcactatagggagaggaattttgttttaacaaaattctgtaaacagaggagatacagaatgttgttaaaaaacctggcggcagcgcaaaagatg

SEQ ID NO: 30281 - DNA, 103 bp, Artificial Sequence
  Synthetic Polynucleotide
taatacgactcactatagggtttggagaggaattttgttttaacaaaattaacagaggagaaattttatgaaaacaaaaaacctggcggcagcgcaaaagatg

SEQ ID NO: 30282 - DNA, 103 bp, Artificial Sequence
  Synthetic Polynucleotide
taatacgactcactataggggatattttggagaggaattttgttttaacaaacagaggagatgttaaatgaaaattcctaacctggcggcagcgcaaaagatg

SEQ ID NO: 30283 - DNA, 103 bp, Artificial Sequence
  Synthetic Polynucleotide
taatacgactcactatagggcatctgatattttggagaggaattttgtttaacagaggagaaaacaaatgtcctctccaaacctggcggcagcgcaaaagatg

SEQ ID NO: 30284 - DNA, 103 bp, Artificial Sequence
  Synthetic Polynucleotide
taatacgactcactatagggaaccgcatctgatattttggagaggaatttaacagaggagaaaattcatgtccaaaataaacctggcggcagcgcaaaagatg

SEQ ID NO: 30285 - DNA, 103 bp, Artificial Sequence
  Synthetic Polynucleotide
taatacgactcactatagggtcgcaaaccgcatctgatattttggagaggaacagaggagacctctcatgaatatcagaaacctggcggcagcgcaaaagatg

SEQ ID NO: 30286 - DNA, 103 bp, Artificial Sequence
  Synthetic Polynucleotide
taatacgactcactatagggtgtcttcgcaaaccgcatctgatattttggaacagaggagaccaaaaatgcagatgcggaacctggcggcagcgcaaaagatg

SEQ ID NO: 30287 - DNA, 103 bp, Artificial Sequence
  Synthetic Polynucleotide
taatacgactcactatagggaaatttgtcttcgcaaaccgcatctgatataacagaggagaatatcaatggcggtttgcaacctggcggcagcgcaaaagatg

SEQ ID NO: 30288 - DNA, 103 bp, Artificial Sequence
  Synthetic Polynucleotide
taatacgactcactatagggtgagaaaatttgtcttcgcaaaccgcatctaacagaggagaagatgcatgttgcgaagaaacctggcggcagcgcaaaagatg

SEQ ID NO: 30289 - DNA, 103 bp, Artificial Sequence
  Synthetic Polynucleotide
taatacgactcactataggggatcaggggctttttgtagagttattgtagaacagaggagactacaaatgctctacaaaaacctggcggcagcgcaaaagatg

SEQ ID NO: 30290 - DNA, 103 bp, Artificial Sequence
  Synthetic Polynucleotide
taatacgactcactatagggcagtctgagaaaatttgtcttcgcaaaccgaacagaggagacggtttatgaagacaaataacctggcggcagcgcaaaagatg

SEQ ID NO: 30291 - DNA, 103 bp, Artificial Sequence
  Synthetic Polynucleotide
taatacgactcactatagggtggatcagtctgagaaaatttgtcttcgcaaacagaggagatgcgaaatgaaattttctaacctggcggcagcgcaaaagatg

SEQ ID NO: 30292 - DNA, 103 bp, Artificial Sequence
  Synthetic Polynucleotide
taatacgactcactatagggattattggatcagtctgagaaaatttgtctaacagaggagaagacaaatgttctcagacaacctggcggcagcgcaaaagatg

SEQ ID NO: 30293 - DNA, 103 bp, Artificial Sequence
  Synthetic Polynucleotide
taatacgactcactatagggacgacattattggatcagtctgagaaaattaacagaggagaaattttatgagactgatcaacctggcggcagcgcaaaagatg

SEQ ID NO: 30294 - DNA, 103 bp, Artificial Sequence
  Synthetic Polynucleotide
taatacgactcactatagggacaaaacgacattattggatcagtctgagaaacagaggagatctcagatggatccaataaacctggcggcagcgcaaaagatg

SEQ ID NO: 30295 - DNA, 103 bp, Artificial Sequence
  Synthetic Polynucleotide
taatacgactcactatagggccttcacaaaacgacattattggatcagtcaacagaggagagactgaatgaataatgtcaacctggcggcagcgcaaaagatg

SEQ ID NO: 30296 - DNA, 103 bp, Artificial Sequence
  Synthetic Polynucleotide
taatacgactcactatagggttgagccttcacaaaacgacattattggataacagaggagaatccaaatgtgtcgttttaacctggcggcagcgcaaaagatg

SEQ ID NO: 30297 - DNA, 103 bp, Artificial Sequence
  Synthetic Polynucleotide
taatacgactcactatagggaattgttgagccttcacaaaacgacattataacagaggagaataatgatgttttgtgaaaacctggcggcagcgcaaaagatg

SEQ ID NO: 30298 - DNA, 103 bp, Artificial Sequence
  Synthetic Polynucleotide
taatacgactcactataggggaaggaattgttgagccttcacaaaacgacaacagaggagagtcgttatgtgaaggctcaacctggcggcagcgcaaaagatg

SEQ ID NO: 30299 - DNA, 103 bp, Artificial Sequence
  Synthetic Polynucleotide
taatacgactcactatagggtttctgaaggaattgttgagccttcacaaaaacagaggagatttgtgatggctcaacaaaacctggcggcagcgcaaaagatg

SEQ ID NO: 30300 - DNA, 103 bp, Artificial Sequence
  Synthetic Polynucleotide
taatacgactcactataggggttcagatcaggggctttttgtagagttataacagaggagaataactatgcaaaaagccaacctggcggcagcgcaaaagatg

SEQ ID NO: 30301 - DNA, 103 bp, Artificial Sequence
  Synthetic Polynucleotide
taatacgactcactatagggtaggctttctgaaggaattgttgagccttcaacagaggagagaaggcatgacaattcctaacctggcggcagcgcaaaagatg

SEQ ID NO: 30302 - DNA, 103 bp, Artificial Sequence
  Synthetic Polynucleotide
taatacgactcactatagggtattctaggctttctgaaggaattgttgagaacagaggagactcaacatgtccttcagaaacctggcggcagcgcaaaagatg

SEQ ID NO: 30303 - DNA, 103 bp, Artificial Sequence
  Synthetic Polynucleotide
taatacgactcactatagggtctcatattctaggctttctgaaggaattgaacagaggagacaattcatgcagaaagccaacctggcggcagcgcaaaagatg

SEQ ID NO: 30304 - DNA, 103 bp, Artificial Sequence
  Synthetic Polynucleotide
taatacgactcactatagggttccttctcatattctaggctttctgaaggaacagaggagaccttcaatgagcctagaaaacctggcggcagcgcaaaagatg

SEQ ID NO: 30305 - DNA, 103 bp, Artificial Sequence
  Synthetic Polynucleotide
taatacgactcactatagggtctacttccttctcatattctaggctttctaacagaggagaagaaagatgagaatatgaaacctggcggcagcgcaaaagatg

SEQ ID NO: 30306 - DNA, 103 bp, Artificial Sequence
  Synthetic Polynucleotide
taatacgactcactatagggtcatctctacttccttctcatattctaggcaacagaggagagcctagatgatgagaaggaacctggcggcagcgcaaaagatg

SEQ ID NO: 30307 - DNA, 103 bp, Artificial Sequence
  Synthetic Polynucleotide
taatacgactcactatagggatctctcatctctacttccttctcatattcaacagaggagagaatatatgaaggaagtaaacctggcggcagcgcaaaagatg

SEQ ID NO: 30308 - DNA, 103 bp, Artificial Sequence
  Synthetic Polynucleotide
taatacgactcactatagggtcgtcatctctcatctctacttccttctcaaacagaggagatgagaaatgagtagagataacctggcggcagcgcaaaagatg

SEQ ID NO: 30309 - DNA, 103 bp, Artificial Sequence
  Synthetic Polynucleotide
taatacgactcactatagggtcgactcgtcatctctcatctctacttcctaacagaggagaaggaagatgagatgagagaacctggcggcagcgcaaaagatg

SEQ ID NO: 30310 - DNA, 103 bp, Artificial Sequence
  Synthetic Polynucleotide
taatacgactcactatagggctgattcgactcgtcatctctcatctctacaacagaggagagtagagatgagagatgacaacctggcggcagcgcaaaagatg

SEQ ID NO: 30311 - DNA, 103 bp, Artificial Sequence
  Synthetic Polynucleotide
taatacgactcactatagggcccttcgattccttctctgtcttctggtttaacagaggagaaaaccaatggacagagaaaacctggcggcagcgcaaaagatg

SEQ ID NO: 30312 - DNA, 103 bp, Artificial Sequence
  Synthetic Polynucleotide
taatacgactcactataggggctatgttcagatcaggggctttttgtagaaacagaggagatctacaatgagcccctgaaacctggcggcagcgcaaaagatg

SEQ ID NO: 30313 - DNA, 103 bp, Artificial Sequence
  Synthetic Polynucleotide
taatacgactcactatagggcaacactgattcgactcgtcatctctcatcaacagaggagagatgagatgtgacgagtcaacctggcggcagcgcaaaagatg

SEQ ID NO: 30314 - DNA, 103 bp, Artificial Sequence
  Synthetic Polynucleotide
taatacgactcactatagggctgagcaacactgattcgactcgtcatctcaacagaggagagagatgatgagtcgaatcaacctggcggcagcgcaaaagatg

SEQ ID NO: 30315 - DNA, 103 bp, Artificial Sequence
  Synthetic Polynucleotide
taatacgactcactatagggcagttctgagcaacactgattcgactcgtcaacagaggagagacgagatgaatcagtgtaacctggcggcagcgcaaaagatg

SEQ ID NO: 30316 - DNA, 103 bp, Artificial Sequence
  Synthetic Polynucleotide
taatacgactcactatagggtcatgcagttctgagcaacactgattcgacaacagaggagagtcgaaatggtgttgctcaacctggcggcagcgcaaaagatg

SEQ ID NO: 30317 - DNA, 103 bp, Artificial Sequence
  Synthetic Polynucleotide
taatacgactcactatagggcatcttcatgcagttctgagcaacactgataacagaggagaatcagtatggctcagaacaacctggcggcagcgcaaaagatg

SEQ ID NO: 30318 - DNA, 103 bp, Artificial Sequence
  Synthetic Polynucleotide
taatacgactcactatagggttcttcatcttcatgcagttctgagcaacaaacagaggagatgttgcatggaactgcataacctggcggcagcgcaaaagatg

SEQ ID NO: 30319 - DNA, 103 bp, Artificial Sequence
  Synthetic Polynucleotide
taatacgactcactatagggtcaacttcttcatcttcatgcagttctgagaacagaggagactcagaatggcatgaagaaacctggcggcagcgcaaaagatg

SEQ ID NO: 30320 - DNA, 103 bp, Artificial Sequence
  Synthetic Polynucleotide
taatacgactcactatagggctgcttcaacttcttcatcttcatgcagttaacagaggagaaactgcatgaagatgaagaacctggcggcagcgcaaaagatg

SEQ ID NO: 30321 - DNA, 103 bp, Artificial Sequence
  Synthetic Polynucleotide
taatacgactcactatagggaatctctgcttcaacttcttcatcttcatgaacagaggagacatgaaatggaagaagttaacctggcggcagcgcaaaagatg

SEQ ID NO: 30322 - DNA, 103 bp, Artificial Sequence
  Synthetic Polynucleotide
taatacgactcactatagggtgagcaatctctgcttcaacttcttcatctaacagaggagaagatgaatgagttgaagcaacctggcggcagcgcaaaagatg

SEQ ID NO: 30323 - DNA, 103 bp, Artificial Sequence
  Synthetic Polynucleotide
taatacgactcactatagggtgtatgctatgttcagatcaggggctttttaacagaggagaaaaaagatgctgatctgaaacctggcggcagcgcaaaagatg

SEQ ID NO: 30324 - DNA, 103 bp, Artificial Sequence
  Synthetic Polynucleotide
taatacgactcactatagggcttgatgagcaatctctgcttcaacttcttaacagaggagaaagaagatgaagcagagaaacctggcggcagcgcaaaagatg

SEQ ID NO: 30325 - DNA, 103 bp, Artificial Sequence
  Synthetic Polynucleotide
taatacgactcactatagggtcccacttgatgagcaatctctgcttcaacaacagaggagagttgaaatggagattgctaacctggcggcagcgcaaaagatg

SEQ ID NO: 30326 - DNA, 103 bp, Artificial Sequence
  Synthetic Polynucleotide
taatacgactcactatagggctttctcccacttgatgagcaatctctgctaacagaggagaagcagaatgtgctcatcaaacctggcggcagcgcaaaagatg

SEQ ID NO: 30327 - DNA, 103 bp, Artificial Sequence
  Synthetic Polynucleotide
taatacgactcactatagggcaaagctttctcccacttgatgagcaatctaacagaggagaagattgatgatcaagtggaacctggcggcagcgcaaaagatg

SEQ ID NO: 30328 - DNA, 103 bp, Artificial Sequence
  Synthetic Polynucleotide
taatacgactcactatagggtttagcaaagctttctcccacttgatgagcaacagaggagagctcatatggtgggagaaaacctggcggcagcgcaaaagatg

SEQ ID NO: 30329 - DNA, 103 bp, Artificial Sequence
  Synthetic Polynucleotide
taatacgactcactatagggtattttttagcaaagctttctcccacttgaaacagaggagatcaagtatgagaaagcttaacctggcggcagcgcaaaagatg

SEQ ID NO: 30330 - DNA, 103 bp, Artificial Sequence
  Synthetic Polynucleotide
taatacgactcactatagggacttgtattttttagcaaagctttctcccaaacagaggagatgggagatggctttgctaaacctggcggcagcgcaaaagatg

SEQ ID NO: 30331 - DNA, 103 bp, Artificial Sequence
  Synthetic Polynucleotide
taatacgactcactatagggagggaacttgtattttttagcaaagctttcaacagaggagagaaagcatggctaaaaaaaacctggcggcagcgcaaaagatg

SEQ ID NO: 30332 - DNA, 103 bp, Artificial Sequence
  Synthetic Polynucleotide
taatacgactcactatagggcttgaagggaacttgtattttttagcaaagaacagaggagactttgcatgaaaatacaaaacctggcggcagcgcaaaagatg

SEQ ID NO: 30333 - DNA, 103 bp, Artificial Sequence
  Synthetic Polynucleotide
taatacgactcactatagggatgatcttgaagggaacttgtattttttagaacagaggagactaaaaatgacaagttccaacctggcggcagcgcaaaagatg

SEQ ID NO: 30334 - DNA, 103 bp, Artificial Sequence
  Synthetic Polynucleotide
taatacgactcactatagggagatttgtatgctatgttcagatcaggggcaacagaggagagcccctatgctgaacataaacctggcggcagcgcaaaagatg

SEQ ID NO: 30335 - DNA, 103 bp, Artificial Sequence
  Synthetic Polynucleotide
taatacgactcactatagggcccagatgatcttgaagggaacttgtatttaacagaggagaaaatacatgttcccttcaaacctggcggcagcgcaaaagatg

SEQ ID NO: 30336 - DNA, 103 bp, Artificial Sequence
  Synthetic Polynucleotide
taatacgactcactatagggaagatcccagatgatcttgaagggaacttgaacagaggagacaagttatgttcaagatcaacctggcggcagcgcaaaagatg

SEQ ID NO: 30337 - DNA, 103 bp, Artificial Sequence
  Synthetic Polynucleotide
taatacgactcactatagggacaagaagatcccagatgatcttgaagggaaacagaggagatcccttatggatcatctgaacctggcggcagcgcaaaagatg

SEQ ID NO: 30338 - DNA, 103 bp, Artificial Sequence
  Synthetic Polynucleotide
taatacgactcactataggggttccacaagaagatcccagatgatcttgaaacagaggagatcaagaatgtctgggatcaacctggcggcagcgcaaaagatg

SEQ ID NO: 30339 - DNA, 103 bp, Artificial Sequence
  Synthetic Polynucleotide
taatacgactcactatagggtcaaagttccacaagaagatcccagatgataacagaggagaatcatcatggatcttcttaacctggcggcagcgcaaaagatg

SEQ ID NO: 30340 - DNA, 103 bp, Artificial Sequence
  Synthetic Polynucleotide
taatacgactcactataggggttgttcaaagttccacaagaagatcccagaacagaggagactgggaatgtcttgtggaaacctggcggcagcgcaaaagatg

SEQ ID NO: 30341 - DNA, 103 bp, Artificial Sequence
  Synthetic Polynucleotide
taatacgactcactatagggctttagttgttcaaagttccacaagaagataacagaggagaatcttcatgtggaactttaacctggcggcagcgcaaaagatg

SEQ ID NO: 30342 - DNA, 103 bp, Artificial Sequence
  Synthetic Polynucleotide
taatacgactcactatagggttcatctttagttgttcaaagttccacaagaacagaggagacttgtgatgctttgaacaaacctggcggcagcgcaaaagatg

SEQ ID NO: 30343 - DNA, 103 bp, Artificial Sequence
  Synthetic Polynucleotide
taatacgactcactatagggctaaattcatctttagttgttcaaagttccaacagaggagaggaactatgaacaactaaaacctggcggcagcgcaaaagatg

SEQ ID NO: 30344 - DNA, 103 bp, Artificial Sequence
  Synthetic Polynucleotide
taatacgactcactatagggatcatctaaattcatctttagttgttcaaaaacagaggagatttgaaatgctaaagatgaacctggcggcagcgcaaaagatg

SEQ ID NO: 30345 - DNA, 103 bp, Artificial Sequence
  Synthetic Polynucleotide
taatacgactcactatagggaaaacagatttgtatgctatgttcagatcaaacagaggagatgatctatgcatagcataaacctggcggcagcgcaaaagatg

SEQ ID NO: 30346 - DNA, 103 bp, Artificial Sequence
  Synthetic Polynucleotide
taatacgactcactatagggacgatatcatctaaattcatctttagttgtaacagaggagaacaactatggatgaatttaacctggcggcagcgcaaaagatg

SEQ ID NO: 30347 - DNA, 103 bp, Artificial Sequence
  Synthetic Polynucleotide
taatacgactcactatagggtcttaacgatatcatctaaattcatctttaaacagaggagataaagaatgatttagatgaacctggcggcagcgcaaaagatg

SEQ ID NO: 30348 - DNA, 103 bp, Artificial Sequence
  Synthetic Polynucleotide
taatacgactcactatagggtgcagtcttaacgatatcatctaaattcataacagaggagaatgaatatggatgatatcaacctggcggcagcgcaaaagatg

SEQ ID NO: 30349 - DNA, 103 bp, Artificial Sequence
  Synthetic Polynucleotide
taatacgactcactatagggtcttgtgcagtcttaacgatatcatctaaaaacagaggagatttagaatgtatcgttaaaacctggcggcagcgcaaaagatg

SEQ ID NO: 30350 - DNA, 103 bp, Artificial Sequence
  Synthetic Polynucleotide
taatacgactcactataggggaacctcttgtgcagtcttaacgatatcataacagaggagaatgataatgttaagactgaacctggcggcagcgcaaaagatg

SEQ ID NO: 30351 - DNA, 103 bp, Artificial Sequence
  Synthetic Polynucleotide
taatacgactcactatagggtcccggaacctcttgtgcagtcttaacgataacagaggagaatcgttatgactgcacaaaacctggcggcagcgcaaaagatg

SEQ ID NO: 30352 - DNA, 103 bp, Artificial Sequence
  Synthetic Polynucleotide
taatacgactcactatagggatgattcccggaacctcttgtgcagtcttaaacagaggagataagacatgacaagaggtaacctggcggcagcgcaaaagatg

SEQ ID NO: 30353 - DNA, 103 bp, Artificial Sequence
  Synthetic Polynucleotide
taatacgactcactatagggattctatgattcccggaacctcttgtgcagaacagaggagactgcacatgaggttccggaacctggcggcagcgcaaaagatg

SEQ ID NO: 30354 - DNA, 103 bp, Artificial Sequence
  Synthetic Polynucleotide
taatacgactcactatagggagcccattctatgattcccggaacctcttgaacagaggagacaagagatgccgggaatcaacctggcggcagcgcaaaagatg

SEQ ID NO: 30355 - DNA, 103 bp, Artificial Sequence
  Synthetic Polynucleotide
taatacgactcactatagggtccctagcccattctatgattcccggaaccaacagaggagaggttccatgaatcatagaaacctggcggcagcgcaaaagatg

SEQ ID NO: 30356 - DNA, 103 bp, Artificial Sequence
  Synthetic Polynucleotide
taatacgactcactatagggctgacaaaacagatttgtatgctatgttcaaacagaggagatgaacaatgcatacaaataacctggcggcagcgcaaaagatg

SEQ ID NO: 30357 - DNA, 103 bp, Artificial Sequence
  Synthetic Polynucleotide
taatacgactcactatagggtcccctccctagcccattctatgattcccgaacagaggagacgggaaatgtagaatgggaacctggcggcagcgcaaaagatg

SEQ ID NO: 30358 - DNA, 103 bp, Artificial Sequence
  Synthetic Polynucleotide
taatacgactcactataggggtttttcccctccctagcccattctatgataacagaggagaatcataatgtgggctaggaacctggcggcagcgcaaaagatg

SEQ ID NO: 30359 - DNA, 103 bp, Artificial Sequence
  Synthetic Polynucleotide
taatacgactcactataggggggaggtttttcccctccctagcccattctaacagaggagaagaatgatgtagggagggaacctggcggcagcgcaaaagatg

SEQ ID NO: 30360 - DNA, 103 bp, Artificial Sequence
  Synthetic Polynucleotide
taatacgactcactatagggttaaagggaggtttttcccctccctagcccaacagaggagagggctaatgaggggaaaaaacctggcggcagcgcaaaagatg

SEQ ID NO: 30361 - DNA, 103 bp, Artificial Sequence
  Synthetic Polynucleotide
taatacgactcactatagggacctcttaaagggaggtttttcccctccctaacagaggagaagggagatgaaaaacctcaacctggcggcagcgcaaaagatg

SEQ ID NO: 30362 - DNA, 103 bp, Artificial Sequence
  Synthetic Polynucleotide
taatacgactcactatagggagtatacctcttaaagggaggtttttccccaacagaggagaggggaaatgcctccctttaacctggcggcagcgcaaaagatg

SEQ ID NO: 30363 - DNA, 103 bp, Artificial Sequence
  Synthetic Polynucleotide
taatacgactcactatagggaccctagtatacctcttaaagggaggttttaacagaggagaaaaaccatgctttaagagaacctggcggcagcgcaaaagatg

SEQ ID NO: 30364 - DNA, 103 bp, Artificial Sequence
  Synthetic Polynucleotide
taatacgactcactatagggcacataccctagtatacctcttaaagggagaacagaggagactccctatgagaggtataaacctggcggcagcgcaaaagatg

SEQ ID NO: 30365 - DNA, 103 bp, Artificial Sequence
  Synthetic Polynucleotide
taatacgactcactatagggagacccacataccctagtatacctcttaaaaacagaggagatttaagatgtatactaggaacctggcggcagcgcaaaagatg

SEQ ID NO: 30366 - DNA, 103 bp, Artificial Sequence
  Synthetic Polynucleotide
taatacgactcactataggggtttaagacccacataccctagtatacctcaacagaggagagaggtaatgtagggtatgaacctggcggcagcgcaaaagatg

SEQ ID NO: 30367 - DNA, 103 bp, Artificial Sequence
  Synthetic Polynucleotide
taatacgactcactataggggaatgctgacaaaacagatttgtatgctataacagaggagaatagcaatgaaatctgttaacctggcggcagcgcaaaagatg

SEQ ID NO: 30368 - DNA, 103 bp, Artificial Sequence
  Synthetic Polynucleotide
taatacgactcactatagggagagtgtttaagacccacataccctagtataacagaggagaatactaatgtatgtgggtaacctggcggcagcgcaaaagatg

SEQ ID NO: 30369 - DNA, 103 bp, Artificial Sequence
  Synthetic Polynucleotide
taatacgactcactatagggcgtttagagtgtttaagacccacataccctaacagaggagaagggtaatggggtcttaaaacctggcggcagcgcaaaagatg

SEQ ID NO: 30370 - DNA, 103 bp, Artificial Sequence
  Synthetic Polynucleotide
taatacgactcactataggggaaaccgtttagagtgtttaagacccacataacagaggagaatgtggatgttaaacactaacctggcggcagcgcaaaagatg

SEQ ID NO: 30371 - DNA, 103 bp, Artificial Sequence
  Synthetic Polynucleotide
taatacgactcactatagggcaattgaaaccgtttagagtgtttaagaccaacagaggagaggtcttatgcactctaaaaacctggcggcagcgcaaaagatg

SEQ ID NO: 30372 - DNA, 103 bp, Artificial Sequence
  Synthetic Polynucleotide
taatacgactcactatagggaccagcaattgaaaccgtttagagtgtttaaacagaggagataaacaatgtaaacggttaacctggcggcagcgcaaaagatg

SEQ ID NO: 30373 - DNA, 103 bp, Artificial Sequence
  Synthetic Polynucleotide
taatacgactcactataggggatcaaccagcaattgaaaccgtttagagtaacagaggagaactctaatgggtttcaataacctggcggcagcgcaaaagatg

SEQ ID NO: 30374 - DNA, 103 bp, Artificial Sequence
  Synthetic Polynucleotide
taatacgactcactatagggatcttgatcaaccagcaattgaaaccgtttaacagaggagaaaacggatgcaattgctgaacctggcggcagcgcaaaagatg

SEQ ID NO: 30375 - DNA, 103 bp, Artificial Sequence
  Synthetic Polynucleotide
taatacgactcactatagggattctatcttgatcaaccagcaattgaaacaacagaggagagtttcaatggctggttgaaacctggcggcagcgcaaaagatg

SEQ ID NO: 30376 - DNA, 103 bp, Artificial Sequence
  Synthetic Polynucleotide
taatacgactcactatagggtggacattctatcttgatcaaccagcaattaacagaggagaaattgcatgttgatcaagaacctggcggcagcgcaaaagatg

SEQ ID NO: 30377 - DNA, 103 bp, Artificial Sequence
  Synthetic Polynucleotide
taatacgactcactatagggtaaattggacattctatcttgatcaaccagaacagaggagactggttatgcaagatagaaacctggcggcagcgcaaaagatg

SEQ ID NO: 30378 - DNA, 103 bp, Artificial Sequence
  Synthetic Polynucleotide
taatacgactcactataggggtattgaatgctgacaaaacagatttgtataacagaggagaatacaaatgtgttttgtcaacctggcggcagcgcaaaagatg

SEQ ID NO: 30379 - DNA, 103 bp, Artificial Sequence
  Synthetic Polynucleotide
taatacgactcactatagggtgaattaaattggacattctatcttgatcaaacagaggagatgatcaatgtagaatgtcaacctggcggcagcgcaaaagatg

SEQ ID NO: 30380 - DNA, 103 bp, Artificial Sequence
  Synthetic Polynucleotide
taatacgactcactatagggctttttgaattaaattggacattctatcttaacagaggagaaagataatgtgtccaattaacctggcggcagcgcaaaagatg

SEQ ID NO: 30381 - DNA, 103 bp, Artificial Sequence
  Synthetic Polynucleotide
taatacgactcactataggggagatctttttgaattaaattggacattctaacagaggagaagaatgatgaatttaattaacctggcggcagcgcaaaagatg

SEQ ID NO: 30382 - DNA, 103 bp, Artificial Sequence
  Synthetic Polynucleotide
taatacgactcactataggggaatcgagatctttttgaattaaattggacaacagaggagagtccaaatgaattcaaaaaacctggcggcagcgcaaaagatg

SEQ ID NO: 30383 - DNA, 103 bp, Artificial Sequence
  Synthetic Polynucleotide
taatacgactcactatagggagtatgaatcgagatctttttgaattaaataacagaggagaatttaaatgaaaaagatcaacctggcggcagcgcaaaagatg

SEQ ID NO: 30384 - DNA, 103 bp, Artificial Sequence
  Synthetic Polynucleotide
taatacgactcactataggggacagagtatgaatcgagatctttttgaataacagaggagaattcaaatggatctcgataacctggcggcagcgcaaaagatg

SEQ ID NO: 30385 - DNA, 103 bp, Artificial Sequence
  Synthetic Polynucleotide
taatacgactcactatagggtttttgacagagtatgaatcgagatcttttaacagaggagaaaaagaatgcgattcataaacctggcggcagcgcaaaagatg

SEQ ID NO: 30386 - DNA, 103 bp, Artificial Sequence
  Synthetic Polynucleotide
taatacgactcactataggggtcattttttgacagagtatgaatcgagataacagaggagaatctcgatgcatactctgaacctggcggcagcgcaaaagatg

SEQ ID NO: 30387 - DNA, 103 bp, Artificial Sequence
  Synthetic Polynucleotide
taatacgactcactatagggtcagagtcattttttgacagagtatgaatcaacagaggagagattcaatgtctgtcaaaaacctggcggcagcgcaaaagatg

SEQ ID NO: 30388 - DNA, 103 bp, Artificial Sequence
  Synthetic Polynucleotide
taatacgactcactatagggctggatcagagtcattttttgacagagtataacagaggagaatactcatgcaaaaaatgaacctggcggcagcgcaaaagatg

SEQ ID NO: 30389 - DNA, 103 bp, Artificial Sequence
  Synthetic Polynucleotide
taatacgactcactataggggggcagtattgaatgctgacaaaacagattaacagaggagaaatctgatgtgtcagcataacctggcggcagcgcaaaagatg

SEQ ID NO: 30390 - DNA, 103 bp, Artificial Sequence
  Synthetic Polynucleotide
taatacgactcactatagggactttctggatcagagtcattttttgacagaacagaggagactgtcaatgaatgactctaacctggcggcagcgcaaaagatg

SEQ ID NO: 30391 - DNA, 103 bp, Artificial Sequence
  Synthetic Polynucleotide
taatacgactcactatagggtgagtactttctggatcagagtcattttttaacagaggagaaaaaaaatgctctgatccaacctggcggcagcgcaaaagatg

SEQ ID NO: 30392 - DNA, 103 bp, Artificial Sequence
  Synthetic Polynucleotide
taatacgactcactatagggtgatctgagtactttctggatcagagtcataacagaggagaatgactatgatccagaaaaacctggcggcagcgcaaaagatg

SEQ ID NO: 30393 - DNA, 103 bp, Artificial Sequence
  Synthetic Polynucleotide
taatacgactcactatagggactattgatctgagtactttctggatcagaaacagaggagatctgatatggaaagtactaacctggcggcagcgcaaaagatg

SEQ ID NO: 30394 - DNA, 103 bp, Artificial Sequence
  Synthetic Polynucleotide
taatacgactcactataggggctgaactattgatctgagtactttctggaaacagaggagatccagaatgtactcagataacctggcggcagcgcaaaagatg

SEQ ID NO: 30395 - DNA, 103 bp, Artificial Sequence
  Synthetic Polynucleotide
taatacgactcactatagggagtgtgctgaactattgatctgagtactttaacagaggagaaaagtaatgagatcaataaacctggcggcagcgcaaaagatg

SEQ ID NO: 30396 - DNA, 103 bp, Artificial Sequence
  Synthetic Polynucleotide
taatacgactcactatagggtatgaagtgtgctgaactattgatctgagtaacagaggagaactcagatgaatagttcaaacctggcggcagcgcaaaagatg

SEQ ID NO: 30397 - DNA, 103 bp, Artificial Sequence
  Synthetic Polynucleotide
taatacgactcactatagggtcatgtatgaagtgtgctgaactattgatcaacagaggagagatcaaatgttcagcacaaacctggcggcagcgcaaaagatg

SEQ ID NO: 30398 - DNA, 103 bp, Artificial Sequence
  Synthetic Polynucleotide
taatacgactcactatagggttttttcatgtatgaagtgtgctgaactataacagaggagaatagttatgcacacttcaaacctggcggcagcgcaaaagatg

SEQ ID NO: 30399 - DNA, 103 bp, Artificial Sequence
  Synthetic Polynucleotide
taatacgactcactatagggaacgtttttttcatgtatgaagtgtgctgaaacagaggagatcagcaatgttcatacataacctggcggcagcgcaaaagatg

SEQ ID NO: 30400 - DNA, 103 bp, Artificial Sequence
  Synthetic Polynucleotide
taatacgactcactatagggcagacgggcagtattgaatgctgacaaaacaacagaggagagttttgatggcattcaataacctggcggcagcgcaaaagatg

SEQ ID NO: 30401 - DNA, 103 bp, Artificial Sequence
  Synthetic Polynucleotide
taatacgactcactatagggatgttaacgtttttttcatgtatgaagtgtaacagaggagaacacttatgacatgaaaaaacctggcggcagcgcaaaagatg

SEQ ID NO: 30402 - DNA, 103 bp, Artificial Sequence
  Synthetic Polynucleotide
taatacgactcactataggggagtgatgttaacgtttttttcatgtatgaaacagaggagatcatacatgaaaaaaacgaacctggcggcagcgcaaaagatg

SEQ ID NO: 30403 - DNA, 103 bp, Artificial Sequence
  Synthetic Polynucleotide
taatacgactcactatagggataatgagtgatgttaacgtttttttcatgaacagaggagacatgaaatgaacgttaacaacctggcggcagcgcaaaagatg

SEQ ID NO: 30404 - DNA, 103 bp, Artificial Sequence
  Synthetic Polynucleotide
taatacgactcactatagggactccataatgagtgatgttaacgttttttaacagaggagaaaaaaaatgtaacatcacaacctggcggcagcgcaaaagatg

SEQ ID NO: 30405 - DNA, 103 bp, Artificial Sequence
  Synthetic Polynucleotide
taatacgactcactatagggaaaaaactccataatgagtgatgttaacgtaacagaggagaacgttaatgtcactcattaacctggcggcagcgcaaaagatg

SEQ ID NO: 30406 - DNA, 103 bp, Artificial Sequence
  Synthetic Polynucleotide
taatacgactcactatagggtttctaaaaaactccataatgagtgatgttaacagaggagaaacatcatgcattatggaaacctggcggcagcgcaaaagatg

SEQ ID NO: 30407 - DNA, 103 bp, Artificial Sequence
  Synthetic Polynucleotide
taatacgactcactatagggtcaactttctaaaaaactccataatgagtgaacagaggagacactcaatgtggagttttaacctggcggcagcgcaaaagatg

SEQ ID NO: 30408 - DNA, 103 bp, Artificial Sequence
  Synthetic Polynucleotide
taatacgactcactatagggtctcatcaactttctaaaaaactccataataacagaggagaattatgatgttttttagaaacctggcggcagcgcaaaagatg

SEQ ID NO: 30409 - DNA, 103 bp, Artificial Sequence
  Synthetic Polynucleotide
taatacgactcactatagggcaatttctcatcaactttctaaaaaactccaacagaggagaggagttatgtagaaagttaacctggcggcagcgcaaaagatg

SEQ ID NO: 30410 - DNA, 103 bp, Artificial Sequence
  Synthetic Polynucleotide
taatacgactcactatagggctttacaatttctcatcaactttctaaaaaaacagaggagatttttaatgagttgatgaaacctggcggcagcgcaaaagatg

SEQ ID NO: 30411 - DNA, 103 bp, Artificial Sequence
  Synthetic Polynucleotide
taatacgactcactatagggtggtccagacgggcagtattgaatgctgacaacagaggagagtcagcatgcaatactgcaacctggcggcagcgcaaaagatg

SEQ ID NO: 30412 - DNA, 103 bp, Artificial Sequence
  Synthetic Polynucleotide
taatacgactcactataggggtcgtctttacaatttctcatcaactttctaacagaggagaagaaagatgatgagaaataacctggcggcagcgcaaaagatg

SEQ ID NO: 30413 - DNA, 103 bp, Artificial Sequence
  Synthetic Polynucleotide
taatacgactcactataggggaactgtcgtctttacaatttctcatcaacaacagaggagagttgatatgaaattgtaaaacctggcggcagcgcaaaagatg

SEQ ID NO: 30414 - DNA, 103 bp, Artificial Sequence
  Synthetic Polynucleotide
taatacgactcactatagggtagaagaactgtcgtctttacaatttctcaaacagaggagatgagaaatggtaaagacgaacctggcggcagcgcaaaagatg

SEQ ID NO: 30415 - DNA, 103 bp, Artificial Sequence
  Synthetic Polynucleotide
taatacgactcactatagggctctttagaagaactgtcgtctttacaattaacagaggagaaattgtatggacgacagtaacctggcggcagcgcaaaagatg

SEQ ID NO: 30416 - DNA, 103 bp, Artificial Sequence
  Synthetic Polynucleotide
taatacgactcactataggggtagcctctttagaagaactgtcgtctttaaacagaggagataaagaatgcagttcttcaacctggcggcagcgcaaaagatg

SEQ ID NO: 30417 - DNA, 103 bp, Artificial Sequence
  Synthetic Polynucleotide
taatacgactcactataggggagcagtagcctctttagaagaactgtcgtaacagaggagaacgacaatgcttctaaagaacctggcggcagcgcaaaagatg

SEQ ID NO: 30418 - DNA, 103 bp, Artificial Sequence
  Synthetic Polynucleotide
taatacgactcactatagggcacaggagcagtagcctctttagaagaactaacagaggagaagttctatgaaagaggctaacctggcggcagcgcaaaagatg

SEQ ID NO: 30419 - DNA, 103 bp, Artificial Sequence
  Synthetic Polynucleotide
taatacgactcactatagggggcaacacaggagcagtagcctctttagaaaacagaggagattctaaatgggctactgcaacctggcggcagcgcaaaagatg

SEQ ID NO: 30420 - DNA, 103 bp, Artificial Sequence
  Synthetic Polynucleotide
taatacgactcactatagggcctcaggcaacacaggagcagtagcctcttaacagaggagaaagaggatgctgctcctgaacctggcggcagcgcaaaagatg

SEQ ID NO: 30421 - DNA, 103 bp, Artificial Sequence
  Synthetic Polynucleotide
taatacgactcactatagggatcatcctcaggcaacacaggagcagtagcaacagaggagagctactatgcctgtgttgaacctggcggcagcgcaaaagatg

SEQ ID NO: 30422 - DNA, 103 bp, Artificial Sequence
  Synthetic Polynucleotide
taatacgactcactatagggttttccccttcgattccttctctgtcttctaacagaggagaagaagaatgagaaggaataacctggcggcagcgcaaaagatg

SEQ ID NO: 30423 - DNA, 103 bp, Artificial Sequence
  Synthetic Polynucleotide
taatacgactcactatagggcttcctggtccagacgggcagtattgaatgaacagaggagacattcaatgctgcccgtcaacctggcggcagcgcaaaagatg

SEQ ID NO: 30424 - DNA, 103 bp, Artificial Sequence
  Synthetic Polynucleotide
taatacgactcactatagggatgtcatcatcctcaggcaacacaggagcaaacagaggagatgctccatggttgcctgaaacctggcggcagcgcaaaagatg

SEQ ID NO: 30425 - DNA, 103 bp, Artificial Sequence
  Synthetic Polynucleotide
taatacgactcactatagggtccatatgtcatcatcctcaggcaacacagaacagaggagactgtgtatgctgaggatgaacctggcggcagcgcaaaagatg

SEQ ID NO: 30426 - DNA, 103 bp, Artificial Sequence
  Synthetic Polynucleotide
taatacgactcactatagggggggatccatatgtcatcatcctcaggcaaaacagaggagattgcctatggatgatgacaacctggcggcagcgcaaaagatg

SEQ ID NO: 30427 - DNA, 103 bp, Artificial Sequence
  Synthetic Polynucleotide
taatacgactcactataggggggggggggatccatatgtcatcatcctcaaacagaggagatgaggaatgtgacatatgaacctggcggcagcgcaaaagatg

SEQ ID NO: 30428 - DNA, 103 bp, Artificial Sequence
  Synthetic Polynucleotide
taatacgactcactatagggattcagggggggggatccatatgtcatcataacagaggagaatgatgatgtatggatccaacctggcggcagcgcaaaagatg

SEQ ID NO: 30429 - DNA, 103 bp, Artificial Sequence
  Synthetic Polynucleotide
taatacgactcactatagggaacgtattcagggggggggatccatatgtcaacagaggagagacataatgatcccccccaacctggcggcagcgcaaaagatg

SEQ ID NO: 30430 - DNA, 103 bp, Artificial Sequence
  Synthetic Polynucleotide
taatacgactcactatagggaagggaacgtattcagggggggggatccataacagaggagaatggatatgcccccctgaaacctggcggcagcgcaaaagatg

SEQ ID NO: 30431 - DNA, 103 bp, Artificial Sequence
  Synthetic Polynucleotide
taatacgactcactatagggcacttaagggaacgtattcagggggggggaaacagaggagatcccccatgctgaatacgaacctggcggcagcgcaaaagatg

SEQ ID NO: 30432 - DNA, 103 bp, Artificial Sequence
  Synthetic Polynucleotide
taatacgactcactatagggaatatcacttaagggaacgtattcagggggaacagaggagaccccctatgtacgttcccaacctggcggcagcgcaaaagatg

SEQ ID NO: 30433 - DNA, 103 bp, Artificial Sequence
  Synthetic Polynucleotide
taatacgactcactatagggcctgtaatatcacttaagggaacgtattcaaacagaggagatgaataatgtcccttaagaacctggcggcagcgcaaaagatg

SEQ ID NO: 30434 - DNA, 103 bp, Artificial Sequence
  Synthetic Polynucleotide
taatacgactcactatagggaacatcttcctggtccagacgggcagtattaacagaggagaaatactatgcgtctggacaacctggcggcagcgcaaaagatg

SEQ ID NO: 30435 - DNA, 103 bp, Artificial Sequence
  Synthetic Polynucleotide
taatacgactcactatagggaactgcctgtaatatcacttaagggaacgtaacagaggagaacgttcatgtaagtgataaacctggcggcagcgcaaaagatg

SEQ ID NO: 30436 - DNA, 103 bp, Artificial Sequence
  Synthetic Polynucleotide
taatacgactcactataggggctagaactgcctgtaatatcacttaagggaacagaggagacccttaatggatattacaaacctggcggcagcgcaaaagatg

SEQ ID NO: 30437 - DNA, 103 bp, Artificial Sequence
  Synthetic Polynucleotide
taatacgactcactatagggcttgagctagaactgcctgtaatatcacttaacagaggagaaagtgaatgtacaggcagaacctggcggcagcgcaaaagatg

SEQ ID NO: 30438 - DNA, 103 bp, Artificial Sequence
  Synthetic Polynucleotide
taatacgactcactatagggagtttcttgagctagaactgcctgtaatataacagaggagaatattaatggcagttctaaacctggcggcagcgcaaaagatg

SEQ ID NO: 30439 - DNA, 103 bp, Artificial Sequence
  Synthetic Polynucleotide
taatacgactcactatagggacagaagtttcttgagctagaactgcctgtaacagaggagaacaggcatgtctagctcaaacctggcggcagcgcaaaagatg

SEQ ID NO: 30440 - DNA, 103 bp, Artificial Sequence
  Synthetic Polynucleotide
taatacgactcactatagggttgatacagaagtttcttgagctagaactgaacagaggagacagttcatgctcaagaaaaacctggcggcagcgcaaaagatg

SEQ ID NO: 30441 - DNA, 103 bp, Artificial Sequence
  Synthetic Polynucleotide
taatacgactcactatagggctccgttgatacagaagtttcttgagctagaacagaggagactagctatggaaacttctaacctggcggcagcgcaaaagatg

SEQ ID NO: 30442 - DNA, 103 bp, Artificial Sequence
  Synthetic Polynucleotide
taatacgactcactataggggacttctccgttgatacagaagtttcttgaaacagaggagatcaagaatgttctgtatcaacctggcggcagcgcaaaagatg

SEQ ID NO: 30443 - DNA, 103 bp, Artificial Sequence
  Synthetic Polynucleotide
taatacgactcactatagggatcttgacttctccgttgatacagaagtttaacagaggagaaaacttatgtatcaacggaacctggcggcagcgcaaaagatg

SEQ ID NO: 30444 - DNA, 103 bp, Artificial Sequence
  Synthetic Polynucleotide
taatacgactcactatagggtgcaaatcttgacttctccgttgatacagaaacagaggagatctgtaatgacggagaagaacctggcggcagcgcaaaagatg

SEQ ID NO: 30445 - DNA, 103 bp, Artificial Sequence
  Synthetic Polynucleotide
taatacgactcactataggggaacaaacatcttcctggtccagacgggcaaacagaggagatgcccgatgggaccaggaaacctggcggcagcgcaaaagatg

SEQ ID NO: 30446 - DNA, 103 bp, Artificial Sequence
  Synthetic Polynucleotide
taatacgactcactatagggagggctgcaaatcttgacttctccgttgataacagaggagaatcaacatggaagtcaagaacctggcggcagcgcaaaagatg

SEQ ID NO: 30447 - DNA, 103 bp, Artificial Sequence
  Synthetic Polynucleotide
taatacgactcactatagggccgttagggctgcaaatcttgacttctccgaacagaggagacggagaatgcaagatttgaacctggcggcagcgcaaaagatg

SEQ ID NO: 30448 - DNA, 103 bp, Artificial Sequence
  Synthetic Polynucleotide
taatacgactcactatagggaatatccgttagggctgcaaatcttgacttaacagaggagaaagtcaatgtttgcagccaacctggcggcagcgcaaaagatg

SEQ ID NO: 30449 - DNA, 103 bp, Artificial Sequence
  Synthetic Polynucleotide
taatacgactcactataggggaatgaatatccgttagggctgcaaatcttaacagaggagaaagattatgagccctaacaacctggcggcagcgcaaaagatg

SEQ ID NO: 30450 - DNA, 103 bp, Artificial Sequence
  Synthetic Polynucleotide
taatacgactcactatagggattttgaatgaatatccgttagggctgcaaaacagaggagattgcagatgtaacggataaacctggcggcagcgcaaaagatg

SEQ ID NO: 30451 - DNA, 103 bp, Artificial Sequence
  Synthetic Polynucleotide
taatacgactcactataggggaactattttgaatgaatatccgttagggcaacagaggagagccctaatggatattcataacctggcggcagcgcaaaagatg

SEQ ID NO: 30452 - DNA, 103 bp, Artificial Sequence
  Synthetic Polynucleotide
taatacgactcactatagggatgacgaactattttgaatgaatatccgttaacagaggagaaacggaatgtcattcaaaaacctggcggcagcgcaaaagatg

SEQ ID NO: 30453 - DNA, 103 bp, Artificial Sequence
  Synthetic Polynucleotide
taatacgactcactatagggaggatatgacgaactattttgaatgaatataacagaggagaatattcatgcaaaatagtaacctggcggcagcgcaaaagatg

SEQ ID NO: 30454 - DNA, 103 bp, Artificial Sequence
  Synthetic Polynucleotide
taatacgactcactatagggatcttaggatatgacgaactattttgaatgaacagaggagacattcaatgtagttcgtcaacctggcggcagcgcaaaagatg

SEQ ID NO: 30455 - DNA, 103 bp, Artificial Sequence
  Synthetic Polynucleotide
taatacgactcactatagggaaaagatcttaggatatgacgaactattttaacagaggagaaaaataatgcgtcatatcaacctggcggcagcgcaaaagatg

SEQ ID NO: 30456 - DNA, 103 bp, Artificial Sequence
  Synthetic Polynucleotide
taatacgactcactatagggaatatgaacaaacatcttcctggtccagacaacagaggagagtctggatgaggaagatgaacctggcggcagcgcaaaagatg

SEQ ID NO: 30457 - DNA, 103 bp, Artificial Sequence
  Synthetic Polynucleotide
taatacgactcactatagggccttcaaaagatcttaggatatgacgaactaacagaggagaagttcgatgtatcctaagaacctggcggcagcgcaaaagatg

SEQ ID NO: 30458 - DNA, 103 bp, Artificial Sequence
  Synthetic Polynucleotide
taatacgactcactatagggacactccttcaaaagatcttaggatatgacaacagaggagagtcataatgtaagatcttaacctggcggcagcgcaaaagatg

SEQ ID NO: 30459 - DNA, 103 bp, Artificial Sequence
  Synthetic Polynucleotide
taatacgactcactatagggagaatacactccttcaaaagatcttaggataacagaggagaatcctaatgtcttttgaaaacctggcggcagcgcaaaagatg

SEQ ID NO: 30460 - DNA, 103 bp, Artificial Sequence
  Synthetic Polynucleotide
taatacgactcactatagggttaccagaatacactccttcaaaagatcttaacagaggagaaagatcatgtgaaggagtaacctggcggcagcgcaaaagatg

SEQ ID NO: 30461 - DNA, 103 bp, Artificial Sequence
  Synthetic Polynucleotide
taatacgactcactataggggtctgttaccagaatacactccttcaaaagaacagaggagacttttgatggagtgtattaacctggcggcagcgcaaaagatg

SEQ ID NO: 30462 - DNA, 103 bp, Artificial Sequence
  Synthetic Polynucleotide
taatacgactcactatagggcattcgtctgttaccagaatacactccttcaacagaggagagaaggaatgtattctggtaacctggcggcagcgcaaaagatg

SEQ ID NO: 30463 - DNA, 103 bp, Artificial Sequence
  Synthetic Polynucleotide
taatacgactcactatagggcctatcattcgtctgttaccagaatacactaacagaggagaagtgtaatgtggtaacagaacctggcggcagcgcaaaagatg

SEQ ID NO: 30464 - DNA, 103 bp, Artificial Sequence
  Synthetic Polynucleotide
taatacgactcactatagggcgagtcctatcattcgtctgttaccagaataacagaggagaattctgatgacagacgaaaacctggcggcagcgcaaaagatg

SEQ ID NO: 30465 - DNA, 103 bp, Artificial Sequence
  Synthetic Polynucleotide
taatacgactcactatagggtttgacgagtcctatcattcgtctgttaccaacagaggagaggtaacatgcgaatgataaacctggcggcagcgcaaaagatg

SEQ ID NO: 30466 - DNA, 103 bp, Artificial Sequence
  Synthetic Polynucleotide
taatacgactcactatagggactattttgacgagtcctatcattcgtctgaacagaggagacagacgatggataggactaacctggcggcagcgcaaaagatg

SEQ ID NO: 30467 - DNA, 103 bp, Artificial Sequence
  Synthetic Polynucleotide
taatacgactcactatagggggctaaatatgaacaaacatcttcctggtcaacagaggagagaccagatggatgtttgtaacctggcggcagcgcaaaagatg

SEQ ID NO: 30468 - DNA, 103 bp, Artificial Sequence
  Synthetic Polynucleotide
taatacgactcactatagggctataactattttgacgagtcctatcattcaacagaggagagaatgaatggactcgtcaaacctggcggcagcgcaaaagatg

SEQ ID NO: 30469 - DNA, 103 bp, Artificial Sequence
  Synthetic Polynucleotide
taatacgactcactatagggtaaccctataactattttgacgagtcctataacagaggagaataggaatggtcaaaataaacctggcggcagcgcaaaagatg

SEQ ID NO: 30470 - DNA, 103 bp, Artificial Sequence
  Synthetic Polynucleotide
taatacgactcactatagggagagttaaccctataactattttgacgagtaacagaggagaactcgtatgaatagttataacctggcggcagcgcaaaagatg

SEQ ID NO: 30471 - DNA, 103 bp, Artificial Sequence
  Synthetic Polynucleotide
taatacgactcactatagggcagatagagttaaccctataactattttgaaacagaggagatcaaaaatgttatagggtaacctggcggcagcgcaaaagatg

SEQ ID NO: 30472 - DNA, 103 bp, Artificial Sequence
  Synthetic Polynucleotide
taatacgactcactatagggactcccagatagagttaaccctataactataacagaggagaatagttatggggttaactaacctggcggcagcgcaaaagatg

SEQ ID NO: 30473 - DNA, 103 bp, Artificial Sequence
  Synthetic Polynucleotide
taatacgactcactatagggatcggactcccagatagagttaaccctataaacagaggagatataggatgaactctatcaacctggcggcagcgcaaaagatg

SEQ ID NO: 30474 - DNA, 103 bp, Artificial Sequence
  Synthetic Polynucleotide
taatacgactcactatagggcagggatcggactcccagatagagttaaccaacagaggagaggttaaatgtatctgggaaacctggcggcagcgcaaaagatg

SEQ ID NO: 30475 - DNA, 103 bp, Artificial Sequence
  Synthetic Polynucleotide
taatacgactcactatagggcccttcagggatcggactcccagatagagtaacagaggagaactctaatggggagtccgaacctggcggcagcgcaaaagatg

SEQ ID NO: 30476 - DNA, 103 bp, Artificial Sequence
  Synthetic Polynucleotide
taatacgactcactatagggttcatcccttcagggatcggactcccagataacagaggagaatctggatgtccgatcccaacctggcggcagcgcaaaagatg

SEQ ID NO: 30477 - DNA, 103 bp, Artificial Sequence
  Synthetic Polynucleotide
taatacgactcactatagggcccaattcatcccttcagggatcggactccaacagaggagaggagtcatgtccctgaagaacctggcggcagcgcaaaagatg

SEQ ID NO: 30478 - DNA, 103 bp, Artificial Sequence
  Synthetic Polynucleotide
taatacgactcactataggggcagcggctaaatatgaacaaacatcttccaacagaggagaggaagaatgttgttcataaacctggcggcagcgcaaaagatg

SEQ ID NO: 30479 - DNA, 103 bp, Artificial Sequence
  Synthetic Polynucleotide
taatacgactcactataggggtatgcccaattcatcccttcagggatcggaacagaggagaccgatcatggaagggatgaacctggcggcagcgcaaaagatg

SEQ ID NO: 30480 - DNA, 103 bp, Artificial Sequence
  Synthetic Polynucleotide
taatacgactcactatagggaatctgtatgcccaattcatcccttcagggaacagaggagaccctgaatggatgaattgaacctggcggcagcgcaaaagatg

SEQ ID NO: 30481 - DNA, 103 bp, Artificial Sequence
  Synthetic Polynucleotide
taatacgactcactatagggtcctgaatctgtatgcccaattcatcccttaacagaggagaaagggaatgattgggcataacctggcggcagcgcaaaagatg

SEQ ID NO: 30482 - DNA, 103 bp, Artificial Sequence
  Synthetic Polynucleotide
taatacgactcactatagggagttctcctgaatctgtatgcccaattcataacagaggagaatgaatatggcatacagaaacctggcggcagcgcaaaagatg

SEQ ID NO: 30483 - DNA, 103 bp, Artificial Sequence
  Synthetic Polynucleotide
taatacgactcactatagggacaagagttctcctgaatctgtatgcccaaaacagaggagattgggcatgcagattcagaacctggcggcagcgcaaaagatg

SEQ ID NO: 30484 - DNA, 103 bp, Artificial Sequence
  Synthetic Polynucleotide
taatacgactcactataggggaaagacaagagttctcctgaatctgtatgaacagaggagacatacaatgtcaggagaaaacctggcggcagcgcaaaagatg

SEQ ID NO: 30485 - DNA, 103 bp, Artificial Sequence
  Synthetic Polynucleotide
taatacgactcactatagggccactgaaagacaagagttctcctgaatctaacagaggagaagattcatgagaactcttaacctggcggcagcgcaaaagatg

SEQ ID NO: 30486 - DNA, 103 bp, Artificial Sequence
  Synthetic Polynucleotide
taatacgactcactatagggtctttccactgaaagacaagagttctcctgaacagaggagacaggagatgtcttgtcttaacctggcggcagcgcaaaagatg

SEQ ID NO: 30487 - DNA, 103 bp, Artificial Sequence
  Synthetic Polynucleotide
taatacgactcactatagggcgctatctttccactgaaagacaagagttcaacagaggagagaactcatgtctttcagtaacctggcggcagcgcaaaagatg

SEQ ID NO: 30488 - DNA, 103 bp, Artificial Sequence
  Synthetic Polynucleotide
taatacgactcactatagggcccagcgctatctttccactgaaagacaagaacagaggagacttgtcatgcagtggaaaaacctggcggcagcgcaaaagatg

SEQ ID NO: 30489 - DNA, 103 bp, Artificial Sequence
  Synthetic Polynucleotide
taatacgactcactatagggtcattgcagcggctaaatatgaacaaacataacagaggagaatgtttatgcatatttagaacctggcggcagcgcaaaagatg

SEQ ID NO: 30490 - DNA, 103 bp, Artificial Sequence
  Synthetic Polynucleotide
taatacgactcactatagggaacggcccagcgctatctttccactgaaagaacagaggagactttcaatggaaagatagaacctggcggcagcgcaaaagatg

SEQ ID NO: 30491 - DNA, 103 bp, Artificial Sequence
  Synthetic Polynucleotide
taatacgactcactatagggcctctaacggcccagcgctatctttccactaacagaggagaagtggaatgatagcgctgaacctggcggcagcgcaaaagatg

SEQ ID NO: 30492 - DNA, 103 bp, Artificial Sequence
  Synthetic Polynucleotide
taatacgactcactatagggctctccctctaacggcccagcgctatctttaacagaggagaaaagatatggctgggccgaacctggcggcagcgcaaaagatg

SEQ ID NO: 30493 - DNA, 103 bp, Artificial Sequence
  Synthetic Polynucleotide
taatacgactcactatagggagctcctctccctctaacggcccagcgctaaacagaggagatagcgcatggccgttagaaacctggcggcagcgcaaaagatg

SEQ ID NO: 30494 - DNA, 103 bp, Artificial Sequence
  Synthetic Polynucleotide
taatacgactcactatagggaatcaagctcctctccctctaacggcccagaacagaggagactgggcatgtagagggagaacctggcggcagcgcaaaagatg

SEQ ID NO: 30495 - DNA, 103 bp, Artificial Sequence
  Synthetic Polynucleotide
taatacgactcactatagggtgagtaatcaagctcctctccctctaacggaacagaggagaccgttaatgggagaggagaacctggcggcagcgcaaaagatg

SEQ ID NO: 30496 - DNA, 103 bp, Artificial Sequence
  Synthetic Polynucleotide
taatacgactcactatagggtcctgtgagtaatcaagctcctctccctctaacagaggagaagagggatgggagcttgaaacctggcggcagcgcaaaagatg

SEQ ID NO: 30497 - DNA, 103 bp, Artificial Sequence
  Synthetic Polynucleotide
taatacgactcactatagggtaatctcctgtgagtaatcaagctcctctcaacagaggagagagaggatgttgattactaacctggcggcagcgcaaaagatg

SEQ ID NO: 30498 - DNA, 103 bp, Artificial Sequence
  Synthetic Polynucleotide
taatacgactcactatagggccaggtaatctcctgtgagtaatcaagctcaacagaggagagagcttatgtactcacagaacctggcggcagcgcaaaagatg

SEQ ID NO: 30499 - DNA, 103 bp, Artificial Sequence
  Synthetic Polynucleotide
taatacgactcactatagggtcctcccaggtaatctcctgtgagtaatcaaacagaggagatgattaatgacaggagataacctggcggcagcgcaaaagatg

SEQ ID NO: 30500 - DNA, 103 bp, Artificial Sequence
  Synthetic Polynucleotide
taatacgactcactatagggaatcctcattgcagcggctaaatatgaacaaacagaggagatgttcaatgttagccgctaacctggcggcagcgcaaaagatg

SEQ ID NO: 30501 - DNA, 103 bp, Artificial Sequence
  Synthetic Polynucleotide
taatacgactcactatagggtgtcatcctcccaggtaatctcctgtgagtaacagaggagaactcacatgagattacctaacctggcggcagcgcaaaagatg

SEQ ID NO: 30502 - DNA, 103 bp, Artificial Sequence
  Synthetic Polynucleotide
taatacgactcactatagggttcattgtcatcctcccaggtaatctcctgaacagaggagacaggagatgacctgggagaacctggcggcagcgcaaaagatg

SEQ ID NO: 30503 - DNA, 103 bp, Artificial Sequence
  Synthetic Polynucleotide
taatacgactcactatagggacaaattcattgtcatcctcccaggtaatcaacagaggagagattacatgggaggatgaaacctggcggcagcgcaaaagatg

SEQ ID NO: 30504 - DNA, 103 bp, Artificial Sequence
  Synthetic Polynucleotide
taatacgactcactatagggatccgacaaattcattgtcatcctcccaggaacagaggagacctgggatgatgacaatgaacctggcggcagcgcaaaagatg

SEQ ID NO: 30505 - DNA, 103 bp, Artificial Sequence
  Synthetic Polynucleotide
taatacgactcactatagggctgtaatccgacaaattcattgtcatcctcaacagaggagagaggatatgaatgaatttaacctggcggcagcgcaaaagatg

SEQ ID NO: 30506 - DNA, 103 bp, Artificial Sequence
  Synthetic Polynucleotide
taatacgactcactatagggcttatctgtaatccgacaaattcattgtcaaacagaggagatgacaaatgatttgtcggaacctggcggcagcgcaaaagatg

SEQ ID NO: 30507 - DNA, 103 bp, Artificial Sequence
  Synthetic Polynucleotide
taatacgactcactatagggtcactcttatctgtaatccgacaaattcataacagaggagaatgaatatgtcggattacaacctggcggcagcgcaaaagatg

SEQ ID NO: 30508 - DNA, 103 bp, Artificial Sequence
  Synthetic Polynucleotide
taatacgactcactatagggagcactcactcttatctgtaatccgacaaaaacagaggagatttgtcatgttacagataaacctggcggcagcgcaaaagatg

SEQ ID NO: 30509 - DNA, 103 bp, Artificial Sequence
  Synthetic Polynucleotide
taatacgactcactatagggtgtttagcactcactcttatctgtaatccgaacagaggagacggattatggataagagtaacctggcggcagcgcaaaagatg

SEQ ID NO: 30510 - DNA, 103 bp, Artificial Sequence
  Synthetic Polynucleotide
taatacgactcactataggggacattgtttagcactcactcttatctgtaaacagaggagatacagaatggagtgagtgaacctggcggcagcgcaaaagatg

SEQ ID NO: 30511 - DNA, 103 bp, Artificial Sequence
  Synthetic Polynucleotide
taatacgactcactatagggtcaaaaatcctcattgcagcggctaaatataacagaggagaatatttatgcgctgcaataacctggcggcagcgcaaaagatg

SEQ ID NO: 30512 - DNA, 103 bp, Artificial Sequence
  Synthetic Polynucleotide
taatacgactcactataggggatatgacattgtttagcactcactcttataacagaggagaataagaatgagtgctaaaaacctggcggcagcgcaaaagatg

SEQ ID NO: 30513 - DNA, 103 bp, Artificial Sequence
  Synthetic Polynucleotide
taatacgactcactatagggcctgtgatatgacattgtttagcactcactaacagaggagaagtgagatgtaaacaatgaacctggcggcagcgcaaaagatg

SEQ ID NO: 30514 - DNA, 103 bp, Artificial Sequence
  Synthetic Polynucleotide
taatacgactcactatagggatctccctgtgatatgacattgtttagcacaacagaggagagtgctaatgaatgtcataaacctggcggcagcgcaaaagatg

SEQ ID NO: 30515 - DNA, 103 bp, Artificial Sequence
  Synthetic Polynucleotide
taatacgactcactatagggccaagatctccctgtgatatgacattgtttaacagaggagaaaacaaatgcatatcacaaacctggcggcagcgcaaaagatg

SEQ ID NO: 30516 - DNA, 103 bp, Artificial Sequence
  Synthetic Polynucleotide
taatacgactcactatagggatgcaccaagatctccctgtgatatgacataacagaggagaatgtcaatgcacagggagaacctggcggcagcgcaaaagatg

SEQ ID NO: 30517 - DNA, 103 bp, Artificial Sequence
  Synthetic Polynucleotide
taatacgactcactatagggtgtttatgcaccaagatctccctgtgatataacagaggagaatatcaatgggagatcttaacctggcggcagcgcaaaagatg

SEQ ID NO: 30518 - DNA, 103 bp, Artificial Sequence
  Synthetic Polynucleotide
taatacgactcactataggggtttatgtttatgcaccaagatctccctgtaacagaggagaacagggatgtcttggtgcaacctggcggcagcgcaaaagatg

SEQ ID NO: 30519 - DNA, 103 bp, Artificial Sequence
  Synthetic Polynucleotide
taatacgactcactatagggctagagtttatgtttatgcaccaagatctcaacagaggagagagatcatggtgcataaaaacctggcggcagcgcaaaagatg

SEQ ID NO: 30520 - DNA, 103 bp, Artificial Sequence
  Synthetic Polynucleotide
taatacgactcactatagggaagctctagagtttatgtttatgcaccaagaacagaggagacttggtatgtaaacataaaacctggcggcagcgcaaaagatg

SEQ ID NO: 30521 - DNA, 103 bp, Artificial Sequence
  Synthetic Polynucleotide
taatacgactcactatagggctggcaagctctagagtttatgtttatgcaaacagaggagatgcataatgataaactctaacctggcggcagcgcaaaagatg

SEQ ID NO: 30522 - DNA, 103 bp, Artificial Sequence
  Synthetic Polynucleotide
taatacgactcactatagggtgccctcaaaaatcctcattgcagcggctaaacagaggagatagccgatgcaatgaggaaacctggcggcagcgcaaaagatg

SEQ ID NO: 30523 - DNA, 103 bp, Artificial Sequence
  Synthetic Polynucleotide
taatacgactcactatagggcagaactggcaagctctagagtttatgtttaacagaggagaaaacatatgctctagagcaacctggcggcagcgcaaaagatg

SEQ ID NO: 30524 - DNA, 103 bp, Artificial Sequence
  Synthetic Polynucleotide
taatacgactcactatagggctgcccagaactggcaagctctagagtttaaacagaggagataaactatggagcttgccaacctggcggcagcgcaaaagatg

SEQ ID NO: 30525 - DNA, 103 bp, Artificial Sequence
  Synthetic Polynucleotide
taatacgactcactatagggcatatctgcccagaactggcaagctctagaaacagaggagatctagaatgtgccagttcaacctggcggcagcgcaaaagatg

SEQ ID NO: 30526 - DNA, 103 bp, Artificial Sequence
  Synthetic Polynucleotide
taatacgactcactatagggagttgcatatctgcccagaactggcaagctaacagaggagaagcttgatggttctgggcaacctggcggcagcgcaaaagatg

SEQ ID NO: 30527 - DNA, 103 bp, Artificial Sequence
  Synthetic Polynucleotide
taatacgactcactatagggtcttcagttgcatatctgcccagaactggcaacagaggagagccagtatggggcagataaacctggcggcagcgcaaaagatg

SEQ ID NO: 30528 - DNA, 103 bp, Artificial Sequence
  Synthetic Polynucleotide
taatacgactcactatagggcttggtcttcagttgcatatctgcccagaaaacagaggagattctggatggatatgcaaaacctggcggcagcgcaaaagatg

SEQ ID NO: 30529 - DNA, 103 bp, Artificial Sequence
  Synthetic Polynucleotide
taatacgactcactataggggattgcttggtcttcagttgcatatctgccaacagaggagaggcagaatggcaactgaaaacctggcggcagcgcaaaagatg

SEQ ID NO: 30530 - DNA, 103 bp, Artificial Sequence
  Synthetic Polynucleotide
taatacgactcactatagggcttcagattgcttggtcttcagttgcatataacagaggagaatatgcatgtgaagaccaaacctggcggcagcgcaaaagatg

SEQ ID NO: 30531 - DNA, 103 bp, Artificial Sequence
  Synthetic Polynucleotide
taatacgactcactatagggatcctcttcagattgcttggtcttcagttgaacagaggagacaactgatgaccaagcaaaacctggcggcagcgcaaaagatg

SEQ ID NO: 30532 - DNA, 103 bp, Artificial Sequence
  Synthetic Polynucleotide
taatacgactcactatagggtttccatcctcttcagattgcttggtcttcaacagaggagagaagacatggcaatctgaaacctggcggcagcgcaaaagatg

SEQ ID NO: 30533 - DNA, 103 bp, Artificial Sequence
  Synthetic Polynucleotide
taatacgactcactatagggttttcttttccccttcgattccttctctgtaacagaggagaacagagatggaatcgaagaacctggcggcagcgcaaaagatg

SEQ ID NO: 30534 - DNA, 103 bp, Artificial Sequence
  Synthetic Polynucleotide
taatacgactcactatagggacagttgccctcaaaaatcctcattgcagcaacagaggagagctgcaatgaggatttttaacctggcggcagcgcaaaagatg

SEQ ID NO: 30535 - DNA, 103 bp, Artificial Sequence
  Synthetic Polynucleotide
taatacgactcactatagggaggtatttccatcctcttcagattgcttggaacagaggagaccaagcatgctgaagaggaacctggcggcagcgcaaaagatg

SEQ ID NO: 30536 - DNA, 103 bp, Artificial Sequence
  Synthetic Polynucleotide
taatacgactcactatagggaacagaggtatttccatcctcttcagattgaacagaggagacaatctatggaggatggaaacctggcggcagcgcaaaagatg

SEQ ID NO: 30537 - DNA, 103 bp, Artificial Sequence
  Synthetic Polynucleotide
taatacgactcactatagggagaagaacagaggtatttccatcctcttcaaacagaggagatgaagaatgtggaaatacaacctggcggcagcgcaaaagatg

SEQ ID NO: 30538 - DNA, 103 bp, Artificial Sequence
  Synthetic Polynucleotide
taatacgactcactatagggactctagaagaacagaggtatttccatcctaacagaggagaaggatgatgatacctctgaacctggcggcagcgcaaaagatg

SEQ ID NO: 30539 - DNA, 103 bp, Artificial Sequence
  Synthetic Polynucleotide
taatacgactcactatagggatttcactctagaagaacagaggtatttccaacagaggagaggaaatatgtctgttcttaacctggcggcagcgcaaaagatg

SEQ ID NO: 30540 - DNA, 103 bp, Artificial Sequence
  Synthetic Polynucleotide
taatacgactcactatagggtttatatttcactctagaagaacagaggtaaacagaggagatacctcatgtcttctagaaacctggcggcagcgcaaaagatg

SEQ ID NO: 30541 - DNA, 103 bp, Artificial Sequence
  Synthetic Polynucleotide
taatacgactcactataggggttaatttatatttcactctagaagaacagaacagaggagactgttcatgtagagtgaaaacctggcggcagcgcaaaagatg

SEQ ID NO: 30542 - DNA, 103 bp, Artificial Sequence
  Synthetic Polynucleotide
taatacgactcactatagggacatggttaatttatatttcactctagaagaacagaggagacttctaatgtgaaatataaacctggcggcagcgcaaaagatg

SEQ ID NO: 30543 - DNA, 103 bp, Artificial Sequence
  Synthetic Polynucleotide
taatacgactcactatagggtgccgacatggttaatttatatttcactctaacagaggagaagagtgatgtataaattaaacctggcggcagcgcaaaagatg

SEQ ID NO: 30544 - DNA, 103 bp, Artificial Sequence
  Synthetic Polynucleotide
taatacgactcactatagggttaactgccgacatggttaatttatatttcaacagaggagagaaataatgattaaccataacctggcggcagcgcaaaagatg

SEQ ID NO: 30545 - DNA, 103 bp, Artificial Sequence
  Synthetic Polynucleotide
taatacgactcactatagggtctggacagttgccctcaaaaatcctcattaacagaggagaaatgagatgttttgagggaacctggcggcagcgcaaaagatg

SEQ ID NO: 30546 - DNA, 103 bp, Artificial Sequence
  Synthetic Polynucleotide
taatacgactcactataggggtctgttaactgccgacatggttaatttataacagaggagaataaatatgccatgtcggaacctggcggcagcgcaaaagatg

SEQ ID NO: 30547 - DNA, 103 bp, Artificial Sequence
  Synthetic Polynucleotide
taatacgactcactatagggtctgagtctgttaactgccgacatggttaaaacagaggagattaaccatgtcggcagttaacctggcggcagcgcaaaagatg

SEQ ID NO: 30548 - DNA, 103 bp, Artificial Sequence
  Synthetic Polynucleotide
taatacgactcactatagggcttgatctgagtctgttaactgccgacatgaacagaggagacatgtcatgagttaacagaacctggcggcagcgcaaaagatg

SEQ ID NO: 30549 - DNA, 103 bp, Artificial Sequence
  Synthetic Polynucleotide
taatacgactcactataggggctcacttgatctgagtctgttaactgccgaacagaggagacggcagatgacagactcaaacctggcggcagcgcaaaagatg

SEQ ID NO: 30550 - DNA, 103 bp, Artificial Sequence
  Synthetic Polynucleotide
taatacgactcactatagggctattgctcacttgatctgagtctgttaacaacagaggagagttaacatgctcagatcaaacctggcggcagcgcaaaagatg

SEQ ID NO: 30551 - DNA, 103 bp, Artificial Sequence
  Synthetic Polynucleotide
taatacgactcactatagggttgttctattgctcacttgatctgagtctgaacagaggagacagactatgatcaagtgaaacctggcggcagcgcaaaagatg

SEQ ID NO: 30552 - DNA, 103 bp, Artificial Sequence
  Synthetic Polynucleotide
taatacgactcactatagggcttgtttgttctattgctcacttgatctgaaacagaggagatcagatatggtgagcaataacctggcggcagcgcaaaagatg

SEQ ID NO: 30553 - DNA, 103 bp, Artificial Sequence
  Synthetic Polynucleotide
taatacgactcactatagggactagcttgtttgttctattgctcacttgaaacagaggagatcaagtatgcaatagaacaacctggcggcagcgcaaaagatg

SEQ ID NO: 30554 - DNA, 103 bp, Artificial Sequence
  Synthetic Polynucleotide
taatacgactcactatagggagggcactagcttgtttgttctattgctcaaacagaggagatgagcaatggaacaaacaaacctggcggcagcgcaaaagatg

SEQ ID NO: 30555 - DNA, 103 bp, Artificial Sequence
  Synthetic Polynucleotide
taatacgactcactatagggtgatgagggcactagcttgtttgttctattaacagaggagaaatagaatgaacaagctaaacctggcggcagcgcaaaagatg

SEQ ID NO: 30556 - DNA, 103 bp, Artificial Sequence
  Synthetic Polynucleotide
taatacgactcactatagggaatcctctggacagttgccctcaaaaatccaacagaggagaggatttatgagggcaactaacctggcggcagcgcaaaagatg

SEQ ID NO: 30557 - DNA, 103 bp, Artificial Sequence
  Synthetic Polynucleotide
taatacgactcactatagggcagcttgatgagggcactagcttgtttgttaacagaggagaaacaaaatggctagtgccaacctggcggcagcgcaaaagatg

SEQ ID NO: 30558 - DNA, 103 bp, Artificial Sequence
  Synthetic Polynucleotide
taatacgactcactatagggttgtgcagcttgatgagggcactagcttgtaacagaggagaacaagcatgtgccctcataacctggcggcagcgcaaaagatg

SEQ ID NO: 30559 - DNA, 103 bp, Artificial Sequence
  Synthetic Polynucleotide
taatacgactcactatagggtgtcattgtgcagcttgatgagggcactagaacagaggagactagtgatgtcatcaagcaacctggcggcagcgcaaaagatg

SEQ ID NO: 30560 - DNA, 103 bp, Artificial Sequence
  Synthetic Polynucleotide
taatacgactcactataggggaaggtgtcattgtgcagcttgatgagggcaacagaggagagccctcatgaagctgcacaacctggcggcagcgcaaaagatg

SEQ ID NO: 30561 - DNA, 103 bp, Artificial Sequence
  Synthetic Polynucleotide
taatacgactcactatagggaggaagaaggtgtcattgtgcagcttgatgaacagaggagacatcaaatggcacaatgaaacctggcggcagcgcaaaagatg

SEQ ID NO: 30562 - DNA, 103 bp, Artificial Sequence
  Synthetic Polynucleotide
taatacgactcactatagggagaacaggaagaaggtgtcattgtgcagctaacagaggagaagctgcatgatgacacctaacctggcggcagcgcaaaagatg

SEQ ID NO: 30563 - DNA, 103 bp, Artificial Sequence
  Synthetic Polynucleotide
taatacgactcactataggggtataagaacaggaagaaggtgtcattgtgaacagaggagacacaatatgaccttcttcaacctggcggcagcgcaaaagatg

SEQ ID NO: 30564 - DNA, 103 bp, Artificial Sequence
  Synthetic Polynucleotide
taatacgactcactataggggaagagtataagaacaggaagaaggtgtcaaacagaggagatgacacatgcttcctgttaacctggcggcagcgcaaaagatg

SEQ ID NO: 30565 - DNA, 103 bp, Artificial Sequence
  Synthetic Polynucleotide
taatacgactcactataggggtctcgaagagtataagaacaggaagaaggaacagaggagaccttctatgtgttcttataacctggcggcagcgcaaaagatg

SEQ ID NO: 30566 - DNA, 103 bp, Artificial Sequence
  Synthetic Polynucleotide
taatacgactcactatagggagtatgtctcgaagagtataagaacaggaaaacagaggagattcctgatgttatactctaacctggcggcagcgcaaaagatg

SEQ ID NO: 30567 - DNA, 103 bp, Artificial Sequence
  Synthetic Polynucleotide
taatacgactcactatagggtatccaatcctctggacagttgccctcaaaaacagaggagatttgagatgaactgtccaaacctggcggcagcgcaaaagatg

SEQ ID NO: 30568 - DNA, 103 bp, Artificial Sequence
  Synthetic Polynucleotide
taatacgactcactatagggaacaaagtatgtctcgaagagtataagaacaacagaggagagttcttatgctcttcgagaacctggcggcagcgcaaaagatg

SEQ ID NO: 30569 - DNA, 103 bp, Artificial Sequence
  Synthetic Polynucleotide
taatacgactcactatagggtccaaaacaaagtatgtctcgaagagtataaacagaggagatatactatgcgagacataaacctggcggcagcgcaaaagatg

SEQ ID NO: 30570 - DNA, 103 bp, Artificial Sequence
  Synthetic Polynucleotide
taatacgactcactatagggatgcatccaaaacaaagtatgtctcgaagaaacagaggagatcttcgatgcatactttgaacctggcggcagcgcaaaagatg

SEQ ID NO: 30571 - DNA, 103 bp, Artificial Sequence
  Synthetic Polynucleotide
taatacgactcactatagggttgttatgcatccaaaacaaagtatgtctcaacagaggagagagacaatgtttgttttgaacctggcggcagcgcaaaagatg

SEQ ID NO: 30572 - DNA, 103 bp, Artificial Sequence
  Synthetic Polynucleotide
taatacgactcactatagggtcacattgttatgcatccaaaacaaagtataacagaggagaatacttatgtttggatgcaacctggcggcagcgcaaaagatg

SEQ ID NO: 30573 - DNA, 103 bp, Artificial Sequence
  Synthetic Polynucleotide
taatacgactcactatagggttttttcacattgttatgcatccaaaacaaaacagaggagattgtttatgatgcataacaacctggcggcagcgcaaaagatg

SEQ ID NO: 30574 - DNA, 103 bp, Artificial Sequence
  Synthetic Polynucleotide
taatacgactcactatagggttagtttttttcacattgttatgcatccaaaacagaggagattggatatgtaacaatgtaacctggcggcagcgcaaaagatg

SEQ ID NO: 30575 - DNA, 103 bp, Artificial Sequence
  Synthetic Polynucleotide
taatacgactcactatagggccatcttagtttttttcacattgttatgcaaacagaggagatgcataatgatgtgaaaaaacctggcggcagcgcaaaagatg

SEQ ID NO: 30576 - DNA, 103 bp, Artificial Sequence
  Synthetic Polynucleotide
taatacgactcactataggggattaccatcttagtttttttcacattgttaacagaggagaaacaatatgaaaaaaactaacctggcggcagcgcaaaagatg

SEQ ID NO: 30577 - DNA, 103 bp, Artificial Sequence
  Synthetic Polynucleotide
taatacgactcactatagggctgtcgattaccatcttagtttttttcacaaacagaggagatgtgaaatgaactaagataacctggcggcagcgcaaaagatg

SEQ ID NO: 30578 - DNA, 103 bp, Artificial Sequence
  Synthetic Polynucleotide
taatacgactcactatagggtagcttatccaatcctctggacagttgcccaacagaggagagggcaaatgtccagaggaaacctggcggcagcgcaaaagatg

SEQ ID NO: 30579 - DNA, 103 bp, Artificial Sequence
  Synthetic Polynucleotide
taatacgactcactatagggtgatactgtcgattaccatcttagttttttaacagaggagaaaaaaaatgagatggtaaaacctggcggcagcgcaaaagatg

SEQ ID NO: 30580 - DNA, 103 bp, Artificial Sequence
  Synthetic Polynucleotide
taatacgactcactataggggatgttgatactgtcgattaccatcttagtaacagaggagaactaagatggtaatcgacaacctggcggcagcgcaaaagatg

SEQ ID NO: 30581 - DNA, 103 bp, Artificial Sequence
  Synthetic Polynucleotide
taatacgactcactatagggtgagagatgttgatactgtcgattaccatcaacagaggagagatggtatgcgacagtataacctggcggcagcgcaaaagatg

SEQ ID NO: 30582 - DNA, 103 bp, Artificial Sequence
  Synthetic Polynucleotide
taatacgactcactataggggatgatgagagatgttgatactgtcgattaaacagaggagataatcgatggtatcaacaaacctggcggcagcgcaaaagatg

SEQ ID NO: 30583 - DNA, 103 bp, Artificial Sequence
  Synthetic Polynucleotide
taatacgactcactatagggcttaagatgatgagagatgttgatactgtcaacagaggagagacagtatgaacatctctaacctggcggcagcgcaaaagatg

SEQ ID NO: 30584 - DNA, 103 bp, Artificial Sequence
  Synthetic Polynucleotide
taatacgactcactatagggtcttacttaagatgatgagagatgttgataaacagaggagatatcaaatgctctcatcaaacctggcggcagcgcaaaagatg

SEQ ID NO: 30585 - DNA, 103 bp, Artificial Sequence
  Synthetic Polynucleotide
taatacgactcactatagggccatctcttacttaagatgatgagagatgtaacagaggagaacatctatgatcatcttaaacctggcggcagcgcaaaagatg

SEQ ID NO: 30586 - DNA, 103 bp, Artificial Sequence
  Synthetic Polynucleotide
taatacgactcactatagggctgagccatctcttacttaagatgatgagaaacagaggagatctcatatgcttaagtaaaacctggcggcagcgcaaaagatg

SEQ ID NO: 30587 - DNA, 103 bp, Artificial Sequence
  Synthetic Polynucleotide
taatacgactcactatagggaccaactgagccatctcttacttaagatgaaacagaggagatcatctatggtaagagataacctggcggcagcgcaaaagatg

SEQ ID NO: 30588 - DNA, 103 bp, Artificial Sequence
  Synthetic Polynucleotide
taatacgactcactatagggaagtgaccaactgagccatctcttacttaaaacagaggagattaagtatgagatggctcaacctggcggcagcgcaaaagatg

SEQ ID NO: 30589 - DNA, 103 bp, Artificial Sequence
  Synthetic Polynucleotide
taatacgactcactatagggttccgtagcttatccaatcctctggacagtaacagaggagaactgtcatgaggattggaaacctggcggcagcgcaaaagatg

SEQ ID NO: 30590 - DNA, 103 bp, Artificial Sequence
  Synthetic Polynucleotide
taatacgactcactatagggcaccaaagtgaccaactgagccatctcttaaacagaggagataagagatggctcagttgaacctggcggcagcgcaaaagatg

SEQ ID NO: 30591 - DNA, 103 bp, Artificial Sequence
  Synthetic Polynucleotide
taatacgactcactatagggttcagcaccaaagtgaccaactgagccatcaacagaggagagatggcatggttggtcacaacctggcggcagcgcaaaagatg

SEQ ID NO: 30592 - DNA, 103 bp, Artificial Sequence
  Synthetic Polynucleotide
taatacgactcactatagggatccgttcagcaccaaagtgaccaactgagaacagaggagactcagtatgtcactttggaacctggcggcagcgcaaaagatg

SEQ ID NO: 30593 - DNA, 103 bp, Artificial Sequence
  Synthetic Polynucleotide
taatacgactcactatagggggacaatccgttcagcaccaaagtgaccaaaacagaggagattggtcatgttggtgctgaacctggcggcagcgcaaaagatg

SEQ ID NO: 30594 - DNA, 103 bp, Artificial Sequence
  Synthetic Polynucleotide
taatacgactcactatagggaaaagggacaatccgttcagcaccaaagtgaacagaggagacactttatggctgaacggaacctggcggcagcgcaaaagatg

SEQ ID NO: 30595 - DNA, 103 bp, Artificial Sequence
  Synthetic Polynucleotide
taatacgactcactatagggctgtcaaaagggacaatccgttcagcaccaaacagaggagatggtgcatgacggattgtaacctggcggcagcgcaaaagatg

SEQ ID NO: 30596 - DNA, 103 bp, Artificial Sequence
  Synthetic Polynucleotide
taatacgactcactatagggtggccctgtcaaaagggacaatccgttcagaacagaggagactgaacatgttgtcccttaacctggcggcagcgcaaaagatg

SEQ ID NO: 30597 - DNA, 103 bp, Artificial Sequence
  Synthetic Polynucleotide
taatacgactcactatagggatgcctggccctgtcaaaagggacaatccgaacagaggagacggattatgccttttgacaacctggcggcagcgcaaaagatg

SEQ ID NO: 30598 - DNA, 103 bp, Artificial Sequence
  Synthetic Polynucleotide
taatacgactcactataggggaaatatgcctggccctgtcaaaagggacaaacagaggagatgtcccatgtgacagggcaacctggcggcagcgcaaaagatg

SEQ ID NO: 30599 - DNA, 103 bp, Artificial Sequence
  Synthetic Polynucleotide
taatacgactcactatagggcattggaaatatgcctggccctgtcaaaagaacagaggagacttttgatggggccaggcaacctggcggcagcgcaaaagatg

SEQ ID NO: 30600 - DNA, 103 bp, Artificial Sequence
  Synthetic Polynucleotide
taatacgactcactatagggtatgattccgtagcttatccaatcctctggaacagaggagaccagagatgtggataagcaacctggcggcagcgcaaaagatg

SEQ ID NO: 30601 - DNA, 103 bp, Artificial Sequence
  Synthetic Polynucleotide
taatacgactcactataggggtatacattggaaatatgcctggccctgtcaacagaggagagacaggatgaggcatattaacctggcggcagcgcaaaagatg

SEQ ID NO: 30602 - DNA, 103 bp, Artificial Sequence
  Synthetic Polynucleotide
taatacgactcactatagggggattgtatacattggaaatatgcctggccaacagaggagaggccagatgtatttccaaaacctggcggcagcgcaaaagatg

SEQ ID NO: 30603 - DNA, 103 bp, Artificial Sequence
  Synthetic Polynucleotide
taatacgactcactatagggttcagggattgtatacattggaaatatgccaacagaggagaggcataatgccaatgtataacctggcggcagcgcaaaagatg

SEQ ID NO: 30604 - DNA, 103 bp, Artificial Sequence
  Synthetic Polynucleotide
taatacgactcactatagggagcccttcagggattgtatacattggaaataacagaggagaatttccatggtatacaataacctggcggcagcgcaaaagatg

SEQ ID NO: 30605 - DNA, 103 bp, Artificial Sequence
  Synthetic Polynucleotide
taatacgactcactataggggacccagcccttcagggattgtatacattgaacagaggagacaatgtatgcaatccctgaacctggcggcagcgcaaaagatg

SEQ ID NO: 30606 - DNA, 103 bp, Artificial Sequence
  Synthetic Polynucleotide
taatacgactcactatagggccagggacccagcccttcagggattgtataaacagaggagatatacaatgcctgaagggaacctggcggcagcgcaaaagatg

SEQ ID NO: 30607 - DNA, 103 bp, Artificial Sequence
  Synthetic Polynucleotide
taatacgactcactatagggggagtccagggacccagcccttcagggattaacagaggagaaatcccatgagggctgggaacctggcggcagcgcaaaagatg

SEQ ID NO: 30608 - DNA, 103 bp, Artificial Sequence
  Synthetic Polynucleotide
taatacgactcactatagggcaatcggagtccagggacccagcccttcagaacagaggagactgaagatgtgggtccctaacctggcggcagcgcaaaagatg

SEQ ID NO: 30609 - DNA, 103 bp, Artificial Sequence
  Synthetic Polynucleotide
taatacgactcactatagggtaaatcaatcggagtccagggacccagcccaacagaggagagggctgatgccctggactaacctggcggcagcgcaaaagatg

SEQ ID NO: 30610 - DNA, 103 bp, Artificial Sequence
  Synthetic Polynucleotide
taatacgactcactatagggtgagataaatcaatcggagtccagggacccaacagaggagagggtccatggactccgataacctggcggcagcgcaaaagatg

SEQ ID NO: 30611 - DNA, 103 bp, Artificial Sequence
  Synthetic Polynucleotide
taatacgactcactataggggctattatgattccgtagcttatccaatccaacagaggagaggattgatgaagctacggaacctggcggcagcgcaaaagatg

SEQ ID NO: 30612 - DNA, 103 bp, Artificial Sequence
  Synthetic Polynucleotide
taatacgactcactatagggtcagatgagataaatcaatcggagtccaggaacagaggagacctggaatgcgattgattaacctggcggcagcgcaaaagatg

SEQ ID NO: 30613 - DNA, 103 bp, Artificial Sequence
  Synthetic Polynucleotide
taatacgactcactatagggacacttcagatgagataaatcaatcggagtaacagaggagaactccgatggatttatctaacctggcggcagcgcaaaagatg

SEQ ID NO: 30614 - DNA, 103 bp, Artificial Sequence
  Synthetic Polynucleotide
taatacgactcactatagggtcaggacacttcagatgagataaatcaatcaacagaggagagattgaatgatctcatctaacctggcggcagcgcaaaagatg

SEQ ID NO: 30615 - DNA, 103 bp, Artificial Sequence
  Synthetic Polynucleotide
taatacgactcactatagggtattgtcaggacacttcagatgagataaataacagaggagaatttatatgatctgaagtaacctggcggcagcgcaaaagatg

SEQ ID NO: 30616 - DNA, 103 bp, Artificial Sequence
  Synthetic Polynucleotide
taatacgactcactataggggtatgtattgtcaggacacttcagatgagaaacagaggagatctcatatgaagtgtcctaacctggcggcagcgcaaaagatg

SEQ ID NO: 30617 - DNA, 103 bp, Artificial Sequence
  Synthetic Polynucleotide
taatacgactcactataggggcaaagtatgtattgtcaggacacttcagaaacagaggagatctgaaatgtcctgacaaaacctggcggcagcgcaaaagatg

SEQ ID NO: 30618 - DNA, 103 bp, Artificial Sequence
  Synthetic Polynucleotide
taatacgactcactatagggcttctgcaaagtatgtattgtcaggacactaacagaggagaagtgtcatgacaatacataacctggcggcagcgcaaaagatg

SEQ ID NO: 30619 - DNA, 103 bp, Artificial Sequence
  Synthetic Polynucleotide
taatacgactcactataggggccctcttctgcaaagtatgtattgtcaggaacagaggagacctgacatgacatactttaacctggcggcagcgcaaaagatg

SEQ ID NO: 30620 - DNA, 103 bp, Artificial Sequence
  Synthetic Polynucleotide
taatacgactcactatagggttgcagccctcttctgcaaagtatgtattgaacagaggagacaatacatgctttgcagaaacctggcggcagcgcaaaagatg

SEQ ID NO: 30621 - DNA, 103 bp, Artificial Sequence
  Synthetic Polynucleotide
taatacgactcactatagggcctcattgcagccctcttctgcaaagtatgaacagaggagacatactatgcagaagaggaacctggcggcagcgcaaaagatg

SEQ ID NO: 30622 - DNA, 103 bp, Artificial Sequence
  Synthetic Polynucleotide
taatacgactcactatagggtcttggctattatgattccgtagcttatccaacagaggagaggataaatgacggaatcaaacctggcggcagcgcaaaagatg

SEQ ID NO: 30623 - DNA, 103 bp, Artificial Sequence
  Synthetic Polynucleotide
taatacgactcactataggggctgccctcattgcagccctcttctgcaaaaacagaggagatttgcaatggagggctgcaacctggcggcagcgcaaaagatg

SEQ ID NO: 30624 - DNA, 103 bp, Artificial Sequence
  Synthetic Polynucleotide
taatacgactcactatagggaccttgctgccctcattgcagccctcttctaacagaggagaagaagaatgctgcaatgaaacctggcggcagcgcaaaagatg

SEQ ID NO: 30625 - DNA, 103 bp, Artificial Sequence
  Synthetic Polynucleotide
taatacgactcactatagggaagacaccttgctgccctcattgcagccctaacagaggagaagggctatgatgagggcaaacctggcggcagcgcaaaagatg

SEQ ID NO: 30626 - DNA, 103 bp, Artificial Sequence
  Synthetic Polynucleotide
taatacgactcactatagggtaagtaagacaccttgctgccctcattgcaaacagaggagatgcaatatgggcagcaagaacctggcggcagcgcaaaagatg

SEQ ID NO: 30627 - DNA, 103 bp, Artificial Sequence
  Synthetic Polynucleotide
taatacgactcactatagggagttctaagtaagacaccttgctgccctcaaacagaggagatgagggatgcaaggtgtcaacctggcggcagcgcaaaagatg

SEQ ID NO: 30628 - DNA, 103 bp, Artificial Sequence
  Synthetic Polynucleotide
taatacgactcactataggggcttcagttctaagtaagacaccttgctgcaacagaggagagcagcaatgtgtcttactaacctggcggcagcgcaaaagatg

SEQ ID NO: 30629 - DNA, 103 bp, Artificial Sequence
  Synthetic Polynucleotide
taatacgactcactatagggagaaggcttcagttctaagtaagacaccttaacagaggagaaaggtgatgtacttagaaaacctggcggcagcgcaaaagatg

SEQ ID NO: 30630 - DNA, 103 bp, Artificial Sequence
  Synthetic Polynucleotide
taatacgactcactatagggtgaaaagaaggcttcagttctaagtaagacaacagaggagagtcttaatgagaactgaaaacctggcggcagcgcaaaagatg

SEQ ID NO: 30631 - DNA, 103 bp, Artificial Sequence
  Synthetic Polynucleotide
taatacgactcactataggggagaatgaaaagaaggcttcagttctaagtaacagaggagaacttagatgtgaagccttaacctggcggcagcgcaaaagatg

SEQ ID NO: 30632 - DNA, 103 bp, Artificial Sequence
  Synthetic Polynucleotide
taatacgactcactataggggttttgagaatgaaaagaaggcttcagttcaacagaggagagaactgatgccttcttttaacctggcggcagcgcaaaagatg

SEQ ID NO: 30633 - DNA, 103 bp, Artificial Sequence
  Synthetic Polynucleotide
taatacgactcactatagggtcctttcttggctattatgattccgtagctaacagaggagaagctacatgatcataataaacctggcggcagcgcaaaagatg

SEQ ID NO: 30634 - DNA, 103 bp, Artificial Sequence
  Synthetic Polynucleotide
taatacgactcactatagggactttgttttgagaatgaaaagaaggcttcaacagaggagagaagccatgttttcattcaacctggcggcagcgcaaaagatg

SEQ ID NO: 30635 - DNA, 103 bp, Artificial Sequence
  Synthetic Polynucleotide
taatacgactcactatagggcctgtactttgttttgagaatgaaaagaagaacagaggagacttcttatgattctcaaaaacctggcggcagcgcaaaagatg

SEQ ID NO: 30636 - DNA, 103 bp, Artificial Sequence
  Synthetic Polynucleotide
taatacgactcactatagggaaatccctgtactttgttttgagaatgaaaaacagaggagatttcatatgcaaaacaaaaacctggcggcagcgcaaaagatg

SEQ ID NO: 30637 - DNA, 103 bp, Artificial Sequence
  Synthetic Polynucleotide
taatacgactcactatagggcaggtaaatccctgtactttgttttgagaaaacagaggagattctcaatgcaaagtacaaacctggcggcagcgcaaaagatg

SEQ ID NO: 30638 - DNA, 103 bp, Artificial Sequence
  Synthetic Polynucleotide
taatacgactcactatagggctgtacaggtaaatccctgtactttgttttaacagaggagaaaaacaatgtacagggataacctggcggcagcgcaaaagatg

SEQ ID NO: 30639 - DNA, 103 bp, Artificial Sequence
  Synthetic Polynucleotide
taatacgactcactatagggtatccctgtacaggtaaatccctgtactttaacagaggagaaaagtaatgggatttaccaacctggcggcagcgcaaaagatg

SEQ ID NO: 30640 - DNA, 103 bp, Artificial Sequence
  Synthetic Polynucleotide
taatacgactcactatagggttgattatccctgtacaggtaaatccctgtaacagaggagaacagggatgtacctgtacaacctggcggcagcgcaaaagatg

SEQ ID NO: 30641 - DNA, 103 bp, Artificial Sequence
  Synthetic Polynucleotide
taatacgactcactatagggccatgttgattatccctgtacaggtaaatcaacagaggagagatttaatggtacagggaaacctggcggcagcgcaaaagatg

SEQ ID NO: 30642 - DNA, 103 bp, Artificial Sequence
  Synthetic Polynucleotide
taatacgactcactatagggggttgccatgttgattatccctgtacaggtaacagaggagaacctgtatggggataatcaacctggcggcagcgcaaaagatg

SEQ ID NO: 30643 - DNA, 103 bp, Artificial Sequence
  Synthetic Polynucleotide
taatacgactcactatagggtatgtggttgccatgttgattatccctgtaaacagaggagatacaggatgaatcaacataacctggcggcagcgcaaaagatg

SEQ ID NO: 30644 - DNA, 103 bp, Artificial Sequence
  Synthetic Polynucleotide
taatacgactcactatagggttactttttcttttccccttcgattccttcaacagaggagagaaggaatggaaggggaaaacctggcggcagcgcaaaagatg

SEQ ID NO: 30645 - DNA, 103 bp, Artificial Sequence
  Synthetic Polynucleotide
taatacgactcactataggggtttctcctttcttggctattatgattccgaacagaggagacggaatatgaatagccaaaacctggcggcagcgcaaaagatg

SEQ ID NO: 30646 - DNA, 103 bp, Artificial Sequence
  Synthetic Polynucleotide
taatacgactcactatagggtggtgtatgtggttgccatgttgattatccaacagaggagaggataaatgacatggcaaaacctggcggcagcgcaaaagatg

SEQ ID NO: 30647 - DNA, 103 bp, Artificial Sequence
  Synthetic Polynucleotide
taatacgactcactataggggaaattggtgtatgtggttgccatgttgataacagaggagaatcaacatggcaaccacaaacctggcggcagcgcaaaagatg

SEQ ID NO: 30648 - DNA, 103 bp, Artificial Sequence
  Synthetic Polynucleotide
taatacgactcactatagggccaacgaaattggtgtatgtggttgccatgaacagaggagacatggcatgcacatacacaacctggcggcagcgcaaaagatg

SEQ ID NO: 30649 - DNA, 103 bp, Artificial Sequence
  Synthetic Polynucleotide
taatacgactcactatagggcataaccaacgaaattggtgtatgtggttgaacagaggagacaaccaatgacaccaattaacctggcggcagcgcaaaagatg

SEQ ID NO: 30650 - DNA, 103 bp, Artificial Sequence
  Synthetic Polynucleotide
taatacgactcactatagggggtgacataaccaacgaaattggtgtatgtaacagaggagaacatacatgaatttcgttaacctggcggcagcgcaaaagatg

SEQ ID NO: 30651 - DNA, 103 bp, Artificial Sequence
  Synthetic Polynucleotide
taatacgactcactataggggtggtggtgacataaccaacgaaattggtgaacagaggagacaccaaatgcgttggttaaacctggcggcagcgcaaaagatg

SEQ ID NO: 30652 - DNA, 103 bp, Artificial Sequence
  Synthetic Polynucleotide
taatacgactcactataggggaaaagtggtggtgacataaccaacgaaataacagaggagaatttcgatggttatgtcaaacctggcggcagcgcaaaagatg

SEQ ID NO: 30653 - DNA, 103 bp, Artificial Sequence
  Synthetic Polynucleotide
taatacgactcactatagggccgctgaaaagtggtggtgacataaccaacaacagaggagagttggtatggtcaccaccaacctggcggcagcgcaaaagatg

SEQ ID NO: 30654 - DNA, 103 bp, Artificial Sequence
  Synthetic Polynucleotide
taatacgactcactatagggtgggaccgctgaaaagtggtggtgacataaaacagaggagattatgtatgcaccactttaacctggcggcagcgcaaaagatg

SEQ ID NO: 30655 - DNA, 103 bp, Artificial Sequence
  Synthetic Polynucleotide
taatacgactcactatagggtgaagtgggaccgctgaaaagtggtggtgaaacagaggagatcaccaatgcttttcagcaacctggcggcagcgcaaaagatg

SEQ ID NO: 30656 - DNA, 103 bp, Artificial Sequence
  Synthetic Polynucleotide
taatacgactcactatagggtaatagtttctcctttcttggctattatgaaacagaggagatcataaatgccaagaaagaacctggcggcagcgcaaaagatg

SEQ ID NO: 30657 - DNA, 103 bp, Artificial Sequence
  Synthetic Polynucleotide
taatacgactcactatagggggggatgaagtgggaccgctgaaaagtggtaacagaggagaaccactatgcagcggtccaacctggcggcagcgcaaaagatg

SEQ ID NO: 30658 - DNA, 103 bp, Artificial Sequence
  Synthetic Polynucleotide
taatacgactcactatagggtggttggggatgaagtgggaccgctgaaaaaacagaggagattttcaatggtcccacttaacctggcggcagcgcaaaagatg

SEQ ID NO: 30659 - DNA, 103 bp, Artificial Sequence
  Synthetic Polynucleotide
taatacgactcactatagggccctctggttggggatgaagtgggaccgctaacagaggagaagcggtatgacttcatccaacctggcggcagcgcaaaagatg

SEQ ID NO: 30660 - DNA, 103 bp, Artificial Sequence
  Synthetic Polynucleotide
taatacgactcactatagggacaatccctctggttggggatgaagtgggaaacagaggagatcccacatgatccccaacaacctggcggcagcgcaaaagatg

SEQ ID NO: 30661 - DNA, 103 bp, Artificial Sequence
  Synthetic Polynucleotide
taatacgactcactatagggtgacgacaatccctctggttggggatgaagaacagaggagacttcatatgcaaccagagaacctggcggcagcgcaaaagatg

SEQ ID NO: 30662 - DNA, 103 bp, Artificial Sequence
  Synthetic Polynucleotide
taatacgactcactatagggtagcttgacgacaatccctctggttggggaaacagaggagatccccaatgagagggattaacctggcggcagcgcaaaagatg

SEQ ID NO: 30663 - DNA, 103 bp, Artificial Sequence
  Synthetic Polynucleotide
taatacgactcactatagggctctctagcttgacgacaatccctctggttaacagaggagaaaccagatggattgtcgtaacctggcggcagcgcaaaagatg

SEQ ID NO: 30664 - DNA, 103 bp, Artificial Sequence
  Synthetic Polynucleotide
taatacgactcactatagggttccactctctagcttgacgacaatccctcaacagaggagagagggaatgtcgtcaagcaacctggcggcagcgcaaaagatg

SEQ ID NO: 30665 - DNA, 103 bp, Artificial Sequence
  Synthetic Polynucleotide
taatacgactcactatagggccttcttccactctctagcttgacgacaataacagaggagaattgtcatgaagctagagaacctggcggcagcgcaaaagatg

SEQ ID NO: 30666 - DNA, 103 bp, Artificial Sequence
  Synthetic Polynucleotide
taatacgactcactatagggcccttccttcttccactctctagcttgacgaacagaggagacgtcaaatgagagagtggaacctggcggcagcgcaaaagatg

SEQ ID NO: 30667 - DNA, 103 bp, Artificial Sequence
  Synthetic Polynucleotide
taatacgactcactatagggggggttaatagtttctcctttcttggctataacagaggagaatagccatgaaaggagaaaacctggcggcagcgcaaaagatg

SEQ ID NO: 30668 - DNA, 103 bp, Artificial Sequence
  Synthetic Polynucleotide
taatacgactcactataggggggtccccttccttcttccactctctagctaacagaggagaagctagatggtggaagaaaacctggcggcagcgcaaaagatg

SEQ ID NO: 30669 - DNA, 103 bp, Artificial Sequence
  Synthetic Polynucleotide
taatacgactcactatagggatcttgggtccccttccttcttccactctcaacagaggagagagagtatgagaaggaagaacctggcggcagcgcaaaagatg

SEQ ID NO: 30670 - DNA, 103 bp, Artificial Sequence
  Synthetic Polynucleotide
taatacgactcactatagggttcgtatcttgggtccccttccttcttccaaacagaggagatggaagatggaaggggacaacctggcggcagcgcaaaagatg

SEQ ID NO: 30671 - DNA, 103 bp, Artificial Sequence
  Synthetic Polynucleotide
taatacgactcactataggggactcttcgtatcttgggtccccttccttcaacagaggagagaaggaatgggacccaagaacctggcggcagcgcaaaagatg

SEQ ID NO: 30672 - DNA, 103 bp, Artificial Sequence
  Synthetic Polynucleotide
taatacgactcactatagggtcaatgactcttcgtatcttgggtccccttaacagaggagaaaggggatgcaagatacgaacctggcggcagcgcaaaagatg

SEQ ID NO: 30673 - DNA, 103 bp, Artificial Sequence
  Synthetic Polynucleotide
taatacgactcactatagggagtggtcaatgactcttcgtatcttgggtcaacagaggagagacccaatgtacgaagagaacctggcggcagcgcaaaagatg

SEQ ID NO: 30674 - DNA, 103 bp, Artificial Sequence
  Synthetic Polynucleotide
taatacgactcactatagggtaaggagtggtcaatgactcttcgtatcttaacagaggagaaagataatgagagtcattaacctggcggcagcgcaaaagatg

SEQ ID NO: 30675 - DNA, 103 bp, Artificial Sequence
  Synthetic Polynucleotide
taatacgactcactatagggcgggataaggagtggtcaatgactcttcgtaacagaggagaacgaagatgcattgaccaaacctggcggcagcgcaaaagatg

SEQ ID NO: 30676 - DNA, 103 bp, Artificial Sequence
  Synthetic Polynucleotide
taatacgactcactatagggagagtcgggataaggagtggtcaatgactcaacagaggagagagtcaatgaccactcctaacctggcggcagcgcaaaagatg

SEQ ID NO: 30677 - DNA, 103 bp, Artificial Sequence
  Synthetic Polynucleotide
taatacgactcactatagggcatttagagtcgggataaggagtggtcaataacagaggagaattgacatgtccttatccaacctggcggcagcgcaaaagatg

SEQ ID NO: 30678 - DNA, 103 bp, Artificial Sequence
  Synthetic Polynucleotide
taatacgactcactatagggtgtccggggttaatagtttctcctttcttgaacagaggagacaagaaatgagaaactataacctggcggcagcgcaaaagatg

SEQ ID NO: 30679 - DNA, 103 bp, Artificial Sequence
  Synthetic Polynucleotide
taatacgactcactatagggtcaaccatttagagtcgggataaggagtggaacagaggagaccactcatgatcccgactaacctggcggcagcgcaaaagatg

SEQ ID NO: 30680 - DNA, 103 bp, Artificial Sequence
  Synthetic Polynucleotide
taatacgactcactatagggtgttctcaaccatttagagtcgggataaggaacagaggagaccttatatggactctaaaaacctggcggcagcgcaaaagatg

SEQ ID NO: 30681 - DNA, 103 bp, Artificial Sequence
  Synthetic Polynucleotide
taatacgactcactataggggtgactgttctcaaccatttagagtcgggaaacagaggagatcccgaatgtaaatggttaacctggcggcagcgcaaaagatg

SEQ ID NO: 30682 - DNA, 103 bp, Artificial Sequence
  Synthetic Polynucleotide
taatacgactcactatagggaggttgtgactgttctcaaccatttagagtaacagaggagaactctaatgggttgagaaaacctggcggcagcgcaaaagatg

SEQ ID NO: 30683 - DNA, 103 bp, Artificial Sequence
  Synthetic Polynucleotide
taatacgactcactatagggcttggaggttgtgactgttctcaaccatttaacagaggagaaaatggatgagaacagtcaacctggcggcagcgcaaaagatg

SEQ ID NO: 30684 - DNA, 103 bp, Artificial Sequence
  Synthetic Polynucleotide
taatacgactcactataggggattccttggaggttgtgactgttctcaacaacagaggagagttgagatgagtcacaacaacctggcggcagcgcaaaagatg

SEQ ID NO: 30685 - DNA, 103 bp, Artificial Sequence
  Synthetic Polynucleotide
taatacgactcactataggggccatgattccttggaggttgtgactgttcaacagaggagagaacagatgcaacctccaaacctggcggcagcgcaaaagatg

SEQ ID NO: 30686 - DNA, 103 bp, Artificial Sequence
  Synthetic Polynucleotide
taatacgactcactatagggtatcagccatgattccttggaggttgtgacaacagaggagagtcacaatgtccaaggaaaacctggcggcagcgcaaaagatg

SEQ ID NO: 30687 - DNA, 103 bp, Artificial Sequence
  Synthetic Polynucleotide
taatacgactcactatagggtccaatatcagccatgattccttggaggttaacagaggagaaacctcatgggaatcatgaacctggcggcagcgcaaaagatg

SEQ ID NO: 30688 - DNA, 103 bp, Artificial Sequence
  Synthetic Polynucleotide
taatacgactcactatagggcaggatccaatatcagccatgattccttggaacagaggagaccaaggatgcatggctgaaacctggcggcagcgcaaaagatg

SEQ ID NO: 30689 - DNA, 103 bp, Artificial Sequence
  Synthetic Polynucleotide
taatacgactcactatagggctaggtgtccggggttaatagtttctccttaacagaggagaaaggagatgctattaaccaacctggcggcagcgcaaaagatg

SEQ ID NO: 30690 - DNA, 103 bp, Artificial Sequence
  Synthetic Polynucleotide
taatacgactcactatagggcactgcaggatccaatatcagccatgattcaacagaggagagaatcaatgctgatattgaacctggcggcagcgcaaaagatg

SEQ ID NO: 30691 - DNA, 103 bp, Artificial Sequence
  Synthetic Polynucleotide
taatacgactcactatagggtcaaccactgcaggatccaatatcagccataacagaggagaatggctatgattggatccaacctggcggcagcgcaaaagatg

SEQ ID NO: 30692 - DNA, 103 bp, Artificial Sequence
  Synthetic Polynucleotide
taatacgactcactatagggccatctcaaccactgcaggatccaatatcaaacagaggagatgatatatgatcctgcagaacctggcggcagcgcaaaagatg

SEQ ID NO: 30693 - DNA, 103 bp, Artificial Sequence
  Synthetic Polynucleotide
taatacgactcactataggggatgtccatctcaaccactgcaggatccaaaacagaggagattggatatggcagtggttaacctggcggcagcgcaaaagatg

SEQ ID NO: 30694 - DNA, 103 bp, Artificial Sequence
  Synthetic Polynucleotide
taatacgactcactatagggttgtagatgtccatctcaaccactgcaggaaacagaggagatcctgcatgggttgagataacctggcggcagcgcaaaagatg

SEQ ID NO: 30695 - DNA, 103 bp, Artificial Sequence
  Synthetic Polynucleotide
taatacgactcactatagggtcttgttgtagatgtccatctcaaccactgaacagaggagacagtggatgagatggacaaacctggcggcagcgcaaaagatg

SEQ ID NO: 30696 - DNA, 103 bp, Artificial Sequence
  Synthetic Polynucleotide
taatacgactcactatagggcattgtcttgttgtagatgtccatctcaacaacagaggagagttgagatggacatctacaacctggcggcagcgcaaaagatg

SEQ ID NO: 30697 - DNA, 103 bp, Artificial Sequence
  Synthetic Polynucleotide
taatacgactcactataggggaaaacattgtcttgttgtagatgtccatcaacagaggagagatggaatgctacaacaaaacctggcggcagcgcaaaagatg

SEQ ID NO: 30698 - DNA, 103 bp, Artificial Sequence
  Synthetic Polynucleotide
taatacgactcactatagggctggagaaaacattgtcttgttgtagatgtaacagaggagaacatctatgacaagacaaaacctggcggcagcgcaaaagatg

SEQ ID NO: 30699 - DNA, 103 bp, Artificial Sequence
  Synthetic Polynucleotide
taatacgactcactatagggaaggactggagaaaacattgtcttgttgtaaacagaggagatacaacatgacaatgtttaacctggcggcagcgcaaaagatg

SEQ ID NO: 30700 - DNA, 103 bp, Artificial Sequence
  Synthetic Polynucleotide
taatacgactcactatagggatttactaggtgtccggggttaatagtttcaacagaggagagaaactatgaaccccggaaacctggcggcagcgcaaaagatg

SEQ ID NO: 30701 - DNA, 103 bp, Artificial Sequence
  Synthetic Polynucleotide
taatacgactcactatagggttccgaaggactggagaaaacattgtcttgaacagaggagacaagacatggttttctccaacctggcggcagcgcaaaagatg

SEQ ID NO: 30702 - DNA, 103 bp, Artificial Sequence
  Synthetic Polynucleotide
taatacgactcactatagggatccattccgaaggactggagaaaacattgaacagaggagacaatgtatgctccagtccaacctggcggcagcgcaaaagatg

SEQ ID NO: 30703 - DNA, 103 bp, Artificial Sequence
  Synthetic Polynucleotide
taatacgactcactataggggcagtatccattccgaaggactggagaaaaaacagaggagattttctatggtccttcggaacctggcggcagcgcaaaagatg

SEQ ID NO: 30704 - DNA, 103 bp, Artificial Sequence
  Synthetic Polynucleotide
taatacgactcactatagggaagttgcagtatccattccgaaggactggaaacagaggagatccagtatgtcggaatggaacctggcggcagcgcaaaagatg

SEQ ID NO: 30705 - DNA, 103 bp, Artificial Sequence
  Synthetic Polynucleotide
taatacgactcactataggggagaaaagttgcagtatccattccgaaggaaacagaggagatccttcatgatggatactaacctggcggcagcgcaaaagatg

SEQ ID NO: 30706 - DNA, 103 bp, Artificial Sequence
  Synthetic Polynucleotide
taatacgactcactatagggttctggagaaaagttgcagtatccattccgaacagaggagacggaatatgtactgcaacaacctggcggcagcgcaaaagatg

SEQ ID NO: 30707 - DNA, 103 bp, Artificial Sequence
  Synthetic Polynucleotide
taatacgactcactatagggggattttctggagaaaagttgcagtatccaaacagaggagatggataatgcaacttttcaacctggcggcagcgcaaaagatg

SEQ ID NO: 30708 - DNA, 103 bp, Artificial Sequence
  Synthetic Polynucleotide
taatacgactcactatagggaatctggattttctggagaaaagttgcagtaacagaggagaactgcaatgtttctccagaacctggcggcagcgcaaaagatg

SEQ ID NO: 30709 - DNA, 103 bp, Artificial Sequence
  Synthetic Polynucleotide
taatacgactcactatagggacaaaaatctggattttctggagaaaagttaacagaggagaaactttatgccagaaaataacctggcggcagcgcaaaagatg

SEQ ID NO: 30710 - DNA, 103 bp, Artificial Sequence
  Synthetic Polynucleotide
taatacgactcactataggggtctcacaaaaatctggattttctggagaaaacagaggagattctccatgaaatccagaaacctggcggcagcgcaaaagatg

SEQ ID NO: 30711 - DNA, 103 bp, Artificial Sequence
  Synthetic Polynucleotide
taatacgactcactatagggtttatatttactaggtgtccggggttaataaacagaggagatattaaatgcggacacctaacctggcggcagcgcaaaagatg

SEQ ID NO: 30712 - DNA, 103 bp, Artificial Sequence
  Synthetic Polynucleotide
taatacgactcactataggggatttgtctcacaaaaatctggattttctgaacagaggagacagaaaatgcagatttttaacctggcggcagcgcaaaagatg

SEQ ID NO: 30713 - DNA, 103 bp, Artificial Sequence
  Synthetic Polynucleotide
taatacgactcactatagggttgatgatttgtctcacaaaaatctggattaacagaggagaaatccaatgttttgtgagaacctggcggcagcgcaaaagatg

SEQ ID NO: 30714 - DNA, 103 bp, Artificial Sequence
  Synthetic Polynucleotide
taatacgactcactataggggagtgttgatgatttgtctcacaaaaatctaacagaggagaagatttatgtgagacaaaaacctggcggcagcgcaaaagatg

SEQ ID NO: 30715 - DNA, 103 bp, Artificial Sequence
  Synthetic Polynucleotide
taatacgactcactatagggaaatggagtgttgatgatttgtctcacaaaaacagaggagatttgtgatgcaaatcatcaacctggcggcagcgcaaaagatg

SEQ ID NO: 30716 - DNA, 103 bp, Artificial Sequence
  Synthetic Polynucleotide
taatacgactcactatagggaatccaaatggagtgttgatgatttgtctcaacagaggagagagacaatgcatcaacacaacctggcggcagcgcaaaagatg

SEQ ID NO: 30717 - DNA, 103 bp, Artificial Sequence
  Synthetic Polynucleotide
taatacgactcactatagggtccggaatccaaatggagtgttgatgatttaacagaggagaaaatcaatgacactccataacctggcggcagcgcaaaagatg

SEQ ID NO: 30718 - DNA, 103 bp, Artificial Sequence
  Synthetic Polynucleotide
taatacgactcactatagggcatcttccggaatccaaatggagtgttgataacagaggagaatcaacatgccatttggaaacctggcggcagcgcaaaagatg

SEQ ID NO: 30719 - DNA, 103 bp, Artificial Sequence
  Synthetic Polynucleotide
taatacgactcactatagggtccctcatcttccggaatccaaatggagtgaacagaggagacactccatgtggattccgaacctggcggcagcgcaaaagatg

SEQ ID NO: 30720 - DNA, 103 bp, Artificial Sequence
  Synthetic Polynucleotide
taatacgactcactatagggcctcgtccctcatcttccggaatccaaatgaacagaggagacatttgatgtccggaagaaacctggcggcagcgcaaaagatg

SEQ ID NO: 30721 - DNA, 103 bp, Artificial Sequence
  Synthetic Polynucleotide
taatacgactcactatagggtaattcctcgtccctcatcttccggaatccaacagaggagaggattcatgaagatgaggaacctggcggcagcgcaaaagatg

SEQ ID NO: 30722 - DNA, 103 bp, Artificial Sequence
  Synthetic Polynucleotide
taatacgactcactatagggtccgttttatatttactaggtgtccggggtaacagaggagaaccccgatgacctagtaaaacctggcggcagcgcaaaagatg

SEQ ID NO: 30723 - DNA, 103 bp, Artificial Sequence
  Synthetic Polynucleotide
taatacgactcactatagggacatgtaattcctcgtccctcatcttccggaacagaggagaccggaaatggagggacgaaacctggcggcagcgcaaaagatg

SEQ ID NO: 30724 - DNA, 103 bp, Artificial Sequence
  Synthetic Polynucleotide
taatacgactcactatagggatgtcacatgtaattcctcgtccctcatctaacagaggagaagatgaatgacgaggaataacctggcggcagcgcaaaagatg

SEQ ID NO: 30725 - DNA, 103 bp, Artificial Sequence
  Synthetic Polynucleotide
taatacgactcactatagggggaagatgtcacatgtaattcctcgtccctaacagaggagaagggacatggaattacataacctggcggcagcgcaaaagatg

SEQ ID NO: 30726 - DNA, 103 bp, Artificial Sequence
  Synthetic Polynucleotide
taatacgactcactatagggcgcttggaagatgtcacatgtaattcctcgaacagaggagacgaggaatgacatgtgacaacctggcggcagcgcaaaagatg

SEQ ID NO: 30727 - DNA, 103 bp, Artificial Sequence
  Synthetic Polynucleotide
taatacgactcactataggggtactcgcttggaagatgtcacatgtaattaacagaggagaaattacatgtgacatcttaacctggcggcagcgcaaaagatg

SEQ ID NO: 30728 - DNA, 103 bp, Artificial Sequence
  Synthetic Polynucleotide
taatacgactcactatagggtaccagtactcgcttggaagatgtcacatgaacagaggagacatgtgatgtcttccaagaacctggcggcagcgcaaaagatg

SEQ ID NO: 30729 - DNA, 103 bp, Artificial Sequence
  Synthetic Polynucleotide
taatacgactcactatagggtaatataccagtactcgcttggaagatgtcaacagaggagagacatcatgcaagcgagtaacctggcggcagcgcaaaagatg

SEQ ID NO: 30730 - DNA, 103 bp, Artificial Sequence
  Synthetic Polynucleotide
taatacgactcactatagggttcagtaatataccagtactcgcttggaagaacagaggagacttccaatggagtactggaacctggcggcagcgcaaaagatg

SEQ ID NO: 30731 - DNA, 103 bp, Artificial Sequence
  Synthetic Polynucleotide
taatacgactcactatagggcatttttcagtaatataccagtactcgcttaacagaggagaaagcgaatgctggtatataacctggcggcagcgcaaaagatg

SEQ ID NO: 30732 - DNA, 103 bp, Artificial Sequence
  Synthetic Polynucleotide
taatacgactcactataggggcttccatttttcagtaatataccagtactaacagaggagaagtactatgatattactgaacctggcggcagcgcaaaagatg

SEQ ID NO: 30733 - DNA, 103 bp, Artificial Sequence
  Synthetic Polynucleotide
taatacgactcactatagggctcagtccgttttatatttactaggtgtccaacagaggagaggacacatggtaaatataaacctggcggcagcgcaaaagatg

SEQ ID NO: 30734 - DNA, 103 bp, Artificial Sequence
  Synthetic Polynucleotide
taatacgactcactatagggactttgcttccatttttcagtaatataccaaacagaggagatggtatatgactgaaaaaaacctggcggcagcgcaaaagatg

SEQ ID NO: 30735 - DNA, 103 bp, Artificial Sequence
  Synthetic Polynucleotide
taatacgactcactatagggcgcagactttgcttccatttttcagtaataaacagaggagatattacatgaaaatggaaaacctggcggcagcgcaaaagatg

SEQ ID NO: 30736 - DNA, 103 bp, Artificial Sequence
  Synthetic Polynucleotide
taatacgactcactataggggaaaccgcagactttgcttccatttttcagaacagaggagactgaaaatgggaagcaaaaacctggcggcagcgcaaaagatg

SEQ ID NO: 30737 - DNA, 103 bp, Artificial Sequence
  Synthetic Polynucleotide
taatacgactcactatagggtcttggaaaccgcagactttgcttccatttaacagaggagaaaatggatgcaaagtctgaacctggcggcagcgcaaaagatg

SEQ ID NO: 30738 - DNA, 103 bp, Artificial Sequence
  Synthetic Polynucleotide
taatacgactcactatagggtttcatcttggaaaccgcagactttgcttcaacagaggagagaagcaatgtctgcggttaacctggcggcagcgcaaaagatg

SEQ ID NO: 30739 - DNA, 103 bp, Artificial Sequence
  Synthetic Polynucleotide
taatacgactcactatagggtcctctttcatcttggaaaccgcagactttaacagaggagaaaagtcatgggtttccaaaacctggcggcagcgcaaaagatg

SEQ ID NO: 30740 - DNA, 103 bp, Artificial Sequence
  Synthetic Polynucleotide
taatacgactcactatagggaataatcctctttcatcttggaaaccgcagaacagaggagactgcggatgccaagatgaaacctggcggcagcgcaaaagatg

SEQ ID NO: 30741 - DNA, 103 bp, Artificial Sequence
  Synthetic Polynucleotide
taatacgactcactatagggttctgaataatcctctttcatcttggaaacaacagaggagagtttccatgatgaaagagaacctggcggcagcgcaaaagatg

SEQ ID NO: 30742 - DNA, 103 bp, Artificial Sequence
  Synthetic Polynucleotide
taatacgactcactatagggtatgcttctgaataatcctctttcatcttgaacagaggagacaagatatgagaggattaaacctggcggcagcgcaaaagatg

SEQ ID NO: 30743 - DNA, 103 bp, Artificial Sequence
  Synthetic Polynucleotide
taatacgactcactatagggccctttatgcttctgaataatcctctttcaaacagaggagatgaaagatgattattcagaacctggcggcagcgcaaaagatg

SEQ ID NO: 30744 - DNA, 103 bp, Artificial Sequence
  Synthetic Polynucleotide
taatacgactcactatagggtcttgctcagtccgttttatatttactaggaacagaggagacctagtatgtataaaacgaacctggcggcagcgcaaaagatg

SEQ ID NO: 30745 - DNA, 103 bp, Artificial Sequence
  Synthetic Polynucleotide
taatacgactcactatagggatgcaccctttatgcttctgaataatcctcaacagaggagagaggatatgtcagaagcaaacctggcggcagcgcaaaagatg

SEQ ID NO: 30746 - DNA, 103 bp, Artificial Sequence
  Synthetic Polynucleotide
taatacgactcactatagggtttgcatgcaccctttatgcttctgaataaaacagaggagattattcatgagcataaagaacctggcggcagcgcaaaagatg

SEQ ID NO: 30747 - DNA, 103 bp, Artificial Sequence
  Synthetic Polynucleotide
taatacgactcactatagggatcattttgcatgcaccctttatgcttctgaacagaggagacagaagatgaaagggtgcaacctggcggcagcgcaaaagatg

SEQ ID NO: 30748 - DNA, 103 bp, Artificial Sequence
  Synthetic Polynucleotide
taatacgactcactatagggagattatcattttgcatgcaccctttatgcaacagaggagagcataaatggtgcatgcaaacctggcggcagcgcaaaagatg

SEQ ID NO: 30749 - DNA, 103 bp, Artificial Sequence
  Synthetic Polynucleotide
taatacgactcactatagggtccacagattatcattttgcatgcacccttaacagaggagaaagggtatgtgcaaaatgaacctggcggcagcgcaaaagatg

SEQ ID NO: 30750 - DNA, 103 bp, Artificial Sequence
  Synthetic Polynucleotide
taatacgactcactataggggactttccacagattatcattttgcatgcaaacagaggagatgcatgatgaatgataataacctggcggcagcgcaaaagatg

SEQ ID NO: 30751 - DNA, 103 bp, Artificial Sequence
  Synthetic Polynucleotide
taatacgactcactatagggccccagactttccacagattatcattttgcaacagaggagagcaaaaatgtaatctgtgaacctggcggcagcgcaaaagatg

SEQ ID NO: 30752 - DNA, 103 bp, Artificial Sequence
  Synthetic Polynucleotide
taatacgactcactatagggtcggaccccagactttccacagattatcataacagaggagaatgataatgtgtggaaagaacctggcggcagcgcaaaagatg

SEQ ID NO: 30753 - DNA, 103 bp, Artificial Sequence
  Synthetic Polynucleotide
taatacgactcactatagggtatagtcggaccccagactttccacagattaacagaggagaaatctgatgaaagtctggaacctggcggcagcgcaaaagatg

SEQ ID NO: 30754 - DNA, 103 bp, Artificial Sequence
  Synthetic Polynucleotide
taatacgactcactatagggcatcatatagtcggaccccagactttccacaacagaggagagtggaaatgctggggtccaacctggcggcagcgcaaaagatg

SEQ ID NO: 30755 - DNA, 103 bp, Artificial Sequence
  Synthetic Polynucleotide
taatacgactcactatagggaagtgttactttttcttttccccttcgattaacagaggagaaatcgaatgggaaaagaaaacctggcggcagcgcaaaagatg

SEQ ID NO: 30756 - DNA, 103 bp, Artificial Sequence
  Synthetic Polynucleotide
taatacgactcactatagggttccttcttgctcagtccgttttatatttaaacagaggagataaataatgaacggactgaacctggcggcagcgcaaaagatg

SEQ ID NO: 30757 - DNA, 103 bp, Artificial Sequence
  Synthetic Polynucleotide
taatacgactcactatagggtgtcccatcatatagtcggaccccagacttaacagaggagaaagtctatggtccgactaaacctggcggcagcgcaaaagatg

SEQ ID NO: 30758 - DNA, 103 bp, Artificial Sequence
  Synthetic Polynucleotide
taatacgactcactatagggacccatgtcccatcatatagtcggaccccaaacagaggagatggggtatgactatatgaaacctggcggcagcgcaaaagatg

SEQ ID NO: 30759 - DNA, 103 bp, Artificial Sequence
  Synthetic Polynucleotide
taatacgactcactatagggaagacacccatgtcccatcatatagtcggaaacagaggagatccgacatgatgatgggaaacctggcggcagcgcaaaagatg

SEQ ID NO: 30760 - DNA, 103 bp, Artificial Sequence
  Synthetic Polynucleotide
taatacgactcactatagggattgtaagacacccatgtcccatcatatagaacagaggagactatatatggggacatggaacctggcggcagcgcaaaagatg

SEQ ID NO: 30761 - DNA, 103 bp, Artificial Sequence
  Synthetic Polynucleotide
taatacgactcactatagggacagaattgtaagacacccatgtcccatcaaacagaggagatgatggatgatgggtgtcaacctggcggcagcgcaaaagatg

SEQ ID NO: 30762 - DNA, 103 bp, Artificial Sequence
  Synthetic Polynucleotide
taatacgactcactatagggtatcaacagaattgtaagacacccatgtccaacagaggagaggacatatgtgtcttacaaacctggcggcagcgcaaaagatg

SEQ ID NO: 30763 - DNA, 103 bp, Artificial Sequence
  Synthetic Polynucleotide
taatacgactcactataggggaggttatcaacagaattgtaagacacccaaacagaggagatgggtgatgtacaattctaacctggcggcagcgcaaaagatg

SEQ ID NO: 30764 - DNA, 103 bp, Artificial Sequence
  Synthetic Polynucleotide
taatacgactcactatagggatcctgaggttatcaacagaattgtaagacaacagaggagagtcttaatgttctgttgaaacctggcggcagcgcaaaagatg

SEQ ID NO: 30765 - DNA, 103 bp, Artificial Sequence
  Synthetic Polynucleotide
taatacgactcactatagggaacacatcctgaggttatcaacagaattgtaacagaggagaacaattatgttgataaccaacctggcggcagcgcaaaagatg

SEQ ID NO: 30766 - DNA, 103 bp, Artificial Sequence
  Synthetic Polynucleotide
taatacgactcactatagggtctggaacacatcctgaggttatcaacagaaacagaggagatctgttatgaacctcaggaacctggcggcagcgcaaaagatg

SEQ ID NO: 30767 - DNA, 103 bp, Artificial Sequence
  Synthetic Polynucleotide
taatacgactcactatagggccagtttccttcttgctcagtccgttttataacagaggagaataaaaatgactgagcaaaacctggcggcagcgcaaaagatg

SEQ ID NO: 30768 - DNA, 103 bp, Artificial Sequence
  Synthetic Polynucleotide
taatacgactcactatagggtttgatctggaacacatcctgaggttatcaaacagaggagatgataaatgcaggatgtgaacctggcggcagcgcaaaagatg

SEQ ID NO: 30769 - DNA, 103 bp, Artificial Sequence
  Synthetic Polynucleotide
taatacgactcactatagggccatttttgatctggaacacatcctgaggtaacagaggagaacctcaatgtgtgttccaaacctggcggcagcgcaaaagatg

SEQ ID NO: 30770 - DNA, 103 bp, Artificial Sequence
  Synthetic Polynucleotide
taatacgactcactataggggttcaccatttttgatctggaacacatcctaacagaggagaaggatgatgtccagatcaaacctggcggcagcgcaaaagatg

SEQ ID NO: 30771 - DNA, 103 bp, Artificial Sequence
  Synthetic Polynucleotide
taatacgactcactatagggtgtttgttcaccatttttgatctggaacacaacagaggagagtgttcatgatcaaaaataacctggcggcagcgcaaaagatg

SEQ ID NO: 30772 - DNA, 103 bp, Artificial Sequence
  Synthetic Polynucleotide
taatacgactcactatagggctgtgtgtttgttcaccatttttgatctggaacagaggagaccagatatgaaatggtgaaacctggcggcagcgcaaaagatg

SEQ ID NO: 30773 - DNA, 103 bp, Artificial Sequence
  Synthetic Polynucleotide
taatacgactcactatagggtttaactgtgtgtttgttcaccatttttgaaacagaggagatcaaaaatggtgaacaaaaacctggcggcagcgcaaaagatg

SEQ ID NO: 30774 - DNA, 103 bp, Artificial Sequence
  Synthetic Polynucleotide
taatacgactcactatagggtccaatttaactgtgtgtttgttcaccattaacagaggagaaatggtatgcaaacacacaacctggcggcagcgcaaaagatg

SEQ ID NO: 30775 - DNA, 103 bp, Artificial Sequence
  Synthetic Polynucleotide
taatacgactcactatagggtattatccaatttaactgtgtgtttgttcaaacagaggagatgaacaatgacacagttaaacctggcggcagcgcaaaagatg

SEQ ID NO: 30776 - DNA, 103 bp, Artificial Sequence
  Synthetic Polynucleotide
taatacgactcactatagggttctatattatccaatttaactgtgtgtttaacagaggagaaaacacatggttaaattgaacctggcggcagcgcaaaagatg

SEQ ID NO: 30777 - DNA, 103 bp, Artificial Sequence
  Synthetic Polynucleotide
taatacgactcactataggggactcttctatattatccaatttaactgtgaacagaggagacacagtatgattggataaaacctggcggcagcgcaaaagatg

SEQ ID NO: 30778 - DNA, 103 bp, Artificial Sequence
  Synthetic Polynucleotide
taatacgactcactatagggtgtgcccagtttccttcttgctcagtccgtaacagaggagaacggacatggcaagaaggaacctggcggcagcgcaaaagatg

SEQ ID NO: 30779 - DNA, 103 bp, Artificial Sequence
  Synthetic Polynucleotide
taatacgactcactatagggcaatggactcttctatattatccaatttaaaacagaggagattaaatatgataatatagaacctggcggcagcgcaaaagatg

SEQ ID NO: 30780 - DNA, 103 bp, Artificial Sequence
  Synthetic Polynucleotide
taatacgactcactatagggtctcacaatggactcttctatattatccaaaacagaggagattggatatgatagaagagaacctggcggcagcgcaaaagatg

SEQ ID NO: 30781 - DNA, 103 bp, Artificial Sequence
  Synthetic Polynucleotide
taatacgactcactatagggagatctctcacaatggactcttctatattaaacagaggagataatatatgagagtccataacctggcggcagcgcaaaagatg

SEQ ID NO: 30782 - DNA, 103 bp, Artificial Sequence
  Synthetic Polynucleotide
taatacgactcactatagggtaataagatctctcacaatggactcttctaaacagaggagatagaagatgccattgtgaaacctggcggcagcgcaaaagatg

SEQ ID NO: 30783 - DNA, 103 bp, Artificial Sequence
  Synthetic Polynucleotide
taatacgactcactatagggcttcttaataagatctctcacaatggactcaacagaggagagagtccatggtgagagataacctggcggcagcgcaaaagatg

SEQ ID NO: 30784 - DNA, 103 bp, Artificial Sequence
  Synthetic Polynucleotide
taatacgactcactatagggtcacgcttcttaataagatctctcacaatgaacagaggagacattgtatgagatcttataacctggcggcagcgcaaaagatg

SEQ ID NO: 30785 - DNA, 103 bp, Artificial Sequence
  Synthetic Polynucleotide
taatacgactcactatagggactcttcacgcttcttaataagatctctcaaacagaggagatgagagatgttattaagaaacctggcggcagcgcaaaagatg

SEQ ID NO: 30786 - DNA, 103 bp, Artificial Sequence
  Synthetic Polynucleotide
taatacgactcactatagggtaggcactcttcacgcttcttaataagatcaacagaggagagatcttatgaagaagcgtaacctggcggcagcgcaaaagatg

SEQ ID NO: 30787 - DNA, 103 bp, Artificial Sequence
  Synthetic Polynucleotide
taatacgactcactataggggcatctaggcactcttcacgcttcttaataaacagaggagatattaaatggcgtgaagaaacctggcggcagcgcaaaagatg

SEQ ID NO: 30788 - DNA, 103 bp, Artificial Sequence
  Synthetic Polynucleotide
taatacgactcactatagggctagagcatctaggcactcttcacgcttctaacagaggagaagaagcatgaagagtgccaacctggcggcagcgcaaaagatg

SEQ ID NO: 30789 - DNA, 103 bp, Artificial Sequence
  Synthetic Polynucleotide
taatacgactcactatagggcaacttgtgcccagtttccttcttgctcagaacagaggagactgagcatgaaggaaactaacctggcggcagcgcaaaagatg

SEQ ID NO: 30790 - DNA, 103 bp, Artificial Sequence
  Synthetic Polynucleotide
taatacgactcactatagggttcttctagagcatctaggcactcttcacgaacagaggagacgtgaaatgtgcctagataacctggcggcagcgcaaaagatg

SEQ ID NO: 30791 - DNA, 103 bp, Artificial Sequence
  Synthetic Polynucleotide
taatacgactcactatagggatgacttcttctagagcatctaggcactctaacagaggagaagagtgatgagatgctctaacctggcggcagcgcaaaagatg

SEQ ID NO: 30792 - DNA, 103 bp, Artificial Sequence
  Synthetic Polynucleotide
taatacgactcactatagggtcaacatgacttcttctagagcatctaggcaacagaggagagcctagatgctctagaagaacctggcggcagcgcaaaagatg

SEQ ID NO: 30793 - DNA, 103 bp, Artificial Sequence
  Synthetic Polynucleotide
taatacgactcactatagggtctagtcaacatgacttcttctagagcatcaacagaggagagatgctatggaagaagtcaacctggcggcagcgcaaaagatg

SEQ ID NO: 30794 - DNA, 103 bp, Artificial Sequence
  Synthetic Polynucleotide
taatacgactcactatagggatagatctagtcaacatgacttcttctagaaacagaggagatctagaatgagtcatgttaacctggcggcagcgcaaaagatg

SEQ ID NO: 30795 - DNA, 103 bp, Artificial Sequence
  Synthetic Polynucleotide
taatacgactcactatagggagcttatagatctagtcaacatgacttcttaacagaggagaaagaagatgtgttgactaaacctggcggcagcgcaaaagatg

SEQ ID NO: 30796 - DNA, 103 bp, Artificial Sequence
  Synthetic Polynucleotide
taatacgactcactatagggtctgaagcttatagatctagtcaacatgacaacagaggagagtcatgatgactagatctaacctggcggcagcgcaaaagatg

SEQ ID NO: 30797 - DNA, 103 bp, Artificial Sequence
  Synthetic Polynucleotide
taatacgactcactatagggaactttctgaagcttatagatctagtcaacaacagaggagagttgacatgatctataagaacctggcggcagcgcaaaagatg

SEQ ID NO: 30798 - DNA, 103 bp, Artificial Sequence
  Synthetic Polynucleotide
taatacgactcactataggggactcaactttctgaagcttatagatctagaacagaggagactagatatgtaagcttcaaacctggcggcagcgcaaaagatg

SEQ ID NO: 30799 - DNA, 103 bp, Artificial Sequence
  Synthetic Polynucleotide
taatacgactcactatagggaaagagactcaactttctgaagcttatagaaacagaggagatctataatgttcagaaagaacctggcggcagcgcaaaagatg

SEQ ID NO: 30800 - DNA, 103 bp, Artificial Sequence
  Synthetic Polynucleotide
taatacgactcactatagggtcctgcaacttgtgcccagtttccttcttgaacagaggagacaagaaatgaactgggcaaacctggcggcagcgcaaaagatg

SEQ ID NO: 30801 - DNA, 103 bp, Artificial Sequence
  Synthetic Polynucleotide
taatacgactcactatagggtttctaaagagactcaactttctgaagcttaacagaggagaaagcttatgaaagttgagaacctggcggcagcgcaaaagatg

SEQ ID NO: 30802 - DNA, 103 bp, Artificial Sequence
  Synthetic Polynucleotide
taatacgactcactatagggcttgctttctaaagagactcaactttctgaaacagaggagatcagaaatgtgagtctctaacctggcggcagcgcaaaagatg

SEQ ID NO: 30803 - DNA, 103 bp, Artificial Sequence
  Synthetic Polynucleotide
taatacgactcactatagggtggaacttgctttctaaagagactcaacttaacagaggagaaagttgatgctctttagaaacctggcggcagcgcaaaagatg

SEQ ID NO: 30804 - DNA, 103 bp, Artificial Sequence
  Synthetic Polynucleotide
taatacgactcactatagggcttcctggaacttgctttctaaagagactcaacagaggagagagtctatgtagaaagcaaacctggcggcagcgcaaaagatg

SEQ ID NO: 30805 - DNA, 103 bp, Artificial Sequence
  Synthetic Polynucleotide
taatacgactcactatagggaccctcttcctggaacttgctttctaaagaaacagaggagatctttaatgagcaagttcaacctggcggcagcgcaaaagatg

SEQ ID NO: 30806 - DNA, 103 bp, Artificial Sequence
  Synthetic Polynucleotide
taatacgactcactatagggaacataccctcttcctggaacttgctttctaacagaggagaagaaagatggttccaggaaacctggcggcagcgcaaaagatg

SEQ ID NO: 30807 - DNA, 103 bp, Artificial Sequence
  Synthetic Polynucleotide
taatacgactcactataggggtgtaaacataccctcttcctggaacttgcaacagaggagagcaagtatgaggaagaggaacctggcggcagcgcaaaagatg

SEQ ID NO: 30808 - DNA, 103 bp, Artificial Sequence
  Synthetic Polynucleotide
taatacgactcactatagggtcatagtgtaaacataccctcttcctggaaaacagaggagattccagatggagggtatgaacctggcggcagcgcaaaagatg

SEQ ID NO: 30809 - DNA, 103 bp, Artificial Sequence
  Synthetic Polynucleotide
taatacgactcactataggggtttatcatagtgtaaacataccctcttccaacagaggagaggaagaatgtatgtttacaacctggcggcagcgcaaaagatg

SEQ ID NO: 30810 - DNA, 103 bp, Artificial Sequence
  Synthetic Polynucleotide
taatacgactcactataggggtattgtttatcatagtgtaaacataccctaacagaggagaagggtaatgttacactataacctggcggcagcgcaaaagatg

SEQ ID NO: 30811 - DNA, 103 bp, Artificial Sequence
  Synthetic Polynucleotide
taatacgactcactatagggccagctcctgcaacttgtgcccagtttcctaacagaggagaaggaaaatgggcacaagtaacctggcggcagcgcaaaagatg

SEQ ID NO: 30812 - DNA, 103 bp, Artificial Sequence
  Synthetic Polynucleotide
taatacgactcactatagggtcattgtattgtttatcatagtgtaaacataacagaggagaatgtttatgctatgataaaacctggcggcagcgcaaaagatg

SEQ ID NO: 30813 - DNA, 103 bp, Artificial Sequence
  Synthetic Polynucleotide
taatacgactcactatagggctccatcattgtattgtttatcatagtgtaaacagaggagatacactatgataaacaataacctggcggcagcgcaaaagatg

SEQ ID NO: 30814 - DNA, 103 bp, Artificial Sequence
  Synthetic Polynucleotide
taatacgactcactataggggttgcctccatcattgtattgtttatcataaacagaggagatatgatatgcaatacaataacctggcggcagcgcaaaagatg

SEQ ID NO: 30815 - DNA, 103 bp, Artificial Sequence
  Synthetic Polynucleotide
taatacgactcactataggggccctgttgcctccatcattgtattgtttaaacagaggagataaacaatgcaatgatggaacctggcggcagcgcaaaagatg

SEQ ID NO: 30816 - DNA, 103 bp, Artificial Sequence
  Synthetic Polynucleotide
taatacgactcactatagggataatgccctgttgcctccatcattgtattaacagaggagaaatacaatgatggaggcaaacctggcggcagcgcaaaagatg

SEQ ID NO: 30817 - DNA, 103 bp, Artificial Sequence
  Synthetic Polynucleotide
taatacgactcactataggggatttataatgccctgttgcctccatcattaacagaggagaaatgatatgggcaacaggaacctggcggcagcgcaaaagatg

SEQ ID NO: 30818 - DNA, 103 bp, Artificial Sequence
  Synthetic Polynucleotide
taatacgactcactatagggccactgatttataatgccctgttgcctccaaacagaggagatggaggatgcagggcattaacctggcggcagcgcaaaagatg

SEQ ID NO: 30819 - DNA, 103 bp, Artificial Sequence
  Synthetic Polynucleotide
taatacgactcactataggggttatccactgatttataatgccctgttgcaacagaggagagcaacaatgcattataaaaacctggcggcagcgcaaaagatg

SEQ ID NO: 30820 - DNA, 103 bp, Artificial Sequence
  Synthetic Polynucleotide
taatacgactcactataggggtccagttatccactgatttataatgccctaacagaggagaagggcaatgtaaatcagtaacctggcggcagcgcaaaagatg

SEQ ID NO: 30821 - DNA, 103 bp, Artificial Sequence
  Synthetic Polynucleotide
taatacgactcactatagggtgtctgtccagttatccactgatttataataacagaggagaattataatgcagtggataaacctggcggcagcgcaaaagatg

SEQ ID NO: 30822 - DNA, 103 bp, Artificial Sequence
  Synthetic Polynucleotide
taatacgactcactatagggttacaccagctcctgcaacttgtgcccagtaacagaggagaactgggatgaagttgcagaacctggcggcagcgcaaaagatg

SEQ ID NO: 30823 - DNA, 103 bp, Artificial Sequence
  Synthetic Polynucleotide
taatacgactcactatagggtagaatgtctgtccagttatccactgatttaacagaggagaaaatcaatggataactggaacctggcggcagcgcaaaagatg

SEQ ID NO: 30824 - DNA, 103 bp, Artificial Sequence
  Synthetic Polynucleotide
taatacgactcactatagggttaggtagaatgtctgtccagttatccactaacagaggagaagtggaatgctggacagaaacctggcggcagcgcaaaagatg

SEQ ID NO: 30825 - DNA, 103 bp, Artificial Sequence
  Synthetic Polynucleotide
taatacgactcactatagggttgggttaggtagaatgtctgtccagttataacagaggagaataactatgcagacattcaacctggcggcagcgcaaaagatg

SEQ ID NO: 30826 - DNA, 103 bp, Artificial Sequence
  Synthetic Polynucleotide
taatacgactcactataggggcagattgggttaggtagaatgtctgtccaaacagaggagatggacaatgattctacctaacctggcggcagcgcaaaagatg

SEQ ID NO: 30827 - DNA, 103 bp, Artificial Sequence
  Synthetic Polynucleotide
taatacgactcactatagggataaggcagattgggttaggtagaatgtctaacagaggagaagacatatgacctaacccaacctggcggcagcgcaaaagatg

SEQ ID NO: 30828 - DNA, 103 bp, Artificial Sequence
  Synthetic Polynucleotide
taatacgactcactatagggccaccataaggcagattgggttaggtagaaaacagaggagattctacatgacccaatctaacctggcggcagcgcaaaagatg

SEQ ID NO: 30829 - DNA, 103 bp, Artificial Sequence
  Synthetic Polynucleotide
taatacgactcactataggggccgtccaccataaggcagattgggttaggaacagaggagacctaacatgatctgccttaacctggcggcagcgcaaaagatg

SEQ ID NO: 30830 - DNA, 103 bp, Artificial Sequence
  Synthetic Polynucleotide
taatacgactcactatagggcacttgccgtccaccataaggcagattgggaacagaggagacccaatatgccttatggtaacctggcggcagcgcaaaagatg

SEQ ID NO: 30831 - DNA, 103 bp, Artificial Sequence
  Synthetic Polynucleotide
taatacgactcactataggggatgacacttgccgtccaccataaggcagaaacagaggagatctgccatgtggtggacgaacctggcggcagcgcaaaagatg

SEQ ID NO: 30832 - DNA, 103 bp, Artificial Sequence
  Synthetic Polynucleotide
taatacgactcactatagggacctggatgacacttgccgtccaccataagaacagaggagacttatgatggacggcaagaacctggcggcagcgcaaaagatg

SEQ ID NO: 30833 - DNA, 103 bp, Artificial Sequence
  Synthetic Polynucleotide
taatacgactcactatagggtttaattacaccagctcctgcaacttgtgcaacagaggagagcacaaatggcaggagctaacctggcggcagcgcaaaagatg

SEQ ID NO: 30834 - DNA, 103 bp, Artificial Sequence
  Synthetic Polynucleotide
taatacgactcactatagggtcataacctggatgacacttgccgtccaccaacagaggagaggtggaatgcaagtgtcaaacctggcggcagcgcaaaagatg

SEQ ID NO: 30835 - DNA, 103 bp, Artificial Sequence
  Synthetic Polynucleotide
taatacgactcactatagggcaccatcataacctggatgacacttgccgtaacagaggagaacggcaatggtcatccagaacctggcggcagcgcaaaagatg

SEQ ID NO: 30836 - DNA, 103 bp, Artificial Sequence
  Synthetic Polynucleotide
taatacgactcactatagggtaatacaccatcataacctggatgacacttaacagaggagaaagtgtatgccaggttataacctggcggcagcgcaaaagatg

SEQ ID NO: 30837 - DNA, 103 bp, Artificial Sequence
  Synthetic Polynucleotide
taatacgactcactatagggttaaataatacaccatcataacctggatgaaacagaggagatcatccatgttatgatggaacctggcggcagcgcaaaagatg

SEQ ID NO: 30838 - DNA, 103 bp, Artificial Sequence
  Synthetic Polynucleotide
taatacgactcactatagggtaccgttaaataatacaccatcataacctgaacagaggagacaggttatgatggtgtataacctggcggcagcgcaaaagatg

SEQ ID NO: 30839 - DNA, 103 bp, Artificial Sequence
  Synthetic Polynucleotide
taatacgactcactatagggtatgataccgttaaataatacaccatcataaacagaggagatatgatatggtattatttaacctggcggcagcgcaaaagatg

SEQ ID NO: 30840 - DNA, 103 bp, Artificial Sequence
  Synthetic Polynucleotide
taatacgactcactatagggtctcttatgataccgttaaataatacaccaaacagaggagatggtgtatgatttaacggaacctggcggcagcgcaaaagatg

SEQ ID NO: 30841 - DNA, 103 bp, Artificial Sequence
  Synthetic Polynucleotide
taatacgactcactatagggtactgtctcttatgataccgttaaataataaacagaggagatattatatgacggtatcaaacctggcggcagcgcaaaagatg

SEQ ID NO: 30842 - DNA, 103 bp, Artificial Sequence
  Synthetic Polynucleotide
taatacgactcactataggggcctctactgtctcttatgataccgttaaaaacagaggagatttaacatgatcataagaaacctggcggcagcgcaaaagatg

SEQ ID NO: 30843 - DNA, 103 bp, Artificial Sequence
  Synthetic Polynucleotide
taatacgactcactatagggattttgcctctactgtctcttatgataccgaacagaggagacggtatatgaagagacagaacctggcggcagcgcaaaagatg

SEQ ID NO: 30844 - DNA, 103 bp, Artificial Sequence
  Synthetic Polynucleotide
taatacgactcactatagggggatctttaattacaccagctcctgcaactaacagaggagaagttgcatgagctggtgtaacctggcggcagcgcaaaagatg

SEQ ID NO: 30845 - DNA, 103 bp, Artificial Sequence
  Synthetic Polynucleotide
taatacgactcactatagggttagtattttgcctctactgtctcttatgaaacagaggagatcataaatgacagtagagaacctggcggcagcgcaaaagatg

SEQ ID NO: 30846 - DNA, 103 bp, Artificial Sequence
  Synthetic Polynucleotide
taatacgactcactatagggtggaattagtattttgcctctactgtctctaacagaggagaagagacatgagaggcaaaaacctggcggcagcgcaaaagatg

SEQ ID NO: 30847 - DNA, 103 bp, Artificial Sequence
  Synthetic Polynucleotide
taatacgactcactatagggatttctggaattagtattttgcctctactgaacagaggagacagtagatgcaaaatactaacctggcggcagcgcaaaagatg

SEQ ID NO: 30848 - DNA, 103 bp, Artificial Sequence
  Synthetic Polynucleotide
taatacgactcactatagggattgcatttctggaattagtattttgcctcaacagaggagagaggcaatgtactaattcaacctggcggcagcgcaaaagatg

SEQ ID NO: 30849 - DNA, 103 bp, Artificial Sequence
  Synthetic Polynucleotide
taatacgactcactatagggatgtgattgcatttctggaattagtattttaacagaggagaaaaataatgattccagaaaacctggcggcagcgcaaaagatg

SEQ ID NO: 30850 - DNA, 103 bp, Artificial Sequence
  Synthetic Polynucleotide
taatacgactcactatagggagtagatgtgattgcatttctggaattagtaacagaggagaactaatatgagaaatgcaaacctggcggcagcgcaaaagatg

SEQ ID NO: 30851 - DNA, 103 bp, Artificial Sequence
  Synthetic Polynucleotide
taatacgactcactatagggctcggagtagatgtgattgcatttctggaaaacagaggagattccagatgtgcaatcacaacctggcggcagcgcaaaagatg

SEQ ID NO: 30852 - DNA, 103 bp, Artificial Sequence
  Synthetic Polynucleotide
taatacgactcactatagggatggtctcggagtagatgtgattgcatttcaacagaggagagaaatgatgtcacatctaaacctggcggcagcgcaaaagatg

SEQ ID NO: 30853 - DNA, 103 bp, Artificial Sequence
  Synthetic Polynucleotide
taatacgactcactatagggtccagatggtctcggagtagatgtgattgcaacagaggagagcaatcatgtctactccgaacctggcggcagcgcaaaagatg

SEQ ID NO: 30854 - DNA, 103 bp, Artificial Sequence
  Synthetic Polynucleotide
taatacgactcactataggggcaactccagatggtctcggagtagatgtgaacagaggagacacatcatgtccgagaccaacctggcggcagcgcaaaagatg

SEQ ID NO: 30855 - DNA, 103 bp, Artificial Sequence
  Synthetic Polynucleotide
taatacgactcactatagggcagtaggatctttaattacaccagctcctgaacagaggagacaggagatggtgtaattaaacctggcggcagcgcaaaagatg

SEQ ID NO: 30856 - DNA, 103 bp, Artificial Sequence
  Synthetic Polynucleotide
taatacgactcactatagggcttgagcaactccagatggtctcggagtagaacagaggagactactcatggaccatctgaacctggcggcagcgcaaaagatg

SEQ ID NO: 30857 - DNA, 103 bp, Artificial Sequence
  Synthetic Polynucleotide
taatacgactcactatagggtttctcttgagcaactccagatggtctcggaacagaggagaccgagaatgtctggagttaacctggcggcagcgcaaaagatg

SEQ ID NO: 30858 - DNA, 103 bp, Artificial Sequence
  Synthetic Polynucleotide
taatacgactcactatagggtggaatttctcttgagcaactccagatggtaacagaggagaaccatcatgagttgctcaaacctggcggcagcgcaaaagatg

SEQ ID NO: 30859 - DNA, 103 bp, Artificial Sequence
  Synthetic Polynucleotide
taatacgactcactataggggggaatggaatttctcttgagcaactccagaacagaggagactggagatgctcaagagaaacctggcggcagcgcaaaagatg

SEQ ID NO: 30860 - DNA, 103 bp, Artificial Sequence
  Synthetic Polynucleotide
taatacgactcactatagggctccagggaatggaatttctcttgagcaacaacagaggagagttgctatggagaaattcaacctggcggcagcgcaaaagatg

SEQ ID NO: 30861 - DNA, 103 bp, Artificial Sequence
  Synthetic Polynucleotide
taatacgactcactatagggggtgtctccagggaatggaatttctcttgaaacagaggagatcaagaatgattccattcaacctggcggcagcgcaaaagatg

SEQ ID NO: 30862 - DNA, 103 bp, Artificial Sequence
  Synthetic Polynucleotide
taatacgactcactatagggaagagggtgtctccagggaatggaatttctaacagaggagaagaaatatgattccctggaacctggcggcagcgcaaaagatg

SEQ ID NO: 30863 - DNA, 103 bp, Artificial Sequence
  Synthetic Polynucleotide
taatacgactcactatagggtgcacaagagggtgtctccagggaatggaaaacagaggagattccatatgctggagacaaacctggcggcagcgcaaaagatg

SEQ ID NO: 30864 - DNA, 103 bp, Artificial Sequence
  Synthetic Polynucleotide
taatacgactcactatagggaatagtgcacaagagggtgtctccagggaaaacagaggagattccctatggacaccctcaacctggcggcagcgcaaaagatg

SEQ ID NO: 30865 - DNA, 103 bp, Artificial Sequence
  Synthetic Polynucleotide
taatacgactcactatagggttcagaatagtgcacaagagggtgtctccaaacagaggagatggagaatgcctcttgtgaacctggcggcagcgcaaaagatg

SEQ ID NO: 30866 - DNA, 103 bp, Artificial Sequence
  Synthetic Polynucleotide
taatacgactcactatagggtgtagaagtgttactttttcttttccccttaacagaggagaaaggggatgagaaaaagtaacctggcggcagcgcaaaagatg

SEQ ID NO: 30867 - DNA, 103 bp, Artificial Sequence
  Synthetic Polynucleotide
taatacgactcactatagggagcatcagtaggatctttaattacaccagcaacagaggagagctggtatgattaaagataacctggcggcagcgcaaaagatg

SEQ ID NO: 30868 - DNA, 103 bp, Artificial Sequence
  Synthetic Polynucleotide
taatacgactcactatagggccattttcagaatagtgcacaagagggtgtaacagaggagaacacccatgtgtgcactaaacctggcggcagcgcaaaagatg

SEQ ID NO: 30869 - DNA, 103 bp, Artificial Sequence
  Synthetic Polynucleotide
taatacgactcactatagggcttccccattttcagaatagtgcacaagagaacagaggagactcttgatgactattctgaacctggcggcagcgcaaaagatg

SEQ ID NO: 30870 - DNA, 103 bp, Artificial Sequence
  Synthetic Polynucleotide
taatacgactcactataggggccatcttccccattttcagaatagtgcacaacagaggagagtgcacatgtctgaaaataacctggcggcagcgcaaaagatg

SEQ ID NO: 30871 - DNA, 103 bp, Artificial Sequence
  Synthetic Polynucleotide
taatacgactcactatagggtctgagccatcttccccattttcagaatagaacagaggagactattcatgaaatggggaaacctggcggcagcgcaaaagatg

SEQ ID NO: 30872 - DNA, 103 bp, Artificial Sequence
  Synthetic Polynucleotide
taatacgactcactatagggtaagatctgagccatcttccccattttcagaacagaggagactgaaaatggggaagatgaacctggcggcagcgcaaaagatg

SEQ ID NO: 30873 - DNA, 103 bp, Artificial Sequence
  Synthetic Polynucleotide
taatacgactcactataggggctggtaagatctgagccatcttccccattaacagaggagaaatgggatggatggctcaaacctggcggcagcgcaaaagatg

SEQ ID NO: 30874 - DNA, 103 bp, Artificial Sequence
  Synthetic Polynucleotide
taatacgactcactataggggcaaagctggtaagatctgagccatcttccaacagaggagaggaagaatgctcagatctaacctggcggcagcgcaaaagatg

SEQ ID NO: 30875 - DNA, 103 bp, Artificial Sequence
  Synthetic Polynucleotide
taatacgactcactataggggctgagcaaagctggtaagatctgagccataacagaggagaatggctatgatcttaccaaacctggcggcagcgcaaaagatg

SEQ ID NO: 30876 - DNA, 103 bp, Artificial Sequence
  Synthetic Polynucleotide
taatacgactcactataggggtatagctgagcaaagctggtaagatctgaaacagaggagatcagatatgaccagctttaacctggcggcagcgcaaaagatg

SEQ ID NO: 30877 - DNA, 103 bp, Artificial Sequence
  Synthetic Polynucleotide
taatacgactcactatagggtttatgtatagctgagcaaagctggtaagaaacagaggagatcttacatgctttgctcaaacctggcggcagcgcaaaagatg

SEQ ID NO: 30878 - DNA, 103 bp, Artificial Sequence
  Synthetic Polynucleotide
taatacgactcactatagggtgctcagcatcagtaggatctttaattacaaacagaggagatgtaatatgagatcctacaacctggcggcagcgcaaaagatg

SEQ ID NO: 30879 - DNA, 103 bp, Artificial Sequence
  Synthetic Polynucleotide
taatacgactcactatagggggtcttttatgtatagctgagcaaagctggaacagaggagaccagctatgctcagctataacctggcggcagcgcaaaagatg

SEQ ID NO: 30880 - DNA, 103 bp, Artificial Sequence
  Synthetic Polynucleotide
taatacgactcactatagggatgagggtcttttatgtatagctgagcaaaaacagaggagatttgctatgctatacataaacctggcggcagcgcaaaagatg

SEQ ID NO: 30881 - DNA, 103 bp, Artificial Sequence
  Synthetic Polynucleotide
taatacgactcactataggggacaaatgagggtcttttatgtatagctgaaacagaggagatcagctatgcataaaagaaacctggcggcagcgcaaaagatg

SEQ ID NO: 30882 - DNA, 103 bp, Artificial Sequence
  Synthetic Polynucleotide
taatacgactcactatagggaaacagacaaatgagggtcttttatgtataaacagaggagatatacaatgaagaccctcaacctggcggcagcgcaaaagatg

SEQ ID NO: 30883 - DNA, 103 bp, Artificial Sequence
  Synthetic Polynucleotide
taatacgactcactataggggtcagaaacagacaaatgagggtcttttataacagaggagaataaaaatgcctcatttgaacctggcggcagcgcaaaagatg

SEQ ID NO: 30884 - DNA, 103 bp, Artificial Sequence
  Synthetic Polynucleotide
taatacgactcactatagggtctatgtcagaaacagacaaatgagggtctaacagaggagaagacccatgtttgtctgtaacctggcggcagcgcaaaagatg

SEQ ID NO: 30885 - DNA, 103 bp, Artificial Sequence
  Synthetic Polynucleotide
taatacgactcactatagggctatatctatgtcagaaacagacaaatgagaacagaggagactcattatgctgtttctgaacctggcggcagcgcaaaagatg

SEQ ID NO: 30886 - DNA, 103 bp, Artificial Sequence
  Synthetic Polynucleotide
taatacgactcactatagggaaatcctatatctatgtcagaaacagacaaaacagaggagattgtctatgtctgacataaacctggcggcagcgcaaaagatg

SEQ ID NO: 30887 - DNA, 103 bp, Artificial Sequence
  Synthetic Polynucleotide
taatacgactcactataggggaaggaaatcctatatctatgtcagaaacaaacagaggagatgtttcatgcatagatataacctggcggcagcgcaaaagatg

SEQ ID NO: 30888 - DNA, 103 bp, Artificial Sequence
  Synthetic Polynucleotide
taatacgactcactatagggtccatgaaggaaatcctatatctatgtcagaacagaggagactgacaatgatataggataacctggcggcagcgcaaaagatg

SEQ ID NO: 30889 - DNA, 103 bp, Artificial Sequence
  Synthetic Polynucleotide
taatacgactcactatagggatgcatgctcagcatcagtaggatctttaaaacagaggagattaaagatgctactgatgaacctggcggcagcgcaaaagatg

SEQ ID NO: 30890 - DNA, 103 bp, Artificial Sequence
  Synthetic Polynucleotide
taatacgactcactatagggcttcttccatgaaggaaatcctatatctataacagaggagaatagatatgggatttcctaacctggcggcagcgcaaaagatg

SEQ ID NO: 30891 - DNA, 103 bp, Artificial Sequence
  Synthetic Polynucleotide
taatacgactcactatagggaaatacttcttccatgaaggaaatcctataaacagaggagatataggatgtccttcatgaacctggcggcagcgcaaaagatg

SEQ ID NO: 30892 - DNA, 103 bp, Artificial Sequence
  Synthetic Polynucleotide
taatacgactcactatagggtcatcaaatacttcttccatgaaggaaatcaacagaggagagatttcatgcatggaagaaacctggcggcagcgcaaaagatg

SEQ ID NO: 30893 - DNA, 103 bp, Artificial Sequence
  Synthetic Polynucleotide
taatacgactcactatagggcacaatcatcaaatacttcttccatgaaggaacagaggagaccttcaatgaagaagtataacctggcggcagcgcaaaagatg

SEQ ID NO: 30894 - DNA, 103 bp, Artificial Sequence
  Synthetic Polynucleotide
taatacgactcactatagggccccccacaatcatcaaatacttcttccataacagaggagaatggaaatggtatttgataacctggcggcagcgcaaaagatg

SEQ ID NO: 30895 - DNA, 103 bp, Artificial Sequence
  Synthetic Polynucleotide
taatacgactcactatagggacactccccccacaatcatcaaatacttctaacagaggagaagaagtatgtgatgattgaacctggcggcagcgcaaaagatg

SEQ ID NO: 30896 - DNA, 103 bp, Artificial Sequence
  Synthetic Polynucleotide
taatacgactcactatagggtatcaacactccccccacaatcatcaaataaacagaggagatatttgatgattgtggggaacctggcggcagcgcaaaagatg

SEQ ID NO: 30897 - DNA, 103 bp, Artificial Sequence
  Synthetic Polynucleotide
taatacgactcactatagggagtcctatcaacactccccccacaatcatcaacagaggagagatgatatgggggggagtaacctggcggcagcgcaaaagatg

SEQ ID NO: 30898 - DNA, 103 bp, Artificial Sequence
  Synthetic Polynucleotide
taatacgactcactatagggcaattagtcctatcaacactccccccacaaaacagaggagattgtggatggagtgttgaaacctggcggcagcgcaaaagatg

SEQ ID NO: 30899 - DNA, 103 bp, Artificial Sequence
  Synthetic Polynucleotide
taatacgactcactataggggaagacaattagtcctatcaacactcccccaacagaggagagggggaatgttgataggaaacctggcggcagcgcaaaagatg

SEQ ID NO: 30900 - DNA, 103 bp, Artificial Sequence
  Synthetic Polynucleotide
taatacgactcactatagggcaatgatgcatgctcagcatcagtaggatcaacagaggagagatcctatggatgctgagaacctggcggcagcgcaaaagatg

SEQ ID NO: 30901 - DNA, 103 bp, Artificial Sequence
  Synthetic Polynucleotide
taatacgactcactatagggaaccagaagacaattagtcctatcaacactaacagaggagaagtgttatgaggactaataacctggcggcagcgcaaaagatg

SEQ ID NO: 30902 - DNA, 103 bp, Artificial Sequence
  Synthetic Polynucleotide
taatacgactcactatagggccaagaaccagaagacaattagtcctatcaaacagaggagatgatagatgtaattgtctaacctggcggcagcgcaaaagatg

SEQ ID NO: 30903 - DNA, 103 bp, Artificial Sequence
  Synthetic Polynucleotide
taatacgactcactatagggcttgaccaagaaccagaagacaattagtccaacagaggagaggactaatggtcttctggaacctggcggcagcgcaaaagatg

SEQ ID NO: 30904 - DNA, 103 bp, Artificial Sequence
  Synthetic Polynucleotide
taatacgactcactatagggaacaacttgaccaagaaccagaagacaattaacagaggagaaattgtatgctggttcttaacctggcggcagcgcaaaagatg

SEQ ID NO: 30905 - DNA, 103 bp, Artificial Sequence
  Synthetic Polynucleotide
taatacgactcactatagggtaaacaacaacttgaccaagaaccagaagaaacagaggagatcttctatgtcttggtcaaacctggcggcagcgcaaaagatg

SEQ ID NO: 30906 - DNA, 103 bp, Artificial Sequence
  Synthetic Polynucleotide
taatacgactcactatagggtactctaaacaacaacttgaccaagaaccaaacagaggagatggttcatggtcaagttgaacctggcggcagcgcaaaagatg

SEQ ID NO: 30907 - DNA, 103 bp, Artificial Sequence
  Synthetic Polynucleotide
taatacgactcactatagggtaacatactctaaacaacaacttgaccaagaacagaggagacttggtatggttgttgttaacctggcggcagcgcaaaagatg

SEQ ID NO: 30908 - DNA, 103 bp, Artificial Sequence
  Synthetic Polynucleotide
taatacgactcactatagggcagtataacatactctaaacaacaacttgaaacagaggagatcaagtatgtgtttagagaacctggcggcagcgcaaaagatg

SEQ ID NO: 30909 - DNA, 103 bp, Artificial Sequence
  Synthetic Polynucleotide
taatacgactcactatagggcttaacagtataacatactctaaacaacaaaacagaggagattgttgatgagagtatgtaacctggcggcagcgcaaaagatg

SEQ ID NO: 30910 - DNA, 103 bp, Artificial Sequence
  Synthetic Polynucleotide
taatacgactcactatagggttcctcttaacagtataacatactctaaacaacagaggagagtttagatgatgttatacaacctggcggcagcgcaaaagatg

SEQ ID NO: 30911 - DNA, 103 bp, Artificial Sequence
  Synthetic Polynucleotide
taatacgactcactatagggccaaccaatgatgcatgctcagcatcagtaaacagaggagatactgaatgtgagcatgcaacctggcggcagcgcaaaagatg

SEQ ID NO: 30912 - DNA, 103 bp, Artificial Sequence
  Synthetic Polynucleotide
taatacgactcactataggggccttttcctcttaacagtataacatactcaacagaggagagagtatatgatactgttaaacctggcggcagcgcaaaagatg

SEQ ID NO: 30913 - DNA, 103 bp, Artificial Sequence
  Synthetic Polynucleotide
taatacgactcactatagggacgaagccttttcctcttaacagtataacaaacagaggagatgttatatggttaagaggaacctggcggcagcgcaaaagatg

SEQ ID NO: 30914 - DNA, 103 bp, Artificial Sequence
  Synthetic Polynucleotide
taatacgactcactatagggccctcacgaagccttttcctcttaacagtaaacagaggagatactgtatggaggaaaagaacctggcggcagcgcaaaagatg

SEQ ID NO: 30915 - DNA, 103 bp, Artificial Sequence
  Synthetic Polynucleotide
taatacgactcactatagggtagaaccctcacgaagccttttcctcttaaaacagaggagattaagaatgaaaggcttcaacctggcggcagcgcaaaagatg

SEQ ID NO: 30916 - DNA, 103 bp, Artificial Sequence
  Synthetic Polynucleotide
taatacgactcactatagggattcatagaaccctcacgaagccttttcctaacagaggagaaggaaaatgcttcgtgagaacctggcggcagcgcaaaagatg

SEQ ID NO: 30917 - DNA, 103 bp, Artificial Sequence
  Synthetic Polynucleotide
taatacgactcactataggggtctcattcatagaaccctcacgaagccttaacagaggagaaaggctatgtgagggttcaacctggcggcagcgcaaaagatg

SEQ ID NO: 30918 - DNA, 103 bp, Artificial Sequence
  Synthetic Polynucleotide
taatacgactcactatagggtggatgtctcattcatagaaccctcacgaaaacagaggagattcgtgatggttctatgaaacctggcggcagcgcaaaagatg

SEQ ID NO: 30919 - DNA, 103 bp, Artificial Sequence
  Synthetic Polynucleotide
taatacgactcactataggggccactggatgtctcattcatagaaccctcaacagaggagagagggtatgatgaatgagaacctggcggcagcgcaaaagatg

SEQ ID NO: 30920 - DNA, 103 bp, Artificial Sequence
  Synthetic Polynucleotide
taatacgactcactatagggacagggccactggatgtctcattcatagaaaacagaggagattctatatgtgagacatcaacctggcggcagcgcaaaagatg

SEQ ID NO: 30921 - DNA, 103 bp, Artificial Sequence
  Synthetic Polynucleotide
taatacgactcactataggggaatgacagggccactggatgtctcattcaaacagaggagatgaatgatgcatccagtgaacctggcggcagcgcaaaagatg

SEQ ID NO: 30922 - DNA, 103 bp, Artificial Sequence
  Synthetic Polynucleotide
taatacgactcactataggggaaggccaaccaatgatgcatgctcagcataacagaggagaatgctgatgatgcatcataacctggcggcagcgcaaaagatg

SEQ ID NO: 30923 - DNA, 103 bp, Artificial Sequence
  Synthetic Polynucleotide
taatacgactcactatagggagtccgaatgacagggccactggatgtctcaacagaggagagagacaatgagtggccctaacctggcggcagcgcaaaagatg

SEQ ID NO: 30924 - DNA, 103 bp, Artificial Sequence
  Synthetic Polynucleotide
taatacgactcactatagggccagaagtccgaatgacagggccactggataacagaggagaatccagatgccctgtcataacctggcggcagcgcaaaagatg

SEQ ID NO: 30925 - DNA, 103 bp, Artificial Sequence
  Synthetic Polynucleotide
taatacgactcactatagggtgtcaccagaagtccgaatgacagggccacaacagaggagagtggccatgtcattcggaaacctggcggcagcgcaaaagatg

SEQ ID NO: 30926 - DNA, 103 bp, Artificial Sequence
  Synthetic Polynucleotide
taatacgactcactatagggctgtttgtcaccagaagtccgaatgacaggaacagaggagacctgtcatgcggacttctaacctggcggcagcgcaaaagatg

SEQ ID NO: 30927 - DNA, 103 bp, Artificial Sequence
  Synthetic Polynucleotide
taatacgactcactataggggaaagctgtttgtcaccagaagtccgaatgaacagaggagacattcgatgttctggtgaaacctggcggcagcgcaaaagatg

SEQ ID NO: 30928 - DNA, 103 bp, Artificial Sequence
  Synthetic Polynucleotide
taatacgactcactatagggcccacgaaagctgtttgtcaccagaagtccaacagaggagaggacttatggtgacaaacaacctggcggcagcgcaaaagatg

SEQ ID NO: 30929 - DNA, 103 bp, Artificial Sequence
  Synthetic Polynucleotide
taatacgactcactatagggagattcccacgaaagctgtttgtcaccagaaacagaggagatctggtatgaaacagcttaacctggcggcagcgcaaaagatg

SEQ ID NO: 30930 - DNA, 103 bp, Artificial Sequence
  Synthetic Polynucleotide
taatacgactcactatagggttgtaagattcccacgaaagctgtttgtcaaacagaggagatgacaaatggctttcgtgaacctggcggcagcgcaaaagatg

SEQ ID NO: 30931 - DNA, 103 bp, Artificial Sequence
  Synthetic Polynucleotide
taatacgactcactatagggaactcttgtaagattcccacgaaagctgttaacagaggagaaacagcatgcgtgggaataacctggcggcagcgcaaaagatg

SEQ ID NO: 30932 - DNA, 103 bp, Artificial Sequence
  Synthetic Polynucleotide
taatacgactcactatagggtgcagaactcttgtaagattcccacgaaagaacagaggagactttcgatggaatcttacaacctggcggcagcgcaaaagatg

SEQ ID NO: 30933 - DNA, 103 bp, Artificial Sequence
  Synthetic Polynucleotide
taatacgactcactatagggcaacagaaggccaaccaatgatgcatgctcaacagaggagagagcatatgtcattggttaacctggcggcagcgcaaaagatg

SEQ ID NO: 30934 - DNA, 103 bp, Artificial Sequence
  Synthetic Polynucleotide
taatacgactcactatagggtagaatgcagaactcttgtaagattcccacaacagaggagagtgggaatgttacaagagaacctggcggcagcgcaaaagatg

SEQ ID NO: 30935 - DNA, 103 bp, Artificial Sequence
  Synthetic Polynucleotide
taatacgactcactatagggcccactagaatgcagaactcttgtaagattaacagaggagaaatcttatgagagttctgaacctggcggcagcgcaaaagatg

SEQ ID NO: 30936 - DNA, 103 bp, Artificial Sequence
  Synthetic Polynucleotide
taatacgactcactatagggaaaaacccactagaatgcagaactcttgtaaacagaggagatacaagatgtctgcattcaacctggcggcagcgcaaaagatg

SEQ ID NO: 30937 - DNA, 103 bp, Artificial Sequence
  Synthetic Polynucleotide
taatacgactcactatagggtacacaaaaacccactagaatgcagaactcaacagaggagagagttcatgattctagtgaacctggcggcagcgcaaaagatg

SEQ ID NO: 30938 - DNA, 103 bp, Artificial Sequence
  Synthetic Polynucleotide
taatacgactcactatagggcactctacacaaaaacccactagaatgcagaacagaggagactgcatatgagtgggtttaacctggcggcagcgcaaaagatg

SEQ ID NO: 30939 - DNA, 103 bp, Artificial Sequence
  Synthetic Polynucleotide
taatacgactcactatagggtgtaacactctacacaaaaacccactagaaaacagaggagattctagatggtttttgtgaacctggcggcagcgcaaaagatg

SEQ ID NO: 30940 - DNA, 103 bp, Artificial Sequence
  Synthetic Polynucleotide
taatacgactcactataggggcccatgtaacactctacacaaaaacccacaacagaggagagtgggtatgtgtgtagagaacctggcggcagcgcaaaagatg

SEQ ID NO: 30941 - DNA, 103 bp, Artificial Sequence
  Synthetic Polynucleotide
taatacgactcactatagggctgaagcccatgtaacactctacacaaaaaaacagaggagatttttgatgagagtgttaaacctggcggcagcgcaaaagatg

SEQ ID NO: 30942 - DNA, 103 bp, Artificial Sequence
  Synthetic Polynucleotide
taatacgactcactatagggaagggctgaagcccatgtaacactctacacaacagaggagagtgtagatggttacatggaacctggcggcagcgcaaaagatg

SEQ ID NO: 30943 - DNA, 103 bp, Artificial Sequence
  Synthetic Polynucleotide
taatacgactcactatagggtttctaagggctgaagcccatgtaacactcaacagaggagagagtgtatgatgggcttcaacctggcggcagcgcaaaagatg

SEQ ID NO: 30944 - DNA, 103 bp, Artificial Sequence
  Synthetic Polynucleotide
taatacgactcactatagggaagcacaacagaaggccaaccaatgatgcaaacagaggagatgcatcatgggttggcctaacctggcggcagcgcaaaagatg

SEQ ID NO: 30945 - DNA, 103 bp, Artificial Sequence
  Synthetic Polynucleotide
taatacgactcactatagggccctttttctaagggctgaagcccatgtaaaacagaggagattacatatgcttcagcccaacctggcggcagcgcaaaagatg

SEQ ID NO: 30946 - DNA, 103 bp, Artificial Sequence
  Synthetic Polynucleotide
taatacgactcactataggggtcggccctttttctaagggctgaagcccaaacagaggagatgggctatggcccttagaaacctggcggcagcgcaaaagatg

SEQ ID NO: 30947 - DNA, 103 bp, Artificial Sequence
  Synthetic Polynucleotide
taatacgactcactataggggattggtcggccctttttctaagggctgaaaacagaggagattcagcatgtagaaaaagaacctggcggcagcgcaaaagatg

SEQ ID NO: 30948 - DNA, 103 bp, Artificial Sequence
  Synthetic Polynucleotide
taatacgactcactataggggcagtgattggtcggccctttttctaagggaacagaggagacccttaatgaaagggccgaacctggcggcagcgcaaaagatg

SEQ ID NO: 30949 - DNA, 103 bp, Artificial Sequence
  Synthetic Polynucleotide
taatacgactcactatagggtagaggcagtgattggtcggccctttttctaacagaggagaagaaaaatggccgaccaaaacctggcggcagcgcaaaagatg

SEQ ID NO: 30950 - DNA, 103 bp, Artificial Sequence
  Synthetic Polynucleotide
taatacgactcactatagggttttttagaggcagtgattggtcggcccttaacagaggagaaagggcatgccaatcactaacctggcggcagcgcaaaagatg

SEQ ID NO: 30951 - DNA, 103 bp, Artificial Sequence
  Synthetic Polynucleotide
taatacgactcactataggggtaacttttttagaggcagtgattggtcggaacagaggagaccgaccatgcactgcctcaacctggcggcagcgcaaaagatg

SEQ ID NO: 30952 - DNA, 103 bp, Artificial Sequence
  Synthetic Polynucleotide
taatacgactcactataggggcaatgtaacttttttagaggcagtgattgaacagaggagacaatcaatgcctctaaaaaacctggcggcagcgcaaaagatg

SEQ ID NO: 30953 - DNA, 103 bp, Artificial Sequence
  Synthetic Polynucleotide
taatacgactcactatagggttttggcaatgtaacttttttagaggcagtaacagaggagaactgccatgaaaaaagttaacctggcggcagcgcaaaagatg

SEQ ID NO: 30954 - DNA, 103 bp, Artificial Sequence
  Synthetic Polynucleotide
taatacgactcactatagggaatgcttttggcaatgtaacttttttagagaacagaggagactctaaatgagttacattaacctggcggcagcgcaaaagatg

SEQ ID NO: 30955 - DNA, 103 bp, Artificial Sequence
  Synthetic Polynucleotide
taatacgactcactatagggtatacaagcacaacagaaggccaaccaatgaacagaggagacattggatggccttctgtaacctggcggcagcgcaaaagatg

SEQ ID NO: 30956 - DNA, 103 bp, Artificial Sequence
  Synthetic Polynucleotide
taatacgactcactatagggccaagaatgcttttggcaatgtaactttttaacagaggagaaaaaagatgcattgccaaaacctggcggcagcgcaaaagatg

SEQ ID NO: 30957 - DNA, 103 bp, Artificial Sequence
  Synthetic Polynucleotide
taatacgactcactatagggtggatccaagaatgcttttggcaatgtaacaacagaggagagttacaatgccaaaagcaaacctggcggcagcgcaaaagatg

SEQ ID NO: 30958 - DNA, 103 bp, Artificial Sequence
  Synthetic Polynucleotide
taatacgactcactatagggagcgctggatccaagaatgcttttggcaataacagaggagaattgccatgagcattcttaacctggcggcagcgcaaaagatg

SEQ ID NO: 30959 - DNA, 103 bp, Artificial Sequence
  Synthetic Polynucleotide
taatacgactcactatagggggagaagcgctggatccaagaatgcttttgaacagaggagacaaaagatgtcttggatcaacctggcggcagcgcaaaagatg

SEQ ID NO: 30960 - DNA, 103 bp, Artificial Sequence
  Synthetic Polynucleotide
taatacgactcactataggggacccggagaagcgctggatccaagaatgcaacagaggagagcattcatggatccagcgaacctggcggcagcgcaaaagatg

SEQ ID NO: 30961 - DNA, 103 bp, Artificial Sequence
  Synthetic Polynucleotide
taatacgactcactataggggaaatgacccggagaagcgctggatccaagaacagaggagacttggaatgagcgcttctaacctggcggcagcgcaaaagatg

SEQ ID NO: 30962 - DNA, 103 bp, Artificial Sequence
  Synthetic Polynucleotide
taatacgactcactatagggcctgagaaatgacccggagaagcgctggataacagaggagaatccagatgttctccgggaacctggcggcagcgcaaaagatg

SEQ ID NO: 30963 - DNA, 103 bp, Artificial Sequence
  Synthetic Polynucleotide
taatacgactcactatagggactggcctgagaaatgacccggagaagcgcaacagaggagagcgcttatgcgggtcattaacctggcggcagcgcaaaagatg

SEQ ID NO: 30964 - DNA, 103 bp, Artificial Sequence
  Synthetic Polynucleotide
taatacgactcactatagggcggttactggcctgagaaatgacccggagaaacagaggagatctccgatgcatttctcaaacctggcggcagcgcaaaagatg

SEQ ID NO: 30965 - DNA, 103 bp, Artificial Sequence
  Synthetic Polynucleotide
taatacgactcactatagggtttaacggttactggcctgagaaatgacccaacagaggagagggtcaatgctcaggccaaacctggcggcagcgcaaaagatg

SEQ ID NO: 30966 - DNA, 103 bp, Artificial Sequence
  Synthetic Polynucleotide
taatacgactcactatagggtaacctatacaagcacaacagaaggccaacaacagaggagagttggcatgctgttgtgcaacctggcggcagcgcaaaagatg

SEQ ID NO: 30967 - DNA, 103 bp, Artificial Sequence
  Synthetic Polynucleotide
taatacgactcactatagggtgatctttaacggttactggcctgagaaataacagaggagaatttctatggccagtaacaacctggcggcagcgcaaaagatg

SEQ ID NO: 30968 - DNA, 103 bp, Artificial Sequence
  Synthetic Polynucleotide
taatacgactcactatagggtcggatgatctttaacggttactggcctgaaacagaggagatcaggcatgtaaccgttaaacctggcggcagcgcaaaagatg

SEQ ID NO: 30969 - DNA, 103 bp, Artificial Sequence
  Synthetic Polynucleotide
taatacgactcactatagggattggtcggatgatctttaacggttactggaacagaggagaccagtaatggttaaagataacctggcggcagcgcaaaagatg

SEQ ID NO: 30970 - DNA, 103 bp, Artificial Sequence
  Synthetic Polynucleotide
taatacgactcactatagggacatgattggtcggatgatctttaacggttaacagaggagaaaccgtatgagatcatccaacctggcggcagcgcaaaagatg

SEQ ID NO: 30971 - DNA, 103 bp, Artificial Sequence
  Synthetic Polynucleotide
taatacgactcactatagggatccgacatgattggtcggatgatctttaaaacagaggagattaaagatgatccgaccaaacctggcggcagcgcaaaagatg

SEQ ID NO: 30972 - DNA, 103 bp, Artificial Sequence
  Synthetic Polynucleotide
taatacgactcactataggggaaggatccgacatgattggtcggatgatcaacagaggagagatcatatgaccaatcataacctggcggcagcgcaaaagatg

SEQ ID NO: 30973 - DNA, 103 bp, Artificial Sequence
  Synthetic Polynucleotide
taatacgactcactatagggagggtgaaggatccgacatgattggtcggaaacagaggagatccgacatgtcatgtcggaacctggcggcagcgcaaaagatg

SEQ ID NO: 30974 - DNA, 103 bp, Artificial Sequence
  Synthetic Polynucleotide
taatacgactcactatagggtctctagggtgaaggatccgacatgattggaacagaggagaccaatcatgtcggatcctaacctggcggcagcgcaaaagatg

SEQ ID NO: 30975 - DNA, 103 bp, Artificial Sequence
  Synthetic Polynucleotide
taatacgactcactataggggatgctctctagggtgaaggatccgacatgaacagaggagacatgtcatgtccttcaccaacctggcggcagcgcaaaagatg

SEQ ID NO: 30976 - DNA, 103 bp, Artificial Sequence
  Synthetic Polynucleotide
taatacgactcactataggggaagcgatgctctctagggtgaaggatccgaacagaggagacggatcatgcaccctagaaacctggcggcagcgcaaaagatg

SEQ ID NO: 30977 - DNA, 103 bp, Artificial Sequence
  Synthetic Polynucleotide
taatacgactcactatagggcatatgtgtgagaatattgattaacatacaaacagaggagatgtatgatgatcaatattaacctggcggcagcgcaaaagatg

SEQ ID NO: 30978 - DNA, 103 bp, Artificial Sequence
  Synthetic Polynucleotide
taatacgactcactatagggtcctgcacggtcttggttatcctaaccctcaacagaggagagagggtatggataaccaaaacctggcggcagcgcaaaagatg

SEQ ID NO: 30979 - DNA, 103 bp, Artificial Sequence
  Synthetic Polynucleotide
taatacgactcactatagggggagcctcagctaatccggtatgcccagcaaacagaggagatgctggatgtaccggattaacctggcggcagcgcaaaagatg

SEQ ID NO: 30980 - DNA, 103 bp, Artificial Sequence
  Synthetic Polynucleotide
taatacgactcactatagggagccgaatctttgtatggactgctctaattaacagaggagaaattagatgagtccatacaacctggcggcagcgcaaaagatg

SEQ ID NO: 30981 - DNA, 103 bp, Artificial Sequence
  Synthetic Polynucleotide
taatacgactcactatagggaggccgaaacttttaaataacgtttctaagaacagaggagacttagaatggttatttaaaacctggcggcagcgcaaaagatg

SEQ ID NO: 30982 - DNA, 103 bp, Artificial Sequence
  Synthetic Polynucleotide
taatacgactcactatagggctgtagtgtgatggcgatcgcgtcccttgcaacagaggagagcaaggatggcgatcgccaacctggcggcagcgcaaaagatg

SEQ ID NO: 30983 - DNA, 103 bp, Artificial Sequence
  Synthetic Polynucleotide
taatacgactcactatagggagcctaactgttggctctactgcgtttgtgaacagaggagacacaaaatgagtagagccaacctggcggcagcgcaaaagatg

SEQ ID NO: 30984 - DNA, 103 bp, Artificial Sequence
  Synthetic Polynucleotide
taatacgactcactatagggaattagggaactattaaactacaggtcggtaacagaggagaaccgacatgtagtttaataacctggcggcagcgcaaaagatg

SEQ ID NO: 30985 - DNA, 103 bp, Artificial Sequence
  Synthetic Polynucleotide
taatacgactcactatagggtggttctctgcttacctctctctgtgttccaacagaggagaggaacaatgagagaggtaaacctggcggcagcgcaaaagatg

SEQ ID NO: 30986 - DNA, 103 bp, Artificial Sequence
  Synthetic Polynucleotide
taatacgactcactatagggtctgcgtccttcgtcgacctttaaagtcttaacagaggagaaagactatgaaggtcgacaacctggcggcagcgcaaaagatg

SEQ ID NO: 30987 - DNA, 103 bp, Artificial Sequence
  Synthetic Polynucleotide
taatacgactcactataggggagagcggaccctctaatgcaatcgaacataacagaggagaatgttcatgtgcattagaaacctggcggcagcgcaaaagatg

SEQ ID NO: 30988 - DNA, 103 bp, Artificial Sequence
  Synthetic Polynucleotide
taatacgactcactatagggaattgtaatgtctattggaatcgtttggcaaacagaggagatgccaaatgattccaataaacctggcggcagcgcaaaagatg

SEQ ID NO: 30989 - DNA, 103 bp, Artificial Sequence
  Synthetic Polynucleotide
taatacgactcactatagggtcttccggatttagagcatgacaacactataacagaggagaatagtgatgtcatgctctaacctggcggcagcgcaaaagatg

SEQ ID NO: 30990 - DNA, 103 bp, Artificial Sequence
  Synthetic Polynucleotide
taatacgactcactatagggagctctataaatctggaatctaccttacctaacagaggagaaggtaaatgagattccagaacctggcggcagcgcaaaagatg

SEQ ID NO: 30991 - DNA, 103 bp, Artificial Sequence
  Synthetic Polynucleotide
taatacgactcactatagggcaacattttgaccgggcctatttcgatggaaacagaggagatccatcatgataggcccgaacctggcggcagcgcaaaagatg

SEQ ID NO: 30992 - DNA, 103 bp, Artificial Sequence
  Synthetic Polynucleotide
taatacgactcactatagggcatcataagaaggcaacttgaggctcgcacaacagaggagagtgcgaatgtcaagttgcaacctggcggcagcgcaaaagatg

SEQ ID NO: 30993 - DNA, 103 bp, Artificial Sequence
  Synthetic Polynucleotide
taatacgactcactatagggcacaggggacaccagcacattcacgtaacaaacagaggagatgttacatgaatgtgctgaacctggcggcagcgcaaaagatg

SEQ ID NO: 30994 - DNA, 103 bp, Artificial Sequence
  Synthetic Polynucleotide
taatacgactcactatagggaagaatcatgaagcgtcagctacttatcggaacagaggagaccgataatgagctgacgcaacctggcggcagcgcaaaagatg

SEQ ID NO: 30995 - DNA, 103 bp, Artificial Sequence
  Synthetic Polynucleotide
taatacgactcactatagggtcagccgcggttagcgtaccagttactctaaacagaggagatagagtatgtggtacgctaacctggcggcagcgcaaaagatg

SEQ ID NO: 30996 - DNA, 103 bp, Artificial Sequence
  Synthetic Polynucleotide
taatacgactcactatagggagatccccttacgtgagactccaaagactaaacagaggagatagtctatggagtctcacaacctggcggcagcgcaaaagatg

SEQ ID NO: 30997 - DNA, 103 bp, Artificial Sequence
  Synthetic Polynucleotide
taatacgactcactataggggcccacaggtctgctgccctgcccggggagaacagaggagactccccatgcagggcagcaacctggcggcagcgcaaaagatg

SEQ ID NO: 30998 - DNA, 103 bp, Artificial Sequence
  Synthetic Polynucleotide
taatacgactcactatagggatcttgggaagtccccttaagtattcgtcgaacagaggagacgacgaatgcttaaggggaacctggcggcagcgcaaaagatg

SEQ ID NO: 30999 - DNA, 103 bp, Artificial Sequence
  Synthetic Polynucleotide
taatacgactcactatagggccacttacctgtgggggccatgggcaggaaaacagaggagattcctgatgatggcccccaacctggcggcagcgcaaaagatg

SEQ ID NO: 31000 - DNA, 103 bp, Artificial Sequence
  Synthetic Polynucleotide
taatacgactcactatagggacacaccagtgactccgtcccacaaggacgaacagaggagacgtcctatggggacggagaacctggcggcagcgcaaaagatg

SEQ ID NO: 31001 - DNA, 103 bp, Artificial Sequence
  Synthetic Polynucleotide
taatacgactcactataggggcctactggagagtgctgacggaatgtgtgaacagaggagacacacaatgcgtcagcacaacctggcggcagcgcaaaagatg

SEQ ID NO: 31002 - DNA, 103 bp, Artificial Sequence
  Synthetic Polynucleotide
taatacgactcactataggggatagaatttcccttactgcttacagcttaaacagaggagataagctatgagcagtaagaacctggcggcagcgcaaaagatg

SEQ ID NO: 31003 - DNA, 103 bp, Artificial Sequence
  Synthetic Polynucleotide
taatacgactcactatagggtagcacgagcagactacctctcccactaccaacagaggagaggtagtatgagaggtagtaacctggcggcagcgcaaaagatg

SEQ ID NO: 31004 - DNA, 103 bp, Artificial Sequence
  Synthetic Polynucleotide
taatacgactcactatagggtagtgtccacccaccgagacatggatacaaaacagaggagattgtatatgtgtctcggtaacctggcggcagcgcaaaagatg

SEQ ID NO: 31005 - DNA, 103 bp, Artificial Sequence
  Synthetic Polynucleotide
taatacgactcactatagggccgacgggtatctcacgcacaccaaagctaaacagaggagatagcttatgtgtgcgtgaaacctggcggcagcgcaaaagatg

SEQ ID NO: 31006 - DNA, 103 bp, Artificial Sequence
  Synthetic Polynucleotide
taatacgactcactataggggcaatgattcatacgtggtggtgcgaacaaaacagaggagattgttcatgccaccacgtaacctggcggcagcgcaaaagatg

SEQ ID NO: 31007 - DNA, 103 bp, Artificial Sequence
  Synthetic Polynucleotide
taatacgactcactatagggtagtgagaaacatccatctaacgcattcctaacagaggagaaggaatatgttagatggaaacctggcggcagcgcaaaagatg

SEQ ID NO: 31008 - DNA, 103 bp, Artificial Sequence
  Synthetic Polynucleotide
taatacgactcactatagggacatcaattcgttacttaggtacatcgggcaacagaggagagcccgaatgacctaagtaaacctggcggcagcgcaaaagatg

SEQ ID NO: 31009 - DNA, 103 bp, Artificial Sequence
  Synthetic Polynucleotide
taatacgactcactataggggcacagttgtggttcgaatgaaatgtcgttaacagaggagaaacgacatgtcattcgaaaacctggcggcagcgcaaaagatg

SEQ ID NO: 31010 - DNA, 103 bp, Artificial Sequence
  Synthetic Polynucleotide
taatacgactcactataggggtctgtaaaccatcaagttgcctcatcctgaacagaggagacaggatatggcaacttgaaacctggcggcagcgcaaaagatg

SEQ ID NO: 31011 - DNA, 103 bp, Artificial Sequence
  Synthetic Polynucleotide
taatacgactcactatagggcagtatgtttacgttatgaacgactgttagaacagaggagactaacaatggttcataacaacctggcggcagcgcaaaagatg

SEQ ID NO: 31012 - DNA, 103 bp, Artificial Sequence
  Synthetic Polynucleotide
taatacgactcactataggggagcgcacccacggcggatacgatcaggaaaacagaggagattcctgatggtatccgccaacctggcggcagcgcaaaagatg

SEQ ID NO: 31013 - DNA, 103 bp, Artificial Sequence
  Synthetic Polynucleotide
taatacgactcactatagggggcgagccaggtcggttcttttttgcctaaaacagaggagattaggcatgaaagaaccgaacctggcggcagcgcaaaagatg

SEQ ID NO: 31014 - DNA, 103 bp, Artificial Sequence
  Synthetic Polynucleotide
taatacgactcactatagggccgagggctacctgccacgggcttagaaataacagaggagaatttctatgcccgtggcaaacctggcggcagcgcaaaagatg

SEQ ID NO: 31015 - DNA, 103 bp, Artificial Sequence
  Synthetic Polynucleotide
taatacgactcactatagggtggcgtgagcctactcaagtccgcctccccaacagaggagaggggagatggacttgagtaacctggcggcagcgcaaaagatg

SEQ ID NO: 31016 - DNA, 103 bp, Artificial Sequence
  Synthetic Polynucleotide
taatacgactcactataggggacttttcctcgcaccaaaagacaccggacaacagaggagagtccggatgcttttggtgaacctggcggcagcgcaaaagatg

SEQ ID NO: 31017 - DNA, 103 bp, Artificial Sequence
  Synthetic Polynucleotide
taatacgactcactatagggacgtgtacttccctagtgtatatctacttcaacagaggagagaagtaatgatacactagaacctggcggcagcgcaaaagatg

SEQ ID NO: 31018 - DNA, 103 bp, Artificial Sequence
  Synthetic Polynucleotide
taatacgactcactatagggacccggcctaccggggttggatgtagaaataacagaggagaatttctatgtccaaccccaacctggcggcagcgcaaaagatg

SEQ ID NO: 31019 - DNA, 103 bp, Artificial Sequence
  Synthetic Polynucleotide
taatacgactcactatagggcacaacacaaagttcgctaaatcgggctataacagaggagaatagccatgtttagcgaaaacctggcggcagcgcaaaagatg

SEQ ID NO: 31020 - DNA, 103 bp, Artificial Sequence
  Synthetic Polynucleotide
taatacgactcactatagggcagcataatctagttcgcaaggttgccagcaacagaggagagctggcatgcttgcgaacaacctggcggcagcgcaaaagatg

SEQ ID NO: 31021 - DNA, 103 bp, Artificial Sequence
  Synthetic Polynucleotide
taatacgactcactataggggagtcataacaacttcacacatacttcctcaacagaggagagaggaaatgtgtgtgaagaacctggcggcagcgcaaaagatg

SEQ ID NO: 31022 - DNA, 103 bp, Artificial Sequence
  Synthetic Polynucleotide
taatacgactcactatagggagagtacaataaagcttcagaactcgcccaaacagaggagatgggcgatgtctgaagctaacctggcggcagcgcaaaagatg

SEQ ID NO: 31023 - DNA, 103 bp, Artificial Sequence
  Synthetic Polynucleotide
taatacgactcactatagggtctcagctgagctatgggcgaacccaggccaacagaggagaggcctgatgtcgcccataaacctggcggcagcgcaaaagatg

SEQ ID NO: 31024 - DNA, 103 bp, Artificial Sequence
  Synthetic Polynucleotide
taatacgactcactatagggttcttaatgaagacccatttagatagcctcaacagaggagagaggctatgtaaatgggtaacctggcggcagcgcaaaagatg

SEQ ID NO: 31025 - DNA, 103 bp, Artificial Sequence
  Synthetic Polynucleotide
taatacgactcactataggggacacggtgcgaccattctctgcctgctccaacagaggagaggagcaatgagagaatggaacctggcggcagcgcaaaagatg

SEQ ID NO: 31026 - DNA, 103 bp, Artificial Sequence
  Synthetic Polynucleotide
taatacgactcactataggggaaaccacgcgcgtatggcctcgctttggtaacagaggagaaccaaaatgaggccatacaacctggcggcagcgcaaaagatg

SEQ ID NO: 31027 - DNA, 103 bp, Artificial Sequence
  Synthetic Polynucleotide
taatacgactcactatagggaggtgcgagcatcagcgtgcgcttggcatgaacagaggagacatgccatgcgcacgctgaacctggcggcagcgcaaaagatg

SEQ ID NO: 31028 - DNA, 103 bp, Artificial Sequence
  Synthetic Polynucleotide
taatacgactcactatagggtgtgtacaggacttatcccgggccatacgaaacagaggagatcgtatatgccgggataaaacctggcggcagcgcaaaagatg

SEQ ID NO: 31029 - DNA, 103 bp, Artificial Sequence
  Synthetic Polynucleotide
taatacgactcactatagggtttgggagctacgccaaaaccgtatcgtccaacagaggagaggacgaatgggttttggcaacctggcggcagcgcaaaagatg

SEQ ID NO: 31030 - DNA, 103 bp, Artificial Sequence
  Synthetic Polynucleotide
taatacgactcactataggggtttgacctcgcattgttggcagcaattttaacagaggagaaaaattatggccaacaataacctggcggcagcgcaaaagatg

SEQ ID NO: 31031 - DNA, 103 bp, Artificial Sequence
  Synthetic Polynucleotide
taatacgactcactataggggtttaattaacagatactattgctttaagaaacagaggagatcttaaatgaatagtatcaacctggcggcagcgcaaaagatg

SEQ ID NO: 31032 - DNA, 103 bp, Artificial Sequence
  Synthetic Polynucleotide
taatacgactcactatagggtggtccgcgattaaacagcgctgttgtgcgaacagaggagacgcacaatggcgctgtttaacctggcggcagcgcaaaagatg

SEQ ID NO: 31033 - DNA, 103 bp, Artificial Sequence
  Synthetic Polynucleotide
taatacgactcactatagggttcacatataaatgctactaggacccttcgaacagaggagacgaaggatgctagtagcaaacctggcggcagcgcaaaagatg

SEQ ID NO: 31034 - DNA, 103 bp, Artificial Sequence
  Synthetic Polynucleotide
taatacgactcactatagggtcaacctgattggagattcgctataggggcaacagaggagagcccctatggcgaatctcaacctggcggcagcgcaaaagatg

SEQ ID NO: 31035 - DNA, 103 bp, Artificial Sequence
  Synthetic Polynucleotide
taatacgactcactatagggttgcaggtactcgacacgaccttcgttcggaacagaggagaccgaacatgggtcgtgtcaacctggcggcagcgcaaaagatg

SEQ ID NO: 31036 - DNA, 103 bp, Artificial Sequence
  Synthetic Polynucleotide
taatacgactcactatagggtattccaacggtttcgtattatgtggggccaacagaggagaggccccatgtaatacgaaaacctggcggcagcgcaaaagatg

SEQ ID NO: 31037 - DNA, 103 bp, Artificial Sequence
  Synthetic Polynucleotide
taatacgactcactatagggaggaggctcgctaataggggctggtggtggaacagaggagaccaccaatggcccctattaacctggcggcagcgcaaaagatg

SEQ ID NO: 31038 - DNA, 103 bp, Artificial Sequence
  Synthetic Polynucleotide
taatacgactcactatagggaatatcaagagaatgatcgtatttcactcaaacagaggagatgagtgatgtacgatcataacctggcggcagcgcaaaagatg

SEQ ID NO: 31039 - DNA, 103 bp, Artificial Sequence
  Synthetic Polynucleotide
taatacgactcactatagggcagccgggagtcctaacaaactggtactccaacagaggagaggagtaatggtttgttagaacctggcggcagcgcaaaagatg

SEQ ID NO: 31040 - DNA, 103 bp, Artificial Sequence
  Synthetic Polynucleotide
taatacgactcactatagggacctattgtgatattccgaacatggggttgaacagaggagacaacccatggttcggaataacctggcggcagcgcaaaagatg

SEQ ID NO: 31041 - DNA, 103 bp, Artificial Sequence
  Synthetic Polynucleotide
taatacgactcactataggggcgaacctcaggggttcccgagccaagtgcaacagaggagagcacttatgtcgggaaccaacctggcggcagcgcaaaagatg

SEQ ID NO: 31042 - DNA, 103 bp, Artificial Sequence
  Synthetic Polynucleotide
taatacgactcactatagggtctggaaggatcagctcttggaacacgcggaacagaggagaccgcgtatgccaagagctaacctggcggcagcgcaaaagatg

SEQ ID NO: 31043 - DNA, 103 bp, Artificial Sequence
  Synthetic Polynucleotide
taatacgactcactatagggagttggtcatatgtggagaagttaccatagaacagaggagactatggatgcttctccacaacctggcggcagcgcaaaagatg

SEQ ID NO: 31044 - DNA, 103 bp, Artificial Sequence
  Synthetic Polynucleotide
taatacgactcactatagggcgggggtccccaatgagtgggatcaagcgcaacagaggagagcgcttatgcccactcataacctggcggcagcgcaaaagatg

SEQ ID NO: 31045 - DNA, 103 bp, Artificial Sequence
  Synthetic Polynucleotide
taatacgactcactatagggtttaaaatgcaggtcacgttccgacacagcaacagaggagagctgtgatggaacgtgacaacctggcggcagcgcaaaagatg

SEQ ID NO: 31046 - DNA, 103 bp, Artificial Sequence
  Synthetic Polynucleotide
taatacgactcactatagggatccgtgacccctggaccctgcaggttggaaacagaggagatccaacatgcagggtccaaacctggcggcagcgcaaaagatg

SEQ ID NO: 31047 - DNA, 103 bp, Artificial Sequence
  Synthetic Polynucleotide
taatacgactcactatagggaggagtttagaacatcccaaggatcacgtcaacagaggagagacgtgatgcttgggatgaacctggcggcagcgcaaaagatg

SEQ ID NO: 31048 - DNA, 103 bp, Artificial Sequence
  Synthetic Polynucleotide
taatacgactcactatagggttattagtgtctggtttcggtcgagtctgtaacagaggagaacagacatgaccgaaaccaacctggcggcagcgcaaaagatg

SEQ ID NO: 31049 - DNA, 103 bp, Artificial Sequence
  Synthetic Polynucleotide
taatacgactcactataggggtaccttacttgggtgcctgagagtcacggaacagaggagaccgtgaatgtcaggcaccaacctggcggcagcgcaaaagatg

SEQ ID NO: 31050 - DNA, 103 bp, Artificial Sequence
  Synthetic Polynucleotide
taatacgactcactatagggatgttgtgcaccctgtccgtggtccctcagaacagaggagactgaggatgcacggacagaacctggcggcagcgcaaaagatg

SEQ ID NO: 31051 - DNA, 103 bp, Artificial Sequence
  Synthetic Polynucleotide
taatacgactcactatagggctatatgtaggcatcgagaaagatacacgaaacagaggagatcgtgtatgtttctcgataacctggcggcagcgcaaaagatg

SEQ ID NO: 31052 - DNA, 103 bp, Artificial Sequence
  Synthetic Polynucleotide
taatacgactcactatagggaccgatcgcgtgctccttgtatgtttcacgaacagaggagacgtgaaatgtacaaggagaacctggcggcagcgcaaaagatg

SEQ ID NO: 31053 - DNA, 103 bp, Artificial Sequence
  Synthetic Polynucleotide
taatacgactcactatagggtgattccaggtgcccctggatagaatgggcaacagaggagagcccatatgatccaggggaacctggcggcagcgcaaaagatg

SEQ ID NO: 31054 - DNA, 103 bp, Artificial Sequence
  Synthetic Polynucleotide
taatacgactcactatagggaatctgtcagttgagttgacagctaaggtgaacagaggagacaccttatgtgtcaactcaacctggcggcagcgcaaaagatg

SEQ ID NO: 31055 - DNA, 103 bp, Artificial Sequence
  Synthetic Polynucleotide
taatacgactcactatagggcagccgactaggggaattgtgattgaatccaacagaggagaggattcatgcacaattccaacctggcggcagcgcaaaagatg

SEQ ID NO: 31056 - DNA, 103 bp, Artificial Sequence
  Synthetic Polynucleotide
taatacgactcactataggggagctagcccacgagcgattaaagggcttgaacagaggagacaagccatgtaatcgctcaacctggcggcagcgcaaaagatg

SEQ ID NO: 31057 - DNA, 103 bp, Artificial Sequence
  Synthetic Polynucleotide
taatacgactcactataggggttctgtcaaccgtaagcacctcccggataaacagaggagatatccgatgggtgcttacaacctggcggcagcgcaaaagatg

SEQ ID NO: 31058 - DNA, 103 bp, Artificial Sequence
  Synthetic Polynucleotide
taatacgactcactatagggcggtctgttagtagaaaccgacaagacagcaacagaggagagctgtcatgtcggtttctaacctggcggcagcgcaaaagatg

SEQ ID NO: 31059 - DNA, 103 bp, Artificial Sequence
  Synthetic Polynucleotide
taatacgactcactataggggtcccaaaatatcttttaacagacgatctcaacagaggagagagatcatgtgttaaaagaacctggcggcagcgcaaaagatg

SEQ ID NO: 31060 - DNA, 103 bp, Artificial Sequence
  Synthetic Polynucleotide
taatacgactcactatagggtggtggtatgtttcccttcatcgtcccttcaacagaggagagaagggatgatgaagggaaacctggcggcagcgcaaaagatg

SEQ ID NO: 31061 - DNA, 103 bp, Artificial Sequence
  Synthetic Polynucleotide
taatacgactcactatagggcattgatagcacgtcccgattgaaatgggtaacagaggagaacccatatgaatcgggacaacctggcggcagcgcaaaagatg

SEQ ID NO: 31062 - DNA, 103 bp, Artificial Sequence
  Synthetic Polynucleotide
taatacgactcactatagggagtctggttatgtcttaccacattaagcacaacagaggagagtgcttatggtggtaagaaacctggcggcagcgcaaaagatg

SEQ ID NO: 31063 - DNA, 103 bp, Artificial Sequence
  Synthetic Polynucleotide
taatacgactcactatagggttcgagtaacggtgtaatagtcttccgacgaacagaggagacgtcggatgactattacaaacctggcggcagcgcaaaagatg

SEQ ID NO: 31064 - DNA, 103 bp, Artificial Sequence
  Synthetic Polynucleotide
taatacgactcactatagggtctgtgtcagcatggggcactactggacctaacagaggagaaggtccatgagtgccccaaacctggcggcagcgcaaaagatg

SEQ ID NO: 31065 - DNA, 103 bp, Artificial Sequence
  Synthetic Polynucleotide
taatacgactcactatagggggaggacgttctacgaaagagcttagtctgaacagaggagacagactatgctctttcgtaacctggcggcagcgcaaaagatg

SEQ ID NO: 31066 - DNA, 103 bp, Artificial Sequence
  Synthetic Polynucleotide
taatacgactcactatagggaattgcgcattacctccgttatactgcatgaacagaggagacatgcaatgtaacggaggaacctggcggcagcgcaaaagatg

SEQ ID NO: 31067 - DNA, 103 bp, Artificial Sequence
  Synthetic Polynucleotide
taatacgactcactataggggtaaggcggctcgtcacttgtgcagcttataacagaggagaataagcatgacaagtgacaacctggcggcagcgcaaaagatg

SEQ ID NO: 31068 - DNA, 103 bp, Artificial Sequence
  Synthetic Polynucleotide
taatacgactcactataggggccgacgcgtgagagctgcagcttgaggcaaacagaggagatgcctcatgctgcagctcaacctggcggcagcgcaaaagatg

SEQ ID NO: 31069 - DNA, 103 bp, Artificial Sequence
  Synthetic Polynucleotide
taatacgactcactatagggggccttacgaaagccaaactctggcccgtcaacagaggagagacgggatggagtttggcaacctggcggcagcgcaaaagatg

SEQ ID NO: 31070 - DNA, 103 bp, Artificial Sequence
  Synthetic Polynucleotide
taatacgactcactatagggggtgtgttgcctaagacgcggacaagaccaaacagaggagatggtctatgccgcgtcttaacctggcggcagcgcaaaagatg

SEQ ID NO: 31071 - DNA, 103 bp, Artificial Sequence
  Synthetic Polynucleotide
taatacgactcactatagggaaatttgctattaatagctatacgatgattaacagaggagaaatcatatgatagctattaacctggcggcagcgcaaaagatg

SEQ ID NO: 31072 - DNA, 103 bp, Artificial Sequence
  Synthetic Polynucleotide
taatacgactcactatagggctgtagacacaagactcccctcgatatgtcaacagaggagagacataatgaggggagtcaacctggcggcagcgcaaaagatg

SEQ ID NO: 31073 - DNA, 103 bp, Artificial Sequence
  Synthetic Polynucleotide
taatacgactcactatagggttgctaggcatgccggctatcgtctgggataacagaggagaatcccaatggatagccggaacctggcggcagcgcaaaagatg

SEQ ID NO: 31074 - DNA, 103 bp, Artificial Sequence
  Synthetic Polynucleotide
taatacgactcactataggggagtttgttctacatgacgatcccactcgtaacagaggagaacgagtatgatcgtcatgaacctggcggcagcgcaaaagatg

SEQ ID NO: 31075 - DNA, 103 bp, Artificial Sequence
  Synthetic Polynucleotide
taatacgactcactatagggtacgacggacgcccgtatatttatatgaccaacagaggagaggtcatatgaatatacggaacctggcggcagcgcaaaagatg

SEQ ID NO: 31076 - DNA, 103 bp, Artificial Sequence
  Synthetic Polynucleotide
taatacgactcactatagggcgttccggacaccgtggacttaagtccaagaacagaggagacttggaatgaagtccacgaacctggcggcagcgcaaaagatg

SEQ ID NO: 31077 - DNA, 103 bp, Artificial Sequence
  Synthetic Polynucleotide
taatacgactcactatagggagacggatacactctaaaagtttgacctctaacagaggagaagaggtatgacttttagaaacctggcggcagcgcaaaagatg

SEQ ID NO: 31078 - DNA, 103 bp, Artificial Sequence
  Synthetic Polynucleotide
taatacgactcactatagggcactgtagatagtacgcgcgcatgtagttcaacagaggagagaactaatggcgcgcgtaaacctggcggcagcgcaaaagatg

SEQ ID NO: 31079 - DNA, 103 bp, Artificial Sequence
  Synthetic Polynucleotide
taatacgactcactatagggaattgaggaacttcaaagccgggtctcgttaacagaggagaaacgagatgcggctttgaaacctggcggcagcgcaaaagatg

SEQ ID NO: 31080 - DNA, 103 bp, Artificial Sequence
  Synthetic Polynucleotide
taatacgactcactatagggggacacactctccatcaaagttaacggcttaacagaggagaaagccgatgactttgatgaacctggcggcagcgcaaaagatg

SEQ ID NO: 31081 - DNA, 103 bp, Artificial Sequence
  Synthetic Polynucleotide
taatacgactcactatagggcggcctcacttaaacacagggccactctacaacagaggagagtagagatgccctgtgttaacctggcggcagcgcaaaagatg

SEQ ID NO: 31082 - DNA, 103 bp, Artificial Sequence
  Synthetic Polynucleotide
taatacgactcactatagggatgtcctatgttagaacgtcagtaaggagtaacagaggagaactcctatgtgacgttctaacctggcggcagcgcaaaagatg

SEQ ID NO: 31083 - DNA, 103 bp, Artificial Sequence
  Synthetic Polynucleotide
taatacgactcactatagggcaagtcagaagagatatagcctacatgccaaacagaggagatggcatatgggctatatcaacctggcggcagcgcaaaagatg

SEQ ID NO: 31084 - DNA, 103 bp, Artificial Sequence
  Synthetic Polynucleotide
taatacgactcactatagggcccctacgcaatcattcgtccgggacttacaacagaggagagtaagtatgggacgaatgaacctggcggcagcgcaaaagatg

SEQ ID NO: 31085 - DNA, 103 bp, Artificial Sequence
  Synthetic Polynucleotide
taatacgactcactataggggagactgtgataggctagcaataagtcgaaaacagaggagattcgacatgttgctagccaacctggcggcagcgcaaaagatg

SEQ ID NO: 31086 - DNA, 103 bp, Artificial Sequence
  Synthetic Polynucleotide
taatacgactcactatagggaagtaagatgtgcgtccatcaaccaatgtgaacagaggagacacattatgtgatggacgaacctggcggcagcgcaaaagatg

SEQ ID NO: 31087 - DNA, 103 bp, Artificial Sequence
  Synthetic Polynucleotide
taatacgactcactataggggagacattaattatacaatgctccttttataacagaggagaataaaaatggcattgtataacctggcggcagcgcaaaagatg

SEQ ID NO: 31088 - DNA, 103 bp, Artificial Sequence
  Synthetic Polynucleotide
taatacgactcactatagggcaatttatcgtacgtgggcagattaactctaacagaggagaagagttatgctgcccacgaacctggcggcagcgcaaaagatg

SEQ ID NO: 31089 - DNA, 103 bp, Artificial Sequence
  Synthetic Polynucleotide
taatacgactcactatagggcgaaggtccgccaagcacgcagatggcggtaacagaggagaaccgccatgtgcgtgcttaacctggcggcagcgcaaaagatg

SEQ ID NO: 31090 - DNA, 103 bp, Artificial Sequence
  Synthetic Polynucleotide
taatacgactcactatagggaggttgtagatgtctcctatccacaacacaaacagaggagatgtgttatggataggagaaacctggcggcagcgcaaaagatg

SEQ ID NO: 31091 - DNA, 103 bp, Artificial Sequence
  Synthetic Polynucleotide
taatacgactcactatagggtccagtaactccatccctacaaggcctcgaaacagaggagatcgaggatgtgtagggataacctggcggcagcgcaaaagatg

SEQ ID NO: 31092 - DNA, 103 bp, Artificial Sequence
  Synthetic Polynucleotide
taatacgactcactataggggagcgatatggacgagagttgaggaacaacaacagaggagagttgttatgcaactctcgaacctggcggcagcgcaaaagatg

SEQ ID NO: 31093 - DNA, 103 bp, Artificial Sequence
  Synthetic Polynucleotide
taatacgactcactataggggaattctgactagtcactgaacacgtatcaaacagaggagatgatacatgttcagtgacaacctggcggcagcgcaaaagatg

SEQ ID NO: 31094 - DNA, 103 bp, Artificial Sequence
  Synthetic Polynucleotide
taatacgactcactatagggttgttcgccaccttaataggggttgcatctaacagaggagaagatgcatgccctattaaaacctggcggcagcgcaaaagatg

SEQ ID NO: 31095 - DNA, 103 bp, Artificial Sequence
  Synthetic Polynucleotide
taatacgactcactatagggtaggcgcgaacccgagatcggcacagtcagaacagaggagactgactatgccgatctcgaacctggcggcagcgcaaaagatg

SEQ ID NO: 31096 - DNA, 103 bp, Artificial Sequence
  Synthetic Polynucleotide
taatacgactcactatagggatacgaagaggatgtccgggagtaattcagaacagaggagactgaatatgtcccggacaaacctggcggcagcgcaaaagatg

SEQ ID NO: 31097 - DNA, 103 bp, Artificial Sequence
  Synthetic Polynucleotide
taatacgactcactataggggcacaaacctaaccactgaaccaagtcagaaacagaggagatctgacatggttcagtggaacctggcggcagcgcaaaagatg

SEQ ID NO: 31098 - DNA, 103 bp, Artificial Sequence
  Synthetic Polynucleotide
taatacgactcactatagggctcaaaggttagtgcttccacagaataggaaacagaggagatcctatatggtggaagcaaacctggcggcagcgcaaaagatg

SEQ ID NO: 31099 - DNA, 103 bp, Artificial Sequence
  Synthetic Polynucleotide
taatacgactcactatagggtgtggacgacgggtggaaccggggaacttcaacagaggagagaagttatgcggttccacaacctggcggcagcgcaaaagatg

SEQ ID NO: 31100 - DNA, 103 bp, Artificial Sequence
  Synthetic Polynucleotide
taatacgactcactatagggttagtctaacgaactcgagaagttacatttaacagaggagaaaatgtatgttctcgagtaacctggcggcagcgcaaaagatg

SEQ ID NO: 31101 - DNA, 103 bp, Artificial Sequence
  Synthetic Polynucleotide
taatacgactcactataggggctaaggtcagatatgagaggcttttatggaacagaggagaccataaatgcctctcataaacctggcggcagcgcaaaagatg

SEQ ID NO: 31102 - DNA, 103 bp, Artificial Sequence
  Synthetic Polynucleotide
taatacgactcactatagggtccgtaattggaatagttaggtgtaaagttaacagaggagaaactttatgcctaactataacctggcggcagcgcaaaagatg

SEQ ID NO: 31103 - DNA, 103 bp, Artificial Sequence
  Synthetic Polynucleotide
taatacgactcactatagggcttaaaatctgttgcggaccagcattggggaacagaggagaccccaaatgtggtccgcaaacctggcggcagcgcaaaagatg

SEQ ID NO: 31104 - DNA, 103 bp, Artificial Sequence
  Synthetic Polynucleotide
taatacgactcactatagggatttcaatgatcacttaggcgagcgcatcaaacagaggagatgatgcatgcgcctaagtaacctggcggcagcgcaaaagatg

SEQ ID NO: 31105 - DNA, 103 bp, Artificial Sequence
  Synthetic Polynucleotide
taatacgactcactatagggaagtttaaaaacggcacatccgggagttctaacagaggagaagaactatgggatgtgccaacctggcggcagcgcaaaagatg

SEQ ID NO: 31106 - DNA, 103 bp, Artificial Sequence
  Synthetic Polynucleotide
taatacgactcactataggggcgttccagccggtaagatcgcgatccgctaacagaggagaagcggaatgcgatcttacaacctggcggcagcgcaaaagatg

SEQ ID NO: 31107 - DNA, 103 bp, Artificial Sequence
  Synthetic Polynucleotide
taatacgactcactatagggtgtaactcgccgatggcgcatgaaacttggaacagaggagaccaagtatgatgcgccataacctggcggcagcgcaaaagatg

SEQ ID NO: 31108 - DNA, 103 bp, Artificial Sequence
  Synthetic Polynucleotide
taatacgactcactataggggatgcgccagcactaccagcttcacctaagaacagaggagacttaggatgagctggtagaacctggcggcagcgcaaaagatg

SEQ ID NO: 31109 - DNA, 103 bp, Artificial Sequence
  Synthetic Polynucleotide
taatacgactcactatagggtcgtggcgggagcctttctatatgattcctaacagaggagaaggaatatgatagaaaggaacctggcggcagcgcaaaagatg

SEQ ID NO: 31110 - DNA, 103 bp, Artificial Sequence
  Synthetic Polynucleotide
taatacgactcactatagggatagcaaacactccagaacatccaatggtcaacagaggagagaccatatgatgttctggaacctggcggcagcgcaaaagatg

SEQ ID NO: 31111 - DNA, 103 bp, Artificial Sequence
  Synthetic Polynucleotide
taatacgactcactataggggttccattggacggattagtgaggacggaaaacagaggagattccgtatgcactaatccaacctggcggcagcgcaaaagatg

SEQ ID NO: 31112 - DNA, 103 bp, Artificial Sequence
  Synthetic Polynucleotide
taatacgactcactataggggccgttgaagcccctccgcactgaaggtcgaacagaggagacgacctatggtgcggaggaacctggcggcagcgcaaaagatg

SEQ ID NO: 31113 - DNA, 103 bp, Artificial Sequence
  Synthetic Polynucleotide
taatacgactcactatagggttatcagtagtcattaatacgggatcactaaacagaggagatagtgaatgcgtattaataacctggcggcagcgcaaaagatg

SEQ ID NO: 31114 - DNA, 103 bp, Artificial Sequence
  Synthetic Polynucleotide
taatacgactcactatagggaactcgaggttatggcgaaaacgaaaagcaaacagaggagatgctttatgttttcgccaaacctggcggcagcgcaaaagatg

SEQ ID NO: 31115 - DNA, 103 bp, Artificial Sequence
  Synthetic Polynucleotide
taatacgactcactatagggcagataaaaaccttagataaggatcggcggaacagaggagaccgccgatgcttatctaaaacctggcggcagcgcaaaagatg

SEQ ID NO: 31116 - DNA, 103 bp, Artificial Sequence
  Synthetic Polynucleotide
taatacgactcactatagggcatggcacaaatactccctcatctttcattaacagaggagaaatgaaatgtgagggagtaacctggcggcagcgcaaaagatg

SEQ ID NO: 31117 - DNA, 103 bp, Artificial Sequence
  Synthetic Polynucleotide
taatacgactcactataggggagccacaccgggacttccgtcgcaggttgaacagaggagacaacctatgacggaagtcaacctggcggcagcgcaaaagatg

SEQ ID NO: 31118 - DNA, 103 bp, Artificial Sequence
  Synthetic Polynucleotide
taatacgactcactatagggatacgcacggaggtatacacgtcagcaaggaacagaggagaccttgcatgcgtgtatacaacctggcggcagcgcaaaagatg

SEQ ID NO: 31119 - DNA, 103 bp, Artificial Sequence
  Synthetic Polynucleotide
taatacgactcactatagggtactgatttgtcgcggcaccatcccaatgtaacagaggagaacattgatgtggtgccgcaacctggcggcagcgcaaaagatg

SEQ ID NO: 31120 - DNA, 103 bp, Artificial Sequence
  Synthetic Polynucleotide
taatacgactcactatagggtggtaaatgcacccacatgatctctgagttaacagaggagaaactcaatgatcatgtggaacctggcggcagcgcaaaagatg

SEQ ID NO: 31121 - DNA, 103 bp, Artificial Sequence
  Synthetic Polynucleotide
taatacgactcactatagggctaggaattcccgactggtaaccattgctgaacagaggagacagcaaatgttaccagtcaacctggcggcagcgcaaaagatg

SEQ ID NO: 31122 - DNA, 103 bp, Artificial Sequence
  Synthetic Polynucleotide
taatacgactcactatagggtcgagagtaaaccatcgggactttacgcataacagaggagaatgcgtatggtcccgatgaacctggcggcagcgcaaaagatg

SEQ ID NO: 31123 - DNA, 103 bp, Artificial Sequence
  Synthetic Polynucleotide
taatacgactcactataggggggatagctcacatctcagcggctcttcaaaacagaggagattgaagatgcgctgagataacctggcggcagcgcaaaagatg

SEQ ID NO: 31124 - DNA, 103 bp, Artificial Sequence
  Synthetic Polynucleotide
taatacgactcactatagggtaggcaatgttaggtaggattacaacttcaaacagaggagatgaagtatgaatcctaccaacctggcggcagcgcaaaagatg

SEQ ID NO: 31125 - DNA, 103 bp, Artificial Sequence
  Synthetic Polynucleotide
taatacgactcactatagggggatagtccgaggcggttgattctaatacaaacagaggagatgtattatgatcaaccgcaacctggcggcagcgcaaaagatg

SEQ ID NO: 31126 - DNA, 103 bp, Artificial Sequence
  Synthetic Polynucleotide
taatacgactcactatagggcactaggcgagaggtgatggatcgtaggctaacagaggagaagcctaatgtccatcaccaacctggcggcagcgcaaaagatg

SEQ ID NO: 31127 - DNA, 103 bp, Artificial Sequence
  Synthetic Polynucleotide
taatacgactcactatagggattagccaaaaggatcctcgattgagctaaaacagaggagattagctatgtcgaggatcaacctggcggcagcgcaaaagatg

SEQ ID NO: 31128 - DNA, 103 bp, Artificial Sequence
  Synthetic Polynucleotide
taatacgactcactatagggtgtcaagcgtagccgggacgctgtagtataaacagaggagatatactatggcgtcccggaacctggcggcagcgcaaaagatg

SEQ ID NO: 31129 - DNA, 103 bp, Artificial Sequence
  Synthetic Polynucleotide
taatacgactcactatagggacagatgtaagttatcgcagacgcccaataaacagaggagatattggatgtctgcgataaacctggcggcagcgcaaaagatg

SEQ ID NO: 31130 - DNA, 103 bp, Artificial Sequence
  Synthetic Polynucleotide
taatacgactcactatagggatacccaacccagaactaggtcttaaaaaaaacagaggagattttttatgacctagttcaacctggcggcagcgcaaaagatg

SEQ ID NO: 31131 - DNA, 103 bp, Artificial Sequence
  Synthetic Polynucleotide
taatacgactcactatagggcatagtgaagttcagcgactgcgatccagcaacagaggagagctggaatgcagtcgctgaacctggcggcagcgcaaaagatg

SEQ ID NO: 31132 - DNA, 103 bp, Artificial Sequence
  Synthetic Polynucleotide
taatacgactcactatagggagcactaacggaactttcgccataatgaggaacagaggagacctcatatgggcgaaagtaacctggcggcagcgcaaaagatg

SEQ ID NO: 31133 - DNA, 103 bp, Artificial Sequence
  Synthetic Polynucleotide
taatacgactcactatagggggatgtcgctcatccccttagtacgccaggaacagaggagacctggcatgctaaggggaaacctggcggcagcgcaaaagatg

SEQ ID NO: 31134 - DNA, 103 bp, Artificial Sequence
  Synthetic Polynucleotide
taatacgactcactatagggtcatctctgcgattagaaattatgtctatcaacagaggagagatagaatgaatttctaaaacctggcggcagcgcaaaagatg

SEQ ID NO: 31135 - DNA, 103 bp, Artificial Sequence
  Synthetic Polynucleotide
taatacgactcactatagggtacggagcgagaagcgagttccccaacttaaacagaggagataagttatggaactcgctaacctggcggcagcgcaaaagatg

SEQ ID NO: 31136 - DNA, 103 bp, Artificial Sequence
  Synthetic Polynucleotide
taatacgactcactatagggagacgtgacccggacataaatgcccggggaaacagaggagatccccgatgatttatgtcaacctggcggcagcgcaaaagatg

SEQ ID NO: 31137 - DNA, 103 bp, Artificial Sequence
  Synthetic Polynucleotide
taatacgactcactatagggagttaacatgtccctactgaaaatcatgcaaacagaggagatgcatgatgttcagtaggaacctggcggcagcgcaaaagatg

SEQ ID NO: 31138 - DNA, 103 bp, Artificial Sequence
  Synthetic Polynucleotide
taatacgactcactatagggtgtcaatattactaagtcgtttggattactaacagaggagaagtaatatgaacgacttaaacctggcggcagcgcaaaagatg

SEQ ID NO: 31139 - DNA, 103 bp, Artificial Sequence
  Synthetic Polynucleotide
taatacgactcactatagggtgattcgtaaggttggtcataagaagtacaaacagaggagatgtactatgtatgaccaaaacctggcggcagcgcaaaagatg

SEQ ID NO: 31140 - DNA, 103 bp, Artificial Sequence
  Synthetic Polynucleotide
taatacgactcactatagggctatgactcttacacagctgaggacgtattaacagaggagaaatacgatgtcagctgtgaacctggcggcagcgcaaaagatg

SEQ ID NO: 31141 - DNA, 103 bp, Artificial Sequence
  Synthetic Polynucleotide
taatacgactcactatagggattgttttaaggtcactatcgctgtcactcaacagaggagagagtgaatgcgatagtgaaacctggcggcagcgcaaaagatg

SEQ ID NO: 31142 - DNA, 103 bp, Artificial Sequence
  Synthetic Polynucleotide
taatacgactcactatagggtactcgaatgccaaccatgcccttcataccaacagaggagaggtatgatgggcatggttaacctggcggcagcgcaaaagatg

SEQ ID NO: 31143 - DNA, 103 bp, Artificial Sequence
  Synthetic Polynucleotide
taatacgactcactatagggtttacaatcttagggaaaactttttacgctaacagaggagaagcgtaatgagttttcccaacctggcggcagcgcaaaagatg

SEQ ID NO: 31144 - DNA, 103 bp, Artificial Sequence
  Synthetic Polynucleotide
taatacgactcactatagggaggtggtttgtgccaaagcaccgcactttcaacagaggagagaaagtatggtgctttggaacctggcggcagcgcaaaagatg

SEQ ID NO: 31145 - DNA, 103 bp, Artificial Sequence
  Synthetic Polynucleotide
taatacgactcactatagggcacgacccatcacccataccacgataataaaacagaggagattattaatgtggtatgggaacctggcggcagcgcaaaagatg

SEQ ID NO: 31146 - DNA, 103 bp, Artificial Sequence
  Synthetic Polynucleotide
taatacgactcactatagggtaagcacgcgtgggccaagtaagagtattcaacagaggagagaatacatgtacttggccaacctggcggcagcgcaaaagatg

SEQ ID NO: 31147 - DNA, 103 bp, Artificial Sequence
  Synthetic Polynucleotide
taatacgactcactatagggagcccacgaatttgattgagctaccgcatcaacagaggagagatgcgatggctcaatcaaacctggcggcagcgcaaaagatg

SEQ ID NO: 31148 - DNA, 103 bp, Artificial Sequence
  Synthetic Polynucleotide
taatacgactcactatagggtagagccgatgtgacgaagaaggacggggcaacagaggagagccccgatgttcttcgtcaacctggcggcagcgcaaaagatg

SEQ ID NO: 31149 - DNA, 103 bp, Artificial Sequence
  Synthetic Polynucleotide
taatacgactcactataggggacgagttaggctcagcgcatcaccgagaaaacagaggagattctcgatgatgcgctgaaacctggcggcagcgcaaaagatg

SEQ ID NO: 31150 - DNA, 103 bp, Artificial Sequence
  Synthetic Polynucleotide
taatacgactcactatagggcagcccctatgcgattgatctgatgaccttaacagaggagaaaggtcatgagatcaatcaacctggcggcagcgcaaaagatg

SEQ ID NO: 31151 - DNA, 103 bp, Artificial Sequence
  Synthetic Polynucleotide
taatacgactcactatagggacacaagagtgtgcgccagttgcaccgcgcaacagaggagagcgcggatgaactggcgcaacctggcggcagcgcaaaagatg

SEQ ID NO: 31152 - DNA, 103 bp, Artificial Sequence
  Synthetic Polynucleotide
taatacgactcactatagggactcgtgatgccccacagatgccggaagggaacagaggagacccttcatgcatctgtggaacctggcggcagcgcaaaagatg

SEQ ID NO: 31153 - DNA, 103 bp, Artificial Sequence
  Synthetic Polynucleotide
taatacgactcactatagggctccatgccggccccttaagagggctgtcgaacagaggagacgacagatgtcttaagggaacctggcggcagcgcaaaagatg

SEQ ID NO: 31154 - DNA, 103 bp, Artificial Sequence
  Synthetic Polynucleotide
taatacgactcactatagggcggacagggtgaccgtttgggatgcgtagcaacagaggagagctacgatgcccaaacggaacctggcggcagcgcaaaagatg

SEQ ID NO: 31155 - DNA, 103 bp, Artificial Sequence
  Synthetic Polynucleotide
taatacgactcactatagggtccggaagctccacaccgcgtgaacgagagaacagaggagactctcgatgacgcggtgtaacctggcggcagcgcaaaagatg

SEQ ID NO: 31156 - DNA, 103 bp, Artificial Sequence
  Synthetic Polynucleotide
taatacgactcactatagggatggaatcccggcctttagctccactgattaacagaggagaaatcagatgagctaaaggaacctggcggcagcgcaaaagatg

SEQ ID NO: 31157 - DNA, 103 bp, Artificial Sequence
  Synthetic Polynucleotide
taatacgactcactatagggggctaggaccccttcttctccttgaagaggaacagaggagacctcttatgggagaagaaaacctggcggcagcgcaaaagatg

SEQ ID NO: 31158 - DNA, 103 bp, Artificial Sequence
  Synthetic Polynucleotide
taatacgactcactatagggggatttgtgaatatgagttcgtaggggtttaacagaggagaaaacccatgcgaactcataacctggcggcagcgcaaaagatg

SEQ ID NO: 31159 - DNA, 103 bp, Artificial Sequence
  Synthetic Polynucleotide
taatacgactcactatagggcaggcctaaggtgacacgcctagatttggaaacagaggagatccaaaatgaggcgtgtcaacctggcggcagcgcaaaagatg

SEQ ID NO: 31160 - DNA, 103 bp, Artificial Sequence
  Synthetic Polynucleotide
taatacgactcactatagggcgcagtttctataatcagatgagatcccgtaacagaggagaacgggaatgcatctgattaacctggcggcagcgcaaaagatg

SEQ ID NO: 31161 - DNA, 103 bp, Artificial Sequence
  Synthetic Polynucleotide
taatacgactcactataggggagagaattcgccagagcaagagtcacaaaaacagaggagatttgtgatgcttgctctgaacctggcggcagcgcaaaagatg

SEQ ID NO: 31162 - DNA, 103 bp, Artificial Sequence
  Synthetic Polynucleotide
taatacgactcactatagggtcactgcttcctttgatttctcctggtgagaacagaggagactcaccatgagaaatcaaaacctggcggcagcgcaaaagatg

SEQ ID NO: 31163 - DNA, 103 bp, Artificial Sequence
  Synthetic Polynucleotide
taatacgactcactatagggcgccacaagcccctggtattgagtagtgaaaacagaggagattcactatgcaataccagaacctggcggcagcgcaaaagatg

SEQ ID NO: 31164 - DNA, 103 bp, Artificial Sequence
  Synthetic Polynucleotide
taatacgactcactatagggttgtctacgactaatctccagtgatgccacaacagaggagagtggcaatgctggagattaacctggcggcagcgcaaaagatg

SEQ ID NO: 31165 - DNA, 103 bp, Artificial Sequence
  Synthetic Polynucleotide
taatacgactcactataggggcgatagtggtcgtgattcgaaccttacctaacagaggagaaggtaaatgtcgaatcacaacctggcggcagcgcaaaagatg

SEQ ID NO: 31166 - DNA, 103 bp, Artificial Sequence
  Synthetic Polynucleotide
taatacgactcactatagggtcggccgtccacccttacagcctcagatggaacagaggagaccatctatggctgtaaggaacctggcggcagcgcaaaagatg

SEQ ID NO: 31167 - DNA, 103 bp, Artificial Sequence
  Synthetic Polynucleotide
taatacgactcactatagggttccaacattagacggaagttaacgctgtgaacagaggagacacagcatgaacttccgtaacctggcggcagcgcaaaagatg

SEQ ID NO: 31168 - DNA, 103 bp, Artificial Sequence
  Synthetic Polynucleotide
taatacgactcactatagggctattcaggtcttactatctcgtatgccgtaacagaggagaacggcaatggagatagtaaacctggcggcagcgcaaaagatg

SEQ ID NO: 31169 - DNA, 103 bp, Artificial Sequence
  Synthetic Polynucleotide
taatacgactcactatagggacaaagttataggacaggctttcactactgaacagaggagacagtagatgaagcctgtcaacctggcggcagcgcaaaagatg

SEQ ID NO: 31170 - DNA, 103 bp, Artificial Sequence
  Synthetic Polynucleotide
taatacgactcactatagggtggactagtaagaggtaggtgtgagacacaaacagaggagatgtgtcatgcacctacctaacctggcggcagcgcaaaagatg

SEQ ID NO: 31171 - DNA, 103 bp, Artificial Sequence
  Synthetic Polynucleotide
taatacgactcactatagggttccctacgacggggcgtcgaatcattcagaacagaggagactgaatatgtcgacgcccaacctggcggcagcgcaaaagatg

SEQ ID NO: 31172 - DNA, 103 bp, Artificial Sequence
  Synthetic Polynucleotide
taatacgactcactatagggaccgcgtactatactacacaaattggcaagaacagaggagacttgccatgttgtgtagtaacctggcggcagcgcaaaagatg

SEQ ID NO: 31173 - DNA, 103 bp, Artificial Sequence
  Synthetic Polynucleotide
taatacgactcactatagggaggtcgatgtttggtaccgaggggcgagaaaacagaggagattctcgatgctcggtaccaacctggcggcagcgcaaaagatg

SEQ ID NO: 31174 - DNA, 103 bp, Artificial Sequence
  Synthetic Polynucleotide
taatacgactcactataggggttgctggccgcccatattatcgtaacgtgaacagaggagacacgttatgataatatggaacctggcggcagcgcaaaagatg

SEQ ID NO: 31175 - DNA, 103 bp, Artificial Sequence
  Synthetic Polynucleotide
taatacgactcactatagggtgaatccagctacatacggtgaatgggaataacagaggagaattcccatgcaccgtatgaacctggcggcagcgcaaaagatg

SEQ ID NO: 31176 - DNA, 103 bp, Artificial Sequence
  Synthetic Polynucleotide
taatacgactcactatagggtgttcttttcaatgctgcaaccggcgatccaacagaggagaggatcgatggttgcagcaaacctggcggcagcgcaaaagatg

SEQ ID NO: 31177 - DNA, 103 bp, Artificial Sequence
  Synthetic Polynucleotide
taatacgactcactatagggaccaattatcccgggcgccacgagcttgggaacagaggagacccaagatggtggcgcccaacctggcggcagcgcaaaagatg

SEQ ID NO: 31178 - DNA, 103 bp, Artificial Sequence
  Synthetic Polynucleotide
taatacgactcactatagggtgggacgctagtaagccgcgcgatcgacttaacagaggagaaagtcgatggcgcggcttaacctggcggcagcgcaaaagatg

SEQ ID NO: 31179 - DNA, 103 bp, Artificial Sequence
  Synthetic Polynucleotide
taatacgactcactatagggcctatggaagtgctctgattctttaaggcgaacagaggagacgccttatggaatcagagaacctggcggcagcgcaaaagatg

SEQ ID NO: 31180 - DNA, 103 bp, Artificial Sequence
  Synthetic Polynucleotide
taatacgactcactatagggcacggcaaaaatagggagcggagagtccttaacagaggagaaaggacatgccgctccctaacctggcggcagcgcaaaagatg

SEQ ID NO: 31181 - DNA, 103 bp, Artificial Sequence
  Synthetic Polynucleotide
taatacgactcactatagggcgacgctcgttctctcggtttaatccactgaacagaggagacagtggatgaaaccgagaaacctggcggcagcgcaaaagatg

SEQ ID NO: 31182 - DNA, 103 bp, Artificial Sequence
  Synthetic Polynucleotide
taatacgactcactatagggcggggcgggccagccaacaagtatcacgttaacagaggagaaacgtgatgcttgttggcaacctggcggcagcgcaaaagatg

SEQ ID NO: 31183 - DNA, 103 bp, Artificial Sequence
  Synthetic Polynucleotide
taatacgactcactatagggacattactcttgctaagtagccgaactataaacagaggagatatagtatggctacttagaacctggcggcagcgcaaaagatg

SEQ ID NO: 31184 - DNA, 103 bp, Artificial Sequence
  Synthetic Polynucleotide
taatacgactcactatagggaaccgacggttgatagccgaaacgcgctccaacagaggagaggagcgatgttcggctataacctggcggcagcgcaaaagatg

SEQ ID NO: 31185 - DNA, 103 bp, Artificial Sequence
  Synthetic Polynucleotide
taatacgactcactatagggcactgtcacgcctctaaagagcaagataataacagaggagaattatcatgctctttagaaacctggcggcagcgcaaaagatg

SEQ ID NO: 31186 - DNA, 103 bp, Artificial Sequence
  Synthetic Polynucleotide
taatacgactcactataggggtgagtgcagctgtaatgtaggcgcgtcgaaacagaggagatcgacgatgctacattacaacctggcggcagcgcaaaagatg

SEQ ID NO: 31187 - DNA, 103 bp, Artificial Sequence
  Synthetic Polynucleotide
taatacgactcactatagggacttgggctggtttaaacatggccccccccaacagaggagaggggggatgcatgtttaaaacctggcggcagcgcaaaagatg

SEQ ID NO: 31188 - DNA, 103 bp, Artificial Sequence
  Synthetic Polynucleotide
taatacgactcactataggggaccagcagtcaccgccccgggtcgacactaacagaggagaagtgtcatgccggggcggaacctggcggcagcgcaaaagatg

SEQ ID NO: 31189 - DNA, 103 bp, Artificial Sequence
  Synthetic Polynucleotide
taatacgactcactatagggattccgtcagaccaatagtggctgagtcgtaacagaggagaacgactatgccactattgaacctggcggcagcgcaaaagatg

SEQ ID NO: 31190 - DNA, 103 bp, Artificial Sequence
  Synthetic Polynucleotide
taatacgactcactatagggttggctcggaacggtgtaggacatacgatgaacagaggagacatcgtatgtcctacaccaacctggcggcagcgcaaaagatg

SEQ ID NO: 31191 - DNA, 103 bp, Artificial Sequence
  Synthetic Polynucleotide
taatacgactcactatagggtgggtgggctacccgctaaccggtcgtgagaacagaggagactcacgatgggttagcggaacctggcggcagcgcaaaagatg

SEQ ID NO: 31192 - DNA, 103 bp, Artificial Sequence
  Synthetic Polynucleotide
taatacgactcactatagggcgttttctgccgacaattcgaccgtccgcaaacagaggagatgcggaatgtcgaattgtaacctggcggcagcgcaaaagatg

SEQ ID NO: 31193 - DNA, 103 bp, Artificial Sequence
  Synthetic Polynucleotide
taatacgactcactatagggccggagatttactgtataaccgagttaagcaacagaggagagcttaaatgggttatacaaacctggcggcagcgcaaaagatg

SEQ ID NO: 31194 - DNA, 103 bp, Artificial Sequence
  Synthetic Polynucleotide
taatacgactcactatagggccacagcaatccacctggcggctaaggtggaacagaggagaccacctatgccgccaggtaacctggcggcagcgcaaaagatg

SEQ ID NO: 31195 - DNA, 103 bp, Artificial Sequence
  Synthetic Polynucleotide
taatacgactcactataggggacactaagattggaagatgataaacggagaacagaggagactccgtatgtcatcttccaacctggcggcagcgcaaaagatg

SEQ ID NO: 31196 - DNA, 103 bp, Artificial Sequence
  Synthetic Polynucleotide
taatacgactcactataggggccaacaccctaattcaggagaccggagataacagaggagaatctccatgctcctgaataacctggcggcagcgcaaaagatg

SEQ ID NO: 31197 - DNA, 103 bp, Artificial Sequence
  Synthetic Polynucleotide
taatacgactcactatagggaaccttaaggcccacattccgataccctacaacagaggagagtagggatgcggaatgtgaacctggcggcagcgcaaaagatg

SEQ ID NO: 31198 - DNA, 103 bp, Artificial Sequence
  Synthetic Polynucleotide
taatacgactcactatagggtggctcaatggtctgcttggtataagattaaacagaggagataatctatgaccaagcagaacctggcggcagcgcaaaagatg

SEQ ID NO: 31199 - DNA, 103 bp, Artificial Sequence
  Synthetic Polynucleotide
taatacgactcactatagggacacccgtggatagggttttgttccagccaaacagaggagatggctgatgcaaaaccctaacctggcggcagcgcaaaagatg

SEQ ID NO: 31200 - DNA, 103 bp, Artificial Sequence
  Synthetic Polynucleotide
taatacgactcactatagggagtcccaagatccccagacttcgtggcataaacagaggagatatgccatgaagtctgggaacctggcggcagcgcaaaagatg

SEQ ID NO: 31201 - DNA, 103 bp, Artificial Sequence
  Synthetic Polynucleotide
taatacgactcactatagggccagtattcattatagaattaaccaccatgaacagaggagacatggtatgtaattctataacctggcggcagcgcaaaagatg

SEQ ID NO: 31202 - DNA, 103 bp, Artificial Sequence
  Synthetic Polynucleotide
taatacgactcactatagggccggggtgggtagacgagtggagcgtagccaacagaggagaggctacatgccactcgtcaacctggcggcagcgcaaaagatg

SEQ ID NO: 31203 - DNA, 103 bp, Artificial Sequence
  Synthetic Polynucleotide
taatacgactcactatagggagggcgctaatcgtacatcagggcattgttaacagaggagaaacaatatgctgatgtacaacctggcggcagcgcaaaagatg

SEQ ID NO: 31204 - DNA, 103 bp, Artificial Sequence
  Synthetic Polynucleotide
taatacgactcactatagggaactcgccgcccgaatccacgcgttgattcaacagaggagagaatcaatgcgtggattcaacctggcggcagcgcaaaagatg

SEQ ID NO: 31205 - DNA, 103 bp, Artificial Sequence
  Synthetic Polynucleotide
taatacgactcactatagggtatgggttgacgcacctcttcgagggctacaacagaggagagtagccatggaagaggtgaacctggcggcagcgcaaaagatg

SEQ ID NO: 31206 - DNA, 103 bp, Artificial Sequence
  Synthetic Polynucleotide
taatacgactcactatagggtctgtccgggctgatgtacgtaggttcgccaacagaggagaggcgaaatgacgtacatcaacctggcggcagcgcaaaagatg

SEQ ID NO: 31207 - DNA, 103 bp, Artificial Sequence
  Synthetic Polynucleotide
taatacgactcactatagggagacaatctgccgttaggataaattagcataacagaggagaatgctaatgtatcctaacaacctggcggcagcgcaaaagatg

SEQ ID NO: 31208 - DNA, 103 bp, Artificial Sequence
  Synthetic Polynucleotide
taatacgactcactatagggttgtcgtggggttccactatcggtttcgtcaacagaggagagacgaaatggatagtggaaacctggcggcagcgcaaaagatg

SEQ ID NO: 31209 - DNA, 103 bp, Artificial Sequence
  Synthetic Polynucleotide
taatacgactcactatagggacgaaaaacggaagctagtaagcacgacggaacagaggagaccgtcgatgttactagctaacctggcggcagcgcaaaagatg

SEQ ID NO: 31210 - DNA, 103 bp, Artificial Sequence
  Synthetic Polynucleotide
taatacgactcactatagggcggcagggcgcgatattgaattcgaaactcaacagaggagagagtttatgattcaatataacctggcggcagcgcaaaagatg

SEQ ID NO: 31211 - DNA, 103 bp, Artificial Sequence
  Synthetic Polynucleotide
taatacgactcactataggggctcgagcaaactgcatataaggtactaataacagaggagaattagtatgttatatgcaaacctggcggcagcgcaaaagatg

SEQ ID NO: 31212 - DNA, 103 bp, Artificial Sequence
  Synthetic Polynucleotide
taatacgactcactatagggctaagtcatgtacgggtgttagccttggtaaacagaggagataccaaatgtaacacccgaacctggcggcagcgcaaaagatg

SEQ ID NO: 31213 - DNA, 103 bp, Artificial Sequence
  Synthetic Polynucleotide
taatacgactcactataggggctttggatttcattgtcggacttggattgaacagaggagacaatccatgtccgacaataacctggcggcagcgcaaaagatg

SEQ ID NO: 31214 - DNA, 103 bp, Artificial Sequence
  Synthetic Polynucleotide
taatacgactcactatagggattgccacaggaccgcgacgctggcgtacgaacagaggagacgtacgatggcgtcgcggaacctggcggcagcgcaaaagatg

SEQ ID NO: 31215 - DNA, 103 bp, Artificial Sequence
  Synthetic Polynucleotide
taatacgactcactataggggactggcgcggaggcatgctaagacccagtaacagaggagaactgggatgtagcatgccaacctggcggcagcgcaaaagatg

SEQ ID NO: 31216 - DNA, 103 bp, Artificial Sequence
  Synthetic Polynucleotide
taatacgactcactatagggggtgaggatatccgggcgtagaagccaagtaacagaggagaacttggatgctacgcccgaacctggcggcagcgcaaaagatg

SEQ ID NO: 31217 - DNA, 103 bp, Artificial Sequence
  Synthetic Polynucleotide
taatacgactcactatagggatgtgaccacaccgattactcacgaaaccaaacagaggagatggtttatggagtaatcgaacctggcggcagcgcaaaagatg

SEQ ID NO: 31218 - DNA, 103 bp, Artificial Sequence
  Synthetic Polynucleotide
taatacgactcactatagggatgcagaaaatgggtgcttcacccggtctgaacagaggagacagaccatgtgaagcaccaacctggcggcagcgcaaaagatg

SEQ ID NO: 31219 - DNA, 103 bp, Artificial Sequence
  Synthetic Polynucleotide
taatacgactcactataggggcattctacgttgcggaatgttcagacatgaacagaggagacatgtcatgacattccgcaacctggcggcagcgcaaaagatg

SEQ ID NO: 31220 - DNA, 103 bp, Artificial Sequence
  Synthetic Polynucleotide
taatacgactcactatagggtgtgagcttactgcagtggggtgagacgcgaacagaggagacgcgtcatgccccactgcaacctggcggcagcgcaaaagatg

SEQ ID NO: 31221 - DNA, 103 bp, Artificial Sequence
  Synthetic Polynucleotide
taatacgactcactatagggctcttccagctttattaggattgtaaatacaacagaggagagtatttatgatcctaataaacctggcggcagcgcaaaagatg

SEQ ID NO: 31222 - DNA, 103 bp, Artificial Sequence
  Synthetic Polynucleotide
taatacgactcactatagggtccgctcttcaagaaagccttaaaacgccgaacagaggagacggcgtatgaaggctttcaacctggcggcagcgcaaaagatg

SEQ ID NO: 31223 - DNA, 103 bp, Artificial Sequence
  Synthetic Polynucleotide
taatacgactcactatagggtcagccatgggctgtgctctgataatcaagaacagaggagacttgatatgcagagcacaaacctggcggcagcgcaaaagatg

SEQ ID NO: 31224 - DNA, 103 bp, Artificial Sequence
  Synthetic Polynucleotide
taatacgactcactatagggcgatagaatcagttttatcaaagcaaaagaaacagaggagatcttttatgttgataaaaaacctggcggcagcgcaaaagatg

SEQ ID NO: 31225 - DNA, 103 bp, Artificial Sequence
  Synthetic Polynucleotide
taatacgactcactatagggaggtatgtgttcgacattgttcgtttatacaacagaggagagtataaatgaacaatgtcaacctggcggcagcgcaaaagatg

SEQ ID NO: 31226 - DNA, 103 bp, Artificial Sequence
  Synthetic Polynucleotide
taatacgactcactatagggaaataccattatattcggagtagataaattaacagaggagaaatttaatgactccgaataacctggcggcagcgcaaaagatg

SEQ ID NO: 31227 - DNA, 103 bp, Artificial Sequence
  Synthetic Polynucleotide
taatacgactcactatagggggatggtgactcctctaaatagagatttcaaacagaggagatgaaatatgtatttagagaacctggcggcagcgcaaaagatg

SEQ ID NO: 31228 - DNA, 103 bp, Artificial Sequence
  Synthetic Polynucleotide
taatacgactcactatagggttttcgaggatactctcgatccgatgtacgaacagaggagacgtacaatggatcgagagaacctggcggcagcgcaaaagatg

SEQ ID NO: 31229 - DNA, 103 bp, Artificial Sequence
  Synthetic Polynucleotide
taatacgactcactatagggatgtactccggggtgctcccccaaagtgcaaacagaggagatgcactatgggggagcacaacctggcggcagcgcaaaagatg

SEQ ID NO: 31230 - DNA, 103 bp, Artificial Sequence
  Synthetic Polynucleotide
taatacgactcactataggggatgtagtctgggcagacagttcagcaagtaacagaggagaacttgcatgactgtctgcaacctggcggcagcgcaaaagatg

SEQ ID NO: 31231 - DNA, 103 bp, Artificial Sequence
  Synthetic Polynucleotide
taatacgactcactataggggaatcacgttcgcacgtacgactgagatttaacagaggagaaaatctatgtcgtacgtgaacctggcggcagcgcaaaagatg

SEQ ID NO: 31232 - DNA, 103 bp, Artificial Sequence
  Synthetic Polynucleotide
taatacgactcactatagggacatccatttctgtacatcaaaagagaacaaacagaggagatgttctatgttgatgtacaacctggcggcagcgcaaaagatg

SEQ ID NO: 31233 - DNA, 103 bp, Artificial Sequence
  Synthetic Polynucleotide
taatacgactcactatagggcagtcggctcctcgtaatcggcgcaatataaacagaggagatatattatgccgattacgaacctggcggcagcgcaaaagatg

SEQ ID NO: 31234 - DNA, 103 bp, Artificial Sequence
  Synthetic Polynucleotide
taatacgactcactatagggatgcatccttttgcctattaaggactcgcgaacagaggagacgcgagatgttaataggcaacctggcggcagcgcaaaagatg

SEQ ID NO: 31235 - DNA, 103 bp, Artificial Sequence
  Synthetic Polynucleotide
taatacgactcactatagggcaactatggggacctgcggctgcatgtatgaacagaggagacatacaatgagccgcaggaacctggcggcagcgcaaaagatg

SEQ ID NO: 31236 - DNA, 103 bp, Artificial Sequence
  Synthetic Polynucleotide
taatacgactcactatagggaagagtttcagaggcacgcatggcacgccgaacagaggagacggcgtatgatgcgtgccaacctggcggcagcgcaaaagatg

SEQ ID NO: 31237 - DNA, 103 bp, Artificial Sequence
  Synthetic Polynucleotide
taatacgactcactataggggttatcattgatacaaatgcatcagacaacaacagaggagagttgtcatgtgcatttgtaacctggcggcagcgcaaaagatg

SEQ ID NO: 31238 - DNA, 103 bp, Artificial Sequence
  Synthetic Polynucleotide
taatacgactcactatagggaaggtgtctagtttatggtattgctcaggtaacagaggagaacctgaatgataccataaaacctggcggcagcgcaaaagatg

SEQ ID NO: 31239 - DNA, 103 bp, Artificial Sequence
  Synthetic Polynucleotide
taatacgactcactatagggcaccattgctgtgacctactgatacggaacaacagaggagagttccgatgcagtaggtcaacctggcggcagcgcaaaagatg

SEQ ID NO: 31240 - DNA, 103 bp, Artificial Sequence
  Synthetic Polynucleotide
taatacgactcactatagggccgtgggctgacacgatggtgggaggctccaacagaggagaggagccatgcaccatcgtaacctggcggcagcgcaaaagatg

SEQ ID NO: 31241 - DNA, 103 bp, Artificial Sequence
  Synthetic Polynucleotide
taatacgactcactatagggcgaatgctttccgttaattaagtatttaggaacagaggagacctaaaatgttaattaacaacctggcggcagcgcaaaagatg

SEQ ID NO: 31242 - DNA, 103 bp, Artificial Sequence
  Synthetic Polynucleotide
taatacgactcactatagggcgtgccagattggtgcatccgataccgggcaacagaggagagcccggatgcggatgcacaacctggcggcagcgcaaaagatg

SEQ ID NO: 31243 - DNA, 103 bp, Artificial Sequence
  Synthetic Polynucleotide
taatacgactcactatagggcatgcggggacgtacaactactcagatcgaaacagaggagatcgatcatggtagttgtaaacctggcggcagcgcaaaagatg

SEQ ID NO: 31244 - DNA, 103 bp, Artificial Sequence
  Synthetic Polynucleotide
taatacgactcactatagggtcttatggcgtgagaatttcttagtctcgcaacagaggagagcgagaatgagaaattctaacctggcggcagcgcaaaagatg

SEQ ID NO: 31245 - DNA, 103 bp, Artificial Sequence
  Synthetic Polynucleotide
taatacgactcactataggggacgcctcacggtacaataatcgtagtggtaacagaggagaaccactatgattattgtaaacctggcggcagcgcaaaagatg

SEQ ID NO: 31246 - DNA, 103 bp, Artificial Sequence
  Synthetic Polynucleotide
taatacgactcactataggggagttacaccaataaacagtgtcgggacctaacagaggagaaggtccatgcactgtttaaacctggcggcagcgcaaaagatg

SEQ ID NO: 31247 - DNA, 103 bp, Artificial Sequence
  Synthetic Polynucleotide
taatacgactcactatagggaagcgggctaatacggatagttgggatttgaacagaggagacaaatcatgactatccgtaacctggcggcagcgcaaaagatg

SEQ ID NO: 31248 - DNA, 103 bp, Artificial Sequence
  Synthetic Polynucleotide
taatacgactcactatagggccttgcgtgaagtttccgcgcaatccgaacaacagaggagagttcggatggcgcggaaaaacctggcggcagcgcaaaagatg

SEQ ID NO: 31249 - DNA, 103 bp, Artificial Sequence
  Synthetic Polynucleotide
taatacgactcactatagggtagcaaacatggggccgacaagcgatcctcaacagaggagagaggatatgttgtcggccaacctggcggcagcgcaaaagatg

SEQ ID NO: 31250 - DNA, 103 bp, Artificial Sequence
  Synthetic Polynucleotide
taatacgactcactatagggattccagtcactatagacgataccttggttaacagaggagaaaccaaatgatcgtctataacctggcggcagcgcaaaagatg

SEQ ID NO: 31251 - DNA, 103 bp, Artificial Sequence
  Synthetic Polynucleotide
taatacgactcactataggggtatgacagttcacgttgcgacttcacgaaaacagaggagattcgtgatgtcgcaacgtaacctggcggcagcgcaaaagatg

SEQ ID NO: 31252 - DNA, 103 bp, Artificial Sequence
  Synthetic Polynucleotide
taatacgactcactatagggatcgacggtctacacttattgatatgacagaacagaggagactgtcaatgcaataagtgaacctggcggcagcgcaaaagatg

SEQ ID NO: 31253 - DNA, 103 bp, Artificial Sequence
  Synthetic Polynucleotide
taatacgactcactatagggcatgctagagagatcacgttactcaaaagtaacagaggagaacttttatgtaacgtgataacctggcggcagcgcaaaagatg

SEQ ID NO: 31254 - DNA, 103 bp, Artificial Sequence
  Synthetic Polynucleotide
taatacgactcactatagggaattacccccgcttacaccgtgaagcgatcaacagaggagagatcgcatgacggtgtaaaacctggcggcagcgcaaaagatg

SEQ ID NO: 31255 - DNA, 103 bp, Artificial Sequence
  Synthetic Polynucleotide
taatacgactcactatagggccagaccagtaacggggcatctctaactgaaacagaggagatcagttatggatgccccgaacctggcggcagcgcaaaagatg

SEQ ID NO: 31256 - DNA, 103 bp, Artificial Sequence
  Synthetic Polynucleotide
taatacgactcactatagggtatacactagttaaccgtgtacgttgattcaacagaggagagaatcaatgtacacggttaacctggcggcagcgcaaaagatg

SEQ ID NO: 31257 - DNA, 103 bp, Artificial Sequence
  Synthetic Polynucleotide
taatacgactcactatagggggcctgctgcttcaactcaaaggccatgttaacagaggagaaacatgatgtttgagttgaacctggcggcagcgcaaaagatg

SEQ ID NO: 31258 - DNA, 103 bp, Artificial Sequence
  Synthetic Polynucleotide
taatacgactcactatagggtcatgaaagcgatccaacagtcgcactaaaaacagaggagatttagtatgactgttggaaacctggcggcagcgcaaaagatg

SEQ ID NO: 31259 - DNA, 103 bp, Artificial Sequence
  Synthetic Polynucleotide
taatacgactcactatagggcaattttgcccctgaaggccttcgcggactaacagaggagaagtccgatgaggccttcaaacctggcggcagcgcaaaagatg

SEQ ID NO: 31260 - DNA, 103 bp, Artificial Sequence
  Synthetic Polynucleotide
taatacgactcactatagggaccaacagtgcttggcctcttgcgactaagaacagaggagacttagtatgaagaggccaaacctggcggcagcgcaaaagatg

SEQ ID NO: 31261 - DNA, 103 bp, Artificial Sequence
  Synthetic Polynucleotide
taatacgactcactatagggtgagctcctaacgcttcaccgcatgatgccaacagaggagaggcatcatgcggtgaagcaacctggcggcagcgcaaaagatg

SEQ ID NO: 31262 - DNA, 103 bp, Artificial Sequence
  Synthetic Polynucleotide
taatacgactcactataggggctcgacagcccgaagtccgggtgccgcacaacagaggagagtgcggatgccggacttcaacctggcggcagcgcaaaagatg

SEQ ID NO: 31263 - DNA, 103 bp, Artificial Sequence
  Synthetic Polynucleotide
taatacgactcactatagggacgaccaggagacgactacgatttcctgagaacagaggagactcaggatgtcgtagtcgaacctggcggcagcgcaaaagatg

SEQ ID NO: 31264 - DNA, 103 bp, Artificial Sequence
  Synthetic Polynucleotide
taatacgactcactataggggctatgccaggaccatagagtccggactcgaacagaggagacgagtcatgactctatggaacctggcggcagcgcaaaagatg

SEQ ID NO: 31265 - DNA, 103 bp, Artificial Sequence
  Synthetic Polynucleotide
taatacgactcactataggggtcacggccaatatttcggctgctagttcgaacagaggagacgaactatgagccgaaataacctggcggcagcgcaaaagatg

SEQ ID NO: 31266 - DNA, 103 bp, Artificial Sequence
  Synthetic Polynucleotide
taatacgactcactatagggcttttatcatcgccaaactctcttccaccgaacagaggagacggtggatgagagtttggaacctggcggcagcgcaaaagatg

SEQ ID NO: 31267 - DNA, 103 bp, Artificial Sequence
  Synthetic Polynucleotide
taatacgactcactatagggctcggtccgtggcgagactgactaactatgaacagaggagacatagtatgtcagtctcgaacctggcggcagcgcaaaagatg

SEQ ID NO: 31268 - DNA, 103 bp, Artificial Sequence
  Synthetic Polynucleotide
taatacgactcactatagggtacagccaaggttgctccccagaaaaggccaacagaggagaggccttatgtggggagcaaacctggcggcagcgcaaaagatg

SEQ ID NO: 31269 - DNA, 103 bp, Artificial Sequence
  Synthetic Polynucleotide
taatacgactcactatagggctgcgtcagggggcatgctcaatgaatactaacagaggagaagtattatgtgagcatgcaacctggcggcagcgcaaaagatg

SEQ ID NO: 31270 - DNA, 103 bp, Artificial Sequence
  Synthetic Polynucleotide
taatacgactcactatagggaaggttggcgccgcacatccacgccttttaaacagaggagataaaagatgtggatgtgcaacctggcggcagcgcaaaagatg

SEQ ID NO: 31271 - DNA, 103 bp, Artificial Sequence
  Synthetic Polynucleotide
taatacgactcactatagggtcagcggtcttcaagcagcgtgctgctcgaaacagaggagatcgagcatgacgctgcttaacctggcggcagcgcaaaagatg

SEQ ID NO: 31272 - DNA, 103 bp, Artificial Sequence
  Synthetic Polynucleotide
taatacgactcactataggggtcgagctcgagctatcgatgattgtttagaacagaggagactaaacatgcatcgatagaacctggcggcagcgcaaaagatg

SEQ ID NO: 31273 - DNA, 103 bp, Artificial Sequence
  Synthetic Polynucleotide
taatacgactcactatagggggtctgggatctgacgggagagccacgaccaacagaggagaggtcgtatgtctcccgtcaacctggcggcagcgcaaaagatg

SEQ ID NO: 31274 - DNA, 103 bp, Artificial Sequence
  Synthetic Polynucleotide
taatacgactcactataggggttcctgagtaagtttacggattttatataaacagaggagatatataatgtccgtaaacaacctggcggcagcgcaaaagatg

SEQ ID NO: 31275 - DNA, 103 bp, Artificial Sequence
  Synthetic Polynucleotide
taatacgactcactatagggatactactacacattacattcacgaagaataacagaggagaattcttatggaatgtaataacctggcggcagcgcaaaagatg

SEQ ID NO: 31276 - DNA, 103 bp, Artificial Sequence
  Synthetic Polynucleotide
taatacgactcactataggggactaaacgctgaataatccaggactgaagaacagaggagacttcagatgtggattattaacctggcggcagcgcaaaagatg

SEQ ID NO: 31277 - DNA, 103 bp, Artificial Sequence
  Synthetic Polynucleotide
taatacgactcactatagggtaacctcccgaaaggtctatggcccccagaaacagaggagatctgggatgcatagacctaacctggcggcagcgcaaaagatg

SEQ ID NO: 31278 - DNA, 103 bp, Artificial Sequence
  Synthetic Polynucleotide
taatacgactcactatagggcttggtaccggataataagatgggtgaaataacagaggagaatttcaatgatcttattaaacctggcggcagcgcaaaagatg

SEQ ID NO: 31279 - DNA, 103 bp, Artificial Sequence
  Synthetic Polynucleotide
taatacgactcactatagggaatacacaatcgtatcagccgcgcccaattaacagaggagaaattggatgcggctgataaacctggcggcagcgcaaaagatg

SEQ ID NO: 31280 - DNA, 103 bp, Artificial Sequence
  Synthetic Polynucleotide
taatacgactcactataggggatgaatctcgacaatacctctcgaatgtcaacagaggagagacattatggaggtattgaacctggcggcagcgcaaaagatg

SEQ ID NO: 31281 - DNA, 103 bp, Artificial Sequence
  Synthetic Polynucleotide
taatacgactcactatagggtaacacctgtcgggtccgccgttcgggcccaacagaggagagggcccatgcggcggaccaacctggcggcagcgcaaaagatg

SEQ ID NO: 31282 - DNA, 103 bp, Artificial Sequence
  Synthetic Polynucleotide
taatacgactcactatagggggagatgtacaatgtgcgcggtgtaaggtaaacagaggagataccttatgccgcgcacaaacctggcggcagcgcaaaagatg

SEQ ID NO: 31283 - DNA, 103 bp, Artificial Sequence
  Synthetic Polynucleotide
taatacgactcactatagggatactaggccgagcctctaccgttaggaaaaacagaggagatttcctatgggtagaggcaacctggcggcagcgcaaaagatg

SEQ ID NO: 31284 - DNA, 103 bp, Artificial Sequence
  Synthetic Polynucleotide
taatacgactcactatagggtgagttgctggctgtttgtgcactaggatgaacagaggagacatcctatggcacaaacaaacctggcggcagcgcaaaagatg

SEQ ID NO: 31285 - DNA, 103 bp, Artificial Sequence
  Synthetic Polynucleotide
taatacgactcactataggggaagtggggggccccaagtccataatacagaacagaggagactgtatatgggacttgggaacctggcggcagcgcaaaagatg

SEQ ID NO: 31286 - DNA, 103 bp, Artificial Sequence
  Synthetic Polynucleotide
taatacgactcactatagggggtctctctagctgataacacttggtgcttaacagaggagaaagcacatggtgttatcaaacctggcggcagcgcaaaagatg

SEQ ID NO: 31287 - DNA, 103 bp, Artificial Sequence
  Synthetic Polynucleotide
taatacgactcactataggggggaggttttggctttgcgagggttatcacaacagaggagagtgataatgctcgcaaagaacctggcggcagcgcaaaagatg

SEQ ID NO: 31288 - DNA, 103 bp, Artificial Sequence
  Synthetic Polynucleotide
taatacgactcactatagggaattttctataacatcttctctagtgacagaacagaggagactgtcaatggagaagatgaacctggcggcagcgcaaaagatg

SEQ ID NO: 31289 - DNA, 103 bp, Artificial Sequence
  Synthetic Polynucleotide
taatacgactcactatagggaaacgcgcgagcgagcaaaaatttttcctgaacagaggagacaggaaatgtttttgctcaacctggcggcagcgcaaaagatg

SEQ ID NO: 31290 - DNA, 103 bp, Artificial Sequence
  Synthetic Polynucleotide
taatacgactcactatagggacactatgtcatgttgcaactcatggacccaacagaggagagggtccatgagttgcaacaacctggcggcagcgcaaaagatg

SEQ ID NO: 31291 - DNA, 103 bp, Artificial Sequence
  Synthetic Polynucleotide
taatacgactcactataggggaggtcacatgaataagtgaaagtttacgcaacagaggagagcgtaaatgttcacttataacctggcggcagcgcaaaagatg

SEQ ID NO: 31292 - DNA, 103 bp, Artificial Sequence
  Synthetic Polynucleotide
taatacgactcactatagggctttgttatacagcgcatgcgcatactctcaacagaggagagagagtatgcgcatgcgcaacctggcggcagcgcaaaagatg

SEQ ID NO: 31293 - DNA, 103 bp, Artificial Sequence
  Synthetic Polynucleotide
taatacgactcactatagggtaccccaagctgttctggttcaggcggatgaacagaggagacatccgatggaaccagaaaacctggcggcagcgcaaaagatg

SEQ ID NO: 31294 - DNA, 103 bp, Artificial Sequence
  Synthetic Polynucleotide
taatacgactcactatagggtggtccagtgaccggggacacagcgatagaaacagaggagatctatcatggtgtccccgaacctggcggcagcgcaaaagatg

SEQ ID NO: 31295 - DNA, 103 bp, Artificial Sequence
  Synthetic Polynucleotide
taatacgactcactatagggacctttagagcccgagccagtcagcatcaaaacagaggagattgatgatgactggctcgaacctggcggcagcgcaaaagatg

SEQ ID NO: 31296 - DNA, 103 bp, Artificial Sequence
  Synthetic Polynucleotide
taatacgactcactatagggtcgactcatctagacagactcgatagtcgcaacagaggagagcgactatggagtctgtcaacctggcggcagcgcaaaagatg

SEQ ID NO: 31297 - DNA, 103 bp, Artificial Sequence
  Synthetic Polynucleotide
taatacgactcactatagggacaagacgaatgacacgacatgataagtcaaacagaggagatgacttatgatgtcgtgtaacctggcggcagcgcaaaagatg

SEQ ID NO: 31298 - DNA, 103 bp, Artificial Sequence
  Synthetic Polynucleotide
taatacgactcactatagggtagttgggaggtctctcgtagacagcgataaacagaggagatatcgcatgctacgagagaacctggcggcagcgcaaaagatg

SEQ ID NO: 31299 - DNA, 103 bp, Artificial Sequence
  Synthetic Polynucleotide
taatacgactcactatagggctccgagtatctctgacggtggatcatatcaacagaggagagatatgatgcaccgtcagaacctggcggcagcgcaaaagatg

SEQ ID NO: 31300 - DNA, 103 bp, Artificial Sequence
  Synthetic Polynucleotide
taatacgactcactatagggttgccagcgtaggcacgtgaatgtgaagagaacagaggagactcttcatgttcacgtgcaacctggcggcagcgcaaaagatg

SEQ ID NO: 31301 - DNA, 103 bp, Artificial Sequence
  Synthetic Polynucleotide
taatacgactcactataggggtgcgtccgcctcgatgccggggcgaccataacagaggagaatggtcatgccggcatcgaacctggcggcagcgcaaaagatg

SEQ ID NO: 31302 - DNA, 103 bp, Artificial Sequence
  Synthetic Polynucleotide
taatacgactcactatagggtgtatacttcctttagcatcatcctgcatgaacagaggagacatgcaatgtgatgctaaaacctggcggcagcgcaaaagatg

SEQ ID NO: 31303 - DNA, 103 bp, Artificial Sequence
  Synthetic Polynucleotide
taatacgactcactatagggcccgccgggttcgccttcatgggcagcattaacagaggagaaatgctatgcatgaaggcaacctggcggcagcgcaaaagatg

SEQ ID NO: 31304 - DNA, 103 bp, Artificial Sequence
  Synthetic Polynucleotide
taatacgactcactatagggtcacatgtgcgcggcgctgagcctgtggtaaacagaggagataccacatgctcagcgccaacctggcggcagcgcaaaagatg

SEQ ID NO: 31305 - DNA, 103 bp, Artificial Sequence
  Synthetic Polynucleotide
taatacgactcactatagggaggacaaaccagactatatgcggaacacagaacagaggagactgtgtatggcatatagtaacctggcggcagcgcaaaagatg

SEQ ID NO: 31306 - DNA, 103 bp, Artificial Sequence
  Synthetic Polynucleotide
taatacgactcactatagggcttactagcgagaggtttcatgtgtccttaaacagaggagataaggaatgatgaaacctaacctggcggcagcgcaaaagatg

SEQ ID NO: 31307 - DNA, 103 bp, Artificial Sequence
  Synthetic Polynucleotide
taatacgactcactataggggagggaggggtcaaagggaattggggtaccaacagaggagaggtaccatgattccctttaacctggcggcagcgcaaaagatg

SEQ ID NO: 31308 - DNA, 103 bp, Artificial Sequence
  Synthetic Polynucleotide
taatacgactcactatagggcgagattttggcgagggggccggttcccctaacagaggagaaggggaatgggccccctcaacctggcggcagcgcaaaagatg

SEQ ID NO: 31309 - DNA, 103 bp, Artificial Sequence
  Synthetic Polynucleotide
taatacgactcactatagggacgttctagcagctctgcccgagaagttctaacagaggagaagaactatgcgggcagagaacctggcggcagcgcaaaagatg

SEQ ID NO: 31310 - DNA, 103 bp, Artificial Sequence
  Synthetic Polynucleotide
taatacgactcactatagggtgccttcggataaatcgcacgtccctaataaacagaggagatattagatgcgtgcgattaacctggcggcagcgcaaaagatg

SEQ ID NO: 31311 - DNA, 103 bp, Artificial Sequence
  Synthetic Polynucleotide
taatacgactcactatagggcgtcacaacgcgactagttctgggacaatcaacagaggagagattgtatgagaactagtaacctggcggcagcgcaaaagatg

SEQ ID NO: 31312 - DNA, 103 bp, Artificial Sequence
  Synthetic Polynucleotide
taatacgactcactatagggtgggagactaacccgctccaattcgcagcaaacagaggagatgctgcatgttggagcggaacctggcggcagcgcaaaagatg

SEQ ID NO: 31313 - DNA, 103 bp, Artificial Sequence
  Synthetic Polynucleotide
taatacgactcactatagggcggattgggagatcgcttcggcccgggcgaaacagaggagatcgcccatgccgaagcgaaacctggcggcagcgcaaaagatg

SEQ ID NO: 31314 - DNA, 103 bp, Artificial Sequence
  Synthetic Polynucleotide
taatacgactcactatagggtctggaagaacgtccgcgccttctcgatcgaacagaggagacgatcgatgaggcgcggaaacctggcggcagcgcaaaagatg

SEQ ID NO: 31315 - DNA, 103 bp, Artificial Sequence
  Synthetic Polynucleotide
taatacgactcactataggggcaagaattcaagacccttaagatggcatgaacagaggagacatgccatgttaagggtcaacctggcggcagcgcaaaagatg

SEQ ID NO: 31316 - DNA, 103 bp, Artificial Sequence
  Synthetic Polynucleotide
taatacgactcactatagggagtgatgatttgaccccaacatctttactgaacagaggagacagtaaatgtgttggggtaacctggcggcagcgcaaaagatg

SEQ ID NO: 31317 - DNA, 103 bp, Artificial Sequence
  Synthetic Polynucleotide
taatacgactcactatagggagacaaaatgttgttctattgagccgctcgaacagaggagacgagcgatgcaatagaacaacctggcggcagcgcaaaagatg

SEQ ID NO: 31318 - DNA, 103 bp, Artificial Sequence
  Synthetic Polynucleotide
taatacgactcactatagggacgcttaagccggggttattggcgaccggcaacagaggagagccggtatgcaataacccaacctggcggcagcgcaaaagatg

SEQ ID NO: 31319 - DNA, 103 bp, Artificial Sequence
  Synthetic Polynucleotide
taatacgactcactataggggtgccgcctatcatagctcaatgataccgtaacagaggagaacggtaatgttgagctataacctggcggcagcgcaaaagatg

SEQ ID NO: 31320 - DNA, 103 bp, Artificial Sequence
  Synthetic Polynucleotide
taatacgactcactataggggatcgccctcgcagtatcgtttcgcggacgaacagaggagacgtccgatgaacgatactaacctggcggcagcgcaaaagatg

SEQ ID NO: 31321 - DNA, 103 bp, Artificial Sequence
  Synthetic Polynucleotide
taatacgactcactatagggacgtgagaatcgcgactctatgcggtgaccaacagaggagaggtcacatgatagagtcgaacctggcggcagcgcaaaagatg

SEQ ID NO: 31322 - DNA, 103 bp, Artificial Sequence
  Synthetic Polynucleotide
taatacgactcactatagggggacgcgtcgttcatccattggacggttcgaacagaggagacgaaccatgcaatggatgaacctggcggcagcgcaaaagatg

SEQ ID NO: 31323 - DNA, 103 bp, Artificial Sequence
  Synthetic Polynucleotide
taatacgactcactatagggactgtctcgtggcgtgactagcgaagctggaacagaggagaccagctatgctagtcacgaacctggcggcagcgcaaaagatg

SEQ ID NO: 31324 - DNA, 103 bp, Artificial Sequence
  Synthetic Polynucleotide
taatacgactcactatagggagacacggtggcccattttagacctcgccaaacagaggagatggcgaatgctaaaatggaacctggcggcagcgcaaaagatg

SEQ ID NO: 31325 - DNA, 103 bp, Artificial Sequence
  Synthetic Polynucleotide
taatacgactcactatagggttgatcttgcaatatgcaaccgttcctacgaacagaggagacgtaggatgggttgcataaacctggcggcagcgcaaaagatg

SEQ ID NO: 31326 - DNA, 103 bp, Artificial Sequence
  Synthetic Polynucleotide
taatacgactcactataggggttagccaacaggtcgtttaagggggatgtaacagaggagaacatccatgttaaacgacaacctggcggcagcgcaaaagatg

SEQ ID NO: 31327 - DNA, 103 bp, Artificial Sequence
  Synthetic Polynucleotide
taatacgactcactatagggcgctctattgatcgcgtgcaccatgcagcgaacagaggagacgctgcatggtgcacgcgaacctggcggcagcgcaaaagatg

SEQ ID NO: 31328 - DNA, 103 bp, Artificial Sequence
  Synthetic Polynucleotide
taatacgactcactatagggtgctaacctttagctcccaagacggcgtataacagaggagaatacgcatgcttgggagcaacctggcggcagcgcaaaagatg

SEQ ID NO: 31329 - DNA, 103 bp, Artificial Sequence
  Synthetic Polynucleotide
taatacgactcactataggggcactgagatgttattgtggactgtacggaaacagaggagatccgtaatgtccacaataaacctggcggcagcgcaaaagatg

SEQ ID NO: 31330 - DNA, 103 bp, Artificial Sequence
  Synthetic Polynucleotide
taatacgactcactatagggcggtcatctcttggttgaacactactaactaacagaggagaagttagatgtgttcaaccaacctggcggcagcgcaaaagatg

SEQ ID NO: 31331 - DNA, 103 bp, Artificial Sequence
  Synthetic Polynucleotide
taatacgactcactatagggaatcttggcgaagtgtttgcttattagcttaacagaggagaaagctaatgagcaaacacaacctggcggcagcgcaaaagatg

SEQ ID NO: 31332 - DNA, 103 bp, Artificial Sequence
  Synthetic Polynucleotide
taatacgactcactatagggaatcgggtcgacggttaccatcccagtcaaaacagaggagattgactatgatggtaaccaacctggcggcagcgcaaaagatg

SEQ ID NO: 31333 - DNA, 103 bp, Artificial Sequence
  Synthetic Polynucleotide
taatacgactcactatagggtgtgaaatagtctcgggctcgccatttcttaacagaggagaaagaaaatgcgagcccgaaacctggcggcagcgcaaaagatg

SEQ ID NO: 31334 - DNA, 103 bp, Artificial Sequence
  Synthetic Polynucleotide
taatacgactcactatagggtgaatgtaacaagggtttaggatgtagggaaacagaggagatccctaatgcctaaacccaacctggcggcagcgcaaaagatg

SEQ ID NO: 31335 - DNA, 103 bp, Artificial Sequence
  Synthetic Polynucleotide
taatacgactcactatagggcctcccggcaaactctgaataaagaggacgaacagaggagacgtcctatgtattcagagaacctggcggcagcgcaaaagatg

SEQ ID NO: 31336 - DNA, 103 bp, Artificial Sequence
  Synthetic Polynucleotide
taatacgactcactataggggcgtcacttcgaacgttggcttgattcggtaacagaggagaaccgaaatgagccaacgtaacctggcggcagcgcaaaagatg

SEQ ID NO: 31337 - DNA, 103 bp, Artificial Sequence
  Synthetic Polynucleotide
taatacgactcactatagggcggcacgcttaatcgtgcttgccaacccgcaacagaggagagcgggtatgcaagcacgaaacctggcggcagcgcaaaagatg

SEQ ID NO: 31338 - DNA, 103 bp, Artificial Sequence
  Synthetic Polynucleotide
taatacgactcactataggggtattcatctaccacgaagaggcattgtctaacagaggagaagacaaatgctcttcgtgaacctggcggcagcgcaaaagatg

SEQ ID NO: 31339 - DNA, 103 bp, Artificial Sequence
  Synthetic Polynucleotide
taatacgactcactataggggccagcggacatggcatgtttgaaccgtgcaacagaggagagcacggatgaaacatgccaacctggcggcagcgcaaaagatg

SEQ ID NO: 31340 - DNA, 103 bp, Artificial Sequence
  Synthetic Polynucleotide
taatacgactcactataggggcgtctaacaagattcgttggtagcggttgaacagaggagacaaccgatgccaacgaataacctggcggcagcgcaaaagatg

SEQ ID NO: 31341 - DNA, 103 bp, Artificial Sequence
  Synthetic Polynucleotide
taatacgactcactatagggagatagcgcgcctttcccgtcgtatcgccaaacagaggagatggcgaatggacgggaaaaacctggcggcagcgcaaaagatg

SEQ ID NO: 31342 - DNA, 103 bp, Artificial Sequence
  Synthetic Polynucleotide
taatacgactcactatagggtacgtgacgcatcaaggaaactggttttttaacagaggagaaaaaaaatggtttccttgaacctggcggcagcgcaaaagatg

SEQ ID NO: 31343 - DNA, 103 bp, Artificial Sequence
  Synthetic Polynucleotide
taatacgactcactatagggacggttacattacatagattcaggcacgacaacagaggagagtcgtgatggaatctatgaacctggcggcagcgcaaaagatg

SEQ ID NO: 31344 - DNA, 103 bp, Artificial Sequence
  Synthetic Polynucleotide
taatacgactcactataggggtgtgcccataggggatacctccggccaagaacagaggagacttggcatgaggtatcccaacctggcggcagcgcaaaagatg

SEQ ID NO: 31345 - DNA, 103 bp, Artificial Sequence
  Synthetic Polynucleotide
taatacgactcactatagggcagcgccgaaatctctacaccactgggctaaacagaggagatagcccatgggtgtagagaacctggcggcagcgcaaaagatg

SEQ ID NO: 31346 - DNA, 103 bp, Artificial Sequence
  Synthetic Polynucleotide
taatacgactcactatagggttagcctatcaatatcatgtgtatctcactaacagaggagaagtgagatgcacatgataaacctggcggcagcgcaaaagatg

SEQ ID NO: 31347 - DNA, 103 bp, Artificial Sequence
  Synthetic Polynucleotide
taatacgactcactatagggcgccatttacgtgggcgatagacgggtaggaacagaggagacctaccatgctatcgcccaacctggcggcagcgcaaaagatg

SEQ ID NO: 31348 - DNA, 103 bp, Artificial Sequence
  Synthetic Polynucleotide
taatacgactcactatagggctcgacctgggggattgtcatattagggagaacagaggagactccctatgatgacaatcaacctggcggcagcgcaaaagatg

SEQ ID NO: 31349 - DNA, 103 bp, Artificial Sequence
  Synthetic Polynucleotide
taatacgactcactataggggtgcgtttccttgtcaagttccacctcggcaacagaggagagccgagatggaacttgacaacctggcggcagcgcaaaagatg

SEQ ID NO: 31350 - DNA, 103 bp, Artificial Sequence
  Synthetic Polynucleotide
taatacgactcactatagggatattggcggttaccggacgacgaagtaataacagaggagaattactatgtcgtccggtaacctggcggcagcgcaaaagatg

SEQ ID NO: 31351 - DNA, 103 bp, Artificial Sequence
  Synthetic Polynucleotide
taatacgactcactatagggatactgatcctgctgcaacactttcaaaggaacagaggagacctttgatggtgttgcagaacctggcggcagcgcaaaagatg

SEQ ID NO: 31352 - DNA, 103 bp, Artificial Sequence
  Synthetic Polynucleotide
taatacgactcactatagggaatactagtctcgatatctgagatccctataacagaggagaatagggatgtcagatatcaacctggcggcagcgcaaaagatg

SEQ ID NO: 31353 - DNA, 103 bp, Artificial Sequence
  Synthetic Polynucleotide
taatacgactcactatagggggggccttttgtatttgcggttctaacattaacagaggagaaatgttatgaccgcaaataacctggcggcagcgcaaaagatg

SEQ ID NO: 31354 - DNA, 103 bp, Artificial Sequence
  Synthetic Polynucleotide
taatacgactcactataggggttatgagtcaagcggtcggcaccgcataaaacagaggagattatgcatggccgaccgcaacctggcggcagcgcaaaagatg

SEQ ID NO: 31355 - DNA, 103 bp, Artificial Sequence
  Synthetic Polynucleotide
taatacgactcactatagggggggtgctaggccccaccgtagtgtcgtctaacagaggagaagacgaatgtacggtgggaacctggcggcagcgcaaaagatg

SEQ ID NO: 31356 - DNA, 103 bp, Artificial Sequence
  Synthetic Polynucleotide
taatacgactcactatagggagggttcgcgggtcatcccgcctggtgatgaacagaggagacatcacatggcgggatgaaacctggcggcagcgcaaaagatg

SEQ ID NO: 31357 - DNA, 103 bp, Artificial Sequence
  Synthetic Polynucleotide
taatacgactcactatagggcgctcaagtaaaaatcactgcttaaaatttaacagaggagaaaatttatggcagtgattaacctggcggcagcgcaaaagatg

SEQ ID NO: 31358 - DNA, 103 bp, Artificial Sequence
  Synthetic Polynucleotide
taatacgactcactatagggcgattcaaccacgcacaatttattactttcaacagaggagagaaagtatgaaattgtgcaacctggcggcagcgcaaaagatg

SEQ ID NO: 31359 - DNA, 103 bp, Artificial Sequence
  Synthetic Polynucleotide
taatacgactcactataggggctatgctctgtagggcttcttattggacgaacagaggagacgtccaatgagaagccctaacctggcggcagcgcaaaagatg

SEQ ID NO: 31360 - DNA, 103 bp, Artificial Sequence
  Synthetic Polynucleotide
taatacgactcactatagggcgcactattataagagaaatacgtgactaaaacagaggagattagtcatgtatttctctaacctggcggcagcgcaaaagatg

SEQ ID NO: 31361 - DNA, 103 bp, Artificial Sequence
  Synthetic Polynucleotide
taatacgactcactatagggcatctcaaccgacggtaaccacctctcatgaacagaggagacatgagatgtggttaccgaacctggcggcagcgcaaaagatg

SEQ ID NO: 31362 - DNA, 103 bp, Artificial Sequence
  Synthetic Polynucleotide
taatacgactcactatagggcagttactagcgccttaccatcattagcataacagaggagaatgctaatgatggtaaggaacctggcggcagcgcaaaagatg

SEQ ID NO: 31363 - DNA, 103 bp, Artificial Sequence
  Synthetic Polynucleotide
taatacgactcactatagggtgagctgagatcgcgccgggggtcccataaaacagaggagattatggatgccccggcgcaacctggcggcagcgcaaaagatg

SEQ ID NO: 31364 - DNA, 103 bp, Artificial Sequence
  Synthetic Polynucleotide
taatacgactcactatagggaggtcccggtatgctccatccacccggacaaacagaggagatgtccgatgggatggagcaacctggcggcagcgcaaaagatg

SEQ ID NO: 31365 - DNA, 103 bp, Artificial Sequence
  Synthetic Polynucleotide
taatacgactcactatagggaagccacccgtgagcgttattggactgtcaaacagaggagatgacagatgaataacgctaacctggcggcagcgcaaaagatg

SEQ ID NO: 31366 - DNA, 103 bp, Artificial Sequence
  Synthetic Polynucleotide
taatacgactcactatagggtctaggacagtagctcgggcccacgagcgaaacagaggagatcgctcatgggcccgagcaacctggcggcagcgcaaaagatg

SEQ ID NO: 31367 - DNA, 103 bp, Artificial Sequence
  Synthetic Polynucleotide
taatacgactcactatagggtgtctgctttacggatgctcacgcctgcagaacagaggagactgcagatgtgagcatccaacctggcggcagcgcaaaagatg

SEQ ID NO: 31368 - DNA, 103 bp, Artificial Sequence
  Synthetic Polynucleotide
taatacgactcactatagggctacccaacgcagtctggctgatgcggaaaaacagaggagatttccgatgcagccagacaacctggcggcagcgcaaaagatg

SEQ ID NO: 31369 - DNA, 103 bp, Artificial Sequence
  Synthetic Polynucleotide
taatacgactcactatagggtgaaagtcttccctcacttacacgtgtttaaacagaggagataaacaatggtaagtgagaacctggcggcagcgcaaaagatg

SEQ ID NO: 31370 - DNA, 103 bp, Artificial Sequence
  Synthetic Polynucleotide
taatacgactcactatagggaagggctgttaaacgaaacgtgcggcgggaaacagaggagatcccgcatgacgtttcgtaacctggcggcagcgcaaaagatg

SEQ ID NO: 31371 - DNA, 103 bp, Artificial Sequence
  Synthetic Polynucleotide
taatacgactcactatagggattttggtctcacctcgtaggggtaactgaaacagaggagatcagttatgcctacgaggaacctggcggcagcgcaaaagatg

SEQ ID NO: 31372 - DNA, 103 bp, Artificial Sequence
  Synthetic Polynucleotide
taatacgactcactatagggctttcgagaaaacaggacgttgcggttattaacagaggagaaataacatgaacgtcctgaacctggcggcagcgcaaaagatg

SEQ ID NO: 31373 - DNA, 103 bp, Artificial Sequence
  Synthetic Polynucleotide
taatacgactcactatagggtagtaaccagtctctttaatcacgacaataaacagaggagatattgtatggattaaagaaacctggcggcagcgcaaaagatg

SEQ ID NO: 31374 - DNA, 103 bp, Artificial Sequence
  Synthetic Polynucleotide
taatacgactcactatagggtacgttcagaatccgcacgggacgccaacaaacagaggagatgttggatgcccgtgcggaacctggcggcagcgcaaaagatg

SEQ ID NO: 31375 - DNA, 103 bp, Artificial Sequence
  Synthetic Polynucleotide
taatacgactcactatagggacctagcttattcgccgacagatacatgtcaacagaggagagacatgatgctgtcggcgaacctggcggcagcgcaaaagatg

SEQ ID NO: 31376 - DNA, 103 bp, Artificial Sequence
  Synthetic Polynucleotide
taatacgactcactatagggaaggtaggtctcgcgaccaaaggcgcataaaacagaggagattatgcatgtttggtcgcaacctggcggcagcgcaaaagatg

SEQ ID NO: 31377 - DNA, 103 bp, Artificial Sequence
  Synthetic Polynucleotide
taatacgactcactataggggctcgcaacttacgagctcgagagctgcataacagaggagaatgcagatgtcgagctcgaacctggcggcagcgcaaaagatg

SEQ ID NO: 31378 - DNA, 103 bp, Artificial Sequence
  Synthetic Polynucleotide
taatacgactcactatagggtgggctaaattacaccatggttattatgagaacagaggagactcataatgaccatggtgaacctggcggcagcgcaaaagatg

SEQ ID NO: 31379 - DNA, 103 bp, Artificial Sequence
  Synthetic Polynucleotide
taatacgactcactataggggttgggtctggaggattcgtggcacattcaaacagaggagatgaatgatgcacgaatccaacctggcggcagcgcaaaagatg

SEQ ID NO: 31380 - DNA, 103 bp, Artificial Sequence
  Synthetic Polynucleotide
taatacgactcactataggggatcccgtaaaagtagtcgggaacaaacctaacagaggagaaggtttatgcccgactacaacctggcggcagcgcaaaagatg

SEQ ID NO: 31381 - DNA, 103 bp, Artificial Sequence
  Synthetic Polynucleotide
taatacgactcactataggggtgctacaggtcttgttgacttcccccacgaacagaggagacgtgggatgagtcaacaaaacctggcggcagcgcaaaagatg

SEQ ID NO: 31382 - DNA, 103 bp, Artificial Sequence
  Synthetic Polynucleotide
taatacgactcactatagggtacccgcgtgattgcgtcaattaaaactaaaacagaggagattagttatgattgacgcaaacctggcggcagcgcaaaagatg

SEQ ID NO: 31383 - DNA, 103 bp, Artificial Sequence
  Synthetic Polynucleotide
taatacgactcactatagggactttcaacattaagagcgcgatcagagacaacagaggagagtctctatgcgcgctcttaacctggcggcagcgcaaaagatg

SEQ ID NO: 31384 - DNA, 103 bp, Artificial Sequence
  Synthetic Polynucleotide
taatacgactcactatagggatcagtagttgagacgcagtaacttaatgcaacagaggagagcattaatgtactgcgtcaacctggcggcagcgcaaaagatg

SEQ ID NO: 31385 - DNA, 103 bp, Artificial Sequence
  Synthetic Polynucleotide
taatacgactcactataggggcctatgttttctcctcggtgtcaagctagaacagaggagactagctatgcaccgaggaaacctggcggcagcgcaaaagatg

SEQ ID NO: 31386 - DNA, 103 bp, Artificial Sequence
  Synthetic Polynucleotide
taatacgactcactatagggtgtgatgcgcatagatcggtgggtccacacaacagaggagagtgtggatgcaccgatctaacctggcggcagcgcaaaagatg

SEQ ID NO: 31387 - DNA, 103 bp, Artificial Sequence
  Synthetic Polynucleotide
taatacgactcactatagggcccatacgcactaacagcagcatcactaccaacagaggagaggtagtatggctgctgttaacctggcggcagcgcaaaagatg

SEQ ID NO: 31388 - DNA, 103 bp, Artificial Sequence
  Synthetic Polynucleotide
taatacgactcactatagggaagcgcacagcaggtacgcagggccgtgtaaacagaggagatacacgatgctgcgtaccaacctggcggcagcgcaaaagatg

SEQ ID NO: 31389 - DNA, 103 bp, Artificial Sequence
  Synthetic Polynucleotide
taatacgactcactatagggccgttttgggtctgagggaacctagcgcgtaacagaggagaacgcgcatggttccctcaaacctggcggcagcgcaaaagatg

SEQ ID NO: 31390 - DNA, 103 bp, Artificial Sequence
  Synthetic Polynucleotide
taatacgactcactatagggccgggtacagaaatcttcgagcgaagcgaaaacagaggagattcgctatgctcgaagataacctggcggcagcgcaaaagatg

SEQ ID NO: 31391 - DNA, 103 bp, Artificial Sequence
  Synthetic Polynucleotide
taatacgactcactatagggcccagttcacgtgggaactacttggagtcgaacagaggagacgactcatggtagttcccaacctggcggcagcgcaaaagatg

SEQ ID NO: 31392 - DNA, 103 bp, Artificial Sequence
  Synthetic Polynucleotide
taatacgactcactatagggcttgaccaaaaccgacgctaaagggtttacaacagaggagagtaaacatgttagcgtcgaacctggcggcagcgcaaaagatg

SEQ ID NO: 31393 - DNA, 103 bp, Artificial Sequence
  Synthetic Polynucleotide
taatacgactcactatagggttcttcgacttgtagctgcgagagtcatccaacagaggagaggatgaatgtcgcagctaaacctggcggcagcgcaaaagatg

SEQ ID NO: 31394 - DNA, 103 bp, Artificial Sequence
  Synthetic Polynucleotide
taatacgactcactataggggttggtaggtgacgtgtggcaacgctccaaaacagaggagattggagatgtgccacacgaacctggcggcagcgcaaaagatg

SEQ ID NO: 31395 - DNA, 103 bp, Artificial Sequence
  Synthetic Polynucleotide
taatacgactcactatagggcgtaaggtgcgctaacgcccgtaattgcggaacagaggagaccgcaaatgcgggcgttaaacctggcggcagcgcaaaagatg

SEQ ID NO: 31396 - DNA, 103 bp, Artificial Sequence
  Synthetic Polynucleotide
taatacgactcactatagggcttccccaagcctcctgagcctttcttaagaacagaggagacttaagatgggctcaggaaacctggcggcagcgcaaaagatg

SEQ ID NO: 31397 - DNA, 103 bp, Artificial Sequence
  Synthetic Polynucleotide
taatacgactcactatagggatcctcctaagacttacggcgtaactgggcaacagaggagagcccagatgcgccgtaagaacctggcggcagcgcaaaagatg

SEQ ID NO: 31398 - DNA, 103 bp, Artificial Sequence
  Synthetic Polynucleotide
taatacgactcactatagggtcttgcgccggttgttttgagtctgaatccaacagaggagaggattcatgctcaaaacaaacctggcggcagcgcaaaagatg

SEQ ID NO: 31399 - DNA, 103 bp, Artificial Sequence
  Synthetic Polynucleotide
taatacgactcactatagggagatgcgggacatgtcacgtcgacggtaacaacagaggagagttaccatggacgtgacaaacctggcggcagcgcaaaagatg

SEQ ID NO: 31400 - DNA, 103 bp, Artificial Sequence
  Synthetic Polynucleotide
taatacgactcactatagggtactaacactttgcacggtgtgatgcggggaacagaggagaccccgcatgacaccgtgcaacctggcggcagcgcaaaagatg

SEQ ID NO: 31401 - DNA, 103 bp, Artificial Sequence
  Synthetic Polynucleotide
taatacgactcactatagggttcattatacctcaaagaaatgtgtagtctaacagaggagaagactaatgatttctttgaacctggcggcagcgcaaaagatg

SEQ ID NO: 31402 - DNA, 103 bp, Artificial Sequence
  Synthetic Polynucleotide
taatacgactcactatagggagcacccgagtttttggtgtcgaacacaagaacagaggagacttgtgatggacaccaaaaacctggcggcagcgcaaaagatg

SEQ ID NO: 31403 - DNA, 103 bp, Artificial Sequence
  Synthetic Polynucleotide
taatacgactcactatagggtggatccgcttgctgactagagtgcccttaaacagaggagataagggatgtctagtcagaacctggcggcagcgcaaaagatg

SEQ ID NO: 31404 - DNA, 103 bp, Artificial Sequence
  Synthetic Polynucleotide
taatacgactcactatagggtccgcaccaggacgatcagttttttaaacaaacagaggagatgtttaatgaactgatcgaacctggcggcagcgcaaaagatg

SEQ ID NO: 31405 - DNA, 103 bp, Artificial Sequence
  Synthetic Polynucleotide
taatacgactcactatagggggcaatacatggacagttaaataaaatgataacagaggagaatcattatgtttaactgtaacctggcggcagcgcaaaagatg

SEQ ID NO: 31406 - DNA, 103 bp, Artificial Sequence
  Synthetic Polynucleotide
taatacgactcactatagggctcattcctgacgaaatatgttaaataacaaacagaggagatgttatatgacatatttcaacctggcggcagcgcaaaagatg

SEQ ID NO: 31407 - DNA, 103 bp, Artificial Sequence
  Synthetic Polynucleotide
taatacgactcactatagggtgtagtctcaaaccgcaatataggctagcaaacagaggagatgctagatgatattgcggaacctggcggcagcgcaaaagatg

SEQ ID NO: 31408 - DNA, 103 bp, Artificial Sequence
  Synthetic Polynucleotide
taatacgactcactatagggtgttctgcgatatggcagatgacacataataacagaggagaattatgatgcatctgccaaacctggcggcagcgcaaaagatg

SEQ ID NO: 31409 - DNA, 103 bp, Artificial Sequence
  Synthetic Polynucleotide
taatacgactcactatagggagactcgacgatgtccgccccgccacatgtaacagaggagaacatgtatgggggcggacaacctggcggcagcgcaaaagatg

SEQ ID NO: 31410 - DNA, 103 bp, Artificial Sequence
  Synthetic Polynucleotide
taatacgactcactatagggcgaaatggtgagagcggcgccagatttaccaacagaggagaggtaaaatgggcgccgctaacctggcggcagcgcaaaagatg

SEQ ID NO: 31411 - DNA, 103 bp, Artificial Sequence
  Synthetic Polynucleotide
taatacgactcactatagggggaggcatgttaggtatcgcaatggctcccaacagaggagagggagcatgtgcgataccaacctggcggcagcgcaaaagatg

SEQ ID NO: 31412 - DNA, 103 bp, Artificial Sequence
  Synthetic Polynucleotide
taatacgactcactatagggtcaagaacaacgactcaaaggtaagcatctaacagaggagaagatgcatgcctttgagtaacctggcggcagcgcaaaagatg

SEQ ID NO: 31413 - DNA, 103 bp, Artificial Sequence
  Synthetic Polynucleotide
taatacgactcactataggggggtgccaaagctgtgggacgggggcgggcaacagaggagagcccgcatgcgtcccacaaacctggcggcagcgcaaaagatg

SEQ ID NO: 31414 - DNA, 103 bp, Artificial Sequence
  Synthetic Polynucleotide
taatacgactcactatagggatataggcgtatgtcattcatacagaccccaacagaggagaggggtcatgatgaatgacaacctggcggcagcgcaaaagatg

SEQ ID NO: 31415 - DNA, 103 bp, Artificial Sequence
  Synthetic Polynucleotide
taatacgactcactataggggatatgagcattcttctttaggatatgggtaacagaggagaacccatatgctaaagaagaacctggcggcagcgcaaaagatg

SEQ ID NO: 31416 - DNA, 103 bp, Artificial Sequence
  Synthetic Polynucleotide
taatacgactcactataggggtgtcatcgcacaacgcgatgccgggagtaaacagaggagatactccatgcatcgcgttaacctggcggcagcgcaaaagatg

SEQ ID NO: 31417 - DNA, 103 bp, Artificial Sequence
  Synthetic Polynucleotide
taatacgactcactatagggtaagagaacctgagacgttaggcgattaataacagaggagaattaatatgctaacgtctaacctggcggcagcgcaaaagatg

SEQ ID NO: 31418 - DNA, 103 bp, Artificial Sequence
  Synthetic Polynucleotide
taatacgactcactatagggatgctctgcttgctctagtcgcgcacagcaaacagaggagatgctgtatgcgactagagaacctggcggcagcgcaaaagatg

SEQ ID NO: 31419 - DNA, 103 bp, Artificial Sequence
  Synthetic Polynucleotide
taatacgactcactatagggggaattttagacccatagcctcttcaagtgaacagaggagacacttgatgaggctatggaacctggcggcagcgcaaaagatg

SEQ ID NO: 31420 - DNA, 103 bp, Artificial Sequence
  Synthetic Polynucleotide
taatacgactcactatagggccggcggacgcaattcccactaacccgtcaaacagaggagatgacggatgagtgggaataacctggcggcagcgcaaaagatg

SEQ ID NO: 31421 - DNA, 103 bp, Artificial Sequence
  Synthetic Polynucleotide
taatacgactcactataggggtcgaccgagatgtgcaccgtggagtgttaaacagaggagataacacatgacggtgcacaacctggcggcagcgcaaaagatg

SEQ ID NO: 31422 - DNA, 103 bp, Artificial Sequence
  Synthetic Polynucleotide
taatacgactcactatagggtcggggtaagcctaccctgtcatggttctgaacagaggagacagaacatggacagggtaaacctggcggcagcgcaaaagatg

SEQ ID NO: 31423 - DNA, 103 bp, Artificial Sequence
  Synthetic Polynucleotide
taatacgactcactatagggcctaggacttaagttcgatgtaacggcggaaacagaggagatccgccatgacatcgaacaacctggcggcagcgcaaaagatg

SEQ ID NO: 31424 - DNA, 103 bp, Artificial Sequence
  Synthetic Polynucleotide
taatacgactcactatagggctcgcccgataccttgagttctccacagttaacagaggagaaactgtatggaactcaagaacctggcggcagcgcaaaagatg

SEQ ID NO: 31425 - DNA, 103 bp, Artificial Sequence
  Synthetic Polynucleotide
taatacgactcactatagggggaattccttttccgggtagagttcaaactaacagaggagaagtttgatgtctacccggaacctggcggcagcgcaaaagatg

SEQ ID NO: 31426 - DNA, 103 bp, Artificial Sequence
  Synthetic Polynucleotide
taatacgactcactatagggtggactaaaacacatgataaatagcgacacaacagaggagagtgtcgatgtttatcatgaacctggcggcagcgcaaaagatg

SEQ ID NO: 31427 - DNA, 103 bp, Artificial Sequence
  Synthetic Polynucleotide
taatacgactcactatagggagcggcctgatggtcatatcttatagcacaaacagaggagatgtgctatgagatatgacaacctggcggcagcgcaaaagatg

SEQ ID NO: 31428 - DNA, 103 bp, Artificial Sequence
  Synthetic Polynucleotide
taatacgactcactatagggtaggtcttgcgacgcaggagcgtgtacgataacagaggagaatcgtaatggctcctgcgaacctggcggcagcgcaaaagatg

SEQ ID NO: 31429 - DNA, 103 bp, Artificial Sequence
  Synthetic Polynucleotide
taatacgactcactatagggcaattagaggtcttcatagtttatataccgaacagaggagacggtatatgaactatgaaaacctggcggcagcgcaaaagatg

SEQ ID NO: 31430 - DNA, 103 bp, Artificial Sequence
  Synthetic Polynucleotide
taatacgactcactataggggttctgaagctatgtgatgtcggatgcggtaacagaggagaaccgcaatggacatcacaaacctggcggcagcgcaaaagatg

SEQ ID NO: 31431 - DNA, 103 bp, Artificial Sequence
  Synthetic Polynucleotide
taatacgactcactatagggattacatatttgccgcttgatgatctttacaacagaggagagtaaagatgatcaagcggaacctggcggcagcgcaaaagatg

SEQ ID NO: 31432 - DNA, 103 bp, Artificial Sequence
  Synthetic Polynucleotide
taatacgactcactatagggccgcgcccaagcaatacaaacttagcttggaacagaggagaccaagcatggtttgtattaacctggcggcagcgcaaaagatg

SEQ ID NO: 31433 - DNA, 103 bp, Artificial Sequence
  Synthetic Polynucleotide
taatacgactcactatagggtcatcactgggcctcagcacctgcgcccctaacagaggagaaggggcatgggtgctgagaacctggcggcagcgcaaaagatg

SEQ ID NO: 31434 - DNA, 103 bp, Artificial Sequence
  Synthetic Polynucleotide
taatacgactcactatagggcatcacagaaacagcataaaggagttcgccaacagaggagaggcgaaatgctttatgctaacctggcggcagcgcaaaagatg

SEQ ID NO: 31435 - DNA, 103 bp, Artificial Sequence
  Synthetic Polynucleotide
taatacgactcactatagggtgcaaccggaccgggaacggtcttgcgtacaacagaggagagtacgcatgaccgttcccaacctggcggcagcgcaaaagatg

SEQ ID NO: 31436 - DNA, 103 bp, Artificial Sequence
  Synthetic Polynucleotide
taatacgactcactatagggttctctattgctacgtaagggtattcgtgtaacagaggagaacacgaatgcccttacgtaacctggcggcagcgcaaaagatg

SEQ ID NO: 31437 - DNA, 103 bp, Artificial Sequence
  Synthetic Polynucleotide
taatacgactcactatagggcgacttgcggctgaaccttcgatcacaagtaacagaggagaacttgtatgcgaaggttcaacctggcggcagcgcaaaagatg

SEQ ID NO: 31438 - DNA, 103 bp, Artificial Sequence
  Synthetic Polynucleotide
taatacgactcactatagggtcatcgggttgtcttaggtttcggcttcctaacagaggagaaggaagatgaaacctaagaacctggcggcagcgcaaaagatg

SEQ ID NO: 31439 - DNA, 103 bp, Artificial Sequence
  Synthetic Polynucleotide
taatacgactcactatagggcctcgagcagaagacttggacgcaccacgtaacagaggagaacgtggatggtccaagtcaacctggcggcagcgcaaaagatg

SEQ ID NO: 31440 - DNA, 103 bp, Artificial Sequence
  Synthetic Polynucleotide
taatacgactcactatagggccgataccgtggcataaatccgccgtcatcaacagaggagagatgacatgggatttatgaacctggcggcagcgcaaaagatg

SEQ ID NO: 31441 - DNA, 103 bp, Artificial Sequence
  Synthetic Polynucleotide
taatacgactcactatagggttgaatgttagaggttccgaatatctttcgaacagaggagacgaaagatgttcggaaccaacctggcggcagcgcaaaagatg

SEQ ID NO: 31442 - DNA, 103 bp, Artificial Sequence
  Synthetic Polynucleotide
taatacgactcactatagggggagtttacaacatgtaccgcgaggagtccaacagaggagaggactcatggcggtacataacctggcggcagcgcaaaagatg

SEQ ID NO: 31443 - DNA, 103 bp, Artificial Sequence
  Synthetic Polynucleotide
taatacgactcactatagggtagacaatgaactctgacactcgccacttgaacagaggagacaagtgatgagtgtcagaaacctggcggcagcgcaaaagatg

SEQ ID NO: 31444 - DNA, 103 bp, Artificial Sequence
  Synthetic Polynucleotide
taatacgactcactatagggaacttcagttttaccagtaaggaaaagcctaacagaggagaaggcttatgcttactggtaacctggcggcagcgcaaaagatg

SEQ ID NO: 31445 - DNA, 103 bp, Artificial Sequence
  Synthetic Polynucleotide
taatacgactcactatagggctaaacttccctcttaatcccccatcgttaaacagaggagataacgaatggggattaagaacctggcggcagcgcaaaagatg

SEQ ID NO: 31446 - DNA, 103 bp, Artificial Sequence
  Synthetic Polynucleotide
taatacgactcactatagggatggtgagtcggccaatacagcctcacctgaacagaggagacaggtgatgctgtattggaacctggcggcagcgcaaaagatg

SEQ ID NO: 31447 - DNA, 103 bp, Artificial Sequence
  Synthetic Polynucleotide
taatacgactcactatagggaatgacggccgctgatcctaagttatgtcaaacagaggagatgacatatgttaggatcaaacctggcggcagcgcaaaagatg

SEQ ID NO: 31448 - DNA, 103 bp, Artificial Sequence
  Synthetic Polynucleotide
taatacgactcactataggggcatagagcgcatacggtagcaagggcctaaacagaggagataggccatggctaccgtaaacctggcggcagcgcaaaagatg

SEQ ID NO: 31449 - DNA, 103 bp, Artificial Sequence
  Synthetic Polynucleotide
taatacgactcactataggggggcggggccatgttccacgacaaagaactaacagaggagaagttctatgtcgtggaacaacctggcggcagcgcaaaagatg

SEQ ID NO: 31450 - DNA, 103 bp, Artificial Sequence
  Synthetic Polynucleotide
taatacgactcactatagggaacagaatataccgaggaggtaaactcagaaacagaggagatctgagatgacctcctcgaacctggcggcagcgcaaaagatg

SEQ ID NO: 31451 - DNA, 103 bp, Artificial Sequence
  Synthetic Polynucleotide
taatacgactcactatagggcgtatgcgtttccatcgtctgtcaggtgcaaacagaggagatgcaccatgcagacgatgaacctggcggcagcgcaaaagatg

SEQ ID NO: 31452 - DNA, 103 bp, Artificial Sequence
  Synthetic Polynucleotide
taatacgactcactatagggaatcgggacagcgaacgtctccgctgaactaacagaggagaagttcaatggagacgttcaacctggcggcagcgcaaaagatg

SEQ ID NO: 31453 - DNA, 103 bp, Artificial Sequence
  Synthetic Polynucleotide
taatacgactcactatagggcaaaattagcggctggtgcggtagtgaggcaacagaggagagcctcaatgccgcaccagaacctggcggcagcgcaaaagatg

SEQ ID NO: 31454 - DNA, 103 bp, Artificial Sequence
  Synthetic Polynucleotide
taatacgactcactataggggggcagcttagtatcgttttataagacctcaacagaggagagaggtcatgtaaaacgataacctggcggcagcgcaaaagatg

SEQ ID NO: 31455 - DNA, 103 bp, Artificial Sequence
  Synthetic Polynucleotide
taatacgactcactatagggtgaggagaccattcgtcatcgcgccatcttaacagaggagaaagatgatgcgatgacgaaacctggcggcagcgcaaaagatg

SEQ ID NO: 31456 - DNA, 103 bp, Artificial Sequence
  Synthetic Polynucleotide
taatacgactcactatagggcttcataatcagagttcacatgattactgcaacagaggagagcagtaatgatgtgaactaacctggcggcagcgcaaaagatg

SEQ ID NO: 31457 - DNA, 103 bp, Artificial Sequence
  Synthetic Polynucleotide
taatacgactcactataggggttcagtcacgcaaggttcctcggtagcgcaacagaggagagcgctaatgaggaaccttaacctggcggcagcgcaaaagatg

SEQ ID NO: 31458 - DNA, 103 bp, Artificial Sequence
  Synthetic Polynucleotide
taatacgactcactatagggagtctaagttcctcgcttcatactttcaataacagaggagaattgaaatgatgaagcgaaacctggcggcagcgcaaaagatg

SEQ ID NO: 31459 - DNA, 103 bp, Artificial Sequence
  Synthetic Polynucleotide
taatacgactcactatagggttataccacacttaaccctgcctatcgggtaacagaggagaacccgaatggcagggttaaacctggcggcagcgcaaaagatg

SEQ ID NO: 31460 - DNA, 103 bp, Artificial Sequence
  Synthetic Polynucleotide
taatacgactcactataggggcatacaacggtaccgggttgaccgacgtcaacagaggagagacgtcatgcaacccggtaacctggcggcagcgcaaaagatg

SEQ ID NO: 31461 - DNA, 103 bp, Artificial Sequence
  Synthetic Polynucleotide
taatacgactcactatagggacgtcgttgtgttaatcatcatatcgctaaaacagaggagattagcgatgtgatgattaaacctggcggcagcgcaaaagatg

SEQ ID NO: 31462 - DNA, 103 bp, Artificial Sequence
  Synthetic Polynucleotide
taatacgactcactataggggaacatgaaatctaccgatcggcactgaggaacagaggagacctcagatgcgatcggtaaacctggcggcagcgcaaaagatg

SEQ ID NO: 31463 - DNA, 103 bp, Artificial Sequence
  Synthetic Polynucleotide
taatacgactcactatagggctgtgttctggtcatttgccataacctggaaacagaggagatccaggatgtggcaaatgaacctggcggcagcgcaaaagatg

SEQ ID NO: 31464 - DNA, 103 bp, Artificial Sequence
  Synthetic Polynucleotide
taatacgactcactatagggctcagcccttagagaggcccgggctgcaccaacagaggagaggtgcaatgcgggcctctaacctggcggcagcgcaaaagatg

SEQ ID NO: 31465 - DNA, 103 bp, Artificial Sequence
  Synthetic Polynucleotide
taatacgactcactataggggttgcgttcatcaagaaaaccactagggataacagaggagaatccctatgggttttcttaacctggcggcagcgcaaaagatg

SEQ ID NO: 31466 - DNA, 103 bp, Artificial Sequence
  Synthetic Polynucleotide
taatacgactcactataggggcgcgaatgtatcgacgtgcgggagtcctgaacagaggagacaggacatgcgcacgtcgaacctggcggcagcgcaaaagatg

SEQ ID NO: 31467 - DNA, 103 bp, Artificial Sequence
  Synthetic Polynucleotide
taatacgactcactatagggttgcttcgagcgatccttcggatgtacagaaacagaggagatctgtaatgccgaaggataacctggcggcagcgcaaaagatg

SEQ ID NO: 31468 - DNA, 103 bp, Artificial Sequence
  Synthetic Polynucleotide
taatacgactcactataggggttctacaagtgcagaaccctatcgtcctcaacagaggagagaggacatgagggttctgaacctggcggcagcgcaaaagatg

SEQ ID NO: 31469 - DNA, 103 bp, Artificial Sequence
  Synthetic Polynucleotide
taatacgactcactatagggtgcctcaagaagtgctggtttaggaagtacaacagaggagagtacttatgaaaccagcaaacctggcggcagcgcaaaagatg

SEQ ID NO: 31470 - DNA, 103 bp, Artificial Sequence
  Synthetic Polynucleotide
taatacgactcactatagggtttcacgcccccgacacgaggatcacacggaacagaggagaccgtgtatgcctcgtgtcaacctggcggcagcgcaaaagatg

SEQ ID NO: 31471 - DNA, 103 bp, Artificial Sequence
  Synthetic Polynucleotide
taatacgactcactataggggttagggggtattaccggcgaaggtgcaataacagaggagaattgcaatgtcgccggtaaacctggcggcagcgcaaaagatg

SEQ ID NO: 31472 - DNA, 103 bp, Artificial Sequence
  Synthetic Polynucleotide
taatacgactcactatagggtaattaataagcacgttcaagctttggaggaacagaggagacctccaatgcttgaacgtaacctggcggcagcgcaaaagatg

SEQ ID NO: 31473 - DNA, 103 bp, Artificial Sequence
  Synthetic Polynucleotide
taatacgactcactatagggagaggtggtgtagacctaccaagctataaaaacagaggagatttataatgtggtaggtcaacctggcggcagcgcaaaagatg

SEQ ID NO: 31474 - DNA, 103 bp, Artificial Sequence
  Synthetic Polynucleotide
taatacgactcactatagggcacgtgagcaatgtgttcctcgtaataatcaacagaggagagattatatggaggaacacaacctggcggcagcgcaaaagatg

SEQ ID NO: 31475 - DNA, 103 bp, Artificial Sequence
  Synthetic Polynucleotide
taatacgactcactataggggcatccgggaaacatctgtttaattaaagaaacagaggagatctttaatgaaacagatgaacctggcggcagcgcaaaagatg

SEQ ID NO: 31476 - DNA, 103 bp, Artificial Sequence
  Synthetic Polynucleotide
taatacgactcactatagggtagacgcgtggagaaggtaagtgtggacgcaacagaggagagcgtccatgcttaccttcaacctggcggcagcgcaaaagatg

SEQ ID NO: 31477 - DNA, 103 bp, Artificial Sequence
  Synthetic Polynucleotide
taatacgactcactatagggttggagcgcccagaggcgttttgactgtctaacagaggagaagacagatgaaacgcctcaacctggcggcagcgcaaaagatg

SEQ ID NO: 31478 - DNA, 103 bp, Artificial Sequence
  Synthetic Polynucleotide
taatacgactcactatagggtcatttgttgagtccttgcaaatcactcgtaacagaggagaacgagtatgttgcaaggaaacctggcggcagcgcaaaagatg

SEQ ID NO: 31479 - DNA, 103 bp, Artificial Sequence
  Synthetic Polynucleotide
taatacgactcactatagggggcgactatgagcatcgtccgtatggatagaacagaggagactatccatgcggacgatgaacctggcggcagcgcaaaagatg

SEQ ID NO: 31480 - DNA, 103 bp, Artificial Sequence
  Synthetic Polynucleotide
taatacgactcactatagggcttacacggcgtgtcgctttaaaacctgggaacagaggagacccaggatgtaaagcgacaacctggcggcagcgcaaaagatg

SEQ ID NO: 31481 - DNA, 103 bp, Artificial Sequence
  Synthetic Polynucleotide
taatacgactcactatagggtgagcggatgcgctcgtcctctcgttcgctaacagaggagaagcgaaatggaggacgagaacctggcggcagcgcaaaagatg

SEQ ID NO: 31482 - DNA, 103 bp, Artificial Sequence
  Synthetic Polynucleotide
taatacgactcactatagggccctgtccaagattgttattcctacaaacaaacagaggagatgtttgatggaataacaaaacctggcggcagcgcaaaagatg

SEQ ID NO: 31483 - DNA, 103 bp, Artificial Sequence
  Synthetic Polynucleotide
taatacgactcactataggggttgagttaactctaaagctttaaacaagcaacagaggagagcttgtatgaagctttagaacctggcggcagcgcaaaagatg

SEQ ID NO: 31484 - DNA, 103 bp, Artificial Sequence
  Synthetic Polynucleotide
taatacgactcactatagggcacctgccgtatctcattgagtattcgagcaacagaggagagctcgaatgctcaatgagaacctggcggcagcgcaaaagatg

SEQ ID NO: 31485 - DNA, 103 bp, Artificial Sequence
  Synthetic Polynucleotide
taatacgactcactatagggttgctagtatccattgcggccctccgcacgaacagaggagacgtgcgatgggccgcaataacctggcggcagcgcaaaagatg

SEQ ID NO: 31486 - DNA, 103 bp, Artificial Sequence
  Synthetic Polynucleotide
taatacgactcactatagggcagtagctagcccgttaatagatcttgacgaacagaggagacgtcaaatgctattaacgaacctggcggcagcgcaaaagatg

SEQ ID NO: 31487 - DNA, 103 bp, Artificial Sequence
  Synthetic Polynucleotide
taatacgactcactatagggtcccagattccgtattacaaagcgtttgacaacagaggagagtcaaaatgtttgtaataaacctggcggcagcgcaaaagatg

SEQ ID NO: 31488 - DNA, 103 bp, Artificial Sequence
  Synthetic Polynucleotide
taatacgactcactatagggttatggctgtctactggttacatttctgcgaacagaggagacgcagaatggtaaccagtaacctggcggcagcgcaaaagatg

SEQ ID NO: 31489 - DNA, 103 bp, Artificial Sequence
  Synthetic Polynucleotide
taatacgactcactatagggggatggcgctcagttcagctcagattgaacaacagaggagagttcaaatggagctgaacaacctggcggcagcgcaaaagatg

SEQ ID NO: 31490 - DNA, 103 bp, Artificial Sequence
  Synthetic Polynucleotide
taatacgactcactataggggccagctgcggtccgaacccctttgacggtaacagaggagaaccgtcatgggggttcggaacctggcggcagcgcaaaagatg

SEQ ID NO: 31491 - DNA, 103 bp, Artificial Sequence
  Synthetic Polynucleotide
taatacgactcactatagggaagttaaagagccttaaacagtgtgcctttaacagaggagaaaaggcatgctgtttaagaacctggcggcagcgcaaaagatg

SEQ ID NO: 31492 - DNA, 103 bp, Artificial Sequence
  Synthetic Polynucleotide
taatacgactcactatagggtgaaacgatgcaccttactctagctgacaaaacagaggagattgtcaatgagagtaaggaacctggcggcagcgcaaaagatg

SEQ ID NO: 31493 - DNA, 103 bp, Artificial Sequence
  Synthetic Polynucleotide
taatacgactcactatagggttaagatcgcgctcatccccttcgatccccaacagaggagaggggatatgaggggatgaaacctggcggcagcgcaaaagatg

SEQ ID NO: 31494 - DNA, 103 bp, Artificial Sequence
  Synthetic Polynucleotide
taatacgactcactatagggctaaactcagatgcgtcttagattcataaaaacagaggagatttatgatgctaagacgcaacctggcggcagcgcaaaagatg

SEQ ID NO: 31495 - DNA, 103 bp, Artificial Sequence
  Synthetic Polynucleotide
taatacgactcactatagggctctcagtgcaggagcaggcgaaggcaatgaacagaggagacattgcatgcgcctgctcaacctggcggcagcgcaaaagatg

SEQ ID NO: 31496 - DNA, 103 bp, Artificial Sequence
  Synthetic Polynucleotide
taatacgactcactataggggggattagatttgaacccacgtcgtttcggaacagaggagaccgaaaatgcgtgggttcaacctggcggcagcgcaaaagatg

SEQ ID NO: 31497 - DNA, 103 bp, Artificial Sequence
  Synthetic Polynucleotide
taatacgactcactatagggacaacgctgggttgaccatcgtcacttgagaacagaggagactcaagatgcgatggtcaaacctggcggcagcgcaaaagatg

SEQ ID NO: 31498 - DNA, 103 bp, Artificial Sequence
  Synthetic Polynucleotide
taatacgactcactataggggctgcgggctacgaactaacaaatcctccaaacagaggagatggaggatgtgttagttcaacctggcggcagcgcaaaagatg

SEQ ID NO: 31499 - DNA, 103 bp, Artificial Sequence
  Synthetic Polynucleotide
taatacgactcactatagggcaaccttacacgttcgaacaccgccacgcgaacagaggagacgcgtgatggtgttcgaaaacctggcggcagcgcaaaagatg

SEQ ID NO: 31500 - DNA, 103 bp, Artificial Sequence
  Synthetic Polynucleotide
taatacgactcactatagggcttggcgtcggaggcgtccggtagcaggccaacagaggagaggcctgatgccggacgccaacctggcggcagcgcaaaagatg

SEQ ID NO: 31501 - DNA, 103 bp, Artificial Sequence
  Synthetic Polynucleotide
taatacgactcactataggggctagttgaaggtctgatagtttacgtttcaacagaggagagaaacgatgactatcagaaacctggcggcagcgcaaaagatg

SEQ ID NO: 31502 - DNA, 103 bp, Artificial Sequence
  Synthetic Polynucleotide
taatacgactcactatagggacttacgcggagtctttctacagtagcttcaacagaggagagaagctatggtagaaagaaacctggcggcagcgcaaaagatg

SEQ ID NO: 31503 - DNA, 103 bp, Artificial Sequence
  Synthetic Polynucleotide
taatacgactcactatagggaatggacggcgagtttcccttgtgtataacaacagaggagagttataatgaagggaaacaacctggcggcagcgcaaaagatg

SEQ ID NO: 31504 - DNA, 103 bp, Artificial Sequence
  Synthetic Polynucleotide
taatacgactcactatagggtagaataccggtagcatgaatcccgctctaaacagaggagatagagcatgattcatgctaacctggcggcagcgcaaaagatg

SEQ ID NO: 31505 - DNA, 103 bp, Artificial Sequence
  Synthetic Polynucleotide
taatacgactcactataggggacggatttgaaacagacgctgactctccaaacagaggagatggagaatgagcgtctgtaacctggcggcagcgcaaaagatg

SEQ ID NO: 31506 - DNA, 103 bp, Artificial Sequence
  Synthetic Polynucleotide
taatacgactcactataggggtgaaagttctggtaatgctggcagtatataacagaggagaatatacatgcagcattacaacctggcggcagcgcaaaagatg

SEQ ID NO: 31507 - DNA, 103 bp, Artificial Sequence
  Synthetic Polynucleotide
taatacgactcactatagggaacgtcatacagatcggaaatttgtacgtcaacagaggagagacgtaatgatttccgataacctggcggcagcgcaaaagatg

SEQ ID NO: 31508 - DNA, 103 bp, Artificial Sequence
  Synthetic Polynucleotide
taatacgactcactatagggaaaatctcacccacgctgattaatctaatgaacagaggagacattagatgaatcagcgtaacctggcggcagcgcaaaagatg

SEQ ID NO: 31509 - DNA, 103 bp, Artificial Sequence
  Synthetic Polynucleotide
taatacgactcactatagggcgagatgaagatggccaatatgaggttttaaacagaggagataaaacatgatattggccaacctggcggcagcgcaaaagatg

SEQ ID NO: 31510 - DNA, 103 bp, Artificial Sequence
  Synthetic Polynucleotide
taatacgactcactatagggtccgttttcgctgggcgtgtctactcttgtaacagaggagaacaagaatggacacgcccaacctggcggcagcgcaaaagatg

SEQ ID NO: 31511 - DNA, 103 bp, Artificial Sequence
  Synthetic Polynucleotide
taatacgactcactatagggttcagtcgttacctcacttgggcacggggaaacagaggagatccccgatgccaagtgagaacctggcggcagcgcaaaagatg

SEQ ID NO: 31512 - DNA, 103 bp, Artificial Sequence
  Synthetic Polynucleotide
taatacgactcactatagggcgaccaaaacgcggtatgaaattatccgcgaacagaggagacgcggaatgtttcataccaacctggcggcagcgcaaaagatg

SEQ ID NO: 31513 - DNA, 103 bp, Artificial Sequence
  Synthetic Polynucleotide
taatacgactcactatagggcgccgcgtatttatcctattgctagcttcgaacagaggagacgaagcatgcaataggataacctggcggcagcgcaaaagatg

SEQ ID NO: 31514 - DNA, 103 bp, Artificial Sequence
  Synthetic Polynucleotide
taatacgactcactataggggggcgctcagtctggtaatttgaacggggaaacagaggagatccccgatgaaattaccaaacctggcggcagcgcaaaagatg

SEQ ID NO: 31515 - DNA, 103 bp, Artificial Sequence
  Synthetic Polynucleotide
taatacgactcactatagggataggtataacctgtcatacgtccgtcaaaaacagaggagatttgacatgcgtatgacaaacctggcggcagcgcaaaagatg

SEQ ID NO: 31516 - DNA, 103 bp, Artificial Sequence
  Synthetic Polynucleotide
taatacgactcactatagggagcggacccaggatcgggacacccctcagcaacagaggagagctgagatgtgtcccgataacctggcggcagcgcaaaagatg

SEQ ID NO: 31517 - DNA, 103 bp, Artificial Sequence
  Synthetic Polynucleotide
taatacgactcactataggggccttcaacgaatccgctaccggacgccctaacagaggagaagggcgatgggtagcggaaacctggcggcagcgcaaaagatg

SEQ ID NO: 31518 - DNA, 103 bp, Artificial Sequence
  Synthetic Polynucleotide
taatacgactcactatagggaaccactccactaacacataggcttgtactaacagaggagaagtacaatgctatgtgttaacctggcggcagcgcaaaagatg

SEQ ID NO: 31519 - DNA, 103 bp, Artificial Sequence
  Synthetic Polynucleotide
taatacgactcactatagggcccgctagtatctaacatgctacatggttgaacagaggagacaaccaatgagcatgttaaacctggcggcagcgcaaaagatg

SEQ ID NO: 31520 - DNA, 103 bp, Artificial Sequence
  Synthetic Polynucleotide
taatacgactcactatagggtcatggcgggtagttgatccaggaattacgaacagaggagacgtaatatgtggatcaacaacctggcggcagcgcaaaagatg

SEQ ID NO: 31521 - DNA, 103 bp, Artificial Sequence
  Synthetic Polynucleotide
taatacgactcactatagggccctataccgctaacgcataacttgagcgcaacagaggagagcgctcatgttatgcgttaacctggcggcagcgcaaaagatg

SEQ ID NO: 31522 - DNA, 103 bp, Artificial Sequence
  Synthetic Polynucleotide
taatacgactcactatagggtggctcggtattacactgtttctgtgtcaaaacagaggagattgacaatgaaacagtgtaacctggcggcagcgcaaaagatg

SEQ ID NO: 31523 - DNA, 103 bp, Artificial Sequence
  Synthetic Polynucleotide
taatacgactcactatagggtggcaggcaatgaagccggcgcaacctttaaacagaggagataaaggatgcgccggcttaacctggcggcagcgcaaaagatg

SEQ ID NO: 31524 - DNA, 103 bp, Artificial Sequence
  Synthetic Polynucleotide
taatacgactcactatagggttccacctccctataaagactacgtcgtaaaacagaggagattacgaatgagtctttataacctggcggcagcgcaaaagatg

SEQ ID NO: 31525 - DNA, 103 bp, Artificial Sequence
  Synthetic Polynucleotide
taatacgactcactataggggtctgccaaggctgagccacgagcgccgttaacagaggagaaacggcatgcgtggctcaaacctggcggcagcgcaaaagatg

SEQ ID NO: 31526 - DNA, 103 bp, Artificial Sequence
  Synthetic Polynucleotide
taatacgactcactatagggaagataccctaagttttctttgtaaaatgcaacagaggagagcatttatgaaagaaaacaacctggcggcagcgcaaaagatg

SEQ ID NO: 31527 - DNA, 103 bp, Artificial Sequence
  Synthetic Polynucleotide
taatacgactcactataggggaatatgacgcgagacgggtagcttaccacaacagaggagagtggtaatgtacccgtctaacctggcggcagcgcaaaagatg

SEQ ID NO: 31528 - DNA, 103 bp, Artificial Sequence
  Synthetic Polynucleotide
taatacgactcactatagggttgggaacagtggcctgcgcagagcacttgaacagaggagacaagtgatgtgcgcaggcaacctggcggcagcgcaaaagatg

SEQ ID NO: 31529 - DNA, 103 bp, Artificial Sequence
  Synthetic Polynucleotide
taatacgactcactatagggcaagtttgtgataactcggggccaagtccgaacagaggagacggactatgccccgagttaacctggcggcagcgcaaaagatg

SEQ ID NO: 31530 - DNA, 103 bp, Artificial Sequence
  Synthetic Polynucleotide
taatacgactcactataggggcaaaccacaagcttaattttccagcagggaacagaggagaccctgcatgaaaattaagaacctggcggcagcgcaaaagatg

SEQ ID NO: 31531 - DNA, 103 bp, Artificial Sequence
  Synthetic Polynucleotide
taatacgactcactatagggtgttggtactggtagcatgattcggttggtaacagaggagaaccaacatgatcatgctaaacctggcggcagcgcaaaagatg

SEQ ID NO: 31532 - DNA, 103 bp, Artificial Sequence
  Synthetic Polynucleotide
taatacgactcactatagggaccgaagaagcccatctaattcttattgggaacagaggagacccaatatgaattagatgaacctggcggcagcgcaaaagatg

SEQ ID NO: 31533 - DNA, 103 bp, Artificial Sequence
  Synthetic Polynucleotide
taatacgactcactatagggctccttcagtctactcataaaatattgttaaacagaggagataacaaatgtttatgagtaacctggcggcagcgcaaaagatg

SEQ ID NO: 31534 - DNA, 103 bp, Artificial Sequence
  Synthetic Polynucleotide
taatacgactcactatagggtgttgtatggagtaattttgagcttattgcaacagaggagagcaataatgtcaaaattaaacctggcggcagcgcaaaagatg

SEQ ID NO: 31535 - DNA, 103 bp, Artificial Sequence
  Synthetic Polynucleotide
taatacgactcactatagggtgttcggaacagttaacttcctttcgcaccaacagaggagaggtgcgatgggaagttaaaacctggcggcagcgcaaaagatg

SEQ ID NO: 31536 - DNA, 103 bp, Artificial Sequence
  Synthetic Polynucleotide
taatacgactcactatagggactaaggtcacgttgtactgaaaatagactaacagaggagaagtctaatgtcagtacaaaacctggcggcagcgcaaaagatg

SEQ ID NO: 31537 - DNA, 103 bp, Artificial Sequence
  Synthetic Polynucleotide
taatacgactcactatagggcatagtttatgagacgctgtcccagccctgaacagaggagacagggcatggacagcgtcaacctggcggcagcgcaaaagatg

SEQ ID NO: 31538 - DNA, 103 bp, Artificial Sequence
  Synthetic Polynucleotide
taatacgactcactatagggaagtggctaaacatcagggatatatgcaaaaacagaggagatttgcaatgatccctgataacctggcggcagcgcaaaagatg

SEQ ID NO: 31539 - DNA, 103 bp, Artificial Sequence
  Synthetic Polynucleotide
taatacgactcactatagggctggttcggacccgctccatgacaaggggaaacagaggagatcccctatgcatggagcgaacctggcggcagcgcaaaagatg

SEQ ID NO: 31540 - DNA, 103 bp, Artificial Sequence
  Synthetic Polynucleotide
taatacgactcactatagggcgccccccgactgcacaagtgtccgaagcgaacagaggagacgcttcatgcacttgtgcaacctggcggcagcgcaaaagatg

SEQ ID NO: 31541 - DNA, 103 bp, Artificial Sequence
  Synthetic Polynucleotide
taatacgactcactatagggggtctcacgatatgtagggtcagtcccaaaaacagaggagatttgggatggaccctacaaacctggcggcagcgcaaaagatg

SEQ ID NO: 31542 - DNA, 103 bp, Artificial Sequence
  Synthetic Polynucleotide
taatacgactcactatagggtcacggtcggtttgccaaggtagagcacagaacagaggagactgtgcatgaccttggcaaacctggcggcagcgcaaaagatg

SEQ ID NO: 31543 - DNA, 103 bp, Artificial Sequence
  Synthetic Polynucleotide
taatacgactcactatagggtgcgattaatgttggtacacagctcagtataacagaggagaatactgatgtgtgtaccaaacctggcggcagcgcaaaagatg

SEQ ID NO: 31544 - DNA, 103 bp, Artificial Sequence
  Synthetic Polynucleotide
taatacgactcactatagggcccaccgaatcggtcacttttccttaatataacagaggagaatattaatgaaaagtgacaacctggcggcagcgcaaaagatg

SEQ ID NO: 31545 - DNA, 103 bp, Artificial Sequence
  Synthetic Polynucleotide
taatacgactcactatagggggctgagtgcgattatctcgggcggagtccaacagaggagaggactcatgccgagataaaacctggcggcagcgcaaaagatg

SEQ ID NO: 31546 - DNA, 103 bp, Artificial Sequence
  Synthetic Polynucleotide
taatacgactcactatagggcgatagtatcttgcgttaggtataggcgtgaacagaggagacacgccatgacctaacgcaacctggcggcagcgcaaaagatg

SEQ ID NO: 31547 - DNA, 103 bp, Artificial Sequence
  Synthetic Polynucleotide
taatacgactcactatagggtgagcaattcccgggacttccaatccctccaacagaggagaggagggatgggaagtcccaacctggcggcagcgcaaaagatg

SEQ ID NO: 31548 - DNA, 103 bp, Artificial Sequence
  Synthetic Polynucleotide
taatacgactcactatagggagttgcctaaactccgttgacacaaagtttaacagaggagaaaacttatggtcaacggaaacctggcggcagcgcaaaagatg

SEQ ID NO: 31549 - DNA, 103 bp, Artificial Sequence
  Synthetic Polynucleotide
taatacgactcactatagggtaggtgcgagtcttgaaaaaaattcttaacaacagaggagagttaagatgttttttcaaaacctggcggcagcgcaaaagatg

SEQ ID NO: 31550 - DNA, 103 bp, Artificial Sequence
  Synthetic Polynucleotide
taatacgactcactatagggtaattttcgtgtagctttggtattcggtaaaacagaggagattaccgatgaccaaagctaacctggcggcagcgcaaaagatg

SEQ ID NO: 31551 - DNA, 103 bp, Artificial Sequence
  Synthetic Polynucleotide
taatacgactcactatagggtgctagtacgcttatgcccattgaacgtgcaacagaggagagcacgtatgatgggcataaacctggcggcagcgcaaaagatg

SEQ ID NO: 31552 - DNA, 103 bp, Artificial Sequence
  Synthetic Polynucleotide
taatacgactcactatagggcgtcaagcataagtggagggatccgtgccaaacagaggagatggcacatgtccctccacaacctggcggcagcgcaaaagatg

SEQ ID NO: 31553 - DNA, 103 bp, Artificial Sequence
  Synthetic Polynucleotide
taatacgactcactatagggtgcaactggaacataactaaatcccgaaacaacagaggagagtttcgatgtttagttataacctggcggcagcgcaaaagatg

SEQ ID NO: 31554 - DNA, 103 bp, Artificial Sequence
  Synthetic Polynucleotide
taatacgactcactatagggttaagactacgtccctattattttccctacaacagaggagagtagggatgataatagggaacctggcggcagcgcaaaagatg

SEQ ID NO: 31555 - DNA, 103 bp, Artificial Sequence
  Synthetic Polynucleotide
taatacgactcactatagggggtcaccgggccgaggagagtgattcgattaacagaggagaaatcgaatgactctcctcaacctggcggcagcgcaaaagatg

SEQ ID NO: 31556 - DNA, 103 bp, Artificial Sequence
  Synthetic Polynucleotide
taatacgactcactatagggaaagggcaagtctatgaggcgttgttaggaaacagaggagatcctaaatgcgcctcataaacctggcggcagcgcaaaagatg

SEQ ID NO: 31557 - DNA, 103 bp, Artificial Sequence
  Synthetic Polynucleotide
taatacgactcactataggggccctaggcccaacccattagtggttcgccaacagaggagaggcgaaatgctaatgggtaacctggcggcagcgcaaaagatg

SEQ ID NO: 31558 - DNA, 103 bp, Artificial Sequence
  Synthetic Polynucleotide
taatacgactcactatagggggtgcacatgtgataaaagatttcggttgcaacagaggagagcaaccatgatcttttataacctggcggcagcgcaaaagatg

SEQ ID NO: 31559 - DNA, 103 bp, Artificial Sequence
  Synthetic Polynucleotide
taatacgactcactataggggtattctccaatcggcgttctgttcgccgaaacagaggagatcggcgatgagaacgccgaacctggcggcagcgcaaaagatg

SEQ ID NO: 31560 - DNA, 103 bp, Artificial Sequence
  Synthetic Polynucleotide
taatacgactcactatagggcattcgtcgctagccattgcttagacggggaacagaggagaccccgtatgagcaatggcaacctggcggcagcgcaaaagatg

SEQ ID NO: 31561 - DNA, 103 bp, Artificial Sequence
  Synthetic Polynucleotide
taatacgactcactatagggggataatagtacgggatgggggtagcagttaacagaggagaaactgcatgccccatcccaacctggcggcagcgcaaaagatg

SEQ ID NO: 31562 - DNA, 103 bp, Artificial Sequence
  Synthetic Polynucleotide
taatacgactcactatagggaccttgacaatcgttgagcttacacgtctcaacagaggagagagacgatgaagctcaacaacctggcggcagcgcaaaagatg

SEQ ID NO: 31563 - DNA, 103 bp, Artificial Sequence
  Synthetic Polynucleotide
taatacgactcactatagggctctttttgcatgccagctccattctgactaacagaggagaagtcagatgggagctggcaacctggcggcagcgcaaaagatg

SEQ ID NO: 31564 - DNA, 103 bp, Artificial Sequence
  Synthetic Polynucleotide
taatacgactcactatagggcactattcacgggaccactccgcgacaggcaacagaggagagcctgtatgggagtggtcaacctggcggcagcgcaaaagatg

SEQ ID NO: 31565 - DNA, 103 bp, Artificial Sequence
  Synthetic Polynucleotide
taatacgactcactatagggtgatcaccgtcaatcttgtgaggccggagcaacagaggagagctccgatgtcacaagataacctggcggcagcgcaaaagatg

SEQ ID NO: 31566 - DNA, 103 bp, Artificial Sequence
  Synthetic Polynucleotide
taatacgactcactatagggggaggggcagcaccatattgaatccggaagaacagaggagacttccgatgtcaatatggaacctggcggcagcgcaaaagatg

SEQ ID NO: 31567 - DNA, 103 bp, Artificial Sequence
  Synthetic Polynucleotide
taatacgactcactatagggggaaaacattagcgccaacaatctgttgctaacagaggagaagcaacatgttgttggcgaacctggcggcagcgcaaaagatg

SEQ ID NO: 31568 - DNA, 103 bp, Artificial Sequence
  Synthetic Polynucleotide
taatacgactcactatagggactatagggggctaccgtgcctaaaaagacaacagaggagagtctttatgggcacggtaaacctggcggcagcgcaaaagatg

SEQ ID NO: 31569 - DNA, 103 bp, Artificial Sequence
  Synthetic Polynucleotide
taatacgactcactatagggtcggagtgacgataggtcatcgtgtaattgaacagaggagacaattaatggatgacctaaacctggcggcagcgcaaaagatg

SEQ ID NO: 31570 - DNA, 103 bp, Artificial Sequence
  Synthetic Polynucleotide
taatacgactcactatagggcccatccaactttgtgggcggcaagtttgcaacagaggagagcaaacatgccgcccacaaacctggcggcagcgcaaaagatg

SEQ ID NO: 31571 - DNA, 103 bp, Artificial Sequence
  Synthetic Polynucleotide
taatacgactcactatagggcgtacagatctagtgcatcagtggtgacgcaacagaggagagcgtcaatgctgatgcacaacctggcggcagcgcaaaagatg

SEQ ID NO: 31572 - DNA, 103 bp, Artificial Sequence
  Synthetic Polynucleotide
taatacgactcactatagggcgcttagtaccccgcagctttggggatgaaaacagaggagattcatcatgaaagctgcgaacctggcggcagcgcaaaagatg

SEQ ID NO: 31573 - DNA, 103 bp, Artificial Sequence
  Synthetic Polynucleotide
taatacgactcactataggggctcaggatgccaacgctaataagaaccgcaacagaggagagcggttatgattagcgttaacctggcggcagcgcaaaagatg

SEQ ID NO: 31574 - DNA, 103 bp, Artificial Sequence
  Synthetic Polynucleotide
taatacgactcactatagggtactggaatgccacctgtcagacgttggacaacagaggagagtccaaatgctgacaggtaacctggcggcagcgcaaaagatg

SEQ ID NO: 31575 - DNA, 103 bp, Artificial Sequence
  Synthetic Polynucleotide
taatacgactcactatagggcgatagtccgctggactaaccggaacttataacagaggagaataagtatgggttagtccaacctggcggcagcgcaaaagatg

SEQ ID NO: 31576 - DNA, 103 bp, Artificial Sequence
  Synthetic Polynucleotide
taatacgactcactatagggatagttaagtcagctccatcactccgggcgaacagaggagacgcccgatgtgatggagcaacctggcggcagcgcaaaagatg

SEQ ID NO: 31577 - DNA, 103 bp, Artificial Sequence
  Synthetic Polynucleotide
taatacgactcactatagggctggggctcctatagtgaagaactgaaatgaacagaggagacatttcatgtcttcactaaacctggcggcagcgcaaaagatg

SEQ ID NO: 31578 - DNA, 103 bp, Artificial Sequence
  Synthetic Polynucleotide
taatacgactcactatagggggccgtgcttaactggtgtctcagatgtgtaacagaggagaacacatatgagacaccagaacctggcggcagcgcaaaagatg

SEQ ID NO: 31579 - DNA, 103 bp, Artificial Sequence
  Synthetic Polynucleotide
taatacgactcactatagggaatagacgtttcaggccagtcctatgaatcaacagaggagagattcaatggactggcctaacctggcggcagcgcaaaagatg

SEQ ID NO: 31580 - DNA, 103 bp, Artificial Sequence
  Synthetic Polynucleotide
taatacgactcactatagggacctgtcgatgaagccgcctgcgagagtggaacagaggagaccactcatgcaggcggctaacctggcggcagcgcaaaagatg

SEQ ID NO: 31581 - DNA, 103 bp, Artificial Sequence
  Synthetic Polynucleotide
taatacgactcactatagggagctaataagcgccgattgcatactactgtaacagaggagaacagtaatgtgcaatcggaacctggcggcagcgcaaaagatg

SEQ ID NO: 31582 - DNA, 103 bp, Artificial Sequence
  Synthetic Polynucleotide
taatacgactcactatagggttagaagcatccggctctggacgtcaagataacagaggagaatcttgatgtccagagccaacctggcggcagcgcaaaagatg

SEQ ID NO: 31583 - DNA, 103 bp, Artificial Sequence
  Synthetic Polynucleotide
taatacgactcactataggggtcagatcgttcggtaagaagctgcaagcgaacagaggagacgcttgatgcttcttaccaacctggcggcagcgcaaaagatg

SEQ ID NO: 31584 - DNA, 103 bp, Artificial Sequence
  Synthetic Polynucleotide
taatacgactcactatagggggtggagatttcaggactggttatactagaaacagaggagatctagtatgaccagtcctaacctggcggcagcgcaaaagatg

SEQ ID NO: 31585 - DNA, 103 bp, Artificial Sequence
  Synthetic Polynucleotide
taatacgactcactatagggaattgcgtccaaagctattggcaaattggtaacagaggagaaccaatatgccaatagctaacctggcggcagcgcaaaagatg

SEQ ID NO: 31586 - DNA, 103 bp, Artificial Sequence
  Synthetic Polynucleotide
taatacgactcactatagggtttcactcccctccgtgccagttcgtagttaacagaggagaaactacatgctggcacggaacctggcggcagcgcaaaagatg

SEQ ID NO: 31587 - DNA, 103 bp, Artificial Sequence
  Synthetic Polynucleotide
taatacgactcactatagggtgacgcgtccttggacttgctaaagcggcgaacagaggagacgccgcatgagcaagtccaacctggcggcagcgcaaaagatg

SEQ ID NO: 31588 - DNA, 103 bp, Artificial Sequence
  Synthetic Polynucleotide
taatacgactcactatagggaggtagctacgatcagaagaaaacgccataaacagaggagatatggcatgttcttctgaaacctggcggcagcgcaaaagatg

SEQ ID NO: 31589 - DNA, 103 bp, Artificial Sequence
  Synthetic Polynucleotide
taatacgactcactataggggaacagggggggttcatggccgcggttgagaacagaggagactcaacatgggccatgaaaacctggcggcagcgcaaaagatg

SEQ ID NO: 31590 - DNA, 103 bp, Artificial Sequence
  Synthetic Polynucleotide
taatacgactcactatagggacgggcgggcgaagaattcccgtgggacgaaacagaggagatcgtccatggggaattctaacctggcggcagcgcaaaagatg

SEQ ID NO: 31591 - DNA, 103 bp, Artificial Sequence
  Synthetic Polynucleotide
taatacgactcactatagggtgtgatatccttagcgttaggaaacatcgcaacagaggagagcgatgatgcctaacgctaacctggcggcagcgcaaaagatg

SEQ ID NO: 31592 - DNA, 103 bp, Artificial Sequence
  Synthetic Polynucleotide
taatacgactcactatagggcaccttctgactacatttggacaaaatgaaaacagaggagattcattatgtccaaatgtaacctggcggcagcgcaaaagatg

SEQ ID NO: 31593 - DNA, 103 bp, Artificial Sequence
  Synthetic Polynucleotide
taatacgactcactatagggttgatgaatactttgattatgaccgctcataacagaggagaatgagcatgcataatcaaaacctggcggcagcgcaaaagatg

SEQ ID NO: 31594 - DNA, 103 bp, Artificial Sequence
  Synthetic Polynucleotide
taatacgactcactatagggatatgcgatctaggccaatgaatcaagattaacagaggagaaatcttatgtcattggccaacctggcggcagcgcaaaagatg

SEQ ID NO: 31595 - DNA, 103 bp, Artificial Sequence
  Synthetic Polynucleotide
taatacgactcactataggggcactcggagatcagcgtcggtaaccactcaacagaggagagagtggatgccgacgctgaacctggcggcagcgcaaaagatg

SEQ ID NO: 31596 - DNA, 103 bp, Artificial Sequence
  Synthetic Polynucleotide
taatacgactcactatagggaaggatcgtgggcggtaaaccagaggcagaaacagaggagatctgccatgggtttaccgaacctggcggcagcgcaaaagatg

SEQ ID NO: 31597 - DNA, 103 bp, Artificial Sequence
  Synthetic Polynucleotide
taatacgactcactatagggtgtatatagtgtgtactctaagacatattgaacagaggagacaatatatgttagagtacaacctggcggcagcgcaaaagatg

SEQ ID NO: 31598 - DNA, 103 bp, Artificial Sequence
  Synthetic Polynucleotide
taatacgactcactatagggcctcgggttaactagagacatgagtcagttaacagaggagaaactgaatgatgtctctaaacctggcggcagcgcaaaagatg

SEQ ID NO: 31599 - DNA, 103 bp, Artificial Sequence
  Synthetic Polynucleotide
taatacgactcactatagggcctgcagctaatgaacggtctgaggccgcgaacagaggagacgcggcatgagaccgttcaacctggcggcagcgcaaaagatg

SEQ ID NO: 31600 - DNA, 103 bp, Artificial Sequence
  Synthetic Polynucleotide
taatacgactcactataggggcccaatatgtcgaaggagaggtggaagcgaacagaggagacgcttcatgctctccttcaacctggcggcagcgcaaaagatg

SEQ ID NO: 31601 - DNA, 103 bp, Artificial Sequence
  Synthetic Polynucleotide
taatacgactcactatagggccgtcctatatattaggagcggagactagaaacagaggagatctagtatgcgctcctaaaacctggcggcagcgcaaaagatg

SEQ ID NO: 31602 - DNA, 103 bp, Artificial Sequence
  Synthetic Polynucleotide
taatacgactcactataggggcggaggggttagtgctactataggcaggtaacagaggagaacctgcatgtagtagcacaacctggcggcagcgcaaaagatg

SEQ ID NO: 31603 - DNA, 103 bp, Artificial Sequence
  Synthetic Polynucleotide
taatacgactcactataggggcccctgcccgatgagaacggagagtggacaacagaggagagtccacatgccgttctcaaacctggcggcagcgcaaaagatg

SEQ ID NO: 31604 - DNA, 103 bp, Artificial Sequence
  Synthetic Polynucleotide
taatacgactcactatagggtccttgatggcatgagtccgggcagtgctgaacagaggagacagcacatgccggactcaaacctggcggcagcgcaaaagatg

SEQ ID NO: 31605 - DNA, 103 bp, Artificial Sequence
  Synthetic Polynucleotide
taatacgactcactatagggcattcgctcatcgcttatataaggtagttgaacagaggagacaactaatgtatataagcaacctggcggcagcgcaaaagatg

SEQ ID NO: 31606 - DNA, 103 bp, Artificial Sequence
  Synthetic Polynucleotide
taatacgactcactatagggcgaagtgcttataactagcagcgaacaagaaacagaggagatcttgtatgctgctagttaacctggcggcagcgcaaaagatg

SEQ ID NO: 31607 - DNA, 103 bp, Artificial Sequence
  Synthetic Polynucleotide
taatacgactcactataggggcgcccattccgatgaaactgagtctttataacagaggagaataaagatgcagtttcataacctggcggcagcgcaaaagatg

SEQ ID NO: 31608 - DNA, 103 bp, Artificial Sequence
  Synthetic Polynucleotide
taatacgactcactataggggcagggaggtccgaggctctacctgatcccaacagaggagagggatcatgtagagcctcaacctggcggcagcgcaaaagatg

SEQ ID NO: 31609 - DNA, 103 bp, Artificial Sequence
  Synthetic Polynucleotide
taatacgactcactatagggtgattaaccccggttctcatgggacccgcgaacagaggagacgcgggatgcatgagaacaacctggcggcagcgcaaaagatg

SEQ ID NO: 31610 - DNA, 103 bp, Artificial Sequence
  Synthetic Polynucleotide
taatacgactcactatagggatcaggcccctgttggcgtcagacgagaataacagaggagaattctcatgtgacgccaaaacctggcggcagcgcaaaagatg

SEQ ID NO: 31611 - DNA, 103 bp, Artificial Sequence
  Synthetic Polynucleotide
taatacgactcactatagggcgatgcttcagcgatatcactgcatggctaaacagaggagatagccaatgagtgatatcaacctggcggcagcgcaaaagatg

SEQ ID NO: 31612 - DNA, 103 bp, Artificial Sequence
  Synthetic Polynucleotide
taatacgactcactatagggcagcaccctaataagcatagtctccccacgaacagaggagacgtgggatgactatgcttaacctggcggcagcgcaaaagatg

SEQ ID NO: 31613 - DNA, 103 bp, Artificial Sequence
  Synthetic Polynucleotide
taatacgactcactatagggtgccaagaaagcactactcagcagttcgacaacagaggagagtcgaaatgctgagtagtaacctggcggcagcgcaaaagatg

SEQ ID NO: 31614 - DNA, 103 bp, Artificial Sequence
  Synthetic Polynucleotide
taatacgactcactatagggaatggcgttttgccaggcggtatattatagaacagaggagactataaatgaccgcctggaacctggcggcagcgcaaaagatg

SEQ ID NO: 31615 - DNA, 103 bp, Artificial Sequence
  Synthetic Polynucleotide
taatacgactcactatagggaacagtaatgtgcgtgttccggtatgtctaaacagaggagatagacaatgcggaacacgaacctggcggcagcgcaaaagatg

SEQ ID NO: 31616 - DNA, 103 bp, Artificial Sequence
  Synthetic Polynucleotide
taatacgactcactatagggggggtagtccatggcctagtctgtttacgtaacagaggagaacgtaaatggactaggccaacctggcggcagcgcaaaagatg

SEQ ID NO: 31617 - DNA, 103 bp, Artificial Sequence
  Synthetic Polynucleotide
taatacgactcactataggggcagtcaggaaacgggtccattttctccctaacagaggagaagggagatgatggacccgaacctggcggcagcgcaaaagatg

SEQ ID NO: 31618 - DNA, 103 bp, Artificial Sequence
  Synthetic Polynucleotide
taatacgactcactatagggtccttgaagggatccgtaactgtgacatttaacagaggagaaaatgtatgagttacggaaacctggcggcagcgcaaaagatg

SEQ ID NO: 31619 - DNA, 103 bp, Artificial Sequence
  Synthetic Polynucleotide
taatacgactcactatagggacccatgtggacatagaaagggattttgccaacagaggagaggcaaaatgcctttctataacctggcggcagcgcaaaagatg

SEQ ID NO: 31620 - DNA, 103 bp, Artificial Sequence
  Synthetic Polynucleotide
taatacgactcactatagggccctccccggccgtaccgccgtgaggattaaacagaggagataatccatgcggcggtacaacctggcggcagcgcaaaagatg

SEQ ID NO: 31621 - DNA, 103 bp, Artificial Sequence
  Synthetic Polynucleotide
taatacgactcactatagggtggaccgatgacaaaacgaatagacccagaaacagaggagatctgggatgattcgttttaacctggcggcagcgcaaaagatg

SEQ ID NO: 31622 - DNA, 103 bp, Artificial Sequence
  Synthetic Polynucleotide
taatacgactcactataggggcagatgcatccttcgaacgaacgcgaggtaacagaggagaacctcgatgtcgttcgaaaacctggcggcagcgcaaaagatg

SEQ ID NO: 31623 - DNA, 103 bp, Artificial Sequence
  Synthetic Polynucleotide
taatacgactcactatagggcttacagagcatgctcgggattccggagagaacagaggagactctccatgatcccgagcaacctggcggcagcgcaaaagatg

SEQ ID NO: 31624 - DNA, 103 bp, Artificial Sequence
  Synthetic Polynucleotide
taatacgactcactatagggcacggcgacccaaaagcagtcactgtccccaacagaggagaggggacatggactgctttaacctggcggcagcgcaaaagatg

SEQ ID NO: 31625 - DNA, 103 bp, Artificial Sequence
  Synthetic Polynucleotide
taatacgactcactatagggtggggggcataggaaggacggcctgttagaaacagaggagatctaacatgccgtccttcaacctggcggcagcgcaaaagatg

SEQ ID NO: 31626 - DNA, 103 bp, Artificial Sequence
  Synthetic Polynucleotide
taatacgactcactataggggacccatcgctaacgcatttctccttacctaacagaggagaaggtaaatggaaatgcgtaacctggcggcagcgcaaaagatg

SEQ ID NO: 31627 - DNA, 103 bp, Artificial Sequence
  Synthetic Polynucleotide
taatacgactcactatagggctatccgccttagacgaggcgtatcgtaacaacagaggagagttacgatgcgcctcgtcaacctggcggcagcgcaaaagatg

SEQ ID NO: 31628 - DNA, 103 bp, Artificial Sequence
  Synthetic Polynucleotide
taatacgactcactatagggacgcttacggacctggcgatcgcctacgagaacagaggagactcgtaatggatcgccagaacctggcggcagcgcaaaagatg

SEQ ID NO: 31629 - DNA, 103 bp, Artificial Sequence
  Synthetic Polynucleotide
taatacgactcactatagggatgctggctactgggatcatatggcagcaaaacagaggagattgctgatgtatgatcccaacctggcggcagcgcaaaagatg

SEQ ID NO: 31630 - DNA, 103 bp, Artificial Sequence
  Synthetic Polynucleotide
taatacgactcactatagggctgcacaatactataacggaggggagttccaacagaggagaggaactatgctccgttataacctggcggcagcgcaaaagatg

SEQ ID NO: 31631 - DNA, 103 bp, Artificial Sequence
  Synthetic Polynucleotide
taatacgactcactatagggaacacccgagaagacagcccctctaattaaaacagaggagattaattatgggggctgtcaacctggcggcagcgcaaaagatg

SEQ ID NO: 31632 - DNA, 103 bp, Artificial Sequence
  Synthetic Polynucleotide
taatacgactcactatagggtacacactcgcctaatccggccaccctcagaacagaggagactgaggatggccggattaaacctggcggcagcgcaaaagatg

SEQ ID NO: 31633 - DNA, 103 bp, Artificial Sequence
  Synthetic Polynucleotide
taatacgactcactatagggagcctcctgtcatgggtcactttattccgcaacagaggagagcggaaatgagtgacccaaacctggcggcagcgcaaaagatg

SEQ ID NO: 31634 - DNA, 103 bp, Artificial Sequence
  Synthetic Polynucleotide
taatacgactcactatagggctcggcaaagcaatattgccatcacgatctaacagaggagaagatcgatgtggcaatataacctggcggcagcgcaaaagatg

SEQ ID NO: 31635 - DNA, 103 bp, Artificial Sequence
  Synthetic Polynucleotide
taatacgactcactatagggatcctggcgcatcaacacaagtattgcagcaacagaggagagctgcaatgcttgtgttgaacctggcggcagcgcaaaagatg

SEQ ID NO: 31636 - DNA, 103 bp, Artificial Sequence
  Synthetic Polynucleotide
taatacgactcactatagggccgtatggtcttatagactccattagaagcaacagaggagagcttctatgggagtctataacctggcggcagcgcaaaagatg

SEQ ID NO: 31637 - DNA, 103 bp, Artificial Sequence
  Synthetic Polynucleotide
taatacgactcactatagggcacccgtcacctatctaaggggtaaataaaaacagaggagatttattatgcccttagataacctggcggcagcgcaaaagatg

SEQ ID NO: 31638 - DNA, 103 bp, Artificial Sequence
  Synthetic Polynucleotide
taatacgactcactatagggcagagtcatccaattagggttaggaacaagaacagaggagacttgttatgaaccctaataacctggcggcagcgcaaaagatg

SEQ ID NO: 31639 - DNA, 103 bp, Artificial Sequence
  Synthetic Polynucleotide
taatacgactcactatagggcgacaatctatgtccactaactggacctccaacagaggagaggaggtatggttagtggaaacctggcggcagcgcaaaagatg

SEQ ID NO: 31640 - DNA, 103 bp, Artificial Sequence
  Synthetic Polynucleotide
taatacgactcactatagggattacgtcttaccggttttattctagttaaaacagaggagattaactatgataaaaccgaacctggcggcagcgcaaaagatg

SEQ ID NO: 31641 - DNA, 103 bp, Artificial Sequence
  Synthetic Polynucleotide
taatacgactcactatagggtcaccacctgcaccagaaaagccactttctaacagaggagaagaaagatgcttttctggaacctggcggcagcgcaaaagatg

SEQ ID NO: 31642 - DNA, 103 bp, Artificial Sequence
  Synthetic Polynucleotide
taatacgactcactataggggaaggcgttcatgccccaacagatgcagccaacagaggagaggctgcatgtgttggggcaacctggcggcagcgcaaaagatg

SEQ ID NO: 31643 - DNA, 103 bp, Artificial Sequence
  Synthetic Polynucleotide
taatacgactcactatagggagcttggttcctcgagatgcgtatgcattgaacagaggagacaatgcatgcgcatctcgaacctggcggcagcgcaaaagatg

SEQ ID NO: 31644 - DNA, 103 bp, Artificial Sequence
  Synthetic Polynucleotide
taatacgactcactataggggattgctagtaattcggctgaacattcgtaaacagaggagatacgaaatgtcagccgaaaacctggcggcagcgcaaaagatg

SEQ ID NO: 31645 - DNA, 103 bp, Artificial Sequence
  Synthetic Polynucleotide
taatacgactcactatagggatgttgcgacatattccatttccaatacgaaacagaggagatcgtatatgaaatggaataacctggcggcagcgcaaaagatg

SEQ ID NO: 31646 - DNA, 103 bp, Artificial Sequence
  Synthetic Polynucleotide
taatacgactcactatagggtatgccgatatagtcacgtggtttacctaaaacagaggagattaggtatgccacgtgacaacctggcggcagcgcaaaagatg

SEQ ID NO: 31647 - DNA, 103 bp, Artificial Sequence
  Synthetic Polynucleotide
taatacgactcactatagggctgggatctgtcaagataggtcggtagcgaaacagaggagatcgctaatgacctatcttaacctggcggcagcgcaaaagatg

SEQ ID NO: 31648 - DNA, 103 bp, Artificial Sequence
  Synthetic Polynucleotide
taatacgactcactatagggcggtgcattgtaggtattatagatcattccaacagaggagaggaatgatgtataataccaacctggcggcagcgcaaaagatg

SEQ ID NO: 31649 - DNA, 103 bp, Artificial Sequence
  Synthetic Polynucleotide
taatacgactcactatagggttgctcggaatgggttggacatacgcactgaacagaggagacagtgcatgtgtccaaccaacctggcggcagcgcaaaagatg

SEQ ID NO: 31650 - DNA, 103 bp, Artificial Sequence
  Synthetic Polynucleotide
taatacgactcactataggggactctcccggtaaggtccatcttcctgctaacagaggagaagcaggatgatggaccttaacctggcggcagcgcaaaagatg

SEQ ID NO: 31651 - DNA, 103 bp, Artificial Sequence
  Synthetic Polynucleotide
taatacgactcactatagggttgtgtgtcatagggtacaacaggtacttgaacagaggagacaagtaatggttgtacccaacctggcggcagcgcaaaagatg

SEQ ID NO: 31652 - DNA, 103 bp, Artificial Sequence
  Synthetic Polynucleotide
taatacgactcactataggggttcgttccccgggtgtcaccgaaccccataacagaggagaatggggatgggtgacaccaacctggcggcagcgcaaaagatg

SEQ ID NO: 31653 - DNA, 103 bp, Artificial Sequence
  Synthetic Polynucleotide
taatacgactcactatagggggtgaaccgcgaacggtaaactcgttttgtaacagaggagaacaaaaatggtttaccgtaacctggcggcagcgcaaaagatg

SEQ ID NO: 31654 - DNA, 103 bp, Artificial Sequence
  Synthetic Polynucleotide
taatacgactcactatagggttgactcgctaccttgtattcggccggtagaacagaggagactaccgatggaatacaagaacctggcggcagcgcaaaagatg

SEQ ID NO: 31655 - DNA, 103 bp, Artificial Sequence
  Synthetic Polynucleotide
taatacgactcactataggggcctcgtctccaaggcaacatacaataaggaacagaggagaccttatatgatgttgcctaacctggcggcagcgcaaaagatg

SEQ ID NO: 31656 - DNA, 103 bp, Artificial Sequence
  Synthetic Polynucleotide
taatacgactcactatagggccggagtagtgtggctactcatatgaggacaacagaggagagtcctcatgtgagtagccaacctggcggcagcgcaaaagatg

SEQ ID NO: 31657 - DNA, 103 bp, Artificial Sequence
  Synthetic Polynucleotide
taatacgactcactatagggggcatgctggttaccggttggaaaatcagcaacagaggagagctgatatgccaaccggtaacctggcggcagcgcaaaagatg

SEQ ID NO: 31658 - DNA, 103 bp, Artificial Sequence
  Synthetic Polynucleotide
taatacgactcactatagggatggtctactccgagtggattacttcagtaaacagaggagatactgaatgaatccactcaacctggcggcagcgcaaaagatg

SEQ ID NO: 31659 - DNA, 103 bp, Artificial Sequence
  Synthetic Polynucleotide
taatacgactcactatagggcgactgatcactatgaggttgatgtactgaaacagaggagatcagtaatgcaacctcataacctggcggcagcgcaaaagatg

SEQ ID NO: 31660 - DNA, 103 bp, Artificial Sequence
  Synthetic Polynucleotide
taatacgactcactatagggtgtcaagctatgaagcgctagcattgggggaacagaggagacccccaatgctagcgcttaacctggcggcagcgcaaaagatg

SEQ ID NO: 31661 - DNA, 103 bp, Artificial Sequence
  Synthetic Polynucleotide
taatacgactcactataggggcgagacccacacgctgatgtgtagtgtcgaacagaggagacgacacatgacatcagcgaacctggcggcagcgcaaaagatg

SEQ ID NO: 31662 - DNA, 103 bp, Artificial Sequence
  Synthetic Polynucleotide
taatacgactcactatagggcgtaaacagattaagattctttgcggcatgaacagaggagacatgccatgaagaatcttaacctggcggcagcgcaaaagatg

SEQ ID NO: 31663 - DNA, 103 bp, Artificial Sequence
  Synthetic Polynucleotide
taatacgactcactatagggttcggattccttcataaccctcgcagacagaacagaggagactgtctatgagggttatgaacctggcggcagcgcaaaagatg

SEQ ID NO: 31664 - DNA, 103 bp, Artificial Sequence
  Synthetic Polynucleotide
taatacgactcactatagggctaagacctaatcctcagggttggcgcctaaacagaggagataggcgatgaccctgaggaacctggcggcagcgcaaaagatg

SEQ ID NO: 31665 - DNA, 103 bp, Artificial Sequence
  Synthetic Polynucleotide
taatacgactcactataggggggacaaaaagtggggcgcaacgaactcctaacagaggagaaggagtatgttgcgccccaacctggcggcagcgcaaaagatg

SEQ ID NO: 31666 - DNA, 103 bp, Artificial Sequence
  Synthetic Polynucleotide
taatacgactcactatagggcgtcgcggctaagatttggacttgtaatataacagaggagaatattaatggtccaaatcaacctggcggcagcgcaaaagatg

SEQ ID NO: 31667 - DNA, 103 bp, Artificial Sequence
  Synthetic Polynucleotide
taatacgactcactatagggcttgcgtaaagcaaatttacgtgggtagctaacagaggagaagctacatgcgtaaatttaacctggcggcagcgcaaaagatg

SEQ ID NO: 31668 - DNA, 103 bp, Artificial Sequence
  Synthetic Polynucleotide
taatacgactcactatagggtaggaggagtcagggatactagttcaggccaacagaggagaggcctgatgtagtatcccaacctggcggcagcgcaaaagatg

SEQ ID NO: 31669 - DNA, 103 bp, Artificial Sequence
  Synthetic Polynucleotide
taatacgactcactatagggtaagggggggccaacctactgcctccgattaacagaggagaaatcggatgcagtaggttaacctggcggcagcgcaaaagatg

SEQ ID NO: 31670 - DNA, 103 bp, Artificial Sequence
  Synthetic Polynucleotide
taatacgactcactatagggccatgctggtttgtctggatgcactgagcgaacagaggagacgctcaatgcatccagacaacctggcggcagcgcaaaagatg

SEQ ID NO: 31671 - DNA, 103 bp, Artificial Sequence
  Synthetic Polynucleotide
taatacgactcactatagggttcgtacacgatcctggataccgcacggacaacagaggagagtccgtatggtatccaggaacctggcggcagcgcaaaagatg

SEQ ID NO: 31672 - DNA, 103 bp, Artificial Sequence
  Synthetic Polynucleotide
taatacgactcactatagggatgttttacaccctggcggggtcactcacgaacagaggagacgtgagatgccccgccagaacctggcggcagcgcaaaagatg

SEQ ID NO: 31673 - DNA, 103 bp, Artificial Sequence
  Synthetic Polynucleotide
taatacgactcactatagggtataagccgctgcaacgcgcgagatgtaggaacagaggagacctacaatgcgcgcgttgaacctggcggcagcgcaaaagatg

SEQ ID NO: 31674 - DNA, 103 bp, Artificial Sequence
  Synthetic Polynucleotide
taatacgactcactatagggaagtactttatatgactctaggccccgagtaacagaggagaactcggatgctagagtcaaacctggcggcagcgcaaaagatg

SEQ ID NO: 31675 - DNA, 103 bp, Artificial Sequence
  Synthetic Polynucleotide
taatacgactcactatagggccatgcacagcaggggatctttctgtaaggaacagaggagaccttacatgaagatccccaacctggcggcagcgcaaaagatg

SEQ ID NO: 31676 - DNA, 103 bp, Artificial Sequence
  Synthetic Polynucleotide
taatacgactcactataggggtacgtcattttagggggctttgacttcgaaacagaggagatcgaagatgaagccccctaacctggcggcagcgcaaaagatg

SEQ ID NO: 31677 - DNA, 103 bp, Artificial Sequence
  Synthetic Polynucleotide
taatacgactcactatagggtcatcagacgggctgatagcagcgtgggctaacagaggagaagcccaatgtgctatcagaacctggcggcagcgcaaaagatg

SEQ ID NO: 31678 - DNA, 103 bp, Artificial Sequence
  Synthetic Polynucleotide
taatacgactcactatagggtaggcgtaattcaactccaacaatgctaaaaacagaggagatttagcatggttggagttaacctggcggcagcgcaaaagatg

SEQ ID NO: 31679 - DNA, 103 bp, Artificial Sequence
  Synthetic Polynucleotide
taatacgactcactatagggtgggtgcgcaaccgtgcggtgacgtcctgcaacagaggagagcaggaatgcaccgcacgaacctggcggcagcgcaaaagatg

SEQ ID NO: 31680 - DNA, 103 bp, Artificial Sequence
  Synthetic Polynucleotide
taatacgactcactatagggtcgtatgatggcagtcctccgccatgtgcgaacagaggagacgcacaatgcggaggactaacctggcggcagcgcaaaagatg

SEQ ID NO: 31681 - DNA, 103 bp, Artificial Sequence
  Synthetic Polynucleotide
taatacgactcactataggggcgcgggctcactgagatcgagagcatgataacagaggagaatcatgatgtcgatctcaaacctggcggcagcgcaaaagatg

SEQ ID NO: 31682 - DNA, 103 bp, Artificial Sequence
  Synthetic Polynucleotide
taatacgactcactatagggagggtcgaccgggacgttataaatttgcagaacagaggagactgcaaatgtataacgtcaacctggcggcagcgcaaaagatg

SEQ ID NO: 31683 - DNA, 103 bp, Artificial Sequence
  Synthetic Polynucleotide
taatacgactcactatagggctctgtcaactaggatccttcaaggcctataacagaggagaataggcatggaaggatccaacctggcggcagcgcaaaagatg

SEQ ID NO: 31684 - DNA, 103 bp, Artificial Sequence
  Synthetic Polynucleotide
taatacgactcactatagggcgtgcacctgcatcagggtggatcgatcgaaacagaggagatcgatcatgccaccctgaaacctggcggcagcgcaaaagatg

SEQ ID NO: 31685 - DNA, 103 bp, Artificial Sequence
  Synthetic Polynucleotide
taatacgactcactataggggtgtgctgggtacctagaagctcatcttcaaacagaggagatgaagaatggcttctaggaacctggcggcagcgcaaaagatg

SEQ ID NO: 31686 - DNA, 103 bp, Artificial Sequence
  Synthetic Polynucleotide
taatacgactcactatagggataagtgattcctagtaagttactccgtcaaacagaggagatgacggatgaacttactaaacctggcggcagcgcaaaagatg

SEQ ID NO: 31687 - DNA, 103 bp, Artificial Sequence
  Synthetic Polynucleotide
taatacgactcactatagggtcagccgttttgaccaaacctcatgaggggaacagaggagacccctcatgaggtttggtaacctggcggcagcgcaaaagatg

SEQ ID NO: 31688 - DNA, 103 bp, Artificial Sequence
  Synthetic Polynucleotide
taatacgactcactataggggatacgacctataacagcagcttatcttagaacagaggagactaagaatggctgctgttaacctggcggcagcgcaaaagatg

SEQ ID NO: 31689 - DNA, 103 bp, Artificial Sequence
  Synthetic Polynucleotide
taatacgactcactatagggcagatattggtaaccgtctcggacgcggccaacagaggagaggccgcatgcgagacggtaacctggcggcagcgcaaaagatg

SEQ ID NO: 31690 - DNA, 103 bp, Artificial Sequence
  Synthetic Polynucleotide
taatacgactcactatagggcaggggcagtcttggagctcaatgtcaaataacagaggagaatttgaatgtgagctccaaacctggcggcagcgcaaaagatg

SEQ ID NO: 31691 - DNA, 103 bp, Artificial Sequence
  Synthetic Polynucleotide
taatacgactcactatagggacctactccattagtcgtcgcagagtgcggaacagaggagaccgcacatggcgacgactaacctggcggcagcgcaaaagatg

SEQ ID NO: 31692 - DNA, 103 bp, Artificial Sequence
  Synthetic Polynucleotide
taatacgactcactatagggcgtccttacgacccactgcgctttcgtcccaacagaggagagggacgatggcgcagtggaacctggcggcagcgcaaaagatg

SEQ ID NO: 31693 - DNA, 103 bp, Artificial Sequence
  Synthetic Polynucleotide
taatacgactcactatagggagagtcattcagaactcagtgtgtcgcataaacagaggagatatgcgatgcactgagttaacctggcggcagcgcaaaagatg

SEQ ID NO: 31694 - DNA, 103 bp, Artificial Sequence
  Synthetic Polynucleotide
taatacgactcactatagggatttttcaagtagccttatagtatggctggaacagaggagaccagccatgctataaggcaacctggcggcagcgcaaaagatg

SEQ ID NO: 31695 - DNA, 103 bp, Artificial Sequence
  Synthetic Polynucleotide
taatacgactcactatagggctgggactccaagggcacgtaagttacacaaacagaggagatgtgtaatgtacgtgcccaacctggcggcagcgcaaaagatg

SEQ ID NO: 31696 - DNA, 103 bp, Artificial Sequence
  Synthetic Polynucleotide
taatacgactcactatagggtaggaaatcaacgccctgtgctaattccacaacagaggagagtggaaatggcacagggcaacctggcggcagcgcaaaagatg

SEQ ID NO: 31697 - DNA, 103 bp, Artificial Sequence
  Synthetic Polynucleotide
taatacgactcactatagggactggaggcccacgtaatttctgtcggactaacagaggagaagtccgatggaaattacgaacctggcggcagcgcaaaagatg

SEQ ID NO: 31698 - DNA, 103 bp, Artificial Sequence
  Synthetic Polynucleotide
taatacgactcactatagggcgactaaacttgtgctaaagcgcccttgagaacagaggagactcaagatggctttagcaaacctggcggcagcgcaaaagatg

SEQ ID NO: 31699 - DNA, 103 bp, Artificial Sequence
  Synthetic Polynucleotide
taatacgactcactataggggaagagcattgcgccactggggtcggccgtaacagaggagaacggccatgcccagtggcaacctggcggcagcgcaaaagatg

SEQ ID NO: 31700 - DNA, 103 bp, Artificial Sequence
  Synthetic Polynucleotide
taatacgactcactatagggagagagcctcgccaatccgccttatcctggaacagaggagaccaggaatgggcggattgaacctggcggcagcgcaaaagatg

SEQ ID NO: 31701 - DNA, 103 bp, Artificial Sequence
  Synthetic Polynucleotide
taatacgactcactatagggtaacacaatcataatgcgaagcctactgcaaacagaggagatgcagtatgcttcgcattaacctggcggcagcgcaaaagatg

SEQ ID NO: 31702 - DNA, 103 bp, Artificial Sequence
  Synthetic Polynucleotide
taatacgactcactatagggagccattagtaaaactgaccccttgcagacaacagaggagagtctgcatggggtcagttaacctggcggcagcgcaaaagatg

SEQ ID NO: 31703 - DNA, 103 bp, Artificial Sequence
  Synthetic Polynucleotide
taatacgactcactatagggatggtagctctctactaggctccattgggaaacagaggagatcccaaatgagcctagtaaacctggcggcagcgcaaaagatg

SEQ ID NO: 31704 - DNA, 103 bp, Artificial Sequence
  Synthetic Polynucleotide
taatacgactcactatagggtagacccgccgcgcgatagcctcgcgtcataacagaggagaatgacgatgggctatcgcaacctggcggcagcgcaaaagatg

SEQ ID NO: 31705 - DNA, 103 bp, Artificial Sequence
  Synthetic Polynucleotide
taatacgactcactatagggcagaggacaaccccagagtatgcgccaagaaacagaggagatcttggatgatactctggaacctggcggcagcgcaaaagatg

SEQ ID NO: 31706 - DNA, 103 bp, Artificial Sequence
  Synthetic Polynucleotide
taatacgactcactatagggatcggaactgtacttctagggatattaacaaacagaggagatgttaaatgccctagaagaacctggcggcagcgcaaaagatg

SEQ ID NO: 31707 - DNA, 103 bp, Artificial Sequence
  Synthetic Polynucleotide
taatacgactcactatagggggacaaccctcccagccttgcatcggggttaacagaggagaaaccccatggcaaggctgaacctggcggcagcgcaaaagatg

SEQ ID NO: 31708 - DNA, 103 bp, Artificial Sequence
  Synthetic Polynucleotide
taatacgactcactatagggagtgagcgcgaccctaaaaacaggagttccaacagaggagaggaactatggtttttaggaacctggcggcagcgcaaaagatg

SEQ ID NO: 31709 - DNA, 103 bp, Artificial Sequence
  Synthetic Polynucleotide
taatacgactcactatagggtccactgcacacattccacgtggtgcgaacaacagaggagagttcgcatgacgtggaataacctggcggcagcgcaaaagatg

SEQ ID NO: 31710 - DNA, 103 bp, Artificial Sequence
  Synthetic Polynucleotide
taatacgactcactatagggagctctctggcgaaagacatccaccggcccaacagaggagagggccgatggatgtctttaacctggcggcagcgcaaaagatg

SEQ ID NO: 31711 - DNA, 103 bp, Artificial Sequence
  Synthetic Polynucleotide
taatacgactcactatagggcgtttgtataaaagaatagcatcccccgagaacagaggagactcgggatgtgctattctaacctggcggcagcgcaaaagatg

SEQ ID NO: 31712 - DNA, 103 bp, Artificial Sequence
  Synthetic Polynucleotide
taatacgactcactatagggtacaccagaaacgcggcttacagctgcggtaacagaggagaaccgcaatggtaagccgcaacctggcggcagcgcaaaagatg

SEQ ID NO: 31713 - DNA, 103 bp, Artificial Sequence
  Synthetic Polynucleotide
taatacgactcactatagggagtgcgatcgcctcccaacccttgatcttaaacagaggagataagatatggggttgggaaacctggcggcagcgcaaaagatg

SEQ ID NO: 31714 - DNA, 103 bp, Artificial Sequence
  Synthetic Polynucleotide
taatacgactcactatagggatcggacgacgcaacatagacgcacaaccaaacagaggagatggttgatggtctatgttaacctggcggcagcgcaaaagatg

SEQ ID NO: 31715 - DNA, 103 bp, Artificial Sequence
  Synthetic Polynucleotide
taatacgactcactatagggtccacataaagaaactgcattgaaagtcagaacagaggagactgactatgaatgcagttaacctggcggcagcgcaaaagatg

SEQ ID NO: 31716 - DNA, 103 bp, Artificial Sequence
  Synthetic Polynucleotide
taatacgactcactataggggacatcctcgtgtgtagtcgggccgatcataacagaggagaatgatcatgccgactacaaacctggcggcagcgcaaaagatg

SEQ ID NO: 31717 - DNA, 103 bp, Artificial Sequence
  Synthetic Polynucleotide
taatacgactcactataggggctccattagtgccctacgcctggggcatgaacagaggagacatgccatgggcgtagggaacctggcggcagcgcaaaagatg

SEQ ID NO: 31718 - DNA, 103 bp, Artificial Sequence
  Synthetic Polynucleotide
taatacgactcactatagggtgtaaagtgagaatcgagcgtagggcgacaaacagaggagatgtcgcatgacgctcgataacctggcggcagcgcaaaagatg

SEQ ID NO: 31719 - DNA, 103 bp, Artificial Sequence
  Synthetic Polynucleotide
taatacgactcactatagggcgattgagcgtcccacttccgtttcgtaacaacagaggagagttacgatgcggaagtggaacctggcggcagcgcaaaagatg

SEQ ID NO: 31720 - DNA, 103 bp, Artificial Sequence
  Synthetic Polynucleotide
taatacgactcactatagggtgaccgattcggcgcttctcgcactctaggaacagaggagacctagaatgcgagaagcgaacctggcggcagcgcaaaagatg

SEQ ID NO: 31721 - DNA, 103 bp, Artificial Sequence
  Synthetic Polynucleotide
taatacgactcactataggggctttcgaaaaactaactgatcggcaattcaacagaggagagaattgatgatcagttagaacctggcggcagcgcaaaagatg

SEQ ID NO: 31722 - DNA, 103 bp, Artificial Sequence
  Synthetic Polynucleotide
taatacgactcactatagggaacacgggtgaaaaggccgtctttagcccgaacagaggagacgggctatggacggccttaacctggcggcagcgcaaaagatg

SEQ ID NO: 31723 - DNA, 103 bp, Artificial Sequence
  Synthetic Polynucleotide
taatacgactcactataggggccaagagcggggaagagagatgttacagtaacagaggagaactgtaatgtctctcttcaacctggcggcagcgcaaaagatg

SEQ ID NO: 31724 - DNA, 103 bp, Artificial Sequence
  Synthetic Polynucleotide
taatacgactcactatagggtgggtcaacttccccaaactcctccctcccaacagaggagagggaggatggagtttgggaacctggcggcagcgcaaaagatg

SEQ ID NO: 31725 - DNA, 103 bp, Artificial Sequence
  Synthetic Polynucleotide
taatacgactcactatagggtaaggtcggcgcttactaacggcagtctacaacagaggagagtagacatgcgttagtaaaacctggcggcagcgcaaaagatg

SEQ ID NO: 31726 - DNA, 103 bp, Artificial Sequence
  Synthetic Polynucleotide
taatacgactcactatagggagtcagtcctaagcgttgtcgtaaaattgaaacagaggagatcaattatgcgacaacgcaacctggcggcagcgcaaaagatg

SEQ ID NO: 31727 - DNA, 103 bp, Artificial Sequence
  Synthetic Polynucleotide
taatacgactcactatagggagttaccagaccttccccaaagctgtagcgaacagaggagacgctacatgtttggggaaaacctggcggcagcgcaaaagatg

SEQ ID NO: 31728 - DNA, 103 bp, Artificial Sequence
  Synthetic Polynucleotide
taatacgactcactatagggactacgtgggtattgcgtagtctgcgtacgaacagaggagacgtacgatgactacgcaaaacctggcggcagcgcaaaagatg

SEQ ID NO: 31729 - DNA, 103 bp, Artificial Sequence
  Synthetic Polynucleotide
taatacgactcactatagggcgtaccgagctctcgtaacgaaccaacctgaacagaggagacaggttatgtcgttacgaaacctggcggcagcgcaaaagatg

SEQ ID NO: 31730 - DNA, 103 bp, Artificial Sequence
  Synthetic Polynucleotide
taatacgactcactatagggccgggagcaataatgttgaacgcaccccataacagaggagaatggggatggttcaacataacctggcggcagcgcaaaagatg

SEQ ID NO: 31731 - DNA, 103 bp, Artificial Sequence
  Synthetic Polynucleotide
taatacgactcactatagggcctactctgatctggcatcgttatttttttaacagaggagaaaaaaaatgacgatgccaaacctggcggcagcgcaaaagatg

SEQ ID NO: 31732 - DNA, 103 bp, Artificial Sequence
  Synthetic Polynucleotide
taatacgactcactatagggcgaggccgatggcgatacacacagagcaggaacagaggagacctgctatgtgtgtatcgaacctggcggcagcgcaaaagatg

SEQ ID NO: 31733 - DNA, 103 bp, Artificial Sequence
  Synthetic Polynucleotide
taatacgactcactatagggtaggctcctatcttaagcaaaaaagaattaaacagaggagataattcatgtttgcttaaaacctggcggcagcgcaaaagatg

SEQ ID NO: 31734 - DNA, 103 bp, Artificial Sequence
  Synthetic Polynucleotide
taatacgactcactatagggacgagttggcggtagtagcgaataccagctaacagaggagaagctggatgtcgctactaaacctggcggcagcgcaaaagatg

SEQ ID NO: 31735 - DNA, 103 bp, Artificial Sequence
  Synthetic Polynucleotide
taatacgactcactatagggtactcggaatctcgattttcaagcttagataacagaggagaatctaaatgtgaaaatcgaacctggcggcagcgcaaaagatg

SEQ ID NO: 31736 - DNA, 103 bp, Artificial Sequence
  Synthetic Polynucleotide
taatacgactcactatagggttagaagaagtgagtgcacaccaccacgccaacagaggagaggcgtgatggtgtgcactaacctggcggcagcgcaaaagatg

SEQ ID NO: 31737 - DNA, 103 bp, Artificial Sequence
  Synthetic Polynucleotide
taatacgactcactatagggtgcttgtcaaatgggctttttagggtatcgaacagaggagacgatacatgaaaaagcccaacctggcggcagcgcaaaagatg

SEQ ID NO: 31738 - DNA, 103 bp, Artificial Sequence
  Synthetic Polynucleotide
taatacgactcactatagggttgttataagccaatacgcctcgcgcggacaacagaggagagtccgcatgaggcgtattaacctggcggcagcgcaaaagatg

SEQ ID NO: 31739 - DNA, 103 bp, Artificial Sequence
  Synthetic Polynucleotide
taatacgactcactatagggcggctgtcgtgtctcttctgtaagacatgcaacagaggagagcatgtatgacagaagagaacctggcggcagcgcaaaagatg

SEQ ID NO: 31740 - DNA, 103 bp, Artificial Sequence
  Synthetic Polynucleotide
taatacgactcactatagggtatgatccgactctatactctaattggggtaacagaggagaaccccaatgagagtatagaacctggcggcagcgcaaaagatg

SEQ ID NO: 31741 - DNA, 103 bp, Artificial Sequence
  Synthetic Polynucleotide
taatacgactcactataggggcttaacctcagggtgcagcgaaacataagaacagaggagacttatgatgcgctgcaccaacctggcggcagcgcaaaagatg

SEQ ID NO: 31742 - DNA, 103 bp, Artificial Sequence
  Synthetic Polynucleotide
taatacgactcactatagggggcgatcgcacgcctatggccccgtgttaaaacagaggagattaacaatgggccataggaacctggcggcagcgcaaaagatg

SEQ ID NO: 31743 - DNA, 103 bp, Artificial Sequence
  Synthetic Polynucleotide
taatacgactcactataggggtccggcaaaaatagaatctgacgttactgaacagaggagacagtaaatgcagattctaaacctggcggcagcgcaaaagatg

SEQ ID NO: 31744 - DNA, 103 bp, Artificial Sequence
  Synthetic Polynucleotide
taatacgactcactatagggtaagcaagggctaggtaaattgaagcgtcgaacagaggagacgacgcatgaatttacctaacctggcggcagcgcaaaagatg

SEQ ID NO: 31745 - DNA, 103 bp, Artificial Sequence
  Synthetic Polynucleotide
taatacgactcactatagggggatatggggcgcgactagcaagggaccctaacagaggagaagggtcatgtgctagtcgaacctggcggcagcgcaaaagatg

SEQ ID NO: 31746 - DNA, 103 bp, Artificial Sequence
  Synthetic Polynucleotide
taatacgactcactatagggaccaaattatacgagaggcattaagtgttgaacagaggagacaacacatgatgcctctcaacctggcggcagcgcaaaagatg

SEQ ID NO: 31747 - DNA, 103 bp, Artificial Sequence
  Synthetic Polynucleotide
taatacgactcactatagggcacatgcacagccgctaggaattaggtgttaacagaggagaaacaccatgttcctagcgaacctggcggcagcgcaaaagatg

SEQ ID NO: 31748 - DNA, 103 bp, Artificial Sequence
  Synthetic Polynucleotide
taatacgactcactatagggtccccggacaagcgcttctttacccgttttaacagaggagaaaaacgatgaaagaagcgaacctggcggcagcgcaaaagatg

SEQ ID NO: 31749 - DNA, 103 bp, Artificial Sequence
  Synthetic Polynucleotide
taatacgactcactatagggaggagctgagcggtgactgtagcttatgataacagaggagaatcataatgtacagtcacaacctggcggcagcgcaaaagatg

SEQ ID NO: 31750 - DNA, 103 bp, Artificial Sequence
  Synthetic Polynucleotide
taatacgactcactatagggctttgtaatagcggacacgctcccaactagaacagaggagactagttatgagcgtgtccaacctggcggcagcgcaaaagatg

SEQ ID NO: 31751 - DNA, 103 bp, Artificial Sequence
  Synthetic Polynucleotide
taatacgactcactatagggttgatctactcttctacgtcgtatacccaaaacagaggagattgggtatgcgacgtagaaacctggcggcagcgcaaaagatg

SEQ ID NO: 31752 - DNA, 103 bp, Artificial Sequence
  Synthetic Polynucleotide
taatacgactcactataggggacaatatattttattcaagactgagagtaaacagaggagatactctatgtcttgaataaacctggcggcagcgcaaaagatg

SEQ ID NO: 31753 - DNA, 103 bp, Artificial Sequence
  Synthetic Polynucleotide
taatacgactcactataggggacaagaaagttatgattaatgtccccctaaacagaggagataggggatgattaatcataacctggcggcagcgcaaaagatg

SEQ ID NO: 31754 - DNA, 103 bp, Artificial Sequence
  Synthetic Polynucleotide
taatacgactcactatagggacttagtcaccttaagcattatatgcgcctaacagaggagaaggcgcatgtaatgcttaaacctggcggcagcgcaaaagatg

SEQ ID NO: 31755 - DNA, 103 bp, Artificial Sequence
  Synthetic Polynucleotide
taatacgactcactatagggggcacgcgatggaggaagtgaccaacctagaacagaggagactaggtatgtcacttcctaacctggcggcagcgcaaaagatg

SEQ ID NO: 31756 - DNA, 103 bp, Artificial Sequence
  Synthetic Polynucleotide
taatacgactcactatagggtacgcttcaaccaaacacttgtgccctgacaacagaggagagtcaggatgcaagtgtttaacctggcggcagcgcaaaagatg

SEQ ID NO: 31757 - DNA, 103 bp, Artificial Sequence
  Synthetic Polynucleotide
taatacgactcactatagggaccgttagtcgcgaagtttgattaaccccgaacagaggagacggggtatgtcaaacttcaacctggcggcagcgcaaaagatg

SEQ ID NO: 31758 - DNA, 103 bp, Artificial Sequence
  Synthetic Polynucleotide
taatacgactcactatagggatttttagtgaactggtgccaaattaaaaaaacagaggagatttttaatgtggcaccagaacctggcggcagcgcaaaagatg

SEQ ID NO: 31759 - DNA, 103 bp, Artificial Sequence
  Synthetic Polynucleotide
taatacgactcactatagggagccttattcgctgtttagcacgcgaattcaacagaggagagaattcatgtgctaaacaaacctggcggcagcgcaaaagatg

SEQ ID NO: 31760 - DNA, 103 bp, Artificial Sequence
  Synthetic Polynucleotide
taatacgactcactatagggttgcgtcaggccacgggtgctagggcacccaacagaggagagggtgcatgagcacccgtaacctggcggcagcgcaaaagatg

SEQ ID NO: 31761 - DNA, 103 bp, Artificial Sequence
  Synthetic Polynucleotide
taatacgactcactatagggcccttcatcgctcttcgcatgttcagttggaacagaggagaccaactatgcatgcgaagaacctggcggcagcgcaaaagatg

SEQ ID NO: 31762 - DNA, 103 bp, Artificial Sequence
  Synthetic Polynucleotide
taatacgactcactatagggcctccatctctgtgcagaatgtaacgggaaaacagaggagattcccgatgcattctgcaaacctggcggcagcgcaaaagatg

SEQ ID NO: 31763 - DNA, 103 bp, Artificial Sequence
  Synthetic Polynucleotide
taatacgactcactatagggcgaaactgatgggtcatgaatattcctccgaacagaggagacggaggatgattcatgacaacctggcggcagcgcaaaagatg

SEQ ID NO: 31764 - DNA, 103 bp, Artificial Sequence
  Synthetic Polynucleotide
taatacgactcactataggggtcaatgagaacacacgtgtgcagctaaggaacagaggagaccttagatgcacacgtgtaacctggcggcagcgcaaaagatg

SEQ ID NO: 31765 - DNA, 103 bp, Artificial Sequence
  Synthetic Polynucleotide
taatacgactcactataggggcaaacctgggagcctgatacacccgactcaacagaggagagagtcgatggtatcaggcaacctggcggcagcgcaaaagatg

SEQ ID NO: 31766 - DNA, 103 bp, Artificial Sequence
  Synthetic Polynucleotide
taatacgactcactatagggctcgttatcttatggagctcaggagccgacaacagaggagagtcggcatgtgagctccaaacctggcggcagcgcaaaagatg

SEQ ID NO: 31767 - DNA, 103 bp, Artificial Sequence
  Synthetic Polynucleotide
taatacgactcactataggggtaggattttgcgacatagagggggtttgaaacagaggagatcaaacatgctctatgtcaacctggcggcagcgcaaaagatg

SEQ ID NO: 31768 - DNA, 103 bp, Artificial Sequence
  Synthetic Polynucleotide
taatacgactcactatagggagtgttacatgtttcacaccgcccggggggaacagaggagaccccccatgcggtgtgaaaacctggcggcagcgcaaaagatg

SEQ ID NO: 31769 - DNA, 103 bp, Artificial Sequence
  Synthetic Polynucleotide
taatacgactcactatagggccgagcttagtgggcagggtaaccatagaaaacagaggagattctatatgtaccctgccaacctggcggcagcgcaaaagatg

SEQ ID NO: 31770 - DNA, 103 bp, Artificial Sequence
  Synthetic Polynucleotide
taatacgactcactatagggtagagctccagctgccggctaccagaccacaacagaggagagtggtcatgtagccggcaaacctggcggcagcgcaaaagatg

SEQ ID NO: 31771 - DNA, 103 bp, Artificial Sequence
  Synthetic Polynucleotide
taatacgactcactatagggtagcagtcctctcattaaaaaatccggccaaacagaggagatggccgatgtttttaatgaacctggcggcagcgcaaaagatg

SEQ ID NO: 31772 - DNA, 103 bp, Artificial Sequence
  Synthetic Polynucleotide
taatacgactcactatagggcattggcgtttgcattggtgacaaaaatgtaacagaggagaacatttatgtcaccaatgaacctggcggcagcgcaaaagatg

SEQ ID NO: 31773 - DNA, 103 bp, Artificial Sequence
  Synthetic Polynucleotide
taatacgactcactatagggaagaaactcttaacagtcgagaccaggtagaacagaggagactacctatgctcgactgtaacctggcggcagcgcaaaagatg

SEQ ID NO: 31774 - DNA, 103 bp, Artificial Sequence
  Synthetic Polynucleotide
taatacgactcactataggggaataacagcaaccgatgaaggcgctgtcgaacagaggagacgacagatgcttcatcggaacctggcggcagcgcaaaagatg

SEQ ID NO: 31775 - DNA, 103 bp, Artificial Sequence
  Synthetic Polynucleotide
taatacgactcactatagggtcgctgaagaagagtgtatttgtaatgcagaacagaggagactgcatatgaaatacactaacctggcggcagcgcaaaagatg

SEQ ID NO: 31776 - DNA, 103 bp, Artificial Sequence
  Synthetic Polynucleotide
taatacgactcactataggggccagcacgcgtcaagtaaacgcatggtgcaacagaggagagcaccaatggtttacttgaacctggcggcagcgcaaaagatg

SEQ ID NO: 31777 - DNA, 103 bp, Artificial Sequence
  Synthetic Polynucleotide
taatacgactcactataggggggtctacgcaatgatctgtaacgctataaaacagaggagattatagatgtacagatcaaacctggcggcagcgcaaaagatg

SEQ ID NO: 31778 - DNA, 103 bp, Artificial Sequence
  Synthetic Polynucleotide
taatacgactcactatagggagcgaaaaaagacctcttgcccggcatcggaacagaggagaccgatgatgggcaagaggaacctggcggcagcgcaaaagatg

SEQ ID NO: 31779 - DNA, 103 bp, Artificial Sequence
  Synthetic Polynucleotide
taatacgactcactatagggctcggagggcagtgcgacgatataacccccaacagaggagagggggtatgatcgtcgcaaacctggcggcagcgcaaaagatg

SEQ ID NO: 31780 - DNA, 103 bp, Artificial Sequence
  Synthetic Polynucleotide
taatacgactcactatagggcatgctgttggcagagtgtgcttacaaaggaacagaggagacctttgatggcacactctaacctggcggcagcgcaaaagatg

SEQ ID NO: 31781 - DNA, 103 bp, Artificial Sequence
  Synthetic Polynucleotide
taatacgactcactatagggcgtccgcttggactggctcaggtcgcccgcaacagaggagagcgggcatgctgagccagaacctggcggcagcgcaaaagatg

SEQ ID NO: 31782 - DNA, 103 bp, Artificial Sequence
  Synthetic Polynucleotide
taatacgactcactatagggattgatctagtaaaccgggatgacgcgagaaacagaggagatctcgcatgatcccggttaacctggcggcagcgcaaaagatg

SEQ ID NO: 31783 - DNA, 103 bp, Artificial Sequence
  Synthetic Polynucleotide
taatacgactcactatagggttccgcccacgtgtaaagctgagggatccgaacagaggagacggatcatgcagctttacaacctggcggcagcgcaaaagatg

SEQ ID NO: 31784 - DNA, 103 bp, Artificial Sequence
  Synthetic Polynucleotide
taatacgactcactataggggttgagactccgggtcccgcggctaagatgaacagaggagacatcttatgcgcgggaccaacctggcggcagcgcaaaagatg

SEQ ID NO: 31785 - DNA, 103 bp, Artificial Sequence
  Synthetic Polynucleotide
taatacgactcactatagggttacggaaaatacaagtataatgcacccgtaacagaggagaacgggtatgttatacttgaacctggcggcagcgcaaaagatg

SEQ ID NO: 31786 - DNA, 103 bp, Artificial Sequence
  Synthetic Polynucleotide
taatacgactcactataggggccatcatacgagtgtgccaaattcgcaccaacagaggagaggtgcgatgttggcacacaacctggcggcagcgcaaaagatg

SEQ ID NO: 31787 - DNA, 103 bp, Artificial Sequence
  Synthetic Polynucleotide
taatacgactcactatagggcaaattatcctcagattacagtaggctctcaacagaggagagagagcatgctgtaatctaacctggcggcagcgcaaaagatg

SEQ ID NO: 31788 - DNA, 103 bp, Artificial Sequence
  Synthetic Polynucleotide
taatacgactcactatagggatagcataatagtcgcacttacgattgtttaacagaggagaaaacaaatgtaagtgcgaaacctggcggcagcgcaaaagatg

SEQ ID NO: 31789 - DNA, 103 bp, Artificial Sequence
  Synthetic Polynucleotide
taatacgactcactataggggttagccagactgcccccaaagggatcgttaacagaggagaaacgatatgtttgggggcaacctggcggcagcgcaaaagatg

SEQ ID NO: 31790 - DNA, 103 bp, Artificial Sequence
  Synthetic Polynucleotide
taatacgactcactatagggcgcggcaccagacggaagtcacttagagtcaacagaggagagactctatgtgacttccgaacctggcggcagcgcaaaagatg

SEQ ID NO: 31791 - DNA, 103 bp, Artificial Sequence
  Synthetic Polynucleotide
taatacgactcactatagggtacttatacccgttctttggctggtgagtgaacagaggagacactcaatggccaaagaaaacctggcggcagcgcaaaagatg

SEQ ID NO: 31792 - DNA, 103 bp, Artificial Sequence
  Synthetic Polynucleotide
taatacgactcactatagggcggtagctgcaatacaagagccgagcccggaacagaggagaccgggcatggctcttgtaaacctggcggcagcgcaaaagatg

SEQ ID NO: 31793 - DNA, 103 bp, Artificial Sequence
  Synthetic Polynucleotide
taatacgactcactatagggcagtagcaacatcttgctccacggttggggaacagaggagaccccaaatgtggagcaagaacctggcggcagcgcaaaagatg

SEQ ID NO: 31794 - DNA, 103 bp, Artificial Sequence
  Synthetic Polynucleotide
taatacgactcactatagggtaaaataccgctcgcggacgaatgtaggtgaacagaggagacacctaatgtcgtccgcgaacctggcggcagcgcaaaagatg

SEQ ID NO: 31795 - DNA, 103 bp, Artificial Sequence
  Synthetic Polynucleotide
taatacgactcactataggggtagtcaatttgtagttaccagctatcgcaaacagaggagatgcgatatgtggtaactaaacctggcggcagcgcaaaagatg

SEQ ID NO: 31796 - DNA, 103 bp, Artificial Sequence
  Synthetic Polynucleotide
taatacgactcactataggggaagttgtcagagggatgatactcgtttataacagaggagaataaacatgtatcatcccaacctggcggcagcgcaaaagatg

SEQ ID NO: 31797 - DNA, 103 bp, Artificial Sequence
  Synthetic Polynucleotide
taatacgactcactatagggtgcatccgttttaattacggttaaccattgaacagaggagacaatggatgaccgtaattaacctggcggcagcgcaaaagatg

SEQ ID NO: 31798 - DNA, 103 bp, Artificial Sequence
  Synthetic Polynucleotide
taatacgactcactatagggtcccacgctgcgaatcaatgactggtccacaacagaggagagtggacatgtcattgattaacctggcggcagcgcaaaagatg

SEQ ID NO: 31799 - DNA, 103 bp, Artificial Sequence
  Synthetic Polynucleotide
taatacgactcactatagggatgaggataatttcaagtacccaccacacaaacagaggagatgtgtgatgggtacttgaaacctggcggcagcgcaaaagatg

SEQ ID NO: 31800 - DNA, 103 bp, Artificial Sequence
  Synthetic Polynucleotide
taatacgactcactatagggttggccagcctaccagcgactcgccaccggaacagaggagaccggtgatgagtcgctggaacctggcggcagcgcaaaagatg

SEQ ID NO: 31801 - DNA, 103 bp, Artificial Sequence
  Synthetic Polynucleotide
taatacgactcactatagggatgtagtgtgcagcatcactaggctcaccaaacagaggagatggtgaatgtagtgatgcaacctggcggcagcgcaaaagatg

SEQ ID NO: 31802 - DNA, 103 bp, Artificial Sequence
  Synthetic Polynucleotide
taatacgactcactataggggacaaaaatcggatctccagcctgttgccgaacagaggagacggcaaatggctggagataacctggcggcagcgcaaaagatg

SEQ ID NO: 31803 - DNA, 103 bp, Artificial Sequence
  Synthetic Polynucleotide
taatacgactcactatagggaatccgcgcatttgtggatgtcttgtcacgaacagaggagacgtgacatgacatccacaaacctggcggcagcgcaaaagatg

SEQ ID NO: 31804 - DNA, 103 bp, Artificial Sequence
  Synthetic Polynucleotide
taatacgactcactatagggggagtgtaagagtgatcagtggagctgctgaacagaggagacagcagatgcactgatcaaacctggcggcagcgcaaaagatg

SEQ ID NO: 31805 - DNA, 103 bp, Artificial Sequence
  Synthetic Polynucleotide
taatacgactcactatagggcactgtgcctcggcgtcggctacataatgcaacagaggagagcattaatgagccgacgcaacctggcggcagcgcaaaagatg

SEQ ID NO: 31806 - DNA, 103 bp, Artificial Sequence
  Synthetic Polynucleotide
taatacgactcactatagggctaaaccatagcgctaattaagaatccactaacagaggagaagtggaatgttaattagcaacctggcggcagcgcaaaagatg

SEQ ID NO: 31807 - DNA, 103 bp, Artificial Sequence
  Synthetic Polynucleotide
taatacgactcactatagggtggaaacactatcaagctgaaggttcgcataacagaggagaatgcgaatgttcagcttgaacctggcggcagcgcaaaagatg

SEQ ID NO: 31808 - DNA, 103 bp, Artificial Sequence
  Synthetic Polynucleotide
taatacgactcactatagggcagggaagatctaggacctgcgtgttcgaaaacagaggagattcgaaatggcaggtcctaacctggcggcagcgcaaaagatg

SEQ ID NO: 31809 - DNA, 103 bp, Artificial Sequence
  Synthetic Polynucleotide
taatacgactcactatagggtagccgtgttgtggtgcaccgaattggtataacagaggagaataccaatgcggtgcaccaacctggcggcagcgcaaaagatg

SEQ ID NO: 31810 - DNA, 103 bp, Artificial Sequence
  Synthetic Polynucleotide
taatacgactcactatagggtaaccgtttggcctaataggagccgtgttgaacagaggagacaacacatgtcctattagaacctggcggcagcgcaaaagatg

SEQ ID NO: 31811 - DNA, 103 bp, Artificial Sequence
  Synthetic Polynucleotide
taatacgactcactatagggtaattgcaagtagaacttccaatgactttaaacagaggagataaagtatgtggaagttcaacctggcggcagcgcaaaagatg

SEQ ID NO: 31812 - DNA, 103 bp, Artificial Sequence
  Synthetic Polynucleotide
taatacgactcactatagggtttcatattttgctcttccaagagcgctaaaacagaggagattagcgatgttggaagagaacctggcggcagcgcaaaagatg

SEQ ID NO: 31813 - DNA, 103 bp, Artificial Sequence
  Synthetic Polynucleotide
taatacgactcactatagggattaagcttaaccgcagccttgcttccaagaacagaggagacttggaatgaaggctgcgaacctggcggcagcgcaaaagatg

SEQ ID NO: 31814 - DNA, 103 bp, Artificial Sequence
  Synthetic Polynucleotide
taatacgactcactatagggaacggcagatagtcttggagggccaagcggaacagaggagaccgcttatgcctccaagaaacctggcggcagcgcaaaagatg

SEQ ID NO: 31815 - DNA, 103 bp, Artificial Sequence
  Synthetic Polynucleotide
taatacgactcactatagggatattggcagtacctctttaaggcactgaaaacagaggagattcagtatgttaaagaggaacctggcggcagcgcaaaagatg

SEQ ID NO: 31816 - DNA, 103 bp, Artificial Sequence
  Synthetic Polynucleotide
taatacgactcactatagggtcagcacagtcctgcaccttgatggtaccgaacagaggagacggtacatgcaaggtgcaaacctggcggcagcgcaaaagatg

SEQ ID NO: 31817 - DNA, 103 bp, Artificial Sequence
  Synthetic Polynucleotide
taatacgactcactatagggactgatgggaaaaaaagtttcaggtaccctaacagaggagaagggtaatggaaacttttaacctggcggcagcgcaaaagatg

SEQ ID NO: 31818 - DNA, 103 bp, Artificial Sequence
  Synthetic Polynucleotide
taatacgactcactatagggtaacctacaatactctgcgaccagtgcgaaaacagaggagattcgcaatggtcgcagagaacctggcggcagcgcaaaagatg

SEQ ID NO: 31819 - DNA, 103 bp, Artificial Sequence
  Synthetic Polynucleotide
taatacgactcactataggggcgcggggtgagtggtagcgtggggtcttaaacagaggagataagacatgacgctaccaaacctggcggcagcgcaaaagatg

SEQ ID NO: 31820 - DNA, 103 bp, Artificial Sequence
  Synthetic Polynucleotide
taatacgactcactatagggggactcagcactgatacgcggcacgggctgaacagaggagacagcccatgccgcgtatcaacctggcggcagcgcaaaagatg

SEQ ID NO: 31821 - DNA, 103 bp, Artificial Sequence
  Synthetic Polynucleotide
taatacgactcactatagggttttagatcgggtatgtcagggggccttttaacagaggagaaaaaggatgcctgacataaacctggcggcagcgcaaaagatg

SEQ ID NO: 31822 - DNA, 103 bp, Artificial Sequence
  Synthetic Polynucleotide
taatacgactcactatagggctacacaggacgaatgcggggcgcaacgcaaacagaggagatgcgttatgccccgcattaacctggcggcagcgcaaaagatg

SEQ ID NO: 31823 - DNA, 103 bp, Artificial Sequence
  Synthetic Polynucleotide
taatacgactcactatagggcacgcgtgaggcccctccggtatgtcccacaacagaggagagtgggaatgaccggagggaacctggcggcagcgcaaaagatg

SEQ ID NO: 31824 - DNA, 103 bp, Artificial Sequence
  Synthetic Polynucleotide
taatacgactcactataggggtgtccttggccgaaacacccgtgaagagaaacagaggagatctcttatggggtgtttcaacctggcggcagcgcaaaagatg

SEQ ID NO: 31825 - DNA, 103 bp, Artificial Sequence
  Synthetic Polynucleotide
taatacgactcactataggggaactttgagggacagcatcccgggcaggcaacagaggagagcctgcatgggatgctgtaacctggcggcagcgcaaaagatg

SEQ ID NO: 31826 - DNA, 103 bp, Artificial Sequence
  Synthetic Polynucleotide
taatacgactcactatagggccaggtgggcattcactctcaacctcaagtaacagaggagaacttgaatgtgagagtgaaacctggcggcagcgcaaaagatg

SEQ ID NO: 31827 - DNA, 103 bp, Artificial Sequence
  Synthetic Polynucleotide
taatacgactcactatagggccgcaggaagcacttctccaggcgctgtagaacagaggagactacagatgctggagaagaacctggcggcagcgcaaaagatg

SEQ ID NO: 31828 - DNA, 103 bp, Artificial Sequence
  Synthetic Polynucleotide
taatacgactcactatagggaacgcacccacgatatgagccgagccgactaacagaggagaagtcggatgggctcatataacctggcggcagcgcaaaagatg

SEQ ID NO: 31829 - DNA, 103 bp, Artificial Sequence
  Synthetic Polynucleotide
taatacgactcactataggggtatggcatggacttcgcactagttgaacgaacagaggagacgttcaatgagtgcgaagaacctggcggcagcgcaaaagatg

SEQ ID NO: 31830 - DNA, 103 bp, Artificial Sequence
  Synthetic Polynucleotide
taatacgactcactatagggattgatcgccacggattcttagccgaattcaacagaggagagaattcatgtaagaatccaacctggcggcagcgcaaaagatg

SEQ ID NO: 31831 - DNA, 103 bp, Artificial Sequence
  Synthetic Polynucleotide
taatacgactcactataggggccgactagccgggtaggcgccaggggaaaaacagaggagatttcccatggcgcctaccaacctggcggcagcgcaaaagatg

SEQ ID NO: 31832 - DNA, 103 bp, Artificial Sequence
  Synthetic Polynucleotide
taatacgactcactatagggttgtgtaagcctcctcgagcgaagtgactcaacagaggagagagtcaatgcgctcgaggaacctggcggcagcgcaaaagatg

SEQ ID NO: 31833 - DNA, 103 bp, Artificial Sequence
  Synthetic Polynucleotide
taatacgactcactatagggctcggacgttaggttataattcacacgaccaacagaggagaggtcgtatgaattataacaacctggcggcagcgcaaaagatg

SEQ ID NO: 31834 - DNA, 103 bp, Artificial Sequence
  Synthetic Polynucleotide
taatacgactcactatagggttagtatcactccaatcacacataacacccaacagaggagagggtgtatggtgtgattgaacctggcggcagcgcaaaagatg

SEQ ID NO: 31835 - DNA, 103 bp, Artificial Sequence
  Synthetic Polynucleotide
taatacgactcactatagggatagttgtcatatggaccccatgaccgaagaacagaggagacttcggatgtggggtccaaacctggcggcagcgcaaaagatg

SEQ ID NO: 31836 - DNA, 103 bp, Artificial Sequence
  Synthetic Polynucleotide
taatacgactcactatagggcatgtctgtaaattgcggggttcaaggcggaacagaggagaccgcctatgaccccgcaaaacctggcggcagcgcaaaagatg

SEQ ID NO: 31837 - DNA, 103 bp, Artificial Sequence
  Synthetic Polynucleotide
taatacgactcactatagggccagtacgtgtaacccaaagcctttttaaaaacagaggagatttaaaatggctttgggtaacctggcggcagcgcaaaagatg

SEQ ID NO: 31838 - DNA, 103 bp, Artificial Sequence
  Synthetic Polynucleotide
taatacgactcactataggggctactgtaaaatctgctaccaaactgattaacagaggagaaatcagatgggtagcagaaacctggcggcagcgcaaaagatg

SEQ ID NO: 31839 - DNA, 103 bp, Artificial Sequence
  Synthetic Polynucleotide
taatacgactcactatagggttctcactcatcacttcgtcctttaggtataacagaggagaatacctatgggacgaagtaacctggcggcagcgcaaaagatg

SEQ ID NO: 31840 - DNA, 103 bp, Artificial Sequence
  Synthetic Polynucleotide
taatacgactcactatagggtaaatagcctagaccgagacattaaaacaaaacagaggagattgtttatgtgtctcggtaacctggcggcagcgcaaaagatg

SEQ ID NO: 31841 - DNA, 103 bp, Artificial Sequence
  Synthetic Polynucleotide
taatacgactcactatagggactgctattacgttggaccccctacgcataaacagaggagatatgcgatgggggtccaaaacctggcggcagcgcaaaagatg

SEQ ID NO: 31842 - DNA, 103 bp, Artificial Sequence
  Synthetic Polynucleotide
taatacgactcactataggggacaaactcatgcaggtggcaagatcgcaaaacagaggagattgcgaatgtgccacctgaacctggcggcagcgcaaaagatg

SEQ ID NO: 31843 - DNA, 103 bp, Artificial Sequence
  Synthetic Polynucleotide
taatacgactcactatagggtttaggttggctggacctactgatacccgtaacagaggagaacgggtatgagtaggtccaacctggcggcagcgcaaaagatg

SEQ ID NO: 31844 - DNA, 103 bp, Artificial Sequence
  Synthetic Polynucleotide
taatacgactcactatagggcccacgtctgacgaagctacaacgcgcctaaacagaggagataggcgatgtgtagcttcaacctggcggcagcgcaaaagatg

SEQ ID NO: 31845 - DNA, 103 bp, Artificial Sequence
  Synthetic Polynucleotide
taatacgactcactatagggccgaggagcaaattcccaggaccgcaagtcaacagaggagagacttgatgtcctgggaaaacctggcggcagcgcaaaagatg

SEQ ID NO: 31846 - DNA, 103 bp, Artificial Sequence
  Synthetic Polynucleotide
taatacgactcactatagggggaatgggagagagtgtggccagagatcagaacagaggagactgatcatgggccacactaacctggcggcagcgcaaaagatg

SEQ ID NO: 31847 - DNA, 103 bp, Artificial Sequence
  Synthetic Polynucleotide
taatacgactcactatagggtctgtctatctgcactgatagcgcatttgtaacagaggagaacaaatatgctatcagtgaacctggcggcagcgcaaaagatg

SEQ ID NO: 31848 - DNA, 103 bp, Artificial Sequence
  Synthetic Polynucleotide
taatacgactcactatagggacgttatccgaaaaatttcacatcctcttcaacagaggagagaagagatggtgaaatttaacctggcggcagcgcaaaagatg

SEQ ID NO: 31849 - DNA, 103 bp, Artificial Sequence
  Synthetic Polynucleotide
taatacgactcactatagggcaaaatcttacagtcgcccccgcgttacggaacagaggagaccgtaaatggggggcgacaacctggcggcagcgcaaaagatg

SEQ ID NO: 31850 - DNA, 103 bp, Artificial Sequence
  Synthetic Polynucleotide
taatacgactcactatagggtcctacgatctagagaagcggttcaagcataacagaggagaatgcttatgccgcttctcaacctggcggcagcgcaaaagatg

SEQ ID NO: 31851 - DNA, 103 bp, Artificial Sequence
  Synthetic Polynucleotide
taatacgactcactatagggtggtgacagcatacggaacggctcatcggaaacagaggagatccgatatgccgttccgtaacctggcggcagcgcaaaagatg

SEQ ID NO: 31852 - DNA, 103 bp, Artificial Sequence
  Synthetic Polynucleotide
taatacgactcactatagggaaggggtcgccacgttgcctacccttgaccaacagaggagaggtcaaatgtaggcaacgaacctggcggcagcgcaaaagatg

SEQ ID NO: 31853 - DNA, 103 bp, Artificial Sequence
  Synthetic Polynucleotide
taatacgactcactataggggtcacaggtgacatccgaagtaaggattggaacagaggagaccaatcatgacttcggataacctggcggcagcgcaaaagatg

SEQ ID NO: 31854 - DNA, 103 bp, Artificial Sequence
  Synthetic Polynucleotide
taatacgactcactatagggtgggcacgctcgctactgtcgagccggaataacagaggagaattccgatgcgacagtagaacctggcggcagcgcaaaagatg

SEQ ID NO: 31855 - DNA, 103 bp, Artificial Sequence
  Synthetic Polynucleotide
taatacgactcactataggggcttgctaaattacgtcggcgtagataaaaaacagaggagattttatatgcgccgacgtaacctggcggcagcgcaaaagatg

SEQ ID NO: 31856 - DNA, 103 bp, Artificial Sequence
  Synthetic Polynucleotide
taatacgactcactatagggcgagaaatccgttgatcctgatcaccgtgtaacagaggagaacacggatgtcaggatcaaacctggcggcagcgcaaaagatg

SEQ ID NO: 31857 - DNA, 103 bp, Artificial Sequence
  Synthetic Polynucleotide
taatacgactcactatagggcaccccttctattggcgttggtgcgggtgaaacagaggagatcacccatgccaacgccaaacctggcggcagcgcaaaagatg

SEQ ID NO: 31858 - DNA, 103 bp, Artificial Sequence
  Synthetic Polynucleotide
taatacgactcactataggggctgaactaaaacatgggcatgtaacattcaacagaggagagaatgtatgatgcccatgaacctggcggcagcgcaaaagatg

SEQ ID NO: 31859 - DNA, 103 bp, Artificial Sequence
  Synthetic Polynucleotide
taatacgactcactatagggacgcgctcgaatccacgtgatattcacaataacagaggagaattgtgatgatcacgtggaacctggcggcagcgcaaaagatg

SEQ ID NO: 31860 - DNA, 103 bp, Artificial Sequence
  Synthetic Polynucleotide
taatacgactcactatagggacttcaacaaggccgagtgcctatgccagtaacagaggagaactggcatgggcactcggaacctggcggcagcgcaaaagatg

SEQ ID NO: 31861 - DNA, 103 bp, Artificial Sequence
  Synthetic Polynucleotide
taatacgactcactatagggatgccgagcaggattgcctccatacgaggtaacagaggagaacctcgatgggaggcaataacctggcggcagcgcaaaagatg

SEQ ID NO: 31862 - DNA, 103 bp, Artificial Sequence
  Synthetic Polynucleotide
taatacgactcactatagggcacgcgtccccgcggttgacggaagcgaggaacagaggagacctcgcatgcgtcaaccgaacctggcggcagcgcaaaagatg

SEQ ID NO: 31863 - DNA, 103 bp, Artificial Sequence
  Synthetic Polynucleotide
taatacgactcactatagggttcccacgcgcggggccagccggactcgctaacagaggagaagcgagatgggctggcccaacctggcggcagcgcaaaagatg

SEQ ID NO: 31864 - DNA, 103 bp, Artificial Sequence
  Synthetic Polynucleotide
taatacgactcactatagggaatataattaaatgtggagataatattcttaacagaggagaaagaatatgatctccacaaacctggcggcagcgcaaaagatg

SEQ ID NO: 31865 - DNA, 103 bp, Artificial Sequence
  Synthetic Polynucleotide
taatacgactcactataggggaagcggacgtcactaatagagagatctctaacagaggagaagagatatgtctattagtaacctggcggcagcgcaaaagatg

SEQ ID NO: 31866 - DNA, 103 bp, Artificial Sequence
  Synthetic Polynucleotide
taatacgactcactatagggtctccttgctttgtgctgcgtatcacgacgaacagaggagacgtcgtatgacgcagcacaacctggcggcagcgcaaaagatg

SEQ ID NO: 31867 - DNA, 103 bp, Artificial Sequence
  Synthetic Polynucleotide
taatacgactcactatagggagggtctcaactcttgtcgacaggttaagtaacagaggagaacttaaatggtcgacaagaacctggcggcagcgcaaaagatg

SEQ ID NO: 31868 - DNA, 103 bp, Artificial Sequence
  Synthetic Polynucleotide
taatacgactcactatagggtacaataaaacccctgtgatgccagctaggaacagaggagacctagcatgcatcacaggaacctggcggcagcgcaaaagatg

SEQ ID NO: 31869 - DNA, 103 bp, Artificial Sequence
  Synthetic Polynucleotide
taatacgactcactataggggaaagtgcgatgcaaggagtcgataccgataacagaggagaatcggtatggactccttgaacctggcggcagcgcaaaagatg

SEQ ID NO: 31870 - DNA, 103 bp, Artificial Sequence
  Synthetic Polynucleotide
taatacgactcactatagggtaagagggtgatacgctaacatgagatcacaacagaggagagtgatcatgtgttagcgtaacctggcggcagcgcaaaagatg

SEQ ID NO: 31871 - DNA, 103 bp, Artificial Sequence
  Synthetic Polynucleotide
taatacgactcactataggggtgcccgctcgatgtaccggtgcaacgagcaacagaggagagctcgtatgaccggtacaaacctggcggcagcgcaaaagatg

SEQ ID NO: 31872 - DNA, 103 bp, Artificial Sequence
  Synthetic Polynucleotide
taatacgactcactatagggtatgtccatcaaaaaagcgccatagggctcaacagaggagagagcccatgggcgcttttaacctggcggcagcgcaaaagatg

SEQ ID NO: 31873 - DNA, 103 bp, Artificial Sequence
  Synthetic Polynucleotide
taatacgactcactatagggcttgttgaattgagtactaccatgaaggccaacagaggagaggccttatgggtagtactaacctggcggcagcgcaaaagatg

SEQ ID NO: 31874 - DNA, 103 bp, Artificial Sequence
  Synthetic Polynucleotide
taatacgactcactatagggcacccaaatgacatgttgggtgggtcgctaaacagaggagatagcgaatgacccaacataacctggcggcagcgcaaaagatg

SEQ ID NO: 31875 - DNA, 103 bp, Artificial Sequence
  Synthetic Polynucleotide
taatacgactcactatagggatggagaaggactggtcggtgcctctcgttaacagaggagaaacgagatgcaccgaccaaacctggcggcagcgcaaaagatg

SEQ ID NO: 31876 - DNA, 103 bp, Artificial Sequence
  Synthetic Polynucleotide
taatacgactcactatagggcagcgctactgccaagaagtccctagaattaacagaggagaaattctatggacttcttgaacctggcggcagcgcaaaagatg

SEQ ID NO: 31877 - DNA, 103 bp, Artificial Sequence
  Synthetic Polynucleotide
taatacgactcactatagggagtggggtactactgaggacgctggtcgctaacagaggagaagcgacatgcgtcctcagaacctggcggcagcgcaaaagatg

SEQ ID NO: 31878 - DNA, 103 bp, Artificial Sequence
  Synthetic Polynucleotide
taatacgactcactatagggctcataccaacctagtcaccccgtgtagcaaacagaggagatgctacatggggtgactaaacctggcggcagcgcaaaagatg

SEQ ID NO: 31879 - DNA, 103 bp, Artificial Sequence
  Synthetic Polynucleotide
taatacgactcactatagggcacaccagttgtaggaacttgcggcatgtcaacagaggagagacatgatgcaagttcctaacctggcggcagcgcaaaagatg

SEQ ID NO: 31880 - DNA, 103 bp, Artificial Sequence
  Synthetic Polynucleotide
taatacgactcactatagggccgctgtcgggcccctgagtcgcacgcaacaacagaggagagttgcgatggactcagggaacctggcggcagcgcaaaagatg

SEQ ID NO: 31881 - DNA, 103 bp, Artificial Sequence
  Synthetic Polynucleotide
taatacgactcactatagggtacacgcagtcagtagttcggttaacacgcaacagaggagagcgtgtatgccgaactacaacctggcggcagcgcaaaagatg

SEQ ID NO: 31882 - DNA, 103 bp, Artificial Sequence
  Synthetic Polynucleotide
taatacgactcactatagggatcgtatccgtgatccacagaggtcgactcaacagaggagagagtcgatgtctgtggataacctggcggcagcgcaaaagatg

SEQ ID NO: 31883 - DNA, 103 bp, Artificial Sequence
  Synthetic Polynucleotide
taatacgactcactatagggacacactgtattctgtaaacgcagaacataaacagaggagatatgttatgcgtttacagaacctggcggcagcgcaaaagatg

SEQ ID NO: 31884 - DNA, 103 bp, Artificial Sequence
  Synthetic Polynucleotide
taatacgactcactatagggtagcaagggcggttgactaatctggccttcaacagaggagagaaggcatgattagtcaaaacctggcggcagcgcaaaagatg

SEQ ID NO: 31885 - DNA, 103 bp, Artificial Sequence
  Synthetic Polynucleotide
taatacgactcactatagggtagtggtaccatttcgtcgcggttacgccaaacagaggagatggcgtatgcgcgacgaaaacctggcggcagcgcaaaagatg

SEQ ID NO: 31886 - DNA, 103 bp, Artificial Sequence
  Synthetic Polynucleotide
taatacgactcactatagggtcgtatcaggttacacctcgatactttaaaaacagaggagatttaaaatgtcgaggtgtaacctggcggcagcgcaaaagatg

SEQ ID NO: 31887 - DNA, 103 bp, Artificial Sequence
  Synthetic Polynucleotide
taatacgactcactatagggctgtcccatatacatatatctaccgaggggaacagaggagacccctcatgagatatatgaacctggcggcagcgcaaaagatg

SEQ ID NO: 31888 - DNA, 103 bp, Artificial Sequence
  Synthetic Polynucleotide
taatacgactcactataggggtgtattgtcattcctccttatgtgttcataacagaggagaatgaacatgtaaggaggaaacctggcggcagcgcaaaagatg

SEQ ID NO: 31889 - DNA, 103 bp, Artificial Sequence
  Synthetic Polynucleotide
taatacgactcactatagggagccgcggcgtccgaccccccaatcgcataaacagaggagatatgcgatgggggggtcgaacctggcggcagcgcaaaagatg

SEQ ID NO: 31890 - DNA, 103 bp, Artificial Sequence
  Synthetic Polynucleotide
taatacgactcactatagggatggggtgcataccgcaccacccaattcgcaacagaggagagcgaatatggtggtgcggaacctggcggcagcgcaaaagatg

SEQ ID NO: 31891 - DNA, 103 bp, Artificial Sequence
  Synthetic Polynucleotide
taatacgactcactatagggcaacttatacacgcaatgaagcgaacgcaaaacagaggagattgcgtatgcttcattgcaacctggcggcagcgcaaaagatg

SEQ ID NO: 31892 - DNA, 103 bp, Artificial Sequence
  Synthetic Polynucleotide
taatacgactcactatagggagaggcgtaattcgatgatatacaccacagaacagaggagactgtggatgatatcatcgaacctggcggcagcgcaaaagatg

SEQ ID NO: 31893 - DNA, 103 bp, Artificial Sequence
  Synthetic Polynucleotide
taatacgactcactatagggcgtccacctgccggttcgcgaccacaccccaacagaggagaggggtgatgtcgcgaaccaacctggcggcagcgcaaaagatg

SEQ ID NO: 31894 - DNA, 103 bp, Artificial Sequence
  Synthetic Polynucleotide
taatacgactcactatagggtggcgaacaagctgtgcttagtcggcaggcaacagaggagagcctgcatgctaagcacaaacctggcggcagcgcaaaagatg

SEQ ID NO: 31895 - DNA, 103 bp, Artificial Sequence
  Synthetic Polynucleotide
taatacgactcactatagggacaggacgggcgtggctactaggacaagtaaacagaggagatacttgatgtagtagccaaacctggcggcagcgcaaaagatg

SEQ ID NO: 31896 - DNA, 103 bp, Artificial Sequence
  Synthetic Polynucleotide
taatacgactcactatagggcaccgggaataaggacaacagtacgacgacaacagaggagagtcgtcatgctgttgtccaacctggcggcagcgcaaaagatg

SEQ ID NO: 31897 - DNA, 103 bp, Artificial Sequence
  Synthetic Polynucleotide
taatacgactcactataggggacgagctatgaaaagaactgtccaccgccaacagaggagaggcggtatgcagttctttaacctggcggcagcgcaaaagatg

SEQ ID NO: 31898 - DNA, 103 bp, Artificial Sequence
  Synthetic Polynucleotide
taatacgactcactatagggggggctggttaacatattgcgctaaggggaaacagaggagatcccctatgcgcaatatgaacctggcggcagcgcaaaagatg

SEQ ID NO: 31899 - DNA, 103 bp, Artificial Sequence
  Synthetic Polynucleotide
taatacgactcactatagggactacgaccataggcaccaagtttactcggaacagaggagaccgagtatgcttggtgccaacctggcggcagcgcaaaagatg

SEQ ID NO: 31900 - DNA, 103 bp, Artificial Sequence
  Synthetic Polynucleotide
taatacgactcactatagggactggggatgaaagttcgatgattaaagtcaacagaggagagactttatgcatcgaactaacctggcggcagcgcaaaagatg

SEQ ID NO: 31901 - DNA, 103 bp, Artificial Sequence
  Synthetic Polynucleotide
taatacgactcactatagggtcccatgactgttgtccacgagcacagcacaacagaggagagtgctgatgtcgtggacaaacctggcggcagcgcaaaagatg

SEQ ID NO: 31902 - DNA, 103 bp, Artificial Sequence
  Synthetic Polynucleotide
taatacgactcactatagggtagtcccacgccactttagcgagcgcctggaacagaggagaccaggcatgcgctaaagtaacctggcggcagcgcaaaagatg

SEQ ID NO: 31903 - DNA, 103 bp, Artificial Sequence
  Synthetic Polynucleotide
taatacgactcactatagggctttcataaaaaggggactaggagcaccagaacagaggagactggtgatgctagtccccaacctggcggcagcgcaaaagatg

SEQ ID NO: 31904 - DNA, 103 bp, Artificial Sequence
  Synthetic Polynucleotide
taatacgactcactataggggcacttataccagttgaaaaataaccaaggaacagaggagaccttggatgtttttcaacaacctggcggcagcgcaaaagatg

SEQ ID NO: 31905 - DNA, 103 bp, Artificial Sequence
  Synthetic Polynucleotide
taatacgactcactatagggtggcattgatttcaagtaaatgtgggccggaacagaggagaccggccatgatttacttgaacctggcggcagcgcaaaagatg

SEQ ID NO: 31906 - DNA, 103 bp, Artificial Sequence
  Synthetic Polynucleotide
taatacgactcactatagggtgaagtgacttcctgctgtgttgcattattaacagaggagaaataatatgacacagcagaacctggcggcagcgcaaaagatg

SEQ ID NO: 31907 - DNA, 103 bp, Artificial Sequence
  Synthetic Polynucleotide
taatacgactcactatagggccgtcaggccattactggtgtaggtcttataacagaggagaataagaatgacaccagtaaacctggcggcagcgcaaaagatg

SEQ ID NO: 31908 - DNA, 103 bp, Artificial Sequence
  Synthetic Polynucleotide
taatacgactcactatagggcatacaatcgcggcgcggattaatccggcaaacagaggagatgccggatgaatccgcgcaacctggcggcagcgcaaaagatg

SEQ ID NO: 31909 - DNA, 103 bp, Artificial Sequence
  Synthetic Polynucleotide
taatacgactcactatagggaagttgacacaccttaaatggatataggggaacagaggagacccctaatgccatttaagaacctggcggcagcgcaaaagatg

SEQ ID NO: 31910 - DNA, 103 bp, Artificial Sequence
  Synthetic Polynucleotide
taatacgactcactataggggctctgaagtctaacacacttgacacaagaaacagaggagatcttgtatgaagtgtgttaacctggcggcagcgcaaaagatg

SEQ ID NO: 31911 - DNA, 103 bp, Artificial Sequence
  Synthetic Polynucleotide
taatacgactcactatagggaaaaagcaatgagaaatatgacggttttggaacagaggagaccaaaaatgtcatatttcaacctggcggcagcgcaaaagatg

SEQ ID NO: 31912 - DNA, 103 bp, Artificial Sequence
  Synthetic Polynucleotide
taatacgactcactatagggtgcctccgccgatactacttcagtctctctaacagaggagaagagagatggaagtagtaaacctggcggcagcgcaaaagatg

SEQ ID NO: 31913 - DNA, 103 bp, Artificial Sequence
  Synthetic Polynucleotide
taatacgactcactatagggacattgccatctgataagattcttccatacaacagaggagagtatggatgaatcttatcaacctggcggcagcgcaaaagatg

SEQ ID NO: 31914 - DNA, 103 bp, Artificial Sequence
  Synthetic Polynucleotide
taatacgactcactatagggctaagatactcccactgccgatcctacttgaacagaggagacaagtaatgtcggcagtgaacctggcggcagcgcaaaagatg

SEQ ID NO: 31915 - DNA, 103 bp, Artificial Sequence
  Synthetic Polynucleotide
taatacgactcactatagggatagataaacttgggcgaatcttattgggaaacagaggagatcccaaatggattcgcccaacctggcggcagcgcaaaagatg

SEQ ID NO: 31916 - DNA, 103 bp, Artificial Sequence
  Synthetic Polynucleotide
taatacgactcactatagggtcactttaactggaatatgacgaaatccgaaacagaggagatcggatatggtcatattcaacctggcggcagcgcaaaagatg

SEQ ID NO: 31917 - DNA, 103 bp, Artificial Sequence
  Synthetic Polynucleotide
taatacgactcactataggggtaggcaaggatgacacttacacagatcctaacagaggagaaggatcatggtaagtgtcaacctggcggcagcgcaaaagatg

SEQ ID NO: 31918 - DNA, 103 bp, Artificial Sequence
  Synthetic Polynucleotide
taatacgactcactatagggtatagaatatgcttgattgaggtgccctaaaacagaggagattagggatgctcaatcaaaacctggcggcagcgcaaaagatg

SEQ ID NO: 31919 - DNA, 103 bp, Artificial Sequence
  Synthetic Polynucleotide
taatacgactcactatagggcagtctgagcagctccgggactctctttttaacagaggagaaaaaagatggtcccggagaacctggcggcagcgcaaaagatg

SEQ ID NO: 31920 - DNA, 103 bp, Artificial Sequence
  Synthetic Polynucleotide
taatacgactcactatagggttaaagaagcccggcctcgccggcccttacaacagaggagagtaaggatgggcgaggccaacctggcggcagcgcaaaagatg

SEQ ID NO: 31921 - DNA, 103 bp, Artificial Sequence
  Synthetic Polynucleotide
taatacgactcactatagggcgtggcaaagagctctgaaagcatgcctcgaacagaggagacgaggcatgctttcagagaacctggcggcagcgcaaaagatg

SEQ ID NO: 31922 - DNA, 103 bp, Artificial Sequence
  Synthetic Polynucleotide
taatacgactcactatagggatcgcatatgaatctgaaaacaatcccccaaacagaggagatgggggatggttttcagaaacctggcggcagcgcaaaagatg

SEQ ID NO: 31923 - DNA, 103 bp, Artificial Sequence
  Synthetic Polynucleotide
taatacgactcactatagggtccctacgtagtttcaccgatctaaatgttaacagaggagaaacattatgatcggtgaaaacctggcggcagcgcaaaagatg

SEQ ID NO: 31924 - DNA, 103 bp, Artificial Sequence
  Synthetic Polynucleotide
taatacgactcactatagggccgtacttttaacttgtcataaatcgaccgaacagaggagacggtcgatgtatgacaagaacctggcggcagcgcaaaagatg

SEQ ID NO: 31925 - DNA, 103 bp, Artificial Sequence
  Synthetic Polynucleotide
taatacgactcactatagggctatcaacgacgtatgtcgaagcttatgagaacagaggagactcataatgttcgacataaacctggcggcagcgcaaaagatg

SEQ ID NO: 31926 - DNA, 103 bp, Artificial Sequence
  Synthetic Polynucleotide
taatacgactcactatagggaacccccgacttccccgtagcacattggagaacagaggagactccaaatggctacggggaacctggcggcagcgcaaaagatg

SEQ ID NO: 31927 - DNA, 103 bp, Artificial Sequence
  Synthetic Polynucleotide
taatacgactcactatagggccctagccggagcattggttcctcagcatgaacagaggagacatgctatggaaccaatgaacctggcggcagcgcaaaagatg

SEQ ID NO: 31928 - DNA, 103 bp, Artificial Sequence
  Synthetic Polynucleotide
taatacgactcactatagggcgatcactgcaacctaaaaaggcgacttagaacagaggagactaagtatgctttttaggaacctggcggcagcgcaaaagatg

SEQ ID NO: 31929 - DNA, 103 bp, Artificial Sequence
  Synthetic Polynucleotide
taatacgactcactatagggggatcagaccattggccgacgaggcgatcgaacagaggagacgatcgatgcgtcggccaaacctggcggcagcgcaaaagatg

SEQ ID NO: 31930 - DNA, 103 bp, Artificial Sequence
  Synthetic Polynucleotide
taatacgactcactataggggcacttggggcgggtattacgtaacagcggaacagaggagaccgctgatgcgtaataccaacctggcggcagcgcaaaagatg

SEQ ID NO: 31931 - DNA, 103 bp, Artificial Sequence
  Synthetic Polynucleotide
taatacgactcactatagggcagggctgatcgtttgatctacgcttatcaaacagaggagatgataaatgtagatcaaaaacctggcggcagcgcaaaagatg

SEQ ID NO: 31932 - DNA, 103 bp, Artificial Sequence
  Synthetic Polynucleotide
taatacgactcactatagggtgtaactgttccaggtggaaagagtctgtaaacagaggagatacagaatgtttccacctaacctggcggcagcgcaaaagatg

SEQ ID NO: 31933 - DNA, 103 bp, Artificial Sequence
  Synthetic Polynucleotide
taatacgactcactatagggcaaagccgttctatagtcaaccattactacaacagaggagagtagtaatggttgactataacctggcggcagcgcaaaagatg

SEQ ID NO: 31934 - DNA, 103 bp, Artificial Sequence
  Synthetic Polynucleotide
taatacgactcactatagggatcctccacatactacgcgagcccagagtgaacagaggagacactctatgctcgcgtagaacctggcggcagcgcaaaagatg

SEQ ID NO: 31935 - DNA, 103 bp, Artificial Sequence
  Synthetic Polynucleotide
taatacgactcactatagggttaacaggctcccctggtgtaggcgaatgtaacagaggagaacattcatgtacaccaggaacctggcggcagcgcaaaagatg

SEQ ID NO: 31936 - DNA, 103 bp, Artificial Sequence
  Synthetic Polynucleotide
taatacgactcactatagggggtacaaccaaataatgaggggtgcgccggaacagaggagaccggcgatgccctcattaaacctggcggcagcgcaaaagatg

SEQ ID NO: 31937 - DNA, 103 bp, Artificial Sequence
  Synthetic Polynucleotide
taatacgactcactatagggagacggtgttgtaaacgctgctaggtctcaaacagaggagatgagacatggcagcgtttaacctggcggcagcgcaaaagatg

SEQ ID NO: 31938 - DNA, 103 bp, Artificial Sequence
  Synthetic Polynucleotide
taatacgactcactatagggacacagggtttagcaggtcgcagtaacagcaacagaggagagctgttatggcgacctgcaacctggcggcagcgcaaaagatg

SEQ ID NO: 31939 - DNA, 103 bp, Artificial Sequence
  Synthetic Polynucleotide
taatacgactcactatagggcagtcaaggactctgtagttgtagcagacaaacagaggagatgtctgatgcaactacagaacctggcggcagcgcaaaagatg

SEQ ID NO: 31940 - DNA, 103 bp, Artificial Sequence
  Synthetic Polynucleotide
taatacgactcactataggggtcgattagagattacttctgcctaatcgtaacagaggagaacgattatgcagaagtaaaacctggcggcagcgcaaaagatg

SEQ ID NO: 31941 - DNA, 103 bp, Artificial Sequence
  Synthetic Polynucleotide
taatacgactcactataggggacattctatagcgacctcggatggtgtttaacagaggagaaaacacatgccgaggtcgaacctggcggcagcgcaaaagatg

SEQ ID NO: 31942 - DNA, 103 bp, Artificial Sequence
  Synthetic Polynucleotide
taatacgactcactatagggccagtattgaagtcatgtggctaacaattgaacagaggagacaattgatggccacatgaaacctggcggcagcgcaaaagatg

SEQ ID NO: 31943 - DNA, 103 bp, Artificial Sequence
  Synthetic Polynucleotide
taatacgactcactatagggggattttacgacgagcttcacacgtaagtgaacagaggagacacttaatggtgaagctcaacctggcggcagcgcaaaagatg

SEQ ID NO: 31944 - DNA, 103 bp, Artificial Sequence
  Synthetic Polynucleotide
taatacgactcactatagggagcggttgaacacaatgatcgcgatgcagcaacagaggagagctgcaatgcgatcattgaacctggcggcagcgcaaaagatg

SEQ ID NO: 31945 - DNA, 103 bp, Artificial Sequence
  Synthetic Polynucleotide
taatacgactcactatagggtgcaatagggtgaaggcttaagtaggtcccaacagaggagagggaccatgttaagccttaacctggcggcagcgcaaaagatg

SEQ ID NO: 31946 - DNA, 103 bp, Artificial Sequence
  Synthetic Polynucleotide
taatacgactcactatagggacagccttcgccgcctttgcactacccgccaacagaggagaggcgggatgtgcaaaggcaacctggcggcagcgcaaaagatg

SEQ ID NO: 31947 - DNA, 103 bp, Artificial Sequence
  Synthetic Polynucleotide
taatacgactcactatagggcgcaatcgtgtgccttaccttttttaccgcaacagaggagagcggtaatgaaggtaaggaacctggcggcagcgcaaaagatg

SEQ ID NO: 31948 - DNA, 103 bp, Artificial Sequence
  Synthetic Polynucleotide
taatacgactcactatagggacctaaattattccgtaccatcttctgacaaacagaggagatgtcagatgatggtacggaacctggcggcagcgcaaaagatg

SEQ ID NO: 31949 - DNA, 103 bp, Artificial Sequence
  Synthetic Polynucleotide
taatacgactcactataggggtcgactcccctcgtgcagtccttcaaataaacagaggagatatttgatggactgcacgaacctggcggcagcgcaaaagatg

SEQ ID NO: 31950 - DNA, 103 bp, Artificial Sequence
  Synthetic Polynucleotide
taatacgactcactatagggaggatcagattcgtcctgtaggtacgtccaaacagaggagatggacgatgctacaggacaacctggcggcagcgcaaaagatg

SEQ ID NO: 31951 - DNA, 103 bp, Artificial Sequence
  Synthetic Polynucleotide
taatacgactcactataggggacgccttgtgcttctttgatttacaactaaacagaggagatagttgatgatcaaagaaaacctggcggcagcgcaaaagatg

SEQ ID NO: 31952 - DNA, 103 bp, Artificial Sequence
  Synthetic Polynucleotide
taatacgactcactatagggcaagagcggtaatacacagcgcgcctataaaacagaggagattatagatgcgctgtgtaaacctggcggcagcgcaaaagatg

SEQ ID NO: 31953 - DNA, 103 bp, Artificial Sequence
  Synthetic Polynucleotide
taatacgactcactatagggtacccggttaacaaagaagaggatttcatcaacagaggagagatgaaatgctcttctttaacctggcggcagcgcaaaagatg

SEQ ID NO: 31954 - DNA, 103 bp, Artificial Sequence
  Synthetic Polynucleotide
taatacgactcactataggggagcagttttaatggagattatcctatgaaaacagaggagattcataatgtaatctccaaacctggcggcagcgcaaaagatg

SEQ ID NO: 31955 - DNA, 103 bp, Artificial Sequence
  Synthetic Polynucleotide
taatacgactcactataggggcataatgtcgaatttgcttgaggattaccaacagaggagaggtaatatgcaagcaaataacctggcggcagcgcaaaagatg

SEQ ID NO: 31956 - DNA, 103 bp, Artificial Sequence
  Synthetic Polynucleotide
taatacgactcactataggggtgccgcgcctgtccgaggactcatcacataacagaggagaatgtgaatggtcctcggaaacctggcggcagcgcaaaagatg

SEQ ID NO: 31957 - DNA, 103 bp, Artificial Sequence
  Synthetic Polynucleotide
taatacgactcactatagggttttccactagctgggaactgcaccactgaaacagaggagatcagtgatgcagttcccaaacctggcggcagcgcaaaagatg

SEQ ID NO: 31958 - DNA, 103 bp, Artificial Sequence
  Synthetic Polynucleotide
taatacgactcactatagggcttaaaacgggatagttccaatctgagaggaacagaggagacctctcatgttggaactaaacctggcggcagcgcaaaagatg

SEQ ID NO: 31959 - DNA, 103 bp, Artificial Sequence
  Synthetic Polynucleotide
taatacgactcactatagggtgattcaggcgcaaaggatggcgccaagataacagaggagaatcttgatgccatcctttaacctggcggcagcgcaaaagatg

SEQ ID NO: 31960 - DNA, 103 bp, Artificial Sequence
  Synthetic Polynucleotide
taatacgactcactataggggtccgaacatctaacctgccttacgtgcataacagaggagaatgcacatgaggcaggttaacctggcggcagcgcaaaagatg

SEQ ID NO: 31961 - DNA, 103 bp, Artificial Sequence
  Synthetic Polynucleotide
taatacgactcactatagggcgtgcacgcattctggcctcacaggaactgaacagaggagacagttcatgtgaggccagaacctggcggcagcgcaaaagatg

SEQ ID NO: 31962 - DNA, 103 bp, Artificial Sequence
  Synthetic Polynucleotide
taatacgactcactatagggagcagatcttctcagtcaatcgacatagtgaacagaggagacactatatggattgactgaacctggcggcagcgcaaaagatg

SEQ ID NO: 31963 - DNA, 103 bp, Artificial Sequence
  Synthetic Polynucleotide
taatacgactcactatagggtcacgctctgggctaagctatctcagtcaaaacagaggagattgactatgatagcttagaacctggcggcagcgcaaaagatg

SEQ ID NO: 31964 - DNA, 103 bp, Artificial Sequence
  Synthetic Polynucleotide
taatacgactcactatagggctgggacaacttaagccgctactcccattcaacagaggagagaatggatgtagcggcttaacctggcggcagcgcaaaagatg

SEQ ID NO: 31965 - DNA, 103 bp, Artificial Sequence
  Synthetic Polynucleotide
taatacgactcactatagggtgcggacgtcaccggcattcgaactgtattaacagaggagaaatacaatgcgaatgccgaacctggcggcagcgcaaaagatg

SEQ ID NO: 31966 - DNA, 103 bp, Artificial Sequence
  Synthetic Polynucleotide
taatacgactcactatagggtaagcttcggatcgtgtatacggtaatagaaacagaggagatctattatggtatacacgaacctggcggcagcgcaaaagatg

SEQ ID NO: 31967 - DNA, 103 bp, Artificial Sequence
  Synthetic Polynucleotide
taatacgactcactatagggtgtaattgttagttgagaacttcttttctaaacagaggagatagaaaatgagttctcaaaacctggcggcagcgcaaaagatg

SEQ ID NO: 31968 - DNA, 103 bp, Artificial Sequence
  Synthetic Polynucleotide
taatacgactcactatagggttccacaatcagcgcgctcgcccttgatagaacagaggagactatcaatggcgagcgcgaacctggcggcagcgcaaaagatg

SEQ ID NO: 31969 - DNA, 103 bp, Artificial Sequence
  Synthetic Polynucleotide
taatacgactcactataggggacgcctagaccatgagtattcgtactagaaacagaggagatctagtatgaatactcataacctggcggcagcgcaaaagatg

SEQ ID NO: 31970 - DNA, 103 bp, Artificial Sequence
  Synthetic Polynucleotide
taatacgactcactatagggtcactatcgttcggacgcgaggctgcgtataacagaggagaatacgcatgctcgcgtccaacctggcggcagcgcaaaagatg

SEQ ID NO: 31971 - DNA, 103 bp, Artificial Sequence
  Synthetic Polynucleotide
taatacgactcactatagggctgggaggtagtattaacgagcatcgcgcgaacagaggagacgcgcgatgctcgttaataacctggcggcagcgcaaaagatg

SEQ ID NO: 31972 - DNA, 103 bp, Artificial Sequence
  Synthetic Polynucleotide
taatacgactcactataggggagaatatgaatggggatacccatagccctaacagaggagaagggctatgggtatccccaacctggcggcagcgcaaaagatg

SEQ ID NO: 31973 - DNA, 103 bp, Artificial Sequence
  Synthetic Polynucleotide
taatacgactcactatagggatggaaaagaccggcaccactgaagtaagaaacagaggagatcttacatgagtggtgccaacctggcggcagcgcaaaagatg

SEQ ID NO: 31974 - DNA, 103 bp, Artificial Sequence
  Synthetic Polynucleotide
taatacgactcactataggggttacctcggtagttaggcgataaagcgtcaacagaggagagacgctatgtcgcctaacaacctggcggcagcgcaaaagatg

SEQ ID NO: 31975 - DNA, 103 bp, Artificial Sequence
  Synthetic Polynucleotide
taatacgactcactatagggtggacacgtagggaaaattttccggtatccaacagaggagaggatacatgaaaattttcaacctggcggcagcgcaaaagatg

SEQ ID NO: 31976 - DNA, 103 bp, Artificial Sequence
  Synthetic Polynucleotide
taatacgactcactatagggtacccaggagtattggacggaagaagttgaaacagaggagatcaactatgtccgtccaaaacctggcggcagcgcaaaagatg

SEQ ID NO: 31977 - DNA, 103 bp, Artificial Sequence
  Synthetic Polynucleotide
taatacgactcactatagggcgacaatgtcgcataattggcccccacgttaacagaggagaaacgtgatggccaattataacctggcggcagcgcaaaagatg

SEQ ID NO: 31978 - DNA, 103 bp, Artificial Sequence
  Synthetic Polynucleotide
taatacgactcactatagggctacaatgtatccttctgcccctctaccagaacagaggagactggtaatggggcagaagaacctggcggcagcgcaaaagatg

SEQ ID NO: 31979 - DNA, 103 bp, Artificial Sequence
  Synthetic Polynucleotide
taatacgactcactatagggcacgggcacgcggtctcgagtctcgacgacaacagaggagagtcgtcatgactcgagacaacctggcggcagcgcaaaagatg

SEQ ID NO: 31980 - DNA, 103 bp, Artificial Sequence
  Synthetic Polynucleotide
taatacgactcactatagggaccaaaccacgaacgtcgcacccacataccaacagaggagaggtatgatggtgcgacgtaacctggcggcagcgcaaaagatg

SEQ ID NO: 31981 - DNA, 103 bp, Artificial Sequence
  Synthetic Polynucleotide
taatacgactcactatagggaggaggggcacttccgtttcttcgccttagaacagaggagactaaggatgagaaacggaaacctggcggcagcgcaaaagatg

SEQ ID NO: 31982 - DNA, 103 bp, Artificial Sequence
  Synthetic Polynucleotide
taatacgactcactatagggctcttgggcgtggcagtggatgagagattgaacagaggagacaatctatgatccactgcaacctggcggcagcgcaaaagatg

SEQ ID NO: 31983 - DNA, 103 bp, Artificial Sequence
  Synthetic Polynucleotide
taatacgactcactataggggaagacgaaaagtgaacggaggaatcgtgaaacagaggagatcacgaatgctccgttcaaacctggcggcagcgcaaaagatg

SEQ ID NO: 31984 - DNA, 103 bp, Artificial Sequence
  Synthetic Polynucleotide
taatacgactcactatagggaacagccccttatctcctgctggattactaaacagaggagatagtaaatgagcaggagaaacctggcggcagcgcaaaagatg

SEQ ID NO: 31985 - DNA, 103 bp, Artificial Sequence
  Synthetic Polynucleotide
taatacgactcactatagggcagaaagtcgtctacttcatttaattggttaacagaggagaaaccaaatgaatgaagtaaacctggcggcagcgcaaaagatg

SEQ ID NO: 31986 - DNA, 103 bp, Artificial Sequence
  Synthetic Polynucleotide
taatacgactcactatagggtcacccagtgggctaaagttcgttcaggcgaacagaggagacgcctgatggaactttagaacctggcggcagcgcaaaagatg

SEQ ID NO: 31987 - DNA, 103 bp, Artificial Sequence
  Synthetic Polynucleotide
taatacgactcactatagggaatatggggaactgacggtgcaactaatagaacagaggagactattaatggcaccgtcaaacctggcggcagcgcaaaagatg

SEQ ID NO: 31988 - DNA, 103 bp, Artificial Sequence
  Synthetic Polynucleotide
taatacgactcactatagggacaaagtgccatttagatgagagtggtagaaacagaggagatctaccatgctcatctaaaacctggcggcagcgcaaaagatg

SEQ ID NO: 31989 - DNA, 103 bp, Artificial Sequence
  Synthetic Polynucleotide
taatacgactcactatagggccgtccctgggggagccccaggcaatgcaaaacagaggagattgcatatgctggggctcaacctggcggcagcgcaaaagatg

SEQ ID NO: 31990 - DNA, 103 bp, Artificial Sequence
  Synthetic Polynucleotide
taatacgactcactatagggccacgtgactgcgacaaggcgccagctattaacagaggagaaatagcatgcgccttgtcaacctggcggcagcgcaaaagatg

SEQ ID NO: 31991 - DNA, 103 bp, Artificial Sequence
  Synthetic Polynucleotide
taatacgactcactataggggttgcgagtaccctattttgggtaagcctgaacagaggagacaggctatgccaaaatagaacctggcggcagcgcaaaagatg

SEQ ID NO: 31992 - DNA, 103 bp, Artificial Sequence
  Synthetic Polynucleotide
taatacgactcactatagggttgggacgcataggtcgtttcgcaggatcaaacagaggagatgatccatggaaacgaccaacctggcggcagcgcaaaagatg

SEQ ID NO: 31993 - DNA, 103 bp, Artificial Sequence
  Synthetic Polynucleotide
taatacgactcactatagggtcctccgtccggaacggacatgcactcgcgaacagaggagacgcgagatgatgtccgttaacctggcggcagcgcaaaagatg

SEQ ID NO: 31994 - DNA, 103 bp, Artificial Sequence
  Synthetic Polynucleotide
taatacgactcactatagggaacaattataagaaagccgttgaatgcttaaacagaggagataagcaatgaacggctttaacctggcggcagcgcaaaagatg

SEQ ID NO: 31995 - DNA, 103 bp, Artificial Sequence
  Synthetic Polynucleotide
taatacgactcactatagggctgttcggatgttgtattgccgtagcttataacagaggagaataagcatgggcaatacaaacctggcggcagcgcaaaagatg

SEQ ID NO: 31996 - DNA, 103 bp, Artificial Sequence
  Synthetic Polynucleotide
taatacgactcactataggggacacgatgggagaaagagcaaggctgcccaacagaggagagggcagatgtgctctttcaacctggcggcagcgcaaaagatg

SEQ ID NO: 31997 - DNA, 103 bp, Artificial Sequence
  Synthetic Polynucleotide
taatacgactcactatagggccagctgaaacccgcgtaaccccgtagattaacagaggagaaatctaatgggttacgcgaacctggcggcagcgcaaaagatg

SEQ ID NO: 31998 - DNA, 103 bp, Artificial Sequence
  Synthetic Polynucleotide
taatacgactcactatagggagagctctgtgcacggctagacacttttttaacagaggagaaaaaaaatgtctagccgtaacctggcggcagcgcaaaagatg

SEQ ID NO: 31999 - DNA, 103 bp, Artificial Sequence
  Synthetic Polynucleotide
taatacgactcactatagggaattagaacggaccaccttaacatgactacaacagaggagagtagtcatgttaaggtggaacctggcggcagcgcaaaagatg

SEQ ID NO: 32000 - DNA, 103 bp, Artificial Sequence
  Synthetic Polynucleotide
taatacgactcactatagggaccccagctctgggttgaagagcgtttattaacagaggagaaataaaatgtcttcaaccaacctggcggcagcgcaaaagatg

SEQ ID NO: 32001 - DNA, 103 bp, Artificial Sequence
  Synthetic Polynucleotide
taatacgactcactatagggcctgatgggggctattactcagacacattaaacagaggagataatgtatgtgagtaataaacctggcggcagcgcaaaagatg

SEQ ID NO: 32002 - DNA, 103 bp, Artificial Sequence
  Synthetic Polynucleotide
taatacgactcactatagggcaggccagcgaaagttaaattgttggcaacaacagaggagagttgccatgaatttaactaacctggcggcagcgcaaaagatg

SEQ ID NO: 32003 - DNA, 103 bp, Artificial Sequence
  Synthetic Polynucleotide
taatacgactcactatagggtgaggtccaggtcgccggcgaataggcagaaacagaggagatctgccatgtcgccggcgaacctggcggcagcgcaaaagatg

SEQ ID NO: 32004 - DNA, 103 bp, Artificial Sequence
  Synthetic Polynucleotide
taatacgactcactatagggggtggtatctcggttagggttgagtttcggaacagaggagaccgaaaatgaaccctaacaacctggcggcagcgcaaaagatg

SEQ ID NO: 32005 - DNA, 103 bp, Artificial Sequence
  Synthetic Polynucleotide
taatacgactcactatagggttgctaccctactgcaggctagcgcggccaaacagaggagatggccgatgtagcctgcaaacctggcggcagcgcaaaagatg

SEQ ID NO: 32006 - DNA, 103 bp, Artificial Sequence
  Synthetic Polynucleotide
taatacgactcactatagggttacgttgcgaacagggatgtaatccagtaaacagaggagatactggatgacatccctgaacctggcggcagcgcaaaagatg

SEQ ID NO: 32007 - DNA, 103 bp, Artificial Sequence
  Synthetic Polynucleotide
taatacgactcactataggggatcatctttctaggtcccggcacgtcgtcaacagaggagagacgacatgccgggacctaacctggcggcagcgcaaaagatg

SEQ ID NO: 32008 - DNA, 103 bp, Artificial Sequence
  Synthetic Polynucleotide
taatacgactcactatagggctcgagtttgtactttacgcactgcgggcaaacagaggagatgcccgatgtgcgtaaagaacctggcggcagcgcaaaagatg

SEQ ID NO: 32009 - DNA, 103 bp, Artificial Sequence
  Synthetic Polynucleotide
taatacgactcactatagggtaggttgtttcgtgtaccgaacatttccgaaacagaggagatcggaaatgttcggtacaaacctggcggcagcgcaaaagatg

SEQ ID NO: 32010 - DNA, 103 bp, Artificial Sequence
  Synthetic Polynucleotide
taatacgactcactatagggccagcagttgactatggggtgtagactgctaacagaggagaagcagtatgcaccccataaacctggcggcagcgcaaaagatg

SEQ ID NO: 32011 - DNA, 103 bp, Artificial Sequence
  Synthetic Polynucleotide
taatacgactcactatagggttctgacacgaggggaacgttccaccacgtaacagaggagaacgtggatgaacgttcccaacctggcggcagcgcaaaagatg

SEQ ID NO: 32012 - DNA, 103 bp, Artificial Sequence
  Synthetic Polynucleotide
taatacgactcactatagggtaatcatcgccataaaatacggacgcctcaaacagaggagatgaggcatgcgtattttaaacctggcggcagcgcaaaagatg

SEQ ID NO: 32013 - DNA, 103 bp, Artificial Sequence
  Synthetic Polynucleotide
taatacgactcactatagggccgcgtgcttacttcgtcctctagctgttgaacagaggagacaacagatggaggacgaaaacctggcggcagcgcaaaagatg

SEQ ID NO: 32014 - DNA, 103 bp, Artificial Sequence
  Synthetic Polynucleotide
taatacgactcactatagggcactctcagtatcaccggatggtaccaggtaacagaggagaacctggatgcatccggtgaacctggcggcagcgcaaaagatg

SEQ ID NO: 32015 - DNA, 103 bp, Artificial Sequence
  Synthetic Polynucleotide
taatacgactcactataggggtctaagacccgacgtgcataggattaataaacagaggagatattaaatgtatgcacgtaacctggcggcagcgcaaaagatg

SEQ ID NO: 32016 - DNA, 103 bp, Artificial Sequence
  Synthetic Polynucleotide
taatacgactcactataggggttgcactattattatgccctcgaatttggaacagaggagaccaaatatgagggcataaaacctggcggcagcgcaaaagatg

SEQ ID NO: 32017 - DNA, 103 bp, Artificial Sequence
  Synthetic Polynucleotide
taatacgactcactataggggctcaaccctgggagggtccaacagacgggaacagaggagacccgtcatgtggaccctcaacctggcggcagcgcaaaagatg

SEQ ID NO: 32018 - DNA, 103 bp, Artificial Sequence
  Synthetic Polynucleotide
taatacgactcactatagggtgcacagaggtatgccgggttgactaccataacagaggagaatggtaatgaacccggcaaacctggcggcagcgcaaaagatg

SEQ ID NO: 32019 - DNA, 103 bp, Artificial Sequence
  Synthetic Polynucleotide
taatacgactcactatagggattcgagaagactgctccccatcgctattaaacagaggagataatagatgtggggagcaaacctggcggcagcgcaaaagatg

SEQ ID NO: 32020 - DNA, 103 bp, Artificial Sequence
  Synthetic Polynucleotide
taatacgactcactatagggctagcacctgggtttgtacgccgagcgaacaacagaggagagttcgcatggcgtacaaaaacctggcggcagcgcaaaagatg

SEQ ID NO: 32021 - DNA, 103 bp, Artificial Sequence
  Synthetic Polynucleotide
taatacgactcactataggggaagtcaactcttcagtctcggacaaaaaaaacagaggagattttttatgcgagactgaaacctggcggcagcgcaaaagatg

SEQ ID NO: 32022 - DNA, 103 bp, Artificial Sequence
  Synthetic Polynucleotide
taatacgactcactatagggatgtaagcggttggacatacctcagcaaggaacagaggagaccttgcatgggtatgtccaacctggcggcagcgcaaaagatg

SEQ ID NO: 32023 - DNA, 103 bp, Artificial Sequence
  Synthetic Polynucleotide
taatacgactcactatagggccgtttggagcgtcaatcgagggtggtacgaacagaggagacgtaccatgctcgattgaaacctggcggcagcgcaaaagatg

SEQ ID NO: 32024 - DNA, 103 bp, Artificial Sequence
  Synthetic Polynucleotide
taatacgactcactataggggtcaccctggggggatgtctttcttaaaccaacagaggagaggtttaatgaagacatccaacctggcggcagcgcaaaagatg

SEQ ID NO: 32025 - DNA, 103 bp, Artificial Sequence
  Synthetic Polynucleotide
taatacgactcactatagggtagcctctatgcatttgacaatgtacgagcaacagaggagagctcgtatgttgtcaaataacctggcggcagcgcaaaagatg

SEQ ID NO: 32026 - DNA, 103 bp, Artificial Sequence
  Synthetic Polynucleotide
taatacgactcactataggggagtgcaaacgccacctcgtatatccagtgaacagaggagacactggatgtacgaggtgaacctggcggcagcgcaaaagatg

SEQ ID NO: 32027 - DNA, 103 bp, Artificial Sequence
  Synthetic Polynucleotide
taatacgactcactatagggcatcggtatgttcacatgaatgactccagtaacagaggagaactggaatgattcatgtgaacctggcggcagcgcaaaagatg

SEQ ID NO: 32028 - DNA, 103 bp, Artificial Sequence
  Synthetic Polynucleotide
taatacgactcactatagggcaagagatgggaatgatctaacaagttgttaacagaggagaaacaacatgttagatcataacctggcggcagcgcaaaagatg

SEQ ID NO: 32029 - DNA, 103 bp, Artificial Sequence
  Synthetic Polynucleotide
taatacgactcactataggggccgcccacttagccgtgttctacgcaagcaacagaggagagcttgcatggaacacggcaacctggcggcagcgcaaaagatg

SEQ ID NO: 32030 - DNA, 103 bp, Artificial Sequence
  Synthetic Polynucleotide
taatacgactcactataggggagatttttatcttttctggcgcagtatcgaacagaggagacgatacatggccagaaaaaacctggcggcagcgcaaaagatg

SEQ ID NO: 32031 - DNA, 103 bp, Artificial Sequence
  Synthetic Polynucleotide
taatacgactcactatagggcatttttatacctatgacaaagaggcccggaacagaggagaccgggcatgtttgtcataaacctggcggcagcgcaaaagatg

SEQ ID NO: 32032 - DNA, 103 bp, Artificial Sequence
  Synthetic Polynucleotide
taatacgactcactatagggactgtaaatggtacgggtcggtgtattgccaacagaggagaggcaatatgccgacccgtaacctggcggcagcgcaaaagatg

SEQ ID NO: 32033 - DNA, 103 bp, Artificial Sequence
  Synthetic Polynucleotide
taatacgactcactatagggtttaagagtgacgatcgcgctacacgttccaacagaggagaggaacgatgagcgcgatcaacctggcggcagcgcaaaagatg

SEQ ID NO: 32034 - DNA, 103 bp, Artificial Sequence
  Synthetic Polynucleotide
taatacgactcactatagggctatcaacccattcgccttatctgttaatcaacagaggagagattaaatgataaggcgaaacctggcggcagcgcaaaagatg

SEQ ID NO: 32035 - DNA, 103 bp, Artificial Sequence
  Synthetic Polynucleotide
taatacgactcactatagggatgcccagcgaggtatgcgaactatcaggtaacagaggagaacctgaatgttcgcatacaacctggcggcagcgcaaaagatg

SEQ ID NO: 32036 - DNA, 103 bp, Artificial Sequence
  Synthetic Polynucleotide
taatacgactcactatagggcccccagccaatgttccgccgatcaggcggaacagaggagaccgcctatgcggcggaacaacctggcggcagcgcaaaagatg

SEQ ID NO: 32037 - DNA, 103 bp, Artificial Sequence
  Synthetic Polynucleotide
taatacgactcactatagggaggcgaacacgtttaaaataatgcaaagataacagaggagaatctttatgttattttaaaacctggcggcagcgcaaaagatg

SEQ ID NO: 32038 - DNA, 103 bp, Artificial Sequence
  Synthetic Polynucleotide
taatacgactcactatagggggagtactgctggcactgttctgaacgcagaacagaggagactgcgtatggaacagtgcaacctggcggcagcgcaaaagatg

SEQ ID NO: 32039 - DNA, 103 bp, Artificial Sequence
  Synthetic Polynucleotide
taatacgactcactatagggtgtgctcaaggacgattatagatatctctcaacagaggagagagagaatgctataatcgaacctggcggcagcgcaaaagatg

SEQ ID NO: 32040 - DNA, 103 bp, Artificial Sequence
  Synthetic Polynucleotide
taatacgactcactatagggaacctaagttccatagtacacggggacaaaaacagaggagatttgtcatggtgtactataacctggcggcagcgcaaaagatg

SEQ ID NO: 32041 - DNA, 103 bp, Artificial Sequence
  Synthetic Polynucleotide
taatacgactcactatagggctttaaaccaactaaaatatgtactatctaaacagaggagatagataatgcatattttaaacctggcggcagcgcaaaagatg

SEQ ID NO: 32042 - DNA, 103 bp, Artificial Sequence
  Synthetic Polynucleotide
taatacgactcactatagggtcagaaccacctgtggggaacttgaggttcaacagaggagagaacctatggttccccacaacctggcggcagcgcaaaagatg

SEQ ID NO: 32043 - DNA, 103 bp, Artificial Sequence
  Synthetic Polynucleotide
taatacgactcactatagggagagagatggaaactctgcagaacgcgcgaaacagaggagatcgcgcatgctgcagagtaacctggcggcagcgcaaaagatg

SEQ ID NO: 32044 - DNA, 103 bp, Artificial Sequence
  Synthetic Polynucleotide
taatacgactcactatagggattattccttgccaatttctgctaataagcaacagaggagagcttatatgcagaaattgaacctggcggcagcgcaaaagatg

SEQ ID NO: 32045 - DNA, 103 bp, Artificial Sequence
  Synthetic Polynucleotide
taatacgactcactatagggtcgtggacgaacgtgtacttggagtgtcctaacagaggagaaggacaatgcaagtacacaacctggcggcagcgcaaaagatg

SEQ ID NO: 32046 - DNA, 103 bp, Artificial Sequence
  Synthetic Polynucleotide
taatacgactcactatagggatatctgtaactgcaactaatcattcagtaaacagaggagatactgaatgattagttgcaacctggcggcagcgcaaaagatg

SEQ ID NO: 32047 - DNA, 103 bp, Artificial Sequence
  Synthetic Polynucleotide
taatacgactcactatagggacgtttactaagcggcttcttatggaaccaaacagaggagatggttcatgaagaagccgaacctggcggcagcgcaaaagatg

SEQ ID NO: 32048 - DNA, 103 bp, Artificial Sequence
  Synthetic Polynucleotide
taatacgactcactatagggtacaaatcctctttcctgtactgattgtgaaacagaggagatcacaaatggtacaggaaaacctggcggcagcgcaaaagatg

SEQ ID NO: 32049 - DNA, 103 bp, Artificial Sequence
  Synthetic Polynucleotide
taatacgactcactatagggattaatcttcggacggtgctgcgtaggaccaacagaggagaggtcctatgcagcaccgtaacctggcggcagcgcaaaagatg

SEQ ID NO: 32050 - DNA, 103 bp, Artificial Sequence
  Synthetic Polynucleotide
taatacgactcactatagggtcctccatggattcgccgtggggccccgttaacagaggagaaacgggatgccacggcgaaacctggcggcagcgcaaaagatg

SEQ ID NO: 32051 - DNA, 103 bp, Artificial Sequence
  Synthetic Polynucleotide
taatacgactcactataggggatacaaataattcaccttggtgcttgtaaaacagaggagattacaaatgccaaggtgaaacctggcggcagcgcaaaagatg

SEQ ID NO: 32052 - DNA, 103 bp, Artificial Sequence
  Synthetic Polynucleotide
taatacgactcactataggggcagaggttctcagcagtgaaccttcagccaacagaggagaggctgaatgttcactgctaacctggcggcagcgcaaaagatg

SEQ ID NO: 32053 - DNA, 103 bp, Artificial Sequence
  Synthetic Polynucleotide
taatacgactcactatagggtatatacaatggaccatacgagccacattgaacagaggagacaatgtatgtcgtatggtaacctggcggcagcgcaaaagatg

SEQ ID NO: 32054 - DNA, 103 bp, Artificial Sequence
  Synthetic Polynucleotide
taatacgactcactatagggtgacgtgtgctatcagttgggaaatcgtttaacagaggagaaaacgaatgcccaactgaaacctggcggcagcgcaaaagatg

SEQ ID NO: 32055 - DNA, 103 bp, Artificial Sequence
  Synthetic Polynucleotide
taatacgactcactatagggccatagtgcattcaagtagtttatcgtgtcaacagaggagagacacgatgaactacttgaacctggcggcagcgcaaaagatg

SEQ ID NO: 32056 - DNA, 103 bp, Artificial Sequence
  Synthetic Polynucleotide
taatacgactcactatagggtggcctcccatcatcgtctggtaacctcaaaacagaggagattgaggatgccagacgataacctggcggcagcgcaaaagatg

SEQ ID NO: 32057 - DNA, 103 bp, Artificial Sequence
  Synthetic Polynucleotide
taatacgactcactatagggtgctggagacttaacctgaccccgtcccataacagaggagaatgggaatgggtcaggttaacctggcggcagcgcaaaagatg

SEQ ID NO: 32058 - DNA, 103 bp, Artificial Sequence
  Synthetic Polynucleotide
taatacgactcactatagggagcgttaatattccaatcctgtgcatgttaaacagaggagataacatatgcaggattggaacctggcggcagcgcaaaagatg

SEQ ID NO: 32059 - DNA, 103 bp, Artificial Sequence
  Synthetic Polynucleotide
taatacgactcactatagggaaatgattggcccatagaacatcttgcgacaacagaggagagtcgcaatgtgttctatgaacctggcggcagcgcaaaagatg

SEQ ID NO: 32060 - DNA, 103 bp, Artificial Sequence
  Synthetic Polynucleotide
taatacgactcactatagggtgctacttaggtgacagaagacatatgtgtaacagaggagaacacatatgtcttctgtcaacctggcggcagcgcaaaagatg

SEQ ID NO: 32061 - DNA, 103 bp, Artificial Sequence
  Synthetic Polynucleotide
taatacgactcactatagggccgtacggtagattggtaagacgtacctggaacagaggagaccaggtatgtcttaccaaaacctggcggcagcgcaaaagatg

SEQ ID NO: 32062 - DNA, 103 bp, Artificial Sequence
  Synthetic Polynucleotide
taatacgactcactataggggaatactgttgaatgctatgttcagttggaaacagaggagatccaacatgacatagcataacctggcggcagcgcaaaagatg

SEQ ID NO: 32063 - DNA, 103 bp, Artificial Sequence
  Synthetic Polynucleotide
taatacgactcactatagggctgtttcgtccgcagtcccacccatctatcaacagaggagagatagaatggtgggactgaacctggcggcagcgcaaaagatg

SEQ ID NO: 32064 - DNA, 103 bp, Artificial Sequence
  Synthetic Polynucleotide
taatacgactcactatagggcctgaactcctgcctcagcatcactgatgaaacagaggagatcatcaatgatgctgaggaacctggcggcagcgcaaaagatg

SEQ ID NO: 32065 - DNA, 103 bp, Artificial Sequence
  Synthetic Polynucleotide
taatacgactcactataggggctaccgcatagtgttaacgaattcgtgccaacagaggagaggcacgatgtcgttaacaaacctggcggcagcgcaaaagatg

SEQ ID NO: 32066 - DNA, 103 bp, Artificial Sequence
  Synthetic Polynucleotide
taatacgactcactatagggagcggggagaaccatctctattacgtatggaacagaggagaccatacatgatagagatgaacctggcggcagcgcaaaagatg

SEQ ID NO: 32067 - DNA, 103 bp, Artificial Sequence
  Synthetic Polynucleotide
taatacgactcactatagggaccttattctgggccaccgcagctggatctaacagaggagaagatccatgtgcggtggcaacctggcggcagcgcaaaagatg

SEQ ID NO: 32068 - DNA, 103 bp, Artificial Sequence
  Synthetic Polynucleotide
taatacgactcactatagggtccttaggcgatgaggttctcacgcataataacagaggagaattatgatggagaacctcaacctggcggcagcgcaaaagatg

SEQ ID NO: 32069 - DNA, 103 bp, Artificial Sequence
  Synthetic Polynucleotide
taatacgactcactataggggcttatgatttttatgagcagcactgtctaaacagaggagatagacaatgctgctcataaacctggcggcagcgcaaaagatg

SEQ ID NO: 32070 - DNA, 103 bp, Artificial Sequence
  Synthetic Polynucleotide
taatacgactcactataggggtgcttagtggccggcaccacaccgcatccaacagaggagaggatgcatggtggtgccgaacctggcggcagcgcaaaagatg

SEQ ID NO: 32071 - DNA, 103 bp, Artificial Sequence
  Synthetic Polynucleotide
taatacgactcactatagggggtgctttaatccaggctataggcctcgcgaacagaggagacgcgagatgtatagcctgaacctggcggcagcgcaaaagatg

SEQ ID NO: 32072 - DNA, 103 bp, Artificial Sequence
  Synthetic Polynucleotide
taatacgactcactatagggctagtcaccatttaatgatcaaaaagtcgtaacagaggagaacgactatgtgatcattaaacctggcggcagcgcaaaagatg

SEQ ID NO: 32073 - DNA, 103 bp, Artificial Sequence
  Synthetic Polynucleotide
taatacgactcactatagggcaagtccgttgcgtaccccctagtcgtcgaaacagaggagatcgacgatgagggggtacaacctggcggcagcgcaaaagatg

SEQ ID NO: 32074 - DNA, 103 bp, Artificial Sequence
  Synthetic Polynucleotide
taatacgactcactatagggtgtcgatcttaaatttcgacaatgagcgccaacagaggagaggcgctatgtgtcgaaataacctggcggcagcgcaaaagatg

SEQ ID NO: 32075 - DNA, 103 bp, Artificial Sequence
  Synthetic Polynucleotide
taatacgactcactatagggttaacccactctattgaacgcagcaatgttaacagaggagaaacattatggcgttcaataacctggcggcagcgcaaaagatg

SEQ ID NO: 32076 - DNA, 103 bp, Artificial Sequence
  Synthetic Polynucleotide
taatacgactcactatagggatcgggcacgagaagggtccggctgattgaaacagaggagatcaatcatgcggacccttaacctggcggcagcgcaaaagatg

SEQ ID NO: 32077 - DNA, 103 bp, Artificial Sequence
  Synthetic Polynucleotide
taatacgactcactatagggtcctctgaaccagttcttcgccacagtctaaacagaggagatagactatggcgaagaacaacctggcggcagcgcaaaagatg

SEQ ID NO: 32078 - DNA, 103 bp, Artificial Sequence
  Synthetic Polynucleotide
taatacgactcactatagggaggataagagcacgagcagacccgtgaatgaacagaggagacattcaatggtctgctcgaacctggcggcagcgcaaaagatg

SEQ ID NO: 32079 - DNA, 103 bp, Artificial Sequence
  Synthetic Polynucleotide
taatacgactcactatagggtcattggactaccattttctttgcctaaataacagaggagaatttagatgaagaaaatgaacctggcggcagcgcaaaagatg

SEQ ID NO: 32080 - DNA, 103 bp, Artificial Sequence
  Synthetic Polynucleotide
taatacgactcactatagggtactgaagcatgcagtccgcaagtccctgtaacagaggagaacagggatgtgcggactgaacctggcggcagcgcaaaagatg

SEQ ID NO: 32081 - DNA, 103 bp, Artificial Sequence
  Synthetic Polynucleotide
taatacgactcactatagggcgctgtgagacacccgtttagaacccgcctaacagaggagaaggcggatgctaaacgggaacctggcggcagcgcaaaagatg

SEQ ID NO: 32082 - DNA, 103 bp, Artificial Sequence
  Synthetic Polynucleotide
taatacgactcactatagggctgtgtcctacctaagctcatccccaccgtaacagaggagaacggtgatgatgagcttaaacctggcggcagcgcaaaagatg

SEQ ID NO: 32083 - DNA, 103 bp, Artificial Sequence
  Synthetic Polynucleotide
taatacgactcactatagggtcccgtctaaagggctgttggatcctatcaaacagaggagatgatagatgccaacagccaacctggcggcagcgcaaaagatg

SEQ ID NO: 32084 - DNA, 103 bp, Artificial Sequence
  Synthetic Polynucleotide
taatacgactcactatagggaatcaaatccagcgcagacatcgtcggtctaacagaggagaagaccgatgatgtctgcgaacctggcggcagcgcaaaagatg

SEQ ID NO: 32085 - DNA, 103 bp, Artificial Sequence
  Synthetic Polynucleotide
taatacgactcactatagggagccagtcggtcggaaggcgtgctcatctgaacagaggagacagatgatgacgccttccaacctggcggcagcgcaaaagatg

SEQ ID NO: 32086 - DNA, 103 bp, Artificial Sequence
  Synthetic Polynucleotide
taatacgactcactataggggttttagtatggagatgaggtattgaaacaaacagaggagatgtttcatgacctcatctaacctggcggcagcgcaaaagatg

SEQ ID NO: 32087 - DNA, 103 bp, Artificial Sequence
  Synthetic Polynucleotide
taatacgactcactataggggtcgaaagccgaacgctacattcaaagtcaaacagaggagatgacttatgatgtagcgtaacctggcggcagcgcaaaagatg

SEQ ID NO: 32088 - DNA, 103 bp, Artificial Sequence
  Synthetic Polynucleotide
taatacgactcactatagggtgcgagtgccgacgtttagtgctacgatcgaacagaggagacgatcgatgcactaaacgaacctggcggcagcgcaaaagatg

SEQ ID NO: 32089 - DNA, 103 bp, Artificial Sequence
  Synthetic Polynucleotide
taatacgactcactataggggctgtattacttaggagtgaatcaaatcggaacagaggagaccgattatgttcactcctaacctggcggcagcgcaaaagatg

SEQ ID NO: 32090 - DNA, 103 bp, Artificial Sequence
  Synthetic Polynucleotide
taatacgactcactataggggcggcttaccacccctccttcgatgctagaaacagaggagatctagcatggaaggagggaacctggcggcagcgcaaaagatg

SEQ ID NO: 32091 - DNA, 103 bp, Artificial Sequence
  Synthetic Polynucleotide
taatacgactcactatagggtcgggactcccccgcgtgcagaggacatttaacagaggagaaaatgtatgctgcacgcgaacctggcggcagcgcaaaagatg

SEQ ID NO: 32092 - DNA, 103 bp, Artificial Sequence
  Synthetic Polynucleotide
taatacgactcactatagggacgtttaatttgatcggtcattaatcactgaacagaggagacagtgaatgatgaccgataacctggcggcagcgcaaaagatg

SEQ ID NO: 32093 - DNA, 103 bp, Artificial Sequence
  Synthetic Polynucleotide
taatacgactcactatagggttttggaatccatccgaattagttatctggaacagaggagaccagatatgtaattcggaaacctggcggcagcgcaaaagatg

SEQ ID NO: 32094 - DNA, 103 bp, Artificial Sequence
  Synthetic Polynucleotide
taatacgactcactatagggagtcaactggaggaatcacgctggcaacgaaacagaggagatcgttgatggcgtgattcaacctggcggcagcgcaaaagatg

SEQ ID NO: 32095 - DNA, 103 bp, Artificial Sequence
  Synthetic Polynucleotide
taatacgactcactataggggccatgttagccattggtcagttagcctgaaacagaggagatcaggcatgctgaccaataacctggcggcagcgcaaaagatg

SEQ ID NO: 32096 - DNA, 103 bp, Artificial Sequence
  Synthetic Polynucleotide
taatacgactcactatagggatagggcagcaactcgcccgaggggctctcaacagaggagagagagcatgtcgggcgagaacctggcggcagcgcaaaagatg

SEQ ID NO: 32097 - DNA, 103 bp, Artificial Sequence
  Synthetic Polynucleotide
taatacgactcactatagggacccttagtaggttacaaccccctatgttgaacagaggagacaacatatggggttgtaaaacctggcggcagcgcaaaagatg

SEQ ID NO: 32098 - DNA, 103 bp, Artificial Sequence
  Synthetic Polynucleotide
taatacgactcactatagggtgtacgccgttgatcttgagcacaatcttgaacagaggagacaagatatggctcaagataacctggcggcagcgcaaaagatg

SEQ ID NO: 32099 - DNA, 103 bp, Artificial Sequence
  Synthetic Polynucleotide
taatacgactcactatagggtgactgccgaaaaccctacgttttctacataacagaggagaatgtagatgacgtagggtaacctggcggcagcgcaaaagatg

SEQ ID NO: 32100 - DNA, 103 bp, Artificial Sequence
  Synthetic Polynucleotide
taatacgactcactatagggggaaaaatgccaacgtgatattcacatcggaacagaggagaccgatgatgatatcacgtaacctggcggcagcgcaaaagatg

SEQ ID NO: 32101 - DNA, 103 bp, Artificial Sequence
  Synthetic Polynucleotide
taatacgactcactatagggtcagcaattcgccagggacacgcgtggaaaaacagaggagatttccaatggtgtccctgaacctggcggcagcgcaaaagatg

SEQ ID NO: 32102 - DNA, 103 bp, Artificial Sequence
  Synthetic Polynucleotide
taatacgactcactatagggtgcttaagccgacgtgcctccaccatctccaacagaggagaggagatatgggaggcacgaacctggcggcagcgcaaaagatg

SEQ ID NO: 32103 - DNA, 103 bp, Artificial Sequence
  Synthetic Polynucleotide
taatacgactcactatagggaagatttaaaagcggttgtgcatcattggtaacagaggagaaccaatatggcacaaccgaacctggcggcagcgcaaaagatg

SEQ ID NO: 32104 - DNA, 103 bp, Artificial Sequence
  Synthetic Polynucleotide
taatacgactcactatagggctgcttaggattcataaacatgagccgattaacagaggagaaatcggatgatgtttatgaacctggcggcagcgcaaaagatg

SEQ ID NO: 32105 - DNA, 103 bp, Artificial Sequence
  Synthetic Polynucleotide
taatacgactcactataggggtcgaatccaggtgataagtagaaagagtaaacagaggagatactctatgtacttatcaaacctggcggcagcgcaaaagatg

SEQ ID NO: 32106 - DNA, 103 bp, Artificial Sequence
  Synthetic Polynucleotide
taatacgactcactataggggaacaagatgcgcatgttacaagattctgaaacagaggagatcagaaatgtgtaacatgaacctggcggcagcgcaaaagatg

SEQ ID NO: 32107 - DNA, 103 bp, Artificial Sequence
  Synthetic Polynucleotide
taatacgactcactataggggaagttaatgcatactacgataacgggggtaacagaggagaacccccatgatcgtagtaaacctggcggcagcgcaaaagatg

SEQ ID NO: 32108 - DNA, 103 bp, Artificial Sequence
  Synthetic Polynucleotide
taatacgactcactatagggtgggagctgaattgacaatccatggccggtaacagaggagaaccggcatgggattgtcaaacctggcggcagcgcaaaagatg

SEQ ID NO: 32109 - DNA, 103 bp, Artificial Sequence
  Synthetic Polynucleotide
taatacgactcactatagggtcggcctgcttaaagcgggctcgtttgcccaacagaggagagggcaaatgagcccgcttaacctggcggcagcgcaaaagatg

SEQ ID NO: 32110 - DNA, 103 bp, Artificial Sequence
  Synthetic Polynucleotide
taatacgactcactataggggcggataaggtggatcgtgctgggacggccaacagaggagaggccgtatgagcacgatcaacctggcggcagcgcaaaagatg

SEQ ID NO: 32111 - DNA, 103 bp, Artificial Sequence
  Synthetic Polynucleotide
taatacgactcactatagggaatttcgaggttgtacgagaatcacatttgaacagaggagacaaatgatgttctcgtacaacctggcggcagcgcaaaagatg

SEQ ID NO: 32112 - DNA, 103 bp, Artificial Sequence
  Synthetic Polynucleotide
taatacgactcactatagggcagtccccagagctcggaatcaacattacaaacagaggagatgtaatatggattccgagaacctggcggcagcgcaaaagatg

SEQ ID NO: 32113 - DNA, 103 bp, Artificial Sequence
  Synthetic Polynucleotide
taatacgactcactatagggattttaggacagtaaatcggtatgccgcgaaacagaggagatcgcggatgaccgatttaaacctggcggcagcgcaaaagatg

SEQ ID NO: 32114 - DNA, 103 bp, Artificial Sequence
  Synthetic Polynucleotide
taatacgactcactatagggaattgtatctagtaccgtacatatgggtcaaacagaggagatgacccatgtgtacggtaaacctggcggcagcgcaaaagatg

SEQ ID NO: 32115 - DNA, 103 bp, Artificial Sequence
  Synthetic Polynucleotide
taatacgactcactatagggcaaccggtatgcaatcccctgcttcgccccaacagaggagaggggcgatgcaggggattaacctggcggcagcgcaaaagatg

SEQ ID NO: 32116 - DNA, 103 bp, Artificial Sequence
  Synthetic Polynucleotide
taatacgactcactatagggtctgcggcagatacaatagggtgctttgagaacagaggagactcaaaatgccctattgtaacctggcggcagcgcaaaagatg

SEQ ID NO: 32117 - DNA, 103 bp, Artificial Sequence
  Synthetic Polynucleotide
taatacgactcactatagggcttaggacggacccagcggaaaacgcttgcaacagaggagagcaagcatgttccgctggaacctggcggcagcgcaaaagatg

SEQ ID NO: 32118 - DNA, 103 bp, Artificial Sequence
  Synthetic Polynucleotide
taatacgactcactatagggcctcgcgtccgcttaaacagtacagggcataacagaggagaatgcccatgactgtttaaaacctggcggcagcgcaaaagatg

SEQ ID NO: 32119 - DNA, 103 bp, Artificial Sequence
  Synthetic Polynucleotide
taatacgactcactatagggaacgagcgtgagattctcttttcaagacaaaacagaggagattgtctatgaaagagaataacctggcggcagcgcaaaagatg

SEQ ID NO: 32120 - DNA, 103 bp, Artificial Sequence
  Synthetic Polynucleotide
taatacgactcactatagggcggacgtatggcgaacggttctacggtggcaacagaggagagccaccatggaaccgttcaacctggcggcagcgcaaaagatg

SEQ ID NO: 32121 - DNA, 103 bp, Artificial Sequence
  Synthetic Polynucleotide
taatacgactcactatagggatcttaggtgaggaacgggcgactgtaatgaacagaggagacattacatgcgcccgttcaacctggcggcagcgcaaaagatg

SEQ ID NO: 32122 - DNA, 103 bp, Artificial Sequence
  Synthetic Polynucleotide
taatacgactcactatagggcagcgcaggcaagtgccggaccggtaaactaacagaggagaagtttaatggtccggcacaacctggcggcagcgcaaaagatg

SEQ ID NO: 32123 - DNA, 103 bp, Artificial Sequence
  Synthetic Polynucleotide
taatacgactcactatagggcacgagcacactgaaagcatacataaacgcaacagaggagagcgtttatgtatgctttcaacctggcggcagcgcaaaagatg

SEQ ID NO: 32124 - DNA, 103 bp, Artificial Sequence
  Synthetic Polynucleotide
taatacgactcactataggggaacccatagactggacccagcgtaatcccaacagaggagagggattatgctgggtccaaacctggcggcagcgcaaaagatg

SEQ ID NO: 32125 - DNA, 103 bp, Artificial Sequence
  Synthetic Polynucleotide
taatacgactcactatagggacttcaggtttctgggcaaaaaccagctggaacagaggagaccagctatgttttgcccaaacctggcggcagcgcaaaagatg

SEQ ID NO: 32126 - DNA, 103 bp, Artificial Sequence
  Synthetic Polynucleotide
taatacgactcactatagggacacagctctaccggatagtaaagcatcttaacagaggagaaagatgatgtactatccgaacctggcggcagcgcaaaagatg

SEQ ID NO: 32127 - DNA, 103 bp, Artificial Sequence
  Synthetic Polynucleotide
taatacgactcactatagggagtagacgctgaatcaacctatcttgttacaacagaggagagtaacaatgtaggttgataacctggcggcagcgcaaaagatg

SEQ ID NO: 32128 - DNA, 103 bp, Artificial Sequence
  Synthetic Polynucleotide
taatacgactcactatagggcgtaatttgccacggagtcttgtatttgggaacagaggagacccaaaatgaagactccgaacctggcggcagcgcaaaagatg

SEQ ID NO: 32129 - DNA, 103 bp, Artificial Sequence
  Synthetic Polynucleotide
taatacgactcactatagggagttcagaggtttacggcgtgcaagggcccaacagaggagagggcccatgcacgccgtaaacctggcggcagcgcaaaagatg

SEQ ID NO: 32130 - DNA, 103 bp, Artificial Sequence
  Synthetic Polynucleotide
taatacgactcactatagggcttggcgcatcagacacctctgatcaatgcaacagaggagagcattgatgagaggtgtcaacctggcggcagcgcaaaagatg

SEQ ID NO: 32131 - DNA, 103 bp, Artificial Sequence
  Synthetic Polynucleotide
taatacgactcactatagggtaccaagtttgatactgatatgtacaggtaaacagaggagatacctgatgatatcagtaaacctggcggcagcgcaaaagatg

SEQ ID NO: 32132 - DNA, 103 bp, Artificial Sequence
  Synthetic Polynucleotide
taatacgactcactatagggaaagtgatcgaacccgaatctctaatccgaaacagaggagatcggatatgagattcgggaacctggcggcagcgcaaaagatg

SEQ ID NO: 32133 - DNA, 103 bp, Artificial Sequence
  Synthetic Polynucleotide
taatacgactcactatagggccgtgatgtccacccagtacgatctgagaaaacagaggagattctcaatgcgtactgggaacctggcggcagcgcaaaagatg

SEQ ID NO: 32134 - DNA, 103 bp, Artificial Sequence
  Synthetic Polynucleotide
taatacgactcactatagggtaggtgaattcctagagaacagggtacgctaacagaggagaagcgtaatgtgttctctaaacctggcggcagcgcaaaagatg

SEQ ID NO: 32135 - DNA, 103 bp, Artificial Sequence
  Synthetic Polynucleotide
taatacgactcactatagggctttgttatatctccgggtcaaccattgataacagaggagaatcaatatgtgacccggaaacctggcggcagcgcaaaagatg

SEQ ID NO: 32136 - DNA, 103 bp, Artificial Sequence
  Synthetic Polynucleotide
taatacgactcactatagggttaggggtgggtgggggtacacacctgtacaacagaggagagtacagatgtgtacccccaacctggcggcagcgcaaaagatg

SEQ ID NO: 32137 - DNA, 103 bp, Artificial Sequence
  Synthetic Polynucleotide
taatacgactcactatagggccgagtttgatgtctgcggaccctagacgcaacagaggagagcgtctatggtccgcagaaacctggcggcagcgcaaaagatg

SEQ ID NO: 32138 - DNA, 103 bp, Artificial Sequence
  Synthetic Polynucleotide
taatacgactcactatagggctgccaacatgttgaccagccgcggaatttaacagaggagaaaattcatgggctggtcaaacctggcggcagcgcaaaagatg

SEQ ID NO: 32139 - DNA, 103 bp, Artificial Sequence
  Synthetic Polynucleotide
taatacgactcactatagggatctataagatggtcttcaccctgagagtgaacagaggagacactctatgggtgaagacaacctggcggcagcgcaaaagatg

SEQ ID NO: 32140 - DNA, 103 bp, Artificial Sequence
  Synthetic Polynucleotide
taatacgactcactatagggacccgagtctatcagggagcaccatagataaacagaggagatatctaatgtgctccctgaacctggcggcagcgcaaaagatg

SEQ ID NO: 32141 - DNA, 103 bp, Artificial Sequence
  Synthetic Polynucleotide
taatacgactcactatagggaacttcacgtcatccgatatgaatttaagtaacagaggagaacttaaatgcatatcggaaacctggcggcagcgcaaaagatg

SEQ ID NO: 32142 - DNA, 103 bp, Artificial Sequence
  Synthetic Polynucleotide
taatacgactcactatagggaactttggtgggcctaacatcatatttcaaaacagaggagattgaaaatggatgttaggaacctggcggcagcgcaaaagatg

SEQ ID NO: 32143 - DNA, 103 bp, Artificial Sequence
  Synthetic Polynucleotide
taatacgactcactatagggtctgcctataaaacgcaccacataggcctcaacagaggagagaggccatggtggtgcgtaacctggcggcagcgcaaaagatg

SEQ ID NO: 32144 - DNA, 103 bp, Artificial Sequence
  Synthetic Polynucleotide
taatacgactcactatagggctgagagcctagcgtctcgaaaatcggaagaacagaggagacttccgatgttcgagacgaacctggcggcagcgcaaaagatg

SEQ ID NO: 32145 - DNA, 103 bp, Artificial Sequence
  Synthetic Polynucleotide
taatacgactcactatagggtctcttacgtcctccaattgcggtgagcttaacagaggagaaagctcatggcaattggaaacctggcggcagcgcaaaagatg

SEQ ID NO: 32146 - DNA, 103 bp, Artificial Sequence
  Synthetic Polynucleotide
taatacgactcactatagggctgtaccaataattccaccacggggacaaaaacagaggagatttgtcatggtggtggaaaacctggcggcagcgcaaaagatg

SEQ ID NO: 32147 - DNA, 103 bp, Artificial Sequence
  Synthetic Polynucleotide
taatacgactcactatagggcattgatttagctcatccgcataaatacgtaacagaggagaacgtatatgtgcggatgaaacctggcggcagcgcaaaagatg

SEQ ID NO: 32148 - DNA, 103 bp, Artificial Sequence
  Synthetic Polynucleotide
taatacgactcactatagggctgaggagacttgaggcctggaggcgagcaaacagaggagatgctcgatgccaggcctcaacctggcggcagcgcaaaagatg

SEQ ID NO: 32149 - DNA, 103 bp, Artificial Sequence
  Synthetic Polynucleotide
taatacgactcactatagggacatttgagtggtcgtccgtaggatacctgaacagaggagacaggtaatgtacggacgaaacctggcggcagcgcaaaagatg

SEQ ID NO: 32150 - DNA, 103 bp, Artificial Sequence
  Synthetic Polynucleotide
taatacgactcactatagggttattgagggttacaactttatcgtggttgaacagaggagacaaccaatgtaaagttgtaacctggcggcagcgcaaaagatg

SEQ ID NO: 32151 - DNA, 103 bp, Artificial Sequence
  Synthetic Polynucleotide
taatacgactcactatagggtgggcagtttgagatgtacgatatagcagtaacagaggagaactgctatgtcgtacatcaacctggcggcagcgcaaaagatg

SEQ ID NO: 32152 - DNA, 103 bp, Artificial Sequence
  Synthetic Polynucleotide
taatacgactcactatagggcgtctacatgcacccacaattattttgaggaacagaggagacctcaaatgaattgtgggaacctggcggcagcgcaaaagatg

SEQ ID NO: 32153 - DNA, 103 bp, Artificial Sequence
  Synthetic Polynucleotide
taatacgactcactataggggagttagaacccctttgtagaccgtttagaaacagaggagatctaaaatgtctacaaagaacctggcggcagcgcaaaagatg

SEQ ID NO: 32154 - DNA, 103 bp, Artificial Sequence
  Synthetic Polynucleotide
taatacgactcactatagggggatagatttcatgtgctttgtcaacccctaacagaggagaaggggtatgcaaagcacaaacctggcggcagcgcaaaagatg

SEQ ID NO: 32155 - DNA, 103 bp, Artificial Sequence
  Synthetic Polynucleotide
taatacgactcactatagggcgaacgacactcttgtccccggccccctgtaacagaggagaacagggatgcggggacaaaacctggcggcagcgcaaaagatg

SEQ ID NO: 32156 - DNA, 103 bp, Artificial Sequence
  Synthetic Polynucleotide
taatacgactcactatagggtcctctgaaccgggttggatgctggtgaataacagaggagaattcacatgcatccaaccaacctggcggcagcgcaaaagatg

SEQ ID NO: 32157 - DNA, 103 bp, Artificial Sequence
  Synthetic Polynucleotide
taatacgactcactatagggacggcccggtgctctccctttgctgaccgtaacagaggagaacggtcatgaaagggagaaacctggcggcagcgcaaaagatg

SEQ ID NO: 32158 - DNA, 103 bp, Artificial Sequence
  Synthetic Polynucleotide
taatacgactcactatagggatatgttcctgtacagttaactgctatggaaacagaggagatccataatggttaactgtaacctggcggcagcgcaaaagatg

SEQ ID NO: 32159 - DNA, 103 bp, Artificial Sequence
  Synthetic Polynucleotide
taatacgactcactatagggtaatgattctccatctataaccgtgatgggaacagaggagacccatcatggttatagataacctggcggcagcgcaaaagatg

SEQ ID NO: 32160 - DNA, 103 bp, Artificial Sequence
  Synthetic Polynucleotide
taatacgactcactatagggccgcccgcacacgagctaaggaaccgggggaacagaggagacccccgatgccttagctcaacctggcggcagcgcaaaagatg

SEQ ID NO: 32161 - DNA, 103 bp, Artificial Sequence
  Synthetic Polynucleotide
taatacgactcactatagggggggaaatgcgatgcgctaagccttccagaaacagaggagatctggaatgcttagcgcaaacctggcggcagcgcaaaagatg

SEQ ID NO: 32162 - DNA, 103 bp, Artificial Sequence
  Synthetic Polynucleotide
taatacgactcactatagggcacgtaggaataatttgcgcttcgagcggaaacagaggagatccgctatgagcgcaaataacctggcggcagcgcaaaagatg

SEQ ID NO: 32163 - DNA, 103 bp, Artificial Sequence
  Synthetic Polynucleotide
taatacgactcactatagggcttgtcatcttgttagctcgcatgcgttgtaacagaggagaacaacgatggcgagctaaaacctggcggcagcgcaaaagatg

SEQ ID NO: 32164 - DNA, 103 bp, Artificial Sequence
  Synthetic Polynucleotide
taatacgactcactatagggatgctttgacttaagcactagaggcggcggaacagaggagaccgccgatgctagtgcttaacctggcggcagcgcaaaagatg

SEQ ID NO: 32165 - DNA, 103 bp, Artificial Sequence
  Synthetic Polynucleotide
taatacgactcactatagggtaatagacgccggcgatgtatttgagttcgaacagaggagacgaactatgatacatcgcaacctggcggcagcgcaaaagatg

SEQ ID NO: 32166 - DNA, 103 bp, Artificial Sequence
  Synthetic Polynucleotide
taatacgactcactatagggtatcataagtagtttcttatgtgttcaggcaacagaggagagcctgaatgcataagaaaaacctggcggcagcgcaaaagatg

SEQ ID NO: 32167 - DNA, 103 bp, Artificial Sequence
  Synthetic Polynucleotide
taatacgactcactatagggttctatccttcaatgtaggttcttccaacaaacagaggagatgttggatgaacctacataacctggcggcagcgcaaaagatg

SEQ ID NO: 32168 - DNA, 103 bp, Artificial Sequence
  Synthetic Polynucleotide
taatacgactcactataggggggtttgacctatgccgtttgccgctactaaacagaggagatagtagatgcaaacggcaaacctggcggcagcgcaaaagatg

SEQ ID NO: 32169 - DNA, 103 bp, Artificial Sequence
  Synthetic Polynucleotide
taatacgactcactataggggtacacctcacgtgtcatagtacggctgtaaacagaggagatacagcatgactatgacaaacctggcggcagcgcaaaagatg

SEQ ID NO: 32170 - DNA, 103 bp, Artificial Sequence
  Synthetic Polynucleotide
taatacgactcactatagggtaaaatgaagaccacctgtctaaaaccttaaacagaggagataaggtatgagacaggtgaacctggcggcagcgcaaaagatg

SEQ ID NO: 32171 - DNA, 103 bp, Artificial Sequence
  Synthetic Polynucleotide
taatacgactcactatagggggcatgcgtgttttggagcgccacggcaggaacagaggagacctgccatggcgctccaaaacctggcggcagcgcaaaagatg

SEQ ID NO: 32172 - DNA, 103 bp, Artificial Sequence
  Synthetic Polynucleotide
taatacgactcactatagggctgacaactctcttgtttattgcagtgttgaacagaggagacaacacatgaataaacaaaacctggcggcagcgcaaaagatg

SEQ ID NO: 32173 - DNA, 103 bp, Artificial Sequence
  Synthetic Polynucleotide
taatacgactcactatagggtgtttgtcgctgcatcctgatatacgataaaacagaggagattatcgatgatcaggatgaacctggcggcagcgcaaaagatg

SEQ ID NO: 32174 - DNA, 103 bp, Artificial Sequence
  Synthetic Polynucleotide
taatacgactcactatagggcgtagtgtgctagtaatcctgcgggcgatcaacagaggagagatcgcatgcaggattacaacctggcggcagcgcaaaagatg

SEQ ID NO: 32175 - DNA, 103 bp, Artificial Sequence
  Synthetic Polynucleotide
taatacgactcactatagggtcagctatgctaatattcgctatttttgacaacagaggagagtcaaaatgagcgaatataacctggcggcagcgcaaaagatg

SEQ ID NO: 32176 - DNA, 103 bp, Artificial Sequence
  Synthetic Polynucleotide
taatacgactcactatagggtgacgttttagtatacctttccttatacgaaacagaggagatcgtatatggaaaggtataacctggcggcagcgcaaaagatg

SEQ ID NO: 32177 - DNA, 103 bp, Artificial Sequence
  Synthetic Polynucleotide
taatacgactcactataggggtcatgggaacgatcttgttttaaaggaataacagaggagaattcctatgaaacaagataacctggcggcagcgcaaaagatg

SEQ ID NO: 32178 - DNA, 103 bp, Artificial Sequence
  Synthetic Polynucleotide
taatacgactcactatagggctaccaaccaccttgatgtgggcttataaaaacagaggagatttataatgccacatcaaaacctggcggcagcgcaaaagatg

SEQ ID NO: 32179 - DNA, 103 bp, Artificial Sequence
  Synthetic Polynucleotide
taatacgactcactatagggtcatgcgagtatgcggcccagtccactagcaacagaggagagctagtatgctgggccgcaacctggcggcagcgcaaaagatg

SEQ ID NO: 32180 - DNA, 103 bp, Artificial Sequence
  Synthetic Polynucleotide
taatacgactcactatagggagttcagtttcctatggaattttgctatctaacagaggagaagatagatgaattccataaacctggcggcagcgcaaaagatg

SEQ ID NO: 32181 - DNA, 103 bp, Artificial Sequence
  Synthetic Polynucleotide
taatacgactcactataggggattgcgttattacactgggtagcctgcttaacagaggagaaagcagatgacccagtgtaacctggcggcagcgcaaaagatg

SEQ ID NO: 32182 - DNA, 103 bp, Artificial Sequence
  Synthetic Polynucleotide
taatacgactcactatagggcgcttgagggcggcgtatcaacgtcaccagaacagaggagactggtgatgttgatacgcaacctggcggcagcgcaaaagatg

SEQ ID NO: 32183 - DNA, 103 bp, Artificial Sequence
  Synthetic Polynucleotide
taatacgactcactatagggcgtggggtggacgcgactgcgaagtgtattaacagaggagaaatacaatgcgcagtcgcaacctggcggcagcgcaaaagatg

SEQ ID NO: 32184 - DNA, 103 bp, Artificial Sequence
  Synthetic Polynucleotide
taatacgactcactatagggaaagtggtctacgctcactctgcccagaataacagaggagaattctgatgagagtgagcaacctggcggcagcgcaaaagatg

SEQ ID NO: 32185 - DNA, 103 bp, Artificial Sequence
  Synthetic Polynucleotide
taatacgactcactataggggccagatggtccatgaagccttttctgcgaaacagaggagatcgcagatgaggcttcataacctggcggcagcgcaaaagatg

SEQ ID NO: 32186 - DNA, 103 bp, Artificial Sequence
  Synthetic Polynucleotide
taatacgactcactatagggcccataatgtggtgccctattgaatgtttgaacagaggagacaaacaatgaatagggcaaacctggcggcagcgcaaaagatg

SEQ ID NO: 32187 - DNA, 103 bp, Artificial Sequence
  Synthetic Polynucleotide
taatacgactcactatagggcatggctctaggtaagaccgttttcggagaaacagaggagatctccgatgacggtcttaaacctggcggcagcgcaaaagatg

SEQ ID NO: 32188 - DNA, 103 bp, Artificial Sequence
  Synthetic Polynucleotide
taatacgactcactatagggagaggcagacacagtatgacgggccaaagaaacagaggagatctttgatgcgtcatactaacctggcggcagcgcaaaagatg

SEQ ID NO: 32189 - DNA, 103 bp, Artificial Sequence
  Synthetic Polynucleotide
taatacgactcactatagggttcactccctaactatctgtagcggggtggaacagaggagaccacccatgtacagatagaacctggcggcagcgcaaaagatg

SEQ ID NO: 32190 - DNA, 103 bp, Artificial Sequence
  Synthetic Polynucleotide
taatacgactcactatagggctggtgggtcccgcgaacttgtcgtgtattaacagaggagaaatacaatgcaagttcgcaacctggcggcagcgcaaaagatg

SEQ ID NO: 32191 - DNA, 103 bp, Artificial Sequence
  Synthetic Polynucleotide
taatacgactcactatagggaaacgtgacttaagatttcaggggggcccgaacagaggagacgggccatgctgaaatctaacctggcggcagcgcaaaagatg

SEQ ID NO: 32192 - DNA, 103 bp, Artificial Sequence
  Synthetic Polynucleotide
taatacgactcactataggggtacgatgccccgacagctgtactgcgccgaacagaggagacggcgcatgacagctgtcaacctggcggcagcgcaaaagatg

SEQ ID NO: 32193 - DNA, 103 bp, Artificial Sequence
  Synthetic Polynucleotide
taatacgactcactataggggtacattatcacctgcgtctggttggcgagaacagaggagactcgccatgcagacgcagaacctggcggcagcgcaaaagatg

SEQ ID NO: 32194 - DNA, 103 bp, Artificial Sequence
  Synthetic Polynucleotide
taatacgactcactatagggtttgcaaagtggtatcggggtcactagtgtaacagaggagaacactaatgaccccgataaacctggcggcagcgcaaaagatg

SEQ ID NO: 32195 - DNA, 103 bp, Artificial Sequence
  Synthetic Polynucleotide
taatacgactcactatagggtaaggtactgtataacatctatatagaaataacagaggagaatttctatgtagatgttaaacctggcggcagcgcaaaagatg

SEQ ID NO: 32196 - DNA, 103 bp, Artificial Sequence
  Synthetic Polynucleotide
taatacgactcactataggggtaagctggataggcccgttatcctattgtaacagaggagaacaataatgtaacgggccaacctggcggcagcgcaaaagatg

SEQ ID NO: 32197 - DNA, 103 bp, Artificial Sequence
  Synthetic Polynucleotide
taatacgactcactatagggagtgcatgtggcttggacagcgaacttgcgaacagaggagacgcaagatggctgtccaaaacctggcggcagcgcaaaagatg

SEQ ID NO: 32198 - DNA, 103 bp, Artificial Sequence
  Synthetic Polynucleotide
taatacgactcactatagggttacaaggggcggaagtcattctcgttctaaacagaggagatagaacatgaatgacttcaacctggcggcagcgcaaaagatg

SEQ ID NO: 32199 - DNA, 103 bp, Artificial Sequence
  Synthetic Polynucleotide
taatacgactcactatagggtcctttcattagacttcttagccgacagttaacagaggagaaactgtatgctaagaagtaacctggcggcagcgcaaaagatg

SEQ ID NO: 32200 - DNA, 103 bp, Artificial Sequence
  Synthetic Polynucleotide
taatacgactcactataggggttgaggaggcttaacctatcctctggcccaacagaggagagggccaatggataggttaaacctggcggcagcgcaaaagatg

SEQ ID NO: 32201 - DNA, 103 bp, Artificial Sequence
  Synthetic Polynucleotide
taatacgactcactataggggtaatatcagcgatgtcagagatgggtggaaacagaggagatccaccatgctctgacataacctggcggcagcgcaaaagatg

SEQ ID NO: 32202 - DNA, 103 bp, Artificial Sequence
  Synthetic Polynucleotide
taatacgactcactatagggaacgtatgagcactaacagctgttcggggaaacagaggagatccccgatgagctgttagaacctggcggcagcgcaaaagatg

SEQ ID NO: 32203 - DNA, 103 bp, Artificial Sequence
  Synthetic Polynucleotide
taatacgactcactatagggcgagtatcaaacgttctcattcagtgtgccaacagaggagaggcacaatgaatgagaacaacctggcggcagcgcaaaagatg

SEQ ID NO: 32204 - DNA, 103 bp, Artificial Sequence
  Synthetic Polynucleotide
taatacgactcactatagggtacgtatctctctgcgattgggcaggtatgaacagaggagacataccatgccaatcgcaaacctggcggcagcgcaaaagatg

SEQ ID NO: 32205 - DNA, 103 bp, Artificial Sequence
  Synthetic Polynucleotide
taatacgactcactatagggccttgaccggttagtccgcctctggctacgaacagaggagacgtagcatgaggcggactaacctggcggcagcgcaaaagatg

SEQ ID NO: 32206 - DNA, 103 bp, Artificial Sequence
  Synthetic Polynucleotide
taatacgactcactatagggttgttttcgagagtttaacttagctgtccaaacagaggagatggacaatgaagttaaacaacctggcggcagcgcaaaagatg

SEQ ID NO: 32207 - DNA, 103 bp, Artificial Sequence
  Synthetic Polynucleotide
taatacgactcactataggggccgctcagggagcatcgatatagcgccgtaacagaggagaacggcgatgtatcgatgcaacctggcggcagcgcaaaagatg

SEQ ID NO: 32208 - DNA, 103 bp, Artificial Sequence
  Synthetic Polynucleotide
taatacgactcactatagggggttgagtctcatacagttaccatttgtggaacagaggagaccacaaatggtaactgtaaacctggcggcagcgcaaaagatg

SEQ ID NO: 32209 - DNA, 103 bp, Artificial Sequence
  Synthetic Polynucleotide
taatacgactcactatagggaggtatagcggtgggcttggtaaaatgctaaacagaggagatagcatatgaccaagcccaacctggcggcagcgcaaaagatg

SEQ ID NO: 32210 - DNA, 103 bp, Artificial Sequence
  Synthetic Polynucleotide
taatacgactcactatagggccagaagatgtgacttaggagtcaagtactaacagaggagaagtactatgctcctaagtaacctggcggcagcgcaaaagatg

SEQ ID NO: 32211 - DNA, 103 bp, Artificial Sequence
  Synthetic Polynucleotide
taatacgactcactatagggtacgcttctgggtcacaatcgttgacgctaaacagaggagatagcgtatgcgattgtgaaacctggcggcagcgcaaaagatg

SEQ ID NO: 32212 - DNA, 103 bp, Artificial Sequence
  Synthetic Polynucleotide
taatacgactcactatagggatctagattggctgaaatacaagaatcaagaacagaggagacttgatatgtgtatttcaaacctggcggcagcgcaaaagatg

SEQ ID NO: 32213 - DNA, 103 bp, Artificial Sequence
  Synthetic Polynucleotide
taatacgactcactataggggcgctgccgcctgtttgatctacaggaacgaacagaggagacgttccatgagatcaaacaacctggcggcagcgcaaaagatg

SEQ ID NO: 32214 - DNA, 103 bp, Artificial Sequence
  Synthetic Polynucleotide
taatacgactcactatagggttcacatcaatctttacctgcaacaacggaaacagaggagatccgttatggcaggtaaaaacctggcggcagcgcaaaagatg

SEQ ID NO: 32215 - DNA, 103 bp, Artificial Sequence
  Synthetic Polynucleotide
taatacgactcactataggggctgtaactcctacgagaatcagtgagagtaacagaggagaactctcatggattctcgtaacctggcggcagcgcaaaagatg

SEQ ID NO: 32216 - DNA, 103 bp, Artificial Sequence
  Synthetic Polynucleotide
taatacgactcactatagggtcgatttaacatggacgcccccttcggactaacagaggagaagtccgatgggggcgtccaacctggcggcagcgcaaaagatg

SEQ ID NO: 32217 - DNA, 103 bp, Artificial Sequence
  Synthetic Polynucleotide
taatacgactcactatagggaggtcgacaagaccggcagaagtggcaagcaacagaggagagcttgcatgttctgccggaacctggcggcagcgcaaaagatg

SEQ ID NO: 32218 - DNA, 103 bp, Artificial Sequence
  Synthetic Polynucleotide
taatacgactcactatagggcgtacgcgcccgggcccaattggcgactttaacagaggagaaaagtcatgaattgggccaacctggcggcagcgcaaaagatg

SEQ ID NO: 32219 - DNA, 103 bp, Artificial Sequence
  Synthetic Polynucleotide
taatacgactcactatagggatgtcgaaccaaaggtattggatataaggaaacagaggagatccttaatgccaatacctaacctggcggcagcgcaaaagatg

SEQ ID NO: 32220 - DNA, 103 bp, Artificial Sequence
  Synthetic Polynucleotide
taatacgactcactataggggaagaattacagtcacgttgtttgagggggaacagaggagaccccctatgacaacgtgaaacctggcggcagcgcaaaagatg

SEQ ID NO: 32221 - DNA, 103 bp, Artificial Sequence
  Synthetic Polynucleotide
taatacgactcactataggggctctgcacttctactacaacagcgttcccaacagaggagagggaacatggttgtagtaaacctggcggcagcgcaaaagatg

SEQ ID NO: 32222 - DNA, 103 bp, Artificial Sequence
  Synthetic Polynucleotide
taatacgactcactatagggacgcggtccggtaaaacgttactgttggcgaacagaggagacgccaaatgtaacgttttaacctggcggcagcgcaaaagatg

SEQ ID NO: 32223 - DNA, 103 bp, Artificial Sequence
  Synthetic Polynucleotide
taatacgactcactatagggttgactttttcgtcgtcggaaaagtctgggaacagaggagacccagaatgttccgacgaaacctggcggcagcgcaaaagatg

SEQ ID NO: 32224 - DNA, 103 bp, Artificial Sequence
  Synthetic Polynucleotide
taatacgactcactatagggaatggaatgaacagcgggggtgcagggttaaacagaggagataacccatgacccccgctaacctggcggcagcgcaaaagatg

SEQ ID NO: 32225 - DNA, 103 bp, Artificial Sequence
  Synthetic Polynucleotide
taatacgactcactatagggcgacacatggcgccaggtaatgagcaggagaacagaggagactcctgatgattacctggaacctggcggcagcgcaaaagatg

SEQ ID NO: 32226 - DNA, 103 bp, Artificial Sequence
  Synthetic Polynucleotide
taatacgactcactatagggtcagaaagttacttaccgacgggcggtgagaacagaggagactcaccatgcgtcggtaaaacctggcggcagcgcaaaagatg

SEQ ID NO: 32227 - DNA, 103 bp, Artificial Sequence
  Synthetic Polynucleotide
taatacgactcactatagggcataccgaaaacgtccggttgccggatgtgaacagaggagacacatcatgcaaccggacaacctggcggcagcgcaaaagatg

SEQ ID NO: 32228 - DNA, 103 bp, Artificial Sequence
  Synthetic Polynucleotide
taatacgactcactatagggagaggtaagattctacgcagccgtacggtcaacagaggagagaccgtatggctgcgtagaacctggcggcagcgcaaaagatg

SEQ ID NO: 32229 - DNA, 103 bp, Artificial Sequence
  Synthetic Polynucleotide
taatacgactcactatagggaaagtaatcgcctgagtgtaatagttaggtaacagaggagaacctaaatgttacactcaaacctggcggcagcgcaaaagatg

SEQ ID NO: 32230 - DNA, 103 bp, Artificial Sequence
  Synthetic Polynucleotide
taatacgactcactatagggtattggtaagaggctccgacgtctgctagcaacagaggagagctagcatgcgtcggagcaacctggcggcagcgcaaaagatg

SEQ ID NO: 32231 - DNA, 103 bp, Artificial Sequence
  Synthetic Polynucleotide
taatacgactcactatagggtgtcccaattaattaccctctgtctacagtaacagaggagaactgtaatgagagggtaaaacctggcggcagcgcaaaagatg

SEQ ID NO: 32232 - DNA, 103 bp, Artificial Sequence
  Synthetic Polynucleotide
taatacgactcactatagggctacgacgctgtttagtgaagtttggaggcaacagaggagagcctccatgcttcactaaaacctggcggcagcgcaaaagatg

SEQ ID NO: 32233 - DNA, 103 bp, Artificial Sequence
  Synthetic Polynucleotide
taatacgactcactatagggagatgtataaacatcgtaatgggattcgcaaacagaggagatgcgaaatgcattacgataacctggcggcagcgcaaaagatg

SEQ ID NO: 32234 - DNA, 103 bp, Artificial Sequence
  Synthetic Polynucleotide
taatacgactcactatagggttcagctatatattgctttgagactgcgataacagaggagaatcgcaatgtcaaagcaaaacctggcggcagcgcaaaagatg

SEQ ID NO: 32235 - DNA, 103 bp, Artificial Sequence
  Synthetic Polynucleotide
taatacgactcactatagggccttgccctggaagcattagcaacttatcaaacagaggagatgataaatggctaatgctaacctggcggcagcgcaaaagatg

SEQ ID NO: 32236 - DNA, 103 bp, Artificial Sequence
  Synthetic Polynucleotide
taatacgactcactataggggacatctcctggcatgcatcacgggcggacaacagaggagagtccgcatgtgatgcatgaacctggcggcagcgcaaaagatg

SEQ ID NO: 32237 - DNA, 103 bp, Artificial Sequence
  Synthetic Polynucleotide
taatacgactcactatagggcatccctaacgaactacctcctcgaggaacaacagaggagagttcctatgggaggtagtaacctggcggcagcgcaaaagatg

SEQ ID NO: 32238 - DNA, 103 bp, Artificial Sequence
  Synthetic Polynucleotide
taatacgactcactatagggattaccccgtcgcggctaatccaactaagtaacagaggagaacttagatggattagccgaacctggcggcagcgcaaaagatg

SEQ ID NO: 32239 - DNA, 103 bp, Artificial Sequence
  Synthetic Polynucleotide
taatacgactcactatagggtagtgaagagtctgcggtatatgatagaaaaacagaggagatttctaatgtataccgcaaacctggcggcagcgcaaaagatg

SEQ ID NO: 32240 - DNA, 103 bp, Artificial Sequence
  Synthetic Polynucleotide
taatacgactcactatagggaagtgggtccgggggtgccatttgctccccaacagaggagaggggagatgatggcacccaacctggcggcagcgcaaaagatg

SEQ ID NO: 32241 - DNA, 103 bp, Artificial Sequence
  Synthetic Polynucleotide
taatacgactcactatagggacatgtaaagcggagctgttacccgaggtaaacagaggagatacctcatgtaacagctcaacctggcggcagcgcaaaagatg

SEQ ID NO: 32242 - DNA, 103 bp, Artificial Sequence
  Synthetic Polynucleotide
taatacgactcactataggggcatgatacttaagttcataaggtagtttcaacagaggagagaaactatgttatgaactaacctggcggcagcgcaaaagatg

SEQ ID NO: 32243 - DNA, 103 bp, Artificial Sequence
  Synthetic Polynucleotide
taatacgactcactatagggctctaattgctcccgggtacatagttcccaaacagaggagatgggaaatgtgtacccggaacctggcggcagcgcaaaagatg

SEQ ID NO: 32244 - DNA, 103 bp, Artificial Sequence
  Synthetic Polynucleotide
taatacgactcactatagggctcccacaaacccgccaagtaccgttgtggaacagaggagaccacaaatgtacttggcgaacctggcggcagcgcaaaagatg

SEQ ID NO: 32245 - DNA, 103 bp, Artificial Sequence
  Synthetic Polynucleotide
taatacgactcactatagggactccttagcccgcgcaaagcacagaattaaacagaggagataattcatggctttgcgcaacctggcggcagcgcaaaagatg

SEQ ID NO: 32246 - DNA, 103 bp, Artificial Sequence
  Synthetic Polynucleotide
taatacgactcactatagggacgccagtgagctcttttacctactatcttaacagaggagaaagataatgggtaaaagaaacctggcggcagcgcaaaagatg

SEQ ID NO: 32247 - DNA, 103 bp, Artificial Sequence
  Synthetic Polynucleotide
taatacgactcactatagggacggacataggaggctccgttgatggatgcaacagaggagagcatccatgaacggagccaacctggcggcagcgcaaaagatg

SEQ ID NO: 32248 - DNA, 103 bp, Artificial Sequence
  Synthetic Polynucleotide
taatacgactcactatagggaagcgaaacgtggtttagggcgttaagcaaaacagaggagattgcttatggccctaaacaacctggcggcagcgcaaaagatg

SEQ ID NO: 32249 - DNA, 103 bp, Artificial Sequence
  Synthetic Polynucleotide
taatacgactcactatagggcccgaacctggcaatcaggctaaggggtgtaacagaggagaacacccatgagcctgattaacctggcggcagcgcaaaagatg

SEQ ID NO: 32250 - DNA, 103 bp, Artificial Sequence
  Synthetic Polynucleotide
taatacgactcactatagggagcaatattattgtaaagtcattacaaaagaacagaggagacttttgatgtgactttacaacctggcggcagcgcaaaagatg

SEQ ID NO: 32251 - DNA, 103 bp, Artificial Sequence
  Synthetic Polynucleotide
taatacgactcactatagggaccggttactttaggtcaaacgcccgcacgaacagaggagacgtgcgatggtttgacctaacctggcggcagcgcaaaagatg

SEQ ID NO: 32252 - DNA, 103 bp, Artificial Sequence
  Synthetic Polynucleotide
taatacgactcactatagggccgatggcgaccattgttcataatgtattcaacagaggagagaatacatgatgaacaataacctggcggcagcgcaaaagatg

SEQ ID NO: 32253 - DNA, 103 bp, Artificial Sequence
  Synthetic Polynucleotide
taatacgactcactataggggccctcgtaagagtacagagcccccaactcaacagaggagagagttgatggctctgtacaacctggcggcagcgcaaaagatg

SEQ ID NO: 32254 - DNA, 103 bp, Artificial Sequence
  Synthetic Polynucleotide
taatacgactcactataggggaccccttcgtcaccttcactccaacgtgtaacagaggagaacacgtatgagtgaaggtaacctggcggcagcgcaaaagatg

SEQ ID NO: 32255 - DNA, 103 bp, Artificial Sequence
  Synthetic Polynucleotide
taatacgactcactatagggtacacggcatgagtcgtccgcagcgttcgtaacagaggagaacgaacatggcggacgacaacctggcggcagcgcaaaagatg

SEQ ID NO: 32256 - DNA, 103 bp, Artificial Sequence
  Synthetic Polynucleotide
taatacgactcactatagggcagagagttgttaacagtccgcagtagtttaacagaggagaaaactaatgcggactgttaacctggcggcagcgcaaaagatg

SEQ ID NO: 32257 - DNA, 103 bp, Artificial Sequence
  Synthetic Polynucleotide
taatacgactcactatagggagcagctcccattggtcccagtggcctttaaacagaggagataaaggatgctgggaccaaacctggcggcagcgcaaaagatg

SEQ ID NO: 32258 - DNA, 103 bp, Artificial Sequence
  Synthetic Polynucleotide
taatacgactcactatagggccgaccggttcctggaggagtcactgattcaacagaggagagaatcaatgactcctccaaacctggcggcagcgcaaaagatg

SEQ ID NO: 32259 - DNA, 103 bp, Artificial Sequence
  Synthetic Polynucleotide
taatacgactcactatagggatcctttaatctagtacaaaaattcagttcaacagaggagagaactgatgttttgtactaacctggcggcagcgcaaaagatg

SEQ ID NO: 32260 - DNA, 103 bp, Artificial Sequence
  Synthetic Polynucleotide
taatacgactcactataggggatcgtcgattatatacctgacttcacaaaaacagaggagatttgtgatgtcaggtataaacctggcggcagcgcaaaagatg

SEQ ID NO: 32261 - DNA, 103 bp, Artificial Sequence
  Synthetic Polynucleotide
taatacgactcactatagggaattcgacgtgcgtgttaaaacaccttggcaacagaggagagccaagatgttttaacacaacctggcggcagcgcaaaagatg

SEQ ID NO: 32262 - DNA, 103 bp, Artificial Sequence
  Synthetic Polynucleotide
taatacgactcactatagggactgaacggacatagacacccgcctcgcctaacagaggagaaggcgaatggggtgtctaaacctggcggcagcgcaaaagatg

SEQ ID NO: 32263 - DNA, 103 bp, Artificial Sequence
  Synthetic Polynucleotide
taatacgactcactatagggacaaggggacacgaatgtcatagtaccgagaacagaggagactcggtatgatgacattcaacctggcggcagcgcaaaagatg

SEQ ID NO: 32264 - DNA, 103 bp, Artificial Sequence
  Synthetic Polynucleotide
taatacgactcactatagggcagtttcgcttctttggaagcttagatagcaacagaggagagctatcatggcttccaaaaacctggcggcagcgcaaaagatg

SEQ ID NO: 32265 - DNA, 103 bp, Artificial Sequence
  Synthetic Polynucleotide
taatacgactcactataggggtctcaagagttgaccgactgcttagcctcaacagaggagagaggctatgcagtcggtcaacctggcggcagcgcaaaagatg

SEQ ID NO: 32266 - DNA, 103 bp, Artificial Sequence
  Synthetic Polynucleotide
taatacgactcactatagggacgtgatgtagatgtaggtgctatgtgtctaacagaggagaagacacatggcacctacaaacctggcggcagcgcaaaagatg

SEQ ID NO: 32267 - DNA, 103 bp, Artificial Sequence
  Synthetic Polynucleotide
taatacgactcactatagggcccctcaacttagcttacctacccgctctaaacagaggagatagagcatgtaggtaagcaacctggcggcagcgcaaaagatg

SEQ ID NO: 32268 - DNA, 103 bp, Artificial Sequence
  Synthetic Polynucleotide
taatacgactcactatagggatcgacgcctaccggcttctaagtcttagcaacagaggagagctaagatgtagaagccgaacctggcggcagcgcaaaagatg

SEQ ID NO: 32269 - DNA, 103 bp, Artificial Sequence
  Synthetic Polynucleotide
taatacgactcactataggggcttagcgaaaggattaagcatagaaatcgaacagaggagacgatttatgtgcttaatcaacctggcggcagcgcaaaagatg

SEQ ID NO: 32270 - DNA, 103 bp, Artificial Sequence
  Synthetic Polynucleotide
taatacgactcactatagggattgacctcgcaaaatatgtttgcccgtcgaacagaggagacgacggatgaacatatttaacctggcggcagcgcaaaagatg

SEQ ID NO: 32271 - DNA, 103 bp, Artificial Sequence
  Synthetic Polynucleotide
taatacgactcactatagggtattggaacctcctcgacctccagatcattaacagaggagaaatgatatggaggtcgagaacctggcggcagcgcaaaagatg

SEQ ID NO: 32272 - DNA, 103 bp, Artificial Sequence
  Synthetic Polynucleotide
taatacgactcactataggggatcagcgtctattcccttcgaagtaagggaacagaggagacccttaatgcgaagggaaaacctggcggcagcgcaaaagatg

SEQ ID NO: 32273 - DNA, 103 bp, Artificial Sequence
  Synthetic Polynucleotide
taatacgactcactatagggcatgtactctctactcctttctctactataaacagaggagatatagtatggaaaggagtaacctggcggcagcgcaaaagatg

SEQ ID NO: 32274 - DNA, 103 bp, Artificial Sequence
  Synthetic Polynucleotide
taatacgactcactatagggtcaatatttacgcaaactgcagacattccgaacagaggagacggaatatgtgcagtttgaacctggcggcagcgcaaaagatg

SEQ ID NO: 32275 - DNA, 103 bp, Artificial Sequence
  Synthetic Polynucleotide
taatacgactcactataggggtgtccatatggcgcacggtagcgtggaggaacagaggagacctccaatgtaccgtgcgaacctggcggcagcgcaaaagatg

SEQ ID NO: 32276 - DNA, 103 bp, Artificial Sequence
  Synthetic Polynucleotide
taatacgactcactataggggaagctcgctaatatacatatgcgccattaaacagaggagataatggatgatatgtataaacctggcggcagcgcaaaagatg

SEQ ID NO: 32277 - DNA, 103 bp, Artificial Sequence
  Synthetic Polynucleotide
taatacgactcactatagggcatttagaagtagtatggcccctatgcaggaacagaggagacctgcaatggggccatacaacctggcggcagcgcaaaagatg

SEQ ID NO: 32278 - DNA, 103 bp, Artificial Sequence
  Synthetic Polynucleotide
taatacgactcactataggggccatacacacagctcggtattgctaccctaacagaggagaagggtaatgataccgagcaacctggcggcagcgcaaaagatg

SEQ ID NO: 32279 - DNA, 103 bp, Artificial Sequence
  Synthetic Polynucleotide
taatacgactcactatagggcagctctcctcgccccggggggtagccagcaacagaggagagctggcatgcccccggggaacctggcggcagcgcaaaagatg

SEQ ID NO: 32280 - DNA, 103 bp, Artificial Sequence
  Synthetic Polynucleotide
taatacgactcactatagggactcaggataaccggacctgagtcacaaaaaacagaggagattttgtatgtcaggtccgaacctggcggcagcgcaaaagatg

SEQ ID NO: 32281 - DNA, 103 bp, Artificial Sequence
  Synthetic Polynucleotide
taatacgactcactatagggtaccgtgtcccggccacaggagctgctctgaacagaggagacagagcatgtcctgtggcaacctggcggcagcgcaaaagatg

SEQ ID NO: 32282 - DNA, 103 bp, Artificial Sequence
  Synthetic Polynucleotide
taatacgactcactatagggacgcacctacacgttaaaaagaattgccgtaacagaggagaacggcaatgctttttaacaacctggcggcagcgcaaaagatg

SEQ ID NO: 32283 - DNA, 103 bp, Artificial Sequence
  Synthetic Polynucleotide
taatacgactcactataggggacgggcaaagcggtccgcggcaaacgctaaacagaggagatagcgtatgccgcggaccaacctggcggcagcgcaaaagatg

SEQ ID NO: 32284 - DNA, 103 bp, Artificial Sequence
  Synthetic Polynucleotide
taatacgactcactatagggagatatattacatggccagggctcggctaaaacagaggagattagccatgccctggccaaacctggcggcagcgcaaaagatg

SEQ ID NO: 32285 - DNA, 103 bp, Artificial Sequence
  Synthetic Polynucleotide
taatacgactcactatagggctccacgaaggcgttcgcttacttcggggtaacagaggagaaccccgatgtaagcgaacaacctggcggcagcgcaaaagatg

SEQ ID NO: 32286 - DNA, 103 bp, Artificial Sequence
  Synthetic Polynucleotide
taatacgactcactatagggagtaacgtaataaggcaccaacttaggaacaacagaggagagttcctatgttggtgcctaacctggcggcagcgcaaaagatg

SEQ ID NO: 32287 - DNA, 103 bp, Artificial Sequence
  Synthetic Polynucleotide
taatacgactcactatagggcaatattatgaacgtcctatctaacagttaaacagaggagataactgatggataggacgaacctggcggcagcgcaaaagatg

SEQ ID NO: 32288 - DNA, 103 bp, Artificial Sequence
  Synthetic Polynucleotide
taatacgactcactataggggggaatttgacagactgctgggtatgggccaacagaggagaggcccaatgccagcagtcaacctggcggcagcgcaaaagatg

SEQ ID NO: 32289 - DNA, 103 bp, Artificial Sequence
  Synthetic Polynucleotide
taatacgactcactatagggagggtttcgggaggacatgcgaacgttcgaaacagaggagatcgaacatgcgcatgtccaacctggcggcagcgcaaaagatg

SEQ ID NO: 32290 - DNA, 103 bp, Artificial Sequence
  Synthetic Polynucleotide
taatacgactcactatagggacccggcgtcgtgctgggtggactaaatgtaacagaggagaacatttatgccacccagcaacctggcggcagcgcaaaagatg

SEQ ID NO: 32291 - DNA, 103 bp, Artificial Sequence
  Synthetic Polynucleotide
taatacgactcactatagggtacctccactaataccaattgtgtccgaaaaacagaggagatttcggatgcaattggtaaacctggcggcagcgcaaaagatg

SEQ ID NO: 32292 - DNA, 103 bp, Artificial Sequence
  Synthetic Polynucleotide
taatacgactcactataggggcacaagtgaacgcttacgttcaaattatgaacagaggagacataatatgaacgtaagcaacctggcggcagcgcaaaagatg

SEQ ID NO: 32293 - DNA, 103 bp, Artificial Sequence
  Synthetic Polynucleotide
taatacgactcactatagggcggaaaaaagcgtagccaggtgtttgcggtaacagaggagaaccgcaatgacctggctaaacctggcggcagcgcaaaagatg

SEQ ID NO: 32294 - DNA, 103 bp, Artificial Sequence
  Synthetic Polynucleotide
taatacgactcactatagggacttatctaacatattaagggctctagacgaacagaggagacgtctaatgcccttaataaacctggcggcagcgcaaaagatg

SEQ ID NO: 32295 - DNA, 103 bp, Artificial Sequence
  Synthetic Polynucleotide
taatacgactcactatagggggcaacacagtcgcaataatgtggggaattaacagaggagaaattccatgcattattgcaacctggcggcagcgcaaaagatg

SEQ ID NO: 32296 - DNA, 103 bp, Artificial Sequence
  Synthetic Polynucleotide
taatacgactcactatagggtggtcacgaagcttctcccctacctgtataaacagaggagatatacaatgaggggagaaaacctggcggcagcgcaaaagatg

SEQ ID NO: 32297 - DNA, 103 bp, Artificial Sequence
  Synthetic Polynucleotide
taatacgactcactatagggggctaacctatacctaagcaaaactcgactaacagaggagaagtcgaatgttgcttaggaacctggcggcagcgcaaaagatg

SEQ ID NO: 32298 - DNA, 103 bp, Artificial Sequence
  Synthetic Polynucleotide
taatacgactcactatagggcaatctcatccccaggctcgatccccgccaaacagaggagatggcggatgtcgagcctgaacctggcggcagcgcaaaagatg

SEQ ID NO: 32299 - DNA, 103 bp, Artificial Sequence
  Synthetic Polynucleotide
taatacgactcactatagggtactctcggtccgtcgatgcacacgcttccaacagaggagaggaagcatgtgcatcgacaacctggcggcagcgcaaaagatg

SEQ ID NO: 32300 - DNA, 103 bp, Artificial Sequence
  Synthetic Polynucleotide
taatacgactcactatagggtgattttggaaataattaggacaagaccgaaacagaggagatcggtcatgtcctaattaaacctggcggcagcgcaaaagatg

SEQ ID NO: 32301 - DNA, 103 bp, Artificial Sequence
  Synthetic Polynucleotide
taatacgactcactatagggtcaaatagtccaatgtcctgatttaactaaaacagaggagattagttatgtcaggacataacctggcggcagcgcaaaagatg

SEQ ID NO: 32302 - DNA, 103 bp, Artificial Sequence
  Synthetic Polynucleotide
taatacgactcactatagggtcgcactctcttaacttgagcaaacttgcgaacagaggagacgcaagatggctcaagttaacctggcggcagcgcaaaagatg

SEQ ID NO: 32303 - DNA, 103 bp, Artificial Sequence
  Synthetic Polynucleotide
taatacgactcactatagggtgaattatgatgttcactcaccacattagaaacagaggagatctaatatggtgagtgaaaacctggcggcagcgcaaaagatg

SEQ ID NO: 32304 - DNA, 103 bp, Artificial Sequence
  Synthetic Polynucleotide
taatacgactcactatagggtactcccatacattcaagtgacgcctcataaacagaggagatatgagatgtcacttgaaaacctggcggcagcgcaaaagatg

SEQ ID NO: 32305 - DNA, 103 bp, Artificial Sequence
  Synthetic Polynucleotide
taatacgactcactatagggtaacgctggtcacctacctacgagcgggtgaacagaggagacacccgatggtaggtaggaacctggcggcagcgcaaaagatg

SEQ ID NO: 32306 - DNA, 103 bp, Artificial Sequence
  Synthetic Polynucleotide
taatacgactcactatagggccgcaggttttggcttgctgggaggcccgaaacagaggagatcgggcatgccagcaagcaacctggcggcagcgcaaaagatg

SEQ ID NO: 32307 - DNA, 103 bp, Artificial Sequence
  Synthetic Polynucleotide
taatacgactcactataggggcacccggttcgtgcacaatggtttattaaaacagaggagattaataatgcattgtgcaaacctggcggcagcgcaaaagatg

SEQ ID NO: 32308 - DNA, 103 bp, Artificial Sequence
  Synthetic Polynucleotide
taatacgactcactatagggtgtttcgtgtaattcctttacaactaatacaacagaggagagtattaatggtaaaggaaaacctggcggcagcgcaaaagatg

SEQ ID NO: 32309 - DNA, 103 bp, Artificial Sequence
  Synthetic Polynucleotide
taatacgactcactataggggctacggagaagacgatgcttaatgattgcaacagaggagagcaatcatgaagcatcgtaacctggcggcagcgcaaaagatg

SEQ ID NO: 32310 - DNA, 103 bp, Artificial Sequence
  Synthetic Polynucleotide
taatacgactcactatagggcgagtcacttcttgctaagaaaaattcagcaacagaggagagctgaaatgttcttagcaaacctggcggcagcgcaaaagatg

SEQ ID NO: 32311 - DNA, 103 bp, Artificial Sequence
  Synthetic Polynucleotide
taatacgactcactataggggagtgctagctttggcatatgaatgacaacaacagaggagagttgtcatgcatatgccaaacctggcggcagcgcaaaagatg

SEQ ID NO: 32312 - DNA, 103 bp, Artificial Sequence
  Synthetic Polynucleotide
taatacgactcactatagggtagtgcgacgccctgcctaaacaacagtagaacagaggagactactgatgtttaggcagaacctggcggcagcgcaaaagatg

SEQ ID NO: 32313 - DNA, 103 bp, Artificial Sequence
  Synthetic Polynucleotide
taatacgactcactatagggtcggtatagtttgatccggtctccgaaaacaacagaggagagttttcatggaccggatcaacctggcggcagcgcaaaagatg

SEQ ID NO: 32314 - DNA, 103 bp, Artificial Sequence
  Synthetic Polynucleotide
taatacgactcactataggggagtgcatgaaccattggcaggaattacaaaacagaggagattgtaaatgctgccaatgaacctggcggcagcgcaaaagatg

SEQ ID NO: 32315 - DNA, 103 bp, Artificial Sequence
  Synthetic Polynucleotide
taatacgactcactatagggatacattagggagacagggtaaatcaaatgaacagaggagacatttgatgtaccctgtcaacctggcggcagcgcaaaagatg

SEQ ID NO: 32316 - DNA, 103 bp, Artificial Sequence
  Synthetic Polynucleotide
taatacgactcactataggggcccgacaaggtaaagacagaagcgtggataacagaggagaatccacatgtctgtctttaacctggcggcagcgcaaaagatg

SEQ ID NO: 32317 - DNA, 103 bp, Artificial Sequence
  Synthetic Polynucleotide
taatacgactcactataggggtcatacacagataccccttgtgacccttaaacagaggagataagggatgcaaggggtaaacctggcggcagcgcaaaagatg

SEQ ID NO: 32318 - DNA, 103 bp, Artificial Sequence
  Synthetic Polynucleotide
taatacgactcactatagggcggttcattaccctatgagcgttgcgagtaaacagaggagatactcgatgcgctcatagaacctggcggcagcgcaaaagatg

SEQ ID NO: 32319 - DNA, 103 bp, Artificial Sequence
  Synthetic Polynucleotide
taatacgactcactatagggctagccgctagctgatcgaagacgaaaattaacagaggagaaattttatgcttcgatcaaacctggcggcagcgcaaaagatg

SEQ ID NO: 32320 - DNA, 103 bp, Artificial Sequence
  Synthetic Polynucleotide
taatacgactcactatagggcctagagtccatcgggggggcataaagtcgaacagaggagacgacttatggcccccccgaacctggcggcagcgcaaaagatg

SEQ ID NO: 32321 - DNA, 103 bp, Artificial Sequence
  Synthetic Polynucleotide
taatacgactcactatagggaggagtcaacgaggactaaaattcgctctgaacagaggagacagagcatgttttagtccaacctggcggcagcgcaaaagatg

SEQ ID NO: 32322 - DNA, 103 bp, Artificial Sequence
  Synthetic Polynucleotide
taatacgactcactatagggtcggccgcctgtcttataggatcagtgcctaacagaggagaaggcacatgtcctataagaacctggcggcagcgcaaaagatg

SEQ ID NO: 32323 - DNA, 103 bp, Artificial Sequence
  Synthetic Polynucleotide
taatacgactcactataggggctataactaagtcagtgattcaggtgtataacagaggagaatacacatgaatcactgaaacctggcggcagcgcaaaagatg

SEQ ID NO: 32324 - DNA, 103 bp, Artificial Sequence
  Synthetic Polynucleotide
taatacgactcactatagggatgcaaatccttgcaggtacgatccggaataacagaggagaattccgatgcgtacctgcaacctggcggcagcgcaaaagatg

SEQ ID NO: 32325 - DNA, 103 bp, Artificial Sequence
  Synthetic Polynucleotide
taatacgactcactatagggatgttatctagttgcgaacaaggccccgtaaacagaggagatacgggatgttgttcgcaaacctggcggcagcgcaaaagatg

SEQ ID NO: 32326 - DNA, 103 bp, Artificial Sequence
  Synthetic Polynucleotide
taatacgactcactatagggaccactagcgctgatcgggatcctagcgaaaacagaggagattcgctatgatcccgatcaacctggcggcagcgcaaaagatg

SEQ ID NO: 32327 - DNA, 103 bp, Artificial Sequence
  Synthetic Polynucleotide
taatacgactcactatagggttgggggcggtagttcatgttcggtcctcgaacagaggagacgaggaatgaacatgaacaacctggcggcagcgcaaaagatg

SEQ ID NO: 32328 - DNA, 103 bp, Artificial Sequence
  Synthetic Polynucleotide
taatacgactcactatagggcaaggtcaagtgaaatgcacttcaatcgacaacagaggagagtcgatatgagtgcatttaacctggcggcagcgcaaaagatg

SEQ ID NO: 32329 - DNA, 103 bp, Artificial Sequence
  Synthetic Polynucleotide
taatacgactcactatagggcgagatggaaacaggacacgattggaagtgaacagaggagacacttcatgtcgtgtcctaacctggcggcagcgcaaaagatg

SEQ ID NO: 32330 - DNA, 103 bp, Artificial Sequence
  Synthetic Polynucleotide
taatacgactcactatagggaaacacggacgtttcgtaaattgattagttaacagaggagaaactaaatgatttacgaaaacctggcggcagcgcaaaagatg

SEQ ID NO: 32331 - DNA, 103 bp, Artificial Sequence
  Synthetic Polynucleotide
taatacgactcactataggggacctttcatagcacatcgttagcggaacaaacagaggagatgttccatgaacgatgtgaacctggcggcagcgcaaaagatg

SEQ ID NO: 32332 - DNA, 103 bp, Artificial Sequence
  Synthetic Polynucleotide
taatacgactcactatagggagatgcctaatccgaggtgcctcaaattataacagaggagaataattatgggcacctcgaacctggcggcagcgcaaaagatg

SEQ ID NO: 32333 - DNA, 103 bp, Artificial Sequence
  Synthetic Polynucleotide
taatacgactcactataggggcggattcccaaggaagctgaaaaacgagtaacagaggagaactcgtatgtcagcttccaacctggcggcagcgcaaaagatg

SEQ ID NO: 32334 - DNA, 103 bp, Artificial Sequence
  Synthetic Polynucleotide
taatacgactcactatagggggctaaatcatgagcttgccgcagtgccagaacagaggagactggcaatgcggcaagctaacctggcggcagcgcaaaagatg

SEQ ID NO: 32335 - DNA, 103 bp, Artificial Sequence
  Synthetic Polynucleotide
taatacgactcactatagggtaccatagtgtgacatgcattcacggtcgtaacagaggagaacgaccatgaatgcatgtaacctggcggcagcgcaaaagatg

SEQ ID NO: 32336 - DNA, 103 bp, Artificial Sequence
  Synthetic Polynucleotide
taatacgactcactatagggtccaaacctctagttaaattaatcccccggaacagaggagaccggggatgtaatttaacaacctggcggcagcgcaaaagatg

SEQ ID NO: 32337 - DNA, 103 bp, Artificial Sequence
  Synthetic Polynucleotide
taatacgactcactatagggccggacaacactgctcgcagagtccggctaaacagaggagatagccgatgtctgcgagcaacctggcggcagcgcaaaagatg

SEQ ID NO: 32338 - DNA, 103 bp, Artificial Sequence
  Synthetic Polynucleotide
taatacgactcactatagggccgcatctgacgaatgtcttgaatgaacataacagaggagaatgttcatgcaagacattaacctggcggcagcgcaaaagatg

SEQ ID NO: 32339 - DNA, 103 bp, Artificial Sequence
  Synthetic Polynucleotide
taatacgactcactatagggtttcgaccagtatctgtgaccatgaatccgaacagaggagacggattatgggtcacagaaacctggcggcagcgcaaaagatg

SEQ ID NO: 32340 - DNA, 103 bp, Artificial Sequence
  Synthetic Polynucleotide
taatacgactcactatagggactgttatccgaatccagcgtgataggacgaacagaggagacgtcctatgacgctggataacctggcggcagcgcaaaagatg

SEQ ID NO: 32341 - DNA, 103 bp, Artificial Sequence
  Synthetic Polynucleotide
taatacgactcactatagggacaacgaggacggccacgccagtttgtgcgaacagaggagacgcacaatgtggcgtggcaacctggcggcagcgcaaaagatg

SEQ ID NO: 32342 - DNA, 103 bp, Artificial Sequence
  Synthetic Polynucleotide
taatacgactcactatagggaaggactaggagatagcgcagggcggtgaaaacagaggagattcaccatgctgcgctataacctggcggcagcgcaaaagatg

SEQ ID NO: 32343 - DNA, 103 bp, Artificial Sequence
  Synthetic Polynucleotide
taatacgactcactatagggttccttaagaccggtgaacagaggcgcaataacagaggagaattgcgatgctgttcaccaacctggcggcagcgcaaaagatg

SEQ ID NO: 32344 - DNA, 103 bp, Artificial Sequence
  Synthetic Polynucleotide
taatacgactcactatagggcgggtccagacgcggatatcttcaaggcataacagaggagaatgcctatgagatatccgaacctggcggcagcgcaaaagatg

SEQ ID NO: 32345 - DNA, 103 bp, Artificial Sequence
  Synthetic Polynucleotide
taatacgactcactatagggctaatgaagcgggagcgacggcgaccaactaacagaggagaagttggatgccgtcgctcaacctggcggcagcgcaaaagatg

SEQ ID NO: 32346 - DNA, 103 bp, Artificial Sequence
  Synthetic Polynucleotide
taatacgactcactatagggggaacattgccagtgcggatgtgccaggacaacagaggagagtcctgatgcatccgcacaacctggcggcagcgcaaaagatg

SEQ ID NO: 32347 - DNA, 103 bp, Artificial Sequence
  Synthetic Polynucleotide
taatacgactcactatagggttttttcagaagcatgtgtttcactttaggaacagaggagacctaaaatgaaacacatgaacctggcggcagcgcaaaagatg

SEQ ID NO: 32348 - DNA, 103 bp, Artificial Sequence
  Synthetic Polynucleotide
taatacgactcactatagggatccgacttacaagtcctctatggatcgagaacagaggagactcgatatgtagaggactaacctggcggcagcgcaaaagatg

SEQ ID NO: 32349 - DNA, 103 bp, Artificial Sequence
  Synthetic Polynucleotide
taatacgactcactatagggagcgacgtcccggttactgttctggccgcaaacagaggagatgcggcatgaacagtaacaacctggcggcagcgcaaaagatg

SEQ ID NO: 32350 - DNA, 103 bp, Artificial Sequence
  Synthetic Polynucleotide
taatacgactcactatagggattcttttccatgtttatctcttgaataacaacagaggagagttattatggagataaacaacctggcggcagcgcaaaagatg

SEQ ID NO: 32351 - DNA, 103 bp, Artificial Sequence
  Synthetic Polynucleotide
taatacgactcactatagggctcctcaagtcataccattggaaagtactcaacagaggagagagtacatgccaatggtaaacctggcggcagcgcaaaagatg

SEQ ID NO: 32352 - DNA, 103 bp, Artificial Sequence
  Synthetic Polynucleotide
taatacgactcactatagggctgcaacattgatcttaacttcattccgtgaacagaggagacacggaatgaagttaagaaacctggcggcagcgcaaaagatg

SEQ ID NO: 32353 - DNA, 103 bp, Artificial Sequence
  Synthetic Polynucleotide
taatacgactcactataggggaaaatacaaatactggaatgggttcgatgaacagaggagacatcgaatgcattccagtaacctggcggcagcgcaaaagatg

SEQ ID NO: 32354 - DNA, 103 bp, Artificial Sequence
  Synthetic Polynucleotide
taatacgactcactatagggcccaccaccgtcaggcagatgtcgtgaagcaacagaggagagcttcaatgcatctgcctaacctggcggcagcgcaaaagatg

SEQ ID NO: 32355 - DNA, 103 bp, Artificial Sequence
  Synthetic Polynucleotide
taatacgactcactatagggatgcgcagtcacgatacgttgtttattaggaacagaggagacctaatatgcaacgtatcaacctggcggcagcgcaaaagatg

SEQ ID NO: 32356 - DNA, 103 bp, Artificial Sequence
  Synthetic Polynucleotide
taatacgactcactatagggtggtaaaaattgcttaggctattatcctccaacagaggagaggaggaatgtagcctaagaacctggcggcagcgcaaaagatg

SEQ ID NO: 32357 - DNA, 103 bp, Artificial Sequence
  Synthetic Polynucleotide
taatacgactcactatagggcttatcactctttctgcgtacttatgtacaaacagaggagatgtacaatggtacgcagaaacctggcggcagcgcaaaagatg

SEQ ID NO: 32358 - DNA, 103 bp, Artificial Sequence
  Synthetic Polynucleotide
taatacgactcactatagggtctcgggccggatgcgccaaacgatagtgcaacagaggagagcactaatgtttggcgcaaacctggcggcagcgcaaaagatg

SEQ ID NO: 32359 - DNA, 103 bp, Artificial Sequence
  Synthetic Polynucleotide
taatacgactcactataggggtgcggacggtgtacaggcgtgttcccataaacagaggagatatgggatgacgcctgtaaacctggcggcagcgcaaaagatg

SEQ ID NO: 32360 - DNA, 103 bp, Artificial Sequence
  Synthetic Polynucleotide
taatacgactcactatagggcgaaagataatccgaagcaacatactgtccaacagaggagaggacagatggttgcttcgaacctggcggcagcgcaaaagatg

SEQ ID NO: 32361 - DNA, 103 bp, Artificial Sequence
  Synthetic Polynucleotide
taatacgactcactatagggaacacagatgtgggtatggacccataacacaacagaggagagtgttaatggtccataccaacctggcggcagcgcaaaagatg

SEQ ID NO: 32362 - DNA, 103 bp, Artificial Sequence
  Synthetic Polynucleotide
taatacgactcactatagggtttccatgcgcgctttgaccagtgtttagcaacagaggagagctaaaatgtggtcaaagaacctggcggcagcgcaaaagatg

SEQ ID NO: 32363 - DNA, 103 bp, Artificial Sequence
  Synthetic Polynucleotide
taatacgactcactatagggcgattctcgaaagttatggaatcaagctagaacagaggagactagctatgttccataacaacctggcggcagcgcaaaagatg

SEQ ID NO: 32364 - DNA, 103 bp, Artificial Sequence
  Synthetic Polynucleotide
taatacgactcactatagggctaagatagatggggctcatacgtactggtaacagaggagaaccagtatgtatgagcccaacctggcggcagcgcaaaagatg

SEQ ID NO: 32365 - DNA, 103 bp, Artificial Sequence
  Synthetic Polynucleotide
taatacgactcactatagggttgttttgtacttttgtcggttgcctctgaaacagaggagatcagagatgaccgacaaaaacctggcggcagcgcaaaagatg

SEQ ID NO: 32366 - DNA, 103 bp, Artificial Sequence
  Synthetic Polynucleotide
taatacgactcactatagggtaggtttaccaatgtgcgttccccgatagcaacagaggagagctatcatggaacgcacaaacctggcggcagcgcaaaagatg

SEQ ID NO: 32367 - DNA, 103 bp, Artificial Sequence
  Synthetic Polynucleotide
taatacgactcactatagggggccttcccaattagctcctatacctggataacagaggagaatccagatgtaggagctaaacctggcggcagcgcaaaagatg

SEQ ID NO: 32368 - DNA, 103 bp, Artificial Sequence
  Synthetic Polynucleotide
taatacgactcactataggggcctatgcgctgcaagtgcaggagccagaaaacagaggagattctggatgctgcacttgaacctggcggcagcgcaaaagatg

SEQ ID NO: 32369 - DNA, 103 bp, Artificial Sequence
  Synthetic Polynucleotide
taatacgactcactatagggcgagtaggcagcaatatgagagtaaatcaaaacagaggagattgattatgtctcatattaacctggcggcagcgcaaaagatg

SEQ ID NO: 32370 - DNA, 103 bp, Artificial Sequence
  Synthetic Polynucleotide
taatacgactcactatagggttgctcgatcgctgtcgtgcgtggctatggaacagaggagaccatagatgcgcacgacaaacctggcggcagcgcaaaagatg

SEQ ID NO: 32371 - DNA, 103 bp, Artificial Sequence
  Synthetic Polynucleotide
taatacgactcactatagggatttacaggggatgcgataagcaagtaacaaacagaggagatgttacatgcttatcgcaaacctggcggcagcgcaaaagatg

SEQ ID NO: 32372 - DNA, 103 bp, Artificial Sequence
  Synthetic Polynucleotide
taatacgactcactatagggccgactgcgcctccgaggataattgttttcaacagaggagagaaaacatgtatcctcggaacctggcggcagcgcaaaagatg

SEQ ID NO: 32373 - DNA, 103 bp, Artificial Sequence
  Synthetic Polynucleotide
taatacgactcactatagggtgtccgtgtcataactcaatgcagagggagaacagaggagactccctatgcattgagttaacctggcggcagcgcaaaagatg

SEQ ID NO: 32374 - DNA, 103 bp, Artificial Sequence
  Synthetic Polynucleotide
taatacgactcactatagggtagcggcctgagctgaggattcagacaagaaacagaggagatcttgtatgaatcctcagaacctggcggcagcgcaaaagatg

SEQ ID NO: 32375 - DNA, 103 bp, Artificial Sequence
  Synthetic Polynucleotide
taatacgactcactatagggatccttagccccgcgccgctggctcttccaaacagaggagatggaagatgcagcggcgcaacctggcggcagcgcaaaagatg

SEQ ID NO: 32376 - DNA, 103 bp, Artificial Sequence
  Synthetic Polynucleotide
taatacgactcactataggggcacctaacaccgattactctgcgtccgagaacagaggagactcggaatgagagtaatcaacctggcggcagcgcaaaagatg

SEQ ID NO: 32377 - DNA, 103 bp, Artificial Sequence
  Synthetic Polynucleotide
taatacgactcactataggggatgttactgggatgtctcctcattcacacaacagaggagagtgtgaatgaggagacataacctggcggcagcgcaaaagatg

SEQ ID NO: 32378 - DNA, 103 bp, Artificial Sequence
  Synthetic Polynucleotide
taatacgactcactatagggtcacttcgctctgagcatgaaatttcgaacaacagaggagagttcgaatgttcatgctcaacctggcggcagcgcaaaagatg

SEQ ID NO: 32379 - DNA, 103 bp, Artificial Sequence
  Synthetic Polynucleotide
taatacgactcactatagggttcaacgggtctaactaggttaagtctttcaacagaggagagaaagaatgaacctagttaacctggcggcagcgcaaaagatg

SEQ ID NO: 32380 - DNA, 103 bp, Artificial Sequence
  Synthetic Polynucleotide
taatacgactcactatagggatacgcgcatccagtatcatagaagatagaaacagaggagatctatcatgtatgatactaacctggcggcagcgcaaaagatg

SEQ ID NO: 32381 - DNA, 103 bp, Artificial Sequence
  Synthetic Polynucleotide
taatacgactcactatagggagactgatcgatgatatgagaagtctgtataacagaggagaatacagatgtctcatatcaacctggcggcagcgcaaaagatg

SEQ ID NO: 32382 - DNA, 103 bp, Artificial Sequence
  Synthetic Polynucleotide
taatacgactcactatagggctacgagtcagtcgtgaggtgatctgggtcaacagaggagagacccaatgcacctcacgaacctggcggcagcgcaaaagatg

SEQ ID NO: 32383 - DNA, 103 bp, Artificial Sequence
  Synthetic Polynucleotide
taatacgactcactatagggcgttgagacatgcatcgaggtcgtcatccgaacagaggagacggatgatgacctcgatgaacctggcggcagcgcaaaagatg

SEQ ID NO: 32384 - DNA, 103 bp, Artificial Sequence
  Synthetic Polynucleotide
taatacgactcactatagggcacgtcatttgccaacgcattcttacgctcaacagaggagagagcgtatgaatgcgttgaacctggcggcagcgcaaaagatg

SEQ ID NO: 32385 - DNA, 103 bp, Artificial Sequence
  Synthetic Polynucleotide
taatacgactcactataggggggtcttcatcggagacactgctaaaatgaaacagaggagatcatttatgcagtgtctcaacctggcggcagcgcaaaagatg

SEQ ID NO: 32386 - DNA, 103 bp, Artificial Sequence
  Synthetic Polynucleotide
taatacgactcactatagggcctctaacagaatttaagttctcagaagtcaacagaggagagacttcatggaacttaaaaacctggcggcagcgcaaaagatg

SEQ ID NO: 32387 - DNA, 103 bp, Artificial Sequence
  Synthetic Polynucleotide
taatacgactcactatagggaagcttcggacacaagcctttgatctcgggaacagaggagacccgagatgaaaggcttgaacctggcggcagcgcaaaagatg

SEQ ID NO: 32388 - DNA, 103 bp, Artificial Sequence
  Synthetic Polynucleotide
taatacgactcactatagggttctctcccaaacagtcttcatgaaagctcaacagaggagagagcttatgtgaagactgaacctggcggcagcgcaaaagatg

SEQ ID NO: 32389 - DNA, 103 bp, Artificial Sequence
  Synthetic Polynucleotide
taatacgactcactatagggttcaatccgagtcgcccactctcatgtctcaacagaggagagagacaatggagtgggcgaacctggcggcagcgcaaaagatg

SEQ ID NO: 32390 - DNA, 103 bp, Artificial Sequence
  Synthetic Polynucleotide
taatacgactcactatagggccctaaagcaggttggtgaccgatggaggcaacagaggagagcctccatgggtcaccaaaacctggcggcagcgcaaaagatg

SEQ ID NO: 32391 - DNA, 103 bp, Artificial Sequence
  Synthetic Polynucleotide
taatacgactcactatagggtcacttaggatttctgtaagagcagtttctaacagaggagaagaaacatgtcttacagaaacctggcggcagcgcaaaagatg

SEQ ID NO: 32392 - DNA, 103 bp, Artificial Sequence
  Synthetic Polynucleotide
taatacgactcactatagggttgcaccctaggctcgtaaaccggacttgaaacagaggagatcaagtatggtttacgagaacctggcggcagcgcaaaagatg

SEQ ID NO: 32393 - DNA, 103 bp, Artificial Sequence
  Synthetic Polynucleotide
taatacgactcactataggggaggggcacgatgtgcacaaacgtgcgacaaacagaggagatgtcgcatgtttgtgcacaacctggcggcagcgcaaaagatg

SEQ ID NO: 32394 - DNA, 103 bp, Artificial Sequence
  Synthetic Polynucleotide
taatacgactcactataggggttcataacaatctttccgaggtgccgcataacagaggagaatgcggatgctcggaaagaacctggcggcagcgcaaaagatg

SEQ ID NO: 32395 - DNA, 103 bp, Artificial Sequence
  Synthetic Polynucleotide
taatacgactcactatagggggtatgctacgaatcttagaaccgggcgctaacagaggagaagcgccatgttctaagataacctggcggcagcgcaaaagatg

SEQ ID NO: 32396 - DNA, 103 bp, Artificial Sequence
  Synthetic Polynucleotide
taatacgactcactatagggattagaactgcttgttgggtatgacccacaaacagaggagatgtgggatgtacccaacaaacctggcggcagcgcaaaagatg

SEQ ID NO: 32397 - DNA, 103 bp, Artificial Sequence
  Synthetic Polynucleotide
taatacgactcactatagggtcgcaggcgcgttgctcagagaactcacaaaacagaggagattgtgaatgctctgagcaaacctggcggcagcgcaaaagatg

SEQ ID NO: 32398 - DNA, 103 bp, Artificial Sequence
  Synthetic Polynucleotide
taatacgactcactatagggtgcttccattcttgtaggggttcatactttaacagaggagaaaagtaatgacccctacaaacctggcggcagcgcaaaagatg

SEQ ID NO: 32399 - DNA, 103 bp, Artificial Sequence
  Synthetic Polynucleotide
taatacgactcactatagggtatacgcacccaaggtacatgctaatcaccaacagaggagaggtgatatgcatgtacctaacctggcggcagcgcaaaagatg

SEQ ID NO: 32400 - DNA, 103 bp, Artificial Sequence
  Synthetic Polynucleotide
taatacgactcactatagggatgtgaacagctttcagcgatgcgactagaaacagaggagatctagtatgatcgctgaaaacctggcggcagcgcaaaagatg

SEQ ID NO: 32401 - DNA, 103 bp, Artificial Sequence
  Synthetic Polynucleotide
taatacgactcactatagggccctaaatcgaaactgtagtcgcgagttgcaacagaggagagcaactatggactacagtaacctggcggcagcgcaaaagatg

SEQ ID NO: 32402 - DNA, 103 bp, Artificial Sequence
  Synthetic Polynucleotide
taatacgactcactatagggttgtaaggcaaaaactcgagtcgacgattgaacagaggagacaatcgatgactcgagttaacctggcggcagcgcaaaagatg

SEQ ID NO: 32403 - DNA, 103 bp, Artificial Sequence
  Synthetic Polynucleotide
taatacgactcactatagggtctaactagaggcagagtaggtttcatacaaacagaggagatgtatgatgcctactctgaacctggcggcagcgcaaaagatg

SEQ ID NO: 32404 - DNA, 103 bp, Artificial Sequence
  Synthetic Polynucleotide
taatacgactcactatagggcaaaccatcacgttccttacacgacacggtaacagaggagaaccgtgatgtgtaaggaaaacctggcggcagcgcaaaagatg

SEQ ID NO: 32405 - DNA, 103 bp, Artificial Sequence
  Synthetic Polynucleotide
taatacgactcactatagggatgacgcacaggacgtcgttatagacgagaaacagaggagatctcgtatgtaacgacgtaacctggcggcagcgcaaaagatg

SEQ ID NO: 32406 - DNA, 103 bp, Artificial Sequence
  Synthetic Polynucleotide
taatacgactcactatagggacacgacaagatttccgagcgtttattgtcaacagaggagagacaatatgcgctcggaaaacctggcggcagcgcaaaagatg

SEQ ID NO: 32407 - DNA, 103 bp, Artificial Sequence
  Synthetic Polynucleotide
taatacgactcactatagggcaggatgagatccgaggcaccccgcctatcaacagaggagagataggatgggtgcctcgaacctggcggcagcgcaaaagatg

SEQ ID NO: 32408 - DNA, 103 bp, Artificial Sequence
  Synthetic Polynucleotide
taatacgactcactatagggcaatcataaccgggtgccttttaaccttgcaacagaggagagcaaggatgaaaggcaccaacctggcggcagcgcaaaagatg

SEQ ID NO: 32409 - DNA, 103 bp, Artificial Sequence
  Synthetic Polynucleotide
taatacgactcactatagggctgatcaagaatccaacattcgctcgacggaacagaggagaccgtcgatggaatgttggaacctggcggcagcgcaaaagatg

SEQ ID NO: 32410 - DNA, 103 bp, Artificial Sequence
  Synthetic Polynucleotide
taatacgactcactatagggatttgcttaatggcctctcggcagtcacataacagaggagaatgtgaatgccgagaggcaacctggcggcagcgcaaaagatg

SEQ ID NO: 32411 - DNA, 103 bp, Artificial Sequence
  Synthetic Polynucleotide
taatacgactcactatagggctctctcgacatggatatactcctgtcgataacagaggagaatcgacatgagtatatccaacctggcggcagcgcaaaagatg

SEQ ID NO: 32412 - DNA, 103 bp, Artificial Sequence
  Synthetic Polynucleotide
taatacgactcactatagggcagttcgctaattagatgtatgcgccgtcgaacagaggagacgacggatgatacatctaaacctggcggcagcgcaaaagatg

SEQ ID NO: 32413 - DNA, 103 bp, Artificial Sequence
  Synthetic Polynucleotide
taatacgactcactatagggattgagttaagattaaaaataaagtgctcaaacagaggagatgagcaatgtatttttaaaacctggcggcagcgcaaaagatg

SEQ ID NO: 32414 - DNA, 103 bp, Artificial Sequence
  Synthetic Polynucleotide
taatacgactcactatagggattgtttaggaattttacattgttgtcgttaacagaggagaaacgacatgaatgtaaaaaacctggcggcagcgcaaaagatg

SEQ ID NO: 32415 - DNA, 103 bp, Artificial Sequence
  Synthetic Polynucleotide
taatacgactcactatagggataagaggttactgggcaacttagcgcaggaacagaggagacctgcgatgagttgcccaaacctggcggcagcgcaaaagatg

SEQ ID NO: 32416 - DNA, 103 bp, Artificial Sequence
  Synthetic Polynucleotide
taatacgactcactatagggcgacaagcgcacgcctagtggcagaacgtcaacagaggagagacgttatgccactaggcaacctggcggcagcgcaaaagatg

SEQ ID NO: 32417 - DNA, 103 bp, Artificial Sequence
  Synthetic Polynucleotide
taatacgactcactatagggcgtgtgcttgtctggtctcacaccacttcaaacagaggagatgaagtatggtgagaccaaacctggcggcagcgcaaaagatg

SEQ ID NO: 32418 - DNA, 103 bp, Artificial Sequence
  Synthetic Polynucleotide
taatacgactcactatagggtatatgtgcttgtccagtgccaatagagccaacagaggagaggctctatgggcactggaaacctggcggcagcgcaaaagatg

SEQ ID NO: 32419 - DNA, 103 bp, Artificial Sequence
  Synthetic Polynucleotide
taatacgactcactatagggcatcttaagaatattactcatccgaccagtaacagaggagaactggtatgatgagtaataacctggcggcagcgcaaaagatg

SEQ ID NO: 32420 - DNA, 103 bp, Artificial Sequence
  Synthetic Polynucleotide
taatacgactcactatagggagaaagacacgtcagcttcgtacatgttacaacagaggagagtaacaatgacgaagctgaacctggcggcagcgcaaaagatg

SEQ ID NO: 32421 - DNA, 103 bp, Artificial Sequence
  Synthetic Polynucleotide
taatacgactcactatagggttgatgcgtttttctccagtctgcttagcgaacagaggagacgctaaatggactggagaaacctggcggcagcgcaaaagatg

SEQ ID NO: 32422 - DNA, 103 bp, Artificial Sequence
  Synthetic Polynucleotide
taatacgactcactatagggccggaagcctacctctgaagccgagcacacaacagaggagagtgtgcatggcttcagagaacctggcggcagcgcaaaagatg

SEQ ID NO: 32423 - DNA, 103 bp, Artificial Sequence
  Synthetic Polynucleotide
taatacgactcactataggggttgaggaggattatcatagtgttttagtgaacagaggagacactaaatgactatgataaacctggcggcagcgcaaaagatg

SEQ ID NO: 32424 - DNA, 103 bp, Artificial Sequence
  Synthetic Polynucleotide
taatacgactcactatagggatttgacctggtcccctctggtcatacggcaacagaggagagccgtaatgccagaggggaacctggcggcagcgcaaaagatg

SEQ ID NO: 32425 - DNA, 103 bp, Artificial Sequence
  Synthetic Polynucleotide
taatacgactcactatagggattgacaggcggcagatagttgcccttaacaacagaggagagttaagatgaactatctgaacctggcggcagcgcaaaagatg

SEQ ID NO: 32426 - DNA, 103 bp, Artificial Sequence
  Synthetic Polynucleotide
taatacgactcactatagggaaggagacgagcataattgaccaagtcgtaaacagaggagatacgacatggtcaattataacctggcggcagcgcaaaagatg

SEQ ID NO: 32427 - DNA, 103 bp, Artificial Sequence
  Synthetic Polynucleotide
taatacgactcactatagggaagcttcgcctattagtttagagtagcgctaacagaggagaagcgctatgctaaactaaaacctggcggcagcgcaaaagatg

SEQ ID NO: 32428 - DNA, 103 bp, Artificial Sequence
  Synthetic Polynucleotide
taatacgactcactatagggtgctgggggggcggtggggctaggtggacaaacagaggagatgtccaatgagccccaccaacctggcggcagcgcaaaagatg

SEQ ID NO: 32429 - DNA, 103 bp, Artificial Sequence
  Synthetic Polynucleotide
taatacgactcactatagggattaccggttcactgacggccagagtgccaaacagaggagatggcacatgggccgtcagaacctggcggcagcgcaaaagatg

SEQ ID NO: 32430 - DNA, 103 bp, Artificial Sequence
  Synthetic Polynucleotide
taatacgactcactatagggtcgtgtacatcgtcacagcccaatgttgcgaacagaggagacgcaacatggggctgtgaaacctggcggcagcgcaaaagatg

SEQ ID NO: 32431 - DNA, 103 bp, Artificial Sequence
  Synthetic Polynucleotide
taatacgactcactatagggacggggtcagacattaaaacagagccaaataacagaggagaatttggatgtgttttaataacctggcggcagcgcaaaagatg

SEQ ID NO: 32432 - DNA, 103 bp, Artificial Sequence
  Synthetic Polynucleotide
taatacgactcactatagggactttaagagttggccaccgtcaactggtgaacagaggagacaccagatgacggtggccaacctggcggcagcgcaaaagatg

SEQ ID NO: 32433 - DNA, 103 bp, Artificial Sequence
  Synthetic Polynucleotide
taatacgactcactatagggcagaagattatattatctcccataagaagcaacagaggagagcttctatggggagataaaacctggcggcagcgcaaaagatg

SEQ ID NO: 32434 - DNA, 103 bp, Artificial Sequence
  Synthetic Polynucleotide
taatacgactcactatagggataccctaccttagggcgatatccactcggaacagaggagaccgagtatgtatcgccctaacctggcggcagcgcaaaagatg

SEQ ID NO: 32435 - DNA, 103 bp, Artificial Sequence
  Synthetic Polynucleotide
taatacgactcactatagggtggacatacgggggccagtaaaccctgacgaacagaggagacgtcagatgttactggccaacctggcggcagcgcaaaagatg

SEQ ID NO: 32436 - DNA, 103 bp, Artificial Sequence
  Synthetic Polynucleotide
taatacgactcactataggggcataaatagaacccttccctcgagcatggaacagaggagaccatgcatgagggaagggaacctggcggcagcgcaaaagatg

SEQ ID NO: 32437 - DNA, 103 bp, Artificial Sequence
  Synthetic Polynucleotide
taatacgactcactatagggggcttttctgcatcgtagcgcagaaaagtgaacagaggagacactttatggcgctacgaaacctggcggcagcgcaaaagatg

SEQ ID NO: 32438 - DNA, 103 bp, Artificial Sequence
  Synthetic Polynucleotide
taatacgactcactatagggtgccaggagtaattcaacttattcatgataaacagaggagatatcatatgtaagttgaaaacctggcggcagcgcaaaagatg

SEQ ID NO: 32439 - DNA, 103 bp, Artificial Sequence
  Synthetic Polynucleotide
taatacgactcactatagggccaactgtaaacccggggggcatatcaccaaacagaggagatggtgaatggccccccggaacctggcggcagcgcaaaagatg

SEQ ID NO: 32440 - DNA, 103 bp, Artificial Sequence
  Synthetic Polynucleotide
taatacgactcactatagggtcgccccaacctggagtgtaagtttcataaaacagaggagattatgaatgttacactccaacctggcggcagcgcaaaagatg

SEQ ID NO: 32441 - DNA, 103 bp, Artificial Sequence
  Synthetic Polynucleotide
taatacgactcactatagggtgacgcgcgcctgaacttaacgccacctgcaacagaggagagcaggtatggttaagttcaacctggcggcagcgcaaaagatg

SEQ ID NO: 32442 - DNA, 103 bp, Artificial Sequence
  Synthetic Polynucleotide
taatacgactcactatagggcagctctagcagtcacagaaaatcgcacaaaacagaggagattgtgcatgtttctgtgaaacctggcggcagcgcaaaagatg

SEQ ID NO: 32443 - DNA, 103 bp, Artificial Sequence
  Synthetic Polynucleotide
taatacgactcactataggggtgaacgagccgacaagctcgaggtatcggaacagaggagaccgataatgcgagcttgtaacctggcggcagcgcaaaagatg

SEQ ID NO: 32444 - DNA, 103 bp, Artificial Sequence
  Synthetic Polynucleotide
taatacgactcactatagggtcgagcaaggtctgattgcccgagtctctcaacagaggagagagagaatggggcaatcaaacctggcggcagcgcaaaagatg

SEQ ID NO: 32445 - DNA, 103 bp, Artificial Sequence
  Synthetic Polynucleotide
taatacgactcactatagggtgcgttttcggtccaccaacggaccagcaaaacagaggagattgctgatgcgttggtggaacctggcggcagcgcaaaagatg

SEQ ID NO: 32446 - DNA, 103 bp, Artificial Sequence
  Synthetic Polynucleotide
taatacgactcactatagggataccaaggcagcctgctttccgctgatacaacagaggagagtatcaatggaaagcaggaacctggcggcagcgcaaaagatg

SEQ ID NO: 32447 - DNA, 103 bp, Artificial Sequence
  Synthetic Polynucleotide
taatacgactcactataggggtgcgttgaaaaacccaatcagtaggggttaacagaggagaaaccccatgtgattgggtaacctggcggcagcgcaaaagatg

SEQ ID NO: 32448 - DNA, 103 bp, Artificial Sequence
  Synthetic Polynucleotide
taatacgactcactatagggtgacatgataacaggcccccgagagacaacaacagaggagagttgtcatgcgggggcctaacctggcggcagcgcaaaagatg

SEQ ID NO: 32449 - DNA, 103 bp, Artificial Sequence
  Synthetic Polynucleotide
taatacgactcactatagggtcagggtcaattgtaaatcgcccctacagtaacagaggagaactgtaatggcgatttacaacctggcggcagcgcaaaagatg

SEQ ID NO: 32450 - DNA, 103 bp, Artificial Sequence
  Synthetic Polynucleotide
taatacgactcactataggggtacctggtgttcccttgttgagatcgaacaacagaggagagttcgaatgcaacaagggaacctggcggcagcgcaaaagatg

SEQ ID NO: 32451 - DNA, 103 bp, Artificial Sequence
  Synthetic Polynucleotide
taatacgactcactatagggattgcatacatacagttaattcttagagacaacagaggagagtctctatgaattaactgaacctggcggcagcgcaaaagatg

SEQ ID NO: 32452 - DNA, 103 bp, Artificial Sequence
  Synthetic Polynucleotide
taatacgactcactatagggaccaatgttgtaagttcaggtctgcgtcttaacagaggagaaagacgatgacctgaactaacctggcggcagcgcaaaagatg

SEQ ID NO: 32453 - DNA, 103 bp, Artificial Sequence
  Synthetic Polynucleotide
taatacgactcactatagggccgcgtgagtaaaatgaccagtacctgtttaacagaggagaaaacagatgctggtcattaacctggcggcagcgcaaaagatg

SEQ ID NO: 32454 - DNA, 103 bp, Artificial Sequence
  Synthetic Polynucleotide
taatacgactcactatagggttatgttacaggaaacacctataatgagttaacagaggagaaactcaatgtaggtgtttaacctggcggcagcgcaaaagatg

SEQ ID NO: 32455 - DNA, 103 bp, Artificial Sequence
  Synthetic Polynucleotide
taatacgactcactatagggtgcgcaagtcgtgtcgcgcgtgcgtctggcaacagaggagagccagaatgacgcgcgacaacctggcggcagcgcaaaagatg

SEQ ID NO: 32456 - DNA, 103 bp, Artificial Sequence
  Synthetic Polynucleotide
taatacgactcactatagggttgagtccacttcctttccccaggtggcaaaacagaggagattgccaatgggggaaaggaacctggcggcagcgcaaaagatg

SEQ ID NO: 32457 - DNA, 103 bp, Artificial Sequence
  Synthetic Polynucleotide
taatacgactcactatagggacacgagccacttttttcttgacgcaacttaacagaggagaaagttgatgcaagaaaaaaacctggcggcagcgcaaaagatg

SEQ ID NO: 32458 - DNA, 103 bp, Artificial Sequence
  Synthetic Polynucleotide
taatacgactcactataggggtcttggggtactatttccctaataacgctaacagaggagaagcgttatgagggaaataaacctggcggcagcgcaaaagatg

SEQ ID NO: 32459 - DNA, 103 bp, Artificial Sequence
  Synthetic Polynucleotide
taatacgactcactatagggctccctggtaagggcaataggggcaacgttaacagaggagaaacgttatgcctattgccaacctggcggcagcgcaaaagatg

SEQ ID NO: 32460 - DNA, 103 bp, Artificial Sequence
  Synthetic Polynucleotide
taatacgactcactatagggaatcattgctagggatttcaatgagggtacaacagaggagagtacccatgttgaaatccaacctggcggcagcgcaaaagatg

SEQ ID NO: 32461 - DNA, 103 bp, Artificial Sequence
  Synthetic Polynucleotide
taatacgactcactatagggttgagattaatgattgcagccactatgcgaaacagaggagatcgcatatgggctgcaataacctggcggcagcgcaaaagatg

SEQ ID NO: 32462 - DNA, 103 bp, Artificial Sequence
  Synthetic Polynucleotide
taatacgactcactatagggccagaagagcctgcctcgattcatcaggtaaacagaggagatacctgatgaatcgaggcaacctggcggcagcgcaaaagatg

SEQ ID NO: 32463 - DNA, 103 bp, Artificial Sequence
  Synthetic Polynucleotide
taatacgactcactatagggaacggaacctaggaaacccctacgcagcgcaacagaggagagcgctgatgaggggtttcaacctggcggcagcgcaaaagatg

SEQ ID NO: 32464 - DNA, 103 bp, Artificial Sequence
  Synthetic Polynucleotide
taatacgactcactatagggtgacctcatactgtatctctaacagtgaggaacagaggagacctcacatgtagagatacaacctggcggcagcgcaaaagatg

SEQ ID NO: 32465 - DNA, 103 bp, Artificial Sequence
  Synthetic Polynucleotide
taatacgactcactatagggatacagctgaactggttccgcagtgtcctaaacagaggagataggacatggcggaaccaaacctggcggcagcgcaaaagatg

SEQ ID NO: 32466 - DNA, 103 bp, Artificial Sequence
  Synthetic Polynucleotide
taatacgactcactatagggcccgttgaaaatgagcccctgcttgccattaacagaggagaaatggcatgcaggggctcaacctggcggcagcgcaaaagatg

SEQ ID NO: 32467 - DNA, 103 bp, Artificial Sequence
  Synthetic Polynucleotide
taatacgactcactataggggccgtgcttttgaatttcgggactcccaagaacagaggagacttgggatgcccgaaattaacctggcggcagcgcaaaagatg

SEQ ID NO: 32468 - DNA, 103 bp, Artificial Sequence
  Synthetic Polynucleotide
taatacgactcactatagggcaatgaaagtttgttagaagcaaaacatcaaacagaggagatgatgtatggcttctaacaacctggcggcagcgcaaaagatg

SEQ ID NO: 32469 - DNA, 103 bp, Artificial Sequence
  Synthetic Polynucleotide
taatacgactcactatagggcagtcgcatatagggcaacgcatctatataaacagaggagatatataatggcgttgcccaacctggcggcagcgcaaaagatg

SEQ ID NO: 32470 - DNA, 103 bp, Artificial Sequence
  Synthetic Polynucleotide
taatacgactcactatagggccgtagtttaattacactaaagtcaatctgaacagaggagacagattatgtttagtgtaaacctggcggcagcgcaaaagatg

SEQ ID NO: 32471 - DNA, 103 bp, Artificial Sequence
  Synthetic Polynucleotide
taatacgactcactatagggaggggcgaaggtgcttcgagttagtaatcgaacagaggagacgattaatgactcgaagcaacctggcggcagcgcaaaagatg

SEQ ID NO: 32472 - DNA, 103 bp, Artificial Sequence
  Synthetic Polynucleotide
taatacgactcactatagggaagaggttcgcatgtactttcttcttctagaacagaggagactagaaatggaaagtacaaacctggcggcagcgcaaaagatg

SEQ ID NO: 32473 - DNA, 103 bp, Artificial Sequence
  Synthetic Polynucleotide
taatacgactcactatagggcgggctgggcaccctagtttgtgggaacgcaacagaggagagcgttcatgcaaactaggaacctggcggcagcgcaaaagatg

SEQ ID NO: 32474 - DNA, 103 bp, Artificial Sequence
  Synthetic Polynucleotide
taatacgactcactatagggtgggccctgacctcctagcggtgcaacgaaaacagaggagattcgttatgccgctaggaaacctggcggcagcgcaaaagatg

SEQ ID NO: 32475 - DNA, 103 bp, Artificial Sequence
  Synthetic Polynucleotide
taatacgactcactatagggtgtaatgaacccgatggactagactaaacaaacagaggagatgtttaatgtagtccatcaacctggcggcagcgcaaaagatg

SEQ ID NO: 32476 - DNA, 103 bp, Artificial Sequence
  Synthetic Polynucleotide
taatacgactcactatagggcaagcactcagcacccacactgatttggggaacagaggagaccccaaatgagtgtgggtaacctggcggcagcgcaaaagatg

SEQ ID NO: 32477 - DNA, 103 bp, Artificial Sequence
  Synthetic Polynucleotide
taatacgactcactatagggggacaaacgctttcccgggcacgcattccaaacagaggagatggaatatgtgcccgggaaacctggcggcagcgcaaaagatg

SEQ ID NO: 32478 - DNA, 103 bp, Artificial Sequence
  Synthetic Polynucleotide
taatacgactcactatagggtatagcatggccgtgccatttcacctgatgaacagaggagacatcagatgaaatggcacaacctggcggcagcgcaaaagatg

SEQ ID NO: 32479 - DNA, 103 bp, Artificial Sequence
  Synthetic Polynucleotide
taatacgactcactatagggcctaagtctgggatgtctctcggtgctgtaaacagaggagatacagcatggagagacataacctggcggcagcgcaaaagatg

SEQ ID NO: 32480 - DNA, 103 bp, Artificial Sequence
  Synthetic Polynucleotide
taatacgactcactatagggcaagttgaggtaggttctatgcactatgtcaacagaggagagacataatgcatagaaccaacctggcggcagcgcaaaagatg

SEQ ID NO: 32481 - DNA, 103 bp, Artificial Sequence
  Synthetic Polynucleotide
taatacgactcactatagggcacaggagtgtctatggaccaagcctgaataacagaggagaattcagatgtggtccataaacctggcggcagcgcaaaagatg

SEQ ID NO: 32482 - DNA, 103 bp, Artificial Sequence
  Synthetic Polynucleotide
taatacgactcactatagggcctgggggtctcattacatccccgaggacgaacagaggagacgtcctatgggatgtaataacctggcggcagcgcaaaagatg

SEQ ID NO: 32483 - DNA, 103 bp, Artificial Sequence
  Synthetic Polynucleotide
taatacgactcactatagggtccaccagaagtactcccatcatacagaagaacagaggagacttctgatggatgggagtaacctggcggcagcgcaaaagatg

SEQ ID NO: 32484 - DNA, 103 bp, Artificial Sequence
  Synthetic Polynucleotide
taatacgactcactatagggagccctaagcagtaacgcgttgcacattgtaacagaggagaacaatgatgaacgcgttaaacctggcggcagcgcaaaagatg

SEQ ID NO: 32485 - DNA, 103 bp, Artificial Sequence
  Synthetic Polynucleotide
taatacgactcactatagggtcacctcgatgggccataacagggtgtacaaacagaggagatgtacaatgtgttatggcaacctggcggcagcgcaaaagatg

SEQ ID NO: 32486 - DNA, 103 bp, Artificial Sequence
  Synthetic Polynucleotide
taatacgactcactatagggtagggataacgacatgtgcctacgcgcgtaaacagaggagatacgcgatgaggcacatgaacctggcggcagcgcaaaagatg

SEQ ID NO: 32487 - DNA, 103 bp, Artificial Sequence
  Synthetic Polynucleotide
taatacgactcactatagggaacgtttgagggagatgcacattaggagtaaacagaggagatactccatgtgtgcatctaacctggcggcagcgcaaaagatg

SEQ ID NO: 32488 - DNA, 103 bp, Artificial Sequence
  Synthetic Polynucleotide
taatacgactcactatagggcgtacgcggtttgttctataaaagggttcgaacagaggagacgaaccatgttatagaacaacctggcggcagcgcaaaagatg

SEQ ID NO: 32489 - DNA, 103 bp, Artificial Sequence
  Synthetic Polynucleotide
taatacgactcactatagggagctgagagggccttaataattcaaaatacaacagaggagagtatttatgattattaagaacctggcggcagcgcaaaagatg

SEQ ID NO: 32490 - DNA, 103 bp, Artificial Sequence
  Synthetic Polynucleotide
taatacgactcactatagggcggccgcatacgcgtgtttcgcacgcgaccaacagaggagaggtcgcatgcgaaacacgaacctggcggcagcgcaaaagatg

SEQ ID NO: 32491 - DNA, 103 bp, Artificial Sequence
  Synthetic Polynucleotide
taatacgactcactataggggcgtactcgtggcggttcgagacaaggggaaacagaggagatcccctatgctcgaaccgaacctggcggcagcgcaaaagatg

SEQ ID NO: 32492 - DNA, 103 bp, Artificial Sequence
  Synthetic Polynucleotide
taatacgactcactataggggtaaaaaggctgtttagacttagggggtgcaacagaggagagcacccatgaagtctaaaaacctggcggcagcgcaaaagatg

SEQ ID NO: 32493 - DNA, 103 bp, Artificial Sequence
  Synthetic Polynucleotide
taatacgactcactatagggttaacggtagtatacccccaagagcaccagaacagaggagactggtgatgttgggggtaaacctggcggcagcgcaaaagatg

SEQ ID NO: 32494 - DNA, 103 bp, Artificial Sequence
  Synthetic Polynucleotide
taatacgactcactatagggaggttcccgcaggattgtctgatcagtgataacagaggagaatcactatgcagacaatcaacctggcggcagcgcaaaagatg

SEQ ID NO: 32495 - DNA, 103 bp, Artificial Sequence
  Synthetic Polynucleotide
taatacgactcactataggggcactcaataccatagaccaaattaaagagaacagaggagactctttatgttggtctataacctggcggcagcgcaaaagatg

SEQ ID NO: 32496 - DNA, 103 bp, Artificial Sequence
  Synthetic Polynucleotide
taatacgactcactatagggatctattgactgacagtcggctgatatcaaaacagaggagattgataatggccgactgtaacctggcggcagcgcaaaagatg

SEQ ID NO: 32497 - DNA, 103 bp, Artificial Sequence
  Synthetic Polynucleotide
taatacgactcactatagggctatgctattactgtccctcggtaacttcaaacagaggagatgaagtatgcgagggacaaacctggcggcagcgcaaaagatg

SEQ ID NO: 32498 - DNA, 103 bp, Artificial Sequence
  Synthetic Polynucleotide
taatacgactcactatagggtggagtatgactctcattgctcctcagctcaacagaggagagagctgatgagcaatgagaacctggcggcagcgcaaaagatg

SEQ ID NO: 32499 - DNA, 103 bp, Artificial Sequence
  Synthetic Polynucleotide
taatacgactcactatagggcttgccctacactggccgcgaaatcggcccaacagaggagagggccgatgtcgcggccaaacctggcggcagcgcaaaagatg

SEQ ID NO: 32500 - DNA, 103 bp, Artificial Sequence
  Synthetic Polynucleotide
taatacgactcactataggggggcctaggcgtgcgcaaggaggtgccgataacagaggagaatcggcatgtccttgcgcaacctggcggcagcgcaaaagatg

SEQ ID NO: 32501 - DNA, 103 bp, Artificial Sequence
  Synthetic Polynucleotide
taatacgactcactatagggactacacgaaaacgttgcgctaagaccattaacagaggagaaatggtatgagcgcaacgaacctggcggcagcgcaaaagatg

SEQ ID NO: 32502 - DNA, 103 bp, Artificial Sequence
  Synthetic Polynucleotide
taatacgactcactatagggggttcgtgacagtgtggggcccttttgagtaacagaggagaactcaaatgggccccacaaacctggcggcagcgcaaaagatg

SEQ ID NO: 32503 - DNA, 103 bp, Artificial Sequence
  Synthetic Polynucleotide
taatacgactcactatagggaatgttcgacaagctggagcccatattcggaacagaggagaccgaatatgggctccagcaacctggcggcagcgcaaaagatg

SEQ ID NO: 32504 - DNA, 103 bp, Artificial Sequence
  Synthetic Polynucleotide
taatacgactcactataggggtaactgatgcttgattatcacttcaaagaaacagaggagatctttgatgtgataatcaaacctggcggcagcgcaaaagatg

SEQ ID NO: 32505 - DNA, 103 bp, Artificial Sequence
  Synthetic Polynucleotide
taatacgactcactatagggcttacaggggtcgacaggtgtcgtcgttggaacagaggagaccaacgatgacacctgtcaacctggcggcagcgcaaaagatg

SEQ ID NO: 32506 - DNA, 103 bp, Artificial Sequence
  Synthetic Polynucleotide
taatacgactcactatagggctataattctccttacttaagtccctcgtcaacagaggagagacgagatgcttaagtaaaacctggcggcagcgcaaaagatg

SEQ ID NO: 32507 - DNA, 103 bp, Artificial Sequence
  Synthetic Polynucleotide
taatacgactcactatagggtgactaatgtatagtcttaacatcgccttgaacagaggagacaaggcatggttaagactaacctggcggcagcgcaaaagatg

SEQ ID NO: 32508 - DNA, 103 bp, Artificial Sequence
  Synthetic Polynucleotide
taatacgactcactatagggtatactggatagcaccgtgtttgataggagaacagaggagactcctaatgaacacggtgaacctggcggcagcgcaaaagatg

SEQ ID NO: 32509 - DNA, 103 bp, Artificial Sequence
  Synthetic Polynucleotide
taatacgactcactatagggcgccatgcctagggcattcgaaaaagagttaacagaggagaaactctatgtcgaatgccaacctggcggcagcgcaaaagatg

SEQ ID NO: 32510 - DNA, 103 bp, Artificial Sequence
  Synthetic Polynucleotide
taatacgactcactatagggtgtgttaatcgtgctagtcgctgtattatcaacagaggagagataatatggcgactagcaacctggcggcagcgcaaaagatg

SEQ ID NO: 32511 - DNA, 103 bp, Artificial Sequence
  Synthetic Polynucleotide
taatacgactcactatagggcgtagagttgtacccagtaggttatcgtgaaacagaggagatcacgaatgcctactgggaacctggcggcagcgcaaaagatg

SEQ ID NO: 32512 - DNA, 103 bp, Artificial Sequence
  Synthetic Polynucleotide
taatacgactcactatagggaaccgtcaccgtttgggagaaaccgagtttaacagaggagaaaactcatgttctcccaaaacctggcggcagcgcaaaagatg

SEQ ID NO: 32513 - DNA, 103 bp, Artificial Sequence
  Synthetic Polynucleotide
taatacgactcactatagggtcaatgttgacaggtctggggatacttgtcaacagaggagagacaagatgccccagaccaacctggcggcagcgcaaaagatg

SEQ ID NO: 32514 - DNA, 103 bp, Artificial Sequence
  Synthetic Polynucleotide
taatacgactcactatagggcaacattttagataagtattctggcaccttaacagaggagaaaggtgatggaatacttaaacctggcggcagcgcaaaagatg

SEQ ID NO: 32515 - DNA, 103 bp, Artificial Sequence
  Synthetic Polynucleotide
taatacgactcactatagggttaccaagcagaaccgggggttcctatgtgaacagaggagacacataatgacccccggtaacctggcggcagcgcaaaagatg

SEQ ID NO: 32516 - DNA, 103 bp, Artificial Sequence
  Synthetic Polynucleotide
taatacgactcactatagggaaatcggcgaaaccgtgtgcgggagagaagaacagaggagacttctcatgcgcacacggaacctggcggcagcgcaaaagatg

SEQ ID NO: 32517 - DNA, 103 bp, Artificial Sequence
  Synthetic Polynucleotide
taatacgactcactatagggctattatactgacggacccagtacttactcaacagaggagagagtaaatgctgggtccgaacctggcggcagcgcaaaagatg

SEQ ID NO: 32518 - DNA, 103 bp, Artificial Sequence
  Synthetic Polynucleotide
taatacgactcactatagggcccccacgttattatcattgaccaacacgaaacagaggagatcgtgtatgtcaatgataaacctggcggcagcgcaaaagatg

SEQ ID NO: 32519 - DNA, 103 bp, Artificial Sequence
  Synthetic Polynucleotide
taatacgactcactatagggcgtgctcggcatgtccatagggagtagccaaacagaggagatggctaatgcctatggacaacctggcggcagcgcaaaagatg

SEQ ID NO: 32520 - DNA, 103 bp, Artificial Sequence
  Synthetic Polynucleotide
taatacgactcactatagggatataggaggatgaactgttggccgcgactaacagaggagaagtcgcatgcaacagttcaacctggcggcagcgcaaaagatg

SEQ ID NO: 32521 - DNA, 103 bp, Artificial Sequence
  Synthetic Polynucleotide
taatacgactcactatagggtacaagcttaccgtcgtcccctaccatatgaacagaggagacatatgatgggggacgacaacctggcggcagcgcaaaagatg

SEQ ID NO: 32522 - DNA, 103 bp, Artificial Sequence
  Synthetic Polynucleotide
taatacgactcactataggggctttgataattgtgggttcttgaacatttaacagaggagaaaatgtatgagaacccacaacctggcggcagcgcaaaagatg

SEQ ID NO: 32523 - DNA, 103 bp, Artificial Sequence
  Synthetic Polynucleotide
taatacgactcactatagggtggtcaccgacgcctttcctagagcgggtcaacagaggagagacccgatgtaggaaaggaacctggcggcagcgcaaaagatg

SEQ ID NO: 32524 - DNA, 103 bp, Artificial Sequence
  Synthetic Polynucleotide
taatacgactcactatagggtttcccccacctgggtactaactaggccaaaacagaggagattggccatgttagtacccaacctggcggcagcgcaaaagatg

SEQ ID NO: 32525 - DNA, 103 bp, Artificial Sequence
  Synthetic Polynucleotide
taatacgactcactataggggttgacgacggaattttccggcgtaagtcgaacagaggagacgacttatgccggaaaataacctggcggcagcgcaaaagatg

SEQ ID NO: 32526 - DNA, 103 bp, Artificial Sequence
  Synthetic Polynucleotide
taatacgactcactataggggaaacagcgctggtatatccatggaaagataacagaggagaatctttatgtggatatacaacctggcggcagcgcaaaagatg

SEQ ID NO: 32527 - DNA, 103 bp, Artificial Sequence
  Synthetic Polynucleotide
taatacgactcactatagggacgaaacggtgcgccctgtaccagtacagcaacagaggagagctgtaatggtacagggcaacctggcggcagcgcaaaagatg

SEQ ID NO: 32528 - DNA, 103 bp, Artificial Sequence
  Synthetic Polynucleotide
taatacgactcactatagggcccatgttgaacggcggctgaaggtcagataacagaggagaatctgaatgtcagccgccaacctggcggcagcgcaaaagatg

SEQ ID NO: 32529 - DNA, 103 bp, Artificial Sequence
  Synthetic Polynucleotide
taatacgactcactatagggataaccctattccgtcgcgctatccagtataacagaggagaatactgatgagcgcgacgaacctggcggcagcgcaaaagatg

SEQ ID NO: 32530 - DNA, 103 bp, Artificial Sequence
  Synthetic Polynucleotide
taatacgactcactatagggcgagttgcggctcgggaggccggtgacatgaacagaggagacatgtcatgggcctcccgaacctggcggcagcgcaaaagatg

SEQ ID NO: 32531 - DNA, 103 bp, Artificial Sequence
  Synthetic Polynucleotide
taatacgactcactatagggggatatgagcgctaatcccgcacagtgccaaacagaggagatggcacatggcgggattaaacctggcggcagcgcaaaagatg

SEQ ID NO: 32532 - DNA, 103 bp, Artificial Sequence
  Synthetic Polynucleotide
taatacgactcactataggggcgctcccatgtgtaacaagggatatcctaaacagaggagataggatatgccttgttacaacctggcggcagcgcaaaagatg

SEQ ID NO: 32533 - DNA, 103 bp, Artificial Sequence
  Synthetic Polynucleotide
taatacgactcactatagggatcttccggacgttataagcgctccgtgtaaacagaggagatacacgatgcgcttataaaacctggcggcagcgcaaaagatg

SEQ ID NO: 32534 - DNA, 103 bp, Artificial Sequence
  Synthetic Polynucleotide
taatacgactcactatagggggggtactaatgtaggggggccccaagcgtaacagaggagaacgcttatggcccccctaaacctggcggcagcgcaaaagatg

SEQ ID NO: 32535 - DNA, 103 bp, Artificial Sequence
  Synthetic Polynucleotide
taatacgactcactatagggagctcgaggatctacgcagaccgtcaataaaacagaggagattattgatggtctgcgtaaacctggcggcagcgcaaaagatg

SEQ ID NO: 32536 - DNA, 103 bp, Artificial Sequence
  Synthetic Polynucleotide
taatacgactcactatagggtcctttgtggggtcgcctctcggtggatggaacagaggagaccatccatggagaggcgaaacctggcggcagcgcaaaagatg

SEQ ID NO: 32537 - DNA, 103 bp, Artificial Sequence
  Synthetic Polynucleotide
taatacgactcactatagggggtttcgctgaccttgggtctaacgacaggaacagaggagacctgtcatgagacccaagaacctggcggcagcgcaaaagatg

SEQ ID NO: 32538 - DNA, 103 bp, Artificial Sequence
  Synthetic Polynucleotide
taatacgactcactatagggtagggtaggcatacataattactcgctcagaacagaggagactgagcatgtaattatgtaacctggcggcagcgcaaaagatg

SEQ ID NO: 32539 - DNA, 103 bp, Artificial Sequence
  Synthetic Polynucleotide
taatacgactcactatagggttcaacctcgcataagaaattgctgggaaaaacagaggagatttcccatgaatttcttaaacctggcggcagcgcaaaagatg

SEQ ID NO: 32540 - DNA, 103 bp, Artificial Sequence
  Synthetic Polynucleotide
taatacgactcactatagggcggttagaaatatgcagtcgaccaagaaggaacagaggagaccttctatgtcgactgcaaacctggcggcagcgcaaaagatg

SEQ ID NO: 32541 - DNA, 103 bp, Artificial Sequence
  Synthetic Polynucleotide
taatacgactcactatagggagacaagcaggcgttgttagcgattaccctaacagaggagaagggtaatggctaacaacaacctggcggcagcgcaaaagatg

SEQ ID NO: 32542 - DNA, 103 bp, Artificial Sequence
  Synthetic Polynucleotide
taatacgactcactatagggggagtacaaacctacgcaccggctgaatataacagaggagaatattcatgcggtgcgtaaacctggcggcagcgcaaaagatg

SEQ ID NO: 32543 - DNA, 103 bp, Artificial Sequence
  Synthetic Polynucleotide
taatacgactcactatagggccattggcccagactcgctccctgaaaccgaacagaggagacggtttatgggagcgagtaacctggcggcagcgcaaaagatg

SEQ ID NO: 32544 - DNA, 103 bp, Artificial Sequence
  Synthetic Polynucleotide
taatacgactcactatagggggcctcgcgatgtctatggtgaaatctgataacagaggagaatcagaatgcaccatagaaacctggcggcagcgcaaaagatg

SEQ ID NO: 32545 - DNA, 103 bp, Artificial Sequence
  Synthetic Polynucleotide
taatacgactcactatagggcccccacgcgaacggtcgtgtgaagtctataacagaggagaatagacatgacacgaccgaacctggcggcagcgcaaaagatg

SEQ ID NO: 32546 - DNA, 103 bp, Artificial Sequence
  Synthetic Polynucleotide
taatacgactcactatagggtatttcgagatggaaagcgtttcttgtgggaacagaggagacccacaatgaacgctttcaacctggcggcagcgcaaaagatg

SEQ ID NO: 32547 - DNA, 103 bp, Artificial Sequence
  Synthetic Polynucleotide
taatacgactcactatagggtccaggcccaaaacacacttggtgattcgaaacagaggagatcgaatatgcaagtgtgtaacctggcggcagcgcaaaagatg

SEQ ID NO: 32548 - DNA, 103 bp, Artificial Sequence
  Synthetic Polynucleotide
taatacgactcactatagggtaaccttggctttgggctgtcactaaaccaaacagaggagatggtttatggacagcccaaacctggcggcagcgcaaaagatg

SEQ ID NO: 32549 - DNA, 103 bp, Artificial Sequence
  Synthetic Polynucleotide
taatacgactcactataggggtcacaattgggacaccttgtggaggatttaacagaggagaaaatccatgacaaggtgtaacctggcggcagcgcaaaagatg

SEQ ID NO: 32550 - DNA, 103 bp, Artificial Sequence
  Synthetic Polynucleotide
taatacgactcactatagggatgtcaaccagtcaccgggcacggtatgtgaacagaggagacacataatgtgcccggtgaacctggcggcagcgcaaaagatg

SEQ ID NO: 32551 - DNA, 103 bp, Artificial Sequence
  Synthetic Polynucleotide
taatacgactcactatagggggaatagcgtttcggtcgcttgttaatctcaacagaggagagagattatgaagcgaccgaacctggcggcagcgcaaaagatg

SEQ ID NO: 32552 - DNA, 103 bp, Artificial Sequence
  Synthetic Polynucleotide
taatacgactcactatagggttagtaaacgatgcgggatctgaagtataaaacagaggagattatacatgagatcccgcaacctggcggcagcgcaaaagatg

SEQ ID NO: 32553 - DNA, 103 bp, Artificial Sequence
  Synthetic Polynucleotide
taatacgactcactatagggcctacgtgtatacactagctgacccgtggtaacagaggagaaccacgatgcagctagtgaacctggcggcagcgcaaaagatg

SEQ ID NO: 32554 - DNA, 103 bp, Artificial Sequence
  Synthetic Polynucleotide
taatacgactcactatagggggcagggctcagggtctatgaatccctctcaacagaggagagagaggatgtcatagaccaacctggcggcagcgcaaaagatg

SEQ ID NO: 32555 - DNA, 103 bp, Artificial Sequence
  Synthetic Polynucleotide
taatacgactcactatagggtcagggaggtatgggatattaccgttacaaaacagaggagattgtaaatgtaatatcccaacctggcggcagcgcaaaagatg

SEQ ID NO: 32556 - DNA, 103 bp, Artificial Sequence
  Synthetic Polynucleotide
taatacgactcactatagggcaggtttgtttcctatgccggagatccgttaacagaggagaaacggaatgccggcatagaacctggcggcagcgcaaaagatg

SEQ ID NO: 32557 - DNA, 103 bp, Artificial Sequence
  Synthetic Polynucleotide
taatacgactcactataggggttcggaaatctgtgtcaagacctgcccttaacagaggagaaagggcatgtcttgacacaacctggcggcagcgcaaaagatg

SEQ ID NO: 32558 - DNA, 103 bp, Artificial Sequence
  Synthetic Polynucleotide
taatacgactcactatagggaggcgtctccatcgcggtgtccagcgacggaacagaggagaccgtcgatggacaccgcgaacctggcggcagcgcaaaagatg

SEQ ID NO: 32559 - DNA, 103 bp, Artificial Sequence
  Synthetic Polynucleotide
taatacgactcactatagggtttgtcgcactcttgaagacacctgacgaaaacagaggagattcgtcatgtgtcttcaaaacctggcggcagcgcaaaagatg

SEQ ID NO: 32560 - DNA, 103 bp, Artificial Sequence
  Synthetic Polynucleotide
taatacgactcactatagggatacgaggtgaactggaagaggtccctcggaacagaggagaccgaggatgctcttccagaacctggcggcagcgcaaaagatg

SEQ ID NO: 32561 - DNA, 103 bp, Artificial Sequence
  Synthetic Polynucleotide
taatacgactcactatagggtttaacgtgggatttgatacagggcgcttaaacagaggagataagcgatgtgtatcaaaaacctggcggcagcgcaaaagatg

SEQ ID NO: 32562 - DNA, 103 bp, Artificial Sequence
  Synthetic Polynucleotide
taatacgactcactatagggctcaacatcatatggcaattcaagtaaccgaacagaggagacggttaatggaattgccaaacctggcggcagcgcaaaagatg

SEQ ID NO: 32563 - DNA, 103 bp, Artificial Sequence
  Synthetic Polynucleotide
taatacgactcactataggggcccatttcccctgcaagaataatcgcctaaacagaggagataggcgatgattcttgcaaacctggcggcagcgcaaaagatg

SEQ ID NO: 32564 - DNA, 103 bp, Artificial Sequence
  Synthetic Polynucleotide
taatacgactcactatagggtttgatactcattgttcagtactatggcaaaacagaggagattgccaatgtactgaacaaacctggcggcagcgcaaaagatg

SEQ ID NO: 32565 - DNA, 103 bp, Artificial Sequence
  Synthetic Polynucleotide
taatacgactcactatagggtgtatacgtatagagtcacccttggagccgaacagaggagacggctcatggggtgactcaacctggcggcagcgcaaaagatg

SEQ ID NO: 32566 - DNA, 103 bp, Artificial Sequence
  Synthetic Polynucleotide
taatacgactcactatagggactacagttctcagttgtgagagatctgggaacagaggagacccagaatgctcacaactaacctggcggcagcgcaaaagatg

SEQ ID NO: 32567 - DNA, 103 bp, Artificial Sequence
  Synthetic Polynucleotide
taatacgactcactatagggaaatacctcttcctactctcaccgagttggaacagaggagaccaactatgtgagagtagaacctggcggcagcgcaaaagatg

SEQ ID NO: 32568 - DNA, 103 bp, Artificial Sequence
  Synthetic Polynucleotide
taatacgactcactatagggtacgggtaatacgtctggcatgaaagcgtaaacagaggagatacgctatgatgccagacaacctggcggcagcgcaaaagatg

SEQ ID NO: 32569 - DNA, 103 bp, Artificial Sequence
  Synthetic Polynucleotide
taatacgactcactataggggctgactttaaacaagtatcccgccacgtaaacagaggagatacgtgatgggatacttgaacctggcggcagcgcaaaagatg

SEQ ID NO: 32570 - DNA, 103 bp, Artificial Sequence
  Synthetic Polynucleotide
taatacgactcactataggggtctctattagataacactttccaatcagcaacagaggagagctgatatgaaagtgttaaacctggcggcagcgcaaaagatg

SEQ ID NO: 32571 - DNA, 103 bp, Artificial Sequence
  Synthetic Polynucleotide
taatacgactcactatagggtggctaggagctatcttcatacaatctgccaacagaggagaggcagaatgtatgaagataacctggcggcagcgcaaaagatg

SEQ ID NO: 32572 - DNA, 103 bp, Artificial Sequence
  Synthetic Polynucleotide
taatacgactcactatagggcccgctatagtctgccgcataactccaccaaacagaggagatggtggatgtatgcggcaaacctggcggcagcgcaaaagatg

SEQ ID NO: 32573 - DNA, 103 bp, Artificial Sequence
  Synthetic Polynucleotide
taatacgactcactatagggggcggttataaccatatcacactgccatataacagaggagaatatggatgtgtgatatgaacctggcggcagcgcaaaagatg

SEQ ID NO: 32574 - DNA, 103 bp, Artificial Sequence
  Synthetic Polynucleotide
taatacgactcactatagggagtaatcggatataagtttgaagaaccgcgaacagaggagacgcggtatgtcaaacttaaacctggcggcagcgcaaaagatg

SEQ ID NO: 32575 - DNA, 103 bp, Artificial Sequence
  Synthetic Polynucleotide
taatacgactcactatagggttttggaataagaagacgacgatggaccgaaacagaggagatcggtcatgcgtcgtcttaacctggcggcagcgcaaaagatg

SEQ ID NO: 32576 - DNA, 103 bp, Artificial Sequence
  Synthetic Polynucleotide
taatacgactcactatagggatagggcgtacagaaattcagatagtgctaaacagaggagatagcacatgctgaatttcaacctggcggcagcgcaaaagatg

SEQ ID NO: 32577 - DNA, 103 bp, Artificial Sequence
  Synthetic Polynucleotide
taatacgactcactatagggtttattgcctgtccaggttagaaatcagtaaacagaggagatactgaatgctaacctggaacctggcggcagcgcaaaagatg

SEQ ID NO: 32578 - DNA, 103 bp, Artificial Sequence
  Synthetic Polynucleotide
taatacgactcactataggggaatcgcgatctaggttagaggtgaaacccaacagaggagagggtttatgctctaacctaacctggcggcagcgcaaaagatg

SEQ ID NO: 32579 - DNA, 103 bp, Artificial Sequence
  Synthetic Polynucleotide
taatacgactcactatagggatactgcccgcctaatgcggtatttaaagtaacagaggagaactttaatgaccgcattaaacctggcggcagcgcaaaagatg

SEQ ID NO: 32580 - DNA, 103 bp, Artificial Sequence
  Synthetic Polynucleotide
taatacgactcactataggggagcgtgatcgtagaaagatccgaagcctaaacagaggagataggctatggatctttctaacctggcggcagcgcaaaagatg

SEQ ID NO: 32581 - DNA, 103 bp, Artificial Sequence
  Synthetic Polynucleotide
taatacgactcactataggggaggaaaccatgactttgtgtcaccctggaaacagaggagatccaggatgacacaaagtaacctggcggcagcgcaaaagatg

SEQ ID NO: 32582 - DNA, 103 bp, Artificial Sequence
  Synthetic Polynucleotide
taatacgactcactatagggataaaatgttgcggaagtgtgctccatactaacagaggagaagtatgatgcacacttccaacctggcggcagcgcaaaagatg

SEQ ID NO: 32583 - DNA, 103 bp, Artificial Sequence
  Synthetic Polynucleotide
taatacgactcactatagggaaagacagcagccgcactcggcagatctgtaacagaggagaacagatatgccgagtgcgaacctggcggcagcgcaaaagatg

SEQ ID NO: 32584 - DNA, 103 bp, Artificial Sequence
  Synthetic Polynucleotide
taatacgactcactatagggcaatgaacggcacgattggttcgcactagtaacagaggagaactagtatgaaccaatcgaacctggcggcagcgcaaaagatg

SEQ ID NO: 32585 - DNA, 103 bp, Artificial Sequence
  Synthetic Polynucleotide
taatacgactcactataggggaaggccgtggcggggtttgggaccgccacaacagaggagagtggcgatgccaaaccccaacctggcggcagcgcaaaagatg

SEQ ID NO: 32586 - DNA, 103 bp, Artificial Sequence
  Synthetic Polynucleotide
taatacgactcactatagggcgtgtaagacggcttaatcatcttcccaggaacagaggagacctgggatgatgattaagaacctggcggcagcgcaaaagatg

SEQ ID NO: 32587 - DNA, 103 bp, Artificial Sequence
  Synthetic Polynucleotide
taatacgactcactataggggcgcaacggcagactgactggtcgttttgaaacagaggagatcaaaaatgccagtcagtaacctggcggcagcgcaaaagatg

SEQ ID NO: 32588 - DNA, 103 bp, Artificial Sequence
  Synthetic Polynucleotide
taatacgactcactataggggcgatgttgcctcggctgatcgtaaagtggaacagaggagaccacttatggatcagccgaacctggcggcagcgcaaaagatg

SEQ ID NO: 32589 - DNA, 103 bp, Artificial Sequence
  Synthetic Polynucleotide
taatacgactcactatagggactggtagctgccaacgaaaggccactcagaacagaggagactgagtatgctttcgttgaacctggcggcagcgcaaaagatg

SEQ ID NO: 32590 - DNA, 103 bp, Artificial Sequence
  Synthetic Polynucleotide
taatacgactcactataggggacgccctactcgtgctaatcttctaacgaaacagaggagatcgttaatggattagcacaacctggcggcagcgcaaaagatg

SEQ ID NO: 32591 - DNA, 103 bp, Artificial Sequence
  Synthetic Polynucleotide
taatacgactcactatagggcttttgattccgcaaacttgggagatttcgaacagaggagacgaaatatgccaagtttgaacctggcggcagcgcaaaagatg

SEQ ID NO: 32592 - DNA, 103 bp, Artificial Sequence
  Synthetic Polynucleotide
taatacgactcactatagggatagtaaagaaagtgtcggagtatcttagaaacagaggagatctaagatgctccgacacaacctggcggcagcgcaaaagatg

SEQ ID NO: 32593 - DNA, 103 bp, Artificial Sequence
  Synthetic Polynucleotide
taatacgactcactatagggcgtttcacgcccggccagggcccagcttcaaacagaggagatgaagcatggccctggccaacctggcggcagcgcaaaagatg

SEQ ID NO: 32594 - DNA, 103 bp, Artificial Sequence
  Synthetic Polynucleotide
taatacgactcactatagggatgataactaactcttccggagaataatcgaacagaggagacgattaatgtccggaagaaacctggcggcagcgcaaaagatg

SEQ ID NO: 32595 - DNA, 103 bp, Artificial Sequence
  Synthetic Polynucleotide
taatacgactcactatagggatgtatctttgttagcaggagcttgaaagaaacagaggagatctttcatgctcctgctaaacctggcggcagcgcaaaagatg

SEQ ID NO: 32596 - DNA, 103 bp, Artificial Sequence
  Synthetic Polynucleotide
taatacgactcactatagggacaatgatggcgccgttagggccggttgcaaacagaggagatgcaacatgccctaacggaacctggcggcagcgcaaaagatg

SEQ ID NO: 32597 - DNA, 103 bp, Artificial Sequence
  Synthetic Polynucleotide
taatacgactcactataggggatctatttcaaatacagctcctaggacttaacagaggagaaagtccatggagctgtataacctggcggcagcgcaaaagatg

SEQ ID NO: 32598 - DNA, 103 bp, Artificial Sequence
  Synthetic Polynucleotide
taatacgactcactatagggattaccaaccaatccggtgatcagtccgacaacagaggagagtcggaatgatcaccggaaacctggcggcagcgcaaaagatg

SEQ ID NO: 32599 - DNA, 103 bp, Artificial Sequence
  Synthetic Polynucleotide
taatacgactcactatagggatacacgctgctctataattctatctttagaacagaggagactaaagatggaattatagaacctggcggcagcgcaaaagatg

SEQ ID NO: 32600 - DNA, 103 bp, Artificial Sequence
  Synthetic Polynucleotide
taatacgactcactatagggggtattgctacggggcgtgcaaatatgaaaaacagaggagatttcatatgtgcacgcccaacctggcggcagcgcaaaagatg

SEQ ID NO: 32601 - DNA, 103 bp, Artificial Sequence
  Synthetic Polynucleotide
taatacgactcactatagggattgcccatactatctgccgagatgggaaaaacagaggagatttcccatgtcggcagataacctggcggcagcgcaaaagatg

SEQ ID NO: 32602 - DNA, 103 bp, Artificial Sequence
  Synthetic Polynucleotide
taatacgactcactataggggtatccgtaaggaaccgagcagacagggtgaacagaggagacaccctatgtgctcggttaacctggcggcagcgcaaaagatg

SEQ ID NO: 32603 - DNA, 103 bp, Artificial Sequence
  Synthetic Polynucleotide
taatacgactcactataggggacatatggaagtgtcggcttggagctactaacagaggagaagtagcatgaagccgacaaacctggcggcagcgcaaaagatg

SEQ ID NO: 32604 - DNA, 103 bp, Artificial Sequence
  Synthetic Polynucleotide
taatacgactcactataggggcaccatagagaacgcgatccggctaatttaacagaggagaaaattaatgggatcgcgtaacctggcggcagcgcaaaagatg

SEQ ID NO: 32605 - DNA, 103 bp, Artificial Sequence
  Synthetic Polynucleotide
taatacgactcactatagggcaaattatgtacgccttagacctggactgcaacagaggagagcagtcatggtctaaggcaacctggcggcagcgcaaaagatg

SEQ ID NO: 32606 - DNA, 103 bp, Artificial Sequence
  Synthetic Polynucleotide
taatacgactcactatagggcccgacgataagaaatgtaaaccgaccggcaacagaggagagccggtatgtttacatttaacctggcggcagcgcaaaagatg

SEQ ID NO: 32607 - DNA, 103 bp, Artificial Sequence
  Synthetic Polynucleotide
taatacgactcactatagggacactacggaacctcgcctcttgttgtaaaaacagaggagatttacaatgagaggcgagaacctggcggcagcgcaaaagatg

SEQ ID NO: 32608 - DNA, 103 bp, Artificial Sequence
  Synthetic Polynucleotide
taatacgactcactatagggatatattctcgtgagtttctactagttgtgaacagaggagacacaacatgtagaaactcaacctggcggcagcgcaaaagatg

SEQ ID NO: 32609 - DNA, 103 bp, Artificial Sequence
  Synthetic Polynucleotide
taatacgactcactatagggaagcgcgagagctccgaaccagaaaatcagaacagaggagactgattatgtggttcggaaacctggcggcagcgcaaaagatg

SEQ ID NO: 32610 - DNA, 103 bp, Artificial Sequence
  Synthetic Polynucleotide
taatacgactcactatagggtagtaagaacggaactccgttggtatgtgcaacagaggagagcacatatgaacggagttaacctggcggcagcgcaaaagatg

SEQ ID NO: 32611 - DNA, 103 bp, Artificial Sequence
  Synthetic Polynucleotide
taatacgactcactatagggtcgtttatgtgagtttttgtgtccaaatgcaacagaggagagcatttatgcacaaaaacaacctggcggcagcgcaaaagatg

SEQ ID NO: 32612 - DNA, 103 bp, Artificial Sequence
  Synthetic Polynucleotide
taatacgactcactatagggacgctatatattgaagatcacgcggtttctaacagaggagaagaaacatggtgatcttcaacctggcggcagcgcaaaagatg

SEQ ID NO: 32613 - DNA, 103 bp, Artificial Sequence
  Synthetic Polynucleotide
taatacgactcactatagggtgtagccgcccgacagcttttacgtgccgaaacagaggagatcggcaatgaaaagctgtaacctggcggcagcgcaaaagatg

SEQ ID NO: 32614 - DNA, 103 bp, Artificial Sequence
  Synthetic Polynucleotide
taatacgactcactatagggtggtcaacgctcggcttacaaagcgtcgttaacagaggagaaacgacatgttgtaagccaacctggcggcagcgcaaaagatg

SEQ ID NO: 32615 - DNA, 103 bp, Artificial Sequence
  Synthetic Polynucleotide
taatacgactcactatagggggatgatccaccggcgtagacgctgaactaaacagaggagatagttcatggtctacgccaacctggcggcagcgcaaaagatg

SEQ ID NO: 32616 - DNA, 103 bp, Artificial Sequence
  Synthetic Polynucleotide
taatacgactcactatagggctttttatggaacgcatgttcctggcacagaacagaggagactgtgcatggaacatgcgaacctggcggcagcgcaaaagatg

SEQ ID NO: 32617 - DNA, 103 bp, Artificial Sequence
  Synthetic Polynucleotide
taatacgactcactatagggctgatctacagggccgcggtaaagttctagaacagaggagactagaaatgtaccgcggcaacctggcggcagcgcaaaagatg

SEQ ID NO: 32618 - DNA, 103 bp, Artificial Sequence
  Synthetic Polynucleotide
taatacgactcactatagggcacaaacgaacacaagttcggttccggagaaacagaggagatctccgatgccgaacttgaacctggcggcagcgcaaaagatg

SEQ ID NO: 32619 - DNA, 103 bp, Artificial Sequence
  Synthetic Polynucleotide
taatacgactcactatagggttcccatggtggggttggttggagttaagtaacagaggagaacttaaatgcaaccaaccaacctggcggcagcgcaaaagatg

SEQ ID NO: 32620 - DNA, 103 bp, Artificial Sequence
  Synthetic Polynucleotide
taatacgactcactatagggccacttgggtacttgaagagcatctggctcaacagaggagagagccaatggctcttcaaaacctggcggcagcgcaaaagatg

SEQ ID NO: 32621 - DNA, 103 bp, Artificial Sequence
  Synthetic Polynucleotide
taatacgactcactatagggcgcgtatggcttgttattcatgagtcgtaaaacagaggagattacgaatgatgaataacaacctggcggcagcgcaaaagatg

SEQ ID NO: 32622 - DNA, 103 bp, Artificial Sequence
  Synthetic Polynucleotide
taatacgactcactatagggggcagtgatggtattagatcgctagattgaaacagaggagatcaatcatgcgatctaataacctggcggcagcgcaaaagatg

SEQ ID NO: 32623 - DNA, 103 bp, Artificial Sequence
  Synthetic Polynucleotide
taatacgactcactatagggttagaaattatagagtagcctgttcgggggaacagaggagacccccgatgaggctactcaacctggcggcagcgcaaaagatg

SEQ ID NO: 32624 - DNA, 103 bp, Artificial Sequence
  Synthetic Polynucleotide
taatacgactcactatagggccacgactgagcacggatccgtctctactgaacagaggagacagtagatgcggatccgtaacctggcggcagcgcaaaagatg

SEQ ID NO: 32625 - DNA, 103 bp, Artificial Sequence
  Synthetic Polynucleotide
taatacgactcactatagggtgcatcctttgacgggaattagacgaaaggaacagaggagacctttcatgtaattcccgaacctggcggcagcgcaaaagatg

SEQ ID NO: 32626 - DNA, 103 bp, Artificial Sequence
  Synthetic Polynucleotide
taatacgactcactatagggacttacacatagcgtctggccacacgagcaaacagaggagatgctcgatgggccagacgaacctggcggcagcgcaaaagatg

SEQ ID NO: 32627 - DNA, 103 bp, Artificial Sequence
  Synthetic Polynucleotide
taatacgactcactatagggcgtggtgacgccaaccacaccgcgtcccgcaacagaggagagcgggaatgggtgtggttaacctggcggcagcgcaaaagatg

SEQ ID NO: 32628 - DNA, 103 bp, Artificial Sequence
  Synthetic Polynucleotide
taatacgactcactataggggttagtttacactcagacgtgggcggagggaacagaggagaccctccatgcacgtctgaaacctggcggcagcgcaaaagatg

SEQ ID NO: 32629 - DNA, 103 bp, Artificial Sequence
  Synthetic Polynucleotide
taatacgactcactataggggttcaataacaattgccacatgttgatattaacagaggagaaatatcatgatgtggcaaaacctggcggcagcgcaaaagatg

SEQ ID NO: 32630 - DNA, 103 bp, Artificial Sequence
  Synthetic Polynucleotide
taatacgactcactatagggacatgccaagcgagaaatgtcaggggcttcaacagaggagagaagccatggacatttctaacctggcggcagcgcaaaagatg

SEQ ID NO: 32631 - DNA, 103 bp, Artificial Sequence
  Synthetic Polynucleotide
taatacgactcactatagggttcataatgattacggccctggcgccgtaaaacagaggagattacggatgcagggccgtaacctggcggcagcgcaaaagatg

SEQ ID NO: 32632 - DNA, 103 bp, Artificial Sequence
  Synthetic Polynucleotide
taatacgactcactatagggatcgaggtagcgtgcctgcttatttacgtgaacagaggagacacgtaatgaagcaggcaaacctggcggcagcgcaaaagatg

SEQ ID NO: 32633 - DNA, 103 bp, Artificial Sequence
  Synthetic Polynucleotide
taatacgactcactatagggcttgtgacccgaacctgagattcacgtgaaaacagaggagattcacgatgatctcaggtaacctggcggcagcgcaaaagatg

SEQ ID NO: 32634 - DNA, 103 bp, Artificial Sequence
  Synthetic Polynucleotide
taatacgactcactatagggtccatagtaccacctttctactgaatttctaacagaggagaagaaatatggtagaaaggaacctggcggcagcgcaaaagatg

SEQ ID NO: 32635 - DNA, 103 bp, Artificial Sequence
  Synthetic Polynucleotide
taatacgactcactatagggattggtccatctccataggattatatgatgaacagaggagacatcatatgatcctatggaacctggcggcagcgcaaaagatg

SEQ ID NO: 32636 - DNA, 103 bp, Artificial Sequence
  Synthetic Polynucleotide
taatacgactcactatagggaccaacatgggttgcggacttgattagcggaacagaggagaccgctaatgaagtccgcaaacctggcggcagcgcaaaagatg

SEQ ID NO: 32637 - DNA, 103 bp, Artificial Sequence
  Synthetic Polynucleotide
taatacgactcactataggggatgttatttatttggtgaagatgatgtgcaacagaggagagcacatatgcttcaccaaaacctggcggcagcgcaaaagatg

SEQ ID NO: 32638 - DNA, 103 bp, Artificial Sequence
  Synthetic Polynucleotide
taatacgactcactataggggaatacagtttgtcattactgaataccgccaacagaggagaggcggtatgcagtaatgaaacctggcggcagcgcaaaagatg

SEQ ID NO: 32639 - DNA, 103 bp, Artificial Sequence
  Synthetic Polynucleotide
taatacgactcactatagggccgtcatcatagataccgggctcgtgagtcaacagaggagagactcaatggcccggtataacctggcggcagcgcaaaagatg

SEQ ID NO: 32640 - DNA, 103 bp, Artificial Sequence
  Synthetic Polynucleotide
taatacgactcactatagggcacggtctatataggagaaggtaagttactaacagaggagaagtaacatgccttctcctaacctggcggcagcgcaaaagatg

SEQ ID NO: 32641 - DNA, 103 bp, Artificial Sequence
  Synthetic Polynucleotide
taatacgactcactataggggctagcctccgagttcttctagtgcaaagcaacagaggagagctttgatgtagaagaacaacctggcggcagcgcaaaagatg

SEQ ID NO: 32642 - DNA, 103 bp, Artificial Sequence
  Synthetic Polynucleotide
taatacgactcactatagggtttgtgccatctaaacggaacggtaccgagaacagaggagactcggtatggttccgtttaacctggcggcagcgcaaaagatg

SEQ ID NO: 32643 - DNA, 103 bp, Artificial Sequence
  Synthetic Polynucleotide
taatacgactcactatagggtctaagagcacgggccgggttgttatcttcaacagaggagagaagatatgaacccggccaacctggcggcagcgcaaaagatg

SEQ ID NO: 32644 - DNA, 103 bp, Artificial Sequence
  Synthetic Polynucleotide
taatacgactcactataggggaacacgatggacgctaccgataagcgataaacagaggagatatcgcatgtcggtagcgaacctggcggcagcgcaaaagatg

SEQ ID NO: 32645 - DNA, 103 bp, Artificial Sequence
  Synthetic Polynucleotide
taatacgactcactatagggacagttatatagttttgccaaatgacgagcaacagaggagagctcgtatgttggcaaaaaacctggcggcagcgcaaaagatg

SEQ ID NO: 32646 - DNA, 103 bp, Artificial Sequence
  Synthetic Polynucleotide
taatacgactcactataggggttcacgagtattcacgcatccaccagtgcaacagaggagagcactgatggatgcgtgaaacctggcggcagcgcaaaagatg

SEQ ID NO: 32647 - DNA, 103 bp, Artificial Sequence
  Synthetic Polynucleotide
taatacgactcactataggggacgaacctaagtataccgtttcgcatccaaacagaggagatggatgatgaacggtataaacctggcggcagcgcaaaagatg

SEQ ID NO: 32648 - DNA, 103 bp, Artificial Sequence
  Synthetic Polynucleotide
taatacgactcactatagggatcttcttacagatatgccttgtaccaagtaacagaggagaacttggatgaaggcatataacctggcggcagcgcaaaagatg

SEQ ID NO: 32649 - DNA, 103 bp, Artificial Sequence
  Synthetic Polynucleotide
taatacgactcactatagggggcttcgatttgcaaagaaagatattgcataacagaggagaatgcaaatgctttctttgaacctggcggcagcgcaaaagatg

SEQ ID NO: 32650 - DNA, 103 bp, Artificial Sequence
  Synthetic Polynucleotide
taatacgactcactatagggtaatttactatgacaaatgccccacaatgtaacagaggagaacattgatgggcatttgtaacctggcggcagcgcaaaagatg

SEQ ID NO: 32651 - DNA, 103 bp, Artificial Sequence
  Synthetic Polynucleotide
taatacgactcactatagggcatatcggatgatactcaaaagttcctcataacagaggagaatgaggatgttttgagtaaacctggcggcagcgcaaaagatg

SEQ ID NO: 32652 - DNA, 103 bp, Artificial Sequence
  Synthetic Polynucleotide
taatacgactcactataggggtgcttcctgacgggtccgtttccccttcaaacagaggagatgaaggatgaacggacccaacctggcggcagcgcaaaagatg

SEQ ID NO: 32653 - DNA, 103 bp, Artificial Sequence
  Synthetic Polynucleotide
taatacgactcactataggggaattagtgcggagcatatgctagcatgccaacagaggagaggcatgatggcatatgctaacctggcggcagcgcaaaagatg

SEQ ID NO: 32654 - DNA, 103 bp, Artificial Sequence
  Synthetic Polynucleotide
taatacgactcactatagggacaccggcgtactaaaatcccatttatgaaaacagaggagattcataatggggattttaaacctggcggcagcgcaaaagatg

SEQ ID NO: 32655 - DNA, 103 bp, Artificial Sequence
  Synthetic Polynucleotide
taatacgactcactatagggtcggaaagtgtccctctatatttgtacattaacagaggagaaatgtaatgatatagaggaacctggcggcagcgcaaaagatg

SEQ ID NO: 32656 - DNA, 103 bp, Artificial Sequence
  Synthetic Polynucleotide
taatacgactcactatagggaggtgactctcgctagcgacataccgactaaacagaggagatagtcgatgtgtcgctagaacctggcggcagcgcaaaagatg

SEQ ID NO: 32657 - DNA, 103 bp, Artificial Sequence
  Synthetic Polynucleotide
taatacgactcactatagggcagctaatgtctctctcaccccgcgctttgaacagaggagacaaagcatggggtgagagaacctggcggcagcgcaaaagatg

SEQ ID NO: 32658 - DNA, 103 bp, Artificial Sequence
  Synthetic Polynucleotide
taatacgactcactatagggcctttaaatattcccgagagtcactgatgtaacagaggagaacatcaatgactctcgggaacctggcggcagcgcaaaagatg

SEQ ID NO: 32659 - DNA, 103 bp, Artificial Sequence
  Synthetic Polynucleotide
taatacgactcactatagggattgcccatagatgccacgtccgtccgcaaaacagaggagattgcggatggacgtggcaaacctggcggcagcgcaaaagatg

SEQ ID NO: 32660 - DNA, 103 bp, Artificial Sequence
  Synthetic Polynucleotide
taatacgactcactatagggcgtcggtgtgaagcgtcacctgcaattgttaacagaggagaaacaatatgaggtgacgcaacctggcggcagcgcaaaagatg

SEQ ID NO: 32661 - DNA, 103 bp, Artificial Sequence
  Synthetic Polynucleotide
taatacgactcactatagggtcgcaaggaacagggctggccgacagacgtaacagaggagaacgtctatgggccagcccaacctggcggcagcgcaaaagatg

SEQ ID NO: 32662 - DNA, 103 bp, Artificial Sequence
  Synthetic Polynucleotide
taatacgactcactatagggacaaacatggagcatatggtacgagctcccaacagaggagagggagcatgtaccatatgaacctggcggcagcgcaaaagatg

SEQ ID NO: 32663 - DNA, 103 bp, Artificial Sequence
  Synthetic Polynucleotide
taatacgactcactatagggcggtcttgattcctcgtcgagtaatcaccaaacagaggagatggtgaatgctcgacgagaacctggcggcagcgcaaaagatg

SEQ ID NO: 32664 - DNA, 103 bp, Artificial Sequence
  Synthetic Polynucleotide
taatacgactcactataggggttattcgttttaaaacaagtaccagtgataacagaggagaatcactatgacttgttttaacctggcggcagcgcaaaagatg

SEQ ID NO: 32665 - DNA, 103 bp, Artificial Sequence
  Synthetic Polynucleotide
taatacgactcactatagggatcccctggcgtcaatactgatgttaatttaacagaggagaaaattaatgtcagtattgaacctggcggcagcgcaaaagatg

SEQ ID NO: 32666 - DNA, 103 bp, Artificial Sequence
  Synthetic Polynucleotide
taatacgactcactatagggggtcgcgagcccatcgtccgtagcttaccaaacagaggagatggtaaatgacggacgataacctggcggcagcgcaaaagatg

SEQ ID NO: 32667 - DNA, 103 bp, Artificial Sequence
  Synthetic Polynucleotide
taatacgactcactatagggcgcgtaggttcgtcaccaccacgcagtcacaacagaggagagtgactatgtggtggtgaaacctggcggcagcgcaaaagatg

SEQ ID NO: 32668 - DNA, 103 bp, Artificial Sequence
  Synthetic Polynucleotide
taatacgactcactatagggggagtagctgacaggagcggcgccggacgaaacagaggagatcgtccatggccgctcctaacctggcggcagcgcaaaagatg

SEQ ID NO: 32669 - DNA, 103 bp, Artificial Sequence
  Synthetic Polynucleotide
taatacgactcactatagggcgttctggaaacacagtagagcctgtggagaacagaggagactccacatgctctactgtaacctggcggcagcgcaaaagatg

SEQ ID NO: 32670 - DNA, 103 bp, Artificial Sequence
  Synthetic Polynucleotide
taatacgactcactatagggtgggctgcaccttctaagctttcggagcataacagaggagaatgctcatgaagcttagaaacctggcggcagcgcaaaagatg

SEQ ID NO: 32671 - DNA, 103 bp, Artificial Sequence
  Synthetic Polynucleotide
taatacgactcactatagggaaccgttcgcgagcatgttggcgctgagtaaacagaggagatactcaatgccaacatgcaacctggcggcagcgcaaaagatg

SEQ ID NO: 32672 - DNA, 103 bp, Artificial Sequence
  Synthetic Polynucleotide
taatacgactcactataggggtagaacctccgttcatcccctgtcccctcaacagaggagagaggggatgggggatgaaaacctggcggcagcgcaaaagatg

SEQ ID NO: 32673 - DNA, 103 bp, Artificial Sequence
  Synthetic Polynucleotide
taatacgactcactatagggcacagcgtgcattgggcttttttggccgaaaacagaggagattcggcatgaaaagcccaaacctggcggcagcgcaaaagatg

SEQ ID NO: 32674 - DNA, 103 bp, Artificial Sequence
  Synthetic Polynucleotide
taatacgactcactatagggtagtgaccgtaccactatgcctgtagcactaacagaggagaagtgctatgggcatagtgaacctggcggcagcgcaaaagatg

SEQ ID NO: 32675 - DNA, 103 bp, Artificial Sequence
  Synthetic Polynucleotide
taatacgactcactatagggaccgtgtgccgccgtgtgtccagcgaatcgaacagaggagacgattcatgggacacacgaacctggcggcagcgcaaaagatg

SEQ ID NO: 32676 - DNA, 103 bp, Artificial Sequence
  Synthetic Polynucleotide
taatacgactcactatagggttacgtctggtcaccaatagagacttgtggaacagaggagaccacaaatgtctattggtaacctggcggcagcgcaaaagatg

SEQ ID NO: 32677 - DNA, 103 bp, Artificial Sequence
  Synthetic Polynucleotide
taatacgactcactataggggatagtcctccgcgtgccattactgaacataacagaggagaatgttcatgaatggcacgaacctggcggcagcgcaaaagatg

SEQ ID NO: 32678 - DNA, 103 bp, Artificial Sequence
  Synthetic Polynucleotide
taatacgactcactatagggcgctgcccgtgtctgaagagcatagcactgaacagaggagacagtgcatggctcttcagaacctggcggcagcgcaaaagatg

SEQ ID NO: 32679 - DNA, 103 bp, Artificial Sequence
  Synthetic Polynucleotide
taatacgactcactatagggaccgacatattttctcggggaatgtgggcgaacagaggagacgcccaatgtccccgagaaacctggcggcagcgcaaaagatg

SEQ ID NO: 32680 - DNA, 103 bp, Artificial Sequence
  Synthetic Polynucleotide
taatacgactcactatagggtccatgagtgtatagctttactcccctttgaacagaggagacaaaggatggtaaagctaaacctggcggcagcgcaaaagatg

SEQ ID NO: 32681 - DNA, 103 bp, Artificial Sequence
  Synthetic Polynucleotide
taatacgactcactatagggtcggttattctgtggaggcgaaggtgacctaacagaggagaaggtcaatgtcgcctccaaacctggcggcagcgcaaaagatg

SEQ ID NO: 32682 - DNA, 103 bp, Artificial Sequence
  Synthetic Polynucleotide
taatacgactcactatagggctacatggttttgtgttttcttgcgggccaaacagaggagatggcccatgagaaaacacaacctggcggcagcgcaaaagatg

SEQ ID NO: 32683 - DNA, 103 bp, Artificial Sequence
  Synthetic Polynucleotide
taatacgactcactatagggccacctgcatagtagtaattccaggagataaacagaggagatatctcatggaattactaaacctggcggcagcgcaaaagatg

SEQ ID NO: 32684 - DNA, 103 bp, Artificial Sequence
  Synthetic Polynucleotide
taatacgactcactatagggcccgcaggtaaacctcaaggcccggaatctaacagaggagaagattcatggccttgaggaacctggcggcagcgcaaaagatg

SEQ ID NO: 32685 - DNA, 103 bp, Artificial Sequence
  Synthetic Polynucleotide
taatacgactcactatagggcggtccccgtagacaaatggtagctttttcaacagaggagagaaaaaatgaccatttgtaacctggcggcagcgcaaaagatg

SEQ ID NO: 32686 - DNA, 103 bp, Artificial Sequence
  Synthetic Polynucleotide
taatacgactcactatagggacaggctggatgtacccgttgttgtccatcaacagaggagagatggaatgcaacgggtaaacctggcggcagcgcaaaagatg

SEQ ID NO: 32687 - DNA, 103 bp, Artificial Sequence
  Synthetic Polynucleotide
taatacgactcactataggggctaagcaagagtggacccctccaatggggaacagaggagaccccatatgaggggtccaaacctggcggcagcgcaaaagatg

SEQ ID NO: 32688 - DNA, 103 bp, Artificial Sequence
  Synthetic Polynucleotide
taatacgactcactatagggctttagtctaacgaattaaagatttagaccaacagaggagaggtctaatgctttaattcaacctggcggcagcgcaaaagatg

SEQ ID NO: 32689 - DNA, 103 bp, Artificial Sequence
  Synthetic Polynucleotide
taatacgactcactatagggacaccgtgggtgtagacctgtcgaggtggtaacagaggagaaccaccatgacaggtctaaacctggcggcagcgcaaaagatg

SEQ ID NO: 32690 - DNA, 103 bp, Artificial Sequence
  Synthetic Polynucleotide
taatacgactcactataggggatggctacgcaggcgcgacgtggagaccaaacagaggagatggtctatgcgtcgcgccaacctggcggcagcgcaaaagatg

SEQ ID NO: 32691 - DNA, 103 bp, Artificial Sequence
  Synthetic Polynucleotide
taatacgactcactatagggcggatgggcacgagatcccttaactcacccaacagaggagagggtgaatgaagggatctaacctggcggcagcgcaaaagatg

SEQ ID NO: 32692 - DNA, 103 bp, Artificial Sequence
  Synthetic Polynucleotide
taatacgactcactatagggcaatgcctcatgcaaactgaatggggtcacaacagaggagagtgaccatgttcagtttgaacctggcggcagcgcaaaagatg

SEQ ID NO: 32693 - DNA, 103 bp, Artificial Sequence
  Synthetic Polynucleotide
taatacgactcactatagggaatcattcactacgccaacaaagggatagcaacagaggagagctatcatgttgttggcgaacctggcggcagcgcaaaagatg

SEQ ID NO: 32694 - DNA, 103 bp, Artificial Sequence
  Synthetic Polynucleotide
taatacgactcactatagggcggcatgaagtatcccaaacaagtgtataaaacagaggagattatacatgtgtttgggaaacctggcggcagcgcaaaagatg

SEQ ID NO: 32695 - DNA, 103 bp, Artificial Sequence
  Synthetic Polynucleotide
taatacgactcactataggggatgtcatccacgccgctcccttctgaactaacagaggagaagttcaatggggagcggcaacctggcggcagcgcaaaagatg

SEQ ID NO: 32696 - DNA, 103 bp, Artificial Sequence
  Synthetic Polynucleotide
taatacgactcactatagggccggtcatagatggattgtgaaacctgggcaacagaggagagcccagatgtcacaatccaacctggcggcagcgcaaaagatg

SEQ ID NO: 32697 - DNA, 103 bp, Artificial Sequence
  Synthetic Polynucleotide
taatacgactcactataggggatatctggtggcatactgacacgcatcgaaacagaggagatcgatgatggtcagtatgaacctggcggcagcgcaaaagatg

SEQ ID NO: 32698 - DNA, 103 bp, Artificial Sequence
  Synthetic Polynucleotide
taatacgactcactatagggatctctgtctccacgaaaagcctgttgtaaaacagaggagattacaaatggcttttcgtaacctggcggcagcgcaaaagatg

SEQ ID NO: 32699 - DNA, 103 bp, Artificial Sequence
  Synthetic Polynucleotide
taatacgactcactatagggtaggtgggctgggatcgtttcgcgcagcggaacagaggagaccgctgatggaaacgatcaacctggcggcagcgcaaaagatg

SEQ ID NO: 32700 - DNA, 103 bp, Artificial Sequence
  Synthetic Polynucleotide
taatacgactcactatagggccactatgtgtgtcgctacgcgtgaaaatcaacagaggagagattttatggcgtagcgaaacctggcggcagcgcaaaagatg

SEQ ID NO: 32701 - DNA, 103 bp, Artificial Sequence
  Synthetic Polynucleotide
taatacgactcactatagggctgtcgtcaagctatcttggaagcagttgcaacagaggagagcaactatgtccaagataaacctggcggcagcgcaaaagatg

SEQ ID NO: 32702 - DNA, 103 bp, Artificial Sequence
  Synthetic Polynucleotide
taatacgactcactatagggagtttgctgcacgcgatgcactcgatccaaaacagaggagattggatatggtgcatcgcaacctggcggcagcgcaaaagatg

SEQ ID NO: 32703 - DNA, 103 bp, Artificial Sequence
  Synthetic Polynucleotide
taatacgactcactatagggtcctcggctcggtgtttgtgttttggcaagaacagaggagacttgccatgacacaaacaaacctggcggcagcgcaaaagatg

SEQ ID NO: 32704 - DNA, 103 bp, Artificial Sequence
  Synthetic Polynucleotide
taatacgactcactataggggaccgcggaatatagggcatccaaacgaggaacagaggagacctcgtatggatgccctaaacctggcggcagcgcaaaagatg

SEQ ID NO: 32705 - DNA, 103 bp, Artificial Sequence
  Synthetic Polynucleotide
taatacgactcactatagggtcgcctagtgccgagtacgacacgtcttcgaacagaggagacgaagaatggtcgtactcaacctggcggcagcgcaaaagatg

SEQ ID NO: 32706 - DNA, 103 bp, Artificial Sequence
  Synthetic Polynucleotide
taatacgactcactatagggcagtttaggacaggccagcccgcgttttgcaacagaggagagcaaaaatggggctggccaacctggcggcagcgcaaaagatg

SEQ ID NO: 32707 - DNA, 103 bp, Artificial Sequence
  Synthetic Polynucleotide
taatacgactcactataggggggccactcagtcacggacaggtagccgaaaacagaggagattcggcatgctgtccgtgaacctggcggcagcgcaaaagatg

SEQ ID NO: 32708 - DNA, 103 bp, Artificial Sequence
  Synthetic Polynucleotide
taatacgactcactatagggccagacgcgccaggaacaatcgctacactgaacagaggagacagtgtatggattgttccaacctggcggcagcgcaaaagatg

SEQ ID NO: 32709 - DNA, 103 bp, Artificial Sequence
  Synthetic Polynucleotide
taatacgactcactatagggcaaccacgtggttacgtgcatagttcaaccaacagaggagaggttgaatgatgcacgtaaacctggcggcagcgcaaaagatg

SEQ ID NO: 32710 - DNA, 103 bp, Artificial Sequence
  Synthetic Polynucleotide
taatacgactcactataggggcgtatataccaactcgcttacggtcctgtaacagaggagaacaggaatgtaagcgagtaacctggcggcagcgcaaaagatg

SEQ ID NO: 32711 - DNA, 103 bp, Artificial Sequence
  Synthetic Polynucleotide
taatacgactcactatagggtttggccgtggggtcaaagtggaaagaagtaacagaggagaacttctatgcactttgacaacctggcggcagcgcaaaagatg

SEQ ID NO: 32712 - DNA, 103 bp, Artificial Sequence
  Synthetic Polynucleotide
taatacgactcactatagggtgtaaaatcgtatactggggcaaccgcaaaaacagaggagatttgcgatggccccagtaaacctggcggcagcgcaaaagatg

SEQ ID NO: 32713 - DNA, 103 bp, Artificial Sequence
  Synthetic Polynucleotide
taatacgactcactatagggtgcaatgctgccccacaacgatacagcggaaacagaggagatccgctatgtcgttgtggaacctggcggcagcgcaaaagatg

SEQ ID NO: 32714 - DNA, 103 bp, Artificial Sequence
  Synthetic Polynucleotide
taatacgactcactatagggcagatgttcgcgcctcagccttgaggacgtaacagaggagaacgtccatgaggctgaggaacctggcggcagcgcaaaagatg

SEQ ID NO: 32715 - DNA, 103 bp, Artificial Sequence
  Synthetic Polynucleotide
taatacgactcactatagggtcttagatctattccggttcttcttcgaagaacagaggagacttcgaatgagaaccggaaacctggcggcagcgcaaaagatg

SEQ ID NO: 32716 - DNA, 103 bp, Artificial Sequence
  Synthetic Polynucleotide
taatacgactcactatagggctttttatttatttactcagaggttggttaaacagaggagataaccaatgtctgagtaaaacctggcggcagcgcaaaagatg

SEQ ID NO: 32717 - DNA, 103 bp, Artificial Sequence
  Synthetic Polynucleotide
taatacgactcactatagggctaatgtgctggcttcctttccagcattagaacagaggagactaatgatggaaaggaagaacctggcggcagcgcaaaagatg

SEQ ID NO: 32718 - DNA, 103 bp, Artificial Sequence
  Synthetic Polynucleotide
taatacgactcactatagggggcagttgtgtataggcggtggctcaaccgaacagaggagacggttgatgcaccgcctaaacctggcggcagcgcaaaagatg

SEQ ID NO: 32719 - DNA, 103 bp, Artificial Sequence
  Synthetic Polynucleotide
taatacgactcactataggggatccggatctcggacaacatctactttcgaacagaggagacgaaagatgatgttgtccaacctggcggcagcgcaaaagatg

SEQ ID NO: 32720 - DNA, 103 bp, Artificial Sequence
  Synthetic Polynucleotide
taatacgactcactatagggtatagttgtgcgcgttcctctgtcaatgcgaacagaggagacgcattatgagaggaacgaacctggcggcagcgcaaaagatg

SEQ ID NO: 32721 - DNA, 103 bp, Artificial Sequence
  Synthetic Polynucleotide
taatacgactcactataggggaaagccgtacaaatcacgggtagatatctaacagaggagaagatatatgcccgtgattaacctggcggcagcgcaaaagatg

SEQ ID NO: 32722 - DNA, 103 bp, Artificial Sequence
  Synthetic Polynucleotide
taatacgactcactatagggtaataagggggtgctgaaccgcatttgtttaacagaggagaaaacaaatgcggttcagcaacctggcggcagcgcaaaagatg

SEQ ID NO: 32723 - DNA, 103 bp, Artificial Sequence
  Synthetic Polynucleotide
taatacgactcactatagggaaagactcccgaggctgggagcgctgatgcaacagaggagagcatcaatgctcccagccaacctggcggcagcgcaaaagatg

SEQ ID NO: 32724 - DNA, 103 bp, Artificial Sequence
  Synthetic Polynucleotide
taatacgactcactataggggtcacgcggcgctatgttgcgaggagatgaaacagaggagatcatctatgcgcaacataaacctggcggcagcgcaaaagatg

SEQ ID NO: 32725 - DNA, 103 bp, Artificial Sequence
  Synthetic Polynucleotide
taatacgactcactatagggccctctgacgcaggtcgcgtgtttttcccaaacagaggagatgggaaatgcacgcgaccaacctggcggcagcgcaaaagatg

SEQ ID NO: 32726 - DNA, 103 bp, Artificial Sequence
  Synthetic Polynucleotide
taatacgactcactatagggttattgcccctgtcgtataggagtgtgtttaacagaggagaaaacacatgcctatacgaaacctggcggcagcgcaaaagatg

SEQ ID NO: 32727 - DNA, 103 bp, Artificial Sequence
  Synthetic Polynucleotide
taatacgactcactatagggttgattaaacacggtaagctacgagggaacaacagaggagagttcccatgtagcttaccaacctggcggcagcgcaaaagatg

SEQ ID NO: 32728 - DNA, 103 bp, Artificial Sequence
  Synthetic Polynucleotide
taatacgactcactatagggccccaggcatagactccgaactagtcaacaaacagaggagatgttgaatggttcggagtaacctggcggcagcgcaaaagatg

SEQ ID NO: 32729 - DNA, 103 bp, Artificial Sequence
  Synthetic Polynucleotide
taatacgactcactataggggaaagcatgctaacgtgtgtatgaatttccaacagaggagaggaaatatgtacacacgtaacctggcggcagcgcaaaagatg

SEQ ID NO: 32730 - DNA, 103 bp, Artificial Sequence
  Synthetic Polynucleotide
taatacgactcactataggggtgacgggacccagcttaatgtttatggcgaacagaggagacgccatatgcattaagctaacctggcggcagcgcaaaagatg

SEQ ID NO: 32731 - DNA, 103 bp, Artificial Sequence
  Synthetic Polynucleotide
taatacgactcactatagggaagcaaatgcggaaggctagcacagctcgaaacagaggagatcgagcatggctagccttaacctggcggcagcgcaaaagatg

SEQ ID NO: 32732 - DNA, 103 bp, Artificial Sequence
  Synthetic Polynucleotide
taatacgactcactatagggtaacggccgaggctagctcatcctattctgaacagaggagacagaatatgatgagctagaacctggcggcagcgcaaaagatg

SEQ ID NO: 32733 - DNA, 103 bp, Artificial Sequence
  Synthetic Polynucleotide
taatacgactcactatagggcgtatccgttatgtgggagatacgcatatcaacagaggagagatatgatgatctcccacaacctggcggcagcgcaaaagatg

SEQ ID NO: 32734 - DNA, 103 bp, Artificial Sequence
  Synthetic Polynucleotide
taatacgactcactatagggccgtcagacaaagacagttcacaacatggcaacagaggagagccatgatgtgaactgtcaacctggcggcagcgcaaaagatg

SEQ ID NO: 32735 - DNA, 103 bp, Artificial Sequence
  Synthetic Polynucleotide
taatacgactcactatagggggaaagtctatcggcacgaaagaacacatgaacagaggagacatgtgatgtttcgtgccaacctggcggcagcgcaaaagatg

SEQ ID NO: 32736 - DNA, 103 bp, Artificial Sequence
  Synthetic Polynucleotide
taatacgactcactatagggatgacccacgaagttcattcatggaacagaaacagaggagatctgttatgtgaatgaacaacctggcggcagcgcaaaagatg

SEQ ID NO: 32737 - DNA, 103 bp, Artificial Sequence
  Synthetic Polynucleotide
taatacgactcactatagggtataatcattgacttgagaggagtcataggaacagaggagacctatgatgcctctcaagaacctggcggcagcgcaaaagatg

SEQ ID NO: 32738 - DNA, 103 bp, Artificial Sequence
  Synthetic Polynucleotide
taatacgactcactatagggctccatctgataaaatgtggaagccgaagcaacagaggagagcttcgatgtccacatttaacctggcggcagcgcaaaagatg

SEQ ID NO: 32739 - DNA, 103 bp, Artificial Sequence
  Synthetic Polynucleotide
taatacgactcactatagggaagtgggcactatccaatgctatccctgataacagaggagaatcaggatgagcattggaaacctggcggcagcgcaaaagatg

SEQ ID NO: 32740 - DNA, 103 bp, Artificial Sequence
  Synthetic Polynucleotide
taatacgactcactatagggatggcacgaaatctctcagccgtcttaggtaacagaggagaacctaaatgggctgagagaacctggcggcagcgcaaaagatg

SEQ ID NO: 32741 - DNA, 103 bp, Artificial Sequence
  Synthetic Polynucleotide
taatacgactcactatagggggtatatcgcggcataatccgacgagtgttaacagaggagaaacactatgcggattatgaacctggcggcagcgcaaaagatg

SEQ ID NO: 32742 - DNA, 103 bp, Artificial Sequence
  Synthetic Polynucleotide
taatacgactcactataggggctgagctgagctcgaagcgtgtgaccggtaacagaggagaaccggtatgacgcttcgaaacctggcggcagcgcaaaagatg

SEQ ID NO: 32743 - DNA, 103 bp, Artificial Sequence
  Synthetic Polynucleotide
taatacgactcactatagggtgtagcatgtcctcaaggaatgtgagcccaaacagaggagatgggctatgattccttgaaacctggcggcagcgcaaaagatg

SEQ ID NO: 32744 - DNA, 103 bp, Artificial Sequence
  Synthetic Polynucleotide
taatacgactcactatagggtgaagaaaaagtcgataatgggcgcgttggaacagaggagaccaacgatgccattatcgaacctggcggcagcgcaaaagatg

SEQ ID NO: 32745 - DNA, 103 bp, Artificial Sequence
  Synthetic Polynucleotide
taatacgactcactataggggggttaggcactgaccgtaaatacgcgcgcaacagaggagagcgcgcatgtttacggtcaacctggcggcagcgcaaaagatg

SEQ ID NO: 32746 - DNA, 103 bp, Artificial Sequence
  Synthetic Polynucleotide
taatacgactcactatagggagggtcccaagtggctcgaatgccccgaaaaacagaggagatttcggatgattcgagccaacctggcggcagcgcaaaagatg

SEQ ID NO: 32747 - DNA, 103 bp, Artificial Sequence
  Synthetic Polynucleotide
taatacgactcactataggggtgcaccacacagggagggcgcaagccggcaacagaggagagccggcatgcgccctcccaacctggcggcagcgcaaaagatg

SEQ ID NO: 32748 - DNA, 103 bp, Artificial Sequence
  Synthetic Polynucleotide
taatacgactcactataggggaatccccataagaccaattgtcagaaggcaacagaggagagccttcatgcaattggtcaacctggcggcagcgcaaaagatg

SEQ ID NO: 32749 - DNA, 103 bp, Artificial Sequence
  Synthetic Polynucleotide
taatacgactcactatagggtgagctgggaaagcctcagcttacgcttgtaacagaggagaacaagcatgagctgaggcaacctggcggcagcgcaaaagatg

SEQ ID NO: 32750 - DNA, 103 bp, Artificial Sequence
  Synthetic Polynucleotide
taatacgactcactatagggttacacacgccctacgagcccgcatagaaaaacagaggagatttctaatggggctcgtaaacctggcggcagcgcaaaagatg

SEQ ID NO: 32751 - DNA, 103 bp, Artificial Sequence
  Synthetic Polynucleotide
taatacgactcactatagggcaaacgaccgcgtaccgtatgccgacttccaacagaggagaggaagtatgcatacggtaaacctggcggcagcgcaaaagatg

SEQ ID NO: 32752 - DNA, 103 bp, Artificial Sequence
  Synthetic Polynucleotide
taatacgactcactatagggcggtccgttcagtcagagggactaagtcgcaacagaggagagcgactatgtccctctgaaacctggcggcagcgcaaaagatg

SEQ ID NO: 32753 - DNA, 103 bp, Artificial Sequence
  Synthetic Polynucleotide
taatacgactcactatagggtcgcctcgagggattacggatgctgcttgtaacagaggagaacaagcatgatccgtaataacctggcggcagcgcaaaagatg

SEQ ID NO: 32754 - DNA, 103 bp, Artificial Sequence
  Synthetic Polynucleotide
taatacgactcactatagggtagacgtgtatctatcttcctcgcctcagtaacagaggagaactgagatgaggaagataaacctggcggcagcgcaaaagatg

SEQ ID NO: 32755 - DNA, 103 bp, Artificial Sequence
  Synthetic Polynucleotide
taatacgactcactatagggtaaggaggcagccagtgtgacgtctcttgaaacagaggagatcaagaatggtcacactgaacctggcggcagcgcaaaagatg

SEQ ID NO: 32756 - DNA, 103 bp, Artificial Sequence
  Synthetic Polynucleotide
taatacgactcactatagggaaataacaaacgatagaacgtgcaacggttaacagaggagaaaccgtatgacgttctataacctggcggcagcgcaaaagatg

SEQ ID NO: 32757 - DNA, 103 bp, Artificial Sequence
  Synthetic Polynucleotide
taatacgactcactatagggccaacttcgggtcttaggacgattcctggaaacagaggagatccaggatgcgtcctaagaacctggcggcagcgcaaaagatg

SEQ ID NO: 32758 - DNA, 103 bp, Artificial Sequence
  Synthetic Polynucleotide
taatacgactcactatagggtttagggacgtcggggctttacgctagcctaacagaggagaaggctaatgtaaagccccaacctggcggcagcgcaaaagatg

SEQ ID NO: 32759 - DNA, 103 bp, Artificial Sequence
  Synthetic Polynucleotide
taatacgactcactataggggattatgcgagcgtcttgcgtaaacttgacaacagaggagagtcaagatgacgcaagacaacctggcggcagcgcaaaagatg

SEQ ID NO: 32760 - DNA, 103 bp, Artificial Sequence
  Synthetic Polynucleotide
taatacgactcactatagggctggtccctcagactgttctcgccgcggagaacagaggagactccgcatggagaacagtaacctggcggcagcgcaaaagatg

SEQ ID NO: 32761 - DNA, 103 bp, Artificial Sequence
  Synthetic Polynucleotide
taatacgactcactatagggtctcttcggtctacacaggtcaagtgatcgaacagaggagacgatcaatggacctgtgtaacctggcggcagcgcaaaagatg

SEQ ID NO: 32762 - DNA, 103 bp, Artificial Sequence
  Synthetic Polynucleotide
taatacgactcactatagggattcgttgccgtcatgatcggtgacacgctaacagaggagaagcgtgatgccgatcatgaacctggcggcagcgcaaaagatg

SEQ ID NO: 32763 - DNA, 103 bp, Artificial Sequence
  Synthetic Polynucleotide
taatacgactcactatagggctaacccctgtagcgaacagcgttttgcttaacagaggagaaagcaaatggctgttcgcaacctggcggcagcgcaaaagatg

SEQ ID NO: 32764 - DNA, 103 bp, Artificial Sequence
  Synthetic Polynucleotide
taatacgactcactatagggcgcggtcattcgttcagaaattcaccagtcaacagaggagagactggatgatttctgaaaacctggcggcagcgcaaaagatg

SEQ ID NO: 32765 - DNA, 103 bp, Artificial Sequence
  Synthetic Polynucleotide
taatacgactcactatagggggacagatgaaggccttgctaatagaattaaacagaggagataattcatgtagcaaggcaacctggcggcagcgcaaaagatg

SEQ ID NO: 32766 - DNA, 103 bp, Artificial Sequence
  Synthetic Polynucleotide
taatacgactcactatagggcggtggagccgtagcatgttaatatgatagaacagaggagactatcaatgtaacatgctaacctggcggcagcgcaaaagatg

SEQ ID NO: 32767 - DNA, 103 bp, Artificial Sequence
  Synthetic Polynucleotide
taatacgactcactatagggtctcgattggcccactgctgccttctttcgaacagaggagacgaaagatggcagcagtgaacctggcggcagcgcaaaagatg

SEQ ID NO: 32768 - DNA, 103 bp, Artificial Sequence
  Synthetic Polynucleotide
taatacgactcactatagggcagctagtgaccaaacaccgtatcatcgccaacagaggagaggcgatatgacggtgtttaacctggcggcagcgcaaaagatg

SEQ ID NO: 32769 - DNA, 103 bp, Artificial Sequence
  Synthetic Polynucleotide
taatacgactcactatagggcgctccttgacttctaatggtacagggggtaacagaggagaacccccatgaccattagaaacctggcggcagcgcaaaagatg

SEQ ID NO: 32770 - DNA, 103 bp, Artificial Sequence
  Synthetic Polynucleotide
taatacgactcactatagggagtatcagaagggagtgaacttagtacaataacagaggagaattgtaatgagttcactcaacctggcggcagcgcaaaagatg

SEQ ID NO: 32771 - DNA, 103 bp, Artificial Sequence
  Synthetic Polynucleotide
taatacgactcactataggggaatctgatgaggttgctgccgcgagggccaacagaggagaggccctatgggcagcaacaacctggcggcagcgcaaaagatg

SEQ ID NO: 32772 - DNA, 103 bp, Artificial Sequence
  Synthetic Polynucleotide
taatacgactcactatagggaggtcactgcgcttccctatatgtccctctaacagaggagaagagggatgtatagggaaaacctggcggcagcgcaaaagatg

SEQ ID NO: 32773 - DNA, 103 bp, Artificial Sequence
  Synthetic Polynucleotide
taatacgactcactataggggtgtcgccgggtcactggatcaatgtccacaacagaggagagtggacatggatccagtgaacctggcggcagcgcaaaagatg

SEQ ID NO: 32774 - DNA, 103 bp, Artificial Sequence
  Synthetic Polynucleotide
taatacgactcactatagggcattagaaacccgttttccttactgtcgcgaacagaggagacgcgacatgaaggaaaacaacctggcggcagcgcaaaagatg

SEQ ID NO: 32775 - DNA, 103 bp, Artificial Sequence
  Synthetic Polynucleotide
taatacgactcactatagggtgttcaaacttgctcgtagccttgagtagaaacagaggagatctactatgggctacgagaacctggcggcagcgcaaaagatg

SEQ ID NO: 32776 - DNA, 103 bp, Artificial Sequence
  Synthetic Polynucleotide
taatacgactcactatagggaacaccagactgaattatacgctgcccaataacagaggagaattgggatgcgtataattaacctggcggcagcgcaaaagatg

SEQ ID NO: 32777 - DNA, 103 bp, Artificial Sequence
  Synthetic Polynucleotide
taatacgactcactatagggatccgcttgggctcataccaaagtagtaataacagaggagaattactatgttggtatgaaacctggcggcagcgcaaaagatg

SEQ ID NO: 32778 - DNA, 103 bp, Artificial Sequence
  Synthetic Polynucleotide
taatacgactcactatagggttcgatatctcgatagcttgaattcggtcaaacagaggagatgaccgatgtcaagctataacctggcggcagcgcaaaagatg

SEQ ID NO: 32779 - DNA, 103 bp, Artificial Sequence
  Synthetic Polynucleotide
taatacgactcactatagggtaagcaaagaacctgaattattatcttgtaaacagaggagatacaagatgataattcagaacctggcggcagcgcaaaagatg

SEQ ID NO: 32780 - DNA, 103 bp, Artificial Sequence
  Synthetic Polynucleotide
taatacgactcactataggggctcgcgaatgcacggctcgccgtggtaacaacagaggagagttaccatggcgagccgtaacctggcggcagcgcaaaagatg

SEQ ID NO: 32781 - DNA, 103 bp, Artificial Sequence
  Synthetic Polynucleotide
taatacgactcactatagggctccgttgaagctagttaatgggtcggtcaaacagaggagatgaccgatgcattaactaaacctggcggcagcgcaaaagatg

SEQ ID NO: 32782 - DNA, 103 bp, Artificial Sequence
  Synthetic Polynucleotide
taatacgactcactatagggatcgtcaagttcccaactcttgctacaaaaaacagaggagattttgtatgaagagttggaacctggcggcagcgcaaaagatg

SEQ ID NO: 32783 - DNA, 103 bp, Artificial Sequence
  Synthetic Polynucleotide
taatacgactcactatagggtttctctcccaccgggccagtgatgtcttcaacagaggagagaagacatgactggcccgaacctggcggcagcgcaaaagatg

SEQ ID NO: 32784 - DNA, 103 bp, Artificial Sequence
  Synthetic Polynucleotide
taatacgactcactatagggccggatgagctacgcgagcccaaaacaaataacagaggagaatttgtatggggctcgcgaacctggcggcagcgcaaaagatg

SEQ ID NO: 32785 - DNA, 103 bp, Artificial Sequence
  Synthetic Polynucleotide
taatacgactcactataggggtccttatggcgggatttgggtagatccctaacagaggagaagggatatgcccaaatccaacctggcggcagcgcaaaagatg

SEQ ID NO: 32786 - DNA, 103 bp, Artificial Sequence
  Synthetic Polynucleotide
taatacgactcactatagggtttcggttagtgcactaaccctgaactgggaacagaggagacccagtatggggttagtgaacctggcggcagcgcaaaagatg

SEQ ID NO: 32787 - DNA, 103 bp, Artificial Sequence
  Synthetic Polynucleotide
taatacgactcactatagggaccatcggggaccgctaacgcccccttatcaacagaggagagataagatggcgttagcgaacctggcggcagcgcaaaagatg

SEQ ID NO: 32788 - DNA, 103 bp, Artificial Sequence
  Synthetic Polynucleotide
taatacgactcactataggggatttatgatctctatgcatactcattacaaacagaggagatgtaatatgtatgcatagaacctggcggcagcgcaaaagatg

SEQ ID NO: 32789 - DNA, 103 bp, Artificial Sequence
  Synthetic Polynucleotide
taatacgactcactataggggccagcagtgatatagagagcctaccccagaacagaggagactggggatggctctctataacctggcggcagcgcaaaagatg

SEQ ID NO: 32790 - DNA, 103 bp, Artificial Sequence
  Synthetic Polynucleotide
taatacgactcactatagggtgtggcaggctccggccttataactaatcaaacagaggagatgattaatgataaggccgaacctggcggcagcgcaaaagatg

SEQ ID NO: 32791 - DNA, 103 bp, Artificial Sequence
  Synthetic Polynucleotide
taatacgactcactatagggcttctcctactcacccggccccatccttcaaacagaggagatgaaggatggggccgggtaacctggcggcagcgcaaaagatg

SEQ ID NO: 32792 - DNA, 103 bp, Artificial Sequence
  Synthetic Polynucleotide
taatacgactcactataggggcacactaggagttcgccggatactggcagaacagaggagactgccaatgtccggcgaaaacctggcggcagcgcaaaagatg

SEQ ID NO: 32793 - DNA, 103 bp, Artificial Sequence
  Synthetic Polynucleotide
taatacgactcactatagggctaaacatgccggtaagaattagtcgcccgaacagaggagacgggcgatgaattcttacaacctggcggcagcgcaaaagatg

SEQ ID NO: 32794 - DNA, 103 bp, Artificial Sequence
  Synthetic Polynucleotide
taatacgactcactataggggggtagccacccccagacccagtcagactcaacagaggagagagtctatgtgggtctggaacctggcggcagcgcaaaagatg

SEQ ID NO: 32795 - DNA, 103 bp, Artificial Sequence
  Synthetic Polynucleotide
taatacgactcactatagggtcttcgggctgggcagatctatccaccttcaacagaggagagaaggtatgtagatctgcaacctggcggcagcgcaaaagatg

SEQ ID NO: 32796 - DNA, 103 bp, Artificial Sequence
  Synthetic Polynucleotide
taatacgactcactatagggtaaaggagattctaccggtaaataacttcaaacagaggagatgaagtatgttaccggtaaacctggcggcagcgcaaaagatg

SEQ ID NO: 32797 - DNA, 103 bp, Artificial Sequence
  Synthetic Polynucleotide
taatacgactcactatagggctagtactgtaccacccggagtggctcaacaacagaggagagttgagatgctccgggtgaacctggcggcagcgcaaaagatg

SEQ ID NO: 32798 - DNA, 103 bp, Artificial Sequence
  Synthetic Polynucleotide
taatacgactcactatagggatcatatggaaggggtagcagacaccgaacaacagaggagagttcggatgctgctacccaacctggcggcagcgcaaaagatg

SEQ ID NO: 32799 - DNA, 103 bp, Artificial Sequence
  Synthetic Polynucleotide
taatacgactcactatagggcaacctcggggttggtatcctcaagggaataacagaggagaattcccatgaggataccaaacctggcggcagcgcaaaagatg

SEQ ID NO: 32800 - DNA, 103 bp, Artificial Sequence
  Synthetic Polynucleotide
taatacgactcactatagggactaaagtcgcaatggcgcgccggcatcataacagaggagaatgatgatggcgcgccataacctggcggcagcgcaaaagatg

SEQ ID NO: 32801 - DNA, 103 bp, Artificial Sequence
  Synthetic Polynucleotide
taatacgactcactatagggttggctatttcggttcaggggtggatgatgaacagaggagacatcatatgcccctgaacaacctggcggcagcgcaaaagatg

SEQ ID NO: 32802 - DNA, 103 bp, Artificial Sequence
  Synthetic Polynucleotide
taatacgactcactatagggctcattgtcaaagtggctgagcagcttaataacagaggagaattaagatgctcagccacaacctggcggcagcgcaaaagatg

SEQ ID NO: 32803 - DNA, 103 bp, Artificial Sequence
  Synthetic Polynucleotide
taatacgactcactataggggccgacggggtggtgcgtgctgaatgttcaaacagaggagatgaacaatgagcacgcacaacctggcggcagcgcaaaagatg

SEQ ID NO: 32804 - DNA, 103 bp, Artificial Sequence
  Synthetic Polynucleotide
taatacgactcactataggggcgatacacagcggtttggaaggcctcccaaacagaggagatgggagatgttccaaaccaacctggcggcagcgcaaaagatg

SEQ ID NO: 32805 - DNA, 103 bp, Artificial Sequence
  Synthetic Polynucleotide
taatacgactcactatagggtctcaacaaggaagttcggatcgcgtgcataacagaggagaatgcacatgatccgaactaacctggcggcagcgcaaaagatg

SEQ ID NO: 32806 - DNA, 103 bp, Artificial Sequence
  Synthetic Polynucleotide
taatacgactcactatagggactcaaaatatagctaggcattcgcattgcaacagaggagagcaatgatgatgcctagcaacctggcggcagcgcaaaagatg

SEQ ID NO: 32807 - DNA, 103 bp, Artificial Sequence
  Synthetic Polynucleotide
taatacgactcactataggggtcgccccgctctcgctcagtacttcgcgaaacagaggagatcgcgaatgactgagcgaaacctggcggcagcgcaaaagatg

SEQ ID NO: 32808 - DNA, 103 bp, Artificial Sequence
  Synthetic Polynucleotide
taatacgactcactatagggggacgtaggatcctattgtgtggtgttataaacagaggagatataacatgacacaatagaacctggcggcagcgcaaaagatg

SEQ ID NO: 32809 - DNA, 103 bp, Artificial Sequence
  Synthetic Polynucleotide
taatacgactcactataggggtctgacggttgctacgatttgaatctattaacagaggagaaatagaatgaaatcgtagaacctggcggcagcgcaaaagatg

SEQ ID NO: 32810 - DNA, 103 bp, Artificial Sequence
  Synthetic Polynucleotide
taatacgactcactatagggtctaccacttaggcgagtggtccgtgggccaacagaggagaggcccaatgaccactcgcaacctggcggcagcgcaaaagatg

SEQ ID NO: 32811 - DNA, 103 bp, Artificial Sequence
  Synthetic Polynucleotide
taatacgactcactatagggctgtagtatcaaacctactgtaattctgggaacagaggagacccagaatgacagtaggtaacctggcggcagcgcaaaagatg

SEQ ID NO: 32812 - DNA, 103 bp, Artificial Sequence
  Synthetic Polynucleotide
taatacgactcactataggggaaatcgcctccccaagtttatgagccactaacagaggagaagtggcatgtaaacttggaacctggcggcagcgcaaaagatg

SEQ ID NO: 32813 - DNA, 103 bp, Artificial Sequence
  Synthetic Polynucleotide
taatacgactcactatagggaggtggacgtgcgtggaacttccgcgcggaaacagaggagatccgcgatgaagttccacaacctggcggcagcgcaaaagatg

SEQ ID NO: 32814 - DNA, 103 bp, Artificial Sequence
  Synthetic Polynucleotide
taatacgactcactataggggtccaatcgcggagccgcttcgagcagcacaacagaggagagtgctgatggaagcggctaacctggcggcagcgcaaaagatg

SEQ ID NO: 32815 - DNA, 103 bp, Artificial Sequence
  Synthetic Polynucleotide
taatacgactcactatagggaaaccgataacggggagcgttgccacacagaacagaggagactgtgtatgaacgctcccaacctggcggcagcgcaaaagatg

SEQ ID NO: 32816 - DNA, 103 bp, Artificial Sequence
  Synthetic Polynucleotide
taatacgactcactatagggtcgtctaacttgtgcagcatgctcacattcaacagaggagagaatgtatgcatgctgcaaacctggcggcagcgcaaaagatg

SEQ ID NO: 32817 - DNA, 103 bp, Artificial Sequence
  Synthetic Polynucleotide
taatacgactcactataggggggcgtactcaggccaattacaggtatagtaacagaggagaactataatggtaattggcaacctggcggcagcgcaaaagatg

SEQ ID NO: 32818 - DNA, 103 bp, Artificial Sequence
  Synthetic Polynucleotide
taatacgactcactatagggggacatccagatatctggagtgagacacaaaacagaggagattgtgtatgactccagataacctggcggcagcgcaaaagatg

SEQ ID NO: 32819 - DNA, 103 bp, Artificial Sequence
  Synthetic Polynucleotide
taatacgactcactataggggggatgtgtgagacacactggcgagacaagaacagaggagacttgtcatgccagtgtgtaacctggcggcagcgcaaaagatg

SEQ ID NO: 32820 - DNA, 103 bp, Artificial Sequence
  Synthetic Polynucleotide
taatacgactcactatagggttgggcacggaggacggctgtgacgtgccaaacagaggagatggcacatgacagccgtcaacctggcggcagcgcaaaagatg

SEQ ID NO: 32821 - DNA, 103 bp, Artificial Sequence
  Synthetic Polynucleotide
taatacgactcactatagggggtctcgccattgctatggacggcattgggaacagaggagacccaatatggtccatagcaacctggcggcagcgcaaaagatg

SEQ ID NO: 32822 - DNA, 103 bp, Artificial Sequence
  Synthetic Polynucleotide
taatacgactcactatagggtacgcatttcccaatcttgtgtcgggcacgaacagaggagacgtgccatgcacaagattaacctggcggcagcgcaaaagatg

SEQ ID NO: 32823 - DNA, 103 bp, Artificial Sequence
  Synthetic Polynucleotide
taatacgactcactatagggtgcgaagcgctggtgcgaaaggaggcatcgaacagaggagacgatgcatgctttcgcacaacctggcggcagcgcaaaagatg

SEQ ID NO: 32824 - DNA, 103 bp, Artificial Sequence
  Synthetic Polynucleotide
taatacgactcactatagggcgtttaatgtgaagtttttggctacaagcaaacagaggagatgcttgatgccaaaaactaacctggcggcagcgcaaaagatg

SEQ ID NO: 32825 - DNA, 103 bp, Artificial Sequence
  Synthetic Polynucleotide
taatacgactcactataggggtgcaccccgcttacctaaagactccggcaaacagaggagatgccggatgctttaggtaaacctggcggcagcgcaaaagatg

SEQ ID NO: 32826 - DNA, 103 bp, Artificial Sequence
  Synthetic Polynucleotide
taatacgactcactatagggacaaaccggcaccccaggcgcggattttgtaacagaggagaacaaaaatggcgcctgggaacctggcggcagcgcaaaagatg

SEQ ID NO: 32827 - DNA, 103 bp, Artificial Sequence
  Synthetic Polynucleotide
taatacgactcactataggggataactcgtattgcgccgaccagagcaaaaacagaggagatttgctatggtcggcgcaaacctggcggcagcgcaaaagatg

SEQ ID NO: 32828 - DNA, 103 bp, Artificial Sequence
  Synthetic Polynucleotide
taatacgactcactatagggtgcacaagcacgtggaacagaccgcacttgaacagaggagacaagtgatgtctgttccaaacctggcggcagcgcaaaagatg

SEQ ID NO: 32829 - DNA, 103 bp, Artificial Sequence
  Synthetic Polynucleotide
taatacgactcactataggggatacaacccccaagtattgtgagtaaagaaacagaggagatctttaatgacaatacttaacctggcggcagcgcaaaagatg

SEQ ID NO: 32830 - DNA, 103 bp, Artificial Sequence
  Synthetic Polynucleotide
taatacgactcactataggggacggtaaacatcccgcacgggcaccaaaaaacagaggagattttggatgccgtgcgggaacctggcggcagcgcaaaagatg

SEQ ID NO: 32831 - DNA, 103 bp, Artificial Sequence
  Synthetic Polynucleotide
taatacgactcactatagggtccaaagttaaaaaagagaacggcgcaggaaacagaggagatcctgcatggttctctttaacctggcggcagcgcaaaagatg

SEQ ID NO: 32832 - DNA, 103 bp, Artificial Sequence
  Synthetic Polynucleotide
taatacgactcactatagggtcggcaggctgaaacagcactcataccgataacagaggagaatcggtatgagtgctgttaacctggcggcagcgcaaaagatg

SEQ ID NO: 32833 - DNA, 103 bp, Artificial Sequence
  Synthetic Polynucleotide
taatacgactcactatagggtggtggcctcaccaaccttccgcagtcggtaacagaggagaaccgacatgggaaggttgaacctggcggcagcgcaaaagatg

SEQ ID NO: 32834 - DNA, 103 bp, Artificial Sequence
  Synthetic Polynucleotide
taatacgactcactatagggctgatacaactcgtttaactccccgggcataacagaggagaatgcccatggagttaaacaacctggcggcagcgcaaaagatg

SEQ ID NO: 32835 - DNA, 103 bp, Artificial Sequence
  Synthetic Polynucleotide
taatacgactcactatagggtacatccaccaacttgcatacggaataaacaacagaggagagtttatatggtatgcaagaacctggcggcagcgcaaaagatg

SEQ ID NO: 32836 - DNA, 103 bp, Artificial Sequence
  Synthetic Polynucleotide
taatacgactcactataggggtaatctgacctcgatcatttccatcttacaacagaggagagtaagaatgaaatgatcgaacctggcggcagcgcaaaagatg

SEQ ID NO: 32837 - DNA, 103 bp, Artificial Sequence
  Synthetic Polynucleotide
taatacgactcactatagggaagaagttggccatctccagaacctattagaacagaggagactaataatgtctggagataacctggcggcagcgcaaaagatg

SEQ ID NO: 32838 - DNA, 103 bp, Artificial Sequence
  Synthetic Polynucleotide
taatacgactcactatagggtgtaatatcgattcaaggggatacgaacgcaacagaggagagcgttcatgtccccttgaaacctggcggcagcgcaaaagatg

SEQ ID NO: 32839 - DNA, 103 bp, Artificial Sequence
  Synthetic Polynucleotide
taatacgactcactatagggaggttggtactggtctgaggttactgttgtaacagaggagaacaacaatgacctcagacaacctggcggcagcgcaaaagatg

SEQ ID NO: 32840 - DNA, 103 bp, Artificial Sequence
  Synthetic Polynucleotide
taatacgactcactatagggagagttttactcccagctcgaccgttttttaacagaggagaaaaaaaatgtcgagctggaacctggcggcagcgcaaaagatg

SEQ ID NO: 32841 - DNA, 103 bp, Artificial Sequence
  Synthetic Polynucleotide
taatacgactcactataggggcgtatttgctgttaccaatgtagtacgataacagaggagaatcgtaatgcattggtaaaacctggcggcagcgcaaaagatg

SEQ ID NO: 32842 - DNA, 103 bp, Artificial Sequence
  Synthetic Polynucleotide
taatacgactcactatagggagcagcaagttttagcgtgacagatcctacaacagaggagagtaggaatggtcacgctaaacctggcggcagcgcaaaagatg

SEQ ID NO: 32843 - DNA, 103 bp, Artificial Sequence
  Synthetic Polynucleotide
taatacgactcactatagggaaatggtagagatccgacaactacccgtcaaacagaggagatgacggatggttgtcggaaacctggcggcagcgcaaaagatg

SEQ ID NO: 32844 - DNA, 103 bp, Artificial Sequence
  Synthetic Polynucleotide
taatacgactcactataggggtggcgatttagtgtcgctgagcagtattcaacagaggagagaatacatgtcagcgacaaacctggcggcagcgcaaaagatg

SEQ ID NO: 32845 - DNA, 103 bp, Artificial Sequence
  Synthetic Polynucleotide
taatacgactcactatagggagcacctcttctacgtcacctgaattccataacagaggagaatggaaatgaggtgacgtaacctggcggcagcgcaaaagatg

SEQ ID NO: 32846 - DNA, 103 bp, Artificial Sequence
  Synthetic Polynucleotide
taatacgactcactatagggtcaaagttccctgtgatctcaatgccatgcaacagaggagagcatggatgtgagatcacaacctggcggcagcgcaaaagatg

SEQ ID NO: 32847 - DNA, 103 bp, Artificial Sequence
  Synthetic Polynucleotide
taatacgactcactataggggagaccacatgctgctgcgccagagacggtaacagaggagaaccgtcatgggcgcagcaaacctggcggcagcgcaaaagatg

SEQ ID NO: 32848 - DNA, 103 bp, Artificial Sequence
  Synthetic Polynucleotide
taatacgactcactatagggttgtagcactgaaggtgatgtgggtccacaaacagaggagatgtggaatgacatcacctaacctggcggcagcgcaaaagatg

SEQ ID NO: 32849 - DNA, 103 bp, Artificial Sequence
  Synthetic Polynucleotide
taatacgactcactatagggctgtagggggctctaatacgtacccgttggaacagaggagaccaacgatgacgtattagaacctggcggcagcgcaaaagatg

SEQ ID NO: 32850 - DNA, 103 bp, Artificial Sequence
  Synthetic Polynucleotide
taatacgactcactatagggaaaagctactactgtttatggacggtgtaaaacagaggagattacacatgccataaacaaacctggcggcagcgcaaaagatg

SEQ ID NO: 32851 - DNA, 103 bp, Artificial Sequence
  Synthetic Polynucleotide
taatacgactcactatagggttggttttaacatgattgtattattactttaacagaggagaaaagtaatgatacaatcaaacctggcggcagcgcaaaagatg

SEQ ID NO: 32852 - DNA, 103 bp, Artificial Sequence
  Synthetic Polynucleotide
taatacgactcactatagggacgctaactaaatatgcgcacacgtaacgtaacagaggagaacgttaatggtgcgcataaacctggcggcagcgcaaaagatg

SEQ ID NO: 32853 - DNA, 103 bp, Artificial Sequence
  Synthetic Polynucleotide
taatacgactcactatagggctgcccatcttaggtcagacgtgtgggaagaacagaggagacttcccatgcgtctgaccaacctggcggcagcgcaaaagatg

SEQ ID NO: 32854 - DNA, 103 bp, Artificial Sequence
  Synthetic Polynucleotide
taatacgactcactatagggtgtcattcgcgttctgttcacggggacagtaacagaggagaactgtcatggtgaacagaaacctggcggcagcgcaaaagatg

SEQ ID NO: 32855 - DNA, 103 bp, Artificial Sequence
  Synthetic Polynucleotide
taatacgactcactataggggtcgggagacttgcctcccatcacttactaaacagaggagatagtaaatgatgggaggcaacctggcggcagcgcaaaagatg

SEQ ID NO: 32856 - DNA, 103 bp, Artificial Sequence
  Synthetic Polynucleotide
taatacgactcactatagggcctgtgtcaagtgatagaacagaatgagtgaacagaggagacactcaatgtgttctatcaacctggcggcagcgcaaaagatg

SEQ ID NO: 32857 - DNA, 103 bp, Artificial Sequence
  Synthetic Polynucleotide
taatacgactcactatagggttataatagaattgaggactacatactgtcaacagaggagagacagtatgtagtcctcaaacctggcggcagcgcaaaagatg

SEQ ID NO: 32858 - DNA, 103 bp, Artificial Sequence
  Synthetic Polynucleotide
taatacgactcactatagggtgatcccaagcgattctatagaatctccacaacagaggagagtggagatgctatagaataacctggcggcagcgcaaaagatg

SEQ ID NO: 32859 - DNA, 103 bp, Artificial Sequence
  Synthetic Polynucleotide
taatacgactcactatagggaaacaggattagttcatgggaaccttcaataacagaggagaattgaaatgtcccatgaaaacctggcggcagcgcaaaagatg

SEQ ID NO: 32860 - DNA, 103 bp, Artificial Sequence
  Synthetic Polynucleotide
taatacgactcactatagggttgcgtctgagcaatgagaactgaacgaacaacagaggagagttcgtatggttctcattaacctggcggcagcgcaaaagatg

SEQ ID NO: 32861 - DNA, 103 bp, Artificial Sequence
  Synthetic Polynucleotide
taatacgactcactataggggattagctggttcaaccacttcgtttcataaacagaggagatatgaaatgaagtggttgaacctggcggcagcgcaaaagatg

SEQ ID NO: 32862 - DNA, 103 bp, Artificial Sequence
  Synthetic Polynucleotide
taatacgactcactatagggagacattcgtggctccagatcgaatagcacaacagaggagagtgctaatggatctggagaacctggcggcagcgcaaaagatg

SEQ ID NO: 32863 - DNA, 103 bp, Artificial Sequence
  Synthetic Polynucleotide
taatacgactcactatagggcacctccccggctgttctgaggcgaattggaacagaggagaccaattatgctcagaacaaacctggcggcagcgcaaaagatg

SEQ ID NO: 32864 - DNA, 103 bp, Artificial Sequence
  Synthetic Polynucleotide
taatacgactcactatagggtaagtgcttgtatcagatgttctcgacaataacagaggagaattgtcatgaacatctgaaacctggcggcagcgcaaaagatg

SEQ ID NO: 32865 - DNA, 103 bp, Artificial Sequence
  Synthetic Polynucleotide
taatacgactcactatagggcgttagtcgatgtgcgtctgggtatatcataacagaggagaatgataatgccagacgcaaacctggcggcagcgcaaaagatg

SEQ ID NO: 32866 - DNA, 103 bp, Artificial Sequence
  Synthetic Polynucleotide
taatacgactcactataggggtgtacttctaatatccgacgataccactgaacagaggagacagtggatgcgtcggataaacctggcggcagcgcaaaagatg

SEQ ID NO: 32867 - DNA, 103 bp, Artificial Sequence
  Synthetic Polynucleotide
taatacgactcactatagggttactgatcaaaaatccttggttgcttacgaacagaggagacgtaagatgccaaggattaacctggcggcagcgcaaaagatg

SEQ ID NO: 32868 - DNA, 103 bp, Artificial Sequence
  Synthetic Polynucleotide
taatacgactcactataggggtgctggattatacctaggaagtgtaatacaacagaggagagtattaatgttcctaggtaacctggcggcagcgcaaaagatg

SEQ ID NO: 32869 - DNA, 103 bp, Artificial Sequence
  Synthetic Polynucleotide
taatacgactcactatagggttgtgaccgttggagccaggagcacaaaaaaacagaggagatttttgatgtcctggctcaacctggcggcagcgcaaaagatg

SEQ ID NO: 32870 - DNA, 103 bp, Artificial Sequence
  Synthetic Polynucleotide
taatacgactcactataggggctaatctgccactcgaatatgtgtttttgaacagaggagacaaaaaatgatattcgagaacctggcggcagcgcaaaagatg

SEQ ID NO: 32871 - DNA, 103 bp, Artificial Sequence
  Synthetic Polynucleotide
taatacgactcactatagggttcgtgtgctgctcgcggattttagtgaagaacagaggagacttcacatgaatccgcgaaacctggcggcagcgcaaaagatg

SEQ ID NO: 32872 - DNA, 103 bp, Artificial Sequence
  Synthetic Polynucleotide
taatacgactcactatagggggcgtccagataattaggcttgacttgcgaaacagaggagatcgcaaatgaagcctaataacctggcggcagcgcaaaagatg

SEQ ID NO: 32873 - DNA, 103 bp, Artificial Sequence
  Synthetic Polynucleotide
taatacgactcactatagggactgggcacggcaaagaacaagaggagagcaacagaggagagctctcatgttgttctttaacctggcggcagcgcaaaagatg

SEQ ID NO: 32874 - DNA, 103 bp, Artificial Sequence
  Synthetic Polynucleotide
taatacgactcactatagggtgatttcctctcacaggagtggggcttttaaacagaggagataaaagatgcactcctgtaacctggcggcagcgcaaaagatg

SEQ ID NO: 32875 - DNA, 103 bp, Artificial Sequence
  Synthetic Polynucleotide
taatacgactcactatagggtacgagtatagcgtgagcgccagtcccagtaacagaggagaactgggatgggcgctcacaacctggcggcagcgcaaaagatg

SEQ ID NO: 32876 - DNA, 103 bp, Artificial Sequence
  Synthetic Polynucleotide
taatacgactcactatagggaaaaagctacagcatctgtgaggaatgcctaacagaggagaaggcatatgtcacagatgaacctggcggcagcgcaaaagatg

SEQ ID NO: 32877 - DNA, 103 bp, Artificial Sequence
  Synthetic Polynucleotide
taatacgactcactatagggggtttccttccccgatccccgtcctctaggaacagaggagacctagaatgcggggatcgaacctggcggcagcgcaaaagatg

SEQ ID NO: 32878 - DNA, 103 bp, Artificial Sequence
  Synthetic Polynucleotide
taatacgactcactatagggaagggacctataggcttattgtgatccgccaacagaggagaggcggaatgcaataagccaacctggcggcagcgcaaaagatg

SEQ ID NO: 32879 - DNA, 103 bp, Artificial Sequence
  Synthetic Polynucleotide
taatacgactcactatagggtgatatagccccttgtagcaggttcttaataacagaggagaattaagatgctgctacaaaacctggcggcagcgcaaaagatg

SEQ ID NO: 32880 - DNA, 103 bp, Artificial Sequence
  Synthetic Polynucleotide
taatacgactcactataggggatgaaatgggctaacatgccctgccctcaaacagaggagatgagggatgggcatgttaaacctggcggcagcgcaaaagatg

SEQ ID NO: 32881 - DNA, 103 bp, Artificial Sequence
  Synthetic Polynucleotide
taatacgactcactatagggagaactaatgagcaagcacaacaagaattcaacagaggagagaattcatgttgtgcttgaacctggcggcagcgcaaaagatg

SEQ ID NO: 32882 - DNA, 103 bp, Artificial Sequence
  Synthetic Polynucleotide
taatacgactcactataggggttatgacagtcacacacgtcgctgatcgtaacagaggagaacgatcatggacgtgtgtaacctggcggcagcgcaaaagatg

SEQ ID NO: 32883 - DNA, 103 bp, Artificial Sequence
  Synthetic Polynucleotide
taatacgactcactataggggtacctcggattcctacttagacgattccgaacagaggagacggaatatgctaagtaggaacctggcggcagcgcaaaagatg

SEQ ID NO: 32884 - DNA, 103 bp, Artificial Sequence
  Synthetic Polynucleotide
taatacgactcactatagggtgatctagagtacgcaaactgaacacattaaacagaggagataatgtatgcagtttgcgaacctggcggcagcgcaaaagatg

SEQ ID NO: 32885 - DNA, 103 bp, Artificial Sequence
  Synthetic Polynucleotide
taatacgactcactatagggggatacgcaacagtcgacactgggaaagtaaacagaggagatactttatgagtgtcgacaacctggcggcagcgcaaaagatg

SEQ ID NO: 32886 - DNA, 103 bp, Artificial Sequence
  Synthetic Polynucleotide
taatacgactcactataggggtgggagtgccgaatgcctcgatctacaaaaacagaggagatttgtaatgcgaggcattaacctggcggcagcgcaaaagatg

SEQ ID NO: 32887 - DNA, 103 bp, Artificial Sequence
  Synthetic Polynucleotide
taatacgactcactatagggccttatctccaatgccctcagttaatggaaaacagaggagattccatatgctgagggcaaacctggcggcagcgcaaaagatg
